United States Patent 7,696,334 (BIOINFORMATICALLY DETECTABLE HUMAN HERPESVIRUS 5 REGULATORY GENE) - sequence listing, part 2

SEQ ID NO: 38370 - DNA, 18 bp, Homo sapiens
tggcttgggaatctctgg

SEQ ID NO: 38371 - DNA, 16 bp, Homo sapiens
tggcctggggccatgg

SEQ ID NO: 38372 - DNA, 17 bp, Homo sapiens
tgacttggtctacttgg

SEQ ID NO: 38373 - DNA, 17 bp, Homo sapiens
tggctggcaccgcttgg

SEQ ID NO: 38374 - DNA, 20 bp, Homo sapiens
tggcttggaaatttctgtgg

SEQ ID NO: 38375 - DNA, 19 bp, Homo sapiens
tggctgggaggcaggttgg

SEQ ID NO: 38376 - DNA, 17 bp, Homo sapiens
ggcttgggggctgccgg

SEQ ID NO: 38377 - DNA, 18 bp, Homo sapiens
tggtagggaattgtttgg

SEQ ID NO: 38378 - DNA, 18 bp, Homo sapiens
tgggttgggagagcctgg

SEQ ID NO: 38379 - DNA, 18 bp, Homo sapiens
tgacttgggagccaatgg

SEQ ID NO: 38380 - DNA, 16 bp, Homo sapiens
ggctaggattgcttgg

SEQ ID NO: 38381 - DNA, 21 bp, Homo sapiens
tggcttgggggaaccagctgg

SEQ ID NO: 38382 - DNA, 18 bp, Homo sapiens
ggcttgggggtgctctgg

SEQ ID NO: 38383 - DNA, 17 bp, Homo sapiens
tggcttggcaactctgg

SEQ ID NO: 38384 - DNA, 16 bp, Homo sapiens
tggcttggggtgctgg

SEQ ID NO: 38385 - DNA, 16 bp, Homo sapiens
tgactaatttgcttgg

SEQ ID NO: 38386 - DNA, 18 bp, Homo sapiens
tggcttggggggacttgg

SEQ ID NO: 38387 - DNA, 20 bp, Homo sapiens
tggcttggggcagctgcagg

SEQ ID NO: 38388 - DNA, 17 bp, Homo sapiens
tggctgggagcgcttgg

SEQ ID NO: 38389 - DNA, 16 bp, Homo sapiens
ggttgggattgcttgg

SEQ ID NO: 38390 - DNA, 16 bp, Homo sapiens
tggcttggaggcctgg

SEQ ID NO: 38391 - DNA, 18 bp, Homo sapiens
tggctccaaattgcttgg

SEQ ID NO: 38392 - DNA, 15 bp, Homo sapiens
ggcttgggactgtgg

SEQ ID NO: 38393 - DNA, 19 bp, Homo sapiens
ggcttggggacgatgctgg

SEQ ID NO: 38394 - DNA, 16 bp, Homo sapiens
ggcttgagttgtttgg

SEQ ID NO: 38395 - DNA, 17 bp, Homo sapiens
tgacttgggtgctttgg

SEQ ID NO: 38396 - DNA, 17 bp, Homo sapiens
tggctctggggctctgg

SEQ ID NO: 38397 - DNA, 20 bp, Homo sapiens
tggttgctgaaattgcttgg

SEQ ID NO: 38398 - DNA, 18 bp, Homo sapiens
ggtgggaagattgcttgg

SEQ ID NO: 38399 - DNA, 19 bp, Homo sapiens
tggcttggggaggtgctgg

SEQ ID NO: 38400 - DNA, 20 bp, Homo sapiens
tgtcttgggaacctctttgg

SEQ ID NO: 38401 - DNA, 18 bp, Homo sapiens
tggcctgggaagggctgg

SEQ ID NO: 38402 - DNA, 20 bp, Homo sapiens
tggcttggggatgaacttgg

SEQ ID NO: 38403 - DNA, 16 bp, Homo sapiens
tggcttcggggcctgg

SEQ ID NO: 38404 - DNA, 17 bp, Homo sapiens
tggcttgagaactctgg

SEQ ID NO: 38405 - DNA, 16 bp, Homo sapiens
tggcttggaaaattgg

SEQ ID NO: 38406 - DNA, 18 bp, Homo sapiens
ggtgggagaattgcttgg

SEQ ID NO: 38407 - DNA, 19 bp, Homo sapiens
tggcttggggcctccttgg

SEQ ID NO: 38408 - DNA, 20 bp, Homo sapiens
tggcctgggagacaagatgg

SEQ ID NO: 38409 - DNA, 17 bp, Homo sapiens
tggtttgggaagcctgg

SEQ ID NO: 38410 - DNA, 17 bp, Homo sapiens
ggcttgggaaagcacgg

SEQ ID NO: 38411 - DNA, 17 bp, Homo sapiens
tggcttgggttacttgg

SEQ ID NO: 38412 - DNA, 18 bp, Homo sapiens
ggtgggaggattgcttgg

SEQ ID NO: 38413 - DNA, 16 bp, Homo sapiens
tggctaggaaccttgg

SEQ ID NO: 38414 - DNA, 18 bp, Homo sapiens
tggctggggactgcttgg

SEQ ID NO: 38415 - DNA, 19 bp, Homo sapiens
tggcctgggaaagatttgg

SEQ ID NO: 38416 - DNA, 16 bp, Homo sapiens
tggcttggggtgttgg

SEQ ID NO: 38417 - DNA, 21 bp, Homo sapiens
tgggttgggagctgcatttgg

SEQ ID NO: 38418 - DNA, 16 bp, Homo sapiens
ggcttgggagctctgg

SEQ ID NO: 38419 - DNA, 18 bp, Homo sapiens
tggcctggacccacttgg

SEQ ID NO: 38420 - DNA, 17 bp, Homo sapiens
tggctcgggaacattgg

SEQ ID NO: 38421 - DNA, 18 bp, Homo sapiens
tggcctgggccacattgg

SEQ ID NO: 38422 - DNA, 16 bp, Homo sapiens
tggcctgagagcttgg

SEQ ID NO: 38423 - DNA, 16 bp, Homo sapiens
tggcttggcactttgg

SEQ ID NO: 38424 - DNA, 19 bp, Homo sapiens
tggcttgggaaatacttgg

SEQ ID NO: 38425 - DNA, 18 bp, Homo sapiens
ggcttcaagcttgcttgg

SEQ ID NO: 38426 - DNA, 18 bp, Homo sapiens
tggcttaggaggcattgg

SEQ ID NO: 38427 - DNA, 16 bp, Homo sapiens
ggcttggggctgctgg

SEQ ID NO: 38428 - DNA, 18 bp, Homo sapiens
ggcttgggaagctgctgg

SEQ ID NO: 38429 - DNA, 18 bp, Homo sapiens
tggcctgggagaagctgg

SEQ ID NO: 38430 - DNA, 16 bp, Homo sapiens
tggcttgggtacctgg

SEQ ID NO: 38431 - DNA, 17 bp, Homo sapiens
tggctgggaatgccagg

SEQ ID NO: 38432 - DNA, 16 bp, Homo sapiens
tggttgggaaaccagg

SEQ ID NO: 38433 - DNA, 18 bp, Homo sapiens
tggcttgggaactgccgg

SEQ ID NO: 38434 - DNA, 19 bp, Homo sapiens
tggctggggatgaacttgg

SEQ ID NO: 38435 - DNA, 16 bp, Homo sapiens
ggcttggataccttgg

SEQ ID NO: 38436 - DNA, 19 bp, Homo sapiens
tggcttgagggcccattgg

SEQ ID NO: 38437 - DNA, 18 bp, Homo sapiens
gcctagtctattgcttgg

SEQ ID NO: 38438 - DNA, 15 bp, Homo sapiens
ggttgggttgcttgg

SEQ ID NO: 38439 - DNA, 16 bp, Homo sapiens
ggcttgggagcgctgg

SEQ ID NO: 38440 - DNA, 17 bp, Homo sapiens
tggctatggtactttgg

SEQ ID NO: 38441 - DNA, 17 bp, Homo sapiens
tggctcgggaatcttgg

SEQ ID NO: 38442 - DNA, 17 bp, Homo sapiens
tggcctgggccacttgg

SEQ ID NO: 38443 - DNA, 19 bp, Homo sapiens
tggctgtggtttgctttgg

SEQ ID NO: 38444 - DNA, 18 bp, Homo sapiens
tggcttggtggctactgg

SEQ ID NO: 38445 - DNA, 17 bp, Homo sapiens
tggcctggcacacttgg

SEQ ID NO: 38446 - DNA, 19 bp, Homo sapiens
tggatattaagttgcttgg

SEQ ID NO: 38447 - DNA, 16 bp, Homo sapiens
tggcttgggattgagg

SEQ ID NO: 38448 - DNA, 18 bp, Homo sapiens
agcaggaggattgcttgg

SEQ ID NO: 38449 - DNA, 19 bp, Homo sapiens
tggcctgggaagtgcgtgg

SEQ ID NO: 38450 - DNA, 18 bp, Homo sapiens
tggcttgggcggccgcgg

SEQ ID NO: 38451 - DNA, 22 bp, Homo sapiens
tggttggggaatcgatccttgg

SEQ ID NO: 38452 - DNA, 17 bp, Homo sapiens
tggtttgggaatttttg

SEQ ID NO: 38453 - DNA, 16 bp, Homo sapiens
ggcttggggattatgg

SEQ ID NO: 38454 - DNA, 16 bp, Homo sapiens
tgacggtattgcttgg

SEQ ID NO: 38455 - DNA, 19 bp, Homo sapiens
tggcttggttgttgtttgg

SEQ ID NO: 38456 - DNA, 16 bp, Homo sapiens
tggcttggcactctgg

SEQ ID NO: 38457 - DNA, 16 bp, Homo sapiens
tggcctgggacactgg

SEQ ID NO: 38458 - DNA, 16 bp, Homo sapiens
tgacttgggaccctgg

SEQ ID NO: 38459 - DNA, 17 bp, Homo sapiens
tggcctggaagccttgg

SEQ ID NO: 38460 - DNA, 16 bp, Homo sapiens
ggcttggggacctcgg

SEQ ID NO: 38461 - DNA, 18 bp, Homo sapiens
tagccagagattgcttgg

SEQ ID NO: 38462 - DNA, 19 bp, Homo sapiens
tgccttgggaagccactgg

SEQ ID NO: 38463 - DNA, 15 bp, Homo sapiens
ggcaggattgcttgg

SEQ ID NO: 38464 - DNA, 16 bp, Homo sapiens
tgacaggattgcttgg

SEQ ID NO: 38465 - DNA, 17 bp, Homo sapiens
tggctgaggttgcttgg

SEQ ID NO: 38466 - DNA, 19 bp, Homo sapiens
tggctcggggttgccttgg

SEQ ID NO: 38467 - DNA, 19 bp, Homo sapiens
tggcttgaggaagctgtgg

SEQ ID NO: 38468 - DNA, 19 bp, Homo sapiens
tggcttagggaagttgtgg

SEQ ID NO: 38469 - DNA, 18 bp, Homo sapiens
tggctctggcttgcttgg

SEQ ID NO: 38470 - DNA, 18 bp, Homo sapiens
tggcttgggtacagcagg

SEQ ID NO: 38471 - DNA, 19 bp, Homo sapiens
ggcttgggaaccagcatgg

SEQ ID NO: 38472 - DNA, 22 bp, Homo sapiens
tgtcttgggaattagcatttgg

SEQ ID NO: 38473 - DNA, 19 bp, Homo sapiens
tggcttggggacaacatgg

SEQ ID NO: 38474 - DNA, 18 bp, Homo sapiens
tggcttggggggacccgg

SEQ ID NO: 38475 - DNA, 19 bp, Homo sapiens
tggcctggggaaatgttgg

SEQ ID NO: 38476 - DNA, 19 bp, Homo sapiens
tgacttggatcagacttgg

SEQ ID NO: 38477 - DNA, 19 bp, Homo sapiens
ggctcctgaaattgcttgg

SEQ ID NO: 38478 - DNA, 16 bp, Homo sapiens
tggcctggggtgctgg

SEQ ID NO: 38479 - DNA, 18 bp, Homo sapiens
tgtttgggaacacgcagg

SEQ ID NO: 38480 - DNA, 16 bp, Homo sapiens
tggcctggctgcttgg

SEQ ID NO: 38481 - DNA, 17 bp, Homo sapiens
tggcttagtgattttgg

SEQ ID NO: 38482 - DNA, 18 bp, Homo sapiens
tggctttggatctaatgg

SEQ ID NO: 38483 - DNA, 16 bp, Homo sapiens
agcgaggattgcttgg

SEQ ID NO: 38484 - DNA, 18 bp, Homo sapiens
tggcctgggaagcgcagg

SEQ ID NO: 38485 - DNA, 19 bp, Homo sapiens
tggatttgggaaactttgg

SEQ ID NO: 38486 - DNA, 18 bp, Homo sapiens
tggcctcgatttgcttgg

SEQ ID NO: 38487 - DNA, 18 bp, Homo sapiens
tggcctgggaccacatgg

SEQ ID NO: 38488 - DNA, 18 bp, Homo sapiens
tggcctggggggcattgg

SEQ ID NO: 38489 - DNA, 16 bp, Homo sapiens
tggcctgggaacccgg

SEQ ID NO: 38490 - DNA, 19 bp, Homo sapiens
tggcttaggattgacttgg

SEQ ID NO: 38491 - DNA, 18 bp, Homo sapiens
tggcttaggtcgttttgg

SEQ ID NO: 38492 - DNA, 16 bp, Homo sapiens
tggcttgggtctctgg

SEQ ID NO: 38493 - DNA, 19 bp, Homo sapiens
tgttttgggaattgtatgg

SEQ ID NO: 38494 - DNA, 15 bp, Homo sapiens
tggctgattgcttgg

SEQ ID NO: 38495 - DNA, 16 bp, Homo sapiens
ggcttggcttgcttgg

SEQ ID NO: 38496 - DNA, 17 bp, Homo sapiens
ggcttggggcactctgg

SEQ ID NO: 38497 - DNA, 16 bp, Homo sapiens
ggcttggggtacttgg

SEQ ID NO: 38498 - DNA, 18 bp, Homo sapiens
tggcctgggagttaatgg

SEQ ID NO: 38499 - DNA, 17 bp, Homo sapiens
tggcttggagaaattgg

SEQ ID NO: 38500 - DNA, 16 bp, Homo sapiens
tggctgggaatacagg

SEQ ID NO: 38501 - DNA, 16 bp, Homo sapiens
tggtttagacgcttgg

SEQ ID NO: 38502 - DNA, 64 bp, Human astrovirus
ggacaggtttgacatcatagacacttctgatgaagaagatgaaaatgagacagaccgtgtaacc

SEQ ID NO: 38503 - DNA, 24 bp, Human astrovirus
tgaaaatgagacagaccgtgtaac

SEQ ID NO: 38504 - DNA, 18 bp, Homo sapiens
tgaaaatgaggagagagc

SEQ ID NO: 38505 - DNA, 17 bp, Homo sapiens
tgaaactgagacagtgc

SEQ ID NO: 38506 - DNA, 19 bp, Homo sapiens
tggaaatgtacaccgtgta

SEQ ID NO: 38507 - DNA, 22 bp, Homo sapiens
tgaaaatgaggcagcattataa

SEQ ID NO: 38508 - DNA, 21 bp, Homo sapiens
tgaaaatggagactttttgtg

SEQ ID NO: 38509 - DNA, 19 bp, Homo sapiens
gagaccccaggccgtgtaa

SEQ ID NO: 38510 - DNA, 18 bp, Homo sapiens
tgataatgagacagaacc

SEQ ID NO: 38511 - DNA, 22 bp, Homo sapiens
tgaaaatgacatatctgtgtaa

SEQ ID NO: 38512 - DNA, 21 bp, Homo sapiens
tgcaaatgagactacagttgt

SEQ ID NO: 38513 - DNA, 17 bp, Homo sapiens
tgaaaagagacagatgt

SEQ ID NO: 38514 - DNA, 20 bp, Homo sapiens
tgaaaatgtgatgacggtgt

SEQ ID NO: 38515 - DNA, 17 bp, Homo sapiens
tgaaaatgagacgcgca

SEQ ID NO: 38516 - DNA, 20 bp, Homo sapiens
tgaaaatgggactaggcgcg

SEQ ID NO: 38517 - DNA, 19 bp, Homo sapiens
tgaaaatgagcaggcctgt

SEQ ID NO: 38518 - DNA, 24 bp, Homo sapiens
tgaaaataaggcaggacctgtaac

SEQ ID NO: 38519 - DNA, 17 bp, Homo sapiens
gagaatgagacagcatg

SEQ ID NO: 38520 - DNA, 18 bp, Homo sapiens
tgaagatgaaacaggtat

SEQ ID NO: 38521 - DNA, 24 bp, Homo sapiens
tgaaaatggggagcaggctgtaac

SEQ ID NO: 38522 - DNA, 71 bp, Southern cowpea mosaic virus
cgtctcctctgggctacctcattttgaccccgtttatggggttgttaagaagtgtgagcctatggggggcg

SEQ ID NO: 38523 - DNA, 24 bp, Southern cowpea mosaic virus
tctgggctacctcattttgacccc

SEQ ID NO: 38524 - DNA, 15 bp, Homo sapiens
tctgagctatttgcc

SEQ ID NO: 38525 - DNA, 22 bp, Homo sapiens
tggggtaccttgtgaacatttc

SEQ ID NO: 38526 - DNA, 18 bp, Homo sapiens
tctgagctgcctctgccc

SEQ ID NO: 38527 - DNA, 20 bp, Homo sapiens
cctgggctgcctcctgctcc

SEQ ID NO: 38528 - DNA, 19 bp, Homo sapiens
tctaggcttcttttgatcc

SEQ ID NO: 38529 - DNA, 15 bp, Homo sapiens
tctgggctccttctg

SEQ ID NO: 38530 - DNA, 21 bp, Homo sapiens
tctgggctccagtttggcccc

SEQ ID NO: 38531 - DNA, 18 bp, Homo sapiens
tctgggctgccgcagctt

SEQ ID NO: 38532 - DNA, 16 bp, Homo sapiens
tgggtacctttgcacc

SEQ ID NO: 38533 - DNA, 23 bp, Homo sapiens
tctgggctatttagagtcatttt

SEQ ID NO: 38534 - DNA, 18 bp, Homo sapiens
tctcggctgcttctaacc

SEQ ID NO: 38535 - DNA, 20 bp, Homo sapiens
tctgggctctccagatggcc

SEQ ID NO: 38536 - DNA, 21 bp, Homo sapiens
tctgggcttcctgatgatccc

SEQ ID NO: 38537 - DNA, 16 bp, Homo sapiens
tctgggcaccctgacc

SEQ ID NO: 38538 - DNA, 22 bp, Homo sapiens
tctgggctattgtgccagcccc

SEQ ID NO: 38539 - DNA, 18 bp, Homo sapiens
tctgggccgccttattcc

SEQ ID NO: 38540 - DNA, 18 bp, Homo sapiens
tctgggctcaacttgacc

SEQ ID NO: 38541 - DNA, 18 bp, Homo sapiens
tctgggcacttccagacc

SEQ ID NO: 38542 - DNA, 18 bp, Homo sapiens
tctgagctgtctcaaccc

SEQ ID NO: 38543 - DNA, 18 bp, Homo sapiens
tctgggcttccttattct

SEQ ID NO: 38544 - DNA, 20 bp, Homo sapiens
cctgggctgcctcgccacga

SEQ ID NO: 38545 - DNA, 24 bp, Homo sapiens
tctgggctgccctggattggcccc

SEQ ID NO: 38546 - DNA, 18 bp, Homo sapiens
tgggtctttattttgacc

SEQ ID NO: 38547 - DNA, 18 bp, Homo sapiens
tctgggcttctgaggtcc

SEQ ID NO: 38548 - DNA, 20 bp, Homo sapiens
tctgggcttagccttggccc

SEQ ID NO: 38549 - DNA, 18 bp, Homo sapiens
tctgagttacctcacctt

SEQ ID NO: 38550 - DNA, 18 bp, Homo sapiens
tggcaccacctcattttg

SEQ ID NO: 38551 - DNA, 19 bp, Homo sapiens
cctgggctgccgcatggcc

SEQ ID NO: 38552 - DNA, 17 bp, Homo sapiens
tctgggctacctatctt

SEQ ID NO: 38553 - DNA, 21 bp, Homo sapiens
agcttccctcattttgattcc

SEQ ID NO: 38554 - DNA, 20 bp, Homo sapiens
tcttaatactctcattttga

SEQ ID NO: 38555 - DNA, 20 bp, Homo sapiens
tctgggttgcccctcactcc

SEQ ID NO: 38556 - DNA, 17 bp, Homo sapiens
tctggctgcctcactcc

SEQ ID NO: 38557 - DNA, 23 bp, Homo sapiens
tctgagctgccttgtggagcccc

SEQ ID NO: 38558 - DNA, 19 bp, Homo sapiens
tctgagctatctccatcct

SEQ ID NO: 38559 - DNA, 20 bp, Homo sapiens
cctgggctacctgcggtccc

SEQ ID NO: 38560 - DNA, 19 bp, Homo sapiens
ggctatgctttttgacccc

SEQ ID NO: 38561 - DNA, 18 bp, Homo sapiens
tctgggctcactttagac

SEQ ID NO: 38562 - DNA, 22 bp, Homo sapiens
tctgagctgccagagtgacccc

SEQ ID NO: 38563 - DNA, 19 bp, Homo sapiens
tccgggctgtctctgtgcc

SEQ ID NO: 38564 - DNA, 15 bp, Homo sapiens
tctgggctttttgcc

SEQ ID NO: 38565 - DNA, 19 bp, Homo sapiens
tctgggctctttctgtccc

SEQ ID NO: 38566 - DNA, 18 bp, Homo sapiens
tcttcaacctcattttga

SEQ ID NO: 38567 - DNA, 24 bp, Homo sapiens
cctgggctacctccagctggtccc

SEQ ID NO: 38568 - DNA, 16 bp, Homo sapiens
tctaggctgtctgacc

SEQ ID NO: 38569 - DNA, 17 bp, Homo sapiens
cctgggttacttcatcc

SEQ ID NO: 38570 - DNA, 16 bp, Homo sapiens
tctgggctgccctgcc

SEQ ID NO: 38571 - DNA, 17 bp, Homo sapiens
tctgggccgccttgccc

SEQ ID NO: 38572 - DNA, 18 bp, Homo sapiens
tctggcttacattttgac

SEQ ID NO: 38573 - DNA, 17 bp, Homo sapiens
tctgggtacctcattct

SEQ ID NO: 38574 - DNA, 25 bp, Homo sapiens
tctgggctcatctcacagccgcccc

SEQ ID NO: 38575 - DNA, 20 bp, Homo sapiens
tctgggctcacttcctgttg

SEQ ID NO: 38576 - DNA, 16 bp, Homo sapiens
tctggctttcattttg

SEQ ID NO: 38577 - DNA, 23 bp, Homo sapiens
tccgggctatctgtcaggtggcc

SEQ ID NO: 38578 - DNA, 17 bp, Homo sapiens
tctgggcatcactttga

SEQ ID NO: 38579 - DNA, 20 bp, Homo sapiens
tctgagctgtcttcagtccc

SEQ ID NO: 38580 - DNA, 15 bp, Homo sapiens
tctgggctccttttg

SEQ ID NO: 38581 - DNA, 24 bp, Homo sapiens
tctgggctgccttgtaggccgccc

SEQ ID NO: 38582 - DNA, 17 bp, Homo sapiens
tctgggctatcaccctg

SEQ ID NO: 38583 - DNA, 21 bp, Homo sapiens
tctgagctgcctcctggcccc

SEQ ID NO: 38584 - DNA, 24 bp, Homo sapiens
tctgggcgtctctgcgccgacccc

SEQ ID NO: 38585 - DNA, 23 bp, Homo sapiens
tctgggcttctgcagcctgaccc

SEQ ID NO: 38586 - DNA, 16 bp, Homo sapiens
tgggttactctgaccc

SEQ ID NO: 38587 - DNA, 20 bp, Homo sapiens
tctgagctgcctttcagccc

SEQ ID NO: 38588 - DNA, 21 bp, Homo sapiens
ctgggtgtagcttattttgac

SEQ ID NO: 38589 - DNA, 15 bp, Homo sapiens
tctgggcttctcgcc

SEQ ID NO: 38590 - DNA, 93 bp, Southern cowpea mosaic virus
aggttaacccatcttggatccatctcctgcctacttctcctgcgataaataaggttgaagtaggacaggaatcggccattttgggcagtacct

SEQ ID NO: 38591 - DNA, 24 bp, Southern cowpea mosaic virus
taggacaggaatcggccattttgg

SEQ ID NO: 38592 - DNA, 21 bp, Homo sapiens
ggacagggccacacattttgg

SEQ ID NO: 38593 - DNA, 21 bp, Homo sapiens
ggagggagtcgggggatttgg

SEQ ID NO: 38594 - DNA, 22 bp, Homo sapiens
agacagttcgaagtcattttgg

SEQ ID NO: 38595 - DNA, 19 bp, Homo sapiens
ggacagaagtggtttttgg

SEQ ID NO: 38596 - DNA, 16 bp, Homo sapiens
ggataggagcattttg

SEQ ID NO: 38597 - DNA, 18 bp, Homo sapiens
caggatgggaaggttttg

SEQ ID NO: 38598 - DNA, 18 bp, Homo sapiens
taggttgggggcattttg

SEQ ID NO: 38599 - DNA, 23 bp, Homo sapiens
taggacagctaaggtcattttgg

SEQ ID NO: 38600 - DNA, 21 bp, Homo sapiens
ggtcagggacagtcattttgg

SEQ ID NO: 38601 - DNA, 19 bp, Homo sapiens
ggggaggaatcagctttgg

SEQ ID NO: 38602 - DNA, 17 bp, Homo sapiens
aggcagggcacattttg

SEQ ID NO: 38603 - DNA, 60 bp, Human astrovirus
ccagggtggatggtatttgttgacaaatacatctattgttgatggggctatgccacctgg

SEQ ID NO: 38604 - DNA, 22 bp, Human astrovirus
ttgatggggctatgccacctgg

SEQ ID NO: 38605 - DNA, 20 bp, Homo sapiens
ttgatgaggagtgtgcctgg

SEQ ID NO: 38606 - DNA, 19 bp, Homo sapiens
tgatggggttgtcccttgg

SEQ ID NO: 38607 - DNA, 21 bp, Homo sapiens
tcggtggggccacaggcctgg

SEQ ID NO: 38608 - DNA, 22 bp, Homo sapiens
tggtggggctgttccagcctgg

SEQ ID NO: 38609 - DNA, 19 bp, Homo sapiens
ttggtggagctaccactgg

SEQ ID NO: 38610 - DNA, 19 bp, Homo sapiens
ctggtggggccaggcttgg

SEQ ID NO: 38611 - DNA, 25 bp, Homo sapiens
ttaatggggttgttttgacacttgg

SEQ ID NO: 38612 - DNA, 21 bp, Homo sapiens
ttgatggggcaggcaagctgg

SEQ ID NO: 38613 - DNA, 23 bp, Homo sapiens
tcgatggggggcacgctgtctgg

SEQ ID NO: 38614 - DNA, 21 bp, Homo sapiens
ttgccaggctatgccacctgg

SEQ ID NO: 38615 - DNA, 20 bp, Homo sapiens
ctggtggggctgtggattgg

SEQ ID NO: 38616 - DNA, 21 bp, Homo sapiens
ttcatggggctgtgccggtgg

SEQ ID NO: 38617 - DNA, 17 bp, Homo sapiens
ttgatgggctggcactg

SEQ ID NO: 38618 - DNA, 16 bp, Homo sapiens
ttgatgggattgcctg

SEQ ID NO: 38619 - DNA, 16 bp, Homo sapiens
ttgttggagccatctg

SEQ ID NO: 38620 - DNA, 23 bp, Homo sapiens
ctgatggggctgtgatgtgctgg

SEQ ID NO: 38621 - DNA, 22 bp, Homo sapiens
tgaagaaagctatgctgcctgg

SEQ ID NO: 38622 - DNA, 20 bp, Homo sapiens
ctggtggggtacgcgcctgg

SEQ ID NO: 38623 - DNA, 20 bp, Homo sapiens
ttgtggggctagtcctttgg

SEQ ID NO: 38624 - DNA, 16 bp, Homo sapiens
ttgctggggctatctg

SEQ ID NO: 38625 - DNA, 24 bp, Homo sapiens
ttgatggggttactgagcctctgg

SEQ ID NO: 38626 - DNA, 19 bp, Homo sapiens
atgtgattgtgccacctgg

SEQ ID NO: 38627 - DNA, 16 bp, Homo sapiens
atggggctgcctctgg

SEQ ID NO: 38628 - DNA, 19 bp, Homo sapiens
gatggggctgtgtcactag

SEQ ID NO: 38629 - DNA, 22 bp, Homo sapiens
tgatggcagtagtgccacctgg

SEQ ID NO: 38630 - DNA, 21 bp, Homo sapiens
ctgatggggcaccagatctgg

SEQ ID NO: 38631 - DNA, 19 bp, Homo sapiens
ctgatggggctgcttctgg

SEQ ID NO: 38632 - DNA, 19 bp, Homo sapiens
ttgatgggctggctcctgg

SEQ ID NO: 38633 - DNA, 20 bp, Homo sapiens
ttgatgaggctgtgctgtgg

SEQ ID NO: 38634 - DNA, 28 bp, Homo sapiens
ctgatggggctgccttttgccacctggc

SEQ ID NO: 38635 - DNA, 98 bp, Rabbit fibroma virus
ggtgtcttatatgtatccactaattgatgtaccagatatgtttttagacgcagttcgtccaatttttcatcgtcagacgtgggcatatacaagttacc

SEQ ID NO: 38636 - DNA, 24 bp, Rabbit fibroma virus
tatatgtatccactaattgatgta

SEQ ID NO: 38637 - DNA, 22 bp, Homo sapiens
tatgttatccacttaaaatgta

SEQ ID NO: 38638 - DNA, 20 bp, Homo sapiens
tatatgtatttacgtgacgc

SEQ ID NO: 38639 - DNA, 20 bp, Homo sapiens
atatgtgtccatttaatgta

SEQ ID NO: 38640 - DNA, 22 bp, Homo sapiens
tatatgtatctctagaacacta

SEQ ID NO: 38641 - DNA, 20 bp, Homo sapiens
tatgtgtatcctttgatgta

SEQ ID NO: 38642 - DNA, 69 bp, Rabbit fibroma virus
aaacacaatcccgactcggaatatatatatgataataaattggtaaatcccagttcgggtattttgttt

SEQ ID NO: 38643 - DNA, 24 bp, Rabbit fibroma virus
ttggtaaatcccagttcgggtatt

SEQ ID NO: 38644 - DNA, 23 bp, Homo sapiens
ttggcgaatcttggtcagatatt

SEQ ID NO: 38645 - DNA, 17 bp, Homo sapiens
ttgggaatcccagttca

SEQ ID NO: 38646 - DNA, 21 bp, Homo sapiens
ttggtaaatcttaattgcgaa

SEQ ID NO: 38647 - DNA, 18 bp, Homo sapiens
ttggtaaattttagctcg

SEQ ID NO: 38648 - DNA, 16 bp, Homo sapiens
ttggtaaatattgggt

SEQ ID NO: 38649 - DNA, 86 bp, Human herpesvirus 7
cgttttcagcatagtataattatttctaaacaaaattttttccgttggttcattaaatgttttagaattaataccattataaaacg

SEQ ID NO: 38650 - DNA, 24 bp, Human herpesvirus 7
tctaaacaaaattttttccgttgg

SEQ ID NO: 38651 - DNA, 19 bp, Homo sapiens
taaacagagttctttccgt

SEQ ID NO: 38652 - DNA, 24 bp, Homo sapiens
tctaagaaagtttttttcccctgg

SEQ ID NO: 38653 - DNA, 22 bp, Homo sapiens
caaacaggaacctctctgttgg

SEQ ID NO: 38654 - DNA, 66 bp, Bovine herpesvirus 4
aatattggccaatcatctctgatatttgtaaggaaataagaaaaaagaagaaaagtggacaatatt

SEQ ID NO: 38655 - DNA, 24 bp, Bovine herpesvirus 4
tattggccaatcatctctgatatt

SEQ ID NO: 38656 - DNA, 21 bp, Homo sapiens
ttggaaaatatttctgatatt

SEQ ID NO: 38657 - DNA, 20 bp, Homo sapiens
tattgaccagtcatctaaac

SEQ ID NO: 38658 - DNA, 18 bp, Homo sapiens
tattggccagtccttgat

SEQ ID NO: 38659 - DNA, 20 bp, Homo sapiens
tactggtcaatcatctgcca

SEQ ID NO: 38660 - DNA, 15 bp, Homo sapiens
tattgaatctctgat

SEQ ID NO: 38661 - DNA, 20 bp, Homo sapiens
tactggccagtcgtctaaac

SEQ ID NO: 38662 - DNA, 80 bp, Bovine adenovirus B
tcttcgtctgaggagctattgctagtgggtgtgcactgacggtgcttccgcgtggcatccgtttgctgcttgacgggtga

SEQ ID NO: 38663 - DNA, 24 bp, Bovine adenovirus B
tattgctagtgggtgtgcactgac

SEQ ID NO: 38664 - DNA, 21 bp, Homo sapiens
tattgcaggtgggtgcacctg

SEQ ID NO: 38665 - DNA, 22 bp, Homo sapiens
tgctctgtaagtgtgtgctgac

SEQ ID NO: 38666 - DNA, 23 bp, Homo sapiens
tattgctagctacagagcgctga

SEQ ID NO: 38667 - DNA, 19 bp, Homo sapiens
tattgcgagtgttgagtgt

SEQ ID NO: 38668 - DNA, 20 bp, Homo sapiens
tgttagtggagataactgac

SEQ ID NO: 38669 - DNA, 21 bp, Homo sapiens
tgctagtgggccagcattgac

SEQ ID NO: 38670 - DNA, 19 bp, Homo sapiens
tattgctgtgtccccactg

SEQ ID NO: 38671 - DNA, 21 bp, Homo sapiens
tatttttggtgaacatgctga

SEQ ID NO: 38672 - DNA, 69 bp, Myxoma virus
aaacacaatcccgactcggaatatatatacgataataaattggtaaatcccagttcgggaattttgttt

SEQ ID NO: 38673 - DNA, 24 bp, Myxoma virus
gtaaatcccagttcgggaattttg

SEQ ID NO: 38674 - DNA, 18 bp, Homo sapiens
tcctagttcggaatcttg

SEQ ID NO: 38675 - DNA, 18 bp, Homo sapiens
gtaaatcctggagatttt

SEQ ID NO: 38676 - DNA, 20 bp, Homo sapiens
aaatcaaggtgggaattttg

SEQ ID NO: 38677 - DNA, 18 bp, Homo sapiens
aaatccctgaggaatttt

SEQ ID NO: 38678 - DNA, 20 bp, Homo sapiens
tagatccctgaggaattttg

SEQ ID NO: 38679 - DNA, 103 bp, Human herpesvirus 5
ctagggaaaacataagaataggaagaaaccgaggtttgggagaaaagctgagataaaatagcgcattttccatacagaggttgttgtttttgtggatcctaag

SEQ ID NO: 38680 - DNA, 24 bp, Human herpesvirus 5
gggaaaacataagaataggaagaa

SEQ ID NO: 38681 - DNA, 21 bp, Homo sapiens
aggaaagcaccatgggaagaa

SEQ ID NO: 38682 - DNA, 20 bp, Homo sapiens
gggaaataggaaaggaggaa

SEQ ID NO: 38683 - DNA, 21 bp, Homo sapiens
gggtaagacaagaatggggag

SEQ ID NO: 38684 - DNA, 23 bp, Homo sapiens
gggaaagtgctgagaaggaagaa

SEQ ID NO: 38685 - DNA, 27 bp, Homo sapiens
gggaaaacttgggaactgtttgaagaa

SEQ ID NO: 38686 - DNA, 18 bp, Homo sapiens
gggaactgaataggagga

SEQ ID NO: 38687 - DNA, 19 bp, Homo sapiens
ggaaaacatgagaaatgga

SEQ ID NO: 38688 - DNA, 21 bp, Homo sapiens
gagaaagcatgaataagaaga

SEQ ID NO: 38689 - DNA, 21 bp, Homo sapiens
gggaagacagaaaaaggagaa

SEQ ID NO: 38690 - DNA, 21 bp, Homo sapiens
gggaaagcacaagaaaaagaa

SEQ ID NO: 38691 - DNA, 23 bp, Homo sapiens
ggaaagcatgcctcataggaaga

SEQ ID NO: 38692 - DNA, 21 bp, Homo sapiens
gggagacataatactccagga

SEQ ID NO: 38693 - DNA, 20 bp, Homo sapiens
gggagcgggaaataggagaa

SEQ ID NO: 38694 - DNA, 24 bp, Homo sapiens
gggaaaacatgatggacaacagaa

SEQ ID NO: 38695 - DNA, 22 bp, Homo sapiens
gggagaggggagaataggagga

SEQ ID NO: 38696 - DNA, 20 bp, Homo sapiens
gggaaaacaggggaaacaga

SEQ ID NO: 38697 - DNA, 16 bp, Homo sapiens
gggaaaacagacggag

SEQ ID NO: 38698 - DNA, 18 bp, Homo sapiens
gagaatggaataggaaga

SEQ ID NO: 38699 - DNA, 22 bp, Homo sapiens
gggaggaataaggataaaaaga

SEQ ID NO: 38700 - DNA, 21 bp, Homo sapiens
gggagagcagcagcaggaaga

SEQ ID NO: 38701 - DNA, 19 bp, Homo sapiens
gggaaaactaaggctcagg

SEQ ID NO: 38702 - DNA, 19 bp, Homo sapiens
gggaaaacaggcagggaga

SEQ ID NO: 38703 - DNA, 19 bp, Homo sapiens
gggaaaataaagaactgaa

SEQ ID NO: 38704 - DNA, 22 bp, Homo sapiens
gggaaaacaagggagtgaagga

SEQ ID NO: 38705 - DNA, 17 bp, Homo sapiens
gggagcatgacaggaag

SEQ ID NO: 38706 - DNA, 22 bp, Homo sapiens
gggaaaacaaggagcaggagaa

SEQ ID NO: 38707 - DNA, 18 bp, Homo sapiens
gagaaaacatgagggaag

SEQ ID NO: 38708 - DNA, 20 bp, Homo sapiens
gagaagaccacataggaaga

SEQ ID NO: 38709 - DNA, 23 bp, Homo sapiens
gggaaaacataatttttgaagaa

SEQ ID NO: 38710 - DNA, 21 bp, Homo sapiens
ggagaaagacggataggaaga

SEQ ID NO: 38711 - DNA, 21 bp, Homo sapiens
aggaagatgtaagaaccagga

SEQ ID NO: 38712 - DNA, 20 bp, Homo sapiens
gggaaaacatgagttgagga

SEQ ID NO: 38713 - DNA, 22 bp, Homo sapiens
gggaacacgaagtgtaggaaga

SEQ ID NO: 38714 - DNA, 22 bp, Homo sapiens
gggaaaacaatgagaggtggaa

SEQ ID NO: 38715 - DNA, 23 bp, Homo sapiens
gggagaataagaatgtgggagaa

SEQ ID NO: 38716 - DNA, 19 bp, Homo sapiens
gggaaggcaaagacaagaa

SEQ ID NO: 38717 - DNA, 26 bp, Homo sapiens
gggagaacaagagccctgaggaagaa

SEQ ID NO: 38718 - DNA, 19 bp, Homo sapiens
gggaaagggtgataggaag

SEQ ID NO: 38719 - DNA, 18 bp, Homo sapiens
gggaaacataaggaagga

SEQ ID NO: 38720 - DNA, 18 bp, Homo sapiens
aggaagaaggtaggaaga

SEQ ID NO: 38721 - DNA, 20 bp, Homo sapiens
gggaagacagggaggcagga

SEQ ID NO: 38722 - DNA, 22 bp, Homo sapiens
ggcaaagaataggaataggaag

SEQ ID NO: 38723 - DNA, 18 bp, Homo sapiens
gggacaaatgtaggaaga

SEQ ID NO: 38724 - DNA, 21 bp, Homo sapiens
gggaaagcagaaaaagaagaa

SEQ ID NO: 38725 - DNA, 23 bp, Homo sapiens
ggggggtcatgtgacaggaagaa

SEQ ID NO: 38726 - DNA, 20 bp, Homo sapiens
gggctagagaataggaggaa

SEQ ID NO: 38727 - DNA, 18 bp, Homo sapiens
gggaaaataagagtcagg

SEQ ID NO: 38728 - DNA, 21 bp, Homo sapiens
gggaaaacacaaggggtgcga

SEQ ID NO: 38729 - DNA, 17 bp, Homo sapiens
gggaaaacaaagcaagg

SEQ ID NO: 38730 - DNA, 19 bp, Homo sapiens
ggaaaaagcagataggaag

SEQ ID NO: 38731 - DNA, 21 bp, Homo sapiens
gggagagtaagaaaaggagaa

SEQ ID NO: 38732 - DNA, 17 bp, Homo sapiens
gggaaaataaagaggaa

SEQ ID NO: 38733 - DNA, 16 bp, Homo sapiens
gggaaaataagaataa

SEQ ID NO: 38734 - DNA, 18 bp, Homo sapiens
gggaagacaagaagaaga

SEQ ID NO: 38735 - DNA, 20 bp, Homo sapiens
gggaaaacagaagacaggaa

SEQ ID NO: 38736 - DNA, 21 bp, Homo sapiens
gggtaaggaagaatgggaaga

SEQ ID NO: 38737 - DNA, 15 bp, Homo sapiens
gggagaacaggaaaa

SEQ ID NO: 38738 - DNA, 21 bp, Homo sapiens
gggaaacagaaaccaggagga

SEQ ID NO: 38739 - DNA, 20 bp, Homo sapiens
gggagaacacaaggtcaaga

SEQ ID NO: 38740 - DNA, 17 bp, Homo sapiens
gggaggacagaaggaag

SEQ ID NO: 38741 - DNA, 16 bp, Homo sapiens
gggaaagaataaggag

SEQ ID NO: 38742 - DNA, 15 bp, Homo sapiens
gggaaaaataggaag

SEQ ID NO: 38743 - DNA, 20 bp, Homo sapiens
gggagacaagaaggggagga

SEQ ID NO: 38744 - DNA, 22 bp, Homo sapiens
gagaaagccacaaaataggaag

SEQ ID NO: 38745 - DNA, 20 bp, Homo sapiens
gggaagaaataagaaaagaa

SEQ ID NO: 38746 - DNA, 20 bp, Homo sapiens
gagacgctgagtaggaagaa

SEQ ID NO: 38747 - DNA, 18 bp, Homo sapiens
gggaaaacaaagcaagaa

SEQ ID NO: 38748 - DNA, 19 bp, Homo sapiens
gggaaataagagaacagga

SEQ ID NO: 38749 - DNA, 20 bp, Homo sapiens
ggaaaaaaaaagtgggaaga

SEQ ID NO: 38750 - DNA, 21 bp, Homo sapiens
gggaaatgaaagaatagagaa

SEQ ID NO: 38751 - DNA, 20 bp, Homo sapiens
gggagaacaaggaacttagg

SEQ ID NO: 38752 - DNA, 25 bp, Homo sapiens
gggaaaaaataaaaccctggaagaa

SEQ ID NO: 38753 - DNA, 20 bp, Homo sapiens
gggaaacagtaggacaggaa

SEQ ID NO: 38754 - DNA, 20 bp, Homo sapiens
gagaggaggaagtaggaaga

SEQ ID NO: 38755 - DNA, 19 bp, Homo sapiens
gggaaaacaaagccaaaga

SEQ ID NO: 38756 - DNA, 21 bp, Homo sapiens
gggaatgtaggagaggaagaa

SEQ ID NO: 38757 - DNA, 17 bp, Homo sapiens
gggaaacataaaaataa

SEQ ID NO: 38758 - DNA, 20 bp, Homo sapiens
ggaaaatataaaacaggaga

SEQ ID NO: 38759 - DNA, 17 bp, Homo sapiens
aggaagaaagtaggaag

SEQ ID NO: 38760 - DNA, 24 bp, Homo sapiens
gggaaaaataagtcttgggaagaa

SEQ ID NO: 38761 - DNA, 24 bp, Homo sapiens
gggaaaacatgagcagctctagaa

SEQ ID NO: 38762 - DNA, 21 bp, Homo sapiens
gggaaaaataggtacagggag

SEQ ID NO: 38763 - DNA, 21 bp, Homo sapiens
gggatgggcataagaagcgga

SEQ ID NO: 38764 - DNA, 21 bp, Homo sapiens
gggaaaacatggctgtcaaga

SEQ ID NO: 38765 - DNA, 15 bp, Homo sapiens
gggaaagataggaag

SEQ ID NO: 38766 - DNA, 20 bp, Homo sapiens
gggaggcatctccaggaaga

SEQ ID NO: 38767 - DNA, 16 bp, Homo sapiens
gggaaaataagagaag

SEQ ID NO: 38768 - DNA, 18 bp, Homo sapiens
gggaaaacggatggaaga

SEQ ID NO: 38769 - DNA, 24 bp, Homo sapiens
gggaaaaataagaacctatgggaa

SEQ ID NO: 38770 - DNA, 23 bp, Homo sapiens
gggaaagtgaggaagcaggaaga

SEQ ID NO: 38771 - DNA, 19 bp, Homo sapiens
ggtaaaacataagtaggaa

SEQ ID NO: 38772 - DNA, 19 bp, Homo sapiens
gggaaaaaataaggtcaga

SEQ ID NO: 38773 - DNA, 19 bp, Homo sapiens
ggaaaggagaaataggaag

SEQ ID NO: 38774 - DNA, 23 bp, Homo sapiens
gggaaaacctgaagctggaagaa

SEQ ID NO: 38775 - DNA, 18 bp, Homo sapiens
gggagaacagggaaagga

SEQ ID NO: 38776 - DNA, 19 bp, Homo sapiens
gggagaaacagaagttagg

SEQ ID NO: 38777 - DNA, 68 bp, Human herpesvirus 5
ctgcaacgctgattgattaaaagatggtctccgatgatgatgttgttattgatcgaatcatggtgcag

SEQ ID NO: 38778 - DNA, 24 bp, Human herpesvirus 5
tgatgttgttattgatcgaatcat

SEQ ID NO: 38779 - DNA, 17 bp, Homo sapiens
tgatgttgttttaagca

SEQ ID NO: 38780 - DNA, 19 bp, Homo sapiens
tgatgttgtttgtttgtca

SEQ ID NO: 38781 - DNA, 74 bp, Southern bean mosaic virus
tctgctctggttgagcgcgtcattcgcgacatacctttataagtatgtgagaactcggctgctcccagaggaga

SEQ ID NO: 38782 - DNA, 24 bp, Southern bean mosaic virus
tgagaactcggctgctcccagagg

SEQ ID NO: 38783 - DNA, 21 bp, Homo sapiens
gagaactcgcggctctagagg

SEQ ID NO: 38784 - DNA, 22 bp, Homo sapiens
tgaaactcagggcttttggagg

SEQ ID NO: 38785 - DNA, 18 bp, Homo sapiens
ggctgtccttcccagagg

SEQ ID NO: 38786 - DNA, 19 bp, Homo sapiens
agctgcctgttcccagagg

SEQ ID NO: 38787 - DNA, 16 bp, Homo sapiens
gaactcggtggcagag

SEQ ID NO: 38788 - DNA, 19 bp, Homo sapiens
tgggaacccgagctcagag

SEQ ID NO: 38789 - DNA, 23 bp, Homo sapiens
tgggaactggtcaagcccagagg

SEQ ID NO: 38790 - DNA, 21 bp, Homo sapiens
gaactccctacctcccagagg

SEQ ID NO: 38791 - DNA, 19 bp, Homo sapiens
acccggccgaagaccaggg

SEQ ID NO: 38792 - DNA, 23 bp, Homo sapiens
aggacttggagaggacccagagg

SEQ ID NO: 38793 - DNA, 18 bp, Homo sapiens
tgagagcccatcccagag

SEQ ID NO: 38794 - DNA, 20 bp, Homo sapiens
gaggactcggccctggctcc

SEQ ID NO: 38795 - DNA, 21 bp, Homo sapiens
tgaaaatgaggctcttggagg

SEQ ID NO: 38796 - DNA, 22 bp, Homo sapiens
tgggaactaggcttcccagagg

SEQ ID NO: 38797 - DNA, 25 bp, Homo sapiens
agaactcggttgtgggcctctggga

SEQ ID NO: 38798 - DNA, 20 bp, Homo sapiens
gagccggtgcgagccagagg

SEQ ID NO: 38799 - DNA, 17 bp, Homo sapiens
ctcctgcctcccagagg

SEQ ID NO: 38800 - DNA, 25 bp, Homo sapiens
tgagaacttgttagtggtccagagg

SEQ ID NO: 38801 - DNA, 19 bp, Homo sapiens
ggctcgcaggccccagagg

SEQ ID NO: 38802 - DNA, 18 bp, Homo sapiens
tgagggctcggctgggag

SEQ ID NO: 38803 - DNA, 21 bp, Homo sapiens
tgagggcccggctggcgatgg

SEQ ID NO: 38804 - DNA, 22 bp, Homo sapiens
agaagggcctctgctcccaggg

SEQ ID NO: 38805 - DNA, 22 bp, Homo sapiens
tgagaactgggctggagcaggg

SEQ ID NO: 38806 - DNA, 21 bp, Homo sapiens
tgaagactctgatcccagagg

SEQ ID NO: 38807 - DNA, 19 bp, Homo sapiens
tgaggacctgagcccagag

SEQ ID NO: 38808 - DNA, 23 bp, Homo sapiens
tgaggacactgatgctcccaggg

SEQ ID NO: 38809 - DNA, 17 bp, Homo sapiens
acccaggctcccggagg

SEQ ID NO: 38810 - DNA, 22 bp, Homo sapiens
gaagcttcagttttcccagagg

SEQ ID NO: 38811 - DNA, 21 bp, Homo sapiens
tgagaactcggtgcggggagg

SEQ ID NO: 38812 - DNA, 22 bp, Homo sapiens
tgagagctgtggctcccagagg

SEQ ID NO: 38813 - DNA, 18 bp, Homo sapiens
tgaaacactgctcctagg

SEQ ID NO: 38814 - DNA, 77 bp, Southern bean mosaic virus
gctattaagagtggtcctcagaccatcggttttggttgtaggaccaagatagatggtgatgactgtctttttactgc

SEQ ID NO: 38815 - DNA, 24 bp, Southern bean mosaic virus
tagatggtgatgactgtcttttta

SEQ ID NO: 38816 - DNA, 17 bp, Homo sapiens
ggtgtgtttgtcttttt

SEQ ID NO: 38817 - DNA, 19 bp, Homo sapiens
tggaatgaattgtcttttt

SEQ ID NO: 38818 - DNA, 22 bp, Homo sapiens
agatggtggtggttaacttttt

SEQ ID NO: 38819 - DNA, 18 bp, Homo sapiens
gagatgaattgtcttttt

SEQ ID NO: 38820 - DNA, 21 bp, Homo sapiens
gataatctggctgttttttta

SEQ ID NO: 38821 - DNA, 22 bp, Homo sapiens
gaaggtgatgacaaggcctttt

SEQ ID NO: 38822 - DNA, 16 bp, Homo sapiens
tagaggtttgtctttt

SEQ ID NO: 38823 - DNA, 18 bp, Homo sapiens
taggggcgctgtcttttt

SEQ ID NO: 38824 - DNA, 67 bp, Fowlpox virus
aggtaatgataaaactattggtctagatatgtaatcaaatcttacacgatctaaattatcccatcct

SEQ ID NO: 38825 - DNA, 24 bp, Fowlpox virus
ttacacgatctaaattatcccatc

SEQ ID NO: 38826 - DNA, 15 bp, Homo sapiens
tacacgatcatccca

SEQ ID NO: 38827 - DNA, 19 bp, Homo sapiens
cacatttaaattattccat

SEQ ID NO: 38828 - DNA, 20 bp, Homo sapiens
acactgcaaattatctcatc

SEQ ID NO: 38829 - DNA, 17 bp, Homo sapiens
gatacaattatcccatc

SEQ ID NO: 38830 - DNA, 115 bp, Southern bean mosaic virus
catagaagttcaagtaaacccctcatggattagcctcttaggtggctctctcaagataaacggagatgacgcctctaatgagtctgctgtgttgggaagcttttattcttctgtg

SEQ ID NO: 38831 - DNA, 24 bp, Southern bean mosaic virus
ttcaagtaaacccctcatggatta

SEQ ID NO: 38832 - DNA, 21 bp, Homo sapiens
caagatggccttcatggatta

SEQ ID NO: 38833 - DNA, 22 bp, Homo sapiens
ttctgagtataaatcatggatt

SEQ ID NO: 38834 - DNA, 18 bp, Homo sapiens
ttcaagggaacccctcat

SEQ ID NO: 38835 - DNA, 19 bp, Homo sapiens
aaacacctctcatggatta

SEQ ID NO: 38836 - DNA, 18 bp, Homo sapiens
aagtatattcatggatta

SEQ ID NO: 38837 - DNA, 65 bp, Equine herpesvirus 2
tatgactaatctagatatgttaattagatatgactaatctagatatgttaattagattagtcata

SEQ ID NO: 38838 - DNA, 24 bp, Equine herpesvirus 2
tgactaatctagatatgttaatta

SEQ ID NO: 38839 - DNA, 22 bp, Homo sapiens
tggctaatcagacaaacaatta

SEQ ID NO: 38840 - DNA, 18 bp, Homo sapiens
tgactaatttagaggtgc

SEQ ID NO: 38841 - DNA, 104 bp, Equine herpesvirus 2
gtgagagtgaagtgtaatgaccacgtgaaacagaaataagtttaacttttttattatttttttaaggtttgttttttttgtatgtatggttagtcttcacctgc

SEQ ID NO: 38842 - DNA, 24 bp, Equine herpesvirus 2
aaacagaaataagtttaacttttt

SEQ ID NO: 38843 - DNA, 23 bp, Homo sapiens
caggcttgtaagtttaacttttt

SEQ ID NO: 38844 - DNA, 21 bp, Homo sapiens
aaacaaaaataataacttttt

SEQ ID NO: 38845 - DNA, 19 bp, Homo sapiens
acaacatagtttaactttt

SEQ ID NO: 38846 - DNA, 21 bp, Homo sapiens
cagaaataaagtttaattttt

SEQ ID NO: 38847 - DNA, 17 bp, Homo sapiens
agaaataagttaccttt

SEQ ID NO: 38848 - DNA, 18 bp, Homo sapiens
aaaagaagtccaactttt

SEQ ID NO: 38849 - DNA, 20 bp, Homo sapiens
aaacagaataagttactttt

SEQ ID NO: 38850 - DNA, 17 bp, Homo sapiens
cagaaatataacttttt

SEQ ID NO: 38851 - DNA, 22 bp, Homo sapiens
aacaaaaataagtatacttttt

SEQ ID NO: 38852 - DNA, 21 bp, Homo sapiens
aaaataagtcctcaacttttt

SEQ ID NO: 38853 - DNA, 64 bp, Fowlpox virus
gtgtattattataaagtccatatcggagttacttttctctaggtattttttataacttatacac

SEQ ID NO: 38854 - DNA, 24 bp, Fowlpox virus
tataaagtccatatcggagttact

SEQ ID NO: 38855 - DNA, 19 bp, Homo sapiens
agttcatagaaaagttact

SEQ ID NO: 38856 - DNA, 18 bp, Homo sapiens
agtccatatctcagcact

SEQ ID NO: 38857 - DNA, 18 bp, Homo sapiens
tataaggtccatatagct

SEQ ID NO: 38858 - DNA, 22 bp, Homo sapiens
tataaagtccagttcataaatt

SEQ ID NO: 38859 - DNA, 21 bp, Homo sapiens
taaagtcctattcaatttact

SEQ ID NO: 38860 - DNA, 24 bp, Homo sapiens
tatggagtccatagcatcagggct

SEQ ID NO: 38861 - DNA, 18 bp, Homo sapiens
tataaagtctatatttga

SEQ ID NO: 38862 - DNA, 17 bp, Homo sapiens
tataaagtttatacgga

SEQ ID NO: 38863 - DNA, 83 bp, Southern bean mosaic virus
ctcaagagactcttcctccagagttgtccgtgatcgaaattcctttcgaagacgttgagactcggagttatgagtttattgag

SEQ ID NO: 38864 - DNA, 24 bp, Southern bean mosaic virus
aagacgttgagactcggagttatg

SEQ ID NO: 38865 - DNA, 18 bp, Homo sapiens
agatgttgagactccagt

SEQ ID NO: 38866 - DNA, 17 bp, Homo sapiens
aagatgttgaaacttga

SEQ ID NO: 38867 - DNA, 18 bp, Homo sapiens
gacgttgaggcctaaagt

SEQ ID NO: 38868 - DNA, 130 bp, Equine herpesvirus 2
tcccacaatctcattggtccagagccctctcagccgcgctctgattggtcgagagctagctggccctctcgaccaaccataggccagggattttgattgacagctccgccggccaatgagaacgcaggga

SEQ ID NO: 38869 - DNA, 24 bp, Equine herpesvirus 2
tcattggtccagagccctctcagc

SEQ ID NO: 38870 - DNA, 17 bp, Homo sapiens
ctggcagctctctcagc

SEQ ID NO: 38871 - DNA, 16 bp, Homo sapiens
tcttggtaagagccct

SEQ ID NO: 38872 - DNA, 22 bp, Homo sapiens
tccttggcttcgtcctctcagc

SEQ ID NO: 38873 - DNA, 25 bp, Homo sapiens
tcattggtgcagaggacatttcggc

SEQ ID NO: 38874 - DNA, 21 bp, Homo sapiens
cattggtccagagaaagcagc

SEQ ID NO: 38875 - DNA, 25 bp, Homo sapiens
tcactggtccgggggacgcctcagc

SEQ ID NO: 38876 - DNA, 21 bp, Homo sapiens
tggtgtgaaagtcctctcagc

SEQ ID NO: 38877 - DNA, 21 bp, Homo sapiens
tctattggtcctcctctcagc

SEQ ID NO: 38878 - DNA, 16 bp, Homo sapiens
ttggtccaaggctcaa

SEQ ID NO: 38879 - DNA, 19 bp, Homo sapiens
ttggtaggggccctctcag

SEQ ID NO: 38880 - DNA, 19 bp, Homo sapiens
tcattggccagttcttcag

SEQ ID NO: 38881 - DNA, 21 bp, Homo sapiens
tcattgtccagagctaccaag

SEQ ID NO: 38882 - DNA, 19 bp, Homo sapiens
tcattggccatgttctcag

SEQ ID NO: 38883 - DNA, 23 bp, Homo sapiens
tcattggtttctctgcctcttag

SEQ ID NO: 38884 - DNA, 21 bp, Homo sapiens
tcctgtcggagttctctcagc

SEQ ID NO: 38885 - DNA, 66 bp, Vaccinia virus
aacaaagaaatggaaatcgtaataccagttatgtttaactttgaaattgttttttattttcttgtt

SEQ ID NO: 38886 - DNA, 24 bp, Vaccinia virus
tggaaatcgtaataccagttatgt

SEQ ID NO: 38887 - DNA, 23 bp, Homo sapiens
tgggaatcgtaaaattcctatgt

SEQ ID NO: 38888 - DNA, 21 bp, Homo sapiens
tggtaacactaccagttgtgt

SEQ ID NO: 38889 - DNA, 103 bp, Human papillomavirus type 42
gaaaacacacaaatagatgtatgtagtaatgttatgatacatatttatgttatttatttgtgtactgtgttaataaactactttttatatgttgtgtgttctc

SEQ ID NO: 38890 - DNA, 24 bp, Human papillomavirus type 42
tactgtgttaataaactacttttt

SEQ ID NO: 38891 - DNA, 18 bp, Homo sapiens
tactgtgtcaataagact

SEQ ID NO: 38892 - DNA, 20 bp, Homo sapiens
ctgtgttaataggacacttt

SEQ ID NO: 38893 - DNA, 17 bp, Homo sapiens
tgtgttaataactgctt

SEQ ID NO: 38894 - DNA, 21 bp, Homo sapiens
tactgcagtaaactacttttt

SEQ ID NO: 38895 - DNA, 18 bp, Homo sapiens
tactgtgtcagtgaacta

SEQ ID NO: 38896 - DNA, 16 bp, Homo sapiens
tactgtgtcaaacttt

SEQ ID NO: 38897 - DNA, 67 bp, Yaba-like disease virus
tgagttgttaaatctttacaggtgtttagatttttcagataaaacaactagagaaaagtataactca

SEQ ID NO: 38898 - DNA, 24 bp, Yaba-like disease virus
taaaacaactagagaaaagtataa

SEQ ID NO: 38899 - DNA, 24 bp, Homo sapiens
caaaacgtggagagaaaagtataa

SEQ ID NO: 38900 - DNA, 19 bp, Homo sapiens
aacctctgagaaaagtata

SEQ ID NO: 38901 - DNA, 22 bp, Homo sapiens
tgaactaaaaataaaagtataa

SEQ ID NO: 38902 - DNA, 17 bp, Homo sapiens
taaaacactagagaaaa

SEQ ID NO: 38903 - DNA, 19 bp, Homo sapiens
tgaactaaaaagaagtata

SEQ ID NO: 38904 - DNA, 19 bp, Homo sapiens
taaggcaactagaagcata

SEQ ID NO: 38905 - DNA, 19 bp, Homo sapiens
taaaacaactggtagaaaa

SEQ ID NO: 38906 - DNA, 16 bp, Homo sapiens
aacaccagagggtata

SEQ ID NO: 38907 - DNA, 18 bp, Homo sapiens
aacagctagagaacagta

SEQ ID NO: 38908 - DNA, 17 bp, Homo sapiens
aaaacaactagaatata

SEQ ID NO: 38909 - DNA, 18 bp, Homo sapiens
caagcacagaaaagtata

SEQ ID NO: 38910 - DNA, 17 bp, Homo sapiens
taaaacactggagaaaa

SEQ ID NO: 38911 - DNA, 18 bp, Homo sapiens
taaaacaacgggagaaaa

SEQ ID NO: 38912 - DNA, 21 bp, Homo sapiens
aaaacacttaaaaaagtataa

SEQ ID NO: 38913 - DNA, 18 bp, Homo sapiens
taaaacaaatagagaaaa

SEQ ID NO: 38914 - DNA, 21 bp, Homo sapiens
acaactaattgtaaagtataa

SEQ ID NO: 38915 - DNA, 21 bp, Homo sapiens
caaatcaagagaaaagtataa

SEQ ID NO: 38916 - DNA, 15 bp, Homo sapiens
caacagagaagtata

SEQ ID NO: 38917 - DNA, 19 bp, Homo sapiens
taaaacaactgtgggagaa

SEQ ID NO: 38918 - DNA, 19 bp, Homo sapiens
aaacaaatagagaaaagta

SEQ ID NO: 38919 - DNA, 63 bp, Human herpesvirus 4
cctcccctccctctccctcgtcctggtcggaaaagtctgaggaggagaaggagaatggggagg

SEQ ID NO: 38920 - DNA, 24 bp, Human herpesvirus 4
tgaggaggagaaggagaatgggga

SEQ ID NO: 38921 - DNA, 22 bp, Homo sapiens
tgaggaggaagggagcactagg

SEQ ID NO: 38922 - DNA, 17 bp, Homo sapiens
ggaggaggaggaggggg

SEQ ID NO: 38923 - DNA, 19 bp, Homo sapiens
gaggaggaggaggaggggg

SEQ ID NO: 38924 - DNA, 20 bp, Homo sapiens
gaggaggagggggggaggga

SEQ ID NO: 38925 - DNA, 21 bp, Homo sapiens
gaggggaggggacccatgggg

SEQ ID NO: 38926 - DNA, 23 bp, Homo sapiens
gagggggggaaggcagggtgggg

SEQ ID NO: 38927 - DNA, 16 bp, Homo sapiens
tgaggaggggatgggg

SEQ ID NO: 38928 - DNA, 19 bp, Homo sapiens
gaggaggaagaggatgggg

SEQ ID NO: 38929 - DNA, 18 bp, Homo sapiens
tgaggagggggaagggga

SEQ ID NO: 38930 - DNA, 20 bp, Homo sapiens
gaggagcatggagggtgggg

SEQ ID NO: 38931 - DNA, 22 bp, Homo sapiens
tggggaggagatggagtaagga

SEQ ID NO: 38932 - DNA, 19 bp, Homo sapiens
tggggaggagaacctgggg

SEQ ID NO: 38933 - DNA, 19 bp, Homo sapiens
gaggaggaggaggggcggg

SEQ ID NO: 38934 - DNA, 22 bp, Homo sapiens
tgaggcgggggcggaatgggga

SEQ ID NO: 38935 - DNA, 22 bp, Homo sapiens
gaggaggaggaggaggcagggg

SEQ ID NO: 38936 - DNA, 17 bp, Homo sapiens
gaggaggaggaatgggg

SEQ ID NO: 38937 - DNA, 20 bp, Homo sapiens
tgggaggagaggggacagga

SEQ ID NO: 38938 - DNA, 18 bp, Homo sapiens
ggggagggggaggtggga

SEQ ID NO: 38939 - DNA, 18 bp, Homo sapiens
tgggaaggagaaggagaa

SEQ ID NO: 38940 - DNA, 21 bp, Homo sapiens
gaggaggagaaggggcgggga

SEQ ID NO: 38941 - DNA, 25 bp, Homo sapiens
gaggagaggggaggagaggtgggga

SEQ ID NO: 38942 - DNA, 19 bp, Homo sapiens
tgaggggagaagacagggg

SEQ ID NO: 38943 - DNA, 21 bp, Homo sapiens
agaggagctggagggtgggga

SEQ ID NO: 38944 - DNA, 20 bp, Homo sapiens
tgaggaggaggaggaaagga

SEQ ID NO: 38945 - DNA, 20 bp, Homo sapiens
gaggaggagaaggggagggg

SEQ ID NO: 38946 - DNA, 20 bp, Homo sapiens
tgaggaggcaggcattgggg

SEQ ID NO: 38947 - DNA, 18 bp, Homo sapiens
tgaggagggagggaagga

SEQ ID NO: 38948 - DNA, 22 bp, Homo sapiens
tgggaggagagggagatgctgg

SEQ ID NO: 38949 - DNA, 23 bp, Homo sapiens
tgggaaggaggaggcaatgggga

SEQ ID NO: 38950 - DNA, 19 bp, Homo sapiens
tgaggaggggggcgcggga

SEQ ID NO: 38951 - DNA, 19 bp, Homo sapiens
gaggaggaggaggagagga

SEQ ID NO: 38952 - DNA, 18 bp, Homo sapiens
ggaggagagggcgtgggg

SEQ ID NO: 38953 - DNA, 21 bp, Homo sapiens
agggggagaatgcagtgggga

SEQ ID NO: 38954 - DNA, 19 bp, Homo sapiens
tgaggagggggtggcgggg

SEQ ID NO: 38955 - DNA, 18 bp, Homo sapiens
tgaggaggggagaggaga

SEQ ID NO: 38956 - DNA, 23 bp, Homo sapiens
tgggagctgaaaggggaatgggg

SEQ ID NO: 38957 - DNA, 16 bp, Homo sapiens
ggggagaggggaggag

SEQ ID NO: 38958 - DNA, 15 bp, Homo sapiens
gaggaggagggtggg

SEQ ID NO: 38959 - DNA, 17 bp, Homo sapiens
tgggaggagaggagggg

SEQ ID NO: 38960 - DNA, 20 bp, Homo sapiens
gaggaggagaaggagttgga

SEQ ID NO: 38961 - DNA, 15 bp, Homo sapiens
gggggaaggagagga

SEQ ID NO: 38962 - DNA, 18 bp, Homo sapiens
tgaggagggaggaggagg

SEQ ID NO: 38963 - DNA, 22 bp, Homo sapiens
tgaggagagaaatggggtgggg

SEQ ID NO: 38964 - DNA, 18 bp, Homo sapiens
ggaggagaggggaaggga

SEQ ID NO: 38965 - DNA, 17 bp, Homo sapiens
tgagggggaggagggaa

SEQ ID NO: 38966 - DNA, 22 bp, Homo sapiens
tggggaggagaaggtgctgggg

SEQ ID NO: 38967 - DNA, 21 bp, Homo sapiens
tgaggggaggggaggatgggg

SEQ ID NO: 38968 - DNA, 19 bp, Homo sapiens
tgaggaggtgggggcgggg

SEQ ID NO: 38969 - DNA, 25 bp, Homo sapiens
tgaggaggggcagggagccttgggg

SEQ ID NO: 38970 - DNA, 19 bp, Homo sapiens
tgaggaggaggaagagggg

SEQ ID NO: 38971 - DNA, 17 bp, Homo sapiens
ggggagaagagctgggg

SEQ ID NO: 38972 - DNA, 19 bp, Homo sapiens
tgagaaggagggggagggg

SEQ ID NO: 38973 - DNA, 17 bp, Homo sapiens
tggggaggagagagggg

SEQ ID NO: 38974 - DNA, 23 bp, Homo sapiens
tggggtggagaaggagccccaga

SEQ ID NO: 38975 - DNA, 18 bp, Homo sapiens
taagtggggggaatgggg

SEQ ID NO: 38976 - DNA, 22 bp, Homo sapiens
tggggagggaagggggttggga

SEQ ID NO: 38977 - DNA, 23 bp, Homo sapiens
tgaggaggagggagactgagggg

SEQ ID NO: 38978 - DNA, 16 bp, Homo sapiens
tgggaggagacatggg

SEQ ID NO: 38979 - DNA, 21 bp, Homo sapiens
tggggaagagaggggagtggg

SEQ ID NO: 38980 - DNA, 23 bp, Homo sapiens
gaggaggaggaggagaagcggga

SEQ ID NO: 38981 - DNA, 21 bp, Homo sapiens
gaggaggggaaggaggcgggg

SEQ ID NO: 38982 - DNA, 20 bp, Homo sapiens
gaggaggaggaggaagagga

SEQ ID NO: 38983 - DNA, 22 bp, Homo sapiens
tggggaggggaggggatcagga

SEQ ID NO: 38984 - DNA, 23 bp, Homo sapiens
gaagtagggaaggagggtgggga

SEQ ID NO: 38985 - DNA, 18 bp, Homo sapiens
tgaggggagaagggtgga

SEQ ID NO: 38986 - DNA, 17 bp, Homo sapiens
ggggagggagtccaaga

SEQ ID NO: 38987 - DNA, 20 bp, Homo sapiens
tgaggaggatgaggccgggg

SEQ ID NO: 38988 - DNA, 18 bp, Homo sapiens
tgaggaggaggtggggga

SEQ ID NO: 38989 - DNA, 19 bp, Homo sapiens
tgaggaggggagggcagga

SEQ ID NO: 38990 - DNA, 20 bp, Homo sapiens
tgaggaggaggaggcggcgg

SEQ ID NO: 38991 - DNA, 19 bp, Homo sapiens
tggggagtgatggatgggg

SEQ ID NO: 38992 - DNA, 18 bp, Homo sapiens
gagagccagggagtgggg

SEQ ID NO: 38993 - DNA, 17 bp, Homo sapiens
ggggagagggggaagga

SEQ ID NO: 38994 - DNA, 21 bp, Homo sapiens
ggaggaggaggaggatgagga

SEQ ID NO: 38995 - DNA, 16 bp, Homo sapiens
tgaggaggagacgggg

SEQ ID NO: 38996 - DNA, 17 bp, Homo sapiens
tgaggggaggaggagaa

SEQ ID NO: 38997 - DNA, 21 bp, Homo sapiens
ggaggaggaggagggcgagga

SEQ ID NO: 38998 - DNA, 17 bp, Homo sapiens
gaggaggaggaggaggg

SEQ ID NO: 38999 - DNA, 17 bp, Homo sapiens
ggggaggaaggagggga

SEQ ID NO: 39000 - DNA, 21 bp, Homo sapiens
tgggaggagggggaaatagga

SEQ ID NO: 39001 - DNA, 18 bp, Homo sapiens
tgaggaggagaactgggg

SEQ ID NO: 39002 - DNA, 20 bp, Homo sapiens
tgatggggaggagtatgggg

SEQ ID NO: 39003 - DNA, 19 bp, Homo sapiens
tgaggaggaggaggaaggg

SEQ ID NO: 39004 - DNA, 20 bp, Homo sapiens
gaggaggggaaggagaggga

SEQ ID NO: 39005 - DNA, 18 bp, Homo sapiens
gaggaggagaaggaaagg

SEQ ID NO: 39006 - DNA, 20 bp, Homo sapiens
gaggaggagaaggaagagga

SEQ ID NO: 39007 - DNA, 21 bp, Homo sapiens
tggggaggaaaggggatgggg

SEQ ID NO: 39008 - DNA, 21 bp, Homo sapiens
tggggaggaggacggacagga

SEQ ID NO: 39009 - DNA, 17 bp, Homo sapiens
tgaggaggaggatgagg

SEQ ID NO: 39010 - DNA, 25 bp, Homo sapiens
tgaggagggggtggggaagcagggg

SEQ ID NO: 39011 - DNA, 21 bp, Homo sapiens
aaagaggggaggagagtgggg

SEQ ID NO: 39012 - DNA, 18 bp, Homo sapiens
gaggaggaggaggggagg

SEQ ID NO: 39013 - DNA, 21 bp, Homo sapiens
gaggaggggaaggaagaagga

SEQ ID NO: 39014 - DNA, 16 bp, Homo sapiens
tgagaaggggagggag

SEQ ID NO: 39015 - DNA, 19 bp, Homo sapiens
tgggaggggaagggaagga

SEQ ID NO: 39016 - DNA, 16 bp, Homo sapiens
ggaggagagggtggga

SEQ ID NO: 39017 - DNA, 18 bp, Homo sapiens
ggggaggcggagctgggg

SEQ ID NO: 39018 - DNA, 21 bp, Homo sapiens
gaggaggggaggggaaggggg

SEQ ID NO: 39019 - DNA, 20 bp, Homo sapiens
tgaggggtggaaggagagga

SEQ ID NO: 39020 - DNA, 16 bp, Homo sapiens
ggaggagaaggggagg

SEQ ID NO: 39021 - DNA, 22 bp, Homo sapiens
tggtgaggagaaggaagcagga

SEQ ID NO: 39022 - DNA, 24 bp, Homo sapiens
tggggtggggaaggagaatggtgg

SEQ ID NO: 39023 - DNA, 21 bp, Homo sapiens
gggggagagaagatatgggga

SEQ ID NO: 39024 - DNA, 26 bp, Homo sapiens
gaggaaagggcggaggggggtgggga

SEQ ID NO: 39025 - DNA, 19 bp, Homo sapiens
ggaggagaaggaggtggga

SEQ ID NO: 39026 - DNA, 19 bp, Homo sapiens
tgaggaagggagggagagg

SEQ ID NO: 39027 - DNA, 19 bp, Homo sapiens
cggggaggagaaggagggg

SEQ ID NO: 39028 - DNA, 16 bp, Homo sapiens
tgagggagaggatggg

SEQ ID NO: 39029 - DNA, 24 bp, Homo sapiens
tggggagcagaaaaacagtgggga

SEQ ID NO: 39030 - DNA, 19 bp, Homo sapiens
tgagaaatggggagtgggg

SEQ ID NO: 39031 - DNA, 19 bp, Homo sapiens
tgggaggagagggactggg

SEQ ID NO: 39032 - DNA, 19 bp, Homo sapiens
tggggaggatgagggagaa

SEQ ID NO: 39033 - DNA, 19 bp, Homo sapiens
agaggcaaggagaatgggg

SEQ ID NO: 39034 - DNA, 18 bp, Homo sapiens
ggaggaggaggaggaggg

SEQ ID NO: 39035 - DNA, 19 bp, Homo sapiens
tgaggggagggaagggagg

SEQ ID NO: 39036 - DNA, 18 bp, Homo sapiens
tgaggaggagggaagggg

SEQ ID NO: 39037 - DNA, 18 bp, Homo sapiens
tgaggagggggtgtgggg

SEQ ID NO: 39038 - DNA, 26 bp, Homo sapiens
tggggagagaaggggctggaatgggg

SEQ ID NO: 39039 - DNA, 21 bp, Homo sapiens
taaggaggaggaggggatgga

SEQ ID NO: 39040 - DNA, 22 bp, Homo sapiens
tgaggagggcaggggggtgggg

SEQ ID NO: 39041 - DNA, 22 bp, Homo sapiens
gagggggaggaaggaatgggga

SEQ ID NO: 39042 - DNA, 18 bp, Homo sapiens
gaggaggaggaggagggg

SEQ ID NO: 39043 - DNA, 16 bp, Homo sapiens
ggaggaggaggagggg

SEQ ID NO: 39044 - DNA, 20 bp, Homo sapiens
gaggaggaggaggaggtgga

SEQ ID NO: 39045 - DNA, 18 bp, Homo sapiens
tggggaggagagaggaga

SEQ ID NO: 39046 - DNA, 23 bp, Homo sapiens
tgaggaggagtgaaggatgggga

SEQ ID NO: 39047 - DNA, 18 bp, Homo sapiens
gaggaggaggaggaaggg

SEQ ID NO: 39048 - DNA, 19 bp, Homo sapiens
ggaggggaaggggaaaggg

SEQ ID NO: 39049 - DNA, 18 bp, Homo sapiens
tgaggagggaggatgggg

SEQ ID NO: 39050 - DNA, 25 bp, Homo sapiens
tgagagggaggaaaactgatgggga

SEQ ID NO: 39051 - DNA, 21 bp, Homo sapiens
tgggaggagagagaatgggga

SEQ ID NO: 39052 - DNA, 24 bp, Homo sapiens
gaggcccaagagggggaatgggga

SEQ ID NO: 39053 - DNA, 21 bp, Homo sapiens
tgagggagagaaggacaagga

SEQ ID NO: 39054 - DNA, 22 bp, Homo sapiens
tggggaggggagggaccgggga

SEQ ID NO: 39055 - DNA, 19 bp, Homo sapiens
aggaggaggggggatggga

SEQ ID NO: 39056 - DNA, 15 bp, Homo sapiens
tgggagggggagggg

SEQ ID NO: 39057 - DNA, 26 bp, Homo sapiens
gagggggagaagacacacagtgggga

SEQ ID NO: 39058 - DNA, 20 bp, Homo sapiens
tgaggaggggaggggagggg

SEQ ID NO: 39059 - DNA, 19 bp, Homo sapiens
ggaggagctgagaatgggg

SEQ ID NO: 39060 - DNA, 22 bp, Homo sapiens
tgaggagggggcaggaaagggg

SEQ ID NO: 39061 - DNA, 18 bp, Homo sapiens
tgagtaggggagatgggg

SEQ ID NO: 39062 - DNA, 18 bp, Homo sapiens
gggggaggaatcaatggg

SEQ ID NO: 39063 - DNA, 22 bp, Homo sapiens
tgggaggagagggggctgggga

SEQ ID NO: 39064 - DNA, 19 bp, Homo sapiens
tggggaggaggaaggaggg

SEQ ID NO: 39065 - DNA, 19 bp, Homo sapiens
tgaggagggaggaggaggg

SEQ ID NO: 39066 - DNA, 21 bp, Homo sapiens
tgaggaagaggaggaggtgga

SEQ ID NO: 39067 - DNA, 21 bp, Homo sapiens
aggggacctggagaatgggga

SEQ ID NO: 39068 - DNA, 18 bp, Homo sapiens
ggaggagagggagtagga

SEQ ID NO: 39069 - DNA, 24 bp, Homo sapiens
tgcggagtgcagggagggtgggga

SEQ ID NO: 39070 - DNA, 23 bp, Homo sapiens
tggggaggggagggagagcaaga

SEQ ID NO: 39071 - DNA, 16 bp, Homo sapiens
gaggaggaggaggggg

SEQ ID NO: 39072 - DNA, 22 bp, Homo sapiens
tgagaggagaggacactgggga

SEQ ID NO: 39073 - DNA, 18 bp, Homo sapiens
gagggggagaaggcctgg

SEQ ID NO: 39074 - DNA, 21 bp, Homo sapiens
tgaggaggtggaagggaaggg

SEQ ID NO: 39075 - DNA, 19 bp, Homo sapiens
tgagggagagaagggaggg

SEQ ID NO: 39076 - DNA, 21 bp, Homo sapiens
gaggggccctgggaatgggga

SEQ ID NO: 39077 - DNA, 18 bp, Homo sapiens
tgaggaggcgaagggagg

SEQ ID NO: 39078 - DNA, 16 bp, Homo sapiens
tgaggaggagagaggg

SEQ ID NO: 39079 - DNA, 21 bp, Homo sapiens
gaggaggaggaggagtccgga

SEQ ID NO: 39080 - DNA, 19 bp, Homo sapiens
aggggaggggagggagggg

SEQ ID NO: 39081 - DNA, 16 bp, Homo sapiens
ggggagaagaagggga

SEQ ID NO: 39082 - DNA, 18 bp, Homo sapiens
tgagggggagaaagagaa

SEQ ID NO: 39083 - DNA, 22 bp, Homo sapiens
tgagtgggggaaggagacaaga

SEQ ID NO: 39084 - DNA, 19 bp, Homo sapiens
gggggagagggaaatgggg

SEQ ID NO: 39085 - DNA, 19 bp, Homo sapiens
tgaaggggggacggtgggg

SEQ ID NO: 39086 - DNA, 20 bp, Homo sapiens
ggggagaaggggaaagggga

SEQ ID NO: 39087 - DNA, 17 bp, Homo sapiens
tgaggaggagagagggg

SEQ ID NO: 39088 - DNA, 28 bp, Homo sapiens
tgaggaggagaggaggggagggtgggga

SEQ ID NO: 39089 - DNA, 19 bp, Homo sapiens
agggaagaggaggatgggg

SEQ ID NO: 39090 - DNA, 24 bp, Homo sapiens
tgaggagggtggggagagtgggga

SEQ ID NO: 39091 - DNA, 20 bp, Homo sapiens
ggggagggtggggatgggga

SEQ ID NO: 39092 - DNA, 23 bp, Homo sapiens
gaggaggatggggagggtgggga

SEQ ID NO: 39093 - DNA, 21 bp, Homo sapiens
gaggggaggggacactgggga

SEQ ID NO: 39094 - DNA, 22 bp, Homo sapiens
tggggaggggaatgagaccagg

SEQ ID NO: 39095 - DNA, 21 bp, Homo sapiens
gaggaggaggaggacatgggg

SEQ ID NO: 39096 - DNA, 19 bp, Homo sapiens
gaggaggaggaggaggcgg

SEQ ID NO: 39097 - DNA, 21 bp, Homo sapiens
tgaggatggaggagcaagggg

SEQ ID NO: 39098 - DNA, 21 bp, Homo sapiens
tgggagggagagggggaggga

SEQ ID NO: 39099 - DNA, 20 bp, Homo sapiens
ggaggaggaggagggccgga

SEQ ID NO: 39100 - DNA, 17 bp, Homo sapiens
tgaggaggagaggaggg

SEQ ID NO: 39101 - DNA, 24 bp, Homo sapiens
tggggaggagatagggtcttggga

SEQ ID NO: 39102 - DNA, 16 bp, Homo sapiens
ggcgaggagaagggga

SEQ ID NO: 39103 - DNA, 19 bp, Homo sapiens
tgaggagggtgagcagggg

SEQ ID NO: 39104 - DNA, 19 bp, Homo sapiens
aggggaggggagggcgggg

SEQ ID NO: 39105 - DNA, 19 bp, Homo sapiens
tgaagaggcgggggtgggg

SEQ ID NO: 39106 - DNA, 21 bp, Homo sapiens
tggggaggagagagggtgggg

SEQ ID NO: 39107 - DNA, 16 bp, Homo sapiens
gaggagggggaggggg

SEQ ID NO: 39108 - DNA, 19 bp, Homo sapiens
tgaggggtgagggctgggg

SEQ ID NO: 39109 - DNA, 23 bp, Homo sapiens
tgaggaagggagggagggaggga

SEQ ID NO: 39110 - DNA, 15 bp, Homo sapiens
ggggagggagaacga

SEQ ID NO: 39111 - DNA, 15 bp, Homo sapiens
gaggaggagaagggg

SEQ ID NO: 39112 - DNA, 20 bp, Homo sapiens
tggggaagagagggaaggga

SEQ ID NO: 39113 - DNA, 18 bp, Homo sapiens
ggggaggaggaggcgggg

SEQ ID NO: 39114 - DNA, 22 bp, Homo sapiens
tgaggaaggagaaggagaggga

SEQ ID NO: 39115 - DNA, 18 bp, Homo sapiens
ggggggaaggaggtggga

SEQ ID NO: 39116 - DNA, 21 bp, Homo sapiens
ggaggaggaggaggacgtgga

SEQ ID NO: 39117 - DNA, 24 bp, Homo sapiens
tgaagaggagagggggtgctgggg

SEQ ID NO: 39118 - DNA, 22 bp, Homo sapiens
tgaagaggagagggagtgcaga

SEQ ID NO: 39119 - DNA, 18 bp, Homo sapiens
ggaggggaaggagactga

SEQ ID NO: 39120 - DNA, 20 bp, Homo sapiens
gaggaggagagggaagagga

SEQ ID NO: 39121 - DNA, 18 bp, Homo sapiens
agagggggtggaatgggg

SEQ ID NO: 39122 - DNA, 22 bp, Homo sapiens
tgaggaaggaggagggaaggga

SEQ ID NO: 39123 - DNA, 20 bp, Homo sapiens
tgagaaggggagggagttgg

SEQ ID NO: 39124 - DNA, 19 bp, Homo sapiens
gaaggagaggaaatgggga

SEQ ID NO: 39125 - DNA, 24 bp, Homo sapiens
tgaggaggggaggggcgtcctggg

SEQ ID NO: 39126 - DNA, 20 bp, Homo sapiens
tgggaggggagggaatgggg

SEQ ID NO: 39127 - DNA, 22 bp, Homo sapiens
tgaggaggaggaggcggttgga

SEQ ID NO: 39128 - DNA, 17 bp, Homo sapiens
tggggaagagagggggg

SEQ ID NO: 39129 - DNA, 20 bp, Homo sapiens
tgagagaggggagggcgggg

SEQ ID NO: 39130 - DNA, 20 bp, Homo sapiens
gaggaggaggaggagcgggg

SEQ ID NO: 39131 - DNA, 24 bp, Homo sapiens
tgaggaagggccaaggggatgggg

SEQ ID NO: 39132 - DNA, 15 bp, Homo sapiens
ggggaggagatgggg

SEQ ID NO: 39133 - DNA, 23 bp, Homo sapiens
aggaggagggggagcgcccgggg

SEQ ID NO: 39134 - DNA, 18 bp, Homo sapiens
ggggagtaggggatgggg

SEQ ID NO: 39135 - DNA, 21 bp, Homo sapiens
aggaggagagggaattaggga

SEQ ID NO: 39136 - DNA, 15 bp, Homo sapiens
tgggaggagaggggg

SEQ ID NO: 39137 - DNA, 18 bp, Homo sapiens
ggggagtggagggtgggg

SEQ ID NO: 39138 - DNA, 20 bp, Homo sapiens
tgaggagggaaggagatggg

SEQ ID NO: 39139 - DNA, 17 bp, Homo sapiens
gaggagggtgagtgggg

SEQ ID NO: 39140 - DNA, 22 bp, Homo sapiens
tggggaagagagggagatgggg

SEQ ID NO: 39141 - DNA, 17 bp, Homo sapiens
gaggagggataatgggg

SEQ ID NO: 39142 - DNA, 16 bp, Homo sapiens
tgaggaggggcatggg

SEQ ID NO: 39143 - DNA, 20 bp, Homo sapiens
tgaggagggcagggacagga

SEQ ID NO: 39144 - DNA, 15 bp, Homo sapiens
gaggagaggaggggg

SEQ ID NO: 39145 - DNA, 23 bp, Homo sapiens
gaggagagaaagagagagtgggg

SEQ ID NO: 39146 - DNA, 18 bp, Homo sapiens
aggaggagaggcctgggg

SEQ ID NO: 39147 - DNA, 20 bp, Homo sapiens
tgaggagaggaagggaagga

SEQ ID NO: 39148 - DNA, 17 bp, Homo sapiens
gaggagagggactgggg

SEQ ID NO: 39149 - DNA, 25 bp, Homo sapiens
tggggagggtggggagagccctgga

SEQ ID NO: 39150 - DNA, 26 bp, Homo sapiens
agaggagaacctggggagggtgggga

SEQ ID NO: 39151 - DNA, 22 bp, Homo sapiens
tgaggagaggaaggcattggga

SEQ ID NO: 39152 - DNA, 20 bp, Homo sapiens
gaggaggaggaggagaagga

SEQ ID NO: 39153 - DNA, 23 bp, Homo sapiens
tgaggaggaggggggacaatggg

SEQ ID NO: 39154 - DNA, 19 bp, Homo sapiens
gaggaggagagggaggctg

SEQ ID NO: 39155 - DNA, 18 bp, Homo sapiens
ggaggagggagcctggga

SEQ ID NO: 39156 - DNA, 20 bp, Homo sapiens
tggggtggagaaaaatgggg

SEQ ID NO: 39157 - DNA, 19 bp, Homo sapiens
ggaggaggaggaactgggg

SEQ ID NO: 39158 - DNA, 18 bp, Homo sapiens
tgggagggggaaggagaa

SEQ ID NO: 39159 - DNA, 21 bp, Homo sapiens
gaggggaaggaggtagtggga

SEQ ID NO: 39160 - DNA, 16 bp, Homo sapiens
tgaggggggaagggga

SEQ ID NO: 39161 - DNA, 20 bp, Homo sapiens
tgaggaggagagggagctga

SEQ ID NO: 39162 - DNA, 20 bp, Homo sapiens
tgagaaggagaaggagtaga

SEQ ID NO: 39163 - DNA, 21 bp, Homo sapiens
gagggggtgatgggaatgggg

SEQ ID NO: 39164 - DNA, 25 bp, Homo sapiens
tgacgggggagaaggggctgaggga

SEQ ID NO: 39165 - DNA, 21 bp, Homo sapiens
tgagaggagagggaacgtgga

SEQ ID NO: 39166 - DNA, 16 bp, Homo sapiens
tgaggagggggtgggg

SEQ ID NO: 39167 - DNA, 18 bp, Homo sapiens
gaggaggagggatctgga

SEQ ID NO: 39168 - DNA, 22 bp, Homo sapiens
tgaggaaaccggggggatgggg

SEQ ID NO: 39169 - DNA, 22 bp, Homo sapiens
tgaggaggaacagaggtgggga

SEQ ID NO: 39170 - DNA, 21 bp, Homo sapiens
tgaggaggggcaggtttgggg

SEQ ID NO: 39171 - DNA, 18 bp, Homo sapiens
tgaggggccagggtgggg

SEQ ID NO: 39172 - DNA, 21 bp, Homo sapiens
gaggagaagaaggcagtgggg

SEQ ID NO: 39173 - DNA, 17 bp, Homo sapiens
ggggaggggaggtagag

SEQ ID NO: 39174 - DNA, 20 bp, Homo sapiens
gaggaggaggagggagagga

SEQ ID NO: 39175 - DNA, 22 bp, Homo sapiens
gaggaggaggggggcagcgggg

SEQ ID NO: 39176 - DNA, 22 bp, Homo sapiens
aggggagggggtgcagtgggga

SEQ ID NO: 39177 - DNA, 21 bp, Homo sapiens
tggggtggaggagggacaggg

SEQ ID NO: 39178 - DNA, 18 bp, Homo sapiens
ggagaagggagagtgggg

SEQ ID NO: 39179 - DNA, 20 bp, Homo sapiens
tggggagagaaggtgagggg

SEQ ID NO: 39180 - DNA, 21 bp, Homo sapiens
gaggaggaggaggaggcaagg

SEQ ID NO: 39181 - DNA, 23 bp, Homo sapiens
cggggaggagaaggaacagggga

SEQ ID NO: 39182 - DNA, 18 bp, Homo sapiens
tgaggaggggagtgagaa

SEQ ID NO: 39183 - DNA, 18 bp, Homo sapiens
cggggggagaagggtggg

SEQ ID NO: 39184 - DNA, 18 bp, Homo sapiens
ggaggggagggaacagga

SEQ ID NO: 39185 - DNA, 96 bp, Human herpesvirus 4
ccgagacgaaggcccgtctgtagaggaagtggttgcgcatgcgggccagctcccagtagaccacgtccccccagacgcgcaggcacagggtctcgg

SEQ ID NO: 39186 - DNA, 24 bp, Human herpesvirus 4
aggaagtggttgcgcatgcgggcc

SEQ ID NO: 39187 - DNA, 16 bp, Homo sapiens
aggaagtgttgcgtgg

SEQ ID NO: 39188 - DNA, 21 bp, Homo sapiens
agaagtggagggatgtgggcc

SEQ ID NO: 39189 - DNA, 21 bp, Homo sapiens
aggaagtggtttgcgtgcacc

SEQ ID NO: 39190 - DNA, 18 bp, Homo sapiens
ggagggtgggatgcgggc

SEQ ID NO: 39191 - DNA, 22 bp, Homo sapiens
aggaagtggtgttggcagggcc

SEQ ID NO: 39192 - DNA, 16 bp, Homo sapiens
ggaagtggttttgggg

SEQ ID NO: 39193 - DNA, 19 bp, Homo sapiens
aggaagtggttgttgccag

SEQ ID NO: 39194 - DNA, 18 bp, Homo sapiens
aggaagtggtggtcgggc

SEQ ID NO: 39195 - DNA, 19 bp, Homo sapiens
agcaggcacgcatgcgggc

SEQ ID NO: 39196 - DNA, 18 bp, Homo sapiens
aggaagtgggatgtgggc

SEQ ID NO: 39197 - DNA, 17 bp, Homo sapiens
aggaagtggtggcgtgc

SEQ ID NO: 39198 - DNA, 26 bp, Homo sapiens
ggaagtggttgtcgtggagtggggcc

SEQ ID NO: 39199 - DNA, 22 bp, Homo sapiens
aggaggtggttacctgcgggcc

SEQ ID NO: 39200 - DNA, 22 bp, Homo sapiens
aggaggtggttacccgcgggcc

SEQ ID NO: 39201 - DNA, 17 bp, Homo sapiens
ggaagcctgcgtgcggg

SEQ ID NO: 39202 - DNA, 22 bp, Homo sapiens
agtgagtctagggcatgcgggc

SEQ ID NO: 39203 - DNA, 17 bp, Homo sapiens
aggaggtggctgcgtac

SEQ ID NO: 39204 - DNA, 25 bp, Homo sapiens
ggaagtggttgctgttggcccgcag

SEQ ID NO: 39205 - DNA, 19 bp, Homo sapiens
ggaagtggctgtgcattgc

SEQ ID NO: 39206 - DNA, 22 bp, Homo sapiens
agaaagatgagcgcgtgcgggc

SEQ ID NO: 39207 - DNA, 17 bp, Homo sapiens
aggaggtggctgctggg

SEQ ID NO: 39208 - DNA, 21 bp, Homo sapiens
aggatggtggttgccaggggc

SEQ ID NO: 39209 - DNA, 19 bp, Homo sapiens
aggcaggtggtgtgcgggc

SEQ ID NO: 39210 - DNA, 18 bp, Homo sapiens
aggaagtggtttaggggc

SEQ ID NO: 39211 - DNA, 71 bp, Human herpesvirus 4
tcccggcacacatcctggatgccctccacgacgctctttagcgtctggaggtccgtggagtagtggcgggg

SEQ ID NO: 39212 - DNA, 20 bp, Human herpesvirus 4
tccgtggagtagtggcgggg

SEQ ID NO: 39213 - DNA, 16 bp, Homo sapiens
tctgcgggtggcgggg

SEQ ID NO: 39214 - DNA, 17 bp, Homo sapiens
tccgggaggcggcgggg

SEQ ID NO: 39215 - DNA, 18 bp, Homo sapiens
tccggtggggcggcgggg

SEQ ID NO: 39216 - DNA, 18 bp, Homo sapiens
tccgtggagggcagcagg

SEQ ID NO: 39217 - DNA, 18 bp, Homo sapiens
tccgcggagccggcgggg

SEQ ID NO: 39218 - DNA, 18 bp, Homo sapiens
tcctggagtaggcgctgg

SEQ ID NO: 39219 - DNA, 17 bp, Homo sapiens
tcctggagtaatctggg

SEQ ID NO: 39220 - DNA, 17 bp, Homo sapiens
tcccgaaggtggcgggg

SEQ ID NO: 39221 - DNA, 19 bp, Homo sapiens
cccagcagtggtggcgggg

SEQ ID NO: 39222 - DNA, 18 bp, Homo sapiens
tccatggaggaggtgggg

SEQ ID NO: 39223 - DNA, 16 bp, Homo sapiens
ccgtgggtcggcgggg

SEQ ID NO: 39224 - DNA, 16 bp, Homo sapiens
tccatggagtgtgggg

SEQ ID NO: 39225 - DNA, 17 bp, Homo sapiens
tcctggcagcggcgggg

SEQ ID NO: 39226 - DNA, 17 bp, Homo sapiens
tcctggaggagctgggg

SEQ ID NO: 39227 - DNA, 22 bp, Homo sapiens
tccgcggagtgggcctccgggg

SEQ ID NO: 39228 - DNA, 19 bp, Homo sapiens
tccggggaaagtggcgggg

SEQ ID NO: 39229 - DNA, 20 bp, Homo sapiens
tccgtggagcgggacgcagg

SEQ ID NO: 39230 - DNA, 20 bp, Homo sapiens
cctgtggggtctcggcgggg

SEQ ID NO: 39231 - DNA, 17 bp, Homo sapiens
tccgtgtggtgacaggg

SEQ ID NO: 39232 - DNA, 15 bp, Homo sapiens
cccgtggaggtgggg

SEQ ID NO: 39233 - DNA, 18 bp, Homo sapiens
tccgtggaggaggagagg

SEQ ID NO: 39234 - DNA, 17 bp, Homo sapiens
tccctggaatggcgggg

SEQ ID NO: 39235 - DNA, 18 bp, Homo sapiens
cgtggagcacgggtgggg

SEQ ID NO: 39236 - DNA, 17 bp, Homo sapiens
tccgggccgcggcgggg

SEQ ID NO: 39237 - DNA, 20 bp, Homo sapiens
tcctccccgcagtggcgggg

SEQ ID NO: 39238 - DNA, 20 bp, Homo sapiens
gtggagcagagcctgtgggg

SEQ ID NO: 39239 - DNA, 19 bp, Homo sapiens
cctgtggagttgggtgggg

SEQ ID NO: 39240 - DNA, 17 bp, Homo sapiens
tccggggcctggcgggg

SEQ ID NO: 39241 - DNA, 17 bp, Homo sapiens
ccgtggggatgacgggg

SEQ ID NO: 39242 - DNA, 19 bp, Homo sapiens
tccgtgcagcagggtgggg

SEQ ID NO: 39243 - DNA, 18 bp, Homo sapiens
tcagtggagtagcagggg

SEQ ID NO: 39244 - DNA, 19 bp, Homo sapiens
gtgtgagcgtgtggcgggg

SEQ ID NO: 39245 - DNA, 19 bp, Homo sapiens
cctggatgtggtggcgggg

SEQ ID NO: 39246 - DNA, 20 bp, Homo sapiens
cccgtggagcttcatcgggg

SEQ ID NO: 39247 - DNA, 17 bp, Homo sapiens
tccggagcttggcgggg

SEQ ID NO: 39248 - DNA, 20 bp, Homo sapiens
ccatggaggtagtggtgggg

SEQ ID NO: 39249 - DNA, 19 bp, Homo sapiens
tcctggacgcacagcgggg

SEQ ID NO: 39250 - DNA, 17 bp, Homo sapiens
tctgtggagtgacaggg

SEQ ID NO: 39251 - DNA, 15 bp, Homo sapiens
cccgtggagtaaggg

SEQ ID NO: 39252 - DNA, 17 bp, Homo sapiens
tccgcggaggcctgggg

SEQ ID NO: 39253 - DNA, 19 bp, Homo sapiens
tccatggagtgggtgaggg

SEQ ID NO: 39254 - DNA, 15 bp, Homo sapiens
tccgtggaggtgggg

SEQ ID NO: 39255 - DNA, 17 bp, Homo sapiens
tcctggcgagggcgggg

SEQ ID NO: 39256 - DNA, 17 bp, Homo sapiens
tccgtggagttgagggg

SEQ ID NO: 39257 - DNA, 20 bp, Homo sapiens
cctgtgggtgcagtgtgggg

SEQ ID NO: 39258 - DNA, 18 bp, Homo sapiens
tcctcaacagtggcgggg

SEQ ID NO: 39259 - DNA, 18 bp, Homo sapiens
cgtggagtagaggtgggg

SEQ ID NO: 39260 - DNA, 19 bp, Homo sapiens
cccgtggagggtggcgggg

SEQ ID NO: 39261 - DNA, 21 bp, Homo sapiens
tccctggagtggccgcgtggg

SEQ ID NO: 39262 - DNA, 16 bp, Homo sapiens
cccgtggagtttgggg

SEQ ID NO: 39263 - DNA, 22 bp, Homo sapiens
tccgagcagcagggtggtgggg

SEQ ID NO: 39264 - DNA, 18 bp, Homo sapiens
tccctgcaaatggcgggg

SEQ ID NO: 39265 - DNA, 19 bp, Homo sapiens
ccgtggagaagttgtgggg

SEQ ID NO: 39266 - DNA, 16 bp, Homo sapiens
tccgcggggtggcagg

SEQ ID NO: 39267 - DNA, 19 bp, Homo sapiens
tccatggagcaccctgggg

SEQ ID NO: 39268 - DNA, 19 bp, Homo sapiens
tccgaggcgcttggcgggg

SEQ ID NO: 39269 - DNA, 17 bp, Homo sapiens
tcctgggctcagcgggg

SEQ ID NO: 39270 - DNA, 21 bp, Homo sapiens
tccgtggagtagaagaagggg

SEQ ID NO: 39271 - DNA, 17 bp, Homo sapiens
tccgtggaatgaagggg

SEQ ID NO: 39272 - DNA, 17 bp, Homo sapiens
cccagctggtggcgggg

SEQ ID NO: 39273 - DNA, 19 bp, Homo sapiens
tctgtgggagtcagcgggg

SEQ ID NO: 39274 - DNA, 18 bp, Homo sapiens
cccgtggagtggtagggg

SEQ ID NO: 39275 - DNA, 17 bp, Homo sapiens
tcctggacgctgcgggg

SEQ ID NO: 39276 - DNA, 15 bp, Homo sapiens
cccgtggagctgggg

SEQ ID NO: 39277 - DNA, 18 bp, Homo sapiens
cccgtggagggcgcgggg

SEQ ID NO: 39278 - DNA, 19 bp, Homo sapiens
tccgtggagcggctgccgg

SEQ ID NO: 39279 - DNA, 17 bp, Homo sapiens
tccgtggagaagtgggg

SEQ ID NO: 39280 - DNA, 17 bp, Homo sapiens
tccctggactggcgggg

SEQ ID NO: 39281 - DNA, 18 bp, Homo sapiens
gtggggtacctggcgggg

SEQ ID NO: 39282 - DNA, 18 bp, Homo sapiens
tcctgggcggcggcgggg

SEQ ID NO: 39283 - DNA, 17 bp, Homo sapiens
ccgtggaaagagcgggg

SEQ ID NO: 39284 - DNA, 15 bp, Homo sapiens
tcctggagtgacggg

SEQ ID NO: 39285 - DNA, 19 bp, Homo sapiens
cgtggagtagctagtgggg

SEQ ID NO: 39286 - DNA, 17 bp, Homo sapiens
tcctgggagcagtgggg

SEQ ID NO: 39287 - DNA, 18 bp, Homo sapiens
tcctggggtgcagcgggg

SEQ ID NO: 39288 - DNA, 19 bp, Homo sapiens
tcttcagatggtggcgggg

SEQ ID NO: 39289 - DNA, 19 bp, Homo sapiens
tccgtagagtgcctcgggg

SEQ ID NO: 39290 - DNA, 20 bp, Homo sapiens
cgcggacggtggtggcgggg

SEQ ID NO: 39291 - DNA, 19 bp, Homo sapiens
tccttggagtaggatgggg

SEQ ID NO: 39292 - DNA, 17 bp, Homo sapiens
tccgagtcctggcgggg

SEQ ID NO: 39293 - DNA, 18 bp, Homo sapiens
tccgtggaggtaggtggg

SEQ ID NO: 39294 - DNA, 18 bp, Homo sapiens
tccgtgtctgtggcgggg

SEQ ID NO: 39295 - DNA, 19 bp, Homo sapiens
tccatggagacagttgggg

SEQ ID NO: 39296 - DNA, 15 bp, Homo sapiens
cctggaggtggcggg

SEQ ID NO: 39297 - DNA, 19 bp, Homo sapiens
tccatgtccactggcgggg

SEQ ID NO: 39298 - DNA, 17 bp, Homo sapiens
tcctgtgggtggtgggg

SEQ ID NO: 39299 - DNA, 18 bp, Homo sapiens
tccgtggactaggcgggg

SEQ ID NO: 39300 - DNA, 15 bp, Homo sapiens
tccgtggagaggagg

SEQ ID NO: 39301 - DNA, 21 bp, Homo sapiens
tccatggaaatgaaggcgggg

SEQ ID NO: 39302 - DNA, 60 bp, Human herpesvirus 4
gcagatgctcttgcctagatacaggatgtcgtccatgctgaggggaggtggggtgtctgc

SEQ ID NO: 39303 - DNA, 24 bp, Human herpesvirus 4
tgcctagatacaggatgtcgtcca

SEQ ID NO: 39304 - DNA, 23 bp, Homo sapiens
tgcctgtgcccacgtgtcgtcca

SEQ ID NO: 39305 - DNA, 19 bp, Homo sapiens
tgcttaaatacaggtcctc

SEQ ID NO: 39306 - DNA, 21 bp, Homo sapiens
tgcttagatgcaggtccctcc

SEQ ID NO: 39307 - DNA, 21 bp, Homo sapiens
tgcttaatacagggaagtcca

SEQ ID NO: 39308 - DNA, 21 bp, Homo sapiens
tgctgggatacagggtgatcg

SEQ ID NO: 39309 - DNA, 22 bp, Homo sapiens
tgcctggatgcaagaggtgcca

SEQ ID NO: 39310 - DNA, 17 bp, Homo sapiens
tgcctggagcaggatgt

SEQ ID NO: 39311 - DNA, 17 bp, Homo sapiens
tgcctagatacagtcat

SEQ ID NO: 39312 - DNA, 20 bp, Homo sapiens
tgcctaggctgtgtcgtcca

SEQ ID NO: 39313 - DNA, 17 bp, Homo sapiens
tgccagatacagggtcc

SEQ ID NO: 39314 - DNA, 17 bp, Homo sapiens
tgccaagatgcaggagc

SEQ ID NO: 39315 - DNA, 60 bp, Human papillomavirus type 3
aaatcttctaattccaagatggatattcctaaggtgtccgcctttcaatatagagtgttt

SEQ ID NO: 39316 - DNA, 24 bp, Human papillomavirus type 3
tccgcctttcaatatagagtgttt

SEQ ID NO: 39317 - DNA, 19 bp, Homo sapiens
gcttttcaataatgtattt

SEQ ID NO: 39318 - DNA, 20 bp, Homo sapiens
gcttttcaaaatgaatgctt

SEQ ID NO: 39319 - DNA, 20 bp, Homo sapiens
cctttcaactgccggtgttt

SEQ ID NO: 39320 - DNA, 23 bp, Homo sapiens
tccaccttttaatattcgtgttt

SEQ ID NO: 39321 - DNA, 15 bp, Homo sapiens
tcccctttcaagtgt

SEQ ID NO: 39322 - DNA, 22 bp, Homo sapiens
ccttttcattttcagagtgttt

SEQ ID NO: 39323 - DNA, 130 bp, Human papillomavirus type 3
gtaaacgctcggcgacaaccacatctagaacagctgctgcaaaaaggaagcgcaccaaaaaatagccacatttgtgttttgtatgtgtaacctgtgtgtatgttttttatgtatgtactgtgtgtgtaat

SEQ ID NO: 39324 - DNA, 24 bp, Human papillomavirus type 3
tgttttgtatgtgtaacctgtgtg

SEQ ID NO: 39325 - DNA, 22 bp, Homo sapiens
tgtgtttgtgtgtgtatgtgtg

SEQ ID NO: 39326 - DNA, 16 bp, Homo sapiens
tgtttgtgtgtgtgtg

SEQ ID NO: 39327 - DNA, 20 bp, Homo sapiens
tgtgtttgtatgtgtaagtg

SEQ ID NO: 39328 - DNA, 18 bp, Homo sapiens
tgttttgtgtgtgtgtgt

SEQ ID NO: 39329 - DNA, 18 bp, Homo sapiens
tgtgttgtatgtgtgtgt

SEQ ID NO: 39330 - DNA, 24 bp, Homo sapiens
tcttggcactgtgtgacctgtgtg

SEQ ID NO: 39331 - DNA, 21 bp, Homo sapiens
tgttttgtgtgtgtatgtgtg

SEQ ID NO: 39332 - DNA, 18 bp, Homo sapiens
tattttgtgtgtgtgtgt

SEQ ID NO: 39333 - DNA, 18 bp, Homo sapiens
tgtattgtgtgtgtgtgt

SEQ ID NO: 39334 - DNA, 24 bp, Homo sapiens
tgttttttccatttaacctgtgtg

SEQ ID NO: 39335 - DNA, 18 bp, Homo sapiens
tgttctgtgtgtgtgtgt

SEQ ID NO: 39336 - DNA, 19 bp, Homo sapiens
tgtgtttgtgtgtgtgtgt

SEQ ID NO: 39337 - DNA, 16 bp, Homo sapiens
ttttgtgtgtgtgtgt

SEQ ID NO: 39338 - DNA, 18 bp, Homo sapiens
tgttgtgtgtgtgtgtgt

SEQ ID NO: 39339 - DNA, 19 bp, Homo sapiens
ttctgctgtggcctgtgtg

SEQ ID NO: 39340 - DNA, 19 bp, Homo sapiens
tgttttgtgtgtgtgtctg

SEQ ID NO: 39341 - DNA, 19 bp, Homo sapiens
tgtttgtattgttctgtgt

SEQ ID NO: 39342 - DNA, 23 bp, Homo sapiens
tgttttatatgtgtggaacaatg

SEQ ID NO: 39343 - DNA, 104 bp, Rabbit oral papillomavirus
tgggcgaaggcctgcagctggtgattagttccactagacgggcaccacggatcctaccgatgcccaagttatttgccactgatgtccatccaggctttttccca

SEQ ID NO: 39344 - DNA, 24 bp, Rabbit oral papillomavirus
agctggtgattagttccactagac

SEQ ID NO: 39345 - DNA, 16 bp, Homo sapiens
gcttggtggttccact

SEQ ID NO: 39346 - DNA, 20 bp, Homo sapiens
agtaggtgattagtcgtaga

SEQ ID NO: 39347 - DNA, 22 bp, Homo sapiens
atgatcgttggttccactagac

SEQ ID NO: 39348 - DNA, 22 bp, Homo sapiens
agctggtggctagttcccagga

SEQ ID NO: 39349 - DNA, 21 bp, Homo sapiens
gctggtgatgggggcttagac

SEQ ID NO: 39350 - DNA, 24 bp, Homo sapiens
aggtggtgattggctaaggctgga

SEQ ID NO: 39351 - DNA, 19 bp, Homo sapiens
agctggtgatggtggcaga

SEQ ID NO: 39352 - DNA, 22 bp, Homo sapiens
agcggtgattctccctgctaga

SEQ ID NO: 39353 - DNA, 23 bp, Homo sapiens
gctgatgatgcagcattgctaga

SEQ ID NO: 39354 - DNA, 22 bp, Homo sapiens
gatgaaaggagtttcactagac

SEQ ID NO: 39355 - DNA, 24 bp, Homo sapiens
agctggtgactgcagagtctagac

SEQ ID NO: 39356 - DNA, 24 bp, Homo sapiens
aactggtgggagtgtctgctggac

SEQ ID NO: 39357 - DNA, 18 bp, Homo sapiens
gcggtgacggctgctaga

SEQ ID NO: 39358 - DNA, 18 bp, Homo sapiens
aactggtgatatcaacta

SEQ ID NO: 39359 - DNA, 83 bp, Rat cytomegalovirus
gatctagattctattgttaaaaggaaaaatgtatcgataataaaccatttttacagagttcagcatcggtggaatcttaaatc

SEQ ID NO: 39360 - DNA, 24 bp, Rat cytomegalovirus
tctattgttaaaaggaaaaatgta

SEQ ID NO: 39361 - DNA, 21 bp, Homo sapiens
tgttaaaaagaaaaaaatgta

SEQ ID NO: 39362 - DNA, 22 bp, Homo sapiens
ctaactgaaagggaaaaatgta

SEQ ID NO: 39363 - DNA, 19 bp, Homo sapiens
tctattgctaaaattatgt

SEQ ID NO: 39364 - DNA, 19 bp, Homo sapiens
ctgttttccagaaaaatgt

SEQ ID NO: 39365 - DNA, 18 bp, Homo sapiens
ttgttccaggaaaaatgt

SEQ ID NO: 39366 - DNA, 20 bp, Homo sapiens
tctagtgttaaaagttatgt

SEQ ID NO: 39367 - DNA, 24 bp, Homo sapiens
tctggtgttaaaagaatttcatgt

SEQ ID NO: 39368 - DNA, 18 bp, Homo sapiens
tctgttggtaaaaggaaa

SEQ ID NO: 39369 - DNA, 18 bp, Homo sapiens
ttgctaaagggagaatgt

SEQ ID NO: 39370 - DNA, 24 bp, Homo sapiens
attgctagggaagggaaaaatgta

SEQ ID NO: 39371 - DNA, 86 bp, Human T-lymphotropic virus 1
gtccgccgtctaggtaagtttagagctcaggtcgagaccgggcctttgtccggcgctcccttggagcctacctagactcagccggc

SEQ ID NO: 39372 - DNA, 86 bp, Human T-lymphotropic virus 1; identical to SEQ ID NO: 39371

SEQ ID NO: 39373 - DNA, 21 bp, Homo sapiens
tctaggtaagcttcactgggt

SEQ ID NO: 39374 - DNA, 19 bp, Homo sapiens
ggttacttagagctcaggt

SEQ ID NO: 39375 - DNA, 24 bp, Homo sapiens
ctgggtagcttcgagagctcaggt

SEQ ID NO: 39376 - DNA, 17 bp, Homo sapiens
tagggtaagagctcagg

SEQ ID NO: 39377 - DNA, 21 bp, Homo sapiens
tctaggtaactttatggaggt

SEQ ID NO: 39378 - DNA, 63 bp, Rat cytomegalovirus
gggaaacgaaaacaaggaagatgtagcaatgtatgaaaagcaagggtcttgagatcgtacctc

SEQ ID NO: 39379 - DNA, 24 bp, Rat cytomegalovirus
acgaaaacaaggaagatgtagcaa

SEQ ID NO: 39380 - DNA, 22 bp, Homo sapiens
caagggcaaggaagaaccgtaa

SEQ ID NO: 39381 - DNA, 25 bp, Homo sapiens
cggaaacaaggcaacatgccggcaa

SEQ ID NO: 39382 - DNA, 22 bp, Homo sapiens
gaaaacaaggggtgaagagtag

SEQ ID NO: 39383 - DNA, 20 bp, Homo sapiens
gaaaagaatgggtgtagcaa

SEQ ID NO: 39384 - DNA, 17 bp, Homo sapiens
gaagtcaaggtatagca

SEQ ID NO: 39385 - DNA, 18 bp, Homo sapiens
agaatttagatgtagcaa

SEQ ID NO: 39386 - DNA, 18 bp, Homo sapiens
acggagaaggatgtagca

SEQ ID NO: 39387 - DNA, 18 bp, Homo sapiens
acgcggacaaggaagacg

SEQ ID NO: 39388 - DNA, 18 bp, Homo sapiens
aaaacaaggagtttgcaa

SEQ ID NO: 39389 - DNA, 18 bp, Homo sapiens
gaaaacgggggatctagc

SEQ ID NO: 39390 - DNA, 19 bp, Homo sapiens
gaaaataagagtgcagcaa

SEQ ID NO: 39391 - DNA, 21 bp, Homo sapiens
gaagacaggatggtgtagcaa

SEQ ID NO: 39392 - DNA, 23 bp, Homo sapiens
actgaaacaaggaagaaaggtag

SEQ ID NO: 39393 - DNA, 19 bp, Homo sapiens
aaaaacaagggcataggca

SEQ ID NO: 39394 - DNA, 19 bp, Homo sapiens
gaaaataagcaaaatgtaa

SEQ ID NO: 39395 - DNA, 18 bp, Homo sapiens
gaaaaaaagatgtagcaa

SEQ ID NO: 39396 - DNA, 19 bp, Homo sapiens
gagagcaagagatgcagca

SEQ ID NO: 39397 - DNA, 18 bp, Homo sapiens
gaacacaaggaagtatag

SEQ ID NO: 39398 - DNA, 19 bp, Homo sapiens
acgaagacaaagaagacat

SEQ ID NO: 39399 - DNA, 21 bp, Homo sapiens
gaaactgaggaagatgaggca

SEQ ID NO: 39400 - DNA, 18 bp, Homo sapiens
gaaaacgaggagcaggca

SEQ ID NO: 39401 - DNA, 22 bp, Homo sapiens
acgaagacatgggatgtgggca

SEQ ID NO: 39402 - DNA, 25 bp, Homo sapiens
acaaaaatacactctgatgtagcaa

SEQ ID NO: 39403 - DNA, 18 bp, Homo sapiens
acagaacaaggaatgcaa

SEQ ID NO: 39404 - DNA, 20 bp, Homo sapiens
acgaaagtgggaaaacggca

SEQ ID NO: 39405 - DNA, 24 bp, Homo sapiens
acaaaaacagggatttggtgtggc

SEQ ID NO: 39406 - DNA, 19 bp, Homo sapiens
gaaaatgaagacacagcaa

SEQ ID NO: 39407 - DNA, 15 bp, Homo sapiens
aacaagaaaatagca

SEQ ID NO: 39408 - DNA, 19 bp, Homo sapiens
caaaaacaagggtcagtaa

SEQ ID NO: 39409 - DNA, 18 bp, Homo sapiens
gaaaacaagggagctaca

SEQ ID NO: 39410 - DNA, 16 bp, Homo sapiens
caaagcaaggaagtgt

SEQ ID NO: 39411 - DNA, 16 bp, Homo sapiens
aaaataaggaagaagc

SEQ ID NO: 39412 - DNA, 17 bp, Homo sapiens
aaacaagggagagagca

SEQ ID NO: 39413 - DNA, 19 bp, Homo sapiens
gagaacaaggagtctgtaa

SEQ ID NO: 39414 - DNA, 18 bp, Homo sapiens
gaaaacagggggaagcag

SEQ ID NO: 39415 - DNA, 20 bp, Homo sapiens
gagacaagggaagatggcaa

SEQ ID NO: 39416 - DNA, 16 bp, Homo sapiens
gaaaaaaggaaaagca

SEQ ID NO: 39417 - DNA, 20 bp, Homo sapiens
gaaatgaggaaaatgagcaa

SEQ ID NO: 39418 - DNA, 18 bp, Homo sapiens
acagaaacaaggaagaca

SEQ ID NO: 39419 - DNA, 20 bp, Homo sapiens
acaagatatttgatgtagca

SEQ ID NO: 39420 - DNA, 18 bp, Homo sapiens
gaggccaaggaaatgcgc

SEQ ID NO: 39421 - DNA, 20 bp, Homo sapiens
gaaaacaaggagattggcaa

SEQ ID NO: 39422 - DNA, 18 bp, Homo sapiens
acaaaaacgaggaggcag

SEQ ID NO: 39423 - DNA, 19 bp, Homo sapiens
accaaaacaagtggtggca

SEQ ID NO: 39424 - DNA, 20 bp, Homo sapiens
gaaaacaagaaatacggtag

SEQ ID NO: 39425 - DNA, 22 bp, Homo sapiens
acgaaggcaggaagacagagca

SEQ ID NO: 39426 - DNA, 23 bp, Homo sapiens
acgaggacaggaattcacagcaa

SEQ ID NO: 39427 - DNA, 17 bp, Homo sapiens
gaaaacagagaatgtaa

SEQ ID NO: 39428 - DNA, 21 bp, Homo sapiens
acgaaaatgtggaaggtgtaa

SEQ ID NO: 39429 - DNA, 20 bp, Homo sapiens
gaaaacagggacaacagtaa

SEQ ID NO: 39430 - DNA, 18 bp, Homo sapiens
caggaacaaggaaggcgc

SEQ ID NO: 39431 - DNA, 19 bp, Homo sapiens
caaaggcaaggaagaaagt

SEQ ID NO: 39432 - DNA, 19 bp, Homo sapiens
caggaacaaggaaacagca

SEQ ID NO: 39433 - DNA, 18 bp, Homo sapiens
gaaatgaaaagatgtggc

SEQ ID NO: 39434 - DNA, 20 bp, Homo sapiens
gaaagcaggggaaaacgcaa

SEQ ID NO: 39435 - DNA, 18 bp, Homo sapiens
gaaagcaaggaaaagcag

SEQ ID NO: 39436 - DNA, 21 bp, Homo sapiens
gaaaacaagtgagcattgtaa

SEQ ID NO: 39437 - DNA, 22 bp, Homo sapiens
gaaaacatagttggtgtagcaa

SEQ ID NO: 39438 - DNA, 22 bp, Homo sapiens
acggaggcaagaaagcgtgcaa

SEQ ID NO: 39439 - DNA, 19 bp, Homo sapiens
gaagacaaggaacctgtag

SEQ ID NO: 39440 - DNA, 17 bp, Homo sapiens
aaaacagggacgcagca

SEQ ID NO: 39441 - DNA, 22 bp, Homo sapiens
acgaaaaccagtcaggtgtggc

SEQ ID NO: 39442 - DNA, 19 bp, Homo sapiens
cgaaacaaggggggcgtgc

SEQ ID NO: 39443 - DNA, 22 bp, Homo sapiens
gagaacaaggagatgtgggcaa

SEQ ID NO: 39444 - DNA, 18 bp, Homo sapiens
gaaggcaaggaagtgcag

SEQ ID NO: 39445 - DNA, 18 bp, Homo sapiens
gaagacagggatgtggca

SEQ ID NO: 39446 - DNA, 19 bp, Homo sapiens
aaagacaggggtgtagcaa

SEQ ID NO: 39447 - DNA, 21 bp, Homo sapiens
gagaacaaggaggagacgtag

SEQ ID NO: 39448 - DNA, 24 bp, Homo sapiens
gaaaatgtggaaaaatagtgtagc

SEQ ID NO: 39449 - DNA, 18 bp, Homo sapiens
gaaaacaagtatgtggca

SEQ ID NO: 39450 - DNA, 19 bp, Homo sapiens
gaaaacagggaggacttag

SEQ ID NO: 39451 - DNA, 16 bp, Homo sapiens
gaagaggaaaatgtaa

SEQ ID NO: 39452 - DNA, 18 bp, Homo sapiens
cgggaacaaggaaaacgt

SEQ ID NO: 39453 - DNA, 23 bp, Homo sapiens
gagaactgggaagatgtgtggca

SEQ ID NO: 39454 - DNA, 20 bp, Homo sapiens
gaaggcaaggaagggccaca

SEQ ID NO: 39455 - DNA, 18 bp, Homo sapiens
aaaacaaggaagaaaaca

SEQ ID NO: 39456 - DNA, 19 bp, Homo sapiens
gaagacgaggatgatgcag

SEQ ID NO: 39457 - DNA, 22 bp, Homo sapiens
acaggaacaagaatagatgtag

SEQ ID NO: 39458 - DNA, 18 bp, Homo sapiens
aaagacaaggaaacttgt

SEQ ID NO: 39459 - DNA, 19 bp, Homo sapiens
gaagcaacgtaatgtagca

SEQ ID NO: 39460 - DNA, 17 bp, Homo sapiens
gaaaatgaggaaaagca

SEQ ID NO: 39461 - DNA, 21 bp, Homo sapiens
aaacaagggaccgagaggtag

SEQ ID NO: 39462 - DNA, 24 bp, Homo sapiens
acgagggaaggaagaaagagggca

SEQ ID NO: 39463 - DNA, 67 bp, Rat cytomegalovirus
gaaaaaagatgactgggaagctatccgtattgtgtttgatacatagattcttctcggtccttgtttt

SEQ ID NO: 39464 - DNA, 24 bp, Rat cytomegalovirus
aagatgactgggaagctatccgta

SEQ ID NO: 39465 - DNA, 22 bp, Homo sapiens
aagaggctgggaaagaacttgt

SEQ ID NO: 39466 - DNA, 18 bp, Homo sapiens
agaggctgggaagcatcc

SEQ ID NO: 39467 - DNA, 22 bp, Homo sapiens
gatgactgagatgagcttctgt

SEQ ID NO: 39468 - DNA, 21 bp, Homo sapiens
aggtaactgggttgagtccgt

SEQ ID NO: 39469 - DNA, 22 bp, Homo sapiens
aagatggtagggaacaaaacgt

SEQ ID NO: 39470 - DNA, 17 bp, Homo sapiens
tgctgggaagctatcca

SEQ ID NO: 39471 - DNA, 21 bp, Homo sapiens
gactggctgggcatatctgta

SEQ ID NO: 39472 - DNA, 22 bp, Homo sapiens
aagatgacctgatcctgtctgt

SEQ ID NO: 39473 - DNA, 18 bp, Homo sapiens
gagactgggaagtccata

SEQ ID NO: 39474 - DNA, 64 bp, Human T-lymphotropic virus 1
gtctccccccggaggacagctcagcaccagctcaggctaggccctgacgtgtccccctaaagac

SEQ ID NO: 39475 - DNA, 17 bp, Human T-lymphotropic virus 1
cgtgtccccctaaagac

SEQ ID NO: 39476 - DNA, 18 bp, Homo sapiens
catgtccctcccagggac

SEQ ID NO: 39477 - DNA, 19 bp, Homo sapiens
cggtcccctatccaaggac

SEQ ID NO: 39478 - DNA, 22 bp, Homo sapiens
cgtatcccccacaccttaaaga

SEQ ID NO: 39479 - DNA, 19 bp, Homo sapiens
catgtcccctcctccagac

SEQ ID NO: 39480 - DNA, 19 bp, Homo sapiens
catgtccccctttcaagac

SEQ ID NO: 39481 - DNA, 18 bp, Homo sapiens
cgtgtccctttagaaaac

SEQ ID NO: 39482 - DNA, 60 bp, Peanut chlorotic streak virus
gatgcaggattaccattaatcttaggaaacaacttcctaaagctatataatccgttcatc

SEQ ID NO: 39483 - DNA, 24 bp, Peanut chlorotic streak virus
ctaaagctatataatccgttcatc

SEQ ID NO: 39484 - DNA, 17 bp, Homo sapiens
taaagctatatggcgtc

SEQ ID NO: 39485 - DNA, 24 bp, Homo sapiens
ctgaagccatatgttgaaattcat

SEQ ID NO: 39486 - DNA, 20 bp, Homo sapiens
tagagctacataatcttgtc

SEQ ID NO: 39487 - DNA, 22 bp, Homo sapiens
taaaactataacaaagttcatc

SEQ ID NO: 39488 - DNA, 19 bp, Homo sapiens
ctgaagtatataatccgtt

SEQ ID NO: 39489 - DNA, 24 bp, Homo sapiens
ctaaacctatataatctagacatc

SEQ ID NO: 39490 - DNA, 20 bp, Homo sapiens
aaactatatttattgttcat

SEQ ID NO: 39491 - DNA, 19 bp, Homo sapiens
taaaagctatatggtccat

SEQ ID NO: 39492 - DNA, 20 bp, Homo sapiens
taaagctaaatcatgttcat

SEQ ID NO: 39493 - DNA, 28 bp, Homo sapiens
taaggctatataagtcagccaggttcat

SEQ ID NO: 39494 - DNA, 21 bp, Homo sapiens
ctaaagctatatcaagtgcat

SEQ ID NO: 39495 - DNA, 107 bp, Human herpesvirus 5
tcttgctcgacgtgccgcgtctggagaactattttctttgtcaagtctgtctttacgagctggacgaggacgagatgggcgaggagatgctgggcatgttggccgga

SEQ ID NO: 39496 - DNA, 24 bp, Human herpesvirus 5
cgagatgggcgaggagatgctggg

SEQ ID NO: 39497 - DNA, 20 bp, Homo sapiens
gaggtgggagaggagacccg

SEQ ID NO: 39498 - DNA, 16 bp, Homo sapiens
cgaggtgggcaagggg

SEQ ID NO: 39499 - DNA, 15 bp, Homo sapiens
gatgggcagtgctgg

SEQ ID NO: 39500 - DNA, 17 bp, Homo sapiens
gaggtgggagagggagg

SEQ ID NO: 39501 - DNA, 20 bp, Homo sapiens
gaggggcgaggagctgcggg

SEQ ID NO: 39502 - DNA, 22 bp, Homo sapiens
gaggtgggtgacgggctgcggg

SEQ ID NO: 39503 - DNA, 24 bp, Homo sapiens
gaggtcttgctgggagatgctggg

SEQ ID NO: 39504 - DNA, 22 bp, Homo sapiens
tgggcggggagggggtgctggg

SEQ ID NO: 39505 - DNA, 19 bp, Homo sapiens
cgaggtgggaggggaccgg

SEQ ID NO: 39506 - DNA, 15 bp, Homo sapiens
agatgggcagtgctg

SEQ ID NO: 39507 - DNA, 20 bp, Homo sapiens
gaagtggagaagatgctggg

SEQ ID NO: 39508 - DNA, 18 bp, Homo sapiens
cgaggaggcaggtgctgg

SEQ ID NO: 39509 - DNA, 19 bp, Homo sapiens
gggcagaagggatgctggg

SEQ ID NO: 39510 - DNA, 15 bp, Homo sapiens
gagatgggggtgctg

SEQ ID NO: 39511 - DNA, 22 bp, Homo sapiens
cgagatgggctggacctctggg

SEQ ID NO: 39512 - DNA, 18 bp, Homo sapiens
tgagcaagggggtgctgg

SEQ ID NO: 39513 - DNA, 21 bp, Homo sapiens
aggcaagtgggggatgctggg

SEQ ID NO: 39514 - DNA, 21 bp, Homo sapiens
gagatggatggggaatccagg

SEQ ID NO: 39515 - DNA, 20 bp, Homo sapiens
gaggtgggcaaggaacaggg

SEQ ID NO: 39516 - DNA, 16 bp, Homo sapiens
tgggtgaggagacagg

SEQ ID NO: 39517 - DNA, 21 bp, Homo sapiens
gagtggagctgggatgctggg

SEQ ID NO: 39518 - DNA, 19 bp, Homo sapiens
gaggggggtagatgctggg

SEQ ID NO: 39519 - DNA, 18 bp, Homo sapiens
cgaggtgggtaggagccg

SEQ ID NO: 39520 - DNA, 18 bp, Homo sapiens
cggatgggcgggggcagg

SEQ ID NO: 39521 - DNA, 20 bp, Homo sapiens
gagatgggtccaatgctggg

SEQ ID NO: 39522 - DNA, 22 bp, Homo sapiens
cgaggtggggaggggagagagg

SEQ ID NO: 39523 - DNA, 18 bp, Homo sapiens
cgagatggggagggctgg

SEQ ID NO: 39524 - DNA, 21 bp, Homo sapiens
gaggtggctgagctatctggg

SEQ ID NO: 39525 - DNA, 19 bp, Homo sapiens
gaggtgggcaagggggctg

SEQ ID NO: 39526 - DNA, 21 bp, Homo sapiens
gagatgggtggggggccacgg

SEQ ID NO: 39527 - DNA, 24 bp, Homo sapiens
cgagatgcctacggggatgctggg

SEQ ID NO: 39528 - DNA, 18 bp, Homo sapiens
aggtgggcgagagtttgg

SEQ ID NO: 39529 - DNA, 19 bp, Homo sapiens
cgggatgggcggggagacg

SEQ ID NO: 39530 - DNA, 22 bp, Homo sapiens
gagatgggtggggggcgatggg

SEQ ID NO: 39531 - DNA, 18 bp, Homo sapiens
gaaatgaggaggtgctgg

SEQ ID NO: 39532 - DNA, 23 bp, Homo sapiens
cgagatcgggcggggatgctggg

SEQ ID NO: 39533 - DNA, 20 bp, Homo sapiens
gatgtgtaagtgatgctggg

SEQ ID NO: 39534 - DNA, 21 bp, Homo sapiens
gagatgggatgaggaggactg

SEQ ID NO: 39535 - DNA, 18 bp, Homo sapiens
gagggggtggggacgcgg

SEQ ID NO: 39536 - DNA, 20 bp, Homo sapiens
aggtgggcgaggaacctggg

SEQ ID NO: 39537 - DNA, 19 bp, Homo sapiens
gagtgggtgaggagtgagg

SEQ ID NO: 39538 - DNA, 22 bp, Homo sapiens
gaggtgctcctgagatgctggg

SEQ ID NO: 39539 - DNA, 16 bp, Homo sapiens
tggggaggagatgggg

SEQ ID NO: 39540 - DNA, 18 bp, Homo sapiens
gatgggcaaggaggcggg

SEQ ID NO: 39541 - DNA, 21 bp, Homo sapiens
aggcacctgggggatgctggg

SEQ ID NO: 39542 - DNA, 25 bp, Homo sapiens
gagatgggtcgaagaaggtgctggg

SEQ ID NO: 39543 - DNA, 18 bp, Homo sapiens
gatgggcagggagcaggg

SEQ ID NO: 39544 - DNA, 15 bp, Homo sapiens
cgagatgggcagctg

SEQ ID NO: 39545 - DNA, 21 bp, Homo sapiens
gagggggactgagatgctggg

SEQ ID NO: 39546 - DNA, 22 bp, Homo sapiens
tgggggaggtggagatgctggg

SEQ ID NO: 39547 - DNA, 18 bp, Homo sapiens
gagatgggtgatggatgg

SEQ ID NO: 39548 - DNA, 22 bp, Homo sapiens
tgggccctcgggggatgctggg

SEQ ID NO: 39549 - DNA, 21 bp, Homo sapiens
cgaggctggctggatgctggg

SEQ ID NO: 39550 - DNA, 19 bp, Homo sapiens
tgggtgaggggatgctggg

SEQ ID NO: 39551 - DNA, 21 bp, Homo sapiens
ccaggtgtgggggatgctggg

SEQ ID NO: 39552 - DNA, 23 bp, Homo sapiens
gaaggtccccaggagatgttggg

SEQ ID NO: 39553 - DNA, 21 bp, Homo sapiens
gagatgggccagggacatggg

SEQ ID NO: 39554 - DNA, 18 bp, Homo sapiens
tgggtgggagatgctggg

SEQ ID NO: 39555 - DNA, 71 bp, Peanut chlorotic streak virus
tagccttgcatatattgatgatataattgtttttactaagggaacaaaagattatcatcttaagcaggttg

SEQ ID NO: 39556 - DNA, 24 bp, Peanut chlorotic streak virus
ttgatgatataattgtttttacta

SEQ ID NO: 39557 - DNA, 23 bp, Homo sapiens
ttgatgataaactgtctttgcta

SEQ ID NO: 39558 - DNA, 22 bp, Homo sapiens
ttgaatgataagaatttttact

SEQ ID NO: 39559 - DNA, 18 bp, Homo sapiens
ttgatgatataattagtt

SEQ ID NO: 39560 - DNA, 18 bp, Homo sapiens
tgatgatatgatattgtt

SEQ ID NO: 39561 - DNA, 19 bp, Homo sapiens
ttgataatataatattact

SEQ ID NO: 39562 - DNA, 21 bp, Homo sapiens
ttgatgacatgattgtaaacc

SEQ ID NO: 39563 - DNA, 65 bp, Human herpesvirus 5
gacgacgtggtttttgcttccgagctgtgtttttattgcagcggtcgttttaaccgcaggtcgtc

SEQ ID NO: 39564 - DNA, 24 bp, Human herpesvirus 5
cagcggtcgttttaaccgcaggtc

SEQ ID NO: 39565 - DNA, 22 bp, Homo sapiens
cagcgccgccttggctgtgggt

SEQ ID NO: 39566 - DNA, 19 bp, Homo sapiens
ggagggctgaccgcaggtc

SEQ ID NO: 39567 - DNA, 15 bp, Homo sapiens
agcggtgccgcaggt

SEQ ID NO: 39568 - DNA, 23 bp, Homo sapiens
ggtgttccaacacgctgcaggtc

SEQ ID NO: 39569 - DNA, 20 bp, Homo sapiens
ggttgttttaaccacaaggt

SEQ ID NO: 39570 - DNA, 74 bp, Human herpesvirus 5
ggcgctcgcacgaggagctggttctttgtccgcccgagatggaggagcgtctagcgccgctgttgcagagtgcc

SEQ ID NO: 39571 - DNA, 24 bp, Human herpesvirus 5
tctagcgccgctgttgcagagtgc

SEQ ID NO: 39572 - DNA, 19 bp, Homo sapiens
tctagttctgctgttgcaa

SEQ ID NO: 39573 - DNA, 16 bp, Homo sapiens
tctagtgttgcagttg

SEQ ID NO: 39574 - DNA, 21 bp, Homo sapiens
tctgcgcgctgctggcagtgt

SEQ ID NO: 39575 - DNA, 18 bp, Homo sapiens
ctggcgccgctggtggtg

SEQ ID NO: 39576 - DNA, 18 bp, Homo sapiens
tctgtcgccgctggagtg

SEQ ID NO: 39577 - DNA, 100 bp, Peanut chlorotic streak virus
gtgatttattgatattaactacagatgctagtgatactacatggggagcagtccttatggcagtacctaatgcatacgaagagtttttatcatttgtcac

SEQ ID NO: 39578 - DNA, 24 bp, Peanut chlorotic streak virus
tggcagtacctaatgcatacgaag

SEQ ID NO: 39579 - DNA, 21 bp, Homo sapiens
tggcagtaactgactttgaag

SEQ ID NO: 39580 - DNA, 20 bp, Homo sapiens
tgggggttccatgcatacga

SEQ ID NO: 39581 - DNA, 22 bp, Homo sapiens
tagcagtacctaggcggcgaag

SEQ ID NO: 39582 - DNA, 21 bp, Homo sapiens
tggcagtagctggcattgaag

SEQ ID NO: 39583 - DNA, 21 bp, Homo sapiens
tggcagcatctggaagcgaag

SEQ ID NO: 39584 - DNA, 19 bp, Homo sapiens
tggtagtacctagggcata

SEQ ID NO: 39585 - DNA, 23 bp, Homo sapiens
tggcaatatgattacatacgaag

SEQ ID NO: 39586 - DNA, 131 bp, Sesbania mosaic virus
gtggtggcattgatgactttgtgcgctactccgctttggttgagcgcctcatacgtgatttacctgctcaggtacatgttggtgaggttgtctcctgaggcaaagcaggacagagtctactataccgctac

SEQ ID NO: 39587 - DNA, 24 bp, Sesbania mosaic virus
tacatgttggtgaggttgtctcct

SEQ ID NO: 39588 - DNA, 18 bp, Homo sapiens
cagttggtgaggttttct

SEQ ID NO: 39589 - DNA, 18 bp, Homo sapiens
tacatgaaaggttgtttc

SEQ ID NO: 39590 - DNA, 20 bp, Homo sapiens
catgttggtgaggctggtct

SEQ ID NO: 39591 - DNA, 21 bp, Homo sapiens
atgtatttatagttgtcttct

SEQ ID NO: 39592 - DNA, 21 bp, Homo sapiens
atgttggtggaaggcatttct

SEQ ID NO: 39593 - DNA, 22 bp, Homo sapiens
tacctgttggcaaatgtcttct

SEQ ID NO: 39594 - DNA, 21 bp, Homo sapiens
catttggctcacatgtctcct

SEQ ID NO: 39595 - DNA, 17 bp, Homo sapiens
catgttggttagtttct

SEQ ID NO: 39596 - DNA, 27 bp, Homo sapiens
tacatcgtctccctgaggttgtcttct

SEQ ID NO: 39597 - DNA, 20 bp, Homo sapiens
taatgttggtgtggttttct

SEQ ID NO: 39598 - DNA, 19 bp, Homo sapiens
tgttgatgatagaattctc

SEQ ID NO: 39599 - DNA, 22 bp, Homo sapiens
tacatgttgtctctacttgtct

SEQ ID NO: 39600 - DNA, 18 bp, Homo sapiens
atgttttgataaggttgt

SEQ ID NO: 39601 - DNA, 16 bp, Homo sapiens
cgactggggttgtctc

SEQ ID NO: 39602 - DNA, 111 bp, Sesbania mosaic virus
gagtattgaagttcaaatcaacccttcatggataagtctgttgggtagctcccttaagttaaacgtaggtgatgcttccaatgagtctgctgtgttggggtccttctactc

SEQ ID NO: 39603 - DNA, 24 bp, Sesbania mosaic virus
tgttgggtagctcccttaagttaa

SEQ ID NO: 39604 - DNA, 18 bp, Homo sapiens
gttgggtagttcccttaa

SEQ ID NO: 39605 - DNA, 21 bp, Homo sapiens
tgctgggtggctttaaccctt

SEQ ID NO: 39606 - DNA, 19 bp, Homo sapiens
ctgaggctcccttgggtta

SEQ ID NO: 39607 - DNA, 79 bp, Sesbania mosaic virus
ggctatcaagagtggacctactactattggttttggttgtagaactaagatcgatggtgaggactgcttattgactgcc

SEQ ID NO: 39608 - DNA, 24 bp, Sesbania mosaic virus
taagatcgatggtgaggactgctt

SEQ ID NO: 39609 - DNA, 23 bp, Homo sapiens
taaggtccaaatttggactgctt

SEQ ID NO: 39610 - DNA, 26 bp, Homo sapiens
taagaacccaattgtgggggctgctt

SEQ ID NO: 39611 - DNA, 21 bp, Homo sapiens
gatgtacagtgagggttgctt

SEQ ID NO: 39612 - DNA, 70 bp, Equine herpesvirus 1
gagtcctcccgcgccggacttggcgccactcccgggaagggccgctgagctcgcaccgggctgggtactc

SEQ ID NO: 39613 - DNA, 20 bp, Equine herpesvirus 1
tcgcaccgggctgggtactc

SEQ ID NO: 39614 - DNA, 15 bp, Homo sapiens
cgcaccggggcactc

SEQ ID NO: 39615 - DNA, 18 bp, Homo sapiens
gcactgggctagaaaact

SEQ ID NO: 39616 - DNA, 20 bp, Homo sapiens
tcgaaccgaaataggtgctc

SEQ ID NO: 39617 - DNA, 19 bp, Homo sapiens
cgcacaacagatgggtact

SEQ ID NO: 39618 - DNA, 20 bp, Homo sapiens
ccgcaccgggctgccgcctc

SEQ ID NO: 39619 - DNA, 18 bp, Homo sapiens
ccgcctggctgggtgctc

SEQ ID NO: 39620 - DNA, 18 bp, Homo sapiens
tccactgggctagacacc

SEQ ID NO: 39621 - DNA, 18 bp, Homo sapiens
gcaccaggcggcaaactc

SEQ ID NO: 39622 - DNA, 18 bp, Homo sapiens
tcgccgccgggagcactc

SEQ ID NO: 39623 - DNA, 19 bp, Homo sapiens
tcgccctgggctggatctc

SEQ ID NO: 39624 - DNA, 15 bp, Homo sapiens
tccaccacaggtact

SEQ ID NO: 39625 - DNA, 18 bp, Homo sapiens
tcgcagcattcaggtact

SEQ ID NO: 39626 - DNA, 18 bp, Homo sapiens
gcaccggaagcagtactc

SEQ ID NO: 39627 - DNA, 18 bp, Homo sapiens
tcgcactgggctggactc

SEQ ID NO: 39628 - DNA, 21 bp, Homo sapiens
tcccactgggctgggggcctc

SEQ ID NO: 39629 - DNA, 20 bp, Homo sapiens
gcaccaggctcaggcagctc

SEQ ID NO: 39630 - DNA, 16 bp, Homo sapiens
tcgctgctgggcaccc

SEQ ID NO: 39631 - DNA, 16 bp, Homo sapiens
cgcagccgcaggtact

SEQ ID NO: 39632 - DNA, 17 bp, Homo sapiens
tcaactggctgggtgct

SEQ ID NO: 39633 - DNA, 18 bp, Homo sapiens
tcgcaactctgggtactc

SEQ ID NO: 39634 - DNA, 17 bp, Homo sapiens
gcaccaaacaggtgctc

SEQ ID NO: 39635 - DNA, 16 bp, Homo sapiens
gcaccaggctgacctc

SEQ ID NO: 39636 - DNA, 20 bp, Homo sapiens
ccgaggcgggctgggtgctc

SEQ ID NO: 39637 - DNA, 18 bp, Homo sapiens
tcgactgggcttatgctc

SEQ ID NO: 39638 - DNA, 20 bp, Homo sapiens
tcgctgctggccgagtgctc

SEQ ID NO: 39639 - DNA, 18 bp, Homo sapiens
ccgccgggccagcagctc

SEQ ID NO: 39640 - DNA, 17 bp, Homo sapiens
tcgtactgggagcactc

SEQ ID NO: 39641 - DNA, 16 bp, Homo sapiens
tcgctgggctgagtct

SEQ ID NO: 39642 - DNA, 19 bp, Homo sapiens
cctcccgggctgggtgctc

SEQ ID NO: 39643 - DNA, 18 bp, Homo sapiens
tcacaccaccggtgggta

SEQ ID NO: 39644 - DNA, 20 bp, Homo sapiens
tcgtgccaggctgtggggct

SEQ ID NO: 39645 - DNA, 20 bp, Homo sapiens
tcgcaccaggtccaagtctc

SEQ ID NO: 39646 - DNA, 18 bp, Homo sapiens
gcgccgggctaaggactc

SEQ ID NO: 39647 - DNA, 17 bp, Homo sapiens
ccgctgggctagcactc

SEQ ID NO: 39648 - DNA, 17 bp, Homo sapiens
tcgcaccggcagcaact

SEQ ID NO: 39649 - DNA, 16 bp, Homo sapiens
tccactggcaaatact

SEQ ID NO: 39650 - DNA, 17 bp, Homo sapiens
gcagggcctgggtactc

SEQ ID NO: 39651 - DNA, 19 bp, Homo sapiens
cgtacaggactgggtgctc

SEQ ID NO: 39652 - DNA, 18 bp, Homo sapiens
gcgccgggctgcagcctc

SEQ ID NO: 39653 - DNA, 19 bp, Homo sapiens
ccgccaccactgggtattc

SEQ ID NO: 39654 - DNA, 19 bp, Homo sapiens
tctaccaagtatgggtgct

SEQ ID NO: 39655 - DNA, 18 bp, Homo sapiens
ccaaatacgtgggtactc

SEQ ID NO: 39656 - DNA, 19 bp, Homo sapiens
tctcactggtagaatactc

SEQ ID NO: 39657 - DNA, 20 bp, Homo sapiens
tcccactgagcagggtgctc

SEQ ID NO: 39658 - DNA, 18 bp, Homo sapiens
tcgccctgggctcaaggt

SEQ ID NO: 39659 - DNA, 19 bp, Homo sapiens
cctgccagggtgggtactc

SEQ ID NO: 39660 - DNA, 99 bp, Sesbania mosaic virus
tcttaaggtctaatgagactctcccaccggagctttccattattgaaataccttttgatgatgttgagacccggagttatgagtttattgaggttgaga

SEQ ID NO: 39661 - DNA, 24 bp, Sesbania mosaic virus
tgttgagacccggagttatgagtt

SEQ ID NO: 39662 - DNA, 20 bp, Homo sapiens
tgctgagacccggagaagct

SEQ ID NO: 39663 - DNA, 26 bp, Homo sapiens
gttgagacctggaaccaatgtgagtt

SEQ ID NO: 39664 - DNA, 101 bp, Sesbania mosaic virus
ggtagaggtaaggctaaacttggtaagcgtgagttcgcttggattccagaatcaggcaagtactgggctgatgaggatgaagatgagctgccacctcctcc

SEQ ID NO: 39665 - DNA, 24 bp, Sesbania mosaic virus
agaggtaaggctaaacttggtaag

SEQ ID NO: 39666 - DNA, 19 bp, Homo sapiens
gaggtaaggctaaaatagg

SEQ ID NO: 39667 - DNA, 24 bp, Homo sapiens
agggataaggctactacaggtaag

SEQ ID NO: 39668 - DNA, 20 bp, Homo sapiens
aggggtgagactaaaggcgg

SEQ ID NO: 39669 - DNA, 23 bp, Homo sapiens
agaggtgggactaaactgttaag

SEQ ID NO: 39670 - DNA, 20 bp, Homo sapiens
gaggtaaggccagaaaggta

SEQ ID NO: 39671 - DNA, 17 bp, Homo sapiens
aggtaaggtcatttggt

SEQ ID NO: 39672 - DNA, 18 bp, Homo sapiens
agaggctagggctggtaa

SEQ ID NO: 39673 - DNA, 20 bp, Homo sapiens
gaggtagggccaggccctgg

SEQ ID NO: 39674 - DNA, 19 bp, Homo sapiens
agaggtgggagctaaggca

SEQ ID NO: 39675 - DNA, 19 bp, Homo sapiens
aggggaaggttaagcctgg

SEQ ID NO: 39676 - DNA, 25 bp, Homo sapiens
aggggtaaggctgggcatgcaggta

SEQ ID NO: 39677 - DNA, 21 bp, Homo sapiens
agatgtaaagagcttggtaag

SEQ ID NO: 39678 - DNA, 18 bp, Homo sapiens
gaggcaaggctgcacctg

SEQ ID NO: 39679 - DNA, 20 bp, Homo sapiens
aggggaaggctaaacaatag

SEQ ID NO: 39680 - DNA, 21 bp, Homo sapiens
agaagtaaggctaaataaata

SEQ ID NO: 39681 - DNA, 22 bp, Homo sapiens
agaggcaaggctgggctgctgg

SEQ ID NO: 39682 - DNA, 22 bp, Homo sapiens
agaggttgctcagcttggtaag

SEQ ID NO: 39683 - DNA, 19 bp, Homo sapiens
gaggtgaggctgcaactgg

SEQ ID NO: 39684 - DNA, 17 bp, Homo sapiens
agaggtggggccaggca

SEQ ID NO: 39685 - DNA, 22 bp, Homo sapiens
gagtcaggctgggcttggtaag

SEQ ID NO: 39686 - DNA, 17 bp, Homo sapiens
aggggtaaggccagtgg

SEQ ID NO: 39687 - DNA, 69 bp, Human papillomavirus type 27
ctcaggcatatggaggagtatgatttgcagttcattttccaactgtgcaaaataaccctcactcctgag

SEQ ID NO: 39688 - DNA, 24 bp, Human papillomavirus type 27
tgtgcaaaataaccctcactcctg

SEQ ID NO: 39689 - DNA, 23 bp, Homo sapiens
tgtgaaggtaactatcactcctg

SEQ ID NO: 39690 - DNA, 22 bp, Homo sapiens
tgtggaggtggccctcaccctg

SEQ ID NO: 39691 - DNA, 18 bp, Homo sapiens
tgtgaacattcactcctg

SEQ ID NO: 39692 - DNA, 25 bp, Homo sapiens
tgtgcaaaatatttttccttatctc

SEQ ID NO: 39693 - DNA, 21 bp, Homo sapiens
tgtgcggaaacgccactcctg

SEQ ID NO: 39694 - DNA, 19 bp, Homo sapiens
tgtggcatcttcactcctg

SEQ ID NO: 39695 - DNA, 24 bp, Homo sapiens
tgtgctaaataaccttatgaactg

SEQ ID NO: 39696 - DNA, 23 bp, Homo sapiens
tggcagacacagcctcactcctg

SEQ ID NO: 39697 - DNA, 21 bp, Homo sapiens
tgcccggggccctcactcctg

SEQ ID NO: 39698 - DNA, 24 bp, Homo sapiens
tgtgcaaataattctataggcctg

SEQ ID NO: 39699 - DNA, 18 bp, Homo sapiens
tgtgcaaataatccttca

SEQ ID NO: 39700 - DNA, 20 bp, Homo sapiens
tgtgcaaaatgcttttgcct

SEQ ID NO: 39701 - DNA, 21 bp, Homo sapiens
tgcaaaatccaagcgttcctg

SEQ ID NO: 39702 - DNA, 21 bp, Homo sapiens
tatgcaaaagggtcttcactc

SEQ ID NO: 39703 - DNA, 62 bp, Human papillomavirus type 27
gttgccagcacagcttaatcctttaattgctcacatcctaaagtgttagctgtgccagcaac

SEQ ID NO: 39704 - DNA, 24 bp, Human papillomavirus type 27
taaagtgttagctgtgccagcaac

SEQ ID NO: 39705 - DNA, 19 bp, Homo sapiens
agtgctaacttccagtaac

SEQ ID NO: 39706 - DNA, 17 bp, Homo sapiens
aagctcagctgtgtcag

SEQ ID NO: 39707 - DNA, 16 bp, Homo sapiens
tgaatgttaaccagca

SEQ ID NO: 39708 - DNA, 18 bp, Homo sapiens
taaagtatgtgctagcaa

SEQ ID NO: 39709 - DNA, 20 bp, Homo sapiens
tgagggttagctgtaggagc

SEQ ID NO: 39710 - DNA, 18 bp, Homo sapiens
taaagtgttgcctgcagc

SEQ ID NO: 39711 - DNA, 25 bp, Homo sapiens
taaagtgtggttctctatttagcaa

SEQ ID NO: 39712 - DNA, 18 bp, Homo sapiens
taaagtgtcagtagtagc

SEQ ID NO: 39713 - DNA, 20 bp, Homo sapiens
taaaatgttagccaaggcaa

SEQ ID NO: 39714 - DNA, 21 bp, Homo sapiens
atatcaagttgtgccagcaac

SEQ ID NO: 39715 - DNA, 21 bp, Homo sapiens
agtgttaactgtggtagcaac

SEQ ID NO: 39716 - DNA, 17 bp, Homo sapiens
aagggcacttgtgccag

SEQ ID NO: 39717 - DNA, 19 bp, Homo sapiens
atgttagctgtacagtggc

SEQ ID NO: 39718 - DNA, 27 bp, Homo sapiens
taaagcgttggcccgatagtgccagca

SEQ ID NO: 39719 - DNA, 19 bp, Homo sapiens
taaagtgttagattgcagc

SEQ ID NO: 39720 - DNA, 17 bp, Homo sapiens
aagtgtcagtcaagcaa

SEQ ID NO: 39721 - DNA, 17 bp, Homo sapiens
gtgcaaatgccagcaac

SEQ ID NO: 39722 - DNA, 21 bp, Homo sapiens
taaagtgctggctgagggcaa

SEQ ID NO: 39723 - DNA, 20 bp, Homo sapiens
gtatcccagctgtgccggca

SEQ ID NO: 39724 - DNA, 15 bp, Homo sapiens
gtgttgcccagcaac

SEQ ID NO: 39725 - DNA, 17 bp, Homo sapiens
aaagtgtttagtcagca

SEQ ID NO: 39726 - DNA, 22 bp, Homo sapiens
aagctgttagccccagggcaac

SEQ ID NO: 39727 - DNA, 19 bp, Homo sapiens
agagttcggatgccagcaa

SEQ ID NO: 39728 - DNA, 130 bp, Human papillomavirus type 27
gcattcctaggctgattatggttctgtgttggcacagatttctactgcgtctgcaggaaaacctgcagcaacagcactttgggcgcgtcgtttctgcagccaactttcacttgccaacttgtcttgccgc

SEQ ID NO: 39729 - DNA, 24 bp, Human papillomavirus type 27
tgtgttggcacagatttctactgc

SEQ ID NO: 39730 - DNA, 19 bp, Homo sapiens
tgtgttggtacaggcttct

SEQ ID NO: 39731 - DNA, 18 bp, Homo sapiens
gtgttggtgattctgctg

SEQ ID NO: 39732 - DNA, 18 bp, Homo sapiens
tgtgttgggcagaattct

SEQ ID NO: 39733 - DNA, 22 bp, Homo sapiens
tggttggcacaggtgacactgc

SEQ ID NO: 39734 - DNA, 18 bp, Homo sapiens
tgttgggtttttctactg

SEQ ID NO: 39735 - DNA, 25 bp, Homo sapiens
tgtgttgggcgtagatgggctctgc

SEQ ID NO: 39736 - DNA, 19 bp, Homo sapiens
gtgtagcttggactactgc

SEQ ID NO: 39737 - DNA, 25 bp, Homo sapiens
gtgttggcgcagatgaaatggctgc

SEQ ID NO: 39738 - DNA, 24 bp, Homo sapiens
tgtgttggatattgacctttgctg

SEQ ID NO: 39739 - DNA, 17 bp, Homo sapiens
tgaacaggtttctactg

SEQ ID NO: 39740 - DNA, 22 bp, Homo sapiens
tgtgttgggcacagggcagctg

SEQ ID NO: 39741 - DNA, 19 bp, Homo sapiens
tgtgttggatggaccactg

SEQ ID NO: 39742 - DNA, 20 bp, Homo sapiens
gttaaacagatttttattgc

SEQ ID NO: 39743 - DNA, 25 bp, Homo sapiens
tgtattggcatggattctatactgc

SEQ ID NO: 39744 - DNA, 68 bp, Walleye dermal sarcoma virus
gagaacttctaaatcagggcatgcgaaaagtaattacgctcttaaacgatccagcaagagaagtattc

SEQ ID NO: 39745 - DNA, 24 bp, Walleye dermal sarcoma virus
ttaaacgatccagcaagagaagta

SEQ ID NO: 39746 - DNA, 19 bp, Homo sapiens
gatacagctagagagaagt

SEQ ID NO: 39747 - DNA, 21 bp, Homo sapiens
cggctctcagcaagagaagta

SEQ ID NO: 39748 - DNA, 22 bp, Homo sapiens
ttaaacgacttcacaccacgag

SEQ ID NO: 39749 - DNA, 64 bp, Human papillomavirus type 27
cgtgtatttcacgttaagctgccagatcccaataaatttggcctgcctgatgctgacctatatg

SEQ ID NO: 39750 - DNA, 24 bp, Human papillomavirus type 27
tttcacgttaagctgccagatccc

SEQ ID NO: 39751 - DNA, 19 bp, Homo sapiens
tttcaccttaagccattcc

SEQ ID NO: 39752 - DNA, 21 bp, Homo sapiens
ttcatgtttaagccagattcc

SEQ ID NO: 39753 - DNA, 21 bp, Homo sapiens
ttccatgttaagctgagaaga

SEQ ID NO: 39754 - DNA, 18 bp, Homo sapiens
actttaagctgtcaagtc

SEQ ID NO: 39755 - DNA, 18 bp, Homo sapiens
tttcaggtcgtcagatcc

SEQ ID NO: 39756 - DNA, 23 bp, Homo sapiens
ttccacgttcagacttgggtccc

SEQ ID NO: 39757 - DNA, 19 bp, Homo sapiens
tttcacgttggccaagatc

SEQ ID NO: 39758 - DNA, 20 bp, Homo sapiens
tttctcgtctattgccagat

SEQ ID NO: 39759 - DNA, 23 bp, Homo sapiens
tttcttgtttttgttcagatccc

SEQ ID NO: 39760 - DNA, 24 bp, Homo sapiens
tttcagttgggaaacagggatccc

SEQ ID NO: 39761 - DNA, 20 bp, Homo sapiens
ttcccaaggctgccaggtcc

SEQ ID NO: 39762 - DNA, 16 bp, Homo sapiens
tttcggtttgccagat

SEQ ID NO: 39763 - DNA, 17 bp, Homo sapiens
tttcacattttccagat

SEQ ID NO: 39764 - DNA, 16 bp, Homo sapiens
tttcaactgccagatc

SEQ ID NO: 39765 - DNA, 21 bp, Homo sapiens
ttcacgttgagctggaactcc

SEQ ID NO: 39766 - DNA, 20 bp, Homo sapiens
tttcatgttaagcctttaga

SEQ ID NO: 39767 - DNA, 18 bp, Homo sapiens
gttgcaactgccaggtcc

SEQ ID NO: 39768 - DNA, 16 bp, Homo sapiens
tttcacgtcagcagat

SEQ ID NO: 39769 - DNA, 76 bp, Ictalurid herpesvirus 1
ggttagtatatacttgatcatcgattcaatgtacggctcaaggtaatcaactgaagagatgattatgtggataacc

SEQ ID NO: 39770 - DNA, 24 bp, Ictalurid herpesvirus 1
tacttgatcatcgattcaatgtac

SEQ ID NO: 39771 - DNA, 19 bp, Homo sapiens
ttgatcatttcacaatgta

SEQ ID NO: 39772 - DNA, 19 bp, Homo sapiens
acttgatcagtacaatgta

SEQ ID NO: 39773 - DNA, 22 bp, Homo sapiens
tactgatgtgtcgattcaatgt

SEQ ID NO: 39774 - DNA, 24 bp, Homo sapiens
ttgatcatttgttccaaaatgtac

SEQ ID NO: 39775 - DNA, 20 bp, Homo sapiens
cttgaccaaggtcaatgtac

SEQ ID NO: 39776 - DNA, 21 bp, Homo sapiens
cttgatacaagatcaatgtac

SEQ ID NO: 39777 - DNA, 19 bp, Homo sapiens
ttaatacaaattcaatgta

SEQ ID NO: 39778 - DNA, 22 bp, Homo sapiens
actatgtacatcgatttgatgt

SEQ ID NO: 39779 - DNA, 19 bp, Homo sapiens
ttgatcatggaggtaatgt

SEQ ID NO: 39780 - DNA, 18 bp, Homo sapiens
ttggacatattcaatgta

SEQ ID NO: 39781 - DNA, 16 bp, Homo sapiens
cttgatcaattaatgt

SEQ ID NO: 39782 - DNA, 121 bp, Human herpesvirus 6
cgccgactccgtccgcagaggcggcgaccgcagcggcagcggaaactgtaacggccacgttctccgaacagcgacagtaacggcggcggcggcggttgtcgccgtcacggtagtcgtggcg

SEQ ID NO: 39783 - DNA, 24 bp, Human herpesvirus 6
agcggaaactgtaacggccacgtt

SEQ ID NO: 39784 - DNA, 25 bp, Homo sapiens
agtgggtactatacgtggctacgtt

SEQ ID NO: 39785 - DNA, 21 bp, Homo sapiens
agggaaactgctggctgtgtt

SEQ ID NO: 39786 - DNA, 21 bp, Homo sapiens
agctgggcaggtggccacgtt

SEQ ID NO: 39787 - DNA, 73 bp, Walleye dermal sarcoma virus
gactacaccaataggaacagagcaaccatttaataatgaaaaatggcagaatttgatatttgggaatatagtt

SEQ ID NO: 39788 - DNA, 24 bp, Walleye dermal sarcoma virus
atggcagaatttgatatttgggaa

SEQ ID NO: 39789 - DNA, 20 bp, Homo sapiens
atggcagaagttaggttggg

SEQ ID NO: 39790 - DNA, 17 bp, Homo sapiens
tggcaggatttgaagga

SEQ ID NO: 39791 - DNA, 21 bp, Homo sapiens
atggagagacttgatttggga

SEQ ID NO: 39792 - DNA, 19 bp, Homo sapiens
atggcagaatttatctgaa

SEQ ID NO: 39793 - DNA, 21 bp, Homo sapiens
tggtagaatcttctttgggaa

SEQ ID NO: 39794 - DNA, 15 bp, Homo sapiens
tggcaaaatttgggg

SEQ ID NO: 39795 - DNA, 24 bp, Homo sapiens
atggcagagtcttacacttgggaa

SEQ ID NO: 39796 - DNA, 18 bp, Homo sapiens
atggggtctgtatttggg

SEQ ID NO: 39797 - DNA, 23 bp, Homo sapiens
atggcagagtatgaccttctggg

SEQ ID NO: 39798 - DNA, 21 bp, Homo sapiens
atggcggtgatgatttgggaa

SEQ ID NO: 39799 - DNA, 22 bp, Homo sapiens
atggcagagttctgagggtgga

SEQ ID NO: 39800 - DNA, 16 bp, Homo sapiens
atggcaggatttgggg

SEQ ID NO: 39801 - DNA, 19 bp, Homo sapiens
atggcagaatttatccgaa

SEQ ID NO: 39802 - DNA, 22 bp, Homo sapiens
tggtgagttctgggatttggga

SEQ ID NO: 39803 - DNA, 18 bp, Homo sapiens
atagcagagagtttggga

SEQ ID NO: 39804 - DNA, 20 bp, Homo sapiens
ggcagggagctatttgggaa

SEQ ID NO: 39805 - DNA, 24 bp, Homo sapiens
atggagagatggtttgtttgggaa

SEQ ID NO: 39806 - DNA, 21 bp, Homo sapiens
atggaagaatttgaaatggaa

SEQ ID NO: 39807 - DNA, 18 bp, Homo sapiens
gcagaatgtaggtttggg

SEQ ID NO: 39808 - DNA, 19 bp, Homo sapiens
atggtagaatttatctgaa

SEQ ID NO: 39809 - DNA, 18 bp, Homo sapiens
tggcagaatttatctgaa

SEQ ID NO: 39810 - DNA, 111 bp, Human herpesvirus 6
ccgtgcacgtcccggttttagcgggagtgtgtgcgcgcgtaccgtaacaaggaaaacccagcgggacgaaacgatcgacccactcctactatccgccctccccgagcacgg

SEQ ID NO: 39811 - DNA, 24 bp, Human herpesvirus 6
tagcgggagtgtgtgcgcgcgtac

SEQ ID NO: 39812 - DNA, 18 bp, Homo sapiens
agtgggggtgtgtgcagc

SEQ ID NO: 39813 - DNA, 19 bp, Homo sapiens
gggggtgtgtaccatgtac

SEQ ID NO: 39814 - DNA, 16 bp, Homo sapiens
gcatgtgtgcgtgcgt

SEQ ID NO: 39815 - DNA, 18 bp, Homo sapiens
gggagtgtgcgtgcgtgt

SEQ ID NO: 39816 - DNA, 20 bp, Homo sapiens
gcgtgtgtgtgtgcgcgcgt

SEQ ID NO: 39817 - DNA, 18 bp, Homo sapiens
gcgggtgtgtgcgtgtgc

SEQ ID NO: 39818 - DNA, 21 bp, Homo sapiens
cagacactgtgtgcgtgtgta

SEQ ID NO: 39819 - DNA, 20 bp, Homo sapiens
acgtgtgtgtgtgtgcgtgt

SEQ ID NO: 39820 - DNA, 20 bp, Homo sapiens
gcgtgagtgtgtgcgcgtgc

SEQ ID NO: 39821 - DNA, 19 bp, Homo sapiens
gcgggagtgtgtgctgagc

SEQ ID NO: 39822 - DNA, 22 bp, Homo sapiens
acaactgtgtgtgcgtgtgtac

SEQ ID NO: 39823 - DNA, 19 bp, Homo sapiens
caggtgtgtgtgtgcgtgc

SEQ ID NO: 39824 - DNA, 19 bp, Homo sapiens
ggtgtgtgtgtgcgtgcgt

SEQ ID NO: 39825 - DNA, 20 bp, Homo sapiens
gcatgagtgtgtgcgtgcgt

SEQ ID NO: 39826 - DNA, 18 bp, Homo sapiens
gagtgtgtgtgtgcgtgt

SEQ ID NO: 39827 - DNA, 21 bp, Homo sapiens
gagacgtgtgtgtgcgcgcgt

SEQ ID NO: 39828 - DNA, 19 bp, Homo sapiens
gcgggagcgtgtgtgatgc

SEQ ID NO: 39829 - DNA, 18 bp, Homo sapiens
gcttgtgtgtgcgtgcgt

SEQ ID NO: 39830 - DNA, 116 bp, Amsacta moorei entomopoxvirus
aagtatacgaactttccgttaacaataattcaattttatttaataaagtatttttataaacatcagaaatattaacatctttatattgttcaattgttttagaaacatcgttactt

SEQ ID NO: 39831 - DNA, 24 bp, Amsacta moorei entomopoxvirus
taacaataattcaattttatttaa

SEQ ID NO: 39832 - DNA, 22 bp, Homo sapiens
taacaataattcagattatatt

SEQ ID NO: 39833 - DNA, 22 bp, Homo sapiens
acaatcaaatcaattttattta

SEQ ID NO: 39834 - DNA, 23 bp, Homo sapiens
taacaaaattcacattttattta

SEQ ID NO: 39835 - DNA, 73 bp, Human herpesvirus 6
tcgccgtacgaaaagagtaccgaatgcaaaaagttaaaggttttttgtaaataaaaaaaaaatagtacgtgga

SEQ ID NO: 39836 - DNA, 24 bp, Human herpesvirus 6
tttgtaaataaaaaaaaaatagta

SEQ ID NO: 39837 - DNA, 25 bp, Homo sapiens
tttgaaacaacaaaaaaaaatagta

SEQ ID NO: 39838 - DNA, 20 bp, Homo sapiens
tttgaaataaaaaaaaaata

SEQ ID NO: 39839 - DNA, 21 bp, Homo sapiens
tttgtaaataacaaaaaaaca

SEQ ID NO: 39840 - DNA, 20 bp, Homo sapiens
ttgctaaaaaaaaaatagta

SEQ ID NO: 39841 - DNA, 21 bp, Homo sapiens
ttgctaaaaaaaaaaatagta

SEQ ID NO: 39842 - DNA, 18 bp, Homo sapiens
tttataaataaaaaaaaa

SEQ ID NO: 39843 - DNA, 92 bp, Equine herpesvirus 4
aagggatattgagctgttagagtacgaaactgacatttcttgaccttggttgttagtgattcggttcattttgaagcagcgtagtaactctt

SEQ ID NO: 39844 - DNA, 24 bp, Equine herpesvirus 4
ttagtgattcggttcattttgaag

SEQ ID NO: 39845 - DNA, 22 bp, Homo sapiens
atgaaatatgttcattttgaag

SEQ ID NO: 39846 - DNA, 19 bp, Homo sapiens
gacttatggttcattttga

SEQ ID NO: 39847 - DNA, 22 bp, Homo sapiens
ttagtggtgatccattttgaag

SEQ ID NO: 39848 - DNA, 15 bp, Homo sapiens
gtgactcggttttga

SEQ ID NO: 39849 - DNA, 66 bp, Camelpox virus
gatatgtttattcataaacgcgtcaaatttttcatgaatcgctaaggagtttaagaatctcatgtc

SEQ ID NO: 39850 - DNA, 24 bp, Camelpox virus
tcgctaaggagtttaagaatctca

SEQ ID NO: 39851 - DNA, 20 bp, Homo sapiens
tcgctcctttgagaatctca

SEQ ID NO: 39852 - DNA, 24 bp, Homo sapiens
tccttaagagaaatgggaatctca

SEQ ID NO: 39853 - DNA, 22 bp, Homo sapiens
tcctgagactataggaatctca

SEQ ID NO: 39854 - DNA, 21 bp, Homo sapiens
cgctggcaaatttaagaatct

SEQ ID NO: 39855 - DNA, 19 bp, Homo sapiens
tcttagggagtctgatctc

SEQ ID NO: 39856 - DNA, 18 bp, Homo sapiens
agatgtgtaagaatctca

SEQ ID NO: 39857 - DNA, 22 bp, Homo sapiens
gcaacctctcttaagaatctca

SEQ ID NO: 39858 - DNA, 20 bp, Homo sapiens
tcctaagaagaaagggtctc

SEQ ID NO: 39859 - DNA, 16 bp, Homo sapiens
gctaaggcagaatctc

SEQ ID NO: 39860 - DNA, 66 bp, Ectromelia virus
ttttcaaatccatttgtgagaagtctatcgccttagataccttttctcgtagtcgaggtttgaaga

SEQ ID NO: 39861 - DNA, 24 bp, Ectromelia virus
taccttttctcgtagtcgaggttt

SEQ ID NO: 39862 - DNA, 18 bp, Homo sapiens
tacctttttttgtagtca

SEQ ID NO: 39863 - DNA, 22 bp, Homo sapiens
ccttttctcatgtaaactgttt

SEQ ID NO: 39864 - DNA, 20 bp, Homo sapiens
ttttctcgtgcaagtggttt

SEQ ID NO: 39865 - DNA, 17 bp, Homo sapiens
accttttctcagaggtt

SEQ ID NO: 39866 - DNA, 131 bp, Ictalurid herpesvirus 1
cccgttgggatagctgagccgcggtccgtgttgaaatccatcttctgtgcttccgatgtggtgcgtttcgttgaaccgtgcccgtcaacaccggaggtcatctcacccataccatggctcaccgtgacggg

SEQ ID NO: 39867 - DNA, 22 bp, Ictalurid herpesvirus 1
taccatggctcaccgtgacggg

SEQ ID NO: 39868 - DNA, 15 bp, Homo sapiens
catggctcactgcag

SEQ ID NO: 39869 - DNA, 16 bp, Homo sapiens
catggctcactcgagg

SEQ ID NO: 39870 - DNA, 21 bp, Homo sapiens
caccatggctttggaaatggg

SEQ ID NO: 39871 - DNA, 21 bp, Homo sapiens
cactatgaaaactgtgacggg

SEQ ID NO: 39872 - DNA, 18 bp, Homo sapiens
ccattggaccgtgacggg

SEQ ID NO: 39873 - DNA, 16 bp, Homo sapiens
accatggctctgtggg

SEQ ID NO: 39874 - DNA, 16 bp, Homo sapiens
ccatggctactcgagg

SEQ ID NO: 39875 - DNA, 19 bp, Homo sapiens
ccatggctccggccgcggg

SEQ ID NO: 39876 - DNA, 19 bp, Homo sapiens
taccatgggtccccatggg

SEQ ID NO: 39877 - DNA, 18 bp, Homo sapiens
taccatagctcactgcag

SEQ ID NO: 39878 - DNA, 17 bp, Homo sapiens
catggctcaatactggg

SEQ ID NO: 39879 - DNA, 19 bp, Homo sapiens
ccatggcttgccagagagg

SEQ ID NO: 39880 - DNA, 17 bp, Homo sapiens
catggctcatccaacgg

SEQ ID NO: 39881 - DNA, 19 bp, Homo sapiens
tgtgctcaccagacatggg

SEQ ID NO: 39882 - DNA, 15 bp, Homo sapiens
ccatggctccatggg

SEQ ID NO: 39883 - DNA, 19 bp, Homo sapiens
ccgcggctgccgtgacggg

SEQ ID NO: 39884 - DNA, 17 bp, Homo sapiens
actgtggctcactgcag

SEQ ID NO: 39885 - DNA, 17 bp, Homo sapiens
accatggctcactgcag

SEQ ID NO: 39886 - DNA, 21 bp, Homo sapiens
taccatggcctagcccttggg

SEQ ID NO: 39887 - DNA, 16 bp, Homo sapiens
catggctcactgtagg

SEQ ID NO: 39888 - DNA, 20 bp, Homo sapiens
taccatggccactgcacagg

SEQ ID NO: 39889 - DNA, 25 bp, Homo sapiens
taccatagcttattggcccgtcacg

SEQ ID NO: 39890 - DNA, 17 bp, Homo sapiens
accgtggctcacctcgg

SEQ ID NO: 39891 - DNA, 18 bp, Homo sapiens
ccatggctcccctaaggg

SEQ ID NO: 39892 - DNA, 22 bp, Homo sapiens
cctggctcacatctgtgacggg

SEQ ID NO: 39893 - DNA, 27 bp, Homo sapiens
taccatggctcttgatgcccgtcacgg

SEQ ID NO: 39894 - DNA, 26 bp, Homo sapiens
tactatgctcaccacctggtgatggg

SEQ ID NO: 39895 - DNA, 20 bp, Homo sapiens
catggctccctggtgatggg

SEQ ID NO: 39896 - DNA, 22 bp, Homo sapiens
tactgtggcccacaccggcggg

SEQ ID NO: 39897 - DNA, 21 bp, Homo sapiens
atggcccactctaaatatggg

SEQ ID NO: 39898 - DNA, 16 bp, Homo sapiens
catggctcactgcagg

SEQ ID NO: 39899 - DNA, 20 bp, Homo sapiens
taccatggattgcctgatgg

SEQ ID NO: 39900 - DNA, 15 bp, Homo sapiens
catgactcactgcag

SEQ ID NO: 39901 - DNA, 64 bp, Ectromelia virus
aatggtagcgcgtctttaactcgtcggttagctctttcttttgatcgagttcgtcgccactatt

SEQ ID NO: 39902 - DNA, 24 bp, Ectromelia virus
tttgatcgagttcgtcgccactat

SEQ ID NO: 39903 - DNA, 18 bp, Homo sapiens
tttgatcaagggccacta

SEQ ID NO: 39904 - DNA, 80 bp, Bovine syncytial virus
gaagatcgagaagagaaaagtacaatgtgaagtaatagctactgccctggactatgtattggtagctcctgtcgatattc

SEQ ID NO: 39905 - DNA, 24 bp, Bovine syncytial virus
gactatgtattggtagctcctgtc

SEQ ID NO: 39906 - DNA, 18 bp, Homo sapiens
gacttcagtagcttctgt

SEQ ID NO: 39907 - DNA, 16 bp, Homo sapiens
gactatgtggtcccct

SEQ ID NO: 39908 - DNA, 23 bp, Homo sapiens
gactgtggttctaccactcctgt

SEQ ID NO: 39909 - DNA, 20 bp, Homo sapiens
cgccctgggtagctcttgtc

SEQ ID NO: 39910 - DNA, 17 bp, Homo sapiens
gactgtgtggctcctgt

SEQ ID NO: 39911 - DNA, 24 bp, Homo sapiens
gataatgtattgggataactctgt

SEQ ID NO: 39912 - DNA, 22 bp, Homo sapiens
gacaatgttacagggcttctgt

SEQ ID NO: 39913 - DNA, 20 bp, Homo sapiens
actatgcagtggtttttgtc

SEQ ID NO: 39914 - DNA, 24 bp, Homo sapiens
gactatgttattggtgaaggtgtc

SEQ ID NO: 39915 - DNA, 63 bp, Murid herpesvirus 4
gaagtagcgaacctctgctcactgcccgggccctccgggaggtgagcaggagttgcgcttttc

SEQ ID NO: 39916 - DNA, 21 bp, Murid herpesvirus 4
tgagcaggagttgcgcttttc

SEQ ID NO: 39917 - DNA, 18 bp, Homo sapiens
tgaacagggattcttttc

SEQ ID NO: 39918 - DNA, 20 bp, Homo sapiens
tgagcaggcggaggcttttc

SEQ ID NO: 39919 - DNA, 17 bp, Homo sapiens
gcagggcggcgcttttc

SEQ ID NO: 39920 - DNA, 16 bp, Homo sapiens
tgggcagaacactttt

SEQ ID NO: 39921 - DNA, 19 bp, Homo sapiens
tgagcaggggctccctttc

SEQ ID NO: 39922 - DNA, 15 bp, Homo sapiens
tgagaggacactttt

SEQ ID NO: 39923 - DNA, 18 bp, Homo sapiens
tgatcaggagtttctttc

SEQ ID NO: 39924 - DNA, 17 bp, Homo sapiens
gagcagaagtgcttttc

SEQ ID NO: 39925 - DNA, 17 bp, Homo sapiens
gagcgggggttgccttc

SEQ ID NO: 39926 - DNA, 18 bp, Homo sapiens
tgagaaggagttgggctc

SEQ ID NO: 39927 - DNA, 16 bp, Homo sapiens
tggcagaggcgctttt

SEQ ID NO: 39928 - DNA, 20 bp, Homo sapiens
tgggcgggagctgcgccctc

SEQ ID NO: 39929 - DNA, 21 bp, Homo sapiens
taagtagccatggcgcttttc

SEQ ID NO: 39930 - DNA, 19 bp, Homo sapiens
tgaacaggccttgtttttc

SEQ ID NO: 39931 - DNA, 19 bp, Homo sapiens
gagcaggaggtctcttttc

SEQ ID NO: 39932 - DNA, 18 bp, Homo sapiens
gagcaggggttggtgctc

SEQ ID NO: 39933 - DNA, 18 bp, Homo sapiens
tgggctaggggttggctt

SEQ ID NO: 39934 - DNA, 17 bp, Homo sapiens
cgggcggaagcgctttt

SEQ ID NO: 39935 - DNA, 16 bp, Homo sapiens
tgagcaggaatgcctc

SEQ ID NO: 39936 - DNA, 19 bp, Homo sapiens
agcaggagtgtgaactttc

SEQ ID NO: 39937 - DNA, 19 bp, Homo sapiens
tgagtggagtttacacttc

SEQ ID NO: 39938 - DNA, 18 bp, Homo sapiens
tgagcagaggtcattttc

SEQ ID NO: 39939 - DNA, 18 bp, Homo sapiens
tgagcaggattcaatttc

SEQ ID NO: 39940 - DNA, 16 bp, Homo sapiens
tgagcagggcttgctt

SEQ ID NO: 39941 - DNA, 19 bp, Homo sapiens
tgagcagagtttaaacttc

SEQ ID NO: 39942 - DNA, 15 bp, Homo sapiens
gcaggagtccctttc

SEQ ID NO: 39943 - DNA, 17 bp, Homo sapiens
tggcaggagttagcttc

SEQ ID NO: 39944 - DNA, 20 bp, Homo sapiens
tgagttaggcaagcgctttt

SEQ ID NO: 39945 - DNA, 22 bp, Homo sapiens
tgggcaagagtcaaagtttttc

SEQ ID NO: 39946 - DNA, 18 bp, Homo sapiens
tggcaggggttctccttc

SEQ ID NO: 39947 - DNA, 19 bp, Homo sapiens
gcgggagccagggcttttc

SEQ ID NO: 39948 - DNA, 19 bp, Homo sapiens
tgagcaggagtctggtgcc

SEQ ID NO: 39949 - DNA, 21 bp, Homo sapiens
tgagcaggattttatgacttc

SEQ ID NO: 39950 - DNA, 21 bp, Homo sapiens
tgggcaggagtcggaggactc

SEQ ID NO: 39951 - DNA, 18 bp, Homo sapiens
tgggcaggagtgcccttt

SEQ ID NO: 39952 - DNA, 20 bp, Homo sapiens
tgaacaggatttgcgttttt

SEQ ID NO: 39953 - DNA, 19 bp, Homo sapiens
tgagaatcagagcgctttt

SEQ ID NO: 39954 - DNA, 18 bp, Homo sapiens
gagcaggaaatgtttttc

SEQ ID NO: 39955 - DNA, 22 bp, Homo sapiens
tgggcagaagttggaacacttt

SEQ ID NO: 39956 - DNA, 19 bp, Homo sapiens
tgaacaggaatttgctttt

SEQ ID NO: 39957 - DNA, 19 bp, Homo sapiens
gagcaggagtcttcttttc

SEQ ID NO: 39958 - DNA, 67 bp, Bovine syncytial virus
ccctacagaaaagataatggctaccatccacaagggattactgaaggccttagatctgagcttgggg

SEQ ID NO: 39959 - DNA, 24 bp, Bovine syncytial virus
tgaaggccttagatctgagcttgg

SEQ ID NO: 39960 - DNA, 18 bp, Homo sapiens
tgagggctataaagcttg

SEQ ID NO: 39961 - DNA, 18 bp, Homo sapiens
agccttggttaagcttgg

SEQ ID NO: 39962 - DNA, 18 bp, Homo sapiens
ggtccttagatcagctgg

SEQ ID NO: 39963 - DNA, 23 bp, Homo sapiens
tgagaggtttgcactgagcttgg

SEQ ID NO: 39964 - DNA, 20 bp, Homo sapiens
tgaggccttacctagtttgg

SEQ ID NO: 39965 - DNA, 18 bp, Homo sapiens
tgagggcctggatctgag

SEQ ID NO: 39966 - DNA, 18 bp, Homo sapiens
taaaggcccctgggcttg

SEQ ID NO: 39967 - DNA, 23 bp, Homo sapiens
tggaggccgtggatctgaactgg

SEQ ID NO: 39968 - DNA, 21 bp, Homo sapiens
ggcacatggatctgagcttgg

SEQ ID NO: 39969 - DNA, 18 bp, Homo sapiens
tgagggccctagagcttg

SEQ ID NO: 39970 - DNA, 18 bp, Homo sapiens
tgagtgccttggagcttg

SEQ ID NO: 39971 - DNA, 18 bp, Homo sapiens
tgggggccttaatctttg

SEQ ID NO: 39972 - DNA, 23 bp, Homo sapiens
tgaagatgaatttctgagcttgg

SEQ ID NO: 39973 - DNA, 18 bp, Homo sapiens
tggaggccttagtccttg

SEQ ID NO: 39974 - DNA, 66 bp, Bovine syncytial virus
ggggaccagttctgatagtgacagatagtaattatgttgctaagagttataatgaagaattgccct

SEQ ID NO: 39975 - DNA, 24 bp, Bovine syncytial virus
tgatagtgacagatagtaattatg

SEQ ID NO: 39976 - DNA, 21 bp, Homo sapiens
gtgtacttgatggtaattatg

SEQ ID NO: 39977 - DNA, 23 bp, Homo sapiens
tgatagtgacaataaccattatg

SEQ ID NO: 39978 - DNA, 70 bp, Bovine syncytial virus
gcggcacaccagaaacttgcacaaactccggattcagcagaaatttgcccaagtgcaacaccgtgtccgc

SEQ ID NO: 39979 - DNA, 24 bp, Bovine syncytial virus
ttgcccaagtgcaacaccgtgtcc

SEQ ID NO: 39980 - DNA, 18 bp, Homo sapiens
ttgcccaactgcagcatc

SEQ ID NO: 39981 - DNA, 21 bp, Homo sapiens
ttacccaagtgtgtactgtcc

SEQ ID NO: 39982 - DNA, 22 bp, Homo sapiens
ccccgcgcacgatgccgtgtcc

SEQ ID NO: 39983 - DNA, 22 bp, Homo sapiens
ttgccccaggagacaccgtgtc

SEQ ID NO: 39984 - DNA, 20 bp, Homo sapiens
ttacccaagaactgctgtgt

SEQ ID NO: 39985 - DNA, 15 bp, Homo sapiens
ccaagtgcaaatgtc

SEQ ID NO: 39986 - DNA, 17 bp, Homo sapiens
ccaagtgcagcctgtcc

SEQ ID NO: 39987 - DNA, 21 bp, Homo sapiens
tgcagcagcagcaccgtgtcc

SEQ ID NO: 39988 - DNA, 17 bp, Homo sapiens
cccaagtgacatgtgtc

SEQ ID NO: 39989 - DNA, 15 bp, Homo sapiens
gcccaagtgcagcgc

SEQ ID NO: 39990 - DNA, 18 bp, Homo sapiens
caaggtgacgccgtgtcc

SEQ ID NO: 39991 - DNA, 16 bp, Homo sapiens
ttgcctaccaccgtgt

SEQ ID NO: 39992 - DNA, 63 bp, Murid herpesvirus 4
agagggggagtgtgtggtctgtagagagacatgagttgatcggcagaccccctctccccctct

SEQ ID NO: 39993 - DNA, 24 bp, Murid herpesvirus 4
gatcggcagaccccctctccccct

SEQ ID NO: 39994 - DNA, 19 bp, Homo sapiens
agccccctcttctctccct

SEQ ID NO: 39995 - DNA, 18 bp, Homo sapiens
gatcgccccctcttcccc

SEQ ID NO: 39996 - DNA, 18 bp, Homo sapiens
ggcagaccccaaacctcc

SEQ ID NO: 39997 - DNA, 23 bp, Homo sapiens
tcagcagaggatctttctttcct

SEQ ID NO: 39998 - DNA, 18 bp, Homo sapiens
ggcttccccctctccccc

SEQ ID NO: 39999 - DNA, 23 bp, Homo sapiens
gagcggagaccccctcttcccct

SEQ ID NO: 40000 - DNA, 19 bp, Homo sapiens
tctgcccccctcttcctct

SEQ ID NO: 40001 - DNA, 18 bp, Homo sapiens
ccagagtcccctctctcc

SEQ ID NO: 40002 - DNA, 26 bp, Homo sapiens
gattggcagacctgtccccaacccct

SEQ ID NO: 40003 - DNA, 22 bp, Homo sapiens
tcggcagaccccttccttccct

SEQ ID NO: 40004 - DNA, 23 bp, Homo sapiens
gaaggacagaccctttttttccc

SEQ ID NO: 40005 - DNA, 22 bp, Homo sapiens
gatcggcaggtgccaaacttcc

SEQ ID NO: 40006 - DNA, 18 bp, Homo sapiens
atcggcagacctgtcccc

SEQ ID NO: 40007 - DNA, 21 bp, Homo sapiens
tcggcagatcaccaggtctcc

SEQ ID NO: 40008 - DNA, 21 bp, Homo sapiens
tctgcaatttcctctccccct

SEQ ID NO: 40009 - DNA, 18 bp, Homo sapiens
gattggggaccccctgcc

SEQ ID NO: 40010 - DNA, 19 bp, Homo sapiens
gctcacccttcctctcccc

SEQ ID NO: 40011 - DNA, 17 bp, Homo sapiens
gatctccccctctcctc

SEQ ID NO: 40012 - DNA, 26 bp, Homo sapiens
atcggcggctgcatccttctcctcct

SEQ ID NO: 40013 - DNA, 21 bp, Homo sapiens
ccagcccccctctttcttcct

SEQ ID NO: 40014 - DNA, 20 bp, Homo sapiens
gatcagcaggcctcctgacc

SEQ ID NO: 40015 - DNA, 20 bp, Homo sapiens
acagcctcccctctcctcct

SEQ ID NO: 40016 - DNA, 20 bp, Homo sapiens
gatgcttacttcctctcccc

SEQ ID NO: 40017 - DNA, 24 bp, Homo sapiens
gatgggcagacctggcagctctcc

SEQ ID NO: 40018 - DNA, 21 bp, Homo sapiens
tctgctaggttttctccccct

SEQ ID NO: 40019 - DNA, 22 bp, Homo sapiens
agccccccttccctctccccct

SEQ ID NO: 40020 - DNA, 18 bp, Homo sapiens
tcggcctcctctccccct

SEQ ID NO: 40021 - DNA, 20 bp, Homo sapiens
gacctgcacctccctctccc

SEQ ID NO: 40022 - DNA, 83 bp, Murid herpesvirus 4
tctcaccctgacagctgtcaggggttacatgagagaacttcatgtaacccctgacagctgtcaacctaatcctgaccgtgaga

SEQ ID NO: 40023 - DNA, 24 bp, Murid herpesvirus 4
cctgacagctgtcaacctaatcct

SEQ ID NO: 40024 - DNA, 24 bp, Homo sapiens
ctgacagctgtttgcagacctcct

SEQ ID NO: 40025 - DNA, 21 bp, Homo sapiens
ctggaggctgtcaaaactcct

SEQ ID NO: 40026 - DNA, 22 bp, Homo sapiens
cctgacaattgtcatgcatcct

SEQ ID NO: 40027 - DNA, 18 bp, Homo sapiens
ctgacatttaacctaatc

SEQ ID NO: 40028 - DNA, 19 bp, Homo sapiens
ctgacaatgacctaatcct

SEQ ID NO: 40029 - DNA, 19 bp, Homo sapiens
ctggcagctgccctgaatc

SEQ ID NO: 40030 - DNA, 24 bp, Homo sapiens
ccagacagctggaggcctggtcct

SEQ ID NO: 40031 - DNA, 19 bp, Homo sapiens
cctgttagctgtcatgcct

SEQ ID NO: 40032 - DNA, 17 bp, Homo sapiens
tggcagccacctagtcc

SEQ ID NO: 40033 - DNA, 25 bp, Homo sapiens
cctgacagcagcaacacttggtcct

SEQ ID NO: 40034 - DNA, 26 bp, Homo sapiens
ccttacagctgttggctcatgttcct

SEQ ID NO: 40035 - DNA, 19 bp, Homo sapiens
cctgacagctgctttgtcc

SEQ ID NO: 40036 - DNA, 21 bp, Homo sapiens
cctgacagtttgttagctaat

SEQ ID NO: 40037 - DNA, 18 bp, Homo sapiens
cctgtagctgtcaactct

SEQ ID NO: 40038 - DNA, 21 bp, Homo sapiens
cctgttggtgccaacctgatc

SEQ ID NO: 40039 - DNA, 24 bp, Homo sapiens
cctggtagctggccagccaatcct

SEQ ID NO: 40040 - DNA, 18 bp, Homo sapiens
cctgagcagctctaatcc

SEQ ID NO: 40041 - DNA, 18 bp, Homo sapiens
ctgacagcttcaggtcct

SEQ ID NO: 40042 - DNA, 21 bp, Homo sapiens
cctgacagcttttaatatcct

SEQ ID NO: 40043 - DNA, 86 bp, Bovine syncytial virus
gcattgtttacagcagatgtcgtagacatcttgaaggacataccaaatgttcaggtatatgtggatgacgtctatgtgagctcagc

SEQ ID NO: 40044 - DNA, 24 bp, Bovine syncytial virus
cagcagatgtcgtagacatcttga

SEQ ID NO: 40045 - DNA, 16 bp, Homo sapiens
cagagacagacatctt

SEQ ID NO: 40046 - DNA, 20 bp, Homo sapiens
aacagatgttgtaatcttga

SEQ ID NO: 40047 - DNA, 20 bp, Homo sapiens
agctgactcagacatcttga

SEQ ID NO: 40048 - DNA, 22 bp, Homo sapiens
cagcagatgaaatgtatcttga

SEQ ID NO: 40049 - DNA, 17 bp, Homo sapiens
cagatcaggacatcttg

SEQ ID NO: 40050 - DNA, 17 bp, Homo sapiens
acagatgtgtcattttg

SEQ ID NO: 40051 - DNA, 19 bp, Homo sapiens
cagtaaatcagacatcttg

SEQ ID NO: 40052 - DNA, 22 bp, Homo sapiens
cagcaaatgccctggtgtcttg

SEQ ID NO: 40053 - DNA, 18 bp, Homo sapiens
gattccgcagacattttg

SEQ ID NO: 40054 - DNA, 23 bp, Homo sapiens
cagcaggtgccgtaggtccctga

SEQ ID NO: 40055 - DNA, 22 bp, Homo sapiens
cagccgggcctagacatcttga

SEQ ID NO: 40056 - DNA, 22 bp, Homo sapiens
cagcgggtgccgtagagcctct

SEQ ID NO: 40057 - DNA, 18 bp, Homo sapiens
agcagatgaggtgtcttg

SEQ ID NO: 40058 - DNA, 20 bp, Homo sapiens
acagacacaagacatcttga

SEQ ID NO: 40059 - DNA, 22 bp, Homo sapiens
tgacagatgcacaaacgttttg

SEQ ID NO: 40060 - DNA, 19 bp, Homo sapiens
acggatgtcgcaggtcttg

SEQ ID NO: 40061 - DNA, 19 bp, Homo sapiens
gcaggacgtggacatcttg

SEQ ID NO: 40062 - DNA, 22 bp, Homo sapiens
agatgtcaagttaacatcttga

SEQ ID NO: 40063 - DNA, 17 bp, Homo sapiens
gcagaaaagacatcttg

SEQ ID NO: 40064 - DNA, 21 bp, Homo sapiens
acagatgcagctgcattttga

SEQ ID NO: 40065 - DNA, 21 bp, Homo sapiens
cagcagatgtctggaccactg

SEQ ID NO: 40066 - DNA, 24 bp, Homo sapiens
gcagatgtcgtggaaaacagtttg

SEQ ID NO: 40067 - DNA, 63 bp, Camelpox virus
gacactttgccagcggttgtagatttatcatatttctccactacatatccgttacaatttgtt

SEQ ID NO: 40068 - DNA, 24 bp, Camelpox virus
tttgccagcggttgtagatttatc

SEQ ID NO: 40069 - DNA, 21 bp, Homo sapiens
tttgccggctgtacaatttat

SEQ ID NO: 40070 - DNA, 22 bp, Homo sapiens
tttgctgttgtcccagatttat

SEQ ID NO: 40071 - DNA, 18 bp, Homo sapiens
tctgctggtcagatttat

SEQ ID NO: 40072 - DNA, 18 bp, Homo sapiens
cttgccaaaaagatttat

SEQ ID NO: 40073 - DNA, 19 bp, Homo sapiens
tttgccggtggttgtaaac

SEQ ID NO: 40074 - DNA, 23 bp, Homo sapiens
tctgtcagtggtttgaaatttat

SEQ ID NO: 40075 - DNA, 72 bp, Murid herpesvirus 4
gtaagggtactctcatcaccaatgtaaattaatatgtagcaaactttggtgtgggagtcctaccccttttgc

SEQ ID NO: 40076 - DNA, 24 bp, Murid herpesvirus 4
aagggtactctcatcaccaatgta

SEQ ID NO: 40077 - DNA, 22 bp, Homo sapiens
gggtgctccaaggtccaatgta

SEQ ID NO: 40078 - DNA, 21 bp, Homo sapiens
aagggtacttcatttcactgt

SEQ ID NO: 40079 - DNA, 23 bp, Homo sapiens
aagggcacttcaaactcaatgta

SEQ ID NO: 40080 - DNA, 23 bp, Homo sapiens
aaggtactcttattacccaatgt

SEQ ID NO: 40081 - DNA, 22 bp, Homo sapiens
agggtttctcatcactgatgta

SEQ ID NO: 40082 - DNA, 22 bp, Homo sapiens
aagggtacttcatggcgcatgt

SEQ ID NO: 40083 - DNA, 21 bp, Homo sapiens
aagggtactttcaccctatgt

SEQ ID NO: 40084 - DNA, 100 bp, Bovine syncytial virus
agggcaatgctctagcagataaacaagctgtttcaggaagctataaggtcttctcaaatgaattgaaacccagcctggatgcagagcttgagcaagtcct

SEQ ID NO: 40085 - DNA, 24 bp, Bovine syncytial virus
tagcagataaacaagctgtttcag

SEQ ID NO: 40086 - DNA, 21 bp, Homo sapiens
gcagataagttgtaagcgttt

SEQ ID NO: 40087 - DNA, 21 bp, Homo sapiens
tagagatagacagtatttcag

SEQ ID NO: 40088 - DNA, 16 bp, Homo sapiens
taacaggaagctgttt

SEQ ID NO: 40089 - DNA, 24 bp, Homo sapiens
tagcagaaagtagaaatgtttcag

SEQ ID NO: 40090 - DNA, 22 bp, Homo sapiens
cagcggataaacagtaactcag

SEQ ID NO: 40091 - DNA, 19 bp, Homo sapiens
tagccctcaaggctgtttc

SEQ ID NO: 40092 - DNA, 24 bp, Homo sapiens
tagcaataaacaagccgttctcag

SEQ ID NO: 40093 - DNA, 18 bp, Homo sapiens
agcaggtaaacaaagtca

SEQ ID NO: 40094 - DNA, 23 bp, Homo sapiens
tagcagatgatgaagacactcag

SEQ ID NO: 40095 - DNA, 17 bp, Homo sapiens
tagcagacaggagtttc

SEQ ID NO: 40096 - DNA, 22 bp, Homo sapiens
cagcagatagatgagactcctt

SEQ ID NO: 40097 - DNA, 16 bp, Homo sapiens
tagcagacaagcattt

SEQ ID NO: 40098 - DNA, 20 bp, Homo sapiens
gcaaatagacaagctaaaca

SEQ ID NO: 40099 - DNA, 22 bp, Homo sapiens
cagcagataaacaagtgaacaa

SEQ ID NO: 40100 - DNA, 17 bp, Homo sapiens
gcagataaacggtctca

SEQ ID NO: 40101 - DNA, 20 bp, Homo sapiens
agcagataaacaaatctcag

SEQ ID NO: 40102 - DNA, 19 bp, Homo sapiens
gctgaatgagctgtttcag

SEQ ID NO: 40103 - DNA, 17 bp, Homo sapiens
gataaacagagtctcag

SEQ ID NO: 40104 - DNA, 20 bp, Homo sapiens
agcagataaacagtatgtct

SEQ ID NO: 40105 - DNA, 21 bp, Homo sapiens
gcgaacaacgggctgtttcag

SEQ ID NO: 40106 - DNA, 20 bp, Homo sapiens
tagtggagaaacaagcaagc

SEQ ID NO: 40107 - DNA, 21 bp, Homo sapiens
tagcagataaggtgagagcca

SEQ ID NO: 40108 - DNA, 75 bp, Murid herpesvirus 4
ggccagggtagctcaatcggtagagcagcggttcctggagtccgctggttctcggttcaagcccgagccctggtt

SEQ ID NO: 40109 - DNA, 24 bp, Murid herpesvirus 4
ttctcggttcaagcccgagccctg

SEQ ID NO: 40110 - DNA, 27 bp, Homo sapiens
ttctcggtaaggagagtttgggtcctg

SEQ ID NO: 40111 - DNA, 16 bp, Homo sapiens
tcctcagcttgagccc

SEQ ID NO: 40112 - DNA, 21 bp, Homo sapiens
ttctgggttcaagcagttagc

SEQ ID NO: 40113 - DNA, 24 bp, Homo sapiens
tctcggcctggggtctgagtcctg

SEQ ID NO: 40114 - DNA, 18 bp, Homo sapiens
tcctcggtttaaggccct

SEQ ID NO: 40115 - DNA, 23 bp, Homo sapiens
ttctgggttcaaacgtggctctg

SEQ ID NO: 40116 - DNA, 21 bp, Homo sapiens
tccttggttcaagtgatcctg

SEQ ID NO: 40117 - DNA, 18 bp, Homo sapiens
tctgcaggcctgagctct

SEQ ID NO: 40118 - DNA, 24 bp, Homo sapiens
ttcctggttcaagtgattctcctg

SEQ ID NO: 40119 - DNA, 24 bp, Homo sapiens
ttctaggttcaagcgattctcctg

SEQ ID NO: 40120 - DNA, 17 bp, Homo sapiens
ggtcaggcctgagccct

SEQ ID NO: 40121 - DNA, 26 bp, Homo sapiens
tctctgttccccaagcctgggccctg

SEQ ID NO: 40122 - DNA, 24 bp, Homo sapiens
ttctgggttcaagcaattctcctg

SEQ ID NO: 40123 - DNA, 23 bp, Homo sapiens
ttctcggcttcaggggtgtcctg

SEQ ID NO: 40124 - DNA, 24 bp, Homo sapiens
ttctgggttcaagagattctcctg

SEQ ID NO: 40125 - DNA, 24 bp, Homo sapiens
ttctgggttcaagtgattctcctg

SEQ ID NO: 40126 - DNA, 19 bp, Homo sapiens
ttctgggttcaaggcttct

SEQ ID NO: 40127 - DNA, 19 bp, Homo sapiens
ctctcagagcctgagccct

SEQ ID NO: 40128 - DNA, 19 bp, Homo sapiens
ttcttggttcaaattcaaa

SEQ ID NO: 40129 - DNA, 24 bp, Homo sapiens
ttctgggttcaagcgattcttctg

SEQ ID NO: 40130 - DNA, 24 bp, Homo sapiens
ttctgggttcaagcgattctcctg

SEQ ID NO: 40131 - DNA, 75 bp, Cowpox virus
tctgaataaaacatcaatgtcgcaatttgtattgtccaatacagaatgtctatgattcgtgttaaaaccatcgga

SEQ ID NO: 40132 - DNA, 24 bp, Cowpox virus
taaaacatcaatgtcgcaatttgt

SEQ ID NO: 40133 - DNA, 19 bp, Homo sapiens
taaaacataaatgtcatca

SEQ ID NO: 40134 - DNA, 19 bp, Homo sapiens
acatcaataccaagtttgt

SEQ ID NO: 40135 - DNA, 19 bp, Homo sapiens
taaaacaccaaacagtttg

SEQ ID NO: 40136 - DNA, 23 bp, Homo sapiens
taaaaaatcaatgtcaatgctgt

SEQ ID NO: 40137 - DNA, 126 bp, Friend murine leukemia virus
agagactgtgatggggcagcctactccgaagacccctcgacaactaagggagttcctagggacggcaggcttctgtcgcctctggatccctgggtttgcagaaatggcagcccccttgtaccctct

SEQ ID NO: 40138 - DNA, 24 bp, Friend murine leukemia virus
actgtgatggggcagcctactccg

SEQ ID NO: 40139 - DNA, 18 bp, Homo sapiens
gtgatggaatgacctact

SEQ ID NO: 40140 - DNA, 17 bp, Homo sapiens
tgtgatggtgccctctc

SEQ ID NO: 40141 - DNA, 22 bp, Homo sapiens
actggggtggggaagcttattc

SEQ ID NO: 40142 - DNA, 18 bp, Homo sapiens
ctgtgatgtggcggctcc

SEQ ID NO: 40143 - DNA, 19 bp, Homo sapiens
actgtgatggggtggcact

SEQ ID NO: 40144 - DNA, 18 bp, Homo sapiens
actgtgatgggggaggct

SEQ ID NO: 40145 - DNA, 19 bp, Homo sapiens
ctgtggtggggcagtgaac

SEQ ID NO: 40146 - DNA, 21 bp, Homo sapiens
ccgactcagggcagcctactc

SEQ ID NO: 40147 - DNA, 18 bp, Homo sapiens
ctgggatggggcagccac

SEQ ID NO: 40148 - DNA, 19 bp, Homo sapiens
tgtgatggggcagttccca

SEQ ID NO: 40149 - DNA, 21 bp, Homo sapiens
tgtgatggggcggcagccccg

SEQ ID NO: 40150 - DNA, 19 bp, Homo sapiens
gtggtgccgcagcctactc

SEQ ID NO: 40151 - DNA, 81 bp, Ovine pulmonary adenocarcinoma virus
tttgtatttccctgtgtcgttcgtggtctcgttcgtgattttttaaagatgagagttgaaatgctacatatgaaatataga

SEQ ID NO: 40152 - DNA, 24 bp, Ovine pulmonary adenocarcinoma virus
aaagatgagagttgaaatgctaca

SEQ ID NO: 40153 - DNA, 19 bp, Homo sapiens
aaaatgaggtgccatgcta

SEQ ID NO: 40154 - DNA, 16 bp, Homo sapiens
tgggagttgaaccaca

SEQ ID NO: 40155 - DNA, 18 bp, Homo sapiens
aaaggtgagagttcaagc

SEQ ID NO: 40156 - DNA, 22 bp, Homo sapiens
agacattttctgaaatgctaca

SEQ ID NO: 40157 - DNA, 20 bp, Homo sapiens
aaagtgacgcttgaaatgct

SEQ ID NO: 40158 - DNA, 18 bp, Homo sapiens
aaagatagcaaaatgcta

SEQ ID NO: 40159 - DNA, 18 bp, Homo sapiens
aagatgagctgagatgct

SEQ ID NO: 40160 - DNA, 19 bp, Homo sapiens
aagatcagagttgactaac

SEQ ID NO: 40161 - DNA, 25 bp, Homo sapiens
aaaaatgagagcaagagaaatgcta

SEQ ID NO: 40162 - DNA, 18 bp, Homo sapiens
gatgaacaaaatgctaca

SEQ ID NO: 40163 - DNA, 23 bp, Homo sapiens
aaagatgggagttgaaggtttgc

SEQ ID NO: 40164 - DNA, 18 bp, Homo sapiens
ggaaatgagagctgttgc

SEQ ID NO: 40165 - DNA, 21 bp, Homo sapiens
aaagatcagggttgaaggtcc

SEQ ID NO: 40166 - DNA, 19 bp, Homo sapiens
ggagctgagagttgatggc

SEQ ID NO: 40167 - DNA, 20 bp, Homo sapiens
aaagatgatagtttatttac

SEQ ID NO: 40168 - DNA, 19 bp, Homo sapiens
agagggaagtgaatgctac

SEQ ID NO: 40169 - DNA, 23 bp, Homo sapiens
aaagatgagggtagtttgatatg

SEQ ID NO: 40170 - DNA, 18 bp, Homo sapiens
aagaagacaggatgctac

SEQ ID NO: 40171 - DNA, 18 bp, Homo sapiens
agatgagagtctgaaatg

SEQ ID NO: 40172 - DNA, 17 bp, Homo sapiens
aggggagagttggccac

SEQ ID NO: 40173 - DNA, 21 bp, Homo sapiens
aagatgagacgttgggttgct

SEQ ID NO: 40174 - DNA, 23 bp, Homo sapiens
aagatgagatgttgggaagtaca

SEQ ID NO: 40175 - DNA, 21 bp, Homo sapiens
aaaaatgagaggcctgctaca

SEQ ID NO: 40176 - DNA, 21 bp, Homo sapiens
aaagatgaagaagaaagtgct

SEQ ID NO: 40177 - DNA, 21 bp, Homo sapiens
aaagtggccaaagatgctaca

SEQ ID NO: 40178 - DNA, 20 bp, Homo sapiens
gatgggagctgaaggaaact

SEQ ID NO: 40179 - DNA, 19 bp, Homo sapiens
aaagataagggttggggcc

SEQ ID NO: 40180 - DNA, 18 bp, Homo sapiens
aaagatgaggtcttgcta

SEQ ID NO: 40181 - DNA, 18 bp, Homo sapiens
gatgaaagttgaagacca

SEQ ID NO: 40182 - DNA, 23 bp, Homo sapiens
aaagatgctaaggggatgctaca

SEQ ID NO: 40183 - DNA, 21 bp, Homo sapiens
aaagtgagagttgtgcctgct

SEQ ID NO: 40184 - DNA, 19 bp, Homo sapiens
gatgagagattgttaatgc

SEQ ID NO: 40185 - DNA, 22 bp, Homo sapiens
agatgggtagatagatgctaca

SEQ ID NO: 40186 - DNA, 18 bp, Homo sapiens
aagaagctgaggtgctac

SEQ ID NO: 40187 - DNA, 21 bp, Homo sapiens
aaaatgagaatttgtgctgca

SEQ ID NO: 40188 - DNA, 18 bp, Homo sapiens
aaagttggaaggtgctac

SEQ ID NO: 40189 - DNA, 20 bp, Homo sapiens
ggaagtgtcaggaaatgcta

SEQ ID NO: 40190 - DNA, 70 bp, Ovine pulmonary adenocarcinoma virus
ggcatatattcctgatccgccaatgattcaatccttaggatgggatagagaaattgtacctgtatatgtt

SEQ ID NO: 40191 - DNA, 24 bp, Ovine pulmonary adenocarcinoma virus
atagagaaattgtacctgtatatg

SEQ ID NO: 40192 - DNA, 22 bp, Homo sapiens
acagagaagttgtggaagctgt

SEQ ID NO: 40193 - DNA, 18 bp, Homo sapiens
gaaaaattggagtatatg

SEQ ID NO: 40194 - DNA, 20 bp, Homo sapiens
ataaaggaattgtacccagt

SEQ ID NO: 40195 - DNA, 17 bp, Homo sapiens
acagagaatctgtatgt

SEQ ID NO: 40196 - DNA, 19 bp, Homo sapiens
gaagagaaattgtgtctat

SEQ ID NO: 40197 - DNA, 17 bp, Homo sapiens
gaaaagttgacctgtat

SEQ ID NO: 40198 - DNA, 93 bp, Cowpox virus
tatatacgataagatatgtttattcataaacgcgtcaaatttttcatgaatcgctaatgagtttaagaatctcatgtcaaattgtcctatata

SEQ ID NO: 40199 - DNA, 93 bp, Cowpox virus; identical to SEQ ID NO: 40198

SEQ ID NO: 40200 - DNA, 18 bp, Homo sapiens
caagatatgtttattcat

SEQ ID NO: 40201 - DNA, 101 bp, Ovine pulmonary adenocarcinoma virus
gctgtcattaaatatttatcatctaaactgttctaattgtatacttactaactgtattagaggagtagccaaaggagaacaagttatcatagtaaaacagc

SEQ ID NO: 40202 - DNA, 24 bp, Ovine pulmonary adenocarcinoma virus
taaactgttctaattgtatactta

SEQ ID NO: 40203 - DNA, 18 bp, Homo sapiens
tgactgaattgtatactt

SEQ ID NO: 40204 - DNA, 25 bp, Homo sapiens
taaactattctgtgtcttgtgctta

SEQ ID NO: 40205 - DNA, 19 bp, Homo sapiens
ctgtgatcttgtatactta

SEQ ID NO: 40206 - DNA, 20 bp, Homo sapiens
aactgttctagttactactt

SEQ ID NO: 40207 - DNA, 24 bp, Homo sapiens
taaactgttttaatataaatactt

SEQ ID NO: 40208 - DNA, 15 bp, Homo sapiens
taaactgttctgcat

SEQ ID NO: 40209 - DNA, 19 bp, Homo sapiens
taaactgttttgcatgctt

SEQ ID NO: 40210 - DNA, 17 bp, Homo sapiens
ctgttctagtactctta

SEQ ID NO: 40211 - DNA, 21 bp, Homo sapiens
aactgttctgaccttttgctt

SEQ ID NO: 40212 - DNA, 20 bp, Homo sapiens
taaactgtgctacccatata

SEQ ID NO: 40213 - DNA, 22 bp, Homo sapiens
taaactgctctgagacacgctt

SEQ ID NO: 40214 - DNA, 19 bp, Homo sapiens
taaactattctaaagactt

SEQ ID NO: 40215 - DNA, 64 bp, Cowpox virus
aatggtagcgcatctttaactcgtcagttagctctttcttttgatcgagttcgtcgctactatt

SEQ ID NO: 40216 - DNA, 24 bp, Cowpox virus
tttgatcgagttcgtcgctactat

SEQ ID NO: 40217 - DNA, 21 bp, Homo sapiens
tttgatagggttggctactat

SEQ ID NO: 40218 - DNA, 15 bp, Homo sapiens
tttgatcaggctact

SEQ ID NO: 40219 - DNA, 80 bp, Friend murine leukemia virus
taggggacctcggatatcgggcctcggccaagaaagcccaaatttgccagaaacaggtcaagtatctggggtatcttcta

SEQ ID NO: 40220 - DNA, 24 bp, Friend murine leukemia virus
tttgccagaaacaggtcaagtatc

SEQ ID NO: 40221 - DNA, 17 bp, Homo sapiens
tttgttagaaacagaca

SEQ ID NO: 40222 - DNA, 23 bp, Homo sapiens
tttgccaaaagaattcgagtatc

SEQ ID NO: 40223 - DNA, 21 bp, Homo sapiens
tttgtagaaacaggttcccat

SEQ ID NO: 40224 - DNA, 20 bp, Homo sapiens
tttgccaaaaataatcgtat

SEQ ID NO: 40225 - DNA, 18 bp, Homo sapiens
agaaacaggggaagtatc

SEQ ID NO: 40226 - DNA, 22 bp, Homo sapiens
tttgcagatgcattcaagtatc

SEQ ID NO: 40227 - DNA, 15 bp, Homo sapiens
tttgccagaaaagta

SEQ ID NO: 40228 - DNA, 19 bp, Homo sapiens
tttgccaggaaatagggtc

SEQ ID NO: 40229 - DNA, 24 bp, Homo sapiens
tctgccaggggtggtcgcagtatc

SEQ ID NO: 40230 - DNA, 18 bp, Homo sapiens
cagagaggtttcaagtat

SEQ ID NO: 40231 - DNA, 20 bp, Homo sapiens
cttgacactgtaggtcaagt

SEQ ID NO: 40232 - DNA, 19 bp, Homo sapiens
tttgctgtgggtcaagtat

SEQ ID NO: 40233 - DNA, 19 bp, Homo sapiens
tttgcaggaaacaggaatc

SEQ ID NO: 40234 - DNA, 20 bp, Homo sapiens
tttgttcaacaaggtcaagt

SEQ ID NO: 40235 - DNA, 20 bp, Homo sapiens
tttgccagtgacagtctgtc

SEQ ID NO: 40236 - DNA, 20 bp, Homo sapiens
tgccagaaactgctctaagt

SEQ ID NO: 40237 - DNA, 18 bp, Homo sapiens
tttgccagcagcaagtat

SEQ ID NO: 40238 - DNA, 87 bp, Friend murine leukemia virus
ctgaggaggggctgcaacatgactgccttgacatcttggctgaagcccacggaactagaccagatcttacggaccagcctctcccag

SEQ ID NO: 40239 - DNA, 87 bp, Friend murine leukemia virus; identical to SEQ ID NO: 40238

SEQ ID NO: 40240 - DNA, 23 bp, Homo sapiens
tcttacagatctcacacttccag

SEQ ID NO: 40241 - DNA, 18 bp, Homo sapiens
tcttgaagaccagcctct

SEQ ID NO: 40242 - DNA, 18 bp, Homo sapiens
cacaccagcctctcccag

SEQ ID NO: 40243 - DNA, 20 bp, Homo sapiens
tcttagggaaagtctcccag

SEQ ID NO: 40244 - DNA, 21 bp, Homo sapiens
tcttacagggccagggctgct

SEQ ID NO: 40245 - DNA, 20 bp, Homo sapiens
gacccagaagcctctcccag

SEQ ID NO: 40246 - DNA, 18 bp, Homo sapiens
ccttcgcagcagcctctc

SEQ ID NO: 40247 - DNA, 17 bp, Homo sapiens
cttaggagcctctctca

SEQ ID NO: 40248 - DNA, 16 bp, Homo sapiens
tcttgcggagcctccc

SEQ ID NO: 40249 - DNA, 18 bp, Homo sapiens
tcttacggccgcgcgctc

SEQ ID NO: 40250 - DNA, 20 bp, Homo sapiens
tctctgagggtctctcccag

SEQ ID NO: 40251 - DNA, 18 bp, Homo sapiens
tcttagattcctctccca

SEQ ID NO: 40252 - DNA, 20 bp, Homo sapiens
tcttgggggcactctcccag

SEQ ID NO: 40253 - DNA, 20 bp, Homo sapiens
ccttatgctacctctcccag

SEQ ID NO: 40254 - DNA, 20 bp, Homo sapiens
tctcacagtgcttcttccag

SEQ ID NO: 40255 - DNA, 22 bp, Homo sapiens
tcttacaggaagtcttctctcc

SEQ ID NO: 40256 - DNA, 19 bp, Homo sapiens
ttacagactggctcttcag

SEQ ID NO: 40257 - DNA, 18 bp, Homo sapiens
tctgcagggcctctccca

SEQ ID NO: 40258 - DNA, 19 bp, Homo sapiens
tctgcggaccaagctttct

SEQ ID NO: 40259 - DNA, 20 bp, Homo sapiens
cttcgtgagccagcctctcc

SEQ ID NO: 40260 - DNA, 17 bp, Homo sapiens
tcttgggatgcctccca

SEQ ID NO: 40261 - DNA, 24 bp, Homo sapiens
tcttgtggtcagtggctgccccag

SEQ ID NO: 40262 - DNA, 22 bp, Homo sapiens
tcttacagagattccttttctc

SEQ ID NO: 40263 - DNA, 18 bp, Homo sapiens
ggaccagccgccgcccag

SEQ ID NO: 40264 - DNA, 20 bp, Homo sapiens
tcttctgccagcccctctcc

SEQ ID NO: 40265 - DNA, 23 bp, Homo sapiens
tctcacgggttagtatctctcag

SEQ ID NO: 40266 - DNA, 61 bp, Camelpox virus
gttactattatttataactgatgtaacccacgtaacattagaattaattatcgatagtaat

SEQ ID NO: 40267 - DNA, 24 bp, Camelpox virus
tattatttataactgatgtaaccc

SEQ ID NO: 40268 - DNA, 21 bp, Homo sapiens
tattacttataactgaataac

SEQ ID NO: 40269 - DNA, 19 bp, Homo sapiens
tattatttaagccactgat

SEQ ID NO: 40270 - DNA, 23 bp, Homo sapiens
tattatttaagtgataatgaccc

SEQ ID NO: 40271 - DNA, 16 bp, Homo sapiens
tatttatgatgcaacc

SEQ ID NO: 40272 - DNA, 19 bp, Homo sapiens
tttgcaactgatgtggtcc

SEQ ID NO: 40273 - DNA, 19 bp, Homo sapiens
tactatttataactgaagc

SEQ ID NO: 40274 - DNA, 19 bp, Homo sapiens
tatttacaccatgtaaccc

SEQ ID NO: 40275 - DNA, 18 bp, Homo sapiens
tattatttgaaactgata

SEQ ID NO: 40276 - DNA, 21 bp, Homo sapiens
tcatttatgatgtatataacc

SEQ ID NO: 40277 - DNA, 22 bp, Homo sapiens
ttatttatagctctatgtgccc

SEQ ID NO: 40278 - DNA, 21 bp, Homo sapiens
tattatttatgacctgatata

SEQ ID NO: 40279 - DNA, 74 bp, Human herpesvirus 2
cgcgcacatctgccgtctgcgcaacaccgcgtccgtcaaggtgctgttggggcgcaagagcgacagcgagcgcg

SEQ ID NO: 40280 - DNA, 24 bp, Human herpesvirus 2
tgctgttggggcgcaagagcgaca

SEQ ID NO: 40281 - DNA, 19 bp, Homo sapiens
tgctggtggggcgtgggca

SEQ ID NO: 40282 - DNA, 18 bp, Homo sapiens
tgttgttggggctcaggc

SEQ ID NO: 40283 - DNA, 16 bp, Homo sapiens
gctgttggggcggcgc

SEQ ID NO: 40284 - DNA, 24 bp, Homo sapiens
tgctgcttggggtcatgggtggcg

SEQ ID NO: 40285 - DNA, 20 bp, Homo sapiens
tgctgttggagcggccggcg

SEQ ID NO: 40286 - DNA, 17 bp, Homo sapiens
ctgttgttaagagcgac

SEQ ID NO: 40287 - DNA, 17 bp, Homo sapiens
tgctgctggcagagtga

SEQ ID NO: 40288 - DNA, 24 bp, Homo sapiens
tgctgttggggagggcggagggcg

SEQ ID NO: 40289 - DNA, 126 bp, Friend murine leukemia virus
gagactgtgatggggcagcctactccgaagacccctcgacaactaagggagttcctagggacggcaggcttctgtcgcctctggatccctgggtttgcagaaatggcagcccccttgtaccctctc

SEQ ID NO: 40290 - DNA, 24 bp, Friend murine leukemia virus
tgtgatggggcagcctactccgaa

SEQ ID NO: 40291 - DNA, 18 bp, Homo sapiens
tgtgatggagctctctga

SEQ ID NO: 40292 - DNA, 17 bp, Homo sapiens
tgtgtggggcagggccg

SEQ ID NO: 40293 - DNA, 19 bp, Homo sapiens
tggggaagcttattctgaa

SEQ ID NO: 40294 - DNA, 20 bp, Homo sapiens
gtgatggggcaggaatctga

SEQ ID NO: 40295 - DNA, 18 bp, Homo sapiens
tgcggtggggcagggctc

SEQ ID NO: 40296 - DNA, 22 bp, Homo sapiens
tgtgagggggcagcgctcactc

SEQ ID NO: 40297 - DNA, 19 bp, Homo sapiens
tgtgacggggtggcttcta

SEQ ID NO: 40298 - DNA, 20 bp, Homo sapiens
tgtgatagggtggtaagccc

SEQ ID NO: 40299 - DNA, 18 bp, Homo sapiens
tgtgatgggttggcctct

SEQ ID NO: 40300 - DNA, 19 bp, Homo sapiens
tgtgttggggcagctgctc

SEQ ID NO: 40301 - DNA, 16 bp, Homo sapiens
tggatggggcccctct

SEQ ID NO: 40302 - DNA, 19 bp, Homo sapiens
tgtgtggggcaggggcact

SEQ ID NO: 40303 - DNA, 19 bp, Homo sapiens
gtgatggggcagtttccca

SEQ ID NO: 40304 - DNA, 19 bp, Homo sapiens
tgtgatggacatattctga

SEQ ID NO: 40305 - DNA, 68 bp, Human herpesvirus 2
ggcggcgatcttccacgcgctcctcaacgccacgacgtaccgggacctggaggaggactggcgccgcc

SEQ ID NO: 40306 - DNA, 24 bp, Human herpesvirus 2
acgcgctcctcaacgccacgacgt

SEQ ID NO: 40307 - DNA, 25 bp, Homo sapiens
cgcgctcctcgccgctgcccagcgt

SEQ ID NO: 40308 - DNA, 21 bp, Homo sapiens
cgcgccccttgacgtcaccgc

SEQ ID NO: 40309 - DNA, 24 bp, Homo sapiens
gcgtcctgcggcacgccacggcgt

SEQ ID NO: 40310 - DNA, 19 bp, Homo sapiens
accgctcttcggcccaacg

SEQ ID NO: 40311 - DNA, 18 bp, Homo sapiens
gctcctcaggctcggcgt

SEQ ID NO: 40312 - DNA, 15 bp, Homo sapiens
gcgctcctcacgacg

SEQ ID NO: 40313 - DNA, 93 bp, Camelpox virus
tatatacgataagatatgtttattcataaacgcgtcaaatttttcatgaatcgctaaggagtttaagaatctcatgtcaaattgtcctatata

SEQ ID NO: 40314 - DNA, 78 bp, Camelpox virus
agcggttgtagatttatcatatttctccactacatatccgttacaatttgttaagaatttagatacatctatattgct

SEQ ID NO: 40315 - DNA, 78 bp, Camelpox virus; identical to SEQ ID NO: 40314

SEQ ID NO: 40316 - DNA, 19 bp, Homo sapiens
taagaatttagaaatcatc

SEQ ID NO: 40317 - DNA, 20 bp, Homo sapiens
agaattcagatatttatatt

SEQ ID NO: 40318 - DNA, 25 bp, Homo sapiens
taagaatttagtaacgtcatatatt

SEQ ID NO: 40319 - DNA, 23 bp, Homo sapiens
taaaaataaaatatatctatatt

SEQ ID NO: 40320 - DNA, 19 bp, Homo sapiens
taagggtctagatacaact

SEQ ID NO: 40321 - DNA, 81 bp, Rauscher murine leukemia virus
ctggggccttggcgtcggccggtggcctacctgtccaaaaagctagacccagtggccgctgggtggcccccttgcctacgg

SEQ ID NO: 40322 - DNA, 24 bp, Rauscher murine leukemia virus
tggcgtcggccggtggcctacctg

SEQ ID NO: 40323 - DNA, 19 bp, Homo sapiens
tgggacaggtggtctacct

SEQ ID NO: 40324 - DNA, 16 bp, Homo sapiens
tggcggcagatggcct

SEQ ID NO: 40325 - DNA, 22 bp, Homo sapiens
tggtgtggtatgatcctacctg

SEQ ID NO: 40326 - DNA, 17 bp, Homo sapiens
tggtgtggccggcgtct

SEQ ID NO: 40327 - DNA, 20 bp, Homo sapiens
tggcgtcggccgcccggcct

SEQ ID NO: 40328 - DNA, 20 bp, Homo sapiens
gcagggtggtggcctgtctg

SEQ ID NO: 40329 - DNA, 87 bp, Rauscher murine leukemia virus
ctgaggaggggctgcaacatgactgccttgacatcttggctgaagcccacggaactagaccagatcttacggatcagcctctcccag

SEQ ID NO: 40330 - DNA, 23 bp, Rauscher murine leukemia virus
tcttacggatcagcctctcccag

SEQ ID NO: 40331 - DNA, 19 bp, Homo sapiens
caacatcagtctttcccag

SEQ ID NO: 40332 - DNA, 16 bp, Homo sapiens
cagaagcctctcccag

SEQ ID NO: 40333 - DNA, 20 bp, Homo sapiens
tcttgatgattttctcccag

SEQ ID NO: 40334 - DNA, 20 bp, Homo sapiens
tctctgacagtctttcccag

SEQ ID NO: 40335 - DNA, 21 bp, Homo sapiens
tctcgtgagtctttctcccag

SEQ ID NO: 40336 - DNA, 17 bp, Homo sapiens
tcttgtggatcaactct

SEQ ID NO: 40337 - DNA, 21 bp, Homo sapiens
tcttccggatcaaattcccag

SEQ ID NO: 40338 - DNA, 17 bp, Homo sapiens
tcttgtcatgcctctcc

SEQ ID NO: 40339 - DNA, 19 bp, Homo sapiens
ttacagatcagtggcctcc

SEQ ID NO: 40340 - DNA, 17 bp, Homo sapiens
tctccatggcctctccc

SEQ ID NO: 40341 - DNA, 60 bp, Human papillomavirus type 84
tggcacgtgtacatataccaaaaggcattgtagccacacttggtagtatgtctatggtta

SEQ ID NO: 40342 - DNA, 17 bp, Human papillomavirus type 84
tagtatgtctatggtta

SEQ ID NO: 40343 - DNA, 18 bp, Homo sapiens
tagtatatgagatggtta

SEQ ID NO: 40344 - DNA, 19 bp, Homo sapiens
cagctatggtctatggtta

SEQ ID NO: 40345 - DNA, 18 bp, Homo sapiens
taatatgtactgtggtta

SEQ ID NO: 40346 - DNA, 61 bp, Human herpesvirus 7
gtttaaaaaatccaaaattcttaatagaaatttattgtgaaatttaaaagattttgtaaat

SEQ ID NO: 40347 - DNA, 24 bp, Human herpesvirus 7
tccaaaattcttaatagaaattta

SEQ ID NO: 40348 - DNA, 18 bp, Homo sapiens
tccaaaatattttaatag

SEQ ID NO: 40349 - DNA, 22 bp, Homo sapiens
cccgactcttggtagaaattta

SEQ ID NO: 40350 - DNA, 25 bp, Homo sapiens
tccaggattcttaatgcaataattt

SEQ ID NO: 40351 - DNA, 18 bp, Homo sapiens
tccaaaattttgaataga

SEQ ID NO: 40352 - DNA, 68 bp, Maize chlorotic mottle virus
ccgcagagtgttccggattgcaggtttgggcaacctgtatgaatttggagtccacaacaactctgcgg

SEQ ID NO: 40353 - DNA, 18 bp, Maize chlorotic mottle virus
tccacaacaactctgcgg

SEQ ID NO: 40354 - DNA, 22 bp, Homo sapiens
tccacaacccagggctctgtgg

SEQ ID NO: 40355 - DNA, 19 bp, Homo sapiens
tccacaacacacaccacgg

SEQ ID NO: 40356 - DNA, 18 bp, Homo sapiens
tcccagcaagccccgcgg

SEQ ID NO: 40357 - DNA, 18 bp, Homo sapiens
tcccagcaggccccgcgg

SEQ ID NO: 40358 - DNA, 19 bp, Homo sapiens
cccacagcaagccccgcgg

SEQ ID NO: 40359 - DNA, 18 bp, Homo sapiens
tccacaaaaactgcttgg

SEQ ID NO: 40360 - DNA, 18 bp, Homo sapiens
tccacaacaagctttgca

SEQ ID NO: 40361 - DNA, 19 bp, Homo sapiens
cccacaactgagcctgcgg

SEQ ID NO: 40362 - DNA, 19 bp, Homo sapiens
tccacaacagtctctgtgg

SEQ ID NO: 40363 - DNA, 24 bp, Homo sapiens
tccaccgcaggtcacttctgcggc

SEQ ID NO: 40364 - DNA, 15 bp, Homo sapiens
tccacaacaacacag

SEQ ID NO: 40365 - DNA, 16 bp, Homo sapiens
cccacaacccctgcgg

SEQ ID NO: 40366 - DNA, 19 bp, Homo sapiens
tcccagcaactctagctgg

SEQ ID NO: 40367 - DNA, 17 bp, Homo sapiens
tccacagcagctcccag

SEQ ID NO: 40368 - DNA, 17 bp, Homo sapiens
cccacaacagtccccgg

SEQ ID NO: 40369 - DNA, 16 bp, Homo sapiens
tccgcaacccccgcgg

SEQ ID NO: 40370 - DNA, 17 bp, Homo sapiens
tccgaacagccctgcgg

SEQ ID NO: 40371 - DNA, 22 bp, Homo sapiens
tccacaaacgacttgtctgtgg

SEQ ID NO: 40372 - DNA, 17 bp, Homo sapiens
cccacaactgcctgcgg

SEQ ID NO: 40373 - DNA, 21 bp, Homo sapiens
cccacagcatccactctgtgg

SEQ ID NO: 40374 - DNA, 18 bp, Homo sapiens
cccacagcaagctgctgg

SEQ ID NO: 40375 - DNA, 84 bp, Maize chlorotic mottle virus
tcaacaatggagatgacaacgtcctgatctgtccggcagtggaggtaggcagagtcagacaggaactgtacagacattggttga

SEQ ID NO: 40376 - DNA, 24 bp, Maize chlorotic mottle virus
agacaggaactgtacagacattgg

SEQ ID NO: 40377 - DNA, 23 bp, Homo sapiens
agaaagggaagcccagacattgg

SEQ ID NO: 40378 - DNA, 23 bp, Homo sapiens
agacaggagttgatgtgcaatgg

SEQ ID NO: 40379 - DNA, 22 bp, Homo sapiens
gaaggagttgtccagacattgg

SEQ ID NO: 40380 - DNA, 15 bp, Homo sapiens
gacaggcgcgacatt

SEQ ID NO: 40381 - DNA, 23 bp, Homo sapiens
agacagaaactgtaagccattgg

SEQ ID NO: 40382 - DNA, 22 bp, Homo sapiens
agacagaatttcaccatgttgg

SEQ ID NO: 40383 - DNA, 22 bp, Homo sapiens
agacaggatttcaccatgttgg

SEQ ID NO: 40384 - DNA, 21 bp, Homo sapiens
aaacaggaattgtgtaactgg

SEQ ID NO: 40385 - DNA, 19 bp, Homo sapiens
agacaggaagtgtacgatg

SEQ ID NO: 40386 - DNA, 19 bp, Homo sapiens
aaacaggaattccacattg

SEQ ID NO: 40387 - DNA, 24 bp, Homo sapiens
aggcaggaactgtagcagctcagg

SEQ ID NO: 40388 - DNA, 22 bp, Homo sapiens
agacagggtttcaccatattgg

SEQ ID NO: 40389 - DNA, 22 bp, Homo sapiens
agacaggatttcaccatattgg

SEQ ID NO: 40390 - DNA, 19 bp, Homo sapiens
agataggaactgtgacatt

SEQ ID NO: 40391 - DNA, 18 bp, Homo sapiens
aggcaggggtggacattg

SEQ ID NO: 40392 - DNA, 22 bp, Homo sapiens
agacagggtttcgccatgttgg

SEQ ID NO: 40393 - DNA, 18 bp, Homo sapiens
gacaggaagttgacgttg

SEQ ID NO: 40394 - DNA, 20 bp, Homo sapiens
gggcacaggtcagacattgg

SEQ ID NO: 40395 - DNA, 21 bp, Homo sapiens
gacagcaacaggagacattgg

SEQ ID NO: 40396 - DNA, 24 bp, Homo sapiens
aggcaagaactgtgcctagcttgg

SEQ ID NO: 40397 - DNA, 18 bp, Homo sapiens
gacaggaagttgacattg

SEQ ID NO: 40398 - DNA, 18 bp, Homo sapiens
gacaggaagttgatgttg

SEQ ID NO: 40399 - DNA, 16 bp, Homo sapiens
caggagtcagacattg

SEQ ID NO: 40400 - DNA, 19 bp, Homo sapiens
aggcaagagctaaacattg

SEQ ID NO: 40401 - DNA, 20 bp, Homo sapiens
aggaggtgctcggacattgg

SEQ ID NO: 40402 - DNA, 60 bp, Murine type C retrovirus
gaaatattcccaagattcgggatgccacaggtattgggttccgataatgggcctgccttc

SEQ ID NO: 40403 - DNA, 24 bp, Murine type C retrovirus
tcccaagattcgggatgccacagg

SEQ ID NO: 40404 - DNA, 26 bp, Homo sapiens
cctcaggattcgggagaaattgcagg

SEQ ID NO: 40405 - DNA, 22 bp, Homo sapiens
ccaagactttgggcagtgcagg

SEQ ID NO: 40406 - DNA, 18 bp, Homo sapiens
gactcagggtgtcacagg

SEQ ID NO: 40407 - DNA, 17 bp, Homo sapiens
cccagcgggtgccacag

SEQ ID NO: 40408 - DNA, 26 bp, Homo sapiens
tcccgggattggagagcagccatagg

SEQ ID NO: 40409 - DNA, 18 bp, Homo sapiens
tcccaagagtggtcacag

SEQ ID NO: 40410 - DNA, 19 bp, Homo sapiens
tcccaggatctgggcacag

SEQ ID NO: 40411 - DNA, 19 bp, Homo sapiens
ccaagagtctagccgcagg

SEQ ID NO: 40412 - DNA, 19 bp, Homo sapiens
ccaagacggatgttgcagg

SEQ ID NO: 40413 - DNA, 22 bp, Homo sapiens
cccaaggcaaagatgccacagg

SEQ ID NO: 40414 - DNA, 24 bp, Homo sapiens
tcccaagagtgcgtattgctgcgg

SEQ ID NO: 40415 - DNA, 20 bp, Homo sapiens
tcccaggatggtgttgcagg

SEQ ID NO: 40416 - DNA, 18 bp, Homo sapiens
tcccaggatccggagcag

SEQ ID NO: 40417 - DNA, 20 bp, Homo sapiens
caagatttaggtgcgttagg

SEQ ID NO: 40418 - DNA, 20 bp, Homo sapiens
ccagggacaggtgccacagg

SEQ ID NO: 40419 - DNA, 20 bp, Homo sapiens
tcccaagatggtgctacagg

SEQ ID NO: 40420 - DNA, 21 bp, Homo sapiens
ccaagattccaaacccacagg

SEQ ID NO: 40421 - DNA, 24 bp, Homo sapiens
tctgaaatccagggatgctgcagg

SEQ ID NO: 40422 - DNA, 23 bp, Homo sapiens
tcccaggattcttcccttacagg

SEQ ID NO: 40423 - DNA, 20 bp, Homo sapiens
caggattatgatgtcacagg

SEQ ID NO: 40424 - DNA, 21 bp, Homo sapiens
tcccaagactctcactgcagg

SEQ ID NO: 40425 - DNA, 18 bp, Homo sapiens
tcccaggattccgagcag

SEQ ID NO: 40426 - DNA, 24 bp, Homo sapiens
tcccagggttgaagtcgccacagg

SEQ ID NO: 40427 - DNA, 25 bp, Homo sapiens
tcccaggatatctaccccccacagg

SEQ ID NO: 40428 - DNA, 64 bp, Maize chlorotic mottle virus
agagtggcttggggtgcagtctcggcgcacacgtgcgcggcaccccaaactccgtagccacttt

SEQ ID NO: 40429 - DNA, 24 bp, Maize chlorotic mottle virus
cggcaccccaaactccgtagccac

SEQ ID NO: 40430 - DNA, 25 bp, Homo sapiens
caccccaactttagctccgtagtca

SEQ ID NO: 40431 - DNA, 23 bp, Homo sapiens
ggcttcctaaaagacatagccac

SEQ ID NO: 40432 - DNA, 18 bp, Homo sapiens
cggcaccccacgctgcca

SEQ ID NO: 40433 - DNA, 20 bp, Homo sapiens
cgacaccctggactcccggc

SEQ ID NO: 40434 - DNA, 21 bp, Homo sapiens
gcactccaatacagtagccac

SEQ ID NO: 40435 - DNA, 18 bp, Homo sapiens
cgggccccagactcccca

SEQ ID NO: 40436 - DNA, 23 bp, Homo sapiens
gcattccaaactcctagttccac

SEQ ID NO: 40437 - DNA, 20 bp, Homo sapiens
cggagccccaaacccgtcgc

SEQ ID NO: 40438 - DNA, 22 bp, Homo sapiens
cggctcccgtcgccgtagccac

SEQ ID NO: 40439 - DNA, 22 bp, Homo sapiens
ggtcccccaaacaacaagctac

SEQ ID NO: 40440 - DNA, 18 bp, Homo sapiens
ggcactacagctccgtag

SEQ ID NO: 40441 - DNA, 24 bp, Homo sapiens
caccttccacagctttgtggccac

SEQ ID NO: 40442 - DNA, 21 bp, Homo sapiens
cagtgccccaaacactgccac

SEQ ID NO: 40443 - DNA, 18 bp, Homo sapiens
gggaccccagcatagcca

SEQ ID NO: 40444 - DNA, 23 bp, Homo sapiens
ggcactccgcactgaaacaccgt

SEQ ID NO: 40445 - DNA, 24 bp, Homo sapiens
ggtgccccaaaccatcagcgtcac

SEQ ID NO: 40446 - DNA, 23 bp, Homo sapiens
cggacaccccatcctgtagccac

SEQ ID NO: 40447 - DNA, 17 bp, Homo sapiens
gcaccccaaacttcagc

SEQ ID NO: 40448 - DNA, 18 bp, Homo sapiens
cggcaccccaggtttcca

SEQ ID NO: 40449 - DNA, 17 bp, Homo sapiens
gcaccccaagctgctgc

SEQ ID NO: 40450 - DNA, 21 bp, Homo sapiens
ggcaccccaggatcaccccat

SEQ ID NO: 40451 - DNA, 19 bp, Homo sapiens
ggtatcccaaactccagcc

SEQ ID NO: 40452 - DNA, 21 bp, Homo sapiens
cagtgtcccaaactccttcac

SEQ ID NO: 40453 - DNA, 18 bp, Homo sapiens
ggcaactcagggcagcca

SEQ ID NO: 40454 - DNA, 23 bp, Homo sapiens
ggtgccacattctttgtagccac

SEQ ID NO: 40455 - DNA, 20 bp, Homo sapiens
cggcacccaaaactttccgc

SEQ ID NO: 40456 - DNA, 20 bp, Homo sapiens
ggaccccaaagcagggccac

SEQ ID NO: 40457 - DNA, 22 bp, Homo sapiens
cgggccccaaacgggaagtcac

SEQ ID NO: 40458 - DNA, 20 bp, Homo sapiens
gacaccccagaggaagccac

SEQ ID NO: 40459 - DNA, 18 bp, Homo sapiens
ggcggcccaaactccggc

SEQ ID NO: 40460 - DNA, 17 bp, Homo sapiens
ggcaccttcccgtagcc

SEQ ID NO: 40461 - DNA, 20 bp, Homo sapiens
cagcaccccgagtctgtcgc

SEQ ID NO: 40462 - DNA, 22 bp, Homo sapiens
ggcacccctaggcactggccgt

SEQ ID NO: 40463 - DNA, 20 bp, Homo sapiens
cggcaccctgggccaggcca

SEQ ID NO: 40464 - DNA, 22 bp, Homo sapiens
cggctcctccagccgtagccac

SEQ ID NO: 40465 - DNA, 21 bp, Homo sapiens
cggcacccccggctcccccac

SEQ ID NO: 40466 - DNA, 21 bp, Homo sapiens
cgacacccggattgtggccac

SEQ ID NO: 40467 - DNA, 21 bp, Homo sapiens
cgggcccgctgtcgtagccac

SEQ ID NO: 40468 - DNA, 18 bp, Homo sapiens
cggcaccctgaactcggt

SEQ ID NO: 40469 - DNA, 17 bp, Homo sapiens
ggcatccaaagcagcca

SEQ ID NO: 40470 - DNA, 60 bp, Human papillomavirus type 84
tagtggtgtttgagcgtggtgatgtaggtctttttactattattttgcttttaattgtta

SEQ ID NO: 40471 - DNA, 24 bp, Human papillomavirus type 84
tttgagcgtggtgatgtaggtctt

SEQ ID NO: 40472 - DNA, 23 bp, Homo sapiens
tttgagatgtggaaccaggtctt

SEQ ID NO: 40473 - DNA, 23 bp, Homo sapiens
tttgagctgatctagtaggtctt

SEQ ID NO: 40474 - DNA, 73 bp, Maize chlorotic mottle virus
cgagagacgtttctcgcttactatacagggccaaagcgcaccatgtatgagaaagcggtgaattccctctacg

SEQ ID NO: 40475 - DNA, 24 bp, Maize chlorotic mottle virus
tgagaaagcggtgaattccctcta

SEQ ID NO: 40476 - DNA, 19 bp, Homo sapiens
tgagatggctcttccctct

SEQ ID NO: 40477 - DNA, 19 bp, Homo sapiens
agaaagcatgctttcttct

SEQ ID NO: 40478 - DNA, 18 bp, Homo sapiens
tgagaagtggaactcccc

SEQ ID NO: 40479 - DNA, 24 bp, Homo sapiens
tgagaaagttgtgaatcagttcct

SEQ ID NO: 40480 - DNA, 22 bp, Homo sapiens
taagaagtacaaattccttcta

SEQ ID NO: 40481 - DNA, 17 bp, Homo sapiens
taagaaagtggttccct

SEQ ID NO: 40482 - DNA, 15 bp, Homo sapiens
tgagaaagggattcc

SEQ ID NO: 40483 - DNA, 21 bp, Homo sapiens
gagaaacagtgattccttcta

SEQ ID NO: 40484 - DNA, 24 bp, Homo sapiens
tgagaaagagcctttgtttctcta

SEQ ID NO: 40485 - DNA, 18 bp, Homo sapiens
tgggagagtggcgaattc

SEQ ID NO: 40486 - DNA, 19 bp, Homo sapiens
tgagaaagtggcgttctct

SEQ ID NO: 40487 - DNA, 18 bp, Homo sapiens
tgaggagctggtgaattc

SEQ ID NO: 40488 - DNA, 20 bp, Homo sapiens
gaggttggtatttcccctct

SEQ ID NO: 40489 - DNA, 20 bp, Homo sapiens
gaggaacagcaattctttct

SEQ ID NO: 40490 - DNA, 16 bp, Homo sapiens
taagaaagaattccct

SEQ ID NO: 40491 - DNA, 20 bp, Homo sapiens
agaaagccattcaatttcct

SEQ ID NO: 40492 - DNA, 20 bp, Homo sapiens
gagaaagtggtgatcatcta

SEQ ID NO: 40493 - DNA, 17 bp, Homo sapiens
tgagaaaggacatccct

SEQ ID NO: 40494 - DNA, 19 bp, Homo sapiens
gagggcctgagttccctct

SEQ ID NO: 40495 - DNA, 22 bp, Homo sapiens
tgggagagcgctggcagctcta

SEQ ID NO: 40496 - DNA, 16 bp, Homo sapiens
tgaaaagtggcccctc

SEQ ID NO: 40497 - DNA, 18 bp, Homo sapiens
tgagaaagcggtgggctc

SEQ ID NO: 40498 - DNA, 20 bp, Homo sapiens
tggaagcaatgatattccct

SEQ ID NO: 40499 - DNA, 22 bp, Homo sapiens
tgagaaaatggtttcttttcta

SEQ ID NO: 40500 - DNA, 20 bp, Homo sapiens
gagggagtgaatttcctcta

SEQ ID NO: 40501 - DNA, 21 bp, Homo sapiens
gaaagggccaggttccctcta

SEQ ID NO: 40502 - DNA, 17 bp, Homo sapiens
gagagccgtttccctct

SEQ ID NO: 40503 - DNA, 23 bp, Homo sapiens
tgacaaagcagtctttttctcta

SEQ ID NO: 40504 - DNA, 21 bp, Homo sapiens
tgagaaaacagtggattccct

SEQ ID NO: 40505 - DNA, 19 bp, Homo sapiens
taagaaagttccgatttcc

SEQ ID NO: 40506 - DNA, 16 bp, Homo sapiens
tgaggcggcttccctc

SEQ ID NO: 40507 - DNA, 19 bp, Homo sapiens
aagaccactggttccctct

SEQ ID NO: 40508 - DNA, 108 bp, Murine type C retrovirus
gagacctagcagacttccggatccagcacccagacttgatcctgctacagtacgtggatgacttactgctggccgctacttccgaactagactgccaacaaggtactc

SEQ ID NO: 40509 - DNA, 24 bp, Murine type C retrovirus
cagcacccagacttgatcctgcta

SEQ ID NO: 40510 - DNA, 20 bp, Homo sapiens
cacccagagccctgcctgct

SEQ ID NO: 40511 - DNA, 19 bp, Homo sapiens
cagtgccatctgtcctgct

SEQ ID NO: 40512 - DNA, 21 bp, Homo sapiens
cagccccaggcttggaccctg

SEQ ID NO: 40513 - DNA, 18 bp, Homo sapiens
cagcacccaagtactgct

SEQ ID NO: 40514 - DNA, 22 bp, Homo sapiens
cagaacccagacttgaaacctg

SEQ ID NO: 40515 - DNA, 18 bp, Homo sapiens
cagcacccgctttctgct

SEQ ID NO: 40516 - DNA, 20 bp, Homo sapiens
ccagactttgtttctctgct

SEQ ID NO: 40517 - DNA, 16 bp, Homo sapiens
agacccactgatcctg

SEQ ID NO: 40518 - DNA, 22 bp, Homo sapiens
cagcaactcaacagattctgct

SEQ ID NO: 40519 - DNA, 16 bp, Homo sapiens
caacatccaatcctgc

SEQ ID NO: 40520 - DNA, 21 bp, Homo sapiens
gccttcaggtaatccctgcta

SEQ ID NO: 40521 - DNA, 16 bp, Homo sapiens
cagccctagctcctgc

SEQ ID NO: 40522 - DNA, 20 bp, Homo sapiens
cagtgcctgggtccctgcta

SEQ ID NO: 40523 - DNA, 20 bp, Homo sapiens
agctcagacctgtgcctgct

SEQ ID NO: 40524 - DNA, 16 bp, Homo sapiens
cagcacccagattggc

SEQ ID NO: 40525 - DNA, 21 bp, Homo sapiens
cagcacttaaaacaccctgct

SEQ ID NO: 40526 - DNA, 17 bp, Homo sapiens
gcatgcttgatcctgct

SEQ ID NO: 40527 - DNA, 17 bp, Homo sapiens
gcacttaacccgctgct

SEQ ID NO: 40528 - DNA, 20 bp, Homo sapiens
cagaacccagactacatgct

SEQ ID NO: 40529 - DNA, 20 bp, Homo sapiens
cagacctaggctcagctgct

SEQ ID NO: 40530 - DNA, 18 bp, Homo sapiens
cagcctctggatcctgct

SEQ ID NO: 40531 - DNA, 21 bp, Homo sapiens
gcacccaggcctgaggccctg

SEQ ID NO: 40532 - DNA, 19 bp, Homo sapiens
gccccacccacatcctgct

SEQ ID NO: 40533 - DNA, 21 bp, Homo sapiens
agctccaggcctgccctgcta

SEQ ID NO: 40534 - DNA, 16 bp, Homo sapiens
cagacccagactctgc

SEQ ID NO: 40535 - DNA, 22 bp, Homo sapiens
agaacttagctgagtcctgcta

SEQ ID NO: 40536 - DNA, 18 bp, Homo sapiens
cagacccaggctcctgct

SEQ ID NO: 40537 - DNA, 19 bp, Homo sapiens
cagcacccgataccctgct

SEQ ID NO: 40538 - DNA, 21 bp, Homo sapiens
cagtaccctggtatcctgcta

SEQ ID NO: 40539 - DNA, 22 bp, Homo sapiens
cagcacccagactctgcccctg

SEQ ID NO: 40540 - DNA, 15 bp, Homo sapiens
agcacccaactctgc

SEQ ID NO: 40541 - DNA, 18 bp, Homo sapiens
cacctccttgatcctgct

SEQ ID NO: 40542 - DNA, 17 bp, Homo sapiens
caggcctagtgatcctg

SEQ ID NO: 40543 - DNA, 18 bp, Homo sapiens
cagcttcagacttgagct

SEQ ID NO: 40544 - DNA, 19 bp, Homo sapiens
gccccgcccatatcctgct

SEQ ID NO: 40545 - DNA, 18 bp, Homo sapiens
acacccaggctgcctgct

SEQ ID NO: 40546 - DNA, 17 bp, Homo sapiens
gcacccagacctgagct

SEQ ID NO: 40547 - DNA, 22 bp, Homo sapiens
gcctccagccaaaatcctgcta

SEQ ID NO: 40548 - DNA, 16 bp, Homo sapiens
gcacccagagcctgct

SEQ ID NO: 40549 - DNA, 18 bp, Homo sapiens
cagcacccagagtgctcg

SEQ ID NO: 40550 - DNA, 18 bp, Homo sapiens
cagcaccctgaccctgct

SEQ ID NO: 40551 - DNA, 20 bp, Homo sapiens
gcacccaggcaccactgcta

SEQ ID NO: 40552 - DNA, 21 bp, Homo sapiens
cagaatattttggtcctgcta

SEQ ID NO: 40553 - DNA, 105 bp, Maize chlorotic mottle virus
ccgactattatgaaaggttactcggttgaacagattggaagacatattgagaacgcgttccgatcgttcaccgatccagtggccattggatttgatgcaagtcgg

SEQ ID NO: 40554 - DNA, 24 bp, Maize chlorotic mottle virus
tgaaaggttactcggttgaacaga

SEQ ID NO: 40555 - DNA, 18 bp, Homo sapiens
tgagaggttactcatgaa

SEQ ID NO: 40556 - DNA, 21 bp, Homo sapiens
gaggggccacggttgaatgga

SEQ ID NO: 40557 - DNA, 22 bp, Homo sapiens
tgaaaggttgtttcttgaacag

SEQ ID NO: 40558 - DNA, 15 bp, Homo sapiens
tgaaggttatgaaca

SEQ ID NO: 40559 - DNA, 21 bp, Homo sapiens
tgaaaggatactcaatacaga

SEQ ID NO: 40560 - DNA, 26 bp, Homo sapiens
tgaaaggttttgatattttgaataga

SEQ ID NO: 40561 - DNA, 25 bp, Homo sapiens
tgaaaggttaatttggttaataaga

SEQ ID NO: 40562 - DNA, 23 bp, Homo sapiens
tgaggggtagctggctgaacaga

SEQ ID NO: 40563 - DNA, 19 bp, Homo sapiens
tgagggcttactcagacag

SEQ ID NO: 40564 - DNA, 17 bp, Homo sapiens
aaaggttgtttaaacag

SEQ ID NO: 40565 - DNA, 17 bp, Homo sapiens
gaaaggttcttggacag

SEQ ID NO: 40566 - DNA, 22 bp, Homo sapiens
gaaaggttgctcagaacacaga

SEQ ID NO: 40567 - DNA, 17 bp, Homo sapiens
gaaaggttgcagagcag

SEQ ID NO: 40568 - DNA, 20 bp, Homo sapiens
taaaaggttacttctataga

SEQ ID NO: 40569 - DNA, 22 bp, Homo sapiens
taaaaggttacttggaaacaga

SEQ ID NO: 40570 - DNA, 20 bp, Homo sapiens
tgagaggtcacttgacgaaa

SEQ ID NO: 40571 - DNA, 17 bp, Homo sapiens
tggaaggttactagtga

SEQ ID NO: 40572 - DNA, 23 bp, Homo sapiens
taaaaggttatttcagagacaga

SEQ ID NO: 40573 - DNA, 22 bp, Homo sapiens
tgaaaggctgacactgaacaga

SEQ ID NO: 40574 - DNA, 19 bp, Homo sapiens
tgataggttactctattga

SEQ ID NO: 40575 - DNA, 20 bp, Homo sapiens
tgaaagattactatgatgga

SEQ ID NO: 40576 - DNA, 19 bp, Homo sapiens
tgaaaggtactccaggctg

SEQ ID NO: 40577 - DNA, 18 bp, Homo sapiens
tgaaaggtggtccccaga

SEQ ID NO: 40578 - DNA, 18 bp, Homo sapiens
tgaaaagttggtgggcag

SEQ ID NO: 40579 - DNA, 21 bp, Homo sapiens
aaaaggtctttggttggacag

SEQ ID NO: 40580 - DNA, 16 bp, Homo sapiens
tgaaaggttcttgaca

SEQ ID NO: 40581 - DNA, 65 bp, Ononis yellow mosaic virus
gctgagtaccacatgtccaatggcagttttccaactcgcctccgaggtcatcccaggtcctcagc

SEQ ID NO: 40582 - DNA, 24 bp, Ononis yellow mosaic virus
ctcgcctccgaggtcatcccaggt

SEQ ID NO: 40583 - DNA, 20 bp, Homo sapiens
tccaaggtccccacccaggt

SEQ ID NO: 40584 - DNA, 21 bp, Homo sapiens
ctcgcctctggttggccgggt

SEQ ID NO: 40585 - DNA, 16 bp, Homo sapiens
cctccaagtcccaggt

SEQ ID NO: 40586 - DNA, 23 bp, Homo sapiens
cccgcctctggattcttttaggt

SEQ ID NO: 40587 - DNA, 19 bp, Homo sapiens
ctcgctctgggtccccagg

SEQ ID NO: 40588 - DNA, 16 bp, Homo sapiens
tcccgatcacccaggt

SEQ ID NO: 40589 - DNA, 20 bp, Homo sapiens
gcccaggggtcatcctgggt

SEQ ID NO: 40590 - DNA, 22 bp, Homo sapiens
ctcgttcttggctgccccaggt

SEQ ID NO: 40591 - DNA, 23 bp, Homo sapiens
ctcgcctctggggccaaagcagg

SEQ ID NO: 40592 - DNA, 18 bp, Homo sapiens
cccgcctctgacctcagg

SEQ ID NO: 40593 - DNA, 24 bp, Homo sapiens
cccgcttctggggaaactccgggt

SEQ ID NO: 40594 - DNA, 17 bp, Homo sapiens
gcagaggtcatcccagg

SEQ ID NO: 40595 - DNA, 21 bp, Homo sapiens
cgcctccgagctgctccgggt

SEQ ID NO: 40596 - DNA, 21 bp, Homo sapiens
ctcccctcccaggttccgggt

SEQ ID NO: 40597 - DNA, 18 bp, Homo sapiens
ctcgctctgtttcccagg

SEQ ID NO: 40598 - DNA, 23 bp, Homo sapiens
ctctcttcccaaacatctcaggt

SEQ ID NO: 40599 - DNA, 21 bp, Homo sapiens
ctcgccgccgttatcccaggt

SEQ ID NO: 40600 - DNA, 15 bp, Homo sapiens
ctcgccccggccccg

SEQ ID NO: 40601 - DNA, 22 bp, Homo sapiens
ctccctctggtcaggcctgggt

SEQ ID NO: 40602 - DNA, 19 bp, Homo sapiens
ctccttctggccatccagg

SEQ ID NO: 40603 - DNA, 19 bp, Homo sapiens
ctcccaggtcattccaagt

SEQ ID NO: 40604 - DNA, 22 bp, Homo sapiens
ctttcctctgtggatcccaggt

SEQ ID NO: 40605 - DNA, 18 bp, Homo sapiens
tcgttctgacgccccagg

SEQ ID NO: 40606 - DNA, 18 bp, Homo sapiens
ctcgcctcgcttcctggg

SEQ ID NO: 40607 - DNA, 19 bp, Homo sapiens
gcttccacttctcccaggt

SEQ ID NO: 40608 - DNA, 25 bp, Homo sapiens
ctcgcctcggaggccaactccaggt

SEQ ID NO: 40609 - DNA, 131 bp, Monkeypox virus
tttttggtccacttttccatacgtttatattcttttaatcctgcgttatccgtttccgttatatacagggatagatcttgcaagttaaatagaatgctcttaaataatgtcatttttttatccgctaaaaa

SEQ ID NO: 40610 - DNA, 24 bp, Monkeypox virus
agggatagatcttgcaagttaaat

SEQ ID NO: 40611 - DNA, 20 bp, Homo sapiens
ggatagagggcgagttaaat

SEQ ID NO: 40612 - DNA, 18 bp, Homo sapiens
agggcacagttgcaagtt

SEQ ID NO: 40613 - DNA, 21 bp, Homo sapiens
agggataaaaagctacaagtt

SEQ ID NO: 40614 - DNA, 22 bp, Homo sapiens
ggatagattgtggcagttaaat

SEQ ID NO: 40615 - DNA, 17 bp, Homo sapiens
gggatagatcttgaaat

SEQ ID NO: 40616 - DNA, 19 bp, Homo sapiens
gagatatacagtgcaagtt

SEQ ID NO: 40617 - DNA, 65 bp, Ononis yellow mosaic virus
cgaagttgaaaactttggcttgagcaccgatcatttgacctgcttaagctatcgtcttcacttcg

SEQ ID NO: 40618 - DNA, 24 bp, Ononis yellow mosaic virus
tttggcttgagcaccgatcatttg

SEQ ID NO: 40619 - DNA, 29 bp, Homo sapiens
tttggtctgagcactagttgcaaatgatc

SEQ ID NO: 40620 - DNA, 21 bp, Homo sapiens
tttggcttgacatccccattt

SEQ ID NO: 40621 - DNA, 63 bp, Human papillomavirus type 29
tgttatttatagtttatagacatttgggattattataacctgtatataacctgtatttgtaca

SEQ ID NO: 40622 - DNA, 24 bp, Human papillomavirus type 29
tttatagtttatagacatttggga

SEQ ID NO: 40623 - DNA, 18 bp, Homo sapiens
taatcaatacatttggga

SEQ ID NO: 40624 - DNA, 22 bp, Homo sapiens
tttatagtcttatagtaaaggg

SEQ ID NO: 40625 - DNA, 22 bp, Homo sapiens
tttatagttatactaaatggga

SEQ ID NO: 40626 - DNA, 16 bp, Homo sapiens
ttcatagtttatttgg

SEQ ID NO: 40627 - DNA, 24 bp, Homo sapiens
tttatggtatcatagtatttggga

SEQ ID NO: 40628 - DNA, 24 bp, Homo sapiens
tttatggtttgtaacaatttggga

SEQ ID NO: 40629 - DNA, 93 bp, Monkeypox virus
tatatacgataagatatgtttattcataaacgcgtcaaatttttcatgaatagctaaggagtttaagaatctcatgtcaaattgtcctatata

SEQ ID NO: 40630 - DNA, 64 bp, Monkeypox virus
aatggtaacgcgtcgttaactcgtcggttaactctttcttttgatcgagttcgtcgctactatt

SEQ ID NO: 40631 - DNA, 24 bp, Monkeypox virus
acgcgtcgttaactcgtcggttaa

SEQ ID NO: 40632 - DNA, 16 bp, Homo sapiens
gccgttatcgttggtt

SEQ ID NO: 40633 - DNA, 16 bp, Homo sapiens
cgcgttgttactcggg

SEQ ID NO: 40634 - DNA, 78 bp, Monkeypox virus
agcggttgtagatttatcatatttctccaccacatatccgttacaatttgttaagaatttagatacatctatattgct

SEQ ID NO: 40635 - DNA, 65 bp, Camelpox virus
tatatatgacataataaattggtaaatcctagttctggtattttactaattactaaatctgtata

SEQ ID NO: 40636 - DNA, 24 bp, Camelpox virus
tatatgacataataaattggtaaa

SEQ ID NO: 40637 - DNA, 19 bp, Homo sapiens
tgatggcataataaaccaa

SEQ ID NO: 40638 - DNA, 19 bp, Homo sapiens
tacatgacatgcatttggt

SEQ ID NO: 40639 - DNA, 25 bp, Homo sapiens
tgatgacatagtaaatgcttagtaa

SEQ ID NO: 40640 - DNA, 18 bp, Homo sapiens
tatgacataaaattggta

SEQ ID NO: 40641 - DNA, 23 bp, Homo sapiens
tatatgacaaatgaactcactgg

SEQ ID NO: 40642 - DNA, 19 bp, Homo sapiens
tatgtacataataaaatga

SEQ ID NO: 40643 - DNA, 19 bp, Homo sapiens
tatatatataataaactgg

SEQ ID NO: 40644 - DNA, 67 bp, Ononis yellow mosaic virus
ccaaatacatcgactgctactgctggtggacctatcgttgtcctaaagcagttgccgatttatttgg

SEQ ID NO: 40645 - DNA, 24 bp, Ononis yellow mosaic virus
ctaaagcagttgccgatttatttg

SEQ ID NO: 40646 - DNA, 20 bp, Homo sapiens
agtcgttgccgaggaacttg

SEQ ID NO: 40647 - DNA, 19 bp, Homo sapiens
ctaaaacatggatttattt

SEQ ID NO: 40648 - DNA, 19 bp, Homo sapiens
ctgaagcagttggtgactt

SEQ ID NO: 40649 - DNA, 19 bp, Homo sapiens
taaggcagttactttattt

SEQ ID NO: 40650 - DNA, 21 bp, Homo sapiens
aagcaattgcttgatgatttg

SEQ ID NO: 40651 - DNA, 20 bp, Homo sapiens
aagcagttgtgtgacacttg

SEQ ID NO: 40652 - DNA, 63 bp, Human herpesvirus 1
cggtcggcgccgatttccggcccggcgcgtccccgcggggccggtccagatcgcggtcgcccg

SEQ ID NO: 40653 - DNA, 23 bp, Human herpesvirus 1
ccggtccagatcgcggtcgcccg

SEQ ID NO: 40654 - DNA, 19 bp, Homo sapiens
ccggtccaggcgccgtgcc

SEQ ID NO: 40655 - DNA, 22 bp, Homo sapiens
ccgggctgacggcggtcgcccg

SEQ ID NO: 40656 - DNA, 16 bp, Homo sapiens
ggcccagatgccgccc

SEQ ID NO: 40657 - DNA, 20 bp, Homo sapiens
ggctggattgcagccacccg

SEQ ID NO: 40658 - DNA, 18 bp, Homo sapiens
ggtccagatgccctcccc

SEQ ID NO: 40659 - DNA, 20 bp, Homo sapiens
ccggtcccggatggcgcccg

SEQ ID NO: 40660 - DNA, 23 bp, Homo sapiens
ggtccagatcactggaaggcccg

SEQ ID NO: 40661 - DNA, 19 bp, Homo sapiens
ccggtccaggtagctgccg

SEQ ID NO: 40662 - DNA, 19 bp, Homo sapiens
ggtccagactgcaaatgtc

SEQ ID NO: 40663 - DNA, 15 bp, Homo sapiens
ccggctcggatcgcc

SEQ ID NO: 40664 - DNA, 17 bp, Homo sapiens
ggtccagaggcctcgcc

SEQ ID NO: 40665 - DNA, 23 bp, Homo sapiens
cggttcgggccgcggagactccg

SEQ ID NO: 40666 - DNA, 20 bp, Homo sapiens
cctgtccagatcttagctcg

SEQ ID NO: 40667 - DNA, 17 bp, Homo sapiens
ccggtccaggctgccca

SEQ ID NO: 40668 - DNA, 19 bp, Homo sapiens
gatccagatccttcctgcc

SEQ ID NO: 40669 - DNA, 64 bp, Ononis yellow mosaic virus
gatccggatttgaaagaagttactgttggtgatcaaaccagtcagcaatttccttatttggatc

SEQ ID NO: 40670 - DNA, 24 bp, Ononis yellow mosaic virus
tgaaagaagttactgttggtgatc

SEQ ID NO: 40671 - DNA, 21 bp, Homo sapiens
tgagagaagttacatgttcat

SEQ ID NO: 40672 - DNA, 26 bp, Homo sapiens
tgtgagaggttaccaccgtggtgatc

SEQ ID NO: 40673 - DNA, 19 bp, Homo sapiens
tggaagaattactgttagc

SEQ ID NO: 40674 - DNA, 24 bp, Homo sapiens
gaaagaagttactattcagtgatc

SEQ ID NO: 40675 - DNA, 18 bp, Homo sapiens
tggaagaagttattgcca

SEQ ID NO: 40676 - DNA, 21 bp, Homo sapiens
taaaggaagttactgaaaaat

SEQ ID NO: 40677 - DNA, 18 bp, Homo sapiens
tgaagaagttactttggt

SEQ ID NO: 40678 - DNA, 18 bp, Homo sapiens
tgagagaagttgatgacc

SEQ ID NO: 40679 - DNA, 22 bp, Homo sapiens
tgaaagaggtcactgtgccagt

SEQ ID NO: 40680 - DNA, 22 bp, Homo sapiens
tgggaggagctactgcccaggt

SEQ ID NO: 40681 - DNA, 23 bp, Homo sapiens
tggaagaagctgggagctgtggt

SEQ ID NO: 40682 - DNA, 20 bp, Homo sapiens
tggaaaaagttacttaagat

SEQ ID NO: 40683 - DNA, 19 bp, Homo sapiens
gaagcagttgctgatagat

SEQ ID NO: 40684 - DNA, 73 bp, Ononis yellow mosaic virus
gcttgctcttccctgatcatctcctcaagtactactcggcttgctgggatttgttctgcagaaagtgcactgc

SEQ ID NO: 40685 - DNA, 24 bp, Ononis yellow mosaic virus
tccctgatcatctcctcaagtact

SEQ ID NO: 40686 - DNA, 20 bp, Homo sapiens
tccctggtcatctcctcagt

SEQ ID NO: 40687 - DNA, 18 bp, Homo sapiens
ctgatcatctcacctact

SEQ ID NO: 40688 - DNA, 22 bp, Homo sapiens
cctgatataaaattcaagtact

SEQ ID NO: 40689 - DNA, 19 bp, Homo sapiens
ctgaccatctctccatact

SEQ ID NO: 40690 - DNA, 20 bp, Homo sapiens
ctgatcatttcttacatact

SEQ ID NO: 40691 - DNA, 22 bp, Homo sapiens
tctctgatcatcttgaactact

SEQ ID NO: 40692 - DNA, 19 bp, Homo sapiens
ctgatcatctcccagcact

SEQ ID NO: 40693 - DNA, 20 bp, Homo sapiens
ctgctgtctcttcaagtact

SEQ ID NO: 40694 - DNA, 15 bp, Homo sapiens
cccctgacctcaagt

SEQ ID NO: 40695 - DNA, 24 bp, Homo sapiens
tccctgacatcttctcacaggact

SEQ ID NO: 40696 - DNA, 20 bp, Homo sapiens
tccctgagcgtctccccagc

SEQ ID NO: 40697 - DNA, 19 bp, Homo sapiens
tccctgatcacttttcagc

SEQ ID NO: 40698 - DNA, 22 bp, Homo sapiens
tccttgggcatctcctccagca

SEQ ID NO: 40699 - DNA, 21 bp, Homo sapiens
cttccagtttcctcaagtgct

SEQ ID NO: 40700 - DNA, 22 bp, Homo sapiens
tctctgtcatctccactgtact

SEQ ID NO: 40701 - DNA, 21 bp, Homo sapiens
tcctcttctttctcaagtact

SEQ ID NO: 40702 - DNA, 20 bp, Homo sapiens
tcctcactttttcaagtact

SEQ ID NO: 40703 - DNA, 84 bp, Beet western yellows virus
ctccttccaatcctagctcaattgaccttcttccgactacagaagatgttggaggtcaatttcgaagatatgggacctgaggag

SEQ ID NO: 40704 - DNA, 24 bp, Beet western yellows virus
ggaggtcaatttcgaagatatggg

SEQ ID NO: 40705 - DNA, 22 bp, Homo sapiens
ggaagtcaattagagatgtggg

SEQ ID NO: 40706 - DNA, 15 bp, Homo sapiens
ggggtcaatttcatg

SEQ ID NO: 40707 - DNA, 19 bp, Homo sapiens
ggagatcagcagggtatgg

SEQ ID NO: 40708 - DNA, 22 bp, Homo sapiens
ggaggccaaggccaggtgtggg

SEQ ID NO: 40709 - DNA, 65 bp, Beet western yellows virus
attcatccgggcgttcagaagagtgggagctataatacatcaagctccaactcccggatccgagt

SEQ ID NO: 40710 - DNA, 24 bp, Beet western yellows virus
catccgggcgttcagaagagtggg

SEQ ID NO: 40711 - DNA, 20 bp, Homo sapiens
cccggccggagaggagtggg

SEQ ID NO: 40712 - DNA, 21 bp, Homo sapiens
cattagggcggaaagagtggg

SEQ ID NO: 40713 - DNA, 22 bp, Homo sapiens
ccgggcgcgcgcggggagtggg

SEQ ID NO: 40714 - DNA, 19 bp, Homo sapiens
catcagagcagaagggtgg

SEQ ID NO: 40715 - DNA, 22 bp, Homo sapiens
tcagggtgccaaggagagtggg

SEQ ID NO: 40716 - DNA, 23 bp, Homo sapiens
cacctggatcacaggagagtggg

SEQ ID NO: 40717 - DNA, 24 bp, Homo sapiens
atccgggctttgggggagggtggg

SEQ ID NO: 40718 - DNA, 21 bp, Homo sapiens
catcctggcggtcagggtggg

SEQ ID NO: 40719 - DNA, 22 bp, Homo sapiens
catccgggttattcggagtggg

SEQ ID NO: 40720 - DNA, 23 bp, Homo sapiens
tccgggcagagctggagagtggg

SEQ ID NO: 40721 - DNA, 19 bp, Homo sapiens
catccgggcgttggagagg

SEQ ID NO: 40722 - DNA, 22 bp, Homo sapiens
agtgttattttggaagagtggg

SEQ ID NO: 40723 - DNA, 20 bp, Homo sapiens
tctggagataggagagtggg

SEQ ID NO: 40724 - DNA, 22 bp, Homo sapiens
atctggccgtgtgtagagtggg

SEQ ID NO: 40725 - DNA, 16 bp, Homo sapiens
cattcggacgagagtg

SEQ ID NO: 40726 - DNA, 21 bp, Homo sapiens
tcctggccctggaagagtggg

SEQ ID NO: 40727 - DNA, 21 bp, Homo sapiens
ggctgagctcaggagagtggg

SEQ ID NO: 40728 - DNA, 131 bp, Vaccinia virus
tttttggtccatttttccatacgtttatattcttttaatcctgcgttatccgtttccgttatatccagtgatagatcgtgcaggttaaatagaatgctcttaaataatgtcatttttttatccgctaaaaa

SEQ ID NO: 40729 - DNA, 24 bp, Vaccinia virus
atcgtgcaggttaaatagaatgct

SEQ ID NO: 40730 - DNA, 21 bp, Homo sapiens
atctgaaccaaatagaatgct

SEQ ID NO: 40731 - DNA, 19 bp, Homo sapiens
atcggcaggttaaatgaat

SEQ ID NO: 40732 - DNA, 18 bp, Homo sapiens
catgttaaatagaatgct

SEQ ID NO: 40733 - DNA, 20 bp, Homo sapiens
gtgcaggctggtgggatgct

SEQ ID NO: 40734 - DNA, 18 bp, Homo sapiens
gcgcaggttcgaaatgct

SEQ ID NO: 40735 - DNA, 15 bp, Homo sapiens
tctgcaggcagaatg

SEQ ID NO: 40736 - DNA, 19 bp, Homo sapiens
atcgtgcagcttggataaa

SEQ ID NO: 40737 - DNA, 64 bp, Alcelaphine herpesvirus 1
gtggggcagaggaaaatttgtggcttccttgcgaaagtatttcaaactaaccacatctccccac

SEQ ID NO: 40738 - DNA, 24 bp, Alcelaphine herpesvirus 1
gggcagaggaaaatttgtggcttc

SEQ ID NO: 40739 - DNA, 21 bp, Homo sapiens
gggcagagggggcgtctcttc

SEQ ID NO: 40740 - DNA, 22 bp, Homo sapiens
ggacagagggggcgttggcttc

SEQ ID NO: 40741 - DNA, 22 bp, Homo sapiens
ggacagaggctgctgtggcttc

SEQ ID NO: 40742 - DNA, 18 bp, Homo sapiens
ggatggagtttgtggctt

SEQ ID NO: 40743 - DNA, 22 bp, Homo sapiens
gggcaggggggatgcttgcttc

SEQ ID NO: 40744 - DNA, 22 bp, Homo sapiens
gggcagagcggggggatggctt

SEQ ID NO: 40745 - DNA, 21 bp, Homo sapiens
gggagagggtccagtggcttc

SEQ ID NO: 40746 - DNA, 20 bp, Homo sapiens
ggccagaggagggtgacttc

SEQ ID NO: 40747 - DNA, 24 bp, Homo sapiens
gggagaggaaaaccaccaggcttc

SEQ ID NO: 40748 - DNA, 21 bp, Homo sapiens
gggagagggacaagtggcttc

SEQ ID NO: 40749 - DNA, 20 bp, Homo sapiens
gggcagaggaaaaatacctt

SEQ ID NO: 40750 - DNA, 25 bp, Homo sapiens
gagcagaggaagagggagaggcttc

SEQ ID NO: 40751 - DNA, 18 bp, Homo sapiens
gggaagagggaaatacct

SEQ ID NO: 40752 - DNA, 23 bp, Homo sapiens
gggcaaggaaaagcctatggctt

SEQ ID NO: 40753 - DNA, 24 bp, Homo sapiens
gagtagagggagaaagatggtttc

SEQ ID NO: 40754 - DNA, 19 bp, Homo sapiens
gggcagaggcaggtgtgac

SEQ ID NO: 40755 - DNA, 22 bp, Homo sapiens
gggcagaggaggtgaagagctt

SEQ ID NO: 40756 - DNA, 19 bp, Homo sapiens
ggggggaggaggatgactt

SEQ ID NO: 40757 - DNA, 16 bp, Homo sapiens
gggcagagaagcggct

SEQ ID NO: 40758 - DNA, 17 bp, Homo sapiens
ggcagaggagctggctt

SEQ ID NO: 40759 - DNA, 19 bp, Homo sapiens
gggtagaagcttgtggctt

SEQ ID NO: 40760 - DNA, 25 bp, Homo sapiens
gggcagagggtggggctggggcttc

SEQ ID NO: 40761 - DNA, 18 bp, Homo sapiens
gggcagaggagaagctgt

SEQ ID NO: 40762 - DNA, 25 bp, Homo sapiens
gggtggaggagcggccaatggcttc

SEQ ID NO: 40763 - DNA, 19 bp, Homo sapiens
gggcaaaggaaagtgactt

SEQ ID NO: 40764 - DNA, 22 bp, Homo sapiens
gggcaaagggaaaggcagcttc

SEQ ID NO: 40765 - DNA, 19 bp, Homo sapiens
gggagagggggatgaactt

SEQ ID NO: 40766 - DNA, 19 bp, Homo sapiens
gagcagaggagggtgattt

SEQ ID NO: 40767 - DNA, 20 bp, Homo sapiens
ggagagaggctggcggcttc

SEQ ID NO: 40768 - DNA, 18 bp, Homo sapiens
aggtaggggaaatggctt

SEQ ID NO: 40769 - DNA, 25 bp, Homo sapiens
gggaagaggaaagtgggagaggctt

SEQ ID NO: 40770 - DNA, 23 bp, Homo sapiens
gggcaggagaaaatcatcccttc

SEQ ID NO: 40771 - DNA, 21 bp, Homo sapiens
gggtgtaggacctgtggcttc

SEQ ID NO: 40772 - DNA, 19 bp, Homo sapiens
gggcgaggagaatttgcaa

SEQ ID NO: 40773 - DNA, 19 bp, Homo sapiens
ggcagaggaaaataaactt

SEQ ID NO: 40774 - DNA, 18 bp, Homo sapiens
gggagagggagataactt

SEQ ID NO: 40775 - DNA, 24 bp, Homo sapiens
gggcagagaggagaaagaggcttc

SEQ ID NO: 40776 - DNA, 21 bp, Homo sapiens
gggcaaaggaagattatactt

SEQ ID NO: 40777 - DNA, 26 bp, Homo sapiens
gggcagaggcgggctgacgtggcttc

SEQ ID NO: 40778 - DNA, 60 bp, Alcelaphine herpesvirus 1
taactaccctccgggagctcggggccgtggccacgcagtctccagccctggaccgagttg

SEQ ID NO: 40779 - DNA, 24 bp, Alcelaphine herpesvirus 1
cgggagctcggggccgtggccacg

SEQ ID NO: 40780 - DNA, 17 bp, Homo sapiens
gggagccggggccccac

SEQ ID NO: 40781 - DNA, 18 bp, Homo sapiens
ggagttcccaggtgtggc

SEQ ID NO: 40782 - DNA, 18 bp, Homo sapiens
gagctcgggggtcctatg

SEQ ID NO: 40783 - DNA, 20 bp, Homo sapiens
cgggagctccggggtctgcg

SEQ ID NO: 40784 - DNA, 17 bp, Homo sapiens
cgggagctcgggctgcg

SEQ ID NO: 40785 - DNA, 18 bp, Homo sapiens
cgggagctcggcgtggcc

SEQ ID NO: 40786 - DNA, 19 bp, Homo sapiens
caggagccctgtggccatg

SEQ ID NO: 40787 - DNA, 18 bp, Homo sapiens
caggagcctgtggccatg

SEQ ID NO: 40788 - DNA, 18 bp, Homo sapiens
gggggttcgaggccggcc

SEQ ID NO: 40789 - DNA, 18 bp, Homo sapiens
ggaagctcggggtttgcg

SEQ ID NO: 40790 - DNA, 20 bp, Homo sapiens
cgggagccgggcagcgctgc

SEQ ID NO: 40791 - DNA, 19 bp, Homo sapiens
cgggcgctcggggtccgcg

SEQ ID NO: 40792 - DNA, 21 bp, Homo sapiens
cgggagcttcgggtgctcgcg

SEQ ID NO: 40793 - DNA, 18 bp, Homo sapiens
cgggggccggggccgggg

SEQ ID NO: 40794 - DNA, 16 bp, Homo sapiens
gggcgcaccgtggcca

SEQ ID NO: 40795 - DNA, 18 bp, Homo sapiens
cgggagctcagggccggc

SEQ ID NO: 40796 - DNA, 18 bp, Homo sapiens
cgggagctgggggttgtg

SEQ ID NO: 40797 - DNA, 27 bp, Homo sapiens
gggagctgggggctgctgcgtggccac

SEQ ID NO: 40798 - DNA, 18 bp, Homo sapiens
cgggagccgggggccgcg

SEQ ID NO: 40799 - DNA, 19 bp, Homo sapiens
cggggctcggggcccgagc

SEQ ID NO: 40800 - DNA, 24 bp, Homo sapiens
cggggactcgggggcacggctgcg

SEQ ID NO: 40801 - DNA, 21 bp, Homo sapiens
cgggggctggagggggccgcg

SEQ ID NO: 40802 - DNA, 21 bp, Homo sapiens
gggggctcggggcctcaatac

SEQ ID NO: 40803 - DNA, 20 bp, Homo sapiens
cggggcttgggggggctgcg

SEQ ID NO: 40804 - DNA, 19 bp, Homo sapiens
cgggagcccggggcgcgcg

SEQ ID NO: 40805 - DNA, 19 bp, Homo sapiens
cgggcgctcggggactgtg

SEQ ID NO: 40806 - DNA, 18 bp, Homo sapiens
cgggggctcgggtcccgg

SEQ ID NO: 40807 - DNA, 18 bp, Homo sapiens
caggagccctgtggccac

SEQ ID NO: 40808 - DNA, 21 bp, Homo sapiens
cgggggctccgcttggccatg

SEQ ID NO: 40809 - DNA, 17 bp, Homo sapiens
cgggagccggggtcgcg

SEQ ID NO: 40810 - DNA, 18 bp, Homo sapiens
cgggagctggggccccac

SEQ ID NO: 40811 - DNA, 22 bp, Homo sapiens
cgggagtccggaggcggttacg

SEQ ID NO: 40812 - DNA, 27 bp, Homo sapiens
ggggtcttggggcatgtgcgtggccac

SEQ ID NO: 40813 - DNA, 23 bp, Homo sapiens
caggagctcggggtggggtcgtg

SEQ ID NO: 40814 - DNA, 17 bp, Homo sapiens
ggagcgcgggctgtggc

SEQ ID NO: 40815 - DNA, 21 bp, Homo sapiens
cgggggctgggaggccagcca

SEQ ID NO: 40816 - DNA, 20 bp, Homo sapiens
ggagcagggctgtggccacg

SEQ ID NO: 40817 - DNA, 23 bp, Homo sapiens
cgggcgggttggccgtggccgcg

SEQ ID NO: 40818 - DNA, 28 bp, Homo sapiens
gggggctcaggggctggtgcgtggccac

SEQ ID NO: 40819 - DNA, 19 bp, Homo sapiens
gggagctcaggtggccgtg

SEQ ID NO: 40820 - DNA, 17 bp, Homo sapiens
ggggctcggagggtcgc

SEQ ID NO: 40821 - DNA, 28 bp, Homo sapiens
cgggaccttggggctggtgcgtggccac

SEQ ID NO: 40822 - DNA, 17 bp, Homo sapiens
gggtgcttggggccggc

SEQ ID NO: 40823 - DNA, 19 bp, Homo sapiens
cgggactcggggctggggc

SEQ ID NO: 40824 - DNA, 23 bp, Homo sapiens
cgggactcggggctcgccccccg

SEQ ID NO: 40825 - DNA, 19 bp, Homo sapiens
cgggggccggggccgggac

SEQ ID NO: 40826 - DNA, 21 bp, Homo sapiens
cgggagctctgggccggcccg

SEQ ID NO: 40827 - DNA, 18 bp, Homo sapiens
aggagctcgggagccgcg

SEQ ID NO: 40828 - DNA, 19 bp, Homo sapiens
cgggaggtcggggccagtg

SEQ ID NO: 40829 - DNA, 19 bp, Homo sapiens
gggggctcgggcggctgcg

SEQ ID NO: 40830 - DNA, 27 bp, Homo sapiens
gggggctcagggctggtgcgtggccac

SEQ ID NO: 40831 - DNA, 19 bp, Homo sapiens
gggagctcgggtaagcgtg

SEQ ID NO: 40832 - DNA, 20 bp, Homo sapiens
cgggagcctggtggcggcca

SEQ ID NO: 40833 - DNA, 18 bp, Homo sapiens
cggggctcggggcagcac

SEQ ID NO: 40834 - DNA, 19 bp, Homo sapiens
gggactcggggtgcccgcg

SEQ ID NO: 40835 - DNA, 90 bp, Vaccinia virus
tcatatttctccactacatatccgttacaatttgttaaaaatttagatacatctatattgctacataatccagctagtgaatatatatga

SEQ ID NO: 40836 - DNA, 24 bp, Vaccinia virus
ttgctacataatccagctagtgaa

SEQ ID NO: 40837 - DNA, 18 bp, Homo sapiens
tgctacatagtcgtgtga

SEQ ID NO: 40838 - DNA, 16 bp, Homo sapiens
tgcacatagctagtga

SEQ ID NO: 40839 - DNA, 18 bp, Homo sapiens
ttgctagtgagctagtga

SEQ ID NO: 40840 - DNA, 17 bp, Homo sapiens
gctacataatttagtaa

SEQ ID NO: 40841 - DNA, 23 bp, Homo sapiens
ttgctacataatcaaatggtgaa

SEQ ID NO: 40842 - DNA, 22 bp, Homo sapiens
ttgctgacatagccagtagtga

SEQ ID NO: 40843 - DNA, 19 bp, Homo sapiens
tacataatttctctagtga

SEQ ID NO: 40844 - DNA, 17 bp, Homo sapiens
ttgccacatggctaatg

SEQ ID NO: 40845 - DNA, 88 bp, Alcelaphine herpesvirus 1
caggcactactttttagccgttttctcggatgacattgagtatttctggaaaaagacaatcttcctgccacccgagagcttctgcctg

SEQ ID NO: 40846 - DNA, 24 bp, Alcelaphine herpesvirus 1
atgacattgagtatttctggaaaa

SEQ ID NO: 40847 - DNA, 21 bp, Homo sapiens
tgacattgaatgttcctcaaa

SEQ ID NO: 40848 - DNA, 23 bp, Homo sapiens
tgaacattgattgccctggaaaa

SEQ ID NO: 40849 - DNA, 21 bp, Homo sapiens
atgatactgagtataacagga

SEQ ID NO: 40850 - DNA, 19 bp, Homo sapiens
tgacttgaatatctggaaa

SEQ ID NO: 40851 - DNA, 17 bp, Homo sapiens
atgacattggtgtggaa

SEQ ID NO: 40852 - DNA, 18 bp, Homo sapiens
atgattgatttttctgga

SEQ ID NO: 40853 - DNA, 19 bp, Homo sapiens
atgcattgagtatgtaagg

SEQ ID NO: 40854 - DNA, 20 bp, Homo sapiens
tgacaatgagatgtggaaaa

SEQ ID NO: 40855 - DNA, 18 bp, Homo sapiens
gacaggtatttctggaaa

SEQ ID NO: 40856 - DNA, 16 bp, Homo sapiens
gactatatttctggaa

SEQ ID NO: 40857 - DNA, 20 bp, Homo sapiens
atgacatttagtatttttag

SEQ ID NO: 40858 - DNA, 21 bp, Homo sapiens
tgaagttgagattttctggaa

SEQ ID NO: 40859 - DNA, 19 bp, Homo sapiens
atgacaatagtttctggaa

SEQ ID NO: 40860 - DNA, 18 bp, Homo sapiens
atgaaattggcctctgga

SEQ ID NO: 40861 - DNA, 21 bp, Homo sapiens
atggcattgagtggcacagaa

SEQ ID NO: 40862 - DNA, 19 bp, Homo sapiens
acaaatcagtttctggaaa

SEQ ID NO: 40863 - DNA, 23 bp, Homo sapiens
atgaaaccaatatttctggaaaa

SEQ ID NO: 40864 - DNA, 19 bp, Homo sapiens
ataacggactatttctgga

SEQ ID NO: 40865 - DNA, 23 bp, Homo sapiens
atggcattgaataggagtgaaaa

SEQ ID NO: 40866 - DNA, 16 bp, Homo sapiens
tgacactgaaactgga

SEQ ID NO: 40867 - DNA, 21 bp, Homo sapiens
atgacatttagtctctttgga

SEQ ID NO: 40868 - DNA, 19 bp, Homo sapiens
attggatgtatttctggaa

SEQ ID NO: 40869 - DNA, 19 bp, Homo sapiens
atgatgatgaatctggaaa

SEQ ID NO: 40870 - DNA, 19 bp, Homo sapiens
tgcattgagctttgggaaa

SEQ ID NO: 40871 - DNA, 24 bp, Homo sapiens
tgacattaactgagttttggaaaa

SEQ ID NO: 40872 - DNA, 19 bp, Homo sapiens
tgacattgactctttggaa

SEQ ID NO: 40873 - DNA, 17 bp, Homo sapiens
gacattgagttcaggga

SEQ ID NO: 40874 - DNA, 17 bp, Homo sapiens
attgactagctggaaaa

SEQ ID NO: 40875 - DNA, 22 bp, Homo sapiens
tggcatcgagtgagcaaagaaa

SEQ ID NO: 40876 - DNA, 20 bp, Homo sapiens
atgacagtggagttctggaa

SEQ ID NO: 40877 - DNA, 20 bp, Homo sapiens
atggccttgagtatatcaga

SEQ ID NO: 40878 - DNA, 18 bp, Homo sapiens
atgtcattgagtggggaa

SEQ ID NO: 40879 - DNA, 21 bp, Homo sapiens
tgcagaagtatttttggaaaa

SEQ ID NO: 40880 - DNA, 20 bp, Homo sapiens
atgaatctgtaaatttctgg

SEQ ID NO: 40881 - DNA, 23 bp, Homo sapiens
tgatgtctcctgtttctggaaaa

SEQ ID NO: 40882 - DNA, 22 bp, Homo sapiens
atcacatggagtatttctggaa

SEQ ID NO: 40883 - DNA, 22 bp, Homo sapiens
tgacatgaggaattctggaaaa

SEQ ID NO: 40884 - DNA, 22 bp, Homo sapiens
atgacattgatgtttttgatga

SEQ ID NO: 40885 - DNA, 20 bp, Homo sapiens
atgataggtaatttctggaa

SEQ ID NO: 40886 - DNA, 21 bp, Homo sapiens
atggcattaagtaaaggaaaa

SEQ ID NO: 40887 - DNA, 20 bp, Homo sapiens
gacaccaaatttctggaaaa

SEQ ID NO: 40888 - DNA, 15 bp, Homo sapiens
gacatatttctggaa

SEQ ID NO: 40889 - DNA, 18 bp, Homo sapiens
tgaggtccgcatttctgg

SEQ ID NO: 40890 - DNA, 18 bp, Homo sapiens
atgacattgtccttggaa

SEQ ID NO: 40891 - DNA, 19 bp, Homo sapiens
actagaatgtttctggaaa

SEQ ID NO: 40892 - DNA, 20 bp, Homo sapiens
atgacattagtattttgtgg

SEQ ID NO: 40893 - DNA, 62 bp, Beet western yellows virus
cttctttactcgtggttagtcgatccggtgctaccacaaaagataccaggagagtaaagaag

SEQ ID NO: 40894 - DNA, 19 bp, Beet western yellows virus
taccaggagagtaaagaag

SEQ ID NO: 40895 - DNA, 18 bp, Homo sapiens
tactcggagagtagaaga

SEQ ID NO: 40896 - DNA, 19 bp, Homo sapiens
taccagaagtgcttggaag

SEQ ID NO: 40897 - DNA, 19 bp, Homo sapiens
caccaggaggcctaagaag

SEQ ID NO: 40898 - DNA, 17 bp, Homo sapiens
caccaggacagcggaag

SEQ ID NO: 40899 - DNA, 21 bp, Homo sapiens
taccagaagatgtccgggaag

SEQ ID NO: 40900 - DNA, 17 bp, Homo sapiens
caccaggagtaccgaag

SEQ ID NO: 40901 - DNA, 18 bp, Homo sapiens
taccaggacagcactaga

SEQ ID NO: 40902 - DNA, 16 bp, Homo sapiens
caccaggaaacagaag

SEQ ID NO: 40903 - DNA, 18 bp, Homo sapiens
accaggagattaaagaag

SEQ ID NO: 40904 - DNA, 18 bp, Homo sapiens
caccaggagttgaagaag

SEQ ID NO: 40905 - DNA, 18 bp, Homo sapiens
ccaggagatatatagaag

SEQ ID NO: 40906 - DNA, 19 bp, Homo sapiens
accaggaggggcagggaag

SEQ ID NO: 40907 - DNA, 19 bp, Homo sapiens
caccagatgcctaaagaag

SEQ ID NO: 40908 - DNA, 16 bp, Homo sapiens
taccaggaaacagaag

SEQ ID NO: 40909 - DNA, 18 bp, Homo sapiens
taccaagaggagcacgga

SEQ ID NO: 40910 - DNA, 19 bp, Homo sapiens
accaggaactgctaagaag

SEQ ID NO: 40911 - DNA, 17 bp, Homo sapiens
accagataaaaaagaag

SEQ ID NO: 40912 - DNA, 17 bp, Homo sapiens
caccaggaggtgggaag

SEQ ID NO: 40913 - DNA, 17 bp, Homo sapiens
caccaggagaacggaag

SEQ ID NO: 40914 - DNA, 22 bp, Homo sapiens
tacctgggagaagaaccagaag

SEQ ID NO: 40915 - DNA, 17 bp, Homo sapiens
accaggaggagcggaag

SEQ ID NO: 40916 - DNA, 17 bp, Homo sapiens
taccaggatggaggaag

SEQ ID NO: 40917 - DNA, 19 bp, Homo sapiens
taccaagaggctaaagaag

SEQ ID NO: 40918 - DNA, 17 bp, Homo sapiens
tacgggagagcatgaag

SEQ ID NO: 40919 - DNA, 16 bp, Homo sapiens
accaggaggcaggaag

SEQ ID NO: 40920 - DNA, 18 bp, Homo sapiens
actaggagaaaaatgaag

SEQ ID NO: 40921 - DNA, 20 bp, Homo sapiens
accaggaggagcgagggaag

SEQ ID NO: 40922 - DNA, 20 bp, Homo sapiens
taccaagaaaatgggagaag

SEQ ID NO: 40923 - DNA, 21 bp, Homo sapiens
aggagagctacacaaagaagc

SEQ ID NO: 40924 - DNA, 16 bp, Homo sapiens
caccaggaggctgaag

SEQ ID NO: 40925 - DNA, 18 bp, Homo sapiens
cctaggagagcatggaaa

SEQ ID NO: 40926 - DNA, 17 bp, Homo sapiens
caccaggaagcgggaag

SEQ ID NO: 40927 - DNA, 18 bp, Homo sapiens
taccaggaaccgcagaga

SEQ ID NO: 40928 - DNA, 18 bp, Homo sapiens
caggaaaaaatagagaag

SEQ ID NO: 40929 - DNA, 22 bp, Homo sapiens
taccaggagccggcaagggaag

SEQ ID NO: 40930 - DNA, 18 bp, Homo sapiens
ccaggaaactaagagaag

SEQ ID NO: 40931 - DNA, 18 bp, Homo sapiens
ccaggaaatgaaaagaag

SEQ ID NO: 40932 - DNA, 21 bp, Homo sapiens
caggagagacccacaaagaag

SEQ ID NO: 40933 - DNA, 21 bp, Homo sapiens
caccaggagcggcagaagaag

SEQ ID NO: 40934 - DNA, 20 bp, Homo sapiens
caccaggaagattaaggaag

SEQ ID NO: 40935 - DNA, 20 bp, Homo sapiens
ccaggagtaaaggaaagaag

SEQ ID NO: 40936 - DNA, 19 bp, Homo sapiens
actaggaataataaagaag

SEQ ID NO: 40937 - DNA, 16 bp, Homo sapiens
tactcaggtaaagaag

SEQ ID NO: 40938 - DNA, 19 bp, Homo sapiens
taccagaagtacgaagaag

SEQ ID NO: 40939 - DNA, 18 bp, Homo sapiens
tactaggaaagtgtaaag

SEQ ID NO: 40940 - DNA, 19 bp, Homo sapiens
taaggtaagagtaaagaag

SEQ ID NO: 40941 - DNA, 18 bp, Homo sapiens
caccaggaggccctgaag

SEQ ID NO: 40942 - DNA, 18 bp, Homo sapiens
actaggagagcggagaag

SEQ ID NO: 40943 - DNA, 19 bp, Homo sapiens
taccaggagaagcccgaag

SEQ ID NO: 40944 - DNA, 18 bp, Homo sapiens
taccaagagaagctgaag

SEQ ID NO: 40945 - DNA, 18 bp, Homo sapiens
taccagaaggtcctgaag

SEQ ID NO: 40946 - DNA, 16 bp, Homo sapiens
taccagagtaaagaag

SEQ ID NO: 40947 - DNA, 19 bp, Homo sapiens
actgggagagacaaagaag

SEQ ID NO: 40948 - DNA, 21 bp, Homo sapiens
caccaggagctgcagaagaag

SEQ ID NO: 40949 - DNA, 19 bp, Homo sapiens
caccaggctcccaaagaag

SEQ ID NO: 40950 - DNA, 19 bp, Homo sapiens
cactgggagaacacagaag

SEQ ID NO: 40951 - DNA, 21 bp, Homo sapiens
ccaggagagcctctagagaag

SEQ ID NO: 40952 - DNA, 18 bp, Homo sapiens
actaggaaaatagagaag

SEQ ID NO: 40953 - DNA, 22 bp, Homo sapiens
actgggagagcaccccaagaag

SEQ ID NO: 40954 - DNA, 18 bp, Homo sapiens
accactaaagtaaggaag

SEQ ID NO: 40955 - DNA, 18 bp, Homo sapiens
taccagtaagactagaga

SEQ ID NO: 40956 - DNA, 17 bp, Homo sapiens
caccagaaaaaaagaag

SEQ ID NO: 40957 - DNA, 16 bp, Homo sapiens
caccaggaataggaag

SEQ ID NO: 40958 - DNA, 16 bp, Homo sapiens
caccaggaagcagaag

SEQ ID NO: 40959 - DNA, 19 bp, Homo sapiens
actaggaggcgcaaaaaag

SEQ ID NO: 40960 - DNA, 16 bp, Homo sapiens
taccagaacaaagaag

SEQ ID NO: 40961 - DNA, 16 bp, Homo sapiens
caccagattaaagaag

SEQ ID NO: 40962 - DNA, 16 bp, Homo sapiens
taccaggaggcagaag

SEQ ID NO: 40963 - DNA, 63 bp, Human herpesvirus 4
tgatcttgtgacgcatgcggcgcaggcaggccgttaggcccatgagcttctgcagcacagaca

SEQ ID NO: 40964 - DNA, 24 bp, Human herpesvirus 4
acgcatgcggcgcaggcaggccgt

SEQ ID NO: 40965 - DNA, 21 bp, Homo sapiens
gcaggtttgcaggcaggccgt

SEQ ID NO: 40966 - DNA, 22 bp, Homo sapiens
actgtcaaagcaggcaggctgt

SEQ ID NO: 40967 - DNA, 19 bp, Homo sapiens
gcgcgggcggtggcggtcg

SEQ ID NO: 40968 - DNA, 20 bp, Homo sapiens
gcgtcgactgggcaggccgt

SEQ ID NO: 40969 - DNA, 16 bp, Homo sapiens
cgcagcggcgcagggg

SEQ ID NO: 40970 - DNA, 22 bp, Homo sapiens
tgcgggggaacaggcaggctgt

SEQ ID NO: 40971 - DNA, 21 bp, Homo sapiens
cgcatgcgggtgtgggccagg

SEQ ID NO: 40972 - DNA, 18 bp, Homo sapiens
cgcggcggcgcaggccgc

SEQ ID NO: 40973 - DNA, 20 bp, Homo sapiens
gcgtgtggtgcaggccaagc

SEQ ID NO: 40974 - DNA, 21 bp, Homo sapiens
cgtacgcggcgtagcgcgcgt

SEQ ID NO: 40975 - DNA, 24 bp, Homo sapiens
acgcaggcggcgatcagaggctgt

SEQ ID NO: 40976 - DNA, 17 bp, Homo sapiens
cgcggtgcagtaggccg

SEQ ID NO: 40977 - DNA, 18 bp, Homo sapiens
gcgatgtggcgcagggag

SEQ ID NO: 40978 - DNA, 97 bp, Human herpesvirus 4
gacaaagagctgctcgctcaggctgttctgtgaatagtacactggggtgtaggagagggccctggtgagacacgtgtctgggaggcggcagttggtc

SEQ ID NO: 40979 - DNA, 24 bp, Human herpesvirus 4
tcgctcaggctgttctgtgaatag

SEQ ID NO: 40980 - DNA, 18 bp, Homo sapiens
tcacttgctctgtgggta

SEQ ID NO: 40981 - DNA, 24 bp, Homo sapiens
aggctgtttactaacgtgaatagc

SEQ ID NO: 40982 - DNA, 19 bp, Homo sapiens
ggtgatattttgtgaatag

SEQ ID NO: 40983 - DNA, 22 bp, Homo sapiens
tcgtttgggctactgtgaatag

SEQ ID NO: 40984 - DNA, 15 bp, Homo sapiens
gccagctccctgtga

SEQ ID NO: 40985 - DNA, 19 bp, Homo sapiens
tcgcatggtactgtgaata

SEQ ID NO: 40986 - DNA, 21 bp, Homo sapiens
tcgtttggctactgtgaatag

SEQ ID NO: 40987 - DNA, 18 bp, Homo sapiens
gccaggctgtttcctgtg

SEQ ID NO: 40988 - DNA, 19 bp, Homo sapiens
tcgcccaggctgtagcgca

SEQ ID NO: 40989 - DNA, 17 bp, Homo sapiens
gcccaggctgttcttga

SEQ ID NO: 40990 - DNA, 18 bp, Homo sapiens
gctcaggctgccggggtg

SEQ ID NO: 40991 - DNA, 20 bp, Homo sapiens
tcgccaggctgttgtccatg

SEQ ID NO: 40992 - DNA, 19 bp, Homo sapiens
tcgcccaggctgtagtgca

SEQ ID NO: 40993 - DNA, 16 bp, Homo sapiens
tcctcaggcttctgtg

SEQ ID NO: 40994 - DNA, 18 bp, Homo sapiens
gctcaggctgcttttgca

SEQ ID NO: 40995 - DNA, 19 bp, Homo sapiens
tcgtccaggctgtagtgca

SEQ ID NO: 40996 - DNA, 22 bp, Homo sapiens
tcgcccaggctggaggggagtg

SEQ ID NO: 40997 - DNA, 109 bp, Human herpesvirus 4
cgaggcgttgtggcacaaacaaaacaggcggaagccctcgtcaggccgcgagaggatggcatcgaggatggcctccgcaatgtcagtgtttgaggccacaagggccttg

SEQ ID NO: 40998 - DNA, 24 bp, Human herpesvirus 4
cgttgtggcacaaacaaaacaggc

SEQ ID NO: 40999 - DNA, 19 bp, Homo sapiens
tgtgtgcacataaaacagg

SEQ ID NO: 41000 - DNA, 19 bp, Homo sapiens
ttgtggcacaaatgaaaac

SEQ ID NO: 41001 - DNA, 22 bp, Homo sapiens
gccaagcacagataaagcaggc

SEQ ID NO: 41002 - DNA, 20 bp, Homo sapiens
ttgttggcagcaaggtaggc

SEQ ID NO: 41003 - DNA, 20 bp, Homo sapiens
cgttgctgggggaaaacaga

SEQ ID NO: 41004 - DNA, 19 bp, Homo sapiens
tatagcaaatgaaacaggc

SEQ ID NO: 41005 - DNA, 16 bp, Homo sapiens
tgtgaaagcaaaacag

SEQ ID NO: 41006 - DNA, 19 bp, Homo sapiens
gtgtggcacagcgtacagg

SEQ ID NO: 41007 - DNA, 21 bp, Homo sapiens
ttgtgggccatacaaaacagg

SEQ ID NO: 41008 - DNA, 23 bp, Homo sapiens
ctacaaaaacaaacaaaacaggc

SEQ ID NO: 41009 - DNA, 23 bp, Homo sapiens
gttgtgtgcaaatggacaaaggc

SEQ ID NO: 41010 - DNA, 19 bp, Homo sapiens
tgtggtcaggcaaaacagg

SEQ ID NO: 41011 - DNA, 21 bp, Homo sapiens
atggccacaggcaggacaggc

SEQ ID NO: 41012 - DNA, 18 bp, Homo sapiens
cgtgtggcacaaaggagg

SEQ ID NO: 41013 - DNA, 22 bp, Homo sapiens
cgtgtggcacaaatgaagtcag

SEQ ID NO: 41014 - DNA, 21 bp, Homo sapiens
tcatgacacaagcagagcagg

SEQ ID NO: 41015 - DNA, 30 bp, Homo sapiens
ccttgtggcacagacctcacaagacaggcg

SEQ ID NO: 41016 - DNA, 23 bp, Homo sapiens
gctgaaaacaaaacaaaataggc

SEQ ID NO: 41017 - DNA, 21 bp, Homo sapiens
gctgtgtggggcagaacaggc

SEQ ID NO: 41018 - DNA, 22 bp, Homo sapiens
cgttgtggttttcaaaatgggc

SEQ ID NO: 41019 - DNA, 82 bp, Human herpesvirus 2
gtcggggcgggagagttcactcggcacgcatgcacgtgtaaccgccagtccgtgcttgcctagcgaactcacccgtcccggc

SEQ ID NO: 41020 - DNA, 24 bp, Human herpesvirus 2
tccgtgcttgcctagcgaactcac

SEQ ID NO: 41021 - DNA, 20 bp, Homo sapiens
tccgtgtttggtgacctaac

SEQ ID NO: 41022 - DNA, 22 bp, Homo sapiens
tccgctgctgcgccgcgagctc

SEQ ID NO: 41023 - DNA, 20 bp, Homo sapiens
ccgtgccccagtggactcac

SEQ ID NO: 41024 - DNA, 19 bp, Homo sapiens
tccttgcttgcctcaaact

SEQ ID NO: 41025 - DNA, 22 bp, Homo sapiens
tccgtgcttgcgtttctctcac

SEQ ID NO: 41026 - DNA, 19 bp, Homo sapiens
gtgcctgcttatggaagct

SEQ ID NO: 41027 - DNA, 21 bp, Homo sapiens
tcggtgcttgcttagaggcac

SEQ ID NO: 41028 - DNA, 23 bp, Homo sapiens
tcctgcttgcctggctccagcac

SEQ ID NO: 41029 - DNA, 20 bp, Homo sapiens
ccgtgcttggccaggactca

SEQ ID NO: 41030 - DNA, 17 bp, Homo sapiens
catgcttgccttcctca

SEQ ID NO: 41031 - DNA, 21 bp, Homo sapiens
gtgctttgtagcagaactcac

SEQ ID NO: 41032 - DNA, 18 bp, Homo sapiens
tccgtgcttatttgaact

SEQ ID NO: 41033 - DNA, 21 bp, Homo sapiens
ccgtgcttgtttcaaactcac

SEQ ID NO: 41034 - DNA, 20 bp, Homo sapiens
tccgtgctggcctgagctca

SEQ ID NO: 41035 - DNA, 18 bp, Homo sapiens
gtgccttgccaaactcac

SEQ ID NO: 41036 - DNA, 127 bp, Human herpesvirus 4
cgtgacatggagaaactgggggaatttgtcttctggcacagctgttgccagggtgctcatgagcgagggccagatgcaggagctgacccaggcgacgagatccaggcccagatgtccctctatcatg

SEQ ID NO: 41037 - DNA, 24 bp, Human herpesvirus 4
agctgttgccagggtgctcatgag

SEQ ID NO: 41038 - DNA, 24 bp, Homo sapiens
agctgttgtgcagcagagtgtgag

SEQ ID NO: 41039 - DNA, 22 bp, Homo sapiens
agctgctgctggattctgtgag

SEQ ID NO: 41040 - DNA, 22 bp, Homo sapiens
agcagttgccagggctggtgag

SEQ ID NO: 41041 - DNA, 15 bp, Homo sapiens
actgtggtgctcatg

SEQ ID NO: 41042 - DNA, 18 bp, Homo sapiens
tgtctgcgtgctcgtgag

SEQ ID NO: 41043 - DNA, 21 bp, Homo sapiens
gctgcctggggtgctcatgag

SEQ ID NO: 41044 - DNA, 18 bp, Homo sapiens
gctgttgctggtgtctga

SEQ ID NO: 41045 - DNA, 17 bp, Homo sapiens
tgtaccaagcttatgag

SEQ ID NO: 41046 - DNA, 18 bp, Homo sapiens
agctgttgctcaggagcc

SEQ ID NO: 41047 - DNA, 15 bp, Homo sapiens
gctgttgccagcatg

SEQ ID NO: 41048 - DNA, 16 bp, Homo sapiens
aactgttgctctcatg

SEQ ID NO: 41049 - DNA, 20 bp, Homo sapiens
gttattatagtgctcatgag

SEQ ID NO: 41050 - DNA, 17 bp, Homo sapiens
agtggttgccaggggct

SEQ ID NO: 41051 - DNA, 21 bp, Homo sapiens
agctgttgcacaggactagtg

SEQ ID NO: 41052 - DNA, 15 bp, Homo sapiens
gttgccaggggctga

SEQ ID NO: 41053 - DNA, 23 bp, Homo sapiens
agctgttgcaaggatgaaatgag

SEQ ID NO: 41054 - DNA, 130 bp, Human herpesvirus 1
gggcgtggccgctattataaaaaaagtgagaacgcgaagcgttcgcactttgtcctaataatatatatattattaggacaaagtgcgaacgcttcgcgttctcactttttttataatagcggccacgccc

SEQ ID NO: 41055 - DNA, 24 bp, Human herpesvirus 1
ttaggacaaagtgcgaacgcttcg

SEQ ID NO: 41056 - DNA, 23 bp, Homo sapiens
ggacaaagtgtggactgttgctt

SEQ ID NO: 41057 - DNA, 83 bp, Human herpesvirus 2
ccgcccgcccgacccccgaataaaccacacaaggcggtacgttttcgtctgtctcgttctttatttctcacacacgcgcgcgg

SEQ ID NO: 41058 - DNA, 24 bp, Human herpesvirus 2
taaaccacacaaggcggtacgttt

SEQ ID NO: 41059 - DNA, 19 bp, Homo sapiens
caaaccacacaagaactgt

SEQ ID NO: 41060 - DNA, 18 bp, Homo sapiens
cagaaggcggcagcattt

SEQ ID NO: 41061 - DNA, 16 bp, Homo sapiens
taaatcacacaaaggt

SEQ ID NO: 41062 - DNA, 19 bp, Homo sapiens
taaacacacaaggtggcac

SEQ ID NO: 41063 - DNA, 21 bp, Homo sapiens
tgaccacacactcatgtgttt

SEQ ID NO: 41064 - DNA, 16 bp, Homo sapiens
taaaccacaaatacgt

SEQ ID NO: 41065 - DNA, 19 bp, Homo sapiens
acacgaccacagtacgttt

SEQ ID NO: 41066 - DNA, 23 bp, Homo sapiens
ccacacaaggttaggtaatgttt

SEQ ID NO: 41067 - DNA, 19 bp, Homo sapiens
ccacttaagcagcatgttt

SEQ ID NO: 41068 - DNA, 93 bp, Human herpesvirus 4
ccgcgcaggaaggggaaggcctcctccgccggcaggtgcagcgtcagaaccaggccgcagcggctctgtgaggtcagccgcttcttgggcagg

SEQ ID NO: 41069 - DNA, 24 bp, Human herpesvirus 4
tgtgaggtcagccgcttcttgggc

SEQ ID NO: 41070 - DNA, 19 bp, Homo sapiens
tggggatgcgtttcttggg

SEQ ID NO: 41071 - DNA, 23 bp, Homo sapiens
tggaggtcaaagtggttttgggc

SEQ ID NO: 41072 - DNA, 22 bp, Homo sapiens
gtggggtcagcccgaggtgggc

SEQ ID NO: 41073 - DNA, 19 bp, Homo sapiens
tgtgaggcagctgcagggg

SEQ ID NO: 41074 - DNA, 19 bp, Homo sapiens
tgagattctgcttcttggg

SEQ ID NO: 41075 - DNA, 19 bp, Homo sapiens
tggaggtcagcagcttggg

SEQ ID NO: 41076 - DNA, 16 bp, Homo sapiens
tgtgaggtcagcctgg

SEQ ID NO: 41077 - DNA, 18 bp, Homo sapiens
tatgaggtcactcttggg

SEQ ID NO: 41078 - DNA, 20 bp, Homo sapiens
tgtgaggtcagcagggaggg

SEQ ID NO: 41079 - DNA, 21 bp, Homo sapiens
tggagggcagggcttcttggg

SEQ ID NO: 41080 - DNA, 19 bp, Homo sapiens
tgtgaggtccagctgttag

SEQ ID NO: 41081 - DNA, 17 bp, Homo sapiens
tgtgaggttggctcttg

SEQ ID NO: 41082 - DNA, 21 bp, Homo sapiens
tgaggtcaccagattcttggg

SEQ ID NO: 41083 - DNA, 20 bp, Homo sapiens
tgtgaggtcagtgtccctgg

SEQ ID NO: 41084 - DNA, 20 bp, Homo sapiens
tgtaggctttgtttcttggg

SEQ ID NO: 41085 - DNA, 15 bp, Homo sapiens
tggaggtcagcctgg

SEQ ID NO: 41086 - DNA, 17 bp, Homo sapiens
gtgagatgtttcttggg

SEQ ID NO: 41087 - DNA, 20 bp, Homo sapiens
tgtgaggttggcagctcttg

SEQ ID NO: 41088 - DNA, 61 bp, Molluscum contagiosum virus
ggtgctccaagattactagtattaccttggcgtagaggtggtaggtgtggaagggcgcgcc

SEQ ID NO: 41089 - DNA, 23 bp, Molluscum contagiosum virus
tggtaggtgtggaagggcgcgcc

SEQ ID NO: 41090 - DNA, 19 bp, Homo sapiens
tggtagtgtggaatttagc

SEQ ID NO: 41091 - DNA, 19 bp, Homo sapiens
ggtgggtgtggaggtggcc

SEQ ID NO: 41092 - DNA, 17 bp, Homo sapiens
ggtgggtgtgggggcac

SEQ ID NO: 41093 - DNA, 17 bp, Homo sapiens
ggtgggtgtgggagaca

SEQ ID NO: 41094 - DNA, 19 bp, Homo sapiens
tggaggtgtgggagatcgg

SEQ ID NO: 41095 - DNA, 18 bp, Homo sapiens
tgggggtgtggaagggac

SEQ ID NO: 41096 - DNA, 20 bp, Homo sapiens
tggcggcgggagggcgcgcc

SEQ ID NO: 41097 - DNA, 16 bp, Homo sapiens
tggtgggtgggaggcg

SEQ ID NO: 41098 - DNA, 19 bp, Homo sapiens
tgctaggtgtggaagtcgg

SEQ ID NO: 41099 - DNA, 18 bp, Homo sapiens
ggtgggctggggcgcgcc

SEQ ID NO: 41100 - DNA, 18 bp, Homo sapiens
tggaggtgtgggcagtgg

SEQ ID NO: 41101 - DNA, 19 bp, Homo sapiens
tggtggtgtgggaagttgg

SEQ ID NO: 41102 - DNA, 25 bp, Homo sapiens
tggcaggtggcgatagggggcgtgc

SEQ ID NO: 41103 - DNA, 18 bp, Homo sapiens
tggtaggtgagggagaac

SEQ ID NO: 41104 - DNA, 18 bp, Homo sapiens
tggtgggtgtgaagctgg

SEQ ID NO: 41105 - DNA, 19 bp, Homo sapiens
tggtggggtggggggaaac

SEQ ID NO: 41106 - DNA, 18 bp, Homo sapiens
tgggaggtgtgggggagc

SEQ ID NO: 41107 - DNA, 19 bp, Homo sapiens
ggtaggtgtgggggaagga

SEQ ID NO: 41108 - DNA, 19 bp, Homo sapiens
ggtgggtgtggggcagggc

SEQ ID NO: 41109 - DNA, 29 bp, Homo sapiens
tggcaggtgtgtgtgtgtgttggcgcgcc

SEQ ID NO: 41110 - DNA, 18 bp, Homo sapiens
tgggggtgtggaacaggc

SEQ ID NO: 41111 - DNA, 22 bp, Homo sapiens
tggaggtgtggggaggggggcg

SEQ ID NO: 41112 - DNA, 21 bp, Homo sapiens
tggaggtgtgggcagcgcgcc

SEQ ID NO: 41113 - DNA, 21 bp, Homo sapiens
tggcaggtgtggagctgtggc

SEQ ID NO: 41114 - DNA, 18 bp, Homo sapiens
tggtaggtgagcttgcgc

SEQ ID NO: 41115 - DNA, 18 bp, Homo sapiens
tggtagatgtggactggg

SEQ ID NO: 41116 - DNA, 17 bp, Homo sapiens
tgggggtgtggacacgc

SEQ ID NO: 41117 - DNA, 19 bp, Homo sapiens
tggtggggtggagggcaca

SEQ ID NO: 41118 - DNA, 16 bp, Homo sapiens
tgggaggtgtgggggc

SEQ ID NO: 41119 - DNA, 24 bp, Homo sapiens
tggtaggtttggaagaccggcgcc

SEQ ID NO: 41120 - DNA, 106 bp, Molluscum contagiosum virus
gggtacgcgcgagcgagcgccggggctctgcgcagcgtgctggcgttcgttcgcgccagtgcgtagccgttctgcgtcagtgtccgggttcgccaccggcgtattc

SEQ ID NO: 41121 - DNA, 24 bp, Molluscum contagiosum virus
cagtgcgtagccgttctgcgtcag

SEQ ID NO: 41122 - DNA, 23 bp, Homo sapiens
cagtgcgcagccgtgactttcag

SEQ ID NO: 41123 - DNA, 20 bp, Homo sapiens
gtggtggactcttctgcgtc

SEQ ID NO: 41124 - DNA, 19 bp, Homo sapiens
cagtgcatggctgttatcg

SEQ ID NO: 41125 - DNA, 20 bp, Homo sapiens
agtgcatagctgctcaatgt

SEQ ID NO: 41126 - DNA, 17 bp, Homo sapiens
cagtgcgtagtgttctg

SEQ ID NO: 41127 - DNA, 19 bp, Homo sapiens
gtgctgctggctgcgtcag

SEQ ID NO: 41128 - DNA, 20 bp, Homo sapiens
gtcgtagccagtggtgtcag

SEQ ID NO: 41129 - DNA, 83 bp, Molluscum contagiosum virus
gcggcgagacgaagtccagcacgcgcgcgtgcgggaagcgcatgaccagcgtcaggcacgcgcgcgtgtcttccagccgctgc

SEQ ID NO: 41130 - DNA, 24 bp, Molluscum contagiosum virus
aggcacgcgcgcgtgtcttccagc

SEQ ID NO: 41131 - DNA, 23 bp, Homo sapiens
ggatgcgcgccccgagttccggc

SEQ ID NO: 41132 - DNA, 19 bp, Homo sapiens
aggcatcgcgcacgtccag

SEQ ID NO: 41133 - DNA, 21 bp, Homo sapiens
aggtggctgccgtcttccagc

SEQ ID NO: 41134 - DNA, 23 bp, Homo sapiens
ggcgtatcactgtgtcttctagc

SEQ ID NO: 41135 - DNA, 25 bp, Homo sapiens
aggtgcgcgcgcatcccaggccagc

SEQ ID NO: 41136 - DNA, 22 bp, Homo sapiens
gggcgcgtgtgtgacctttagc

SEQ ID NO: 41137 - DNA, 22 bp, Homo sapiens
agctgcgtgcgtctcctccggc

SEQ ID NO: 41138 - DNA, 18 bp, Homo sapiens
gcacgcgcgcgtgcacag

SEQ ID NO: 41139 - DNA, 21 bp, Homo sapiens
ggcaggcgtgccccttctggc

SEQ ID NO: 41140 - DNA, 22 bp, Homo sapiens
ggcgcgcgcacgcccctccagc

SEQ ID NO: 41141 - DNA, 17 bp, Homo sapiens
ggcacgccaccttccag

SEQ ID NO: 41142 - DNA, 23 bp, Homo sapiens
aggcgcgtgcgttgccacccggc

SEQ ID NO: 41143 - DNA, 21 bp, Homo sapiens
aggcgcgcgcgtgggtccagc

SEQ ID NO: 41144 - DNA, 23 bp, Homo sapiens
ggagcgcgcgcggcggacccggc

SEQ ID NO: 41145 - DNA, 18 bp, Homo sapiens
agacgcgcgcgcgcgcct

SEQ ID NO: 41146 - DNA, 19 bp, Homo sapiens
ggcgcgcccgtgcaaaccc

SEQ ID NO: 41147 - DNA, 18 bp, Homo sapiens
aggcatgcggcgccctcc

SEQ ID NO: 41148 - DNA, 19 bp, Homo sapiens
aggctgcgagatcttccag

SEQ ID NO: 41149 - DNA, 18 bp, Homo sapiens
ggcacgtccgcgacccag

SEQ ID NO: 41150 - DNA, 18 bp, Homo sapiens
ggcacgctgcccctccag

SEQ ID NO: 41151 - DNA, 18 bp, Homo sapiens
aggcaagcgcgcctctag

SEQ ID NO: 41152 - DNA, 23 bp, Homo sapiens
ggcacgtccgcgcctacttcagc

SEQ ID NO: 41153 - DNA, 18 bp, Homo sapiens
gcgcatgcgcgcttccag

SEQ ID NO: 41154 - DNA, 20 bp, Homo sapiens
ggcatgcacgtgccctcggc

SEQ ID NO: 41155 - DNA, 20 bp, Homo sapiens
gcgcgcgtggggcgtccagc

SEQ ID NO: 41156 - DNA, 20 bp, Homo sapiens
agcatgcggcatcttctggc

SEQ ID NO: 41157 - DNA, 17 bp, Homo sapiens
aggggcgcgcgcggctc

SEQ ID NO: 41158 - DNA, 24 bp, Homo sapiens
agcgcgcgcgtgtgtgaaaggagc

SEQ ID NO: 41159 - DNA, 22 bp, Homo sapiens
ggcgcatgcgtgtggtcccagc

SEQ ID NO: 41160 - DNA, 21 bp, Homo sapiens
ggcactgtcagttcttccagc

SEQ ID NO: 41161 - DNA, 22 bp, Homo sapiens
ggcgcgcgctcacgactccagc

SEQ ID NO: 41162 - DNA, 22 bp, Homo sapiens
aggcacgtgttactatttccag

SEQ ID NO: 41163 - DNA, 23 bp, Homo sapiens
ggaaaagcactgtgtcttccagc

SEQ ID NO: 41164 - DNA, 22 bp, Homo sapiens
aggcaggtgtgcgtcccctggc

SEQ ID NO: 41165 - DNA, 20 bp, Homo sapiens
gcacgcgtccgccttctggc

SEQ ID NO: 41166 - DNA, 17 bp, Homo sapiens
gcgcgcgcgcccccggc

SEQ ID NO: 41167 - DNA, 15 bp, Homo sapiens
agggcgcgcgccagc

SEQ ID NO: 41168 - DNA, 21 bp, Homo sapiens
ggcactggtcagtcttccagc

SEQ ID NO: 41169 - DNA, 21 bp, Homo sapiens
aggtgggcggtctcttccagc

SEQ ID NO: 41170 - DNA, 16 bp, Homo sapiens
aggcggcgcgcgccca

SEQ ID NO: 41171 - DNA, 21 bp, Homo sapiens
aggcatctgcgcccctccagc

SEQ ID NO: 41172 - DNA, 17 bp, Homo sapiens
ggcccgcgcgcctccag

SEQ ID NO: 41173 - DNA, 21 bp, Homo sapiens
gcgcgcgtgcagggagcccag

SEQ ID NO: 41174 - DNA, 21 bp, Homo sapiens
ggcgggcgggcttcttccagc

SEQ ID NO: 41175 - DNA, 22 bp, Homo sapiens
aggcacgggcctgccttccagc

SEQ ID NO: 41176 - DNA, 21 bp, Homo sapiens
ggcacgcgcgccgtccgcagc

SEQ ID NO: 41177 - DNA, 25 bp, Homo sapiens
gggtgtgcgcgcgccgacctctggc

SEQ ID NO: 41178 - DNA, 23 bp, Homo sapiens
aggtgcgtgcctgtaatcccagc

SEQ ID NO: 41179 - DNA, 16 bp, Homo sapiens
agcacgtgcgcgtcca

SEQ ID NO: 41180 - DNA, 21 bp, Homo sapiens
agggggtacgtgtcttccagc

SEQ ID NO: 41181 - DNA, 61 bp, Murid herpesvirus 4
acacacctacaaatttacatctacaggattgcctgagagactgctaaaattgtttgtctgt

SEQ ID NO: 41182 - DNA, 17 bp, Murid herpesvirus 4
taaaattgtttgtctgt

SEQ ID NO: 41183 - DNA, 18 bp, Homo sapiens
taaaattgctctgactgt

SEQ ID NO: 41184 - DNA, 18 bp, Homo sapiens
aaattgttctaagtctgt

SEQ ID NO: 41185 - DNA, 96 bp, Murid herpesvirus 4
tttatcctgcaagactgtggccagcttaccaaaaaattctctagatattgacaaactggaagatattttggggtgcccggtccagtcctggataga

SEQ ID NO: 41186 - DNA, 24 bp, Murid herpesvirus 4
tattttggggtgcccggtccagtc

SEQ ID NO: 41187 - DNA, 19 bp, Homo sapiens
ttttggggatgctgttagt

SEQ ID NO: 41188 - DNA, 21 bp, Homo sapiens
tttggggtttgaggttcagtc

SEQ ID NO: 41189 - DNA, 22 bp, Homo sapiens
tattttggggcatggtctggtc

SEQ ID NO: 41190 - DNA, 17 bp, Homo sapiens
tattttgggggtgtagt

SEQ ID NO: 41191 - DNA, 18 bp, Homo sapiens
tattttggggagactggt

SEQ ID NO: 41192 - DNA, 19 bp, Homo sapiens
tattctggggtgatccagt

SEQ ID NO: 41193 - DNA, 67 bp, Molluscum contagiosum virus
cttctggcgggcagctctgctggcaggcatccttggctcggcttgccggcgtcctcttcccgcggag

SEQ ID NO: 41194 - DNA, 24 bp, Molluscum contagiosum virus
tggcgggcagctctgctggcaggc

SEQ ID NO: 41195 - DNA, 21 bp, Homo sapiens
ggcgggcggcgggcggcgggc

SEQ ID NO: 41196 - DNA, 22 bp, Homo sapiens
ggtgggcagctcattctgcagg

SEQ ID NO: 41197 - DNA, 23 bp, Homo sapiens
ggcgggcgggcgggctggcaggc

SEQ ID NO: 41198 - DNA, 19 bp, Homo sapiens
tggcgggcgggcgggcggg

SEQ ID NO: 41199 - DNA, 20 bp, Homo sapiens
ggcgggctggggtggtgggc

SEQ ID NO: 41200 - DNA, 18 bp, Homo sapiens
tgggggcctgctggtggg

SEQ ID NO: 41201 - DNA, 17 bp, Homo sapiens
ggcgggcggctgcgggc

SEQ ID NO: 41202 - DNA, 21 bp, Homo sapiens
ggtgggtgccgtctggcaggc

SEQ ID NO: 41203 - DNA, 23 bp, Homo sapiens
tggcgggcagcgccccgtgcagg

SEQ ID NO: 41204 - DNA, 18 bp, Homo sapiens
ggtgggcggctctccagg

SEQ ID NO: 41205 - DNA, 22 bp, Homo sapiens
ggcgggcggctcgcccacgggc

SEQ ID NO: 41206 - DNA, 21 bp, Homo sapiens
tggcgggcgggcagggcgggc

SEQ ID NO: 41207 - DNA, 22 bp, Homo sapiens
tggcgggcggcgcctctcaggc

SEQ ID NO: 41208 - DNA, 23 bp, Homo sapiens
tggcgggcggcgtgcgggcaggc

SEQ ID NO: 41209 - DNA, 23 bp, Homo sapiens
tggtgggggctctgcctgtgagg

SEQ ID NO: 41210 - DNA, 20 bp, Homo sapiens
ggtgggcagctgagagcagg

SEQ ID NO: 41211 - DNA, 21 bp, Homo sapiens
tggcaggcagggctggcaggc

SEQ ID NO: 41212 - DNA, 24 bp, Homo sapiens
tggcgggctgacgagctggcgggc

SEQ ID NO: 41213 - DNA, 19 bp, Homo sapiens
tggtgggcagcccctgggc

SEQ ID NO: 41214 - DNA, 22 bp, Homo sapiens
tggtgggggctctgctggaggc

SEQ ID NO: 41215 - DNA, 19 bp, Homo sapiens
tggcgggcgagccggcggg

SEQ ID NO: 41216 - DNA, 16 bp, Homo sapiens
tggcggcagctcccag

SEQ ID NO: 41217 - DNA, 17 bp, Homo sapiens
tggcggcagctctgccg

SEQ ID NO: 41218 - DNA, 20 bp, Homo sapiens
tggcgggcggctctcgcagg

SEQ ID NO: 41219 - DNA, 16 bp, Homo sapiens
tggcgggcagcactgg

SEQ ID NO: 41220 - DNA, 22 bp, Homo sapiens
tggcggacagctctctctgggc

SEQ ID NO: 41221 - DNA, 21 bp, Homo sapiens
tggcaggcggctcctgcaggc

SEQ ID NO: 41222 - DNA, 22 bp, Homo sapiens
tagcgaggctttgctggcaggc

SEQ ID NO: 41223 - DNA, 21 bp, Homo sapiens
tggcgggcggcgctgcgaagc

SEQ ID NO: 41224 - DNA, 23 bp, Homo sapiens
tggtgggcacatctgctggcagg

SEQ ID NO: 41225 - DNA, 19 bp, Homo sapiens
tggcgggcgggcgggcagg

SEQ ID NO: 41226 - DNA, 19 bp, Homo sapiens
tggtgggaggtgtggcagg

SEQ ID NO: 41227 - DNA, 18 bp, Homo sapiens
cggcgggcggctctaggc

SEQ ID NO: 41228 - DNA, 18 bp, Homo sapiens
tgggggcattttggcagg

SEQ ID NO: 41229 - DNA, 19 bp, Homo sapiens
tggcgggcaggcgggtggg

SEQ ID NO: 41230 - DNA, 22 bp, Homo sapiens
tggcgggcgacgggcggcgggc

SEQ ID NO: 41231 - DNA, 22 bp, Homo sapiens
tggctggcagcagagggcaggc

SEQ ID NO: 41232 - DNA, 20 bp, Homo sapiens
ggtgggcagctagagcaggc

SEQ ID NO: 41233 - DNA, 17 bp, Homo sapiens
tgggggcagctttgggc

SEQ ID NO: 41234 - DNA, 19 bp, Homo sapiens
gggcagcttccgtgtgggc

SEQ ID NO: 41235 - DNA, 19 bp, Homo sapiens
tggcgggcagtcttgcagg

SEQ ID NO: 41236 - DNA, 16 bp, Homo sapiens
tggcggatgctggcag

SEQ ID NO: 41237 - DNA, 18 bp, Homo sapiens
tggtgggcagctcgcagg

SEQ ID NO: 41238 - DNA, 16 bp, Homo sapiens
tggctggcactggcag

SEQ ID NO: 41239 - DNA, 23 bp, Homo sapiens
tggcgggcggcgtgggggcaggc

SEQ ID NO: 41240 - DNA, 23 bp, Homo sapiens
tggtgggcagcctgtgagatggc

SEQ ID NO: 41241 - DNA, 24 bp, Homo sapiens
ggtgggcagctccaggtgcctgca

SEQ ID NO: 41242 - DNA, 21 bp, Homo sapiens
tggccggtggttcctagcagg

SEQ ID NO: 41243 - DNA, 19 bp, Homo sapiens
tggcgggcggctcggcagg

SEQ ID NO: 41244 - DNA, 18 bp, Homo sapiens
tggcgggcacctctgtgc

SEQ ID NO: 41245 - DNA, 17 bp, Homo sapiens
tggcaggcagttctggg

SEQ ID NO: 41246 - DNA, 22 bp, Homo sapiens
ggtgggcatgggcttggcaggc

SEQ ID NO: 41247 - DNA, 21 bp, Homo sapiens
tgggggcagcccaaggtgggc

SEQ ID NO: 41248 - DNA, 80 bp, Melanoplus sanguinipes entomopoxvirus
acagcatttaatacatattctaaatctaagtaatataatttatataattcattatttaatttagttttattcggtgatgt

SEQ ID NO: 41249 - DNA, 24 bp, Melanoplus sanguinipes entomopoxvirus
ttcattatttaatttagttttatt

SEQ ID NO: 41250 - DNA, 19 bp, Homo sapiens
ttcatgtttaattcagttt

SEQ ID NO: 41251 - DNA, 21 bp, Homo sapiens
attatttaaatcagttttatt

SEQ ID NO: 41252 - DNA, 18 bp, Homo sapiens
ttcattatttgacttagt

SEQ ID NO: 41253 - DNA, 25 bp, Homo sapiens
ttcattatctaatttctattttatt

SEQ ID NO: 41254 - DNA, 23 bp, Homo sapiens
ttcagtacaaccttagttttatt

SEQ ID NO: 41255 - DNA, 70 bp, Marburg virus
agtggactctccacttctcttctcgagtattccctataagtgatttacttgatagaatgtcaagtccact

SEQ ID NO: 41256 - DNA, 18 bp, Marburg virus
tagaatgtcaagtccact

SEQ ID NO: 41257 - DNA, 17 bp, Homo sapiens
tagaatgtcctatcact

SEQ ID NO: 41258 - DNA, 18 bp, Homo sapiens
taaaatgcaaagtccact

SEQ ID NO: 41259 - DNA, 16 bp, Homo sapiens
caggatgtagtccact

SEQ ID NO: 41260 - DNA, 17 bp, Homo sapiens
taggtgtcaaattcact

SEQ ID NO: 41261 - DNA, 19 bp, Homo sapiens
taaaatgtcaaaagacact

SEQ ID NO: 41262 - DNA, 16 bp, Homo sapiens
tacaattcagtccact

SEQ ID NO: 41263 - DNA, 15 bp, Homo sapiens
taaaacaagtccact

SEQ ID NO: 41264 - DNA, 20 bp, Homo sapiens
tagaacgtccctctgtcact

SEQ ID NO: 41265 - DNA, 15 bp, Homo sapiens
tagaatgcaaccact

SEQ ID NO: 41266 - DNA, 17 bp, Homo sapiens
tagaatgtctaatccct

SEQ ID NO: 41267 - DNA, 25 bp, Homo sapiens
cagaatgtcatgccacagtccacta

SEQ ID NO: 41268 - DNA, 16 bp, Homo sapiens
taaaatgtaagccact

SEQ ID NO: 41269 - DNA, 19 bp, Homo sapiens
tagaatatcttcatccact

SEQ ID NO: 41270 - DNA, 21 bp, Homo sapiens
tagaaagtcaagtcaatcact

SEQ ID NO: 41271 - DNA, 20 bp, Homo sapiens
taaaatgtcagaggtacact

SEQ ID NO: 41272 - DNA, 18 bp, Homo sapiens
tagtatgtcctgcccact

SEQ ID NO: 41273 - DNA, 18 bp, Homo sapiens
gaatgtcaaggacccact

SEQ ID NO: 41274 - DNA, 21 bp, Homo sapiens
tagaatgtctggcagatcact

SEQ ID NO: 41275 - DNA, 15 bp, Homo sapiens
cagagccagtccact

SEQ ID NO: 41276 - DNA, 18 bp, Homo sapiens
agaatatcactgtccact

SEQ ID NO: 41277 - DNA, 16 bp, Homo sapiens
caaaatgaagtccact

SEQ ID NO: 41278 - DNA, 15 bp, Homo sapiens
tagaatgagtccact

SEQ ID NO: 41279 - DNA, 18 bp, Homo sapiens
aaatgtcaaaggtctact

SEQ ID NO: 41280 - DNA, 17 bp, Homo sapiens
taaaagttaagtccact

SEQ ID NO: 41281 - DNA, 18 bp, Homo sapiens
cagaagtctgagtccact

SEQ ID NO: 41282 - DNA, 17 bp, Homo sapiens
taaaaatcaagtccact

SEQ ID NO: 41283 - DNA, 18 bp, Homo sapiens
cagaatgtcttctccact

SEQ ID NO: 41284 - DNA, 16 bp, Homo sapiens
taaaatgtggtccact

SEQ ID NO: 41285 - DNA, 19 bp, Homo sapiens
gaatgtcagcaaatccact

SEQ ID NO: 41286 - DNA, 15 bp, Homo sapiens
taaaatgtgtccact

SEQ ID NO: 41287 - DNA, 20 bp, Homo sapiens
agaatgtcaaaagcagcact

SEQ ID NO: 41288 - DNA, 15 bp, Homo sapiens
cagaatgccaccact

SEQ ID NO: 41289 - DNA, 19 bp, Homo sapiens
caggacatcaaggtccact

SEQ ID NO: 41290 - DNA, 18 bp, Homo sapiens
cagatggcagagtccact

SEQ ID NO: 41291 - DNA, 17 bp, Homo sapiens
cagcatacaagtccact

SEQ ID NO: 41292 - DNA, 18 bp, Homo sapiens
tagaatatcaaaagtact

SEQ ID NO: 41293 - DNA, 17 bp, Homo sapiens
tagaatgcctttccact

SEQ ID NO: 41294 - DNA, 21 bp, Homo sapiens
tagaatatttccccctccact

SEQ ID NO: 41295 - DNA, 85 bp, Leishmania RNA virus 1-1
caatgagatcgatgttgagactgaagcaagaagaaggctagatgtcggcagtctaagcatgcagaggctcgacgagaatgaattg

SEQ ID NO: 41296 - DNA, 24 bp, Leishmania RNA virus 1-1
gatgttgagactgaagcaagaaga

SEQ ID NO: 41297 - DNA, 19 bp, Homo sapiens
gatggtgtagagcaagaag

SEQ ID NO: 41298 - DNA, 19 bp, Homo sapiens
tgttggggacagcaagaag

SEQ ID NO: 41299 - DNA, 17 bp, Homo sapiens
tgttgagattggcaaaa

SEQ ID NO: 41300 - DNA, 21 bp, Homo sapiens
tgttgaggatggaatgcaaga

SEQ ID NO: 41301 - DNA, 19 bp, Homo sapiens
gatgtgggatttcaagaag

SEQ ID NO: 41302 - DNA, 22 bp, Homo sapiens
atgttgaggaactgcaggagga

SEQ ID NO: 41303 - DNA, 23 bp, Homo sapiens
gatgttggtgctcctcaagaaga

SEQ ID NO: 41304 - DNA, 18 bp, Homo sapiens
gaggctgaggcaagaaga

SEQ ID NO: 41305 - DNA, 22 bp, Homo sapiens
gatgttgagacttggagatcag

SEQ ID NO: 41306 - DNA, 18 bp, Homo sapiens
gagactgaggcaggagga

SEQ ID NO: 41307 - DNA, 21 bp, Homo sapiens
tgagagactgaggcaggagga

SEQ ID NO: 41308 - DNA, 22 bp, Homo sapiens
tgtggaggcaagaagcaggaag

SEQ ID NO: 41309 - DNA, 17 bp, Homo sapiens
atgcctggagcaagaag

SEQ ID NO: 41310 - DNA, 19 bp, Homo sapiens
tgttggaaagggcaagaag

SEQ ID NO: 41311 - DNA, 23 bp, Homo sapiens
gttgggagactgaggcaggagga

SEQ ID NO: 41312 - DNA, 22 bp, Homo sapiens
gatgtggagactgaggcccaga

SEQ ID NO: 41313 - DNA, 24 bp, Homo sapiens
tgttgagactgggttggtagaaga

SEQ ID NO: 41314 - DNA, 19 bp, Homo sapiens
gatgctgaggctggggaag

SEQ ID NO: 41315 - DNA, 22 bp, Homo sapiens
ctgagaggctgaagcaggagga

SEQ ID NO: 41316 - DNA, 22 bp, Homo sapiens
ttgagaggctgaagcaggagga

SEQ ID NO: 41317 - DNA, 19 bp, Homo sapiens
gatttgagactgagctaga

SEQ ID NO: 41318 - DNA, 19 bp, Homo sapiens
gacgttgaggtgcaagaag

SEQ ID NO: 41319 - DNA, 23 bp, Homo sapiens
atgttgggagagctggcaagaag

SEQ ID NO: 41320 - DNA, 18 bp, Homo sapiens
gatgttgaggcaggagaa

SEQ ID NO: 41321 - DNA, 21 bp, Homo sapiens
tgccagactgaagcaggagga

SEQ ID NO: 41322 - DNA, 22 bp, Homo sapiens
gatgttgaaggcttcagtcaag

SEQ ID NO: 41323 - DNA, 22 bp, Homo sapiens
tgctgagattgaaatttaaaag

SEQ ID NO: 41324 - DNA, 15 bp, Homo sapiens
atgttgagactggaa

SEQ ID NO: 41325 - DNA, 18 bp, Homo sapiens
gaagttgaaaccagggca

SEQ ID NO: 41326 - DNA, 17 bp, Homo sapiens
atgttgagctgcaggag

SEQ ID NO: 41327 - DNA, 21 bp, Homo sapiens
ggtgttacagaggcaagaaga

SEQ ID NO: 41328 - DNA, 20 bp, Homo sapiens
gatgttgaactggggctgga

SEQ ID NO: 41329 - DNA, 18 bp, Homo sapiens
gaggctgaagcaggagga

SEQ ID NO: 41330 - DNA, 24 bp, Homo sapiens
gatgaggaaactgaggcaggaaga

SEQ ID NO: 41331 - DNA, 24 bp, Homo sapiens
gatgtagaatcagaagcaaggaga

SEQ ID NO: 41332 - DNA, 17 bp, Homo sapiens
atgttgagatgaggaag

SEQ ID NO: 41333 - DNA, 21 bp, Homo sapiens
gatttgaggctgaagagtcag

SEQ ID NO: 41334 - DNA, 18 bp, Homo sapiens
gatgttgaacaagggaag

SEQ ID NO: 41335 - DNA, 19 bp, Homo sapiens
gaccccggctgaggcagga

SEQ ID NO: 41336 - DNA, 22 bp, Homo sapiens
gatgttgatggttggagcctga

SEQ ID NO: 41337 - DNA, 81 bp, Lymphocystis disease virus 1
taatacgatcgtttgaacattcgttgggtagtaaatcaattaatttttgcaatttagattgtttttcaagcggttctatta

SEQ ID NO: 41338 - DNA, 24 bp, Lymphocystis disease virus 1
gatcgtttgaacattcgttgggta

SEQ ID NO: 41339 - DNA, 17 bp, Homo sapiens
tcatttgtgcgttgggt

SEQ ID NO: 41340 - DNA, 21 bp, Homo sapiens
gattgtttaaacatataaggt

SEQ ID NO: 41341 - DNA, 18 bp, Homo sapiens
gatcgtttgagctcaggt

SEQ ID NO: 41342 - DNA, 91 bp, Lymphocystis disease virus 1
aagaaaacaccgattaaattagcatcagctacatttaaatattcttttagataatttataatttgcttatgtaatttttttaatatttctt

SEQ ID NO: 41343 - DNA, 24 bp, Lymphocystis disease virus 1
attaaattagcatcagctacattt

SEQ ID NO: 41344 - DNA, 18 bp, Homo sapiens
aaattagatgctacattt

SEQ ID NO: 41345 - DNA, 22 bp, Homo sapiens
attaaatagcatcatctcattt

SEQ ID NO: 41346 - DNA, 21 bp, Homo sapiens
aattaacagtcagctgcattt

SEQ ID NO: 41347 - DNA, 25 bp, Homo sapiens
attaaactagatccaagttacattt

SEQ ID NO: 41348 - DNA, 18 bp, Homo sapiens
attagattagcttcagct

SEQ ID NO: 41349 - DNA, 20 bp, Homo sapiens
attaaattaacattacagcc

SEQ ID NO: 41350 - DNA, 23 bp, Homo sapiens
aaattagcaccatcattacattt

SEQ ID NO: 41351 - DNA, 100 bp, Melanoplus sanguinipes entomopoxvirus
tgatgttttattatatttctcaaatgcttcttttaataattcttctttttcattagaagataaactatcaaataattttatatttttaataactacatta

SEQ ID NO: 41352 - DNA, 24 bp, Melanoplus sanguinipes entomopoxvirus
tgttttattatatttctcaaatgc

SEQ ID NO: 41353 - DNA, 21 bp, Homo sapiens
tgttttatcattatcaaatgc

SEQ ID NO: 41354 - DNA, 22 bp, Homo sapiens
tgttttgatatatttccattgc

SEQ ID NO: 41355 - DNA, 18 bp, Homo sapiens
gttttattacatcaaatg

SEQ ID NO: 41356 - DNA, 24 bp, Homo sapiens
gttttattatattgggtggaatgc

SEQ ID NO: 41357 - DNA, 20 bp, Homo sapiens
gttttattagtgctcaaatg

SEQ ID NO: 41358 - DNA, 24 bp, Homo sapiens
gttttattgtactcctattaaatg

SEQ ID NO: 41359 - DNA, 19 bp, Homo sapiens
tgttttgttttatttccca

SEQ ID NO: 41360 - DNA, 20 bp, Homo sapiens
tgtcttggggttctcaaatg

SEQ ID NO: 41361 - DNA, 65 bp, Leishmania RNA virus 1-1
tccttgtggtggtgtcgttatacaggtaatacataacgtatacgtatagtgactaactacttgga

SEQ ID NO: 41362 - DNA, 24 bp, Leishmania RNA virus 1-1
tgtcgttatacaggtaatacataa

SEQ ID NO: 41363 - DNA, 22 bp, Homo sapiens
ccatcatacaggtaatatataa

SEQ ID NO: 41364 - DNA, 19 bp, Homo sapiens
tgtcattatgcagtacata

SEQ ID NO: 41365 - DNA, 23 bp, Homo sapiens
tgttattacacattaatgcataa

SEQ ID NO: 41366 - DNA, 21 bp, Homo sapiens
tgtttttatacagaacacata

SEQ ID NO: 41367 - DNA, 30 bp, Homo sapiens
tgtccttatacacatcaggtagtacataat

SEQ ID NO: 41368 - DNA, 98 bp, Melanoplus sanguinipes entomopoxvirus
gattctgatatataaatagtatttttttcattatatgttagactcggcaaaataccgggtctattaataaggtcttcatatttagatttatcatcatc

SEQ ID NO: 41369 - DNA, 24 bp, Melanoplus sanguinipes entomopoxvirus
tataaatagtatttttttcattat

SEQ ID NO: 41370 - DNA, 21 bp, Homo sapiens
tataaatagtatcttttttca

SEQ ID NO: 41371 - DNA, 21 bp, Homo sapiens
tataaataatatttttttcac

SEQ ID NO: 41372 - DNA, 21 bp, Homo sapiens
ataggtcattcttttcattat

SEQ ID NO: 41373 - DNA, 23 bp, Homo sapiens
tataattctatttttttcattat

SEQ ID NO: 41374 - DNA, 93 bp, Melanoplus sanguinipes entomopoxvirus
tatagcaatatgaatttttttattattaaatattaaattatctaaatccattttattttatattttaatattaatttttcatagactgttata

SEQ ID NO: 41375 - DNA, 24 bp, Melanoplus sanguinipes entomopoxvirus
tattaaatattaaattatctaaat

SEQ ID NO: 41376 - DNA, 22 bp, Homo sapiens
tattaaatataaattgtctaaa

SEQ ID NO: 41377 - DNA, 20 bp, Homo sapiens
taaatattaaatttctaaat

SEQ ID NO: 41378 - DNA, 18 bp, Homo sapiens
tattaaatattaaatatc

SEQ ID NO: 41379 - DNA, 122 bp, Lymphocystis disease virus 1
gatctaaataatctccgttcaaaattgttttacattcttcttttaattctataattaactgttgtagatcaactacattcattaaaattttggggtaatgtaaatgaaaactttgtttaatt

SEQ ID NO: 41380 - DNA, 24 bp, Lymphocystis disease virus 1
gtagatcaactacattcattaaaa

SEQ ID NO: 41381 - DNA, 17 bp, Homo sapiens
gtagatcaactatttca

SEQ ID NO: 41382 - DNA, 21 bp, Homo sapiens
aatcaactgcatgcaccaaaa

SEQ ID NO: 41383 - DNA, 20 bp, Homo sapiens
gatcaagcacttcattaaaa

SEQ ID NO: 41384 - DNA, 23 bp, Homo sapiens
gtagatcactcatctttattaaa

SEQ ID NO: 41385 - DNA, 19 bp, Homo sapiens
gcagaatgcattcattaaa

SEQ ID NO: 41386 - DNA, 16 bp, Homo sapiens
gacacacattcattaa

SEQ ID NO: 41387 - DNA, 21 bp, Homo sapiens
gtacattaactacattttcac

SEQ ID NO: 41388 - DNA, 20 bp, Homo sapiens
agatcaatttcttcattaaa

SEQ ID NO: 41389 - DNA, 16 bp, Homo sapiens
agatcaactaccatta

SEQ ID NO: 41390 - DNA, 21 bp, Homo sapiens
gtaaatcaatgaccattcatt

SEQ ID NO: 41391 - DNA, 94 bp, Marburg virus
ggcatactatggtgatgcgagggcattattcagtgctacaaattcttttttcaattgctataatgatacaactacgaacctccatacatttgcc

SEQ ID NO: 41392 - DNA, 24 bp, Marburg virus
actatggtgatgcgagggcattat

SEQ ID NO: 41393 - DNA, 18 bp, Homo sapiens
tggttacaaaggcattat

SEQ ID NO: 41394 - DNA, 18 bp, Homo sapiens
catggtgatgtgagacac

SEQ ID NO: 41395 - DNA, 20 bp, Homo sapiens
actgggccatggagggcatt

SEQ ID NO: 41396 - DNA, 19 bp, Homo sapiens
actatggtgtgtgaatagg

SEQ ID NO: 41397 - DNA, 15 bp, Homo sapiens
acttgggagggcatt

SEQ ID NO: 41398 - DNA, 17 bp, Homo sapiens
atggtggtgcgggacat

SEQ ID NO: 41399 - DNA, 19 bp, Homo sapiens
tggtagatgagggcattat

SEQ ID NO: 41400 - DNA, 75 bp, Swinepox virus
aatgtttacatatagcggatcaacatacaagagaaaaatataatacgttagtagatcaagcaacttttaaatatt

SEQ ID NO: 41401 - DNA, 24 bp, Swinepox virus
gtagatcaagcaacttttaaatat

SEQ ID NO: 41402 - DNA, 20 bp, Homo sapiens
gatcaagcagaggaaaatat

SEQ ID NO: 41403 - DNA, 19 bp, Homo sapiens
gtaaatcaggcagttttta

SEQ ID NO: 41404 - DNA, 18 bp, Homo sapiens
gtagacaagcaactttta

SEQ ID NO: 41405 - DNA, 68 bp, Bovine herpesvirus 4
ctatcgaatccaggcccctgattggtggattgctgaaagccaatcaggggcctggatttgcccaatag

SEQ ID NO: 41406 - DNA, 24 bp, Bovine herpesvirus 4
tcgaatccaggcccctgattggtg

SEQ ID NO: 41407 - DNA, 23 bp, Homo sapiens
gaacccaggcccttccctcagtg

SEQ ID NO: 41408 - DNA, 17 bp, Homo sapiens
gaatccaggtttgaggt

SEQ ID NO: 41409 - DNA, 25 bp, Homo sapiens
gaatccaggtctcctacctctggtg

SEQ ID NO: 41410 - DNA, 23 bp, Homo sapiens
ccgaatccgggctctaaggagtg

SEQ ID NO: 41411 - DNA, 19 bp, Homo sapiens
tcaatccaggtcctaacgt

SEQ ID NO: 41412 - DNA, 19 bp, Homo sapiens
tctaggctctctgattggt

SEQ ID NO: 41413 - DNA, 21 bp, Homo sapiens
tccaatccaggtccctgattg

SEQ ID NO: 41414 - DNA, 18 bp, Homo sapiens
gaatcctgctgattggtg

SEQ ID NO: 41415 - DNA, 18 bp, Homo sapiens
tcgaatccagcttttgat

SEQ ID NO: 41416 - DNA, 18 bp, Homo sapiens
tcaaatccaggcctcagt

SEQ ID NO: 41417 - DNA, 19 bp, Homo sapiens
gaatagattttgattggtg

SEQ ID NO: 41418 - DNA, 122 bp, Swinepox virus
tagctactacacaccatcgaaaaaatctccatttatgttagatgcgggggagtatgtatttttacctatgtgtttcggaaatgtatttatttataagggaagtatgatggaattgggttctg

SEQ ID NO: 41419 - DNA, 24 bp, Swinepox virus
tatgttagatgcgggggagtatgt

SEQ ID NO: 41420 - DNA, 23 bp, Homo sapiens
tattttaggtgctgagagtatgt

SEQ ID NO: 41421 - DNA, 24 bp, Homo sapiens
tatgtaggggcctagggggtgtgt

SEQ ID NO: 41422 - DNA, 23 bp, Homo sapiens
tattttaggttcaaggagtatgt

SEQ ID NO: 41423 - DNA, 75 bp, Chimpanzee cytomegalovirus
gaggttgttgaccacgtacaggtgctcgtcgtaggtgagactctggcccacgtccagcatttcgcggtcctgccc

SEQ ID NO: 41424 - DNA, 24 bp, Chimpanzee cytomegalovirus
caggtgctcgtcgtaggtgagact

SEQ ID NO: 41425 - DNA, 19 bp, Homo sapiens
gctgtctgtaggtgaggct

SEQ ID NO: 41426 - DNA, 19 bp, Homo sapiens
caggtgctcttcgtgaatg

SEQ ID NO: 41427 - DNA, 18 bp, Homo sapiens
caggtgcttctcggcagg

SEQ ID NO: 41428 - DNA, 20 bp, Homo sapiens
caggtgcttgagcgtgaggt

SEQ ID NO: 41429 - DNA, 17 bp, Homo sapiens
caggtgctcatcggggc

SEQ ID NO: 41430 - DNA, 18 bp, Homo sapiens
caggttacataggtgagc

SEQ ID NO: 41431 - DNA, 24 bp, Homo sapiens
caggtgctcctcaggggtgaggct

SEQ ID NO: 41432 - DNA, 18 bp, Homo sapiens
aggtgcttgttgaatgaa

SEQ ID NO: 41433 - DNA, 81 bp, Chimpanzee cytomegalovirus
gaccttctgcagataggcgcgcttgcgcacgttgacctcgcgcgtgacgttgtggacgcgcgagcgggcgtccaaggggtc

SEQ ID NO: 41434 - DNA, 24 bp, Chimpanzee cytomegalovirus
tctgcagataggcgcgcttgcgca

SEQ ID NO: 41435 - DNA, 19 bp, Homo sapiens
tctgcggaaggcgcccgcg

SEQ ID NO: 41436 - DNA, 20 bp, Homo sapiens
cctgcaggtaggcgcgggca

SEQ ID NO: 41437 - DNA, 22 bp, Homo sapiens
ccgtcttgggtgcgcttgcgca

SEQ ID NO: 41438 - DNA, 21 bp, Homo sapiens
tctgcggataagcggattgca

SEQ ID NO: 41439 - DNA, 21 bp, Homo sapiens
tgcgcacgtgcgtgcttgcgc

SEQ ID NO: 41440 - DNA, 24 bp, Homo sapiens
tctgcagaggggcgtcagaaggca

SEQ ID NO: 41441 - DNA, 87 bp, Chimpanzee cytomegalovirus
gactataacctccgaagtacgggaccagtaggtaaaatccgacaaggaatatattcgttccggtatatccgtaaacaggttgtactc

SEQ ID NO: 41442 - DNA, 24 bp, Chimpanzee cytomegalovirus
tataacctccgaagtacgggacca

SEQ ID NO: 41443 - DNA, 23 bp, Homo sapiens
tacaattttcgaagtacttacca

SEQ ID NO: 41444 - DNA, 17 bp, Homo sapiens
acttcctgtcaggacca

SEQ ID NO: 41445 - DNA, 17 bp, Homo sapiens
tataacctttactggac

SEQ ID NO: 41446 - DNA, 17 bp, Homo sapiens
tataaccttgaagacaa

SEQ ID NO: 41447 - DNA, 19 bp, Homo sapiens
acctctgggtacaggacca

SEQ ID NO: 41448 - DNA, 22 bp, Homo sapiens
caacctccgcctcctgggatca

SEQ ID NO: 41449 - DNA, 19 bp, Homo sapiens
taacttccgaagtattcca

SEQ ID NO: 41450 - DNA, 23 bp, Homo sapiens
tataacctctgcagaagctggac

SEQ ID NO: 41451 - DNA, 16 bp, Homo sapiens
tataaccttccaggcc

SEQ ID NO: 41452 - DNA, 18 bp, Homo sapiens
catgacctccgaggccag

SEQ ID NO: 41453 - DNA, 99 bp, Human herpesvirus 3
gctatcgacagctacgacgtattaatactggatgaggtaatgtcagtgattggacaattatactcccccacaatgagacgtctttccgcggttgatagc

SEQ ID NO: 41454 - DNA, 24 bp, Human herpesvirus 3
actggatgaggtaatgtcagtgat

SEQ ID NO: 41455 - DNA, 20 bp, Homo sapiens
tggtatagaatgtcagtgat

SEQ ID NO: 41456 - DNA, 18 bp, Homo sapiens
ctggctggggttcagtga

SEQ ID NO: 41457 - DNA, 20 bp, Homo sapiens
ctggatgaggtgtcggtgat

SEQ ID NO: 41458 - DNA, 24 bp, Homo sapiens
actggatggggtggagcctaggat

SEQ ID NO: 41459 - DNA, 16 bp, Homo sapiens
ctggagaggtagtagc

SEQ ID NO: 41460 - DNA, 21 bp, Homo sapiens
ggcaacagtgatgtcggtgat

SEQ ID NO: 41461 - DNA, 15 bp, Homo sapiens
actgatgtgtcagtg

SEQ ID NO: 41462 - DNA, 21 bp, Homo sapiens
actggatggggaatagaggat

SEQ ID NO: 41463 - DNA, 21 bp, Homo sapiens
ctggatgagtgaatttgggtg

SEQ ID NO: 41464 - DNA, 20 bp, Homo sapiens
tggatggggagatgttggca

SEQ ID NO: 41465 - DNA, 21 bp, Homo sapiens
actggataggtagttcctttg

SEQ ID NO: 41466 - DNA, 67 bp, Swinepox virus
aataaaatcagaatctatatttgaaatagttagagagtgcttagaatatcctaaatctgactttatt

SEQ ID NO: 41467 - DNA, 24 bp, Swinepox virus
ttagaatatcctaaatctgacttt

SEQ ID NO: 41468 - DNA, 19 bp, Homo sapiens
ttagaatcatttctgactt

SEQ ID NO: 41469 - DNA, 21 bp, Homo sapiens
gaatactataaatctggcttt

SEQ ID NO: 41470 - DNA, 18 bp, Homo sapiens
ttagaacatcttaagtct

SEQ ID NO: 41471 - DNA, 16 bp, Homo sapiens
gaatatcctaaataac

SEQ ID NO: 41472 - DNA, 18 bp, Homo sapiens
ttagagtgtcccaaacct

SEQ ID NO: 41473 - DNA, 15 bp, Homo sapiens
aatatcacctgactt

SEQ ID NO: 41474 - DNA, 24 bp, Homo sapiens
ttaaaatatcttatttctggcttt

SEQ ID NO: 41475 - DNA, 68 bp, Chimpanzee cytomegalovirus
gctgtcggtgaagcgcaactccaccgtgtgatggcggtcgcagtgatccaaacgcagcaccgtacggt

SEQ ID NO: 41476 - DNA, 24 bp, Chimpanzee cytomegalovirus
tcggtgaagcgcaactccaccgtg

SEQ ID NO: 41477 - DNA, 27 bp, Homo sapiens
tcggtgaagagcttctgcttcaccgtg

SEQ ID NO: 41478 - DNA, 18 bp, Homo sapiens
tcggtgaaatgctgccgt

SEQ ID NO: 41479 - DNA, 23 bp, Homo sapiens
tcggtaaagcgtggccaggcgtg

SEQ ID NO: 41480 - DNA, 20 bp, Homo sapiens
tcggtgaagcgaaattctac

SEQ ID NO: 41481 - DNA, 71 bp, Human herpesvirus 3
tctcaaattatcgcgatggatgctacagtaaactcgcagtttattgatttaatctccggattgcgtggaga

SEQ ID NO: 41482 - DNA, 24 bp, Human herpesvirus 3
tatcgcgatggatgctacagtaaa

SEQ ID NO: 41483 - DNA, 19 bp, Homo sapiens
acgtggagaagctacagta

SEQ ID NO: 41484 - DNA, 18 bp, Homo sapiens
gccaaatgctacagtaaa

SEQ ID NO: 41485 - DNA, 17 bp, Homo sapiens
gcgtatctactacagta

SEQ ID NO: 41486 - DNA, 18 bp, Homo sapiens
tatcacagttgctacagt

SEQ ID NO: 41487 - DNA, 74 bp, Human herpesvirus 3
aactagcactacgattacaatgtgggcataacatctgtatattttcatcaactttatcgttttcggagctagtt

SEQ ID NO: 41488 - DNA, 24 bp, Human herpesvirus 3
tagcactacgattacaatgtgggc

SEQ ID NO: 41489 - DNA, 17 bp, Homo sapiens
agcgctacgattacagg

SEQ ID NO: 41490 - DNA, 19 bp, Homo sapiens
tagcaccattggatgtggg

SEQ ID NO: 41491 - DNA, 22 bp, Homo sapiens
gccactgcactccaatgtgggc

SEQ ID NO: 41492 - DNA, 18 bp, Homo sapiens
taacactgctaatgtggg

SEQ ID NO: 41493 - DNA, 17 bp, Homo sapiens
agtgctacgattacagg

SEQ ID NO: 41494 - DNA, 23 bp, Homo sapiens
gcaagacaggttatgatgtgggc

SEQ ID NO: 41495 - DNA, 70 bp, Human herpesvirus 3
tgggggcgtgtatacgaatacctgaagcgttggaagcatttgacgtatttcaaaaaatatacacgcacta

SEQ ID NO: 41496 - DNA, 24 bp, Human herpesvirus 3
ggcgtgtatacgaatacctgaagc

SEQ ID NO: 41497 - DNA, 24 bp, Homo sapiens
ggtcagattgcgaatacctggggc

SEQ ID NO: 41498 - DNA, 21 bp, Homo sapiens
ggtgtgtatacgaaacgacgc

SEQ ID NO: 41499 - DNA, 18 bp, Homo sapiens
ggcatgtatgtatctggg

SEQ ID NO: 41500 - DNA, 23 bp, Homo sapiens
ggctgtccagcaatacctgaggc

SEQ ID NO: 41501 - DNA, 18 bp, Homo sapiens
ggcgtgtatactgaaaag

SEQ ID NO: 41502 - DNA, 69 bp, Tupaia herpesvirus
gcttagcgacgatgcacccgtgagggaggagtcgtgagcgtcctcctcaccggtacatcgtcgccacgc

SEQ ID NO: 41503 - DNA, 24 bp, Tupaia herpesvirus
cacccgtgagggaggagtcgtgag

SEQ ID NO: 41504 - DNA, 19 bp, Homo sapiens
ccggagggaggctctggag

SEQ ID NO: 41505 - DNA, 20 bp, Homo sapiens
cactcgagggggaggaagtg

SEQ ID NO: 41506 - DNA, 17 bp, Homo sapiens
cccgagagggaggcgga

SEQ ID NO: 41507 - DNA, 21 bp, Homo sapiens
accctgagggaggtgaaggag

SEQ ID NO: 41508 - DNA, 16 bp, Homo sapiens
ccctgagggagcctga

SEQ ID NO: 41509 - DNA, 20 bp, Homo sapiens
cgtgagagcttagtcgtgag

SEQ ID NO: 41510 - DNA, 21 bp, Homo sapiens
cacttggagggagggcccgtg

SEQ ID NO: 41511 - DNA, 17 bp, Homo sapiens
cccgtgagggggtcctg

SEQ ID NO: 41512 - DNA, 20 bp, Homo sapiens
cacccgggagggagggcctg

SEQ ID NO: 41513 - DNA, 19 bp, Homo sapiens
actttgagggaggagaatg

SEQ ID NO: 41514 - DNA, 16 bp, Homo sapiens
caccagtgggggcgtg

SEQ ID NO: 41515 - DNA, 20 bp, Homo sapiens
cccgggagggggctgctgag

SEQ ID NO: 41516 - DNA, 23 bp, Homo sapiens
cactcgtgagggggcttcttgag

SEQ ID NO: 41517 - DNA, 21 bp, Homo sapiens
caccctgagggaggccaggtg

SEQ ID NO: 41518 - DNA, 17 bp, Homo sapiens
cactgtgagggaggagc

SEQ ID NO: 41519 - DNA, 18 bp, Homo sapiens
catgagggagagagtgag

SEQ ID NO: 41520 - DNA, 67 bp, Eimeria brunetti RNA virus 1
tttccgcggcctccattggctgggacctttaacgacacagggttattcccagtcatgtacgcggaga

SEQ ID NO: 41521 - DNA, 22 bp, Eimeria brunetti RNA virus 1
ttcccagtcatgtacgcggaga

SEQ ID NO: 41522 - DNA, 16 bp, Homo sapiens
ttcccagctgccggag

SEQ ID NO: 41523 - DNA, 22 bp, Homo sapiens
ttcccagtcatgagggtgggga

SEQ ID NO: 41524 - DNA, 22 bp, Homo sapiens
ttcccaatcatgcagatggaga

SEQ ID NO: 41525 - DNA, 19 bp, Homo sapiens
ttctcagtcatggcactga

SEQ ID NO: 41526 - DNA, 20 bp, Homo sapiens
ttcccagttggctcatggga

SEQ ID NO: 41527 - DNA, 22 bp, Homo sapiens
ttcccagttctgtacaagcaga

SEQ ID NO: 41528 - DNA, 17 bp, Homo sapiens
ttcccagtggtgtcgga

SEQ ID NO: 41529 - DNA, 16 bp, Homo sapiens
tcctcagtcatgtgga

SEQ ID NO: 41530 - DNA, 18 bp, Homo sapiens
ttccatcatgcaagggag

SEQ ID NO: 41531 - DNA, 17 bp, Homo sapiens
ttcccagcatgacagag

SEQ ID NO: 41532 - DNA, 21 bp, Homo sapiens
ttcccagtcgtttggcagaga

SEQ ID NO: 41533 - DNA, 19 bp, Homo sapiens
tccccagtcaggtttggag

SEQ ID NO: 41534 - DNA, 17 bp, Homo sapiens
ttcccagtatatgtgca

SEQ ID NO: 41535 - DNA, 18 bp, Homo sapiens
tccccggccgcgcggaga

SEQ ID NO: 41536 - DNA, 18 bp, Homo sapiens
ttcccagctattcaggag

SEQ ID NO: 41537 - DNA, 18 bp, Homo sapiens
ctcccagttactccggag

SEQ ID NO: 41538 - DNA, 22 bp, Homo sapiens
ttcccagtctgtgcggtggaga

SEQ ID NO: 41539 - DNA, 20 bp, Homo sapiens
ttctggtctcacgcaggaga

SEQ ID NO: 41540 - DNA, 17 bp, Homo sapiens
ctcctggctgcgcggag

SEQ ID NO: 41541 - DNA, 18 bp, Homo sapiens
ttcccagtttgtgagcag

SEQ ID NO: 41542 - DNA, 18 bp, Homo sapiens
ttcccagtcatgtattca

SEQ ID NO: 41543 - DNA, 18 bp, Homo sapiens
ccagtacgcagctggaga

SEQ ID NO: 41544 - DNA, 16 bp, Homo sapiens
ctcccagttgctggag

SEQ ID NO: 41545 - DNA, 18 bp, Homo sapiens
ttcacagtcatgcaggga

SEQ ID NO: 41546 - DNA, 18 bp, Homo sapiens
ttcccagtcagctgtgag

SEQ ID NO: 41547 - DNA, 16 bp, Homo sapiens
ttccaagtcatgtgga

SEQ ID NO: 41548 - DNA, 23 bp, Homo sapiens
ttctcagtcatgtaccacgcaga

SEQ ID NO: 41549 - DNA, 19 bp, Homo sapiens
ttcccagtgcccttggaga

SEQ ID NO: 41550 - DNA, 21 bp, Homo sapiens
ttcccagtcatgagaactcgg

SEQ ID NO: 41551 - DNA, 18 bp, Homo sapiens
ttcccagtcaagttgcag

SEQ ID NO: 41552 - DNA, 16 bp, Homo sapiens
ttcccaattatgtgga

SEQ ID NO: 41553 - DNA, 19 bp, Homo sapiens
tctccagtcatgtgtgaga

SEQ ID NO: 41554 - DNA, 23 bp, Homo sapiens
ttcccagttggtgctcctggaga

SEQ ID NO: 41555 - DNA, 20 bp, Homo sapiens
ttccggtccggctgcgggga

SEQ ID NO: 41556 - DNA, 19 bp, Homo sapiens
ttcccagtggtggcgtcga

SEQ ID NO: 41557 - DNA, 16 bp, Homo sapiens
ttcccagtcaagtgga

SEQ ID NO: 41558 - DNA, 23 bp, Homo sapiens
ttcccagttaatgtgtctaaaga

SEQ ID NO: 41559 - DNA, 16 bp, Homo sapiens
tcccagtcagctggag

SEQ ID NO: 41560 - DNA, 21 bp, Homo sapiens
ttcttagtcctgtacacatga

SEQ ID NO: 41561 - DNA, 17 bp, Homo sapiens
ctcccagtgttgtggag

SEQ ID NO: 41562 - DNA, 19 bp, Homo sapiens
tcccagtcacccttggaga

SEQ ID NO: 41563 - DNA, 17 bp, Homo sapiens
ccagcattgcacggaga

SEQ ID NO: 41564 - DNA, 20 bp, Homo sapiens
ttcccagtccgtcagggaga

SEQ ID NO: 41565 - DNA, 22 bp, Homo sapiens
ttcccagtgtatgtacactaga

SEQ ID NO: 41566 - DNA, 21 bp, Homo sapiens
ttctcagctatgacacagaga

SEQ ID NO: 41567 - DNA, 18 bp, Homo sapiens
ttcccagttggtgacaga

SEQ ID NO: 41568 - DNA, 90 bp, Tupaia herpesvirus
gtctccggtcagcccgcttccctcgacggcctcgtcgtcccatccgtttcgtacgccgaggctaccgagggcagtcagccggccgcagac

SEQ ID NO: 41569 - DNA, 24 bp, Tupaia herpesvirus
cgaggctaccgagggcagtcagcc

SEQ ID NO: 41570 - DNA, 18 bp, Homo sapiens
cgggccggggcagtcagc

SEQ ID NO: 41571 - DNA, 21 bp, Homo sapiens
cgaggctacagagccatggcc

SEQ ID NO: 41572 - DNA, 22 bp, Homo sapiens
cgaggctaccaagttaagtagc

SEQ ID NO: 41573 - DNA, 19 bp, Homo sapiens
cgaggctgctacaatcagc

SEQ ID NO: 41574 - DNA, 19 bp, Homo sapiens
caaggctattgaggtgagc

SEQ ID NO: 41575 - DNA, 24 bp, Homo sapiens
gaggctaccgcagggccccgcgcc

SEQ ID NO: 41576 - DNA, 28 bp, Homo sapiens
gaggctactgaggtcactggctgactgc

SEQ ID NO: 41577 - DNA, 19 bp, Homo sapiens
aggttactgccagtcagcc

SEQ ID NO: 41578 - DNA, 22 bp, Homo sapiens
cgagagctgccgggggcgcgcc

SEQ ID NO: 41579 - DNA, 18 bp, Homo sapiens
ggctgccgagagctggcc

SEQ ID NO: 41580 - DNA, 22 bp, Homo sapiens
caaggcaggggggcagtcagcc

SEQ ID NO: 41581 - DNA, 18 bp, Homo sapiens
gaggctattcaggcagcc

SEQ ID NO: 41582 - DNA, 22 bp, Homo sapiens
cggggctgtggcccagtcagcc

SEQ ID NO: 41583 - DNA, 18 bp, Homo sapiens
cggggctcctgagggcag

SEQ ID NO: 41584 - DNA, 26 bp, Homo sapiens
ggccaccgagttagttggctgactgc

SEQ ID NO: 41585 - DNA, 21 bp, Homo sapiens
cgaggcaaccgggaagcagcc

SEQ ID NO: 41586 - DNA, 22 bp, Homo sapiens
cggggcagccggggatccaagc

SEQ ID NO: 41587 - DNA, 24 bp, Homo sapiens
cgaggcagccggggcagcacggcc

SEQ ID NO: 41588 - DNA, 16 bp, Homo sapiens
gctgagggcaggcagc

SEQ ID NO: 41589 - DNA, 21 bp, Homo sapiens
gaggccactgagagttgttag

SEQ ID NO: 41590 - DNA, 21 bp, Homo sapiens
gaggcaccgtgcccagtcagc

SEQ ID NO: 41591 - DNA, 26 bp, Homo sapiens
gaggctacccagggcacaatttggtc

SEQ ID NO: 41592 - DNA, 20 bp, Homo sapiens
cggggcagccgggacctcag

SEQ ID NO: 41593 - DNA, 19 bp, Homo sapiens
gaggcagccgaggcagggc

SEQ ID NO: 41594 - DNA, 18 bp, Homo sapiens
cggggcactgagggcagc

SEQ ID NO: 41595 - DNA, 18 bp, Homo sapiens
cgaggctccgggggtgcc

SEQ ID NO: 41596 - DNA, 15 bp, Homo sapiens
agctaggcagtcagc

SEQ ID NO: 41597 - DNA, 18 bp, Homo sapiens
cgaggctacagagccagc

SEQ ID NO: 41598 - DNA, 18 bp, Homo sapiens
cggggcaccgagggcgtc

SEQ ID NO: 41599 - DNA, 16 bp, Homo sapiens
cgggtctggcagtcag

SEQ ID NO: 41600 - DNA, 20 bp, Homo sapiens
gaaggacatggggcagtcag

SEQ ID NO: 41601 - DNA, 17 bp, Homo sapiens
gaggcgccgggacagcc

SEQ ID NO: 41602 - DNA, 23 bp, Homo sapiens
cggggcggccgagggcctgggtc

SEQ ID NO: 41603 - DNA, 24 bp, Homo sapiens
cggggttacctggggctttcccag

SEQ ID NO: 41604 - DNA, 18 bp, Homo sapiens
ggcagaagggcagtcggc

SEQ ID NO: 41605 - DNA, 25 bp, Homo sapiens
cgagggctgccgggggacgccagcc

SEQ ID NO: 41606 - DNA, 18 bp, Homo sapiens
gaggggaggggcagtcag

SEQ ID NO: 41607 - DNA, 18 bp, Homo sapiens
caaggctaccggtcagtc

SEQ ID NO: 41608 - DNA, 110 bp, Human herpesvirus 1
gcggggggaggagcggggggaggagcggggggaggagcggggggaggagcggggggaggagcggggggaggagcggggggaggagcggggggaggagcggggggaggagc

SEQ ID NO: 41609 - DNA, 24 bp, Human herpesvirus 1
ggggaggagcggggggaggagcgg

SEQ ID NO: 41610 - DNA, 19 bp, Homo sapiens
ggggcggagctgggggcgg

SEQ ID NO: 41611 - DNA, 17 bp, Homo sapiens
gggggggcagggggcgg

SEQ ID NO: 41612 - DNA, 22 bp, Homo sapiens
ggggggcgggtggggagaaggg

SEQ ID NO: 41613 - DNA, 17 bp, Homo sapiens
gggggagctgggggcgg

SEQ ID NO: 41614 - DNA, 18 bp, Homo sapiens
ggggaggggctggggggg

SEQ ID NO: 41615 - DNA, 22 bp, Homo sapiens
ggagaggggcggccacgggcgg

SEQ ID NO: 41616 - DNA, 18 bp, Homo sapiens
gaggaggaggaggggcgg

SEQ ID NO: 41617 - DNA, 24 bp, Homo sapiens
ggggagggggtgcagtgggggtgg

SEQ ID NO: 41618 - DNA, 18 bp, Homo sapiens
gggcgggagcgaggagcg

SEQ ID NO: 41619 - DNA, 17 bp, Homo sapiens
ggggtggggtggggagg

SEQ ID NO: 41620 - DNA, 23 bp, Homo sapiens
ggggagggggtgggggagagtgg

SEQ ID NO: 41621 - DNA, 21 bp, Homo sapiens
ggggagcggtggggcttgcgg

SEQ ID NO: 41622 - DNA, 25 bp, Homo sapiens
ggggaggaggtggcggcgggagcgg

SEQ ID NO: 41623 - DNA, 19 bp, Homo sapiens
gggcgaggggtgggggggg

SEQ ID NO: 41624 - DNA, 17 bp, Homo sapiens
ggggaggacaggggtgg

SEQ ID NO: 41625 - DNA, 19 bp, Homo sapiens
gggcaggagcgggctgagg

SEQ ID NO: 41626 - DNA, 23 bp, Homo sapiens
ggggcaggagtggggtagggcgg

SEQ ID NO: 41627 - DNA, 22 bp, Homo sapiens
ggaggaggggtgggggccccgg

SEQ ID NO: 41628 - DNA, 18 bp, Homo sapiens
ggggagggcgtggggagg

SEQ ID NO: 41629 - DNA, 18 bp, Homo sapiens
ggggagggcgggcaggcg

SEQ ID NO: 41630 - DNA, 18 bp, Homo sapiens
ggggaggggcgggggcgg

SEQ ID NO: 41631 - DNA, 17 bp, Homo sapiens
gggggcggggaggggcg

SEQ ID NO: 41632 - DNA, 18 bp, Homo sapiens
agggaggaggaggggcgg

SEQ ID NO: 41633 - DNA, 18 bp, Homo sapiens
ggggggggcagggggcgg

SEQ ID NO: 41634 - DNA, 19 bp, Homo sapiens
ggggagggccgaggggcgg

SEQ ID NO: 41635 - DNA, 24 bp, Homo sapiens
ggggaggagagggacacctggcgg

SEQ ID NO: 41636 - DNA, 22 bp, Homo sapiens
ggggaggaggcggagggagcgg

SEQ ID NO: 41637 - DNA, 19 bp, Homo sapiens
ggggcggggtggggggaag

SEQ ID NO: 41638 - DNA, 19 bp, Homo sapiens
gggaggagtgtgggggtgg

SEQ ID NO: 41639 - DNA, 19 bp, Homo sapiens
ggggagaggcgggggggcg

SEQ ID NO: 41640 - DNA, 21 bp, Homo sapiens
gggcgaggggccgaggggcgg

SEQ ID NO: 41641 - DNA, 17 bp, Homo sapiens
gggggggcggcgggcgg

SEQ ID NO: 41642 - DNA, 19 bp, Homo sapiens
ggggagccgcggggggcgg

SEQ ID NO: 41643 - DNA, 24 bp, Homo sapiens
gggaaggggcggcggagggggcgg

SEQ ID NO: 41644 - DNA, 23 bp, Homo sapiens
ggggaggagctgggaaggagcgg

SEQ ID NO: 41645 - DNA, 24 bp, Homo sapiens
gggcaggagtaccctggggggcgg

SEQ ID NO: 41646 - DNA, 19 bp, Homo sapiens
ggggagaggggaggagcgg

SEQ ID NO: 41647 - DNA, 19 bp, Homo sapiens
ggggaggagcggccggtgg

SEQ ID NO: 41648 - DNA, 19 bp, Homo sapiens
ggagaggagcggagagcgg

SEQ ID NO: 41649 - DNA, 19 bp, Homo sapiens
gaggaggggcgggggctgg

SEQ ID NO: 41650 - DNA, 29 bp, Homo sapiens
gaggaggggcggggagaggaaggagcggc

SEQ ID NO: 41651 - DNA, 20 bp, Homo sapiens
ggagaggggcggggggcagg

SEQ ID NO: 41652 - DNA, 20 bp, Homo sapiens
gggggcgggtggggggaacg

SEQ ID NO: 41653 - DNA, 25 bp, Homo sapiens
ggaggggagcggggacctgcagcgg

SEQ ID NO: 41654 - DNA, 20 bp, Homo sapiens
gggcgaggagctgggggcgg

SEQ ID NO: 41655 - DNA, 18 bp, Homo sapiens
ggggagggcagggggcgg

SEQ ID NO: 41656 - DNA, 25 bp, Homo sapiens
gggaggggcggggacgcaggggcgg

SEQ ID NO: 41657 - DNA, 21 bp, Homo sapiens
gggaaggggcgggggggaccg

SEQ ID NO: 41658 - DNA, 23 bp, Homo sapiens
ggggggcggggcgggaggggcgg

SEQ ID NO: 41659 - DNA, 22 bp, Homo sapiens
ggggagggttggggggacacag

SEQ ID NO: 41660 - DNA, 18 bp, Homo sapiens
ggggatgaggaaggggag

SEQ ID NO: 41661 - DNA, 21 bp, Homo sapiens
ggggcggagcgcggggggcgg

SEQ ID NO: 41662 - DNA, 18 bp, Homo sapiens
ggagggggtggaggggcg

SEQ ID NO: 41663 - DNA, 19 bp, Homo sapiens
ggggaggaggcgggagtgg

SEQ ID NO: 41664 - DNA, 19 bp, Homo sapiens
ggagggggggtggggggcg

SEQ ID NO: 41665 - DNA, 18 bp, Homo sapiens
ggcggggagggggggtgg

SEQ ID NO: 41666 - DNA, 17 bp, Homo sapiens
ggggagggcgggggcgg

SEQ ID NO: 41667 - DNA, 22 bp, Homo sapiens
ggggaggggccgggggctgcgg

SEQ ID NO: 41668 - DNA, 18 bp, Homo sapiens
ggggcggcggggggggcg

SEQ ID NO: 41669 - DNA, 17 bp, Homo sapiens
ggggggggcgggggggg

SEQ ID NO: 41670 - DNA, 21 bp, Homo sapiens
gggggcgggtgaggggagcgg

SEQ ID NO: 41671 - DNA, 20 bp, Homo sapiens
gaggaggagcggcggggcgg

SEQ ID NO: 41672 - DNA, 19 bp, Homo sapiens
ggggaggggcagcgggtgg

SEQ ID NO: 41673 - DNA, 21 bp, Homo sapiens
ggggagggcgggcgggggcgg

SEQ ID NO: 41674 - DNA, 18 bp, Homo sapiens
ggcgggggcggggaggcg

SEQ ID NO: 41675 - DNA, 19 bp, Homo sapiens
ggggaagagaggggagtgg

SEQ ID NO: 41676 - DNA, 24 bp, Homo sapiens
gggaaggggcgggaccacgggcgg

SEQ ID NO: 41677 - DNA, 20 bp, Homo sapiens
ggggaggggagggggggagg

SEQ ID NO: 41678 - DNA, 16 bp, Homo sapiens
gggaaggagcaggagc

SEQ ID NO: 41679 - DNA, 23 bp, Homo sapiens
ggggagcgggcggcgcggagtgg

SEQ ID NO: 41680 - DNA, 19 bp, Homo sapiens
ggggaggggtggggaggag

SEQ ID NO: 41681 - DNA, 18 bp, Homo sapiens
ggggaggggcggcagtgg

SEQ ID NO: 41682 - DNA, 19 bp, Homo sapiens
gggggaggggaggggagcg

SEQ ID NO: 41683 - DNA, 21 bp, Homo sapiens
gggaggggatgggaggagtgg

SEQ ID NO: 41684 - DNA, 19 bp, Homo sapiens
ggggaggggcggcaggcgg

SEQ ID NO: 41685 - DNA, 19 bp, Homo sapiens
ggggaggagtggagggtgg

SEQ ID NO: 41686 - DNA, 21 bp, Homo sapiens
ggggggcgggggggtgagtgg

SEQ ID NO: 41687 - DNA, 22 bp, Homo sapiens
ggggaggagtggaggggaacag

SEQ ID NO: 41688 - DNA, 22 bp, Homo sapiens
aggggagtgaggggaggagtgg

SEQ ID NO: 41689 - DNA, 20 bp, Homo sapiens
ggggaggggcggcggctcgg

SEQ ID NO: 41690 - DNA, 20 bp, Homo sapiens
gggaggcgggggaggggcgg

SEQ ID NO: 41691 - DNA, 27 bp, Homo sapiens
ggcgaggagtgggctggcgaggagtgg

SEQ ID NO: 41692 - DNA, 18 bp, Homo sapiens
ggggaggacgggaggtgg

SEQ ID NO: 41693 - DNA, 21 bp, Homo sapiens
ggggaggatgctgaggagtgg

SEQ ID NO: 41694 - DNA, 16 bp, Homo sapiens
ggggagagaggggtgg

SEQ ID NO: 41695 - DNA, 19 bp, Homo sapiens
ggggagggctgggggctgg

SEQ ID NO: 41696 - DNA, 18 bp, Homo sapiens
gggggggggcgggggggg

SEQ ID NO: 41697 - DNA, 21 bp, Homo sapiens
ggcgggggcggggggtgctgg

SEQ ID NO: 41698 - DNA, 19 bp, Homo sapiens
ggcggaggagaggggagcg

SEQ ID NO: 41699 - DNA, 21 bp, Homo sapiens
ggggagaggcagggggagcgg

SEQ ID NO: 41700 - DNA, 18 bp, Homo sapiens
ggggaggatggagagtgg

SEQ ID NO: 41701 - DNA, 17 bp, Homo sapiens
gggggagccgggggagg

SEQ ID NO: 41702 - DNA, 19 bp, Homo sapiens
ggggaggggtggggagcgc

SEQ ID NO: 41703 - DNA, 20 bp, Homo sapiens
ggggggggggggggtcccag

SEQ ID NO: 41704 - DNA, 22 bp, Homo sapiens
gggaggggggtttggggggcgg

SEQ ID NO: 41705 - DNA, 18 bp, Homo sapiens
ggggagaggtgggggagg

SEQ ID NO: 41706 - DNA, 17 bp, Homo sapiens
ggggagggcaggggtgg

SEQ ID NO: 41707 - DNA, 21 bp, Homo sapiens
ggggaggggtgggtggggtgg

SEQ ID NO: 41708 - DNA, 19 bp, Homo sapiens
ggggatggggggggggtgg

SEQ ID NO: 41709 - DNA, 21 bp, Homo sapiens
ggggcggggtggggggcaagg

SEQ ID NO: 41710 - DNA, 20 bp, Homo sapiens
ggggaggggagggggctcgg

SEQ ID NO: 41711 - DNA, 18 bp, Homo sapiens
ggggcgggccgggggcgg

SEQ ID NO: 41712 - DNA, 17 bp, Homo sapiens
ggggagggggaggggcg

SEQ ID NO: 41713 - DNA, 23 bp, Homo sapiens
ggggaggagctgtgctggggtgg

SEQ ID NO: 41714 - DNA, 18 bp, Homo sapiens
gggggagctcgggggcgg

SEQ ID NO: 41715 - DNA, 22 bp, Homo sapiens
ggggaggagtagggaacgatgg

SEQ ID NO: 41716 - DNA, 16 bp, Homo sapiens
ggggggccgggggagg

SEQ ID NO: 41717 - DNA, 19 bp, Homo sapiens
ggggaggggcgggtgacgg

SEQ ID NO: 41718 - DNA, 19 bp, Homo sapiens
ggagtggggggaggggcgg

SEQ ID NO: 41719 - DNA, 18 bp, Homo sapiens
ggggaggatggagggcgg

SEQ ID NO: 41720 - DNA, 27 bp, Homo sapiens
gaggaggggcggctaccggaggggcgg

SEQ ID NO: 41721 - DNA, 22 bp, Homo sapiens
gggggggacgggggggctcagg

SEQ ID NO: 41722 - DNA, 21 bp, Homo sapiens
ggtgaggcgtgggaggggcgg

SEQ ID NO: 41723 - DNA, 19 bp, Homo sapiens
ggggggagtcggggggagg

SEQ ID NO: 41724 - DNA, 21 bp, Homo sapiens
gggggggggggggggtttcgg

SEQ ID NO: 41725 - DNA, 25 bp, Homo sapiens
ggggaggaaggtcagggaggagcgg

SEQ ID NO: 41726 - DNA, 22 bp, Homo sapiens
ggggaggaggggggcacagcgg

SEQ ID NO: 41727 - DNA, 24 bp, Homo sapiens
ggggggtggggacggaaggggcgg

SEQ ID NO: 41728 - DNA, 22 bp, Homo sapiens
ggggaggggcaggggagagcgg

SEQ ID NO: 41729 - DNA, 18 bp, Homo sapiens
agggggagtggggaggcg

SEQ ID NO: 41730 - DNA, 19 bp, Homo sapiens
ggggaggagtgaggggaag

SEQ ID NO: 41731 - DNA, 16 bp, Homo sapiens
ggggggagaggggagg

SEQ ID NO: 41732 - DNA, 18 bp, Homo sapiens
ggggaggggagggggatg

SEQ ID NO: 41733 - DNA, 24 bp, Homo sapiens
ggggcgggggcggggcgagggcgg

SEQ ID NO: 41734 - DNA, 19 bp, Homo sapiens
ggggagagtggggggaaaa

SEQ ID NO: 41735 - DNA, 23 bp, Homo sapiens
gggtgaggagtgggccagagtgg

SEQ ID NO: 41736 - DNA, 19 bp, Homo sapiens
gggcgggagcagggggtgg

SEQ ID NO: 41737 - DNA, 20 bp, Homo sapiens
ggggaggggcgggggggcag

SEQ ID NO: 41738 - DNA, 19 bp, Homo sapiens
gggtgggggcgagggggcg

SEQ ID NO: 41739 - DNA, 18 bp, Homo sapiens
ggggaggggcgggagtgg

SEQ ID NO: 41740 - DNA, 16 bp, Homo sapiens
gggggggcgggggggg

SEQ ID NO: 41741 - DNA, 21 bp, Homo sapiens
ggggggcggcgggggggacag

SEQ ID NO: 41742 - DNA, 24 bp, Homo sapiens
gggaggggcgggggagaggagcgg

SEQ ID NO: 41743 - DNA, 22 bp, Homo sapiens
ggggaggaggagcggggagcgg

SEQ ID NO: 41744 - DNA, 25 bp, Homo sapiens
ggaggatctgtagggggaggggcgg

SEQ ID NO: 41745 - DNA, 23 bp, Homo sapiens
ggggaggggcgggggctccgcgg

SEQ ID NO: 41746 - DNA, 23 bp, Homo sapiens
gggaagggaggtgggaggggcgg

SEQ ID NO: 41747 - DNA, 20 bp, Homo sapiens
ggggcaggagcgggggctgg

SEQ ID NO: 41748 - DNA, 19 bp, Homo sapiens
ggggagggtcgccggagcg

SEQ ID NO: 41749 - DNA, 19 bp, Homo sapiens
ggggaggggtggggagaaa

SEQ ID NO: 41750 - DNA, 18 bp, Homo sapiens
ggggtggggagaggggcg

SEQ ID NO: 41751 - DNA, 19 bp, Homo sapiens
agggaggagcgatcgggag

SEQ ID NO: 41752 - DNA, 19 bp, Homo sapiens
ggggagggggcgggcgggg

SEQ ID NO: 41753 - DNA, 20 bp, Homo sapiens
ggagagggacaatggggagg

SEQ ID NO: 41754 - DNA, 21 bp, Homo sapiens
ggggagggtcggggggccagg

SEQ ID NO: 41755 - DNA, 18 bp, Homo sapiens
ggggagaagcaggggtgg

SEQ ID NO: 41756 - DNA, 25 bp, Homo sapiens
ggggagcggtgggaaaggggggtgg

SEQ ID NO: 41757 - DNA, 21 bp, Homo sapiens
gggtgggttgggggggagcgg

SEQ ID NO: 41758 - DNA, 19 bp, Homo sapiens
ggggcggggcgggggacgg

SEQ ID NO: 41759 - DNA, 20 bp, Homo sapiens
gggtgggagcggggggctgg

SEQ ID NO: 41760 - DNA, 18 bp, Homo sapiens
ggggagggctgggagcgg

SEQ ID NO: 41761 - DNA, 18 bp, Homo sapiens
ggggtgggtggggggagg

SEQ ID NO: 41762 - DNA, 25 bp, Homo sapiens
ggcggaggagctccccagggagtgg

SEQ ID NO: 41763 - DNA, 25 bp, Homo sapiens
gggtgggagcgggagggaggagcgg

SEQ ID NO: 41764 - DNA, 27 bp, Homo sapiens
ggggaggggcgcccgggggaggggcgg

SEQ ID NO: 41765 - DNA, 20 bp, Homo sapiens
ggggaggcagcgggggtcag

SEQ ID NO: 41766 - DNA, 20 bp, Homo sapiens
agggaggtactggggggcgg

SEQ ID NO: 41767 - DNA, 19 bp, Homo sapiens
gggggagggaaggggagcg

SEQ ID NO: 41768 - DNA, 21 bp, Homo sapiens
ggggcctggggggaggggcgg

SEQ ID NO: 41769 - DNA, 19 bp, Homo sapiens
ggggagagagcaggggcgg

SEQ ID NO: 41770 - DNA, 19 bp, Homo sapiens
ggggcgagcgggcgggcgg

SEQ ID NO: 41771 - DNA, 22 bp, Homo sapiens
gaggaggagcgggcgcgggcgg

SEQ ID NO: 41772 - DNA, 18 bp, Homo sapiens
ggggtgaagggggagtgg

SEQ ID NO: 41773 - DNA, 18 bp, Homo sapiens
ggggcggagcgggggcgg

SEQ ID NO: 41774 - DNA, 16 bp, Homo sapiens
ggggcggggaggggcg

SEQ ID NO: 41775 - DNA, 18 bp, Homo sapiens
gggtgggggcggagggcg

SEQ ID NO: 41776 - DNA, 18 bp, Homo sapiens
ggggaggaggggaggtgg

SEQ ID NO: 41777 - DNA, 22 bp, Homo sapiens
ggggagggggagcgaggggcgg

SEQ ID NO: 41778 - DNA, 24 bp, Homo sapiens
ggggaggcggcgggccgggggcgg

SEQ ID NO: 41779 - DNA, 25 bp, Homo sapiens
ggggaggagagaaggagaggggcgg

SEQ ID NO: 41780 - DNA, 18 bp, Homo sapiens
ggggcgggcggggaggcg

SEQ ID NO: 41781 - DNA, 24 bp, Homo sapiens
ggggagggcgggggccacaggcgg

SEQ ID NO: 41782 - DNA, 20 bp, Homo sapiens
agggaggagtggggggaaaa

SEQ ID NO: 41783 - DNA, 22 bp, Homo sapiens
ggggagggttgcgggggggcgg

SEQ ID NO: 41784 - DNA, 19 bp, Homo sapiens
gggagggaggagaggagcg

SEQ ID NO: 41785 - DNA, 25 bp, Homo sapiens
ggggcgggggcgggggcgggggcgg

SEQ ID NO: 41786 - DNA, 18 bp, Homo sapiens
ggaggggggcggagggcg

SEQ ID NO: 41787 - DNA, 19 bp, Homo sapiens
ggggaggcaaggaggggcg

SEQ ID NO: 41788 - DNA, 19 bp, Homo sapiens
ggggaggggttggacagcg

SEQ ID NO: 41789 - DNA, 18 bp, Homo sapiens
ggggagggcggagggcgg

SEQ ID NO: 41790 - DNA, 18 bp, Homo sapiens
ggggaggggtgggggtgc

SEQ ID NO: 41791 - DNA, 19 bp, Homo sapiens
ggggagggaaggggagtgg

SEQ ID NO: 41792 - DNA, 22 bp, Homo sapiens
ggggagggtggggggttgctgg

SEQ ID NO: 41793 - DNA, 19 bp, Homo sapiens
gggggtaagggaggggcgg

SEQ ID NO: 41794 - DNA, 16 bp, Homo sapiens
ggggggcgaggggcgg

SEQ ID NO: 41795 - DNA, 19 bp, Homo sapiens
ggggaggggtgtggaggcg

SEQ ID NO: 41796 - DNA, 21 bp, Homo sapiens
gggaaggggtgtaaggagtgg

SEQ ID NO: 41797 - DNA, 26 bp, Homo sapiens
ggggagggtggagatgaggggggcgg

SEQ ID NO: 41798 - DNA, 19 bp, Homo sapiens
ggggaggagctgggtgtgg

SEQ ID NO: 41799 - DNA, 22 bp, Homo sapiens
ggggagcaagcgggaggggcgg

SEQ ID NO: 41800 - DNA, 17 bp, Homo sapiens
ggggggagcggcggtgg

SEQ ID NO: 41801 - DNA, 16 bp, Homo sapiens
ggggaggggggagtgg

SEQ ID NO: 41802 - DNA, 18 bp, Homo sapiens
ggggggagtggggggagg

SEQ ID NO: 41803 - DNA, 17 bp, Homo sapiens
gggggggaggggagggg

SEQ ID NO: 41804 - DNA, 20 bp, Homo sapiens
ggggaggggtgggagggagg

SEQ ID NO: 41805 - DNA, 21 bp, Homo sapiens
gggagggggcggggcgggtgg

SEQ ID NO: 41806 - DNA, 18 bp, Homo sapiens
ggggggtggcaggggcgg

SEQ ID NO: 41807 - DNA, 21 bp, Homo sapiens
gggtaggggcaaggggggcgg

SEQ ID NO: 41808 - DNA, 21 bp, Homo sapiens
ggggaggggagggggacgcgg

SEQ ID NO: 41809 - DNA, 23 bp, Homo sapiens
ggggtggggacgcgggggagcgg

SEQ ID NO: 41810 - DNA, 21 bp, Homo sapiens
ggggagggtgatggggggtgg

SEQ ID NO: 41811 - DNA, 19 bp, Homo sapiens
ggggaggaatggggtgcgg

SEQ ID NO: 41812 - DNA, 20 bp, Homo sapiens
ggggaggggtgacggggtgg

SEQ ID NO: 41813 - DNA, 18 bp, Homo sapiens
ggggagggcgcgggagcg

SEQ ID NO: 41814 - DNA, 18 bp, Homo sapiens
ggagaggagggaggggcg

SEQ ID NO: 41815 - DNA, 19 bp, Homo sapiens
ggggatgggcggggaagcg

SEQ ID NO: 41816 - DNA, 16 bp, Homo sapiens
gaggaggaggaggagc

SEQ ID NO: 41817 - DNA, 22 bp, Homo sapiens
ggggggagcaggagaagagtgg

SEQ ID NO: 41818 - DNA, 19 bp, Homo sapiens
ggggaggggtggggtgggg

SEQ ID NO: 41819 - DNA, 20 bp, Homo sapiens
ggggaggaggtggtgggcgg

SEQ ID NO: 41820 - DNA, 18 bp, Homo sapiens
ggggggggtggggagagg

SEQ ID NO: 41821 - DNA, 18 bp, Homo sapiens
gggggcggggtgggggcg

SEQ ID NO: 41822 - DNA, 17 bp, Homo sapiens
ggggagggcgggaaggg

SEQ ID NO: 41823 - DNA, 21 bp, Homo sapiens
ggggaggagctctgggggcgg

SEQ ID NO: 41824 - DNA, 19 bp, Homo sapiens
ggggaggggcggcggggag

SEQ ID NO: 41825 - DNA, 18 bp, Homo sapiens
gggagggggcgggggtgg

SEQ ID NO: 41826 - DNA, 19 bp, Homo sapiens
ggtggggagtggagggtgg

SEQ ID NO: 41827 - DNA, 18 bp, Homo sapiens
ggggtggaggaggggtgg

SEQ ID NO: 41828 - DNA, 19 bp, Homo sapiens
ggggatggagtgaaagggg

SEQ ID NO: 41829 - DNA, 19 bp, Homo sapiens
gggggggccggaggggtgg

SEQ ID NO: 41830 - DNA, 20 bp, Homo sapiens
ggggggtgggggtcaggcag

SEQ ID NO: 41831 - DNA, 22 bp, Homo sapiens
ggcggggagcggggggcgccgg

SEQ ID NO: 41832 - DNA, 16 bp, Homo sapiens
ggggaggggggagagc

SEQ ID NO: 41833 - DNA, 25 bp, Homo sapiens
ggggggggcggggggtgaagagcgg

SEQ ID NO: 41834 - DNA, 21 bp, Homo sapiens
ggggaggagggggtggggcgg

SEQ ID NO: 41835 - DNA, 20 bp, Homo sapiens
ggcggggagcgggctggtgg

SEQ ID NO: 41836 - DNA, 19 bp, Homo sapiens
ggggacgagcgggtggcgg

SEQ ID NO: 41837 - DNA, 19 bp, Homo sapiens
gggcgggagcgggggccgg

SEQ ID NO: 41838 - DNA, 20 bp, Homo sapiens
gggaaggggtaggggggtgg

SEQ ID NO: 41839 - DNA, 17 bp, Homo sapiens
ggggtgggcggggggag

SEQ ID NO: 41840 - DNA, 19 bp, Homo sapiens
ggggagggatagggagtgg

SEQ ID NO: 41841 - DNA, 17 bp, Homo sapiens
ggggaaggggggggtgg

SEQ ID NO: 41842 - DNA, 22 bp, Homo sapiens
ggggagtgggcccggggggcgg

SEQ ID NO: 41843 - DNA, 24 bp, Homo sapiens
agggtggggtggggggaggggcgg

SEQ ID NO: 41844 - DNA, 21 bp, Homo sapiens
ggggggaggtggggctggcgg

SEQ ID NO: 41845 - DNA, 21 bp, Homo sapiens
ggggaggggtggaggggctgg

SEQ ID NO: 41846 - DNA, 18 bp, Homo sapiens
ggggtaggggaggggtgg

SEQ ID NO: 41847 - DNA, 19 bp, Homo sapiens
ggggggggggggcgggcag

SEQ ID NO: 41848 - DNA, 17 bp, Homo sapiens
gggggaagtgggggcgg

SEQ ID NO: 41849 - DNA, 20 bp, Homo sapiens
gggaggggccgggggagcgg

SEQ ID NO: 41850 - DNA, 18 bp, Homo sapiens
ggggacgggaggggggcg

SEQ ID NO: 41851 - DNA, 22 bp, Homo sapiens
ggggcggtggggggaaaggcgg

SEQ ID NO: 41852 - DNA, 20 bp, Homo sapiens
agggggagggggaggggcgg

SEQ ID NO: 41853 - DNA, 17 bp, Homo sapiens
ggggaggaaagaggagg

SEQ ID NO: 41854 - DNA, 21 bp, Homo sapiens
agggaggaagaggaggggcgg

SEQ ID NO: 41855 - DNA, 23 bp, Homo sapiens
ggggagggttggtgatggggtgg

SEQ ID NO: 41856 - DNA, 19 bp, Homo sapiens
gggagggagcccgggagcg

SEQ ID NO: 41857 - DNA, 17 bp, Homo sapiens
ggggggtgggggggaag

SEQ ID NO: 41858 - DNA, 22 bp, Homo sapiens
ggggggggcggggggcgggcgg

SEQ ID NO: 41859 - DNA, 16 bp, Homo sapiens
gggcggggggcgggcg

SEQ ID NO: 41860 - DNA, 23 bp, Homo sapiens
ggagaggggcgggcgcagggtgg

SEQ ID NO: 41861 - DNA, 20 bp, Homo sapiens
ggggaggggtgtggggaaag

SEQ ID NO: 41862 - DNA, 17 bp, Homo sapiens
gggcggcgggaggagcg

SEQ ID NO: 41863 - DNA, 19 bp, Homo sapiens
ggggaggggcggggtgggg

SEQ ID NO: 41864 - DNA, 19 bp, Homo sapiens
ggggggagtgaggggccgg

SEQ ID NO: 41865 - DNA, 24 bp, Homo sapiens
gggcgaggggcgggcgaagagcgg

SEQ ID NO: 41866 - DNA, 20 bp, Homo sapiens
ggggaggaggcgggggccgg

SEQ ID NO: 41867 - DNA, 19 bp, Homo sapiens
gggaaggggtggggggtgg

SEQ ID NO: 41868 - DNA, 19 bp, Homo sapiens
ggggagagggtgggaggcg

SEQ ID NO: 41869 - DNA, 25 bp, Homo sapiens
ggggagcggcggccgaccggggcgg

SEQ ID NO: 41870 - DNA, 22 bp, Homo sapiens
ggggagggtggtggaggagcgg

SEQ ID NO: 41871 - DNA, 68 bp, Leishmania RNA virus 1-4
tgccttacgacccgttgaaaggatctgggagaacagtaatgtcatccttgaccctgggagtatcggca

SEQ ID NO: 41872 - DNA, 24 bp, Leishmania RNA virus 1-4
acccgttgaaaggatctgggagaa

SEQ ID NO: 41873 - DNA, 20 bp, Homo sapiens
ccttttgaaaggcagaggag

SEQ ID NO: 41874 - DNA, 21 bp, Homo sapiens
acccgttggaggcgggtggga

SEQ ID NO: 41875 - DNA, 16 bp, Homo sapiens
gtgaaaggtgtggaga

SEQ ID NO: 41876 - DNA, 20 bp, Homo sapiens
tcgattcagatttgggagaa

SEQ ID NO: 41877 - DNA, 20 bp, Homo sapiens
acccgttgcagggacggggg

SEQ ID NO: 41878 - DNA, 23 bp, Homo sapiens
acccattgggggcggagggggag

SEQ ID NO: 41879 - DNA, 17 bp, Homo sapiens
ccgttggggcctgggag

SEQ ID NO: 41880 - DNA, 20 bp, Homo sapiens
ttggaggacccaggggagaa

SEQ ID NO: 41881 - DNA, 19 bp, Homo sapiens
ttggggggtcctaggagaa

SEQ ID NO: 41882 - DNA, 17 bp, Homo sapiens
cccttgagccctgggag

SEQ ID NO: 41883 - DNA, 23 bp, Homo sapiens
caccaaaagggggtttgggggaa

SEQ ID NO: 41884 - DNA, 20 bp, Homo sapiens
ttgaaaggagagcccggaga

SEQ ID NO: 41885 - DNA, 20 bp, Homo sapiens
gttgaaaggttctaccagga

SEQ ID NO: 41886 - DNA, 19 bp, Homo sapiens
ttgaggttccatgggagaa

SEQ ID NO: 41887 - DNA, 21 bp, Homo sapiens
cccaggaggggtctgggggaa

SEQ ID NO: 41888 - DNA, 17 bp, Homo sapiens
gtgaaaggaagcaagag

SEQ ID NO: 41889 - DNA, 16 bp, Homo sapiens
ccctaggtctgggaga

SEQ ID NO: 41890 - DNA, 20 bp, Homo sapiens
ccctgttgagagcctgggag

SEQ ID NO: 41891 - DNA, 22 bp, Homo sapiens
ccgctgggagagtccgggagaa

SEQ ID NO: 41892 - DNA, 18 bp, Homo sapiens
acccttgggactgggaga

SEQ ID NO: 41893 - DNA, 17 bp, Homo sapiens
cccgctggcctgggaga

SEQ ID NO: 41894 - DNA, 20 bp, Homo sapiens
acccgttgcagggaccggaa

SEQ ID NO: 41895 - DNA, 20 bp, Homo sapiens
cctgtgagagaagaggagaa

SEQ ID NO: 41896 - DNA, 17 bp, Homo sapiens
gttggaatctgggagaa

SEQ ID NO: 41897 - DNA, 20 bp, Homo sapiens
cctggctcacaggatctggg

SEQ ID NO: 41898 - DNA, 17 bp, Homo sapiens
gtagaggactgggagaa

SEQ ID NO: 41899 - DNA, 20 bp, Homo sapiens
ctgagtgggatctgggggaa

SEQ ID NO: 41900 - DNA, 17 bp, Homo sapiens
cctttgaaaggacggaa

SEQ ID NO: 41901 - DNA, 19 bp, Homo sapiens
cctttgaaagggtactgaa

SEQ ID NO: 41902 - DNA, 24 bp, Homo sapiens
acctggttggggctgccctgggag

SEQ ID NO: 41903 - DNA, 16 bp, Homo sapiens
catcagatttgggaga

SEQ ID NO: 41904 - DNA, 22 bp, Homo sapiens
gttgaaagcatttttactggaa

SEQ ID NO: 41905 - DNA, 22 bp, Homo sapiens
gctgagagcagggatctgggag

SEQ ID NO: 41906 - DNA, 20 bp, Homo sapiens
ccctttgggggtccggagag

SEQ ID NO: 41907 - DNA, 18 bp, Homo sapiens
cctgcccaggtctgggag

SEQ ID NO: 41908 - DNA, 19 bp, Homo sapiens
cctgctggaagacagggag

SEQ ID NO: 41909 - DNA, 17 bp, Homo sapiens
cctgctgagcctgggag

SEQ ID NO: 41910 - DNA, 17 bp, Homo sapiens
cccttgaggcctgggag

SEQ ID NO: 41911 - DNA, 19 bp, Homo sapiens
gttaaaagggaaaaaagaa

SEQ ID NO: 41912 - DNA, 23 bp, Homo sapiens
acccagtgctaggatctgggaga

SEQ ID NO: 41913 - DNA, 17 bp, Homo sapiens
acccgttggtgggggag

SEQ ID NO: 41914 - DNA, 21 bp, Homo sapiens
acctgtttgaaggcagccggg

SEQ ID NO: 41915 - DNA, 17 bp, Homo sapiens
cgttaggtctgggagaa

SEQ ID NO: 41916 - DNA, 17 bp, Homo sapiens
ccgttgtatctgggaga

SEQ ID NO: 41917 - DNA, 19 bp, Homo sapiens
acctgttgaaagaatagag

SEQ ID NO: 41918 - DNA, 23 bp, Homo sapiens
acctgatgggagggacaggagaa

SEQ ID NO: 41919 - DNA, 19 bp, Homo sapiens
acctgttgcaggtggggag

SEQ ID NO: 41920 - DNA, 20 bp, Homo sapiens
cctgttcaaaggatcaagag

SEQ ID NO: 41921 - DNA, 18 bp, Homo sapiens
ccttgaaagggaacagga

SEQ ID NO: 41922 - DNA, 70 bp, Eimeria brunetti RNA virus 1
gctacgagttcctgcgtgtcgctggctcgccattcactggtgtgggcggttacgtggcgaggtcggtggc

SEQ ID NO: 41923 - DNA, 24 bp, Eimeria brunetti RNA virus 1
tgggcggttacgtggcgaggtcgg

SEQ ID NO: 41924 - DNA, 17 bp, Homo sapiens
ggcaaagtggcggggtg

SEQ ID NO: 41925 - DNA, 17 bp, Homo sapiens
gggcggttgtgggggtg

SEQ ID NO: 41926 - DNA, 22 bp, Homo sapiens
tgggcggatcacctgaggtcgg

SEQ ID NO: 41927 - DNA, 22 bp, Homo sapiens
tgggtggatcacctgaggtcgg

SEQ ID NO: 41928 - DNA, 25 bp, Homo sapiens
tgggcggtgcccggggcggggtcgg

SEQ ID NO: 41929 - DNA, 22 bp, Homo sapiens
tgggcggatcacttgaggtcgg

SEQ ID NO: 41930 - DNA, 17 bp, Homo sapiens
tgggcagttctggggtg

SEQ ID NO: 41931 - DNA, 123 bp, Human herpesvirus 1
gggctggggccggggagggctggggccggggagggctggggccggggagggctggggccggggagggctggggccggggagggctggggccggggagggctggggctggggagggctggggct

SEQ ID NO: 41932 - DNA, 24 bp, Human herpesvirus 1
gggccggggagggctggggccggg

SEQ ID NO: 41933 - DNA, 19 bp, Homo sapiens
ggggcggggcaggggccgg

SEQ ID NO: 41934 - DNA, 20 bp, Homo sapiens
gggcggggagggtccgcggg

SEQ ID NO: 41935 - DNA, 23 bp, Homo sapiens
gggctggggagagggcctctggg

SEQ ID NO: 41936 - DNA, 23 bp, Homo sapiens
gggctggggcgctggtggccggg

SEQ ID NO: 41937 - DNA, 18 bp, Homo sapiens
ggactgggctggggctgg

SEQ ID NO: 41938 - DNA, 20 bp, Homo sapiens
gggttggggagggtgggcag

SEQ ID NO: 41939 - DNA, 26 bp, Homo sapiens
gggctgggggagtaccaggggctggg

SEQ ID NO: 41940 - DNA, 19 bp, Homo sapiens
gggctgaggtggggctggg

SEQ ID NO: 41941 - DNA, 19 bp, Homo sapiens
gggtgggggagggctgagg

SEQ ID NO: 41942 - DNA, 20 bp, Homo sapiens
gggcgggggcgggggccggg

SEQ ID NO: 41943 - DNA, 21 bp, Homo sapiens
gctctgagggctggggctggg

SEQ ID NO: 41944 - DNA, 21 bp, Homo sapiens
gggctgggagggctggagagg

SEQ ID NO: 41945 - DNA, 20 bp, Homo sapiens
gggctggtgagggctggtgg

SEQ ID NO: 41946 - DNA, 20 bp, Homo sapiens
aggccggggagtgggctggg

SEQ ID NO: 41947 - DNA, 22 bp, Homo sapiens
gggctagggggagggggtcggg

SEQ ID NO: 41948 - DNA, 19 bp, Homo sapiens
gggctcggggggcgccggg

SEQ ID NO: 41949 - DNA, 21 bp, Homo sapiens
ggggtgggggccagggccggg

SEQ ID NO: 41950 - DNA, 19 bp, Homo sapiens
ggcctggggaagggttggg

SEQ ID NO: 41951 - DNA, 27 bp, Homo sapiens
gggctgaggctgggggctggggtcggg

SEQ ID NO: 41952 - DNA, 25 bp, Homo sapiens
gggccgggcagggccccctcccggg

SEQ ID NO: 41953 - DNA, 24 bp, Homo sapiens
gggcaggggaaaggaggggttggg

SEQ ID NO: 41954 - DNA, 21 bp, Homo sapiens
gagtcggggagggttgaaagg

SEQ ID NO: 41955 - DNA, 18 bp, Homo sapiens
gggcggggagggggccgg

SEQ ID NO: 41956 - DNA, 20 bp, Homo sapiens
gggctggggaagacgctggg

SEQ ID NO: 41957 - DNA, 22 bp, Homo sapiens
ggctgggacgcctggggccggg

SEQ ID NO: 41958 - DNA, 25 bp, Homo sapiens
gggcctggggagacctggggctggg

SEQ ID NO: 41959 - DNA, 18 bp, Homo sapiens
gggctgggcgggggccgg

SEQ ID NO: 41960 - DNA, 20 bp, Homo sapiens
gggtggggagggctgcaggg

SEQ ID NO: 41961 - DNA, 26 bp, Homo sapiens
gggctggggctggggctggggctggg

SEQ ID NO: 41962 - DNA, 22 bp, Homo sapiens
cggggctggggctggggctggg

SEQ ID NO: 41963 - DNA, 18 bp, Homo sapiens
cggcggggctggggctgg

SEQ ID NO: 41964 - DNA, 23 bp, Homo sapiens
gggccggaggggtgcaggctggg

SEQ ID NO: 41965 - DNA, 18 bp, Homo sapiens
gggccaggtggggctggg

SEQ ID NO: 41966 - DNA, 21 bp, Homo sapiens
gggcaggggagaggggctggg

SEQ ID NO: 41967 - DNA, 20 bp, Homo sapiens
gggctggggaggtctgcggg

SEQ ID NO: 41968 - DNA, 26 bp, Homo sapiens
gggctggggatggaaaggtggttggg

SEQ ID NO: 41969 - DNA, 22 bp, Homo sapiens
gggcctggggctgagggctggg

SEQ ID NO: 41970 - DNA, 21 bp, Homo sapiens
gggtgagggctgggggttggg

SEQ ID NO: 41971 - DNA, 22 bp, Homo sapiens
gggctagggggtgagggctggg

SEQ ID NO: 41972 - DNA, 19 bp, Homo sapiens
gggctggggggctgctggg

SEQ ID NO: 41973 - DNA, 18 bp, Homo sapiens
gggccgggcgggggccgg

SEQ ID NO: 41974 - DNA, 18 bp, Homo sapiens
gggcgggggccgggccgg

SEQ ID NO: 41975 - DNA, 18 bp, Homo sapiens
gggccgcgggggagccgg

SEQ ID NO: 41976 - DNA, 19 bp, Homo sapiens
ggcccggggccggggccgg

SEQ ID NO: 41977 - DNA, 18 bp, Homo sapiens
gggctgggggtggctgga

SEQ ID NO: 41978 - DNA, 19 bp, Homo sapiens
ggcctggggaggggctggg

SEQ ID NO: 41979 - DNA, 17 bp, Homo sapiens
gggccgggagggccggg

SEQ ID NO: 41980 - DNA, 19 bp, Homo sapiens
gagccctggctggggctgg

SEQ ID NO: 41981 - DNA, 21 bp, Homo sapiens
gggccggcgatgcgggtcggg

SEQ ID NO: 41982 - DNA, 21 bp, Homo sapiens
gggcggggagggggtgctggg

SEQ ID NO: 41983 - DNA, 22 bp, Homo sapiens
ggactggggaaaaggggctggg

SEQ ID NO: 41984 - DNA, 23 bp, Homo sapiens
gggcctggctggctggggctggg

SEQ ID NO: 41985 - DNA, 25 bp, Homo sapiens
gggtcgggaaggggccagggccggg

SEQ ID NO: 41986 - DNA, 20 bp, Homo sapiens
gggccggggctggggctggg

SEQ ID NO: 41987 - DNA, 19 bp, Homo sapiens
gggtggggctggggctggg

SEQ ID NO: 41988 - DNA, 19 bp, Homo sapiens
gggctggagggggctgagg

SEQ ID NO: 41989 - DNA, 18 bp, Homo sapiens
gggctgggaggggctggg

SEQ ID NO: 41990 - DNA, 21 bp, Homo sapiens
ggcccggggaagggggctggg

SEQ ID NO: 41991 - DNA, 22 bp, Homo sapiens
gggccgcgggacgggggctggg

SEQ ID NO: 41992 - DNA, 20 bp, Homo sapiens
gggctgggggttaggctggg

SEQ ID NO: 41993 - DNA, 18 bp, Homo sapiens
gggcggggagggctgcgg

SEQ ID NO: 41994 - DNA, 19 bp, Homo sapiens
gggctgggggtggcacggg

SEQ ID NO: 41995 - DNA, 26 bp, Homo sapiens
ggggcggggcggggcgggggccgggc

SEQ ID NO: 41996 - DNA, 22 bp, Homo sapiens
gggcggggaaggcggggctggg

SEQ ID NO: 41997 - DNA, 20 bp, Homo sapiens
gggccggggcgggggtcggg

SEQ ID NO: 41998 - DNA, 20 bp, Homo sapiens
gggcgggggtcggggctggg

SEQ ID NO: 41999 - DNA, 20 bp, Homo sapiens
gggctgaggctggggccggg

SEQ ID NO: 42000 - DNA, 18 bp, Homo sapiens
ggaaggggctggggctgg

SEQ ID NO: 42001 - DNA, 19 bp, Homo sapiens
gggccagggagggcgtggg

SEQ ID NO: 42002 - DNA, 23 bp, Homo sapiens
gggccagggcttaaggggttggg

SEQ ID NO: 42003 - DNA, 23 bp, Homo sapiens
ggtctggggagggtccctgcggg

SEQ ID NO: 42004 - DNA, 18 bp, Homo sapiens
gggccgggtcggggtcgg

SEQ ID NO: 42005 - DNA, 19 bp, Homo sapiens
gggtcggggtcgggccggg

SEQ ID NO: 42006 - DNA, 20 bp, Homo sapiens
gggccggggccggggtcggg

SEQ ID NO: 42007 - DNA, 23 bp, Homo sapiens
gggccgggcggggggctcctggg

SEQ ID NO: 42008 - DNA, 21 bp, Homo sapiens
gggtggggggccggggccggg

SEQ ID NO: 42009 - DNA, 22 bp, Homo sapiens
ggccgggctggctggggctggg

SEQ ID NO: 42010 - DNA, 23 bp, Homo sapiens
ggtctggggaaggaggggttggg

SEQ ID NO: 42011 - DNA, 22 bp, Homo sapiens
gggatgggggttgggggtcggg

SEQ ID NO: 42012 - DNA, 18 bp, Homo sapiens
ggctggggagtggctggg

SEQ ID NO: 42013 - DNA, 23 bp, Homo sapiens
gggtggggagggatggggctggg

SEQ ID NO: 42014 - DNA, 24 bp, Homo sapiens
gggcccggcggggctggggctggg

SEQ ID NO: 42015 - DNA, 18 bp, Homo sapiens
gggctgggggcggccggg

SEQ ID NO: 42016 - DNA, 19 bp, Homo sapiens
gggtgggggccgggctggg

SEQ ID NO: 42017 - DNA, 20 bp, Homo sapiens
ggctggggagggcgtgcggg

SEQ ID NO: 42018 - DNA, 19 bp, Homo sapiens
gggccgggcccggggccgg

SEQ ID NO: 42019 - DNA, 20 bp, Homo sapiens
gggctggggcagggcctggg

SEQ ID NO: 42020 - DNA, 24 bp, Homo sapiens
gggctgggaagggtccgcactggg

SEQ ID NO: 42021 - DNA, 23 bp, Homo sapiens
gggccgggaggggtagacctggg

SEQ ID NO: 42022 - DNA, 18 bp, Homo sapiens
ggggctggctggggccgg

SEQ ID NO: 42023 - DNA, 24 bp, Homo sapiens
ggctggggccgggctggggctggg

SEQ ID NO: 42024 - DNA, 24 bp, Homo sapiens
gggccgggtggggcgaagcccggg

SEQ ID NO: 42025 - DNA, 20 bp, Homo sapiens
gagctggggagggaaccggg

SEQ ID NO: 42026 - DNA, 24 bp, Homo sapiens
gggctgggggaaccctgggctggg

SEQ ID NO: 42027 - DNA, 20 bp, Homo sapiens
gggctgagggagggttgagg

SEQ ID NO: 42028 - DNA, 21 bp, Homo sapiens
gggccaggggagggttgtggg

SEQ ID NO: 42029 - DNA, 18 bp, Homo sapiens
gggcgggcgtggggccgg

SEQ ID NO: 42030 - DNA, 18 bp, Homo sapiens
gggtggggaggagttggg

SEQ ID NO: 42031 - DNA, 23 bp, Homo sapiens
gggctgggcagggctgggctggg

SEQ ID NO: 42032 - DNA, 22 bp, Homo sapiens
gggctggggagcggctggcggg

SEQ ID NO: 42033 - DNA, 18 bp, Homo sapiens
ggctggggccggggccgg

SEQ ID NO: 42034 - DNA, 21 bp, Homo sapiens
gggctgggagggctggcacag

SEQ ID NO: 42035 - DNA, 20 bp, Homo sapiens
gggctgagggagggtgtggg

SEQ ID NO: 42036 - DNA, 22 bp, Homo sapiens
gggtggggaggggcatcttggg

SEQ ID NO: 42037 - DNA, 20 bp, Homo sapiens
gggctggggaggggcttggg

SEQ ID NO: 42038 - DNA, 21 bp, Homo sapiens
ggggctggggctggggctggg

SEQ ID NO: 42039 - DNA, 21 bp, Homo sapiens
gggcctggggctggggctggg

SEQ ID NO: 42040 - DNA, 22 bp, Homo sapiens
gggctggggtgggggctctggg

SEQ ID NO: 42041 - DNA, 20 bp, Homo sapiens
gggctggggaggggcgtggg

SEQ ID NO: 42042 - DNA, 21 bp, Homo sapiens
gggctgggagggtccgctggg

SEQ ID NO: 42043 - DNA, 22 bp, Homo sapiens
gagctggggaggggaccctggg

SEQ ID NO: 42044 - DNA, 22 bp, Homo sapiens
gggctggaggaggggctctggg

SEQ ID NO: 42045 - DNA, 19 bp, Homo sapiens
gggctgggagggccctggg

SEQ ID NO: 42046 - DNA, 19 bp, Homo sapiens
gagctggggtggggctggg

SEQ ID NO: 42047 - DNA, 20 bp, Homo sapiens
gaggtagggttggggccggg

SEQ ID NO: 42048 - DNA, 25 bp, Homo sapiens
gggatggggaggggccactgctggg

SEQ ID NO: 42049 - DNA, 18 bp, Homo sapiens
gggccgggcggggttggg

SEQ ID NO: 42050 - DNA, 24 bp, Homo sapiens
gggttggagggggcaggggccggg

SEQ ID NO: 42051 - DNA, 25 bp, Homo sapiens
gggctgggagggctgaggggctggg

SEQ ID NO: 42052 - DNA, 19 bp, Homo sapiens
gggctggggtgggcctggg

SEQ ID NO: 42053 - DNA, 19 bp, Homo sapiens
gggccagggagtgggccgg

SEQ ID NO: 42054 - DNA, 21 bp, Homo sapiens
ggtgccggggccggggccggg

SEQ ID NO: 42055 - DNA, 22 bp, Homo sapiens
gggcaggggaagcggggccggg

SEQ ID NO: 42056 - DNA, 20 bp, Homo sapiens
gggcccgggaggggactggg

SEQ ID NO: 42057 - DNA, 20 bp, Homo sapiens
gggccgggagggggcgtggg

SEQ ID NO: 42058 - DNA, 23 bp, Homo sapiens
gggccggggcggggcgctgcggg

SEQ ID NO: 42059 - DNA, 22 bp, Homo sapiens
gcgctgggggctccgggccggg

SEQ ID NO: 42060 - DNA, 26 bp, Homo sapiens
ggcccggggaggggaaaagggtcggg

SEQ ID NO: 42061 - DNA, 22 bp, Homo sapiens
gggctggggagaagacgctggg

SEQ ID NO: 42062 - DNA, 21 bp, Homo sapiens
gggccggggcgcggggtcggg

SEQ ID NO: 42063 - DNA, 24 bp, Homo sapiens
aggccggggagggagctctccggg

SEQ ID NO: 42064 - DNA, 18 bp, Homo sapiens
aggctggggaggggccgg

SEQ ID NO: 42065 - DNA, 16 bp, Homo sapiens
gggcgggagggctggg

SEQ ID NO: 42066 - DNA, 19 bp, Homo sapiens
gggctgggggcgggctggg

SEQ ID NO: 42067 - DNA, 19 bp, Homo sapiens
gggcttgggggggctgcgg

SEQ ID NO: 42068 - DNA, 23 bp, Homo sapiens
gggccgggggcggcggggccggg

SEQ ID NO: 42069 - DNA, 18 bp, Homo sapiens
gggccggggggcggccgg

SEQ ID NO: 42070 - DNA, 21 bp, Homo sapiens
gggctggggggaagggctggg

SEQ ID NO: 42071 - DNA, 18 bp, Homo sapiens
gggctggggcggggccgg

SEQ ID NO: 42072 - DNA, 22 bp, Homo sapiens
gggctgggaggaggtggctggg

SEQ ID NO: 42073 - DNA, 21 bp, Homo sapiens
aggctgggggcaggggctggg

SEQ ID NO: 42074 - DNA, 20 bp, Homo sapiens
gggccggcgggggctgcggg

SEQ ID NO: 42075 - DNA, 19 bp, Homo sapiens
gagctgggggagggccggg

SEQ ID NO: 42076 - DNA, 18 bp, Homo sapiens
gggccgcggcggggccgg

SEQ ID NO: 42077 - DNA, 19 bp, Homo sapiens
gggttggggagaggctggg

SEQ ID NO: 42078 - DNA, 19 bp, Homo sapiens
gggctggggccgggccggg

SEQ ID NO: 42079 - DNA, 20 bp, Homo sapiens
aggcgcgggctggggccggg

SEQ ID NO: 42080 - DNA, 18 bp, Homo sapiens
ggggcggggtggggccgg

SEQ ID NO: 42081 - DNA, 20 bp, Homo sapiens
ggtgggggctgggggttggg

SEQ ID NO: 42082 - DNA, 22 bp, Homo sapiens
gggttagggagagcaggctggg

SEQ ID NO: 42083 - DNA, 21 bp, Homo sapiens
gggcaggggagggctggaggg

SEQ ID NO: 42084 - DNA, 18 bp, Homo sapiens
ggcctggggcggggccgg

SEQ ID NO: 42085 - DNA, 21 bp, Homo sapiens
gggccggggcgggtctccggg

SEQ ID NO: 42086 - DNA, 20 bp, Homo sapiens
gggctacggctggggctggg

SEQ ID NO: 42087 - DNA, 22 bp, Homo sapiens
gggttggggaggcctggcaagg

SEQ ID NO: 42088 - DNA, 21 bp, Homo sapiens
gggctgggggcctcggctggg

SEQ ID NO: 42089 - DNA, 19 bp, Homo sapiens
gggtcggggaggccgtggg

SEQ ID NO: 42090 - DNA, 23 bp, Homo sapiens
gggctaggggctgcggggctggg

SEQ ID NO: 42091 - DNA, 19 bp, Homo sapiens
gggctgggtagggctgagg

SEQ ID NO: 42092 - DNA, 22 bp, Homo sapiens
gagtcggggagggagcgccggg

SEQ ID NO: 42093 - DNA, 21 bp, Homo sapiens
gggtggggaggggaggctggg

SEQ ID NO: 42094 - DNA, 24 bp, Homo sapiens
aggctacccagggctggggttggg

SEQ ID NO: 42095 - DNA, 22 bp, Homo sapiens
gggtggggagggtaaaagcggg

SEQ ID NO: 42096 - DNA, 22 bp, Homo sapiens
ggtgctggggccaggggccggg

SEQ ID NO: 42097 - DNA, 26 bp, Homo sapiens
gggctggggctggagctggggccggg

SEQ ID NO: 42098 - DNA, 22 bp, Homo sapiens
gggcggggagggcgctcctggg

SEQ ID NO: 42099 - DNA, 21 bp, Homo sapiens
gggccgggagggggctgcggg

SEQ ID NO: 42100 - DNA, 19 bp, Homo sapiens
gggctggggcggggctggg

SEQ ID NO: 42101 - DNA, 19 bp, Homo sapiens
gggctgggcagtggtcggg

SEQ ID NO: 42102 - DNA, 23 bp, Homo sapiens
gggccgggggcgtcatagccggg

SEQ ID NO: 42103 - DNA, 19 bp, Homo sapiens
gccaggggctggggctggg

SEQ ID NO: 42104 - DNA, 23 bp, Homo sapiens
gggctggcggggccggggccggg

SEQ ID NO: 42105 - DNA, 21 bp, Homo sapiens
gggctgggctcaggggctggg

SEQ ID NO: 42106 - DNA, 27 bp, Homo sapiens
gggctggggggcggcggcggggccggg

SEQ ID NO: 42107 - DNA, 24 bp, Homo sapiens
gggctgcggggctgcagggctggg

SEQ ID NO: 42108 - DNA, 19 bp, Homo sapiens
gggtaggggagaggctggg

SEQ ID NO: 42109 - DNA, 18 bp, Homo sapiens
gggttggcatggggccgg

SEQ ID NO: 42110 - DNA, 27 bp, Homo sapiens
gggctgggggtgctgggaggggctggg

SEQ ID NO: 42111 - DNA, 19 bp, Homo sapiens
gggctgaggggggcccggg

SEQ ID NO: 42112 - DNA, 22 bp, Homo sapiens
aggctgggggcatggggttggg

SEQ ID NO: 42113 - DNA, 19 bp, Homo sapiens
gggctgggggggctgctgg

SEQ ID NO: 42114 - DNA, 28 bp, Homo sapiens
ggactggggagggctgaagagggctggg

SEQ ID NO: 42115 - DNA, 18 bp, Homo sapiens
gggccgggaggggaccgg

SEQ ID NO: 42116 - DNA, 24 bp, Homo sapiens
gggctgaggagggctgggagtggg

SEQ ID NO: 42117 - DNA, 21 bp, Homo sapiens
gggcctggggccagggtcggg

SEQ ID NO: 42118 - DNA, 22 bp, Homo sapiens
gggccgcggggcccgggtcggg

SEQ ID NO: 42119 - DNA, 20 bp, Homo sapiens
gggccggcggcggggctggg

SEQ ID NO: 42120 - DNA, 23 bp, Homo sapiens
gggttggcgaaccccgggccggg

SEQ ID NO: 42121 - DNA, 18 bp, Homo sapiens
ggcgttggctggggctgg

SEQ ID NO: 42122 - DNA, 19 bp, Homo sapiens
gggtgggggatgggttggg

SEQ ID NO: 42123 - DNA, 20 bp, Homo sapiens
ggctggggagggctggccag

SEQ ID NO: 42124 - DNA, 21 bp, Homo sapiens
gggccgggcgcaggggctggg

SEQ ID NO: 42125 - DNA, 23 bp, Homo sapiens
ggggctgggctcttggggttggg

SEQ ID NO: 42126 - DNA, 18 bp, Homo sapiens
gggcggggatggggccgg

SEQ ID NO: 42127 - DNA, 26 bp, Homo sapiens
gggctggggcaggtgcatgggctggg

SEQ ID NO: 42128 - DNA, 19 bp, Homo sapiens
gggctgggggtgcggccgg

SEQ ID NO: 42129 - DNA, 22 bp, Homo sapiens
gggctggggcaggcgggctggg

SEQ ID NO: 42130 - DNA, 21 bp, Homo sapiens
gggccggggcagggggctggg

SEQ ID NO: 42131 - DNA, 17 bp, Homo sapiens
gggctgggggggctggg

SEQ ID NO: 42132 - DNA, 18 bp, Homo sapiens
gggctgggcagggctggg

SEQ ID NO: 42133 - DNA, 21 bp, Homo sapiens
gggctggggcccggggctggg

SEQ ID NO: 42134 - DNA, 20 bp, Homo sapiens
gggatggggagtaggctggg

SEQ ID NO: 42135 - DNA, 23 bp, Homo sapiens
gggctggggcaggaggggctggg

SEQ ID NO: 42136 - DNA, 19 bp, Homo sapiens
aggctgggggggtgctggg

SEQ ID NO: 42137 - DNA, 23 bp, Homo sapiens
ggctccctcgggctggggccggg

SEQ ID NO: 42138 - DNA, 19 bp, Homo sapiens
gggccgggagagggtcggg

SEQ ID NO: 42139 - DNA, 26 bp, Homo sapiens
gggctggggatggcggatgggctggg

SEQ ID NO: 42140 - DNA, 23 bp, Homo sapiens
gggctggggaggggctacctggg

SEQ ID NO: 42141 - DNA, 24 bp, Homo sapiens
gggctggggagggactggccatgg

SEQ ID NO: 42142 - DNA, 18 bp, Homo sapiens
gggcaggcctggggctgg

SEQ ID NO: 42143 - DNA, 19 bp, Homo sapiens
gggtcagggaagggctggg

SEQ ID NO: 42144 - DNA, 19 bp, Homo sapiens
gggccgggggcaggccggg

SEQ ID NO: 42145 - DNA, 24 bp, Homo sapiens
ggccgggtattagctggggctggg

SEQ ID NO: 42146 - DNA, 20 bp, Homo sapiens
gggccaggggagggcacggg

SEQ ID NO: 42147 - DNA, 20 bp, Homo sapiens
ggcctggggagggaactggg

SEQ ID NO: 42148 - DNA, 23 bp, Homo sapiens
aggctgggtgtcctggggccggg

SEQ ID NO: 42149 - DNA, 24 bp, Homo sapiens
gggcctgggggttgtagggctggg

SEQ ID NO: 42150 - DNA, 22 bp, Homo sapiens
gggctgggggctgggggctggg

SEQ ID NO: 42151 - DNA, 19 bp, Homo sapiens
gggcgggggagggctgtgg

SEQ ID NO: 42152 - DNA, 23 bp, Homo sapiens
gggcccgggaagagggggttggg

SEQ ID NO: 42153 - DNA, 21 bp, Homo sapiens
gaggctgcagctggggttggg

SEQ ID NO: 42154 - DNA, 26 bp, Homo sapiens
gagctggagccggggctggggctggg

SEQ ID NO: 42155 - DNA, 21 bp, Homo sapiens
gggttgggggcgggggccggg

SEQ ID NO: 42156 - DNA, 22 bp, Homo sapiens
gggtgggggtggtggggctggg

SEQ ID NO: 42157 - DNA, 20 bp, Homo sapiens
gggtggggaggggcgctggg

SEQ ID NO: 42158 - DNA, 22 bp, Homo sapiens
gggccaggggagggggctcggg

SEQ ID NO: 42159 - DNA, 21 bp, Homo sapiens
gggccgaggagggggcccggg

SEQ ID NO: 42160 - DNA, 19 bp, Homo sapiens
gggccggggcagggtcggg

SEQ ID NO: 42161 - DNA, 19 bp, Homo sapiens
gggctgggaggggtctggg

SEQ ID NO: 42162 - DNA, 26 bp, Homo sapiens
gggccgggggagggaggtgggctggg

SEQ ID NO: 42163 - DNA, 24 bp, Homo sapiens
gggctggggtgtcagggggctggg

SEQ ID NO: 42164 - DNA, 23 bp, Homo sapiens
gggctggggaagggctggaaggg

SEQ ID NO: 42165 - DNA, 18 bp, Homo sapiens
gggctgggagggctccgg

SEQ ID NO: 42166 - DNA, 19 bp, Homo sapiens
aggccgggggcggggccgg

SEQ ID NO: 42167 - DNA, 18 bp, Homo sapiens
gggcggggggcaggccgg

SEQ ID NO: 42168 - DNA, 21 bp, Homo sapiens
gggccaggggagggcagtggg

SEQ ID NO: 42169 - DNA, 23 bp, Homo sapiens
gggctgggggggccagcgctggg

SEQ ID NO: 42170 - DNA, 19 bp, Homo sapiens
gggccggtgagaggctggg

SEQ ID NO: 42171 - DNA, 23 bp, Homo sapiens
gggctgggggggccgcccccggg

SEQ ID NO: 42172 - DNA, 19 bp, Homo sapiens
gggctggggaggggcgcgg

SEQ ID NO: 42173 - DNA, 21 bp, Homo sapiens
gggccgggggcggatatcggg

SEQ ID NO: 42174 - DNA, 24 bp, Homo sapiens
gggcaggggagggctccaggtggg

SEQ ID NO: 42175 - DNA, 22 bp, Homo sapiens
gggctgggaatggcgggccggg

SEQ ID NO: 42176 - DNA, 18 bp, Homo sapiens
gggccgggcagggctggg

SEQ ID NO: 42177 - DNA, 21 bp, Homo sapiens
gggctggggcgcggggctggg

SEQ ID NO: 42178 - DNA, 23 bp, Homo sapiens
gggctgcggggcgcggggccggg

SEQ ID NO: 42179 - DNA, 22 bp, Homo sapiens
gggctcgggagtccgggccggg

SEQ ID NO: 42180 - DNA, 22 bp, Homo sapiens
gggctggtggggccaggctggg

SEQ ID NO: 42181 - DNA, 19 bp, Homo sapiens
ggggcggggccggggccgg

SEQ ID NO: 42182 - DNA, 18 bp, Homo sapiens
gggcggggagggcgcggg

SEQ ID NO: 42183 - DNA, 21 bp, Homo sapiens
gggtcggggagggctcgcggg

SEQ ID NO: 42184 - DNA, 22 bp, Homo sapiens
aggttggggaggaggggttggg

SEQ ID NO: 42185 - DNA, 20 bp, Homo sapiens
gctggggagggggcctcggg

SEQ ID NO: 42186 - DNA, 23 bp, Homo sapiens
gggcccgggcgcctggggccggg

SEQ ID NO: 42187 - DNA, 21 bp, Homo sapiens
gggctgagggagggcgccggg

SEQ ID NO: 42188 - DNA, 23 bp, Homo sapiens
gggcgggggacccgagggccggg

SEQ ID NO: 42189 - DNA, 22 bp, Homo sapiens
ggccgggggcggcggggccggg

SEQ ID NO: 42190 - DNA, 22 bp, Homo sapiens
gggcgcggggctcggggctggg

SEQ ID NO: 42191 - DNA, 18 bp, Homo sapiens
gggccggggcgcggtcgg

SEQ ID NO: 42192 - DNA, 19 bp, Homo sapiens
gggctgggcagggctaggg

SEQ ID NO: 42193 - DNA, 20 bp, Homo sapiens
gggcgggggggggggttggg

SEQ ID NO: 42194 - DNA, 22 bp, Homo sapiens
gggcccggggccgggggccggg

SEQ ID NO: 42195 - DNA, 19 bp, Homo sapiens
gggcggtggctggggtcgg

SEQ ID NO: 42196 - DNA, 23 bp, Homo sapiens
agcatctgagggttggggctggg

SEQ ID NO: 42197 - DNA, 22 bp, Homo sapiens
gggctggggacgggaggctggg

SEQ ID NO: 42198 - DNA, 21 bp, Homo sapiens
gggcgcggggccggggccggg

SEQ ID NO: 42199 - DNA, 22 bp, Homo sapiens
gggctggggagggggctctggg

SEQ ID NO: 42200 - DNA, 21 bp, Homo sapiens
gggctggggagggtgtcaggg

SEQ ID NO: 42201 - DNA, 21 bp, Homo sapiens
gggccggggtgggagactggg

SEQ ID NO: 42202 - DNA, 28 bp, Homo sapiens
gggctggggtggggtttggcgggctggg

SEQ ID NO: 42203 - DNA, 21 bp, Homo sapiens
ggctggggaggcagggctggg

SEQ ID NO: 42204 - DNA, 19 bp, Homo sapiens
gggtgggggaggggctggg

SEQ ID NO: 42205 - DNA, 23 bp, Homo sapiens
gggctgtcctggctggggctggg

SEQ ID NO: 42206 - DNA, 22 bp, Homo sapiens
gggctgcgggccgggggtcggg

SEQ ID NO: 42207 - DNA, 22 bp, Homo sapiens
gggccgaggcctcggggctggg

SEQ ID NO: 42208 - DNA, 21 bp, Homo sapiens
ggggctggctttggggctggg

SEQ ID NO: 42209 - DNA, 25 bp, Homo sapiens
gggtggggagggaggcggggctggg

SEQ ID NO: 42210 - DNA, 27 bp, Homo sapiens
gggctgggggtgttgggaggggctggg

SEQ ID NO: 42211 - DNA, 19 bp, Homo sapiens
gggctgggagggatctggg

SEQ ID NO: 42212 - DNA, 24 bp, Homo sapiens
gggtcggagagggtgcagcctggg

SEQ ID NO: 42213 - DNA, 20 bp, Homo sapiens
cgctgactgctggggctggg

SEQ ID NO: 42214 - DNA, 23 bp, Homo sapiens
gagctggggagggtctgactggg

SEQ ID NO: 42215 - DNA, 21 bp, Homo sapiens
ggagctggggctggggctggg

SEQ ID NO: 42216 - DNA, 23 bp, Homo sapiens
gggcggggagtgccagggctggg

SEQ ID NO: 42217 - DNA, 23 bp, Homo sapiens
aggccggggagggctggcttggg

SEQ ID NO: 42218 - DNA, 19 bp, Homo sapiens
gggttgggaaggagttggg

SEQ ID NO: 42219 - DNA, 21 bp, Homo sapiens
gggctggagacttgggctggg

SEQ ID NO: 42220 - DNA, 24 bp, Homo sapiens
gggctggtgagtggtggggctggg

SEQ ID NO: 42221 - DNA, 20 bp, Homo sapiens
ggtctggggagggttgatgg

SEQ ID NO: 42222 - DNA, 22 bp, Homo sapiens
ggactgacaggctggggtcggg

SEQ ID NO: 42223 - DNA, 22 bp, Homo sapiens
gggcagcggggctggggctggg

SEQ ID NO: 42224 - DNA, 18 bp, Homo sapiens
gggccgggctggggctgg

SEQ ID NO: 42225 - DNA, 25 bp, Homo sapiens
aggctggggtaatcatggggctggg

SEQ ID NO: 42226 - DNA, 24 bp, Homo sapiens
gggtggggacagggtggggctggg

SEQ ID NO: 42227 - DNA, 18 bp, Homo sapiens
gggcggggagggcacggg

SEQ ID NO: 42228 - DNA, 18 bp, Homo sapiens
gggtgggactggggctgg

SEQ ID NO: 42229 - DNA, 20 bp, Homo sapiens
aggcacgggctggggccggg

SEQ ID NO: 42230 - DNA, 19 bp, Homo sapiens
gggctggggagtgttccgg

SEQ ID NO: 42231 - DNA, 21 bp, Homo sapiens
gggcaggggcgcggggctggg

SEQ ID NO: 42232 - DNA, 20 bp, Homo sapiens
gggctgggtgcggggctggg

SEQ ID NO: 42233 - DNA, 18 bp, Homo sapiens
gggtagagctggggctgg

SEQ ID NO: 42234 - DNA, 22 bp, Homo sapiens
gggccgtgggcagggggccggg

SEQ ID NO: 42235 - DNA, 23 bp, Homo sapiens
ggtctggggaggggtcccttggg

SEQ ID NO: 42236 - DNA, 20 bp, Homo sapiens
gggccggggatagggccggg

SEQ ID NO: 42237 - DNA, 19 bp, Homo sapiens
gggccgcgggcggggccgg

SEQ ID NO: 42238 - DNA, 19 bp, Homo sapiens
gggctggggaggtctgagg

SEQ ID NO: 42239 - DNA, 21 bp, Homo sapiens
gggctggggaccagggctggg

SEQ ID NO: 42240 - DNA, 19 bp, Homo sapiens
gggccgtggggggcgcggg

SEQ ID NO: 42241 - DNA, 18 bp, Homo sapiens
ggagttggctggggctgg

SEQ ID NO: 42242 - DNA, 24 bp, Homo sapiens
gggctggggtaggcggcggttggg

SEQ ID NO: 42243 - DNA, 20 bp, Homo sapiens
gggctggggggtgccctggg

SEQ ID NO: 42244 - DNA, 21 bp, Homo sapiens
aggccggggaggggcaccggg

SEQ ID NO: 42245 - DNA, 21 bp, Homo sapiens
gggccgcggagtgaggccggg

SEQ ID NO: 42246 - DNA, 21 bp, Homo sapiens
ggaccccgggctggggctggg

SEQ ID NO: 42247 - DNA, 24 bp, Homo sapiens
gggtgcggggcctccggggccggg

SEQ ID NO: 42248 - DNA, 17 bp, Homo sapiens
gctgaggctggggctgg

SEQ ID NO: 42249 - DNA, 19 bp, Homo sapiens
gggcagggggagggttggg

SEQ ID NO: 42250 - DNA, 24 bp, Homo sapiens
gggctgggggcgggagtcgccggg

SEQ ID NO: 42251 - DNA, 20 bp, Homo sapiens
gctggggagggggcgccggg

SEQ ID NO: 42252 - DNA, 20 bp, Homo sapiens
ggactggggaggacgttggg

SEQ ID NO: 42253 - DNA, 21 bp, Homo sapiens
gagctggaacttggggctggg

SEQ ID NO: 42254 - DNA, 25 bp, Homo sapiens
gggctggggcaggggtgaggctggg

SEQ ID NO: 42255 - DNA, 23 bp, Homo sapiens
gggccgggggagcctgggccggg

SEQ ID NO: 42256 - DNA, 65 bp, Leishmania RNA virus 1-4
tcggacattgctgatatcatggcccaggctagctggaagaaatccatgagtaatgagagtgccga

SEQ ID NO: 42257 - DNA, 23 bp, Leishmania RNA virus 1-4
tccatgagtaatgagagtgccga

SEQ ID NO: 42258 - DNA, 21 bp, Homo sapiens
tccatgagtgatgcagatgtg

SEQ ID NO: 42259 - DNA, 20 bp, Homo sapiens
ccatgagtggatactgctga

SEQ ID NO: 42260 - DNA, 18 bp, Homo sapiens
tccggagtaatgagacta

SEQ ID NO: 42261 - DNA, 15 bp, Homo sapiens
tccatgagtaactgc

SEQ ID NO: 42262 - DNA, 17 bp, Homo sapiens
tccggaatggagtgccg

SEQ ID NO: 42263 - DNA, 18 bp, Homo sapiens
tggggtgatgagagtgcc

SEQ ID NO: 42264 - DNA, 16 bp, Homo sapiens
tccataaaggagtgcg

SEQ ID NO: 42265 - DNA, 20 bp, Homo sapiens
tccgggcgcgagagtgtcga

SEQ ID NO: 42266 - DNA, 21 bp, Homo sapiens
catgagaactcggggtgtcga

SEQ ID NO: 42267 - DNA, 22 bp, Homo sapiens
tccatgaggaaagctgtgctga

SEQ ID NO: 42268 - DNA, 18 bp, Homo sapiens
tccagtgtttgagagtgc

SEQ ID NO: 42269 - DNA, 19 bp, Homo sapiens
caagagtgtagagtgctga

SEQ ID NO: 42270 - DNA, 18 bp, Homo sapiens
tccatgagatgatgagaa

SEQ ID NO: 42271 - DNA, 18 bp, Homo sapiens
tccttgagtaatggacgc

SEQ ID NO: 42272 - DNA, 20 bp, Homo sapiens
tccaagagtgattttgctga

SEQ ID NO: 42273 - DNA, 22 bp, Homo sapiens
ccatgactcccggagagtgccg

SEQ ID NO: 42274 - DNA, 20 bp, Homo sapiens
tccagagtgcccaggagtgc

SEQ ID NO: 42275 - DNA, 23 bp, Homo sapiens
tccatgagtggtagacttactga

SEQ ID NO: 42276 - DNA, 130 bp, Eimeria brunetti RNA virus 1
gtcgaacgtgtcgggctagccatggtcgggcgtgtgccctggagagcgatggcgttgactgcttatgcggctatggaaccgtcgctgtatgggaacccgtctggcggtgtgcgtgctgcgtacatatcac

SEQ ID NO: 42277 - DNA, 24 bp, Eimeria brunetti RNA virus 1
ggctatggaaccgtcgctgtatgg

SEQ ID NO: 42278 - DNA, 24 bp, Homo sapiens
ggctatggaacatgtccaatctgg

SEQ ID NO: 42279 - DNA, 18 bp, Homo sapiens
ggctgtagaggctgtatg

SEQ ID NO: 42280 - DNA, 17 bp, Homo sapiens
ggctatgggccgttgct

SEQ ID NO: 42281 - DNA, 19 bp, Homo sapiens
ggtcatggaactgtgtgtg

SEQ ID NO: 42282 - DNA, 15 bp, Homo sapiens
ggcatggagctgtat

SEQ ID NO: 42283 - DNA, 26 bp, Homo sapiens
ggctatggatgctgtcgtcccccagg

SEQ ID NO: 42284 - DNA, 22 bp, Homo sapiens
ggctgggagcgccgctgtgtgg

SEQ ID NO: 42285 - DNA, 130 bp, Leishmania RNA virus 1-4
tgttcgtggacagagcttctttgcggtagattatgatgacttcaattctcaacatacgttgctgtcacagaagattgtgtttgaggaattgtttcagcatatcaactgcaatatgtcctggacccgaaca

SEQ ID NO: 42286 - DNA, 24 bp, Leishmania RNA virus 1-4
ttcaattctcaacatacgttgctg

SEQ ID NO: 42287 - DNA, 22 bp, Homo sapiens
ttcaattcataaattgttgctg

SEQ ID NO: 42288 - DNA, 20 bp, Homo sapiens
ttcaattttcaccacagctg

SEQ ID NO: 42289 - DNA, 19 bp, Homo sapiens
ttcagctctcaacattgct

SEQ ID NO: 42290 - DNA, 18 bp, Homo sapiens
ttcaattctgacattacc

SEQ ID NO: 42291 - DNA, 23 bp, Homo sapiens
ttcaattcctaaattatttgctg

SEQ ID NO: 42292 - DNA, 65 bp, Leishmania RNA virus 1-4
tccttgtggtggagttgttatacaagtaatacataatgtatatgtataaggacgcaccattcgga

SEQ ID NO: 42293 - DNA, 24 bp, Leishmania RNA virus 1-4
agttgttatacaagtaatacataa

SEQ ID NO: 42294 - DNA, 20 bp, Homo sapiens
atcatacaggtaatatataa

SEQ ID NO: 42295 - DNA, 20 bp, Homo sapiens
ttgttatatacaacacataa

SEQ ID NO: 42296 - DNA, 21 bp, Homo sapiens
gttgttataacaaaccatcat

SEQ ID NO: 42297 - DNA, 21 bp, Homo sapiens
agttgtcatgtgggtaataca

SEQ ID NO: 42298 - DNA, 21 bp, Homo sapiens
aggtgttatacaagaccaata

SEQ ID NO: 42299 - DNA, 19 bp, Homo sapiens
gttgttatactgaatacat

SEQ ID NO: 42300 - DNA, 78 bp, Primate T-lymphotropic virus 3
gccgtggaccagccctggtcgcctcgcttacctgggtcgccgtttcgtgaccgggccatctccctgctgtttgacggc

SEQ ID NO: 42301 - DNA, 24 bp, Primate T-lymphotropic virus 3
gaccgggccatctccctgctgttt

SEQ ID NO: 42302 - DNA, 19 bp, Homo sapiens
gactgggccttcttctggc

SEQ ID NO: 42303 - DNA, 23 bp, Homo sapiens
gggccggcatctccctgctgttt

SEQ ID NO: 42304 - DNA, 18 bp, Homo sapiens
gctcaaaccctgctgttt

SEQ ID NO: 42305 - DNA, 18 bp, Homo sapiens
gaccgggcgtcttcctgc

SEQ ID NO: 42306 - DNA, 18 bp, Homo sapiens
gggccttctccccaggct

SEQ ID NO: 42307 - DNA, 21 bp, Homo sapiens
gggccatcttcctcagccctt

SEQ ID NO: 42308 - DNA, 23 bp, Homo sapiens
ggctgaagtcattcctgctgttt

SEQ ID NO: 42309 - DNA, 21 bp, Homo sapiens
gggcctgatgtcctgctgttt

SEQ ID NO: 42310 - DNA, 20 bp, Homo sapiens
gggcccgaggcctgctgttt

SEQ ID NO: 42311 - DNA, 22 bp, Homo sapiens
gactggccatctcacagggttt

SEQ ID NO: 42312 - DNA, 18 bp, Homo sapiens
gaccgggccggcttccct

SEQ ID NO: 42313 - DNA, 16 bp, Homo sapiens
gactggccactgctgt

SEQ ID NO: 42314 - DNA, 23 bp, Homo sapiens
gagccatcttttttttgttgttt

SEQ ID NO: 42315 - DNA, 16 bp, Homo sapiens
ggacctcttgctgttt

SEQ ID NO: 42316 - DNA, 19 bp, Homo sapiens
gggttcttccttgctgttt

SEQ ID NO: 42317 - DNA, 22 bp, Homo sapiens
gactgggtcagagatgctgttt

SEQ ID NO: 42318 - DNA, 64 bp, Macaca mulatta rhadinovirus
gacgcaccaagaaggcatcctgatggtgtttaaaaaaaatattgtcccgcacatctttaaggtc

SEQ ID NO: 42319 - DNA, 24 bp, Macaca mulatta rhadinovirus
attgtcccgcacatctttaaggtc

SEQ ID NO: 42320 - DNA, 21 bp, Homo sapiens
attgatccttattttaaggtc

SEQ ID NO: 42321 - DNA, 19 bp, Homo sapiens
ttgttctgcacatcctggc

SEQ ID NO: 42322 - DNA, 19 bp, Homo sapiens
tcccgtaattattaaggtc

SEQ ID NO: 42323 - DNA, 24 bp, Homo sapiens
ctgttatgcagcatttttgaggtc

SEQ ID NO: 42324 - DNA, 22 bp, Homo sapiens
ttgttcacacctttttgaggtc

SEQ ID NO: 42325 - DNA, 19 bp, Homo sapiens
atcttcacatctttggggt

SEQ ID NO: 42326 - DNA, 17 bp, Homo sapiens
ttgccccactttggggt

SEQ ID NO: 42327 - DNA, 18 bp, Homo sapiens
ttggcctgcacatcttca

SEQ ID NO: 42328 - DNA, 65 bp, Macaca mulatta rhadinovirus
gtacgttcatcgccctgaacctgtcgtttatagagaacatagatttcagggtcatcgagctgtac

SEQ ID NO: 42329 - DNA, 24 bp, Macaca mulatta rhadinovirus
gccctgaacctgtcgtttatagag

SEQ ID NO: 42330 - DNA, 21 bp, Homo sapiens
gcttgaacctgcgaggtggag

SEQ ID NO: 42331 - DNA, 21 bp, Homo sapiens
gcttgaacctgggaggtagag

SEQ ID NO: 42332 - DNA, 22 bp, Homo sapiens
gccccgggcctgtcgccctgag

SEQ ID NO: 42333 - DNA, 18 bp, Homo sapiens
gcctagaactcttataga

SEQ ID NO: 42334 - DNA, 22 bp, Homo sapiens
ccctgggtctgccactgtagag

SEQ ID NO: 42335 - DNA, 18 bp, Homo sapiens
gccctgaacttgttttcc

SEQ ID NO: 42336 - DNA, 19 bp, Homo sapiens
gctctgagactgttacaga

SEQ ID NO: 42337 - DNA, 19 bp, Homo sapiens
gccttgggtctgccgtcca

SEQ ID NO: 42338 - DNA, 104 bp, Amsacta moorei entomopoxvirus
aaagaattagattgtaaatatacaaaaattaattctttaaaaggaatagaaaatattattaatttaaaagaattagattgttctgatacaaaaattaattcttt

SEQ ID NO: 42339 - DNA, 24 bp, Amsacta moorei entomopoxvirus
ttaatttaaaagaattagattgtt

SEQ ID NO: 42340 - DNA, 18 bp, Homo sapiens
taatttaaaaggattaga

SEQ ID NO: 42341 - DNA, 23 bp, Homo sapiens
ttaatttaaaagaagttactgtt

SEQ ID NO: 42342 - DNA, 105 bp, Alcelaphine herpesvirus 1
tttttgtagacaaagaagagtacaccctctcatgggcccagcaatttagaaacatctcttactgcagatgggctcactggaagagctttgataatgctataaaaa

SEQ ID NO: 42343 - DNA, 24 bp, Alcelaphine herpesvirus 1
ttactgcagatgggctcactggaa

SEQ ID NO: 42344 - DNA, 17 bp, Homo sapiens
ctgcgggcaccactgga

SEQ ID NO: 42345 - DNA, 21 bp, Homo sapiens
ctgcagatggggtgagtctgg

SEQ ID NO: 42346 - DNA, 22 bp, Homo sapiens
ttactacagatgggtcacagaa

SEQ ID NO: 42347 - DNA, 19 bp, Homo sapiens
ctgcagattccagctggaa

SEQ ID NO: 42348 - DNA, 17 bp, Homo sapiens
tactgcagatggctgga

SEQ ID NO: 42349 - DNA, 18 bp, Homo sapiens
tgagatgggctgatggaa

SEQ ID NO: 42350 - DNA, 20 bp, Homo sapiens
ttactatggatgggctgtgg

SEQ ID NO: 42351 - DNA, 18 bp, Homo sapiens
ttactgcaggggcagtgg

SEQ ID NO: 42352 - DNA, 17 bp, Homo sapiens
ttactgcaattaactgg

SEQ ID NO: 42353 - DNA, 16 bp, Homo sapiens
tcactgcacttactgg

SEQ ID NO: 42354 - DNA, 18 bp, Homo sapiens
tgcagaatatcactggaa

SEQ ID NO: 42355 - DNA, 18 bp, Homo sapiens
ctgcacaattcactggaa

SEQ ID NO: 42356 - DNA, 21 bp, Homo sapiens
ttattgcgacttccactggaa

SEQ ID NO: 42357 - DNA, 17 bp, Homo sapiens
ttaatgcagatgggtgg

SEQ ID NO: 42358 - DNA, 20 bp, Homo sapiens
ttactggggatgggcttctg

SEQ ID NO: 42359 - DNA, 23 bp, Homo sapiens
ttaatgcagatgtgggtgttgga

SEQ ID NO: 42360 - DNA, 17 bp, Homo sapiens
ttactgcagagccctgg

SEQ ID NO: 42361 - DNA, 18 bp, Homo sapiens
ctgcagatctctcgctgg

SEQ ID NO: 42362 - DNA, 20 bp, Homo sapiens
ttactgcatatggattctgg

SEQ ID NO: 42363 - DNA, 17 bp, Homo sapiens
ctgcagaggccactgga

SEQ ID NO: 42364 - DNA, 21 bp, Homo sapiens
tgctgtgtaaagacactggaa

SEQ ID NO: 42365 - DNA, 23 bp, Homo sapiens
tgcgggatctgggctcactggaa

SEQ ID NO: 42366 - DNA, 16 bp, Homo sapiens
ttactgcaaatggtgg

SEQ ID NO: 42367 - DNA, 21 bp, Homo sapiens
ttactgcggatggcaccggaa

SEQ ID NO: 42368 - DNA, 20 bp, Homo sapiens
ttattgcagatggacacgga

SEQ ID NO: 42369 - DNA, 19 bp, Homo sapiens
ctgcagattctgagctggg

SEQ ID NO: 42370 - DNA, 15 bp, Homo sapiens
ctgcgggtcactgga

SEQ ID NO: 42371 - DNA, 91 bp, Macaca mulatta rhadinovirus
ggggggtctgtttctcctgtggcagccgttaacgccgctaagcctagctgacgagatgcgcgaattaaacggcaccacgccagcacccccc

SEQ ID NO: 42372 - DNA, 24 bp, Macaca mulatta rhadinovirus
agccgttaacgccgctaagcctag

SEQ ID NO: 42373 - DNA, 21 bp, Homo sapiens
agccagacccgctaagcctag

SEQ ID NO: 42374 - DNA, 22 bp, Homo sapiens
gtttttacatgactaagcctag

SEQ ID NO: 42375 - DNA, 19 bp, Homo sapiens
agccttgacagcaagccta

SEQ ID NO: 42376 - DNA, 18 bp, Homo sapiens
gccgttaacccgcctcta

SEQ ID NO: 42377 - DNA, 66 bp, Alcelaphine herpesvirus 1
gcactggtgtcccataataaagtgtatgactcattgtaagagcatgttgtactgacttcctggtgt

SEQ ID NO: 42378 - DNA, 24 bp, Alcelaphine herpesvirus 1
actggtgtcccataataaagtgta

SEQ ID NO: 42379 - DNA, 27 bp, Homo sapiens
actagtgtttcatttcctagaggtgta

SEQ ID NO: 42380 - DNA, 19 bp, Homo sapiens
actggtgttcacatggtat

SEQ ID NO: 42381 - DNA, 20 bp, Homo sapiens
ggtgtctggcttaaagtgta

SEQ ID NO: 42382 - DNA, 24 bp, Homo sapiens
actggtgcctgtaatcacccggtg

SEQ ID NO: 42383 - DNA, 20 bp, Homo sapiens
actgatgacaggtaaagtgt

SEQ ID NO: 42384 - DNA, 15 bp, Homo sapiens
actgtgtcccaagtg

SEQ ID NO: 42385 - DNA, 21 bp, Homo sapiens
actagtgtttccatggggtgt

SEQ ID NO: 42386 - DNA, 18 bp, Homo sapiens
ggtgtccttgcaaagtgt

SEQ ID NO: 42387 - DNA, 20 bp, Homo sapiens
ctggtgcctgtaatcccagc

SEQ ID NO: 42388 - DNA, 21 bp, Homo sapiens
acaggtgtccctgtaaggtgt

SEQ ID NO: 42389 - DNA, 21 bp, Homo sapiens
actggtgtcctactacatgtg

SEQ ID NO: 42390 - DNA, 17 bp, Homo sapiens
tggttctcacaaagtgt

SEQ ID NO: 42391 - DNA, 15 bp, Homo sapiens
actggtaataaagtg

SEQ ID NO: 42392 - DNA, 23 bp, Homo sapiens
actggtgcctgtaatcaccctgt

SEQ ID NO: 42393 - DNA, 21 bp, Homo sapiens
tggtgtcctaatacatatgta

SEQ ID NO: 42394 - DNA, 21 bp, Homo sapiens
acttgtgtcctagaaagtgta

SEQ ID NO: 42395 - DNA, 20 bp, Homo sapiens
actggtgtgccatggcagtg

SEQ ID NO: 42396 - DNA, 22 bp, Homo sapiens
actggggttctgcataaagtgt

SEQ ID NO: 42397 - DNA, 61 bp, Macaca mulatta rhadinovirus
gagcctccgcacgtccaccccggggatctgctactcgcgccccccggtcacgttcaggttc

SEQ ID NO: 42398 - DNA, 22 bp, Macaca mulatta rhadinovirus
ccccccggtcacgttcaggttc

SEQ ID NO: 42399 - DNA, 18 bp, Homo sapiens
cctccggtcacatggttc

SEQ ID NO: 42400 - DNA, 16 bp, Homo sapiens
cctcagtcttcaggtt

SEQ ID NO: 42401 - DNA, 20 bp, Homo sapiens
cctcggccacgctcccgttc

SEQ ID NO: 42402 - DNA, 21 bp, Homo sapiens
cccggccagccgggtgggttc

SEQ ID NO: 42403 - DNA, 18 bp, Homo sapiens
ccctcagacattcaggtt

SEQ ID NO: 42404 - DNA, 20 bp, Homo sapiens
ccctactgggcatcaggttc

SEQ ID NO: 42405 - DNA, 19 bp, Homo sapiens
ccccccagtcactgggttc

SEQ ID NO: 42406 - DNA, 22 bp, Homo sapiens
ccccctggctggagccaggttc

SEQ ID NO: 42407 - DNA, 18 bp, Homo sapiens
ccgcccgagttcaggttc

SEQ ID NO: 42408 - DNA, 18 bp, Homo sapiens
cctccgtcctccaggttc

SEQ ID NO: 42409 - DNA, 21 bp, Homo sapiens
cctcccgggcggatcaggttc

SEQ ID NO: 42410 - DNA, 18 bp, Homo sapiens
ccttcaggcctcaggttc

SEQ ID NO: 42411 - DNA, 19 bp, Homo sapiens
ccccaggtctgacaggttc

SEQ ID NO: 42412 - DNA, 16 bp, Homo sapiens
cctggcattcaggttc

SEQ ID NO: 42413 - DNA, 16 bp, Homo sapiens
cccggtcaagtgattc

SEQ ID NO: 42414 - DNA, 22 bp, Homo sapiens
cctcaggtccagtctcaggttc

SEQ ID NO: 42415 - DNA, 17 bp, Homo sapiens
cccgggaactcaggttc

SEQ ID NO: 42416 - DNA, 18 bp, Homo sapiens
ccctgtcgaatccaggtt

SEQ ID NO: 42417 - DNA, 20 bp, Homo sapiens
ccttccagtcgtgacagttc

SEQ ID NO: 42418 - DNA, 19 bp, Homo sapiens
cccccagggattcaggttc

SEQ ID NO: 42419 - DNA, 20 bp, Homo sapiens
ccccctgggccttcaggttc

SEQ ID NO: 42420 - DNA, 17 bp, Homo sapiens
ccctcacgtttcaggtt

SEQ ID NO: 42421 - DNA, 18 bp, Homo sapiens
cctcacttgttcaggttc

SEQ ID NO: 42422 - DNA, 20 bp, Homo sapiens
ccattgtcttgttcaggttc

SEQ ID NO: 42423 - DNA, 19 bp, Homo sapiens
cccccggccactggcgttc

SEQ ID NO: 42424 - DNA, 17 bp, Homo sapiens
cctggccacaccaagtt

SEQ ID NO: 42425 - DNA, 17 bp, Homo sapiens
cccacctggctcaggtt

SEQ ID NO: 42426 - DNA, 18 bp, Homo sapiens
ccccggccaaccaggttc

SEQ ID NO: 42427 - DNA, 19 bp, Homo sapiens
cccctctggttccaggttc

SEQ ID NO: 42428 - DNA, 16 bp, Homo sapiens
cctggcgctcaggttc

SEQ ID NO: 42429 - DNA, 15 bp, Homo sapiens
ccccagtcgtcggtt

SEQ ID NO: 42430 - DNA, 19 bp, Homo sapiens
ccccagctgcctcaggttc

SEQ ID NO: 42431 - DNA, 17 bp, Homo sapiens
ccctccagcatcaggtt

SEQ ID NO: 42432 - DNA, 16 bp, Homo sapiens
ccctggtcacatggtc

SEQ ID NO: 42433 - DNA, 21 bp, Homo sapiens
ccctctcggcgcctcaggttc

SEQ ID NO: 42434 - DNA, 18 bp, Homo sapiens
cccgaggtattcaggttc

SEQ ID NO: 42435 - DNA, 16 bp, Homo sapiens
cctcccgactcaggtt

SEQ ID NO: 42436 - DNA, 19 bp, Homo sapiens
ccctccgctcacgccgctc

SEQ ID NO: 42437 - DNA, 19 bp, Homo sapiens
ccaggtcagcataaggttc

SEQ ID NO: 42438 - DNA, 19 bp, Homo sapiens
cccactggctgtcaggttc

SEQ ID NO: 42439 - DNA, 19 bp, Homo sapiens
cctcctgtggcttcaggtt

SEQ ID NO: 42440 - DNA, 19 bp, Homo sapiens
cctgatcacgctcccgttc

SEQ ID NO: 42441 - DNA, 21 bp, Homo sapiens
cctccctgcgtcctcaggttc

SEQ ID NO: 42442 - DNA, 21 bp, Homo sapiens
ccctcaggtccatgcgggttc

SEQ ID NO: 42443 - DNA, 20 bp, Homo sapiens
cctcccaggttcccaggttc

SEQ ID NO: 42444 - DNA, 23 bp, Homo sapiens
cctcctgcttcaagtccaggttc

SEQ ID NO: 42445 - DNA, 18 bp, Homo sapiens
cccgtcttgcccaggttc

SEQ ID NO: 42446 - DNA, 71 bp, Bovine herpesvirus 4
aaacacaaaaatgtatgttcaaccttttattatacaataaaactttgtgaacttatacatttgctttgttt

SEQ ID NO: 42447 - DNA, 24 bp, Bovine herpesvirus 4
aaatgtatgttcaaccttttatta

SEQ ID NO: 42448 - DNA, 22 bp, Homo sapiens
aaatggctcaataccttttatt

SEQ ID NO: 42449 - DNA, 18 bp, Homo sapiens
ggatgtatgttcattctt

SEQ ID NO: 42450 - DNA, 19 bp, Homo sapiens
tgtatgtatcagtctctca

SEQ ID NO: 42451 - DNA, 19 bp, Homo sapiens
gtatgttcaatacattatt

SEQ ID NO: 42452 - DNA, 17 bp, Homo sapiens
aaatgtatgttcatctc

SEQ ID NO: 42453 - DNA, 23 bp, Homo sapiens
tgtatgtttctttacttttatta

SEQ ID NO: 42454 - DNA, 23 bp, Homo sapiens
atgtatgcttcaacacacttatt

SEQ ID NO: 42455 - DNA, 23 bp, Homo sapiens
aaatgcatgtcgacatttttatt

SEQ ID NO: 42456 - DNA, 22 bp, Homo sapiens
aaatgtatgttttgtcttcatt

SEQ ID NO: 42457 - DNA, 20 bp, Homo sapiens
gtaatgctcaaccttttatt

SEQ ID NO: 42458 - DNA, 131 bp, Bovine herpesvirus 4
aaacctaatcagaaattcagaaaactatcttgaaattgacatccacagggctagtgatatcttcaatatctgatatcaactatgttagggatggtctacaagaatagaaatcttctatttctgaaagaaat

SEQ ID NO: 42459 - DNA, 24 bp, Bovine herpesvirus 4
tgttagggatggtctacaagaata

SEQ ID NO: 42460 - DNA, 22 bp, Homo sapiens
tgttagggatgtggatagaata

SEQ ID NO: 42461 - DNA, 21 bp, Homo sapiens
ttagggatttcactcaagaat

SEQ ID NO: 42462 - DNA, 22 bp, Homo sapiens
tggtagggacacgataagaata

SEQ ID NO: 42463 - DNA, 22 bp, Homo sapiens
tgttaggaaccaaataagaata

SEQ ID NO: 42464 - DNA, 19 bp, Homo sapiens
tgtaggggtggaacgaaga

SEQ ID NO: 42465 - DNA, 18 bp, Homo sapiens
tgtagggacggtgggaat

SEQ ID NO: 42466 - DNA, 21 bp, Homo sapiens
gttgggggaagggcaagaata

SEQ ID NO: 42467 - DNA, 20 bp, Homo sapiens
gagacggtgtctgtgagaat

SEQ ID NO: 42468 - DNA, 24 bp, Homo sapiens
tgtcagggaacatttacaagaata

SEQ ID NO: 42469 - DNA, 22 bp, Homo sapiens
tgttagggatggtctccccaag

SEQ ID NO: 42470 - DNA, 24 bp, Homo sapiens
tgtttggaaaactctgcaagaata

SEQ ID NO: 42471 - DNA, 22 bp, Homo sapiens
gttagggagcaaggctgcagga

SEQ ID NO: 42472 - DNA, 62 bp, Bovine herpesvirus 4
atttcacatgtaaaacaatcttaaacaccaccaagggtataattgttttatatttctgaaat

SEQ ID NO: 42473 - DNA, 24 bp, Bovine herpesvirus 4
tgtaaaacaatcttaaacaccacc

SEQ ID NO: 42474 - DNA, 19 bp, Homo sapiens
tgtaaaacaattgtacacc

SEQ ID NO: 42475 - DNA, 23 bp, Homo sapiens
tgtgaatacaggcacacaccacc

SEQ ID NO: 42476 - DNA, 19 bp, Homo sapiens
taaaatttcataaacacca

SEQ ID NO: 42477 - DNA, 25 bp, Homo sapiens
tataaaacagattgcaagtaccacc

SEQ ID NO: 42478 - DNA, 17 bp, Homo sapiens
tgtaaacaatctttcac

SEQ ID NO: 42479 - DNA, 21 bp, Homo sapiens
tgaaaaacaatctattttacc

SEQ ID NO: 42480 - DNA, 18 bp, Homo sapiens
tgtacaacaatcccacca

SEQ ID NO: 42481 - DNA, 18 bp, Homo sapiens
tgtagaacaaaaacacca

SEQ ID NO: 42482 - DNA, 23 bp, Homo sapiens
tgaaaaacaatgggaacatcacc

SEQ ID NO: 42483 - DNA, 18 bp, Homo sapiens
tgtaaacaatcaaaccac

SEQ ID NO: 42484 - DNA, 21 bp, Homo sapiens
taagacaatcttaaagtacac

SEQ ID NO: 42485 - DNA, 26 bp, Homo sapiens
tgcaaaacagtcccagcaacgccgcc

SEQ ID NO: 42486 - DNA, 19 bp, Homo sapiens
tgcaacagtttaaacacca

SEQ ID NO: 42487 - DNA, 19 bp, Homo sapiens
taaaatttccaaaacacca

SEQ ID NO: 42488 - DNA, 22 bp, Homo sapiens
tgtaaaatattaaaacaccacc

SEQ ID NO: 42489 - DNA, 23 bp, Homo sapiens
gtaaaacaattagggacaccacc

SEQ ID NO: 42490 - DNA, 16 bp, Homo sapiens
tataaaactaaacacc

SEQ ID NO: 42491 - DNA, 22 bp, Homo sapiens
tggaaaacaatctactcccacc

SEQ ID NO: 42492 - DNA, 18 bp, Homo sapiens
tgtaaaacgatctgccac

SEQ ID NO: 42493 - DNA, 22 bp, Homo sapiens
tgttaaacaatcttttaatacc

SEQ ID NO: 42494 - DNA, 93 bp, Meleagrid herpesvirus 1
gcagatgtaaaggcctggtgaggcgagtgtctagattacaggagactaatatagtcggtaacctgtcacttcactccaacaggatcagtcagc

SEQ ID NO: 42495 - DNA, 24 bp, Meleagrid herpesvirus 1
taacctgtcacttcactccaacag

SEQ ID NO: 42496 - DNA, 20 bp, Homo sapiens
cctgccactcggggcagcag

SEQ ID NO: 42497 - DNA, 19 bp, Homo sapiens
ctgccattcattccaacag

SEQ ID NO: 42498 - DNA, 17 bp, Homo sapiens
cctaacggctccaacag

SEQ ID NO: 42499 - DNA, 21 bp, Homo sapiens
caacctgtcacgtgccaacag

SEQ ID NO: 42500 - DNA, 16 bp, Homo sapiens
acctgtcattttccaa

SEQ ID NO: 42501 - DNA, 20 bp, Homo sapiens
acctggaattactccaacag

SEQ ID NO: 42502 - DNA, 21 bp, Homo sapiens
taacctgcactttgctcacag

SEQ ID NO: 42503 - DNA, 21 bp, Homo sapiens
ccttgtcacctcctctgacag

SEQ ID NO: 42504 - DNA, 18 bp, Homo sapiens
tgcaactttactccaaca

SEQ ID NO: 42505 - DNA, 24 bp, Homo sapiens
acttgtcactcacccctctaacag

SEQ ID NO: 42506 - DNA, 18 bp, Homo sapiens
gccccttcactccagcag

SEQ ID NO: 42507 - DNA, 22 bp, Homo sapiens
taacctgtacttcaaatgacag

SEQ ID NO: 42508 - DNA, 22 bp, Homo sapiens
tgtcacctctttattctaacag

SEQ ID NO: 42509 - DNA, 20 bp, Homo sapiens
ctgttgagcatctccaacag

SEQ ID NO: 42510 - DNA, 22 bp, Homo sapiens
ctctcaaacttcactctaacag

SEQ ID NO: 42511 - DNA, 15 bp, Homo sapiens
taacctgcactcaac

SEQ ID NO: 42512 - DNA, 18 bp, Homo sapiens
cctgtttcactccagcag

SEQ ID NO: 42513 - DNA, 19 bp, Homo sapiens
ctttcattcctcccaacag

SEQ ID NO: 42514 - DNA, 67 bp, Meleagrid herpesvirus 1
ctgtcgtcccccgatgccgatctcgcacacagaggctgttcgtgatagaacggacggtgacttccag

SEQ ID NO: 42515 - DNA, 24 bp, Meleagrid herpesvirus 1
ttcgtgatagaacggacggtgact

SEQ ID NO: 42516 - DNA, 20 bp, Homo sapiens
gtggaggatgggacagtgct

SEQ ID NO: 42517 - DNA, 21 bp, Homo sapiens
ttcgtgacaggactctgtgtg

SEQ ID NO: 42518 - DNA, 18 bp, Homo sapiens
ttcttgatagaatggggt

SEQ ID NO: 42519 - DNA, 112 bp, Ectromelia virus
atgtagatgacgcggaacacatatctcagataactaatgatgtatctacacaaacgggaaaaagaaatcagagttagatagatacatggaaatgtatcctcgtcatagatat

SEQ ID NO: 42520 - DNA, 24 bp, Ectromelia virus
tagatgacgcggaacacatatctc

SEQ ID NO: 42521 - DNA, 17 bp, Homo sapiens
gatgccagcacatatct

SEQ ID NO: 42522 - DNA, 17 bp, Homo sapiens
gatgagggcacatatct

SEQ ID NO: 42523 - DNA, 26 bp, Homo sapiens
tagataactagatcaacacgtgtctc

SEQ ID NO: 42524 - DNA, 19 bp, Homo sapiens
tagggacgcggagtgatct

SEQ ID NO: 42525 - DNA, 18 bp, Homo sapiens
gagacgcggaaccactct

SEQ ID NO: 42526 - DNA, 21 bp, Homo sapiens
tagtgggcttcacacatatct

SEQ ID NO: 42527 - DNA, 129 bp, Lumpy skin disease virus
ggaatgtttggaatatccaaaggcagattttctaacattagttaataatatgtcatttgatgtaaaaaatggtattgttttaaattttaagttagaaaatataaattgtttagataatccaaatatatc

SEQ ID NO: 42528 - DNA, 129 bp, Lumpy skin disease virus; identical to SEQ ID NO: 42527

SEQ ID NO: 42529 - DNA, 21 bp, Homo sapiens
tgttcttctgtttaagttaga

SEQ ID NO: 42530 - DNA, 19 bp, Homo sapiens
ttcccccaaattttaagtt

SEQ ID NO: 42531 - DNA, 28 bp, Homo sapiens
tactgtttttaagtcattttaagttgga

SEQ ID NO: 42532 - DNA, 24 bp, Homo sapiens
gttccaggtgaattttaagttaga

SEQ ID NO: 42533 - DNA, 63 bp, Meleagrid herpesvirus 1
gttttgccccatcggctatctgctcccaaaaagttgtaatataggtgccgctgggtgcgaaat

SEQ ID NO: 42534 - DNA, 22 bp, Meleagrid herpesvirus 1
taggtgccgctgggtgcgaaat

SEQ ID NO: 42535 - DNA, 19 bp, Homo sapiens
caggtgcaggggtgtggaa

SEQ ID NO: 42536 - DNA, 16 bp, Homo sapiens
ggttcgctgggccgaa

SEQ ID NO: 42537 - DNA, 19 bp, Homo sapiens
taggtgctgtttgctaaat

SEQ ID NO: 42538 - DNA, 19 bp, Homo sapiens
tagggttgctgtacaaaat

SEQ ID NO: 42539 - DNA, 17 bp, Homo sapiens
caggtgccgctgcgccg

SEQ ID NO: 42540 - DNA, 16 bp, Homo sapiens
ggtgtggtgtgcgaaa

SEQ ID NO: 42541 - DNA, 20 bp, Homo sapiens
ggcgccgccatctggcggga

SEQ ID NO: 42542 - DNA, 19 bp, Homo sapiens
ggtgtcactgagctgaaat

SEQ ID NO: 42543 - DNA, 18 bp, Homo sapiens
caggtgtcgcaggcggga

SEQ ID NO: 42544 - DNA, 20 bp, Homo sapiens
aggtgccagaattgtgaaat

SEQ ID NO: 42545 - DNA, 19 bp, Homo sapiens
taggtgtcgcaggggggaa

SEQ ID NO: 42546 - DNA, 17 bp, Homo sapiens
taggtccgctaaagaaa

SEQ ID NO: 42547 - DNA, 19 bp, Homo sapiens
tacgcaagactgggtgcga

SEQ ID NO: 42548 - DNA, 15 bp, Homo sapiens
taggtgctggatgcg

SEQ ID NO: 42549 - DNA, 21 bp, Homo sapiens
tagagtgctggcacagtggaa

SEQ ID NO: 42550 - DNA, 18 bp, Homo sapiens
aggtgccgctggatggaa

SEQ ID NO: 42551 - DNA, 18 bp, Homo sapiens
taggtgccttgcagtgga

SEQ ID NO: 42552 - DNA, 15 bp, Homo sapiens
taggtgccaggtgga

SEQ ID NO: 42553 - DNA, 19 bp, Homo sapiens
taggtgccgctcgggtgca

SEQ ID NO: 42554 - DNA, 76 bp, Ectromelia virus
cgatttacgtaatctatatacaagatatatgcgagagaatgatatcgcagagtatcatatagagaatgcgaggtcg

SEQ ID NO: 42555 - DNA, 24 bp, Ectromelia virus
gcagagtatcatatagagaatgcg

SEQ ID NO: 42556 - DNA, 21 bp, Homo sapiens
cagagtccagtagagaatgcg

SEQ ID NO: 42557 - DNA, 21 bp, Homo sapiens
gcaaaggccatggagaatgcg

SEQ ID NO: 42558 - DNA, 16 bp, Homo sapiens
acagagtatgagaatg

SEQ ID NO: 42559 - DNA, 77 bp, Ectromelia virus
cggttactatcaatattattcatctagtgattatgaaaattataatgaatattattatgatgattatgatagaactg

SEQ ID NO: 42560 - DNA, 17 bp, Ectromelia virus
tgattatgatagaactg

SEQ ID NO: 42561 - DNA, 23 bp, Homo sapiens
tgactataacgtaatagaactgc

SEQ ID NO: 42562 - DNA, 20 bp, Homo sapiens
tgatatatgatagaagactg

SEQ ID NO: 42563 - DNA, 18 bp, Homo sapiens
tgatcatagctagaactg

SEQ ID NO: 42564 - DNA, 20 bp, Homo sapiens
tgattttaatgtcagaactg

SEQ ID NO: 42565 - DNA, 19 bp, Homo sapiens
tgatcatgtggcaaaactg

SEQ ID NO: 42566 - DNA, 101 bp, Ectromelia virus
tattactaacataaagataatacgtaaactacttaatcttagcagacatgctccacataatctatttagagatcgagtcatgcacgattatataagtaata

SEQ ID NO: 42567 - DNA, 24 bp, Ectromelia virus
tacgtaaactacttaatcttagca

SEQ ID NO: 42568 - DNA, 21 bp, Homo sapiens
tacttaaactacttaaactta

SEQ ID NO: 42569 - DNA, 21 bp, Homo sapiens
cgttagacctgcatcttagca

SEQ ID NO: 42570 - DNA, 20 bp, Homo sapiens
gtatactacttataacctag

SEQ ID NO: 42571 - DNA, 20 bp, Homo sapiens
gtaagctacttaaagactta

SEQ ID NO: 42572 - DNA, 17 bp, Homo sapiens
gtaaccatgatcttagc

SEQ ID NO: 42573 - DNA, 20 bp, Homo sapiens
gttgaactacttgatctgca

SEQ ID NO: 42574 - DNA, 71 bp, Meleagrid herpesvirus 1
atgtccaggggacctcgcgattgtgggaagaccgcttatatacacactcgacggggtttgttttggcacgt

SEQ ID NO: 42575 - DNA, 24 bp, Meleagrid herpesvirus 1
caggggacctcgcgattgtgggaa

SEQ ID NO: 42576 - DNA, 15 bp, Homo sapiens
ggggacctcggcggg

SEQ ID NO: 42577 - DNA, 16 bp, Homo sapiens
ggggacccgcaaggga

SEQ ID NO: 42578 - DNA, 17 bp, Homo sapiens
ggggacccggcggtggg

SEQ ID NO: 42579 - DNA, 15 bp, Homo sapiens
ggggacctcagtggg

SEQ ID NO: 42580 - DNA, 22 bp, Homo sapiens
cagggggcctgtgcaccgcagg

SEQ ID NO: 42581 - DNA, 20 bp, Homo sapiens
ggggggcaaacttgtgggaa

SEQ ID NO: 42582 - DNA, 17 bp, Homo sapiens
aggggggccttgtggga

SEQ ID NO: 42583 - DNA, 16 bp, Homo sapiens
ggggacctgcggtggg

SEQ ID NO: 42584 - DNA, 20 bp, Homo sapiens
caggggaccttgcagcagaa

SEQ ID NO: 42585 - DNA, 17 bp, Homo sapiens
ggggattccttgtggga

SEQ ID NO: 42586 - DNA, 19 bp, Homo sapiens
tgagggaccttgggtggga

SEQ ID NO: 42587 - DNA, 21 bp, Homo sapiens
aggggacctcgcggcacagag

SEQ ID NO: 42588 - DNA, 16 bp, Homo sapiens
agggacccattgtggg

SEQ ID NO: 42589 - DNA, 17 bp, Homo sapiens
ggggagactttgtgaga

SEQ ID NO: 42590 - DNA, 18 bp, Homo sapiens
gggtggccccattgtggg

SEQ ID NO: 42591 - DNA, 17 bp, Homo sapiens
caggggacccaggtggg

SEQ ID NO: 42592 - DNA, 22 bp, Homo sapiens
caggggacctggagaatgggga

SEQ ID NO: 42593 - DNA, 27 bp, Homo sapiens
cagggaactagaactcggttgtgggaa

SEQ ID NO: 42594 - DNA, 20 bp, Homo sapiens
ggggagatttactgtgggaa

SEQ ID NO: 42595 - DNA, 17 bp, Homo sapiens
ggggaggcctcgcggga

SEQ ID NO: 42596 - DNA, 19 bp, Homo sapiens
ggggacctcagccaaggga

SEQ ID NO: 42597 - DNA, 18 bp, Homo sapiens
caggtgaccttgcggtag

SEQ ID NO: 42598 - DNA, 20 bp, Homo sapiens
cagggaactttgcgaataga

SEQ ID NO: 42599 - DNA, 17 bp, Homo sapiens
caggtggcctcgtggga

SEQ ID NO: 42600 - DNA, 15 bp, Homo sapiens
caggggacccgtggg

SEQ ID NO: 42601 - DNA, 23 bp, Homo sapiens
caggggacctctggggcccgggg

SEQ ID NO: 42602 - DNA, 17 bp, Homo sapiens
gggggtctcttgtggaa

SEQ ID NO: 42603 - DNA, 18 bp, Homo sapiens
cagtgggcctctgtggga

SEQ ID NO: 42604 - DNA, 20 bp, Homo sapiens
caggggacctgattgttggg

SEQ ID NO: 42605 - DNA, 22 bp, Homo sapiens
agggaaccttgcttagggtggg

SEQ ID NO: 42606 - DNA, 60 bp, Ectromelia virus
gcattctgtctttaagggattttctgacaaagttagaaaaaatgatttagacatgaatgt

SEQ ID NO: 42607 - DNA, 24 bp, Ectromelia virus
tctgtctttaagggattttctgac

SEQ ID NO: 42608 - DNA, 16 bp, Homo sapiens
tgcctttaaattctga

SEQ ID NO: 42609 - DNA, 18 bp, Homo sapiens
ctgctggggattttttga

SEQ ID NO: 42610 - DNA, 16 bp, Homo sapiens
tgtcaggattttctga

SEQ ID NO: 42611 - DNA, 20 bp, Homo sapiens
tctgtcttttgggggctctg

SEQ ID NO: 42612 - DNA, 18 bp, Homo sapiens
tctgtctttgagggctga

SEQ ID NO: 42613 - DNA, 20 bp, Homo sapiens
tctgtcttagggattttctg

SEQ ID NO: 42614 - DNA, 20 bp, Homo sapiens
tctgactttgggggatcccc

SEQ ID NO: 42615 - DNA, 18 bp, Homo sapiens
tctttgagcaattctgac

SEQ ID NO: 42616 - DNA, 23 bp, Homo sapiens
tctgtcttcaaggtgggactgac

SEQ ID NO: 42617 - DNA, 21 bp, Homo sapiens
tctgtcttggtcacctttctg

SEQ ID NO: 42618 - DNA, 21 bp, Homo sapiens
tctgtgtttaggggtcatcct

SEQ ID NO: 42619 - DNA, 18 bp, Homo sapiens
tcttctttaggatttctg

SEQ ID NO: 42620 - DNA, 21 bp, Homo sapiens
tcttcttccatattttctgac

SEQ ID NO: 42621 - DNA, 17 bp, Homo sapiens
tcttgaggattttctga

SEQ ID NO: 42622 - DNA, 19 bp, Homo sapiens
tctgtctctgtatttttga

SEQ ID NO: 42623 - DNA, 19 bp, Homo sapiens
cctgtctttgggggaattt

SEQ ID NO: 42624 - DNA, 21 bp, Homo sapiens
tctgtctatgaggcttctgac

SEQ ID NO: 42625 - DNA, 22 bp, Homo sapiens
tctgttctttaggccttctgac

SEQ ID NO: 42626 - DNA, 19 bp, Homo sapiens
tctgtctttgtatcttctg

SEQ ID NO: 42627 - DNA, 18 bp, Homo sapiens
cctgtctttaagggcctg

SEQ ID NO: 42628 - DNA, 19 bp, Homo sapiens
tatctttaatgttttctga

SEQ ID NO: 42629 - DNA, 16 bp, Homo sapiens
tctttatgattttctg

SEQ ID NO: 42630 - DNA, 20 bp, Homo sapiens
tctgtctactttattttctg

SEQ ID NO: 42631 - DNA, 20 bp, Homo sapiens
tctgttttcaatactttctg

SEQ ID NO: 42632 - DNA, 19 bp, Homo sapiens
tctgtctttgtgattctga

SEQ ID NO: 42633 - DNA, 19 bp, Homo sapiens
tgtcttttggttttctgac

SEQ ID NO: 42634 - DNA, 19 bp, Homo sapiens
cctgtctttggatttttga

SEQ ID NO: 42635 - DNA, 19 bp, Homo sapiens
tctgtcttgggatatttga

SEQ ID NO: 42636 - DNA, 21 bp, Homo sapiens
tctgtttttaaggggaatgac

SEQ ID NO: 42637 - DNA, 20 bp, Homo sapiens
tctgctttaaaaaattctga

SEQ ID NO: 42638 - DNA, 16 bp, Homo sapiens
tctgtcttggggcctg

SEQ ID NO: 42639 - DNA, 19 bp, Homo sapiens
tgtcagagggattttctga

SEQ ID NO: 42640 - DNA, 19 bp, Homo sapiens
tgctagaagattttctgac

SEQ ID NO: 42641 - DNA, 70 bp, Ectromelia virus
tcgagtatatgatctcatctcgatctcaatcatcttatttgagtcgtattcctaatgagatattactcga

SEQ ID NO: 42642 - DNA, 24 bp, Ectromelia virus
tatgatctcatctcgatctcaatc

SEQ ID NO: 42643 - DNA, 22 bp, Homo sapiens
tatgatctcattgttctgaatc

SEQ ID NO: 42644 - DNA, 21 bp, Homo sapiens
tgatctcattttcctctcaat

SEQ ID NO: 42645 - DNA, 23 bp, Homo sapiens
tatgattattgatgaatctcaat

SEQ ID NO: 42646 - DNA, 19 bp, Homo sapiens
gatctcatcctcattgatc

SEQ ID NO: 42647 - DNA, 19 bp, Homo sapiens
tatgagctcatctcgttcc

SEQ ID NO: 42648 - DNA, 26 bp, Homo sapiens
tatgatcttatgcaagttactcaatc

SEQ ID NO: 42649 - DNA, 64 bp, Tupaia herpesvirus
acgaagatcttgaggctgggtagctgacaggcttcggtccggaaggtgcccagcaggatctcgt

SEQ ID NO: 42650 - DNA, 24 bp, Tupaia herpesvirus
cggaaggtgcccagcaggatctcg

SEQ ID NO: 42651 - DNA, 20 bp, Homo sapiens
cgcgaggtgcccagtggcag

SEQ ID NO: 42652 - DNA, 17 bp, Homo sapiens
cggaaggtgccagtggg

SEQ ID NO: 42653 - DNA, 19 bp, Homo sapiens
cgaaagcagcaggatctcg

SEQ ID NO: 42654 - DNA, 17 bp, Homo sapiens
gagggtgcccatggtct

SEQ ID NO: 42655 - DNA, 17 bp, Homo sapiens
ggtgcagcaggatttcg

SEQ ID NO: 42656 - DNA, 19 bp, Homo sapiens
ggaaggtgccatggtttcc

SEQ ID NO: 42657 - DNA, 18 bp, Homo sapiens
gggaggtgctcagctgac

SEQ ID NO: 42658 - DNA, 22 bp, Homo sapiens
ggcgtgcagtggcgggatctcg

SEQ ID NO: 42659 - DNA, 20 bp, Homo sapiens
ggagtgcagtggcaggatct

SEQ ID NO: 42660 - DNA, 19 bp, Homo sapiens
gagggtgcccagttcctcg

SEQ ID NO: 42661 - DNA, 22 bp, Homo sapiens
ggagtgcagtggcgggatctcg

SEQ ID NO: 42662 - DNA, 21 bp, Homo sapiens
ggaaggtgctcaaccttctcg

SEQ ID NO: 42663 - DNA, 20 bp, Homo sapiens
ggaaagtgttcaagaggtct

SEQ ID NO: 42664 - DNA, 17 bp, Homo sapiens
cggaaggtgccgggttc

SEQ ID NO: 42665 - DNA, 18 bp, Homo sapiens
ggaaggtgcccaggatct

SEQ ID NO: 42666 - DNA, 16 bp, Homo sapiens
cagggtgcccagtagg

SEQ ID NO: 42667 - DNA, 21 bp, Homo sapiens
agctcccccagcgggatctcg

SEQ ID NO: 42668 - DNA, 18 bp, Homo sapiens
ggaaggtgctagtaagat

SEQ ID NO: 42669 - DNA, 21 bp, Homo sapiens
ggagtgagtggcgggatctcg

SEQ ID NO: 42670 - DNA, 16 bp, Homo sapiens
gggccagcaggatctc

SEQ ID NO: 42671 - DNA, 20 bp, Homo sapiens
agtgcagtggcgggatctcg

SEQ ID NO: 42672 - DNA, 17 bp, Homo sapiens
gggggtgcccagtgatc

SEQ ID NO: 42673 - DNA, 17 bp, Homo sapiens
cgggagtgcccagcggg

SEQ ID NO: 42674 - DNA, 61 bp, Bovine herpesvirus 4
tggtcaagatgtaccccgaaatcatgagagataatggtccctttgatgtggggatatacca

SEQ ID NO: 42675 - DNA, 18 bp, Bovine herpesvirus 4
tgatgtggggatatacca

SEQ ID NO: 42676 - DNA, 20 bp, Homo sapiens
tgatggaaaaagatatacca

SEQ ID NO: 42677 - DNA, 17 bp, Homo sapiens
tgaatggaaatatacca

SEQ ID NO: 42678 - DNA, 17 bp, Homo sapiens
tgatgtggggataccca

SEQ ID NO: 42679 - DNA, 17 bp, Homo sapiens
tgatgtgttaactacca

SEQ ID NO: 42680 - DNA, 18 bp, Homo sapiens
tgattaaacaatatacca

SEQ ID NO: 42681 - DNA, 15 bp, Homo sapiens
tgatgtgagaatcca

SEQ ID NO: 42682 - DNA, 15 bp, Homo sapiens
tgacgtgggaatcca

SEQ ID NO: 42683 - DNA, 17 bp, Homo sapiens
taatataaaatatacca

SEQ ID NO: 42684 - DNA, 16 bp, Homo sapiens
tgatgagggaacacca

SEQ ID NO: 42685 - DNA, 18 bp, Homo sapiens
gattatcaggatatacca

SEQ ID NO: 42686 - DNA, 17 bp, Homo sapiens
tgacctatgatatacca

SEQ ID NO: 42687 - DNA, 18 bp, Homo sapiens
tgatgtggagattcccca

SEQ ID NO: 42688 - DNA, 20 bp, Homo sapiens
taatgtagttaaatatacca

SEQ ID NO: 42689 - DNA, 19 bp, Homo sapiens
tgatgtagaagctatgcca

SEQ ID NO: 42690 - DNA, 18 bp, Homo sapiens
tgatgtaggctcacatca

SEQ ID NO: 42691 - DNA, 18 bp, Homo sapiens
tatgagaacagtatacca

SEQ ID NO: 42692 - DNA, 21 bp, Homo sapiens
tgatgcggggatggggtacca

SEQ ID NO: 42693 - DNA, 18 bp, Homo sapiens
tatggataagatatacca

SEQ ID NO: 42694 - DNA, 17 bp, Homo sapiens
tgacgtggtatacacca

SEQ ID NO: 42695 - DNA, 18 bp, Homo sapiens
tgatgtggttacatgcca

SEQ ID NO: 42696 - DNA, 17 bp, Homo sapiens
tgatctgaattatacca

SEQ ID NO: 42697 - DNA, 15 bp, Homo sapiens
tgatgtgaagcacca

SEQ ID NO: 42698 - DNA, 16 bp, Homo sapiens
tgacgcggatatacca

SEQ ID NO: 42699 - DNA, 19 bp, Homo sapiens
tgagtagagacgtatgcca

SEQ ID NO: 42700 - DNA, 16 bp, Homo sapiens
tgataaaaatatacca

SEQ ID NO: 42701 - DNA, 18 bp, Homo sapiens
tgtgctgttaatatacca

SEQ ID NO: 42702 - DNA, 18 bp, Homo sapiens
tgatgggaagacatgcca

SEQ ID NO: 42703 - DNA, 16 bp, Homo sapiens
tgagtgggaacagcca

SEQ ID NO: 42704 - DNA, 18 bp, Homo sapiens
tgagtggggacacagcca

SEQ ID NO: 42705 - DNA, 16 bp, Homo sapiens
tgagtagaatatacca

SEQ ID NO: 42706 - DNA, 18 bp, Homo sapiens
tgtgtggggaaagtacca

SEQ ID NO: 42707 - DNA, 17 bp, Homo sapiens
tgatgtggaggatgcca

SEQ ID NO: 42708 - DNA, 84 bp, Sheeppox virus
gttgaatggtcatcgaataagttttggaaaatagacactcataaggttatcgatgccgaaacttctatcagtgattattacaat

SEQ ID NO: 42709 - DNA, 19 bp, Sheeppox virus
tatcagtgattattacaat

SEQ ID NO: 42710 - DNA, 19 bp, Homo sapiens
taccagtaataattacaat

SEQ ID NO: 42711 - DNA, 17 bp, Homo sapiens
atcagtaacattacaat

SEQ ID NO: 42712 - DNA, 19 bp, Homo sapiens
catcagtggctaagttaca

SEQ ID NO: 42713 - DNA, 19 bp, Homo sapiens
tatcaggacacatcacaat

SEQ ID NO: 42714 - DNA, 21 bp, Homo sapiens
taccagtgaggagcttacaat

SEQ ID NO: 42715 - DNA, 21 bp, Homo sapiens
catcagtagttttattacaat

SEQ ID NO: 42716 - DNA, 19 bp, Homo sapiens
catcagtggaccaaccaat

SEQ ID NO: 42717 - DNA, 18 bp, Homo sapiens
atcagtgattgagacaat

SEQ ID NO: 42718 - DNA, 17 bp, Homo sapiens
catcagcaacttacaat

SEQ ID NO: 42719 - DNA, 16 bp, Homo sapiens
tatcagttattacaat

SEQ ID NO: 42720 - DNA, 20 bp, Homo sapiens
tatcaagtgatatgcacaat

SEQ ID NO: 42721 - DNA, 18 bp, Homo sapiens
catcagcatctttacaat

SEQ ID NO: 42722 - DNA, 19 bp, Homo sapiens
tatcagtgtattagacaca

SEQ ID NO: 42723 - DNA, 16 bp, Homo sapiens
atcagtgaatcacaat

SEQ ID NO: 42724 - DNA, 70 bp, Meleagrid herpesvirus 1
cctgttggagtgaagtgacaggttaccgactatattagtctcctgtaatctagacactcgcctcaccagg

SEQ ID NO: 42725 - DNA, 24 bp, Meleagrid herpesvirus 1
agtgaagtgacaggttaccgacta

SEQ ID NO: 42726 - DNA, 19 bp, Homo sapiens
agtaaaatggttgctgact

SEQ ID NO: 42727 - DNA, 23 bp, Homo sapiens
gtgaaggacaggttgtgaggact

SEQ ID NO: 42728 - DNA, 19 bp, Homo sapiens
agtgaagtgagggttgtcc

SEQ ID NO: 42729 - DNA, 22 bp, Homo sapiens
gtggggtgacaggagtgggact

SEQ ID NO: 42730 - DNA, 20 bp, Homo sapiens
agtgaagtacagtgaggtta

SEQ ID NO: 42731 - DNA, 21 bp, Homo sapiens
agtgaaatgatgtgatgacta

SEQ ID NO: 42732 - DNA, 18 bp, Homo sapiens
gtgaagtgggggcacact

SEQ ID NO: 42733 - DNA, 22 bp, Homo sapiens
gtggaatgacaggcgtgaacta

SEQ ID NO: 42734 - DNA, 19 bp, Homo sapiens
agtgaagtagcttctgact

SEQ ID NO: 42735 - DNA, 19 bp, Homo sapiens
aggaggtgacaaacgtccg

SEQ ID NO: 42736 - DNA, 62 bp, Bovine herpesvirus 4
gagtttagatctgaattgatactgtccaatcaggatctagtacaatatgtttatctaagctt

SEQ ID NO: 42737 - DNA, 22 bp, Bovine herpesvirus 4
tacaatatgtttatctaagctt

SEQ ID NO: 42738 - DNA, 21 bp, Homo sapiens
atacatagagaatctaagctt

SEQ ID NO: 42739 - DNA, 18 bp, Homo sapiens
tacaagctgccatctaag

SEQ ID NO: 42740 - DNA, 21 bp, Homo sapiens
caatatgttggtggcaagctt

SEQ ID NO: 42741 - DNA, 20 bp, Homo sapiens
tacaaaatgtatctaagctt

SEQ ID NO: 42742 - DNA, 17 bp, Homo sapiens
caatactttctaagctt

SEQ ID NO: 42743 - DNA, 17 bp, Homo sapiens
atatgggcactaagctt

SEQ ID NO: 42744 - DNA, 20 bp, Homo sapiens
tacaaaatgttctacagctt

SEQ ID NO: 42745 - DNA, 17 bp, Homo sapiens
tacaatatgtttaaagc

SEQ ID NO: 42746 - DNA, 20 bp, Homo sapiens
tacaacatgttcaatggctt

SEQ ID NO: 42747 - DNA, 16 bp, Homo sapiens
caatatgtttattgct

SEQ ID NO: 42748 - DNA, 130 bp, Sheeppox virus
ggaatgtttggaatatccaaaggcggattttctaacattagttaataatatgtcatttgatgtaaaaaatggtattgttttaaattttaagttagaaaatataaattgtttagataatccaaatatatct

SEQ ID NO: 42749 - DNA, 65 bp, Bovine herpesvirus 4
gcacagtatcaaggatcaactctgtttatctagacatgaatacttcaatcccaggctacccgtgt

SEQ ID NO: 42750 - DNA, 24 bp, Bovine herpesvirus 4
aaggatcaactctgtttatctaga

SEQ ID NO: 42751 - DNA, 20 bp, Homo sapiens
aagcatcaactctgtgccag

SEQ ID NO: 42752 - DNA, 24 bp, Homo sapiens
ggtcagttactctgtttatctgga

SEQ ID NO: 42753 - DNA, 19 bp, Homo sapiens
aaggatcaatgagatctag

SEQ ID NO: 42754 - DNA, 21 bp, Homo sapiens
ggagatcgctgtttatctaga

SEQ ID NO: 42755 - DNA, 20 bp, Homo sapiens
aaggatcagattttctattt

SEQ ID NO: 42756 - DNA, 22 bp, Homo sapiens
aaggaccagcttgtgagtctag

SEQ ID NO: 42757 - DNA, 22 bp, Homo sapiens
aagaatcaattctgttcttcag

SEQ ID NO: 42758 - DNA, 18 bp, Homo sapiens
aaggatcagcacctattt

SEQ ID NO: 42759 - DNA, 20 bp, Homo sapiens
ggagatcgactccgccttct

SEQ ID NO: 42760 - DNA, 21 bp, Homo sapiens
aaagatcaattctaatctgga

SEQ ID NO: 42761 - DNA, 19 bp, Homo sapiens
aggatcaactgtgtaccag

SEQ ID NO: 42762 - DNA, 20 bp, Homo sapiens
gggttgactctgtcccctag

SEQ ID NO: 42763 - DNA, 24 bp, Homo sapiens
aggggttggttgtgcccacctaga

SEQ ID NO: 42764 - DNA, 24 bp, Homo sapiens
aaagatcaactctgcctacctaga

SEQ ID NO: 42765 - DNA, 17 bp, Homo sapiens
agggtccactctactag

SEQ ID NO: 42766 - DNA, 23 bp, Homo sapiens
aggaatcaactttagcatctgga

SEQ ID NO: 42767 - DNA, 20 bp, Homo sapiens
agcatcaactcccatttaga

SEQ ID NO: 42768 - DNA, 18 bp, Homo sapiens
gggtcaactgatttatct

SEQ ID NO: 42769 - DNA, 20 bp, Homo sapiens
ggactcagaacttatctaga

SEQ ID NO: 42770 - DNA, 24 bp, Homo sapiens
agatcaactttaggattatctgga

SEQ ID NO: 42771 - DNA, 19 bp, Homo sapiens
aaggatcactagtgaatct

SEQ ID NO: 42772 - DNA, 15 bp, Homo sapiens
aggaccaacttatct

SEQ ID NO: 42773 - DNA, 68 bp, Tupaia herpesvirus
gttgccgctctgatactcctccgggatgagccacatggtctcgttgcggtagctgtcctggtggtaac

SEQ ID NO: 42774 - DNA, 24 bp, Tupaia herpesvirus
tgcggtagctgtcctggtggtaac

SEQ ID NO: 42775 - DNA, 21 bp, Homo sapiens
tgcggtagctgtgttcttggc

SEQ ID NO: 42776 - DNA, 22 bp, Homo sapiens
tgtggtggcagtcgcctgtggt

SEQ ID NO: 42777 - DNA, 22 bp, Homo sapiens
tgcggtagttctcccgcctggc

SEQ ID NO: 42778 - DNA, 18 bp, Homo sapiens
tgttgtagctgtggtaat

SEQ ID NO: 42779 - DNA, 18 bp, Homo sapiens
tgggtggctggtggtggc

SEQ ID NO: 42780 - DNA, 20 bp, Homo sapiens
tgggtagctgtggcatggtg

SEQ ID NO: 42781 - DNA, 22 bp, Homo sapiens
tgcagtggtggccgtggtggta

SEQ ID NO: 42782 - DNA, 18 bp, Homo sapiens
tgcggcagcggtggtggc

SEQ ID NO: 42783 - DNA, 20 bp, Homo sapiens
tgtggtgcttgcttggtagc

SEQ ID NO: 42784 - DNA, 21 bp, Homo sapiens
tgctgtagctgttttaaaagt

SEQ ID NO: 42785 - DNA, 18 bp, Homo sapiens
tgaggtactggtggtggc

SEQ ID NO: 42786 - DNA, 21 bp, Homo sapiens
tgtggtattgtgaagggtaac

SEQ ID NO: 42787 - DNA, 20 bp, Homo sapiens
tgtggagttgttccagtaat

SEQ ID NO: 42788 - DNA, 18 bp, Homo sapiens
tgtggcgctggtggtggt

SEQ ID NO: 42789 - DNA, 18 bp, Homo sapiens
tgaggtagcggtggtggc

SEQ ID NO: 42790 - DNA, 17 bp, Homo sapiens
tgggtagtggtggtggt

SEQ ID NO: 42791 - DNA, 18 bp, Homo sapiens
tgtggtgttgctggtgat

SEQ ID NO: 42792 - DNA, 18 bp, Homo sapiens
ggtagctgagctggtggc

SEQ ID NO: 42793 - DNA, 19 bp, Homo sapiens
tgggtagggtggtggtggt

SEQ ID NO: 42794 - DNA, 16 bp, Homo sapiens
gcggtggcccggtggt

SEQ ID NO: 42795 - DNA, 20 bp, Homo sapiens
tgcggagttgttccagtaat

SEQ ID NO: 42796 - DNA, 18 bp, Homo sapiens
tgtggcactggtggtggt

SEQ ID NO: 42797 - DNA, 18 bp, Homo sapiens
tgcgtggctgtcctgttg

SEQ ID NO: 42798 - DNA, 16 bp, Homo sapiens
tgcggttgctgtggta

SEQ ID NO: 42799 - DNA, 20 bp, Homo sapiens
tgggcagctcctggtggtaa

SEQ ID NO: 42800 - DNA, 22 bp, Homo sapiens
tgcggtaggtgtcttgttcagt

SEQ ID NO: 42801 - DNA, 18 bp, Homo sapiens
tgctggctgtccggtggt

SEQ ID NO: 42802 - DNA, 131 bp, Murid herpesvirus 4
ttatcaggattagaacatttgggacagtgaggtgtttagtaaaaatggtgggcaagcacagaagtgtgaatgtccccgctgggttttgaaaatcatctatgttattgtccattctgtaagagtccaggtaa

SEQ ID NO: 42803 - DNA, 24 bp, Murid herpesvirus 4
agtaaaaatggtgggcaagcacag

SEQ ID NO: 42804 - DNA, 22 bp, Homo sapiens
agcaggagtgtcttaagcacag

SEQ ID NO: 42805 - DNA, 19 bp, Homo sapiens
agtaaaatgacaaagcaca

SEQ ID NO: 42806 - DNA, 18 bp, Homo sapiens
agaaaaatggtgggggca

SEQ ID NO: 42807 - DNA, 19 bp, Homo sapiens
agtaagtgtggccagtaca

SEQ ID NO: 42808 - DNA, 21 bp, Homo sapiens
agcaaaggaatagcaggtgca

SEQ ID NO: 42809 - DNA, 20 bp, Homo sapiens
agtgaaatggtggttgtaca

SEQ ID NO: 42810 - DNA, 23 bp, Homo sapiens
agtaaaggtcgtactatgcacag

SEQ ID NO: 42811 - DNA, 21 bp, Homo sapiens
agaaaagtggtggaccacgca

SEQ ID NO: 42812 - DNA, 23 bp, Homo sapiens
agtgaaagtgtttttaagcacag

SEQ ID NO: 42813 - DNA, 26 bp, Homo sapiens
aataaaaatggtcatctagggcacag

SEQ ID NO: 42814 - DNA, 22 bp, Homo sapiens
aataaaaatgagaggagcacag

SEQ ID NO: 42815 - DNA, 19 bp, Homo sapiens
agtaacaatgaggggcaca

SEQ ID NO: 42816 - DNA, 24 bp, Homo sapiens
agtaacaggtgagtcaaagcacag

SEQ ID NO: 42817 - DNA, 18 bp, Homo sapiens
aataaaaaactgtgagca

SEQ ID NO: 42818 - DNA, 17 bp, Homo sapiens
gtaagaggagcaagcac

SEQ ID NO: 42819 - DNA, 19 bp, Homo sapiens
agaaaaatggcaaagtaca

SEQ ID NO: 42820 - DNA, 15 bp, Homo sapiens
gtaagtgaaagcaca

SEQ ID NO: 42821 - DNA, 15 bp, Homo sapiens
ataaaaatcaagcac

SEQ ID NO: 42822 - DNA, 19 bp, Homo sapiens
aataaaaaattagcaggca

SEQ ID NO: 42823 - DNA, 22 bp, Homo sapiens
gtaagaggtaatttaagcacag

SEQ ID NO: 42824 - DNA, 17 bp, Homo sapiens
taaaaattgtaagcaca

SEQ ID NO: 42825 - DNA, 18 bp, Homo sapiens
ataaaaattagctgggca

SEQ ID NO: 42826 - DNA, 19 bp, Homo sapiens
agtgaaaataggtgggaca

SEQ ID NO: 42827 - DNA, 24 bp, Homo sapiens
agtaacagatgaattgggcaggca

SEQ ID NO: 42828 - DNA, 18 bp, Homo sapiens
taaaaatgtggccaagca

SEQ ID NO: 42829 - DNA, 17 bp, Homo sapiens
agtaaaaagtgggccag

SEQ ID NO: 42830 - DNA, 23 bp, Homo sapiens
agaggaaatattttcaagcacag

SEQ ID NO: 42831 - DNA, 21 bp, Homo sapiens
gtaaaaatgggctcgtgtgca

SEQ ID NO: 42832 - DNA, 18 bp, Homo sapiens
aataggggtcgcaagcac

SEQ ID NO: 42833 - DNA, 24 bp, Homo sapiens
agtcaaggtgggcagagggtacag

SEQ ID NO: 42834 - DNA, 16 bp, Homo sapiens
agcaaagtgggcaggc

SEQ ID NO: 42835 - DNA, 20 bp, Homo sapiens
aataaaaaattaggtgggca

SEQ ID NO: 42836 - DNA, 18 bp, Homo sapiens
agtaaaaatgctgttaca

SEQ ID NO: 42837 - DNA, 18 bp, Homo sapiens
ataaaaattagccgggca

SEQ ID NO: 42838 - DNA, 22 bp, Homo sapiens
agcaaaaagaaaatggcaggca

SEQ ID NO: 42839 - DNA, 18 bp, Homo sapiens
agaaaaagaataagcaag

SEQ ID NO: 42840 - DNA, 20 bp, Homo sapiens
gtaagaatgggggccaccag

SEQ ID NO: 42841 - DNA, 18 bp, Homo sapiens
agaaaaattagccgggca

SEQ ID NO: 42842 - DNA, 23 bp, Homo sapiens
agtaaggttggtccaaggcacag

SEQ ID NO: 42843 - DNA, 21 bp, Homo sapiens
agcagaggtggacagggtgca

SEQ ID NO: 42844 - DNA, 25 bp, Homo sapiens
agtaaaaaatgcctcgccgggtgca

SEQ ID NO: 42845 - DNA, 19 bp, Homo sapiens
agaaaaaattagctgggca

SEQ ID NO: 42846 - DNA, 92 bp, Human herpesvirus 4
ggcgacacttgggtgcacaggtggccgtaggtgtcacgtgaccttttccgccggcacctttaagctgccgcgatgtacccccggggatcgcc

SEQ ID NO: 42847 - DNA, 24 bp, Human herpesvirus 4
aagctgccgcgatgtacccccggg

SEQ ID NO: 42848 - DNA, 22 bp, Homo sapiens
actgtcgctttaggcccccggg

SEQ ID NO: 42849 - DNA, 20 bp, Homo sapiens
gccgttgcatctcccccggg

SEQ ID NO: 42850 - DNA, 22 bp, Homo sapiens
aagctgcgacttcacccccggg

SEQ ID NO: 42851 - DNA, 15 bp, Homo sapiens
agctcctgacccccg

SEQ ID NO: 42852 - DNA, 25 bp, Homo sapiens
aagctgccgatttcaggcccccggg

SEQ ID NO: 42853 - DNA, 22 bp, Homo sapiens
gccgccgcggtgcagacctggg

SEQ ID NO: 42854 - DNA, 20 bp, Homo sapiens
gctgccactgctttcctggg

SEQ ID NO: 42855 - DNA, 21 bp, Homo sapiens
aagctgcctgtgtcctctggg

SEQ ID NO: 42856 - DNA, 22 bp, Homo sapiens
gccgccgcggaaactccccggg

SEQ ID NO: 42857 - DNA, 18 bp, Homo sapiens
aagctgccgcagcctcgg

SEQ ID NO: 42858 - DNA, 23 bp, Homo sapiens
aagctgccactgctgcttctggg

SEQ ID NO: 42859 - DNA, 23 bp, Homo sapiens
agcagccgcgcgccgcccccggg

SEQ ID NO: 42860 - DNA, 21 bp, Homo sapiens
gctgccgctgcagggcctggg

SEQ ID NO: 42861 - DNA, 16 bp, Homo sapiens
gcgccgcagcccccgg

SEQ ID NO: 42862 - DNA, 23 bp, Homo sapiens
gctgccgccaaccggccctcggg

SEQ ID NO: 42863 - DNA, 27 bp, Homo sapiens
aagctgcctgtgtcgcccacccctggg

SEQ ID NO: 42864 - DNA, 19 bp, Homo sapiens
gctgctgctgacccttggg

SEQ ID NO: 42865 - DNA, 18 bp, Homo sapiens
gctgtcaccacccccggg

SEQ ID NO: 42866 - DNA, 23 bp, Homo sapiens
agctgccgccgctcacttccggg

SEQ ID NO: 42867 - DNA, 17 bp, Homo sapiens
gcgccgcgagctcccgg

SEQ ID NO: 42868 - DNA, 22 bp, Homo sapiens
gctgccgcgggaaatcctcggg

SEQ ID NO: 42869 - DNA, 15 bp, Homo sapiens
aagtgctgcaccccg

SEQ ID NO: 42870 - DNA, 21 bp, Homo sapiens
agccgccgcgcaagccccggg

SEQ ID NO: 42871 - DNA, 16 bp, Homo sapiens
gctcccgcacccccgg

SEQ ID NO: 42872 - DNA, 24 bp, Homo sapiens
aagctgcctgctgcacttcccggg

SEQ ID NO: 42873 - DNA, 20 bp, Homo sapiens
gctgccgcgggccggtcggg

SEQ ID NO: 42874 - DNA, 24 bp, Homo sapiens
gctgccgcagctcagacccctggg

SEQ ID NO: 42875 - DNA, 22 bp, Homo sapiens
agccgctgctttctcccccggg

SEQ ID NO: 42876 - DNA, 22 bp, Homo sapiens
aagttgcatgagtgcttccggg

SEQ ID NO: 42877 - DNA, 20 bp, Homo sapiens
agccgccggcagcctctggg

SEQ ID NO: 42878 - DNA, 23 bp, Homo sapiens
aaactgccgttcgcattcctggg

SEQ ID NO: 42879 - DNA, 21 bp, Homo sapiens
agctgccgcggggtggacggg

SEQ ID NO: 42880 - DNA, 23 bp, Homo sapiens
aagctgccgtggagatggttggg

SEQ ID NO: 42881 - DNA, 24 bp, Homo sapiens
agctgccggggacgatgtcccggg

SEQ ID NO: 42882 - DNA, 20 bp, Homo sapiens
agccgccgggcatccttggg

SEQ ID NO: 42883 - DNA, 24 bp, Homo sapiens
agctgccgtggatcacttcttggg

SEQ ID NO: 42884 - DNA, 20 bp, Homo sapiens
gctgcgtgcaggcccccggg

SEQ ID NO: 42885 - DNA, 16 bp, Homo sapiens
ctgccgcgagccccgg

SEQ ID NO: 42886 - DNA, 23 bp, Homo sapiens
aaactgccgcagcgctccctggg

SEQ ID NO: 42887 - DNA, 21 bp, Homo sapiens
aagctgtccgtttgccctggg

SEQ ID NO: 42888 - DNA, 22 bp, Homo sapiens
aagctgccagtggggccttggg

SEQ ID NO: 42889 - DNA, 16 bp, Homo sapiens
gccgccgcgtccccgg

SEQ ID NO: 42890 - DNA, 23 bp, Homo sapiens
agctgccaggagcagtccctggg

SEQ ID NO: 42891 - DNA, 21 bp, Homo sapiens
actgccgctcccactcccggg

SEQ ID NO: 42892 - DNA, 81 bp, Murid herpesvirus 4
gggtggatatcaaagtagacaatcccttaaagagaaaacaggaatctttaccgggattcttctgaaacaatcttttccccc

SEQ ID NO: 42893 - DNA, 24 bp, Murid herpesvirus 4
taccgggattcttctgaaacaatc

SEQ ID NO: 42894 - DNA, 18 bp, Homo sapiens
caggcaactgaaacaatc

SEQ ID NO: 42895 - DNA, 22 bp, Homo sapiens
taccggcccctctggggcaatc

SEQ ID NO: 42896 - DNA, 16 bp, Homo sapiens
caagtcttctgagaca

SEQ ID NO: 42897 - DNA, 24 bp, Homo sapiens
gggattccagtttctgaaataatc

SEQ ID NO: 42898 - DNA, 16 bp, Homo sapiens
cctggactgaaacaat

SEQ ID NO: 42899 - DNA, 16 bp, Homo sapiens
caggttttctgaaaca

SEQ ID NO: 42900 - DNA, 18 bp, Homo sapiens
tacctcgcttctgaaaca

SEQ ID NO: 42901 - DNA, 20 bp, Homo sapiens
ccaggattcttttgttcaat

SEQ ID NO: 42902 - DNA, 19 bp, Homo sapiens
tacatggttctgaaacaat

SEQ ID NO: 42903 - DNA, 20 bp, Homo sapiens
gggattctcttgaaataatc

SEQ ID NO: 42904 - DNA, 17 bp, Homo sapiens
ccaagacttttgaaaca

SEQ ID NO: 42905 - DNA, 72 bp, Human herpesvirus 8
ccacacccccaggatcttcctctaaggcccccaccaaacctggtgaggaagcatctggtcctaagagtgtgg

SEQ ID NO: 42906 - DNA, 24 bp, Human herpesvirus 8
tgaggaagcatctggtcctaagag

SEQ ID NO: 42907 - DNA, 22 bp, Homo sapiens
ggaagcattctagccctgagag

SEQ ID NO: 42908 - DNA, 19 bp, Homo sapiens
tgggggagcttctggtcct

SEQ ID NO: 42909 - DNA, 22 bp, Homo sapiens
agggggcatatggtcttaagag

SEQ ID NO: 42910 - DNA, 25 bp, Homo sapiens
tgaggaagcgtcctggtctggcgag

SEQ ID NO: 42911 - DNA, 19 bp, Homo sapiens
tgagacacatcctggtcct

SEQ ID NO: 42912 - DNA, 21 bp, Homo sapiens
tggagaagcactccttgggag

SEQ ID NO: 42913 - DNA, 22 bp, Homo sapiens
tgagaaagcataaaattaagag

SEQ ID NO: 42914 - DNA, 22 bp, Homo sapiens
tgagtaggcatctgactgggag

SEQ ID NO: 42915 - DNA, 22 bp, Homo sapiens
tggggcagcatctatgtaggag

SEQ ID NO: 42916 - DNA, 22 bp, Homo sapiens
tgggcaagcacggtcttgggag

SEQ ID NO: 42917 - DNA, 22 bp, Homo sapiens
tgaggaagttctgggcctggag

SEQ ID NO: 42918 - DNA, 20 bp, Homo sapiens
aggaagcacaggtctgggag

SEQ ID NO: 42919 - DNA, 20 bp, Homo sapiens
tgagggaacgtaggcctgag

SEQ ID NO: 42920 - DNA, 21 bp, Homo sapiens
tggggaacatggttctgagag

SEQ ID NO: 42921 - DNA, 22 bp, Homo sapiens
tgaggaagcgggtgcttaagag

SEQ ID NO: 42922 - DNA, 17 bp, Homo sapiens
tgaggaagcgtcctgag

SEQ ID NO: 42923 - DNA, 23 bp, Homo sapiens
tgaggaagcagaggccctgggag

SEQ ID NO: 42924 - DNA, 21 bp, Homo sapiens
tgaggaaacaccacttaagag

SEQ ID NO: 42925 - DNA, 19 bp, Homo sapiens
tggggaagcatcttccaag

SEQ ID NO: 42926 - DNA, 24 bp, Homo sapiens
tggggaaggcaatggggtcctgag

SEQ ID NO: 42927 - DNA, 25 bp, Homo sapiens
tgggaagcatggtacctcctaggag

SEQ ID NO: 42928 - DNA, 21 bp, Homo sapiens
tgaggaagagtctcctctgag

SEQ ID NO: 42929 - DNA, 18 bp, Homo sapiens
tggggaagggtttcaaga

SEQ ID NO: 42930 - DNA, 21 bp, Homo sapiens
tgagaaagcaagcctcttaag

SEQ ID NO: 42931 - DNA, 20 bp, Homo sapiens
aggaagcatcaggataggag

SEQ ID NO: 42932 - DNA, 22 bp, Homo sapiens
tgaggaaggtcacagttaagag

SEQ ID NO: 42933 - DNA, 22 bp, Homo sapiens
tggggaggcatctggctctcag

SEQ ID NO: 42934 - DNA, 22 bp, Homo sapiens
tgaggaagttttgggcctggag

SEQ ID NO: 42935 - DNA, 22 bp, Homo sapiens
tgaggcagcacctgcctgggag

SEQ ID NO: 42936 - DNA, 18 bp, Homo sapiens
tgaggaagcaagagtcct

SEQ ID NO: 42937 - DNA, 60 bp, Saimiriine herpesvirus 2
tggtttagagctaaatttgtgaactctttaagaaaactttacaaaatcagctcatctcca

SEQ ID NO: 42938 - DNA, 24 bp, Saimiriine herpesvirus 2
tagagctaaatttgtgaactcttt

SEQ ID NO: 42939 - DNA, 21 bp, Homo sapiens
agagctaaaaaagagctcttt

SEQ ID NO: 42940 - DNA, 24 bp, Homo sapiens
tagagccagggcacaaaactcttt

SEQ ID NO: 42941 - DNA, 21 bp, Homo sapiens
tagagtgggtgtgaactcttt

SEQ ID NO: 42942 - DNA, 16 bp, Homo sapiens
gagctaaatctcaact

SEQ ID NO: 42943 - DNA, 20 bp, Homo sapiens
gagctaaactgaaactcttt

SEQ ID NO: 42944 - DNA, 19 bp, Homo sapiens
tagagccaaagaagctctt

SEQ ID NO: 42945 - DNA, 20 bp, Homo sapiens
cagagctaggtctgttcttt

SEQ ID NO: 42946 - DNA, 21 bp, Homo sapiens
tagagctagatttctgtcttt

SEQ ID NO: 42947 - DNA, 18 bp, Homo sapiens
tagggctatgaaactctt

SEQ ID NO: 42948 - DNA, 91 bp, Saimiriine herpesvirus 2
acctgaaaattggattgataacaaagagttaaagttctgttactgtacaaaaaaactaggatttagaattatcactcctttgcctgcaggt

SEQ ID NO: 42949 - DNA, 24 bp, Saimiriine herpesvirus 2
tggattgataacaaagagttaaag

SEQ ID NO: 42950 - DNA, 23 bp, Homo sapiens
tgaattgatgactcctgttaaag

SEQ ID NO: 42951 - DNA, 19 bp, Homo sapiens
tggattgatatggaggcaa

SEQ ID NO: 42952 - DNA, 18 bp, Homo sapiens
tggattgatacaaagtag

SEQ ID NO: 42953 - DNA, 17 bp, Homo sapiens
tggattggtaagaatca

SEQ ID NO: 42954 - DNA, 19 bp, Homo sapiens
tggattgatagcaacaaag

SEQ ID NO: 42955 - DNA, 21 bp, Homo sapiens
tggactgataacaatatagaa

SEQ ID NO: 42956 - DNA, 18 bp, Homo sapiens
tggatggattagagttaa

SEQ ID NO: 42957 - DNA, 23 bp, Homo sapiens
tggaggagcacaaagagttaaag

SEQ ID NO: 42958 - DNA, 17 bp, Homo sapiens
tggattgtaacaaaagc

SEQ ID NO: 42959 - DNA, 18 bp, Homo sapiens
tagattgataataaaaag

SEQ ID NO: 42960 - DNA, 17 bp, Homo sapiens
tggatgataacaataaa

SEQ ID NO: 42961 - DNA, 104 bp, Human herpesvirus 8
gtgcagagaaacgactcgcgagtagcgtgtttgacctggagacgatgttcagggagtacaactactacacacatcgtctcgcgggtttgcgcgaggatctggac

SEQ ID NO: 42962 - DNA, 24 bp, Human herpesvirus 8
tcgcgggtttgcgcgaggatctgg

SEQ ID NO: 42963 - DNA, 18 bp, Homo sapiens
gcaggcgtggggatctgg

SEQ ID NO: 42964 - DNA, 15 bp, Homo sapiens
cgcgggttaggatct

SEQ ID NO: 42965 - DNA, 17 bp, Homo sapiens
tctggggcgaggatttg

SEQ ID NO: 42966 - DNA, 18 bp, Homo sapiens
tctcgggtttggaactgg

SEQ ID NO: 42967 - DNA, 21 bp, Homo sapiens
gcgggtctgtgcacactctgg

SEQ ID NO: 42968 - DNA, 67 bp, Human herpesvirus 8
gaggcagaaggcggatgatctgaaaaaaagtacaccctcggtgtttcagcgtaccgcaaacggcctt

SEQ ID NO: 42969 - DNA, 24 bp, Human herpesvirus 8
tgtttcagcgtaccgcaaacggcc

SEQ ID NO: 42970 - DNA, 24 bp, Homo sapiens
tgtttcagcttagtacaaggtggc

SEQ ID NO: 42971 - DNA, 20 bp, Homo sapiens
tgtttcattttccaaacggc

SEQ ID NO: 42972 - DNA, 22 bp, Homo sapiens
tttcagcgcgcatgtgggtggc

SEQ ID NO: 42973 - DNA, 21 bp, Homo sapiens
tgtttcagctgtattgcaggc

SEQ ID NO: 42974 - DNA, 22 bp, Homo sapiens
tgtttcagcatgtctctgggcc

SEQ ID NO: 42975 - DNA, 78 bp, Saimiriine herpesvirus 2
gaagatttaaatggtttattagaccttgctgctattgattcaacattcaatgtagataatctaaaagactgtgtcttc

SEQ ID NO: 42976 - DNA, 24 bp, Saimiriine herpesvirus 2
taaatggtttattagaccttgctg

SEQ ID NO: 42977 - DNA, 20 bp, Homo sapiens
tggccgcagggaccttgctg

SEQ ID NO: 42978 - DNA, 22 bp, Homo sapiens
atggtgtatgggggccttgctg

SEQ ID NO: 42979 - DNA, 19 bp, Homo sapiens
ggctggcagggccttgctg

SEQ ID NO: 42980 - DNA, 26 bp, Homo sapiens
taaatggctttgagcagtttttgctg

SEQ ID NO: 42981 - DNA, 21 bp, Homo sapiens
taagtggtttattgagagctg

SEQ ID NO: 42982 - DNA, 19 bp, Homo sapiens
atggtttatatgcaccttg

SEQ ID NO: 42983 - DNA, 22 bp, Homo sapiens
tgatggtttcccttccttgctg

SEQ ID NO: 42984 - DNA, 19 bp, Homo sapiens
atggctgtgtaccttgctg

SEQ ID NO: 42985 - DNA, 17 bp, Homo sapiens
atggttcattagccctg

SEQ ID NO: 42986 - DNA, 71 bp, Human herpesvirus 8
ctgaacacttttatcgccctgaatctatcctttattcaaaacatagacttcaaggccatcgagctgtacag

SEQ ID NO: 42987 - DNA, 24 bp, Human herpesvirus 8
tatcgccctgaatctatcctttat

SEQ ID NO: 42988 - DNA, 18 bp, Homo sapiens
gccatgaaattcctttat

SEQ ID NO: 42989 - DNA, 19 bp, Homo sapiens
ctaaaagtttatcctttat

SEQ ID NO: 42990 - DNA, 97 bp, Human herpesvirus 6B
tcgccccgaaaccgcaacgcggcagagtcggcgccacacccccgtcccccgagttcgcgatgggctggcgccgaccctgccgcggcaacgaaggcga

SEQ ID NO: 42991 - DNA, 24 bp, Human herpesvirus 6B
tgggctggcgccgaccctgccgcg

SEQ ID NO: 42992 - DNA, 21 bp, Homo sapiens
tgggctgctcgctgcctgccg

SEQ ID NO: 42993 - DNA, 17 bp, Homo sapiens
tgggctggcccgaccct

SEQ ID NO: 42994 - DNA, 18 bp, Homo sapiens
tgggctggttgatgccgc

SEQ ID NO: 42995 - DNA, 17 bp, Homo sapiens
tgggctggcgctgctca

SEQ ID NO: 42996 - DNA, 20 bp, Homo sapiens
tgggccggcgccgcaccgtg

SEQ ID NO: 42997 - DNA, 18 bp, Homo sapiens
tgggctggctcggccttg

SEQ ID NO: 42998 - DNA, 19 bp, Homo sapiens
tgggctgggcgccggctcg

SEQ ID NO: 42999 - DNA, 21 bp, Homo sapiens
tgggttgccggggttgccgcg

SEQ ID NO: 43000 - DNA, 19 bp, Homo sapiens
tgggctgggccatgcttgc

SEQ ID NO: 43001 - DNA, 19 bp, Homo sapiens
tgggctggcgctgagcctg

SEQ ID NO: 43002 - DNA, 18 bp, Homo sapiens
tgggctggcgtctcctgc

SEQ ID NO: 43003 - DNA, 22 bp, Homo sapiens
ggctggcgccgaccccaccccg

SEQ ID NO: 43004 - DNA, 16 bp, Homo sapiens
tgggctggcactgccc

SEQ ID NO: 43005 - DNA, 18 bp, Homo sapiens
tgggctggtccccgccgc

SEQ ID NO: 43006 - DNA, 19 bp, Homo sapiens
tgggctggcggccggtctg

SEQ ID NO: 43007 - DNA, 16 bp, Homo sapiens
tgggctgacctcctgc

SEQ ID NO: 43008 - DNA, 23 bp, Homo sapiens
tgggctggcctggtctcctagcg

SEQ ID NO: 43009 - DNA, 19 bp, Homo sapiens
tgggctggtgcggagctgc

SEQ ID NO: 43010 - DNA, 16 bp, Homo sapiens
ggctgcggccctgccg

SEQ ID NO: 43011 - DNA, 20 bp, Homo sapiens
tgggctggtgttgagtgcca

SEQ ID NO: 43012 - DNA, 22 bp, Homo sapiens
tgggctggcggcggggagcgcg

SEQ ID NO: 43013 - DNA, 17 bp, Homo sapiens
gggtactggccctgccg

SEQ ID NO: 43014 - DNA, 20 bp, Homo sapiens
tgggctggtgcggtgcccgc

SEQ ID NO: 43015 - DNA, 15 bp, Homo sapiens
tgggctggccctggc

SEQ ID NO: 43016 - DNA, 126 bp, Human herpesvirus 6B
ccccgccctcatcccctgacacacccggtggaaaaaacgaaagacacataaataaaacgaattttgttgttaaaaatgtttccacgtgacgtccccggtgattcccggagatgcggcacgcggcgg

SEQ ID NO: 43017 - DNA, 24 bp, Human herpesvirus 6B
acccggtggaaaaaacgaaagaca

SEQ ID NO: 43018 - DNA, 18 bp, Homo sapiens
ggttcaaaaatgaaagac

SEQ ID NO: 43019 - DNA, 20 bp, Homo sapiens
caatggaaaggtgaaagaca

SEQ ID NO: 43020 - DNA, 16 bp, Homo sapiens
cggtggaagcgaagac

SEQ ID NO: 43021 - DNA, 15 bp, Homo sapiens
ggggaaaaacaaaga

SEQ ID NO: 43022 - DNA, 15 bp, Homo sapiens
acccagtggagaaag

SEQ ID NO: 43023 - DNA, 15 bp, Homo sapiens
cccggtagagaagac

SEQ ID NO: 43024 - DNA, 16 bp, Homo sapiens
cccgtggaaaaacgaa

SEQ ID NO: 43025 - DNA, 16 bp, Homo sapiens
cctggggaaaaaagaa

SEQ ID NO: 43026 - DNA, 23 bp, Homo sapiens
ccaggtggaaagaacatctaaca

SEQ ID NO: 43027 - DNA, 24 bp, Homo sapiens
acccagtgggagaaaaactgaaga

SEQ ID NO: 43028 - DNA, 16 bp, Homo sapiens
ccagtggagaagagac

SEQ ID NO: 43029 - DNA, 18 bp, Homo sapiens
ccagaagagtgaaagaca

SEQ ID NO: 43030 - DNA, 21 bp, Homo sapiens
ccaacaaaaaaatgaaagaca

SEQ ID NO: 43031 - DNA, 20 bp, Homo sapiens
cctggtggaaaacaaaatga

SEQ ID NO: 43032 - DNA, 18 bp, Homo sapiens
gatggaaagtggaagaca

SEQ ID NO: 43033 - DNA, 18 bp, Homo sapiens
ggtggaaatcaaaagaca

SEQ ID NO: 43034 - DNA, 24 bp, Homo sapiens
acccggtggagcagctgactggac

SEQ ID NO: 43035 - DNA, 20 bp, Homo sapiens
acctggtgaaaaggttaacg

SEQ ID NO: 43036 - DNA, 22 bp, Homo sapiens
acccagtggagcatggaagaca

SEQ ID NO: 43037 - DNA, 18 bp, Homo sapiens
actcggtggaaagcagac

SEQ ID NO: 43038 - DNA, 25 bp, Homo sapiens
acccgatggagaatcgaggaagaca

SEQ ID NO: 43039 - DNA, 23 bp, Homo sapiens
cctgtggaaaagggaagtggaca

SEQ ID NO: 43040 - DNA, 20 bp, Homo sapiens
cccagggaaagtgaaagaca

SEQ ID NO: 43041 - DNA, 20 bp, Homo sapiens
cctcctagaagtgaaagaca

SEQ ID NO: 43042 - DNA, 18 bp, Homo sapiens
acccagtggagaagaaag

SEQ ID NO: 43043 - DNA, 18 bp, Homo sapiens
actcagtggaaagaaaca

SEQ ID NO: 43044 - DNA, 17 bp, Homo sapiens
cagtggaaaatgaaaga

SEQ ID NO: 43045 - DNA, 18 bp, Homo sapiens
acccagtggaaagaagaa

SEQ ID NO: 43046 - DNA, 17 bp, Homo sapiens
ccggtggaatgaaggac

SEQ ID NO: 43047 - DNA, 22 bp, Homo sapiens
cccagcaaaagaagcgaaggac

SEQ ID NO: 43048 - DNA, 69 bp, Infectious pancreatic necrosis virus
tggactcatgggccagcgggtccgaggcaggaagctattcaaagcacctcaagacccggcttgagtcca

SEQ ID NO: 43049 - DNA, 24 bp, Infectious pancreatic necrosis virus
cacctcaagacccggcttgagtcc

SEQ ID NO: 43050 - DNA, 18 bp, Homo sapiens
cacccaagtccttgggtc

SEQ ID NO: 43051 - DNA, 17 bp, Homo sapiens
cctcagattcttaagtc

SEQ ID NO: 43052 - DNA, 21 bp, Homo sapiens
cagctcaaggcgttactgagt

SEQ ID NO: 43053 - DNA, 15 bp, Homo sapiens
ctcaaacccggagtc

SEQ ID NO: 43054 - DNA, 15 bp, Homo sapiens
cacctcaggcctgag

SEQ ID NO: 43055 - DNA, 19 bp, Homo sapiens
ccttaggactcctgagtcc

SEQ ID NO: 43056 - DNA, 17 bp, Homo sapiens
cctcagggcttgaggtc

SEQ ID NO: 43057 - DNA, 20 bp, Homo sapiens
cacctcaaggccagcagagt

SEQ ID NO: 43058 - DNA, 17 bp, Homo sapiens
cacctcaaaggcctggc

SEQ ID NO: 43059 - DNA, 17 bp, Homo sapiens
cccaagaccctctgggt

SEQ ID NO: 43060 - DNA, 17 bp, Homo sapiens
ccttcagggcccgagtc

SEQ ID NO: 43061 - DNA, 16 bp, Homo sapiens
cacctaaggactgagt

SEQ ID NO: 43062 - DNA, 17 bp, Homo sapiens
cctcaagacctggagtc

SEQ ID NO: 43063 - DNA, 18 bp, Homo sapiens
cacctcaaggcccaagtc

SEQ ID NO: 43064 - DNA, 20 bp, Homo sapiens
cacctcaaggatcctgggtc

SEQ ID NO: 43065 - DNA, 16 bp, Homo sapiens
cacctcaaagttgggt

SEQ ID NO: 43066 - DNA, 19 bp, Homo sapiens
cctcaagcctgggtggtcc

SEQ ID NO: 43067 - DNA, 20 bp, Homo sapiens
tcacaggtcctcctgagtcc

SEQ ID NO: 43068 - DNA, 23 bp, Homo sapiens
caccactgagttggtttgagtcc

SEQ ID NO: 43069 - DNA, 21 bp, Homo sapiens
ctcaagactgggccacatatc

SEQ ID NO: 43070 - DNA, 18 bp, Homo sapiens
tcaagcataacttgagtc

SEQ ID NO: 43071 - DNA, 17 bp, Homo sapiens
cacctcagggctgagtc

SEQ ID NO: 43072 - DNA, 19 bp, Homo sapiens
cctcaagactcaaaagtcc

SEQ ID NO: 43073 - DNA, 15 bp, Homo sapiens
ctcaaagcttgagtc

SEQ ID NO: 43074 - DNA, 18 bp, Homo sapiens
acctcaagacacaatggt

SEQ ID NO: 43075 - DNA, 25 bp, Homo sapiens
cacctcggggacccaaaaggagtcc

SEQ ID NO: 43076 - DNA, 20 bp, Homo sapiens
acctcaagaatccagaagtc

SEQ ID NO: 43077 - DNA, 18 bp, Homo sapiens
cacccaagcccttgggtc

SEQ ID NO: 43078 - DNA, 21 bp, Homo sapiens
caactcaagatcctccaagtc

SEQ ID NO: 43079 - DNA, 17 bp, Homo sapiens
cctgaagacactgagtc

SEQ ID NO: 43080 - DNA, 20 bp, Homo sapiens
cacttctagatcacctgagt

SEQ ID NO: 43081 - DNA, 23 bp, Homo sapiens
cactcttgggactcgggtcgtcc

SEQ ID NO: 43082 - DNA, 19 bp, Homo sapiens
ctcaagaccaccttgggtc

SEQ ID NO: 43083 - DNA, 16 bp, Homo sapiens
cacttcaaacccaggt

SEQ ID NO: 43084 - DNA, 19 bp, Homo sapiens
tcaagattctcctgagtcc

SEQ ID NO: 43085 - DNA, 16 bp, Homo sapiens
ctcagaggcttgagtc

SEQ ID NO: 43086 - DNA, 21 bp, Homo sapiens
cacctcaagcctgtggggtcc

SEQ ID NO: 43087 - DNA, 18 bp, Homo sapiens
cacctcaaggcccgaccc

SEQ ID NO: 43088 - DNA, 20 bp, Homo sapiens
acttcaaatccatcaagtcc

SEQ ID NO: 43089 - DNA, 19 bp, Homo sapiens
cacccaagactaaagagtc

SEQ ID NO: 43090 - DNA, 16 bp, Homo sapiens
cacctagagacctgag

SEQ ID NO: 43091 - DNA, 17 bp, Homo sapiens
ctcaagactaggaaatc

SEQ ID NO: 43092 - DNA, 18 bp, Homo sapiens
cctctcagaagcttgagt

SEQ ID NO: 43093 - DNA, 19 bp, Homo sapiens
ctcaaacctggagcaatcc

SEQ ID NO: 43094 - DNA, 20 bp, Homo sapiens
cacctcaaagcccgagagtc

SEQ ID NO: 43095 - DNA, 20 bp, Homo sapiens
caccttaaggaccccaagtc

SEQ ID NO: 43096 - DNA, 25 bp, Homo sapiens
cacctcaaagcttggccctgtgtcc

SEQ ID NO: 43097 - DNA, 19 bp, Homo sapiens
cagctcaaggcttgttgtc

SEQ ID NO: 43098 - DNA, 16 bp, Homo sapiens
cctccgaggccgagtc

SEQ ID NO: 43099 - DNA, 22 bp, Homo sapiens
acctcaaggccaggcttgggtc

SEQ ID NO: 43100 - DNA, 20 bp, Homo sapiens
cacctcaagattggtgtgtc

SEQ ID NO: 43101 - DNA, 24 bp, Homo sapiens
caccccggggcctaaactcgagtc

SEQ ID NO: 43102 - DNA, 18 bp, Homo sapiens
caccttgagccccggcct

SEQ ID NO: 43103 - DNA, 24 bp, Homo sapiens
caccttcagacctgagttgggtcc

SEQ ID NO: 43104 - DNA, 18 bp, Homo sapiens
acctcagcaccttgagtc

SEQ ID NO: 43105 - DNA, 19 bp, Homo sapiens
cactcaagccgtttgagtc

SEQ ID NO: 43106 - DNA, 20 bp, Homo sapiens
ctcaagacctcacagggtcc

SEQ ID NO: 43107 - DNA, 19 bp, Homo sapiens
cacccaagactgttgggtc

SEQ ID NO: 43108 - DNA, 61 bp, Infectious pancreatic necrosis virus
ggtgaggccttcgggtcgctcgtggtagtaataccagaagcgtacccggaacttcttgacc

SEQ ID NO: 43109 - DNA, 24 bp, Infectious pancreatic necrosis virus
aagcgtacccggaacttcttgacc

SEQ ID NO: 43110 - DNA, 21 bp, Homo sapiens
gcgtcatagtccttcttgacc

SEQ ID NO: 43111 - DNA, 22 bp, Homo sapiens
aagtgtacccggagctgaaacc

SEQ ID NO: 43112 - DNA, 18 bp, Homo sapiens
aagcgtgtaattcttgac

SEQ ID NO: 43113 - DNA, 19 bp, Homo sapiens
agggtcctggaacttcttg

SEQ ID NO: 43114 - DNA, 19 bp, Homo sapiens
aagtgtccccactcttgac

SEQ ID NO: 43115 - DNA, 23 bp, Homo sapiens
aagcatacttcatctctttttga

SEQ ID NO: 43116 - DNA, 20 bp, Homo sapiens
agggtacccggggcttggcc

SEQ ID NO: 43117 - DNA, 21 bp, Homo sapiens
aagtgtcctaaccatcttgac

SEQ ID NO: 43118 - DNA, 98 bp, Melanoplus sanguinipes entomopoxvirus
ttgtaataataatggaactatatcttttgatatttcttttctaatactggtatttggtataatatattttaaatctatagtttttttatttattacaa

SEQ ID NO: 43119 - DNA, 24 bp, Melanoplus sanguinipes entomopoxvirus
tctatagtttttttatttattaca

SEQ ID NO: 43120 - DNA, 20 bp, Homo sapiens
ctaccattttatttattaca

SEQ ID NO: 43121 - DNA, 24 bp, Homo sapiens
tctaatagtttttttaattttaca

SEQ ID NO: 43122 - DNA, 20 bp, Homo sapiens
tctatatttttttcatttac

SEQ ID NO: 43123 - DNA, 21 bp, Homo sapiens
catagttcatagtttattaca

SEQ ID NO: 43124 - DNA, 18 bp, Homo sapiens
tctatggttttctcactt

SEQ ID NO: 43125 - DNA, 22 bp, Homo sapiens
tataatttagaaatttattaca

SEQ ID NO: 43126 - DNA, 18 bp, Homo sapiens
tctgtagttcttttactt

SEQ ID NO: 43127 - DNA, 69 bp, Melanoplus sanguinipes entomopoxvirus
acattcatttgtaaaattttttaatttatttctaaaattatttccaacatcatcaaatataatgagtgt

SEQ ID NO: 43128 - DNA, 24 bp, Melanoplus sanguinipes entomopoxvirus
tcatttgtaaaattttttaattta

SEQ ID NO: 43129 - DNA, 18 bp, Homo sapiens
tcatctgtaaaatttttc

SEQ ID NO: 43130 - DNA, 18 bp, Homo sapiens
tcatttgtaaggtttctc

SEQ ID NO: 43131 - DNA, 60 bp, Infectious pancreatic necrosis virus
gaggaacggaaacatcgtggtggagaaaatattcgctggccccgcgatgggaccgtcctc

SEQ ID NO: 43132 - DNA, 24 bp, Infectious pancreatic necrosis virus
acggaaacatcgtggtggagaaaa

SEQ ID NO: 43133 - DNA, 18 bp, Homo sapiens
ggagatggcgttgaagaa

SEQ ID NO: 43134 - DNA, 22 bp, Homo sapiens
ggaaagggagatgtggggagaa

SEQ ID NO: 43135 - DNA, 18 bp, Homo sapiens
ggaacacagtgggggaaa

SEQ ID NO: 43136 - DNA, 19 bp, Homo sapiens
acgggcacagtggggagaa

SEQ ID NO: 43137 - DNA, 18 bp, Homo sapiens
gaaacatcctaagaggaa

SEQ ID NO: 43138 - DNA, 20 bp, Homo sapiens
ggaaacatggcaaaagaaga

SEQ ID NO: 43139 - DNA, 20 bp, Homo sapiens
cggaagtttgtgaatgaaga

SEQ ID NO: 43140 - DNA, 17 bp, Homo sapiens
acagagttggtggagaa

SEQ ID NO: 43141 - DNA, 18 bp, Homo sapiens
cggaagcgctgtggggaa

SEQ ID NO: 43142 - DNA, 20 bp, Homo sapiens
ggaaacaatgccagggagaa

SEQ ID NO: 43143 - DNA, 19 bp, Homo sapiens
ggaaaaatcggcctggaga

SEQ ID NO: 43144 - DNA, 20 bp, Homo sapiens
acgaagacataatggaggag

SEQ ID NO: 43145 - DNA, 17 bp, Homo sapiens
ggaacgtggtgggggaa

SEQ ID NO: 43146 - DNA, 20 bp, Homo sapiens
cagagacccagcaggtggag

SEQ ID NO: 43147 - DNA, 23 bp, Homo sapiens
acagaaatgtttctcagaggaga

SEQ ID NO: 43148 - DNA, 19 bp, Homo sapiens
acagaaatatgaggaggaa

SEQ ID NO: 43149 - DNA, 19 bp, Homo sapiens
gaaatgtccacggaggaga

SEQ ID NO: 43150 - DNA, 17 bp, Homo sapiens
ggaggcgcgtggagaaa

SEQ ID NO: 43151 - DNA, 17 bp, Homo sapiens
cggctgtggtggagaaa

SEQ ID NO: 43152 - DNA, 16 bp, Homo sapiens
ggaaatcatgaaggag

SEQ ID NO: 43153 - DNA, 21 bp, Homo sapiens
ggaaacgtccgtggtcaggag

SEQ ID NO: 43154 - DNA, 20 bp, Homo sapiens
acggggacgtagcgggggaa

SEQ ID NO: 43155 - DNA, 18 bp, Homo sapiens
ggaaacattatttgaaaa

SEQ ID NO: 43156 - DNA, 20 bp, Homo sapiens
ggagcgaccctggtggagaa

SEQ ID NO: 43157 - DNA, 17 bp, Homo sapiens
cagaaatagtggggaaa

SEQ ID NO: 43158 - DNA, 20 bp, Homo sapiens
ggaaatattttgaatggaaa

SEQ ID NO: 43159 - DNA, 17 bp, Homo sapiens
ggaaacatcagaagaaa

SEQ ID NO: 43160 - DNA, 20 bp, Homo sapiens
ggagacacgttcagggaaga

SEQ ID NO: 43161 - DNA, 17 bp, Homo sapiens
ggaacagaatggagaaa

SEQ ID NO: 43162 - DNA, 17 bp, Homo sapiens
cagagacaatggagaaa

SEQ ID NO: 43163 - DNA, 21 bp, Homo sapiens
ggaaatattgatgacaggaga

SEQ ID NO: 43164 - DNA, 18 bp, Homo sapiens
ggaaacacgagtggaaaa

SEQ ID NO: 43165 - DNA, 21 bp, Homo sapiens
agatctcattgtggtggagaa

SEQ ID NO: 43166 - DNA, 18 bp, Homo sapiens
cggaacacaatggagaga

SEQ ID NO: 43167 - DNA, 17 bp, Homo sapiens
ggaaacatcagggaaaa

SEQ ID NO: 43168 - DNA, 22 bp, Homo sapiens
acagaagcaagtttggggaaaa

SEQ ID NO: 43169 - DNA, 21 bp, Homo sapiens
ggaggtcatcttgggagaaaa

SEQ ID NO: 43170 - DNA, 18 bp, Homo sapiens
gggaaccggtggagaaaa

SEQ ID NO: 43171 - DNA, 18 bp, Homo sapiens
cggaggcgcggcgggaga

SEQ ID NO: 43172 - DNA, 18 bp, Homo sapiens
acggaagattagggaaaa

SEQ ID NO: 43173 - DNA, 21 bp, Homo sapiens
acagaagcattgcagagaaga

SEQ ID NO: 43174 - DNA, 21 bp, Homo sapiens
acgtgaagcccatgtggagaa

SEQ ID NO: 43175 - DNA, 16 bp, Homo sapiens
ggaaatgctggagaaa

SEQ ID NO: 43176 - DNA, 16 bp, Homo sapiens
ggaaacatgtgtggag

SEQ ID NO: 43177 - DNA, 19 bp, Homo sapiens
ggagacctctgggtggaga

SEQ ID NO: 43178 - DNA, 17 bp, Homo sapiens
ggaaacatctggagaga

SEQ ID NO: 43179 - DNA, 22 bp, Homo sapiens
ggaaacatagtgcagatgagaa

SEQ ID NO: 43180 - DNA, 20 bp, Homo sapiens
gaaaacagtagtggtgggga

SEQ ID NO: 43181 - DNA, 21 bp, Homo sapiens
ggagacgtcggtgttgttgaa

SEQ ID NO: 43182 - DNA, 19 bp, Homo sapiens
ggaactatcgttgtaagag

SEQ ID NO: 43183 - DNA, 16 bp, Homo sapiens
ggaaacatagagagaa

SEQ ID NO: 43184 - DNA, 19 bp, Homo sapiens
ggaaacattgtagaggaga

SEQ ID NO: 43185 - DNA, 19 bp, Homo sapiens
acggaaccaaattggggag

SEQ ID NO: 43186 - DNA, 18 bp, Homo sapiens
ggaacacggagtggagaa

SEQ ID NO: 43187 - DNA, 21 bp, Homo sapiens
ggggacatgcacgatggagaa

SEQ ID NO: 43188 - DNA, 18 bp, Homo sapiens
ggaaacatcttaggggaa

SEQ ID NO: 43189 - DNA, 18 bp, Homo sapiens
ggatacatgacggggaaa

SEQ ID NO: 43190 - DNA, 15 bp, Homo sapiens
ggaaacaatggggaa

SEQ ID NO: 43191 - DNA, 20 bp, Homo sapiens
ggaaggttccgtggtgggga

SEQ ID NO: 43192 - DNA, 18 bp, Homo sapiens
cggcaacatcgtgtaaaa

SEQ ID NO: 43193 - DNA, 16 bp, Homo sapiens
gggaacatcggtagaa

SEQ ID NO: 43194 - DNA, 20 bp, Homo sapiens
ggaaattccccaggaggaga

SEQ ID NO: 43195 - DNA, 19 bp, Homo sapiens
ggagacaaagatggggaga

SEQ ID NO: 43196 - DNA, 17 bp, Homo sapiens
ggaaacacctagaggaa

SEQ ID NO: 43197 - DNA, 20 bp, Homo sapiens
ggaaacaaaaatggggaaga

SEQ ID NO: 43198 - DNA, 19 bp, Homo sapiens
ggaaatatgcaaggaggag

SEQ ID NO: 43199 - DNA, 19 bp, Homo sapiens
acggaggcagcggacggaa

SEQ ID NO: 43200 - DNA, 23 bp, Homo sapiens
ggaaacagcatattaggagaaaa

SEQ ID NO: 43201 - DNA, 19 bp, Homo sapiens
ggatatatcagggagaaaa

SEQ ID NO: 43202 - DNA, 23 bp, Homo sapiens
actgaaatgattggtggagaaaa

SEQ ID NO: 43203 - DNA, 20 bp, Homo sapiens
cagaggacaagggtggagaa

SEQ ID NO: 43204 - DNA, 20 bp, Homo sapiens
ggaaatacagaaggagaaaa

SEQ ID NO: 43205 - DNA, 18 bp, Homo sapiens
gaaacggcatgggggaga

SEQ ID NO: 43206 - DNA, 16 bp, Homo sapiens
ggaaacactggggaga

SEQ ID NO: 43207 - DNA, 20 bp, Homo sapiens
gggaacacgttgatggaaaa

SEQ ID NO: 43208 - DNA, 20 bp, Homo sapiens
ggaaacattagtgctggaga

SEQ ID NO: 43209 - DNA, 18 bp, Homo sapiens
ggaggtcgtggtagtaga

SEQ ID NO: 43210 - DNA, 19 bp, Homo sapiens
ggagacatcgtagggggaa

SEQ ID NO: 43211 - DNA, 18 bp, Homo sapiens
ggagacgccggcgggaaa

SEQ ID NO: 43212 - DNA, 17 bp, Homo sapiens
gggaactagcggagaaa

SEQ ID NO: 43213 - DNA, 22 bp, Homo sapiens
acaggggtggcgtggtggggaa

SEQ ID NO: 43214 - DNA, 23 bp, Homo sapiens
agaaatgttcagcctggagaaaa

SEQ ID NO: 43215 - DNA, 19 bp, Homo sapiens
ggagacagaagtggagaaa

SEQ ID NO: 43216 - DNA, 24 bp, Homo sapiens
acagaaatatcggtaaaaaggaga

SEQ ID NO: 43217 - DNA, 22 bp, Homo sapiens
ggaacattgactacagggagaa

SEQ ID NO: 43218 - DNA, 16 bp, Homo sapiens
ggaacgtggacggaga

SEQ ID NO: 43219 - DNA, 19 bp, Homo sapiens
ggaaacattagcgggagag

SEQ ID NO: 43220 - DNA, 17 bp, Homo sapiens
ggatacactggtggaga

SEQ ID NO: 43221 - DNA, 16 bp, Homo sapiens
ggaaaggtcagagaaa

SEQ ID NO: 43222 - DNA, 19 bp, Homo sapiens
ggaaacatgttgggagaga

SEQ ID NO: 43223 - DNA, 21 bp, Homo sapiens
ggagacgtctgacaaagaaaa

SEQ ID NO: 43224 - DNA, 17 bp, Homo sapiens
gaaaacaccctggagag

SEQ ID NO: 43225 - DNA, 21 bp, Homo sapiens
ggaagtcgagcactggggaaa

SEQ ID NO: 43226 - DNA, 19 bp, Homo sapiens
ggaagcctcgggtggagaa

SEQ ID NO: 43227 - DNA, 22 bp, Homo sapiens
acagaaacaaacgtggggaaaa

SEQ ID NO: 43228 - DNA, 22 bp, Homo sapiens
acgggcactagaaggtggagaa

SEQ ID NO: 43229 - DNA, 20 bp, Homo sapiens
acagggtaccctggtggaga

SEQ ID NO: 43230 - DNA, 19 bp, Homo sapiens
ggacacatcgctaagggga

SEQ ID NO: 43231 - DNA, 21 bp, Homo sapiens
acagagacattgggtctggag

SEQ ID NO: 43232 - DNA, 19 bp, Homo sapiens
ggaggagcaggtggagaaa

SEQ ID NO: 43233 - DNA, 20 bp, Homo sapiens
tgagacccacaggtggagaa

SEQ ID NO: 43234 - DNA, 22 bp, Homo sapiens
ggaaacattgtggtgtgcaaaa

SEQ ID NO: 43235 - DNA, 17 bp, Homo sapiens
tgagaattctagtggag

SEQ ID NO: 43236 - DNA, 19 bp, Homo sapiens
cggaaacgcgtgtgccagg

SEQ ID NO: 43237 - DNA, 23 bp, Homo sapiens
ggaaacacactttgtggggaaaa

SEQ ID NO: 43238 - DNA, 16 bp, Homo sapiens
ggaaatcatggagaag

SEQ ID NO: 43239 - DNA, 18 bp, Homo sapiens
ggtggtcatgtggagaaa

SEQ ID NO: 43240 - DNA, 19 bp, Homo sapiens
gggcatcgcaggcggggaa

SEQ ID NO: 43241 - DNA, 21 bp, Homo sapiens
ggaagcatctagaatggagaa

SEQ ID NO: 43242 - DNA, 27 bp, Homo sapiens
acggcaggcatcgtccgcgcgggggag

SEQ ID NO: 43243 - DNA, 18 bp, Homo sapiens
gggcgcacggatggagaa

SEQ ID NO: 43244 - DNA, 19 bp, Homo sapiens
gaaacatcagcagagaaaa

SEQ ID NO: 43245 - DNA, 17 bp, Homo sapiens
acggagacgtgatgaag

SEQ ID NO: 43246 - DNA, 18 bp, Homo sapiens
ggaaatatgcagtgggaa

SEQ ID NO: 43247 - DNA, 19 bp, Homo sapiens
ggaaaatcgtgtcaggaaa

SEQ ID NO: 43248 - DNA, 23 bp, Homo sapiens
ggcagacatcaggaaggaggaga

SEQ ID NO: 43249 - DNA, 18 bp, Homo sapiens
gaaaacaccatggggaga

SEQ ID NO: 43250 - DNA, 20 bp, Homo sapiens
cgaaggcacagtggaggaaa

SEQ ID NO: 43251 - DNA, 22 bp, Homo sapiens
agaaatgttcgcacaggggaaa

SEQ ID NO: 43252 - DNA, 20 bp, Homo sapiens
ggaggcacgcgatgagggag

SEQ ID NO: 43253 - DNA, 18 bp, Homo sapiens
ggaaacatgtttagaaaa

SEQ ID NO: 43254 - DNA, 18 bp, Homo sapiens
ggaaaccccgtggggaga

SEQ ID NO: 43255 - DNA, 17 bp, Homo sapiens
ggagacaatgaagagaa

SEQ ID NO: 43256 - DNA, 15 bp, Homo sapiens
ggaaacactggggag

SEQ ID NO: 43257 - DNA, 18 bp, Homo sapiens
cagaaacaggtttggaga

SEQ ID NO: 43258 - DNA, 21 bp, Homo sapiens
ggaagttcaaatgtgagaaaa

SEQ ID NO: 43259 - DNA, 21 bp, Homo sapiens
ggaaacagagagtgggggaga

SEQ ID NO: 43260 - DNA, 24 bp, Homo sapiens
acgggacatcgtggccgtgcgaag

SEQ ID NO: 43261 - DNA, 19 bp, Homo sapiens
acgggaaggtcgtggggga

SEQ ID NO: 43262 - DNA, 16 bp, Homo sapiens
gaaaagatggtggaga

SEQ ID NO: 43263 - DNA, 20 bp, Homo sapiens
ggaaatgccgcggtggagaa

SEQ ID NO: 43264 - DNA, 15 bp, Homo sapiens
ggaaaggtggagaaa

SEQ ID NO: 43265 - DNA, 19 bp, Homo sapiens
acgaagacatcatggagag

SEQ ID NO: 43266 - DNA, 18 bp, Homo sapiens
ggaagcatggcgggggag

SEQ ID NO: 43267 - DNA, 20 bp, Homo sapiens
cggaggaatcgtggtcagaa

SEQ ID NO: 43268 - DNA, 17 bp, Homo sapiens
ggaatgtcgtagtaaag

SEQ ID NO: 43269 - DNA, 18 bp, Homo sapiens
ggatgtatcatggagaaa

SEQ ID NO: 43270 - DNA, 19 bp, Homo sapiens
ggaaaaatctatgaggaaa

SEQ ID NO: 43271 - DNA, 18 bp, Homo sapiens
cagaaacattgaaggaaa

SEQ ID NO: 43272 - DNA, 18 bp, Homo sapiens
ggagccagggtggagaaa

SEQ ID NO: 43273 - DNA, 18 bp, Homo sapiens
ggaaagattctggagaaa

SEQ ID NO: 43274 - DNA, 17 bp, Homo sapiens
ggagccgggtggagaaa

SEQ ID NO: 43275 - DNA, 22 bp, Homo sapiens
cggaacgcaggcgatggggaga

SEQ ID NO: 43276 - DNA, 18 bp, Homo sapiens
ggaagcatcagtagagaa

SEQ ID NO: 43277 - DNA, 17 bp, Homo sapiens
ggaaacatgtaagaaag

SEQ ID NO: 43278 - DNA, 19 bp, Homo sapiens
gggggcaccttggagagaa

SEQ ID NO: 43279 - DNA, 19 bp, Homo sapiens
ggaggcatcagcggaggaa

SEQ ID NO: 43280 - DNA, 18 bp, Homo sapiens
gaaaacattatgggagaa

SEQ ID NO: 43281 - DNA, 19 bp, Homo sapiens
tgagacccacaggtggaga

SEQ ID NO: 43282 - DNA, 19 bp, Homo sapiens
ggagacagggctggagaaa

SEQ ID NO: 43283 - DNA, 19 bp, Homo sapiens
ggagacatcgcggagggaa

SEQ ID NO: 43284 - DNA, 19 bp, Homo sapiens
cgagacccacaggtggaga

SEQ ID NO: 43285 - DNA, 17 bp, Homo sapiens
ggagtctggtggagaaa

SEQ ID NO: 43286 - DNA, 18 bp, Homo sapiens
cggggacaccacggggag

SEQ ID NO: 43287 - DNA, 16 bp, Homo sapiens
gaagcatctggagaaa

SEQ ID NO: 43288 - DNA, 18 bp, Homo sapiens
agaagcatggtggggaga

SEQ ID NO: 43289 - DNA, 22 bp, Homo sapiens
ggagacgtttggtaactgagaa

SEQ ID NO: 43290 - DNA, 22 bp, Homo sapiens
ggaagcacagagctggggagaa

SEQ ID NO: 43291 - DNA, 22 bp, Homo sapiens
ggaaaattcaaaatggagaaaa

SEQ ID NO: 43292 - DNA, 65 bp, Infectious pancreatic necrosis virus
ccatggccagagcaaaagaagtgaaggacgccgaagtgttcaaacttctgaaactcatgtcatgg

SEQ ID NO: 43293 - DNA, 24 bp, Infectious pancreatic necrosis virus
ttcaaacttctgaaactcatgtca

SEQ ID NO: 43294 - DNA, 18 bp, Homo sapiens
tcagactttcactcatgt

SEQ ID NO: 43295 - DNA, 18 bp, Homo sapiens
ttcaacttctgccatgtc

SEQ ID NO: 43296 - DNA, 23 bp, Homo sapiens
ttctggcttctgaaaacatgtca

SEQ ID NO: 43297 - DNA, 25 bp, Homo sapiens
ttcagccttctgaaataaatggtca

SEQ ID NO: 43298 - DNA, 19 bp, Homo sapiens
ttcaaagttaactcatgtc

SEQ ID NO: 43299 - DNA, 20 bp, Homo sapiens
caaatttctgaaatccttca

SEQ ID NO: 43300 - DNA, 19 bp, Homo sapiens
ttcaacttctgagggagtc

SEQ ID NO: 43301 - DNA, 15 bp, Homo sapiens
aaacttctgaaatgc

SEQ ID NO: 43302 - DNA, 18 bp, Homo sapiens
ttcaataaagctcatgtc

SEQ ID NO: 43303 - DNA, 20 bp, Homo sapiens
ttcaaactgctggaacaatg

SEQ ID NO: 43304 - DNA, 19 bp, Homo sapiens
ttcaaactcctgtttatgt

SEQ ID NO: 43305 - DNA, 19 bp, Homo sapiens
ttcagcttctgaaaaatca

SEQ ID NO: 43306 - DNA, 19 bp, Homo sapiens
ctcaggccccaactcatgt

SEQ ID NO: 43307 - DNA, 65 bp, Infectious pancreatic necrosis virus
gacgtccccgtggttaccgtgacaagctccacgctagtcacagcggacaactacaggggggcgtc

SEQ ID NO: 43308 - DNA, 24 bp, Infectious pancreatic necrosis virus
tccccgtggttaccgtgacaagct

SEQ ID NO: 43309 - DNA, 17 bp, Homo sapiens
gtggttacatgtaaact

SEQ ID NO: 43310 - DNA, 19 bp, Homo sapiens
cccgtggctgttgcacgct

SEQ ID NO: 43311 - DNA, 17 bp, Homo sapiens
ccccgtggttacttgca

SEQ ID NO: 43312 - DNA, 21 bp, Homo sapiens
tccccgtaggcctggcgagct

SEQ ID NO: 43313 - DNA, 18 bp, Homo sapiens
tccccgtgttacccaggc

SEQ ID NO: 43314 - DNA, 20 bp, Homo sapiens
cctggctactgtgacaagct

SEQ ID NO: 43315 - DNA, 17 bp, Homo sapiens
tcctgtggttacaaagc

SEQ ID NO: 43316 - DNA, 21 bp, Homo sapiens
tccccgtgggttgtgagagct

SEQ ID NO: 43317 - DNA, 76 bp, Potato leafroll virus
gtaatgatatctccatactagtaggtccacccaactgggaaggtctactatcagtcaaaggagctcatttcattac

SEQ ID NO: 43318 - DNA, 19 bp, Potato leafroll virus
aaggagctcatttcattac

SEQ ID NO: 43319 - DNA, 17 bp, Homo sapiens
aagggcagtttcattac

SEQ ID NO: 43320 - DNA, 17 bp, Homo sapiens
aaggcctctttcattac

SEQ ID NO: 43321 - DNA, 17 bp, Homo sapiens
aaggaacagcctcatta

SEQ ID NO: 43322 - DNA, 18 bp, Homo sapiens
agaagctcatcaacttac

SEQ ID NO: 43323 - DNA, 19 bp, Homo sapiens
gaactctttgtttcattac

SEQ ID NO: 43324 - DNA, 18 bp, Homo sapiens
aagggctcttttcattac

SEQ ID NO: 43325 - DNA, 21 bp, Homo sapiens
aaggagccctggcctcattac

SEQ ID NO: 43326 - DNA, 19 bp, Homo sapiens
agatcctccatttcattac

SEQ ID NO: 43327 - DNA, 15 bp, Homo sapiens
agaagctcacattac

SEQ ID NO: 43328 - DNA, 18 bp, Homo sapiens
aagaagctcctttgttac

SEQ ID NO: 43329 - DNA, 18 bp, Homo sapiens
aggcaaaccatttcatta

SEQ ID NO: 43330 - DNA, 16 bp, Homo sapiens
aaggagctttccttac

SEQ ID NO: 43331 - DNA, 18 bp, Homo sapiens
ggggcccactctgcatta

SEQ ID NO: 43332 - DNA, 17 bp, Homo sapiens
aaggcagcccttcatta

SEQ ID NO: 43333 - DNA, 18 bp, Homo sapiens
agaagccttattcattac

SEQ ID NO: 43334 - DNA, 20 bp, Homo sapiens
aagaagcttcttactcatta

SEQ ID NO: 43335 - DNA, 18 bp, Homo sapiens
aaggaactcattcaaaac

SEQ ID NO: 43336 - DNA, 17 bp, Homo sapiens
aggagctcataaactac

SEQ ID NO: 43337 - DNA, 18 bp, Homo sapiens
aaggagctcagatattac

SEQ ID NO: 43338 - DNA, 16 bp, Homo sapiens
aaagagctgcccatca

SEQ ID NO: 43339 - DNA, 20 bp, Homo sapiens
aaggaactgaccatcattac

SEQ ID NO: 43340 - DNA, 16 bp, Homo sapiens
aaagagcatttcatta

SEQ ID NO: 43341 - DNA, 20 bp, Homo sapiens
aaggggctcacaacaattac

SEQ ID NO: 43342 - DNA, 18 bp, Homo sapiens
aggggtccatttcatcac

SEQ ID NO: 43343 - DNA, 17 bp, Homo sapiens
agggtctcatttcctac

SEQ ID NO: 43344 - DNA, 17 bp, Homo sapiens
aggtgctatctcattac

SEQ ID NO: 43345 - DNA, 18 bp, Homo sapiens
aaggatcttattcattac

SEQ ID NO: 43346 - DNA, 17 bp, Homo sapiens
aagaaccacttcattac

SEQ ID NO: 43347 - DNA, 18 bp, Homo sapiens
aggcagctgttctcatta

SEQ ID NO: 43348 - DNA, 16 bp, Homo sapiens
aagaagccttcattac

SEQ ID NO: 43349 - DNA, 20 bp, Homo sapiens
aagaagccccattttattac

SEQ ID NO: 43350 - DNA, 19 bp, Homo sapiens
aagggctccatttcattac

SEQ ID NO: 43351 - DNA, 18 bp, Homo sapiens
aaggaaccatgtcattac

SEQ ID NO: 43352 - DNA, 17 bp, Homo sapiens
aggaagtatttcattac

SEQ ID NO: 43353 - DNA, 18 bp, Homo sapiens
aggcttccatttcattac

SEQ ID NO: 43354 - DNA, 16 bp, Homo sapiens
aaggagcctcaactac

SEQ ID NO: 43355 - DNA, 18 bp, Homo sapiens
aagggtctctctccatta

SEQ ID NO: 43356 - DNA, 19 bp, Homo sapiens
aggagacgcagttcattac

SEQ ID NO: 43357 - DNA, 17 bp, Homo sapiens
aagggactcctcattac

SEQ ID NO: 43358 - DNA, 18 bp, Homo sapiens
aggaactcagaactcatt

SEQ ID NO: 43359 - DNA, 18 bp, Homo sapiens
aggagcccaaccccttac

SEQ ID NO: 43360 - DNA, 18 bp, Homo sapiens
aagtagttcacctcatta

SEQ ID NO: 43361 - DNA, 16 bp, Homo sapiens
aaggagcttctattac

SEQ ID NO: 43362 - DNA, 18 bp, Homo sapiens
agcttgtcatttcattac

SEQ ID NO: 43363 - DNA, 17 bp, Homo sapiens
aaagagctcaagactac

SEQ ID NO: 43364 - DNA, 90 bp, Bhendi yellow vein mosaic virus satellite DNA beta
gtaaattagacagacaccgataggtaaatgagacaccgatatatcggttctcaattggtacctctggagtcttataaagtgcttgtttac

SEQ ID NO: 43365 - DNA, 24 bp, Bhendi yellow vein mosaic virus satellite DNA beta
ttctcaattggtacctctggagtc

SEQ ID NO: 43366 - DNA, 21 bp, Homo sapiens
tcttcagaatgtttctggagt

SEQ ID NO: 43367 - DNA, 23 bp, Homo sapiens
ttcccagttgttgttctggagtc

SEQ ID NO: 43368 - DNA, 17 bp, Homo sapiens
tcaggctttctggagtc

SEQ ID NO: 43369 - DNA, 16 bp, Homo sapiens
ttctcaattggtgtct

SEQ ID NO: 43370 - DNA, 23 bp, Homo sapiens
ttctagctgctgcttctggagtc

SEQ ID NO: 43371 - DNA, 21 bp, Homo sapiens
tcttgtcaacacttctggagt

SEQ ID NO: 43372 - DNA, 19 bp, Homo sapiens
tcaggagtgtctctggagt

SEQ ID NO: 43373 - DNA, 15 bp, Homo sapiens
ttctcaatgctggag

SEQ ID NO: 43374 - DNA, 22 bp, Homo sapiens
ttctacctccatctctggagtc

SEQ ID NO: 43375 - DNA, 20 bp, Homo sapiens
ttctccgtgtctctggagtc

SEQ ID NO: 43376 - DNA, 19 bp, Homo sapiens
tcattggtacagacaggtc

SEQ ID NO: 43377 - DNA, 19 bp, Homo sapiens
tcttcaattggtgtgtagt

SEQ ID NO: 43378 - DNA, 22 bp, Homo sapiens
ttcccacagagcctctggagtc

SEQ ID NO: 43379 - DNA, 18 bp, Homo sapiens
ttctcaattgatcggggt

SEQ ID NO: 43380 - DNA, 18 bp, Homo sapiens
ttccaattggtgtgtagt

SEQ ID NO: 43381 - DNA, 61 bp, Potato leafroll virus
ttgagaaaacagttgaggcatacagaaattgtgtaactaacgccccactgtgctcccttaa

SEQ ID NO: 43382 - DNA, 24 bp, Potato leafroll virus
aacagttgaggcatacagaaattg

SEQ ID NO: 43383 - DNA, 16 bp, Homo sapiens
gttgtggcagaaattg

SEQ ID NO: 43384 - DNA, 19 bp, Homo sapiens
agttgaaggccagaaattg

SEQ ID NO: 43385 - DNA, 18 bp, Homo sapiens
acagttgatccagaagtt

SEQ ID NO: 43386 - DNA, 19 bp, Homo sapiens
aacaataaatacagaaatt

SEQ ID NO: 43387 - DNA, 22 bp, Homo sapiens
aacagtgggtgtccagaaattg

SEQ ID NO: 43388 - DNA, 22 bp, Homo sapiens
cagcctctatatacagaagttg

SEQ ID NO: 43389 - DNA, 17 bp, Homo sapiens
ttaaaatacagaaattg

SEQ ID NO: 43390 - DNA, 15 bp, Homo sapiens
agttgaggcaagaaa

SEQ ID NO: 43391 - DNA, 20 bp, Homo sapiens
aaggtgaaatacagaaattg

SEQ ID NO: 43392 - DNA, 18 bp, Homo sapiens
gctggacctcagaaattg

SEQ ID NO: 43393 - DNA, 18 bp, Homo sapiens
gttgacacacagagattg

SEQ ID NO: 43394 - DNA, 62 bp, Potato leafroll virus
ccacaaacagagcaaactcgatgaaggccgctaccgcctcatcatgtctgtttccttggtgg

SEQ ID NO: 43395 - DNA, 24 bp, Potato leafroll virus
gagcaaactcgatgaaggccgcta

SEQ ID NO: 43396 - DNA, 22 bp, Homo sapiens
gagcaaggtttgggggccgcta

SEQ ID NO: 43397 - DNA, 20 bp, Homo sapiens
gggcaagaccggaggccgct

SEQ ID NO: 43398 - DNA, 20 bp, Homo sapiens
ggcagacgcgggggccgcta

SEQ ID NO: 43399 - DNA, 19 bp, Homo sapiens
gcaaactcatggatcatct

SEQ ID NO: 43400 - DNA, 22 bp, Homo sapiens
gagctcgatgacccggttgcta

SEQ ID NO: 43401 - DNA, 19 bp, Homo sapiens
ggcgggcccgaggccgcta

SEQ ID NO: 43402 - DNA, 21 bp, Homo sapiens
gcaaactcgatatgcatgcta

SEQ ID NO: 43403 - DNA, 20 bp, Homo sapiens
gagcaaatgaagggttgcta

SEQ ID NO: 43404 - DNA, 20 bp, Homo sapiens
gagctgggcggaaggccgct

SEQ ID NO: 43405 - DNA, 19 bp, Homo sapiens
gagcgtggctcggaccgct

SEQ ID NO: 43406 - DNA, 21 bp, Homo sapiens
gcaaactcgatatgcacgcta

SEQ ID NO: 43407 - DNA, 21 bp, Homo sapiens
gcaaactcgatatgcgtgcta

SEQ ID NO: 43408 - DNA, 16 bp, Homo sapiens
gagacttgaaaagccg

SEQ ID NO: 43409 - DNA, 66 bp, Potato leafroll virus
gccgttccggtcaacaccaacaaaatgctttacaagttgatccatggttataatccggaatgtggc

SEQ ID NO: 43410 - DNA, 24 bp, Potato leafroll virus
ttgatccatggttataatccggaa

SEQ ID NO: 43411 - DNA, 23 bp, Homo sapiens
ttgatccattagccaatttggaa

SEQ ID NO: 43412 - DNA, 17 bp, Homo sapiens
gatccacataatttgga

SEQ ID NO: 43413 - DNA, 18 bp, Homo sapiens
ttgaccatggttaatgga

SEQ ID NO: 43414 - DNA, 21 bp, Homo sapiens
tggtctatggttataccacaa

SEQ ID NO: 43415 - DNA, 20 bp, Homo sapiens
ttgatccacggttgtgacca

SEQ ID NO: 43416 - DNA, 16 bp, Homo sapiens
catggtcaatctggaa

SEQ ID NO: 43417 - DNA, 22 bp, Homo sapiens
ttgatccaagccagaaatctgg

SEQ ID NO: 43418 - DNA, 71 bp, Human herpesvirus 6B
ccccggtccacataggaagccaagggcggacgaaaataaaaacccgtccgtaattcacacacgaatcgggg

SEQ ID NO: 43419 - DNA, 24 bp, Human herpesvirus 6B
tccgtaattcacacacgaatcggg

SEQ ID NO: 43420 - DNA, 23 bp, Homo sapiens
taattcacgccgaagaagttggg

SEQ ID NO: 43421 - DNA, 18 bp, Homo sapiens
tccatgattcacacatga

SEQ ID NO: 43422 - DNA, 19 bp, Homo sapiens
tccgtaattcactgccagg

SEQ ID NO: 43423 - DNA, 23 bp, Homo sapiens
gtagctcacacaaaattattggg

SEQ ID NO: 43424 - DNA, 82 bp, Potato leafroll virus
cttctcccagtgctcactcagctgacctttgaccgactacagaagatgtcggaggccagctttgaggatatgagcgcagaag

SEQ ID NO: 43425 - DNA, 24 bp, Potato leafroll virus
tcccagtgctcactcagctgacct

SEQ ID NO: 43426 - DNA, 18 bp, Homo sapiens
cctcagtgctcacttgct

SEQ ID NO: 43427 - DNA, 25 bp, Homo sapiens
tcctggtagctcactcgtccatcct

SEQ ID NO: 43428 - DNA, 22 bp, Homo sapiens
tcctcgtgctctagactgacct

SEQ ID NO: 43429 - DNA, 20 bp, Homo sapiens
tccatgctcactcgggaagc

SEQ ID NO: 43430 - DNA, 16 bp, Homo sapiens
tcccagtgcttgctgc

SEQ ID NO: 43431 - DNA, 15 bp, Homo sapiens
atgctcactaccacc

SEQ ID NO: 43432 - DNA, 16 bp, Homo sapiens
ccagtgctcccaactg

SEQ ID NO: 43433 - DNA, 17 bp, Homo sapiens
tcctgacctcagctgac

SEQ ID NO: 43434 - DNA, 23 bp, Homo sapiens
tcccagtggttactccaatgtac

SEQ ID NO: 43435 - DNA, 17 bp, Homo sapiens
tccccgtgacagctgac

SEQ ID NO: 43436 - DNA, 16 bp, Homo sapiens
agtgctcagctggcct

SEQ ID NO: 43437 - DNA, 23 bp, Homo sapiens
cctggtaaatgctcagctggcct

SEQ ID NO: 43438 - DNA, 23 bp, Homo sapiens
ccccagtgtttaaaagctggcct

SEQ ID NO: 43439 - DNA, 17 bp, Homo sapiens
tcccagtgctagctgcc

SEQ ID NO: 43440 - DNA, 24 bp, Homo sapiens
agtgctcattcctacaactggcct

SEQ ID NO: 43441 - DNA, 22 bp, Homo sapiens
tcccagtgctggcaccagacct

SEQ ID NO: 43442 - DNA, 20 bp, Homo sapiens
tcccagtggtcacttctgct

SEQ ID NO: 43443 - DNA, 18 bp, Homo sapiens
tcccagtgatcattgcca

SEQ ID NO: 43444 - DNA, 24 bp, Homo sapiens
ccccggtgctcacttgcctgacct

SEQ ID NO: 43445 - DNA, 20 bp, Homo sapiens
tcccagctgctcaggtggct

SEQ ID NO: 43446 - DNA, 19 bp, Homo sapiens
ccactgcttgccaactgac

SEQ ID NO: 43447 - DNA, 20 bp, Homo sapiens
ccagtgcttgctctaggcca

SEQ ID NO: 43448 - DNA, 15 bp, Homo sapiens
tcccaggctgctgac

SEQ ID NO: 43449 - DNA, 19 bp, Homo sapiens
tctccgtgctcaccagacc

SEQ ID NO: 43450 - DNA, 21 bp, Homo sapiens
tccaaacacccactcagttga

SEQ ID NO: 43451 - DNA, 21 bp, Homo sapiens
tcccagctgttcattcagcca

SEQ ID NO: 43452 - DNA, 24 bp, Homo sapiens
tcccagtgtttagctctccaacct

SEQ ID NO: 43453 - DNA, 19 bp, Homo sapiens
ccagtgctttctgcaacta

SEQ ID NO: 43454 - DNA, 20 bp, Homo sapiens
cctagtgccatggctgacct

SEQ ID NO: 43455 - DNA, 17 bp, Homo sapiens
tcccagtactcactgcc

SEQ ID NO: 43456 - DNA, 22 bp, Homo sapiens
tcccagtgatcatttttaacct

SEQ ID NO: 43457 - DNA, 17 bp, Homo sapiens
tcccagtgccacaggct

SEQ ID NO: 43458 - DNA, 21 bp, Homo sapiens
ccagtgcttatgctattgcct

SEQ ID NO: 43459 - DNA, 24 bp, Homo sapiens
tcccgcgtgtttccaggctgacct

SEQ ID NO: 43460 - DNA, 21 bp, Homo sapiens
tcccagtatttgctgcaaact

SEQ ID NO: 43461 - DNA, 22 bp, Homo sapiens
ccttggacaattcagctgacct

SEQ ID NO: 43462 - DNA, 22 bp, Homo sapiens
tcccagtgctgtgctgaggcct

SEQ ID NO: 43463 - DNA, 23 bp, Homo sapiens
cagtgctcattcgggagggacct

SEQ ID NO: 43464 - DNA, 20 bp, Homo sapiens
ccagtgctcacatcctggct

SEQ ID NO: 43465 - DNA, 22 bp, Homo sapiens
tctcagtgctctttgcagatct

SEQ ID NO: 43466 - DNA, 20 bp, Homo sapiens
tcccaatgttgcccaggctg

SEQ ID NO: 43467 - DNA, 23 bp, Homo sapiens
tcctcgggtgactcagctgacct

SEQ ID NO: 43468 - DNA, 21 bp, Homo sapiens
tctcagggctcactcagggac

SEQ ID NO: 43469 - DNA, 21 bp, Homo sapiens
ccccagtgttcactcccacct

SEQ ID NO: 43470 - DNA, 73 bp, Potato leafroll virus
cgtattggatgctggaggatgatatggaggtgagaaatcgcctgacatttaataacacccagctcaccaagcg

SEQ ID NO: 43471 - DNA, 24 bp, Potato leafroll virus
tattggatgctggaggatgatatg

SEQ ID NO: 43472 - DNA, 22 bp, Homo sapiens
tattgtaggagaggatggtatg

SEQ ID NO: 43473 - DNA, 19 bp, Homo sapiens
tattggattgctgacggtg

SEQ ID NO: 43474 - DNA, 21 bp, Homo sapiens
cattggatgctggagatagat

SEQ ID NO: 43475 - DNA, 20 bp, Homo sapiens
tattagatgctggagggctg

SEQ ID NO: 43476 - DNA, 88 bp, Human herpesvirus 6B
aacttttctttgttcgtgaacatattttcaaaatttcctttattcagacctttggattttaagtactcgtttacgacattctggagtt

SEQ ID NO: 43477 - DNA, 24 bp, Human herpesvirus 6B
ttcgtgaacatattttcaaaattt

SEQ ID NO: 43478 - DNA, 20 bp, Homo sapiens
tgaacataaactcaagattt

SEQ ID NO: 43479 - DNA, 20 bp, Homo sapiens
tgaacatatttaaaaaattt

SEQ ID NO: 43480 - DNA, 22 bp, Homo sapiens
ttcctgataactttcaaaattt

SEQ ID NO: 43481 - DNA, 22 bp, Homo sapiens
catgtacatatttttaaaattt

SEQ ID NO: 43482 - DNA, 18 bp, Homo sapiens
ttcgtgaacaacaaaatt

SEQ ID NO: 43483 - DNA, 61 bp, Human herpesvirus 6B
gcgagacagatcagcatttggcagcctaaacggagactgcacagaatcgagatcgttttgc

SEQ ID NO: 43484 - DNA, 24 bp, Human herpesvirus 6B
actgcacagaatcgagatcgtttt

SEQ ID NO: 43485 - DNA, 20 bp, Homo sapiens
ctgcacagacttgggatgtt

SEQ ID NO: 43486 - DNA, 19 bp, Homo sapiens
caaaaatcgagattgtttt

SEQ ID NO: 43487 - DNA, 22 bp, Homo sapiens
ctgacacttttgagatcgtttt

SEQ ID NO: 43488 - DNA, 22 bp, Homo sapiens
ctgcacagacatcacttgtttt

SEQ ID NO: 43489 - DNA, 18 bp, Homo sapiens
acagaagaaaatcgtttt

SEQ ID NO: 43490 - DNA, 20 bp, Homo sapiens
ctgcacagagtctacgtttt

SEQ ID NO: 43491 - DNA, 19 bp, Homo sapiens
gcacagaatgcactgtttt

SEQ ID NO: 43492 - DNA, 16 bp, Homo sapiens
actgcacaggatggtt

SEQ ID NO: 43493 - DNA, 70 bp, Ateline herpesvirus 3
tagtatggtttagagctaagtttgttaacgccctaaggaagctttacaagattagttcatcaccatattg

SEQ ID NO: 43494 - DNA, 24 bp, Ateline herpesvirus 3
ctttacaagattagttcatcacca

SEQ ID NO: 43495 - DNA, 18 bp, Homo sapiens
ctttacaaggtttgttca

SEQ ID NO: 43496 - DNA, 23 bp, Homo sapiens
tttacatgcacagttcattgcca

SEQ ID NO: 43497 - DNA, 20 bp, Homo sapiens
ttcacaaggtaatgtcatca

SEQ ID NO: 43498 - DNA, 20 bp, Homo sapiens
ctctacaagagacatcatca

SEQ ID NO: 43499 - DNA, 25 bp, Homo sapiens
tttacaaagattcaaaacattacca

SEQ ID NO: 43500 - DNA, 18 bp, Homo sapiens
tttacaagattacttctc

SEQ ID NO: 43501 - DNA, 22 bp, Homo sapiens
ccttacaagggccactcgtcac

SEQ ID NO: 43502 - DNA, 22 bp, Homo sapiens
ctttgaagatcaagaatcacca

SEQ ID NO: 43503 - DNA, 22 bp, Homo sapiens
ctttacaagcttgtagacacac

SEQ ID NO: 43504 - DNA, 26 bp, Homo sapiens
ctttacaagtgttttcgggttcatca

SEQ ID NO: 43505 - DNA, 24 bp, Homo sapiens
cttcacaggattaattaattgcca

SEQ ID NO: 43506 - DNA, 21 bp, Homo sapiens
tttataagatcagtaccttca

SEQ ID NO: 43507 - DNA, 18 bp, Homo sapiens
cttcacaagggttcttca

SEQ ID NO: 43508 - DNA, 22 bp, Homo sapiens
ctttaaagattagtatttatca

SEQ ID NO: 43509 - DNA, 18 bp, Homo sapiens
ctttacaaattagttacc

SEQ ID NO: 43510 - DNA, 25 bp, Homo sapiens
ctttacaaggattggtttaacatca

SEQ ID NO: 43511 - DNA, 20 bp, Homo sapiens
cataatcatgttcatcatca

SEQ ID NO: 43512 - DNA, 22 bp, Homo sapiens
ctttgccaagaaggcatcacca

SEQ ID NO: 43513 - DNA, 18 bp, Homo sapiens
tttacaaaaacatcatca

SEQ ID NO: 43514 - DNA, 20 bp, Homo sapiens
ctttgcaagactagaaatca

SEQ ID NO: 43515 - DNA, 19 bp, Homo sapiens
ctgtacacgtgttcatcac

SEQ ID NO: 43516 - DNA, 21 bp, Homo sapiens
ctttacaagttcaagttcatc

SEQ ID NO: 43517 - DNA, 18 bp, Homo sapiens
tttacaagcttaaccacc

SEQ ID NO: 43518 - DNA, 22 bp, Homo sapiens
tttatgaaatacggttcatcac

SEQ ID NO: 43519 - DNA, 19 bp, Homo sapiens
ctttgcaggatcagccatc

SEQ ID NO: 43520 - DNA, 60 bp, Ateline herpesvirus 3
aactgggagaagtttgtagtacatcagaccatctaaaaagggccccagactttatcagtt

SEQ ID NO: 43521 - DNA, 24 bp, Ateline herpesvirus 3
agaagtttgtagtacatcagacca

SEQ ID NO: 43522 - DNA, 21 bp, Homo sapiens
agaggtgcacttgcatcagac

SEQ ID NO: 43523 - DNA, 19 bp, Homo sapiens
gaagtgtgggtcatcagac

SEQ ID NO: 43524 - DNA, 17 bp, Homo sapiens
agaagtttgtaacagac

SEQ ID NO: 43525 - DNA, 22 bp, Homo sapiens
agaagtttgtacatgcaggcca

SEQ ID NO: 43526 - DNA, 18 bp, Homo sapiens
gaggtttgtagactacac

SEQ ID NO: 43527 - DNA, 21 bp, Homo sapiens
agaattcccagcatcagacca

SEQ ID NO: 43528 - DNA, 25 bp, Homo sapiens
agttgtagtacgaatccgtcaggcc

SEQ ID NO: 43529 - DNA, 21 bp, Homo sapiens
aggagtttgtagatgctccca

SEQ ID NO: 43530 - DNA, 16 bp, Homo sapiens
aaagttatacatcaga

SEQ ID NO: 43531 - DNA, 21 bp, Homo sapiens
agaagtttggggacaggagac

SEQ ID NO: 43532 - DNA, 18 bp, Homo sapiens
agagtttgtagtatacac

SEQ ID NO: 43533 - DNA, 23 bp, Homo sapiens
agaagtttgaagtttttggacca

SEQ ID NO: 43534 - DNA, 20 bp, Homo sapiens
gactccgtggtgcatcagac

SEQ ID NO: 43535 - DNA, 60 bp, Bovine adenovirus B
gggttccctccacattgtgggcaaccgttgtaggcgttggccaaccatgcaggggaatgt

SEQ ID NO: 43536 - DNA, 24 bp, Bovine adenovirus B
ttggccaaccatgcaggggaatgt

SEQ ID NO: 43537 - DNA, 18 bp, Homo sapiens
tggccagccatgcagcag

SEQ ID NO: 43538 - DNA, 21 bp, Homo sapiens
ttggccaacttgaaacaatgt

SEQ ID NO: 43539 - DNA, 22 bp, Homo sapiens
ctggccagggggaggggaatgt

SEQ ID NO: 43540 - DNA, 19 bp, Homo sapiens
ctggctgacctcgggaatg

SEQ ID NO: 43541 - DNA, 22 bp, Homo sapiens
tggccaaccattctctgaatgt

SEQ ID NO: 43542 - DNA, 20 bp, Homo sapiens
ttggccaaataggtgagggg

SEQ ID NO: 43543 - DNA, 22 bp, Homo sapiens
tggccaaccgctgcagggatgt

SEQ ID NO: 43544 - DNA, 18 bp, Homo sapiens
ttggccaatcattggatg

SEQ ID NO: 43545 - DNA, 19 bp, Homo sapiens
ttggccaactgtgcgagga

SEQ ID NO: 43546 - DNA, 23 bp, Homo sapiens
ttggctggcatgcagatctcagt

SEQ ID NO: 43547 - DNA, 74 bp, Ateline herpesvirus 3
ttctaacacatgtgtgggcaacagatatcctcatgccaatgcaacaggactggcacatgctcacggatacagaa

SEQ ID NO: 43548 - DNA, 24 bp, Ateline herpesvirus 3
acaggactggcacatgctcacgga

SEQ ID NO: 43549 - DNA, 19 bp, Homo sapiens
acaggactggtgtagacag

SEQ ID NO: 43550 - DNA, 19 bp, Homo sapiens
acaggactggtgagcctgg

SEQ ID NO: 43551 - DNA, 21 bp, Homo sapiens
acaggactggagctgggcgga

SEQ ID NO: 43552 - DNA, 19 bp, Homo sapiens
gaactatgcatgctcatgg

SEQ ID NO: 43553 - DNA, 17 bp, Homo sapiens
acgggactggcatggtc

SEQ ID NO: 43554 - DNA, 19 bp, Homo sapiens
acaagactggtgtgtctgg

SEQ ID NO: 43555 - DNA, 22 bp, Homo sapiens
acaggactggcctctgggtgga

SEQ ID NO: 43556 - DNA, 19 bp, Homo sapiens
acaggagctggtgacgcgg

SEQ ID NO: 43557 - DNA, 20 bp, Homo sapiens
ggagggctggcacagcccgg

SEQ ID NO: 43558 - DNA, 22 bp, Homo sapiens
caggactggtgcaggctcctga

SEQ ID NO: 43559 - DNA, 22 bp, Homo sapiens
acaggactaggcacgtctctgg

SEQ ID NO: 43560 - DNA, 19 bp, Homo sapiens
cagtattggcacagcttgg

SEQ ID NO: 43561 - DNA, 23 bp, Homo sapiens
acaggactggttacagagctgga

SEQ ID NO: 43562 - DNA, 16 bp, Homo sapiens
cagggctggtgcacgg

SEQ ID NO: 43563 - DNA, 21 bp, Homo sapiens
ggactggacatggctcacgga

SEQ ID NO: 43564 - DNA, 18 bp, Homo sapiens
ggactggcagagccacgg

SEQ ID NO: 43565 - DNA, 18 bp, Homo sapiens
ggcggggccactcacgga

SEQ ID NO: 43566 - DNA, 18 bp, Homo sapiens
caggctggagactcacgg

SEQ ID NO: 43567 - DNA, 22 bp, Homo sapiens
acgggactgcagccaccgcgga

SEQ ID NO: 43568 - DNA, 20 bp, Homo sapiens
caggactggcctctaaacgg

SEQ ID NO: 43569 - DNA, 25 bp, Homo sapiens
acagggttggccggctccattacgg

SEQ ID NO: 43570 - DNA, 17 bp, Homo sapiens
gggctggcacaccctgg

SEQ ID NO: 43571 - DNA, 20 bp, Homo sapiens
cagggctggatgactcacgg

SEQ ID NO: 43572 - DNA, 21 bp, Homo sapiens
caaggctggcacatggcagga

SEQ ID NO: 43573 - DNA, 20 bp, Homo sapiens
ggggctctgctgctcacgga

SEQ ID NO: 43574 - DNA, 17 bp, Homo sapiens
caggactggcatactgg

SEQ ID NO: 43575 - DNA, 16 bp, Homo sapiens
agactggcagccgcgg

SEQ ID NO: 43576 - DNA, 19 bp, Homo sapiens
acaggactgttacacaagc

SEQ ID NO: 43577 - DNA, 17 bp, Homo sapiens
caggttggtgctcacag

SEQ ID NO: 43578 - DNA, 20 bp, Homo sapiens
cagaactggtactgaaatgg

SEQ ID NO: 43579 - DNA, 19 bp, Homo sapiens
cagggctggcacaggctgg

SEQ ID NO: 43580 - DNA, 20 bp, Homo sapiens
caagcttacatgctcatgga

SEQ ID NO: 43581 - DNA, 19 bp, Homo sapiens
cagggctggcacctgccca

SEQ ID NO: 43582 - DNA, 24 bp, Homo sapiens
cagtgctcacatcatgctcgtgga

SEQ ID NO: 43583 - DNA, 17 bp, Homo sapiens
acaggactgtgcgtgct

SEQ ID NO: 43584 - DNA, 23 bp, Homo sapiens
actgggtaatccatgctcatgga

SEQ ID NO: 43585 - DNA, 62 bp, Human herpesvirus 6B
gggtctgcaaaaccctctgagaatacacagcattaaaattctcgttcttcctcaaatgaccc

SEQ ID NO: 43586 - DNA, 22 bp, Human herpesvirus 6B
ctcgttcttcctcaaatgaccc

SEQ ID NO: 43587 - DNA, 19 bp, Homo sapiens
cgtgagatcctcaaatgac

SEQ ID NO: 43588 - DNA, 19 bp, Homo sapiens
tcctgggctcaaatgatcc

SEQ ID NO: 43589 - DNA, 18 bp, Homo sapiens
ctcttcttcctcagaacc

SEQ ID NO: 43590 - DNA, 21 bp, Homo sapiens
ccgctgcacctcaagtgatcc

SEQ ID NO: 43591 - DNA, 23 bp, Homo sapiens
ctcattcttaaattaaatgaccc

SEQ ID NO: 43592 - DNA, 24 bp, Homo sapiens
ctcattctttctcagggctggtcc

SEQ ID NO: 43593 - DNA, 22 bp, Homo sapiens
tccttcttcctccactggaccc

SEQ ID NO: 43594 - DNA, 19 bp, Homo sapiens
tcctgagctcaaatgatcc

SEQ ID NO: 43595 - DNA, 19 bp, Homo sapiens
ctcattctttctcaacacc

SEQ ID NO: 43596 - DNA, 23 bp, Homo sapiens
tcgttcttccctgactgagaccc

SEQ ID NO: 43597 - DNA, 16 bp, Homo sapiens
ctcgtcttcctctacc

SEQ ID NO: 43598 - DNA, 16 bp, Homo sapiens
gttctccctcagatcc

SEQ ID NO: 43599 - DNA, 21 bp, Homo sapiens
ctcgctcttctttccggatcc

SEQ ID NO: 43600 - DNA, 19 bp, Homo sapiens
tcctggcctcaagtgatcc

SEQ ID NO: 43601 - DNA, 20 bp, Homo sapiens
ctcatgagctcaaatgatcc

SEQ ID NO: 43602 - DNA, 17 bp, Homo sapiens
gctcccctcaaatggcc

SEQ ID NO: 43603 - DNA, 17 bp, Homo sapiens
ctagccctttcaaatga

SEQ ID NO: 43604 - DNA, 21 bp, Homo sapiens
ctctttcttcctagactgacc

SEQ ID NO: 43605 - DNA, 20 bp, Homo sapiens
catccccccttaagtgaccc

SEQ ID NO: 43606 - DNA, 20 bp, Homo sapiens
tcaaacctctcaaatgaccc

SEQ ID NO: 43607 - DNA, 20 bp, Homo sapiens
tcctcaggctcaagtgatcc

SEQ ID NO: 43608 - DNA, 16 bp, Homo sapiens
tcgttcttccctgacc

SEQ ID NO: 43609 - DNA, 16 bp, Homo sapiens
tcgttctccctagacc

SEQ ID NO: 43610 - DNA, 23 bp, Homo sapiens
ctctttcttcctctccctgatcc

SEQ ID NO: 43611 - DNA, 20 bp, Homo sapiens
attcttccttaaagaagacc

SEQ ID NO: 43612 - DNA, 16 bp, Homo sapiens
tcgtccttcctgagcc

SEQ ID NO: 43613 - DNA, 16 bp, Homo sapiens
gttcttcccaagaccc

SEQ ID NO: 43614 - DNA, 19 bp, Homo sapiens
tcctgacctcaagtgatcc

SEQ ID NO: 43615 - DNA, 19 bp, Homo sapiens
tcctaggctcaaatgatcc

SEQ ID NO: 43616 - DNA, 22 bp, Homo sapiens
ctttttcttcctccttgtaccc

SEQ ID NO: 43617 - DNA, 19 bp, Homo sapiens
cattcctgtcctcaaatga

SEQ ID NO: 43618 - DNA, 20 bp, Homo sapiens
ctctttcttcctttccaacc

SEQ ID NO: 43619 - DNA, 19 bp, Homo sapiens
tcctgacctcaaatgatcc

SEQ ID NO: 43620 - DNA, 17 bp, Homo sapiens
gttcttccccaccgccc

SEQ ID NO: 43621 - DNA, 17 bp, Homo sapiens
ctcgctctggcaaatga

SEQ ID NO: 43622 - DNA, 19 bp, Homo sapiens
ccacacttcttcaaatgac

SEQ ID NO: 43623 - DNA, 19 bp, Homo sapiens
tcctggcctcaaatgatcc

SEQ ID NO: 43624 - DNA, 20 bp, Homo sapiens
cccgttctttctccccgccc

SEQ ID NO: 43625 - DNA, 21 bp, Homo sapiens
ctccttcttcctcaagagtcc

SEQ ID NO: 43626 - DNA, 16 bp, Homo sapiens
gtccttcctcaggacc

SEQ ID NO: 43627 - DNA, 18 bp, Homo sapiens
ctcttcttcctcccgacc

SEQ ID NO: 43628 - DNA, 23 bp, Homo sapiens
ctcattctcagtgcaggtgatcc

SEQ ID NO: 43629 - DNA, 17 bp, Homo sapiens
cgttctttctcagagcc

SEQ ID NO: 43630 - DNA, 15 bp, Homo sapiens
gttctccaaatgacc

SEQ ID NO: 43631 - DNA, 18 bp, Homo sapiens
ctcattctccaggtgacc

SEQ ID NO: 43632 - DNA, 21 bp, Homo sapiens
ctcgctctgtgcggatgaccc

SEQ ID NO: 43633 - DNA, 22 bp, Homo sapiens
tcgttctccctgtacctggccc

SEQ ID NO: 43634 - DNA, 18 bp, Homo sapiens
ctcgttctacctcacgtg

SEQ ID NO: 43635 - DNA, 20 bp, Homo sapiens
ctcgttcttaccttgggccc

SEQ ID NO: 43636 - DNA, 19 bp, Homo sapiens
ttctgggctcaaatgatcc

SEQ ID NO: 43637 - DNA, 18 bp, Homo sapiens
ctcgtccttcttcctaac

SEQ ID NO: 43638 - DNA, 25 bp, Homo sapiens
ttcttcctctaaattaagtggcccg

SEQ ID NO: 43639 - DNA, 19 bp, Homo sapiens
tcctgacttcaaatgatcc

SEQ ID NO: 43640 - DNA, 19 bp, Homo sapiens
tcctgcactcaaatgatcc

SEQ ID NO: 43641 - DNA, 20 bp, Homo sapiens
ctccttcttccttcccgtcc

SEQ ID NO: 43642 - DNA, 23 bp, Homo sapiens
ctcgttcttgtggtgaatgatcc

SEQ ID NO: 43643 - DNA, 19 bp, Homo sapiens
ctccttctttctcatggac

SEQ ID NO: 43644 - DNA, 19 bp, Homo sapiens
cctttccccccttgaatga

SEQ ID NO: 43645 - DNA, 16 bp, Homo sapiens
ctctttcttcctaacc

SEQ ID NO: 43646 - DNA, 17 bp, Homo sapiens
ctcttcttcctctgtcc

SEQ ID NO: 43647 - DNA, 16 bp, Homo sapiens
ctctttcttcctcacc

SEQ ID NO: 43648 - DNA, 20 bp, Homo sapiens
ctcttcttccttaaatatcc

SEQ ID NO: 43649 - DNA, 21 bp, Homo sapiens
ctcgttcctctttctcgaccc

SEQ ID NO: 43650 - DNA, 21 bp, Homo sapiens
cttattcttccagtatggccc

SEQ ID NO: 43651 - DNA, 18 bp, Homo sapiens
tcgtcttcttcttcgccc

SEQ ID NO: 43652 - DNA, 21 bp, Homo sapiens
ctctttcttcctcacacaccc

SEQ ID NO: 43653 - DNA, 24 bp, Homo sapiens
ctcgatcttctttctggccgaccc

SEQ ID NO: 43654 - DNA, 19 bp, Homo sapiens
tccttcttcccccggaccc

SEQ ID NO: 43655 - DNA, 19 bp, Homo sapiens
ctcttcttcctcatgggcc

SEQ ID NO: 43656 - DNA, 17 bp, Homo sapiens
ctcattcttccttgtcc

SEQ ID NO: 43657 - DNA, 21 bp, Homo sapiens
ctggctgcccctcaagtggcc

SEQ ID NO: 43658 - DNA, 17 bp, Homo sapiens
ctcgttctcgctcctga

SEQ ID NO: 43659 - DNA, 19 bp, Homo sapiens
ctcttcttccttggtggcc

SEQ ID NO: 43660 - DNA, 20 bp, Homo sapiens
ctttttctttcaaatgatcc

SEQ ID NO: 43661 - DNA, 16 bp, Homo sapiens
ctcgttcctccagacc

SEQ ID NO: 43662 - DNA, 19 bp, Homo sapiens
ctccttctggctgatgacc

SEQ ID NO: 43663 - DNA, 22 bp, Homo sapiens
ctcacgactcctcgaatggccc

SEQ ID NO: 43664 - DNA, 23 bp, Homo sapiens
ctcattcttcctcctgccaaccc

SEQ ID NO: 43665 - DNA, 19 bp, Homo sapiens
ctcttcttcccattgatcc

SEQ ID NO: 43666 - DNA, 18 bp, Homo sapiens
ctcttcttcctcatcacc

SEQ ID NO: 43667 - DNA, 16 bp, Homo sapiens
ctcgttctccctcgcc

SEQ ID NO: 43668 - DNA, 16 bp, Homo sapiens
tcattcttccttgtcc

SEQ ID NO: 43669 - DNA, 19 bp, Homo sapiens
gctaaccttcaaatgaccc

SEQ ID NO: 43670 - DNA, 18 bp, Homo sapiens
attcttcctcataacacc

SEQ ID NO: 43671 - DNA, 19 bp, Homo sapiens
ctccttcttctcggtggcc

SEQ ID NO: 43672 - DNA, 17 bp, Homo sapiens
ctcattcttccctggcc

SEQ ID NO: 43673 - DNA, 69 bp, Murid herpesvirus 4
tggcaattgaaaagtggttacagcccaaaaacggggcctgttttgatgagtagccaccaagagatgcca

SEQ ID NO: 43674 - DNA, 23 bp, Murid herpesvirus 4
tgagtagccaccaagagatgcca

SEQ ID NO: 43675 - DNA, 23 bp, Homo sapiens
tgagtagctgccgaaggggtcca

SEQ ID NO: 43676 - DNA, 21 bp, Homo sapiens
tgcggcaccactgagagatgc

SEQ ID NO: 43677 - DNA, 20 bp, Homo sapiens
taagtcaatgagagatgcca

SEQ ID NO: 43678 - DNA, 24 bp, Homo sapiens
tgatagccacgcacacagatgcca

SEQ ID NO: 43679 - DNA, 20 bp, Homo sapiens
aagagcctgctgagagatgc

SEQ ID NO: 43680 - DNA, 20 bp, Homo sapiens
tgggcaggacggagatgcca

SEQ ID NO: 43681 - DNA, 19 bp, Homo sapiens
tgagtggccacaaatgcca

SEQ ID NO: 43682 - DNA, 25 bp, Homo sapiens
tgagtagctgggactacaggtgcca

SEQ ID NO: 43683 - DNA, 20 bp, Homo sapiens
tgagtagcccatcaaaaagc

SEQ ID NO: 43684 - DNA, 21 bp, Homo sapiens
tgagtagccctgggagatcca

SEQ ID NO: 43685 - DNA, 17 bp, Homo sapiens
tggcagccaagagacgc

SEQ ID NO: 43686 - DNA, 20 bp, Homo sapiens
tgagtagctggttgagaccc

SEQ ID NO: 43687 - DNA, 18 bp, Homo sapiens
tgagctaggggagatgcc

SEQ ID NO: 43688 - DNA, 18 bp, Homo sapiens
tgagtaaccactgagctg

SEQ ID NO: 43689 - DNA, 20 bp, Homo sapiens
gagtttggcttcaagagatg

SEQ ID NO: 43690 - DNA, 16 bp, Homo sapiens
tgagtagccgccagcc

SEQ ID NO: 43691 - DNA, 20 bp, Homo sapiens
tgggtaggagggagatgcca

SEQ ID NO: 43692 - DNA, 19 bp, Homo sapiens
gaaaagttgagagatgcca

SEQ ID NO: 43693 - DNA, 20 bp, Homo sapiens
tgaatagccattgagagagc

SEQ ID NO: 43694 - DNA, 18 bp, Homo sapiens
aaccaccgagagatgcca

SEQ ID NO: 43695 - DNA, 20 bp, Homo sapiens
taagtagccatcacaggcca

SEQ ID NO: 43696 - DNA, 19 bp, Homo sapiens
tgagcagccatccctctgc

SEQ ID NO: 43697 - DNA, 20 bp, Homo sapiens
tgagcagccactgaggtcca

SEQ ID NO: 43698 - DNA, 25 bp, Homo sapiens
tgagtagctaagactacaggtgcca

SEQ ID NO: 43699 - DNA, 21 bp, Homo sapiens
tgagcagctgccggtactcca

SEQ ID NO: 43700 - DNA, 22 bp, Homo sapiens
tgagtggccaccaagccttcca

SEQ ID NO: 43701 - DNA, 20 bp, Homo sapiens
gcaggcaactcaagagatgc

SEQ ID NO: 43702 - DNA, 19 bp, Homo sapiens
tgagcagccaccaggagcc

SEQ ID NO: 43703 - DNA, 19 bp, Homo sapiens
cagtccatgggagatgcca

SEQ ID NO: 43704 - DNA, 18 bp, Homo sapiens
tgagtgtgctaagatgcc

SEQ ID NO: 43705 - DNA, 20 bp, Homo sapiens
tgagtagctgcacaacccca

SEQ ID NO: 43706 - DNA, 17 bp, Homo sapiens
tgagtagccatcaggcc

SEQ ID NO: 43707 - DNA, 20 bp, Homo sapiens
gtggctcaaatcaagagatg

SEQ ID NO: 43708 - DNA, 20 bp, Homo sapiens
tgagcagctactgtgtgcca

SEQ ID NO: 43709 - DNA, 20 bp, Homo sapiens
tgagtagcttttagaatatg

SEQ ID NO: 43710 - DNA, 17 bp, Homo sapiens
tgagtagccacaaggcc

SEQ ID NO: 43711 - DNA, 18 bp, Homo sapiens
tgagtaaccacagtgatg

SEQ ID NO: 43712 - DNA, 18 bp, Homo sapiens
tgagcagctgccaacccc

SEQ ID NO: 43713 - DNA, 19 bp, Homo sapiens
agcagctagagagatgcca

SEQ ID NO: 43714 - DNA, 23 bp, Homo sapiens
tgagtaattgtttttaaatgcca

SEQ ID NO: 43715 - DNA, 18 bp, Homo sapiens
gagtccagttaagagatg

SEQ ID NO: 43716 - DNA, 18 bp, Homo sapiens
tggtacacaagagatgcc

SEQ ID NO: 43717 - DNA, 21 bp, Homo sapiens
agtaactgctgggagatgcca

SEQ ID NO: 43718 - DNA, 16 bp, Homo sapiens
tgagtagcagcagatg

SEQ ID NO: 43719 - DNA, 20 bp, Homo sapiens
tgggtggccaccaacactgc

SEQ ID NO: 43720 - DNA, 18 bp, Homo sapiens
tggctagccaccaggatg

SEQ ID NO: 43721 - DNA, 22 bp, Homo sapiens
tgggcagccaccatggcagtgc

SEQ ID NO: 43722 - DNA, 17 bp, Homo sapiens
tgcgtagccactgaccc

SEQ ID NO: 43723 - DNA, 18 bp, Homo sapiens
tgagcagccgtcactgcc

SEQ ID NO: 43724 - DNA, 19 bp, Homo sapiens
tgagtagccatgtaacccc

SEQ ID NO: 43725 - DNA, 21 bp, Homo sapiens
tgagtcggctaacagatgcca

SEQ ID NO: 43726 - DNA, 122 bp, Bovine adenovirus B
tttgagaataatgtactggtgtacaaagtgctgagacgggagagtccctcaaccgtgaaaatgtgtgtttgtgggacttctcattatgcaaagcctttgacactggcaattatttcttcaga

SEQ ID NO: 43727 - DNA, 24 bp, Bovine adenovirus B
taatgtactggtgtacaaagtgct

SEQ ID NO: 43728 - DNA, 20 bp, Homo sapiens
taatgtactggtgatgaagc

SEQ ID NO: 43729 - DNA, 18 bp, Homo sapiens
taatgtgtgtaaagtgct

SEQ ID NO: 43730 - DNA, 18 bp, Homo sapiens
taatgtttgtaaaagtgc

SEQ ID NO: 43731 - DNA, 21 bp, Homo sapiens
aatgtgcttgataacaaagtg

SEQ ID NO: 43732 - DNA, 20 bp, Homo sapiens
atgtattagagttaagtgct

SEQ ID NO: 43733 - DNA, 22 bp, Homo sapiens
taatgtctggtacatgtaagtg

SEQ ID NO: 43734 - DNA, 17 bp, Homo sapiens
atgtactggtgctagtg

SEQ ID NO: 43735 - DNA, 23 bp, Homo sapiens
taatatatttggagcaaagtgct

SEQ ID NO: 43736 - DNA, 74 bp, Helminthosporium victoriae virus 190S
gcgactcgtccgcttgacaggagaagctacggccttaaaggctgttgaccctctcttgccctgcgccgtttcgc

SEQ ID NO: 43737 - DNA, 24 bp, Helminthosporium victoriae virus 190S
tgacaggagaagctacggccttaa

SEQ ID NO: 43738 - DNA, 22 bp, Homo sapiens
tgacaggagcacatgtggcctt

SEQ ID NO: 43739 - DNA, 20 bp, Homo sapiens
tgagaggagaagctggctct

SEQ ID NO: 43740 - DNA, 22 bp, Homo sapiens
tgacggagctccctgtggcctt

SEQ ID NO: 43741 - DNA, 17 bp, Homo sapiens
tgacaggaagagctggc

SEQ ID NO: 43742 - DNA, 19 bp, Homo sapiens
tgacaggaggcgcagctta

SEQ ID NO: 43743 - DNA, 18 bp, Homo sapiens
aggagagaaacagcctta

SEQ ID NO: 43744 - DNA, 19 bp, Homo sapiens
ggagaggccctggccttaa

SEQ ID NO: 43745 - DNA, 22 bp, Homo sapiens
tgctaggagaagctgtgtacct

SEQ ID NO: 43746 - DNA, 20 bp, Homo sapiens
tgagaggagaagctgcacgc

SEQ ID NO: 43747 - DNA, 16 bp, Homo sapiens
cagggccaacggcctt

SEQ ID NO: 43748 - DNA, 19 bp, Homo sapiens
tgacaggaaaggctgtcag

SEQ ID NO: 43749 - DNA, 20 bp, Homo sapiens
ggagccagctacggctttaa

SEQ ID NO: 43750 - DNA, 18 bp, Homo sapiens
tgactggagaagctcctc

SEQ ID NO: 43751 - DNA, 18 bp, Homo sapiens
tgatgggacaagctacag

SEQ ID NO: 43752 - DNA, 19 bp, Homo sapiens
tggcaagagtctggcctta

SEQ ID NO: 43753 - DNA, 15 bp, Homo sapiens
tgacggaacggcctt

SEQ ID NO: 43754 - DNA, 21 bp, Homo sapiens
tgacaggaggcgtgtgtcctt

SEQ ID NO: 43755 - DNA, 18 bp, Homo sapiens
tgaaggagaaaggcttta

SEQ ID NO: 43756 - DNA, 15 bp, Homo sapiens
caggagaagctgcct

SEQ ID NO: 43757 - DNA, 17 bp, Homo sapiens
tgacaagagaggtccct

SEQ ID NO: 43758 - DNA, 21 bp, Homo sapiens
acaggagagggctcggcttta

SEQ ID NO: 43759 - DNA, 21 bp, Homo sapiens
tgacaggagacagctgcacga

SEQ ID NO: 43760 - DNA, 66 bp, Cucurbit aphid-borne yellows virus
gatattggctcgtctcaccttcaaccggttacagaagatgttggaggtaagatatgttgacttatc

SEQ ID NO: 43761 - DNA, 24 bp, Cucurbit aphid-borne yellows virus
ttggaggtaagatatgttgactta

SEQ ID NO: 43762 - DNA, 21 bp, Homo sapiens
tcggaggtgagatgtgatttg

SEQ ID NO: 43763 - DNA, 22 bp, Homo sapiens
ttggggctaggactgctgactt

SEQ ID NO: 43764 - DNA, 20 bp, Homo sapiens
ttggtggtaagatgcctctt

SEQ ID NO: 43765 - DNA, 19 bp, Homo sapiens
ggaggtaagaaggtgactt

SEQ ID NO: 43766 - DNA, 25 bp, Homo sapiens
ttggaggtacaggtatgctgtgctt

SEQ ID NO: 43767 - DNA, 22 bp, Homo sapiens
ggaggtaaggtcaggtggctta

SEQ ID NO: 43768 - DNA, 20 bp, Homo sapiens
ttggaggtgatggtgagctt

SEQ ID NO: 43769 - DNA, 20 bp, Homo sapiens
ttggaggctgggatatggtg

SEQ ID NO: 43770 - DNA, 19 bp, Homo sapiens
ttgaaggtaagatatgtca

SEQ ID NO: 43771 - DNA, 20 bp, Homo sapiens
tggaggtaagatgtgaattg

SEQ ID NO: 43772 - DNA, 19 bp, Homo sapiens
ttggaggtagggcatggtg

SEQ ID NO: 43773 - DNA, 60 bp, Cucurbit aphid-borne yellows virus
cattccggtcaacaaggccaaaatgctctataagcttatacatggctatgaaccggaatg

SEQ ID NO: 43774 - DNA, 22 bp, Cucurbit aphid-borne yellows virus
tacatggctatgaaccggaatg

SEQ ID NO: 43775 - DNA, 16 bp, Homo sapiens
cacatggctatggaat

SEQ ID NO: 43776 - DNA, 16 bp, Homo sapiens
acatggctgtgacgga

SEQ ID NO: 43777 - DNA, 22 bp, Homo sapiens
cacatggccatatattggaatg

SEQ ID NO: 43778 - DNA, 19 bp, Homo sapiens
tacatggcaatgaaaagga

SEQ ID NO: 43779 - DNA, 17 bp, Homo sapiens
taatggctataaaggga

SEQ ID NO: 43780 - DNA, 23 bp, Homo sapiens
tgatggctatggggaagggaatg

SEQ ID NO: 43781 - DNA, 18 bp, Homo sapiens
tgtgctgtgaccaggatg

SEQ ID NO: 43782 - DNA, 19 bp, Homo sapiens
tacatggctgtgagaccaa

SEQ ID NO: 43783 - DNA, 15 bp, Homo sapiens
tacatggctggaata

SEQ ID NO: 43784 - DNA, 16 bp, Homo sapiens
tacatggcctgggaat

SEQ ID NO: 43785 - DNA, 18 bp, Homo sapiens
taatggctatgagaccaa

SEQ ID NO: 43786 - DNA, 16 bp, Homo sapiens
tactggctatgggaat

SEQ ID NO: 43787 - DNA, 19 bp, Homo sapiens
cacatggctgggcgggatg

SEQ ID NO: 43788 - DNA, 16 bp, Homo sapiens
tgggatgaccggaatg

SEQ ID NO: 43789 - DNA, 62 bp, Helminthosporium victoriae virus 190S
gggttgtctatcgggccaccccctgctcagactatttgagcgaggctgaccgatgatgacct

SEQ ID NO: 43790 - DNA, 24 bp, Helminthosporium victoriae virus 190S
tgtctatcgggccaccccctgctc

SEQ ID NO: 43791 - DNA, 22 bp, Homo sapiens
tgtccatcgagagcttctgctc

SEQ ID NO: 43792 - DNA, 23 bp, Homo sapiens
tgtgctgtcaggtccccctgctc

SEQ ID NO: 43793 - DNA, 21 bp, Homo sapiens
tctattcccatctccctgctc

SEQ ID NO: 43794 - DNA, 18 bp, Homo sapiens
gaccgctaccccctgctc

SEQ ID NO: 43795 - DNA, 21 bp, Homo sapiens
tgtccctttcaccctctgttc

SEQ ID NO: 43796 - DNA, 22 bp, Homo sapiens
tatctatctggccctcctgttc

SEQ ID NO: 43797 - DNA, 22 bp, Homo sapiens
tgccctctgccaccccctgctc

SEQ ID NO: 43798 - DNA, 22 bp, Homo sapiens
gtctatcgctgcccctctgctc

SEQ ID NO: 43799 - DNA, 19 bp, Homo sapiens
tgcctcctcatcccctgct

SEQ ID NO: 43800 - DNA, 22 bp, Homo sapiens
tgcctttggccgccccctgctc

SEQ ID NO: 43801 - DNA, 17 bp, Homo sapiens
gtctaccacctcctgct

SEQ ID NO: 43802 - DNA, 21 bp, Homo sapiens
tgtcctgtcccctcccctgct

SEQ ID NO: 43803 - DNA, 22 bp, Homo sapiens
tgtctgtctccattccctgctc

SEQ ID NO: 43804 - DNA, 20 bp, Homo sapiens
gcccagggccacctcttgct

SEQ ID NO: 43805 - DNA, 18 bp, Homo sapiens
tcaaaccatcccttgctc

SEQ ID NO: 43806 - DNA, 68 bp, Cucurbit aphid-borne yellows virus
cgacgagaggagatcgactttcctgggataacttcctacaggatttcaaacaggcggtcctctcgttg

SEQ ID NO: 43807 - DNA, 24 bp, Cucurbit aphid-borne yellows virus
ctacaggatttcaaacaggcggtc

SEQ ID NO: 43808 - DNA, 22 bp, Homo sapiens
ccacaggattttaaagcctacg

SEQ ID NO: 43809 - DNA, 19 bp, Homo sapiens
cactggccaaacaggtggt

SEQ ID NO: 43810 - DNA, 17 bp, Homo sapiens
caggactcacaggtggt

SEQ ID NO: 43811 - DNA, 20 bp, Homo sapiens
ctgcaggatttcagggaagt

SEQ ID NO: 43812 - DNA, 17 bp, Homo sapiens
tgacaggattttaagca

SEQ ID NO: 43813 - DNA, 23 bp, Homo sapiens
ctacaggagtttcaacaatgggt

SEQ ID NO: 43814 - DNA, 19 bp, Homo sapiens
ggaggccaaggcaggcggt

SEQ ID NO: 43815 - DNA, 17 bp, Homo sapiens
cagcatttcaaagcagt

SEQ ID NO: 43816 - DNA, 17 bp, Homo sapiens
ctacaggattgcaggca

SEQ ID NO: 43817 - DNA, 18 bp, Homo sapiens
tacaggatttgagccaat

SEQ ID NO: 43818 - DNA, 19 bp, Homo sapiens
ctatgggatttcaaaaaac

SEQ ID NO: 43819 - DNA, 21 bp, Homo sapiens
ctacaggatttctgaatcagt

SEQ ID NO: 43820 - DNA, 18 bp, Homo sapiens
tacaggatttaaaaaaag

SEQ ID NO: 43821 - DNA, 20 bp, Homo sapiens
ctacaggggttcaaacagac

SEQ ID NO: 43822 - DNA, 18 bp, Homo sapiens
tacaggatgtcagggagt

SEQ ID NO: 43823 - DNA, 19 bp, Homo sapiens
caggagcctacaggcggtc

SEQ ID NO: 43824 - DNA, 64 bp, Helminthosporium victoriae virus 190S
tggatacaccggtgctgaattcttacgacttgggatcaacaagtcgtacgccatcgggtatcta

SEQ ID NO: 43825 - DNA, 18 bp, Helminthosporium victoriae virus 190S
tacgccatcgggtatcta

SEQ ID NO: 43826 - DNA, 19 bp, Homo sapiens
tacaccatggcctcatcta

SEQ ID NO: 43827 - DNA, 17 bp, Homo sapiens
tacgccatatgatccta

SEQ ID NO: 43828 - DNA, 22 bp, Homo sapiens
tacgccattgttttccgggtat

SEQ ID NO: 43829 - DNA, 18 bp, Homo sapiens
cgccatcataaagatcta

SEQ ID NO: 43830 - DNA, 131 bp, Helminthosporium victoriae virus 190S
ggttgaggcccaagctcgaaatcgcgcgaccggcgatcaagtccctgatgctctcgtcatcttgccagaaaagccggacctggagctcaaactcgaccgcacgtcccgatgccgaagcttaggcgccaacc

SEQ ID NO: 43831 - DNA, 24 bp, Helminthosporium victoriae virus 190S
tccctgatgctctcgtcatcttgc

SEQ ID NO: 43832 - DNA, 19 bp, Homo sapiens
cctgatgctctctctctgc

SEQ ID NO: 43833 - DNA, 16 bp, Homo sapiens
tctctgataccatctt

SEQ ID NO: 43834 - DNA, 20 bp, Homo sapiens
cctatgctctccttctttgc

SEQ ID NO: 43835 - DNA, 23 bp, Homo sapiens
tccctggtactctcgggcgctgc

SEQ ID NO: 43836 - DNA, 23 bp, Homo sapiens
tccctgatgcctcaccttcttgc

SEQ ID NO: 43837 - DNA, 21 bp, Homo sapiens
tctctgatgctacccttcttg

SEQ ID NO: 43838 - DNA, 18 bp, Homo sapiens
cccggtggggtcatcttg

SEQ ID NO: 43839 - DNA, 23 bp, Homo sapiens
ccctgatggattctgttgtcttg

SEQ ID NO: 43840 - DNA, 21 bp, Homo sapiens
tccctgatgtcttgtccctgc

SEQ ID NO: 43841 - DNA, 19 bp, Homo sapiens
tcattgatgctcttgtctc

SEQ ID NO: 43842 - DNA, 21 bp, Homo sapiens
tctttgatgctctgcagctgc

SEQ ID NO: 43843 - DNA, 22 bp, Homo sapiens
cccttggactgtcgtcatcttg

SEQ ID NO: 43844 - DNA, 21 bp, Homo sapiens
ccctgatgctcttctagttgc

SEQ ID NO: 43845 - DNA, 22 bp, Homo sapiens
cccagccacttttgtcatcttg

SEQ ID NO: 43846 - DNA, 23 bp, Homo sapiens
tccttgatactctttttttttgc

SEQ ID NO: 43847 - DNA, 20 bp, Homo sapiens
tgattgcaagttcatcttgc

SEQ ID NO: 43848 - DNA, 18 bp, Homo sapiens
tccctgatcctagtcttg

SEQ ID NO: 43849 - DNA, 22 bp, Homo sapiens
tctttgatgccctgatttcttg

SEQ ID NO: 43850 - DNA, 19 bp, Homo sapiens
ctgatgctcttgcaggctg

SEQ ID NO: 43851 - DNA, 23 bp, Homo sapiens
cccacatctctctcgtcattttg

SEQ ID NO: 43852 - DNA, 61 bp, Gallid herpesvirus 3
cggccgcattcatattctcgatttcttgtgcaaacacccgttcgaaatgatccatgcgccg

SEQ ID NO: 43853 - DNA, 24 bp, Gallid herpesvirus 3
gccgcattcatattctcgatttct

SEQ ID NO: 43854 - DNA, 19 bp, Homo sapiens
gcagcattcataaggtttc

SEQ ID NO: 43855 - DNA, 22 bp, Homo sapiens
gccgtcttcatattccctactt

SEQ ID NO: 43856 - DNA, 23 bp, Homo sapiens
gctgcattcattcataggtttct

SEQ ID NO: 43857 - DNA, 19 bp, Homo sapiens
actgcattcataaggtttc

SEQ ID NO: 43858 - DNA, 60 bp, Gallid herpesvirus 3
acgtagtatctatcttgataaggctatgcgagcaggccccatccgggatatgagctaggt

SEQ ID NO: 43859 - DNA, 24 bp, Gallid herpesvirus 3
tatcttgataaggctatgcgagca

SEQ ID NO: 43860 - DNA, 18 bp, Homo sapiens
tatcttgagaggcaggcg

SEQ ID NO: 43861 - DNA, 22 bp, Homo sapiens
tatcttgagtaagggttgagca

SEQ ID NO: 43862 - DNA, 18 bp, Homo sapiens
tattttcataaggctttg

SEQ ID NO: 43863 - DNA, 20 bp, Homo sapiens
tattctgaagactatgtgag

SEQ ID NO: 43864 - DNA, 18 bp, Homo sapiens
tatcttgaaaaggttata

SEQ ID NO: 43865 - DNA, 21 bp, Homo sapiens
tcttgatagggctactgggcg

SEQ ID NO: 43866 - DNA, 25 bp, Homo sapiens
tatcttgatagcggtccatagagca

SEQ ID NO: 43867 - DNA, 18 bp, Homo sapiens
tatcttaatggggttgcg

SEQ ID NO: 43868 - DNA, 18 bp, Homo sapiens
tcttgataggagctcatg

SEQ ID NO: 43869 - DNA, 62 bp, Human enterovirus A
caggtcgatgagtcactgcgatccccacgggcgaccgtggcagtggctgcgttggcggcctg

SEQ ID NO: 43870 - DNA, 24 bp, Human enterovirus A
tgagtcactgcgatccccacgggc

SEQ ID NO: 43871 - DNA, 19 bp, Homo sapiens
cgggtcactgccgcacggg

SEQ ID NO: 43872 - DNA, 19 bp, Homo sapiens
taagtcatggtcccacggg

SEQ ID NO: 43873 - DNA, 19 bp, Homo sapiens
tgagtcactgggtcccagg

SEQ ID NO: 43874 - DNA, 25 bp, Homo sapiens
tgagtcactgtgtctggcgcccgtg

SEQ ID NO: 43875 - DNA, 27 bp, Homo sapiens
tgggtcactgcaaagatcactatgggc

SEQ ID NO: 43876 - DNA, 19 bp, Homo sapiens
tgagtcactgtgattacag

SEQ ID NO: 43877 - DNA, 20 bp, Homo sapiens
tgagtcactgaggtccaagg

SEQ ID NO: 43878 - DNA, 19 bp, Homo sapiens
taagtcacagccccacggg

SEQ ID NO: 43879 - DNA, 19 bp, Homo sapiens
tgagtcactgggtccccgg

SEQ ID NO: 43880 - DNA, 18 bp, Homo sapiens
tgcagtcactcccatggg

SEQ ID NO: 43881 - DNA, 20 bp, Homo sapiens
gcagctgcgatccctgtggg

SEQ ID NO: 43882 - DNA, 25 bp, Homo sapiens
tgagccactgcgcccagccatgggc

SEQ ID NO: 43883 - DNA, 18 bp, Homo sapiens
gctcctggccccacgggc

SEQ ID NO: 43884 - DNA, 28 bp, Homo sapiens
tgggtcactgcagttctgcgcccgtggg

SEQ ID NO: 43885 - DNA, 24 bp, Homo sapiens
gagtcactgtgatttttgcccgtg

SEQ ID NO: 43886 - DNA, 85 bp, Gallid herpesvirus 3
ggagcggaacccattgaataatgtcgtgtatgagtctatcaatatttcaccgtatacgttaacccgcagcattttttccagctcc

SEQ ID NO: 43887 - DNA, 24 bp, Gallid herpesvirus 3
tacgttaacccgcagcattttttc

SEQ ID NO: 43888 - DNA, 21 bp, Homo sapiens
tacattacccagcattttttc

SEQ ID NO: 43889 - DNA, 19 bp, Homo sapiens
gttagaagcagcatttttt

SEQ ID NO: 43890 - DNA, 22 bp, Homo sapiens
tactttgcagacagcatttttt

SEQ ID NO: 43891 - DNA, 17 bp, Homo sapiens
caactgcagcatttttt

SEQ ID NO: 43892 - DNA, 68 bp, Human papillomavirus type 54
gactggaactttggtataacccccccagctacaagtagtttggaggacacatataggtttgtacagtc

SEQ ID NO: 43893 - DNA, 24 bp, Human papillomavirus type 54
actttggtataacccccccagcta

SEQ ID NO: 43894 - DNA, 18 bp, Homo sapiens
accttggtcccttcagct

SEQ ID NO: 43895 - DNA, 23 bp, Homo sapiens
actttagtataagcctctcagct

SEQ ID NO: 43896 - DNA, 22 bp, Homo sapiens
ctttggtatgtgccatgcagct

SEQ ID NO: 43897 - DNA, 17 bp, Homo sapiens
ctcggacctccccagct

SEQ ID NO: 43898 - DNA, 19 bp, Homo sapiens
ctttgctcctcccccagct

SEQ ID NO: 43899 - DNA, 20 bp, Homo sapiens
ctttaaaattcccccagcta

SEQ ID NO: 43900 - DNA, 19 bp, Homo sapiens
ctttggctcctccccagct

SEQ ID NO: 43901 - DNA, 21 bp, Homo sapiens
ctttggcactgccccctggct

SEQ ID NO: 43902 - DNA, 20 bp, Homo sapiens
ggttttcaacttccccagct

SEQ ID NO: 43903 - DNA, 19 bp, Homo sapiens
ctcagctacctccccagct

SEQ ID NO: 43904 - DNA, 21 bp, Homo sapiens
actctgaccccctccccagct

SEQ ID NO: 43905 - DNA, 20 bp, Homo sapiens
ctttgacataattcctccag

SEQ ID NO: 43906 - DNA, 17 bp, Homo sapiens
tctgggcctccccagct

SEQ ID NO: 43907 - DNA, 22 bp, Homo sapiens
tttagcactagagcccctccag

SEQ ID NO: 43908 - DNA, 20 bp, Homo sapiens
ccttgggccttccccagcta

SEQ ID NO: 43909 - DNA, 19 bp, Homo sapiens
accttggtaacctctggct

SEQ ID NO: 43910 - DNA, 16 bp, Homo sapiens
actctaccctcccagc

SEQ ID NO: 43911 - DNA, 18 bp, Homo sapiens
tttggtacaaaaacagct

SEQ ID NO: 43912 - DNA, 19 bp, Homo sapiens
ctctgggccctccccagct

SEQ ID NO: 43913 - DNA, 17 bp, Homo sapiens
tctggactcccccagct

SEQ ID NO: 43914 - DNA, 71 bp, Human papillomavirus type 54
gggtcgcaagtttttactacaggctggcctacgtgcacgtccgcgccttcggcctgtaaagcgtgcagccc

SEQ ID NO: 43915 - DNA, 24 bp, Human papillomavirus type 54
tcgcaagtttttactacaggctgg

SEQ ID NO: 43916 - DNA, 22 bp, Homo sapiens
ccgcaagttggaggcgggctgg

SEQ ID NO: 43917 - DNA, 24 bp, Homo sapiens
tccaagtggccacctgcaggctgg

SEQ ID NO: 43918 - DNA, 18 bp, Homo sapiens
tccaaagactgcaggctg

SEQ ID NO: 43919 - DNA, 20 bp, Homo sapiens
gtacctatgctgcaggctgg

SEQ ID NO: 43920 - DNA, 22 bp, Homo sapiens
tccaagttttccctaaggctgg

SEQ ID NO: 43921 - DNA, 19 bp, Homo sapiens
tccaagaacctgcaggctg

SEQ ID NO: 43922 - DNA, 20 bp, Homo sapiens
gttctgttgctgcaggctgg

SEQ ID NO: 43923 - DNA, 22 bp, Homo sapiens
tccaagtttttgcagaagctgg

SEQ ID NO: 43924 - DNA, 18 bp, Homo sapiens
cgcgagctctgcaggctg

SEQ ID NO: 43925 - DNA, 19 bp, Homo sapiens
tcggtgctgctgcaggctg

SEQ ID NO: 43926 - DNA, 17 bp, Homo sapiens
agtttttacacggctgg

SEQ ID NO: 43927 - DNA, 92 bp, Murine leukemia virus
tctggcaaccaccctctgtggacctggtggcctgaccttaccccagatttatgtatgttagcccaccatggaccatcttattgggggctaga

SEQ ID NO: 43928 - DNA, 24 bp, Murine leukemia virus
ttagcccaccatggaccatcttat

SEQ ID NO: 43929 - DNA, 22 bp, Homo sapiens
tagctcacggaaaccatcttat

SEQ ID NO: 43930 - DNA, 18 bp, Homo sapiens
ttagcccatctgcagctt

SEQ ID NO: 43931 - DNA, 18 bp, Homo sapiens
tcagttcaccatggctta

SEQ ID NO: 43932 - DNA, 24 bp, Homo sapiens
tcagtttttaatggatcatcttat

SEQ ID NO: 43933 - DNA, 22 bp, Homo sapiens
acctattattggaccattttat

SEQ ID NO: 43934 - DNA, 82 bp, Human papillomavirus type 54
ccagtttctaaggttgtcagcacggatgaatatgtgactcgcacaagcatatactatcatgcaagcagctctagattattgg

SEQ ID NO: 43935 - DNA, 24 bp, Human papillomavirus type 54
tctaaggttgtcagcacggatgaa

SEQ ID NO: 43936 - DNA, 19 bp, Homo sapiens
tctaaggtttcacaaaatg

SEQ ID NO: 43937 - DNA, 17 bp, Homo sapiens
cctggggttcacggatg

SEQ ID NO: 43938 - DNA, 19 bp, Homo sapiens
tctaaggtgttgggaatga

SEQ ID NO: 43939 - DNA, 22 bp, Homo sapiens
tctgaggttgccaggaccatga

SEQ ID NO: 43940 - DNA, 21 bp, Homo sapiens
tcctagggggcagcacggatg

SEQ ID NO: 43941 - DNA, 22 bp, Homo sapiens
taagattgtgattctggatgaa

SEQ ID NO: 43942 - DNA, 19 bp, Homo sapiens
tctcgggttgtcaggggtg

SEQ ID NO: 43943 - DNA, 18 bp, Homo sapiens
taaagttgtcaaggggtg

SEQ ID NO: 43944 - DNA, 21 bp, Homo sapiens
tctgaggttgtcacagctgaa

SEQ ID NO: 43945 - DNA, 20 bp, Homo sapiens
tctaaggttgctggctgatg

SEQ ID NO: 43946 - DNA, 18 bp, Homo sapiens
ggttgtcagtcacactga

SEQ ID NO: 43947 - DNA, 20 bp, Homo sapiens
taaggttgtcatggtgtgaa

SEQ ID NO: 43948 - DNA, 22 bp, Homo sapiens
ctgaggttgggcaccacggatg

SEQ ID NO: 43949 - DNA, 19 bp, Homo sapiens
tctaaggtgtggagggtga

SEQ ID NO: 43950 - DNA, 20 bp, Homo sapiens
taaggctgtcggctccctga

SEQ ID NO: 43951 - DNA, 118 bp, Frog adenovirus 1
gcttcacaagaccaacaaaaggtggtgaacaacgttttgactcgtctattgcctggattactaactcaagaattaagaactttaaaagtcaccacacttgcagatgggtctgtgaagt

SEQ ID NO: 43952 - DNA, 24 bp, Frog adenovirus 1
taactcaagaattaagaactttaa

SEQ ID NO: 43953 - DNA, 20 bp, Homo sapiens
ctcagaattaagcaaattaa

SEQ ID NO: 43954 - DNA, 24 bp, Homo sapiens
taactcagcttagaagaactttaa

SEQ ID NO: 43955 - DNA, 21 bp, Homo sapiens
actcaagaaagcgagttttaa

SEQ ID NO: 43956 - DNA, 18 bp, Homo sapiens
aactcaaaaagaacttta

SEQ ID NO: 43957 - DNA, 22 bp, Homo sapiens
taactcaaaaatgtaactttaa

SEQ ID NO: 43958 - DNA, 18 bp, Homo sapiens
tcaagaattacactttaa

SEQ ID NO: 43959 - DNA, 18 bp, Homo sapiens
taactggagaattaagaa

SEQ ID NO: 43960 - DNA, 19 bp, Homo sapiens
aagaaccatggaactttaa

SEQ ID NO: 43961 - DNA, 78 bp, Common chimpanzee papillomavirus 1
tctagactacttgcagtgggtaatccctatttccctattagaaaagctaacaaaactattgtacccaaggtatctgga

SEQ ID NO: 43962 - DNA, 24 bp, Common chimpanzee papillomavirus 1
agtgggtaatccctatttccctat

SEQ ID NO: 43963 - DNA, 24 bp, Homo sapiens
ataagcaagtttctattttcctat

SEQ ID NO: 43964 - DNA, 20 bp, Homo sapiens
tgggtaatcccagaaattcc

SEQ ID NO: 43965 - DNA, 23 bp, Homo sapiens
agtaggtgatttcttttccctat

SEQ ID NO: 43966 - DNA, 18 bp, Homo sapiens
gtgggtcagatttcccta

SEQ ID NO: 43967 - DNA, 20 bp, Homo sapiens
agtggctaatccctggccta

SEQ ID NO: 43968 - DNA, 22 bp, Homo sapiens
gttggtatttctatttccttat

SEQ ID NO: 43969 - DNA, 19 bp, Homo sapiens
gtgggtaattgatctctct

SEQ ID NO: 43970 - DNA, 21 bp, Homo sapiens
gtgggggtcagatttccctat

SEQ ID NO: 43971 - DNA, 19 bp, Homo sapiens
agatgaccttatttcccta

SEQ ID NO: 43972 - DNA, 109 bp, Common chimpanzee papillomavirus 1
aacgtgctgcaagtacatctacagccacacctacacgtaaaaaggttaaacggaaatagtttataattgtgttggtatgtgtgttatgtatgtgtgttgtttatatgtt

SEQ ID NO: 43973 - DNA, 24 bp, Common chimpanzee papillomavirus 1
tgcaagtacatctacagccacacc

SEQ ID NO: 43974 - DNA, 20 bp, Homo sapiens
tgcaagtacagctttaaagc

SEQ ID NO: 43975 - DNA, 21 bp, Homo sapiens
agcacttttctacagctgcac

SEQ ID NO: 43976 - DNA, 19 bp, Homo sapiens
tacaagtacatgtccatgc

SEQ ID NO: 43977 - DNA, 23 bp, Homo sapiens
tgtgagagcagcccagccacacc

SEQ ID NO: 43978 - DNA, 25 bp, Homo sapiens
tgcaagtaaaacaaacagctgtacc

SEQ ID NO: 43979 - DNA, 21 bp, Homo sapiens
tgcaagtaggtctcttccaca

SEQ ID NO: 43980 - DNA, 18 bp, Homo sapiens
tgctgcttcttacagcca

SEQ ID NO: 43981 - DNA, 22 bp, Homo sapiens
gcctccaacatctacagccaca

SEQ ID NO: 43982 - DNA, 20 bp, Homo sapiens
tgaaagtggatacagccaca

SEQ ID NO: 43983 - DNA, 20 bp, Homo sapiens
agtatacgcagagccacacc

SEQ ID NO: 43984 - DNA, 19 bp, Homo sapiens
tgcaggtgcatcacacagc

SEQ ID NO: 43985 - DNA, 26 bp, Homo sapiens
tggaagtacatctgctgagctcatac

SEQ ID NO: 43986 - DNA, 16 bp, Homo sapiens
gcaggttacagccaca

SEQ ID NO: 43987 - DNA, 19 bp, Homo sapiens
tgcaagttacatgttacca

SEQ ID NO: 43988 - DNA, 22 bp, Homo sapiens
tacaggtgcatgccaccacacc

SEQ ID NO: 43989 - DNA, 21 bp, Homo sapiens
tgcaagtatcttttgctgcac

SEQ ID NO: 43990 - DNA, 20 bp, Homo sapiens
tgtgagtacatcatactcca

SEQ ID NO: 43991 - DNA, 17 bp, Homo sapiens
tgaagttcacagccaca

SEQ ID NO: 43992 - DNA, 22 bp, Homo sapiens
tgcaggcatgtgacaccacacc

SEQ ID NO: 43993 - DNA, 22 bp, Homo sapiens
tacaggtgcatcctaccacacc

SEQ ID NO: 43994 - DNA, 19 bp, Homo sapiens
tgcaaatacatactatgcc

SEQ ID NO: 43995 - DNA, 19 bp, Homo sapiens
tgcagctggtcagccacac

SEQ ID NO: 43996 - DNA, 19 bp, Homo sapiens
tgcatgtacaaagccacac

SEQ ID NO: 43997 - DNA, 22 bp, Homo sapiens
tgcaaggtatcaacaaccacac

SEQ ID NO: 43998 - DNA, 23 bp, Homo sapiens
tgcgagggcacggacgccacacc

SEQ ID NO: 43999 - DNA, 17 bp, Homo sapiens
tgcagtgacagccacac

SEQ ID NO: 44000 - DNA, 23 bp, Homo sapiens
tgcggggccagctaagccacacc

SEQ ID NO: 44001 - DNA, 17 bp, Homo sapiens
caagtacatctcaatca

SEQ ID NO: 44002 - DNA, 19 bp, Homo sapiens
tgcaaatatgtctagacac

SEQ ID NO: 44003 - DNA, 24 bp, Homo sapiens
tacaagtaacccaggcagccacac

SEQ ID NO: 44004 - DNA, 20 bp, Homo sapiens
tgaagtacatctgtttggcc

SEQ ID NO: 44005 - DNA, 17 bp, Homo sapiens
caagtacatgctgccca

SEQ ID NO: 44006 - DNA, 19 bp, Homo sapiens
tgcaagtacatttattaca

SEQ ID NO: 44007 - DNA, 22 bp, Homo sapiens
agtacatccactgggttgcacc

SEQ ID NO: 44008 - DNA, 21 bp, Homo sapiens
tgcaagtacactgcatacaac

SEQ ID NO: 44009 - DNA, 16 bp, Homo sapiens
tgaagtacacagccac

SEQ ID NO: 44010 - DNA, 22 bp, Homo sapiens
tacaggtgtgtaccaccacacc

SEQ ID NO: 44011 - DNA, 17 bp, Homo sapiens
tgaaagtcacagccaca

SEQ ID NO: 44012 - DNA, 19 bp, Homo sapiens
tgcaagtacattaacacag

SEQ ID NO: 44013 - DNA, 68 bp, Frog adenovirus 1
caaacattaccatcgacacttcacaatgctgaactggtggagcaaagtgtcactctggctgtgctttg

SEQ ID NO: 44014 - DNA, 24 bp, Frog adenovirus 1
tcgacacttcacaatgctgaactg

SEQ ID NO: 44015 - DNA, 22 bp, Homo sapiens
tcacacttcacaaagccaactg

SEQ ID NO: 44016 - DNA, 18 bp, Homo sapiens
gacacttccaagacactg

SEQ ID NO: 44017 - DNA, 21 bp, Homo sapiens
tcaacacttcttgctgaactg

SEQ ID NO: 44018 - DNA, 19 bp, Homo sapiens
gacggtcactgctgaactg

SEQ ID NO: 44019 - DNA, 19 bp, Homo sapiens
tcagcacttcacaatcacc

SEQ ID NO: 44020 - DNA, 22 bp, Homo sapiens
gacacttcacattcaagggctg

SEQ ID NO: 44021 - DNA, 19 bp, Homo sapiens
tcgtgcttcacaatcagcc

SEQ ID NO: 44022 - DNA, 64 bp, Common chimpanzee papillomavirus 1
ttgtgtcttctgaggcccagttgtttaataaaccttactggttacacaaggcccagggacacaa

SEQ ID NO: 44023 - DNA, 22 bp, Common chimpanzee papillomavirus 1
tacacaaggcccagggacacaa

SEQ ID NO: 44024 - DNA, 19 bp, Homo sapiens
tacacaaggacagagcaca

SEQ ID NO: 44025 - DNA, 23 bp, Homo sapiens
tacacaaggctgattactgtaca

SEQ ID NO: 44026 - DNA, 20 bp, Homo sapiens
catgaggcaggcagacacaa

SEQ ID NO: 44027 - DNA, 21 bp, Homo sapiens
cacaaggcactgctgggcaca

SEQ ID NO: 44028 - DNA, 19 bp, Homo sapiens
tacaaaaggtccaagaaca

SEQ ID NO: 44029 - DNA, 19 bp, Homo sapiens
acacgggacatgggacaca

SEQ ID NO: 44030 - DNA, 19 bp, Homo sapiens
caaaggcccaggaaagcaa

SEQ ID NO: 44031 - DNA, 19 bp, Homo sapiens
acacaaggcttggattcaa

SEQ ID NO: 44032 - DNA, 16 bp, Homo sapiens
cacacacaggggcaca

SEQ ID NO: 44033 - DNA, 19 bp, Homo sapiens
tacacaagactttaaagca

SEQ ID NO: 44034 - DNA, 17 bp, Homo sapiens
acacattagggacacaa

SEQ ID NO: 44035 - DNA, 19 bp, Homo sapiens
caagtacccagggacacaa

SEQ ID NO: 44036 - DNA, 20 bp, Homo sapiens
cacgtgaggcccaaagccac

SEQ ID NO: 44037 - DNA, 21 bp, Homo sapiens
taccagttcctggggacacaa

SEQ ID NO: 44038 - DNA, 16 bp, Homo sapiens
cacgagacaggacaca

SEQ ID NO: 44039 - DNA, 19 bp, Homo sapiens
tacaagaggcccaaattca

SEQ ID NO: 44040 - DNA, 20 bp, Homo sapiens
tacggagggaccaggacaca

SEQ ID NO: 44041 - DNA, 18 bp, Homo sapiens
tacatgagcccagaggca

SEQ ID NO: 44042 - DNA, 21 bp, Homo sapiens
tacccagggccgagtgacaca

SEQ ID NO: 44043 - DNA, 17 bp, Homo sapiens
cacccacagggacacaa

SEQ ID NO: 44044 - DNA, 19 bp, Homo sapiens
tactcaagaaaaggacaca

SEQ ID NO: 44045 - DNA, 17 bp, Homo sapiens
acactgccagggacaca

SEQ ID NO: 44046 - DNA, 16 bp, Homo sapiens
tacacaaaggtacaca

SEQ ID NO: 44047 - DNA, 22 bp, Homo sapiens
acacagggatcatgggacacaa

SEQ ID NO: 44048 - DNA, 19 bp, Homo sapiens
tacacaaagtcatccacac

SEQ ID NO: 44049 - DNA, 17 bp, Homo sapiens
tacagtgggggacacaa

SEQ ID NO: 44050 - DNA, 18 bp, Homo sapiens
acacaagcatggacacaa

SEQ ID NO: 44051 - DNA, 20 bp, Homo sapiens
tacacagtgaatggacacaa

SEQ ID NO: 44052 - DNA, 16 bp, Homo sapiens
cacaaggccagccaca

SEQ ID NO: 44053 - DNA, 17 bp, Homo sapiens
cacacagggaggacaca

SEQ ID NO: 44054 - DNA, 20 bp, Homo sapiens
tacacaagaaaaggatgcaa

SEQ ID NO: 44055 - DNA, 16 bp, Homo sapiens
acacaggccgggcaca

SEQ ID NO: 44056 - DNA, 19 bp, Homo sapiens
accaggccttagggacaca

SEQ ID NO: 44057 - DNA, 19 bp, Homo sapiens
tacacaagacagcggacac

SEQ ID NO: 44058 - DNA, 16 bp, Homo sapiens
cataagaaaggacaca

SEQ ID NO: 44059 - DNA, 22 bp, Homo sapiens
tacacaaggctcttctgcacaa

SEQ ID NO: 44060 - DNA, 20 bp, Homo sapiens
cacagggtctgaaggacaca

SEQ ID NO: 44061 - DNA, 21 bp, Homo sapiens
cacaaggcctgaattcacaca

SEQ ID NO: 44062 - DNA, 18 bp, Homo sapiens
cacacagtgcgggacaca

SEQ ID NO: 44063 - DNA, 18 bp, Homo sapiens
acaaggcctagttaccaa

SEQ ID NO: 44064 - DNA, 17 bp, Homo sapiens
acagagacagggacaca

SEQ ID NO: 44065 - DNA, 17 bp, Homo sapiens
cacaaggctaaaacgca

SEQ ID NO: 44066 - DNA, 15 bp, Homo sapiens
acacaaggccaaaca

SEQ ID NO: 44067 - DNA, 19 bp, Homo sapiens
cacgggaaccagggacaca

SEQ ID NO: 44068 - DNA, 17 bp, Homo sapiens
acacaaggctgagagca

SEQ ID NO: 44069 - DNA, 20 bp, Homo sapiens
acatcaaggtggggacacaa

SEQ ID NO: 44070 - DNA, 19 bp, Homo sapiens
tacagaggctgaaaacaca

SEQ ID NO: 44071 - DNA, 17 bp, Homo sapiens
tacacaagcccaagcca

SEQ ID NO: 44072 - DNA, 15 bp, Homo sapiens
cacaagcccagcaca

SEQ ID NO: 44073 - DNA, 18 bp, Homo sapiens
cacacagatggggacaca

SEQ ID NO: 44074 - DNA, 16 bp, Homo sapiens
cacacaaagggataca

SEQ ID NO: 44075 - DNA, 19 bp, Homo sapiens
acacaaagatggggcacaa

SEQ ID NO: 44076 - DNA, 18 bp, Homo sapiens
cacaaagcacaaacacaa

SEQ ID NO: 44077 - DNA, 17 bp, Homo sapiens
cacagggcagaacacaa

SEQ ID NO: 44078 - DNA, 17 bp, Homo sapiens
cataagaaaggacacaa

SEQ ID NO: 44079 - DNA, 18 bp, Homo sapiens
acaaggtcaaagacacaa

SEQ ID NO: 44080 - DNA, 20 bp, Homo sapiens
acatgcagagcagggacaca

SEQ ID NO: 44081 - DNA, 20 bp, Homo sapiens
acacagcagtgaggggcaca

SEQ ID NO: 44082 - DNA, 19 bp, Homo sapiens
caagtgcccaggggcacaa

SEQ ID NO: 44083 - DNA, 19 bp, Homo sapiens
acatggggctaagaacaca

SEQ ID NO: 44084 - DNA, 18 bp, Homo sapiens
taccaaaacagggacaca

SEQ ID NO: 44085 - DNA, 21 bp, Homo sapiens
cacacaagacctggggacaca

SEQ ID NO: 44086 - DNA, 18 bp, Homo sapiens
cacacaaggcttaaacca

SEQ ID NO: 44087 - DNA, 22 bp, Homo sapiens
acacaaggtctcaggatgcaca

SEQ ID NO: 44088 - DNA, 17 bp, Homo sapiens
tacagaagaggacacaa

SEQ ID NO: 44089 - DNA, 20 bp, Homo sapiens
tacacaaagctgctgataca

SEQ ID NO: 44090 - DNA, 16 bp, Homo sapiens
tacacaagatggcaca

SEQ ID NO: 44091 - DNA, 18 bp, Homo sapiens
cacaggcccagctactca

SEQ ID NO: 44092 - DNA, 16 bp, Homo sapiens
acacaaagggggcaca

SEQ ID NO: 44093 - DNA, 19 bp, Homo sapiens
tacattaggaacaaggaca

SEQ ID NO: 44094 - DNA, 16 bp, Homo sapiens
tacaaaggaaggacac

SEQ ID NO: 44095 - DNA, 18 bp, Homo sapiens
cacaaagctcaaggcaca

SEQ ID NO: 44096 - DNA, 19 bp, Homo sapiens
tacacaaagttcagagcca

SEQ ID NO: 44097 - DNA, 15 bp, Homo sapiens
acacagggagacaca

SEQ ID NO: 44098 - DNA, 19 bp, Homo sapiens
tacataggagccaaagaca

SEQ ID NO: 44099 - DNA, 21 bp, Homo sapiens
acacagggacacagggacaca

SEQ ID NO: 44100 - DNA, 18 bp, Homo sapiens
tacacaagtccaaaacca

SEQ ID NO: 44101 - DNA, 18 bp, Homo sapiens
caacacccagggacacaa

SEQ ID NO: 44102 - DNA, 23 bp, Homo sapiens
tacacaaggccagcatttcacaa

SEQ ID NO: 44103 - DNA, 16 bp, Homo sapiens
acacaggcaggataca

SEQ ID NO: 44104 - DNA, 20 bp, Homo sapiens
cacgtgagggcagggacaca

SEQ ID NO: 44105 - DNA, 16 bp, Homo sapiens
tacactgggagacaca

SEQ ID NO: 44106 - DNA, 20 bp, Homo sapiens
acacttggatggggacacaa

SEQ ID NO: 44107 - DNA, 19 bp, Homo sapiens
tacacaagcctggcaccaa

SEQ ID NO: 44108 - DNA, 18 bp, Homo sapiens
acacagggacagggcaca

SEQ ID NO: 44109 - DNA, 115 bp, Ectromelia virus
gagatagttttctctattctgaaataattagaactagaaacatgtttagaaaaaaacgattatttctgaattattctaattatttgaacaaacaggaaagaagtatactatcgtc

SEQ ID NO: 44110 - DNA, 24 bp, Ectromelia virus
tgaaataattagaactagaaacat

SEQ ID NO: 44111 - DNA, 18 bp, Homo sapiens
tgaaataattaaagctaa

SEQ ID NO: 44112 - DNA, 24 bp, Homo sapiens
tgaaagaaaaaaaactagaaacat

SEQ ID NO: 44113 - DNA, 16 bp, Homo sapiens
aaataattagagaaac

SEQ ID NO: 44114 - DNA, 24 bp, Homo sapiens
tgaaataatgagaaaaataaacat

SEQ ID NO: 44115 - DNA, 21 bp, Homo sapiens
taatgcagctactagaaacat

SEQ ID NO: 44116 - DNA, 18 bp, Homo sapiens
tgaaataattatgaacta

SEQ ID NO: 44117 - DNA, 17 bp, Homo sapiens
tgaaatagtgaaccaga

SEQ ID NO: 44118 - DNA, 17 bp, Homo sapiens
aaataattagaatagaa

SEQ ID NO: 44119 - DNA, 82 bp, Ectromelia virus
gcgaagatgactctcaaattattacacttacggcattcgttaaccaatgcctatggtgtcataaacgagtatccgtatccgc

SEQ ID NO: 44120 - DNA, 24 bp, Ectromelia virus
tattacacttacggcattcgttaa

SEQ ID NO: 44121 - DNA, 17 bp, Homo sapiens
ttacacttgcaatgtta

SEQ ID NO: 44122 - DNA, 20 bp, Homo sapiens
tattacattgatggcattca

SEQ ID NO: 44123 - DNA, 67 bp, Camelpox virus
gagtgtttatccagggaaatcaaagaagaagttaatatagacaattcttttgtattcatagacactc

SEQ ID NO: 44124 - DNA, 67 bp, Camelpox virus; identical to SEQ ID NO: 44123

SEQ ID NO: 44125 - DNA, 19 bp, Homo sapiens
agggaatcaaagaagaggt

SEQ ID NO: 44126 - DNA, 18 bp, Homo sapiens
aaggaaatcagagggaga

SEQ ID NO: 44127 - DNA, 18 bp, Homo sapiens
gaaatcaaagaatgcagt

SEQ ID NO: 44128 - DNA, 18 bp, Homo sapiens
agggagattaaagaaaaa

SEQ ID NO: 44129 - DNA, 21 bp, Homo sapiens
agggaaatcaggaggaggagt

SEQ ID NO: 44130 - DNA, 18 bp, Homo sapiens
agggaaataaaggggaag

SEQ ID NO: 44131 - DNA, 19 bp, Homo sapiens
agggaggtgaaagaagaaa

SEQ ID NO: 44132 - DNA, 18 bp, Homo sapiens
agggaaacagagaagcca

SEQ ID NO: 44133 - DNA, 22 bp, Homo sapiens
aggaaaatcagacttcaaagtt

SEQ ID NO: 44134 - DNA, 18 bp, Homo sapiens
agggagatcaaaaagaaa

SEQ ID NO: 44135 - DNA, 22 bp, Homo sapiens
gggaaatcaggttgggaggtta

SEQ ID NO: 44136 - DNA, 18 bp, Homo sapiens
agggaaacaaagagttaa

SEQ ID NO: 44137 - DNA, 20 bp, Homo sapiens
agggaactcaaagaaaaaat

SEQ ID NO: 44138 - DNA, 19 bp, Homo sapiens
agggaaatataaggggaaa

SEQ ID NO: 44139 - DNA, 16 bp, Homo sapiens
agggaaacagaggaaa

SEQ ID NO: 44140 - DNA, 18 bp, Homo sapiens
gggagaccaagaagttaa

SEQ ID NO: 44141 - DNA, 17 bp, Homo sapiens
gggaaatcaaaaagcta

SEQ ID NO: 44142 - DNA, 21 bp, Homo sapiens
agggaaatcaaaagtaaaagt

SEQ ID NO: 44143 - DNA, 20 bp, Homo sapiens
gggaagtatgagaagttaat

SEQ ID NO: 44144 - DNA, 18 bp, Homo sapiens
agggaaatcagggaaaga

SEQ ID NO: 44145 - DNA, 18 bp, Homo sapiens
agggaaacaaagaatcag

SEQ ID NO: 44146 - DNA, 18 bp, Homo sapiens
agggagataaagaaaaag

SEQ ID NO: 44147 - DNA, 18 bp, Homo sapiens
agggaggtctgaagaagt

SEQ ID NO: 44148 - DNA, 20 bp, Homo sapiens
agggaaatcaggcaagaaaa

SEQ ID NO: 44149 - DNA, 19 bp, Homo sapiens
ggaaaatcagagacatagt

SEQ ID NO: 44150 - DNA, 20 bp, Homo sapiens
agggaaatctaggaaggcag

SEQ ID NO: 44151 - DNA, 17 bp, Homo sapiens
agggaaacagagacatc

SEQ ID NO: 44152 - DNA, 24 bp, Homo sapiens
agggcaatcaaagaacttaaaagt

SEQ ID NO: 44153 - DNA, 19 bp, Homo sapiens
agggaaaccaaagagccaa

SEQ ID NO: 44154 - DNA, 21 bp, Homo sapiens
aggaagttggaggagaagcca

SEQ ID NO: 44155 - DNA, 21 bp, Homo sapiens
gggagaatcaaagaatcatta

SEQ ID NO: 44156 - DNA, 22 bp, Homo sapiens
agggagaccaaaggaaattaat

SEQ ID NO: 44157 - DNA, 18 bp, Homo sapiens
agggaaaccggggaaatc

SEQ ID NO: 44158 - DNA, 22 bp, Homo sapiens
agagagatcaaagaagaagcca

SEQ ID NO: 44159 - DNA, 26 bp, Homo sapiens
agggaaattaaatggaaacttttaat

SEQ ID NO: 44160 - DNA, 20 bp, Homo sapiens
aggcaaattggagaaaaagt

SEQ ID NO: 44161 - DNA, 17 bp, Homo sapiens
aaggaaattgaagagaa

SEQ ID NO: 44162 - DNA, 17 bp, Homo sapiens
agggaaacagagaggct

SEQ ID NO: 44163 - DNA, 20 bp, Homo sapiens
agggaagttgagaaaaagtt

SEQ ID NO: 44164 - DNA, 17 bp, Homo sapiens
agggaaattcaagagaa

SEQ ID NO: 44165 - DNA, 22 bp, Homo sapiens
gggaagggaaggagaagttaat

SEQ ID NO: 44166 - DNA, 23 bp, Homo sapiens
ggaaattaacataggaagttaat

SEQ ID NO: 44167 - DNA, 19 bp, Homo sapiens
agggaagcagggaagaaat

SEQ ID NO: 44168 - DNA, 18 bp, Homo sapiens
ggggatcagggaagaagt

SEQ ID NO: 44169 - DNA, 18 bp, Homo sapiens
aggtaaatcgaagaagaa

SEQ ID NO: 44170 - DNA, 18 bp, Homo sapiens
agggaaatcaaagaacaa

SEQ ID NO: 44171 - DNA, 20 bp, Homo sapiens
ggtgaagtcaaagggaaagt

SEQ ID NO: 44172 - DNA, 104 bp, Human papillomavirus type 44
aggaacagatgtttgccagacatttttttaatagggctggaacagttggtgaggacgtttcccaggatctggttattaaaagtgctagtaaaaatactgttcct

SEQ ID NO: 44173 - DNA, 24 bp, Human papillomavirus type 44
tttcccaggatctggttattaaaa

SEQ ID NO: 44174 - DNA, 21 bp, Homo sapiens
tctcttgggatctgggctatt

SEQ ID NO: 44175 - DNA, 19 bp, Homo sapiens
tctcccaggatctgggcac

SEQ ID NO: 44176 - DNA, 18 bp, Homo sapiens
tctcccagggtctcaggt

SEQ ID NO: 44177 - DNA, 21 bp, Homo sapiens
tcctaggataaattattaaaa

SEQ ID NO: 44178 - DNA, 17 bp, Homo sapiens
tttcccagatcttgcta

SEQ ID NO: 44179 - DNA, 23 bp, Homo sapiens
cttcctgggatctgaagcctaaa

SEQ ID NO: 44180 - DNA, 16 bp, Homo sapiens
ccaaaggttattaaaa

SEQ ID NO: 44181 - DNA, 24 bp, Homo sapiens
tttcccaggattctgtccagtaaa

SEQ ID NO: 44182 - DNA, 19 bp, Homo sapiens
tttcgaggatctggttacc

SEQ ID NO: 44183 - DNA, 21 bp, Homo sapiens
tttcctaatgggttattaaaa

SEQ ID NO: 44184 - DNA, 19 bp, Homo sapiens
tctcctgggatccagggtt

SEQ ID NO: 44185 - DNA, 20 bp, Homo sapiens
tttcccagggttagtttcta

SEQ ID NO: 44186 - DNA, 22 bp, Homo sapiens
ttccttggtacagttattaaaa

SEQ ID NO: 44187 - DNA, 21 bp, Homo sapiens
ttcccgaatcctggttattaa

SEQ ID NO: 44188 - DNA, 18 bp, Homo sapiens
tttcccaggactgactgg

SEQ ID NO: 44189 - DNA, 27 bp, Homo sapiens
tttcccaagattaaatgattattaaaa

SEQ ID NO: 44190 - DNA, 25 bp, Homo sapiens
tttcccaggttgtcaactattaaaa

SEQ ID NO: 44191 - DNA, 65 bp, Paramecium bursaria Chlorella virus 1
atttattggtataatttcagtattcgcatactcttcggcaaactttctcaaatcatctaatgaat

SEQ ID NO: 44192 - DNA, 24 bp, Paramecium bursaria Chlorella virus 1
tattggtataatttcagtattcgc

SEQ ID NO: 44193 - DNA, 22 bp, Homo sapiens
tactggtatgattttatacagc

SEQ ID NO: 44194 - DNA, 74 bp, Woolly monkey sarcoma virus
gtggcgggccaccaatggaggacctgatcacgggcaagacatgcctcagggccaccaatggaggacctgatcac

SEQ ID NO: 44195 - DNA, 24 bp, Woolly monkey sarcoma virus
tggaggacctgatcacgggcaaga

SEQ ID NO: 44196 - DNA, 20 bp, Homo sapiens
tggaggacactggtggctag

SEQ ID NO: 44197 - DNA, 22 bp, Homo sapiens
tgggagacctgatactctcaag

SEQ ID NO: 44198 - DNA, 21 bp, Homo sapiens
tggaggacttggtctgtgggc

SEQ ID NO: 44199 - DNA, 18 bp, Homo sapiens
tggaagactcgctgggca

SEQ ID NO: 44200 - DNA, 20 bp, Homo sapiens
tgaaggacttgatttagagg

SEQ ID NO: 44201 - DNA, 17 bp, Homo sapiens
ggaggacctgggcgcag

SEQ ID NO: 44202 - DNA, 17 bp, Homo sapiens
ggaggggtgcgggcaag

SEQ ID NO: 44203 - DNA, 24 bp, Homo sapiens
tggagcatacataaacgggcaaga

SEQ ID NO: 44204 - DNA, 18 bp, Homo sapiens
tgaaggacctggagcaag

SEQ ID NO: 44205 - DNA, 19 bp, Homo sapiens
tggaggttctgatcacagg

SEQ ID NO: 44206 - DNA, 18 bp, Homo sapiens
tgggagacctgaaacagg

SEQ ID NO: 44207 - DNA, 19 bp, Homo sapiens
tggagaacctgactgtagg

SEQ ID NO: 44208 - DNA, 19 bp, Homo sapiens
ggaggacctgagccgtagg

SEQ ID NO: 44209 - DNA, 18 bp, Homo sapiens
tggaggaccagagcaggg

SEQ ID NO: 44210 - DNA, 20 bp, Homo sapiens
tggggcacctgatcatcagg

SEQ ID NO: 44211 - DNA, 18 bp, Homo sapiens
tggagagtctggagcaag

SEQ ID NO: 44212 - DNA, 19 bp, Homo sapiens
tggggagacagtgggcaag

SEQ ID NO: 44213 - DNA, 17 bp, Homo sapiens
tggaggacctggagggc

SEQ ID NO: 44214 - DNA, 18 bp, Homo sapiens
tggaggacttgatggagg

SEQ ID NO: 44215 - DNA, 20 bp, Homo sapiens
tggaggactgggtctgtggg

SEQ ID NO: 44216 - DNA, 22 bp, Homo sapiens
tggcaggactacttgggcaaga

SEQ ID NO: 44217 - DNA, 20 bp, Homo sapiens
ggagggtctgatccaacggg

SEQ ID NO: 44218 - DNA, 18 bp, Homo sapiens
tggagacctgatgctggg

SEQ ID NO: 44219 - DNA, 22 bp, Homo sapiens
tggaggaccgggtcatcccagg

SEQ ID NO: 44220 - DNA, 21 bp, Homo sapiens
tggagtacctgatcccacaag

SEQ ID NO: 44221 - DNA, 20 bp, Homo sapiens
tggaggacttggccaccagc

SEQ ID NO: 44222 - DNA, 20 bp, Homo sapiens
tgaaggacctggccagcaag

SEQ ID NO: 44223 - DNA, 16 bp, Homo sapiens
tggggaccctgggcaa

SEQ ID NO: 44224 - DNA, 21 bp, Homo sapiens
tggggaacctgatgctccagg

SEQ ID NO: 44225 - DNA, 95 bp, Cercopithecine herpesvirus 7
ggcatacaacaaacgatacatatatgattgctggtactcccggaacataccgcacgggaacgtcagttaattgtattgtagaagaagtcgatgct

SEQ ID NO: 44226 - DNA, 24 bp, Cercopithecine herpesvirus 7
tgattgctggtactcccggaacat

SEQ ID NO: 44227 - DNA, 15 bp, Homo sapiens
attgctggcactgga

SEQ ID NO: 44228 - DNA, 19 bp, Homo sapiens
tgttgctggtgacaaggaa

SEQ ID NO: 44229 - DNA, 19 bp, Homo sapiens
tgattgctgggccaatgga

SEQ ID NO: 44230 - DNA, 21 bp, Homo sapiens
gattactgattcctgggacat

SEQ ID NO: 44231 - DNA, 18 bp, Homo sapiens
tggttgctggtgccctga

SEQ ID NO: 44232 - DNA, 20 bp, Homo sapiens
tgattgctggtactacttga

SEQ ID NO: 44233 - DNA, 17 bp, Homo sapiens
gatgctgtgctcccgga

SEQ ID NO: 44234 - DNA, 19 bp, Homo sapiens
tggatgctggtactctcag

SEQ ID NO: 44235 - DNA, 22 bp, Homo sapiens
tggatgctggtattcttaacac

SEQ ID NO: 44236 - DNA, 18 bp, Homo sapiens
ctggtacttttggaacat

SEQ ID NO: 44237 - DNA, 22 bp, Homo sapiens
tgatagcttctgcccggaacat

SEQ ID NO: 44238 - DNA, 19 bp, Homo sapiens
tggttgtggtactcctgga

SEQ ID NO: 44239 - DNA, 18 bp, Homo sapiens
tgattgctggactcctgg

SEQ ID NO: 44240 - DNA, 66 bp, Paramecium bursaria Chlorella virus 1
taatgcgcttggactttttagttgtatactacttttgtataaaacctataagttacatgtgtttta

SEQ ID NO: 44241 - DNA, 24 bp, Paramecium bursaria Chlorella virus 1
taaaacctataagttacatgtgtt

SEQ ID NO: 44242 - DNA, 22 bp, Homo sapiens
aaacctattgagtacatatgtt

SEQ ID NO: 44243 - DNA, 22 bp, Homo sapiens
taaaacccaaactacatgtgtt

SEQ ID NO: 44244 - DNA, 19 bp, Homo sapiens
taagccctataagtattgt

SEQ ID NO: 44245 - DNA, 19 bp, Homo sapiens
taaaacatacaacatgtgt

SEQ ID NO: 44246 - DNA, 19 bp, Homo sapiens
aaacctataatcgtgtgtt

SEQ ID NO: 44247 - DNA, 24 bp, Homo sapiens
taaaacttagagttacatgcagtt

SEQ ID NO: 44248 - DNA, 83 bp, Cercopithecine herpesvirus 7
atacaatacaaaatacaactcttcgcatgtaagaactggagatatccaaacatatcttacacgcgggggttttgttattgtat

SEQ ID NO: 44249 - DNA, 24 bp, Cercopithecine herpesvirus 7
tacaaaatacaactcttcgcatgt

SEQ ID NO: 44250 - DNA, 23 bp, Homo sapiens
tacaaaggcaaactttcgcatgt

SEQ ID NO: 44251 - DNA, 22 bp, Homo sapiens
tacaaatgcaactcttttctgt

SEQ ID NO: 44252 - DNA, 22 bp, Homo sapiens
caaaatacagttcatcttctgt

SEQ ID NO: 44253 - DNA, 26 bp, Homo sapiens
tacaaaatactactttcataatatgt

SEQ ID NO: 44254 - DNA, 19 bp, Homo sapiens
tacaaaatacaaatgcccg

SEQ ID NO: 44255 - DNA, 19 bp, Homo sapiens
tacaaaatacaattgcatg

SEQ ID NO: 44256 - DNA, 21 bp, Homo sapiens
caaaatacagctttcaactgt

SEQ ID NO: 44257 - DNA, 15 bp, Homo sapiens
acaaaatacaaccat

SEQ ID NO: 44258 - DNA, 18 bp, Homo sapiens
aaaatacagctctgctgt

SEQ ID NO: 44259 - DNA, 19 bp, Homo sapiens
caaaatacaattcatccat

SEQ ID NO: 44260 - DNA, 19 bp, Homo sapiens
aaatacaactgatctatgt

SEQ ID NO: 44261 - DNA, 19 bp, Homo sapiens
tacgaaatgtaactcttca

SEQ ID NO: 44262 - DNA, 130 bp, Woolly monkey sarcoma virus
tcccctcctacgggagcagcataccgctcgacactatgctttacgaaggtaatggacaccgctaggtgcaaggcaaggcactgcaaggagaggccttactaaggctactgtcgagtctcctgagaggtaa

SEQ ID NO: 44263 - DNA, 24 bp, Woolly monkey sarcoma virus
actatgctttacgaaggtaatgga

SEQ ID NO: 44264 - DNA, 18 bp, Homo sapiens
ctttgcttctggtaatgg

SEQ ID NO: 44265 - DNA, 17 bp, Homo sapiens
catgctttacaaaatgg

SEQ ID NO: 44266 - DNA, 18 bp, Homo sapiens
catgttttacaacaatgg

SEQ ID NO: 44267 - DNA, 19 bp, Homo sapiens
actgtgctctaaataatgg

SEQ ID NO: 44268 - DNA, 18 bp, Homo sapiens
gcttctaaaaggtaatgg

SEQ ID NO: 44269 - DNA, 20 bp, Homo sapiens
actatgttttacacaatgga

SEQ ID NO: 44270 - DNA, 25 bp, Homo sapiens
acaatgctttatgggggtagggtgg

SEQ ID NO: 44271 - DNA, 19 bp, Homo sapiens
tatgcctttgttaggtgga

SEQ ID NO: 44272 - DNA, 18 bp, Homo sapiens
actatgctttggacatgg

SEQ ID NO: 44273 - DNA, 64 bp, Human papillomavirus type 13
ttgtgtcttctgaggcccagttgtttaataaaccttattggttacaaaaggcccagggacacaa

SEQ ID NO: 44274 - DNA, 23 bp, Human papillomavirus type 13
ttacaaaaggcccagggacacaa

SEQ ID NO: 44275 - DNA, 20 bp, Homo sapiens
ttacaaaagttgttacacaa

SEQ ID NO: 44276 - DNA, 16 bp, Homo sapiens
tacaaaggtgggcaca

SEQ ID NO: 44277 - DNA, 18 bp, Homo sapiens
aaaggcccaggaaagcaa

SEQ ID NO: 44278 - DNA, 18 bp, Homo sapiens
ctacaatttagggacaca

SEQ ID NO: 44279 - DNA, 19 bp, Homo sapiens
caaaaggctcaggtcaaca

SEQ ID NO: 44280 - DNA, 20 bp, Homo sapiens
aaaaggccaaatggacacaa

SEQ ID NO: 44281 - DNA, 21 bp, Homo sapiens
ttacaaaaaggctgaacacaa

SEQ ID NO: 44282 - DNA, 19 bp, Homo sapiens
ttacaaaagggtgaacaca

SEQ ID NO: 44283 - DNA, 20 bp, Homo sapiens
aaaaggccttagcaatgcaa

SEQ ID NO: 44284 - DNA, 21 bp, Homo sapiens
ttacggggtgccgaaggacac

SEQ ID NO: 44285 - DNA, 21 bp, Homo sapiens
ttacaaaagcattaagcacaa

SEQ ID NO: 44286 - DNA, 21 bp, Homo sapiens
ttacaaaagttcaatttacac

SEQ ID NO: 44287 - DNA, 20 bp, Homo sapiens
ttacagaaagttcaggaaca

SEQ ID NO: 44288 - DNA, 20 bp, Homo sapiens
ttacaaaagagtgggccggg

SEQ ID NO: 44289 - DNA, 15 bp, Homo sapiens
caaaaggcaaacaca

SEQ ID NO: 44290 - DNA, 20 bp, Homo sapiens
ttacagataggcaaacacaa

SEQ ID NO: 44291 - DNA, 16 bp, Homo sapiens
tcacaaaaggcaaaca

SEQ ID NO: 44292 - DNA, 20 bp, Homo sapiens
ttacaggagacccaggttca

SEQ ID NO: 44293 - DNA, 24 bp, Homo sapiens
ttacaaaaaggcttacaagatgca

SEQ ID NO: 44294 - DNA, 19 bp, Homo sapiens
acaaaaggctcagaataca

SEQ ID NO: 44295 - DNA, 19 bp, Homo sapiens
ttacaaaatgcctaagtca

SEQ ID NO: 44296 - DNA, 20 bp, Homo sapiens
ttacaaaaaggcagtataca

SEQ ID NO: 44297 - DNA, 20 bp, Homo sapiens
cagaaggcaatagggacaca

SEQ ID NO: 44298 - DNA, 16 bp, Homo sapiens
tacaaaaggagataca

SEQ ID NO: 44299 - DNA, 16 bp, Homo sapiens
tacagaagaggacaca

SEQ ID NO: 44300 - DNA, 20 bp, Homo sapiens
ttacaaaaaggctaagcaca

SEQ ID NO: 44301 - DNA, 16 bp, Homo sapiens
aaaaggaagagacaca

SEQ ID NO: 44302 - DNA, 19 bp, Homo sapiens
ttacaagaagcccaaaaca

SEQ ID NO: 44303 - DNA, 18 bp, Homo sapiens
tacaaaaagctggggaca

SEQ ID NO: 44304 - DNA, 17 bp, Homo sapiens
ctacaaaggaaggacac

SEQ ID NO: 44305 - DNA, 21 bp, Homo sapiens
ttacaaaagacccaatttaca

SEQ ID NO: 44306 - DNA, 15 bp, Homo sapiens
tcacaaaagaggaca

SEQ ID NO: 44307 - DNA, 17 bp, Homo sapiens
ttacaaaagcagataca

SEQ ID NO: 44308 - DNA, 21 bp, Homo sapiens
ctacaaaaggcttgttcctag

SEQ ID NO: 44309 - DNA, 18 bp, Homo sapiens
ttacaaagagaggacaca

SEQ ID NO: 44310 - DNA, 19 bp, Homo sapiens
ttagaaaaggcctccatgg

SEQ ID NO: 44311 - DNA, 17 bp, Homo sapiens
ttacaaaagcctaaaga

SEQ ID NO: 44312 - DNA, 20 bp, Homo sapiens
tcacaaaagttgagggacac

SEQ ID NO: 44313 - DNA, 18 bp, Homo sapiens
aaaaggcccaacgcacaa

SEQ ID NO: 44314 - DNA, 22 bp, Homo sapiens
ttacaaaaagtttttccagtga

SEQ ID NO: 44315 - DNA, 20 bp, Homo sapiens
ttacaagagacccagttaca

SEQ ID NO: 44316 - DNA, 18 bp, Homo sapiens
ttacaaaaggtccactgg

SEQ ID NO: 44317 - DNA, 21 bp, Homo sapiens
ctacaaaaggatctgatacaa

SEQ ID NO: 44318 - DNA, 70 bp, Cercopithecine herpesvirus 7
ggcaccgatacgcgtgttgttttacagaactctatgagagtttctggagactcaaagcgttgttacagcc

SEQ ID NO: 44319 - DNA, 19 bp, Cercopithecine herpesvirus 7
tcaaagcgttgttacagcc

SEQ ID NO: 44320 - DNA, 19 bp, Homo sapiens
tcaaagcaggatgttagcc

SEQ ID NO: 44321 - DNA, 17 bp, Homo sapiens
ccaaagatcctacagcc

SEQ ID NO: 44322 - DNA, 18 bp, Homo sapiens
tcacagcctgctgcagcc

SEQ ID NO: 44323 - DNA, 17 bp, Homo sapiens
cagagccctccacagcc

SEQ ID NO: 44324 - DNA, 18 bp, Homo sapiens
tcacggccgctcacagcc

SEQ ID NO: 44325 - DNA, 16 bp, Homo sapiens
ccaaagcgtccaggcc

SEQ ID NO: 44326 - DNA, 16 bp, Homo sapiens
tcaaacgtcagcagcc

SEQ ID NO: 44327 - DNA, 16 bp, Homo sapiens
caaatgtgttacagcc

SEQ ID NO: 44328 - DNA, 19 bp, Homo sapiens
tcaaagcgatccttcagcc

SEQ ID NO: 44329 - DNA, 16 bp, Homo sapiens
tcaaacgttgtgagcc

SEQ ID NO: 44330 - DNA, 20 bp, Homo sapiens
tcaaaacgctgagaacagcc

SEQ ID NO: 44331 - DNA, 21 bp, Homo sapiens
tcagaagtgccacaatacagc

SEQ ID NO: 44332 - DNA, 18 bp, Homo sapiens
ccaaagcactgagcagcc

SEQ ID NO: 44333 - DNA, 20 bp, Homo sapiens
tcaggacgccgcccgcagcc

SEQ ID NO: 44334 - DNA, 20 bp, Homo sapiens
cagagcgttgtgcaccagcc

SEQ ID NO: 44335 - DNA, 19 bp, Homo sapiens
tcagagtaacgctacagcc

SEQ ID NO: 44336 - DNA, 16 bp, Homo sapiens
tcgaagcatcacagcc

SEQ ID NO: 44337 - DNA, 16 bp, Homo sapiens
tcaagtctccacagcc

SEQ ID NO: 44338 - DNA, 20 bp, Homo sapiens
tcagggctgtgccacaggcc

SEQ ID NO: 44339 - DNA, 17 bp, Homo sapiens
tcatacatgttacagcc

SEQ ID NO: 44340 - DNA, 17 bp, Homo sapiens
ccaaagcgtgcagagcc

SEQ ID NO: 44341 - DNA, 19 bp, Homo sapiens
tcacagcggggccacagcc

SEQ ID NO: 44342 - DNA, 17 bp, Homo sapiens
tcacagctccgcacagc

SEQ ID NO: 44343 - DNA, 18 bp, Homo sapiens
tcaaagcattaaactgcc

SEQ ID NO: 44344 - DNA, 20 bp, Homo sapiens
tcaagagacatgttacagcc

SEQ ID NO: 44345 - DNA, 16 bp, Homo sapiens
tccaagcgtcaacagc

SEQ ID NO: 44346 - DNA, 17 bp, Homo sapiens
ccagagcagcgacagcc

SEQ ID NO: 44347 - DNA, 19 bp, Homo sapiens
caaaggtggaattacagcc

SEQ ID NO: 44348 - DNA, 19 bp, Homo sapiens
tcaagcgactcttacagcc

SEQ ID NO: 44349 - DNA, 18 bp, Homo sapiens
tcatagctcactacagcc

SEQ ID NO: 44350 - DNA, 19 bp, Homo sapiens
caaagtgatcattacagcc

SEQ ID NO: 44351 - DNA, 15 bp, Homo sapiens
caaagcgccgcagcc

SEQ ID NO: 44352 - DNA, 17 bp, Homo sapiens
tcaaagcatttcaaagc

SEQ ID NO: 44353 - DNA, 18 bp, Homo sapiens
tctaagtattctacagcc

SEQ ID NO: 44354 - DNA, 18 bp, Homo sapiens
tcaaaacgcataacagcc

SEQ ID NO: 44355 - DNA, 19 bp, Homo sapiens
tcaaagcatctcacaggcc

SEQ ID NO: 44356 - DNA, 17 bp, Homo sapiens
tcaatacctgttacagc

SEQ ID NO: 44357 - DNA, 18 bp, Homo sapiens
tcacagctcactacagcc

SEQ ID NO: 44358 - DNA, 16 bp, Homo sapiens
tcaaagcaatgcagcc

SEQ ID NO: 44359 - DNA, 17 bp, Homo sapiens
tctgaggttgtcacagc

SEQ ID NO: 44360 - DNA, 20 bp, Homo sapiens
tcaaagcaggccccccagcc

SEQ ID NO: 44361 - DNA, 18 bp, Homo sapiens
tcacagcttattgcagcc

SEQ ID NO: 44362 - DNA, 17 bp, Homo sapiens
ccaaagcaaactacagc

SEQ ID NO: 44363 - DNA, 16 bp, Homo sapiens
tcaaagcagtcacagc

SEQ ID NO: 44364 - DNA, 16 bp, Homo sapiens
tcaaatgtcacaagcc

SEQ ID NO: 44365 - DNA, 18 bp, Homo sapiens
tcaaaatgtcatcacagc

SEQ ID NO: 44366 - DNA, 16 bp, Homo sapiens
caaagagtctacagcc

SEQ ID NO: 44367 - DNA, 17 bp, Homo sapiens
ccaaagcgccgctggcc

SEQ ID NO: 44368 - DNA, 18 bp, Homo sapiens
caaagcatccattatagc

SEQ ID NO: 44369 - DNA, 17 bp, Homo sapiens
tcaaaactgattacagc

SEQ ID NO: 44370 - DNA, 17 bp, Homo sapiens
ccaaagccaccacagcc

SEQ ID NO: 44371 - DNA, 19 bp, Homo sapiens
tcaaagcaggctgagcagc

SEQ ID NO: 44372 - DNA, 18 bp, Homo sapiens
ccaaagcaggctgcagcc

SEQ ID NO: 44373 - DNA, 18 bp, Homo sapiens
tcaaagcggggtccagcc

SEQ ID NO: 44374 - DNA, 18 bp, Homo sapiens
tcacagctccctgcagcc

SEQ ID NO: 44375 - DNA, 17 bp, Homo sapiens
ccagagcgggctacagc

SEQ ID NO: 44376 - DNA, 18 bp, Homo sapiens
tcaacagctgccacagcc

SEQ ID NO: 44377 - DNA, 16 bp, Homo sapiens
tcaaacgagccacagc

SEQ ID NO: 44378 - DNA, 18 bp, Homo sapiens
tcaaaattctgttacagc

SEQ ID NO: 44379 - DNA, 19 bp, Homo sapiens
tcaggcggccgctacggcc

SEQ ID NO: 44380 - DNA, 18 bp, Homo sapiens
tcaaaggcccccacagcc

SEQ ID NO: 44381 - DNA, 18 bp, Homo sapiens
ccagggcggtgttacagc

SEQ ID NO: 44382 - DNA, 16 bp, Homo sapiens
tcatagcggtcacagc

SEQ ID NO: 44383 - DNA, 19 bp, Homo sapiens
tcaaggcagctccacggcc

SEQ ID NO: 44384 - DNA, 16 bp, Homo sapiens
tcaaaccaatcacagc

SEQ ID NO: 44385 - DNA, 17 bp, Homo sapiens
tcaggcactgctgcagc

SEQ ID NO: 44386 - DNA, 16 bp, Homo sapiens
tcaaactcccacagcc

SEQ ID NO: 44387 - DNA, 17 bp, Homo sapiens
tgaaggtctccacagcc

SEQ ID NO: 44388 - DNA, 18 bp, Homo sapiens
tcacggtcagccacagcc

SEQ ID NO: 44389 - DNA, 16 bp, Homo sapiens
ccgaagcgccgcagcc

SEQ ID NO: 44390 - DNA, 16 bp, Homo sapiens
ccaaagcggccacggc

SEQ ID NO: 44391 - DNA, 19 bp, Homo sapiens
tcagaggcagaccacagcc

SEQ ID NO: 44392 - DNA, 16 bp, Homo sapiens
tcacacgtttacagcc

SEQ ID NO: 44393 - DNA, 18 bp, Homo sapiens
tcacagcttactgcagcc

SEQ ID NO: 44394 - DNA, 18 bp, Homo sapiens
tgaaacagtagttacagc

SEQ ID NO: 44395 - DNA, 19 bp, Homo sapiens
tcaaagcagtccctgtcag

SEQ ID NO: 44396 - DNA, 19 bp, Homo sapiens
tcacagctcccgcacagcc

SEQ ID NO: 44397 - DNA, 19 bp, Homo sapiens
tcacagctcctgcacagcc

SEQ ID NO: 44398 - DNA, 17 bp, Homo sapiens
tcatgacaattacagcc

SEQ ID NO: 44399 - DNA, 19 bp, Homo sapiens
tcaaagcagtagttatggc

SEQ ID NO: 44400 - DNA, 18 bp, Homo sapiens
tcagaagtccccacagcc

SEQ ID NO: 44401 - DNA, 19 bp, Homo sapiens
tcaaagcagtagttacggc

SEQ ID NO: 44402 - DNA, 16 bp, Homo sapiens
caaagatgttacagcc

SEQ ID NO: 44403 - DNA, 18 bp, Homo sapiens
tctgagcgtcgctccagc

SEQ ID NO: 44404 - DNA, 19 bp, Homo sapiens
tcagcagcggctcacagcc

SEQ ID NO: 44405 - DNA, 18 bp, Homo sapiens
tcaaagaggtgccacagc

SEQ ID NO: 44406 - DNA, 16 bp, Homo sapiens
cagagcagccacagcc

SEQ ID NO: 44407 - DNA, 16 bp, Homo sapiens
tcaaactgctacggcc

SEQ ID NO: 44408 - DNA, 21 bp, Homo sapiens
tcgaagcgttggcagcacagc

SEQ ID NO: 44409 - DNA, 17 bp, Homo sapiens
tcagggcgcccacagcc

SEQ ID NO: 44410 - DNA, 18 bp, Homo sapiens
tcaaaacgtaagccacag

SEQ ID NO: 44411 - DNA, 18 bp, Homo sapiens
tcaacagctcaccacagc

SEQ ID NO: 44412 - DNA, 15 bp, Homo sapiens
caaaggcctacagcc

SEQ ID NO: 44413 - DNA, 84 bp, Cercopithecine herpesvirus 7
caaattacgtataatataggggagtggctttagcataatatttaagcagaaacaaacaggcacctctctaccaagacgttgttg

SEQ ID NO: 44414 - DNA, 24 bp, Cercopithecine herpesvirus 7
aattacgtataatataggggagtg

SEQ ID NO: 44415 - DNA, 20 bp, Homo sapiens
ttacatataatacattagtg

SEQ ID NO: 44416 - DNA, 20 bp, Homo sapiens
ttactgtaagggagggggtg

SEQ ID NO: 44417 - DNA, 20 bp, Homo sapiens
cgtatgaaccgcggggagtg

SEQ ID NO: 44418 - DNA, 22 bp, Homo sapiens
aattacatattggtggggggtg

SEQ ID NO: 44419 - DNA, 63 bp, Tupaia herpesvirus
atctagttagtcctttgacgaggatgaaaagagtcacgatttgtcaacatcaaactaattgat

SEQ ID NO: 44420 - DNA, 24 bp, Tupaia herpesvirus
cgatttgtcaacatcaaactaatt

SEQ ID NO: 44421 - DNA, 19 bp, Homo sapiens
tgccaacaatgtcagacta

SEQ ID NO: 44422 - DNA, 20 bp, Homo sapiens
gatttgccagtatcagtcct

SEQ ID NO: 44423 - DNA, 21 bp, Homo sapiens
ccatttgtcaatatcatccca

SEQ ID NO: 44424 - DNA, 126 bp, Variola virus
ataattagaactagaaacatgtctagaaagaaacgattatttctaaattattccaattatttgaacaaacaggaaagaagtatactatcgtcatttttttctctagatccagctacgattgataat

SEQ ID NO: 44425 - DNA, 24 bp, Variola virus
acgattatttctaaattattccaa

SEQ ID NO: 44426 - DNA, 21 bp, Homo sapiens
attatttctaggggcttccaa

SEQ ID NO: 44427 - DNA, 20 bp, Homo sapiens
atcatttacaaattattcca

SEQ ID NO: 44428 - DNA, 21 bp, Homo sapiens
attatttaaaaattattccaa

SEQ ID NO: 44429 - DNA, 22 bp, Homo sapiens
aattatttaccctgttattcca

SEQ ID NO: 44430 - DNA, 16 bp, Homo sapiens
accattatttctaacc

SEQ ID NO: 44431 - DNA, 21 bp, Homo sapiens
acaattataaaattattccaa

SEQ ID NO: 44432 - DNA, 21 bp, Homo sapiens
gattgttagcaattattccaa

SEQ ID NO: 44433 - DNA, 20 bp, Homo sapiens
gattatttcctgatctccaa

SEQ ID NO: 44434 - DNA, 80 bp, Tupaia herpesvirus
ccgccgcgctcggtctcggtgccgcggggtcgaggccggttatccggtttcgggccaggagtcggagaggtcgcggacgg

SEQ ID NO: 44435 - DNA, 24 bp, Tupaia herpesvirus
tcggtgccgcggggtcgaggccgg

SEQ ID NO: 44436 - DNA, 17 bp, Homo sapiens
ggtgcccgggagagccg

SEQ ID NO: 44437 - DNA, 21 bp, Homo sapiens
ggtgctgtggccaaaggctgg

SEQ ID NO: 44438 - DNA, 15 bp, Homo sapiens
tcgggaggtcgaggc

SEQ ID NO: 44439 - DNA, 20 bp, Homo sapiens
ggtgccgcgggcatggctgg

SEQ ID NO: 44440 - DNA, 21 bp, Homo sapiens
tcggtgctccgggccggccgg

SEQ ID NO: 44441 - DNA, 22 bp, Homo sapiens
ccgggccgggggttggggctgg

SEQ ID NO: 44442 - DNA, 17 bp, Homo sapiens
tcggtcccgccgaggcg

SEQ ID NO: 44443 - DNA, 65 bp, Variola virus
ctttatctattctgaatcatggagcagctggttctacagctgaacaactatcaaaatatatagag

SEQ ID NO: 44444 - DNA, 24 bp, Variola virus
tctattctgaatcatggagcagct

SEQ ID NO: 44445 - DNA, 18 bp, Homo sapiens
tcaattctgaaaagtagc

SEQ ID NO: 44446 - DNA, 21 bp, Homo sapiens
tcagttctgcatggagcagct

SEQ ID NO: 44447 - DNA, 19 bp, Homo sapiens
tctgtctgaaacaagcagc

SEQ ID NO: 44448 - DNA, 19 bp, Homo sapiens
tattctgaatcaacttagc

SEQ ID NO: 44449 - DNA, 16 bp, Homo sapiens
tccattctgaaggcag

SEQ ID NO: 44450 - DNA, 21 bp, Homo sapiens
tctatgttgagtccaacagct

SEQ ID NO: 44451 - DNA, 17 bp, Homo sapiens
tattctgaactaagcag

SEQ ID NO: 44452 - DNA, 21 bp, Homo sapiens
tctgatctgaatcagctgagc

SEQ ID NO: 44453 - DNA, 22 bp, Homo sapiens
tattctgaaataaggagtagct

SEQ ID NO: 44454 - DNA, 23 bp, Homo sapiens
tcagttctgaatttgcaccagct

SEQ ID NO: 44455 - DNA, 22 bp, Homo sapiens
tctattctgacttgctctaaag

SEQ ID NO: 44456 - DNA, 19 bp, Homo sapiens
tctactctgaaatcagtgg

SEQ ID NO: 44457 - DNA, 23 bp, Homo sapiens
tctattctgaacacctcccagct

SEQ ID NO: 44458 - DNA, 19 bp, Homo sapiens
tctgttctgaatgatggaa

SEQ ID NO: 44459 - DNA, 18 bp, Homo sapiens
cctattctgagctggcag

SEQ ID NO: 44460 - DNA, 19 bp, Homo sapiens
tctattctgaatttgaaac

SEQ ID NO: 44461 - DNA, 63 bp, Variola virus
tttaaaaaatggtgtggtaagttatacactaaaagtatagacttgtatatgccaaagtttaaa

SEQ ID NO: 44462 - DNA, 18 bp, Variola virus
tatatgccaaagtttaaa

SEQ ID NO: 44463 - DNA, 18 bp, Homo sapiens
tgatgccactagcctaaa

SEQ ID NO: 44464 - DNA, 17 bp, Homo sapiens
catatgccatttctaaa

SEQ ID NO: 44465 - DNA, 16 bp, Homo sapiens
tatatgccagtttaaa

SEQ ID NO: 44466 - DNA, 17 bp, Homo sapiens
catacaccaagtttaaa

SEQ ID NO: 44467 - DNA, 18 bp, Homo sapiens
tatctgccatagtctaaa

SEQ ID NO: 44468 - DNA, 21 bp, Homo sapiens
catatgccaatctattttaaa

SEQ ID NO: 44469 - DNA, 18 bp, Homo sapiens
tatatttcaaagttcaaa

SEQ ID NO: 44470 - DNA, 17 bp, Homo sapiens
tatatgccaaatccaaa

SEQ ID NO: 44471 - DNA, 95 bp, Variola virus
gggtgagaacgttccagagtgtctatccagggaaatcaaagaagaagttaatatagacaattcttttgtattcatagacactcggttttttattc

SEQ ID NO: 44472 - DNA, 64 bp, Tupaia herpesvirus
gggcgccccgagcatcggcggtgtctctcgagagctttcgagatctctcggtcctcggggcccc

SEQ ID NO: 44473 - DNA, 21 bp, Tupaia herpesvirus
tctctcggtcctcggggcccc

SEQ ID NO: 44474 - DNA, 17 bp, Homo sapiens
tctctggtgggaggccc

SEQ ID NO: 44475 - DNA, 20 bp, Homo sapiens
tctcctggtccccacatccc

SEQ ID NO: 44476 - DNA, 18 bp, Homo sapiens
cctctggattggggcccc

SEQ ID NO: 44477 - DNA, 21 bp, Homo sapiens
tctctctgtctctctggggcc

SEQ ID NO: 44478 - DNA, 18 bp, Homo sapiens
tctgcggcttggggcccc

SEQ ID NO: 44479 - DNA, 21 bp, Homo sapiens
tctctcgggcgctggggtccc

SEQ ID NO: 44480 - DNA, 18 bp, Homo sapiens
tcttccggtgggggcccc

SEQ ID NO: 44481 - DNA, 19 bp, Homo sapiens
tctcacggagcagggcccc

SEQ ID NO: 44482 - DNA, 17 bp, Homo sapiens
cctttcggtcctcggcc

SEQ ID NO: 44483 - DNA, 18 bp, Homo sapiens
ctctcggtcgggggctcc

SEQ ID NO: 44484 - DNA, 16 bp, Homo sapiens
tctctcggcggcgccc

SEQ ID NO: 44485 - DNA, 19 bp, Homo sapiens
tctcttgtctgggggcccc

SEQ ID NO: 44486 - DNA, 19 bp, Homo sapiens
tctctcgtcttccggtccc

SEQ ID NO: 44487 - DNA, 21 bp, Homo sapiens
tcgtctcggctgtggggcccc

SEQ ID NO: 44488 - DNA, 18 bp, Homo sapiens
ctgcggcctcggggcccc

SEQ ID NO: 44489 - DNA, 20 bp, Homo sapiens
ccttggtgaggcagggcccc

SEQ ID NO: 44490 - DNA, 17 bp, Homo sapiens
ctcccgggtggggcccc

SEQ ID NO: 44491 - DNA, 20 bp, Homo sapiens
tctttcgctcaggacggccc

SEQ ID NO: 44492 - DNA, 23 bp, Homo sapiens
tctctcggatcctggccgggtcc

SEQ ID NO: 44493 - DNA, 18 bp, Homo sapiens
cctcagccctcggggtcc

SEQ ID NO: 44494 - DNA, 20 bp, Homo sapiens
ctgagctctctcggggctcc

SEQ ID NO: 44495 - DNA, 19 bp, Homo sapiens
tctctcgctcgctcgctcc

SEQ ID NO: 44496 - DNA, 19 bp, Homo sapiens
tctccggtggggaggcccc

SEQ ID NO: 44497 - DNA, 20 bp, Homo sapiens
tctctcggggaaggggtccc

SEQ ID NO: 44498 - DNA, 17 bp, Homo sapiens
tctctcggctcagctcc

SEQ ID NO: 44499 - DNA, 22 bp, Homo sapiens
tccctcggttctggagcagtcc

SEQ ID NO: 44500 - DNA, 20 bp, Homo sapiens
tctctcggtcctctggggcc

SEQ ID NO: 44501 - DNA, 18 bp, Homo sapiens
ctctcggttcctgccgcc

SEQ ID NO: 44502 - DNA, 17 bp, Homo sapiens
tcaccacagctcggggc

SEQ ID NO: 44503 - DNA, 21 bp, Homo sapiens
tcgctcggtcccgtcggtccc

SEQ ID NO: 44504 - DNA, 19 bp, Homo sapiens
tcgctcctcccggggcccc

SEQ ID NO: 44505 - DNA, 20 bp, Homo sapiens
tctctgcgacccggggcccc

SEQ ID NO: 44506 - DNA, 18 bp, Homo sapiens
cctcggtcctcacggtgc

SEQ ID NO: 44507 - DNA, 16 bp, Homo sapiens
tctcccggtccttgac

SEQ ID NO: 44508 - DNA, 19 bp, Homo sapiens
tcccccgcctcggggctcc

SEQ ID NO: 44509 - DNA, 17 bp, Homo sapiens
tctcagtccataagccc

SEQ ID NO: 44510 - DNA, 21 bp, Homo sapiens
ctcttggccaggtggggcccc

SEQ ID NO: 44511 - DNA, 20 bp, Homo sapiens
tctctcagtcccggcgttcc

SEQ ID NO: 44512 - DNA, 18 bp, Homo sapiens
tcttggcctcaggacccc

SEQ ID NO: 44513 - DNA, 24 bp, Homo sapiens
tctctcgagggagtccggggcccc

SEQ ID NO: 44514 - DNA, 22 bp, Homo sapiens
tccctcggtttccatttggtcc

SEQ ID NO: 44515 - DNA, 19 bp, Homo sapiens
cctctcggtcctcacaggc

SEQ ID NO: 44516 - DNA, 19 bp, Homo sapiens
tctcggtccttcacactcc

SEQ ID NO: 44517 - DNA, 18 bp, Homo sapiens
tcccttggctggggcccc

SEQ ID NO: 44518 - DNA, 19 bp, Homo sapiens
tccctccgtttggggtccc

SEQ ID NO: 44519 - DNA, 18 bp, Homo sapiens
tcttgttctcagagctcc

SEQ ID NO: 44520 - DNA, 16 bp, Homo sapiens
ctctcggcggggctcc

SEQ ID NO: 44521 - DNA, 21 bp, Homo sapiens
ctcttggttttcagaagcccc

SEQ ID NO: 44522 - DNA, 20 bp, Homo sapiens
cctctcggtcctccagcccc

SEQ ID NO: 44523 - DNA, 23 bp, Homo sapiens
tctttcaggtccatcggggtccc

SEQ ID NO: 44524 - DNA, 18 bp, Homo sapiens
ctcccgcctcggggtccc

SEQ ID NO: 44525 - DNA, 21 bp, Homo sapiens
ccttccagcccttggggctcc

SEQ ID NO: 44526 - DNA, 15 bp, Homo sapiens
tccctcccggggccc

SEQ ID NO: 44527 - DNA, 19 bp, Homo sapiens
ccttggtggtcggggcccc

SEQ ID NO: 44528 - DNA, 18 bp, Homo sapiens
cctcagggccttggggcc

SEQ ID NO: 44529 - DNA, 19 bp, Homo sapiens
ctctcggagctctcggggc

SEQ ID NO: 44530 - DNA, 18 bp, Homo sapiens
ctcttggtccccagttcc

SEQ ID NO: 44531 - DNA, 21 bp, Homo sapiens
tctcagtcttcaaagggtccc

SEQ ID NO: 44532 - DNA, 15 bp, Homo sapiens
tctctcggtccgccc

SEQ ID NO: 44533 - DNA, 21 bp, Homo sapiens
tccctctcaccttggggcccc

SEQ ID NO: 44534 - DNA, 15 bp, Homo sapiens
cctctcggtcagaac

SEQ ID NO: 44535 - DNA, 19 bp, Homo sapiens
tctcctcggtttaaggccc

SEQ ID NO: 44536 - DNA, 18 bp, Homo sapiens
tctccgccgcggggcccc

SEQ ID NO: 44537 - DNA, 17 bp, Homo sapiens
tctctctggcgggctcc

SEQ ID NO: 44538 - DNA, 18 bp, Homo sapiens
tctgttgcccggggcccc

SEQ ID NO: 44539 - DNA, 18 bp, Homo sapiens
tctctcggttctgccacc

SEQ ID NO: 44540 - DNA, 16 bp, Homo sapiens
tctctcaacctggggc

SEQ ID NO: 44541 - DNA, 18 bp, Homo sapiens
tctttctgtcctcggtcc

SEQ ID NO: 44542 - DNA, 18 bp, Homo sapiens
cctctcagacggggttcc

SEQ ID NO: 44543 - DNA, 22 bp, Homo sapiens
tcccagcccctcttggggctcc

SEQ ID NO: 44544 - DNA, 16 bp, Homo sapiens
cctctcctcccggggc

SEQ ID NO: 44545 - DNA, 20 bp, Homo sapiens
tctttcggctttggagcccc

SEQ ID NO: 44546 - DNA, 19 bp, Homo sapiens
ccttggttccccaggtccc

SEQ ID NO: 44547 - DNA, 19 bp, Homo sapiens
tcgctgggcttggggcccc

SEQ ID NO: 44548 - DNA, 20 bp, Homo sapiens
tctctcggcctccgcgtccc

SEQ ID NO: 44549 - DNA, 20 bp, Homo sapiens
tctctcggctcttaacggcc

SEQ ID NO: 44550 - DNA, 17 bp, Homo sapiens
tctctcggcccaggccc

SEQ ID NO: 44551 - DNA, 18 bp, Homo sapiens
ctctggcttcggggcccc

SEQ ID NO: 44552 - DNA, 16 bp, Homo sapiens
tctcgccaggggcccc

SEQ ID NO: 44553 - DNA, 18 bp, Homo sapiens
tctctcggtgggaagccc

SEQ ID NO: 44554 - DNA, 15 bp, Homo sapiens
cctcccactcggggc

SEQ ID NO: 44555 - DNA, 15 bp, Homo sapiens
tctctcggcctgccc

SEQ ID NO: 44556 - DNA, 17 bp, Homo sapiens
cctctcggttcagtccc

SEQ ID NO: 44557 - DNA, 18 bp, Homo sapiens
cctctcggatgggggccc

SEQ ID NO: 44558 - DNA, 18 bp, Homo sapiens
tccctcgggaggggtccc

SEQ ID NO: 44559 - DNA, 15 bp, Homo sapiens
tctcccggggggccc

SEQ ID NO: 44560 - DNA, 19 bp, Homo sapiens
tctccggcccttggggtcc

SEQ ID NO: 44561 - DNA, 17 bp, Homo sapiens
tctctcggcccctgccc

SEQ ID NO: 44562 - DNA, 19 bp, Homo sapiens
tctctcagtcgctggtccc

SEQ ID NO: 44563 - DNA, 23 bp, Homo sapiens
ccttggtcctgttggtgggtccc

SEQ ID NO: 44564 - DNA, 16 bp, Homo sapiens
ctctcggtccgccgcc

SEQ ID NO: 44565 - DNA, 27 bp, Homo sapiens
tctctcagtcctaaaatctggggcccc

SEQ ID NO: 44566 - DNA, 17 bp, Homo sapiens
tcactcggtccctgccc

SEQ ID NO: 44567 - DNA, 21 bp, Homo sapiens
ctccgaacgcctcggggcccc

SEQ ID NO: 44568 - DNA, 16 bp, Homo sapiens
ctccagtctcggggcc

SEQ ID NO: 44569 - DNA, 18 bp, Homo sapiens
tcccttggtcctcaggcc

SEQ ID NO: 44570 - DNA, 20 bp, Homo sapiens
tctctgggttccgctgcccc

SEQ ID NO: 44571 - DNA, 16 bp, Homo sapiens
tccctcggttccaccc

SEQ ID NO: 44572 - DNA, 19 bp, Homo sapiens
tctctcgggtctccgaagc

SEQ ID NO: 44573 - DNA, 17 bp, Homo sapiens
tccttcgctcggggccc

SEQ ID NO: 44574 - DNA, 21 bp, Homo sapiens
tctctcagtcccctcggggcc

SEQ ID NO: 44575 - DNA, 17 bp, Homo sapiens
tctgggatcggggcccc

SEQ ID NO: 44576 - DNA, 19 bp, Homo sapiens
tctcggtcctcacagtccc

SEQ ID NO: 44577 - DNA, 15 bp, Homo sapiens
tctctcggtcaaccc

SEQ ID NO: 44578 - DNA, 18 bp, Homo sapiens
tccctcggaaggggcccc

SEQ ID NO: 44579 - DNA, 20 bp, Homo sapiens
tctatcctccatcggggccc

SEQ ID NO: 44580 - DNA, 22 bp, Homo sapiens
ctcagagcctcctcggggctcc

SEQ ID NO: 44581 - DNA, 19 bp, Homo sapiens
tctcgcgggcgcggggccc

SEQ ID NO: 44582 - DNA, 18 bp, Homo sapiens
tctctcggttcacacgcc

SEQ ID NO: 44583 - DNA, 18 bp, Homo sapiens
tctcagtctcagtgcccc

SEQ ID NO: 44584 - DNA, 18 bp, Homo sapiens
cctctcggtttgccagcc

SEQ ID NO: 44585 - DNA, 20 bp, Homo sapiens
cctctcggtcctgctggccc

SEQ ID NO: 44586 - DNA, 18 bp, Homo sapiens
tcactcggtccacatacc

SEQ ID NO: 44587 - DNA, 18 bp, Homo sapiens
tctcggtcttgaggtccc

SEQ ID NO: 44588 - DNA, 18 bp, Homo sapiens
ctcccagccttggggccc

SEQ ID NO: 44589 - DNA, 19 bp, Homo sapiens
tctgcctgtcttcggggcc

SEQ ID NO: 44590 - DNA, 18 bp, Homo sapiens
tctcccatgatcggggcc

SEQ ID NO: 44591 - DNA, 18 bp, Homo sapiens
tctttcagtgagggcccc

SEQ ID NO: 44592 - DNA, 21 bp, Homo sapiens
tcccccagccttcggggtccc

SEQ ID NO: 44593 - DNA, 18 bp, Homo sapiens
tccagcacctcggggtcc

SEQ ID NO: 44594 - DNA, 19 bp, Homo sapiens
tccacaaacttggggtccc

SEQ ID NO: 44595 - DNA, 20 bp, Homo sapiens
ctctccgccctcggggttcc

SEQ ID NO: 44596 - DNA, 16 bp, Homo sapiens
cctctccctggggccc

SEQ ID NO: 44597 - DNA, 18 bp, Homo sapiens
ctcaggcctcggggcccc

SEQ ID NO: 44598 - DNA, 19 bp, Homo sapiens
cctctcggtccccggttcc

SEQ ID NO: 44599 - DNA, 16 bp, Homo sapiens
tcctgcctcggggccc

SEQ ID NO: 44600 - DNA, 20 bp, Homo sapiens
cctcggtctcaagaagctcc

SEQ ID NO: 44601 - DNA, 15 bp, Homo sapiens
tctctcagtcgagcc

SEQ ID NO: 44602 - DNA, 21 bp, Homo sapiens
tcccgctcacctcggggctcc

SEQ ID NO: 44603 - DNA, 90 bp, Tupaia herpesvirus
cgccgctggctcggagccaagtgcgccggcggccgggctcggatcgctcgctcgcccacgctgctgcactcggctcccgggccctcggcg

SEQ ID NO: 44604 - DNA, 24 bp, Tupaia herpesvirus
ctcgcccacgctgctgcactcggc

SEQ ID NO: 44605 - DNA, 22 bp, Homo sapiens
ctcggctgcgctgctgtgtggc

SEQ ID NO: 44606 - DNA, 18 bp, Homo sapiens
gctcgcgcggcgctcggc

SEQ ID NO: 44607 - DNA, 24 bp, Homo sapiens
ctcggtctgcagcaggcactcggc

SEQ ID NO: 44608 - DNA, 19 bp, Homo sapiens
ctttcccacgctgctccgg

SEQ ID NO: 44609 - DNA, 16 bp, Homo sapiens
ctcgcctcgccactcg

SEQ ID NO: 44610 - DNA, 22 bp, Homo sapiens
tcttccgtgcacagcactcggc

SEQ ID NO: 44611 - DNA, 19 bp, Homo sapiens
ctcgcgccctccactcggc

SEQ ID NO: 44612 - DNA, 21 bp, Homo sapiens
ctcgctctgccgccgcttggc

SEQ ID NO: 44613 - DNA, 21 bp, Homo sapiens
ctcgcctgctgctgctgctgc

SEQ ID NO: 44614 - DNA, 21 bp, Homo sapiens
cacgcttgtgctgcacctggc

SEQ ID NO: 44615 - DNA, 17 bp, Homo sapiens
gcccgcgctgctcaggc

SEQ ID NO: 44616 - DNA, 18 bp, Homo sapiens
ctcctccacgctgcccgg

SEQ ID NO: 44617 - DNA, 19 bp, Homo sapiens
ctcgccgcacgttgctggc

SEQ ID NO: 44618 - DNA, 18 bp, Homo sapiens
tcgccccacgttgctcgg

SEQ ID NO: 44619 - DNA, 25 bp, Homo sapiens
tcgcccacgccgggtctgattcggc

SEQ ID NO: 44620 - DNA, 18 bp, Homo sapiens
cccgcctgcgctgccggc

SEQ ID NO: 44621 - DNA, 18 bp, Homo sapiens
ctcgctcggccggctcgg

SEQ ID NO: 44622 - DNA, 25 bp, Homo sapiens
ctcgcccacgctggcttgggtcggc

SEQ ID NO: 44623 - DNA, 16 bp, Homo sapiens
tccccacgccgctcgg

SEQ ID NO: 44624 - DNA, 20 bp, Homo sapiens
cccgcccatattgcacttgg

SEQ ID NO: 44625 - DNA, 19 bp, Homo sapiens
cacgtcagctgcacttggc

SEQ ID NO: 44626 - DNA, 15 bp, Homo sapiens
ccacggccactcggc

SEQ ID NO: 44627 - DNA, 23 bp, Homo sapiens
ctcccctgcgctgctgttccggc

SEQ ID NO: 44628 - DNA, 26 bp, Homo sapiens
ctcctccacgctgcgggccagctcgg

SEQ ID NO: 44629 - DNA, 21 bp, Homo sapiens
gcctggcaggctgcgcttggc

SEQ ID NO: 44630 - DNA, 17 bp, Homo sapiens
gccacgccagaactcgg

SEQ ID NO: 44631 - DNA, 23 bp, Homo sapiens
ctcgcccattcagcccactcggc

SEQ ID NO: 44632 - DNA, 23 bp, Homo sapiens
cgccgtgggctgctgcgcttggc

SEQ ID NO: 44633 - DNA, 65 bp, Human herpesvirus 7
gtctagaaaatataacgcaatatgttagttaaaaatgtaacttgttagattgatatttcatgggc

SEQ ID NO: 44634 - DNA, 24 bp, Human herpesvirus 7
taacgcaatatgttagttaaaaat

SEQ ID NO: 44635 - DNA, 17 bp, Homo sapiens
gcaatatatagtagaaa

SEQ ID NO: 44636 - DNA, 17 bp, Homo sapiens
gcaatagagttaaaaat

SEQ ID NO: 44637 - DNA, 21 bp, Homo sapiens
aacgcaatgtgttcacacaaa

SEQ ID NO: 44638 - DNA, 18 bp, Homo sapiens
gcaatatgcttattaaaa

SEQ ID NO: 44639 - DNA, 23 bp, Homo sapiens
taatacaatgactttagttaaaa

SEQ ID NO: 44640 - DNA, 61 bp, Cowpox virus
atagacgctatttatccgggcggtatacccaaaaggggtgagaacgttccagagtgtctat

SEQ ID NO: 44641 - DNA, 23 bp, Cowpox virus
tgagaacgttccagagtgtctat

SEQ ID NO: 44642 - DNA, 17 bp, Homo sapiens
gagagcgttccaggcgt

SEQ ID NO: 44643 - DNA, 20 bp, Homo sapiens
tgagagtttgcaatgtctat

SEQ ID NO: 44644 - DNA, 22 bp, Homo sapiens
gagggcgttccaggaacaatgt

SEQ ID NO: 44645 - DNA, 21 bp, Homo sapiens
tgaggtgttgttcatgtctat

SEQ ID NO: 44646 - DNA, 22 bp, Homo sapiens
tgagaacgttttgaaccctagc

SEQ ID NO: 44647 - DNA, 17 bp, Homo sapiens
tgagagcgtccggaggt

SEQ ID NO: 44648 - DNA, 18 bp, Homo sapiens
tgagaatttccaaagcac

SEQ ID NO: 44649 - DNA, 19 bp, Homo sapiens
gagaatgttccagatgagc

SEQ ID NO: 44650 - DNA, 19 bp, Homo sapiens
tgagaacattttagagcac

SEQ ID NO: 44651 - DNA, 17 bp, Homo sapiens
tgagatcgttccaatct

SEQ ID NO: 44652 - DNA, 15 bp, Homo sapiens
gagccagagtgtcta

SEQ ID NO: 44653 - DNA, 19 bp, Homo sapiens
tggaacgttccagaaccca

SEQ ID NO: 44654 - DNA, 19 bp, Homo sapiens
tgagaaagtttcagaacat

SEQ ID NO: 44655 - DNA, 18 bp, Homo sapiens
gagagcgttccagatgcc

SEQ ID NO: 44656 - DNA, 21 bp, Homo sapiens
tgagggtgtctgagtgtctat

SEQ ID NO: 44657 - DNA, 23 bp, Homo sapiens
tgggaaccttccagaaaggttct

SEQ ID NO: 44658 - DNA, 20 bp, Homo sapiens
tgagacacaggagtgtctat

SEQ ID NO: 44659 - DNA, 20 bp, Homo sapiens
tgggaacgctccagccgtat

SEQ ID NO: 44660 - DNA, 67 bp, Cowpox virus
gagtgtctatccagggaaatcaaagaagaagttaatatagataattcttttgtattcatagacactc

SEQ ID NO: 44661 - DNA, 24 bp, Cowpox virus
taattcttttgtattcatagacac

SEQ ID NO: 44662 - DNA, 22 bp, Homo sapiens
taattcttttatattaaaaaca

SEQ ID NO: 44663 - DNA, 18 bp, Homo sapiens
tctttgcgtcatagacac

SEQ ID NO: 44664 - DNA, 26 bp, Homo sapiens
taacttttttgtacaattgcatagac

SEQ ID NO: 44665 - DNA, 25 bp, Homo sapiens
taattttttgtatttttagtagaca

SEQ ID NO: 44666 - DNA, 18 bp, Homo sapiens
ttctttgccaatagacac

SEQ ID NO: 44667 - DNA, 17 bp, Homo sapiens
ttctttgtattcaaaga

SEQ ID NO: 44668 - DNA, 20 bp, Homo sapiens
ttctttttttggcatagaca

SEQ ID NO: 44669 - DNA, 19 bp, Homo sapiens
taattctttttgtacaaca

SEQ ID NO: 44670 - DNA, 22 bp, Homo sapiens
attcttttggttcccataggca

SEQ ID NO: 44671 - DNA, 26 bp, Homo sapiens
taatttttttgtatttttagtagaca

SEQ ID NO: 44672 - DNA, 19 bp, Homo sapiens
taattttttgtattcttag

SEQ ID NO: 44673 - DNA, 21 bp, Homo sapiens
ttcctttgagtaacatagaca

SEQ ID NO: 44674 - DNA, 19 bp, Homo sapiens
ttcttttgagtaatagaca

SEQ ID NO: 44675 - DNA, 21 bp, Homo sapiens
ttcttttgcatctcttcatag

SEQ ID NO: 44676 - DNA, 24 bp, Homo sapiens
taattttttgtattttagtagaca

SEQ ID NO: 44677 - DNA, 24 bp, Homo sapiens
taattctttttgtgtgtgagacac

SEQ ID NO: 44678 - DNA, 21 bp, Homo sapiens
taattcttagtatatggacac

SEQ ID NO: 44679 - DNA, 88 bp, Spleen focus-forming virus
gtgtcggtgacgccgtgtgggtacgccggcaccagactaagaacttagaaccccgctggaaaggaccctacaccgtcctgctgaccac

SEQ ID NO: 44680 - DNA, 24 bp, Spleen focus-forming virus
tcggtgacgccgtgtgggtacgcc

SEQ ID NO: 44681 - DNA, 16 bp, Homo sapiens
tcggtgcagatgggta

SEQ ID NO: 44682 - DNA, 18 bp, Homo sapiens
ggtgacgctgtatgccgg

SEQ ID NO: 44683 - DNA, 21 bp, Homo sapiens
tcggtgacattgtggcctggc

SEQ ID NO: 44684 - DNA, 126 bp, Cowpox virus
ataattagaactagaaacatgtctagaaagaaacgattatttctgaattattccaattatttgaacaaacaggaaagaagtatactatcgtcatttttttctctatatccagctactactgataat

SEQ ID NO: 44685 - DNA, 24 bp, Cowpox virus
tagaaagaaacgattatttctgaa

SEQ ID NO: 44686 - DNA, 21 bp, Homo sapiens
tagaaaaataaaaatttctga

SEQ ID NO: 44687 - DNA, 22 bp, Homo sapiens
tagaaagaaattggttactcct

SEQ ID NO: 44688 - DNA, 21 bp, Homo sapiens
taaaaataaattatttctgaa

SEQ ID NO: 44689 - DNA, 22 bp, Homo sapiens
tagaaataagtcatatttctga

SEQ ID NO: 44690 - DNA, 16 bp, Homo sapiens
tagaaagaacgtccga

SEQ ID NO: 44691 - DNA, 18 bp, Homo sapiens
gaaacacttttatttctg

SEQ ID NO: 44692 - DNA, 19 bp, Homo sapiens
gaaagaaactttattttga

SEQ ID NO: 44693 - DNA, 21 bp, Homo sapiens
agagggaaagaacatttctga

SEQ ID NO: 44694 - DNA, 21 bp, Homo sapiens
gaagagggacctatttctgaa

SEQ ID NO: 44695 - DNA, 25 bp, Homo sapiens
tagaaagagacggctgtactttgaa

SEQ ID NO: 44696 - DNA, 27 bp, Homo sapiens
tagaaagaggaggttatctttacctga

SEQ ID NO: 44697 - DNA, 22 bp, Homo sapiens
tagaagaagttgcatttctgaa

SEQ ID NO: 44698 - DNA, 18 bp, Homo sapiens
tagaaacagacgatcatt

SEQ ID NO: 44699 - DNA, 19 bp, Homo sapiens
gaaagaaacaaattctgaa

SEQ ID NO: 44700 - DNA, 19 bp, Homo sapiens
cagaaagaaatgaagtctg

SEQ ID NO: 44701 - DNA, 24 bp, Homo sapiens
cagaaagaaatatatatttttgaa

SEQ ID NO: 44702 - DNA, 17 bp, Homo sapiens
gaaagaatttatttctg

SEQ ID NO: 44703 - DNA, 20 bp, Homo sapiens
aaaagaaatactattctgaa

SEQ ID NO: 44704 - DNA, 22 bp, Homo sapiens
agaaacgagatataattctgaa

SEQ ID NO: 44705 - DNA, 23 bp, Homo sapiens
taggaagaaacagaaaacctgaa

SEQ ID NO: 44706 - DNA, 20 bp, Homo sapiens
tagagggagacgacttctga

SEQ ID NO: 44707 - DNA, 23 bp, Homo sapiens
tagacaagtggcattatttctga

SEQ ID NO: 44708 - DNA, 21 bp, Homo sapiens
cagaaagaggctggatttctg

SEQ ID NO: 44709 - DNA, 16 bp, Homo sapiens
agaaacgttctctgaa

SEQ ID NO: 44710 - DNA, 19 bp, Homo sapiens
cagaaagaaagcctttctg

SEQ ID NO: 44711 - DNA, 126 bp, Spleen focus-forming virus
agagactgtgatggggcagcctactccaaagacccctcgacaactaagggagttcctagggacggcaggcttctgtcgcctctggatccccgggtttgcagaaatggcagcccccttgtaccctct

SEQ ID NO: 44712 - DNA, 24 bp, Spleen focus-forming virus
actgtgatggggcagcctactcca

SEQ ID NO: 44713 - DNA, 21 bp, Homo sapiens
ctgtgatggggtgacacaatc

SEQ ID NO: 44714 - DNA, 17 bp, Homo sapiens
ctgtgatggtctattcc

SEQ ID NO: 44715 - DNA, 19 bp, Homo sapiens
ctgtatgcagtctactcca

SEQ ID NO: 44716 - DNA, 26 bp, Homo sapiens
actgtgatcgggctccagctacttca

SEQ ID NO: 44717 - DNA, 17 bp, Homo sapiens
tgtgataggcttattcc

SEQ ID NO: 44718 - DNA, 20 bp, Homo sapiens
ctttggtggggcagatccca

SEQ ID NO: 44719 - DNA, 19 bp, Homo sapiens
actggatggggctcactcc

SEQ ID NO: 44720 - DNA, 19 bp, Homo sapiens
tgtggctgcccctactcca

SEQ ID NO: 44721 - DNA, 20 bp, Homo sapiens
tgtggtgggacagtgtgcct

SEQ ID NO: 44722 - DNA, 22 bp, Homo sapiens
tgtgatggtaacatctgctcca

SEQ ID NO: 44723 - DNA, 19 bp, Homo sapiens
tgtgatggtggcaggtcca

SEQ ID NO: 44724 - DNA, 20 bp, Homo sapiens
ctgtgctggggcctcctcca

SEQ ID NO: 44725 - DNA, 20 bp, Homo sapiens
tgtgatggggcggcagcccc

SEQ ID NO: 44726 - DNA, 21 bp, Homo sapiens
gtgacagactggcctgctcca

SEQ ID NO: 44727 - DNA, 20 bp, Homo sapiens
tgtgtgtatagcctacttca

SEQ ID NO: 44728 - DNA, 23 bp, Homo sapiens
tggaacaaaggcagtctactcca

SEQ ID NO: 44729 - DNA, 87 bp, Spleen focus-forming virus
ctgaagaggggctgcaacatgactgccttgacatcttggctgaagcccacggaactagaccagatcttacggaccagcctctcccag

SEQ ID NO: 44730 - DNA, 122 bp, Human herpesvirus 7
gatacccattcaagtgaaaggctattatagttaggagggctagcaatataagaaaacttatattcaatgtatttttttttaagctatgaaagtaaagatacctattcaagtgaaaggctatt

SEQ ID NO: 44731 - DNA, 24 bp, Human herpesvirus 7
tgaaaggctattatagttaggagg

SEQ ID NO: 44732 - DNA, 24 bp, Homo sapiens
tgaacaggttgaacttttaggagg

SEQ ID NO: 44733 - DNA, 17 bp, Homo sapiens
tgaaagctattgtaggg

SEQ ID NO: 44734 - DNA, 20 bp, Homo sapiens
tgaggactgtagttaggagg

SEQ ID NO: 44735 - DNA, 22 bp, Homo sapiens
tgaaaggcttccacctgggagg

SEQ ID NO: 44736 - DNA, 18 bp, Homo sapiens
agggttatggctaggagg

SEQ ID NO: 44737 - DNA, 17 bp, Homo sapiens
cgagggcacagttaggg

SEQ ID NO: 44738 - DNA, 18 bp, Homo sapiens
tgaaaggcagttgtgaag

SEQ ID NO: 44739 - DNA, 18 bp, Homo sapiens
aaaggctattatggttgg

SEQ ID NO: 44740 - DNA, 17 bp, Homo sapiens
gaaaggctgtttaggag

SEQ ID NO: 44741 - DNA, 22 bp, Homo sapiens
tggaaggctgttttaaaagagg

SEQ ID NO: 44742 - DNA, 21 bp, Homo sapiens
tgaaaggctttaaaaaggagg

SEQ ID NO: 44743 - DNA, 93 bp, Human herpesvirus 7
gtataaaaaacttaaggtttatttaaaagtccatattttataaaagttaatgaaaaagaaactgaatagaaatagattgataagtccatatgc

SEQ ID NO: 44744 - DNA, 24 bp, Human herpesvirus 7
aagaaactgaatagaaatagattg

SEQ ID NO: 44745 - DNA, 21 bp, Homo sapiens
aagaaactgaaaggagcacag

SEQ ID NO: 44746 - DNA, 21 bp, Homo sapiens
aagaaactgaaaaggggctag

SEQ ID NO: 44747 - DNA, 18 bp, Homo sapiens
aagaaactgaataggatt

SEQ ID NO: 44748 - DNA, 21 bp, Homo sapiens
aagaaactgagtagagccaaa

SEQ ID NO: 44749 - DNA, 20 bp, Homo sapiens
aagacactgaataggaacag

SEQ ID NO: 44750 - DNA, 22 bp, Homo sapiens
agaacgagacagaaataggttg

SEQ ID NO: 44751 - DNA, 20 bp, Homo sapiens
aagaaactgatgtggaaata

SEQ ID NO: 44752 - DNA, 18 bp, Homo sapiens
agaagctgaacaggaata

SEQ ID NO: 44753 - DNA, 23 bp, Homo sapiens
aagaggtttacaaaaatagattg

SEQ ID NO: 44754 - DNA, 22 bp, Homo sapiens
gaaatagaatagattttgattg

SEQ ID NO: 44755 - DNA, 22 bp, Homo sapiens
aggaactgaatagtagaaacag

SEQ ID NO: 44756 - DNA, 90 bp, Camelpox virus
tgtctagaaagaaacgattatttctgaattattccaattatttaaacaaacaggaaagaagtatactatcgtcatttttttctctagata

SEQ ID NO: 44757 - DNA, 90 bp, Camelpox virus; identical to SEQ ID NO: 44756

SEQ ID NO: 44758 - DNA, 18 bp, Homo sapiens
caattatttctgagccca

SEQ ID NO: 44759 - DNA, 22 bp, Homo sapiens
acgcttatttctgggtgtccaa

SEQ ID NO: 44760 - DNA, 17 bp, Homo sapiens
ttatttctggacattcc

SEQ ID NO: 44761 - DNA, 19 bp, Homo sapiens
cgatatttctggtgaccca

SEQ ID NO: 44762 - DNA, 19 bp, Homo sapiens
gacatctgggttattccaa

SEQ ID NO: 44763 - DNA, 22 bp, Homo sapiens
cgggtgaatctgaattgttcca

SEQ ID NO: 44764 - DNA, 18 bp, Homo sapiens
cgttatttctgctaattc

SEQ ID NO: 44765 - DNA, 19 bp, Homo sapiens
gattcactgattattccaa

SEQ ID NO: 44766 - DNA, 67 bp, Porcine adenovirus A
ggcagcgccgcccgcccgcagcggcggtcccccgccctcggctgccgaggcggcccatcgtgctgcc

SEQ ID NO: 44767 - DNA, 24 bp, Porcine adenovirus A
tgccgaggcggcccatcgtgctgc

SEQ ID NO: 44768 - DNA, 21 bp, Homo sapiens
tgctggggcggccctcaagcc

SEQ ID NO: 44769 - DNA, 22 bp, Homo sapiens
gctggggcggcccgcttgttgc

SEQ ID NO: 44770 - DNA, 21 bp, Homo sapiens
tgccgaggctgcccgtggggc

SEQ ID NO: 44771 - DNA, 21 bp, Homo sapiens
tactgaggcggctgcggctgc

SEQ ID NO: 44772 - DNA, 18 bp, Homo sapiens
tgtcaaggcggctctgtg

SEQ ID NO: 44773 - DNA, 18 bp, Homo sapiens
tgccgaggctgctccctg

SEQ ID NO: 44774 - DNA, 16 bp, Homo sapiens
tgccgaagcggcccct

SEQ ID NO: 44775 - DNA, 21 bp, Homo sapiens
ccgaggcggctccgccgctgc

SEQ ID NO: 44776 - DNA, 23 bp, Homo sapiens
tggttaagcgcctatcgtgctgc

SEQ ID NO: 44777 - DNA, 19 bp, Homo sapiens
tgccaggcccttcgtgctg

SEQ ID NO: 44778 - DNA, 20 bp, Homo sapiens
tgccgaggggccctcttctg

SEQ ID NO: 44779 - DNA, 22 bp, Homo sapiens
tgcggggcggcccggggcgtgc

SEQ ID NO: 44780 - DNA, 23 bp, Homo sapiens
tgctgggacggcccgcagcctgc

SEQ ID NO: 44781 - DNA, 16 bp, Homo sapiens
tgccgaggcgctcgtg

SEQ ID NO: 44782 - DNA, 18 bp, Homo sapiens
tgccgaggcggtcctcgc

SEQ ID NO: 44783 - DNA, 17 bp, Homo sapiens
tgcagaggcggcttgcc

SEQ ID NO: 44784 - DNA, 131 bp, Murine hepatitis virus
agagttgcatgaagatattgttgaaattctccgcagaaggggttgcacggcagatcaatccagacactggattccgcactgcactgtggcccaatttgacgaagaaagagaaacaaaaggaatgcaattct

SEQ ID NO: 44785 - DNA, 24 bp, Murine hepatitis virus
cactgcactgtggcccaatttgac

SEQ ID NO: 44786 - DNA, 21 bp, Homo sapiens
tgctattatagcccagtttga

SEQ ID NO: 44787 - DNA, 15 bp, Homo sapiens
ctgcactgggctttg

SEQ ID NO: 44788 - DNA, 17 bp, Homo sapiens
tgccctcgcccaatttg

SEQ ID NO: 44789 - DNA, 19 bp, Homo sapiens
tgcactgtggcctctcaga

SEQ ID NO: 44790 - DNA, 24 bp, Homo sapiens
cacagcacctccccccaatttgac

SEQ ID NO: 44791 - DNA, 21 bp, Homo sapiens
ctgcatccctgtccaatttga

SEQ ID NO: 44792 - DNA, 21 bp, Homo sapiens
ctgggctgtggccctggggac

SEQ ID NO: 44793 - DNA, 19 bp, Homo sapiens
cactgtaactataatttga

SEQ ID NO: 44794 - DNA, 21 bp, Homo sapiens
cacttgtgaaaaaccaatttg

SEQ ID NO: 44795 - DNA, 15 bp, Homo sapiens
tgcactgtggtctga

SEQ ID NO: 44796 - DNA, 20 bp, Homo sapiens
ctgcactgtggtccaatgac

SEQ ID NO: 44797 - DNA, 22 bp, Homo sapiens
cactgcacagtggcctggtgac

SEQ ID NO: 44798 - DNA, 16 bp, Homo sapiens
ctcactgtggccctga

SEQ ID NO: 44799 - DNA, 25 bp, Homo sapiens
cactgcatttgtggtgggcgtttga

SEQ ID NO: 44800 - DNA, 19 bp, Homo sapiens
cactgcagtgtggttccca

SEQ ID NO: 44801 - DNA, 24 bp, Homo sapiens
cacggcactgtgaaggaagtttga

SEQ ID NO: 44802 - DNA, 16 bp, Homo sapiens
gcactgtggcaatctg

SEQ ID NO: 44803 - DNA, 20 bp, Homo sapiens
actgcactggggccagcgac

SEQ ID NO: 44804 - DNA, 19 bp, Homo sapiens
cacttattgtggccctctg

SEQ ID NO: 44805 - DNA, 22 bp, Homo sapiens
cattgtgctgtgaccgctttga

SEQ ID NO: 44806 - DNA, 19 bp, Homo sapiens
cactgcacgtggcctcaat

SEQ ID NO: 44807 - DNA, 19 bp, Homo sapiens
cattacactgtaaatttga

SEQ ID NO: 44808 - DNA, 22 bp, Homo sapiens
cactgcagcctcctgatttgac

SEQ ID NO: 44809 - DNA, 19 bp, Homo sapiens
ctgccctgaacaatttgac

SEQ ID NO: 44810 - DNA, 20 bp, Homo sapiens
ctgcagaagtctaatttgac

SEQ ID NO: 44811 - DNA, 16 bp, Homo sapiens
ctgcactgtggctcga

SEQ ID NO: 44812 - DNA, 19 bp, Homo sapiens
tgctcatattccaatttga

SEQ ID NO: 44813 - DNA, 64 bp, Murine hepatitis virus
gatgactggtttctatttggtgacagtcgttctgactgtacctatgtagaaaataacggtcatc

SEQ ID NO: 44814 - DNA, 24 bp, Murine hepatitis virus
tttctatttggtgacagtcgttct

SEQ ID NO: 44815 - DNA, 20 bp, Homo sapiens
tttctatttggtgcaacgtt

SEQ ID NO: 44816 - DNA, 17 bp, Homo sapiens
tttcatttggtggcagt

SEQ ID NO: 44817 - DNA, 17 bp, Homo sapiens
tatttggttgctgttct

SEQ ID NO: 44818 - DNA, 18 bp, Homo sapiens
tttcttttggtgacaagc

SEQ ID NO: 44819 - DNA, 21 bp, Homo sapiens
tttctttttgataaagttgtt

SEQ ID NO: 44820 - DNA, 22 bp, Homo sapiens
tttccatcttaacagttgttct

SEQ ID NO: 44821 - DNA, 67 bp, Porcine adenovirus A
gggaccgctccaatgagttctcctatggcaagcggtcgctgctgggggagtcaggagacaccgtccc

SEQ ID NO: 44822 - DNA, 24 bp, Porcine adenovirus A
tgctgggggagtcaggagacaccg

SEQ ID NO: 44823 - DNA, 18 bp, Homo sapiens
tgctgggggcagtggcac

SEQ ID NO: 44824 - DNA, 16 bp, Homo sapiens
tggatagtaggagaca

SEQ ID NO: 44825 - DNA, 20 bp, Homo sapiens
tgctgagctgcaggagacac

SEQ ID NO: 44826 - DNA, 21 bp, Homo sapiens
gctgggggaactgaggcaccg

SEQ ID NO: 44827 - DNA, 20 bp, Homo sapiens
ctgggggaggatgggtaccg

SEQ ID NO: 44828 - DNA, 19 bp, Homo sapiens
tgctggaggaggccggtac

SEQ ID NO: 44829 - DNA, 18 bp, Homo sapiens
tgggggagtcggcagccg

SEQ ID NO: 44830 - DNA, 18 bp, Homo sapiens
tgctagggctaggaggca

SEQ ID NO: 44831 - DNA, 16 bp, Homo sapiens
ctggggcaggggacac

SEQ ID NO: 44832 - DNA, 18 bp, Homo sapiens
tgcagtcaggaggcatcg

SEQ ID NO: 44833 - DNA, 19 bp, Homo sapiens
tgtgggggattagacatcg

SEQ ID NO: 44834 - DNA, 20 bp, Homo sapiens
tgctgcatatcaggagatac

SEQ ID NO: 44835 - DNA, 20 bp, Homo sapiens
tgctggagggggttggggag

SEQ ID NO: 44836 - DNA, 18 bp, Homo sapiens
tgggggagtgaggtgccg

SEQ ID NO: 44837 - DNA, 21 bp, Homo sapiens
tgtgggggagttggggttaca

SEQ ID NO: 44838 - DNA, 18 bp, Homo sapiens
tgttgggggagatgggac

SEQ ID NO: 44839 - DNA, 22 bp, Homo sapiens
gctgggggaatgtggggcgccg

SEQ ID NO: 44840 - DNA, 18 bp, Homo sapiens
tgctgggggggtggggag

SEQ ID NO: 44841 - DNA, 16 bp, Homo sapiens
tgctgggggggcagag

SEQ ID NO: 44842 - DNA, 22 bp, Homo sapiens
tgtggttcaccaggaggcaccg

SEQ ID NO: 44843 - DNA, 16 bp, Homo sapiens
tgctggtggaggacac

SEQ ID NO: 44844 - DNA, 15 bp, Homo sapiens
ctgggggaaaggcac

SEQ ID NO: 44845 - DNA, 21 bp, Homo sapiens
gctgggggcgtggggatgccg

SEQ ID NO: 44846 - DNA, 23 bp, Homo sapiens
tgctgggagggggtagtggggga

SEQ ID NO: 44847 - DNA, 16 bp, Homo sapiens
gctgggggacaggaga

SEQ ID NO: 44848 - DNA, 22 bp, Homo sapiens
tgctggggtacaggggacaccg

SEQ ID NO: 44849 - DNA, 19 bp, Homo sapiens
tgctgggggagcaggagcc

SEQ ID NO: 44850 - DNA, 15 bp, Homo sapiens
gctgggggcagggac

SEQ ID NO: 44851 - DNA, 16 bp, Homo sapiens
tgctggggaggcagac

SEQ ID NO: 44852 - DNA, 19 bp, Homo sapiens
tgctggggaaaagtcaaga

SEQ ID NO: 44853 - DNA, 19 bp, Homo sapiens
tgctggaaacaggaggcac

SEQ ID NO: 44854 - DNA, 20 bp, Homo sapiens
tgctgagggggttggggaca

SEQ ID NO: 44855 - DNA, 19 bp, Homo sapiens
tgcatgggggaggtggaga

SEQ ID NO: 44856 - DNA, 18 bp, Homo sapiens
ccgttagtcaggaggcac

SEQ ID NO: 44857 - DNA, 17 bp, Homo sapiens
tgggggagaggcagaca

SEQ ID NO: 44858 - DNA, 20 bp, Homo sapiens
gggaagtacaggagacaccg

SEQ ID NO: 44859 - DNA, 17 bp, Homo sapiens
gctgggaaggaggggac

SEQ ID NO: 44860 - DNA, 23 bp, Homo sapiens
tgctgggggtggtggaggcaccg

SEQ ID NO: 44861 - DNA, 22 bp, Homo sapiens
tgctggaggggagcgggcaccg

SEQ ID NO: 44862 - DNA, 21 bp, Homo sapiens
tgttgggggaggcgggggccg

SEQ ID NO: 44863 - DNA, 17 bp, Homo sapiens
tgccgggagcccgggag

SEQ ID NO: 44864 - DNA, 18 bp, Homo sapiens
tgttgggggagtcagaga

SEQ ID NO: 44865 - DNA, 21 bp, Homo sapiens
tgcgggggacagaagatgccg

SEQ ID NO: 44866 - DNA, 21 bp, Homo sapiens
tgctggggggctgcgtgggga

SEQ ID NO: 44867 - DNA, 61 bp, Porcine adenovirus A
ggtggagatggcagaggctgtcgccgcgcccgaggtgctgcccagcctccccgtctccatc

SEQ ID NO: 44868 - DNA, 24 bp, Porcine adenovirus A
agaggctgtcgccgcgcccgaggt

SEQ ID NO: 44869 - DNA, 17 bp, Homo sapiens
gagggtgtcacccgagg

SEQ ID NO: 44870 - DNA, 18 bp, Homo sapiens
aaaggctagtgcctgagg

SEQ ID NO: 44871 - DNA, 19 bp, Homo sapiens
ggctgtcagcgcctggggt

SEQ ID NO: 44872 - DNA, 23 bp, Homo sapiens
gaggctgtcagcgtgagcggggt

SEQ ID NO: 44873 - DNA, 24 bp, Homo sapiens
gaggctgtcgctgtaaacataggt

SEQ ID NO: 44874 - DNA, 19 bp, Homo sapiens
agaggctgttcccgtggag

SEQ ID NO: 44875 - DNA, 27 bp, Homo sapiens
aggggctgtcaggcgcgtgctcggggt

SEQ ID NO: 44876 - DNA, 22 bp, Homo sapiens
gaggctgtgctgcagggctggt

SEQ ID NO: 44877 - DNA, 24 bp, Homo sapiens
agaggctgtcctggagtgagaggt

SEQ ID NO: 44878 - DNA, 23 bp, Homo sapiens
gaggctgtcgtgccagaagaggt

SEQ ID NO: 44879 - DNA, 20 bp, Homo sapiens
agtattgccgcgcccggggt

SEQ ID NO: 44880 - DNA, 22 bp, Homo sapiens
gaggctgcgctgcggtacctcg

SEQ ID NO: 44881 - DNA, 22 bp, Homo sapiens
agaggccgggcttgcctgaggt

SEQ ID NO: 44882 - DNA, 20 bp, Homo sapiens
gaggctgtccttgttgaggt

SEQ ID NO: 44883 - DNA, 25 bp, Homo sapiens
gaggctgcacgcaggtgcccggggt

SEQ ID NO: 44884 - DNA, 20 bp, Homo sapiens
gaggctgtgtgtgctgaggt

SEQ ID NO: 44885 - DNA, 26 bp, Homo sapiens
agaggctgttgtcctgatgcaggggt

SEQ ID NO: 44886 - DNA, 21 bp, Homo sapiens
agaggctgcggcggttggggt

SEQ ID NO: 44887 - DNA, 20 bp, Homo sapiens
gaggcagccctgcccggggt

SEQ ID NO: 44888 - DNA, 22 bp, Homo sapiens
gaggattgttggagcccggggt

SEQ ID NO: 44889 - DNA, 79 bp, Porcine adenovirus A
gccgcctgtccccggatcaccccgtgatcgtccgacgccactaccgggccaactgggccagtctgaagggacgcgtggc

SEQ ID NO: 44890 - DNA, 24 bp, Porcine adenovirus A
tccccggatcaccccgtgatcgtc

SEQ ID NO: 44891 - DNA, 18 bp, Homo sapiens
tccccggatgcgcttcca

SEQ ID NO: 44892 - DNA, 26 bp, Homo sapiens
tccctggagtgccccgcaactgcgtc

SEQ ID NO: 44893 - DNA, 21 bp, Homo sapiens
tctccgggtccgcccgccgtc

SEQ ID NO: 44894 - DNA, 20 bp, Homo sapiens
tccccggattccctcctgtc

SEQ ID NO: 44895 - DNA, 68 bp, Murine hepatitis virus
gtggtgatttagaaataggagacctaccgcaggatgatgaggaagcgtgggccgagctaagttaccac

SEQ ID NO: 44896 - DNA, 24 bp, Murine hepatitis virus
tgatttagaaataggagacctacc

SEQ ID NO: 44897 - DNA, 24 bp, Homo sapiens
tgatttaggaaagtcacaaaccta

SEQ ID NO: 44898 - DNA, 18 bp, Homo sapiens
tgatttaaaaaaatacct

SEQ ID NO: 44899 - DNA, 22 bp, Homo sapiens
tgattagaaatcctggtctacc

SEQ ID NO: 44900 - DNA, 23 bp, Homo sapiens
tgacttaaaataggggacctgcc

SEQ ID NO: 44901 - DNA, 17 bp, Homo sapiens
tgatttaaaataggaga

SEQ ID NO: 44902 - DNA, 19 bp, Homo sapiens
atttagagacaagtctacc

SEQ ID NO: 44903 - DNA, 18 bp, Homo sapiens
tgatttagaagtatgaag

SEQ ID NO: 44904 - DNA, 18 bp, Homo sapiens
taatttagagagagccta

SEQ ID NO: 44905 - DNA, 23 bp, Homo sapiens
tgattagaaatggatcataccta

SEQ ID NO: 44906 - DNA, 18 bp, Homo sapiens
tgacttggaaacgaccta

SEQ ID NO: 44907 - DNA, 17 bp, Homo sapiens
taatttagaaatgaaaa

SEQ ID NO: 44908 - DNA, 22 bp, Homo sapiens
tgatttgggaacaggaagcacc

SEQ ID NO: 44909 - DNA, 18 bp, Homo sapiens
tgatttagagaaggggag

SEQ ID NO: 44910 - DNA, 18 bp, Homo sapiens
tgatttagaagaagctac

SEQ ID NO: 44911 - DNA, 18 bp, Homo sapiens
tggttcagaaagaagcct

SEQ ID NO: 44912 - DNA, 19 bp, Homo sapiens
tggtttagaggtaagaaac

SEQ ID NO: 44913 - DNA, 22 bp, Homo sapiens
gactctgagtgggaggcctgcc

SEQ ID NO: 44914 - DNA, 91 bp, Murine hepatitis virus
caaagaaacacctacttcttcagacatgtgcacgataatagcatctattttcgtaccgtgtgtagaatgaagggttgtatgtgttgatttg

SEQ ID NO: 44915 - DNA, 24 bp, Murine hepatitis virus
ttcgtaccgtgtgtagaatgaagg

SEQ ID NO: 44916 - DNA, 20 bp, Homo sapiens
gtgtgtctgtggaatgaagg

SEQ ID NO: 44917 - DNA, 23 bp, Homo sapiens
ttctgccttgtgtagaatggggg

SEQ ID NO: 44918 - DNA, 20 bp, Homo sapiens
gtgccgtggaaaaatgaagg

SEQ ID NO: 44919 - DNA, 121 bp, Murine hepatitis virus
ttggcttgacctcgacccaaagttgtgtaattcaggaaagatttccgcaaagagtggtaactctctctttaggagttttcacttcactgatttttacaattatacgggtgagggagaccaa

SEQ ID NO: 44920 - DNA, 24 bp, Murine hepatitis virus
tgtgtaattcaggaaagatttccg

SEQ ID NO: 44921 - DNA, 20 bp, Homo sapiens
tgtatgattcataagatttc

SEQ ID NO: 44922 - DNA, 16 bp, Homo sapiens
tgtacaggaagatttc

SEQ ID NO: 44923 - DNA, 18 bp, Homo sapiens
tgtgtaattcggagaaga

SEQ ID NO: 44924 - DNA, 18 bp, Homo sapiens
tgtggaattcagggagat

SEQ ID NO: 44925 - DNA, 63 bp, Porcine adenovirus A
ggcgcccgcggcggttccggtgcctcccccagcccctccagccccgcgcgcgccgcgtgcgcc

SEQ ID NO: 44926 - DNA, 21 bp, Porcine adenovirus A
cccgcgcgcgccgcgtgcgcc

SEQ ID NO: 44927 - DNA, 15 bp, Homo sapiens
cccgcccgcgcgcgc

SEQ ID NO: 44928 - DNA, 18 bp, Homo sapiens
cccgcgcgcagaggcgcc

SEQ ID NO: 44929 - DNA, 18 bp, Homo sapiens
cccccgcgcgcctgcgca

SEQ ID NO: 44930 - DNA, 19 bp, Homo sapiens
ccctcgtgcgccccggcgc

SEQ ID NO: 44931 - DNA, 17 bp, Homo sapiens
cgcgcacggcccgcgcc

SEQ ID NO: 44932 - DNA, 18 bp, Homo sapiens
ccccggcccgcgtgcgcc

SEQ ID NO: 44933 - DNA, 16 bp, Homo sapiens
cccgcgcgtcctggcc

SEQ ID NO: 44934 - DNA, 22 bp, Homo sapiens
cctcgcgtgcgctcacccagcc

SEQ ID NO: 44935 - DNA, 20 bp, Homo sapiens
cctcgccgcctcgcgtgcgc

SEQ ID NO: 44936 - DNA, 17 bp, Homo sapiens
ccgtgcgcgcactcgcc

SEQ ID NO: 44937 - DNA, 16 bp, Homo sapiens
gccggccgcgtgcgcc

SEQ ID NO: 44938 - DNA, 18 bp, Homo sapiens
cccgagcgcgccaggtgc

SEQ ID NO: 44939 - DNA, 16 bp, Homo sapiens
cccgcgccgccaccgc

SEQ ID NO: 44940 - DNA, 18 bp, Homo sapiens
cacgcgccgccggtgcgc

SEQ ID NO: 44941 - DNA, 17 bp, Homo sapiens
cccgcggcgccgcaggc

SEQ ID NO: 44942 - DNA, 20 bp, Homo sapiens
ccgcggcccactcgtgcgcc

SEQ ID NO: 44943 - DNA, 17 bp, Homo sapiens
ccaccccgcgcgtgcgc

SEQ ID NO: 44944 - DNA, 17 bp, Homo sapiens
cccgcggcgccgcgggc

SEQ ID NO: 44945 - DNA, 18 bp, Homo sapiens
cccgcgtgcatccccggc

SEQ ID NO: 44946 - DNA, 16 bp, Homo sapiens
cgcgcgcgcgcgccgc

SEQ ID NO: 44947 - DNA, 15 bp, Homo sapiens
cccgcgcgcgcgcgc

SEQ ID NO: 44948 - DNA, 18 bp, Homo sapiens
ccgctcagcccgtgcgcc

SEQ ID NO: 44949 - DNA, 20 bp, Homo sapiens
cccgcgcgcgtccgggcggc

SEQ ID NO: 44950 - DNA, 20 bp, Homo sapiens
cgcggtgcacccgcgtgcgc

SEQ ID NO: 44951 - DNA, 22 bp, Homo sapiens
cccacgcgcgccaccccgtgcg

SEQ ID NO: 44952 - DNA, 22 bp, Homo sapiens
ccgcgcgcgacaggtgggtgcc

SEQ ID NO: 44953 - DNA, 18 bp, Homo sapiens
caccgcgtgcgtgccgcc

SEQ ID NO: 44954 - DNA, 15 bp, Homo sapiens
cgccgcgcgctgcgc

SEQ ID NO: 44955 - DNA, 20 bp, Homo sapiens
cccgcgctgtcaccgcgcgc

SEQ ID NO: 44956 - DNA, 24 bp, Homo sapiens
cccgcgccgcgccccgcgggtgcc

SEQ ID NO: 44957 - DNA, 16 bp, Homo sapiens
cccgcgcgcggcctgc

SEQ ID NO: 44958 - DNA, 17 bp, Homo sapiens
cccgcgcggcccgcggc

SEQ ID NO: 44959 - DNA, 16 bp, Homo sapiens
ccgccgcgccagccgc

SEQ ID NO: 44960 - DNA, 18 bp, Homo sapiens
cccgcgccgcacccgcgt

SEQ ID NO: 44961 - DNA, 23 bp, Homo sapiens
cccgcgcgtcgcccccgcgcgcc

SEQ ID NO: 44962 - DNA, 19 bp, Homo sapiens
cccgcgcgccgactcgcgt

SEQ ID NO: 44963 - DNA, 23 bp, Homo sapiens
cccgcgcgtcgccggcgcacgcg

SEQ ID NO: 44964 - DNA, 15 bp, Homo sapiens
cccgcgcgcccgcac

SEQ ID NO: 44965 - DNA, 19 bp, Homo sapiens
ccgcgcgcgcgcacacgtg

SEQ ID NO: 44966 - DNA, 18 bp, Homo sapiens
cgctgcgccgcggccgcc

SEQ ID NO: 44967 - DNA, 20 bp, Homo sapiens
cccgcgccgcagcacctgcg

SEQ ID NO: 44968 - DNA, 16 bp, Homo sapiens
gcgcgcgcccaccgcc

SEQ ID NO: 44969 - DNA, 20 bp, Homo sapiens
ccctgcgcgcgcgtgcgtgc

SEQ ID NO: 44970 - DNA, 17 bp, Homo sapiens
cccgcgcgcccagcgcc

SEQ ID NO: 44971 - DNA, 18 bp, Homo sapiens
cctgcgcgcgcgcccgcc

SEQ ID NO: 44972 - DNA, 15 bp, Homo sapiens
cccgcgcggcgctgc

SEQ ID NO: 44973 - DNA, 21 bp, Homo sapiens
cccgcgcgtggcccggggcgc

SEQ ID NO: 44974 - DNA, 19 bp, Homo sapiens
cggcgcatcgccgtgcgcc

SEQ ID NO: 44975 - DNA, 23 bp, Homo sapiens
cccgcgcgggtcccgggcgtgcg

SEQ ID NO: 44976 - DNA, 17 bp, Homo sapiens
cccgcgctgccgcgcgc

SEQ ID NO: 44977 - DNA, 19 bp, Homo sapiens
cccgccgcgcgcacgcgtg

SEQ ID NO: 44978 - DNA, 23 bp, Homo sapiens
cctgcgcgcgcggcagagaggcc

SEQ ID NO: 44979 - DNA, 18 bp, Homo sapiens
gcgcgcgccgcccgcgcc

SEQ ID NO: 44980 - DNA, 16 bp, Homo sapiens
cgcgcgcgccctgcgc

SEQ ID NO: 44981 - DNA, 18 bp, Homo sapiens
cctgggcgcgccgcatcg

SEQ ID NO: 44982 - DNA, 17 bp, Homo sapiens
cccgcgccgcgctcggc

SEQ ID NO: 44983 - DNA, 18 bp, Homo sapiens
cgcgcgcgcgcgcgcgcc

SEQ ID NO: 44984 - DNA, 19 bp, Homo sapiens
cccgacgcgcgccgcaagc

SEQ ID NO: 44985 - DNA, 24 bp, Homo sapiens
cctgcgccgcgccacttgtgcgcc

SEQ ID NO: 44986 - DNA, 21 bp, Homo sapiens
cccgcgcgcgccctcgcagcc

SEQ ID NO: 44987 - DNA, 20 bp, Homo sapiens
cccgcgccgcgcgggggcgc

SEQ ID NO: 44988 - DNA, 20 bp, Homo sapiens
cccgcgcgccccggccgcgc

SEQ ID NO: 44989 - DNA, 17 bp, Homo sapiens
cccccgcgcgccccggc

SEQ ID NO: 44990 - DNA, 18 bp, Homo sapiens
ccgcgcgcgacaagcgcc

SEQ ID NO: 44991 - DNA, 19 bp, Homo sapiens
cgtgcgcgccaacgcggcc

SEQ ID NO: 44992 - DNA, 17 bp, Homo sapiens
ccgcgcgcgcccgcgcg

SEQ ID NO: 44993 - DNA, 18 bp, Homo sapiens
ccgcgcgcggccagcggc

SEQ ID NO: 44994 - DNA, 16 bp, Homo sapiens
cccgcgcggcccgcgc

SEQ ID NO: 44995 - DNA, 18 bp, Homo sapiens
cccgcgtcgcccgcacgc

SEQ ID NO: 44996 - DNA, 17 bp, Homo sapiens
cccgcgcgcgcggctgc

SEQ ID NO: 44997 - DNA, 19 bp, Homo sapiens
ccgcgcgcgccttacagcc

SEQ ID NO: 44998 - DNA, 17 bp, Homo sapiens
ccccgcgccgcctgcgc

SEQ ID NO: 44999 - DNA, 21 bp, Homo sapiens
cccgtgcgcaccgggcaggcc

SEQ ID NO: 45000 - DNA, 17 bp, Homo sapiens
cccagcgcgcgtgcgcc

SEQ ID NO: 45001 - DNA, 15 bp, Homo sapiens
ccccgcgcgctgcgc

SEQ ID NO: 45002 - DNA, 19 bp, Homo sapiens
cccgcgcgcgcctcccgcc

SEQ ID NO: 45003 - DNA, 16 bp, Homo sapiens
ccccgcgcgcctacgc

SEQ ID NO: 45004 - DNA, 19 bp, Homo sapiens
cccgcgcacgatgccgtgt

SEQ ID NO: 45005 - DNA, 16 bp, Homo sapiens
cccgctgcgcatgcgc

SEQ ID NO: 45006 - DNA, 17 bp, Homo sapiens
cccggcgtgccacacgc

SEQ ID NO: 45007 - DNA, 18 bp, Homo sapiens
cccggcgcgccgggcacc

SEQ ID NO: 45008 - DNA, 16 bp, Homo sapiens
cccgcgcgcggccagc

SEQ ID NO: 45009 - DNA, 18 bp, Homo sapiens
cccccgctcgacgtgcgc

SEQ ID NO: 45010 - DNA, 17 bp, Homo sapiens
cccgctgcgcgctcggc

SEQ ID NO: 45011 - DNA, 21 bp, Homo sapiens
cccgcgtgcgtcctccgcgcc

SEQ ID NO: 45012 - DNA, 19 bp, Homo sapiens
cccgcgcgcgcagcccgcg

SEQ ID NO: 45013 - DNA, 16 bp, Homo sapiens
cccgccggacgtgcgc

SEQ ID NO: 45014 - DNA, 18 bp, Homo sapiens
cccgccgtgcgcccgagc

SEQ ID NO: 45015 - DNA, 21 bp, Homo sapiens
cccgcgcgccctggaacgtgc

SEQ ID NO: 45016 - DNA, 19 bp, Homo sapiens
cccgccgcgcggccggtgc

SEQ ID NO: 45017 - DNA, 23 bp, Homo sapiens
cccgcgcggcgcccaacatcgcc

SEQ ID NO: 45018 - DNA, 20 bp, Homo sapiens
ccggcgccgcaccgtgcgcc

SEQ ID NO: 45019 - DNA, 19 bp, Homo sapiens
ccgccgcgcccacgacgcc

SEQ ID NO: 45020 - DNA, 18 bp, Homo sapiens
cccgcgcgcccgtgcccg

SEQ ID NO: 45021 - DNA, 18 bp, Homo sapiens
ccgtgcgcgcgcggcccc

SEQ ID NO: 45022 - DNA, 16 bp, Homo sapiens
cccgtgcgcgcgcggc

SEQ ID NO: 45023 - DNA, 20 bp, Homo sapiens
cccgccgcgccggcgtggcc

SEQ ID NO: 45024 - DNA, 18 bp, Homo sapiens
cgcgcccgccgcgcccgc

SEQ ID NO: 45025 - DNA, 21 bp, Homo sapiens
ccgcgcgccccgcgggagggc

SEQ ID NO: 45026 - DNA, 17 bp, Homo sapiens
cccgcggcggggcgcgc

SEQ ID NO: 45027 - DNA, 17 bp, Homo sapiens
cccgccgcgccccgcgc

SEQ ID NO: 45028 - DNA, 19 bp, Homo sapiens
ccgcatgcgccgccgcgcc

SEQ ID NO: 45029 - DNA, 17 bp, Homo sapiens
cgcgccgccgcgccgcc

SEQ ID NO: 45030 - DNA, 21 bp, Homo sapiens
actcgcgggagggcgtgcgcc

SEQ ID NO: 45031 - DNA, 16 bp, Homo sapiens
ccgcgtgcgcggcgcc

SEQ ID NO: 45032 - DNA, 18 bp, Homo sapiens
ccccgcgccgcctgcgcc

SEQ ID NO: 45033 - DNA, 19 bp, Homo sapiens
cccgcgtgccgtggcggcc

SEQ ID NO: 45034 - DNA, 20 bp, Homo sapiens
cccgccgcgctgcctgcgcc

SEQ ID NO: 45035 - DNA, 20 bp, Homo sapiens
cccgcccgcgcgctctcgcc

SEQ ID NO: 45036 - DNA, 16 bp, Homo sapiens
cccgccgcgccgcggc

SEQ ID NO: 45037 - DNA, 19 bp, Homo sapiens
cgcgcgcgcgcgcgcgcgc

SEQ ID NO: 45038 - DNA, 18 bp, Homo sapiens
gcgcgcctcccgcgcgcc

SEQ ID NO: 45039 - DNA, 18 bp, Homo sapiens
cccgcgcgcgtcggggcc

SEQ ID NO: 45040 - DNA, 18 bp, Homo sapiens
cgccgcgccgcgcagtgc

SEQ ID NO: 45041 - DNA, 19 bp, Homo sapiens
cgcgcgcgccgcgcggcgc

SEQ ID NO: 45042 - DNA, 19 bp, Homo sapiens
cccgcgcgcagcctcgtgc

SEQ ID NO: 45043 - DNA, 19 bp, Homo sapiens
cccgcgccgccacctccgc

SEQ ID NO: 45044 - DNA, 20 bp, Homo sapiens
ccctgcgcgccgcaaaggcc

SEQ ID NO: 45045 - DNA, 18 bp, Homo sapiens
cccgcgcgggccacaggc

SEQ ID NO: 45046 - DNA, 20 bp, Homo sapiens
cccgcctgcgcgccgcgcgc

SEQ ID NO: 45047 - DNA, 18 bp, Homo sapiens
cccgcgctgcgcctgcgt

SEQ ID NO: 45048 - DNA, 17 bp, Homo sapiens
cgcgcgcgcgcgctcgc

SEQ ID NO: 45049 - DNA, 18 bp, Homo sapiens
cccgcgcggtgctgaacc

SEQ ID NO: 45050 - DNA, 16 bp, Homo sapiens
cccgcgcggcccgggc

SEQ ID NO: 45051 - DNA, 17 bp, Homo sapiens
cccgcgcgccccgcacc

SEQ ID NO: 45052 - DNA, 21 bp, Homo sapiens
cgcgccgcgcccagacgcgcc

SEQ ID NO: 45053 - DNA, 16 bp, Homo sapiens
cccgcgccgccccggc

SEQ ID NO: 45054 - DNA, 16 bp, Homo sapiens
cccgcgctgcccgcgc

SEQ ID NO: 45055 - DNA, 24 bp, Homo sapiens
cccgcgcgggcgctggcgcacgcg

SEQ ID NO: 45056 - DNA, 17 bp, Homo sapiens
cccgcgcgcccgcgcgc

SEQ ID NO: 45057 - DNA, 21 bp, Homo sapiens
ccgcgcgctgcgtactgcgcc

SEQ ID NO: 45058 - DNA, 19 bp, Homo sapiens
ccggcgcgtgccgcgtgac

SEQ ID NO: 45059 - DNA, 22 bp, Homo sapiens
cccgcgcggcccgagctgtgcg

SEQ ID NO: 45060 - DNA, 16 bp, Homo sapiens
cccgcgcgccctcagc

SEQ ID NO: 45061 - DNA, 16 bp, Homo sapiens
cccgacgcgcatgcgc

SEQ ID NO: 45062 - DNA, 22 bp, Homo sapiens
cccgcgtacgcggagccgcgcc

SEQ ID NO: 45063 - DNA, 18 bp, Homo sapiens
ccgcgccgccctccgtgc

SEQ ID NO: 45064 - DNA, 18 bp, Homo sapiens
cccgcgcggcggcagcgc

SEQ ID NO: 45065 - DNA, 17 bp, Homo sapiens
cccgcacgcgcaaccgc

SEQ ID NO: 45066 - DNA, 21 bp, Homo sapiens
cccgcgcgcagcgggcgcgcc

SEQ ID NO: 45067 - DNA, 21 bp, Homo sapiens
cgcgcgcggctgggagcagcc

SEQ ID NO: 45068 - DNA, 19 bp, Homo sapiens
ccgcgcgtgcggccacgcc

SEQ ID NO: 45069 - DNA, 20 bp, Homo sapiens
cccgcgcgagctcaacaggc

SEQ ID NO: 45070 - DNA, 19 bp, Homo sapiens
cccgcgcggccgtaggtgc

SEQ ID NO: 45071 - DNA, 23 bp, Homo sapiens
cccgtgcacaccatgtgtgtgcc

SEQ ID NO: 45072 - DNA, 21 bp, Homo sapiens
cgccagtccgctgcgtgcgcc

SEQ ID NO: 45073 - DNA, 20 bp, Homo sapiens
ccccgcgcgcctgactcgcc

SEQ ID NO: 45074 - DNA, 20 bp, Homo sapiens
cggcagcagccgcgtgcgcc

SEQ ID NO: 45075 - DNA, 19 bp, Homo sapiens
cccgggcgcgcgctcatgc

SEQ ID NO: 45076 - DNA, 17 bp, Homo sapiens
cccgcgccgccacgcac

SEQ ID NO: 45077 - DNA, 17 bp, Homo sapiens
cccgcgcgtccaggtgc

SEQ ID NO: 45078 - DNA, 19 bp, Homo sapiens
cccgccgcgctctctggcc

SEQ ID NO: 45079 - DNA, 17 bp, Homo sapiens
ccctgcgcgccgagtgc

SEQ ID NO: 45080 - DNA, 16 bp, Homo sapiens
cctgcggcgccgcggc

SEQ ID NO: 45081 - DNA, 21 bp, Homo sapiens
cccagcgtgcgcgcggccgcc

SEQ ID NO: 45082 - DNA, 17 bp, Homo sapiens
cccgccgcgccctcggc

SEQ ID NO: 45083 - DNA, 16 bp, Homo sapiens
ccctcgcgccctgcgc

SEQ ID NO: 45084 - DNA, 18 bp, Homo sapiens
cccgcgcggcccggggcc

SEQ ID NO: 45085 - DNA, 18 bp, Homo sapiens
cccacgcgcgcagccgcc

SEQ ID NO: 45086 - DNA, 18 bp, Homo sapiens
cccgacagcacgcgtgcg

SEQ ID NO: 45087 - DNA, 24 bp, Homo sapiens
cctcgcgtgcgtcctgtgggtgcc

SEQ ID NO: 45088 - DNA, 17 bp, Homo sapiens
cgtgcgggccgtgcgcc

SEQ ID NO: 45089 - DNA, 17 bp, Homo sapiens
ccgcgccgcccagagcc

SEQ ID NO: 45090 - DNA, 18 bp, Homo sapiens
cccacgcgcgccacgtgc

SEQ ID NO: 45091 - DNA, 20 bp, Homo sapiens
cccacgtgcgccggatgagc

SEQ ID NO: 45092 - DNA, 18 bp, Homo sapiens
ccggcgcgcgccgcgagc

SEQ ID NO: 45093 - DNA, 17 bp, Homo sapiens
ccgcgccgccggctgcc

SEQ ID NO: 45094 - DNA, 18 bp, Homo sapiens
cgcgcgcgtcgagacgcc

SEQ ID NO: 45095 - DNA, 20 bp, Homo sapiens
ccgcgcgcgtccccagcgcc

SEQ ID NO: 45096 - DNA, 19 bp, Homo sapiens
ccctcgcgcgcgcacctgc

SEQ ID NO: 45097 - DNA, 17 bp, Homo sapiens
cccgccgcgctcccggc

SEQ ID NO: 45098 - DNA, 15 bp, Homo sapiens
cccgccgcgctgcgc

SEQ ID NO: 45099 - DNA, 17 bp, Homo sapiens
cgcccgcggcccgcgcc

SEQ ID NO: 45100 - DNA, 17 bp, Homo sapiens
ccgcgccgcacaaacgc

SEQ ID NO: 45101 - DNA, 20 bp, Homo sapiens
cccgcggcgccgcaggaggc

SEQ ID NO: 45102 - DNA, 20 bp, Homo sapiens
cacgcgcgccgcgcaatgcc

SEQ ID NO: 45103 - DNA, 19 bp, Homo sapiens
cccgcgcgcgggccgtgcg

SEQ ID NO: 45104 - DNA, 16 bp, Homo sapiens
cccgcgcgcagcctgc

SEQ ID NO: 45105 - DNA, 17 bp, Homo sapiens
cccgggcgcgccgcggc

SEQ ID NO: 45106 - DNA, 17 bp, Homo sapiens
cgcgtgcaccacacgcc

SEQ ID NO: 45107 - DNA, 17 bp, Homo sapiens
ccccgcgccgcttgcgc

SEQ ID NO: 45108 - DNA, 18 bp, Homo sapiens
cccggcgcgcgctctggc

SEQ ID NO: 45109 - DNA, 17 bp, Homo sapiens
cccgtgcacgccgcagc

SEQ ID NO: 45110 - DNA, 19 bp, Homo sapiens
ccgcgccgcccttagcgcc

SEQ ID NO: 45111 - DNA, 20 bp, Homo sapiens
cctgcatgtgccgcgtgacc

SEQ ID NO: 45112 - DNA, 17 bp, Homo sapiens
ccgcgcgctcctgggcc

SEQ ID NO: 45113 - DNA, 19 bp, Homo sapiens
ccgcgtgtgctcgcgcgcg

SEQ ID NO: 45114 - DNA, 18 bp, Homo sapiens
gcggggcgccgcgtgtgc

SEQ ID NO: 45115 - DNA, 19 bp, Homo sapiens
cccgcgcgcgcgcccgcgc

SEQ ID NO: 45116 - DNA, 20 bp, Homo sapiens
ccttgcgcgccgggggcgcc

SEQ ID NO: 45117 - DNA, 18 bp, Homo sapiens
cccgcgcgggctggcacc

SEQ ID NO: 45118 - DNA, 17 bp, Homo sapiens
cccgcccgcgcacccgc

SEQ ID NO: 45119 - DNA, 19 bp, Homo sapiens
cccgcgccgccgcgccgcc

SEQ ID NO: 45120 - DNA, 16 bp, Homo sapiens
cccgcgccgcccgagc

SEQ ID NO: 45121 - DNA, 19 bp, Homo sapiens
cgctgcgccgcgcagcgcc

SEQ ID NO: 45122 - DNA, 19 bp, Homo sapiens
cccggcgaacccgtgcgcc

SEQ ID NO: 45123 - DNA, 17 bp, Homo sapiens
cctgcgcgcccgcgcgc

SEQ ID NO: 45124 - DNA, 20 bp, Homo sapiens
ccctgcgcgcgccgagggcc

SEQ ID NO: 45125 - DNA, 21 bp, Homo sapiens
cccttgcgcgcgtgcgtgcgc

SEQ ID NO: 45126 - DNA, 18 bp, Homo sapiens
cgcgccgctgcccgcgcc

SEQ ID NO: 45127 - DNA, 17 bp, Homo sapiens
ccgcgcgcgacgcaacc

SEQ ID NO: 45128 - DNA, 20 bp, Homo sapiens
cccgtgcctgcagcgcgcgc

SEQ ID NO: 45129 - DNA, 16 bp, Homo sapiens
gcacgcgcacagcgcc

SEQ ID NO: 45130 - DNA, 21 bp, Homo sapiens
cccgccgcgctaccgagcgcc

SEQ ID NO: 45131 - DNA, 21 bp, Homo sapiens
cccgcgcgcggccgagcggcc

SEQ ID NO: 45132 - DNA, 19 bp, Homo sapiens
ccctgcgtgcgcctcgggc

SEQ ID NO: 45133 - DNA, 21 bp, Homo sapiens
cccgtgcgccttccaaagcgc

SEQ ID NO: 45134 - DNA, 20 bp, Homo sapiens
cctgcagcgtgccgcacgcc

SEQ ID NO: 45135 - DNA, 18 bp, Homo sapiens
cgcgcgcgctgacatggc

SEQ ID NO: 45136 - DNA, 16 bp, Homo sapiens
cccggcatgcgtgcgc

SEQ ID NO: 45137 - DNA, 17 bp, Homo sapiens
cgcgcgcgcacttcgcc

SEQ ID NO: 45138 - DNA, 18 bp, Homo sapiens
ccgcgcgcgttcacgggc

SEQ ID NO: 45139 - DNA, 16 bp, Homo sapiens
ccccgcgcgcccgagc

SEQ ID NO: 45140 - DNA, 18 bp, Homo sapiens
cccgcgccgcgcccgggc

SEQ ID NO: 45141 - DNA, 20 bp, Homo sapiens
ccttgcgtgcacacgtgtgc

SEQ ID NO: 45142 - DNA, 21 bp, Homo sapiens
cccgcgggcgtggcacgcgcc

SEQ ID NO: 45143 - DNA, 21 bp, Homo sapiens
cctgcgcggctaaccctcgcc

SEQ ID NO: 45144 - DNA, 19 bp, Homo sapiens
cccgctgcgcccaagggcc

SEQ ID NO: 45145 - DNA, 20 bp, Homo sapiens
cgcgtgcgcgtgcgcgcgcc

SEQ ID NO: 45146 - DNA, 19 bp, Homo sapiens
cccgcgcgctccccgcggc

SEQ ID NO: 45147 - DNA, 21 bp, Homo sapiens
ccgtgcgcgccgagctgcgcc

SEQ ID NO: 45148 - DNA, 19 bp, Homo sapiens
cccgcgccgccggagcgcc

SEQ ID NO: 45149 - DNA, 20 bp, Homo sapiens
cccgcgtgccccgaagtagc

SEQ ID NO: 45150 - DNA, 18 bp, Homo sapiens
cccgcgcgcagcgccgcc

SEQ ID NO: 45151 - DNA, 16 bp, Homo sapiens
cccgcgcgagcccggc

SEQ ID NO: 45152 - DNA, 19 bp, Homo sapiens
cctcgcgcgcgcgcccgcc

SEQ ID NO: 45153 - DNA, 19 bp, Homo sapiens
cgctgcgcgcgcgctcgcc

SEQ ID NO: 45154 - DNA, 16 bp, Homo sapiens
cccgctgcgcgcgcgc

SEQ ID NO: 45155 - DNA, 18 bp, Homo sapiens
cccgcccgcgcgccctgc

SEQ ID NO: 45156 - DNA, 20 bp, Homo sapiens
cccgcgcgccggacccgcgt

SEQ ID NO: 45157 - DNA, 17 bp, Homo sapiens
cccgcacgcgcccgcgc

SEQ ID NO: 45158 - DNA, 20 bp, Homo sapiens
cccgcgcccgcgcccgcgcc

SEQ ID NO: 45159 - DNA, 21 bp, Homo sapiens
cccgcgcgcccgcaacttgcc

SEQ ID NO: 45160 - DNA, 18 bp, Homo sapiens
cccgcgcgcgcggcctgc

SEQ ID NO: 45161 - DNA, 23 bp, Homo sapiens
cccgcgtgcgaccctccggcgtg

SEQ ID NO: 45162 - DNA, 20 bp, Homo sapiens
cccgcgcgtgcgcagtggcc

SEQ ID NO: 45163 - DNA, 18 bp, Homo sapiens
cccacgcgcgcccctcgc

SEQ ID NO: 45164 - DNA, 19 bp, Homo sapiens
cccgcgccgccccgcggcc

SEQ ID NO: 45165 - DNA, 17 bp, Homo sapiens
cccatgcgcgccgaacg

SEQ ID NO: 45166 - DNA, 19 bp, Homo sapiens
cccgccgcgcgcgggacgc

SEQ ID NO: 45167 - DNA, 20 bp, Homo sapiens
ccgtgcgccgggagcgcgcc

SEQ ID NO: 45168 - DNA, 18 bp, Homo sapiens
ccctcgcgcgccgaggcc

SEQ ID NO: 45169 - DNA, 19 bp, Homo sapiens
cccagcgtgcgcacacacg

SEQ ID NO: 45170 - DNA, 17 bp, Homo sapiens
cccgcgcgcagtgtggc

SEQ ID NO: 45171 - DNA, 18 bp, Homo sapiens
cccgcgcggctcccacgt

SEQ ID NO: 45172 - DNA, 19 bp, Homo sapiens
cccggcgtgctgggcgacc

SEQ ID NO: 45173 - DNA, 16 bp, Homo sapiens
cccgcgcgcccgcggc

SEQ ID NO: 45174 - DNA, 21 bp, Homo sapiens
cccgcgccgcgccccctcgcc

SEQ ID NO: 45175 - DNA, 19 bp, Homo sapiens
cctgcgcgcacgcgcagcg

SEQ ID NO: 45176 - DNA, 17 bp, Homo sapiens
ccccgcgcgccgcgcgc

SEQ ID NO: 45177 - DNA, 20 bp, Homo sapiens
cccgcgcggccaggggcgcc

SEQ ID NO: 45178 - DNA, 19 bp, Homo sapiens
cccggcgcgcgcctgcagc

SEQ ID NO: 45179 - DNA, 20 bp, Homo sapiens
ccgcgcgcagccgggcggcc

SEQ ID NO: 45180 - DNA, 21 bp, Homo sapiens
cctgcgtgcgcgcaggcagcc

SEQ ID NO: 45181 - DNA, 20 bp, Homo sapiens
cctgtgcacgtacatgtgcc

SEQ ID NO: 45182 - DNA, 20 bp, Homo sapiens
ccgtgggcgcacacaagcgc

SEQ ID NO: 45183 - DNA, 20 bp, Homo sapiens
ccgcgcgtgccccatcatgc

SEQ ID NO: 45184 - DNA, 18 bp, Homo sapiens
cgcgcgtgcgtagtcgcc

SEQ ID NO: 45185 - DNA, 18 bp, Homo sapiens
cccgcgcgctggccacgc

SEQ ID NO: 45186 - DNA, 16 bp, Homo sapiens
cccacgcgcgcccagc

SEQ ID NO: 45187 - DNA, 20 bp, Homo sapiens
ccctgcgcgcaccggctgtg

SEQ ID NO: 45188 - DNA, 16 bp, Homo sapiens
cccgcgcgcgcccggc

SEQ ID NO: 45189 - DNA, 22 bp, Homo sapiens
ccgcgcgcgcagtcggtgcgcc

SEQ ID NO: 45190 - DNA, 17 bp, Homo sapiens
ccccgcgcgccgcgggc

SEQ ID NO: 45191 - DNA, 17 bp, Homo sapiens
ccccgctccgcgtgcgc

SEQ ID NO: 45192 - DNA, 19 bp, Homo sapiens
cccccgcgtgctctacgcc

SEQ ID NO: 45193 - DNA, 22 bp, Homo sapiens
ccacgcgtgccagatcctgtgc

SEQ ID NO: 45194 - DNA, 16 bp, Homo sapiens
cccgcgccgcccgggc

SEQ ID NO: 45195 - DNA, 18 bp, Homo sapiens
cctgtgcgcgccggtggc

SEQ ID NO: 45196 - DNA, 18 bp, Homo sapiens
gctgcgtgcgcgtgtgcc

SEQ ID NO: 45197 - DNA, 22 bp, Homo sapiens
cccagtgcgcgtgcgtgggcgc

SEQ ID NO: 45198 - DNA, 23 bp, Homo sapiens
cccgcgcgctgctggcgcacgcg

SEQ ID NO: 45199 - DNA, 18 bp, Homo sapiens
cctgcgcgcgcccccgcc

SEQ ID NO: 45200 - DNA, 20 bp, Homo sapiens
cccgccgcgtgcctctcgcc

SEQ ID NO: 45201 - DNA, 18 bp, Homo sapiens
cccgcgccgcgctgcgcc

SEQ ID NO: 45202 - DNA, 17 bp, Homo sapiens
cgcacgcgcccgcgggc

SEQ ID NO: 45203 - DNA, 20 bp, Homo sapiens
cccgcgcgctgcccgcagcc

SEQ ID NO: 45204 - DNA, 23 bp, Homo sapiens
cccgcgcgctgccggcgcacgcg

SEQ ID NO: 45205 - DNA, 18 bp, Homo sapiens
cccgcgccgcggtccgcc

SEQ ID NO: 45206 - DNA, 16 bp, Homo sapiens
cccgcgcggccacggc

SEQ ID NO: 45207 - DNA, 20 bp, Homo sapiens
ccccgcgtgccgtccgcgcc

SEQ ID NO: 45208 - DNA, 21 bp, Homo sapiens
cccacgcgcgcccgcaccgcc

SEQ ID NO: 45209 - DNA, 17 bp, Homo sapiens
cctgcgctgccacgtgc

SEQ ID NO: 45210 - DNA, 19 bp, Homo sapiens
cccatgcgtgtcgtacacc

SEQ ID NO: 45211 - DNA, 19 bp, Homo sapiens
ccctgcgcgccgcggctgc

SEQ ID NO: 45212 - DNA, 17 bp, Homo sapiens
cgcgccgctgcggctgc

SEQ ID NO: 45213 - DNA, 20 bp, Homo sapiens
cccgcgcgacgcgtcccgcc

SEQ ID NO: 45214 - DNA, 20 bp, Homo sapiens
cccgccgcgcgccctcccgc

SEQ ID NO: 45215 - DNA, 19 bp, Homo sapiens
cccgcgtgcgctcctgcgc

SEQ ID NO: 45216 - DNA, 19 bp, Homo sapiens
ccggcgcgtgcgcgagcgc

SEQ ID NO: 45217 - DNA, 16 bp, Homo sapiens
cccgcgcggcacttgc

SEQ ID NO: 45218 - DNA, 19 bp, Homo sapiens
cctgcgcgccaggcagcgc

SEQ ID NO: 45219 - DNA, 19 bp, Homo sapiens
cccgcgcagtgcgcccgcc

SEQ ID NO: 45220 - DNA, 16 bp, Homo sapiens
cccgcacgcgttgcgc

SEQ ID NO: 45221 - DNA, 19 bp, Homo sapiens
ccggcgtgcgcggaacgcc

SEQ ID NO: 45222 - DNA, 19 bp, Homo sapiens
cgcacgcgtccgcgcggcc

SEQ ID NO: 45223 - DNA, 22 bp, Homo sapiens
ccgcgcgccgcccctcggcgcc

SEQ ID NO: 45224 - DNA, 16 bp, Homo sapiens
cgccgcgtgcgcgcgc

SEQ ID NO: 45225 - DNA, 19 bp, Homo sapiens
cccgcgccgcctgcgcgcc

SEQ ID NO: 45226 - DNA, 19 bp, Homo sapiens
ccctgcgtgcgctacatgc

SEQ ID NO: 45227 - DNA, 118 bp, Human papillomavirus type 55
ttaatctgtgtgtcctgttccaccccatgagtaagtgttgtagtattgtgtgttatgtctggtgtatacaatatacaacatatgtacagccatgttgttttataaaacacatttttaa

SEQ ID NO: 45228 - DNA, 24 bp, Human papillomavirus type 55
tacaatatacaacatatgtacagc

SEQ ID NO: 45229 - DNA, 25 bp, Homo sapiens
caatatacagtatttacacaacagc

SEQ ID NO: 45230 - DNA, 17 bp, Homo sapiens
atatataatatgtacag

SEQ ID NO: 45231 - DNA, 21 bp, Homo sapiens
tacagatatacagtttacagc

SEQ ID NO: 45232 - DNA, 19 bp, Homo sapiens
atatgcacagtatgtacag

SEQ ID NO: 45233 - DNA, 24 bp, Homo sapiens
tacaatacatggtagacatgacag

SEQ ID NO: 45234 - DNA, 24 bp, Homo sapiens
tacataaggcatatatatgtacag

SEQ ID NO: 45235 - DNA, 23 bp, Homo sapiens
tacatatacataaatatgtacag

SEQ ID NO: 45236 - DNA, 19 bp, Homo sapiens
atatatatacatgtacagc

SEQ ID NO: 45237 - DNA, 22 bp, Homo sapiens
tacaatatacaacactatatgc

SEQ ID NO: 45238 - DNA, 19 bp, Homo sapiens
tacaatatacaacaaaatg

SEQ ID NO: 45239 - DNA, 20 bp, Homo sapiens
acaatatacaaggtgtgcag

SEQ ID NO: 45240 - DNA, 17 bp, Homo sapiens
tatacaacattacaagc

SEQ ID NO: 45241 - DNA, 17 bp, Homo sapiens
tacaatacaacctatgt

SEQ ID NO: 45242 - DNA, 19 bp, Homo sapiens
tacaatataacaacatgta

SEQ ID NO: 45243 - DNA, 22 bp, Homo sapiens
acaatatacaaacatgtacagc

SEQ ID NO: 45244 - DNA, 18 bp, Homo sapiens
tacaatataaacatacgc

SEQ ID NO: 45245 - DNA, 18 bp, Homo sapiens
caatatttgtatgtacag

SEQ ID NO: 45246 - DNA, 21 bp, Homo sapiens
atatacaagcatgtgtgtagc

SEQ ID NO: 45247 - DNA, 23 bp, Homo sapiens
acaatatgcccacatatgtacag

SEQ ID NO: 45248 - DNA, 21 bp, Homo sapiens
tacatatatacagatatacag

SEQ ID NO: 45249 - DNA, 18 bp, Homo sapiens
aacatacaacttctacag

SEQ ID NO: 45250 - DNA, 23 bp, Homo sapiens
caatgtacaacagagagcatagc

SEQ ID NO: 45251 - DNA, 20 bp, Homo sapiens
aataacaacaattatacagc

SEQ ID NO: 45252 - DNA, 18 bp, Homo sapiens
tacagtatacaacatctg

SEQ ID NO: 45253 - DNA, 18 bp, Homo sapiens
tacatatacaactctgta

SEQ ID NO: 45254 - DNA, 18 bp, Homo sapiens
tacaatatagatatgtac

SEQ ID NO: 45255 - DNA, 17 bp, Homo sapiens
atatacaacagtaccac

SEQ ID NO: 45256 - DNA, 22 bp, Homo sapiens
caatatagacagtgcatacagc

SEQ ID NO: 45257 - DNA, 25 bp, Homo sapiens
cacatatacacatacatatgtatag

SEQ ID NO: 45258 - DNA, 25 bp, Homo sapiens
tacatatatacacacactgtacagc

SEQ ID NO: 45259 - DNA, 21 bp, Homo sapiens
tacaaatatacaactacacag

SEQ ID NO: 45260 - DNA, 17 bp, Homo sapiens
tacaatatacacacata

SEQ ID NO: 45261 - DNA, 23 bp, Homo sapiens
tacaagatacaacattttaacag

SEQ ID NO: 45262 - DNA, 19 bp, Homo sapiens
aatatacaaatatacacaa

SEQ ID NO: 45263 - DNA, 18 bp, Homo sapiens
tacaatatacactgtaca

SEQ ID NO: 45264 - DNA, 19 bp, Homo sapiens
cacagtgtacaacacatat

SEQ ID NO: 45265 - DNA, 22 bp, Homo sapiens
tacatatatcttttatgtacag

SEQ ID NO: 45266 - DNA, 24 bp, Homo sapiens
tacacatatacaatatgcatatgt

SEQ ID NO: 45267 - DNA, 17 bp, Homo sapiens
atatacaacatcacagc

SEQ ID NO: 45268 - DNA, 19 bp, Homo sapiens
tacaatacacagactctgt

SEQ ID NO: 45269 - DNA, 18 bp, Homo sapiens
tacaatgaacaacacagc

SEQ ID NO: 45270 - DNA, 18 bp, Homo sapiens
atatacagtatatgtaca

SEQ ID NO: 45271 - DNA, 15 bp, Homo sapiens
aatatacaaatgtac

SEQ ID NO: 45272 - DNA, 19 bp, Homo sapiens
tacaaaatagcatgtacag

SEQ ID NO: 45273 - DNA, 60 bp, Bovine herpesvirus 4
taaagggggcacatgtggctatagtagaatctctactcaatatagtgtccgcccccttta

SEQ ID NO: 45274 - DNA, 24 bp, Bovine herpesvirus 4
aagggggcacatgtggctatagta

SEQ ID NO: 45275 - DNA, 21 bp, Homo sapiens
agggggcacatggagctcagt

SEQ ID NO: 45276 - DNA, 19 bp, Homo sapiens
agggggcatggtgccgagt

SEQ ID NO: 45277 - DNA, 19 bp, Homo sapiens
aagggaggcacatagatgg

SEQ ID NO: 45278 - DNA, 19 bp, Homo sapiens
gggggcactgtgggcacag

SEQ ID NO: 45279 - DNA, 21 bp, Homo sapiens
gggggaacatgtgagcagagt

SEQ ID NO: 45280 - DNA, 19 bp, Homo sapiens
agggggcagtggctatggt

SEQ ID NO: 45281 - DNA, 20 bp, Homo sapiens
aaggggccatgtgtgtataa

SEQ ID NO: 45282 - DNA, 19 bp, Homo sapiens
aagggggcaatgtgggcta

SEQ ID NO: 45283 - DNA, 22 bp, Homo sapiens
aggagggcacatgtgtatgagt

SEQ ID NO: 45284 - DNA, 62 bp, Human echovirus 1
caggctgatgagtcaccgtattccccacgggcgaccgtgacggtggctgcgttggcggcctg

SEQ ID NO: 45285 - DNA, 24 bp, Human echovirus 1
tgagtcaccgtattccccacgggc

SEQ ID NO: 45286 - DNA, 18 bp, Homo sapiens
tgggcaccatcccacggg

SEQ ID NO: 45287 - DNA, 23 bp, Homo sapiens
tgattcaccgcaagactgtgggc

SEQ ID NO: 45288 - DNA, 21 bp, Homo sapiens
gagtcaccgtctttcgtgggc

SEQ ID NO: 45289 - DNA, 25 bp, Homo sapiens
tgagtcactctgtttttcgcccgtg

SEQ ID NO: 45290 - DNA, 29 bp, Homo sapiens
tgagtcactgtcttctttgtgcccgtggg

SEQ ID NO: 45291 - DNA, 24 bp, Homo sapiens
tgagtcactggtttcctgcccgtg

SEQ ID NO: 45292 - DNA, 21 bp, Homo sapiens
tgggtctgtcagtcccacggg

SEQ ID NO: 45293 - DNA, 24 bp, Homo sapiens
tgagccacctcctccttcgcgggc

SEQ ID NO: 45294 - DNA, 68 bp, Bovine herpesvirus 4
gtttctataacaacctcccccaggtccagttatgaactcccaccttacaccagagatattatggatgc

SEQ ID NO: 45295 - DNA, 24 bp, Bovine herpesvirus 4
tctataacaacctcccccaggtcc

SEQ ID NO: 45296 - DNA, 19 bp, Homo sapiens
catgacaacctctgcctcc

SEQ ID NO: 45297 - DNA, 24 bp, Homo sapiens
tctataacaaacttcttaacagcc

SEQ ID NO: 45298 - DNA, 21 bp, Homo sapiens
tctcccacctttcccaggtcc

SEQ ID NO: 45299 - DNA, 20 bp, Homo sapiens
cctaaacctcccctgggtcc

SEQ ID NO: 45300 - DNA, 18 bp, Homo sapiens
tctatgacaaccccacat

SEQ ID NO: 45301 - DNA, 22 bp, Homo sapiens
tctataactatttccccatgtc

SEQ ID NO: 45302 - DNA, 23 bp, Homo sapiens
tctatacggcctgcgccaggtcc

SEQ ID NO: 45303 - DNA, 18 bp, Homo sapiens
tctataacgtctccctcc

SEQ ID NO: 45304 - DNA, 22 bp, Homo sapiens
tctgagcagccaggcccaggtc

SEQ ID NO: 45305 - DNA, 20 bp, Homo sapiens
tctataacatttcctaggcc

SEQ ID NO: 45306 - DNA, 19 bp, Homo sapiens
tctatggaacctcccggcc

SEQ ID NO: 45307 - DNA, 21 bp, Homo sapiens
tctgtaaaaacctccctatgt

SEQ ID NO: 45308 - DNA, 19 bp, Homo sapiens
tctaaacactttccaggtc

SEQ ID NO: 45309 - DNA, 117 bp, Bovine herpesvirus 4
gaaactagacataaaataaatatttaccaacttggaacttttacttcaagtcatgaagatagtggaagagaagttaggtgtttgttgggagccttgaaatatcttatgtctttcctc

SEQ ID NO: 45310 - DNA, 24 bp, Bovine herpesvirus 4
agagaagttaggtgtttgttggga

SEQ ID NO: 45311 - DNA, 17 bp, Homo sapiens
gagaagtagacgttggg

SEQ ID NO: 45312 - DNA, 20 bp, Homo sapiens
agggagttaggtaggatggg

SEQ ID NO: 45313 - DNA, 16 bp, Homo sapiens
agagaagtgggtgtgg

SEQ ID NO: 45314 - DNA, 21 bp, Homo sapiens
gaggttggttgagtgctggga

SEQ ID NO: 45315 - DNA, 22 bp, Homo sapiens
agagaagttggggttttacggg

SEQ ID NO: 45316 - DNA, 17 bp, Homo sapiens
gagagggtgctgttggg

SEQ ID NO: 45317 - DNA, 19 bp, Homo sapiens
gagaagttggggcgagggg

SEQ ID NO: 45318 - DNA, 18 bp, Homo sapiens
agagggcttgggtgtttg

SEQ ID NO: 45319 - DNA, 17 bp, Homo sapiens
gaaaagttgttgttggg

SEQ ID NO: 45320 - DNA, 20 bp, Homo sapiens
gagaagctgggctggttggg

SEQ ID NO: 45321 - DNA, 22 bp, Homo sapiens
agaggaggtgttggtgttggga

SEQ ID NO: 45322 - DNA, 22 bp, Homo sapiens
gagaaattgggtgtgttcggga

SEQ ID NO: 45323 - DNA, 19 bp, Homo sapiens
agagaagtaggtgagaggg

SEQ ID NO: 45324 - DNA, 18 bp, Homo sapiens
gagaagctgcttgttggg

SEQ ID NO: 45325 - DNA, 16 bp, Homo sapiens
agctaggtgggtggga

SEQ ID NO: 45326 - DNA, 23 bp, Homo sapiens
gaggtgttgggaaggatgttggg

SEQ ID NO: 45327 - DNA, 19 bp, Homo sapiens
aggaagttgggtccctggg

SEQ ID NO: 45328 - DNA, 22 bp, Homo sapiens
agggaggtgggtgcctgctggg

SEQ ID NO: 45329 - DNA, 23 bp, Homo sapiens
agggaggtgtcaaggtgttggga

SEQ ID NO: 45330 - DNA, 15 bp, Homo sapiens
agagaagttggtggg

SEQ ID NO: 45331 - DNA, 22 bp, Homo sapiens
aggtaagttaggtgttgtgtgg

SEQ ID NO: 45332 - DNA, 21 bp, Homo sapiens
gaggggtggcaggttgttggg

SEQ ID NO: 45333 - DNA, 22 bp, Homo sapiens
agagaagtgggtgttccctgga

SEQ ID NO: 45334 - DNA, 25 bp, Homo sapiens
gagaagttgggtgctttcccccggg

SEQ ID NO: 45335 - DNA, 22 bp, Homo sapiens
agagagggtgggtgctactggg

SEQ ID NO: 45336 - DNA, 19 bp, Homo sapiens
agaagagttaggtgccggg

SEQ ID NO: 45337 - DNA, 80 bp, Human papillomavirus type 55
taatagtacagaatataaacaatacatgcgacatgttgaggagtttgacttacagtttatgtttcaattatgtagtatta

SEQ ID NO: 45338 - DNA, 24 bp, Human papillomavirus type 55
tacagtttatgtttcaattatgta

SEQ ID NO: 45339 - DNA, 23 bp, Homo sapiens
tacagttatgttttgcctcctgt

SEQ ID NO: 45340 - DNA, 16 bp, Homo sapiens
agcttaccaattatgt

SEQ ID NO: 45341 - DNA, 23 bp, Homo sapiens
tacagtatgactccaattatgta

SEQ ID NO: 45342 - DNA, 24 bp, Homo sapiens
tacagtttagttttaaaggcatgt

SEQ ID NO: 45343 - DNA, 18 bp, Homo sapiens
atttatgtaaattatgta

SEQ ID NO: 45344 - DNA, 20 bp, Homo sapiens
gttcaccttttgattatgta

SEQ ID NO: 45345 - DNA, 80 bp, Human papillomavirus type 55
aaaacgtcctgcatctgcagccacttcatcctccagtaaacccaaacggtctaggaagaagtagtatgtgttattgtttt

SEQ ID NO: 45346 - DNA, 24 bp, Human papillomavirus type 55
taggaagaagtagtatgtgttatt

SEQ ID NO: 45347 - DNA, 19 bp, Homo sapiens
ggaaggagtggtgtgccac

SEQ ID NO: 45348 - DNA, 20 bp, Homo sapiens
taggaagaagtgaaagttgt

SEQ ID NO: 45349 - DNA, 17 bp, Homo sapiens
taggaagcagtggtgtt

SEQ ID NO: 45350 - DNA, 21 bp, Homo sapiens
agaagacactgatgtgttatt

SEQ ID NO: 45351 - DNA, 20 bp, Homo sapiens
taggaagaagtggagtacat

SEQ ID NO: 45352 - DNA, 21 bp, Homo sapiens
ggtaagaagtggtgtgtcatt

SEQ ID NO: 45353 - DNA, 70 bp, Gallid herpesvirus 2
ccttttgcttgttcactgtgcggcattattacatttacaccggtaatgctgcgcatgaaagagcgaacgg

SEQ ID NO: 45354 - DNA, 24 bp, Gallid herpesvirus 2
atgctgcgcatgaaagagcgaacg

SEQ ID NO: 45355 - DNA, 17 bp, Homo sapiens
tgtgcgcatggggaaca

SEQ ID NO: 45356 - DNA, 19 bp, Homo sapiens
ctggtcaagagagcgaacg

SEQ ID NO: 45357 - DNA, 17 bp, Homo sapiens
tgctgcgtggaaaaaac

SEQ ID NO: 45358 - DNA, 20 bp, Homo sapiens
tgcgtgtgcatgagagagcg

SEQ ID NO: 45359 - DNA, 20 bp, Homo sapiens
atactgcaagaaagggcgaa

SEQ ID NO: 45360 - DNA, 16 bp, Homo sapiens
tgcggcgcatgaaggc

SEQ ID NO: 45361 - DNA, 21 bp, Homo sapiens
atgctgcgtgcacggcgggcg

SEQ ID NO: 45362 - DNA, 16 bp, Homo sapiens
cgctgcgcaccgagcg

SEQ ID NO: 45363 - DNA, 19 bp, Homo sapiens
atgctgcgcctggacagcg

SEQ ID NO: 45364 - DNA, 19 bp, Homo sapiens
atgctgcagctggagagag

SEQ ID NO: 45365 - DNA, 130 bp, Peanut clump virus
ggaggagataaatatcttacgcaaagaagcgcttgagctacagaaacaagtgacggagcaaaaggctgttgtggctgagctgaggttacagatttctaagcaacagggcgctagcgcaggaactacctct

SEQ ID NO: 45366 - DNA, 24 bp, Peanut clump virus
tgagctgaggttacagatttctaa

SEQ ID NO: 45367 - DNA, 22 bp, Homo sapiens
gcccagtaggttgtagatttct

SEQ ID NO: 45368 - DNA, 24 bp, Homo sapiens
tggctggggttgtcttatttctaa

SEQ ID NO: 45369 - DNA, 20 bp, Homo sapiens
tgggctgaggcttgtagact

SEQ ID NO: 45370 - DNA, 17 bp, Homo sapiens
taagctgactcagattt

SEQ ID NO: 45371 - DNA, 20 bp, Homo sapiens
tgactgacttctagatttct

SEQ ID NO: 45372 - DNA, 18 bp, Homo sapiens
tgagctgaggctgtttcc

SEQ ID NO: 45373 - DNA, 20 bp, Homo sapiens
gctgaggcaccaatttctaa

SEQ ID NO: 45374 - DNA, 21 bp, Homo sapiens
tgacctggcaaagatttctaa

SEQ ID NO: 45375 - DNA, 20 bp, Homo sapiens
tgatttgaggttatcagact

SEQ ID NO: 45376 - DNA, 15 bp, Homo sapiens
tggctgaagatttct

SEQ ID NO: 45377 - DNA, 21 bp, Homo sapiens
tgaggctgggaggtgatttct

SEQ ID NO: 45378 - DNA, 20 bp, Homo sapiens
tgagctgatgttgtacttct

SEQ ID NO: 45379 - DNA, 18 bp, Homo sapiens
gagctgaggttccattct

SEQ ID NO: 45380 - DNA, 18 bp, Homo sapiens
tgagctgagggtgcagat

SEQ ID NO: 45381 - DNA, 19 bp, Homo sapiens
actggagagagatttctaa

SEQ ID NO: 45382 - DNA, 21 bp, Homo sapiens
tggcttgaaaaagatttctaa

SEQ ID NO: 45383 - DNA, 19 bp, Homo sapiens
ccgaggttgtggatttcta

SEQ ID NO: 45384 - DNA, 95 bp, Peanut clump virus
gcactgatagacgcgatagagcgagattacccatatatcgtttggggagttatgccttgaatgttgtttatgttttgtttattgtttttctgtgt

SEQ ID NO: 45385 - DNA, 24 bp, Peanut clump virus
ttgaatgttgtttatgttttgttt

SEQ ID NO: 45386 - DNA, 21 bp, Homo sapiens
tgatgtttttatgttttgttt

SEQ ID NO: 45387 - DNA, 21 bp, Homo sapiens
ttgaagttgttacttttgttt

SEQ ID NO: 45388 - DNA, 22 bp, Homo sapiens
ttgaatgtgtgactttttgttt

SEQ ID NO: 45389 - DNA, 22 bp, Homo sapiens
ttggggtttttatgttttgttt

SEQ ID NO: 45390 - DNA, 28 bp, Homo sapiens
ttgattgtttatattttatgttttgttt

SEQ ID NO: 45391 - DNA, 19 bp, Homo sapiens
aatgttgtcttctttgttt

SEQ ID NO: 45392 - DNA, 22 bp, Homo sapiens
aatgtttcacattgttttgttt

SEQ ID NO: 45393 - DNA, 22 bp, Homo sapiens
tgagagtatttgtgttttgttt

SEQ ID NO: 45394 - DNA, 18 bp, Homo sapiens
gaatgttgtattttgttt

SEQ ID NO: 45395 - DNA, 23 bp, Homo sapiens
ctgaatggttctgtgttttgttt

SEQ ID NO: 45396 - DNA, 18 bp, Homo sapiens
ttgaatgttgtcttgttt

SEQ ID NO: 45397 - DNA, 23 bp, Homo sapiens
ttgaatgttttttgtttttgttt

SEQ ID NO: 45398 - DNA, 24 bp, Homo sapiens
ttgatgtcctgagatgttttgttt

SEQ ID NO: 45399 - DNA, 86 bp, Human herpesvirus 1
cgaggggaacgggggatggaaggacgggaagtggaagtcctgatacccatcctacacccccctgccttccaccctccggccccccg

SEQ ID NO: 45400 - DNA, 24 bp, Human herpesvirus 1
tggaaggacgggaagtggaagtcc

SEQ ID NO: 45401 - DNA, 19 bp, Homo sapiens
tggaaggaaggctgaagtc

SEQ ID NO: 45402 - DNA, 22 bp, Homo sapiens
ggggggaagaccctggaagtcc

SEQ ID NO: 45403 - DNA, 20 bp, Homo sapiens
gggaggtgggggagatgtcc

SEQ ID NO: 45404 - DNA, 24 bp, Homo sapiens
tgaaagggtggggtggaggggtcc

SEQ ID NO: 45405 - DNA, 20 bp, Homo sapiens
tgggagacgggagggcaccc

SEQ ID NO: 45406 - DNA, 24 bp, Homo sapiens
tggaaggaggggctaataggagtc

SEQ ID NO: 45407 - DNA, 20 bp, Homo sapiens
ggcactggaggtggaagtcc

SEQ ID NO: 45408 - DNA, 18 bp, Homo sapiens
gggaggacgggaggtgga

SEQ ID NO: 45409 - DNA, 24 bp, Homo sapiens
tggaaggatgagaattctgtaagt

SEQ ID NO: 45410 - DNA, 22 bp, Homo sapiens
ggaaagtgcagggtgggggtcc

SEQ ID NO: 45411 - DNA, 21 bp, Homo sapiens
tgggaggaggggaaacatgtc

SEQ ID NO: 45412 - DNA, 22 bp, Homo sapiens
tggaggtgcgggaagtgcatcc

SEQ ID NO: 45413 - DNA, 16 bp, Homo sapiens
tggaaggatggtgggt

SEQ ID NO: 45414 - DNA, 18 bp, Homo sapiens
ggagggaggggaagagtc

SEQ ID NO: 45415 - DNA, 20 bp, Homo sapiens
tggaaggagaggaagtctgg

SEQ ID NO: 45416 - DNA, 25 bp, Homo sapiens
tgggaggacaggaagctccggactc

SEQ ID NO: 45417 - DNA, 20 bp, Homo sapiens
agggggggggggtggaagtc

SEQ ID NO: 45418 - DNA, 22 bp, Homo sapiens
tggaaggggggaagcatgtagt

SEQ ID NO: 45419 - DNA, 25 bp, Homo sapiens
tggaaggcggggggcattcggactc

SEQ ID NO: 45420 - DNA, 18 bp, Homo sapiens
ggatgggacctggaagtc

SEQ ID NO: 45421 - DNA, 25 bp, Homo sapiens
tggaaggactggggtcctggagtcc

SEQ ID NO: 45422 - DNA, 25 bp, Homo sapiens
tggggggtgcggggcacacaggtcc

SEQ ID NO: 45423 - DNA, 20 bp, Homo sapiens
ggaagggcagcgagaagtcc

SEQ ID NO: 45424 - DNA, 26 bp, Homo sapiens
tgggaggacggactaaggggaggtcc

SEQ ID NO: 45425 - DNA, 21 bp, Homo sapiens
tggtgagggtggaggaagtcc

SEQ ID NO: 45426 - DNA, 23 bp, Homo sapiens
tgagagggattcagtggaagtcc

SEQ ID NO: 45427 - DNA, 22 bp, Homo sapiens
tggcagggtggggggtggggtc

SEQ ID NO: 45428 - DNA, 20 bp, Homo sapiens
tggaagacgaggaagtctgg

SEQ ID NO: 45429 - DNA, 18 bp, Homo sapiens
tggaaggcgagggaagtc

SEQ ID NO: 45430 - DNA, 16 bp, Homo sapiens
tgggaggacgggaggg

SEQ ID NO: 45431 - DNA, 23 bp, Homo sapiens
tgggaggatggcagtggaagtcc

SEQ ID NO: 45432 - DNA, 22 bp, Homo sapiens
ggacggggcggcacagaagtcc

SEQ ID NO: 45433 - DNA, 24 bp, Homo sapiens
tggaaggaccgggggtgggggacc

SEQ ID NO: 45434 - DNA, 18 bp, Homo sapiens
tggggggggggggaagtc

SEQ ID NO: 45435 - DNA, 22 bp, Homo sapiens
tggaaggatgtggggagcgtcc

SEQ ID NO: 45436 - DNA, 18 bp, Homo sapiens
tgggaggacagaggaggt

SEQ ID NO: 45437 - DNA, 24 bp, Homo sapiens
tggaagaacgggcctgcggggtcc

SEQ ID NO: 45438 - DNA, 20 bp, Homo sapiens
gaggttggggaagtggaagt

SEQ ID NO: 45439 - DNA, 19 bp, Homo sapiens
tgggggcgtctgtggaagt

SEQ ID NO: 45440 - DNA, 21 bp, Homo sapiens
tgggagaacggggagtgggcc

SEQ ID NO: 45441 - DNA, 19 bp, Homo sapiens
gaaatgaggaagtggaggt

SEQ ID NO: 45442 - DNA, 22 bp, Homo sapiens
tggaagtgtgggggtggggttc

SEQ ID NO: 45443 - DNA, 18 bp, Homo sapiens
tggaagcgtgcggaagtc

SEQ ID NO: 45444 - DNA, 18 bp, Homo sapiens
tgggaggaagggaagtag

SEQ ID NO: 45445 - DNA, 20 bp, Homo sapiens
gagggacgggaagccccgtc

SEQ ID NO: 45446 - DNA, 22 bp, Homo sapiens
tggaaggaagggaggcgatgtc

SEQ ID NO: 45447 - DNA, 22 bp, Homo sapiens
tggaaggaggggcacagggtcc

SEQ ID NO: 45448 - DNA, 25 bp, Homo sapiens
tgggagaatgggtaagtttggactc

SEQ ID NO: 45449 - DNA, 20 bp, Homo sapiens
tggagaggtgggaagtgaga

SEQ ID NO: 45450 - DNA, 64 bp, Macaca mulatta rhadinovirus
gcttttcacgccacgcgtataaacgagttttcagtcataaattgtaccaggctggcatggaagc

SEQ ID NO: 45451 - DNA, 20 bp, Macaca mulatta rhadinovirus
taccaggctggcatggaagc

SEQ ID NO: 45452 - DNA, 21 bp, Homo sapiens
caggctaatctctgtggaagc

SEQ ID NO: 45453 - DNA, 18 bp, Homo sapiens
caggcggagcatggaagc

SEQ ID NO: 45454 - DNA, 18 bp, Homo sapiens
ccaggccaggctgggggc

SEQ ID NO: 45455 - DNA, 19 bp, Homo sapiens
taccaggccgcggccaagc

SEQ ID NO: 45456 - DNA, 21 bp, Homo sapiens
taccaggctgggtgagagagc

SEQ ID NO: 45457 - DNA, 18 bp, Homo sapiens
ccaggctgggacaggggc

SEQ ID NO: 45458 - DNA, 18 bp, Homo sapiens
taccaggcatgcagaagc

SEQ ID NO: 45459 - DNA, 17 bp, Homo sapiens
caccaggctatgggggc

SEQ ID NO: 45460 - DNA, 18 bp, Homo sapiens
agctacaggcatggaagc

SEQ ID NO: 45461 - DNA, 17 bp, Homo sapiens
ccaggctggactggagc

SEQ ID NO: 45462 - DNA, 19 bp, Homo sapiens
aactggcacatgtggaagc

SEQ ID NO: 45463 - DNA, 17 bp, Homo sapiens
acacaggctgtgggagc

SEQ ID NO: 45464 - DNA, 16 bp, Homo sapiens
accaggctgtgggagc

SEQ ID NO: 45465 - DNA, 17 bp, Homo sapiens
ccagaaggtatggaagc

SEQ ID NO: 45466 - DNA, 18 bp, Homo sapiens
caggcttggaatggaagc

SEQ ID NO: 45467 - DNA, 19 bp, Homo sapiens
taccagactggcacctaag

SEQ ID NO: 45468 - DNA, 18 bp, Homo sapiens
caccaggctgagccctgg

SEQ ID NO: 45469 - DNA, 18 bp, Homo sapiens
agcagtgaccatggaagc

SEQ ID NO: 45470 - DNA, 15 bp, Homo sapiens
taccaggctgagaag

SEQ ID NO: 45471 - DNA, 17 bp, Homo sapiens
ccaggctgggaagaagc

SEQ ID NO: 45472 - DNA, 23 bp, Homo sapiens
tacacagaagaacggcatgggag

SEQ ID NO: 45473 - DNA, 19 bp, Homo sapiens
ccaggctggcacagaaagc

SEQ ID NO: 45474 - DNA, 15 bp, Homo sapiens
caccactatggaagc

SEQ ID NO: 45475 - DNA, 18 bp, Homo sapiens
ccaggctggggacagagc

SEQ ID NO: 45476 - DNA, 17 bp, Homo sapiens
caccaggctaatgggag

SEQ ID NO: 45477 - DNA, 18 bp, Homo sapiens
agccgtcgctatggaagc

SEQ ID NO: 45478 - DNA, 20 bp, Homo sapiens
taccaggctggcctcacaag

SEQ ID NO: 45479 - DNA, 19 bp, Homo sapiens
taccagctggcacaggagc

SEQ ID NO: 45480 - DNA, 19 bp, Homo sapiens
ccgggctggccacgagggc

SEQ ID NO: 45481 - DNA, 21 bp, Homo sapiens
accaggctgacagctggaggc

SEQ ID NO: 45482 - DNA, 17 bp, Homo sapiens
ccaggctggctgtcagc

SEQ ID NO: 45483 - DNA, 18 bp, Homo sapiens
caggctgggcacagaggc

SEQ ID NO: 45484 - DNA, 16 bp, Homo sapiens
accactgtatggaagc

SEQ ID NO: 45485 - DNA, 17 bp, Homo sapiens
acctagggcatggaggc

SEQ ID NO: 45486 - DNA, 20 bp, Homo sapiens
accaggctggcttagggagc

SEQ ID NO: 45487 - DNA, 19 bp, Homo sapiens
aactagccattatggaagc

SEQ ID NO: 45488 - DNA, 26 bp, Homo sapiens
taccagactttataggcatggaagcg

SEQ ID NO: 45489 - DNA, 19 bp, Homo sapiens
ccaggctgagccaagaagc

SEQ ID NO: 45490 - DNA, 22 bp, Homo sapiens
cactgggctgagccagggaggc

SEQ ID NO: 45491 - DNA, 20 bp, Homo sapiens
ccaggctggtgagacacagc

SEQ ID NO: 45492 - DNA, 16 bp, Homo sapiens
ccaggctggctgcagc

SEQ ID NO: 45493 - DNA, 19 bp, Homo sapiens
ccaggctggcctcagaggc

SEQ ID NO: 45494 - DNA, 19 bp, Homo sapiens
caccaaactccatgggggc

SEQ ID NO: 45495 - DNA, 19 bp, Homo sapiens
ccgggctggcatgggaagc

SEQ ID NO: 45496 - DNA, 18 bp, Homo sapiens
accaggctgggacccagc

SEQ ID NO: 45497 - DNA, 19 bp, Homo sapiens
actaggctacattgggggc

SEQ ID NO: 45498 - DNA, 17 bp, Homo sapiens
ccaggtgacttggaggc

SEQ ID NO: 45499 - DNA, 17 bp, Homo sapiens
caccattctcatggaag

SEQ ID NO: 45500 - DNA, 17 bp, Homo sapiens
cacacaaaccatggaag

SEQ ID NO: 45501 - DNA, 18 bp, Homo sapiens
accaggctggtgaatcgc

SEQ ID NO: 45502 - DNA, 18 bp, Homo sapiens
taccagctgtgcaaaaag

SEQ ID NO: 45503 - DNA, 17 bp, Homo sapiens
caccaggcaagggaggc

SEQ ID NO: 45504 - DNA, 19 bp, Homo sapiens
caccagcatcagtggaggc

SEQ ID NO: 45505 - DNA, 17 bp, Homo sapiens
accaggcccaaggaggc

SEQ ID NO: 45506 - DNA, 18 bp, Homo sapiens
ccaggctgaatgacaggc

SEQ ID NO: 45507 - DNA, 21 bp, Homo sapiens
caggctggtctccatggaggc

SEQ ID NO: 45508 - DNA, 20 bp, Homo sapiens
accaggcccacactggaggc

SEQ ID NO: 45509 - DNA, 18 bp, Homo sapiens
ccaggctggacgtggagc

SEQ ID NO: 45510 - DNA, 17 bp, Homo sapiens
ccaggctggcagacagc

SEQ ID NO: 45511 - DNA, 18 bp, Homo sapiens
caccaggttctgagaagc

SEQ ID NO: 45512 - DNA, 17 bp, Homo sapiens
ccaggtaacatgggggc

SEQ ID NO: 45513 - DNA, 17 bp, Homo sapiens
taccaggcacttgggag

SEQ ID NO: 45514 - DNA, 16 bp, Homo sapiens
ccaggctggcagacgc

SEQ ID NO: 45515 - DNA, 21 bp, Homo sapiens
taccagcacaaggatggaggc

SEQ ID NO: 45516 - DNA, 22 bp, Homo sapiens
taccaggctggtcccaggaagc

SEQ ID NO: 45517 - DNA, 19 bp, Homo sapiens
accaggctggccaacatgg

SEQ ID NO: 45518 - DNA, 17 bp, Homo sapiens
ccaggctgccctggagc

SEQ ID NO: 45519 - DNA, 17 bp, Homo sapiens
ccatggcacatggaagc

SEQ ID NO: 45520 - DNA, 17 bp, Homo sapiens
ccaggctgccggacagc

SEQ ID NO: 45521 - DNA, 18 bp, Homo sapiens
tacacaaacttatggaag

SEQ ID NO: 45522 - DNA, 21 bp, Homo sapiens
ccaggctggacacttgggggc

SEQ ID NO: 45523 - DNA, 18 bp, Homo sapiens
accaggctgcctggaagc

SEQ ID NO: 45524 - DNA, 19 bp, Homo sapiens
caccaggcagggtgggggc

SEQ ID NO: 45525 - DNA, 15 bp, Homo sapiens
ccaggctgcacaagc

SEQ ID NO: 45526 - DNA, 15 bp, Homo sapiens
ccaggctgctggagc

SEQ ID NO: 45527 - DNA, 19 bp, Homo sapiens
accaggctcagcaggaggc

SEQ ID NO: 45528 - DNA, 20 bp, Homo sapiens
caccgggaccccatggaagc

SEQ ID NO: 45529 - DNA, 16 bp, Homo sapiens
ccaggctggccggagc

SEQ ID NO: 45530 - DNA, 18 bp, Homo sapiens
ccaggctgggatgaaggc

SEQ ID NO: 45531 - DNA, 18 bp, Homo sapiens
ccaggctgaaggggaagc

SEQ ID NO: 45532 - DNA, 18 bp, Homo sapiens
ccaggctccgcatggagc

SEQ ID NO: 45533 - DNA, 15 bp, Homo sapiens
accaggacatggaag

SEQ ID NO: 45534 - DNA, 19 bp, Homo sapiens
ccaggctgtgcatggaggc

SEQ ID NO: 45535 - DNA, 20 bp, Homo sapiens
ccaggctgtccacttggaag

SEQ ID NO: 45536 - DNA, 21 bp, Homo sapiens
caccaggctggatctgagggc

SEQ ID NO: 45537 - DNA, 20 bp, Homo sapiens
caccaggcccgtctgggagc

SEQ ID NO: 45538 - DNA, 18 bp, Homo sapiens
ccacggaaacatgggagc

SEQ ID NO: 45539 - DNA, 20 bp, Homo sapiens
caccggggcggtgtgggagc

SEQ ID NO: 45540 - DNA, 19 bp, Homo sapiens
caggctggtcattacaagc

SEQ ID NO: 45541 - DNA, 17 bp, Homo sapiens
accaggctcgcgggagc

SEQ ID NO: 45542 - DNA, 18 bp, Homo sapiens
accaggctggtctggaag

SEQ ID NO: 45543 - DNA, 20 bp, Homo sapiens
taccaggcagctctggaggc

SEQ ID NO: 45544 - DNA, 20 bp, Homo sapiens
taccggccggcagtgggggc

SEQ ID NO: 45545 - DNA, 19 bp, Homo sapiens
tacctaggcccctgggagc

SEQ ID NO: 45546 - DNA, 19 bp, Homo sapiens
caggctggcacactagagc

SEQ ID NO: 45547 - DNA, 16 bp, Homo sapiens
accaggctaaaggaag

SEQ ID NO: 45548 - DNA, 18 bp, Homo sapiens
caggctggctccagaggc

SEQ ID NO: 45549 - DNA, 16 bp, Homo sapiens
ccaggctgctcagagc

SEQ ID NO: 45550 - DNA, 20 bp, Homo sapiens
ccagactgtggcatgggggc

SEQ ID NO: 45551 - DNA, 18 bp, Homo sapiens
tactaggctagctcatag

SEQ ID NO: 45552 - DNA, 16 bp, Homo sapiens
ccaggccacagggagc

SEQ ID NO: 45553 - DNA, 16 bp, Homo sapiens
accaggctggtggagc

SEQ ID NO: 45554 - DNA, 20 bp, Homo sapiens
tactgggctagtacaaaagc

SEQ ID NO: 45555 - DNA, 19 bp, Homo sapiens
agtgcaagaccatggaagc

SEQ ID NO: 45556 - DNA, 24 bp, Homo sapiens
taccaggcctcttcccatgggggc

SEQ ID NO: 45557 - DNA, 18 bp, Homo sapiens
caccaggctgtgcaaagc

SEQ ID NO: 45558 - DNA, 20 bp, Homo sapiens
caccaggcaatgcagggagc

SEQ ID NO: 45559 - DNA, 18 bp, Homo sapiens
caggctgaatggtggagc

SEQ ID NO: 45560 - DNA, 18 bp, Homo sapiens
ccaacagcagcatgggag

SEQ ID NO: 45561 - DNA, 19 bp, Homo sapiens
ccaggctgagccgggaggc

SEQ ID NO: 45562 - DNA, 20 bp, Homo sapiens
taccagacgaaacaggaagc

SEQ ID NO: 45563 - DNA, 18 bp, Homo sapiens
acccacagggcatggaag

SEQ ID NO: 45564 - DNA, 19 bp, Homo sapiens
caggctggcagaagggagc

SEQ ID NO: 45565 - DNA, 20 bp, Homo sapiens
taccaggcgtggctctaagc

SEQ ID NO: 45566 - DNA, 17 bp, Homo sapiens
ccaggctggctggaggc

SEQ ID NO: 45567 - DNA, 16 bp, Homo sapiens
ccaggctgaggaaagc

SEQ ID NO: 45568 - DNA, 19 bp, Homo sapiens
ccaggctgggcgacagagc

SEQ ID NO: 45569 - DNA, 19 bp, Homo sapiens
tacacagaaaatatggaag

SEQ ID NO: 45570 - DNA, 17 bp, Homo sapiens
taccaggccgacggaag

SEQ ID NO: 45571 - DNA, 18 bp, Homo sapiens
catcctgggcatggaagc

SEQ ID NO: 45572 - DNA, 20 bp, Homo sapiens
taccaggcttggcaaaaagc

SEQ ID NO: 45573 - DNA, 17 bp, Homo sapiens
tacgggcttggggaagc

SEQ ID NO: 45574 - DNA, 16 bp, Homo sapiens
ccaggctgacaaaagc

SEQ ID NO: 45575 - DNA, 17 bp, Homo sapiens
ccaggctaggaggaagc

SEQ ID NO: 45576 - DNA, 21 bp, Homo sapiens
ccaggctgggggacagggagc

SEQ ID NO: 45577 - DNA, 16 bp, Homo sapiens
ccagcaacatgggagc

SEQ ID NO: 45578 - DNA, 18 bp, Homo sapiens
ccaggctggtcaggaggc

SEQ ID NO: 45579 - DNA, 16 bp, Homo sapiens
ccatgctcatggaagc

SEQ ID NO: 45580 - DNA, 16 bp, Homo sapiens
ccaggctgtcaggagc

SEQ ID NO: 45581 - DNA, 20 bp, Homo sapiens
cctgggctggcatccaaagc

SEQ ID NO: 45582 - DNA, 22 bp, Homo sapiens
accaggctggtcaacaggaggc

SEQ ID NO: 45583 - DNA, 17 bp, Homo sapiens
ccaggctggtctggagc

SEQ ID NO: 45584 - DNA, 19 bp, Homo sapiens
taccaggcaggctaagagc

SEQ ID NO: 45585 - DNA, 20 bp, Homo sapiens
caggctgagttcctggaagc

SEQ ID NO: 45586 - DNA, 73 bp, Human herpesvirus 1
gacccacgtactccaagaaggcatgtgtcccaccccgcctgtgtttttgtgcctggctctctatgcttgggtc

SEQ ID NO: 45587 - DNA, 24 bp, Human herpesvirus 1
tgcctggctctctatgcttgggtc

SEQ ID NO: 45588 - DNA, 24 bp, Homo sapiens
tgcctggtgccacaagcttgggtc

SEQ ID NO: 45589 - DNA, 20 bp, Homo sapiens
tgcgcggctatgtttgggtc

SEQ ID NO: 45590 - DNA, 24 bp, Homo sapiens
tgcttgggttctacttgtttgggt

SEQ ID NO: 45591 - DNA, 23 bp, Homo sapiens
tgtctgtttttcctccttgggtc

SEQ ID NO: 45592 - DNA, 25 bp, Homo sapiens
tgcctgtgctctgagaccttgggtc

SEQ ID NO: 45593 - DNA, 18 bp, Homo sapiens
tgcttggcttcttgtggt

SEQ ID NO: 45594 - DNA, 19 bp, Homo sapiens
tggctggctctttggttgg

SEQ ID NO: 45595 - DNA, 21 bp, Homo sapiens
tgcctggctgtttatgcctag

SEQ ID NO: 45596 - DNA, 16 bp, Homo sapiens
tggctctttgttgagt

SEQ ID NO: 45597 - DNA, 15 bp, Homo sapiens
tgcctggctcctagg

SEQ ID NO: 45598 - DNA, 16 bp, Homo sapiens
tgcctggctctctgga

SEQ ID NO: 45599 - DNA, 19 bp, Homo sapiens
ctggcttcctacttgggtc

SEQ ID NO: 45600 - DNA, 20 bp, Homo sapiens
tgcttggctctctggacggt

SEQ ID NO: 45601 - DNA, 24 bp, Homo sapiens
tgcctggctcttcctgcatgggtc

SEQ ID NO: 45602 - DNA, 21 bp, Homo sapiens
tgactctctgtgatgggggtc

SEQ ID NO: 45603 - DNA, 19 bp, Homo sapiens
tgcctggcctctgtccttg

SEQ ID NO: 45604 - DNA, 21 bp, Homo sapiens
tgcttgtcccctgcttgggtc

SEQ ID NO: 45605 - DNA, 19 bp, Homo sapiens
tggctcaggtgtttgggtc

SEQ ID NO: 45606 - DNA, 103 bp, Peanut clump virus
agaatgcctgggaaatgatagagaaagagagactgaaacttagtgcagaaaagaaccgcgctgagtacgaagtcaattctcttacttcagccaggaatagtct

SEQ ID NO: 45607 - DNA, 24 bp, Peanut clump virus
tgagtacgaagtcaattctcttac

SEQ ID NO: 45608 - DNA, 17 bp, Homo sapiens
tgagtacgaggtcatct

SEQ ID NO: 45609 - DNA, 21 bp, Homo sapiens
tgagaaatgttgattctctta

SEQ ID NO: 45610 - DNA, 20 bp, Homo sapiens
tgggttcaagcaattctctt

SEQ ID NO: 45611 - DNA, 20 bp, Homo sapiens
tgagtaggaacattctctta

SEQ ID NO: 45612 - DNA, 18 bp, Homo sapiens
tgagttgaaaatcctctt

SEQ ID NO: 45613 - DNA, 23 bp, Homo sapiens
tgggtgcgggcagcctctcttac

SEQ ID NO: 45614 - DNA, 17 bp, Homo sapiens
tgagtacgtggcattct

SEQ ID NO: 45615 - DNA, 15 bp, Homo sapiens
gtacaaagttctctt

SEQ ID NO: 45616 - DNA, 20 bp, Homo sapiens
tgagttcaagcgattctctt

SEQ ID NO: 45617 - DNA, 20 bp, Homo sapiens
tgggtacaaagtatactctt

SEQ ID NO: 45618 - DNA, 20 bp, Homo sapiens
tgagttcaagcaattctctt

SEQ ID NO: 45619 - DNA, 19 bp, Homo sapiens
tgagtatgtatttctctta

SEQ ID NO: 45620 - DNA, 22 bp, Homo sapiens
tggatatgaattaaattctctt

SEQ ID NO: 45621 - DNA, 20 bp, Homo sapiens
tgagtccaagcaattctctt

SEQ ID NO: 45622 - DNA, 65 bp, Equine herpesvirus 4
gacttaaacgcatacgggtatagactatcacgcaatggtccaccctccgtgctggttaccgagtc

SEQ ID NO: 45623 - DNA, 24 bp, Equine herpesvirus 4
tccaccctccgtgctggttaccga

SEQ ID NO: 45624 - DNA, 16 bp, Homo sapiens
acacctcactggttac

SEQ ID NO: 45625 - DNA, 17 bp, Homo sapiens
tccaccctttgagttac

SEQ ID NO: 45626 - DNA, 19 bp, Homo sapiens
tcgactctccgtgctggct

SEQ ID NO: 45627 - DNA, 20 bp, Homo sapiens
cctgccttttgtgctggcta

SEQ ID NO: 45628 - DNA, 24 bp, Homo sapiens
tccatcctttcacatggttaccga

SEQ ID NO: 45629 - DNA, 16 bp, Homo sapiens
ccatcctccgtgagtc

SEQ ID NO: 45630 - DNA, 17 bp, Homo sapiens
caccatctgtgccaccg

SEQ ID NO: 45631 - DNA, 18 bp, Homo sapiens
tccgcctccgtgctggcc

SEQ ID NO: 45632 - DNA, 19 bp, Homo sapiens
caccttcccccagttaccg

SEQ ID NO: 45633 - DNA, 24 bp, Homo sapiens
tccaccctgtcgtggctctactga

SEQ ID NO: 45634 - DNA, 18 bp, Homo sapiens
tccaccctccatgagatt

SEQ ID NO: 45635 - DNA, 22 bp, Homo sapiens
tccacgctctgccccttgctga

SEQ ID NO: 45636 - DNA, 22 bp, Homo sapiens
tccacccctctggtgttgctgg

SEQ ID NO: 45637 - DNA, 18 bp, Homo sapiens
tccaccctgcgtagctac

SEQ ID NO: 45638 - DNA, 20 bp, Homo sapiens
ctctctgccgtggttaccga

SEQ ID NO: 45639 - DNA, 18 bp, Homo sapiens
cctccgtgctctctgcga

SEQ ID NO: 45640 - DNA, 21 bp, Homo sapiens
tccaccctttagttatactga

SEQ ID NO: 45641 - DNA, 22 bp, Homo sapiens
tccacgcagcgcctggttgccg

SEQ ID NO: 45642 - DNA, 19 bp, Homo sapiens
tccaccctctgggtcctgg

SEQ ID NO: 45643 - DNA, 21 bp, Homo sapiens
tccgccctccgtcttcgtccg

SEQ ID NO: 45644 - DNA, 18 bp, Homo sapiens
tccgccctccgtatctgg

SEQ ID NO: 45645 - DNA, 18 bp, Homo sapiens
ccaccctctgtgggctgg

SEQ ID NO: 45646 - DNA, 22 bp, Homo sapiens
tccacgcctctccagttgctga

SEQ ID NO: 45647 - DNA, 18 bp, Homo sapiens
tccaaagctggttactga

SEQ ID NO: 45648 - DNA, 18 bp, Homo sapiens
tccacccttcctggctgg

SEQ ID NO: 45649 - DNA, 17 bp, Homo sapiens
tccaccctcctgttgtt

SEQ ID NO: 45650 - DNA, 21 bp, Homo sapiens
tccgtcctccatggatactga

SEQ ID NO: 45651 - DNA, 19 bp, Homo sapiens
ccactagtgctggttgccg

SEQ ID NO: 45652 - DNA, 69 bp, Erysimum latent virus
ctcaagagctgtggtcagcgctcaacactctaatgcctctaagcgctctcacctcacccagcctccgag

SEQ ID NO: 45653 - DNA, 24 bp, Erysimum latent virus
caagagctgtggtcagcgctcaac

SEQ ID NO: 45654 - DNA, 23 bp, Homo sapiens
caacagcctgacatggcgctcaa

SEQ ID NO: 45655 - DNA, 21 bp, Homo sapiens
ggagagctgtggcactatctc

SEQ ID NO: 45656 - DNA, 20 bp, Homo sapiens
caagagctggggtccttctc

SEQ ID NO: 45657 - DNA, 19 bp, Homo sapiens
aagagctgtggtcagtggc

SEQ ID NO: 45658 - DNA, 19 bp, Homo sapiens
gacacgattcagcgctcaa

SEQ ID NO: 45659 - DNA, 17 bp, Homo sapiens
aaggctgtggtctcccc

SEQ ID NO: 45660 - DNA, 18 bp, Homo sapiens
caacagctgtggtctcaa

SEQ ID NO: 45661 - DNA, 19 bp, Homo sapiens
aagagctgtcggttgtaca

SEQ ID NO: 45662 - DNA, 18 bp, Homo sapiens
caagagctgtggccaagc

SEQ ID NO: 45663 - DNA, 19 bp, Homo sapiens
caaaagctgtggtttcaac

SEQ ID NO: 45664 - DNA, 17 bp, Homo sapiens
aaagccagacagcgctc

SEQ ID NO: 45665 - DNA, 18 bp, Homo sapiens
agagctgtgcctgctcaa

SEQ ID NO: 45666 - DNA, 19 bp, Homo sapiens
caagagctgggaccggctc

SEQ ID NO: 45667 - DNA, 17 bp, Homo sapiens
agctggagcgcgctcaa

SEQ ID NO: 45668 - DNA, 18 bp, Homo sapiens
caagagctgtgatccagc

SEQ ID NO: 45669 - DNA, 20 bp, Homo sapiens
aggggctgtggcctgccagc

SEQ ID NO: 45670 - DNA, 19 bp, Homo sapiens
caatgggctgtggctcagc

SEQ ID NO: 45671 - DNA, 17 bp, Homo sapiens
gagcagcagcgctcaac

SEQ ID NO: 45672 - DNA, 18 bp, Homo sapiens
caaggctgtggtcttggc

SEQ ID NO: 45673 - DNA, 16 bp, Homo sapiens
agggccatggcgctca

SEQ ID NO: 45674 - DNA, 20 bp, Homo sapiens
caagaactgtggtcactgct

SEQ ID NO: 45675 - DNA, 19 bp, Homo sapiens
gagctgtggcttgagcggc

SEQ ID NO: 45676 - DNA, 22 bp, Homo sapiens
caggagctgcagtcagcgttca

SEQ ID NO: 45677 - DNA, 21 bp, Homo sapiens
caagagcttgccttctgctca

SEQ ID NO: 45678 - DNA, 18 bp, Homo sapiens
agagctgtggtccacggc

SEQ ID NO: 45679 - DNA, 22 bp, Homo sapiens
caaaggctgtggtcagtcatca

SEQ ID NO: 45680 - DNA, 20 bp, Homo sapiens
gagcgcaagctcagcgctca

SEQ ID NO: 45681 - DNA, 17 bp, Homo sapiens
agagctgctgtgcgctc

SEQ ID NO: 45682 - DNA, 18 bp, Homo sapiens
aagggctgtggtgagtcg

SEQ ID NO: 45683 - DNA, 18 bp, Homo sapiens
caacggctgtagccgctc

SEQ ID NO: 45684 - DNA, 23 bp, Homo sapiens
aaagttgtggttcaaacttcaac

SEQ ID NO: 45685 - DNA, 16 bp, Homo sapiens
agggccgcggcgctca

SEQ ID NO: 45686 - DNA, 23 bp, Homo sapiens
aggtgctggcccgggcgctcaac

SEQ ID NO: 45687 - DNA, 18 bp, Homo sapiens
caagaactgtggaaaagc

SEQ ID NO: 45688 - DNA, 17 bp, Homo sapiens
aggggctgtggcagccc

SEQ ID NO: 45689 - DNA, 21 bp, Homo sapiens
caaaggctgtggtgccacctc

SEQ ID NO: 45690 - DNA, 25 bp, Homo sapiens
caagacgctctctctagtgctcagc

SEQ ID NO: 45691 - DNA, 21 bp, Homo sapiens
caggagctgtgattgtgctca

SEQ ID NO: 45692 - DNA, 18 bp, Homo sapiens
caagggctgtgctcagca

SEQ ID NO: 45693 - DNA, 23 bp, Homo sapiens
caagagccaccttggtgttcagc

SEQ ID NO: 45694 - DNA, 19 bp, Homo sapiens
aggggctgctgcgctcaac

SEQ ID NO: 45695 - DNA, 20 bp, Homo sapiens
caggaactgtggttatcaac

SEQ ID NO: 45696 - DNA, 20 bp, Homo sapiens
caaggctcttggtgttcagc

SEQ ID NO: 45697 - DNA, 21 bp, Homo sapiens
caagagctgtggtcagctcca

SEQ ID NO: 45698 - DNA, 17 bp, Homo sapiens
caagagcttccagctgc

SEQ ID NO: 45699 - DNA, 19 bp, Homo sapiens
aagggctgtggcgaagggc

SEQ ID NO: 45700 - DNA, 18 bp, Homo sapiens
caagggctgtgatcagac

SEQ ID NO: 45701 - DNA, 67 bp, Erysimum latent virus
tagaaactgatgactcatgcgctggcccaatctccaccttccaggatctctttccagccagttacta

SEQ ID NO: 45702 - DNA, 22 bp, Erysimum latent virus
atctctttccagccagttacta

SEQ ID NO: 45703 - DNA, 18 bp, Homo sapiens
tctctttctggcactact

SEQ ID NO: 45704 - DNA, 19 bp, Homo sapiens
atcctttccagctcagcta

SEQ ID NO: 45705 - DNA, 19 bp, Homo sapiens
atctcctggaccagttact

SEQ ID NO: 45706 - DNA, 18 bp, Homo sapiens
atctcttcccagttcatc

SEQ ID NO: 45707 - DNA, 16 bp, Homo sapiens
atctcttccaggagct

SEQ ID NO: 45708 - DNA, 17 bp, Homo sapiens
cctctttccagcagcca

SEQ ID NO: 45709 - DNA, 20 bp, Homo sapiens
tctctttccaatgaatacta

SEQ ID NO: 45710 - DNA, 16 bp, Homo sapiens
tctctttccagctact

SEQ ID NO: 45711 - DNA, 16 bp, Homo sapiens
tctttccaacattact

SEQ ID NO: 45712 - DNA, 22 bp, Homo sapiens
atctctttccattcccatccct

SEQ ID NO: 45713 - DNA, 18 bp, Homo sapiens
tcactttccagcgttcct

SEQ ID NO: 45714 - DNA, 15 bp, Homo sapiens
tctctctccagtact

SEQ ID NO: 45715 - DNA, 16 bp, Homo sapiens
tctctttccaagtcac

SEQ ID NO: 45716 - DNA, 21 bp, Homo sapiens
cctttttccagcccgttgcta

SEQ ID NO: 45717 - DNA, 19 bp, Homo sapiens
tctctttccgagctgtact

SEQ ID NO: 45718 - DNA, 17 bp, Homo sapiens
atctctctctagcagtc

SEQ ID NO: 45719 - DNA, 19 bp, Homo sapiens
atctcttttcaagccggcc

SEQ ID NO: 45720 - DNA, 23 bp, Homo sapiens
atctcttttccagtcccagacta

SEQ ID NO: 45721 - DNA, 19 bp, Homo sapiens
atctttttccaacattcta

SEQ ID NO: 45722 - DNA, 21 bp, Homo sapiens
tctctttcagcatagcaatta

SEQ ID NO: 45723 - DNA, 16 bp, Homo sapiens
tctttccacctttact

SEQ ID NO: 45724 - DNA, 19 bp, Homo sapiens
tccttccagttgaatcact

SEQ ID NO: 45725 - DNA, 20 bp, Homo sapiens
atctctttcagttagttgct

SEQ ID NO: 45726 - DNA, 16 bp, Homo sapiens
tcttcaacagttacta

SEQ ID NO: 45727 - DNA, 17 bp, Homo sapiens
atctctttctagtaact

SEQ ID NO: 45728 - DNA, 20 bp, Homo sapiens
atctcttccagccatcttct

SEQ ID NO: 45729 - DNA, 20 bp, Homo sapiens
tctcttcccagcccttccct

SEQ ID NO: 45730 - DNA, 17 bp, Homo sapiens
ctctttccagagtgact

SEQ ID NO: 45731 - DNA, 16 bp, Homo sapiens
cctctttccagagtta

SEQ ID NO: 45732 - DNA, 19 bp, Homo sapiens
ctctttccagcctctacta

SEQ ID NO: 45733 - DNA, 17 bp, Homo sapiens
tcttcaagtcagttact

SEQ ID NO: 45734 - DNA, 23 bp, Homo sapiens
atctctttcccgctagcgcagct

SEQ ID NO: 45735 - DNA, 19 bp, Homo sapiens
tcctttccagctgtcccta

SEQ ID NO: 45736 - DNA, 19 bp, Homo sapiens
tctccaacaccagttgcta

SEQ ID NO: 45737 - DNA, 19 bp, Homo sapiens
tctcttcctggctgtcact

SEQ ID NO: 45738 - DNA, 22 bp, Homo sapiens
acctttttccagtcatccatct

SEQ ID NO: 45739 - DNA, 21 bp, Homo sapiens
tctctttcaggcaaagcacta

SEQ ID NO: 45740 - DNA, 21 bp, Homo sapiens
tctcttcccagttcaacagct

SEQ ID NO: 45741 - DNA, 16 bp, Homo sapiens
atcttttccagctacc

SEQ ID NO: 45742 - DNA, 17 bp, Homo sapiens
tctctttcctgccaact

SEQ ID NO: 45743 - DNA, 20 bp, Homo sapiens
atctcttctcagggaccgct

SEQ ID NO: 45744 - DNA, 20 bp, Homo sapiens
atccttttccagccgcttct

SEQ ID NO: 45745 - DNA, 19 bp, Homo sapiens
tctccttctggctgcttct

SEQ ID NO: 45746 - DNA, 23 bp, Homo sapiens
tctctttccagcttctcaaacta

SEQ ID NO: 45747 - DNA, 17 bp, Homo sapiens
tcactttccagaaatta

SEQ ID NO: 45748 - DNA, 20 bp, Homo sapiens
tctttccagcagagcaacta

SEQ ID NO: 45749 - DNA, 20 bp, Homo sapiens
acctctttttggagcccact

SEQ ID NO: 45750 - DNA, 16 bp, Homo sapiens
tcttttccagcactta

SEQ ID NO: 45751 - DNA, 18 bp, Homo sapiens
ctctttccagaattacta

SEQ ID NO: 45752 - DNA, 15 bp, Homo sapiens
ctctttccagttact

SEQ ID NO: 45753 - DNA, 18 bp, Homo sapiens
atctcctttcagaatact

SEQ ID NO: 45754 - DNA, 17 bp, Homo sapiens
tctttccaaagtgtact

SEQ ID NO: 45755 - DNA, 17 bp, Homo sapiens
tctttccagtgcagact

SEQ ID NO: 45756 - DNA, 17 bp, Homo sapiens
tctctccatcagttgct

SEQ ID NO: 45757 - DNA, 15 bp, Homo sapiens
tccctttccaatact

SEQ ID NO: 45758 - DNA, 24 bp, Homo sapiens
tcctttccattcctccggttgcta

SEQ ID NO: 45759 - DNA, 21 bp, Homo sapiens
atctcttctggcacagtagct

SEQ ID NO: 45760 - DNA, 21 bp, Homo sapiens
atctgtttccagccgagctct

SEQ ID NO: 45761 - DNA, 20 bp, Homo sapiens
atctcttcacatagttacta

SEQ ID NO: 45762 - DNA, 17 bp, Homo sapiens
atctctttatcagtcac

SEQ ID NO: 45763 - DNA, 21 bp, Homo sapiens
atctccttctggctgcgcact

SEQ ID NO: 45764 - DNA, 25 bp, Homo sapiens
tccctttcttttccagccagttgct

SEQ ID NO: 45765 - DNA, 19 bp, Homo sapiens
atcctttccagccaggact

SEQ ID NO: 45766 - DNA, 17 bp, Homo sapiens
atctcttccagttaact

SEQ ID NO: 45767 - DNA, 19 bp, Homo sapiens
ctctttcacagagttacta

SEQ ID NO: 45768 - DNA, 19 bp, Homo sapiens
atcttttctcagccaccca

SEQ ID NO: 45769 - DNA, 18 bp, Homo sapiens
tcctttccattggttact

SEQ ID NO: 45770 - DNA, 18 bp, Homo sapiens
tcctttccagtgtagact

SEQ ID NO: 45771 - DNA, 20 bp, Homo sapiens
atccctttttcctcttacta

SEQ ID NO: 45772 - DNA, 19 bp, Homo sapiens
tctttttccagctgacact

SEQ ID NO: 45773 - DNA, 22 bp, Homo sapiens
atctttttggaaccagttgcta

SEQ ID NO: 45774 - DNA, 18 bp, Homo sapiens
atctccttccagccagtt

SEQ ID NO: 45775 - DNA, 21 bp, Homo sapiens
atctcttcccactgggttact

SEQ ID NO: 45776 - DNA, 17 bp, Homo sapiens
atcctttccagtgctct

SEQ ID NO: 45777 - DNA, 64 bp, Erysimum latent virus
gacttctttccagagattgtcttccaactcaacatgataactgcccctctgacaaaaagaagtt

SEQ ID NO: 45778 - DNA, 24 bp, Erysimum latent virus
taactgcccctctgacaaaaagaa

SEQ ID NO: 45779 - DNA, 21 bp, Homo sapiens
taactgccatatcagaaagaa

SEQ ID NO: 45780 - DNA, 19 bp, Homo sapiens
aactgctcagctgacaaaa

SEQ ID NO: 45781 - DNA, 19 bp, Homo sapiens
ctgcctcctgtaaaaagaa

SEQ ID NO: 45782 - DNA, 20 bp, Homo sapiens
aactgccctgaggcctaaga

SEQ ID NO: 45783 - DNA, 24 bp, Homo sapiens
caaccatatctctgacaaaaagaa

SEQ ID NO: 45784 - DNA, 20 bp, Homo sapiens
cttcccctctggcagggaga

SEQ ID NO: 45785 - DNA, 17 bp, Homo sapiens
taactacccacaaggag

SEQ ID NO: 45786 - DNA, 25 bp, Homo sapiens
taactccctagcttcacaaagagaa

SEQ ID NO: 45787 - DNA, 23 bp, Homo sapiens
taactcccctctgtacacagaga

SEQ ID NO: 45788 - DNA, 19 bp, Homo sapiens
taactggccctacaaaaag

SEQ ID NO: 45789 - DNA, 17 bp, Homo sapiens
taactgccttccacaaa

SEQ ID NO: 45790 - DNA, 22 bp, Homo sapiens
ctgtcccttacataaaaaagaa

SEQ ID NO: 45791 - DNA, 20 bp, Homo sapiens
aactgcccctcaaggaagaa

SEQ ID NO: 45792 - DNA, 23 bp, Homo sapiens
taactgcccattcttttaaagaa

SEQ ID NO: 45793 - DNA, 20 bp, Homo sapiens
ccggtcctctgacaggaaga

SEQ ID NO: 45794 - DNA, 18 bp, Homo sapiens
taactgccttgataaaag

SEQ ID NO: 45795 - DNA, 18 bp, Homo sapiens
aactgccccagtaaaaag

SEQ ID NO: 45796 - DNA, 21 bp, Homo sapiens
gcttctctgacagagaaagaa

SEQ ID NO: 45797 - DNA, 24 bp, Homo sapiens
cttcccctccaaaaatggtaaaga

SEQ ID NO: 45798 - DNA, 24 bp, Homo sapiens
caactgtcctcacggcaaaaagaa

SEQ ID NO: 45799 - DNA, 26 bp, Homo sapiens
taactgccccgttctttggataaaag

SEQ ID NO: 45800 - DNA, 22 bp, Homo sapiens
gccgttcctctgacactcagaa

SEQ ID NO: 45801 - DNA, 18 bp, Homo sapiens
taactgcccctctataca

SEQ ID NO: 45802 - DNA, 18 bp, Homo sapiens
tgcccagcttaaaaagaa

SEQ ID NO: 45803 - DNA, 19 bp, Homo sapiens
taactcccctctgacccag

SEQ ID NO: 45804 - DNA, 18 bp, Homo sapiens
taactgctctgccaaaga

SEQ ID NO: 45805 - DNA, 22 bp, Homo sapiens
taactgccttttggcagggaga

SEQ ID NO: 45806 - DNA, 17 bp, Homo sapiens
taactgtgacaaaaaga

SEQ ID NO: 45807 - DNA, 16 bp, Homo sapiens
actgcctctgaccaga

SEQ ID NO: 45808 - DNA, 24 bp, Homo sapiens
caactgccccggggacgatgaaag

SEQ ID NO: 45809 - DNA, 19 bp, Homo sapiens
aactgcccttctgttaaga

SEQ ID NO: 45810 - DNA, 16 bp, Homo sapiens
ctgcccgagaaaaaga

SEQ ID NO: 45811 - DNA, 16 bp, Homo sapiens
actgctgacaaagaga

SEQ ID NO: 45812 - DNA, 20 bp, Homo sapiens
ctgcccctcccactagaaga

SEQ ID NO: 45813 - DNA, 21 bp, Homo sapiens
ctgcccctagctgcaggaaga

SEQ ID NO: 45814 - DNA, 19 bp, Homo sapiens
actgtctctaaaaaaagaa

SEQ ID NO: 45815 - DNA, 18 bp, Homo sapiens
taactcctgacaaaaaga

SEQ ID NO: 45816 - DNA, 23 bp, Homo sapiens
ctgggggactctgacagggagaa

SEQ ID NO: 45817 - DNA, 20 bp, Homo sapiens
actgctctgacactgaaaag

SEQ ID NO: 45818 - DNA, 62 bp, Erysimum latent virus
ggcaattgtctctaccgctcctggtgtcaagtttaccgtcgcgacccaaatgtgcgattgcc

SEQ ID NO: 45819 - DNA, 24 bp, Erysimum latent virus
tcgcgacccaaatgtgcgattgcc

SEQ ID NO: 45820 - DNA, 22 bp, Homo sapiens
ccgcgacccggcctcggttgcc

SEQ ID NO: 45821 - DNA, 21 bp, Homo sapiens
gcgatccaagtgtgtggttgc

SEQ ID NO: 45822 - DNA, 23 bp, Homo sapiens
cgcgatctgggtgtgatggtgcc

SEQ ID NO: 45823 - DNA, 16 bp, Homo sapiens
gacccaaatcatttgc

SEQ ID NO: 45824 - DNA, 19 bp, Homo sapiens
gacccaaagtggagcagcc

SEQ ID NO: 45825 - DNA, 70 bp, Equine herpesvirus 4
ggcgttcatcggtctcgggcgcgcgctggtatatcttaacactagctgcggcctaacccatttggacgtt

SEQ ID NO: 45826 - DNA, 24 bp, Equine herpesvirus 4
tagctgcggcctaacccatttgga

SEQ ID NO: 45827 - DNA, 19 bp, Homo sapiens
gctggccagtccatttgga

SEQ ID NO: 45828 - DNA, 18 bp, Homo sapiens
gctgcggcctggcctcgg

SEQ ID NO: 45829 - DNA, 21 bp, Homo sapiens
gctggggcctggcccatttgg

SEQ ID NO: 45830 - DNA, 20 bp, Homo sapiens
gcaaccttgacccatttgga

SEQ ID NO: 45831 - DNA, 29 bp, Homo sapiens
tagctgcgcttggcaccgggtccaaatgg

SEQ ID NO: 45832 - DNA, 18 bp, Homo sapiens
gctgcggccagcccttgg

SEQ ID NO: 45833 - DNA, 17 bp, Homo sapiens
actggaaatccatttgg

SEQ ID NO: 45834 - DNA, 20 bp, Homo sapiens
gctgcggccagcgcactgga

SEQ ID NO: 45835 - DNA, 21 bp, Homo sapiens
agctgcaaaagtttatttgga

SEQ ID NO: 45836 - DNA, 22 bp, Homo sapiens
tagccgcggcctggtaagtgga

SEQ ID NO: 45837 - DNA, 16 bp, Homo sapiens
tgtggcctaactttgg

SEQ ID NO: 45838 - DNA, 22 bp, Homo sapiens
tagctgcagtctagtcgtgtgg

SEQ ID NO: 45839 - DNA, 24 bp, Homo sapiens
agctgcggcctgactgatccaaag

SEQ ID NO: 45840 - DNA, 62 bp, Alcelaphine herpesvirus 1
tcctatcctgctgaactttagcagaaactctagcgagtttcagctagtgttgtatgatagga

SEQ ID NO: 45841 - DNA, 24 bp, Alcelaphine herpesvirus 1
ttcagctagtgttgtatgatagga

SEQ ID NO: 45842 - DNA, 23 bp, Homo sapiens
ttcagctcagtgacaagatagga

SEQ ID NO: 45843 - DNA, 19 bp, Homo sapiens
agcagtgttgtatataaga

SEQ ID NO: 45844 - DNA, 20 bp, Homo sapiens
agttagtgttgtcaaatagg

SEQ ID NO: 45845 - DNA, 72 bp, Equine herpesvirus 4
atacccggcgattttcccaaccacccctctaacaacgatatacggcattccctgggaccaggtcgagggtgt

SEQ ID NO: 45846 - DNA, 24 bp, Equine herpesvirus 4
acccggcgattttcccaaccaccc

SEQ ID NO: 45847 - DNA, 20 bp, Homo sapiens
ccggtgtatcccaaccaccc

SEQ ID NO: 45848 - DNA, 19 bp, Homo sapiens
cctgcaaccccgactgccc

SEQ ID NO: 45849 - DNA, 18 bp, Homo sapiens
cctgcaatcccagccacc

SEQ ID NO: 45850 - DNA, 17 bp, Homo sapiens
cccgcaatcccagccac

SEQ ID NO: 45851 - DNA, 18 bp, Homo sapiens
ggcttcctctgaccaccc

SEQ ID NO: 45852 - DNA, 16 bp, Homo sapiens
cccggctcccaaccac

SEQ ID NO: 45853 - DNA, 17 bp, Homo sapiens
ccgacactttcccaacc

SEQ ID NO: 45854 - DNA, 21 bp, Homo sapiens
ccgggattttccccaacatcc

SEQ ID NO: 45855 - DNA, 19 bp, Homo sapiens
acaattttttttaaccacc

SEQ ID NO: 45856 - DNA, 18 bp, Homo sapiens
gcgcgctcccaaccgccc

SEQ ID NO: 45857 - DNA, 23 bp, Homo sapiens
cagcgattccaccgcaatcgccc

SEQ ID NO: 45858 - DNA, 18 bp, Homo sapiens
accaggtaacttcccaac

SEQ ID NO: 45859 - DNA, 20 bp, Homo sapiens
cccaggcacagcccaaccac

SEQ ID NO: 45860 - DNA, 21 bp, Homo sapiens
caggtgttttcccaactgtcc

SEQ ID NO: 45861 - DNA, 18 bp, Homo sapiens
acctgcaatcccagccac

SEQ ID NO: 45862 - DNA, 17 bp, Homo sapiens
cctgcaatcccaactac

SEQ ID NO: 45863 - DNA, 24 bp, Homo sapiens
ccggtggtgacgctccagttaccc

SEQ ID NO: 45864 - DNA, 19 bp, Homo sapiens
ggcttctctcccagccacc

SEQ ID NO: 45865 - DNA, 17 bp, Homo sapiens
cctgcaatcccagccac

SEQ ID NO: 45866 - DNA, 16 bp, Homo sapiens
ggttctccaaccaccc

SEQ ID NO: 45867 - DNA, 19 bp, Homo sapiens
gcgactttcttggccaccc

SEQ ID NO: 45868 - DNA, 20 bp, Homo sapiens
accctgggtttcccaaccac

SEQ ID NO: 45869 - DNA, 20 bp, Homo sapiens
ggttcctcctcccaactacc

SEQ ID NO: 45870 - DNA, 23 bp, Homo sapiens
accctgctaacacccaaccatcc

SEQ ID NO: 45871 - DNA, 18 bp, Homo sapiens
acccggcggtctctaccc

SEQ ID NO: 45872 - DNA, 26 bp, Homo sapiens
acccgtcgacccccgcctggccgccc

SEQ ID NO: 45873 - DNA, 21 bp, Homo sapiens
cctgcaactttcccaaccgcc

SEQ ID NO: 45874 - DNA, 18 bp, Homo sapiens
cggtccccccaaccaccc

SEQ ID NO: 45875 - DNA, 20 bp, Homo sapiens
cccggccctccccagctgcc

SEQ ID NO: 45876 - DNA, 18 bp, Homo sapiens
ccggcgactctagccacc

SEQ ID NO: 45877 - DNA, 23 bp, Homo sapiens
acctagtctagtctcaaccaccc

SEQ ID NO: 45878 - DNA, 19 bp, Homo sapiens
ggccgatttccagccatcc

SEQ ID NO: 45879 - DNA, 20 bp, Homo sapiens
cctggctccatccaaccacc

SEQ ID NO: 45880 - DNA, 20 bp, Homo sapiens
accgggcgattccggtgacc

SEQ ID NO: 45881 - DNA, 22 bp, Homo sapiens
ccggcgactcctccggccgccc

SEQ ID NO: 45882 - DNA, 17 bp, Homo sapiens
gcattttcccaactgcc

SEQ ID NO: 45883 - DNA, 19 bp, Homo sapiens
cagaattttcccaatcacc

SEQ ID NO: 45884 - DNA, 23 bp, Homo sapiens
ccaggcatgcatctcaaccaccc

SEQ ID NO: 45885 - DNA, 18 bp, Homo sapiens
accgggcacctcccaacc

SEQ ID NO: 45886 - DNA, 19 bp, Homo sapiens
acctcgtgatccaaccgcc

SEQ ID NO: 45887 - DNA, 21 bp, Homo sapiens
cctcgcccctcccagccaccc

SEQ ID NO: 45888 - DNA, 17 bp, Homo sapiens
ggcgatttccactaccc

SEQ ID NO: 45889 - DNA, 18 bp, Homo sapiens
cccggcggggcaaccacc

SEQ ID NO: 45890 - DNA, 18 bp, Homo sapiens
ggcgctttcccaccaccc

SEQ ID NO: 45891 - DNA, 19 bp, Homo sapiens
acctcgtgatccgaccacc

SEQ ID NO: 45892 - DNA, 20 bp, Homo sapiens
ggcaccactcccaaccaccc

SEQ ID NO: 45893 - DNA, 23 bp, Homo sapiens
acctagtgattttcccaattacc

SEQ ID NO: 45894 - DNA, 21 bp, Homo sapiens
accctgttttcccagccatcc

SEQ ID NO: 45895 - DNA, 22 bp, Homo sapiens
acccgcgattccacacgatcac

SEQ ID NO: 45896 - DNA, 16 bp, Homo sapiens
ccactttcccaaccac

SEQ ID NO: 45897 - DNA, 23 bp, Homo sapiens
ccgcggggctccctcagccatcc

SEQ ID NO: 45898 - DNA, 18 bp, Homo sapiens
gctgattttcccacaacc

SEQ ID NO: 45899 - DNA, 21 bp, Homo sapiens
cccaggtgcgtctaaccaccc

SEQ ID NO: 45900 - DNA, 126 bp, Vaccinia virus
ataattagaactagaaacatgtttagaaagaaacgattatttctgaattattccaattatttgtccaaacaggaaagaagtatactatcgtcatttttttctctatatccagctactgctgataat

SEQ ID NO: 45901 - DNA, 24 bp, Vaccinia virus
aaacaggaaagaagtatactatcg

SEQ ID NO: 45902 - DNA, 17 bp, Homo sapiens
aaacagggaaaagtaca

SEQ ID NO: 45903 - DNA, 17 bp, Homo sapiens
aaacaggaaaaaagata

SEQ ID NO: 45904 - DNA, 18 bp, Homo sapiens
ggacaggaaaggggcaca

SEQ ID NO: 45905 - DNA, 24 bp, Homo sapiens
aaaaaggaaagaaagagttactat

SEQ ID NO: 45906 - DNA, 23 bp, Homo sapiens
aaacaggagaaaagagtgaatcg

SEQ ID NO: 45907 - DNA, 23 bp, Homo sapiens
aacaggaaggaggtcagagcccg

SEQ ID NO: 45908 - DNA, 18 bp, Homo sapiens
acaggaaaggagaccctc

SEQ ID NO: 45909 - DNA, 21 bp, Homo sapiens
aaacaggaaagaaagttcact

SEQ ID NO: 45910 - DNA, 19 bp, Homo sapiens
aaacagaagagaacatact

SEQ ID NO: 45911 - DNA, 19 bp, Homo sapiens
caggaaagaccctagctat

SEQ ID NO: 45912 - DNA, 20 bp, Homo sapiens
caggaaagaaggaggctccg

SEQ ID NO: 45913 - DNA, 18 bp, Homo sapiens
ggaaagaaaataagctat

SEQ ID NO: 45914 - DNA, 19 bp, Homo sapiens
aaacagagaaaacaatact

SEQ ID NO: 45915 - DNA, 21 bp, Homo sapiens
aacagaaaaggagtgtcccat

SEQ ID NO: 45916 - DNA, 19 bp, Homo sapiens
aacaggaaagaatacaact

SEQ ID NO: 45917 - DNA, 17 bp, Homo sapiens
ggaaagaagtgacaacc

SEQ ID NO: 45918 - DNA, 22 bp, Homo sapiens
aaacaggggagaattcccttcg

SEQ ID NO: 45919 - DNA, 21 bp, Homo sapiens
aaacagtaaagagaatactat

SEQ ID NO: 45920 - DNA, 21 bp, Homo sapiens
ggacaggaaatgaggtaagct

SEQ ID NO: 45921 - DNA, 89 bp, Vaccinia virus
gaatgttccagagtgtttatccagggaaattaaagaagaagttaatatagacaattcttttgtattcatagacactcggttttttattc

SEQ ID NO: 45922 - DNA, 24 bp, Vaccinia virus
ttccagagtgtttatccagggaaa

SEQ ID NO: 45923 - DNA, 22 bp, Homo sapiens
tcccaggacactatctggggaa

SEQ ID NO: 45924 - DNA, 16 bp, Homo sapiens
tccagatgtctgggga

SEQ ID NO: 45925 - DNA, 18 bp, Homo sapiens
ttccggcagtccagggaa

SEQ ID NO: 45926 - DNA, 25 bp, Homo sapiens
ttccaaggaaaagaattcagggaaa

SEQ ID NO: 45927 - DNA, 19 bp, Homo sapiens
ctccaggtagatccaggga

SEQ ID NO: 45928 - DNA, 24 bp, Homo sapiens
ttcaagagtgtttatacgtagaaa

SEQ ID NO: 45929 - DNA, 20 bp, Homo sapiens
ttccaggaagggtttaggga

SEQ ID NO: 45930 - DNA, 19 bp, Homo sapiens
tccagagtcactcggggaa

SEQ ID NO: 45931 - DNA, 18 bp, Homo sapiens
tccagggtcatcggggaa

SEQ ID NO: 45932 - DNA, 19 bp, Homo sapiens
ttcctgaatcatccaggga

SEQ ID NO: 45933 - DNA, 19 bp, Homo sapiens
ttcctgctttgtccaggga

SEQ ID NO: 45934 - DNA, 15 bp, Homo sapiens
tccagaatccaggga

SEQ ID NO: 45935 - DNA, 18 bp, Homo sapiens
agaatgctgctagggaaa

SEQ ID NO: 45936 - DNA, 19 bp, Homo sapiens
ttccagaggccggtgggga

SEQ ID NO: 45937 - DNA, 20 bp, Homo sapiens
ttctaggtgtttacttagag

SEQ ID NO: 45938 - DNA, 19 bp, Homo sapiens
ttctcagttatccagggaa

SEQ ID NO: 45939 - DNA, 20 bp, Homo sapiens
ctccagggattccagggaaa

SEQ ID NO: 45940 - DNA, 21 bp, Homo sapiens
ttctagatgtttacacagaga

SEQ ID NO: 45941 - DNA, 19 bp, Homo sapiens
ttccaaagcatccagggaa

SEQ ID NO: 45942 - DNA, 21 bp, Homo sapiens
ttccagagggtgcagagggaa

SEQ ID NO: 45943 - DNA, 23 bp, Homo sapiens
tcctggagtgttttatggggaaa

SEQ ID NO: 45944 - DNA, 21 bp, Homo sapiens
tccagagtggcagtcggggga

SEQ ID NO: 45945 - DNA, 22 bp, Homo sapiens
ttccagagctgcctcggggaaa

SEQ ID NO: 45946 - DNA, 25 bp, Homo sapiens
tcctagagacatacatttgggggaa

SEQ ID NO: 45947 - DNA, 24 bp, Homo sapiens
tctagagaacaacattcagggaaa

SEQ ID NO: 45948 - DNA, 17 bp, Homo sapiens
ctctggagctccaggga

SEQ ID NO: 45949 - DNA, 17 bp, Homo sapiens
ttcctgctatccaggga

SEQ ID NO: 45950 - DNA, 16 bp, Homo sapiens
ttccagagtgcaggga

SEQ ID NO: 45951 - DNA, 18 bp, Homo sapiens
ccagcgtgtccgggggaa

SEQ ID NO: 45952 - DNA, 19 bp, Homo sapiens
ctccagaggctctagggaa

SEQ ID NO: 45953 - DNA, 22 bp, Homo sapiens
ttcgagggtggaggccagggaa

SEQ ID NO: 45954 - DNA, 22 bp, Homo sapiens
ttccaagtgtttgtgcaatggg

SEQ ID NO: 45955 - DNA, 18 bp, Homo sapiens
ttccagagctccagggaa

SEQ ID NO: 45956 - DNA, 22 bp, Homo sapiens
ttccagaggttgcttctgggga

SEQ ID NO: 45957 - DNA, 17 bp, Homo sapiens
tccagcttgtccaggga

SEQ ID NO: 45958 - DNA, 20 bp, Homo sapiens
ttccagcgtgacccagggaa

SEQ ID NO: 45959 - DNA, 18 bp, Homo sapiens
ttccagtgtccccaggga

SEQ ID NO: 45960 - DNA, 17 bp, Homo sapiens
gagtgtttacaaagaaa

SEQ ID NO: 45961 - DNA, 23 bp, Homo sapiens
ttccagagatgtttagacttggg

SEQ ID NO: 45962 - DNA, 22 bp, Homo sapiens
ttccaaagtcgaactccaggga

SEQ ID NO: 45963 - DNA, 82 bp, Melanoplus sanguinipes entomopoxvirus
taaagctgattgtataaatttactattaatacctaattgaccactaataataaattttttatcattaatataattagtttta

SEQ ID NO: 45964 - DNA, 24 bp, Melanoplus sanguinipes entomopoxvirus
aagctgattgtataaatttactat

SEQ ID NO: 45965 - DNA, 20 bp, Homo sapiens
gctgtttgttttcttactat

SEQ ID NO: 45966 - DNA, 18 bp, Homo sapiens
aagctgattgtgtaactc

SEQ ID NO: 45967 - DNA, 17 bp, Homo sapiens
gctgatccaaatttact

SEQ ID NO: 45968 - DNA, 19 bp, Homo sapiens
aactggctacaaatttact

SEQ ID NO: 45969 - DNA, 18 bp, Homo sapiens
aagctgattgatgtaaat

SEQ ID NO: 45970 - DNA, 19 bp, Homo sapiens
gctctcataaatttactat

SEQ ID NO: 45971 - DNA, 19 bp, Homo sapiens
aagctgattgtgtcaatct

SEQ ID NO: 45972 - DNA, 16 bp, Homo sapiens
tgattataatttacta

SEQ ID NO: 45973 - DNA, 82 bp, Camelpox virus
gcgaggatgactctcaaattattacactcacggcattcgttaaccaatgcctatggtgtcataaacgagtatccgtgtccgc

SEQ ID NO: 45974 - DNA, 24 bp, Camelpox virus
tattacactcacggcattcgttaa

SEQ ID NO: 45975 - DNA, 21 bp, Homo sapiens
tattacattcgcgagctccat

SEQ ID NO: 45976 - DNA, 78 bp, Equine herpesvirus 2
ggctgcgggacagtgatggagatgatggtggcccagagggaccacctgcgcgtgtcccacgtgtccccctttgcggtc

SEQ ID NO: 45977 - DNA, 24 bp, Equine herpesvirus 2
atggagatgatggtggcccagagg

SEQ ID NO: 45978 - DNA, 20 bp, Homo sapiens
tggagatggaggtcccgagg

SEQ ID NO: 45979 - DNA, 22 bp, Homo sapiens
atgcagatggtggtgggaacgg

SEQ ID NO: 45980 - DNA, 16 bp, Homo sapiens
tgaagggtggcccagg

SEQ ID NO: 45981 - DNA, 22 bp, Homo sapiens
atggtggtggtggtggtgatgg

SEQ ID NO: 45982 - DNA, 22 bp, Homo sapiens
tggggatggtggcttcgggagg

SEQ ID NO: 45983 - DNA, 25 bp, Homo sapiens
tggagatgaatggggaaaacagagg

SEQ ID NO: 45984 - DNA, 18 bp, Homo sapiens
tggagatggagcttggag

SEQ ID NO: 45985 - DNA, 16 bp, Homo sapiens
ggagggtggcccagag

SEQ ID NO: 45986 - DNA, 16 bp, Homo sapiens
atggggacgatgggga

SEQ ID NO: 45987 - DNA, 17 bp, Homo sapiens
ggaggtgatggtgggag

SEQ ID NO: 45988 - DNA, 20 bp, Homo sapiens
tgggtggtggagcctcaggg

SEQ ID NO: 45989 - DNA, 19 bp, Homo sapiens
tggggggtggtggccaggg

SEQ ID NO: 45990 - DNA, 20 bp, Homo sapiens
tggtggtggtatcccagagg

SEQ ID NO: 45991 - DNA, 17 bp, Homo sapiens
tggagaatgatggggag

SEQ ID NO: 45992 - DNA, 21 bp, Homo sapiens
atggagggttctgcccagagg

SEQ ID NO: 45993 - DNA, 18 bp, Homo sapiens
atggaaatggctttagag

SEQ ID NO: 45994 - DNA, 15 bp, Homo sapiens
atggagatgggtaga

SEQ ID NO: 45995 - DNA, 21 bp, Homo sapiens
tgcagatgatgctgttggagg

SEQ ID NO: 45996 - DNA, 21 bp, Homo sapiens
ggggaagaagtggcccagagg

SEQ ID NO: 45997 - DNA, 18 bp, Homo sapiens
atggagatggggcaggag

SEQ ID NO: 45998 - DNA, 22 bp, Homo sapiens
ggagatggtggtgatgatgagg

SEQ ID NO: 45999 - DNA, 18 bp, Homo sapiens
atgtgagatggtggagag

SEQ ID NO: 46000 - DNA, 18 bp, Homo sapiens
tggtgatggtggctggag

SEQ ID NO: 46001 - DNA, 20 bp, Homo sapiens
ggagtggggtggcccggagg

SEQ ID NO: 46002 - DNA, 15 bp, Homo sapiens
tggagatggcccagg

SEQ ID NO: 46003 - DNA, 25 bp, Homo sapiens
tggagatggatgcgtggcctggagg

SEQ ID NO: 46004 - DNA, 19 bp, Homo sapiens
tggaggtggctcccagagg

SEQ ID NO: 46005 - DNA, 22 bp, Homo sapiens
tggcctacatggtggcccaggg

SEQ ID NO: 46006 - DNA, 23 bp, Homo sapiens
atggagatgctggctcagggagg

SEQ ID NO: 46007 - DNA, 20 bp, Homo sapiens
tgggtgactgcacccagagg

SEQ ID NO: 46008 - DNA, 22 bp, Homo sapiens
atggtgatggtggaggtagagg

SEQ ID NO: 46009 - DNA, 20 bp, Homo sapiens
atggcggtggtggtgagaag

SEQ ID NO: 46010 - DNA, 20 bp, Homo sapiens
tgaaggacctggcccagagg

SEQ ID NO: 46011 - DNA, 20 bp, Homo sapiens
tggagatgctgaagcggagg

SEQ ID NO: 46012 - DNA, 20 bp, Homo sapiens
tggggaaggctccccagagg

SEQ ID NO: 46013 - DNA, 20 bp, Homo sapiens
tggggcatgtggcccagagg

SEQ ID NO: 46014 - DNA, 19 bp, Homo sapiens
atggagatggtgtgtgcag

SEQ ID NO: 46015 - DNA, 18 bp, Homo sapiens
tggagggatggtggggag

SEQ ID NO: 46016 - DNA, 24 bp, Homo sapiens
tgtggatggtggtgacgttggagg

SEQ ID NO: 46017 - DNA, 22 bp, Homo sapiens
ggggatggtggttgggtggagg

SEQ ID NO: 46018 - DNA, 24 bp, Homo sapiens
atggagatggtggtggtggggagg

SEQ ID NO: 46019 - DNA, 22 bp, Homo sapiens
tggagaggtagagccccagagg

SEQ ID NO: 46020 - DNA, 18 bp, Homo sapiens
atggggatggaggtagag

SEQ ID NO: 46021 - DNA, 27 bp, Homo sapiens
tggaggtggtggtggttctgcctctgg

SEQ ID NO: 46022 - DNA, 17 bp, Homo sapiens
tggaggctggcccagag

SEQ ID NO: 46023 - DNA, 21 bp, Homo sapiens
gagactgtggtggtttggagg

SEQ ID NO: 46024 - DNA, 17 bp, Homo sapiens
tggagcgtggcccagag

SEQ ID NO: 46025 - DNA, 22 bp, Homo sapiens
tggagatgaccagactccaggg

SEQ ID NO: 46026 - DNA, 17 bp, Homo sapiens
tggtgatgatggtggtg

SEQ ID NO: 46027 - DNA, 21 bp, Homo sapiens
ggagatggccccacccagagg

SEQ ID NO: 46028 - DNA, 16 bp, Homo sapiens
atggtgatgatggaga

SEQ ID NO: 46029 - DNA, 19 bp, Homo sapiens
tggaaatgcaggcctaggg

SEQ ID NO: 46030 - DNA, 24 bp, Homo sapiens
tggtgatggtggtggtagtagagg

SEQ ID NO: 46031 - DNA, 21 bp, Homo sapiens
tggagatgaggggcttagagg

SEQ ID NO: 46032 - DNA, 21 bp, Homo sapiens
atgggggatggtggcaagtgg

SEQ ID NO: 46033 - DNA, 20 bp, Homo sapiens
atggagatggtgatgaaggg

SEQ ID NO: 46034 - DNA, 18 bp, Homo sapiens
ggaggtgatggtggtgcc

SEQ ID NO: 46035 - DNA, 19 bp, Homo sapiens
tggtcctggtggcccaggg

SEQ ID NO: 46036 - DNA, 21 bp, Homo sapiens
tggtgatggtggtggtgatgg

SEQ ID NO: 46037 - DNA, 25 bp, Homo sapiens
tggtggtgatggtggtgatgggagg

SEQ ID NO: 46038 - DNA, 17 bp, Homo sapiens
tggggatggtggtggag

SEQ ID NO: 46039 - DNA, 16 bp, Homo sapiens
gagagatgacccagag

SEQ ID NO: 46040 - DNA, 20 bp, Homo sapiens
tggtggtggtggtgctgagg

SEQ ID NO: 46041 - DNA, 78 bp, Cowpox virus
agaaagaaacgattatttctgaattattccaattatttgaacaaacaggaaagaagtatactatcgtcatttttttct

SEQ ID NO: 46042 - DNA, 70 bp, Camelpox virus
ggatgactctcaaattattacactcacggcattcgttaaccaatgcctatggtgtcataaacgagtatcc

SEQ ID NO: 46043 - DNA, 66 bp, Fowl adenovirus D
gtcgcaggcccagtagagcgccgggttctccgggtcgaacgtgagccgtgtgtgcgggcccttgat

SEQ ID NO: 46044 - DNA, 24 bp, Fowl adenovirus D
gcccagtagagcgccgggttctcc

SEQ ID NO: 46045 - DNA, 30 bp, Homo sapiens
gcccagtacggtgcggccttcggagaaccc

SEQ ID NO: 46046 - DNA, 20 bp, Homo sapiens
gcccggggagcgccgcgtcc

SEQ ID NO: 46047 - DNA, 18 bp, Homo sapiens
acccagagccgggttttc

SEQ ID NO: 46048 - DNA, 24 bp, Homo sapiens
gcccagagcctctccgggttctcc

SEQ ID NO: 46049 - DNA, 19 bp, Homo sapiens
gcccagtaggctgctatct

SEQ ID NO: 46050 - DNA, 25 bp, Homo sapiens
gcctggtagaacgctgacaaattcc

SEQ ID NO: 46051 - DNA, 16 bp, Homo sapiens
gcccagcagggcttct

SEQ ID NO: 46052 - DNA, 17 bp, Homo sapiens
ccagtaaagtccattct

SEQ ID NO: 46053 - DNA, 26 bp, Homo sapiens
agtagagcatattttttggagaaccc

SEQ ID NO: 46054 - DNA, 18 bp, Homo sapiens
gtggagcaagagttctcc

SEQ ID NO: 46055 - DNA, 23 bp, Homo sapiens
gcccagtagaggctgctggagac

SEQ ID NO: 46056 - DNA, 19 bp, Homo sapiens
agtagagatggggttctcc

SEQ ID NO: 46057 - DNA, 22 bp, Homo sapiens
gcctagatcctctgggttctcc

SEQ ID NO: 46058 - DNA, 26 bp, Homo sapiens
cccagtggggtgcgctctggagaacc

SEQ ID NO: 46059 - DNA, 18 bp, Homo sapiens
acccagtagagacgttct

SEQ ID NO: 46060 - DNA, 19 bp, Homo sapiens
cctcaggggccgggttttc

SEQ ID NO: 46061 - DNA, 21 bp, Homo sapiens
ccagtagagtctccaggctct

SEQ ID NO: 46062 - DNA, 23 bp, Homo sapiens
gcttagtaaagcaaattgttctc

SEQ ID NO: 46063 - DNA, 20 bp, Homo sapiens
gcccagtagagcttgggacc

SEQ ID NO: 46064 - DNA, 20 bp, Homo sapiens
gcacagtagggcgccgggcc

SEQ ID NO: 46065 - DNA, 21 bp, Homo sapiens
gctcagtgggatgcaggctct

SEQ ID NO: 46066 - DNA, 21 bp, Homo sapiens
gcccagtggggccccttctcc

SEQ ID NO: 46067 - DNA, 18 bp, Homo sapiens
ccagccccgccgggttct

SEQ ID NO: 46068 - DNA, 19 bp, Homo sapiens
gcccagcagagtgctgggt

SEQ ID NO: 46069 - DNA, 24 bp, Homo sapiens
gctcagcggggcgccgagggctcc

SEQ ID NO: 46070 - DNA, 23 bp, Homo sapiens
gcctggtgggcgccaaaccgtcc

SEQ ID NO: 46071 - DNA, 16 bp, Homo sapiens
gcccagtggggtcccc

SEQ ID NO: 46072 - DNA, 19 bp, Homo sapiens
ccagaggggtaggttctcc

SEQ ID NO: 46073 - DNA, 23 bp, Homo sapiens
gcccagtaaagctgacgtttttc

SEQ ID NO: 46074 - DNA, 20 bp, Homo sapiens
gcccagtagggcgtcgttgg

SEQ ID NO: 46075 - DNA, 18 bp, Homo sapiens
cccagtagagtgcattct

SEQ ID NO: 46076 - DNA, 21 bp, Homo sapiens
gcacggtggagcgccagcgtc

SEQ ID NO: 46077 - DNA, 20 bp, Homo sapiens
gcctgtggagaggggttctc

SEQ ID NO: 46078 - DNA, 17 bp, Homo sapiens
cccagtcccgggttctc

SEQ ID NO: 46079 - DNA, 18 bp, Homo sapiens
gccctagtagaggttctc

SEQ ID NO: 46080 - DNA, 25 bp, Homo sapiens
gcccagtagaagcgtcgctggagac

SEQ ID NO: 46081 - DNA, 19 bp, Homo sapiens
gcccagtacagcgctattc

SEQ ID NO: 46082 - DNA, 19 bp, Homo sapiens
caggtgggccaggttctcc

SEQ ID NO: 46083 - DNA, 18 bp, Homo sapiens
ccagtggaggctggatcc

SEQ ID NO: 46084 - DNA, 21 bp, Homo sapiens
ccagtagaggcttccggagac

SEQ ID NO: 46085 - DNA, 76 bp, Gallid herpesvirus 3
ggcccgcgcacaacaaatcgcggattacttaactgcatccatgcaagcactgactgtgatagaatacgatagggcc

SEQ ID NO: 46086 - DNA, 22 bp, Gallid herpesvirus 3
tgtgatagaatacgatagggcc

SEQ ID NO: 46087 - DNA, 19 bp, Homo sapiens
gtggtagaatacagcatgc

SEQ ID NO: 46088 - DNA, 17 bp, Homo sapiens
tgtgtcagtgatagggc

SEQ ID NO: 46089 - DNA, 19 bp, Homo sapiens
tgtggggagaaacagggcc

SEQ ID NO: 46090 - DNA, 16 bp, Homo sapiens
tggatagtaatagggc

SEQ ID NO: 46091 - DNA, 21 bp, Homo sapiens
tgttatagaatacaacatgcc

SEQ ID NO: 46092 - DNA, 17 bp, Homo sapiens
tgtgatggaatacaagg

SEQ ID NO: 46093 - DNA, 21 bp, Homo sapiens
tgtggtaaaacaccaagggcc

SEQ ID NO: 46094 - DNA, 17 bp, Homo sapiens
tgtggggaatacaaagc

SEQ ID NO: 46095 - DNA, 18 bp, Homo sapiens
tgtagtggaagatagggc

SEQ ID NO: 46096 - DNA, 17 bp, Homo sapiens
tgtgaggaggacagggc

SEQ ID NO: 46097 - DNA, 21 bp, Homo sapiens
gtgatggggtaagacagggcc

SEQ ID NO: 46098 - DNA, 21 bp, Homo sapiens
tgttgtagcagccgatagggc

SEQ ID NO: 46099 - DNA, 19 bp, Homo sapiens
tgtgataaatataagtggg

SEQ ID NO: 46100 - DNA, 22 bp, Homo sapiens
tgtggtaagaacatatagggcc

SEQ ID NO: 46101 - DNA, 17 bp, Homo sapiens
tgtgatagaaaatgggc

SEQ ID NO: 46102 - DNA, 20 bp, Homo sapiens
tgtgataagtgccaaggggc

SEQ ID NO: 46103 - DNA, 20 bp, Homo sapiens
tgtttttaatatgatagggc

SEQ ID NO: 46104 - DNA, 16 bp, Homo sapiens
tgtgtgaagatagggc

SEQ ID NO: 46105 - DNA, 18 bp, Homo sapiens
tgtgtagaatactcaagg

SEQ ID NO: 46106 - DNA, 19 bp, Homo sapiens
gtgatagatgcactggggc

SEQ ID NO: 46107 - DNA, 19 bp, Homo sapiens
tgtatagaacatcagggcc

SEQ ID NO: 46108 - DNA, 17 bp, Homo sapiens
tgtgaggagaatagggc

SEQ ID NO: 46109 - DNA, 20 bp, Homo sapiens
tgtgatagaaaacgtgatgg

SEQ ID NO: 46110 - DNA, 22 bp, Homo sapiens
tgtggtggaaaaacacagggcc

SEQ ID NO: 46111 - DNA, 16 bp, Homo sapiens
tgtgatagaacgaggg

SEQ ID NO: 46112 - DNA, 21 bp, Homo sapiens
tgtgataggagggatcaggcc

SEQ ID NO: 46113 - DNA, 86 bp, Fowl adenovirus D
gcgtaatgggcgtggtcatcctcggctatataagggggcgcgtcgagcgcttcctgcagttggtgatcgacttccgccagggacgc

SEQ ID NO: 46114 - DNA, 24 bp, Fowl adenovirus D
ctgcagttggtgatcgacttccgc

SEQ ID NO: 46115 - DNA, 16 bp, Homo sapiens
ctgcagttgggatact

SEQ ID NO: 46116 - DNA, 21 bp, Homo sapiens
ctgcagttgctggtaggccgc

SEQ ID NO: 46117 - DNA, 18 bp, Homo sapiens
cagaagatcgacttccgc

SEQ ID NO: 46118 - DNA, 21 bp, Homo sapiens
ctgcagctggtggagtcatct

SEQ ID NO: 46119 - DNA, 21 bp, Homo sapiens
tgtagttggtggtccgggcgc

SEQ ID NO: 46120 - DNA, 17 bp, Homo sapiens
ctgctgttggtaacttc

SEQ ID NO: 46121 - DNA, 20 bp, Homo sapiens
ctgcagttgctggtgctact

SEQ ID NO: 46122 - DNA, 21 bp, Homo sapiens
ctgcagttggaggtctggccg

SEQ ID NO: 46123 - DNA, 78 bp, Gallid herpesvirus 3
atttcttctccgtgttgcagatctatgatattggtgcgatggtcacgagccaagacgtttacaagtcggaggaggagt

SEQ ID NO: 46124 - DNA, 24 bp, Gallid herpesvirus 3
agccaagacgtttacaagtcggag

SEQ ID NO: 46125 - DNA, 18 bp, Homo sapiens
agccaaggtgttttagcc

SEQ ID NO: 46126 - DNA, 22 bp, Homo sapiens
agccgagctgtttataattcga

SEQ ID NO: 46127 - DNA, 18 bp, Homo sapiens
agccaagatgttgcaaat

SEQ ID NO: 46128 - DNA, 21 bp, Homo sapiens
gccaggtgccgagagtcggag

SEQ ID NO: 46129 - DNA, 22 bp, Homo sapiens
agccgaaggtaaggagtcggag

SEQ ID NO: 46130 - DNA, 21 bp, Homo sapiens
ccgagaattgatgagtcggag

SEQ ID NO: 46131 - DNA, 24 bp, Homo sapiens
agccaagatgattttcagtcggag

SEQ ID NO: 46132 - DNA, 18 bp, Homo sapiens
agtcaagatatttacaaa

SEQ ID NO: 46133 - DNA, 21 bp, Homo sapiens
agctagacgtttgtggtgcag

SEQ ID NO: 46134 - DNA, 18 bp, Homo sapiens
gctaagacatttgtaatc

SEQ ID NO: 46135 - DNA, 20 bp, Homo sapiens
agccaaacaccaggagttgg

SEQ ID NO: 46136 - DNA, 66 bp, Fowl adenovirus D
ccctctccttcatgcgccgataccccgactcggtgacgaagaggctgtcggtgtccccgtagaggg

SEQ ID NO: 46137 - DNA, 24 bp, Fowl adenovirus D
aagaggctgtcggtgtccccgtag

SEQ ID NO: 46138 - DNA, 19 bp, Homo sapiens
aagacgctggggtccccgt

SEQ ID NO: 46139 - DNA, 17 bp, Homo sapiens
aagggctgagtccccgt

SEQ ID NO: 46140 - DNA, 17 bp, Homo sapiens
ggctgtcatccttgtag

SEQ ID NO: 46141 - DNA, 27 bp, Homo sapiens
aagagactgttctctaagtccctgtag

SEQ ID NO: 46142 - DNA, 25 bp, Homo sapiens
aagaggctctccattttctttgtag

SEQ ID NO: 46143 - DNA, 18 bp, Homo sapiens
gaggctgtgacaccccgt

SEQ ID NO: 46144 - DNA, 22 bp, Homo sapiens
aggtgcctggtggtgtccctgt

SEQ ID NO: 46145 - DNA, 21 bp, Homo sapiens
aggggttaagcctgtccccgt

SEQ ID NO: 46146 - DNA, 17 bp, Homo sapiens
agaggctggctccctgt

SEQ ID NO: 46147 - DNA, 19 bp, Homo sapiens
gaagctgtcggtgaagtag

SEQ ID NO: 46148 - DNA, 20 bp, Homo sapiens
gaggtcgccggtgtcttcgt

SEQ ID NO: 46149 - DNA, 23 bp, Homo sapiens
aaaggctgtctgtaggtccccgt

SEQ ID NO: 46150 - DNA, 19 bp, Homo sapiens
gaggctgcagcgcccgtag

SEQ ID NO: 46151 - DNA, 17 bp, Homo sapiens
gaggctgttgtcttgta

SEQ ID NO: 46152 - DNA, 78 bp, Gallid herpesvirus 3
agagctgtcgcgaagtattcgctccgtgcgggtaacgccgaaatagacttagcgcccgaggagttttcgtacggctct

SEQ ID NO: 46153 - DNA, 24 bp, Gallid herpesvirus 3
tcgcgaagtattcgctccgtgcgg

SEQ ID NO: 46154 - DNA, 22 bp, Homo sapiens
tcccgggcgccgctccgtgtgg

SEQ ID NO: 46155 - DNA, 21 bp, Homo sapiens
tcgcgaaatgatcctgtgtgg

SEQ ID NO: 46156 - DNA, 20 bp, Homo sapiens
tcatgaagtatttgccggcc

SEQ ID NO: 46157 - DNA, 63 bp, Fowl adenovirus D
gatgtagtagacgttggcgcggatgggatctcccttggccgccttgaagtgggtcttggcatc

SEQ ID NO: 46158 - DNA, 24 bp, Fowl adenovirus D
tagtagacgttggcgcggatggga

SEQ ID NO: 46159 - DNA, 16 bp, Homo sapiens
gtaatgttaggatggg

SEQ ID NO: 46160 - DNA, 18 bp, Homo sapiens
gagctggtgtggatggga

SEQ ID NO: 46161 - DNA, 23 bp, Homo sapiens
tagtgcattaatagtggatggga

SEQ ID NO: 46162 - DNA, 127 bp, Fowl adenovirus D
gtacgcggtgaaggtaagttgcttccaaaaggcgtgggtgttgctgggaatggtgggtcgcaggaaaatgttaaagtcgccgtgcatgccgagttcgtctttgaagtacttgtcgtaactgtcgtac

SEQ ID NO: 46163 - DNA, 24 bp, Fowl adenovirus D
ttcgtctttgaagtacttgtcgta

SEQ ID NO: 46164 - DNA, 18 bp, Homo sapiens
ttcctctttgaagtttgt

SEQ ID NO: 46165 - DNA, 110 bp, Fowl adenovirus D
gtcgctgggcgcgacgactcctcgcgcccacctgtgaagccgcgtggggtcctttttatcgtagttggggttgggcaggtggaagaggacgtcgttaaagaggaggcggc

SEQ ID NO: 46166 - DNA, 24 bp, Fowl adenovirus D
tggaagaggacgtcgttaaagagg

SEQ ID NO: 46167 - DNA, 23 bp, Homo sapiens
tggaagagcacagatgaaagagg

SEQ ID NO: 46168 - DNA, 22 bp, Homo sapiens
tgggggagacaccagggagagg

SEQ ID NO: 46169 - DNA, 22 bp, Homo sapiens
tggagaaggacgagcaaagagg

SEQ ID NO: 46170 - DNA, 19 bp, Homo sapiens
tgggaggggaagtcgtcaa

SEQ ID NO: 46171 - DNA, 20 bp, Homo sapiens
tggaaaagggaaataaaggg

SEQ ID NO: 46172 - DNA, 25 bp, Homo sapiens
gggggaggacgtcttaaaagggagg

SEQ ID NO: 46173 - DNA, 19 bp, Homo sapiens
gagaaagctgttaaagagg

SEQ ID NO: 46174 - DNA, 24 bp, Homo sapiens
ggaggagggcgaagccaagggagg

SEQ ID NO: 46175 - DNA, 21 bp, Homo sapiens
gggagaggacagcggaggagg

SEQ ID NO: 46176 - DNA, 17 bp, Homo sapiens
ggaagaggacaaaagag

SEQ ID NO: 46177 - DNA, 18 bp, Homo sapiens
tggaagaggatggtggtt

SEQ ID NO: 46178 - DNA, 23 bp, Homo sapiens
tgggggagggcctgtcccagagg

SEQ ID NO: 46179 - DNA, 21 bp, Homo sapiens
tgggaggaggtgccaaagagg

SEQ ID NO: 46180 - DNA, 19 bp, Homo sapiens
tggaagaagggtaaagaag

SEQ ID NO: 46181 - DNA, 23 bp, Homo sapiens
gggagaggacgacaccaaggagg

SEQ ID NO: 46182 - DNA, 21 bp, Homo sapiens
cggggaggaacactagggagg

SEQ ID NO: 46183 - DNA, 21 bp, Homo sapiens
tggaagggaaataaatagagg

SEQ ID NO: 46184 - DNA, 16 bp, Homo sapiens
gggagaggacacagag

SEQ ID NO: 46185 - DNA, 21 bp, Homo sapiens
tgggtgagggccagggagagg

SEQ ID NO: 46186 - DNA, 19 bp, Homo sapiens
tggaggggagggtaaagag

SEQ ID NO: 46187 - DNA, 17 bp, Homo sapiens
gaggagtggttaaagag

SEQ ID NO: 46188 - DNA, 22 bp, Homo sapiens
tgggagagggacaatggggagg

SEQ ID NO: 46189 - DNA, 25 bp, Homo sapiens
gaagaggatgttgagttgcaggagg

SEQ ID NO: 46190 - DNA, 19 bp, Homo sapiens
tggaagaggatgctgttaa

SEQ ID NO: 46191 - DNA, 20 bp, Homo sapiens
tgggagagggtgcaaagaga

SEQ ID NO: 46192 - DNA, 16 bp, Homo sapiens
tggaagaagggttgag

SEQ ID NO: 46193 - DNA, 23 bp, Homo sapiens
tggaagagagtgcatcagagagg

SEQ ID NO: 46194 - DNA, 22 bp, Homo sapiens
tggggaaggatggcgggagagg

SEQ ID NO: 46195 - DNA, 17 bp, Homo sapiens
tggaagagaggcaagag

SEQ ID NO: 46196 - DNA, 17 bp, Homo sapiens
tggaagggaaccaaagg

SEQ ID NO: 46197 - DNA, 20 bp, Homo sapiens
ggaagagggtgggcaaaggg

SEQ ID NO: 46198 - DNA, 19 bp, Homo sapiens
tggaagaggagctcgggag

SEQ ID NO: 46199 - DNA, 22 bp, Homo sapiens
ggaagaggaaaatgcttgaagg

SEQ ID NO: 46200 - DNA, 19 bp, Homo sapiens
tgggggaagggccggagag

SEQ ID NO: 46201 - DNA, 23 bp, Homo sapiens
tgagagagggtgccccaaagagg

SEQ ID NO: 46202 - DNA, 24 bp, Homo sapiens
ggaagggggcgggacgtggagagg

SEQ ID NO: 46203 - DNA, 25 bp, Homo sapiens
tgggaggacgttgccattcaggagg

SEQ ID NO: 46204 - DNA, 20 bp, Homo sapiens
tggaaggggacaaagagagg

SEQ ID NO: 46205 - DNA, 19 bp, Homo sapiens
tggagagggctgaaaggag

SEQ ID NO: 46206 - DNA, 17 bp, Homo sapiens
tggaagaggcacaaagg

SEQ ID NO: 46207 - DNA, 19 bp, Homo sapiens
tggaagaagggttgggagg

SEQ ID NO: 46208 - DNA, 21 bp, Homo sapiens
tgggaggaggtcggggagagg

SEQ ID NO: 46209 - DNA, 24 bp, Homo sapiens
tgggggtgggatcagttaaagagg

SEQ ID NO: 46210 - DNA, 23 bp, Homo sapiens
tggaggaggaggaagggaaaggg

SEQ ID NO: 46211 - DNA, 23 bp, Homo sapiens
tggaagagacggacaccgggagg

SEQ ID NO: 46212 - DNA, 96 bp, Murid herpesvirus 4
ggttgtgtcatgacgggcttcagtccattaagtggatgctgtcacctactgagtgccaccttccacagtgggcgtggcagccacatcaagcatacc

SEQ ID NO: 46213 - DNA, 24 bp, Murid herpesvirus 4
tccacagtgggcgtggcagccaca

SEQ ID NO: 46214 - DNA, 17 bp, Homo sapiens
tccaggtcgatggcagc

SEQ ID NO: 46215 - DNA, 18 bp, Homo sapiens
cagtgggctatggtcaca

SEQ ID NO: 46216 - DNA, 20 bp, Homo sapiens
tctacagcgaatagcagcca

SEQ ID NO: 46217 - DNA, 15 bp, Homo sapiens
cagtggacacagcca

SEQ ID NO: 46218 - DNA, 22 bp, Homo sapiens
tctacagtgggtatcacgtggc

SEQ ID NO: 46219 - DNA, 19 bp, Homo sapiens
tccaagtgccagcagccac

SEQ ID NO: 46220 - DNA, 18 bp, Homo sapiens
tccacagtgaaatggtgg

SEQ ID NO: 46221 - DNA, 17 bp, Homo sapiens
tccacagtgggacgcca

SEQ ID NO: 46222 - DNA, 20 bp, Homo sapiens
cacagtggggacaaagctgc

SEQ ID NO: 46223 - DNA, 18 bp, Homo sapiens
tccacgtggcacggttgc

SEQ ID NO: 46224 - DNA, 20 bp, Homo sapiens
cacaatgggcaggcgccaca

SEQ ID NO: 46225 - DNA, 20 bp, Homo sapiens
gtggcttcatggcagccaca

SEQ ID NO: 46226 - DNA, 16 bp, Homo sapiens
tccacagggtcagcca

SEQ ID NO: 46227 - DNA, 22 bp, Homo sapiens
cactagacatgtggtggtcaca

SEQ ID NO: 46228 - DNA, 15 bp, Homo sapiens
cagtggaaacagcca

SEQ ID NO: 46229 - DNA, 19 bp, Homo sapiens
tcccagtagcggcggctgc

SEQ ID NO: 46230 - DNA, 21 bp, Homo sapiens
tccatggtgggtgaggggcca

SEQ ID NO: 46231 - DNA, 23 bp, Homo sapiens
cacagtgagaatctacagctgca

SEQ ID NO: 46232 - DNA, 19 bp, Homo sapiens
tctgcaggggaggggccac

SEQ ID NO: 46233 - DNA, 19 bp, Homo sapiens
gcgggagttggcagctgca

SEQ ID NO: 46234 - DNA, 17 bp, Homo sapiens
tcctggtgggcgtgcaa

SEQ ID NO: 46235 - DNA, 18 bp, Homo sapiens
cccatgggtggcagccac

SEQ ID NO: 46236 - DNA, 20 bp, Homo sapiens
cccacagtggtgatggccgc

SEQ ID NO: 46237 - DNA, 19 bp, Homo sapiens
cacagtggtgttagccaca

SEQ ID NO: 46238 - DNA, 19 bp, Homo sapiens
cacagggcagccggcagcc

SEQ ID NO: 46239 - DNA, 20 bp, Homo sapiens
acagctcagtggcagctgca

SEQ ID NO: 46240 - DNA, 17 bp, Homo sapiens
tccagctgtggcagccc

SEQ ID NO: 46241 - DNA, 19 bp, Homo sapiens
cagggatgtggcagctgca

SEQ ID NO: 46242 - DNA, 18 bp, Homo sapiens
catatgggcgtggtcaac

SEQ ID NO: 46243 - DNA, 23 bp, Homo sapiens
tcctggtgtcgggggcagccaca

SEQ ID NO: 46244 - DNA, 20 bp, Homo sapiens
cacagtgggtcctcgggcca

SEQ ID NO: 46245 - DNA, 19 bp, Homo sapiens
tcccagtgaatgcagccac

SEQ ID NO: 46246 - DNA, 17 bp, Homo sapiens
tccctggtcacggcagc

SEQ ID NO: 46247 - DNA, 23 bp, Homo sapiens
tccacagcggctctctagctaca

SEQ ID NO: 46248 - DNA, 17 bp, Homo sapiens
cacagtagggtgtaagc

SEQ ID NO: 46249 - DNA, 18 bp, Homo sapiens
tcctggtggtggcagcca

SEQ ID NO: 46250 - DNA, 20 bp, Homo sapiens
tccaggtgggcgctgacgcc

SEQ ID NO: 46251 - DNA, 18 bp, Homo sapiens
tcccagtggcgcagccgc

SEQ ID NO: 46252 - DNA, 18 bp, Homo sapiens
gtggccatggcagttaca

SEQ ID NO: 46253 - DNA, 18 bp, Homo sapiens
tccacgttgggcagccac

SEQ ID NO: 46254 - DNA, 23 bp, Homo sapiens
cccacagtggcatggcggctgca

SEQ ID NO: 46255 - DNA, 18 bp, Homo sapiens
atggtggcgacagccgca

SEQ ID NO: 46256 - DNA, 22 bp, Homo sapiens
tccacagctcgctggtggttgc

SEQ ID NO: 46257 - DNA, 16 bp, Homo sapiens
acagtgggtggcatcc

SEQ ID NO: 46258 - DNA, 19 bp, Homo sapiens
tccacggtgggcgcctcca

SEQ ID NO: 46259 - DNA, 19 bp, Homo sapiens
tccacagtggacctggtca

SEQ ID NO: 46260 - DNA, 19 bp, Homo sapiens
gtggagggggtcagccaca

SEQ ID NO: 46261 - DNA, 20 bp, Homo sapiens
tccacagttggcgtgggcca

SEQ ID NO: 46262 - DNA, 20 bp, Homo sapiens
cacagggcgtggcagccaca

SEQ ID NO: 46263 - DNA, 19 bp, Homo sapiens
tcctagtgggcatgtgcca

SEQ ID NO: 46264 - DNA, 20 bp, Homo sapiens
caccgggtgtggcagccaca

SEQ ID NO: 46265 - DNA, 19 bp, Homo sapiens
tgggatgatggcagctaca

SEQ ID NO: 46266 - DNA, 21 bp, Homo sapiens
tccaccgatgtggcagctgca

SEQ ID NO: 46267 - DNA, 21 bp, Homo sapiens
tccacagatgtggcagctgca

SEQ ID NO: 46268 - DNA, 20 bp, Homo sapiens
ccacaggcatggtggccaca

SEQ ID NO: 46269 - DNA, 23 bp, Homo sapiens
tccacactgccccaggcagccac

SEQ ID NO: 46270 - DNA, 17 bp, Homo sapiens
cacagtgacatggctac

SEQ ID NO: 46271 - DNA, 22 bp, Homo sapiens
cacatatgaaatggcagccaca

SEQ ID NO: 46272 - DNA, 18 bp, Homo sapiens
tccacagtgggcagccac

SEQ ID NO: 46273 - DNA, 22 bp, Homo sapiens
tcctggagtctgtggcagccac

SEQ ID NO: 46274 - DNA, 24 bp, Homo sapiens
ccacagtgggcaggtagagctgca

SEQ ID NO: 46275 - DNA, 19 bp, Homo sapiens
ggacacagtggcagccaca

SEQ ID NO: 46276 - DNA, 20 bp, Homo sapiens
tccaccgtgagggcagccac

SEQ ID NO: 46277 - DNA, 103 bp, Human papillomavirus type 29
actacttaggcatggctgctgacccctatggcgacagcatgtttttttttctgcgtagggaacaactgtttgccaggcacttctttaatcgtgctggtgtagt

SEQ ID NO: 46278 - DNA, 24 bp, Human papillomavirus type 29
aggcatggctgctgacccctatgg

SEQ ID NO: 46279 - DNA, 24 bp, Homo sapiens
aggcatggtggctcacatttgtgg

SEQ ID NO: 46280 - DNA, 18 bp, Homo sapiens
agcatggctgcggctgtg

SEQ ID NO: 46281 - DNA, 24 bp, Homo sapiens
ggggtggctgctggtcggctgtgg

SEQ ID NO: 46282 - DNA, 19 bp, Homo sapiens
aggcaggactgcccctatg

SEQ ID NO: 46283 - DNA, 23 bp, Homo sapiens
ggcaggttgctgaccaggccatg

SEQ ID NO: 46284 - DNA, 23 bp, Homo sapiens
aggtgtggctgtggcccccacgg

SEQ ID NO: 46285 - DNA, 29 bp, Homo sapiens
aggaatggctgctgactgcggccataggg

SEQ ID NO: 46286 - DNA, 22 bp, Homo sapiens
aggatggctgctggatacatgg

SEQ ID NO: 46287 - DNA, 23 bp, Homo sapiens
aggtatggctgctgagcaccagg

SEQ ID NO: 46288 - DNA, 22 bp, Homo sapiens
aggcatggtggagcatctgtgg

SEQ ID NO: 46289 - DNA, 21 bp, Homo sapiens
aggcatggctttgattctctg

SEQ ID NO: 46290 - DNA, 21 bp, Homo sapiens
agggtggctagatccctgtgg

SEQ ID NO: 46291 - DNA, 24 bp, Homo sapiens
aggcatggtggcatgcacctgtgg

SEQ ID NO: 46292 - DNA, 24 bp, Homo sapiens
aggcatggtggcacgtgcctgtgg

SEQ ID NO: 46293 - DNA, 20 bp, Homo sapiens
ggcatggctcgctggcctcc

SEQ ID NO: 46294 - DNA, 25 bp, Homo sapiens
aggcggggctgctggccagctgtgg

SEQ ID NO: 46295 - DNA, 21 bp, Homo sapiens
agatatggctgctggccttgg

SEQ ID NO: 46296 - DNA, 20 bp, Homo sapiens
ggcatggcctgagcctgtgg

SEQ ID NO: 46297 - DNA, 24 bp, Homo sapiens
ggttggctgctggaaacagtatgg

SEQ ID NO: 46298 - DNA, 23 bp, Homo sapiens
ggtgggctgctgggcccctgtgg

SEQ ID NO: 46299 - DNA, 23 bp, Homo sapiens
ggctggtgctgctgtccctatgg

SEQ ID NO: 46300 - DNA, 19 bp, Homo sapiens
ggctggctgctggtcctcc

SEQ ID NO: 46301 - DNA, 19 bp, Homo sapiens
aagtatggctgctgcaatg

SEQ ID NO: 46302 - DNA, 29 bp, Homo sapiens
aggtgtggctgcctgactaggccataggg

SEQ ID NO: 46303 - DNA, 19 bp, Homo sapiens
ggctgtggctgctgtcatg

SEQ ID NO: 46304 - DNA, 22 bp, Homo sapiens
gacaaaccactggtctctatgg

SEQ ID NO: 46305 - DNA, 21 bp, Homo sapiens
aggcatggctgcagagagcct

SEQ ID NO: 46306 - DNA, 22 bp, Homo sapiens
gcatggctgctggaggcggtgg

SEQ ID NO: 46307 - DNA, 17 bp, Homo sapiens
ggcaggctgctgagctg

SEQ ID NO: 46308 - DNA, 19 bp, Homo sapiens
ggccgtggctgctgagctg

SEQ ID NO: 46309 - DNA, 21 bp, Homo sapiens
aggggtggctgctgaaagcct

SEQ ID NO: 46310 - DNA, 121 bp, Human papillomavirus type 29
cctggcagtgccatatacagtcccacacctagtgggtccatggtaacgtctgaggctcaaatatttaataagccttactggctacagcaggcccagggacacaacaatggtatatgctggg

SEQ ID NO: 46311 - DNA, 24 bp, Human papillomavirus type 29
tggcagtgccatatacagtcccac

SEQ ID NO: 46312 - DNA, 16 bp, Homo sapiens
tggcagtggtatgtcc

SEQ ID NO: 46313 - DNA, 17 bp, Homo sapiens
tggccgtgtcatacagt

SEQ ID NO: 46314 - DNA, 16 bp, Homo sapiens
tgtcagtgccatgccc

SEQ ID NO: 46315 - DNA, 15 bp, Homo sapiens
tggcagcgccagtcc

SEQ ID NO: 46316 - DNA, 19 bp, Homo sapiens
tggcagtgctttatatcaa

SEQ ID NO: 46317 - DNA, 20 bp, Homo sapiens
tagcagggcatacagtctca

SEQ ID NO: 46318 - DNA, 22 bp, Homo sapiens
tggcgggcacctgtagtcccac

SEQ ID NO: 46319 - DNA, 19 bp, Homo sapiens
tggcagtgctgcaagccca

SEQ ID NO: 46320 - DNA, 24 bp, Homo sapiens
tggcagtgtgcatcagtagtccca

SEQ ID NO: 46321 - DNA, 15 bp, Homo sapiens
tggcatgacagtccc

SEQ ID NO: 46322 - DNA, 23 bp, Homo sapiens
tggcagtgtatactcagtttcac

SEQ ID NO: 46323 - DNA, 22 bp, Homo sapiens
tggcacgtgcctgtagtcccac

SEQ ID NO: 46324 - DNA, 24 bp, Homo sapiens
tgggagtgtctgcctcagtcccac

SEQ ID NO: 46325 - DNA, 28 bp, Homo sapiens
tggcagtgaaagtagtatacggtttcac

SEQ ID NO: 46326 - DNA, 22 bp, Homo sapiens
tggcgagtacctgtagtcccac

SEQ ID NO: 46327 - DNA, 20 bp, Homo sapiens
tggtattgcaaacagtccca

SEQ ID NO: 46328 - DNA, 17 bp, Homo sapiens
tggcagtgttatatgcc

SEQ ID NO: 46329 - DNA, 18 bp, Homo sapiens
ggcagggatacagtccca

SEQ ID NO: 46330 - DNA, 18 bp, Homo sapiens
tggcagtgatataattcc

SEQ ID NO: 46331 - DNA, 20 bp, Homo sapiens
tggcagtgtcctgtgtccca

SEQ ID NO: 46332 - DNA, 24 bp, Homo sapiens
ggtggtgcgaacctatagtcccac

SEQ ID NO: 46333 - DNA, 24 bp, Homo sapiens
tggcagtgtgtgctttcagtccca

SEQ ID NO: 46334 - DNA, 21 bp, Homo sapiens
tggcaggtgcctacagtccca

SEQ ID NO: 46335 - DNA, 20 bp, Homo sapiens
tggcaatgccatgtgtctca

SEQ ID NO: 46336 - DNA, 21 bp, Homo sapiens
tgccagtgttgtatacaacac

SEQ ID NO: 46337 - DNA, 120 bp, Human herpesvirus 8
aaacaaggtagaaaccaacggggtcctcaggtggtatttccggaagcattaccaaataaggcaacctcagctgggaataccagcggactacccccaactgtattcaaccctcctttgttt

SEQ ID NO: 46338 - DNA, 24 bp, Human herpesvirus 8
tggtatttccggaagcattaccaa

SEQ ID NO: 46339 - DNA, 18 bp, Homo sapiens
tggtatcgtgagcattac

SEQ ID NO: 46340 - DNA, 18 bp, Homo sapiens
tgatatcttgagcattac

SEQ ID NO: 46341 - DNA, 18 bp, Homo sapiens
tggcatttagcaggcatt

SEQ ID NO: 46342 - DNA, 19 bp, Homo sapiens
tggtattttgggaagatca

SEQ ID NO: 46343 - DNA, 19 bp, Homo sapiens
tgatatttctgcattatca

SEQ ID NO: 46344 - DNA, 17 bp, Homo sapiens
tggtacttttggaacat

SEQ ID NO: 46345 - DNA, 15 bp, Homo sapiens
tggtatttcacatta

SEQ ID NO: 46346 - DNA, 21 bp, Homo sapiens
tgggtttccggaatccaacca

SEQ ID NO: 46347 - DNA, 21 bp, Homo sapiens
tggtttcggcgagtgttacca

SEQ ID NO: 46348 - DNA, 20 bp, Homo sapiens
tggtatttcctggtgtacca

SEQ ID NO: 46349 - DNA, 66 bp, Human papillomavirus type 29
acacaactgtgcattctgggctgtacgcctcccatgggcgaacactggggtaagggcactgtgtgt

SEQ ID NO: 46350 - DNA, 24 bp, Human papillomavirus type 29
aacactggggtaagggcactgtgt

SEQ ID NO: 46351 - DNA, 19 bp, Homo sapiens
cactggggtgaggagatgt

SEQ ID NO: 46352 - DNA, 18 bp, Homo sapiens
ctggggtagggaccttgt

SEQ ID NO: 46353 - DNA, 18 bp, Homo sapiens
acactgggggggccagtg

SEQ ID NO: 46354 - DNA, 28 bp, Homo sapiens
cactgggaaatcttaggggtgttgtgta

SEQ ID NO: 46355 - DNA, 18 bp, Homo sapiens
cacaagggggcactgtgt

SEQ ID NO: 46356 - DNA, 19 bp, Homo sapiens
cactggggtaagtggagca

SEQ ID NO: 46357 - DNA, 19 bp, Homo sapiens
cactgaggtagcaatgtgt

SEQ ID NO: 46358 - DNA, 18 bp, Homo sapiens
ctcgggacaacactgtgt

SEQ ID NO: 46359 - DNA, 21 bp, Homo sapiens
cactgtggacgtgcactgtgt

SEQ ID NO: 46360 - DNA, 17 bp, Homo sapiens
ctcagggggcactgtgt

SEQ ID NO: 46361 - DNA, 19 bp, Homo sapiens
cattgaggtaaggggccca

SEQ ID NO: 46362 - DNA, 18 bp, Homo sapiens
acatggggtttcactgtg

SEQ ID NO: 46363 - DNA, 21 bp, Homo sapiens
ctggggtaaggacacaggtgt

SEQ ID NO: 46364 - DNA, 16 bp, Homo sapiens
tggggtaaggatatgt

SEQ ID NO: 46365 - DNA, 20 bp, Homo sapiens
acaggggtaagggaacatgt

SEQ ID NO: 46366 - DNA, 16 bp, Homo sapiens
actggggtaagaggtg

SEQ ID NO: 46367 - DNA, 18 bp, Homo sapiens
aacactgtggtaggggtg

SEQ ID NO: 46368 - DNA, 19 bp, Homo sapiens
ctggggtaagaacctgtgt

SEQ ID NO: 46369 - DNA, 17 bp, Homo sapiens
ctggggtggggcagtgt

SEQ ID NO: 46370 - DNA, 17 bp, Homo sapiens
ctggggtttcactgtgt

SEQ ID NO: 46371 - DNA, 17 bp, Homo sapiens
ctggtgaggcactgtgt

SEQ ID NO: 46372 - DNA, 20 bp, Homo sapiens
caccgcgcggggcattgtgt

SEQ ID NO: 46373 - DNA, 22 bp, Homo sapiens
cactggggagggagtcctgtgt

SEQ ID NO: 46374 - DNA, 24 bp, Homo sapiens
aacaacttgaaaggggtgctgtgt

SEQ ID NO: 46375 - DNA, 20 bp, Homo sapiens
acactggggtgggaagatgt

SEQ ID NO: 46376 - DNA, 79 bp, Human papillomavirus type 29
taggtttgtaacatcctctgccataacttgtcaaaaagatttggcccctacagaaaagcaggatccgtatgcaaagcta

SEQ ID NO: 46377 - DNA, 24 bp, Human papillomavirus type 29
ttggcccctacagaaaagcaggat

SEQ ID NO: 46378 - DNA, 21 bp, Homo sapiens
tcggctggaggagagcaggat

SEQ ID NO: 46379 - DNA, 22 bp, Homo sapiens
ttggtgctctgaccagcaggat

SEQ ID NO: 46380 - DNA, 17 bp, Homo sapiens
ctggtccctacagggat

SEQ ID NO: 46381 - DNA, 16 bp, Homo sapiens
ctggcccctgcaggat

SEQ ID NO: 46382 - DNA, 20 bp, Homo sapiens
ctggcccctgtagaagttgc

SEQ ID NO: 46383 - DNA, 22 bp, Homo sapiens
ttggcccctcatggggagggat

SEQ ID NO: 46384 - DNA, 17 bp, Homo sapiens
ttggtccccacagggga

SEQ ID NO: 46385 - DNA, 23 bp, Homo sapiens
ttggccccgtgctccagcaggat

SEQ ID NO: 46386 - DNA, 25 bp, Homo sapiens
tggcccctgctggtacaggagcagg

SEQ ID NO: 46387 - DNA, 18 bp, Homo sapiens
ttggcccctgatacggga

SEQ ID NO: 46388 - DNA, 25 bp, Homo sapiens
ttgacccctacaggggcagcaggat

SEQ ID NO: 46389 - DNA, 19 bp, Homo sapiens
ttggacctccggagcagga

SEQ ID NO: 46390 - DNA, 18 bp, Homo sapiens
ttggtttctacagaaaag

SEQ ID NO: 46391 - DNA, 22 bp, Homo sapiens
ttggcccctgcagccggcccgg

SEQ ID NO: 46392 - DNA, 21 bp, Homo sapiens
tcggcccctggaaaaagcagg

SEQ ID NO: 46393 - DNA, 22 bp, Homo sapiens
ctggccctagcaggagcaggat

SEQ ID NO: 46394 - DNA, 17 bp, Homo sapiens
ttggcccctcagaaaaa

SEQ ID NO: 46395 - DNA, 23 bp, Homo sapiens
ttggttcctgagaaaagcgagat

SEQ ID NO: 46396 - DNA, 20 bp, Homo sapiens
ttggcatctacagaagccag

SEQ ID NO: 46397 - DNA, 19 bp, Homo sapiens
ttgtccctggagagcagga

SEQ ID NO: 46398 - DNA, 19 bp, Homo sapiens
ttggccctacagggtcagg

SEQ ID NO: 46399 - DNA, 21 bp, Homo sapiens
ttgtgctctttgaagcaggat

SEQ ID NO: 46400 - DNA, 16 bp, Homo sapiens
ttagcctcagagcagg

SEQ ID NO: 46401 - DNA, 131 bp, Human papillomavirus type 29
gtgtgtatgtatttattaccatatgtgtttgtatgtctgtatgtctgtacaatgtatgtatgtatacttcaactatgtatgtgtggatgtataaataaagtatgtcacatagttttatattttatacatat

SEQ ID NO: 46402 - DNA, 24 bp, Human papillomavirus type 29
aagtatgtcacatagttttatatt

SEQ ID NO: 46403 - DNA, 19 bp, Homo sapiens
tgttacatggttttatatt

SEQ ID NO: 46404 - DNA, 20 bp, Homo sapiens
gtatttcacatatgctatat

SEQ ID NO: 46405 - DNA, 19 bp, Homo sapiens
aagtatgttatctagttcc

SEQ ID NO: 46406 - DNA, 17 bp, Homo sapiens
aagtatgtccagagttt

SEQ ID NO: 46407 - DNA, 21 bp, Homo sapiens
agtatgtcataagccatatat

SEQ ID NO: 46408 - DNA, 22 bp, Homo sapiens
aagtatttcacagcagttatat

SEQ ID NO: 46409 - DNA, 131 bp, Human herpesvirus 8
caccccaggagccccggcagcaccccaggagccccggcagcaccccaggagccccggcagcaccccaggagccccggcagcaccccaggagccccggcagcaccccaggagccccggcagcaccccaggag

SEQ ID NO: 46410 - DNA, 24 bp, Human herpesvirus 8
cagcaccccaggagccccggcagc

SEQ ID NO: 46411 - DNA, 20 bp, Homo sapiens
gcgccccgagttccggcagc

SEQ ID NO: 46412 - DNA, 21 bp, Homo sapiens
agcaccccagcagccggtagc

SEQ ID NO: 46413 - DNA, 18 bp, Homo sapiens
cagctctccaggagccgc

SEQ ID NO: 46414 - DNA, 22 bp, Homo sapiens
gcactggagcggccccggcggc

SEQ ID NO: 46415 - DNA, 22 bp, Homo sapiens
gcgctccaagtgccccggcggc

SEQ ID NO: 46416 - DNA, 20 bp, Homo sapiens
gctccccaggagcccacggc

SEQ ID NO: 46417 - DNA, 21 bp, Homo sapiens
cagtgtcccagcagcccctgc

SEQ ID NO: 46418 - DNA, 18 bp, Homo sapiens
agcccccgcccctggcag

SEQ ID NO: 46419 - DNA, 16 bp, Homo sapiens
cagccccctcccggca

SEQ ID NO: 46420 - DNA, 18 bp, Homo sapiens
cagccccgagccccggcg

SEQ ID NO: 46421 - DNA, 19 bp, Homo sapiens
gcggccccggcccggcggc

SEQ ID NO: 46422 - DNA, 20 bp, Homo sapiens
gctcccaggagaggcctggc

SEQ ID NO: 46423 - DNA, 23 bp, Homo sapiens
caggtcccgggactcccggcagc

SEQ ID NO: 46424 - DNA, 20 bp, Homo sapiens
agtaccccaggggctgaagc

SEQ ID NO: 46425 - DNA, 22 bp, Homo sapiens
cagcaccccaaagcttggcggc

SEQ ID NO: 46426 - DNA, 18 bp, Homo sapiens
cagtgcctcagaagcagc

SEQ ID NO: 46427 - DNA, 19 bp, Homo sapiens
cagcgtctcaagagccccg

SEQ ID NO: 46428 - DNA, 19 bp, Homo sapiens
cagcaccccagagcagggc

SEQ ID NO: 46429 - DNA, 22 bp, Homo sapiens
gcagtgaaagggtcccggcagc

SEQ ID NO: 46430 - DNA, 19 bp, Homo sapiens
cacctggggctccggcagc

SEQ ID NO: 46431 - DNA, 20 bp, Homo sapiens
gcgcctacagccccggcggc

SEQ ID NO: 46432 - DNA, 18 bp, Homo sapiens
cagcaccccacgggtggc

SEQ ID NO: 46433 - DNA, 20 bp, Homo sapiens
cagcacccaaggagcatcag

SEQ ID NO: 46434 - DNA, 20 bp, Homo sapiens
gcactgagcgctccggcagc

SEQ ID NO: 46435 - DNA, 17 bp, Homo sapiens
cagcagagtcctggcag

SEQ ID NO: 46436 - DNA, 21 bp, Homo sapiens
cagcgccacccgcccggcagc

SEQ ID NO: 46437 - DNA, 17 bp, Homo sapiens
gcccccaggagcgcggc

SEQ ID NO: 46438 - DNA, 21 bp, Homo sapiens
cagctcggtgagtcccggcag

SEQ ID NO: 46439 - DNA, 19 bp, Homo sapiens
cccccgcagctccggcagc

SEQ ID NO: 46440 - DNA, 21 bp, Homo sapiens
caggaccccaggcctggcggc

SEQ ID NO: 46441 - DNA, 21 bp, Homo sapiens
cagcggcccagcaggcggcag

SEQ ID NO: 46442 - DNA, 18 bp, Homo sapiens
agcacaccgcaccggcag

SEQ ID NO: 46443 - DNA, 18 bp, Homo sapiens
gcaatcctggccgacagc

SEQ ID NO: 46444 - DNA, 23 bp, Homo sapiens
cagcaccctgggaagtgttgggc

SEQ ID NO: 46445 - DNA, 15 bp, Homo sapiens
accccagggccgacg

SEQ ID NO: 46446 - DNA, 20 bp, Homo sapiens
cagcctcccaggaccccggc

SEQ ID NO: 46447 - DNA, 16 bp, Homo sapiens
gcaccccagagctggc

SEQ ID NO: 46448 - DNA, 22 bp, Homo sapiens
cagcagcccgcgccccggcagc

SEQ ID NO: 46449 - DNA, 19 bp, Homo sapiens
gctgccccaggagagcggc

SEQ ID NO: 46450 - DNA, 22 bp, Homo sapiens
accccaggtgcccactctcagc

SEQ ID NO: 46451 - DNA, 22 bp, Homo sapiens
cagcacccaggagtctgggagc

SEQ ID NO: 46452 - DNA, 20 bp, Homo sapiens
cactccggggctccggcagc

SEQ ID NO: 46453 - DNA, 23 bp, Homo sapiens
gcatcccaggagatgatggcggc

SEQ ID NO: 46454 - DNA, 21 bp, Homo sapiens
cagcaggggggccccggcggc

SEQ ID NO: 46455 - DNA, 20 bp, Homo sapiens
gcgccccgcagcccggcagc

SEQ ID NO: 46456 - DNA, 22 bp, Homo sapiens
gcagccccgggggcgtcggcag

SEQ ID NO: 46457 - DNA, 24 bp, Homo sapiens
cagcacccggcactggctggcagc

SEQ ID NO: 46458 - DNA, 22 bp, Homo sapiens
cagcaccctggccagcggcggc

SEQ ID NO: 46459 - DNA, 17 bp, Homo sapiens
cagccccgacctcggcg

SEQ ID NO: 46460 - DNA, 19 bp, Homo sapiens
acaccccaggagcttcagc

SEQ ID NO: 46461 - DNA, 15 bp, Homo sapiens
accccaggaaggcag

SEQ ID NO: 46462 - DNA, 18 bp, Homo sapiens
gcaccccagggggccggc

SEQ ID NO: 46463 - DNA, 18 bp, Homo sapiens
agcaccccagaggcgcaa

SEQ ID NO: 46464 - DNA, 19 bp, Homo sapiens
gctgcccggctccggcagc

SEQ ID NO: 46465 - DNA, 22 bp, Homo sapiens
gcaccttaggagccctgtgggc

SEQ ID NO: 46466 - DNA, 17 bp, Homo sapiens
gcactcccatccggcag

SEQ ID NO: 46467 - DNA, 21 bp, Homo sapiens
cagtccccagcggccggcagc

SEQ ID NO: 46468 - DNA, 20 bp, Homo sapiens
cagcgtttccaggagacggc

SEQ ID NO: 46469 - DNA, 20 bp, Homo sapiens
gctccgtcacctccggcagc

SEQ ID NO: 46470 - DNA, 19 bp, Homo sapiens
ccctcgggcacccggcagc

SEQ ID NO: 46471 - DNA, 21 bp, Homo sapiens
cagcacttcaggaggccaagg

SEQ ID NO: 46472 - DNA, 19 bp, Homo sapiens
gcgtcccaccgccggcagc

SEQ ID NO: 46473 - DNA, 18 bp, Homo sapiens
caggccccggcgcggcag

SEQ ID NO: 46474 - DNA, 18 bp, Homo sapiens
cagccccaggccccggcg

SEQ ID NO: 46475 - DNA, 21 bp, Homo sapiens
cagacgtcctgtggccccggc

SEQ ID NO: 46476 - DNA, 21 bp, Homo sapiens
accccgcaccgccccggcagc

SEQ ID NO: 46477 - DNA, 21 bp, Homo sapiens
gcgcctccagcacccggcagc

SEQ ID NO: 46478 - DNA, 19 bp, Homo sapiens
cagctcccaggagcacagc

SEQ ID NO: 46479 - DNA, 22 bp, Homo sapiens
cagcaccctgagagcccgtggc

SEQ ID NO: 46480 - DNA, 18 bp, Homo sapiens
ccccggacccccggcagc

SEQ ID NO: 46481 - DNA, 21 bp, Homo sapiens
gctttccaggagcggggcagc

SEQ ID NO: 46482 - DNA, 19 bp, Homo sapiens
cccctacgcgcccggcagc

SEQ ID NO: 46483 - DNA, 21 bp, Homo sapiens
gcacccctctcttccggcagc

SEQ ID NO: 46484 - DNA, 19 bp, Homo sapiens
gccaccccagtgctggcag

SEQ ID NO: 46485 - DNA, 17 bp, Homo sapiens
cagcaccccagggcggg

SEQ ID NO: 46486 - DNA, 21 bp, Homo sapiens
cagcagcctgggcttggcggc

SEQ ID NO: 46487 - DNA, 19 bp, Homo sapiens
cagcacccaggagcacagc

SEQ ID NO: 46488 - DNA, 20 bp, Homo sapiens
gcaccccaggggacgcgggc

SEQ ID NO: 46489 - DNA, 18 bp, Homo sapiens
cagactccaggagcttgc

SEQ ID NO: 46490 - DNA, 20 bp, Homo sapiens
gccgggcccagccccggcag

SEQ ID NO: 46491 - DNA, 19 bp, Homo sapiens
acctggggcacccggcagc

SEQ ID NO: 46492 - DNA, 20 bp, Homo sapiens
gccaccccaggagctgggac

SEQ ID NO: 46493 - DNA, 18 bp, Homo sapiens
cagccccgatccccggtg

SEQ ID NO: 46494 - DNA, 18 bp, Homo sapiens
caggaccccagacggcag

SEQ ID NO: 46495 - DNA, 21 bp, Homo sapiens
cagcacccaggagtctacagc

SEQ ID NO: 46496 - DNA, 22 bp, Homo sapiens
cagtttagggagccccggcagc

SEQ ID NO: 46497 - DNA, 20 bp, Homo sapiens
cagtaccccagaggggtggc

SEQ ID NO: 46498 - DNA, 22 bp, Homo sapiens
gcatctgatgggccccggcagc

SEQ ID NO: 46499 - DNA, 22 bp, Homo sapiens
cagcaccctaggaggccaaggc

SEQ ID NO: 46500 - DNA, 23 bp, Homo sapiens
gcacctcaggcggctccggcagc

SEQ ID NO: 46501 - DNA, 17 bp, Homo sapiens
acaccccaacttggcag

SEQ ID NO: 46502 - DNA, 19 bp, Homo sapiens
cagaccccaggagggtcgg

SEQ ID NO: 46503 - DNA, 24 bp, Homo sapiens
gcgctccaggagcgcccaggcggc

SEQ ID NO: 46504 - DNA, 22 bp, Homo sapiens
cagcaccctgggaggtggaggc

SEQ ID NO: 46505 - DNA, 19 bp, Homo sapiens
gcgcctcctgcccggcagc

SEQ ID NO: 46506 - DNA, 19 bp, Homo sapiens
gctccaggagcgcggcagc

SEQ ID NO: 46507 - DNA, 21 bp, Homo sapiens
cagcacttctggggaagcagc

SEQ ID NO: 46508 - DNA, 18 bp, Homo sapiens
cagaccccaggagcttgc

SEQ ID NO: 46509 - DNA, 19 bp, Homo sapiens
gcactccagcagcctgggc

SEQ ID NO: 46510 - DNA, 20 bp, Homo sapiens
gctgtcccaggagccggagc

SEQ ID NO: 46511 - DNA, 17 bp, Homo sapiens
gcgccgagtcccggcag

SEQ ID NO: 46512 - DNA, 24 bp, Homo sapiens
caggccctttagctctctggcagc

SEQ ID NO: 46513 - DNA, 20 bp, Homo sapiens
gcgtccctcagcccggcagc

SEQ ID NO: 46514 - DNA, 19 bp, Homo sapiens
accctggccacccggcagc

SEQ ID NO: 46515 - DNA, 17 bp, Homo sapiens
agacctcaggagcccgc

SEQ ID NO: 46516 - DNA, 20 bp, Homo sapiens
cagcagccccgggaggtggc

SEQ ID NO: 46517 - DNA, 18 bp, Homo sapiens
cccaggagtccaggaagc

SEQ ID NO: 46518 - DNA, 19 bp, Homo sapiens
gcgccccaggaggctcggc

SEQ ID NO: 46519 - DNA, 20 bp, Homo sapiens
gcaccccaggaaggcgcagc

SEQ ID NO: 46520 - DNA, 22 bp, Homo sapiens
cagcccccggttctcctggcag

SEQ ID NO: 46521 - DNA, 19 bp, Homo sapiens
gcgccgcctgctcggcagc

SEQ ID NO: 46522 - DNA, 18 bp, Homo sapiens
gcgtcccaggagcgcggc

SEQ ID NO: 46523 - DNA, 19 bp, Homo sapiens
acaccccagataatggcag

SEQ ID NO: 46524 - DNA, 17 bp, Homo sapiens
cagcccccaggagtggc

SEQ ID NO: 46525 - DNA, 20 bp, Homo sapiens
gcacaggcggctccggcagc

SEQ ID NO: 46526 - DNA, 22 bp, Homo sapiens
cagcactaccaggcccggcagc

SEQ ID NO: 46527 - DNA, 21 bp, Homo sapiens
gccaccccggcaggcggcagc

SEQ ID NO: 46528 - DNA, 20 bp, Homo sapiens
gcggcccaaactccggcagc

SEQ ID NO: 46529 - DNA, 22 bp, Homo sapiens
cagcaccctgggaggccaaggc

SEQ ID NO: 46530 - DNA, 20 bp, Homo sapiens
cagcaccccagggagcaggg

SEQ ID NO: 46531 - DNA, 19 bp, Homo sapiens
cagctcccaggagcagggc

SEQ ID NO: 46532 - DNA, 19 bp, Homo sapiens
gcgcgccagtcccggcagc

SEQ ID NO: 46533 - DNA, 21 bp, Homo sapiens
cagcaccctgagggcctgaac

SEQ ID NO: 46534 - DNA, 21 bp, Homo sapiens
cagcccagaaggctttggtag

SEQ ID NO: 46535 - DNA, 26 bp, Homo sapiens
accgccccagcgagggtcctggcagc

SEQ ID NO: 46536 - DNA, 21 bp, Homo sapiens
cagtggcctgagcccggcagc

SEQ ID NO: 46537 - DNA, 22 bp, Homo sapiens
gcagcccaggagccctggaggc

SEQ ID NO: 46538 - DNA, 24 bp, Homo sapiens
agcatcttcaagggtcctggcagc

SEQ ID NO: 46539 - DNA, 22 bp, Homo sapiens
cagtgactccagcagcggcggc

SEQ ID NO: 46540 - DNA, 19 bp, Homo sapiens
cagaccccaggaggtcagc

SEQ ID NO: 46541 - DNA, 22 bp, Homo sapiens
cagcactttgggaagccaaggc

SEQ ID NO: 46542 - DNA, 19 bp, Homo sapiens
cagcccttcaggagccagc

SEQ ID NO: 46543 - DNA, 18 bp, Homo sapiens
cagcatcccaggaggccc

SEQ ID NO: 46544 - DNA, 21 bp, Homo sapiens
cagcatcccggcggcgcaggc

SEQ ID NO: 46545 - DNA, 19 bp, Homo sapiens
gctctccctccccggcagc

SEQ ID NO: 46546 - DNA, 20 bp, Homo sapiens
cagcacccgggagtgggggc

SEQ ID NO: 46547 - DNA, 19 bp, Homo sapiens
cagtgcccaggaagggcag

SEQ ID NO: 46548 - DNA, 21 bp, Homo sapiens
gctcccactgaccccggcagc

SEQ ID NO: 46549 - DNA, 18 bp, Homo sapiens
acctgcaagtcccggcag

SEQ ID NO: 46550 - DNA, 23 bp, Homo sapiens
cagggccccaggagtcacttagc

SEQ ID NO: 46551 - DNA, 20 bp, Homo sapiens
caggtcccgggggccccggc

SEQ ID NO: 46552 - DNA, 24 bp, Homo sapiens
gcaccccaggatgctgacgccggc

SEQ ID NO: 46553 - DNA, 19 bp, Homo sapiens
gcaccccaggggcttccag

SEQ ID NO: 46554 - DNA, 21 bp, Homo sapiens
cagcacccgggagggaatcag

SEQ ID NO: 46555 - DNA, 19 bp, Homo sapiens
cagccgctccgcccggcag

SEQ ID NO: 46556 - DNA, 19 bp, Homo sapiens
cagcagcccaggggtcggc

SEQ ID NO: 46557 - DNA, 20 bp, Homo sapiens
caacaccctggggaggtagc

SEQ ID NO: 46558 - DNA, 21 bp, Homo sapiens
cagcactttgggacgccacag

SEQ ID NO: 46559 - DNA, 19 bp, Homo sapiens
cagcccccttcccggcagc

SEQ ID NO: 46560 - DNA, 23 bp, Homo sapiens
cagcacctaaaagcccctggcag

SEQ ID NO: 46561 - DNA, 18 bp, Homo sapiens
gcagccccgggagcccgg

SEQ ID NO: 46562 - DNA, 21 bp, Homo sapiens
aacatcctgctcaccggcagc

SEQ ID NO: 46563 - DNA, 19 bp, Homo sapiens
caccacccctccccggcag

SEQ ID NO: 46564 - DNA, 18 bp, Homo sapiens
cccaggagccctcccagc

SEQ ID NO: 46565 - DNA, 24 bp, Homo sapiens
agcgcctcgggagccccgaatagc

SEQ ID NO: 46566 - DNA, 24 bp, Homo sapiens
cagcctcacctcggccccggcggc

SEQ ID NO: 46567 - DNA, 20 bp, Homo sapiens
cagcacccaggggtccgagc

SEQ ID NO: 46568 - DNA, 21 bp, Homo sapiens
gccatcataagtcctggcagc

SEQ ID NO: 46569 - DNA, 18 bp, Homo sapiens
gcattgggccccggcggc

SEQ ID NO: 46570 - DNA, 20 bp, Homo sapiens
catcccaggagctcccagag

SEQ ID NO: 46571 - DNA, 24 bp, Homo sapiens
agcacctggtccggtcccggcagc

SEQ ID NO: 46572 - DNA, 17 bp, Homo sapiens
agacctcaggagcctgc

SEQ ID NO: 46573 - DNA, 18 bp, Homo sapiens
acccagcagggccctggc

SEQ ID NO: 46574 - DNA, 131 bp, Equine herpesvirus 1
ctttgttgaacttgccgtacccgtccagcttgatgttatacaccgacgttaccttgttaactatgtacgcccagtcaaaattaacgatgttgtagccggtggcgaactcgggagagtactgcttgagaaag

SEQ ID NO: 46575 - DNA, 24 bp, Equine herpesvirus 1
tgttgtagccggtggcgaactcgg

SEQ ID NO: 46576 - DNA, 18 bp, Homo sapiens
tgttatagctggagagga

SEQ ID NO: 46577 - DNA, 18 bp, Homo sapiens
gttgtagttggtggtccg

SEQ ID NO: 46578 - DNA, 16 bp, Homo sapiens
tgttgtagtggtggcc

SEQ ID NO: 46579 - DNA, 69 bp, Human papillomavirus type 10
agggtgtttcgggtgcggttgcctgaccctaataagtttggactgcctgacgcccgcatatataaccct

SEQ ID NO: 46580 - DNA, 24 bp, Human papillomavirus type 10
cgggtgcggttgcctgaccctaat

SEQ ID NO: 46581 - DNA, 20 bp, Homo sapiens
caggtgcatgggctgaccct

SEQ ID NO: 46582 - DNA, 18 bp, Homo sapiens
gagccaccatgcctgacc

SEQ ID NO: 46583 - DNA, 16 bp, Homo sapiens
gggtgagcttgaccct

SEQ ID NO: 46584 - DNA, 108 bp, Human papillomavirus type 10
cacctccaatgggagagcattggggcaagggaaccccgtgcaggaacccacctgcacagggcgattgccctcccctggagcttataacttcccctattcaggatggtg

SEQ ID NO: 46585 - DNA, 24 bp, Human papillomavirus type 10
acagggcgattgccctcccctgga

SEQ ID NO: 46586 - DNA, 22 bp, Homo sapiens
acagggccgttctaccccctgg

SEQ ID NO: 46587 - DNA, 21 bp, Homo sapiens
acagggcgagagctcttttgg

SEQ ID NO: 46588 - DNA, 19 bp, Homo sapiens
gggctgcattctcccctgg

SEQ ID NO: 46589 - DNA, 21 bp, Homo sapiens
agggctgcaccctcccttgga

SEQ ID NO: 46590 - DNA, 22 bp, Homo sapiens
acaggcatatgctctcctctgg

SEQ ID NO: 46591 - DNA, 23 bp, Homo sapiens
acagggcggtctggtagtcctgg

SEQ ID NO: 46592 - DNA, 19 bp, Homo sapiens
acagggcgagtgcagctgg

SEQ ID NO: 46593 - DNA, 21 bp, Homo sapiens
gggcgtgtccccttcccctgg

SEQ ID NO: 46594 - DNA, 25 bp, Homo sapiens
acggggcgatcgtccagctgctgga

SEQ ID NO: 46595 - DNA, 21 bp, Homo sapiens
cagagtcttaccctcctctgg

SEQ ID NO: 46596 - DNA, 18 bp, Homo sapiens
agggcaggcctcctctgg

SEQ ID NO: 46597 - DNA, 16 bp, Homo sapiens
ggcagttctcccctgg

SEQ ID NO: 46598 - DNA, 20 bp, Homo sapiens
agggcagcagcttcccctgg

SEQ ID NO: 46599 - DNA, 17 bp, Homo sapiens
gggccgccctcccctgg

SEQ ID NO: 46600 - DNA, 22 bp, Homo sapiens
gggcgcgaggccctcccttgga

SEQ ID NO: 46601 - DNA, 18 bp, Homo sapiens
aacggtgccctcctctgg

SEQ ID NO: 46602 - DNA, 23 bp, Homo sapiens
acaggctgccccctcttctctgg

SEQ ID NO: 46603 - DNA, 21 bp, Homo sapiens
ggggtctcctccctcccctgg

SEQ ID NO: 46604 - DNA, 18 bp, Homo sapiens
cagggcgaggtcctctgg

SEQ ID NO: 46605 - DNA, 19 bp, Homo sapiens
gggctttgccctcccttgg

SEQ ID NO: 46606 - DNA, 22 bp, Homo sapiens
acaggtcagcgccctctcctgg

SEQ ID NO: 46607 - DNA, 21 bp, Homo sapiens
gggcaccaccctctcttctgg

SEQ ID NO: 46608 - DNA, 21 bp, Homo sapiens
acagggcaggtggcctctgga

SEQ ID NO: 46609 - DNA, 22 bp, Homo sapiens
caggacagacccttcccctgga

SEQ ID NO: 46610 - DNA, 21 bp, Homo sapiens
agggcggtgcggatccctgga

SEQ ID NO: 46611 - DNA, 23 bp, Homo sapiens
gggtgctgccctctttcttctgg

SEQ ID NO: 46612 - DNA, 18 bp, Homo sapiens
agggttccctcccctgga

SEQ ID NO: 46613 - DNA, 19 bp, Homo sapiens
ggcagggccctcccctgga

SEQ ID NO: 46614 - DNA, 64 bp, Human herpesvirus 8
gtgtttttgattgtagcggaaaaatgtaataaattttacagacagttttgcctactgagaacat

SEQ ID NO: 46615 - DNA, 24 bp, Human herpesvirus 8
tttttgattgtagcggaaaaatgt

SEQ ID NO: 46616 - DNA, 23 bp, Homo sapiens
tttttgatttcaactcaaaatgt

SEQ ID NO: 46617 - DNA, 22 bp, Homo sapiens
tttttaattggcttaaaaatgt

SEQ ID NO: 46618 - DNA, 18 bp, Homo sapiens
tttctgattgatgggaaa

SEQ ID NO: 46619 - DNA, 22 bp, Homo sapiens
ttcttggtaagaggaaaaatgt

SEQ ID NO: 46620 - DNA, 25 bp, Homo sapiens
tttttgatttcattaagaaaaatgt

SEQ ID NO: 46621 - DNA, 24 bp, Homo sapiens
tttttgattgtagacattgggtgt

SEQ ID NO: 46622 - DNA, 102 bp, Equine herpesvirus 1
ataacttttggtcacccacctcgaacgtcgagtagtcgacggatggttgaagcccggccagatccacttcatcgagcgccagggtggtgaaacagaggttat

SEQ ID NO: 46623 - DNA, 24 bp, Equine herpesvirus 1
acttttggtcacccacctcgaacg

SEQ ID NO: 46624 - DNA, 22 bp, Homo sapiens
actcttggttgcccaggctaga

SEQ ID NO: 46625 - DNA, 21 bp, Homo sapiens
acttttggtctccccaaggcg

SEQ ID NO: 46626 - DNA, 21 bp, Homo sapiens
acatttggccactaccttgaa

SEQ ID NO: 46627 - DNA, 21 bp, Homo sapiens
acttctggtcatttgccatct

SEQ ID NO: 46628 - DNA, 21 bp, Homo sapiens
ttttggtcacttgcttctcaa

SEQ ID NO: 46629 - DNA, 77 bp, Equine herpesvirus 1
tcctggatacaatactctcctattacgcccctccggtcaggccctcccgcgtaataggagggtatttctttataggg

SEQ ID NO: 46630 - DNA, 24 bp, Equine herpesvirus 1
tacaatactctcctattacgcccc

SEQ ID NO: 46631 - DNA, 21 bp, Homo sapiens
tacaatgctttcccatcaccc

SEQ ID NO: 46632 - DNA, 23 bp, Homo sapiens
tacaatcttctttttcacacccc

SEQ ID NO: 46633 - DNA, 19 bp, Homo sapiens
taaatactcttctgcaccc

SEQ ID NO: 46634 - DNA, 22 bp, Homo sapiens
taccatgctctcctacatggcc

SEQ ID NO: 46635 - DNA, 21 bp, Homo sapiens
tacgatctctcctaagatccc

SEQ ID NO: 46636 - DNA, 18 bp, Homo sapiens
tacatgctttcctattac

SEQ ID NO: 46637 - DNA, 20 bp, Homo sapiens
caatactcttcccagggccc

SEQ ID NO: 46638 - DNA, 16 bp, Homo sapiens
aatactctccattggc

SEQ ID NO: 46639 - DNA, 16 bp, Homo sapiens
aatactctctcccacc

SEQ ID NO: 46640 - DNA, 17 bp, Homo sapiens
cacagtactcttcagcc

SEQ ID NO: 46641 - DNA, 18 bp, Homo sapiens
taaatactcttttagccc

SEQ ID NO: 46642 - DNA, 21 bp, Homo sapiens
taaatactctttattagcccc

SEQ ID NO: 46643 - DNA, 24 bp, Homo sapiens
cagtgctctcctatctgctgcccc

SEQ ID NO: 46644 - DNA, 20 bp, Homo sapiens
tacattgttctcctactgca

SEQ ID NO: 46645 - DNA, 18 bp, Homo sapiens
atactctcacagcgcccc

SEQ ID NO: 46646 - DNA, 82 bp, Equine herpesvirus 1
cgtcgccacagaatacatgtctagagatatcaggccattgattttcaccttgctcttcttctgaaaatggttcgtggcgatg

SEQ ID NO: 46647 - DNA, 24 bp, Equine herpesvirus 1
tgtctagagatatcaggccattga

SEQ ID NO: 46648 - DNA, 18 bp, Homo sapiens
tagggaagaagccattga

SEQ ID NO: 46649 - DNA, 18 bp, Homo sapiens
tgtctagagctgtcagcc

SEQ ID NO: 46650 - DNA, 19 bp, Homo sapiens
tatctagaggcagttattg

SEQ ID NO: 46651 - DNA, 19 bp, Homo sapiens
tctagagatcattcattga

SEQ ID NO: 46652 - DNA, 23 bp, Homo sapiens
tatctagaaatataggctattga

SEQ ID NO: 46653 - DNA, 20 bp, Homo sapiens
tgcctagaggtcaattattg

SEQ ID NO: 46654 - DNA, 16 bp, Homo sapiens
tgtctgaggagccatt

SEQ ID NO: 46655 - DNA, 111 bp, Equine herpesvirus 1
gggcgggatagctcagcaaacctggatgggtcatcgtgtgaggcgctctccgaagtctctactatgtcgtacacgtgaaatctctcaaatctggggttgaatccatcgccc

SEQ ID NO: 46656 - DNA, 24 bp, Equine herpesvirus 1
tactatgtcgtacacgtgaaatct

SEQ ID NO: 46657 - DNA, 20 bp, Homo sapiens
tatgctaagtagtgaaatct

SEQ ID NO: 46658 - DNA, 19 bp, Homo sapiens
tattccacacacgtggaat

SEQ ID NO: 46659 - DNA, 18 bp, Homo sapiens
catgtgcatgtgaaatct

SEQ ID NO: 46660 - DNA, 23 bp, Homo sapiens
tactaagtctgtaagtgaaatct

SEQ ID NO: 46661 - DNA, 20 bp, Homo sapiens
tactatatcgtgcacttaaa

SEQ ID NO: 46662 - DNA, 20 bp, Homo sapiens
ctattgtgggctcacgtgaa

SEQ ID NO: 46663 - DNA, 19 bp, Homo sapiens
tactatgtacgtgtaaaac

SEQ ID NO: 46664 - DNA, 76 bp, Rat cytomegalovirus
ctccgggagggaaaacggcgagggtagaaacgagcggtgagcaaaatcccctcgctcgtcgtcgtcctcctcggag

SEQ ID NO: 46665 - DNA, 24 bp, Rat cytomegalovirus
gggaaaacggcgagggtagaaacg

SEQ ID NO: 46666 - DNA, 18 bp, Homo sapiens
gggaaaatgctttagaaa

SEQ ID NO: 46667 - DNA, 16 bp, Homo sapiens
gggagggaggcagaaa

SEQ ID NO: 46668 - DNA, 20 bp, Homo sapiens
ggcgaggcggcgaggcgaga

SEQ ID NO: 46669 - DNA, 20 bp, Homo sapiens
aggatgcggtggtagaaacg

SEQ ID NO: 46670 - DNA, 18 bp, Homo sapiens
gggtggacggcaagggag

SEQ ID NO: 46671 - DNA, 18 bp, Homo sapiens
gggaaggtggcgaaagag

SEQ ID NO: 46672 - DNA, 19 bp, Homo sapiens
gagaacggcggcgggaacg

SEQ ID NO: 46673 - DNA, 17 bp, Homo sapiens
gggaaaacagcagggag

SEQ ID NO: 46674 - DNA, 19 bp, Homo sapiens
gggaaaaggcgagggcaaa

SEQ ID NO: 46675 - DNA, 17 bp, Homo sapiens
gggagggcagcgataga

SEQ ID NO: 46676 - DNA, 19 bp, Homo sapiens
gggaaggcagcctggaaac

SEQ ID NO: 46677 - DNA, 16 bp, Homo sapiens
gggaagggcaagggag

SEQ ID NO: 46678 - DNA, 19 bp, Homo sapiens
gggaaaaggcctcaggaga

SEQ ID NO: 46679 - DNA, 18 bp, Homo sapiens
gggagacggcaagtcggc

SEQ ID NO: 46680 - DNA, 22 bp, Homo sapiens
gggagaacagccctcagaagcg

SEQ ID NO: 46681 - DNA, 19 bp, Homo sapiens
gggaggatggcaagggcag

SEQ ID NO: 46682 - DNA, 21 bp, Homo sapiens
ggggtggcaccagtagaaacg

SEQ ID NO: 46683 - DNA, 16 bp, Homo sapiens
gggaaagtggcagaaa

SEQ ID NO: 46684 - DNA, 21 bp, Homo sapiens
gggaagacagcggggcccacg

SEQ ID NO: 46685 - DNA, 21 bp, Homo sapiens
gggaaaacgacggcgagcaga

SEQ ID NO: 46686 - DNA, 17 bp, Homo sapiens
gggacggcggcggcaaa

SEQ ID NO: 46687 - DNA, 20 bp, Homo sapiens
gggcatccagagggtagaaa

SEQ ID NO: 46688 - DNA, 16 bp, Homo sapiens
gggaggggatagaaac

SEQ ID NO: 46689 - DNA, 18 bp, Homo sapiens
gggaaaacagtgacaggt

SEQ ID NO: 46690 - DNA, 22 bp, Homo sapiens
gggaagacaggtggtgaaaacg

SEQ ID NO: 46691 - DNA, 18 bp, Homo sapiens
gggaaatgcaggtagaaa

SEQ ID NO: 46692 - DNA, 20 bp, Homo sapiens
gggcaaacagaatgggtgga

SEQ ID NO: 46693 - DNA, 20 bp, Homo sapiens
gggaaatggggcaaacagaa

SEQ ID NO: 46694 - DNA, 16 bp, Homo sapiens
gggaaaacgtgggaaa

SEQ ID NO: 46695 - DNA, 19 bp, Homo sapiens
gagaggacggcgaggccag

SEQ ID NO: 46696 - DNA, 20 bp, Homo sapiens
gggaaagcaggcaatgggag

SEQ ID NO: 46697 - DNA, 22 bp, Homo sapiens
gggagggcagtaggtggagacg

SEQ ID NO: 46698 - DNA, 20 bp, Homo sapiens
gggaaagcagcgctcgggag

SEQ ID NO: 46699 - DNA, 15 bp, Homo sapiens
gggaaggcaggcaga

SEQ ID NO: 46700 - DNA, 18 bp, Homo sapiens
ggcgaggacggcgaaggt

SEQ ID NO: 46701 - DNA, 17 bp, Homo sapiens
aggagagcgaaggtaga

SEQ ID NO: 46702 - DNA, 20 bp, Homo sapiens
aggaaaggacagggtggaaa

SEQ ID NO: 46703 - DNA, 20 bp, Homo sapiens
gggaggaggcgagggaaacg

SEQ ID NO: 46704 - DNA, 18 bp, Homo sapiens
ggggggcgagaagtggaa

SEQ ID NO: 46705 - DNA, 19 bp, Homo sapiens
ggaaggtggcgagaggaaa

SEQ ID NO: 46706 - DNA, 17 bp, Homo sapiens
gggaagaggcggggcga

SEQ ID NO: 46707 - DNA, 18 bp, Homo sapiens
aggagaacggcgacggag

SEQ ID NO: 46708 - DNA, 21 bp, Homo sapiens
gggaaaacggagtaagggaaa

SEQ ID NO: 46709 - DNA, 18 bp, Homo sapiens
gggaaaatgtggcagaaa

SEQ ID NO: 46710 - DNA, 87 bp, Bovine herpesvirus 1
gtcatcggcgtacgtggggatgtaccgcgactgaaagctgttggcgacgtaagagtccgggcccatcagcccagatatgtcgatgac

SEQ ID NO: 46711 - DNA, 24 bp, Bovine herpesvirus 1
aagagtccgggcccatcagcccag

SEQ ID NO: 46712 - DNA, 18 bp, Homo sapiens
agaggttcgagatcagcc

SEQ ID NO: 46713 - DNA, 22 bp, Homo sapiens
agaggtcatgccgtcagcccag

SEQ ID NO: 46714 - DNA, 19 bp, Homo sapiens
gtccaggctcccctcccag

SEQ ID NO: 46715 - DNA, 21 bp, Homo sapiens
gagccggagagcacagcccag

SEQ ID NO: 46716 - DNA, 16 bp, Homo sapiens
gagttcgagaccagcc

SEQ ID NO: 46717 - DNA, 20 bp, Homo sapiens
gtcgggcccggtgacctcag

SEQ ID NO: 46718 - DNA, 16 bp, Homo sapiens
gagccgggcccaaccc

SEQ ID NO: 46719 - DNA, 16 bp, Homo sapiens
gagttcaagatcagcc

SEQ ID NO: 46720 - DNA, 17 bp, Homo sapiens
gagttcgagatcagccc

SEQ ID NO: 46721 - DNA, 24 bp, Homo sapiens
aagatgaggagtctgtcagcccag

SEQ ID NO: 46722 - DNA, 17 bp, Homo sapiens
aggtccgggcccttcag

SEQ ID NO: 46723 - DNA, 18 bp, Homo sapiens
aagtgtccgggcccccag

SEQ ID NO: 46724 - DNA, 19 bp, Homo sapiens
agagtccgggcctctgagc

SEQ ID NO: 46725 - DNA, 19 bp, Homo sapiens
aagagttcgagaccagccc

SEQ ID NO: 46726 - DNA, 19 bp, Homo sapiens
gagttcgagaccagcccag

SEQ ID NO: 46727 - DNA, 18 bp, Homo sapiens
aagagtcccggggctcag

SEQ ID NO: 46728 - DNA, 17 bp, Homo sapiens
agggcccgggcccgcag

SEQ ID NO: 46729 - DNA, 17 bp, Homo sapiens
gagtttgaaaccagccc

SEQ ID NO: 46730 - DNA, 19 bp, Homo sapiens
aagagtcagggcccatcag

SEQ ID NO: 46731 - DNA, 16 bp, Homo sapiens
agagttgggcccacag

SEQ ID NO: 46732 - DNA, 18 bp, Homo sapiens
gggcacccatcagcccag

SEQ ID NO: 46733 - DNA, 19 bp, Homo sapiens
agaatccgggcccgggccc

SEQ ID NO: 46734 - DNA, 22 bp, Homo sapiens
ggaagtccgggccgtcgtccag

SEQ ID NO: 46735 - DNA, 21 bp, Homo sapiens
gagtccggggccccttcccag

SEQ ID NO: 46736 - DNA, 19 bp, Homo sapiens
gtctgaggccccagcccag

SEQ ID NO: 46737 - DNA, 16 bp, Homo sapiens
gagttcgggcccagcc

SEQ ID NO: 46738 - DNA, 18 bp, Homo sapiens
aaagtcaccatcagctca

SEQ ID NO: 46739 - DNA, 19 bp, Homo sapiens
gtccgagcccccataccag

SEQ ID NO: 46740 - DNA, 19 bp, Homo sapiens
aagagtccgagtagctcag

SEQ ID NO: 46741 - DNA, 21 bp, Homo sapiens
gagggccgggcccacagtcag

SEQ ID NO: 46742 - DNA, 23 bp, Homo sapiens
gaggggccgggcccggggcccag

SEQ ID NO: 46743 - DNA, 19 bp, Homo sapiens
agagtccaggcccatccac

SEQ ID NO: 46744 - DNA, 21 bp, Homo sapiens
gaggtcctggagtcagcccag

SEQ ID NO: 46745 - DNA, 21 bp, Homo sapiens
agtctgggtttgccagcccag

SEQ ID NO: 46746 - DNA, 20 bp, Homo sapiens
gggtgctcccatcagctcag

SEQ ID NO: 46747 - DNA, 18 bp, Homo sapiens
aagtggtccatcagctca

SEQ ID NO: 46748 - DNA, 21 bp, Homo sapiens
gtctggggggcgtcagcccag

SEQ ID NO: 46749 - DNA, 21 bp, Homo sapiens
gagtccgggtccaaggcccag

SEQ ID NO: 46750 - DNA, 17 bp, Homo sapiens
aagggcccgggccaccc

SEQ ID NO: 46751 - DNA, 21 bp, Homo sapiens
gagagacccaaatcagcccag

SEQ ID NO: 46752 - DNA, 21 bp, Homo sapiens
gagtccagggccagtattcag

SEQ ID NO: 46753 - DNA, 20 bp, Homo sapiens
agaggctggactcagcccag

SEQ ID NO: 46754 - DNA, 19 bp, Homo sapiens
gtccgagctcgctttccag

SEQ ID NO: 46755 - DNA, 19 bp, Homo sapiens
gagtttgagaccagcccag

SEQ ID NO: 46756 - DNA, 18 bp, Homo sapiens
aagagctcaaggtcagcc

SEQ ID NO: 46757 - DNA, 17 bp, Homo sapiens
gagtttgagaccagccc

SEQ ID NO: 46758 - DNA, 17 bp, Homo sapiens
gagttcgagaccagccc

SEQ ID NO: 46759 - DNA, 21 bp, Homo sapiens
aagagtttgcaaccagcccag

SEQ ID NO: 46760 - DNA, 20 bp, Homo sapiens
gccgggccctctgccagccc

SEQ ID NO: 46761 - DNA, 21 bp, Homo sapiens
aagggtccaggctcagggccc

SEQ ID NO: 46762 - DNA, 16 bp, Homo sapiens
gaattcaagatcagcc

SEQ ID NO: 46763 - DNA, 17 bp, Homo sapiens
agggtcgggcccactgc

SEQ ID NO: 46764 - DNA, 16 bp, Homo sapiens
gagttcgaaaccagcc

SEQ ID NO: 46765 - DNA, 20 bp, Homo sapiens
gagtccagggccgtctctcc

SEQ ID NO: 46766 - DNA, 18 bp, Homo sapiens
gactccgggccctcgccc

SEQ ID NO: 46767 - DNA, 17 bp, Homo sapiens
gagctggagaccagccc

SEQ ID NO: 46768 - DNA, 18 bp, Homo sapiens
aagcgttcgggaccagcc

SEQ ID NO: 46769 - DNA, 17 bp, Homo sapiens
aggtccgggccacgccc

SEQ ID NO: 46770 - DNA, 20 bp, Homo sapiens
ccagacgcccatcagctcag

SEQ ID NO: 46771 - DNA, 23 bp, Homo sapiens
aagagctgggccccgccacccag

SEQ ID NO: 46772 - DNA, 19 bp, Homo sapiens
gagccgggccgagcctcag

SEQ ID NO: 46773 - DNA, 18 bp, Homo sapiens
aagagttcagtgtcagcc

SEQ ID NO: 46774 - DNA, 17 bp, Homo sapiens
gtccgaacgcagctcag

SEQ ID NO: 46775 - DNA, 20 bp, Homo sapiens
cagtgccttcatcagcccag

SEQ ID NO: 46776 - DNA, 16 bp, Homo sapiens
gagtccgagaccagcc

SEQ ID NO: 46777 - DNA, 18 bp, Homo sapiens
gagtcctcatcggctcag

SEQ ID NO: 46778 - DNA, 66 bp, Rat cytomegalovirus
tacagctacgaagagaatatatgttatgtgagaatgttagacatttttcttttaaatttgcttgta

SEQ ID NO: 46779 - DNA, 24 bp, Rat cytomegalovirus
acgaagagaatatatgttatgtga

SEQ ID NO: 46780 - DNA, 19 bp, Homo sapiens
aagagaatatcaaatgtga

SEQ ID NO: 46781 - DNA, 16 bp, Homo sapiens
gaagaggattatgtga

SEQ ID NO: 46782 - DNA, 21 bp, Homo sapiens
aagaggggacaaagttatgtg

SEQ ID NO: 46783 - DNA, 16 bp, Homo sapiens
gaggagaatctatgtg

SEQ ID NO: 46784 - DNA, 22 bp, Homo sapiens
gaagaaataattttttatgtga

SEQ ID NO: 46785 - DNA, 19 bp, Homo sapiens
gaggcgacattgttatgtg

SEQ ID NO: 46786 - DNA, 22 bp, Homo sapiens
agagaatagtataagcaagtga

SEQ ID NO: 46787 - DNA, 17 bp, Homo sapiens
aagagaataatagtgtg

SEQ ID NO: 46788 - DNA, 15 bp, Homo sapiens
gaagagtatatcatg

SEQ ID NO: 46789 - DNA, 20 bp, Homo sapiens
gaggagagaatatgaatatg

SEQ ID NO: 46790 - DNA, 18 bp, Homo sapiens
gagagaatatatatgtga

SEQ ID NO: 46791 - DNA, 102 bp, Human herpesvirus 1
accacagcgcatgcgccgggccgttgtggggccccgggccggggccccttgggtccgccggggccccgggccgggccgccacgggggccggccgttggcggt

SEQ ID NO: 46792 - DNA, 24 bp, Human herpesvirus 1
cgttgtggggccccgggccggggc

SEQ ID NO: 46793 - DNA, 20 bp, Homo sapiens
ttgtggggccctgcgctggc

SEQ ID NO: 46794 - DNA, 21 bp, Homo sapiens
gttgtgggattccaggtgggc

SEQ ID NO: 46795 - DNA, 19 bp, Homo sapiens
gttgtggggccacataggg

SEQ ID NO: 46796 - DNA, 20 bp, Homo sapiens
cgctgtggggcttcgagtgg

SEQ ID NO: 46797 - DNA, 19 bp, Homo sapiens
gttgtggggtcctgtgggc

SEQ ID NO: 46798 - DNA, 19 bp, Homo sapiens
cgtgtggggctctggtcgg

SEQ ID NO: 46799 - DNA, 22 bp, Homo sapiens
ctgagcggccccgggctggggc

SEQ ID NO: 46800 - DNA, 22 bp, Homo sapiens
gttgttgggtcctggataaggg

SEQ ID NO: 46801 - DNA, 18 bp, Homo sapiens
agagcttcgggccggggc

SEQ ID NO: 46802 - DNA, 22 bp, Homo sapiens
tgtgggctgcctgggctggggc

SEQ ID NO: 46803 - DNA, 21 bp, Homo sapiens
cgtgtgtggggtctggggggc

SEQ ID NO: 46804 - DNA, 19 bp, Homo sapiens
cgtcgtggggcttctgggg

SEQ ID NO: 46805 - DNA, 20 bp, Homo sapiens
gctgtgccgtgggccggggc

SEQ ID NO: 46806 - DNA, 22 bp, Homo sapiens
gtcgtgggagaagcggtcgggg

SEQ ID NO: 46807 - DNA, 19 bp, Homo sapiens
cgtgtggggcccgaagggg

SEQ ID NO: 46808 - DNA, 19 bp, Homo sapiens
tgtggggctcccactgggc

SEQ ID NO: 46809 - DNA, 21 bp, Homo sapiens
gctgtggggactggctggggc

SEQ ID NO: 46810 - DNA, 24 bp, Homo sapiens
gtgtggggccttggcccagtgggc

SEQ ID NO: 46811 - DNA, 23 bp, Homo sapiens
ttgtggggctagtcctttggggc

SEQ ID NO: 46812 - DNA, 20 bp, Homo sapiens
gcgccagtcccgggccgggg

SEQ ID NO: 46813 - DNA, 21 bp, Homo sapiens
gtgatagagtcgggccggggc

SEQ ID NO: 46814 - DNA, 19 bp, Homo sapiens
tgtggggtgggggccgggg

SEQ ID NO: 46815 - DNA, 18 bp, Homo sapiens
gttgtggagtcccaaggg

SEQ ID NO: 46816 - DNA, 23 bp, Homo sapiens
gtgtgtggggccccggccggggc

SEQ ID NO: 46817 - DNA, 21 bp, Homo sapiens
cgttctggggccctggggacg

SEQ ID NO: 46818 - DNA, 18 bp, Homo sapiens
gttgtggggccctggccg

SEQ ID NO: 46819 - DNA, 65 bp, Human herpesvirus 1
ccagcggccggccggcgcttagggggaggatgtcgccgacgccccttggccgccccggctgcagg

SEQ ID NO: 46820 - DNA, 24 bp, Human herpesvirus 1
acgccccttggccgccccggctgc

SEQ ID NO: 46821 - DNA, 21 bp, Homo sapiens
gccgcctcggcgtcccggctg

SEQ ID NO: 46822 - DNA, 20 bp, Homo sapiens
ccctggccacggaatggctg

SEQ ID NO: 46823 - DNA, 18 bp, Homo sapiens
gctcccttggtccagctg

SEQ ID NO: 46824 - DNA, 18 bp, Homo sapiens
gctcccttggctgcctgg

SEQ ID NO: 46825 - DNA, 25 bp, Homo sapiens
gccccccaaagccctgccctggctg

SEQ ID NO: 46826 - DNA, 22 bp, Homo sapiens
cgcccgccgccgctccggctgc

SEQ ID NO: 46827 - DNA, 21 bp, Homo sapiens
acgcgcggctgccccggctgc

SEQ ID NO: 46828 - DNA, 21 bp, Homo sapiens
gcccttggctcacccggctgc

SEQ ID NO: 46829 - DNA, 19 bp, Homo sapiens
gcccttggccgccccgtgc

SEQ ID NO: 46830 - DNA, 22 bp, Homo sapiens
cgtccccgaccgtcccggctgc

SEQ ID NO: 46831 - DNA, 18 bp, Homo sapiens
cgccgctcctcccggctg

SEQ ID NO: 46832 - DNA, 16 bp, Homo sapiens
gcccccctccccggct

SEQ ID NO: 46833 - DNA, 21 bp, Homo sapiens
gcctccctgccgccctggctg

SEQ ID NO: 46834 - DNA, 17 bp, Homo sapiens
ccccttggccgccgagc

SEQ ID NO: 46835 - DNA, 21 bp, Homo sapiens
acgcttggcagctccggctgc

SEQ ID NO: 46836 - DNA, 26 bp, Homo sapiens
acagctcagccacctgttctggctgc

SEQ ID NO: 46837 - DNA, 22 bp, Homo sapiens
acgctcctctcagcccggctgc

SEQ ID NO: 46838 - DNA, 19 bp, Homo sapiens
gcttccccgctccggctgc

SEQ ID NO: 46839 - DNA, 19 bp, Homo sapiens
ccttttggccacatgactg

SEQ ID NO: 46840 - DNA, 21 bp, Homo sapiens
cgctccccgagctccggctgc

SEQ ID NO: 46841 - DNA, 16 bp, Homo sapiens
gccccttgccgggctg

SEQ ID NO: 46842 - DNA, 23 bp, Homo sapiens
gcctccctaacgacttcggctgc

SEQ ID NO: 46843 - DNA, 25 bp, Homo sapiens
cgccccttcctggcgcctcggctgc

SEQ ID NO: 46844 - DNA, 22 bp, Homo sapiens
gctccgggactgctccggctgc

SEQ ID NO: 46845 - DNA, 22 bp, Homo sapiens
acccttcttggccgcccacagc

SEQ ID NO: 46846 - DNA, 18 bp, Homo sapiens
cccttggccagtggttgc

SEQ ID NO: 46847 - DNA, 17 bp, Homo sapiens
cgcctcttggccagctg

SEQ ID NO: 46848 - DNA, 21 bp, Homo sapiens
acgcctcctggctgttcctgc

SEQ ID NO: 46849 - DNA, 18 bp, Homo sapiens
cccttcccttccggctgc

SEQ ID NO: 46850 - DNA, 17 bp, Homo sapiens
gccccttggctgctggc

SEQ ID NO: 46851 - DNA, 19 bp, Homo sapiens
gcctcttggtgcccggctg

SEQ ID NO: 46852 - DNA, 21 bp, Homo sapiens
acgtgcctcccatcccggctg

SEQ ID NO: 46853 - DNA, 28 bp, Homo sapiens
acgccccttggacgcccctcccggctgc

SEQ ID NO: 46854 - DNA, 23 bp, Homo sapiens
gcagcggaggctgccccggctgc

SEQ ID NO: 46855 - DNA, 18 bp, Homo sapiens
cgtcccctggccttgctg

SEQ ID NO: 46856 - DNA, 19 bp, Homo sapiens
gccgtctgcgtcccggctg

SEQ ID NO: 46857 - DNA, 23 bp, Homo sapiens
gcgcttgctcctctcccggctgc

SEQ ID NO: 46858 - DNA, 18 bp, Homo sapiens
gcgtcccggtcccggctg

SEQ ID NO: 46859 - DNA, 21 bp, Homo sapiens
cgccccttgtcgagcagctgc

SEQ ID NO: 46860 - DNA, 18 bp, Homo sapiens
ccttcggccgcctccagc

SEQ ID NO: 46861 - DNA, 18 bp, Homo sapiens
acgccccttggccacccc

SEQ ID NO: 46862 - DNA, 19 bp, Homo sapiens
gctccctgccccccggctg

SEQ ID NO: 46863 - DNA, 20 bp, Homo sapiens
caccccttggtgcggggctg

SEQ ID NO: 46864 - DNA, 18 bp, Homo sapiens
gccccctcctcccggctg

SEQ ID NO: 46865 - DNA, 22 bp, Homo sapiens
actccccttggccgctgaaagc

SEQ ID NO: 46866 - DNA, 24 bp, Homo sapiens
cgcccccgccgccgccctggctgc

SEQ ID NO: 46867 - DNA, 19 bp, Homo sapiens
acgtcccttggcccttccg

SEQ ID NO: 46868 - DNA, 19 bp, Homo sapiens
acgccccttggccctcagc

SEQ ID NO: 46869 - DNA, 17 bp, Homo sapiens
ccaccttgtcccggctg

SEQ ID NO: 46870 - DNA, 19 bp, Homo sapiens
acaccccttggccatgctg

SEQ ID NO: 46871 - DNA, 18 bp, Homo sapiens
gccctgtggccgccctgc

SEQ ID NO: 46872 - DNA, 20 bp, Homo sapiens
gctcttcggccgcccaaaac

SEQ ID NO: 46873 - DNA, 19 bp, Homo sapiens
gcctccttggccgctaagc

SEQ ID NO: 46874 - DNA, 25 bp, Homo sapiens
gccccttggcctcctgcttggctgc

SEQ ID NO: 46875 - DNA, 22 bp, Homo sapiens
caccaatggctgccccggctgc

SEQ ID NO: 46876 - DNA, 19 bp, Homo sapiens
cgcccagcgccccggctgc

SEQ ID NO: 46877 - DNA, 27 bp, Homo sapiens
accccccggggtggctgccttggctgc

SEQ ID NO: 46878 - DNA, 22 bp, Homo sapiens
gcccgggagccgctccggctgc

SEQ ID NO: 46879 - DNA, 23 bp, Homo sapiens
acccttccactctgctctggctg

SEQ ID NO: 46880 - DNA, 19 bp, Homo sapiens
cgtcctttggccgcctggc

SEQ ID NO: 46881 - DNA, 19 bp, Homo sapiens
accccttttggctgctggc

SEQ ID NO: 46882 - DNA, 17 bp, Homo sapiens
gcccccggccccggctg

SEQ ID NO: 46883 - DNA, 19 bp, Homo sapiens
cgcccctcctcctcggttg

SEQ ID NO: 46884 - DNA, 131 bp, Human herpesvirus 1
tctgcctctgccgcttgtgagtgcgcgcgccggctctgcggtgtcggcggcggctgcggcggctgcggcggccgccgtgttcggtctcggtagccggccggcgggtggactcgcggggggccggagggtgg

SEQ ID NO: 46885 - DNA, 24 bp, Human herpesvirus 1
tgagtgcgcgcgccggctctgcgg

SEQ ID NO: 46886 - DNA, 23 bp, Homo sapiens
tgggcgcgcgcgggactttgcgg

SEQ ID NO: 46887 - DNA, 20 bp, Homo sapiens
gcgcgcgccggctcccccgg

SEQ ID NO: 46888 - DNA, 20 bp, Homo sapiens
gagtggttctggctctgcgg

SEQ ID NO: 46889 - DNA, 18 bp, Homo sapiens
gtgcgtgcgccggcaccg

SEQ ID NO: 46890 - DNA, 18 bp, Homo sapiens
tgagtgtggctctctgcg

SEQ ID NO: 46891 - DNA, 19 bp, Homo sapiens
tgagagcgtgggctctgcg

SEQ ID NO: 46892 - DNA, 22 bp, Homo sapiens
tgggtgcgctgcagcagctgtg

SEQ ID NO: 46893 - DNA, 21 bp, Homo sapiens
gagtgcgtggggcctctgcgg

SEQ ID NO: 46894 - DNA, 106 bp, Human herpesvirus 1
ggcaaagcggcggggcggttcggggggggggggggggggcgggaaaccaagtaggcccgcccatccgcggcccctcccggcagccacgcccccagcgtcgggtgtc

SEQ ID NO: 46895 - DNA, 24 bp, Human herpesvirus 1
aagcggcggggcggttcggggggg

SEQ ID NO: 46896 - DNA, 17 bp, Homo sapiens
ggcggggcgtggggggg

SEQ ID NO: 46897 - DNA, 16 bp, Homo sapiens
gcggcggggtgtaggg

SEQ ID NO: 46898 - DNA, 19 bp, Homo sapiens
agcggcggggcggacgggg

SEQ ID NO: 46899 - DNA, 22 bp, Homo sapiens
gcgcggggccggcgcggggggg

SEQ ID NO: 46900 - DNA, 18 bp, Homo sapiens
ggcgggggggcgggtggg

SEQ ID NO: 46901 - DNA, 16 bp, Homo sapiens
ggtggggcgccggggg

SEQ ID NO: 46902 - DNA, 21 bp, Homo sapiens
aggtgccgggggatggggggg

SEQ ID NO: 46903 - DNA, 18 bp, Homo sapiens
agtggaggggcggtgggg

SEQ ID NO: 46904 - DNA, 16 bp, Homo sapiens
gcggcgggcggcgggg

SEQ ID NO: 46905 - DNA, 19 bp, Homo sapiens
cggcggcggggttgggggg

SEQ ID NO: 46906 - DNA, 19 bp, Homo sapiens
gcaggcggggccagggggg

SEQ ID NO: 46907 - DNA, 20 bp, Homo sapiens
agccggcggggcggccgggg

SEQ ID NO: 46908 - DNA, 21 bp, Homo sapiens
gcggccgggcgggggcggggg

SEQ ID NO: 46909 - DNA, 22 bp, Homo sapiens
agcagcggggcgggggcggggg

SEQ ID NO: 46910 - DNA, 18 bp, Homo sapiens
gcggttgggcgcaggggg

SEQ ID NO: 46911 - DNA, 19 bp, Homo sapiens
ggcgtggggtgcgcggggg

SEQ ID NO: 46912 - DNA, 22 bp, Homo sapiens
gcggcggggggcggagcggggg

SEQ ID NO: 46913 - DNA, 20 bp, Homo sapiens
ggtggtggcggtggcggggg

SEQ ID NO: 46914 - DNA, 22 bp, Homo sapiens
gcggcggggcggcgcatggggg

SEQ ID NO: 46915 - DNA, 19 bp, Homo sapiens
agcggcggggcgcgcgggg

SEQ ID NO: 46916 - DNA, 19 bp, Homo sapiens
agggcggggcggtggcggg

SEQ ID NO: 46917 - DNA, 17 bp, Homo sapiens
ggggggcggggcggggg

SEQ ID NO: 46918 - DNA, 19 bp, Homo sapiens
cggcggggggttggggggg

SEQ ID NO: 46919 - DNA, 19 bp, Homo sapiens
agggcggggcggcgcgggg

SEQ ID NO: 46920 - DNA, 20 bp, Homo sapiens
gcgcggggcgatgagggggg

SEQ ID NO: 46921 - DNA, 20 bp, Homo sapiens
ggcgcgggaggatggggggg

SEQ ID NO: 46922 - DNA, 19 bp, Homo sapiens
gcggcaggggtggcagggg

SEQ ID NO: 46923 - DNA, 18 bp, Homo sapiens
ggcaggggcggggcgggg

SEQ ID NO: 46924 - DNA, 18 bp, Homo sapiens
ggggggcggggcgggagg

SEQ ID NO: 46925 - DNA, 18 bp, Homo sapiens
aggggcggggcgtggggg

SEQ ID NO: 46926 - DNA, 21 bp, Homo sapiens
gcggcggggggggcggggggg

SEQ ID NO: 46927 - DNA, 19 bp, Homo sapiens
agcggcggggcgggcgggg

SEQ ID NO: 46928 - DNA, 17 bp, Homo sapiens
gcggtggggggcggggg

SEQ ID NO: 46929 - DNA, 17 bp, Homo sapiens
ggtggggcggtgggggg

SEQ ID NO: 46930 - DNA, 17 bp, Homo sapiens
agcggctgggcggttgg

SEQ ID NO: 46931 - DNA, 18 bp, Homo sapiens
ggcgggcggggcggaggg

SEQ ID NO: 46932 - DNA, 22 bp, Homo sapiens
ggcggcggcggtggcggagggg

SEQ ID NO: 46933 - DNA, 17 bp, Homo sapiens
gcggcgggcgagggggg

SEQ ID NO: 46934 - DNA, 22 bp, Homo sapiens
agcggcgggcggcgttcggggg

SEQ ID NO: 46935 - DNA, 15 bp, Homo sapiens
ggcggggggcggggg

SEQ ID NO: 46936 - DNA, 18 bp, Homo sapiens
gcggcgcggcgggagggg

SEQ ID NO: 46937 - DNA, 21 bp, Homo sapiens
gcgcgcggggtggggcggggg

SEQ ID NO: 46938 - DNA, 22 bp, Homo sapiens
gcggccggggccggtggggggg

SEQ ID NO: 46939 - DNA, 23 bp, Homo sapiens
agcagcggggtgggggtgggggg

SEQ ID NO: 46940 - DNA, 17 bp, Homo sapiens
ggcggtgggggtggggg

SEQ ID NO: 46941 - DNA, 18 bp, Homo sapiens
ggcgggtggggcgggggg

SEQ ID NO: 46942 - DNA, 23 bp, Homo sapiens
aaggggcggggcggggtgggggg

SEQ ID NO: 46943 - DNA, 19 bp, Homo sapiens
agtggcagggcggaggggg

SEQ ID NO: 46944 - DNA, 18 bp, Homo sapiens
gcggcggagtgcaggggg

SEQ ID NO: 46945 - DNA, 16 bp, Homo sapiens
ggcggcggcgcggggg

SEQ ID NO: 46946 - DNA, 17 bp, Homo sapiens
ggcggggcggggtgggg

SEQ ID NO: 46947 - DNA, 15 bp, Homo sapiens
agcggcgctcggggg

SEQ ID NO: 46948 - DNA, 19 bp, Homo sapiens
agggtggggtggcaagggg

SEQ ID NO: 46949 - DNA, 21 bp, Homo sapiens
gcggcggggcgcgcacggggg

SEQ ID NO: 46950 - DNA, 19 bp, Homo sapiens
agggtggggtgggctgggg

SEQ ID NO: 46951 - DNA, 17 bp, Homo sapiens
agcggggggcggttggg

SEQ ID NO: 46952 - DNA, 20 bp, Homo sapiens
gggggtggaggtcggggggg

SEQ ID NO: 46953 - DNA, 18 bp, Homo sapiens
ggaggggcgtagaggggg

SEQ ID NO: 46954 - DNA, 18 bp, Homo sapiens
gcggtgggcggccggggg

SEQ ID NO: 46955 - DNA, 18 bp, Homo sapiens
agtgggggggcggggggg

SEQ ID NO: 46956 - DNA, 17 bp, Homo sapiens
gcggtggggcagggggg

SEQ ID NO: 46957 - DNA, 18 bp, Homo sapiens
ggctgtggggctgggggg

SEQ ID NO: 46958 - DNA, 22 bp, Homo sapiens
gcggggggcggcggcgcggggg

SEQ ID NO: 46959 - DNA, 17 bp, Homo sapiens
ggggggcggcggggggg

SEQ ID NO: 46960 - DNA, 15 bp, Homo sapiens
agcggggggtggggg

SEQ ID NO: 46961 - DNA, 23 bp, Homo sapiens
agggcggggctgggctggggggg

SEQ ID NO: 46962 - DNA, 16 bp, Homo sapiens
ggcggtgggatggggg

SEQ ID NO: 46963 - DNA, 21 bp, Homo sapiens
gcggtgggcgaagctgggggg

SEQ ID NO: 46964 - DNA, 18 bp, Homo sapiens
ggcgtggcgggggggggg

SEQ ID NO: 46965 - DNA, 19 bp, Homo sapiens
gcggtggggggtaaggggg

SEQ ID NO: 46966 - DNA, 20 bp, Homo sapiens
gcgccggggtgggcgcgggg

SEQ ID NO: 46967 - DNA, 17 bp, Homo sapiens
gccgcgggcgcgggggg

SEQ ID NO: 46968 - DNA, 20 bp, Homo sapiens
gggggggcggcgatgggggg

SEQ ID NO: 46969 - DNA, 23 bp, Homo sapiens
gcggcggggcggggagaaggggg

SEQ ID NO: 46970 - DNA, 19 bp, Homo sapiens
ggcgggggttgcggggggg

SEQ ID NO: 46971 - DNA, 19 bp, Homo sapiens
agtggtggggtgagggggg

SEQ ID NO: 46972 - DNA, 21 bp, Homo sapiens
gcggcggcggcggcacggggg

SEQ ID NO: 46973 - DNA, 22 bp, Homo sapiens
ggcggtggcggcgggggtgggg

SEQ ID NO: 46974 - DNA, 23 bp, Homo sapiens
gcgcggggcggtggcggcggggg

SEQ ID NO: 46975 - DNA, 20 bp, Homo sapiens
ggtggcggcggtggcagggg

SEQ ID NO: 46976 - DNA, 19 bp, Homo sapiens
gcggcgggaggcggggggg

SEQ ID NO: 46977 - DNA, 15 bp, Homo sapiens
ggcgggggctggggg

SEQ ID NO: 46978 - DNA, 20 bp, Homo sapiens
ggggggcgatgggcgggggg

SEQ ID NO: 46979 - DNA, 18 bp, Homo sapiens
ggcggggggtgggtgggg

SEQ ID NO: 46980 - DNA, 19 bp, Homo sapiens
agggggcgggggagggggg

SEQ ID NO: 46981 - DNA, 17 bp, Homo sapiens
gcgcggggcgcgggggg

SEQ ID NO: 46982 - DNA, 20 bp, Homo sapiens
gcggcggggtgggcgggggg

SEQ ID NO: 46983 - DNA, 17 bp, Homo sapiens
gcggcggggatgggggg

SEQ ID NO: 46984 - DNA, 16 bp, Homo sapiens
ggcggggcggcggggg

SEQ ID NO: 46985 - DNA, 20 bp, Homo sapiens
ggcggtggtggtggaggggg

SEQ ID NO: 46986 - DNA, 22 bp, Homo sapiens
gcggcggaggcggtggaggggg

SEQ ID NO: 46987 - DNA, 19 bp, Homo sapiens
gcgcggggcgggctcgggg

SEQ ID NO: 46988 - DNA, 17 bp, Homo sapiens
gcggggggcggtaaggg

SEQ ID NO: 46989 - DNA, 17 bp, Homo sapiens
ggcaggggcggcagggg

SEQ ID NO: 46990 - DNA, 22 bp, Homo sapiens
gcggcggcggcggcagccgggg

SEQ ID NO: 46991 - DNA, 19 bp, Homo sapiens
agggtggggtggggtgggg

SEQ ID NO: 46992 - DNA, 16 bp, Homo sapiens
ggtggggcagcagggg

SEQ ID NO: 46993 - DNA, 22 bp, Homo sapiens
gcggtggcggcggcgttggggg

SEQ ID NO: 46994 - DNA, 19 bp, Homo sapiens
ggcggtgggggtggtgggg

SEQ ID NO: 46995 - DNA, 19 bp, Homo sapiens
gcggggggcggggtggggg

SEQ ID NO: 46996 - DNA, 17 bp, Homo sapiens
aggtgcggggcgagggg

SEQ ID NO: 46997 - DNA, 19 bp, Homo sapiens
gcggcgggcggcacggggg

SEQ ID NO: 46998 - DNA, 17 bp, Homo sapiens
ggcgggagtcggggggg

SEQ ID NO: 46999 - DNA, 20 bp, Homo sapiens
gcggcggcggcggtggcggg

SEQ ID NO: 47000 - DNA, 20 bp, Homo sapiens
ggtgggggcgggcggggggg

SEQ ID NO: 47001 - DNA, 18 bp, Homo sapiens
agcggggggcgccggggg

SEQ ID NO: 47002 - DNA, 17 bp, Homo sapiens
ggcggggcgggtaaggg

SEQ ID NO: 47003 - DNA, 17 bp, Homo sapiens
gccgcgggggcgggggg

SEQ ID NO: 47004 - DNA, 21 bp, Homo sapiens
gcggcgggagcgggtccgggg

SEQ ID NO: 47005 - DNA, 17 bp, Homo sapiens
ggtggggcggcgggggg

SEQ ID NO: 47006 - DNA, 20 bp, Homo sapiens
ggaggtggggctcagggggg

SEQ ID NO: 47007 - DNA, 17 bp, Homo sapiens
cggcggggcgggtgggg

SEQ ID NO: 47008 - DNA, 19 bp, Homo sapiens
gctggggcgggagcggggg

SEQ ID NO: 47009 - DNA, 21 bp, Homo sapiens
gcgccggggcggaggccgggg

SEQ ID NO: 47010 - DNA, 17 bp, Homo sapiens
ggcggggcggggagggg

SEQ ID NO: 47011 - DNA, 18 bp, Homo sapiens
ggcggggcggggtagggg

SEQ ID NO: 47012 - DNA, 19 bp, Homo sapiens
agtggtggggcggttatag

SEQ ID NO: 47013 - DNA, 21 bp, Homo sapiens
agcggcgggcgcggaccgggg

SEQ ID NO: 47014 - DNA, 20 bp, Homo sapiens
gcggcggggggacgggaggg

SEQ ID NO: 47015 - DNA, 18 bp, Homo sapiens
gcggcaggggctgggggg

SEQ ID NO: 47016 - DNA, 19 bp, Homo sapiens
aggggcggggcggcagggg

SEQ ID NO: 47017 - DNA, 21 bp, Homo sapiens
ggacggtggggtgggctgggg

SEQ ID NO: 47018 - DNA, 19 bp, Homo sapiens
aagggtggggggtgggggg

SEQ ID NO: 47019 - DNA, 19 bp, Homo sapiens
gcggtgggcgggcaggggg

SEQ ID NO: 47020 - DNA, 18 bp, Homo sapiens
gcggggggtggttcatag

SEQ ID NO: 47021 - DNA, 23 bp, Homo sapiens
gcggcggggtggagagtgggggg

SEQ ID NO: 47022 - DNA, 19 bp, Homo sapiens
gcgcggggcgtcgtggggg

SEQ ID NO: 47023 - DNA, 20 bp, Homo sapiens
aggggcggggcgagcggggg

SEQ ID NO: 47024 - DNA, 17 bp, Homo sapiens
gcggtggggggctgggg

SEQ ID NO: 47025 - DNA, 76 bp, Rat cytomegalovirus
tttttttattttgtctttgggtttataggagagaaaaactcccggatggacattgactttagagagagtaaaagaa

SEQ ID NO: 47026 - DNA, 24 bp, Rat cytomegalovirus
tattttgtctttgggtttatagga

SEQ ID NO: 47027 - DNA, 23 bp, Homo sapiens
tattttctcttctggtttatagg

SEQ ID NO: 47028 - DNA, 20 bp, Homo sapiens
ttttgctttgggtcagaagg

SEQ ID NO: 47029 - DNA, 21 bp, Homo sapiens
tgctttgttttgcttatagga

SEQ ID NO: 47030 - DNA, 19 bp, Homo sapiens
cattttgtctttatatagg

SEQ ID NO: 47031 - DNA, 19 bp, Homo sapiens
ttttgttttctttatagga

SEQ ID NO: 47032 - DNA, 21 bp, Homo sapiens
tattttatttttggagacagg

SEQ ID NO: 47033 - DNA, 22 bp, Homo sapiens
ctttgtatttgggtttgtggga

SEQ ID NO: 47034 - DNA, 18 bp, Homo sapiens
ttttatctggattgtagg

SEQ ID NO: 47035 - DNA, 16 bp, Homo sapiens
ttttgtcttggagagg

SEQ ID NO: 47036 - DNA, 21 bp, Homo sapiens
cattttgtctttccaagtggg

SEQ ID NO: 47037 - DNA, 18 bp, Homo sapiens
tattttgtctatgggttc

SEQ ID NO: 47038 - DNA, 15 bp, Homo sapiens
tattttgttttgggg

SEQ ID NO: 47039 - DNA, 73 bp, Equine arteritis virus
ttgccgccgtgggcaatcggttgttagtcccaggtaggcccactatcgattatgcagtggcctacggcagcaa

SEQ ID NO: 47040 - DNA, 24 bp, Equine arteritis virus
ccgccgtgggcaatcggttgttag

SEQ ID NO: 47041 - DNA, 15 bp, Homo sapiens
gccgtgggcaagtta

SEQ ID NO: 47042 - DNA, 24 bp, Homo sapiens
ccgttgtaggcaagtaaagttgtt

SEQ ID NO: 47043 - DNA, 20 bp, Homo sapiens
gtgggcaatttcaaatttag

SEQ ID NO: 47044 - DNA, 18 bp, Homo sapiens
ccgctgtgggcagtgcca

SEQ ID NO: 47045 - DNA, 19 bp, Homo sapiens
cctcgtgggcagtcaggtg

SEQ ID NO: 47046 - DNA, 15 bp, Homo sapiens
ccgccgtgggggttg

SEQ ID NO: 47047 - DNA, 65 bp, Rat cytomegalovirus
gtgccgtttagatggtctcagaccgggatcgaggtgcaaggttgggtctaaggcgggaaggggat

SEQ ID NO: 47048 - DNA, 24 bp, Rat cytomegalovirus
ttgggtctaaggcgggaaggggat

SEQ ID NO: 47049 - DNA, 18 bp, Homo sapiens
ctgggaggcgggaggggg

SEQ ID NO: 47050 - DNA, 19 bp, Homo sapiens
ttgggctttggagaagggg

SEQ ID NO: 47051 - DNA, 21 bp, Homo sapiens
ttaaaaaaaggcggggggggg

SEQ ID NO: 47052 - DNA, 19 bp, Homo sapiens
ctgggtctggggcaggggg

SEQ ID NO: 47053 - DNA, 19 bp, Homo sapiens
aggtaaaggcggggagggg

SEQ ID NO: 47054 - DNA, 21 bp, Homo sapiens
ttgggctccctggggaggggg

SEQ ID NO: 47055 - DNA, 20 bp, Homo sapiens
taggcctcggtggggggggg

SEQ ID NO: 47056 - DNA, 23 bp, Homo sapiens
ttgggtcctggcccgagaagggg

SEQ ID NO: 47057 - DNA, 64 bp, Myxoma virus
cacggtcgttgtaggcttgtgatagatgagaaacataaacggtttgttcgccacgatcgccgtg

SEQ ID NO: 47058 - DNA, 24 bp, Myxoma virus
tcgttgtaggcttgtgatagatga

SEQ ID NO: 47059 - DNA, 16 bp, Homo sapiens
tcttgtaggctttgat

SEQ ID NO: 47060 - DNA, 18 bp, Homo sapiens
tcgctgtaggggtggatg

SEQ ID NO: 47061 - DNA, 23 bp, Homo sapiens
gttgtaggtactgagataggtga

SEQ ID NO: 47062 - DNA, 19 bp, Homo sapiens
gttgaagggctatagatga

SEQ ID NO: 47063 - DNA, 61 bp, Amsacta moorei entomopoxvirus
gttttagaaaaccatctactatatcatatgaaatactggtatttgatatttcttttaaaac

SEQ ID NO: 47064 - DNA, 20 bp, Amsacta moorei entomopoxvirus
tttgatatttcttttaaaac

SEQ ID NO: 47065 - DNA, 18 bp, Homo sapiens
taatctttcttttaaaac

SEQ ID NO: 47066 - DNA, 18 bp, Homo sapiens
tctggtatttctcccaaa

SEQ ID NO: 47067 - DNA, 18 bp, Homo sapiens
tttgatgtttccctcaaa

SEQ ID NO: 47068 - DNA, 18 bp, Homo sapiens
taacatttcttttaaaac

SEQ ID NO: 47069 - DNA, 21 bp, Homo sapiens
ttccatcctttcttttaaaac

SEQ ID NO: 47070 - DNA, 20 bp, Homo sapiens
tttaatatttctttacaaaa

SEQ ID NO: 47071 - DNA, 20 bp, Homo sapiens
tttaatgtctcctttaaaac

SEQ ID NO: 47072 - DNA, 18 bp, Homo sapiens
tgattcttcttttaaaac

SEQ ID NO: 47073 - DNA, 18 bp, Homo sapiens
tttgatacttccactaaa

SEQ ID NO: 47074 - DNA, 101 bp, Myxoma virus
tcgcgaggagaactccgccgtaaactcgggacgtaacggaacggatgcgtctacgaacaactcccgtaacgcgagaaaggcgtcggagtcctccacgacgg

SEQ ID NO: 47075 - DNA, 24 bp, Myxoma virus
taacgcgagaaaggcgtcggagtc

SEQ ID NO: 47076 - DNA, 19 bp, Homo sapiens
taacgcttggcgtcggagt

SEQ ID NO: 47077 - DNA, 22 bp, Homo sapiens
cgcggggagggacaccggggtc

SEQ ID NO: 47078 - DNA, 18 bp, Homo sapiens
gcggggaaggccagagtc

SEQ ID NO: 47079 - DNA, 20 bp, Homo sapiens
acgccgagcggtgtcggagt

SEQ ID NO: 47080 - DNA, 89 bp, Equine herpesvirus 4
gtgtatgaaatgggcgggatactatctacgtggaccaatttgcatattatatgaaaactaaccgcatgatggcgctattttttaaacac

SEQ ID NO: 47081 - DNA, 24 bp, Equine herpesvirus 4
tatgaaatgggcgggatactatct

SEQ ID NO: 47082 - DNA, 21 bp, Homo sapiens
tgaggacaagggatactgtct

SEQ ID NO: 47083 - DNA, 24 bp, Homo sapiens
tatgaatggagtttggtactatct

SEQ ID NO: 47084 - DNA, 20 bp, Homo sapiens
tgaaacgaagaaagtactat

SEQ ID NO: 47085 - DNA, 18 bp, Homo sapiens
tgaaatgaccagtactat

SEQ ID NO: 47086 - DNA, 19 bp, Homo sapiens
tatgaaatgggcagggata

SEQ ID NO: 47087 - DNA, 19 bp, Homo sapiens
tatgaggtggaaacactat

SEQ ID NO: 47088 - DNA, 24 bp, Homo sapiens
atgaaatggaatcaagtgttatct

SEQ ID NO: 47089 - DNA, 20 bp, Homo sapiens
tgaaaagaaaaatactatct

SEQ ID NO: 47090 - DNA, 18 bp, Homo sapiens
tgaagtgggtgggatact

SEQ ID NO: 47091 - DNA, 19 bp, Homo sapiens
tatgaaatagtaatatact

SEQ ID NO: 47092 - DNA, 20 bp, Homo sapiens
gagatggggtctcactatct

SEQ ID NO: 47093 - DNA, 21 bp, Homo sapiens
tatgagaatacgagatattat

SEQ ID NO: 47094 - DNA, 117 bp, Primate T-lymphotropic virus 3
cctccacctcctcttcgaagaatattccactgtccccttttctctactttttaatgaaaaaggggcaaatgtcagtgatgatgagcttcgagacggaccacaaccaccaactggagg

SEQ ID NO: 47095 - DNA, 24 bp, Primate T-lymphotropic virus 3
tattccactgtccccttttctcta

SEQ ID NO: 47096 - DNA, 18 bp, Homo sapiens
cattccctcccccctttt

SEQ ID NO: 47097 - DNA, 21 bp, Homo sapiens
tctgctgtccttcctccctct

SEQ ID NO: 47098 - DNA, 20 bp, Homo sapiens
ccgtcccctccttttctcta

SEQ ID NO: 47099 - DNA, 22 bp, Homo sapiens
tattccactttattttttctct

SEQ ID NO: 47100 - DNA, 18 bp, Homo sapiens
ttccactgtctccaccct

SEQ ID NO: 47101 - DNA, 17 bp, Homo sapiens
ttcctgttccttcctct

SEQ ID NO: 47102 - DNA, 16 bp, Homo sapiens
tattccactgtgtctc

SEQ ID NO: 47103 - DNA, 23 bp, Homo sapiens
attcagtggtttccttttctcta

SEQ ID NO: 47104 - DNA, 16 bp, Homo sapiens
ttccctgtccctttct

SEQ ID NO: 47105 - DNA, 20 bp, Homo sapiens
cattccctctccttttttct

SEQ ID NO: 47106 - DNA, 22 bp, Homo sapiens
ttccattttctctacctcttct

SEQ ID NO: 47107 - DNA, 24 bp, Homo sapiens
tattccatcgtcccctggaagtct

SEQ ID NO: 47108 - DNA, 21 bp, Homo sapiens
tatgccactgtcttatctttt

SEQ ID NO: 47109 - DNA, 18 bp, Homo sapiens
tatgccactgtctttcct

SEQ ID NO: 47110 - DNA, 16 bp, Homo sapiens
ttctactgttctctct

SEQ ID NO: 47111 - DNA, 18 bp, Homo sapiens
attccaccttttttctct

SEQ ID NO: 47112 - DNA, 15 bp, Homo sapiens
attccactgtctctc

SEQ ID NO: 47113 - DNA, 21 bp, Homo sapiens
actttccattccttttctcta

SEQ ID NO: 47114 - DNA, 19 bp, Homo sapiens
cattccactgtgattttct

SEQ ID NO: 47115 - DNA, 15 bp, Homo sapiens
ccactgtctttctct

SEQ ID NO: 47116 - DNA, 18 bp, Homo sapiens
tatttcactctcctctct

SEQ ID NO: 47117 - DNA, 18 bp, Homo sapiens
ttccactgtcacctccct

SEQ ID NO: 47118 - DNA, 18 bp, Homo sapiens
ctccgctgttctctctct

SEQ ID NO: 47119 - DNA, 22 bp, Homo sapiens
ttcctctgtcccctaggcccta

SEQ ID NO: 47120 - DNA, 19 bp, Homo sapiens
ttcttccatctttttctct

SEQ ID NO: 47121 - DNA, 18 bp, Homo sapiens
ttccactgtgaattctct

SEQ ID NO: 47122 - DNA, 24 bp, Homo sapiens
cattcctagatccctttttctcta

SEQ ID NO: 47123 - DNA, 18 bp, Homo sapiens
tattccactcttcctctt

SEQ ID NO: 47124 - DNA, 19 bp, Homo sapiens
catttcactgcctttctct

SEQ ID NO: 47125 - DNA, 21 bp, Homo sapiens
ttccactgtcattatgctttt

SEQ ID NO: 47126 - DNA, 20 bp, Homo sapiens
tacttcactgtcctttatct

SEQ ID NO: 47127 - DNA, 18 bp, Homo sapiens
tattcactgtcctgcttt

SEQ ID NO: 47128 - DNA, 17 bp, Homo sapiens
ttccactgtctttttct

SEQ ID NO: 47129 - DNA, 17 bp, Homo sapiens
tattccactgtttctcc

SEQ ID NO: 47130 - DNA, 17 bp, Homo sapiens
ttcttactgtcttctcc

SEQ ID NO: 47131 - DNA, 18 bp, Homo sapiens
ttccagccccttttctct

SEQ ID NO: 47132 - DNA, 19 bp, Homo sapiens
tattccactgctcctgcct

SEQ ID NO: 47133 - DNA, 16 bp, Homo sapiens
ttccactatcttctcc

SEQ ID NO: 47134 - DNA, 21 bp, Homo sapiens
tccacacatggccttttctct

SEQ ID NO: 47135 - DNA, 20 bp, Homo sapiens
ttccactgtaccctacatct

SEQ ID NO: 47136 - DNA, 19 bp, Homo sapiens
tcccacaatccttttctct

SEQ ID NO: 47137 - DNA, 16 bp, Homo sapiens
tattccacttttttct

SEQ ID NO: 47138 - DNA, 18 bp, Homo sapiens
cactgtctgtcttctcta

SEQ ID NO: 47139 - DNA, 17 bp, Homo sapiens
ttccctgtcccttctct

SEQ ID NO: 47140 - DNA, 20 bp, Homo sapiens
ccccacttcccttttctcta

SEQ ID NO: 47141 - DNA, 20 bp, Homo sapiens
ttctttgtccttcccctcta

SEQ ID NO: 47142 - DNA, 23 bp, Homo sapiens
attccacctccccctttttttct

SEQ ID NO: 47143 - DNA, 20 bp, Homo sapiens
tccgaatgtctttttctcta

SEQ ID NO: 47144 - DNA, 19 bp, Homo sapiens
ttcaacagccttttctcta

SEQ ID NO: 47145 - DNA, 17 bp, Homo sapiens
ttccatctcttttctct

SEQ ID NO: 47146 - DNA, 22 bp, Homo sapiens
tattctcgctgtcctcctctct

SEQ ID NO: 47147 - DNA, 21 bp, Homo sapiens
cattgttccctttccatttct

SEQ ID NO: 47148 - DNA, 18 bp, Homo sapiens
tatcctgctgctttctct

SEQ ID NO: 47149 - DNA, 15 bp, Homo sapiens
ttccactgtttttcc

SEQ ID NO: 47150 - DNA, 22 bp, Homo sapiens
ttcaacagaattcttttctcta

SEQ ID NO: 47151 - DNA, 18 bp, Homo sapiens
tattccacagttttctcc

SEQ ID NO: 47152 - DNA, 20 bp, Homo sapiens
tattccactggcccagatct

SEQ ID NO: 47153 - DNA, 71 bp, Primate T-lymphotropic virus 3
aggctctgacgtctctccctaccctggctcccggaaaaaaccgaaaaccacccatttcctcatgtttgcct

SEQ ID NO: 47154 - DNA, 24 bp, Primate T-lymphotropic virus 3
tctgacgtctctccctaccctggc

SEQ ID NO: 47155 - DNA, 22 bp, Homo sapiens
tggcgtctctcttctcagtggc

SEQ ID NO: 47156 - DNA, 16 bp, Homo sapiens
tctgacgcctctcctg

SEQ ID NO: 47157 - DNA, 28 bp, Homo sapiens
tctggtgcctctcccgccctatcctggc

SEQ ID NO: 47158 - DNA, 22 bp, Homo sapiens
ctgacgtctctggtgctctggc

SEQ ID NO: 47159 - DNA, 22 bp, Homo sapiens
tctgctggctctctgccttggc

SEQ ID NO: 47160 - DNA, 20 bp, Homo sapiens
cctgaacattcttaccctgg

SEQ ID NO: 47161 - DNA, 18 bp, Homo sapiens
tctgacgtccctcactgg

SEQ ID NO: 47162 - DNA, 21 bp, Homo sapiens
tctgagtcctcctgccttggc

SEQ ID NO: 47163 - DNA, 21 bp, Homo sapiens
tctggggtctctccctctggc

SEQ ID NO: 47164 - DNA, 22 bp, Homo sapiens
cgtctcccctctttattctggc

SEQ ID NO: 47165 - DNA, 19 bp, Homo sapiens
tctgacatttaaaccctgg

SEQ ID NO: 47166 - DNA, 18 bp, Homo sapiens
tctggctctccaccctgg

SEQ ID NO: 47167 - DNA, 21 bp, Homo sapiens
tctgaagtctccccctctggc

SEQ ID NO: 47168 - DNA, 18 bp, Homo sapiens
tctggcgttctctcccta

SEQ ID NO: 47169 - DNA, 18 bp, Homo sapiens
tctgacatttcatcctgg

SEQ ID NO: 47170 - DNA, 96 bp, Amsacta moorei entomopoxvirus
ttacataatttatattaagaatatcaaatattctatctaaacagaattcgtaagatatagtttttgtataattatttttatatataaattgtgtaa

SEQ ID NO: 47171 - DNA, 24 bp, Amsacta moorei entomopoxvirus
taatttatattaagaatatcaaat

SEQ ID NO: 47172 - DNA, 21 bp, Homo sapiens
tttataagccaaatatcaaat

SEQ ID NO: 47173 - DNA, 19 bp, Homo sapiens
taacttaaagaatatcaaa

SEQ ID NO: 47174 - DNA, 23 bp, Homo sapiens
aatttatgttaaggatatcaaat

SEQ ID NO: 47175 - DNA, 18 bp, Homo sapiens
ttacactgaatatcaaat

SEQ ID NO: 47176 - DNA, 84 bp, Myxoma virus
ttgtatgtgacgtttccggaataaaaaggttgatccgtcgtgaacgaagggtcgaatacgtgtctccagctcgtcttcatacga

SEQ ID NO: 47177 - DNA, 24 bp, Myxoma virus
tatgtgacgtttccggaataaaaa

SEQ ID NO: 47178 - DNA, 20 bp, Homo sapiens
gtggaatgttccggaataaa

SEQ ID NO: 47179 - DNA, 20 bp, Homo sapiens
tatgtgacttttgtccagaa

SEQ ID NO: 47180 - DNA, 21 bp, Homo sapiens
catgttcatctggaataaaaa

SEQ ID NO: 47181 - DNA, 23 bp, Homo sapiens
tatgtgacggtttcgcaatcaga

SEQ ID NO: 47182 - DNA, 17 bp, Homo sapiens
tatgtgtgtttcccgaa

SEQ ID NO: 47183 - DNA, 22 bp, Homo sapiens
tatgtgacatttcccttaggaa

SEQ ID NO: 47184 - DNA, 22 bp, Homo sapiens
tatgtgaagattggaataaaaa

SEQ ID NO: 47185 - DNA, 18 bp, Homo sapiens
tatgtgactgtttttgga

SEQ ID NO: 47186 - DNA, 64 bp, Myxoma virus
gttgtcgctttcgttgtagacgtatcggaacgtccatagtccgatatctcgacacgcgcacgac

SEQ ID NO: 47187 - DNA, 20 bp, Myxoma virus
tatctcgacacgcgcacgac

SEQ ID NO: 47188 - DNA, 18 bp, Homo sapiens
tatccttgaccgcacgac

SEQ ID NO: 47189 - DNA, 18 bp, Homo sapiens
atctcgactcactgcgac

SEQ ID NO: 47190 - DNA, 94 bp, Equine herpesvirus 4
gtttttttttattgctaatgcgtaaacctgccccatgcccccagtacaaacaagggggggggggcactaaaaatttttgcgcgaaaaaaaaaac

SEQ ID NO: 47191 - DNA, 24 bp, Equine herpesvirus 4
ttgctaatgcgtaaacctgcccca

SEQ ID NO: 47192 - DNA, 18 bp, Homo sapiens
gctagtggtcctgcccca

SEQ ID NO: 47193 - DNA, 19 bp, Homo sapiens
tgctaatgtgtaaatttcc

SEQ ID NO: 47194 - DNA, 19 bp, Homo sapiens
tcgctggcagatctgcccc

SEQ ID NO: 47195 - DNA, 22 bp, Homo sapiens
ttgcttgaagtgatctgcccca

SEQ ID NO: 47196 - DNA, 21 bp, Homo sapiens
ttgtaaagcgagcctgcccca

SEQ ID NO: 47197 - DNA, 22 bp, Homo sapiens
ttgctaatgcggtggcactctg

SEQ ID NO: 47198 - DNA, 19 bp, Homo sapiens
ctagtggcaccctgcccca

SEQ ID NO: 47199 - DNA, 20 bp, Homo sapiens
ttgcagcacacaacctgccc

SEQ ID NO: 47200 - DNA, 19 bp, Homo sapiens
ttgctaatgttaacagccc

SEQ ID NO: 47201 - DNA, 20 bp, Homo sapiens
ctgcagcgaggcctgcccca

SEQ ID NO: 47202 - DNA, 21 bp, Homo sapiens
ttgtaaagctaacctgcctca

SEQ ID NO: 47203 - DNA, 16 bp, Homo sapiens
ttactaacaacctgcc

SEQ ID NO: 47204 - DNA, 15 bp, Homo sapiens
ttgctaatgcatctg

SEQ ID NO: 47205 - DNA, 20 bp, Homo sapiens
ttgttaatgcatatacctcc

SEQ ID NO: 47206 - DNA, 61 bp, Primate T-lymphotropic virus 3
gctggccacgtgccccgaacatcagattacctgggaccccatcgatggacgcgttgtcagc

SEQ ID NO: 47207 - DNA, 22 bp, Primate T-lymphotropic virus 3
catcgatggacgcgttgtcagc

SEQ ID NO: 47208 - DNA, 18 bp, Homo sapiens
gatggacgtctgcgcagc

SEQ ID NO: 47209 - DNA, 18 bp, Homo sapiens
tcgtgtggccctgtcagc

SEQ ID NO: 47210 - DNA, 17 bp, Homo sapiens
catctgtggacacaatc

SEQ ID NO: 47211 - DNA, 21 bp, Homo sapiens
catcggtcctgggttgtcagc

SEQ ID NO: 47212 - DNA, 20 bp, Homo sapiens
atgggcagtgtgttgtcagc

SEQ ID NO: 47213 - DNA, 17 bp, Homo sapiens
catcgatgaatgttcag

SEQ ID NO: 47214 - DNA, 19 bp, Homo sapiens
atggtcactggttgtcagc

SEQ ID NO: 47215 - DNA, 18 bp, Homo sapiens
catcgatggacaggatgt

SEQ ID NO: 47216 - DNA, 18 bp, Homo sapiens
tcaatggacaaaagtcag

SEQ ID NO: 47217 - DNA, 19 bp, Homo sapiens
catcatgggtgtgaccagc

SEQ ID NO: 47218 - DNA, 16 bp, Homo sapiens
gatgcacgtcgcaagc

SEQ ID NO: 47219 - DNA, 17 bp, Homo sapiens
tcgatgagcttgttggc

SEQ ID NO: 47220 - DNA, 23 bp, Homo sapiens
catcgatgggagttttgcttagc

SEQ ID NO: 47221 - DNA, 19 bp, Homo sapiens
atcgcttccagttgtcagc

SEQ ID NO: 47222 - DNA, 16 bp, Homo sapiens
gatggacatgttcagc

SEQ ID NO: 47223 - DNA, 17 bp, Homo sapiens
tcggggaaccagtcagc

SEQ ID NO: 47224 - DNA, 19 bp, Homo sapiens
tcatggatgcgctgccagc

SEQ ID NO: 47225 - DNA, 16 bp, Homo sapiens
gatggtgcctgtcagc

SEQ ID NO: 47226 - DNA, 130 bp, Equine herpesvirus 4
caagcttcgcgttcagcggcttctgtttgcgcaacaatcacatacggaattctctccttcacactgggcagttcttcattccgcatagcgagcttaaagtaaacagtgaggtgcggtagccgcttgtttg

SEQ ID NO: 47227 - DNA, 24 bp, Equine herpesvirus 4
cagcggcttctgtttgcgcaacaa

SEQ ID NO: 47228 - DNA, 16 bp, Homo sapiens
cagcggctccgcggcg

SEQ ID NO: 47229 - DNA, 19 bp, Homo sapiens
cagcggctgctgcttggca

SEQ ID NO: 47230 - DNA, 17 bp, Homo sapiens
cagcggctcctgcagca

SEQ ID NO: 47231 - DNA, 22 bp, Homo sapiens
cagcagcttctgagggtggcaa

SEQ ID NO: 47232 - DNA, 21 bp, Homo sapiens
cagtggcttcagtgaatgcca

SEQ ID NO: 47233 - DNA, 18 bp, Homo sapiens
agcggccattgcgcaaca

SEQ ID NO: 47234 - DNA, 20 bp, Homo sapiens
cagcggctcctggctgcggc

SEQ ID NO: 47235 - DNA, 20 bp, Homo sapiens
cagcggctcctcaaggcggc

SEQ ID NO: 47236 - DNA, 23 bp, Homo sapiens
cagtgatttccattgcgcaacaa

SEQ ID NO: 47237 - DNA, 17 bp, Homo sapiens
cagcggctcccgcggcg

SEQ ID NO: 47238 - DNA, 20 bp, Homo sapiens
gcggcttcctgatccagcaa

SEQ ID NO: 47239 - DNA, 20 bp, Homo sapiens
cagtggctataggcgcagca

SEQ ID NO: 47240 - DNA, 20 bp, Homo sapiens
cagaggcttctggctggcaa

SEQ ID NO: 47241 - DNA, 20 bp, Homo sapiens
ggctctgtttggtttgacaa

SEQ ID NO: 47242 - DNA, 17 bp, Homo sapiens
cagcggctgctgcagca

SEQ ID NO: 47243 - DNA, 20 bp, Homo sapiens
cagggtttctgttcttgcaa

SEQ ID NO: 47244 - DNA, 20 bp, Homo sapiens
gcggcttgtccccagcggca

SEQ ID NO: 47245 - DNA, 19 bp, Homo sapiens
cagcagcttgggtgtgacg

SEQ ID NO: 47246 - DNA, 16 bp, Homo sapiens
gcggttccacgcagca

SEQ ID NO: 47247 - DNA, 16 bp, Homo sapiens
cagtggatttgcacaa

SEQ ID NO: 47248 - DNA, 20 bp, Homo sapiens
agcggccttccagtgtagca

SEQ ID NO: 47249 - DNA, 19 bp, Homo sapiens
ggctatctgttcataacaa

SEQ ID NO: 47250 - DNA, 21 bp, Homo sapiens
cagggcttctccttgtggcaa

SEQ ID NO: 47251 - DNA, 22 bp, Homo sapiens
cagcggctctgagcttgcagca

SEQ ID NO: 47252 - DNA, 18 bp, Homo sapiens
acggctccctgcgcggca

SEQ ID NO: 47253 - DNA, 20 bp, Homo sapiens
cagcggcctcatgagacgca

SEQ ID NO: 47254 - DNA, 20 bp, Homo sapiens
cagcggctcttcttgtgcaa

SEQ ID NO: 47255 - DNA, 18 bp, Homo sapiens
cagtgctttcttacgcaa

SEQ ID NO: 47256 - DNA, 18 bp, Homo sapiens
cagtggcttttttgcaca

SEQ ID NO: 47257 - DNA, 24 bp, Homo sapiens
cagtgacttctttcttgcgcaaca

SEQ ID NO: 47258 - DNA, 18 bp, Homo sapiens
acggctgcttgtgtggca

SEQ ID NO: 47259 - DNA, 18 bp, Homo sapiens
cagcgttttctgtttcca

SEQ ID NO: 47260 - DNA, 21 bp, Homo sapiens
ggcttctacaatttgtaacaa

SEQ ID NO: 47261 - DNA, 18 bp, Homo sapiens
cagcgctctgtgtagcaa

SEQ ID NO: 47262 - DNA, 19 bp, Homo sapiens
agcagctttatttgtaaca

SEQ ID NO: 47263 - DNA, 21 bp, Homo sapiens
cagtggcttctgcttattgca

SEQ ID NO: 47264 - DNA, 18 bp, Homo sapiens
cagcaggtttctgcagca

SEQ ID NO: 47265 - DNA, 18 bp, Homo sapiens
gcggtctccgcacgcaac

SEQ ID NO: 47266 - DNA, 18 bp, Homo sapiens
agcggcttttgttggacg

SEQ ID NO: 47267 - DNA, 16 bp, Homo sapiens
cagcggccttggtgca

SEQ ID NO: 47268 - DNA, 21 bp, Homo sapiens
agtggcttctggccaggtgcg

SEQ ID NO: 47269 - DNA, 17 bp, Homo sapiens
cagctgcttctgcagca

SEQ ID NO: 47270 - DNA, 23 bp, Homo sapiens
cagcggcttccgtcctgcagcaa

SEQ ID NO: 47271 - DNA, 19 bp, Homo sapiens
cagggtttctgtttttcaa

SEQ ID NO: 47272 - DNA, 16 bp, Homo sapiens
cagcggctgttcggca

SEQ ID NO: 47273 - DNA, 20 bp, Homo sapiens
cagggcttctgtttaagcaa

SEQ ID NO: 47274 - DNA, 23 bp, Homo sapiens
cagggcttctgtggtgcgcaaca

SEQ ID NO: 47275 - DNA, 93 bp, Tupaia herpesvirus
cgtccgcggcgacggcgccgtcgccgccgcgctcggaacgttcggaacgttcggaacgctcggagtggggtcgacggcccgaggaagcggacg

SEQ ID NO: 47276 - DNA, 24 bp, Tupaia herpesvirus
ggagtggggtcgacggcccgagga

SEQ ID NO: 47277 - DNA, 21 bp, Homo sapiens
ggggtggtgcccggcccgagg

SEQ ID NO: 47278 - DNA, 19 bp, Homo sapiens
gggtggggtcacctggagg

SEQ ID NO: 47279 - DNA, 22 bp, Homo sapiens
ggagtggggttagtgttgggga

SEQ ID NO: 47280 - DNA, 18 bp, Homo sapiens
ggagtggggtggcaaagg

SEQ ID NO: 47281 - DNA, 18 bp, Homo sapiens
ggagtagggtcgccgggg

SEQ ID NO: 47282 - DNA, 19 bp, Homo sapiens
ggagtggggtgagctgggg

SEQ ID NO: 47283 - DNA, 19 bp, Homo sapiens
gaggacgacggcccgagga

SEQ ID NO: 47284 - DNA, 15 bp, Homo sapiens
ggagtggggtgggag

SEQ ID NO: 47285 - DNA, 15 bp, Homo sapiens
gagtggggtcccgag

SEQ ID NO: 47286 - DNA, 18 bp, Homo sapiens
ggagtggggctggggagg

SEQ ID NO: 47287 - DNA, 17 bp, Homo sapiens
gggtggggtctgcaagg

SEQ ID NO: 47288 - DNA, 22 bp, Homo sapiens
gggtggggccgggtccacgggg

SEQ ID NO: 47289 - DNA, 16 bp, Homo sapiens
gcggcggcggcccgag

SEQ ID NO: 47290 - DNA, 20 bp, Homo sapiens
ggtgtggggtcatctgggga

SEQ ID NO: 47291 - DNA, 22 bp, Homo sapiens
gggctgggtccgggtccgagga

SEQ ID NO: 47292 - DNA, 21 bp, Homo sapiens
gggtggtgggagggcctgggg

SEQ ID NO: 47293 - DNA, 23 bp, Homo sapiens
gggatggggtcggagactgggga

SEQ ID NO: 47294 - DNA, 18 bp, Homo sapiens
gtggggcacagcctgggg

SEQ ID NO: 47295 - DNA, 21 bp, Homo sapiens
ggagtggggtcagctctggga

SEQ ID NO: 47296 - DNA, 16 bp, Homo sapiens
gtggggtcgggggagg

SEQ ID NO: 47297 - DNA, 18 bp, Homo sapiens
gggtggggtcagacgggg

SEQ ID NO: 47298 - DNA, 16 bp, Homo sapiens
ggagtggggtggggag

SEQ ID NO: 47299 - DNA, 21 bp, Homo sapiens
gagtggggttggggctgggga

SEQ ID NO: 47300 - DNA, 21 bp, Homo sapiens
gggtggggtcggtggccccgg

SEQ ID NO: 47301 - DNA, 21 bp, Homo sapiens
ggagtggggatgatggtccca

SEQ ID NO: 47302 - DNA, 19 bp, Homo sapiens
ggagtggggttgatgctca

SEQ ID NO: 47303 - DNA, 22 bp, Homo sapiens
ggagtggggctgactgagcagg

SEQ ID NO: 47304 - DNA, 19 bp, Homo sapiens
ggaatgggggcgcctgagg

SEQ ID NO: 47305 - DNA, 21 bp, Homo sapiens
gggtggggctgagggtgggga

SEQ ID NO: 47306 - DNA, 23 bp, Homo sapiens
gaagtggggttggggagttgagg

SEQ ID NO: 47307 - DNA, 21 bp, Homo sapiens
gcagtggagctggcttgggga

SEQ ID NO: 47308 - DNA, 22 bp, Homo sapiens
ggagtggacagacggcctgggg

SEQ ID NO: 47309 - DNA, 22 bp, Homo sapiens
ggagtggggttggggcttagga

SEQ ID NO: 47310 - DNA, 17 bp, Homo sapiens
gggcggggtcggcggcc

SEQ ID NO: 47311 - DNA, 18 bp, Homo sapiens
ggagtgggggtgaccagg

SEQ ID NO: 47312 - DNA, 18 bp, Homo sapiens
ggagtggaaggcctgggg

SEQ ID NO: 47313 - DNA, 23 bp, Homo sapiens
ggagtggggcttggttcagagga

SEQ ID NO: 47314 - DNA, 21 bp, Homo sapiens
gggtgggagcaggcccgagga

SEQ ID NO: 47315 - DNA, 20 bp, Homo sapiens
ggtgtggggttggcaggagg

SEQ ID NO: 47316 - DNA, 21 bp, Homo sapiens
ggagtggggtatgtgtcgagg

SEQ ID NO: 47317 - DNA, 23 bp, Homo sapiens
gggtgggggttggcattgggagg

SEQ ID NO: 47318 - DNA, 19 bp, Homo sapiens
ggagtggggctgaccaagg

SEQ ID NO: 47319 - DNA, 16 bp, Homo sapiens
ggagtggggtctgcag

SEQ ID NO: 47320 - DNA, 18 bp, Homo sapiens
ggattggggtcggggagg

SEQ ID NO: 47321 - DNA, 21 bp, Homo sapiens
ggaggtggggatgcctgggga

SEQ ID NO: 47322 - DNA, 17 bp, Homo sapiens
gtggggtcgggggatgg

SEQ ID NO: 47323 - DNA, 27 bp, Homo sapiens
ggagtgaggacaggaggtggcctgagg

SEQ ID NO: 47324 - DNA, 16 bp, Homo sapiens
ggagtggggtcgtggg

SEQ ID NO: 47325 - DNA, 27 bp, Homo sapiens
gaggtggggtcggttggtggctgggga

SEQ ID NO: 47326 - DNA, 17 bp, Homo sapiens
gggtggggtccgccagg

SEQ ID NO: 47327 - DNA, 18 bp, Homo sapiens
gggtggggctggaagagg

SEQ ID NO: 47328 - DNA, 20 bp, Homo sapiens
gggtggggtagagggtgggg

SEQ ID NO: 47329 - DNA, 20 bp, Homo sapiens
gggtgggggcgatagaagga

SEQ ID NO: 47330 - DNA, 21 bp, Homo sapiens
gggtggggctggcgcccgagg

SEQ ID NO: 47331 - DNA, 23 bp, Homo sapiens
gggtggggtcctgaggcctgggg

SEQ ID NO: 47332 - DNA, 19 bp, Homo sapiens
ggagtgggggtggctcagg

SEQ ID NO: 47333 - DNA, 18 bp, Homo sapiens
gggctggatggcccgagg

SEQ ID NO: 47334 - DNA, 21 bp, Homo sapiens
ggagtgggggcggtgagagga

SEQ ID NO: 47335 - DNA, 18 bp, Homo sapiens
gggtggggtggttccagg

SEQ ID NO: 47336 - DNA, 20 bp, Homo sapiens
ggagtggggttgaaatgagg

SEQ ID NO: 47337 - DNA, 24 bp, Homo sapiens
ggagtggggtggggtaggagagga

SEQ ID NO: 47338 - DNA, 22 bp, Homo sapiens
ggagtggggccggtgggccagg

SEQ ID NO: 47339 - DNA, 21 bp, Homo sapiens
gggtggggtgtctgccgggga

SEQ ID NO: 47340 - DNA, 27 bp, Homo sapiens
gggtgaggtcctgcctcggtccgggga

SEQ ID NO: 47341 - DNA, 22 bp, Homo sapiens
ggagtggggtcctggcttgggg

SEQ ID NO: 47342 - DNA, 25 bp, Homo sapiens
agagtgggacgtgggcggcctgggg

SEQ ID NO: 47343 - DNA, 23 bp, Homo sapiens
ggagtggggctggcctggcgagg

SEQ ID NO: 47344 - DNA, 19 bp, Homo sapiens
ggagtggggtcgggtgggg

SEQ ID NO: 47345 - DNA, 23 bp, Homo sapiens
ggagtagggggtgcggcctgggg

SEQ ID NO: 47346 - DNA, 18 bp, Homo sapiens
ggagtggggcggctgtag

SEQ ID NO: 47347 - DNA, 24 bp, Homo sapiens
ggagtgggtgttggtggagccagg

SEQ ID NO: 47348 - DNA, 21 bp, Homo sapiens
agagtagagatggtctgagga

SEQ ID NO: 47349 - DNA, 16 bp, Homo sapiens
ggagtggagggcaagg

SEQ ID NO: 47350 - DNA, 17 bp, Homo sapiens
ggggtgggggcccgagg

SEQ ID NO: 47351 - DNA, 24 bp, Homo sapiens
gaagtggggtcgacgggcggtagg

SEQ ID NO: 47352 - DNA, 19 bp, Homo sapiens
ggagtggggacggcaaagg

SEQ ID NO: 47353 - DNA, 18 bp, Homo sapiens
gagtggggttggtggagg

SEQ ID NO: 47354 - DNA, 20 bp, Homo sapiens
gggtggggtcggggcagcga

SEQ ID NO: 47355 - DNA, 19 bp, Homo sapiens
gggtgggggtgacccaaag

SEQ ID NO: 47356 - DNA, 19 bp, Homo sapiens
ggagggggccagcctgagg

SEQ ID NO: 47357 - DNA, 23 bp, Homo sapiens
ggagtggggtcaggtggtccagg

SEQ ID NO: 47358 - DNA, 23 bp, Homo sapiens
gggtggaggttgatggtgtagga

SEQ ID NO: 47359 - DNA, 22 bp, Homo sapiens
ggagtggggccggggcctgggg

SEQ ID NO: 47360 - DNA, 20 bp, Homo sapiens
ggagtgggtgtgacctgagg

SEQ ID NO: 47361 - DNA, 79 bp, Ictalurid herpesvirus 1
acgtgttttttttaagttattttactattgagccacctatacactctgttacaaaaaaaacattgaaaaatagatatgt

SEQ ID NO: 47362 - DNA, 24 bp, Ictalurid herpesvirus 1
taagttattttactattgagccac

SEQ ID NO: 47363 - DNA, 18 bp, Homo sapiens
agttattttgttattggc

SEQ ID NO: 47364 - DNA, 20 bp, Homo sapiens
taagttatttatttaagcca

SEQ ID NO: 47365 - DNA, 22 bp, Homo sapiens
aattattttgctgttagagcca

SEQ ID NO: 47366 - DNA, 25 bp, Homo sapiens
taagttattttactctttttagtca

SEQ ID NO: 47367 - DNA, 21 bp, Homo sapiens
agttattttcccctggcagcc

SEQ ID NO: 47368 - DNA, 15 bp, Homo sapiens
gttatccttgagcca

SEQ ID NO: 47369 - DNA, 22 bp, Homo sapiens
taagttatttaactaccaatgc

SEQ ID NO: 47370 - DNA, 18 bp, Homo sapiens
taaattattttagagcca

SEQ ID NO: 47371 - DNA, 19 bp, Homo sapiens
aagttattttccagagcca

SEQ ID NO: 47372 - DNA, 21 bp, Homo sapiens
gttattttatttctaaagcca

SEQ ID NO: 47373 - DNA, 23 bp, Homo sapiens
taagttatcttgcccaaagtcac

SEQ ID NO: 47374 - DNA, 19 bp, Homo sapiens
taagttaatctttgagcca

SEQ ID NO: 47375 - DNA, 16 bp, Homo sapiens
agctatgattgagcca

SEQ ID NO: 47376 - DNA, 23 bp, Homo sapiens
aagttgtttctcagttgagccac

SEQ ID NO: 47377 - DNA, 78 bp, Ictalurid herpesvirus 1
gatatgtcaatacaacagtcaatgttctcaggattgcaagtgcgtttttaagaaaaagaaatatgatgaagatatatc

SEQ ID NO: 47378 - DNA, 24 bp, Ictalurid herpesvirus 1
tatgtcaatacaacagtcaatgtt

SEQ ID NO: 47379 - DNA, 22 bp, Homo sapiens
tgtcaatgcagaatctaatgtt

SEQ ID NO: 47380 - DNA, 21 bp, Homo sapiens
catgtcagtgagttcaatgtt

SEQ ID NO: 47381 - DNA, 21 bp, Homo sapiens
tcaatggtaacagtcaatgtt

SEQ ID NO: 47382 - DNA, 21 bp, Homo sapiens
atgttcacaacagttggtgtt

SEQ ID NO: 47383 - DNA, 22 bp, Homo sapiens
tgctgtgaaaacagtcagtgtt

SEQ ID NO: 47384 - DNA, 18 bp, Homo sapiens
tatgtcaaacagcagatg

SEQ ID NO: 47385 - DNA, 18 bp, Homo sapiens
tatatcaatacaatggtc

SEQ ID NO: 47386 - DNA, 23 bp, Homo sapiens
catgttagcaactggtcaatgtt

SEQ ID NO: 47387 - DNA, 69 bp, Tupaia herpesvirus
cgtgcgtgttctgtgcgttatataaccagaacaagctgtgtctggactttgcgcgcaacgatctgcacg

SEQ ID NO: 47388 - DNA, 24 bp, Tupaia herpesvirus
gtgcgttatataaccagaacaagc

SEQ ID NO: 47389 - DNA, 19 bp, Homo sapiens
gtgagttttccagaacaag

SEQ ID NO: 47390 - DNA, 21 bp, Homo sapiens
gcggctgagaccagaacaagc

SEQ ID NO: 47391 - DNA, 23 bp, Homo sapiens
gtgcgttaatgtgactaaacaag

SEQ ID NO: 47392 - DNA, 17 bp, Homo sapiens
gtgggttatataactga

SEQ ID NO: 47393 - DNA, 20 bp, Homo sapiens
gtgtaacaaccagagtaagc

SEQ ID NO: 47394 - DNA, 21 bp, Homo sapiens
gtggccaaaattagaacaagc

SEQ ID NO: 47395 - DNA, 21 bp, Homo sapiens
gtacgtctggtcagaacaagc

SEQ ID NO: 47396 - DNA, 22 bp, Homo sapiens
atgtgttatataaccggaaagc

SEQ ID NO: 47397 - DNA, 19 bp, Homo sapiens
tgtgttatataacttaaga

SEQ ID NO: 47398 - DNA, 93 bp, Ictalurid herpesvirus 1
acacccacttccagggcgtaacccgaaagttctcaccacacccacttccagggcgtaacccgaaagttctcaccacacccacttccagggcgt

SEQ ID NO: 47399 - DNA, 24 bp, Ictalurid herpesvirus 1
cgaaagttctcaccacacccactt

SEQ ID NO: 47400 - DNA, 24 bp, Homo sapiens
gaaagttctgctctgtccccactt

SEQ ID NO: 47401 - DNA, 22 bp, Homo sapiens
gaaggaggccccacacctgctt

SEQ ID NO: 47402 - DNA, 25 bp, Homo sapiens
cgaaagttcctcatttctcttactt

SEQ ID NO: 47403 - DNA, 23 bp, Homo sapiens
gaaagttctctatcagacagctt

SEQ ID NO: 47404 - DNA, 19 bp, Homo sapiens
gcaaccacacaccacactc

SEQ ID NO: 47405 - DNA, 17 bp, Homo sapiens
cgagagccacacccact

SEQ ID NO: 47406 - DNA, 21 bp, Homo sapiens
cgagagctctgcagcccactt

SEQ ID NO: 47407 - DNA, 21 bp, Homo sapiens
gaaagtcctcattgaactcca

SEQ ID NO: 47408 - DNA, 24 bp, Homo sapiens
gagagttcccacgtgtgtccactt

SEQ ID NO: 47409 - DNA, 19 bp, Homo sapiens
cgagaagtctgcacccact

SEQ ID NO: 47410 - DNA, 19 bp, Homo sapiens
caaaagttctcacatacac

SEQ ID NO: 47411 - DNA, 20 bp, Homo sapiens
gagattctactaacccactt

SEQ ID NO: 47412 - DNA, 25 bp, Homo sapiens
gaaaattcccttactgtgcctactt

SEQ ID NO: 47413 - DNA, 20 bp, Homo sapiens
aaggaccttcatacccactt

SEQ ID NO: 47414 - DNA, 22 bp, Homo sapiens
aaaatcagagccacacccactt

SEQ ID NO: 47415 - DNA, 24 bp, Homo sapiens
aagttctcatcactggctacactt

SEQ ID NO: 47416 - DNA, 19 bp, Homo sapiens
atcctcactgcacctgctt

SEQ ID NO: 47417 - DNA, 23 bp, Homo sapiens
gaaagttctctatcagacaactt

SEQ ID NO: 47418 - DNA, 21 bp, Homo sapiens
gaaggttctcacttcctactt

SEQ ID NO: 47419 - DNA, 60 bp, Tupaia herpesvirus
ggcgtggcgatacgacgaagccgtggagatggctctgaccgtgtgtgaaacgaccgctcc

SEQ ID NO: 47420 - DNA, 24 bp, Tupaia herpesvirus
tgaccgtgtgtgaaacgaccgctc

SEQ ID NO: 47421 - DNA, 18 bp, Homo sapiens
tgatttgtgtgaaatgac

SEQ ID NO: 47422 - DNA, 17 bp, Homo sapiens
gcaatggaacggccgct

SEQ ID NO: 47423 - DNA, 17 bp, Homo sapiens
gtgtgtgaagcaagctc

SEQ ID NO: 47424 - DNA, 18 bp, Homo sapiens
tgtgtgaaaggaaggctc

SEQ ID NO: 47425 - DNA, 19 bp, Homo sapiens
tgactggtgtgaaaacact

SEQ ID NO: 47426 - DNA, 22 bp, Homo sapiens
tggccgtgtgtagagtgggctc

SEQ ID NO: 47427 - DNA, 117 bp, Equine herpesvirus 4
accacatggtggttatctgtataaactgcacctgttaacgtgtaactgcgccaccacaagggcgtatataaaagtgcatgtaaatcgagtgtttaaaaaatagcgccatcatgcggt

SEQ ID NO: 47428 - DNA, 24 bp, Equine herpesvirus 4
tatctgtataaactgcacctgtta

SEQ ID NO: 47429 - DNA, 21 bp, Homo sapiens
tctgtataatcaccaatgtta

SEQ ID NO: 47430 - DNA, 19 bp, Homo sapiens
tctgtatcattacctgtta

SEQ ID NO: 47431 - DNA, 21 bp, Homo sapiens
tatctgtaagagctgcatcta

SEQ ID NO: 47432 - DNA, 19 bp, Homo sapiens
cgtataaaggccactgtta

SEQ ID NO: 47433 - DNA, 23 bp, Homo sapiens
tatttgtaaaacaggacctgtta

SEQ ID NO: 47434 - DNA, 22 bp, Homo sapiens
tatctgtatagaactgtcagct

SEQ ID NO: 47435 - DNA, 20 bp, Homo sapiens
tatttgtataaatagcctct

SEQ ID NO: 47436 - DNA, 20 bp, Homo sapiens
tctgtacaaaaccaaatgtt

SEQ ID NO: 47437 - DNA, 22 bp, Homo sapiens
tatctgtaagactaacaagtta

SEQ ID NO: 47438 - DNA, 22 bp, Homo sapiens
tacctgtgtgaactggcacttg

SEQ ID NO: 47439 - DNA, 19 bp, Homo sapiens
tatctgtaagactggagtt

SEQ ID NO: 47440 - DNA, 18 bp, Homo sapiens
tatctgaataaactgtcc

SEQ ID NO: 47441 - DNA, 79 bp, Equine herpesvirus 4
cggcttgtggaggtaagagctcccgggggacggcttaccaacttggcttcatacttatctgctctcttctccttcgctg

SEQ ID NO: 47442 - DNA, 24 bp, Equine herpesvirus 4
tgtggaggtaagagctcccggggg

SEQ ID NO: 47443 - DNA, 20 bp, Homo sapiens
tgtggagggagagctgcagg

SEQ ID NO: 47444 - DNA, 19 bp, Homo sapiens
tgtggagggggaggagggg

SEQ ID NO: 47445 - DNA, 17 bp, Homo sapiens
tggaggtatctccgggg

SEQ ID NO: 47446 - DNA, 20 bp, Homo sapiens
tgtggggtgggggctcccag

SEQ ID NO: 47447 - DNA, 24 bp, Homo sapiens
tgtggaggggaggtatggtggggg

SEQ ID NO: 47448 - DNA, 20 bp, Homo sapiens
tgtggaggtgagagccccag

SEQ ID NO: 47449 - DNA, 22 bp, Homo sapiens
gtgggggtaagagcggtggggg

SEQ ID NO: 47450 - DNA, 20 bp, Homo sapiens
tgtggaggaagggcatgggg

SEQ ID NO: 47451 - DNA, 20 bp, Homo sapiens
tggaggtgcagacccggggg

SEQ ID NO: 47452 - DNA, 22 bp, Homo sapiens
tggggtctttggctcccggggg

SEQ ID NO: 47453 - DNA, 16 bp, Homo sapiens
tggaggtaggaagggg

SEQ ID NO: 47454 - DNA, 21 bp, Homo sapiens
tgtggagggggagaggagggg

SEQ ID NO: 47455 - DNA, 23 bp, Homo sapiens
gtggaggtggggggagggcgggg

SEQ ID NO: 47456 - DNA, 26 bp, Homo sapiens
tgtggaggaaggggcttctgcccccg

SEQ ID NO: 47457 - DNA, 19 bp, Homo sapiens
tgtggggtgggggaagggg

SEQ ID NO: 47458 - DNA, 25 bp, Homo sapiens
gtggaggtggggatggggttggggg

SEQ ID NO: 47459 - DNA, 23 bp, Homo sapiens
tggggtcctccagttcccggggg

SEQ ID NO: 47460 - DNA, 24 bp, Homo sapiens
tgtggatgtggctggtcccggggg

SEQ ID NO: 47461 - DNA, 18 bp, Homo sapiens
gtggaggtggggaggggg

SEQ ID NO: 47462 - DNA, 22 bp, Homo sapiens
tgtggaggcaggagttccaagg

SEQ ID NO: 47463 - DNA, 19 bp, Homo sapiens
tgtggagggaagggccggg

SEQ ID NO: 47464 - DNA, 18 bp, Homo sapiens
tgtggagggagagtgggg

SEQ ID NO: 47465 - DNA, 21 bp, Homo sapiens
tgtggaggggccgcctggggg

SEQ ID NO: 47466 - DNA, 19 bp, Homo sapiens
tgtggaggggagagctggg

SEQ ID NO: 47467 - DNA, 20 bp, Homo sapiens
tgtggaggaaggggcttggg

SEQ ID NO: 47468 - DNA, 19 bp, Homo sapiens
tgtggaggtgggacgtggg

SEQ ID NO: 47469 - DNA, 19 bp, Homo sapiens
tgtggaggtaagagtttcc

SEQ ID NO: 47470 - DNA, 21 bp, Homo sapiens
tgtggaagtaggggctgacgg

SEQ ID NO: 47471 - DNA, 21 bp, Homo sapiens
tgtggtgggtgggaggtgggg

SEQ ID NO: 47472 - DNA, 22 bp, Homo sapiens
tgcggaggatcgcttccggggg

SEQ ID NO: 47473 - DNA, 22 bp, Homo sapiens
tgtggaggttgggggagtgggg

SEQ ID NO: 47474 - DNA, 21 bp, Homo sapiens
tgtggagggctctcctggggg

SEQ ID NO: 47475 - DNA, 21 bp, Homo sapiens
tgtggaggggctgcctggggg

SEQ ID NO: 47476 - DNA, 20 bp, Homo sapiens
gtggaggtgagagacagggg

SEQ ID NO: 47477 - DNA, 22 bp, Homo sapiens
tggaggtagggcatggtggggg

SEQ ID NO: 47478 - DNA, 20 bp, Homo sapiens
tgtggaggggaggggcgggg

SEQ ID NO: 47479 - DNA, 20 bp, Homo sapiens
tgtggaggtgggagtcaggg

SEQ ID NO: 47480 - DNA, 16 bp, Homo sapiens
tgtggaggcaagtggg

SEQ ID NO: 47481 - DNA, 30 bp, Homo sapiens
tgtggaggtgggatttagctggcccccggg

SEQ ID NO: 47482 - DNA, 23 bp, Homo sapiens
tgtggaggaagagctgaatcagg

SEQ ID NO: 47483 - DNA, 69 bp, Equine herpesvirus 4
cctctcaaatcttgggttaaactcatcaccgcgaaaatctttgccgttccaaacccgaatcctgcgagg

SEQ ID NO: 47484 - DNA, 24 bp, Equine herpesvirus 4
tcttgggttaaactcatcaccgcg

SEQ ID NO: 47485 - DNA, 23 bp, Homo sapiens
tcttggattgagcattcactgcg

SEQ ID NO: 47486 - DNA, 24 bp, Homo sapiens
tcttgggttagctcgcttctcgcg

SEQ ID NO: 47487 - DNA, 18 bp, Homo sapiens
tcttgggctgatactatc

SEQ ID NO: 47488 - DNA, 20 bp, Homo sapiens
tcttgggtttagactcgccg

SEQ ID NO: 47489 - DNA, 22 bp, Homo sapiens
tcttgggttcaggcttcaagcg

SEQ ID NO: 47490 - DNA, 18 bp, Homo sapiens
ccctgggttcgtcgccgc

SEQ ID NO: 47491 - DNA, 74 bp, Bovine herpesvirus 1
gctcgggcgcatccgctcgctcgtcgacaacgagctctgcgtgtacttcgacagcagcgccgcgcgccccgagc

SEQ ID NO: 47492 - DNA, 24 bp, Bovine herpesvirus 1
ttcgacagcagcgccgcgcgcccc

SEQ ID NO: 47493 - DNA, 18 bp, Homo sapiens
ctcggcggcgccgcgccc

SEQ ID NO: 47494 - DNA, 24 bp, Homo sapiens
ctcgagggcagtgccgcgcgtccc

SEQ ID NO: 47495 - DNA, 18 bp, Homo sapiens
tccgatcgccgcgcgccc

SEQ ID NO: 47496 - DNA, 18 bp, Homo sapiens
ttcagcagcagctcatgc

SEQ ID NO: 47497 - DNA, 19 bp, Homo sapiens
ctcggcagccccgcgcgcc

SEQ ID NO: 47498 - DNA, 17 bp, Homo sapiens
ttcacagcagctgctcc

SEQ ID NO: 47499 - DNA, 23 bp, Homo sapiens
tctggcagcagcggtgcagctcc

SEQ ID NO: 47500 - DNA, 25 bp, Homo sapiens
ttcgacaagtcctagtcgtgcgccc

SEQ ID NO: 47501 - DNA, 23 bp, Homo sapiens
ttcggcagcgccccgtgtgcccc

SEQ ID NO: 47502 - DNA, 22 bp, Homo sapiens
ttcgccgcccttcgcgcgcccc

SEQ ID NO: 47503 - DNA, 20 bp, Homo sapiens
ttcggtgacagcaccgcccc

SEQ ID NO: 47504 - DNA, 24 bp, Homo sapiens
ttcagcagcagcgccgccaccgcc

SEQ ID NO: 47505 - DNA, 16 bp, Homo sapiens
tccgacgccgcgcgcc

SEQ ID NO: 47506 - DNA, 21 bp, Homo sapiens
tccgacagcagggggcgcccc

SEQ ID NO: 47507 - DNA, 23 bp, Homo sapiens
ctcggtagcagccgacacgcccc

SEQ ID NO: 47508 - DNA, 97 bp, Physalis mottle virus
atctcgtcaattccattccgactgctactgccatgaatcaaatgggacatcatgccatcacgatcagcagcagtcaaggtggcacttatgatgagat

SEQ ID NO: 47509 - DNA, 24 bp, Physalis mottle virus
catcatgccatcacgatcagcagc

SEQ ID NO: 47510 - DNA, 21 bp, Homo sapiens
atcatgccattgcattccagc

SEQ ID NO: 47511 - DNA, 20 bp, Homo sapiens
tcatgccacgggtcagcggc

SEQ ID NO: 47512 - DNA, 18 bp, Homo sapiens
catcatgcatcaccacag

SEQ ID NO: 47513 - DNA, 18 bp, Homo sapiens
atcatactacatcagcag

SEQ ID NO: 47514 - DNA, 22 bp, Homo sapiens
gccagcgaacacggtcagcagc

SEQ ID NO: 47515 - DNA, 19 bp, Homo sapiens
catgtgtcaaaatcagcag

SEQ ID NO: 47516 - DNA, 21 bp, Homo sapiens
atcatgccattgcactccagc

SEQ ID NO: 47517 - DNA, 22 bp, Homo sapiens
catcatcctgggtgtcagcagc

SEQ ID NO: 47518 - DNA, 20 bp, Homo sapiens
tcatgccattgcactccagc

SEQ ID NO: 47519 - DNA, 18 bp, Homo sapiens
catcatactgttcagcag

SEQ ID NO: 47520 - DNA, 22 bp, Homo sapiens
catcatgcagtcactcagcagc

SEQ ID NO: 47521 - DNA, 25 bp, Homo sapiens
catcagccatcatcaaaatagtggc

SEQ ID NO: 47522 - DNA, 22 bp, Homo sapiens
catcatgccatgtcagggcagc

SEQ ID NO: 47523 - DNA, 21 bp, Homo sapiens
atcatgccattgtactccagc

SEQ ID NO: 47524 - DNA, 21 bp, Homo sapiens
catgccacaggaatcagcagc

SEQ ID NO: 47525 - DNA, 17 bp, Homo sapiens
catcgtgccatcagagc

SEQ ID NO: 47526 - DNA, 20 bp, Homo sapiens
catcatgccagcacctgcag

SEQ ID NO: 47527 - DNA, 24 bp, Homo sapiens
catcatgcacaacacctcagtggc

SEQ ID NO: 47528 - DNA, 18 bp, Homo sapiens
tgctactgattcagcagc

SEQ ID NO: 47529 - DNA, 21 bp, Homo sapiens
cattatatccaatatcagcag

SEQ ID NO: 47530 - DNA, 21 bp, Homo sapiens
atcatgccattgcactctagc

SEQ ID NO: 47531 - DNA, 24 bp, Homo sapiens
caccgtgcctggcggatcagcagc

SEQ ID NO: 47532 - DNA, 19 bp, Homo sapiens
tctgccatcacacatcagc

SEQ ID NO: 47533 - DNA, 21 bp, Homo sapiens
atcatgccattgtactacagc

SEQ ID NO: 47534 - DNA, 24 bp, Homo sapiens
catcatgccactgcactccagcag

SEQ ID NO: 47535 - DNA, 18 bp, Homo sapiens
atcatccaggctcagcag

SEQ ID NO: 47536 - DNA, 18 bp, Homo sapiens
catgccatcacacgcagc

SEQ ID NO: 47537 - DNA, 20 bp, Homo sapiens
tctgtcatatttccagcagc

SEQ ID NO: 47538 - DNA, 24 bp, Homo sapiens
atcatgccttgtatgattggcagc

SEQ ID NO: 47539 - DNA, 25 bp, Homo sapiens
catcagcagcaggacgatcagcagc

SEQ ID NO: 47540 - DNA, 25 bp, Homo sapiens
catcgtgttgccatggcaattcagc

SEQ ID NO: 47541 - DNA, 21 bp, Homo sapiens
cactgtgccatcaggagtggc

SEQ ID NO: 47542 - DNA, 19 bp, Homo sapiens
tgccctcgtgatcagcagc

SEQ ID NO: 47543 - DNA, 21 bp, Homo sapiens
atcatgccattgcgctccagc

SEQ ID NO: 47544 - DNA, 62 bp, Bovine herpesvirus 1
ggcgactacgatatactagtgttggacgaagttatgtccaccctggcccagttgtattcgcc

SEQ ID NO: 47545 - DNA, 24 bp, Bovine herpesvirus 1
actacgatatactagtgttggacg

SEQ ID NO: 47546 - DNA, 22 bp, Homo sapiens
actctgatggggctgttggacg

SEQ ID NO: 47547 - DNA, 24 bp, Homo sapiens
actacgatgagctacttcagtggg

SEQ ID NO: 47548 - DNA, 62 bp, Physalis mottle virus
gtcacgttgggtgactctgtcgatccacgcctggaaaccgacccaccttcccccaacccgac

SEQ ID NO: 47549 - DNA, 24 bp, Physalis mottle virus
acgttgggtgactctgtcgatcca

SEQ ID NO: 47550 - DNA, 18 bp, Homo sapiens
attgttgatctgttgatc

SEQ ID NO: 47551 - DNA, 21 bp, Homo sapiens
gttgggtgaccataaggtcca

SEQ ID NO: 47552 - DNA, 18 bp, Homo sapiens
gctgggtggctttaaccc

SEQ ID NO: 47553 - DNA, 19 bp, Homo sapiens
cgatgggtgactgctgatc

SEQ ID NO: 47554 - DNA, 17 bp, Homo sapiens
cgttgggtcgcgggtcc

SEQ ID NO: 47555 - DNA, 18 bp, Homo sapiens
gtttgatgatctctgtcg

SEQ ID NO: 47556 - DNA, 23 bp, Homo sapiens
gttggggattcagatgagatcca

SEQ ID NO: 47557 - DNA, 18 bp, Homo sapiens
gtgggtgacacctggtcc

SEQ ID NO: 47558 - DNA, 17 bp, Homo sapiens
acgttgggagactagtc

SEQ ID NO: 47559 - DNA, 18 bp, Homo sapiens
gttgggtgactcccttcc

SEQ ID NO: 47560 - DNA, 69 bp, Physalis mottle virus
tgccaactgtccgcttggtgcactgaacatttccgcccaaccatctgcaccaccaatgattacactgca

SEQ ID NO: 47561 - DNA, 24 bp, Physalis mottle virus
tctgcaccaccaatgattacactg

SEQ ID NO: 47562 - DNA, 22 bp, Homo sapiens
tctacacccctggattacactg

SEQ ID NO: 47563 - DNA, 15 bp, Homo sapiens
tctgcaccatgacac

SEQ ID NO: 47564 - DNA, 18 bp, Homo sapiens
tctgcaccactgaagcca

SEQ ID NO: 47565 - DNA, 18 bp, Homo sapiens
tctgcccaccacactaca

SEQ ID NO: 47566 - DNA, 25 bp, Homo sapiens
tctgcaccaccgagtaccgcgactg

SEQ ID NO: 47567 - DNA, 16 bp, Homo sapiens
tgctaccaatgataca

SEQ ID NO: 47568 - DNA, 22 bp, Homo sapiens
tctgcagccagaggttacactg

SEQ ID NO: 47569 - DNA, 24 bp, Homo sapiens
tcttcaccaccaatggagccactg

SEQ ID NO: 47570 - DNA, 22 bp, Homo sapiens
tgcaccactacactgaacactg

SEQ ID NO: 47571 - DNA, 23 bp, Homo sapiens
tctgtacaactgcgtttacactg

SEQ ID NO: 47572 - DNA, 26 bp, Homo sapiens
tctgcaccgttcgatgcctgttactg

SEQ ID NO: 47573 - DNA, 19 bp, Homo sapiens
tctgtccaccagtcacact

SEQ ID NO: 47574 - DNA, 24 bp, Homo sapiens
tctgaccacctccacattacactg

SEQ ID NO: 47575 - DNA, 25 bp, Homo sapiens
ctgcaccaccaatgcttcagcactg

SEQ ID NO: 47576 - DNA, 18 bp, Homo sapiens
tctgcacctcaatggtca

SEQ ID NO: 47577 - DNA, 25 bp, Homo sapiens
tctggttgccaatgaccagtaactg

SEQ ID NO: 47578 - DNA, 16 bp, Homo sapiens
tctgtaccaataacac

SEQ ID NO: 47579 - DNA, 20 bp, Homo sapiens
tctgctaatatgttacactg

SEQ ID NO: 47580 - DNA, 70 bp, Physalis mottle virus
gatgattcagtcattgtcggcactccacccatctccccgaattggcctgccatcaaagacctccttcatc

SEQ ID NO: 47581 - DNA, 24 bp, Physalis mottle virus
agtcattgtcggcactccacccat

SEQ ID NO: 47582 - DNA, 17 bp, Homo sapiens
gttgttgtcaacatcca

SEQ ID NO: 47583 - DNA, 19 bp, Homo sapiens
aatcattgttggttcaacc

SEQ ID NO: 47584 - DNA, 19 bp, Homo sapiens
agtcattgttggaacttcc

SEQ ID NO: 47585 - DNA, 19 bp, Homo sapiens
agtcactgttgcccatcca

SEQ ID NO: 47586 - DNA, 19 bp, Homo sapiens
aatcattgtcttccattca

SEQ ID NO: 47587 - DNA, 18 bp, Homo sapiens
agtcattgtctccatcca

SEQ ID NO: 47588 - DNA, 18 bp, Homo sapiens
agtccggcactctgccca

SEQ ID NO: 47589 - DNA, 18 bp, Homo sapiens
gtcgtcgtccaccaccca

SEQ ID NO: 47590 - DNA, 18 bp, Homo sapiens
agccattgttcctgtcca

SEQ ID NO: 47591 - DNA, 19 bp, Homo sapiens
aggtattgtggtccaccca

SEQ ID NO: 47592 - DNA, 21 bp, Homo sapiens
gtcattgtctctcttgcccat

SEQ ID NO: 47593 - DNA, 19 bp, Homo sapiens
aatcattgttggtacgtca

SEQ ID NO: 47594 - DNA, 130 bp, Human spumaretrovirus
tggaaatagtatataaggatagtttctagattgtacgggagctcttcactactcgctgcgtcgagagtgtacgagactctccaggtttggtaagaaatattttatattgttataatgttactatgatcca

SEQ ID NO: 47595 - DNA, 24 bp, Human spumaretrovirus
tagtatataaggatagtttctaga

SEQ ID NO: 47596 - DNA, 21 bp, Homo sapiens
atatatgaaataatttctaga

SEQ ID NO: 47597 - DNA, 22 bp, Homo sapiens
agtatgtaaggacagagttaga

SEQ ID NO: 47598 - DNA, 19 bp, Homo sapiens
tagtatacaagtataattt

SEQ ID NO: 47599 - DNA, 18 bp, Homo sapiens
atatataagtatttctag

SEQ ID NO: 47600 - DNA, 18 bp, Homo sapiens
cagtatatggttttctag

SEQ ID NO: 47601 - DNA, 106 bp, Human foamy virus
ggatttgtatattagccttgctaagggagacatctagtgatataagtgtgaactacacttatcttaaatgatgtaactccttaggataatcaatatacaaaattcc

SEQ ID NO: 47602 - DNA, 24 bp, Human foamy virus
agggagacatctagtgatataagt

SEQ ID NO: 47603 - DNA, 22 bp, Homo sapiens
agggagattaaaacatataagt

SEQ ID NO: 47604 - DNA, 18 bp, Homo sapiens
agagagacatttacagtg

SEQ ID NO: 47605 - DNA, 17 bp, Homo sapiens
agggagacatttatgat

SEQ ID NO: 47606 - DNA, 114 bp, Human herpesvirus 8
gcgagtcgctatgacgcgtcgagggtccttcgtctccagagccaggagagtcggcattggcatcatcaactggctgaaccccagacgcactatggcgcgtcgatggtccctcgt

SEQ ID NO: 47607 - DNA, 24 bp, Human herpesvirus 8
cactatggcgcgtcgatggtccct

SEQ ID NO: 47608 - DNA, 17 bp, Homo sapiens
tatggctgtcagagtcc

SEQ ID NO: 47609 - DNA, 23 bp, Homo sapiens
cactggccaagtcgatggtctct

SEQ ID NO: 47610 - DNA, 18 bp, Homo sapiens
cacttgggagatggtccc

SEQ ID NO: 47611 - DNA, 22 bp, Homo sapiens
cactgtcttggtgtcgatggtc

SEQ ID NO: 47612 - DNA, 15 bp, Homo sapiens
tatggccgtggtccc

SEQ ID NO: 47613 - DNA, 21 bp, Homo sapiens
catggtgtctcgatggttcct

SEQ ID NO: 47614 - DNA, 84 bp, Human foamy virus
ggaagtgaagaacctcgtgacccaaatactcctgctcctcatagacgtacctgggatgagagacacaaggttcttaaattgtcc

SEQ ID NO: 47615 - DNA, 24 bp, Human foamy virus
tgaagaacctcgtgacccaaatac

SEQ ID NO: 47616 - DNA, 18 bp, Homo sapiens
gaagggcccccaacccaa

SEQ ID NO: 47617 - DNA, 21 bp, Homo sapiens
gaaacaccttggcccaaatac

SEQ ID NO: 47618 - DNA, 18 bp, Homo sapiens
agacctttaaccaaatac

SEQ ID NO: 47619 - DNA, 19 bp, Homo sapiens
tgaagaaccaaaacttcaa

SEQ ID NO: 47620 - DNA, 22 bp, Homo sapiens
tgaagagctctttgccaaatac

SEQ ID NO: 47621 - DNA, 22 bp, Homo sapiens
tgaaaaccctatgtccaaatac

SEQ ID NO: 47622 - DNA, 24 bp, Homo sapiens
tgaaaaaccccagaatctgaatac

SEQ ID NO: 47623 - DNA, 18 bp, Homo sapiens
tgaagactgccccaaata

SEQ ID NO: 47624 - DNA, 16 bp, Homo sapiens
tgaagaaactccaaat

SEQ ID NO: 47625 - DNA, 16 bp, Homo sapiens
tgaaaaatacccaaat

SEQ ID NO: 47626 - DNA, 20 bp, Homo sapiens
tgaagaaccatttgaatcca

SEQ ID NO: 47627 - DNA, 19 bp, Homo sapiens
gaagtttcagacccaaata

SEQ ID NO: 47628 - DNA, 19 bp, Homo sapiens
tgaagaactttgtatccaa

SEQ ID NO: 47629 - DNA, 18 bp, Homo sapiens
tgaggagttaacccaaat

SEQ ID NO: 47630 - DNA, 18 bp, Homo sapiens
tgaagacatcacccaaat

SEQ ID NO: 47631 - DNA, 21 bp, Homo sapiens
agggaccctatccccaaatac

SEQ ID NO: 47632 - DNA, 22 bp, Homo sapiens
tgaaaaccaccctcccaaatac

SEQ ID NO: 47633 - DNA, 19 bp, Homo sapiens
tgaaggccctcatgaccca

SEQ ID NO: 47634 - DNA, 122 bp, Human herpesvirus 4
gcagctctaacttggcatctcttttacagtggttctcctgatttgctcttcgtgctcttcatgtccactgagcaagatccttctggcacgactgttcctatatgctctcgcactcttgttgc

SEQ ID NO: 47635 - DNA, 24 bp, Human herpesvirus 4
tggcacgactgttcctatatgctc

SEQ ID NO: 47636 - DNA, 20 bp, Homo sapiens
tggcattgctgttccctgcc

SEQ ID NO: 47637 - DNA, 21 bp, Homo sapiens
tgttacggctgttcccagact

SEQ ID NO: 47638 - DNA, 21 bp, Homo sapiens
ggcgcggctgttcctaacctc

SEQ ID NO: 47639 - DNA, 18 bp, Homo sapiens
gattgttcctatacagct

SEQ ID NO: 47640 - DNA, 19 bp, Homo sapiens
tggcatgctgttcctcctg

SEQ ID NO: 47641 - DNA, 19 bp, Homo sapiens
tggctgactgttcctccct

SEQ ID NO: 47642 - DNA, 23 bp, Homo sapiens
tggcacaactgtagatggtgctc

SEQ ID NO: 47643 - DNA, 63 bp, Human herpesvirus 8
ggtttgggcaacaaaactcttaaccctttgcgcgaatgcaagcaagagtggctaatgtctgcc

SEQ ID NO: 47644 - DNA, 24 bp, Human herpesvirus 8
caagcaagagtggctaatgtctgc

SEQ ID NO: 47645 - DNA, 18 bp, Homo sapiens
aagcagagtggctgtctg

SEQ ID NO: 47646 - DNA, 19 bp, Homo sapiens
tgagtgagagtggcggctg

SEQ ID NO: 47647 - DNA, 23 bp, Homo sapiens
ggagcgagggtggctgcaccagc

SEQ ID NO: 47648 - DNA, 27 bp, Homo sapiens
tgagaaagagtaaagagctaatgtttg

SEQ ID NO: 47649 - DNA, 15 bp, Homo sapiens
gcaagataatgtctg

SEQ ID NO: 47650 - DNA, 18 bp, Homo sapiens
agctaagagtggcccctg

SEQ ID NO: 47651 - DNA, 22 bp, Homo sapiens
caggcacgcagttaatgtctgc

SEQ ID NO: 47652 - DNA, 18 bp, Homo sapiens
gagtaagcagaatgtctg

SEQ ID NO: 47653 - DNA, 16 bp, Homo sapiens
caaacaagaaatgtct

SEQ ID NO: 47654 - DNA, 21 bp, Homo sapiens
caaggagggtggttaatctgc

SEQ ID NO: 47655 - DNA, 18 bp, Homo sapiens
caagcaagccggtgtctg

SEQ ID NO: 47656 - DNA, 20 bp, Homo sapiens
gcaatggccaccatgtctgc

SEQ ID NO: 47657 - DNA, 19 bp, Homo sapiens
aacaattgtttaatgtctg

SEQ ID NO: 47658 - DNA, 23 bp, Homo sapiens
aagtaagagtgactcattcctgc

SEQ ID NO: 47659 - DNA, 24 bp, Homo sapiens
caagcaagagctggtctcatctgc

SEQ ID NO: 47660 - DNA, 19 bp, Homo sapiens
caggcaggagcggctgcct

SEQ ID NO: 47661 - DNA, 22 bp, Homo sapiens
caggcgtgatggctaatgtctg

SEQ ID NO: 47662 - DNA, 18 bp, Homo sapiens
aagcgagacaaatgtctg

SEQ ID NO: 47663 - DNA, 16 bp, Homo sapiens
caagaacgatgtctgc

SEQ ID NO: 47664 - DNA, 21 bp, Homo sapiens
agataagctattgatgtctgc

SEQ ID NO: 47665 - DNA, 19 bp, Homo sapiens
aagtggcagtgaacgtctg

SEQ ID NO: 47666 - DNA, 18 bp, Homo sapiens
agtaagctataatgtctg

SEQ ID NO: 47667 - DNA, 16 bp, Homo sapiens
aagaaagcaatgtctg

SEQ ID NO: 47668 - DNA, 15 bp, Homo sapiens
aagcaagtagtgtct

SEQ ID NO: 47669 - DNA, 22 bp, Homo sapiens
agccaagggtggccagttctgc

SEQ ID NO: 47670 - DNA, 20 bp, Homo sapiens
agacgcccagctaatgtttg

SEQ ID NO: 47671 - DNA, 18 bp, Homo sapiens
aaaagcgcagatgtctgc

SEQ ID NO: 47672 - DNA, 21 bp, Homo sapiens
agcaggagtggctctgggtgc

SEQ ID NO: 47673 - DNA, 22 bp, Homo sapiens
caggcagagtggctcacgcctg

SEQ ID NO: 47674 - DNA, 19 bp, Homo sapiens
caagcaagatggctgatgc

SEQ ID NO: 47675 - DNA, 21 bp, Homo sapiens
caaggggtaaataatgtctgc

SEQ ID NO: 47676 - DNA, 19 bp, Homo sapiens
gagtgagaaccaatgtctg

SEQ ID NO: 47677 - DNA, 21 bp, Homo sapiens
agcaaaagtggtagctatttg

SEQ ID NO: 47678 - DNA, 18 bp, Homo sapiens
gcagggaatgatgtctgc

SEQ ID NO: 47679 - DNA, 20 bp, Homo sapiens
agcaaattatttaatgtctg

SEQ ID NO: 47680 - DNA, 20 bp, Homo sapiens
caggcaggagggctccttgc

SEQ ID NO: 47681 - DNA, 22 bp, Homo sapiens
agctgggaccacaggtgtctgc

SEQ ID NO: 47682 - DNA, 22 bp, Homo sapiens
tgactaagaaggtaatgtttgc

SEQ ID NO: 47683 - DNA, 20 bp, Homo sapiens
aaggagagtggcgaagctgc

SEQ ID NO: 47684 - DNA, 23 bp, Homo sapiens
agccaactagttgctaatgtttg

SEQ ID NO: 47685 - DNA, 23 bp, Homo sapiens
tgagcagaacagctagtgtttgc

SEQ ID NO: 47686 - DNA, 16 bp, Homo sapiens
gcaggagtggctgtcc

SEQ ID NO: 47687 - DNA, 23 bp, Homo sapiens
caggccagagtggccccacctgc

SEQ ID NO: 47688 - DNA, 23 bp, Homo sapiens
tgagtgagaatggctatcattgc

SEQ ID NO: 47689 - DNA, 17 bp, Homo sapiens
agctgtgctaatgtttg

SEQ ID NO: 47690 - DNA, 19 bp, Homo sapiens
gcgaagtggctcacatctg

SEQ ID NO: 47691 - DNA, 24 bp, Homo sapiens
tgagaagagtggcccttcctctgc

SEQ ID NO: 47692 - DNA, 18 bp, Homo sapiens
caagcaaggggatgtttg

SEQ ID NO: 47693 - DNA, 19 bp, Homo sapiens
tgacaagaaaaaatgtctg

SEQ ID NO: 47694 - DNA, 22 bp, Homo sapiens
agcaaggggtctagatgtctgc

SEQ ID NO: 47695 - DNA, 21 bp, Homo sapiens
caatgggagaataaatgtctg

SEQ ID NO: 47696 - DNA, 19 bp, Homo sapiens
caggcaggaagcatgtctg

SEQ ID NO: 47697 - DNA, 21 bp, Homo sapiens
aggaaagagtggtccttctgc

SEQ ID NO: 47698 - DNA, 19 bp, Homo sapiens
gcagagtggctcacgcctg

SEQ ID NO: 47699 - DNA, 18 bp, Homo sapiens
agagtggcctggtgtctg

SEQ ID NO: 47700 - DNA, 64 bp, Human herpesvirus 8
gtgatgttgcgataacatcctctgggatgccaagcagatcaaagaggtcttcatcgcacatcgc

SEQ ID NO: 47701 - DNA, 24 bp, Human herpesvirus 8
aaagaggtcttcatcgcacatcgc

SEQ ID NO: 47702 - DNA, 21 bp, Homo sapiens
aagaggtcttctctccattgc

SEQ ID NO: 47703 - DNA, 18 bp, Homo sapiens
aaagaggtcttcagcaca

SEQ ID NO: 47704 - DNA, 21 bp, Homo sapiens
aaagaggtctcgtttcctcgc

SEQ ID NO: 47705 - DNA, 19 bp, Homo sapiens
aaagatgtcttcgtcccac

SEQ ID NO: 47706 - DNA, 18 bp, Homo sapiens
aaagagtcttcattttgc

SEQ ID NO: 47707 - DNA, 19 bp, Homo sapiens
ggagaggtcttcgatccgc

SEQ ID NO: 47708 - DNA, 23 bp, Homo sapiens
ggaggggtcctcatcctggttgc

SEQ ID NO: 47709 - DNA, 20 bp, Homo sapiens
ggaaaggtctttatctgcac

SEQ ID NO: 47710 - DNA, 19 bp, Homo sapiens
aaagaggctttacagtcgc

SEQ ID NO: 47711 - DNA, 18 bp, Homo sapiens
aaagaagtcttcatctca

SEQ ID NO: 47712 - DNA, 18 bp, Homo sapiens
aaagaggtttcattctgc

SEQ ID NO: 47713 - DNA, 67 bp, Human herpesvirus 8
tactataacaggaaacatagaagttgcggatagagcctggtttctaacggcaatgatatttatagtg

SEQ ID NO: 47714 - DNA, 23 bp, Human herpesvirus 8
taacggcaatgatatttatagtg

SEQ ID NO: 47715 - DNA, 19 bp, Homo sapiens
ggcgtaatccattatagtg

SEQ ID NO: 47716 - DNA, 19 bp, Homo sapiens
gcccctgatatttatggtg

SEQ ID NO: 47717 - DNA, 21 bp, Homo sapiens
ggcgctgaccctgttatagtg

SEQ ID NO: 47718 - DNA, 18 bp, Homo sapiens
cagcaatggtcagtagtg

SEQ ID NO: 47719 - DNA, 20 bp, Homo sapiens
acagcgatgatattttagtg

SEQ ID NO: 47720 - DNA, 65 bp, Human herpesvirus 6
tgcatgaaaatatcattaaattgttttacaaattttaaatgcaatttaaaagaatttttgtagca

SEQ ID NO: 47721 - DNA, 91 bp, Human herpesvirus 6
tgtatttttctttgcagagatgtatggagagcttatattgggggaaaatacctgactgttctgcctatattcgaatgttgaagtatgtaca

SEQ ID NO: 47722 - DNA, 24 bp, Human herpesvirus 6
tggagagcttatattgggggaaaa

SEQ ID NO: 47723 - DNA, 17 bp, Homo sapiens
tgggcagcttggggaaa

SEQ ID NO: 47724 - DNA, 22 bp, Homo sapiens
ggagggggaggttgggggaaaa

SEQ ID NO: 47725 - DNA, 25 bp, Homo sapiens
tgtagagtttatactaattggaaaa

SEQ ID NO: 47726 - DNA, 22 bp, Homo sapiens
tggagagttataaaaaaaggga

SEQ ID NO: 47727 - DNA, 16 bp, Homo sapiens
ggaggcccctggggga

SEQ ID NO: 47728 - DNA, 18 bp, Homo sapiens
tgggaagccctgggggaa

SEQ ID NO: 47729 - DNA, 19 bp, Homo sapiens
tgggggctttgctggggga

SEQ ID NO: 47730 - DNA, 21 bp, Homo sapiens
tgggaagcttgtggcaaggaa

SEQ ID NO: 47731 - DNA, 19 bp, Homo sapiens
tggagagctggtgtcgggg

SEQ ID NO: 47732 - DNA, 20 bp, Homo sapiens
tggaggcgtttgtaagggaa

SEQ ID NO: 47733 - DNA, 16 bp, Homo sapiens
tggaaagctgggggaa

SEQ ID NO: 47734 - DNA, 17 bp, Homo sapiens
tggagagcttgttgaag

SEQ ID NO: 47735 - DNA, 19 bp, Homo sapiens
tgaagagtcagtgggggaa

SEQ ID NO: 47736 - DNA, 20 bp, Homo sapiens
tggagggtttcattggaaga

SEQ ID NO: 47737 - DNA, 17 bp, Homo sapiens
tgggagtgttgggggaa

SEQ ID NO: 47738 - DNA, 20 bp, Homo sapiens
tggagggcttatatcttgga

SEQ ID NO: 47739 - DNA, 21 bp, Homo sapiens
tggggaccgggtggggggaaa

SEQ ID NO: 47740 - DNA, 21 bp, Homo sapiens
gagagcttgtgtgtttgggga

SEQ ID NO: 47741 - DNA, 22 bp, Homo sapiens
tggggggctagtattgggaaaa

SEQ ID NO: 47742 - DNA, 17 bp, Homo sapiens
tggagggcttgggaaga

SEQ ID NO: 47743 - DNA, 18 bp, Homo sapiens
tggaaaagttgggggaaa

SEQ ID NO: 47744 - DNA, 17 bp, Homo sapiens
ggagagttttggggaaa

SEQ ID NO: 47745 - DNA, 19 bp, Homo sapiens
tggaggagcttgtagggga

SEQ ID NO: 47746 - DNA, 19 bp, Homo sapiens
gagagcttgtactctgaga

SEQ ID NO: 47747 - DNA, 21 bp, Homo sapiens
tggggatgggatgggggaaaa

SEQ ID NO: 47748 - DNA, 21 bp, Homo sapiens
tggaggggcagccctggggga

SEQ ID NO: 47749 - DNA, 22 bp, Homo sapiens
tggagagctctataagtgagaa

SEQ ID NO: 47750 - DNA, 18 bp, Homo sapiens
tggaggcttatgggggaa

SEQ ID NO: 47751 - DNA, 20 bp, Homo sapiens
tggagggcttgtgaaagaaa

SEQ ID NO: 47752 - DNA, 21 bp, Homo sapiens
tggaagagtagtggggggaaa

SEQ ID NO: 47753 - DNA, 22 bp, Homo sapiens
tggagacttatatttcatgaaa

SEQ ID NO: 47754 - DNA, 19 bp, Homo sapiens
tgtagagcttatgtcaaag

SEQ ID NO: 47755 - DNA, 20 bp, Homo sapiens
tggagataagtttgggggaa

SEQ ID NO: 47756 - DNA, 20 bp, Homo sapiens
tggagatttatgtttgaaag

SEQ ID NO: 47757 - DNA, 21 bp, Homo sapiens
gagagcttatggaataggaga

SEQ ID NO: 47758 - DNA, 20 bp, Homo sapiens
tggagagcatatatacagaa

SEQ ID NO: 47759 - DNA, 17 bp, Homo sapiens
tggagggttgggggaaa

SEQ ID NO: 47760 - DNA, 20 bp, Homo sapiens
tggagagcttgatttgagaa

SEQ ID NO: 47761 - DNA, 19 bp, Homo sapiens
tggggtcaagttgggggaa

SEQ ID NO: 47762 - DNA, 17 bp, Homo sapiens
tggagagcattagggaa

SEQ ID NO: 47763 - DNA, 15 bp, Homo sapiens
ggagagcttggggga

SEQ ID NO: 47764 - DNA, 23 bp, Homo sapiens
tggggatttatcaccagggaaaa

SEQ ID NO: 47765 - DNA, 16 bp, Homo sapiens
gagggctcctggggga

SEQ ID NO: 47766 - DNA, 17 bp, Homo sapiens
tggaggcttatggagga

SEQ ID NO: 47767 - DNA, 19 bp, Homo sapiens
tggggagcctgctagggaa

SEQ ID NO: 47768 - DNA, 19 bp, Homo sapiens
tggggatttatttgggaga

SEQ ID NO: 47769 - DNA, 20 bp, Homo sapiens
tgggggcttggtggggagaa

SEQ ID NO: 47770 - DNA, 17 bp, Homo sapiens
tggagagcttgagaaaa

SEQ ID NO: 47771 - DNA, 21 bp, Homo sapiens
tggagagcttgtcgttgttgg

SEQ ID NO: 47772 - DNA, 20 bp, Homo sapiens
tggagaatttacagggaaaa

SEQ ID NO: 47773 - DNA, 17 bp, Homo sapiens
tggggaactggggggaa

SEQ ID NO: 47774 - DNA, 25 bp, Homo sapiens
tggagatcttatatttatttgaaaa

SEQ ID NO: 47775 - DNA, 17 bp, Homo sapiens
tgggatgcgttggggga

SEQ ID NO: 47776 - DNA, 22 bp, Homo sapiens
tggggggtctgtactgggagga

SEQ ID NO: 47777 - DNA, 18 bp, Homo sapiens
ggagggcttgtgggagaa

SEQ ID NO: 47778 - DNA, 17 bp, Homo sapiens
ggagagctggtggggga

SEQ ID NO: 47779 - DNA, 16 bp, Homo sapiens
tggggaactgggggaa

SEQ ID NO: 47780 - DNA, 17 bp, Homo sapiens
ggagagcttataggaag

SEQ ID NO: 47781 - DNA, 19 bp, Homo sapiens
tggagtgtttattggagaa

SEQ ID NO: 47782 - DNA, 20 bp, Homo sapiens
tggggagcttggcttgagga

SEQ ID NO: 47783 - DNA, 18 bp, Homo sapiens
ggggagcttgttggagaa

SEQ ID NO: 47784 - DNA, 17 bp, Homo sapiens
tggagagttgaggggaa

SEQ ID NO: 47785 - DNA, 20 bp, Homo sapiens
gagggcttacatacagggga

SEQ ID NO: 47786 - DNA, 19 bp, Homo sapiens
gagagggcagtgggggaaa

SEQ ID NO: 47787 - DNA, 18 bp, Homo sapiens
ggagagcttgtcaaggaa

SEQ ID NO: 47788 - DNA, 19 bp, Homo sapiens
ggggagtttattaggagaa

SEQ ID NO: 47789 - DNA, 16 bp, Homo sapiens
tggagagctgtggaag

SEQ ID NO: 47790 - DNA, 20 bp, Homo sapiens
tggggagtgtattcaggaga

SEQ ID NO: 47791 - DNA, 19 bp, Homo sapiens
tagagaaagttgggggaaa

SEQ ID NO: 47792 - DNA, 20 bp, Homo sapiens
tggagagctggtgatggggg

SEQ ID NO: 47793 - DNA, 21 bp, Homo sapiens
tggttctgtgtattgggggaa

SEQ ID NO: 47794 - DNA, 18 bp, Homo sapiens
gagggcttgtgcaggaaa

SEQ ID NO: 47795 - DNA, 17 bp, Homo sapiens
tggaggagcttggggga

SEQ ID NO: 47796 - DNA, 16 bp, Homo sapiens
gggagttactggggga

SEQ ID NO: 47797 - DNA, 19 bp, Homo sapiens
tggagaactttctggggaa

SEQ ID NO: 47798 - DNA, 21 bp, Homo sapiens
tggagagcctgacaatgggga

SEQ ID NO: 47799 - DNA, 19 bp, Homo sapiens
tggaggaggttgggggaaa

SEQ ID NO: 47800 - DNA, 20 bp, Homo sapiens
tggaggaggttgggggaaaa

SEQ ID NO: 47801 - DNA, 15 bp, Homo sapiens
tgggagcttggggga

SEQ ID NO: 47802 - DNA, 81 bp, Human herpesvirus 6
gggtgtgatgtacaggaaaatgacgaagatgaaggaaccaatcgctgcataacgttaaaccgcaagtgcagaaatacaccc

SEQ ID NO: 47803 - DNA, 24 bp, Human herpesvirus 6
tacaggaaaatgacgaagatgaag

SEQ ID NO: 47804 - DNA, 19 bp, Homo sapiens
aggaaaatgactgtaaaag

SEQ ID NO: 47805 - DNA, 21 bp, Homo sapiens
cacaggaaaatgaaactgaag

SEQ ID NO: 47806 - DNA, 17 bp, Homo sapiens
acaggaaaatgtcatga

SEQ ID NO: 47807 - DNA, 18 bp, Homo sapiens
acaggaaaatgatggaag

SEQ ID NO: 47808 - DNA, 20 bp, Homo sapiens
caggaaggacacgaagatga

SEQ ID NO: 47809 - DNA, 16 bp, Homo sapiens
caggaatggagatgaa

SEQ ID NO: 47810 - DNA, 19 bp, Homo sapiens
tacagagagaaaaagatga

SEQ ID NO: 47811 - DNA, 19 bp, Homo sapiens
tacaggatggtgagatgaa

SEQ ID NO: 47812 - DNA, 21 bp, Homo sapiens
cacaggaaaaggtgagagatg

SEQ ID NO: 47813 - DNA, 22 bp, Homo sapiens
caggaagattccgtagatgaag

SEQ ID NO: 47814 - DNA, 17 bp, Homo sapiens
tacagggagaagatgaa

SEQ ID NO: 47815 - DNA, 18 bp, Homo sapiens
tacagtagagaaagatga

SEQ ID NO: 47816 - DNA, 19 bp, Homo sapiens
ggagaacatgaagatgaag

SEQ ID NO: 47817 - DNA, 21 bp, Homo sapiens
cagacagagatgaagatgaag

SEQ ID NO: 47818 - DNA, 19 bp, Homo sapiens
cagaaggagacagatgaag

SEQ ID NO: 47819 - DNA, 22 bp, Homo sapiens
tgaggagagaaagagaagatga

SEQ ID NO: 47820 - DNA, 23 bp, Homo sapiens
caggaaaatgacctgttctgaag

SEQ ID NO: 47821 - DNA, 22 bp, Homo sapiens
tacaggaaaggaggacagatga

SEQ ID NO: 47822 - DNA, 21 bp, Homo sapiens
tacaggaaaatacttttgaag

SEQ ID NO: 47823 - DNA, 19 bp, Homo sapiens
tacaggaaaatgaggcaga

SEQ ID NO: 47824 - DNA, 23 bp, Homo sapiens
ggaattccgagatgaagatgaag

SEQ ID NO: 47825 - DNA, 20 bp, Homo sapiens
tacaggaaaatcatgagaag

SEQ ID NO: 47826 - DNA, 21 bp, Homo sapiens
ggaaaacaatgaaagatgaag

SEQ ID NO: 47827 - DNA, 17 bp, Homo sapiens
ggaaagaaggaagatga

SEQ ID NO: 47828 - DNA, 17 bp, Homo sapiens
cacaggaagtgagatga

SEQ ID NO: 47829 - DNA, 20 bp, Homo sapiens
ggtaagtgaagaagatgaag

SEQ ID NO: 47830 - DNA, 16 bp, Homo sapiens
aggaaatgaaaagatg

SEQ ID NO: 47831 - DNA, 19 bp, Homo sapiens
tacaggaaggtgacagaca

SEQ ID NO: 47832 - DNA, 21 bp, Homo sapiens
ggaaaatttggtgagatgaag

SEQ ID NO: 47833 - DNA, 18 bp, Homo sapiens
ggaaaagaaaagatgaag

SEQ ID NO: 47834 - DNA, 22 bp, Homo sapiens
tacagaaaaatgtgtgatgaag

SEQ ID NO: 47835 - DNA, 18 bp, Homo sapiens
tacaggaagtgagtgaag

SEQ ID NO: 47836 - DNA, 19 bp, Homo sapiens
aggaaaatggaaaatgaag

SEQ ID NO: 47837 - DNA, 20 bp, Homo sapiens
aggaaagttctgagatgaag

SEQ ID NO: 47838 - DNA, 20 bp, Homo sapiens
ggaaaatgaaagtaatgaag

SEQ ID NO: 47839 - DNA, 20 bp, Homo sapiens
ggtagatggtgaagatgaag

SEQ ID NO: 47840 - DNA, 17 bp, Homo sapiens
aggaaaatgggaagata

SEQ ID NO: 47841 - DNA, 21 bp, Homo sapiens
agaaaatgtgtagggatgaag

SEQ ID NO: 47842 - DNA, 126 bp, Human papillomavirus type 86
tatatattttgggttctggctactgtatatacaggtactgtggtacattggattgttataatcacacaaccagccatctactgctgctacactaccttgtacagccccttccccatacagtatgta

SEQ ID NO: 47843 - DNA, 24 bp, Human papillomavirus type 86
tattttgggttctggctactgtat

SEQ ID NO: 47844 - DNA, 18 bp, Homo sapiens
ttctgggttctgcagtgt

SEQ ID NO: 47845 - DNA, 24 bp, Homo sapiens
tattttggtttttgtagcagctgt

SEQ ID NO: 47846 - DNA, 16 bp, Homo sapiens
tttgggttgcactgta

SEQ ID NO: 47847 - DNA, 20 bp, Homo sapiens
cattttgggtttggagctgt

SEQ ID NO: 47848 - DNA, 66 bp, Human T-lymphotropic virus 2
ggttccacctgccttctttcaatcaatgcgaaagcacaccccctaccgaaatggatgcctggaacc

SEQ ID NO: 47849 - DNA, 24 bp, Human T-lymphotropic virus 2
tccacctgccttctttcaatcaat

SEQ ID NO: 47850 - DNA, 19 bp, Homo sapiens
cacctgttttcttcctcca

SEQ ID NO: 47851 - DNA, 17 bp, Homo sapiens
tccactgccttcagtca

SEQ ID NO: 47852 - DNA, 18 bp, Homo sapiens
ctgccttctttctagcaa

SEQ ID NO: 47853 - DNA, 19 bp, Homo sapiens
cacctgttttctttcaacc

SEQ ID NO: 47854 - DNA, 18 bp, Homo sapiens
ctgctctgctcaatcaat

SEQ ID NO: 47855 - DNA, 18 bp, Homo sapiens
tccagctgtcttcttcca

SEQ ID NO: 47856 - DNA, 18 bp, Homo sapiens
ccgcctcccgggttcaat

SEQ ID NO: 47857 - DNA, 18 bp, Homo sapiens
tctgccagccttctttca

SEQ ID NO: 47858 - DNA, 18 bp, Homo sapiens
tccacctgctcttttttc

SEQ ID NO: 47859 - DNA, 18 bp, Homo sapiens
tccactctgtctcaatca

SEQ ID NO: 47860 - DNA, 20 bp, Homo sapiens
tgcctgtcattcaagtcaat

SEQ ID NO: 47861 - DNA, 21 bp, Homo sapiens
ctgccagtcctgtcaatcaat

SEQ ID NO: 47862 - DNA, 19 bp, Homo sapiens
cctgcctgccagccagtca

SEQ ID NO: 47863 - DNA, 22 bp, Homo sapiens
cacttccttcttccacgacaat

SEQ ID NO: 47864 - DNA, 25 bp, Homo sapiens
cccctttctcttttttcaatcaata

SEQ ID NO: 47865 - DNA, 17 bp, Homo sapiens
ctgcttccttccctcaa

SEQ ID NO: 47866 - DNA, 20 bp, Homo sapiens
tcctcctgttttctggcaat

SEQ ID NO: 47867 - DNA, 19 bp, Homo sapiens
tccatctatcaatcaatca

SEQ ID NO: 47868 - DNA, 18 bp, Homo sapiens
tccacctgcttctccaat

SEQ ID NO: 47869 - DNA, 23 bp, Homo sapiens
ctgtttccttccaccacatcaat

SEQ ID NO: 47870 - DNA, 19 bp, Homo sapiens
tcccctgccttcttggcaa

SEQ ID NO: 47871 - DNA, 16 bp, Homo sapiens
caccttcctttccaat

SEQ ID NO: 47872 - DNA, 18 bp, Homo sapiens
cctgcctgctccaacaat

SEQ ID NO: 47873 - DNA, 23 bp, Homo sapiens
cctgcctttttcttatggtcaat

SEQ ID NO: 47874 - DNA, 21 bp, Homo sapiens
cacttttcttctttcttcaat

SEQ ID NO: 47875 - DNA, 22 bp, Homo sapiens
ctgcctcccgggttcaatcaat

SEQ ID NO: 47876 - DNA, 19 bp, Homo sapiens
tccacctgcatcgagatca

SEQ ID NO: 47877 - DNA, 20 bp, Homo sapiens
ctgttttcttccatttcaat

SEQ ID NO: 47878 - DNA, 20 bp, Homo sapiens
tccatttcctttccctttca

SEQ ID NO: 47879 - DNA, 22 bp, Homo sapiens
catctcctaggccccaatcaat

SEQ ID NO: 47880 - DNA, 20 bp, Homo sapiens
tccacctgcttttctcctca

SEQ ID NO: 47881 - DNA, 76 bp, Cowpox virus
gcaatgttaaagtgactcctccagattactcacctataatcgcgagtattaaaggtaagagttatgacgcattagc

SEQ ID NO: 47882 - DNA, 61 bp, Camelpox virus
aagtaaagatttcaaagatgttttctgtcagaaaataccatccaagtcaatatctttactt

SEQ ID NO: 47883 - DNA, 24 bp, Camelpox virus
taaagatttcaaagatgttttctg

SEQ ID NO: 47884 - DNA, 20 bp, Homo sapiens
aaagatttcaaacaaatttt

SEQ ID NO: 47885 - DNA, 21 bp, Homo sapiens
taaagattctaagatgatttt

SEQ ID NO: 47886 - DNA, 21 bp, Homo sapiens
actccacgagggtgttttctg

SEQ ID NO: 47887 - DNA, 18 bp, Homo sapiens
agaatttcaaagcattct

SEQ ID NO: 47888 - DNA, 19 bp, Homo sapiens
aaaatttccctgttttctg

SEQ ID NO: 47889 - DNA, 15 bp, Homo sapiens
agacagatgttttct

SEQ ID NO: 47890 - DNA, 16 bp, Homo sapiens
agatttcaaatgcttt

SEQ ID NO: 47891 - DNA, 16 bp, Homo sapiens
aagatggatgttttct

SEQ ID NO: 47892 - DNA, 21 bp, Homo sapiens
gatttcaacccagcttttctg

SEQ ID NO: 47893 - DNA, 19 bp, Homo sapiens
agatttcaaagatggtctg

SEQ ID NO: 47894 - DNA, 21 bp, Homo sapiens
aagattttaagtagttttctg

SEQ ID NO: 47895 - DNA, 17 bp, Homo sapiens
aagatttcattttttct

SEQ ID NO: 47896 - DNA, 21 bp, Homo sapiens
agatgtcagagggattttctg

SEQ ID NO: 47897 - DNA, 98 bp, Variola virus
ggtttagtatctcaattgtctgtcttaagttccattacaaatatactaacgtctgagtatttggatttggaaaagaaaatttgtgagtatatcagatc

SEQ ID NO: 47898 - DNA, 24 bp, Variola virus
tgagtatttggatttggaaaagaa

SEQ ID NO: 47899 - DNA, 18 bp, Homo sapiens
tttggatttggaaaggaa

SEQ ID NO: 47900 - DNA, 18 bp, Homo sapiens
agtgtttgggacttgaaa

SEQ ID NO: 47901 - DNA, 17 bp, Homo sapiens
tgagtacttgggaggaa

SEQ ID NO: 47902 - DNA, 19 bp, Homo sapiens
gagtatttggctctgagaa

SEQ ID NO: 47903 - DNA, 18 bp, Homo sapiens
gtatttagctggggaaga

SEQ ID NO: 47904 - DNA, 21 bp, Homo sapiens
tgagtgctcacttggaaagga

SEQ ID NO: 47905 - DNA, 21 bp, Homo sapiens
gaaataggatttggggaagaa

SEQ ID NO: 47906 - DNA, 23 bp, Homo sapiens
tgagtatttgaacatctaaagga

SEQ ID NO: 47907 - DNA, 18 bp, Homo sapiens
tgaggtaggttggaaaag

SEQ ID NO: 47908 - DNA, 21 bp, Homo sapiens
gtattgctgaagttggaaaag

SEQ ID NO: 47909 - DNA, 17 bp, Homo sapiens
tgagttttggacaaaga

SEQ ID NO: 47910 - DNA, 22 bp, Homo sapiens
agtacttagatttggaagagaa

SEQ ID NO: 47911 - DNA, 22 bp, Homo sapiens
tgatgtgtagtttggaaaagaa

SEQ ID NO: 47912 - DNA, 19 bp, Homo sapiens
tgaataatttggaggggga

SEQ ID NO: 47913 - DNA, 21 bp, Homo sapiens
tgagggtttgggaaaaaagaa

SEQ ID NO: 47914 - DNA, 22 bp, Homo sapiens
gagtatttgggaattagaagag

SEQ ID NO: 47915 - DNA, 17 bp, Homo sapiens
tgatatttggatgggga

SEQ ID NO: 47916 - DNA, 18 bp, Homo sapiens
tgggtatttggataagaa

SEQ ID NO: 47917 - DNA, 18 bp, Homo sapiens
tgagtatttggctgagaa

SEQ ID NO: 47918 - DNA, 21 bp, Homo sapiens
tgatgcttatttggaaaagaa

SEQ ID NO: 47919 - DNA, 19 bp, Homo sapiens
tgagcatatctcttggaaa

SEQ ID NO: 47920 - DNA, 20 bp, Homo sapiens
tggttatttggatggtgaag

SEQ ID NO: 47921 - DNA, 18 bp, Homo sapiens
tgagagtttggattgtgg

SEQ ID NO: 47922 - DNA, 23 bp, Homo sapiens
tgagtgtttaatactggaaaaga

SEQ ID NO: 47923 - DNA, 18 bp, Homo sapiens
tgggtgtttagatcagga

SEQ ID NO: 47924 - DNA, 21 bp, Homo sapiens
tgggtacttgggatacgggaa

SEQ ID NO: 47925 - DNA, 21 bp, Homo sapiens
tgacagttggatttggaggag

SEQ ID NO: 47926 - DNA, 19 bp, Homo sapiens
agtatttgggaaactgaaa

SEQ ID NO: 47927 - DNA, 18 bp, Homo sapiens
tggcctgatttggagaag

SEQ ID NO: 47928 - DNA, 84 bp, Amsacta moorei entomopoxvirus
taatatttgtaattatttttttaataaaatataatactatatcatttgtattattattgttatttaaaataattctaaatttta

SEQ ID NO: 47929 - DNA, 24 bp, Amsacta moorei entomopoxvirus
ttattgttatttaaaataattcta

SEQ ID NO: 47930 - DNA, 21 bp, Homo sapiens
ttgttatttaaatgacctcta

SEQ ID NO: 47931 - DNA, 22 bp, Homo sapiens
ctactaatttaaaataattcta

SEQ ID NO: 47932 - DNA, 22 bp, Homo sapiens
ttattgtcatttaaaaacaact

SEQ ID NO: 47933 - DNA, 18 bp, Homo sapiens
tatttctaaaataattct

SEQ ID NO: 47934 - DNA, 23 bp, Homo sapiens
ctattgccaaaaaaatgattcta

SEQ ID NO: 47935 - DNA, 21 bp, Homo sapiens
ttaatatttaaaataattcta

SEQ ID NO: 47936 - DNA, 70 bp, Amsacta moorei entomopoxvirus
aatattgaatgtattattgattttattaatatatttatttaaaaaatcattatatattacatttaatatt

SEQ ID NO: 47937 - DNA, 24 bp, Amsacta moorei entomopoxvirus
ttgaatgtattattgattttatta

SEQ ID NO: 47938 - DNA, 23 bp, Homo sapiens
ttgaggtattgatgactttatta

SEQ ID NO: 47939 - DNA, 24 bp, Homo sapiens
ttcaatgtatcaaaaattttatta

SEQ ID NO: 47940 - DNA, 21 bp, Homo sapiens
tgaatgtattatatcaatttt

SEQ ID NO: 47941 - DNA, 27 bp, Homo sapiens
ttgaatatattgcacaatattttatta

SEQ ID NO: 47942 - DNA, 76 bp, Amsacta moorei entomopoxvirus
actttcattaataatatttttaaatttatcagagtttacatattctccgtttaaaaaattttttattaattctggt

SEQ ID NO: 47943 - DNA, 24 bp, Amsacta moorei entomopoxvirus
tcattaataatatttttaaattta

SEQ ID NO: 47944 - DNA, 19 bp, Homo sapiens
tcaataataatattttcaa

SEQ ID NO: 47945 - DNA, 66 bp, Amsacta moorei entomopoxvirus
tgatatagatttaatatttgtttatcatatttatcatatatagattcaatcatagtatctatatca

SEQ ID NO: 47946 - DNA, 24 bp, Amsacta moorei entomopoxvirus
tatagatttaatatttgtttatca

SEQ ID NO: 47947 - DNA, 19 bp, Homo sapiens
tacagatttaattcatgtt

SEQ ID NO: 47948 - DNA, 20 bp, Homo sapiens
taagatttaatacagtttat

SEQ ID NO: 47949 - DNA, 21 bp, Homo sapiens
catagatttttctctgtttat

SEQ ID NO: 47950 - DNA, 21 bp, Homo sapiens
tatagtttaatatctatatca

SEQ ID NO: 47951 - DNA, 23 bp, Homo sapiens
tatagatttatatatttagttta

SEQ ID NO: 47952 - DNA, 62 bp, Amsacta moorei entomopoxvirus
gatataatatttactaatttatcatctgatatataatttttaatataattagttaatttatc

SEQ ID NO: 47953 - DNA, 24 bp, Amsacta moorei entomopoxvirus
tatataatttttaatataattagt

SEQ ID NO: 47954 - DNA, 18 bp, Homo sapiens
tatacaatttttaatata

SEQ ID NO: 47955 - DNA, 22 bp, Homo sapiens
tatatatttttaataaattagt

SEQ ID NO: 47956 - DNA, 19 bp, Homo sapiens
taatctttaatataacagt

SEQ ID NO: 47957 - DNA, 76 bp, Amsacta moorei entomopoxvirus
gtattgaattcataaattatatattctatttcgcttaaaattttagttattaatatatcattactatatttaatat

SEQ ID NO: 47958 - DNA, 24 bp, Amsacta moorei entomopoxvirus
tatatattctatttcgcttaaaat

SEQ ID NO: 47959 - DNA, 21 bp, Homo sapiens
tatattccattaaactaaaat

SEQ ID NO: 47960 - DNA, 20 bp, Homo sapiens
tatatattctatcttcccaa

SEQ ID NO: 47961 - DNA, 21 bp, Homo sapiens
tacatattctgtttcataaaa

SEQ ID NO: 47962 - DNA, 18 bp, Homo sapiens
tatacattttatttcccc

SEQ ID NO: 47963 - DNA, 67 bp, Amsacta moorei entomopoxvirus
tttattagatattatattaatttcatcatatattcctgctatgttttcattttttgattctaataaa

SEQ ID NO: 47964 - DNA, 24 bp, Amsacta moorei entomopoxvirus
tattagatattatattaatttcat

SEQ ID NO: 47965 - DNA, 19 bp, Homo sapiens
tattagatattattttaat

SEQ ID NO: 47966 - DNA, 18 bp, Homo sapiens
ttagatatccaatttcat

SEQ ID NO: 47967 - DNA, 85 bp, Amsacta moorei entomopoxvirus
taaaacatctaaagatgatagatgtgtattaatttcatcttgtttaatatttatatcatctattttttcatcaatagatttttta

SEQ ID NO: 47968 - DNA, 24 bp, Amsacta moorei entomopoxvirus
aagatgatagatgtgtattaattt

SEQ ID NO: 47969 - DNA, 21 bp, Homo sapiens
agagatagttgtgattaattt

SEQ ID NO: 47970 - DNA, 18 bp, Homo sapiens
aagatatagatgcagcat

SEQ ID NO: 47971 - DNA, 21 bp, Homo sapiens
aagataatgatatattaattt

SEQ ID NO: 47972 - DNA, 92 bp, Amsacta moorei entomopoxvirus
taataatatcatgtatataattttttatatttatattaaattcttgatctgatcttaaactatatatcaaatcttgtacatttatattatta

SEQ ID NO: 47973 - DNA, 24 bp, Amsacta moorei entomopoxvirus
tcatgtatataattttttatattt

SEQ ID NO: 47974 - DNA, 24 bp, Homo sapiens
tcatgtattaatctcaatatattt

SEQ ID NO: 47975 - DNA, 20 bp, Homo sapiens
atgtacatatttttatattt

SEQ ID NO: 47976 - DNA, 24 bp, Homo sapiens
tcatgtatagggctctttatattt

SEQ ID NO: 47977 - DNA, 24 bp, Homo sapiens
tcatgtatatattatataatattt

SEQ ID NO: 47978 - DNA, 21 bp, Homo sapiens
tgcatataattttttatactt

SEQ ID NO: 47979 - DNA, 79 bp, Amsacta moorei entomopoxvirus
tgtttgtcaatcatataattaatattttcttttatactattatcattatatataaaatatttaatatgttcttcaaata

SEQ ID NO: 47980 - DNA, 18 bp, Amsacta moorei entomopoxvirus
taatatgttcttcaaata

SEQ ID NO: 47981 - DNA, 19 bp, Homo sapiens
caatatgtgtccttcaaat

SEQ ID NO: 47982 - DNA, 21 bp, Homo sapiens
caatatgcttttcttcaaata

SEQ ID NO: 47983 - DNA, 17 bp, Homo sapiens
caatatgttcttaaata

SEQ ID NO: 47984 - DNA, 18 bp, Homo sapiens
caaaacattcttcaaata

SEQ ID NO: 47985 - DNA, 18 bp, Homo sapiens
caacacgttcttcaaata

SEQ ID NO: 47986 - DNA, 77 bp, Equine herpesvirus 1
atacgaaacattgtcggctcaaaaactcccacagatgtccatcgacgtcgatggaactgtttggcaatgctttgtgt

SEQ ID NO: 47987 - DNA, 24 bp, Equine herpesvirus 1
aacattgtcggctcaaaaactccc

SEQ ID NO: 47988 - DNA, 16 bp, Homo sapiens
aacattgtggttcctc

SEQ ID NO: 47989 - DNA, 18 bp, Homo sapiens
ttggagaactcaaaaact

SEQ ID NO: 47990 - DNA, 19 bp, Homo sapiens
tgatgagcccaaaagctcc

SEQ ID NO: 47991 - DNA, 19 bp, Homo sapiens
aacattatcctcaaaagct

SEQ ID NO: 47992 - DNA, 23 bp, Homo sapiens
acattttctaaataaaagctccc

SEQ ID NO: 47993 - DNA, 21 bp, Homo sapiens
ctatagcatttaaaaactccc

SEQ ID NO: 47994 - DNA, 19 bp, Homo sapiens
catgtgcagggaaactccc

SEQ ID NO: 47995 - DNA, 18 bp, Homo sapiens
ttgccactgaaaactccc

SEQ ID NO: 47996 - DNA, 21 bp, Homo sapiens
gcctaagctttgaaaactccc

SEQ ID NO: 47997 - DNA, 18 bp, Homo sapiens
acattgtctgccaggact

SEQ ID NO: 47998 - DNA, 19 bp, Homo sapiens
gtcatcactcaaaagttcc

SEQ ID NO: 47999 - DNA, 27 bp, Homo sapiens
aacattgtcagacttggaagagttccc

SEQ ID NO: 48000 - DNA, 16 bp, Homo sapiens
ttgtcgacaaacttcc

SEQ ID NO: 48001 - DNA, 20 bp, Homo sapiens
aacattgtacggtttaaact

SEQ ID NO: 48002 - DNA, 17 bp, Homo sapiens
atttccagtcaaaaact

SEQ ID NO: 48003 - DNA, 17 bp, Homo sapiens
ttgtctggaaaaactcc

SEQ ID NO: 48004 - DNA, 20 bp, Homo sapiens
cattggtattaaaaactccc

SEQ ID NO: 48005 - DNA, 17 bp, Homo sapiens
aacactgtcttaaaact

SEQ ID NO: 48006 - DNA, 23 bp, Homo sapiens
aacattattgctgtaaaacttcc

SEQ ID NO: 48007 - DNA, 21 bp, Homo sapiens
cactgtcatacacagaattcc

SEQ ID NO: 48008 - DNA, 19 bp, Homo sapiens
acattgtcgctccccttcc

SEQ ID NO: 48009 - DNA, 18 bp, Homo sapiens
ttgtgcaggaaaactccc

SEQ ID NO: 48010 - DNA, 20 bp, Homo sapiens
acactgtcactagagctccc

SEQ ID NO: 48011 - DNA, 19 bp, Homo sapiens
cacagagcttaaaaactcc

SEQ ID NO: 48012 - DNA, 22 bp, Homo sapiens
cagtgtcagcttcggggactcc

SEQ ID NO: 48013 - DNA, 26 bp, Homo sapiens
aacactgttggcttcccggagactcc

SEQ ID NO: 48014 - DNA, 130 bp, Bovine parvovirus
tactcatttcctgcatccaccatattggctgcccgggccaataatgcgagcggctgcgccgctgcgcgcttcgcgcgcgcattgtaaggcctaatcgggcagccaatatggtggatgcaggaaatgagta

SEQ ID NO: 48015 - DNA, 24 bp, Bovine parvovirus
tcgggcagccaatatggtggatgc

SEQ ID NO: 48016 - DNA, 16 bp, Homo sapiens
ggacagtcagtggatg

SEQ ID NO: 48017 - DNA, 22 bp, Homo sapiens
gggtgcctggatggatgggtgc

SEQ ID NO: 48018 - DNA, 24 bp, Homo sapiens
tcgggcagtggcacttgtgggtgc

SEQ ID NO: 48019 - DNA, 19 bp, Homo sapiens
ccgggcatagtggtgggtg

SEQ ID NO: 48020 - DNA, 18 bp, Homo sapiens
tcggggggccaataaatg

SEQ ID NO: 48021 - DNA, 23 bp, Homo sapiens
cgtccaggtcgatgtggtggatg

SEQ ID NO: 48022 - DNA, 23 bp, Homo sapiens
tcgggcagctcgtagcctcgtgc

SEQ ID NO: 48023 - DNA, 21 bp, Homo sapiens
gggcaggcacatggtgggtgc

SEQ ID NO: 48024 - DNA, 19 bp, Homo sapiens
tcgggggcctgggtggatg

SEQ ID NO: 48025 - DNA, 17 bp, Homo sapiens
gggcagctgggtgaata

SEQ ID NO: 48026 - DNA, 22 bp, Homo sapiens
cgggcaggggtggtggtggatg

SEQ ID NO: 48027 - DNA, 21 bp, Homo sapiens
gagcagccagtgggttggtgc

SEQ ID NO: 48028 - DNA, 16 bp, Homo sapiens
tcgggcagccagatgg

SEQ ID NO: 48029 - DNA, 91 bp, Lumpy skin disease virus
actttgaaaaagcttctgtttatgcatgtaggttatttaaacagttttataacgaaaaaaaatatgatttagataaatgttttttaaaagt

SEQ ID NO: 48030 - DNA, 24 bp, Lumpy skin disease virus
tgaaaaagcttctgtttatgcatg

SEQ ID NO: 48031 - DNA, 18 bp, Homo sapiens
tgagaaagctcctggcat

SEQ ID NO: 48032 - DNA, 23 bp, Homo sapiens
tgaaaaagtttctgatccctatg

SEQ ID NO: 48033 - DNA, 18 bp, Homo sapiens
cggaaaagcttctgggca

SEQ ID NO: 48034 - DNA, 19 bp, Homo sapiens
tgaaaggatttctgtttac

SEQ ID NO: 48035 - DNA, 22 bp, Homo sapiens
tggaaaagcctctgcgcccatg

SEQ ID NO: 48036 - DNA, 22 bp, Homo sapiens
tggaaaagcctctggggcgatg

SEQ ID NO: 48037 - DNA, 17 bp, Homo sapiens
agggtcatttatgcatg

SEQ ID NO: 48038 - DNA, 18 bp, Homo sapiens
gcttctgtccacatcatg

SEQ ID NO: 48039 - DNA, 66 bp, Canine adenovirus
gccaagattaacaccttttacatgcgtactgttgttcaaattttagtattaagtgatgaccttggc

SEQ ID NO: 48040 - DNA, 24 bp, Canine adenovirus
ttagtattaagtgatgaccttggc

SEQ ID NO: 48041 - DNA, 21 bp, Homo sapiens
ttaatattttatggccttggc

SEQ ID NO: 48042 - DNA, 64 bp, Ateline herpesvirus 3
gctcttataatattggactccaccataggaaacttccgaaattgagaacaaccacaataagagc

SEQ ID NO: 48043 - DNA, 22 bp, Ateline herpesvirus 3
tgagaacaaccacaataagagc

SEQ ID NO: 48044 - DNA, 20 bp, Homo sapiens
tggcaacaaccagctagagc

SEQ ID NO: 48045 - DNA, 17 bp, Homo sapiens
tgagaacaattataaga

SEQ ID NO: 48046 - DNA, 19 bp, Homo sapiens
tgagaacattacatgaagc

SEQ ID NO: 48047 - DNA, 21 bp, Homo sapiens
taagaacaggtcacataggag

SEQ ID NO: 48048 - DNA, 21 bp, Homo sapiens
tgagaaccagccacccggagc

SEQ ID NO: 48049 - DNA, 19 bp, Homo sapiens
agaaacacaacaataagag

SEQ ID NO: 48050 - DNA, 18 bp, Homo sapiens
tgggacaaccacgagaac

SEQ ID NO: 48051 - DNA, 22 bp, Homo sapiens
tgagaacaatcatgctgggagc

SEQ ID NO: 48052 - DNA, 22 bp, Homo sapiens
tgagaactatcacaagaacagc

SEQ ID NO: 48053 - DNA, 19 bp, Homo sapiens
tgacaacagccacaagaac

SEQ ID NO: 48054 - DNA, 18 bp, Homo sapiens
tgagaacaaactgcagag

SEQ ID NO: 48055 - DNA, 21 bp, Homo sapiens
tgagaacagaccaccatgagc

SEQ ID NO: 48056 - DNA, 24 bp, Homo sapiens
tgagaacagttccttccccagagc

SEQ ID NO: 48057 - DNA, 18 bp, Homo sapiens
tgaaacagtcacaataag

SEQ ID NO: 48058 - DNA, 23 bp, Homo sapiens
tgagagcaaccacaccccagggc

SEQ ID NO: 48059 - DNA, 20 bp, Homo sapiens
taagagcaacaacaaagagc

SEQ ID NO: 48060 - DNA, 18 bp, Homo sapiens
aggacagaccacaataag

SEQ ID NO: 48061 - DNA, 20 bp, Homo sapiens
agtacatattacaataagag

SEQ ID NO: 48062 - DNA, 19 bp, Homo sapiens
tgagaacagcctgaacaaa

SEQ ID NO: 48063 - DNA, 20 bp, Homo sapiens
tgagcacaacaattcaagag

SEQ ID NO: 48064 - DNA, 19 bp, Homo sapiens
gagaacaattgtaagatgc

SEQ ID NO: 48065 - DNA, 16 bp, Homo sapiens
tgaaacaaccactgag

SEQ ID NO: 48066 - DNA, 19 bp, Homo sapiens
tgggagcaaccacagaagc

SEQ ID NO: 48067 - DNA, 19 bp, Homo sapiens
tgaggactgaaataagagc

SEQ ID NO: 48068 - DNA, 26 bp, Homo sapiens
tgagaacagcctgtgcaacatggagc

SEQ ID NO: 48069 - DNA, 23 bp, Homo sapiens
tgagaacaaatacactcaagggc

SEQ ID NO: 48070 - DNA, 22 bp, Homo sapiens
taagaacagccagttttaggag

SEQ ID NO: 48071 - DNA, 21 bp, Homo sapiens
tgagacaaccactgagggagc

SEQ ID NO: 48072 - DNA, 20 bp, Homo sapiens
tgagaacaagcacgcagggc

SEQ ID NO: 48073 - DNA, 22 bp, Homo sapiens
tgagaacacccctgtaaagagc

SEQ ID NO: 48074 - DNA, 19 bp, Homo sapiens
gaaaactggtaataagagc

SEQ ID NO: 48075 - DNA, 19 bp, Homo sapiens
taagaacaactgcattaag

SEQ ID NO: 48076 - DNA, 20 bp, Homo sapiens
gaaggtccagacaataagag

SEQ ID NO: 48077 - DNA, 24 bp, Homo sapiens
tgagaacagccaggtctctcagag

SEQ ID NO: 48078 - DNA, 19 bp, Homo sapiens
tgagaacaccaatcagagc

SEQ ID NO: 48079 - DNA, 20 bp, Homo sapiens
tgagaacaattccaatgaag

SEQ ID NO: 48080 - DNA, 20 bp, Homo sapiens
aaaacctattacaataagag

SEQ ID NO: 48081 - DNA, 21 bp, Homo sapiens
tgagaaccacacaataagggc

SEQ ID NO: 48082 - DNA, 18 bp, Homo sapiens
gagtgaccacaaccaaag

SEQ ID NO: 48083 - DNA, 17 bp, Homo sapiens
agaacaaagaataagag

SEQ ID NO: 48084 - DNA, 60 bp, Saimiriine herpesvirus 2
ggattattacacaatgacatgtcatctacaatatgtagatctactgtttttgtgctatcc

SEQ ID NO: 48085 - DNA, 24 bp, Saimiriine herpesvirus 2
tattacacaatgacatgtcatcta

SEQ ID NO: 48086 - DNA, 19 bp, Homo sapiens
caaaatgatgtgtcatcta

SEQ ID NO: 48087 - DNA, 17 bp, Homo sapiens
tattacacaaggcatat

SEQ ID NO: 48088 - DNA, 20 bp, Homo sapiens
tatcatgcagtgacatgcat

SEQ ID NO: 48089 - DNA, 22 bp, Homo sapiens
tattactcaatgacatttttct

SEQ ID NO: 48090 - DNA, 22 bp, Homo sapiens
tattacactaaaaaagtcatct

SEQ ID NO: 48091 - DNA, 18 bp, Homo sapiens
tacaaaactgtgtcatct

SEQ ID NO: 48092 - DNA, 17 bp, Homo sapiens
tattcacaatgatatgc

SEQ ID NO: 48093 - DNA, 26 bp, Homo sapiens
cattacatgtcattctatgtcatcta

SEQ ID NO: 48094 - DNA, 18 bp, Homo sapiens
cacaatgacacccgacta

SEQ ID NO: 48095 - DNA, 18 bp, Homo sapiens
tattacacatgagaatgt

SEQ ID NO: 48096 - DNA, 18 bp, Homo sapiens
ttacacaatgaagagcat

SEQ ID NO: 48097 - DNA, 24 bp, Homo sapiens
tattcacctgagccatgtcatcta

SEQ ID NO: 48098 - DNA, 17 bp, Homo sapiens
tattacacatggcatgc

SEQ ID NO: 48099 - DNA, 22 bp, Homo sapiens
tattacacaatgtgaaggctct

SEQ ID NO: 48100 - DNA, 21 bp, Homo sapiens
attacatagcactcatgtcat

SEQ ID NO: 48101 - DNA, 21 bp, Homo sapiens
tattacctggtgacatcatcc

SEQ ID NO: 48102 - DNA, 20 bp, Homo sapiens
tatttcacaatgagtttatc

SEQ ID NO: 48103 - DNA, 22 bp, Homo sapiens
cacaatgaaaattctatgtcat

SEQ ID NO: 48104 - DNA, 19 bp, Homo sapiens
tattacacaagggtatcac

SEQ ID NO: 48105 - DNA, 19 bp, Homo sapiens
tattacatatgaacacatc

SEQ ID NO: 48106 - DNA, 17 bp, Homo sapiens
tattcacaatgacatgt

SEQ ID NO: 48107 - DNA, 19 bp, Homo sapiens
tacacaatgaatgggtcta

SEQ ID NO: 48108 - DNA, 110 bp, Saimiriine herpesvirus 2
gttcttgaagtacacaaggcttgaatccaacaccataagaaaagtgagttgtttgtgtatcagccatagcaatttcttgttttgtagagtaagactgatgcttcaagaat

SEQ ID NO: 48109 - DNA, 24 bp, Saimiriine herpesvirus 2
tgaagtacacaaggcttgaatcca

SEQ ID NO: 48110 - DNA, 15 bp, Homo sapiens
tgaagtacacattga

SEQ ID NO: 48111 - DNA, 20 bp, Homo sapiens
tgaaatacacacagaggatt

SEQ ID NO: 48112 - DNA, 18 bp, Homo sapiens
tgaagtacaagaggactc

SEQ ID NO: 48113 - DNA, 24 bp, Homo sapiens
tgaagtctgttgaacttgaattca

SEQ ID NO: 48114 - DNA, 22 bp, Homo sapiens
tgaggacacaagagcctggtcc

SEQ ID NO: 48115 - DNA, 17 bp, Homo sapiens
tgaggtagcaaggccca

SEQ ID NO: 48116 - DNA, 23 bp, Homo sapiens
tgaagcacgtagaggaaaatcca

SEQ ID NO: 48117 - DNA, 20 bp, Homo sapiens
aagtacacaagcttgatcca

SEQ ID NO: 48118 - DNA, 21 bp, Homo sapiens
tgaagtacacggatgggtcca

SEQ ID NO: 48119 - DNA, 18 bp, Homo sapiens
cgagtacacaaggtgtcc

SEQ ID NO: 48120 - DNA, 18 bp, Homo sapiens
tgaaatacacagggtctc

SEQ ID NO: 48121 - DNA, 20 bp, Homo sapiens
gttcacgaggcttgaatcca

SEQ ID NO: 48122 - DNA, 19 bp, Homo sapiens
gaagcttgaggcttgaatc

SEQ ID NO: 48123 - DNA, 19 bp, Homo sapiens
gtacacaaggggaactcca

SEQ ID NO: 48124 - DNA, 16 bp, Homo sapiens
tgagtacacactgaat

SEQ ID NO: 48125 - DNA, 23 bp, Homo sapiens
tggagagcacaaggctcttccca

SEQ ID NO: 48126 - DNA, 19 bp, Homo sapiens
tgaagaaccatttgaatcc

SEQ ID NO: 48127 - DNA, 20 bp, Homo sapiens
tgaagtacacacattagaat

SEQ ID NO: 48128 - DNA, 19 bp, Homo sapiens
tgaaatgcacaaggcctcc

SEQ ID NO: 48129 - DNA, 16 bp, Homo sapiens
gtgcacagacaaatcc

SEQ ID NO: 48130 - DNA, 17 bp, Homo sapiens
tgaagtacaaaggttga

SEQ ID NO: 48131 - DNA, 17 bp, Homo sapiens
gagtcacacaggcctga

SEQ ID NO: 48132 - DNA, 20 bp, Homo sapiens
tgaggtaaaggtcttgaatc

SEQ ID NO: 48133 - DNA, 21 bp, Homo sapiens
tggagtaatgagctcaaatcc

SEQ ID NO: 48134 - DNA, 18 bp, Homo sapiens
tggggtgcacaaagcttg

SEQ ID NO: 48135 - DNA, 19 bp, Homo sapiens
tgaactacacaataggatt

SEQ ID NO: 48136 - DNA, 21 bp, Homo sapiens
tggggcacacaagacgaatcc

SEQ ID NO: 48137 - DNA, 18 bp, Homo sapiens
tgaagtacactggaaatc

SEQ ID NO: 48138 - DNA, 73 bp, Saimiriine herpesvirus 2
gttttcacattacatccaaaaagttctctagtgtataagaatgtgtttccgcctggagaaatgtttctaaaac

SEQ ID NO: 48139 - DNA, 24 bp, Saimiriine herpesvirus 2
cattacatccaaaaagttctctag

SEQ ID NO: 48140 - DNA, 20 bp, Homo sapiens
ttacatccaagaaccgccct

SEQ ID NO: 48141 - DNA, 22 bp, Homo sapiens
attacatcctgctcctttctag

SEQ ID NO: 48142 - DNA, 17 bp, Homo sapiens
ttacatccaatttctct

SEQ ID NO: 48143 - DNA, 20 bp, Homo sapiens
atttcatccttattctctag

SEQ ID NO: 48144 - DNA, 16 bp, Homo sapiens
ttacgtccactctcta

SEQ ID NO: 48145 - DNA, 18 bp, Homo sapiens
cattacattcataaagtt

SEQ ID NO: 48146 - DNA, 19 bp, Homo sapiens
cattacactcaagggtcct

SEQ ID NO: 48147 - DNA, 20 bp, Homo sapiens
catgacatttaaaaagccct

SEQ ID NO: 48148 - DNA, 20 bp, Homo sapiens
attacatcctgattttctag

SEQ ID NO: 48149 - DNA, 24 bp, Homo sapiens
catcaaatctagaaggttctctag

SEQ ID NO: 48150 - DNA, 20 bp, Homo sapiens
cattacatctgcaaagcccc

SEQ ID NO: 48151 - DNA, 16 bp, Homo sapiens
tcacatctaaagttcc

SEQ ID NO: 48152 - DNA, 18 bp, Homo sapiens
cattacatccaaaaggtt

SEQ ID NO: 48153 - DNA, 17 bp, Homo sapiens
ttacatccaagggttct

SEQ ID NO: 48154 - DNA, 72 bp, Human adenovirus E
gagcagcagcacacaacaggcgcaagagtcagagaaaggctgagctctaacctgtccacccgctctctgctc

SEQ ID NO: 48155 - DNA, 24 bp, Human adenovirus E
taacctgtccacccgctctctgct

SEQ ID NO: 48156 - DNA, 23 bp, Homo sapiens
taaactgtccactgacacctgct

SEQ ID NO: 48157 - DNA, 15 bp, Homo sapiens
ctgtcccatctctgc

SEQ ID NO: 48158 - DNA, 21 bp, Homo sapiens
cctctccacggtgactctgct

SEQ ID NO: 48159 - DNA, 16 bp, Homo sapiens
acctgcccgcctgtgc

SEQ ID NO: 48160 - DNA, 18 bp, Homo sapiens
cctgctgtgccctctgct

SEQ ID NO: 48161 - DNA, 19 bp, Homo sapiens
cctgcccgccccctctgct

SEQ ID NO: 48162 - DNA, 18 bp, Homo sapiens
cctgtcctgctctctgct

SEQ ID NO: 48163 - DNA, 25 bp, Homo sapiens
taacctatctgcttggccatctgct

SEQ ID NO: 48164 - DNA, 16 bp, Homo sapiens
acctgtacttctctgc

SEQ ID NO: 48165 - DNA, 19 bp, Homo sapiens
acctgtcctccggccagct

SEQ ID NO: 48166 - DNA, 20 bp, Homo sapiens
gtctcacgtcctgctctctg

SEQ ID NO: 48167 - DNA, 21 bp, Homo sapiens
aacttgtccaccctttttgct

SEQ ID NO: 48168 - DNA, 18 bp, Homo sapiens
acctgtccgcctttctcc

SEQ ID NO: 48169 - DNA, 23 bp, Homo sapiens
aacctgtcccatgcctctctgct

SEQ ID NO: 48170 - DNA, 15 bp, Homo sapiens
aacctgtccatctgc

SEQ ID NO: 48171 - DNA, 17 bp, Homo sapiens
gccatccgctctctgct

SEQ ID NO: 48172 - DNA, 19 bp, Homo sapiens
cctggccgctcccaatgct

SEQ ID NO: 48173 - DNA, 20 bp, Homo sapiens
ccaccattctgctctctgct

SEQ ID NO: 48174 - DNA, 21 bp, Homo sapiens
ccgtctgttcccttctctgct

SEQ ID NO: 48175 - DNA, 21 bp, Homo sapiens
taacctcttaacctctctgct

SEQ ID NO: 48176 - DNA, 20 bp, Homo sapiens
acctggtgctgctctctgct

SEQ ID NO: 48177 - DNA, 21 bp, Homo sapiens
ctgtccatggctgtctctgct

SEQ ID NO: 48178 - DNA, 18 bp, Homo sapiens
cctgtccatctacttgct

SEQ ID NO: 48179 - DNA, 22 bp, Homo sapiens
cctgtccatcctcacacttgct

SEQ ID NO: 48180 - DNA, 21 bp, Homo sapiens
cctgtccactttccggcagct

SEQ ID NO: 48181 - DNA, 64 bp, Saimiriine herpesvirus 2
gctcttattatgttagcttccaccataggaaactttctaaattgtgagcaaccgcaataagagc

SEQ ID NO: 48182 - DNA, 24 bp, Saimiriine herpesvirus 2
taaattgtgagcaaccgcaataag

SEQ ID NO: 48183 - DNA, 22 bp, Homo sapiens
aaactaacgcaaccgcagtaag

SEQ ID NO: 48184 - DNA, 23 bp, Homo sapiens
taaactgtgggcatgctgataag

SEQ ID NO: 48185 - DNA, 19 bp, Homo sapiens
taagttatgagcaatacca

SEQ ID NO: 48186 - DNA, 19 bp, Homo sapiens
actgtgagtaacctataag

SEQ ID NO: 48187 - DNA, 17 bp, Homo sapiens
aattgtgagagcagtaa

SEQ ID NO: 48188 - DNA, 16 bp, Homo sapiens
tgtgagcaacaataag

SEQ ID NO: 48189 - DNA, 19 bp, Homo sapiens
tgtgtgctaactgcaataa

SEQ ID NO: 48190 - DNA, 21 bp, Homo sapiens
taagttgtgagcaatgaacaa

SEQ ID NO: 48191 - DNA, 123 bp, Human papillomavirus type 14
cttcttttatagagccaccattacctgcaactatatttggcttagcaaacctattggaaataccactagatgattgtttagtaccttgtaacttttgtggtaattttttgactcatttagaag

SEQ ID NO: 48192 - DNA, 24 bp, Human papillomavirus type 14
ttagtaccttgtaacttttgtggt

SEQ ID NO: 48193 - DNA, 17 bp, Homo sapiens
tagtaccttctttgtgg

SEQ ID NO: 48194 - DNA, 21 bp, Homo sapiens
ttaggatcttgtaacctaggt

SEQ ID NO: 48195 - DNA, 16 bp, Homo sapiens
ttagtactctgtagtg

SEQ ID NO: 48196 - DNA, 23 bp, Homo sapiens
ttagtattttctaacttcctatg

SEQ ID NO: 48197 - DNA, 23 bp, Homo sapiens
ttagattaatgtgcttttgtggt

SEQ ID NO: 48198 - DNA, 20 bp, Homo sapiens
gtgccttgcatttttgtggt

SEQ ID NO: 48199 - DNA, 24 bp, Homo sapiens
ttagtattttgtggccttgatagt

SEQ ID NO: 48200 - DNA, 118 bp, Human papillomavirus type 14
tgagtttaatgaattttatgagagtactgttgaaggcagagaaatagagagtgtaacaggcaaatctatttttgatgttgatgtcaggtgctatacctgcatgaaatttttagattca

SEQ ID NO: 48201 - DNA, 24 bp, Human papillomavirus type 14
aggcagagaaatagagagtgtaac

SEQ ID NO: 48202 - DNA, 20 bp, Homo sapiens
aggcagagaactggagttgt

SEQ ID NO: 48203 - DNA, 15 bp, Homo sapiens
aggcagaggagagtg

SEQ ID NO: 48204 - DNA, 18 bp, Homo sapiens
ggcagagaaaaggaaatg

SEQ ID NO: 48205 - DNA, 20 bp, Homo sapiens
ggccagaggagcaaagtgta

SEQ ID NO: 48206 - DNA, 20 bp, Homo sapiens
aggttgagaaatagaccgta

SEQ ID NO: 48207 - DNA, 21 bp, Homo sapiens
aggcaaggaaatagctttaac

SEQ ID NO: 48208 - DNA, 23 bp, Homo sapiens
aggcagagggacacaccagtgta

SEQ ID NO: 48209 - DNA, 17 bp, Homo sapiens
aggagagaaatagaaaa

SEQ ID NO: 48210 - DNA, 18 bp, Homo sapiens
agggagaaagtaagtgta

SEQ ID NO: 48211 - DNA, 18 bp, Homo sapiens
aggcagaagataggcagc

SEQ ID NO: 48212 - DNA, 16 bp, Homo sapiens
agcagagagggagtgt

SEQ ID NO: 48213 - DNA, 19 bp, Homo sapiens
aggcgcagaaatggaaagt

SEQ ID NO: 48214 - DNA, 20 bp, Homo sapiens
aggcagagaaggaggagagc

SEQ ID NO: 48215 - DNA, 18 bp, Homo sapiens
ggcagagagggagggcaa

SEQ ID NO: 48216 - DNA, 17 bp, Homo sapiens
aggcagagaagagagcg

SEQ ID NO: 48217 - DNA, 18 bp, Homo sapiens
aggagaggggtagagagc

SEQ ID NO: 48218 - DNA, 17 bp, Homo sapiens
aggcagagaaaagaaaa

SEQ ID NO: 48219 - DNA, 18 bp, Homo sapiens
ggcagggagaaagcagtg

SEQ ID NO: 48220 - DNA, 17 bp, Homo sapiens
aggcagaggagcaggca

SEQ ID NO: 48221 - DNA, 18 bp, Homo sapiens
aggcagggaagagaatgt

SEQ ID NO: 48222 - DNA, 16 bp, Homo sapiens
ggcagagaagcaggtg

SEQ ID NO: 48223 - DNA, 22 bp, Homo sapiens
aggcagagacaatggagaaagc

SEQ ID NO: 48224 - DNA, 19 bp, Homo sapiens
agtagagaaataggttgta

SEQ ID NO: 48225 - DNA, 21 bp, Homo sapiens
agtcagagaaataacttgtaa

SEQ ID NO: 48226 - DNA, 18 bp, Homo sapiens
ggcaaggggtagaaaatg

SEQ ID NO: 48227 - DNA, 17 bp, Homo sapiens
agacagagaagtttgta

SEQ ID NO: 48228 - DNA, 18 bp, Homo sapiens
ggcaggggaaaggagagc

SEQ ID NO: 48229 - DNA, 23 bp, Homo sapiens
ggcagggggaaaaagtacagtgt

SEQ ID NO: 48230 - DNA, 21 bp, Homo sapiens
ggcagagaggggggcaggaat

SEQ ID NO: 48231 - DNA, 17 bp, Homo sapiens
aggcagagagatggcgc

SEQ ID NO: 48232 - DNA, 20 bp, Homo sapiens
aggcagagggggagaaagtg

SEQ ID NO: 48233 - DNA, 15 bp, Homo sapiens
aggcagaggagagta

SEQ ID NO: 48234 - DNA, 16 bp, Homo sapiens
ggcagagaggagagcg

SEQ ID NO: 48235 - DNA, 18 bp, Homo sapiens
aggcagagagggagagag

SEQ ID NO: 48236 - DNA, 22 bp, Homo sapiens
aggcagagaaagggggaagggc

SEQ ID NO: 48237 - DNA, 19 bp, Homo sapiens
aggcagaggaaagggagag

SEQ ID NO: 48238 - DNA, 19 bp, Homo sapiens
aggcagagtaatgtggtaa

SEQ ID NO: 48239 - DNA, 18 bp, Homo sapiens
aggcagagagagagagag

SEQ ID NO: 48240 - DNA, 22 bp, Homo sapiens
aggcagagaaatggagcctgta

SEQ ID NO: 48241 - DNA, 17 bp, Homo sapiens
agcagagaaatgggaat

SEQ ID NO: 48242 - DNA, 19 bp, Homo sapiens
aggcagagggtagagcatg

SEQ ID NO: 48243 - DNA, 18 bp, Homo sapiens
aggcagaggggcaggagc

SEQ ID NO: 48244 - DNA, 19 bp, Homo sapiens
aggcaagaaatagggagta

SEQ ID NO: 48245 - DNA, 17 bp, Homo sapiens
ggcagaaaataatgtaa

SEQ ID NO: 48246 - DNA, 17 bp, Homo sapiens
aggtagaggaaagaatg

SEQ ID NO: 48247 - DNA, 17 bp, Homo sapiens
ggcagggaggagagtgc

SEQ ID NO: 48248 - DNA, 21 bp, Homo sapiens
aggcagagggctggagcccaa

SEQ ID NO: 48249 - DNA, 18 bp, Homo sapiens
ggcagggaggtagagagt

SEQ ID NO: 48250 - DNA, 15 bp, Homo sapiens
aggcagagaggtgca

SEQ ID NO: 48251 - DNA, 21 bp, Homo sapiens
aggcagaggagggatagaggc

SEQ ID NO: 48252 - DNA, 20 bp, Homo sapiens
aggcagagataatagatgaa

SEQ ID NO: 48253 - DNA, 18 bp, Homo sapiens
ggcagagaggcagagagc

SEQ ID NO: 48254 - DNA, 23 bp, Homo sapiens
agcagagaaatggaggagaaggc

SEQ ID NO: 48255 - DNA, 17 bp, Homo sapiens
ggcagagaagaggtaca

SEQ ID NO: 48256 - DNA, 18 bp, Homo sapiens
aggcagagggaaagagca

SEQ ID NO: 48257 - DNA, 20 bp, Homo sapiens
ggctgaggaataaagatgtg

SEQ ID NO: 48258 - DNA, 18 bp, Homo sapiens
aggcagagggacagagaa

SEQ ID NO: 48259 - DNA, 18 bp, Homo sapiens
aggcagagaagggaaaat

SEQ ID NO: 48260 - DNA, 18 bp, Homo sapiens
aggcagagaggtgagtgt

SEQ ID NO: 48261 - DNA, 21 bp, Homo sapiens
aagcagagaagtggagagagc

SEQ ID NO: 48262 - DNA, 16 bp, Homo sapiens
aggcagagaaagaggc

SEQ ID NO: 48263 - DNA, 21 bp, Homo sapiens
aggcggaagaatggagtgcaa

SEQ ID NO: 48264 - DNA, 16 bp, Homo sapiens
aggagagaaataagtg

SEQ ID NO: 48265 - DNA, 17 bp, Homo sapiens
aggcagagggtaggagc

SEQ ID NO: 48266 - DNA, 18 bp, Homo sapiens
aggcagaaggtagatgta

SEQ ID NO: 48267 - DNA, 20 bp, Homo sapiens
aggcagagaaggtggaaaat

SEQ ID NO: 48268 - DNA, 21 bp, Homo sapiens
aggcaggaaataaatagtaac

SEQ ID NO: 48269 - DNA, 18 bp, Homo sapiens
aggcagagggagagaagc

SEQ ID NO: 48270 - DNA, 19 bp, Homo sapiens
aggcggggagaaagggcgt

SEQ ID NO: 48271 - DNA, 15 bp, Homo sapiens
aggcagaggaagtgt

SEQ ID NO: 48272 - DNA, 18 bp, Homo sapiens
aggcagagaaggaggcaa

SEQ ID NO: 48273 - DNA, 17 bp, Homo sapiens
aggtggagaaaagagag

SEQ ID NO: 48274 - DNA, 21 bp, Homo sapiens
aggcagagaagtggtcagagt

SEQ ID NO: 48275 - DNA, 25 bp, Homo sapiens
aggcagagaaaatggggggtggaga

SEQ ID NO: 48276 - DNA, 16 bp, Homo sapiens
ggcagagaaataagtg

SEQ ID NO: 48277 - DNA, 22 bp, Homo sapiens
aagcagagaagtggatcagaga

SEQ ID NO: 48278 - DNA, 18 bp, Homo sapiens
aggcagagaggtatgagc

SEQ ID NO: 48279 - DNA, 17 bp, Homo sapiens
aggtgagagatagaaaa

SEQ ID NO: 48280 - DNA, 22 bp, Homo sapiens
aggcagagagataaactaaagc

SEQ ID NO: 48281 - DNA, 18 bp, Homo sapiens
ggcagagagagtagaggc

SEQ ID NO: 48282 - DNA, 18 bp, Homo sapiens
aggcagagaaatatgaag

SEQ ID NO: 48283 - DNA, 18 bp, Homo sapiens
aggcagaaaatatgtgta

SEQ ID NO: 48284 - DNA, 22 bp, Homo sapiens
aggaggttggggagagtgtaac

SEQ ID NO: 48285 - DNA, 20 bp, Homo sapiens
aggcagagaaggagagaggc

SEQ ID NO: 48286 - DNA, 18 bp, Homo sapiens
aggccagagaacaggtgt

SEQ ID NO: 48287 - DNA, 21 bp, Homo sapiens
aggcagagaaggaataaggta

SEQ ID NO: 48288 - DNA, 23 bp, Homo sapiens
aagcagagaagtaggctcagagc

SEQ ID NO: 48289 - DNA, 21 bp, Homo sapiens
aggcagagaatagaaagaagc

SEQ ID NO: 48290 - DNA, 22 bp, Homo sapiens
aggcagagagctggggaaaagc

SEQ ID NO: 48291 - DNA, 18 bp, Homo sapiens
aggtagagaatggaggtg

SEQ ID NO: 48292 - DNA, 18 bp, Homo sapiens
ggcgagggatagagaggt

SEQ ID NO: 48293 - DNA, 17 bp, Homo sapiens
aggcagagggagatgtg

SEQ ID NO: 48294 - DNA, 17 bp, Homo sapiens
ggcagaggagagagcat

SEQ ID NO: 48295 - DNA, 17 bp, Homo sapiens
aggcagagggatgagta

SEQ ID NO: 48296 - DNA, 18 bp, Homo sapiens
aggcagagaaggaaatgt

SEQ ID NO: 48297 - DNA, 19 bp, Homo sapiens
aggcagaggcaatggaggt

SEQ ID NO: 48298 - DNA, 21 bp, Homo sapiens
aggcagaggggcaggtgcgac

SEQ ID NO: 48299 - DNA, 19 bp, Homo sapiens
aggcgagaaataggtctaa

SEQ ID NO: 48300 - DNA, 19 bp, Homo sapiens
aggcagagagaagagaggc

SEQ ID NO: 48301 - DNA, 19 bp, Homo sapiens
aggcagaggaatggagagt

SEQ ID NO: 48302 - DNA, 21 bp, Homo sapiens
aggcagaaggggtgaaaagta

SEQ ID NO: 48303 - DNA, 18 bp, Homo sapiens
aggcagagaggagcataa

SEQ ID NO: 48304 - DNA, 18 bp, Homo sapiens
aggcagagaaagagagag

SEQ ID NO: 48305 - DNA, 20 bp, Homo sapiens
aggcagaaaaatagacaagt

SEQ ID NO: 48306 - DNA, 18 bp, Homo sapiens
aggcagagaaggtgagtg

SEQ ID NO: 48307 - DNA, 20 bp, Homo sapiens
aggcagagagaggaagaagc

SEQ ID NO: 48308 - DNA, 15 bp, Homo sapiens
aggcagagaagagaa

SEQ ID NO: 48309 - DNA, 20 bp, Homo sapiens
ggcagagagatgacaagggt

SEQ ID NO: 48310 - DNA, 19 bp, Homo sapiens
aggcagagagggtagacag

SEQ ID NO: 48311 - DNA, 19 bp, Homo sapiens
aggcatggaaatagacatg

SEQ ID NO: 48312 - DNA, 20 bp, Homo sapiens
ggcagagaggagaaagaggc

SEQ ID NO: 48313 - DNA, 16 bp, Homo sapiens
aggcagagagagggta

SEQ ID NO: 48314 - DNA, 20 bp, Homo sapiens
ggcggagagtatagagtcgc

SEQ ID NO: 48315 - DNA, 18 bp, Homo sapiens
ggcagagaaataagggca

SEQ ID NO: 48316 - DNA, 19 bp, Homo sapiens
aggcagagagggagagggt

SEQ ID NO: 48317 - DNA, 20 bp, Homo sapiens
aggcagagggattggactgt

SEQ ID NO: 48318 - DNA, 64 bp, Human herpesvirus 5
gaaaacaacaataatgagaatgaaatcaccacaaccaagccagatttcacgtccatgagttttt

SEQ ID NO: 48319 - DNA, 20 bp, Human herpesvirus 5
tttcacgtccatgagttttt

SEQ ID NO: 48320 - DNA, 20 bp, Homo sapiens
ttcacgggacaggagttttt

SEQ ID NO: 48321 - DNA, 17 bp, Homo sapiens
tttcacttccgagtttt

SEQ ID NO: 48322 - DNA, 17 bp, Homo sapiens
tttcacgtcataagttt

SEQ ID NO: 48323 - DNA, 21 bp, Homo sapiens
tttcacatccacataattttt

SEQ ID NO: 48324 - DNA, 16 bp, Homo sapiens
tttctccagagttttt

SEQ ID NO: 48325 - DNA, 18 bp, Homo sapiens
tttcgcgctcatgagctt

SEQ ID NO: 48326 - DNA, 20 bp, Homo sapiens
tttcacatggaaaagttttt

SEQ ID NO: 48327 - DNA, 18 bp, Homo sapiens
tctcctccgtgagttttt

SEQ ID NO: 48328 - DNA, 19 bp, Homo sapiens
tttcatatccataagtttt

SEQ ID NO: 48329 - DNA, 17 bp, Homo sapiens
cttcatgtctgagtttt

SEQ ID NO: 48330 - DNA, 16 bp, Homo sapiens
tttcacatcagctttt

SEQ ID NO: 48331 - DNA, 17 bp, Homo sapiens
ttccacgtctggccttt

SEQ ID NO: 48332 - DNA, 19 bp, Homo sapiens
tttcacatccattacattt

SEQ ID NO: 48333 - DNA, 19 bp, Homo sapiens
tttcaagtccaaagtcttt

SEQ ID NO: 48334 - DNA, 17 bp, Homo sapiens
tttctccctgagttttt

SEQ ID NO: 48335 - DNA, 19 bp, Homo sapiens
tttgcacatctgagttttt

SEQ ID NO: 48336 - DNA, 18 bp, Homo sapiens
tttcatatccatgacttt

SEQ ID NO: 48337 - DNA, 18 bp, Homo sapiens
tctcatccatgagttttt

SEQ ID NO: 48338 - DNA, 71 bp, Human papillomavirus type 28
gtgcaggctacatttttgggcttattttgtgctgctgctgtgttcgttttggctgtgtgtgcttcctgcgc

SEQ ID NO: 48339 - DNA, 24 bp, Human papillomavirus type 28
gctacatttttgggcttattttgt

SEQ ID NO: 48340 - DNA, 24 bp, Homo sapiens
gctgcatctttgggcatcctttgt

SEQ ID NO: 48341 - DNA, 19 bp, Homo sapiens
tacatttttgttattttgt

SEQ ID NO: 48342 - DNA, 24 bp, Homo sapiens
ctacgttttccttccttattttgt

SEQ ID NO: 48343 - DNA, 21 bp, Homo sapiens
gctacatttgtggtcatttgt

SEQ ID NO: 48344 - DNA, 21 bp, Homo sapiens
gctaatttttgtactttttgt

SEQ ID NO: 48345 - DNA, 18 bp, Homo sapiens
gctgcattcttgggactt

SEQ ID NO: 48346 - DNA, 24 bp, Homo sapiens
gctaatttttaaaaattattttgt

SEQ ID NO: 48347 - DNA, 21 bp, Homo sapiens
gctaatttttgtatattttgt

SEQ ID NO: 48348 - DNA, 22 bp, Homo sapiens
gctacattttactttattttgt

SEQ ID NO: 48349 - DNA, 25 bp, Homo sapiens
tacatttttatagtttttattttgt

SEQ ID NO: 48350 - DNA, 22 bp, Homo sapiens
gctaatttttaaaatattttgt

SEQ ID NO: 48351 - DNA, 18 bp, Homo sapiens
tctctgggtttgttttgt

SEQ ID NO: 48352 - DNA, 83 bp, Human papillomavirus type 28
gcttttgtaactatttggtatacaagttattcacagcgtaatgaattcttgtccactgtaaaggtaccacctggtatacaggt

SEQ ID NO: 48353 - DNA, 24 bp, Human papillomavirus type 28
tggtatacaagttattcacagcgt

SEQ ID NO: 48354 - DNA, 21 bp, Homo sapiens
tagtatataaacccacagtgt

SEQ ID NO: 48355 - DNA, 18 bp, Homo sapiens
tagtatgcaagttatcac

SEQ ID NO: 48356 - DNA, 60 bp, Human papillomavirus type 28
acaatggcgatcatactgtcctgtttctggagccagatgacgtgtatctattgttgttgt

SEQ ID NO: 48357 - DNA, 23 bp, Human papillomavirus type 28
tgacgtgtatctattgttgttgt

SEQ ID NO: 48358 - DNA, 16 bp, Homo sapiens
tgacgtgtatgtgttg

SEQ ID NO: 48359 - DNA, 21 bp, Homo sapiens
tgaatggacttttgttgttgt

SEQ ID NO: 48360 - DNA, 16 bp, Homo sapiens
tgcgtgtgtgttgttg

SEQ ID NO: 48361 - DNA, 21 bp, Homo sapiens
taatgtattttttgttgttgt

SEQ ID NO: 48362 - DNA, 26 bp, Homo sapiens
tgacagaggtgttttgttgttgttgt

SEQ ID NO: 48363 - DNA, 21 bp, Homo sapiens
tgacatgtgtgattttgttgt

SEQ ID NO: 48364 - DNA, 24 bp, Homo sapiens
acatgccctatttattgttgttgt

SEQ ID NO: 48365 - DNA, 22 bp, Homo sapiens
tgattgtatctatcatatttgt

SEQ ID NO: 48366 - DNA, 19 bp, Homo sapiens
tgaatctttttgttgttgt

SEQ ID NO: 48367 - DNA, 23 bp, Homo sapiens
tgttttgtatttgttgttgttgt

SEQ ID NO: 48368 - DNA, 21 bp, Homo sapiens
tgatcatgttgttgttgttgt

SEQ ID NO: 48369 - DNA, 19 bp, Homo sapiens
tgtaactttttgttgttgt

SEQ ID NO: 48370 - DNA, 18 bp, Homo sapiens
gtgtaagtttgttgttgt

SEQ ID NO: 48371 - DNA, 119 bp, Bovine herpesvirus 4
ttttgtgcacagcgatttggtatcccgggtctagacatggttctatccaatacaaaagcagacatggacggactgccatgtaaactcagaacccaggtgggtacttgttttggccagag

SEQ ID NO: 48372 - DNA, 24 bp, Bovine herpesvirus 4
tggtatcccgggtctagacatggt

SEQ ID NO: 48373 - DNA, 21 bp, Homo sapiens
tggtaccctgggggctgtggt

SEQ ID NO: 48374 - DNA, 22 bp, Homo sapiens
tgggtcccctaatggacatggt

SEQ ID NO: 48375 - DNA, 75 bp, Human papillomavirus type 55
ttgatgatggtgatacatggttgttattatggtttatattaaccttaattgttaccattgtggcattgttattaa

SEQ ID NO: 48376 - DNA, 24 bp, Human papillomavirus type 55
tacatggttgttattatggtttat

SEQ ID NO: 48377 - DNA, 18 bp, Homo sapiens
catgcttgttattgcatg

SEQ ID NO: 48378 - DNA, 17 bp, Homo sapiens
tacatggttttattata

SEQ ID NO: 48379 - DNA, 16 bp, Homo sapiens
tggttgttatggattt

SEQ ID NO: 48380 - DNA, 18 bp, Homo sapiens
cacggttgctcctggttt

SEQ ID NO: 48381 - DNA, 20 bp, Homo sapiens
tacgatggttgttattgagg

SEQ ID NO: 48382 - DNA, 23 bp, Homo sapiens
tacatggtttttaaacaatttat

SEQ ID NO: 48383 - DNA, 19 bp, Homo sapiens
tacatggtgttgcttttat

SEQ ID NO: 48384 - DNA, 19 bp, Homo sapiens
tgggcgctttatggtttat

SEQ ID NO: 48385 - DNA, 21 bp, Homo sapiens
atggatgacttagtggtttat

SEQ ID NO: 48386 - DNA, 18 bp, Homo sapiens
tacatagtgatatggttt

SEQ ID NO: 48387 - DNA, 23 bp, Homo sapiens
tgatggttgttagctgtgtttat

SEQ ID NO: 48388 - DNA, 95 bp, Camelpox virus
gtctgtacaaaagtttgagattttcagattctgcggctatagagaagtataattctttggtagaatggggaacatctacttactggaaaataggc

SEQ ID NO: 48389 - DNA, 24 bp, Camelpox virus
tagaatggggaacatctacttact

SEQ ID NO: 48390 - DNA, 21 bp, Homo sapiens
taaaatgggcacattttactt

SEQ ID NO: 48391 - DNA, 19 bp, Homo sapiens
agggtggggggcatccact

SEQ ID NO: 48392 - DNA, 22 bp, Homo sapiens
tagggactggcatttacttact

SEQ ID NO: 48393 - DNA, 18 bp, Homo sapiens
gaatggggaagtcaaccc

SEQ ID NO: 48394 - DNA, 16 bp, Homo sapiens
gaatggggaagactta

SEQ ID NO: 48395 - DNA, 16 bp, Homo sapiens
ggggcatctacttgct

SEQ ID NO: 48396 - DNA, 16 bp, Homo sapiens
gaatgggatctattta

SEQ ID NO: 48397 - DNA, 20 bp, Homo sapiens
tagaacggggagcgtccact

SEQ ID NO: 48398 - DNA, 26 bp, Homo sapiens
cagaaagcggggaacgtttacttgct

SEQ ID NO: 48399 - DNA, 19 bp, Homo sapiens
taaaatggggagaacttac

SEQ ID NO: 48400 - DNA, 66 bp, Variola virus
ggaagacacattatttgacgacgagttatactctattatagaacgctctttcgatgataattttcc

SEQ ID NO: 48401 - DNA, 24 bp, Variola virus
tagaacgctctttcgatgataatt

SEQ ID NO: 48402 - DNA, 17 bp, Homo sapiens
tagaatgccctgataat

SEQ ID NO: 48403 - DNA, 19 bp, Homo sapiens
gaatgctctttcatttgat

SEQ ID NO: 48404 - DNA, 19 bp, Homo sapiens
cagggcgcttttcaatgat

SEQ ID NO: 48405 - DNA, 70 bp, Melanoplus sanguinipes entomopoxvirus
caaatactttatattgtgttttgtatctatgattaataaaacaagaaataattacatcaatatatttttg

SEQ ID NO: 48406 - DNA, 24 bp, Melanoplus sanguinipes entomopoxvirus
tattgtgttttgtatctatgatta

SEQ ID NO: 48407 - DNA, 22 bp, Homo sapiens
tattggttttgtaaaacaatta

SEQ ID NO: 48408 - DNA, 19 bp, Homo sapiens
tattgttgttactatgatt

SEQ ID NO: 48409 - DNA, 23 bp, Homo sapiens
tattgtgttttctgttgcttcta

SEQ ID NO: 48410 - DNA, 18 bp, Homo sapiens
tgttgttgctctatgatt

SEQ ID NO: 48411 - DNA, 20 bp, Homo sapiens
cattgtgttttgtaaggctg

SEQ ID NO: 48412 - DNA, 63 bp, Melanoplus sanguinipes entomopoxvirus
tttaaattttattttattgccatttgatacataatgtctaatagcatctttagtatgtttaaa

SEQ ID NO: 48413 - DNA, 24 bp, Melanoplus sanguinipes entomopoxvirus
taatagcatctttagtatgtttaa

SEQ ID NO: 48414 - DNA, 24 bp, Homo sapiens
taatagcttttaaatcatgtttaa

SEQ ID NO: 48415 - DNA, 17 bp, Homo sapiens
agcatccccatgtgttt

SEQ ID NO: 48416 - DNA, 22 bp, Homo sapiens
atagcctttaaactatgtttaa

SEQ ID NO: 48417 - DNA, 20 bp, Homo sapiens
taatagcactctattgttta

SEQ ID NO: 48418 - DNA, 24 bp, Homo sapiens
taatagcactttaaagatgtttaa

SEQ ID NO: 48419 - DNA, 20 bp, Homo sapiens
agcatctttaacatttttaa

SEQ ID NO: 48420 - DNA, 19 bp, Homo sapiens
taatacatctttggtacat

SEQ ID NO: 48421 - DNA, 75 bp, Camelpox virus
gagacgtccatatctgattattatgatgaggtaaaaaataaaccgtttaatattgatccggggtattatattttc

SEQ ID NO: 48422 - DNA, 23 bp, Camelpox virus
ttgatccggggtattatattttc

SEQ ID NO: 48423 - DNA, 18 bp, Homo sapiens
ctgatctggtcatatttt

SEQ ID NO: 48424 - DNA, 21 bp, Homo sapiens
ttggcctggagtcatattttc

SEQ ID NO: 48425 - DNA, 21 bp, Homo sapiens
ttaatccggggagctgttttc

SEQ ID NO: 48426 - DNA, 66 bp, Ectromelia virus
ggaagacacattatttgacgacgaattatactctattatagaacgatctttcgatgataaatttcc

SEQ ID NO: 48427 - DNA, 24 bp, Ectromelia virus
tagaacgatctttcgatgataaat

SEQ ID NO: 48428 - DNA, 18 bp, Homo sapiens
gagtgatctttcaaaaat

SEQ ID NO: 48429 - DNA, 20 bp, Homo sapiens
taggactgtctttcgaaaat

SEQ ID NO: 48430 - DNA, 66 bp, Camelpox virus
ggaagacatattatttgacgacgagttatactctattatagaacgctctttcgatgataaatttcc

SEQ ID NO: 48431 - DNA, 24 bp, Camelpox virus
tagaacgctctttcgatgataaat

SEQ ID NO: 48432 - DNA, 23 bp, Homo sapiens
taaaacgctttttcacagtaaat

SEQ ID NO: 48433 - DNA, 15 bp, Homo sapiens
tagaacactctgatg

SEQ ID NO: 48434 - DNA, 17 bp, Homo sapiens
agaacgctcttgaataa

SEQ ID NO: 48435 - DNA, 61 bp, Paramecium bursaria Chlorella virus 1
cacgaaactcttaatgtttctccttaggatttctgccagagtttgtccttagagttttgtg

SEQ ID NO: 48436 - DNA, 20 bp, Paramecium bursaria Chlorella virus 1
tttgtccttagagttttgtg

SEQ ID NO: 48437 - DNA, 18 bp, Homo sapiens
tttgtcctaggtcccctg

SEQ ID NO: 48438 - DNA, 19 bp, Homo sapiens
tctgtccttggtgtctgtg

SEQ ID NO: 48439 - DNA, 18 bp, Homo sapiens
tgtccctggggttttgtg

SEQ ID NO: 48440 - DNA, 20 bp, Homo sapiens
ttgtcctttctaattttgtg

SEQ ID NO: 48441 - DNA, 15 bp, Homo sapiens
tttatccttagctgt

SEQ ID NO: 48442 - DNA, 17 bp, Homo sapiens
tctgtccttcccttgtg

SEQ ID NO: 48443 - DNA, 15 bp, Homo sapiens
tgtccttgccctgtg

SEQ ID NO: 48444 - DNA, 18 bp, Homo sapiens
tttgtcctctggaagcct

SEQ ID NO: 48445 - DNA, 20 bp, Homo sapiens
ttgtgttcagaagttttgtg

SEQ ID NO: 48446 - DNA, 18 bp, Homo sapiens
cttgtccttttatttgtg

SEQ ID NO: 48447 - DNA, 20 bp, Homo sapiens
tttgtccttgagataacatg

SEQ ID NO: 48448 - DNA, 20 bp, Homo sapiens
tttgtcatgataattttgtg

SEQ ID NO: 48449 - DNA, 20 bp, Homo sapiens
cttgtccccaaagttttgtg

SEQ ID NO: 48450 - DNA, 16 bp, Homo sapiens
tttgtccttggccttg

SEQ ID NO: 48451 - DNA, 18 bp, Homo sapiens
tttgtccttgaagtttta

SEQ ID NO: 48452 - DNA, 18 bp, Homo sapiens
ttgtccttggtttctgtg

SEQ ID NO: 48453 - DNA, 19 bp, Homo sapiens
tttgtccttagcggctctg

SEQ ID NO: 48454 - DNA, 20 bp, Homo sapiens
tctgtccttggtcatctgtg

SEQ ID NO: 48455 - DNA, 21 bp, Homo sapiens
cttgtccttggggcctttgtg

SEQ ID NO: 48456 - DNA, 18 bp, Homo sapiens
tttgtctttgagccccat

SEQ ID NO: 48457 - DNA, 18 bp, Homo sapiens
tttgtccttaaaaaactg

SEQ ID NO: 48458 - DNA, 20 bp, Homo sapiens
tttgttcagcaagttttgtg

SEQ ID NO: 48459 - DNA, 16 bp, Homo sapiens
ttgtccttaggctgtg

SEQ ID NO: 48460 - DNA, 22 bp, Homo sapiens
tttgtccctttctagctttgtg

SEQ ID NO: 48461 - DNA, 17 bp, Homo sapiens
tttgtccctgtgttgtg

SEQ ID NO: 48462 - DNA, 19 bp, Homo sapiens
ttgtccttaagcctttgtg

SEQ ID NO: 48463 - DNA, 20 bp, Homo sapiens
tttgtccttaaaaaggagtg

SEQ ID NO: 48464 - DNA, 18 bp, Homo sapiens
tttggttagagttttgtg

SEQ ID NO: 48465 - DNA, 19 bp, Homo sapiens
tctgtccttgcagcatgtg

SEQ ID NO: 48466 - DNA, 18 bp, Homo sapiens
tttgtccctaggactgtg

SEQ ID NO: 48467 - DNA, 19 bp, Homo sapiens
tttgcaatcaggttttgtg

SEQ ID NO: 48468 - DNA, 20 bp, Homo sapiens
tttgtcctttagatacactg

SEQ ID NO: 48469 - DNA, 17 bp, Homo sapiens
tttgtcctgaggctgtg

SEQ ID NO: 48470 - DNA, 18 bp, Homo sapiens
tgtccttaataccctgtg

SEQ ID NO: 48471 - DNA, 19 bp, Homo sapiens
tttatccaaacattttgtg

SEQ ID NO: 48472 - DNA, 20 bp, Homo sapiens
cttgtccttggagccacatg

SEQ ID NO: 48473 - DNA, 18 bp, Homo sapiens
tttgcctatagttttgtg

SEQ ID NO: 48474 - DNA, 18 bp, Homo sapiens
cttgttcttagatctgtg

SEQ ID NO: 48475 - DNA, 19 bp, Homo sapiens
tttgtaccttaggcaaatg

SEQ ID NO: 48476 - DNA, 17 bp, Homo sapiens
tttgtccttcagatttg

SEQ ID NO: 48477 - DNA, 20 bp, Homo sapiens
cttgtcataacagttttgtg

SEQ ID NO: 48478 - DNA, 20 bp, Homo sapiens
ttgtctttctaagttttgtg

SEQ ID NO: 48479 - DNA, 21 bp, Homo sapiens
tttgtccttggctgggttgtg

SEQ ID NO: 48480 - DNA, 19 bp, Homo sapiens
cttgtccttggagacactg

SEQ ID NO: 48481 - DNA, 15 bp, Homo sapiens
tttatcaagttttgt

SEQ ID NO: 48482 - DNA, 16 bp, Homo sapiens
tttgtcttaggtcctg

SEQ ID NO: 48483 - DNA, 18 bp, Homo sapiens
tttgtcttcagtcctgtg

SEQ ID NO: 48484 - DNA, 18 bp, Homo sapiens
tgtccttaggcagccctg

SEQ ID NO: 48485 - DNA, 17 bp, Homo sapiens
tttgccttcgctttgtg

SEQ ID NO: 48486 - DNA, 19 bp, Homo sapiens
ttatttttagagttttgtg

SEQ ID NO: 48487 - DNA, 17 bp, Homo sapiens
tttctcccaattttgtg

SEQ ID NO: 48488 - DNA, 17 bp, Homo sapiens
tttgtccttgaaaattg

SEQ ID NO: 48489 - DNA, 19 bp, Homo sapiens
tttgccttcacattttgtg

SEQ ID NO: 48490 - DNA, 17 bp, Homo sapiens
tttgtccttaaatattg

SEQ ID NO: 48491 - DNA, 18 bp, Homo sapiens
ttctcccagagttttgtg

SEQ ID NO: 48492 - DNA, 94 bp, Paramecium bursaria Chlorella virus 1
gcaagcgcattatatgtttttgatatcttaatgatatacaaagtttgcaagcgcattatatgttttcaagatgttgatgatgtataaaagttgc

SEQ ID NO: 48493 - DNA, 24 bp, Paramecium bursaria Chlorella virus 1
tgatatacaaagtttgcaagcgca

SEQ ID NO: 48494 - DNA, 26 bp, Homo sapiens
taatatacaaggtttctcaaagtgca

SEQ ID NO: 48495 - DNA, 20 bp, Homo sapiens
tgctgtacaaagtcccgcgc

SEQ ID NO: 48496 - DNA, 20 bp, Homo sapiens
tgattacaaagtgcggtgca

SEQ ID NO: 48497 - DNA, 20 bp, Homo sapiens
tgatatgcaaagtccatgca

SEQ ID NO: 48498 - DNA, 22 bp, Homo sapiens
tgataatggtcttgcaagtgca

SEQ ID NO: 48499 - DNA, 21 bp, Homo sapiens
tgatgtacaaagtatcaaacg

SEQ ID NO: 48500 - DNA, 29 bp, Homo sapiens
tgatatacaaaagttgtgtatgcgcttgc

SEQ ID NO: 48501 - DNA, 21 bp, Homo sapiens
tgatatacaaagataaatgca

SEQ ID NO: 48502 - DNA, 19 bp, Homo sapiens
tatacaaatctgaagtgca

SEQ ID NO: 48503 - DNA, 23 bp, Homo sapiens
gatatacaggctaattaagtgca

SEQ ID NO: 48504 - DNA, 61 bp, Paramecium bursaria Chlorella virus 1
gcgcctgcggcataatgttcggtgtgagtgtgttttaacaaatcatgcgtgctgtgcgtgc

SEQ ID NO: 48505 - DNA, 21 bp, Paramecium bursaria Chlorella virus 1
aatcatgcgtgctgtgcgtgc

SEQ ID NO: 48506 - DNA, 22 bp, Homo sapiens
atacatgcagattttgtgtgtg

SEQ ID NO: 48507 - DNA, 16 bp, Homo sapiens
tcatgcgtagtggtgc

SEQ ID NO: 48508 - DNA, 18 bp, Homo sapiens
aatcatggtgctctttgc

SEQ ID NO: 48509 - DNA, 17 bp, Homo sapiens
tcatgtgtgtatgcgtg

SEQ ID NO: 48510 - DNA, 18 bp, Homo sapiens
atgtgtgcgtgtgcgtgc

SEQ ID NO: 48511 - DNA, 22 bp, Homo sapiens
aatcatgcatgccccgtggtgc

SEQ ID NO: 48512 - DNA, 18 bp, Homo sapiens
atcgtgcgtgcgtatgtg

SEQ ID NO: 48513 - DNA, 19 bp, Homo sapiens
tcattcggagcgtgcgtgc

SEQ ID NO: 48514 - DNA, 19 bp, Homo sapiens
aatcatatactgtgtgtgc

SEQ ID NO: 48515 - DNA, 16 bp, Homo sapiens
ccatggctgtgcgtgc

SEQ ID NO: 48516 - DNA, 18 bp, Homo sapiens
catcgtgtgtgtgcatgc

SEQ ID NO: 48517 - DNA, 18 bp, Homo sapiens
tcatgctgccccgtggtg

SEQ ID NO: 48518 - DNA, 17 bp, Homo sapiens
atcatgccaatgcgtgc

SEQ ID NO: 48519 - DNA, 18 bp, Homo sapiens
atcatgcgtggtctggtg

SEQ ID NO: 48520 - DNA, 15 bp, Homo sapiens
catggtggtgcgtgc

SEQ ID NO: 48521 - DNA, 17 bp, Homo sapiens
catgcgtctatgtgtgc

SEQ ID NO: 48522 - DNA, 18 bp, Homo sapiens
aaccacatattgtgcgtg

SEQ ID NO: 48523 - DNA, 21 bp, Homo sapiens
aatcatgtgtacgcatgtgtg

SEQ ID NO: 48524 - DNA, 19 bp, Homo sapiens
gctgtggctgtgtgcgtgc

SEQ ID NO: 48525 - DNA, 19 bp, Homo sapiens
catgtgtgttcatacatgc

SEQ ID NO: 48526 - DNA, 19 bp, Homo sapiens
aatcatgctgctttcatgc

SEQ ID NO: 48527 - DNA, 17 bp, Homo sapiens
catgcgtgcacacatgc

SEQ ID NO: 48528 - DNA, 15 bp, Homo sapiens
catgcgtgcccatgc

SEQ ID NO: 48529 - DNA, 17 bp, Homo sapiens
tcaggtaccatgtgtgc

SEQ ID NO: 48530 - DNA, 17 bp, Homo sapiens
tcgagcgtgctaacgtg

SEQ ID NO: 48531 - DNA, 18 bp, Homo sapiens
tctgcgtgtacgtgtgtg

SEQ ID NO: 48532 - DNA, 16 bp, Homo sapiens
tctgcgcggtgcgtgc

SEQ ID NO: 48533 - DNA, 19 bp, Homo sapiens
acgctgtgtctgtgtgtgc

SEQ ID NO: 48534 - DNA, 66 bp, Rat cytomegalovirus
ccggttaatgaccacgatcgcgatcttgctttctctttatttggtatttccttgtggtcaaaccgg

SEQ ID NO: 48535 - DNA, 24 bp, Rat cytomegalovirus
accacgatcgcgatcttgctttct

SEQ ID NO: 48536 - DNA, 18 bp, Homo sapiens
ccgcatgtccttgctttc

SEQ ID NO: 48537 - DNA, 17 bp, Homo sapiens
acgatgcctcttgcttt

SEQ ID NO: 48538 - DNA, 20 bp, Homo sapiens
caatttggatcttgctttct

SEQ ID NO: 48539 - DNA, 22 bp, Homo sapiens
caccttcatgatcttgctttct

SEQ ID NO: 48540 - DNA, 17 bp, Homo sapiens
gatcggatgtgctttct

SEQ ID NO: 48541 - DNA, 18 bp, Homo sapiens
cgggtcccaccttgcttt

SEQ ID NO: 48542 - DNA, 22 bp, Homo sapiens
accatgcgtaatcttgctttct

SEQ ID NO: 48543 - DNA, 19 bp, Homo sapiens
acgatctgagctcctttct

SEQ ID NO: 48544 - DNA, 26 bp, Homo sapiens
ccacggcgccctccttcttgctttct

SEQ ID NO: 48545 - DNA, 17 bp, Homo sapiens
ccaccgttccttgcttt

SEQ ID NO: 48546 - DNA, 21 bp, Homo sapiens
accatgatagcgatactttct

SEQ ID NO: 48547 - DNA, 19 bp, Homo sapiens
ccatggcgcgatctcagct

SEQ ID NO: 48548 - DNA, 19 bp, Homo sapiens
ccatctgcccttgctttct

SEQ ID NO: 48549 - DNA, 22 bp, Homo sapiens
accatgcttggctgtgctttct

SEQ ID NO: 48550 - DNA, 19 bp, Homo sapiens
catgatgactgtgctttct

SEQ ID NO: 48551 - DNA, 63 bp, Rat cytomegalovirus
ggggcgggtggatctgtgactaatccataaaaacgtcagcgactcctcctcaaaatctgcccc

SEQ ID NO: 48552 - DNA, 24 bp, Rat cytomegalovirus
cagcgactcctcctcaaaatctgc

SEQ ID NO: 48553 - DNA, 21 bp, Homo sapiens
gcggctcctcctcgcggctgc

SEQ ID NO: 48554 - DNA, 20 bp, Homo sapiens
caggatttcttcaaaatctg

SEQ ID NO: 48555 - DNA, 24 bp, Homo sapiens
cagcgactctgtgctgcgaatctg

SEQ ID NO: 48556 - DNA, 25 bp, Homo sapiens
cagcaactcttcctgctccctctgc

SEQ ID NO: 48557 - DNA, 23 bp, Homo sapiens
gcgcctcctcccatctagtctgc

SEQ ID NO: 48558 - DNA, 19 bp, Homo sapiens
gcaggctccctaaatctgc

SEQ ID NO: 48559 - DNA, 23 bp, Homo sapiens
cagcggctcctccctcagagtct

SEQ ID NO: 48560 - DNA, 21 bp, Homo sapiens
cagcgactctcttcaggctgc

SEQ ID NO: 48561 - DNA, 17 bp, Homo sapiens
agcggctcctcctgctg

SEQ ID NO: 48562 - DNA, 24 bp, Homo sapiens
cagcagcttctgggaaaaatctgc

SEQ ID NO: 48563 - DNA, 20 bp, Homo sapiens
gcgctcctcctcggggtctg

SEQ ID NO: 48564 - DNA, 18 bp, Homo sapiens
cagcagctcttccctctg

SEQ ID NO: 48565 - DNA, 22 bp, Homo sapiens
acaacagctcctcaaggtctgc

SEQ ID NO: 48566 - DNA, 19 bp, Homo sapiens
gattcctcctccctcatgc

SEQ ID NO: 48567 - DNA, 21 bp, Homo sapiens
agcgacatactcgaaatctgc

SEQ ID NO: 48568 - DNA, 20 bp, Homo sapiens
acggctcctcctcccgctgc

SEQ ID NO: 48569 - DNA, 19 bp, Homo sapiens
tccaggtcctcaaagtctg

SEQ ID NO: 48570 - DNA, 20 bp, Homo sapiens
cagcgacaagttaaaatctg

SEQ ID NO: 48571 - DNA, 26 bp, Homo sapiens
gccggctcctcctccagacagtctgc

SEQ ID NO: 48572 - DNA, 63 bp, Gallid herpesvirus 3
tgtctgaatttatgtgcgagattactatatacaaaaattctatgtgcagaatatttacagacg

SEQ ID NO: 48573 - DNA, 21 bp, Gallid herpesvirus 3
tgtgcagaatatttacagacg

SEQ ID NO: 48574 - DNA, 16 bp, Homo sapiens
tgtgtagatttacaga

SEQ ID NO: 48575 - DNA, 17 bp, Homo sapiens
gtgtagaaatccacaga

SEQ ID NO: 48576 - DNA, 18 bp, Homo sapiens
tgtgcaaatattttcaaa

SEQ ID NO: 48577 - DNA, 17 bp, Homo sapiens
tggcagaatatttacag

SEQ ID NO: 48578 - DNA, 16 bp, Homo sapiens
tgtcagaacatacaga

SEQ ID NO: 48579 - DNA, 18 bp, Homo sapiens
tgtacagaatacaaaaga

SEQ ID NO: 48580 - DNA, 17 bp, Homo sapiens
tgtagcagaactcacag

SEQ ID NO: 48581 - DNA, 18 bp, Homo sapiens
actaagtatttacagacg

SEQ ID NO: 48582 - DNA, 21 bp, Homo sapiens
tgtatagaatgactgtacaga

SEQ ID NO: 48583 - DNA, 17 bp, Homo sapiens
tgtgcaaatgcccacag

SEQ ID NO: 48584 - DNA, 18 bp, Homo sapiens
gtgcagagtattcacaaa

SEQ ID NO: 48585 - DNA, 23 bp, Homo sapiens
tgagcagaatatgaaagtacaga

SEQ ID NO: 48586 - DNA, 23 bp, Homo sapiens
tgtgcagagcacttaactggacg

SEQ ID NO: 48587 - DNA, 19 bp, Homo sapiens
tgtctagaatattttacag

SEQ ID NO: 48588 - DNA, 18 bp, Homo sapiens
tgtacaaagatttacaga

SEQ ID NO: 48589 - DNA, 19 bp, Homo sapiens
tgtgcagaagtctactaga

SEQ ID NO: 48590 - DNA, 17 bp, Homo sapiens
tgtgcagatatgacaaa

SEQ ID NO: 48591 - DNA, 83 bp, Cowpox virus
tttgtaaaggatatgatatgttgtgattctagaatagtagtagctctatctagtctagtatctaaacattgggaattgacaaa

SEQ ID NO: 48592 - DNA, 76 bp, Gallid herpesvirus 3
ggttcttgtctatcaccggagttttcttaggaatcgttatttgcaccgagatgggcctgctgatagacccgggacc

SEQ ID NO: 48593 - DNA, 24 bp, Gallid herpesvirus 3
caccgagatgggcctgctgataga

SEQ ID NO: 48594 - DNA, 17 bp, Homo sapiens
ccggagcctgctgatag

SEQ ID NO: 48595 - DNA, 20 bp, Homo sapiens
cctgggccactgctgataga

SEQ ID NO: 48596 - DNA, 19 bp, Homo sapiens
cctgagatgggcctcatag

SEQ ID NO: 48597 - DNA, 18 bp, Homo sapiens
gagatgggtggagatgga

SEQ ID NO: 48598 - DNA, 19 bp, Homo sapiens
cgagatggggctccccaga

SEQ ID NO: 48599 - DNA, 24 bp, Homo sapiens
cactgacatggatgccttgataga

SEQ ID NO: 48600 - DNA, 17 bp, Homo sapiens
gaggggcctgctgcaga

SEQ ID NO: 48601 - DNA, 18 bp, Homo sapiens
caccaggtgggcctgcta

SEQ ID NO: 48602 - DNA, 19 bp, Homo sapiens
cactgagatggggctgcta

SEQ ID NO: 48603 - DNA, 20 bp, Homo sapiens
cactgatagtctgctggtag

SEQ ID NO: 48604 - DNA, 21 bp, Homo sapiens
cctgactgcatgtctgctgat

SEQ ID NO: 48605 - DNA, 17 bp, Homo sapiens
caccgacgtgggccctg

SEQ ID NO: 48606 - DNA, 20 bp, Homo sapiens
cactgaaatgggctgaatag

SEQ ID NO: 48607 - DNA, 20 bp, Homo sapiens
ccgagcctttctgctgatag

SEQ ID NO: 48608 - DNA, 77 bp, Monkeypox virus
atttttatcataacactacttcggttagatgttttagaaaaaaataaatatcactaccgttcttgttttataaaaat

SEQ ID NO: 48609 - DNA, 24 bp, Monkeypox virus
cataacactacttcggttagatgt

SEQ ID NO: 48610 - DNA, 17 bp, Homo sapiens
ataacactagtttaatg

SEQ ID NO: 48611 - DNA, 18 bp, Homo sapiens
cataacatttgctagatg

SEQ ID NO: 48612 - DNA, 19 bp, Homo sapiens
tgaacactgcaactagatg

SEQ ID NO: 48613 - DNA, 19 bp, Homo sapiens
cactatcttagttagatgt

SEQ ID NO: 48614 - DNA, 18 bp, Homo sapiens
aacactactttcaaatgt

SEQ ID NO: 48615 - DNA, 21 bp, Homo sapiens
acaacactattctttggatgt

SEQ ID NO: 48616 - DNA, 23 bp, Homo sapiens
cacagtgttactttattagatgt

SEQ ID NO: 48617 - DNA, 19 bp, Homo sapiens
acactaaacaattggatgt

SEQ ID NO: 48618 - DNA, 22 bp, Homo sapiens
catgaccttactggtcagatgt

SEQ ID NO: 48619 - DNA, 18 bp, Homo sapiens
ctactatcaattagatgt

SEQ ID NO: 48620 - DNA, 18 bp, Homo sapiens
cataacactataccaggt

SEQ ID NO: 48621 - DNA, 18 bp, Homo sapiens
acaataccaggttagatg

SEQ ID NO: 48622 - DNA, 117 bp, Tupaia herpesvirus
gacgcgggggtccccagcggcgccgcggtgagcaccgtcgcgtcggccagcgccgccaccgccgtgccggccgccgcgcgaggcgacgcgtgtctccaggcgccgccggcccgcgtc

SEQ ID NO: 48623 - DNA, 24 bp, Tupaia herpesvirus
ccgcgcgaggcgacgcgtgtctcc

SEQ ID NO: 48624 - DNA, 22 bp, Homo sapiens
gcgaggcgggcgcgcgcactcc

SEQ ID NO: 48625 - DNA, 18 bp, Homo sapiens
cctgcgggggagtgtctc

SEQ ID NO: 48626 - DNA, 19 bp, Homo sapiens
acgtgcatgtgcgtgtctc

SEQ ID NO: 48627 - DNA, 20 bp, Homo sapiens
ccgcgcgaaggtggccacca

SEQ ID NO: 48628 - DNA, 19 bp, Homo sapiens
ccgtgtaggcagatgtctc

SEQ ID NO: 48629 - DNA, 19 bp, Homo sapiens
ccgcgcgggctggcacctc

SEQ ID NO: 48630 - DNA, 17 bp, Homo sapiens
ccgcgcggggcggcggc

SEQ ID NO: 48631 - DNA, 21 bp, Homo sapiens
ccgctcacggtgcgtgtctcc

SEQ ID NO: 48632 - DNA, 18 bp, Homo sapiens
ccgctggggcggtatctc

SEQ ID NO: 48633 - DNA, 21 bp, Homo sapiens
ccgcgatgaggcggcgcgtct

SEQ ID NO: 48634 - DNA, 20 bp, Homo sapiens
ccgcgtgaggcgacgctgcc

SEQ ID NO: 48635 - DNA, 19 bp, Homo sapiens
ccacgcgacttgtgtgtct

SEQ ID NO: 48636 - DNA, 18 bp, Homo sapiens
cccgcgaggcggtggctc

SEQ ID NO: 48637 - DNA, 22 bp, Homo sapiens
gcgtgtgagggtctgtgtctcc

SEQ ID NO: 48638 - DNA, 22 bp, Homo sapiens
gcgcgaggcggcgcaggggtct

SEQ ID NO: 48639 - DNA, 19 bp, Homo sapiens
ccccacggcgtgtgtctcc

SEQ ID NO: 48640 - DNA, 77 bp, Tupaia herpesvirus
gcgtcgacgacggggcgacggcggcggacggcgcggctccgccgggccaggtccgcgacgccgcccccgtcgcgcgc

SEQ ID NO: 48641 - DNA, 24 bp, Tupaia herpesvirus
tcgacgacggggcgacggcggcgg

SEQ ID NO: 48642 - DNA, 23 bp, Homo sapiens
cggcggcgggcaccgggcggcgg

SEQ ID NO: 48643 - DNA, 18 bp, Homo sapiens
cggtggcgcgggcggcgg

SEQ ID NO: 48644 - DNA, 18 bp, Homo sapiens
cggggacggcggcggcgg

SEQ ID NO: 48645 - DNA, 22 bp, Homo sapiens
cgagctttggcggcggcggcgg

SEQ ID NO: 48646 - DNA, 22 bp, Homo sapiens
cggccgagggcggtggcggcgg

SEQ ID NO: 48647 - DNA, 18 bp, Homo sapiens
gacggctggtggcggcgg

SEQ ID NO: 48648 - DNA, 21 bp, Homo sapiens
cggcagcggcggcggcggcgg

SEQ ID NO: 48649 - DNA, 18 bp, Homo sapiens
cggcggcggcggcgacgg

SEQ ID NO: 48650 - DNA, 20 bp, Homo sapiens
cggtttggcggcggcggcgg

SEQ ID NO: 48651 - DNA, 18 bp, Homo sapiens
cggggcgggcggcggcgg

SEQ ID NO: 48652 - DNA, 21 bp, Homo sapiens
tcggcgggcggcgggcggcgg

SEQ ID NO: 48653 - DNA, 24 bp, Homo sapiens
tcggcggcgcggccccgacggcgg

SEQ ID NO: 48654 - DNA, 18 bp, Homo sapiens
cggtggcagcggcggcgg

SEQ ID NO: 48655 - DNA, 20 bp, Homo sapiens
cgcgagggcggcggcggcgg

SEQ ID NO: 48656 - DNA, 18 bp, Homo sapiens
cggcggtaacagcggcgg

SEQ ID NO: 48657 - DNA, 21 bp, Homo sapiens
cggcggcggcggcggcagcgg

SEQ ID NO: 48658 - DNA, 24 bp, Homo sapiens
tcgactgcggggcccgggcggcgg

SEQ ID NO: 48659 - DNA, 22 bp, Homo sapiens
tctgcggcggtaggggcggcgg

SEQ ID NO: 48660 - DNA, 20 bp, Homo sapiens
cgcggcgcaggcggcggcgg

SEQ ID NO: 48661 - DNA, 21 bp, Homo sapiens
cgcagagggtggcggcggcgg

SEQ ID NO: 48662 - DNA, 24 bp, Homo sapiens
cggcggcgggggcggcggcggcgg

SEQ ID NO: 48663 - DNA, 20 bp, Homo sapiens
cgcgatggcggcggcggcgg

SEQ ID NO: 48664 - DNA, 17 bp, Homo sapiens
gacaggcggcggcggcg

SEQ ID NO: 48665 - DNA, 22 bp, Homo sapiens
cggcggcggctcgcggcggcgg

SEQ ID NO: 48666 - DNA, 25 bp, Homo sapiens
cggcggcggcgctgggtggcggcgg

SEQ ID NO: 48667 - DNA, 22 bp, Homo sapiens
cggctggaggcggcggcggcgg

SEQ ID NO: 48668 - DNA, 21 bp, Homo sapiens
cggcgacggggacggcggcgg

SEQ ID NO: 48669 - DNA, 17 bp, Homo sapiens
cggcggtggcggcggcg

SEQ ID NO: 48670 - DNA, 19 bp, Homo sapiens
cgggaggcggcggcggcgg

SEQ ID NO: 48671 - DNA, 21 bp, Homo sapiens
cggcggcggcagcggcggcgg

SEQ ID NO: 48672 - DNA, 20 bp, Homo sapiens
cggccaggcggcggcggcgg

SEQ ID NO: 48673 - DNA, 18 bp, Homo sapiens
cgaggcgggcagcggcgg

SEQ ID NO: 48674 - DNA, 19 bp, Homo sapiens
cggggggaaacggcggcgg

SEQ ID NO: 48675 - DNA, 21 bp, Homo sapiens
acggcggctgggcggcggcgg

SEQ ID NO: 48676 - DNA, 22 bp, Homo sapiens
tcggcggcagggcggagcgcgg

SEQ ID NO: 48677 - DNA, 24 bp, Homo sapiens
ccgcggcggaggcggcggcggcgg

SEQ ID NO: 48678 - DNA, 23 bp, Homo sapiens
tcgcggtccagaggcggcggcgg

SEQ ID NO: 48679 - DNA, 21 bp, Homo sapiens
cgacgacagaggcggcggcgg

SEQ ID NO: 48680 - DNA, 22 bp, Homo sapiens
tcaccactggcggtggcggcgg

SEQ ID NO: 48681 - DNA, 24 bp, Homo sapiens
cggcggcggaggcggcggtggcgg

SEQ ID NO: 48682 - DNA, 24 bp, Homo sapiens
cggcggcggcagcagcggcggcgg

SEQ ID NO: 48683 - DNA, 18 bp, Homo sapiens
cggcggcggggcaggcgg

SEQ ID NO: 48684 - DNA, 24 bp, Homo sapiens
tcgcgacccccgcggcggcggcgg

SEQ ID NO: 48685 - DNA, 21 bp, Homo sapiens
cggcagaggcggcggcggcgg

SEQ ID NO: 48686 - DNA, 21 bp, Homo sapiens
cgacgcccccggcggcggcgg

SEQ ID NO: 48687 - DNA, 19 bp, Homo sapiens
aacgaggcggcggcggcgg

SEQ ID NO: 48688 - DNA, 22 bp, Homo sapiens
cgaaagcgggcggcggcggcgg

SEQ ID NO: 48689 - DNA, 18 bp, Homo sapiens
cggcggcagcggcggcgg

SEQ ID NO: 48690 - DNA, 21 bp, Homo sapiens
cggctgcggcggcggcggcgg

SEQ ID NO: 48691 - DNA, 21 bp, Homo sapiens
cggcgcgggcggtggcggcgg

SEQ ID NO: 48692 - DNA, 24 bp, Homo sapiens
cggcgacggcggcgacggcggcgg

SEQ ID NO: 48693 - DNA, 24 bp, Homo sapiens
tcgacggggggcggggcccggcgg

SEQ ID NO: 48694 - DNA, 18 bp, Homo sapiens
cggaggcggcggcggcgg

SEQ ID NO: 48695 - DNA, 15 bp, Homo sapiens
cgagaggcggcggcg

SEQ ID NO: 48696 - DNA, 19 bp, Homo sapiens
cggtgacgctcggcggcgg

SEQ ID NO: 48697 - DNA, 21 bp, Homo sapiens
tcggcggcggggcgggctcag

SEQ ID NO: 48698 - DNA, 21 bp, Homo sapiens
cgcgagctgcggtggcggcgg

SEQ ID NO: 48699 - DNA, 19 bp, Homo sapiens
cgagctgcggtggcggcgg

SEQ ID NO: 48700 - DNA, 19 bp, Homo sapiens
cgcgggccggcggcggcgg

SEQ ID NO: 48701 - DNA, 26 bp, Homo sapiens
tcggcggcggggtcaggccggggcgg

SEQ ID NO: 48702 - DNA, 20 bp, Homo sapiens
cggcgcggcggcggcggcgg

SEQ ID NO: 48703 - DNA, 22 bp, Homo sapiens
acggcggcagcagcggcggcgg

SEQ ID NO: 48704 - DNA, 22 bp, Homo sapiens
cggcgacaggctccggcggcgg

SEQ ID NO: 48705 - DNA, 20 bp, Homo sapiens
cggcggcggggcggcggcgg

SEQ ID NO: 48706 - DNA, 18 bp, Homo sapiens
cggcggctgcggcggcgg

SEQ ID NO: 48707 - DNA, 17 bp, Homo sapiens
cgcggcggctggcggcg

SEQ ID NO: 48708 - DNA, 24 bp, Homo sapiens
tcagcgttccggtggcggcggcgg

SEQ ID NO: 48709 - DNA, 21 bp, Homo sapiens
cggcaacagcggcggcggcgg

SEQ ID NO: 48710 - DNA, 21 bp, Homo sapiens
cgactctggcggcggcggcgg

SEQ ID NO: 48711 - DNA, 21 bp, Homo sapiens
cggcggcggcggcggcggcgg

SEQ ID NO: 48712 - DNA, 18 bp, Homo sapiens
cggtagcggtggcggcgg

SEQ ID NO: 48713 - DNA, 20 bp, Homo sapiens
cggcccggcggcggcggcgg

SEQ ID NO: 48714 - DNA, 24 bp, Homo sapiens
cggcggcggtagcggtggcggcgg

SEQ ID NO: 48715 - DNA, 22 bp, Homo sapiens
cggcgcggcgcggcggcggcgg

SEQ ID NO: 48716 - DNA, 20 bp, Homo sapiens
cgctgaggcggcggcggcgg

SEQ ID NO: 48717 - DNA, 18 bp, Homo sapiens
cggccggcggcggcggcg

SEQ ID NO: 48718 - DNA, 21 bp, Homo sapiens
cggcggtggcggaggcggcgg

SEQ ID NO: 48719 - DNA, 20 bp, Homo sapiens
cgcgggactcacggcggcgg

SEQ ID NO: 48720 - DNA, 18 bp, Homo sapiens
acggcggcggcggcggcg

SEQ ID NO: 48721 - DNA, 23 bp, Homo sapiens
tcggtccgcggtggcggcggcgg

SEQ ID NO: 48722 - DNA, 21 bp, Homo sapiens
cgctccgggcggcggcggcgg

SEQ ID NO: 48723 - DNA, 18 bp, Homo sapiens
cggtggggacggcggtgg

SEQ ID NO: 48724 - DNA, 18 bp, Homo sapiens
cgggcgcggcggcggcgg

SEQ ID NO: 48725 - DNA, 18 bp, Homo sapiens
cggcggcggcaggcggcg

SEQ ID NO: 48726 - DNA, 25 bp, Homo sapiens
acggcggcagcagaggcggcggcgg

SEQ ID NO: 48727 - DNA, 21 bp, Homo sapiens
tcgaggtggagcaggcggcgg

SEQ ID NO: 48728 - DNA, 22 bp, Homo sapiens
ccgcggcgggcggcggcggcgg

SEQ ID NO: 48729 - DNA, 26 bp, Homo sapiens
cggcgagccggggcggcggcggcggc

SEQ ID NO: 48730 - DNA, 18 bp, Homo sapiens
cggaatcggcggcggcgg

SEQ ID NO: 48731 - DNA, 24 bp, Homo sapiens
cggcggcggagcgggcggcggcgg

SEQ ID NO: 48732 - DNA, 18 bp, Homo sapiens
cggcggcggcgggcggcg

SEQ ID NO: 48733 - DNA, 17 bp, Homo sapiens
cgaaggcggcggcggcg

SEQ ID NO: 48734 - DNA, 20 bp, Homo sapiens
cgggggccggacagcggcgg

SEQ ID NO: 48735 - DNA, 26 bp, Homo sapiens
cggcggcggcgggcggatggcggcgg

SEQ ID NO: 48736 - DNA, 20 bp, Homo sapiens
cggcggcacggcggtggcgg

SEQ ID NO: 48737 - DNA, 18 bp, Homo sapiens
ggccggcggcggcggcgg

SEQ ID NO: 48738 - DNA, 23 bp, Homo sapiens
tccacgatgccgggcggcggcgg

SEQ ID NO: 48739 - DNA, 21 bp, Homo sapiens
aacagagggtggtggcggcgg

SEQ ID NO: 48740 - DNA, 22 bp, Homo sapiens
tccaccgcagcggcggcggcgg

SEQ ID NO: 48741 - DNA, 17 bp, Homo sapiens
gatggccgcggcggcgg

SEQ ID NO: 48742 - DNA, 22 bp, Homo sapiens
cggcggcggggcgggggcgcgg

SEQ ID NO: 48743 - DNA, 21 bp, Homo sapiens
cggcggaggcgacggcggcgg

SEQ ID NO: 48744 - DNA, 22 bp, Homo sapiens
acgacggcgacgacggcggcgg

SEQ ID NO: 48745 - DNA, 22 bp, Homo sapiens
tcggcggcggtggcggtggcgg

SEQ ID NO: 48746 - DNA, 21 bp, Homo sapiens
cggtggcggtagcggcggcgg

SEQ ID NO: 48747 - DNA, 18 bp, Homo sapiens
gacgaccgatggcggcgg

SEQ ID NO: 48748 - DNA, 21 bp, Homo sapiens
tcgacggcgggggcgctgcgg

SEQ ID NO: 48749 - DNA, 25 bp, Homo sapiens
tcggcggcggaggcggcggcggcgg

SEQ ID NO: 48750 - DNA, 25 bp, Homo sapiens
cggcggcggcggcgggcggcggcgg

SEQ ID NO: 48751 - DNA, 21 bp, Homo sapiens
tcgcttccgcggcggcggcgg

SEQ ID NO: 48752 - DNA, 26 bp, Homo sapiens
ccgacggccgcgggcggcggcggcgg

SEQ ID NO: 48753 - DNA, 18 bp, Homo sapiens
cgcgcggcagcggcggcg

SEQ ID NO: 48754 - DNA, 18 bp, Homo sapiens
gacggcggacggcggcgg

SEQ ID NO: 48755 - DNA, 19 bp, Homo sapiens
gagggggcggcggcggcgg

SEQ ID NO: 48756 - DNA, 21 bp, Homo sapiens
cggtggcggcgacggcggcgg

SEQ ID NO: 48757 - DNA, 20 bp, Homo sapiens
cgacggcggcgcggcggcgg

SEQ ID NO: 48758 - DNA, 18 bp, Homo sapiens
cggggaccgacggcggcg

SEQ ID NO: 48759 - DNA, 23 bp, Homo sapiens
cggccggaaggcggcggcggcgg

SEQ ID NO: 48760 - DNA, 19 bp, Homo sapiens
gaggaggcggcggcggcgg

SEQ ID NO: 48761 - DNA, 18 bp, Homo sapiens
acggcggcagcggcggcg

SEQ ID NO: 48762 - DNA, 19 bp, Homo sapiens
ccggcggcggggccggcgg

SEQ ID NO: 48763 - DNA, 20 bp, Homo sapiens
cggttgggcggcggcggcgg

SEQ ID NO: 48764 - DNA, 21 bp, Homo sapiens
cgaaaacggcggcggcggcgg

SEQ ID NO: 48765 - DNA, 19 bp, Homo sapiens
cgcggggcggtggcggcgg

SEQ ID NO: 48766 - DNA, 20 bp, Homo sapiens
cggcggtggcgaggcggcgg

SEQ ID NO: 48767 - DNA, 20 bp, Homo sapiens
gggcatggcggcggcggcgg

SEQ ID NO: 48768 - DNA, 17 bp, Homo sapiens
gactcgcggcggcggcg

SEQ ID NO: 48769 - DNA, 18 bp, Homo sapiens
cgggaacggcggcggcgg

SEQ ID NO: 48770 - DNA, 23 bp, Homo sapiens
tcggctcgacgcggcggcggcgg

SEQ ID NO: 48771 - DNA, 20 bp, Homo sapiens
cgacgcggcggcggcggtgg

SEQ ID NO: 48772 - DNA, 22 bp, Homo sapiens
tcgatgcgggcggcggcggcgg

SEQ ID NO: 48773 - DNA, 26 bp, Homo sapiens
tcggagggagggggcggcggcggcgg

SEQ ID NO: 48774 - DNA, 18 bp, Homo sapiens
cggcggaggcaacggcgg

SEQ ID NO: 48775 - DNA, 23 bp, Homo sapiens
tccacgacccgaggcggcggcgg

SEQ ID NO: 48776 - DNA, 21 bp, Homo sapiens
cggcggcggctgcggcggcgg

SEQ ID NO: 48777 - DNA, 20 bp, Homo sapiens
gagtagggcggcggcggcgg

SEQ ID NO: 48778 - DNA, 20 bp, Homo sapiens
cggcggtggcggggcggcgg

SEQ ID NO: 48779 - DNA, 30 bp, Homo sapiens
ccggcgacgggctcccgcggcggcggcggc

SEQ ID NO: 48780 - DNA, 22 bp, Homo sapiens
tcggcgtggggcggcgaggcgg

SEQ ID NO: 48781 - DNA, 24 bp, Homo sapiens
cggagacgcgggcggcggcggcgg

SEQ ID NO: 48782 - DNA, 21 bp, Homo sapiens
cggccgaggcggcggcggcgg

SEQ ID NO: 48783 - DNA, 22 bp, Homo sapiens
gactcctcggcggcggtggcgg

SEQ ID NO: 48784 - DNA, 23 bp, Homo sapiens
tcgtggcggagcggcggtggcgg

SEQ ID NO: 48785 - DNA, 24 bp, Homo sapiens
cggcgacacaggcggtggcggtgg

SEQ ID NO: 48786 - DNA, 19 bp, Homo sapiens
cgacggcggggctgggtgg

SEQ ID NO: 48787 - DNA, 23 bp, Homo sapiens
tcggcggcgcgggcgggcgcgcg

SEQ ID NO: 48788 - DNA, 23 bp, Homo sapiens
cggcgagtctgcgacggcggcgg

SEQ ID NO: 48789 - DNA, 21 bp, Homo sapiens
cggcgacaccgacggcggcgg

SEQ ID NO: 48790 - DNA, 21 bp, Homo sapiens
cggcggaggcggcggcggcgg

SEQ ID NO: 48791 - DNA, 22 bp, Homo sapiens
acggcggcagcggcggcggcgg

SEQ ID NO: 48792 - DNA, 24 bp, Homo sapiens
cggcggcggcggctgcggcggtgg

SEQ ID NO: 48793 - DNA, 21 bp, Homo sapiens
tccactcggcggcggcggcgg

SEQ ID NO: 48794 - DNA, 20 bp, Homo sapiens
cggggccctcgcggcggcgg

SEQ ID NO: 48795 - DNA, 18 bp, Homo sapiens
acggccgcggcggcggcg

SEQ ID NO: 48796 - DNA, 22 bp, Homo sapiens
tcggcacggggcagtagggcgg

SEQ ID NO: 48797 - DNA, 19 bp, Homo sapiens
cggaaggcggcggcggcgg

SEQ ID NO: 48798 - DNA, 27 bp, Homo sapiens
cgacggcggcgggggcggtggcggcgg

SEQ ID NO: 48799 - DNA, 25 bp, Homo sapiens
tcggcggcggcagcggtggcggcgg

SEQ ID NO: 48800 - DNA, 22 bp, Homo sapiens
cggcggcggagctcggcggcgg

SEQ ID NO: 48801 - DNA, 19 bp, Homo sapiens
gaggaggcggtggcggcgg

SEQ ID NO: 48802 - DNA, 18 bp, Homo sapiens
cggcggcggggcgggccg

SEQ ID NO: 48803 - DNA, 21 bp, Homo sapiens
cggcggcggggtgcgctgcgg

SEQ ID NO: 48804 - DNA, 22 bp, Homo sapiens
ccgcgacgcgcggcggcggcgg

SEQ ID NO: 48805 - DNA, 25 bp, Homo sapiens
ccgcgacggggcggggcgagggcgg

SEQ ID NO: 48806 - DNA, 26 bp, Homo sapiens
ccggcgcagctgggcggcggcggcgg

SEQ ID NO: 48807 - DNA, 22 bp, Homo sapiens
ccggcacaggtggtggcggcgg

SEQ ID NO: 48808 - DNA, 20 bp, Homo sapiens
gatgacggggcactgggtgg

SEQ ID NO: 48809 - DNA, 23 bp, Homo sapiens
gaagacgcggctgacggcggtgg

SEQ ID NO: 48810 - DNA, 25 bp, Homo sapiens
ccgcgtttactggcggcggcggcgg

SEQ ID NO: 48811 - DNA, 21 bp, Homo sapiens
cgacggcgacaacggcggtgg

SEQ ID NO: 48812 - DNA, 24 bp, Homo sapiens
cggcgacaacggcggtggcggcgg

SEQ ID NO: 48813 - DNA, 18 bp, Homo sapiens
acggcggtggcggcggcg

SEQ ID NO: 48814 - DNA, 18 bp, Homo sapiens
cgcgcggcggcggcggcg

SEQ ID NO: 48815 - DNA, 18 bp, Homo sapiens
cggtagcagcggcggcgg

SEQ ID NO: 48816 - DNA, 21 bp, Homo sapiens
cggcgatggcgacggcggcgg

SEQ ID NO: 48817 - DNA, 16 bp, Homo sapiens
gacgggcgtggcggcg

SEQ ID NO: 48818 - DNA, 18 bp, Homo sapiens
tcggcgacgggcgactgg

SEQ ID NO: 48819 - DNA, 19 bp, Homo sapiens
cgcggggcggcggcggtgg

SEQ ID NO: 48820 - DNA, 18 bp, Homo sapiens
acgacggcggcggcggcg

SEQ ID NO: 48821 - DNA, 20 bp, Homo sapiens
tcgggcggcggggcgcgcgg

SEQ ID NO: 48822 - DNA, 20 bp, Homo sapiens
cggctgagcggcggcggcgg

SEQ ID NO: 48823 - DNA, 20 bp, Homo sapiens
cgcggtcgcggcggcggcgg

SEQ ID NO: 48824 - DNA, 19 bp, Homo sapiens
cgctgggccgcggcggcgg

SEQ ID NO: 48825 - DNA, 18 bp, Homo sapiens
acgggacggcggcggcgg

SEQ ID NO: 48826 - DNA, 20 bp, Homo sapiens
gacgctggcggcggcggcgg

SEQ ID NO: 48827 - DNA, 17 bp, Homo sapiens
cgcagtggcggcggcgg

SEQ ID NO: 48828 - DNA, 21 bp, Homo sapiens
cgatggcggcaggggcggtgg

SEQ ID NO: 48829 - DNA, 21 bp, Homo sapiens
cggcggctgctttggcggcgg

SEQ ID NO: 48830 - DNA, 94 bp, Mushroom bacilliform virus
gtgactcacacccaggttatccctggtgcaagttgggttcagataataaagcggttttaacgggttttggtgatttaatttgggatgaagttgc

SEQ ID NO: 48831 - DNA, 24 bp, Mushroom bacilliform virus
taacgggttttggtgatttaattt

SEQ ID NO: 48832 - DNA, 21 bp, Homo sapiens
gggttttggtcattttaattt

SEQ ID NO: 48833 - DNA, 19 bp, Homo sapiens
ggttttggtgttgtaattt

SEQ ID NO: 48834 - DNA, 19 bp, Homo sapiens
caggaatctgatttaattt

SEQ ID NO: 48835 - DNA, 18 bp, Homo sapiens
gggtttcttgtttaattt

SEQ ID NO: 48836 - DNA, 19 bp, Homo sapiens
ggcaatggtggtttaattt

SEQ ID NO: 48837 - DNA, 21 bp, Homo sapiens
gggttttggccattttaattt

SEQ ID NO: 48838 - DNA, 112 bp, Mushroom bacilliform virus
ttttattaaacaagagccacacagtcttgagaaagttaatgctggtcgactccgtattattgcggcagttggcctcgtcgatcaaatcgtgactaggttgttgtgtatgaaa

SEQ ID NO: 48839 - DNA, 24 bp, Mushroom bacilliform virus
ttaatgctggtcgactccgtatta

SEQ ID NO: 48840 - DNA, 21 bp, Homo sapiens
taatgctatctactttgtatt

SEQ ID NO: 48841 - DNA, 19 bp, Homo sapiens
atgctggcatctttgtatt

SEQ ID NO: 48842 - DNA, 61 bp, Mushroom bacilliform virus
gtgatggccgaacacggtacgatttgtgaaacagacatttcgggctgggattggtcagtac

SEQ ID NO: 48843 - DNA, 24 bp, Mushroom bacilliform virus
tggccgaacacggtacgatttgtg

SEQ ID NO: 48844 - DNA, 24 bp, Homo sapiens
tggccaacacggtgaaaccctgtg

SEQ ID NO: 48845 - DNA, 21 bp, Homo sapiens
ggctgggcatggtgacttgtg

SEQ ID NO: 48846 - DNA, 79 bp, Mushroom bacilliform virus
cgactacgtacacagttagcgggagaggagatcggagggtatctgaatttcttccttcgtgtacatgcatatgtggtcg

SEQ ID NO: 48847 - DNA, 24 bp, Mushroom bacilliform virus
agcgggagaggagatcggagggta

SEQ ID NO: 48848 - DNA, 20 bp, Homo sapiens
gcggtggaggagacctggta

SEQ ID NO: 48849 - DNA, 19 bp, Homo sapiens
gggagaggggatatgggta

SEQ ID NO: 48850 - DNA, 21 bp, Homo sapiens
gcgggagaggagggacggggt

SEQ ID NO: 48851 - DNA, 21 bp, Homo sapiens
gggagggggggaaggcagggt

SEQ ID NO: 48852 - DNA, 19 bp, Homo sapiens
gctggagaggagggaaggt

SEQ ID NO: 48853 - DNA, 17 bp, Homo sapiens
gcgggagaggtggtggt

SEQ ID NO: 48854 - DNA, 18 bp, Homo sapiens
agtgggagaggagggtgg

SEQ ID NO: 48855 - DNA, 19 bp, Homo sapiens
cggggcatggtcggagggt

SEQ ID NO: 48856 - DNA, 18 bp, Homo sapiens
gcgcggagaggagagagg

SEQ ID NO: 48857 - DNA, 18 bp, Homo sapiens
gggggaggaacaactggt

SEQ ID NO: 48858 - DNA, 22 bp, Homo sapiens
agtaggagaggggaggagggta

SEQ ID NO: 48859 - DNA, 16 bp, Homo sapiens
gcgggagagggcgggg

SEQ ID NO: 48860 - DNA, 23 bp, Homo sapiens
gcgggagagggccccagggggta

SEQ ID NO: 48861 - DNA, 16 bp, Homo sapiens
gggagggtcggagggt

SEQ ID NO: 48862 - DNA, 19 bp, Homo sapiens
agcgggagcggggatccgg

SEQ ID NO: 48863 - DNA, 22 bp, Homo sapiens
gcaggagaggggatcttccagt

SEQ ID NO: 48864 - DNA, 19 bp, Homo sapiens
agtgagagaggaaagaggg

SEQ ID NO: 48865 - DNA, 18 bp, Homo sapiens
agcggaggaggagaaggt

SEQ ID NO: 48866 - DNA, 16 bp, Homo sapiens
gcgggaggggaggtgc

SEQ ID NO: 48867 - DNA, 20 bp, Homo sapiens
ggctggaggtcctggagggt

SEQ ID NO: 48868 - DNA, 16 bp, Homo sapiens
cgggagaggggcgggt

SEQ ID NO: 48869 - DNA, 20 bp, Homo sapiens
agggggagagggggctgggt

SEQ ID NO: 48870 - DNA, 23 bp, Homo sapiens
agtgggagagggggcaggagggt

SEQ ID NO: 48871 - DNA, 23 bp, Homo sapiens
gcggggggggggttcaggagggt

SEQ ID NO: 48872 - DNA, 19 bp, Homo sapiens
gggagaggtgggggagggt

SEQ ID NO: 48873 - DNA, 18 bp, Homo sapiens
agtggggcaggaaagggt

SEQ ID NO: 48874 - DNA, 19 bp, Homo sapiens
agcgggagagcttgagggt

SEQ ID NO: 48875 - DNA, 17 bp, Homo sapiens
agcgggaggggaggcgg

SEQ ID NO: 48876 - DNA, 19 bp, Homo sapiens
agagggagagggctagggt

SEQ ID NO: 48877 - DNA, 20 bp, Homo sapiens
agggggagaggagagatggt

SEQ ID NO: 48878 - DNA, 23 bp, Homo sapiens
gcggagaggggatcgagacgggt

SEQ ID NO: 48879 - DNA, 18 bp, Homo sapiens
gcgggagagaggatgggg

SEQ ID NO: 48880 - DNA, 20 bp, Homo sapiens
gggggaggagaaaacaggta

SEQ ID NO: 48881 - DNA, 18 bp, Homo sapiens
agtggggaggaggagagg

SEQ ID NO: 48882 - DNA, 22 bp, Homo sapiens
aggggagggggatcatagggta

SEQ ID NO: 48883 - DNA, 18 bp, Homo sapiens
agtgggagaggaggacga

SEQ ID NO: 48884 - DNA, 22 bp, Homo sapiens
agggggagaggaggggcttggt

SEQ ID NO: 48885 - DNA, 21 bp, Homo sapiens
gctgggagaggtcacgggggt

SEQ ID NO: 48886 - DNA, 19 bp, Homo sapiens
gcggcggaggagatgaagg

SEQ ID NO: 48887 - DNA, 20 bp, Homo sapiens
gcgggagagaggcccagggt

SEQ ID NO: 48888 - DNA, 23 bp, Homo sapiens
aacggggggggagattttggggt

SEQ ID NO: 48889 - DNA, 25 bp, Homo sapiens
agcaggagaggggagaggtgagggt

SEQ ID NO: 48890 - DNA, 17 bp, Homo sapiens
gcggtgggatggggggt

SEQ ID NO: 48891 - DNA, 16 bp, Homo sapiens
ggagggagcggagggt

SEQ ID NO: 48892 - DNA, 17 bp, Homo sapiens
gcgggagagaggaaggt

SEQ ID NO: 48893 - DNA, 15 bp, Homo sapiens
agcgggaaggagagg

SEQ ID NO: 48894 - DNA, 18 bp, Homo sapiens
aggggaggggagaaaggt

SEQ ID NO: 48895 - DNA, 17 bp, Homo sapiens
gggagagggaggagggt

SEQ ID NO: 48896 - DNA, 17 bp, Homo sapiens
gggagagtgaggagggt

SEQ ID NO: 48897 - DNA, 20 bp, Homo sapiens
gggggagcaggtggggggta

SEQ ID NO: 48898 - DNA, 18 bp, Homo sapiens
agagggagaggagattgg

SEQ ID NO: 48899 - DNA, 19 bp, Homo sapiens
gcgggaggacagggagggt

SEQ ID NO: 48900 - DNA, 17 bp, Homo sapiens
agtgggagaggggatgg

SEQ ID NO: 48901 - DNA, 18 bp, Homo sapiens
ggggagggtccaggggta

SEQ ID NO: 48902 - DNA, 17 bp, Homo sapiens
ggaggggaggcaggggt

SEQ ID NO: 48903 - DNA, 23 bp, Homo sapiens
gggagagggggggcacgggggta

SEQ ID NO: 48904 - DNA, 21 bp, Homo sapiens
agtggggaggaaggatagggt

SEQ ID NO: 48905 - DNA, 17 bp, Homo sapiens
gggagaggagcgggggt

SEQ ID NO: 48906 - DNA, 15 bp, Homo sapiens
gggagaggaaagggt

SEQ ID NO: 48907 - DNA, 17 bp, Homo sapiens
gcaggagaggggtgggt

SEQ ID NO: 48908 - DNA, 20 bp, Homo sapiens
gcgggagagagacggagggt

SEQ ID NO: 48909 - DNA, 15 bp, Homo sapiens
gggagaagggaaggt

SEQ ID NO: 48910 - DNA, 21 bp, Homo sapiens
agagggaggtcctggagggta

SEQ ID NO: 48911 - DNA, 18 bp, Homo sapiens
ggggggagttcggagggt

SEQ ID NO: 48912 - DNA, 23 bp, Homo sapiens
gcggggatggcggatcggagggt

SEQ ID NO: 48913 - DNA, 15 bp, Homo sapiens
agcggggagggaggg

SEQ ID NO: 48914 - DNA, 21 bp, Homo sapiens
agcaggagggcccaggggggt

SEQ ID NO: 48915 - DNA, 22 bp, Homo sapiens
agcaggggaccatacggagggt

SEQ ID NO: 48916 - DNA, 15 bp, Homo sapiens
ggaagaggagagggt

SEQ ID NO: 48917 - DNA, 16 bp, Homo sapiens
gggagaggagaggagg

SEQ ID NO: 48918 - DNA, 16 bp, Homo sapiens
cggggggatggggggt

SEQ ID NO: 48919 - DNA, 17 bp, Homo sapiens
agcgggaggggatgggg

SEQ ID NO: 48920 - DNA, 18 bp, Homo sapiens
agcgggagaggggctggt

SEQ ID NO: 48921 - DNA, 18 bp, Homo sapiens
gctgggagaggagagggt

SEQ ID NO: 48922 - DNA, 21 bp, Homo sapiens
agtggtgggagtaggagggta

SEQ ID NO: 48923 - DNA, 18 bp, Homo sapiens
aggtgggaggtggagggt

SEQ ID NO: 48924 - DNA, 18 bp, Homo sapiens
gccggggggtcggggggt

SEQ ID NO: 48925 - DNA, 21 bp, Homo sapiens
agtgggggcggggggaaggta

SEQ ID NO: 48926 - DNA, 24 bp, Homo sapiens
agtgggaggggagagcagacagta

SEQ ID NO: 48927 - DNA, 17 bp, Homo sapiens
gccggagggcggggggt

SEQ ID NO: 48928 - DNA, 17 bp, Homo sapiens
gcggagaggagatgggg

SEQ ID NO: 48929 - DNA, 88 bp, Mushroom bacilliform virus
ccaggcggtcagctatcgggtgattacaacacatcttcgagtaattcgagaatgagagtgattgccacgatgtttgctcgatacctgg

SEQ ID NO: 48930 - DNA, 24 bp, Mushroom bacilliform virus
gagaatgagagtgattgccacgat

SEQ ID NO: 48931 - DNA, 21 bp, Homo sapiens
gagggagagggagaccacgat

SEQ ID NO: 48932 - DNA, 19 bp, Homo sapiens
gagaatgagggttgcttga

SEQ ID NO: 48933 - DNA, 18 bp, Homo sapiens
gagagtgagagagaactg

SEQ ID NO: 48934 - DNA, 18 bp, Homo sapiens
aagatgggggtgattgcc

SEQ ID NO: 48935 - DNA, 20 bp, Homo sapiens
ggaagaacgtggttgccacg

SEQ ID NO: 48936 - DNA, 22 bp, Homo sapiens
gagggtgaaagtgaacactgat

SEQ ID NO: 48937 - DNA, 21 bp, Homo sapiens
agaatgagcaaaatattgcca

SEQ ID NO: 48938 - DNA, 69 bp, Sendai virus
gccgtcaggatcaaggatcggagacccccaacagggactcgctccgccccagaccgcccgaccgacggc

SEQ ID NO: 48939 - DNA, 24 bp, Sendai virus
tcgctccgccccagaccgcccgac

SEQ ID NO: 48940 - DNA, 19 bp, Homo sapiens
tcgctccacttcaggggcc

SEQ ID NO: 48941 - DNA, 23 bp, Homo sapiens
tcgctccaccctgcctgctccga

SEQ ID NO: 48942 - DNA, 20 bp, Homo sapiens
cgctccgctccgggccgtcg

SEQ ID NO: 48943 - DNA, 16 bp, Homo sapiens
cgctccgcccggcccg

SEQ ID NO: 48944 - DNA, 21 bp, Homo sapiens
cacaccgccccaggctgcccg

SEQ ID NO: 48945 - DNA, 19 bp, Homo sapiens
tcctccgccccctgcccga

SEQ ID NO: 48946 - DNA, 19 bp, Homo sapiens
tcgctccgctgccctccga

SEQ ID NO: 48947 - DNA, 18 bp, Homo sapiens
tcgctccggcctaagcgc

SEQ ID NO: 48948 - DNA, 24 bp, Homo sapiens
tcctgcgtagccaggccgcccgac

SEQ ID NO: 48949 - DNA, 21 bp, Homo sapiens
tcgccccgttccaggcctccc

SEQ ID NO: 48950 - DNA, 19 bp, Homo sapiens
ccgctccgccctttcctcg

SEQ ID NO: 48951 - DNA, 15 bp, Homo sapiens
tcgtccgcccgcccg

SEQ ID NO: 48952 - DNA, 20 bp, Homo sapiens
tcgcccgccccagacagagc

SEQ ID NO: 48953 - DNA, 18 bp, Homo sapiens
actccgcctcctcctccg

SEQ ID NO: 48954 - DNA, 20 bp, Homo sapiens
tcgctctcgctcctggcccg

SEQ ID NO: 48955 - DNA, 17 bp, Homo sapiens
tcgccccgcccggctcg

SEQ ID NO: 48956 - DNA, 21 bp, Homo sapiens
tcggtccctgggccgcccgac

SEQ ID NO: 48957 - DNA, 20 bp, Homo sapiens
tcgctccgtcccacgtcccg

SEQ ID NO: 48958 - DNA, 19 bp, Homo sapiens
ccgctttgccccagaaggc

SEQ ID NO: 48959 - DNA, 19 bp, Homo sapiens
tcactccgctccagccccg

SEQ ID NO: 48960 - DNA, 19 bp, Homo sapiens
cgctccgctccggccggac

SEQ ID NO: 48961 - DNA, 24 bp, Homo sapiens
tcgccccgccctcgggcccgcccg

SEQ ID NO: 48962 - DNA, 16 bp, Homo sapiens
tcgctccgcccgctcg

SEQ ID NO: 48963 - DNA, 17 bp, Homo sapiens
ccgctccgctccggccc

SEQ ID NO: 48964 - DNA, 21 bp, Homo sapiens
tctctccgctccggcagcggc

SEQ ID NO: 48965 - DNA, 21 bp, Homo sapiens
ccgctccggccgccgcccgac

SEQ ID NO: 48966 - DNA, 20 bp, Homo sapiens
gctccgccctaggacaggac

SEQ ID NO: 48967 - DNA, 21 bp, Homo sapiens
cgcagtcgcttagaccgctcg

SEQ ID NO: 48968 - DNA, 20 bp, Homo sapiens
cgctccgccatgcgctcgac

SEQ ID NO: 48969 - DNA, 18 bp, Homo sapiens
tccttccgccccaggcac

SEQ ID NO: 48970 - DNA, 19 bp, Homo sapiens
gctttgtcccaaacccccg

SEQ ID NO: 48971 - DNA, 18 bp, Homo sapiens
ccgctccgctccgctccg

SEQ ID NO: 48972 - DNA, 19 bp, Homo sapiens
tcgccccgccccctgcccg

SEQ ID NO: 48973 - DNA, 15 bp, Homo sapiens
ctccgccccaggccc

SEQ ID NO: 48974 - DNA, 24 bp, Homo sapiens
tcggtccgccccggaccgacctcg

SEQ ID NO: 48975 - DNA, 16 bp, Homo sapiens
tcgccccgccccgccc

SEQ ID NO: 48976 - DNA, 22 bp, Homo sapiens
cgctccgctccagacccgcgcg

SEQ ID NO: 48977 - DNA, 71 bp, Plantago asiatica mosaic virus
gtaaccctcagcggccccagcccgacgcccaccatctctctggcacaaatcgctggggtcgtcaaagtcac

SEQ ID NO: 48978 - DNA, 24 bp, Plantago asiatica mosaic virus
cagcggccccagcccgacgcccac

SEQ ID NO: 48979 - DNA, 22 bp, Homo sapiens
agcggcccatggcccgggtccc

SEQ ID NO: 48980 - DNA, 21 bp, Homo sapiens
cagcggccgcgccccgcccac

SEQ ID NO: 48981 - DNA, 19 bp, Homo sapiens
cagcggcccagcccctccc

SEQ ID NO: 48982 - DNA, 22 bp, Homo sapiens
cagcagccctgctggcgtttgc

SEQ ID NO: 48983 - DNA, 22 bp, Homo sapiens
accactgccggcccgacgccca

SEQ ID NO: 48984 - DNA, 21 bp, Homo sapiens
gcggccccggcccggcggcgc

SEQ ID NO: 48985 - DNA, 16 bp, Homo sapiens
gcggccccagcggccc

SEQ ID NO: 48986 - DNA, 21 bp, Homo sapiens
caccggcctcggccgcgcgcc

SEQ ID NO: 48987 - DNA, 22 bp, Homo sapiens
cagcggcccccgccgccgtccc

SEQ ID NO: 48988 - DNA, 22 bp, Homo sapiens
cagcggcctgcgggacggtcca

SEQ ID NO: 48989 - DNA, 17 bp, Homo sapiens
cagcgcccccagcgccc

SEQ ID NO: 48990 - DNA, 20 bp, Homo sapiens
gcggcccccggcccgagcgc

SEQ ID NO: 48991 - DNA, 20 bp, Homo sapiens
cagcggccgcagctcaccac

SEQ ID NO: 48992 - DNA, 17 bp, Homo sapiens
cggcgccggcgacgccc

SEQ ID NO: 48993 - DNA, 19 bp, Homo sapiens
gcggccccggcggccccgc

SEQ ID NO: 48994 - DNA, 17 bp, Homo sapiens
gcgcctccagcccgggc

SEQ ID NO: 48995 - DNA, 18 bp, Homo sapiens
gcggcccgccggcgccca

SEQ ID NO: 48996 - DNA, 18 bp, Homo sapiens
cagcagtcccagccctgc

SEQ ID NO: 48997 - DNA, 18 bp, Homo sapiens
cagtggccccagccccgc

SEQ ID NO: 48998 - DNA, 19 bp, Homo sapiens
gcagccccagcctaggcac

SEQ ID NO: 48999 - DNA, 23 bp, Homo sapiens
cagtcgcttcagcccgatttccc

SEQ ID NO: 49000 - DNA, 21 bp, Homo sapiens
cagcggcccccgccactctgc

SEQ ID NO: 49001 - DNA, 18 bp, Homo sapiens
cagcagccctggccctac

SEQ ID NO: 49002 - DNA, 22 bp, Homo sapiens
cagcggtgccagcccacctcgc

SEQ ID NO: 49003 - DNA, 19 bp, Homo sapiens
gcggcccccgcccccgccc

SEQ ID NO: 49004 - DNA, 17 bp, Homo sapiens
gcggccccggctcccgc

SEQ ID NO: 49005 - DNA, 23 bp, Homo sapiens
cagcggcccctgcctcagcccac

SEQ ID NO: 49006 - DNA, 16 bp, Homo sapiens
gcggcccctgccccgc

SEQ ID NO: 49007 - DNA, 21 bp, Homo sapiens
cagcggccctgcgtcctctgc

SEQ ID NO: 49008 - DNA, 18 bp, Homo sapiens
agcagccagcccggtgcc

SEQ ID NO: 49009 - DNA, 21 bp, Homo sapiens
cagggccccaggtcttgccca

SEQ ID NO: 49010 - DNA, 16 bp, Homo sapiens
gcggccccggccccgc

SEQ ID NO: 49011 - DNA, 24 bp, Homo sapiens
cagcagccctggttacatggcccg

SEQ ID NO: 49012 - DNA, 20 bp, Homo sapiens
gcggccccagcaggatccgc

SEQ ID NO: 49013 - DNA, 20 bp, Homo sapiens
agcggtcccggccccaacgc

SEQ ID NO: 49014 - DNA, 22 bp, Homo sapiens
cagcggccccggcccagagcgc

SEQ ID NO: 49015 - DNA, 21 bp, Homo sapiens
cagcgggcagctccgacgccc

SEQ ID NO: 49016 - DNA, 20 bp, Homo sapiens
cagcggcacccggccgaacc

SEQ ID NO: 49017 - DNA, 20 bp, Homo sapiens
acggccccggctcacgtcgc

SEQ ID NO: 49018 - DNA, 15 bp, Homo sapiens
gcggccccgccccgc

SEQ ID NO: 49019 - DNA, 18 bp, Homo sapiens
ggccccagcccagaacac

SEQ ID NO: 49020 - DNA, 20 bp, Homo sapiens
cagcggcctcggcccaccgc

SEQ ID NO: 49021 - DNA, 17 bp, Homo sapiens
agcggccccagcttaca

SEQ ID NO: 49022 - DNA, 19 bp, Homo sapiens
cagcagccctgagacgtcc

SEQ ID NO: 49023 - DNA, 21 bp, Homo sapiens
cagcggccccagccatttcac

SEQ ID NO: 49024 - DNA, 22 bp, Homo sapiens
cagcggccgccggcccgcgtcc

SEQ ID NO: 49025 - DNA, 21 bp, Homo sapiens
gcggccccggcccccgggccc

SEQ ID NO: 49026 - DNA, 20 bp, Homo sapiens
cagggccccagtgaagccca

SEQ ID NO: 49027 - DNA, 16 bp, Homo sapiens
gcagcccccgcgctca

SEQ ID NO: 49028 - DNA, 20 bp, Homo sapiens
gctgccccagcaactcccac

SEQ ID NO: 49029 - DNA, 21 bp, Homo sapiens
cagtgcttccagcccacaccc

SEQ ID NO: 49030 - DNA, 20 bp, Homo sapiens
cagggccccagcatcctcgc

SEQ ID NO: 49031 - DNA, 18 bp, Homo sapiens
ggccatccccacgcccac

SEQ ID NO: 49032 - DNA, 22 bp, Homo sapiens
gccggccccacaacccgcctgc

SEQ ID NO: 49033 - DNA, 19 bp, Homo sapiens
cagcggcctacaccgtcca

SEQ ID NO: 49034 - DNA, 21 bp, Homo sapiens
ggttgtcccagcccccaacac

SEQ ID NO: 49035 - DNA, 18 bp, Homo sapiens
gcggccccgaccctccgc

SEQ ID NO: 49036 - DNA, 19 bp, Homo sapiens
gcgcccccggcccgcccgc

SEQ ID NO: 49037 - DNA, 18 bp, Homo sapiens
cagtgctcccagcccccc

SEQ ID NO: 49038 - DNA, 19 bp, Homo sapiens
agcggtcctggcccgacac

SEQ ID NO: 49039 - DNA, 20 bp, Homo sapiens
cagctgccccagcctggagc

SEQ ID NO: 49040 - DNA, 22 bp, Homo sapiens
cagcggccttggcctcggaggc

SEQ ID NO: 49041 - DNA, 18 bp, Homo sapiens
cagcagccccggccccgc

SEQ ID NO: 49042 - DNA, 18 bp, Homo sapiens
agcggcccgagcctgcgc

SEQ ID NO: 49043 - DNA, 20 bp, Homo sapiens
agcgtccccagccgagctca

SEQ ID NO: 49044 - DNA, 19 bp, Homo sapiens
cagcggcctcatgacctgc

SEQ ID NO: 49045 - DNA, 18 bp, Homo sapiens
caccggccccagccccgc

SEQ ID NO: 49046 - DNA, 20 bp, Homo sapiens
cagcggccccagttgatgcc

SEQ ID NO: 49047 - DNA, 22 bp, Homo sapiens
cagcggccgcgagagcgcccac

SEQ ID NO: 49048 - DNA, 17 bp, Homo sapiens
cagcgtcccagcccagc

SEQ ID NO: 49049 - DNA, 24 bp, Homo sapiens
gcggccccgctccagccgatccac

SEQ ID NO: 49050 - DNA, 20 bp, Homo sapiens
cagtgaccccagcttttcac

SEQ ID NO: 49051 - DNA, 16 bp, Homo sapiens
gcggccgccacgccca

SEQ ID NO: 49052 - DNA, 24 bp, Homo sapiens
cagcagccccagcgagatgcctac

SEQ ID NO: 49053 - DNA, 17 bp, Homo sapiens
cagcgtcccagccccac

SEQ ID NO: 49054 - DNA, 21 bp, Homo sapiens
acggccccagcccggcgaaca

SEQ ID NO: 49055 - DNA, 16 bp, Homo sapiens
gcggcccagcccgggc

SEQ ID NO: 49056 - DNA, 22 bp, Homo sapiens
cagcggccgtagccgcgtccca

SEQ ID NO: 49057 - DNA, 24 bp, Homo sapiens
gctggccccagtccctcagcccac

SEQ ID NO: 49058 - DNA, 22 bp, Homo sapiens
cagcggcccttgtcctcagcgc

SEQ ID NO: 49059 - DNA, 21 bp, Homo sapiens
cagcggcccagcccggatcgc

SEQ ID NO: 49060 - DNA, 20 bp, Homo sapiens
ggccccagccttctgatcac

SEQ ID NO: 49061 - DNA, 20 bp, Homo sapiens
cagtggccccaaggtcctgc

SEQ ID NO: 49062 - DNA, 19 bp, Homo sapiens
gcggccccgcccctttcgc

SEQ ID NO: 49063 - DNA, 19 bp, Homo sapiens
ggccccagcccctgggccc

SEQ ID NO: 49064 - DNA, 17 bp, Homo sapiens
cagggccccagctgccc

SEQ ID NO: 49065 - DNA, 16 bp, Homo sapiens
gcggccccggccgccc

SEQ ID NO: 49066 - DNA, 17 bp, Homo sapiens
gcggccccgcctcgccc

SEQ ID NO: 49067 - DNA, 20 bp, Homo sapiens
gctttggccccggcccccgc

SEQ ID NO: 49068 - DNA, 23 bp, Homo sapiens
cagcggcctcacttgttgatcac

SEQ ID NO: 49069 - DNA, 19 bp, Homo sapiens
cagcggccccgactcccca

SEQ ID NO: 49070 - DNA, 17 bp, Homo sapiens
gcggccccggccacccc

SEQ ID NO: 49071 - DNA, 20 bp, Homo sapiens
cagcggcctacagcacctgc

SEQ ID NO: 49072 - DNA, 17 bp, Homo sapiens
cagtagcccccacgcca

SEQ ID NO: 49073 - DNA, 20 bp, Homo sapiens
cagcggcccctgctgacagc

SEQ ID NO: 49074 - DNA, 20 bp, Homo sapiens
gctggccccagccgaactgc

SEQ ID NO: 49075 - DNA, 15 bp, Homo sapiens
gcggccccaccgcgc

SEQ ID NO: 49076 - DNA, 18 bp, Homo sapiens
agcggccccagccgtgcc

SEQ ID NO: 49077 - DNA, 18 bp, Homo sapiens
gcggccccagcctggcgc

SEQ ID NO: 49078 - DNA, 17 bp, Homo sapiens
cagcggccccgccccgc

SEQ ID NO: 49079 - DNA, 18 bp, Homo sapiens
cagtgctcccagccccac

SEQ ID NO: 49080 - DNA, 16 bp, Homo sapiens
cagggccccagcgccc

SEQ ID NO: 49081 - DNA, 17 bp, Homo sapiens
agcggccccgcacctgc

SEQ ID NO: 49082 - DNA, 22 bp, Homo sapiens
gcggcgccagcccacctcccac

SEQ ID NO: 49083 - DNA, 19 bp, Homo sapiens
gcggccccgctgcctccgc

SEQ ID NO: 49084 - DNA, 20 bp, Homo sapiens
gcggccccgcaggttgccca

SEQ ID NO: 49085 - DNA, 23 bp, Homo sapiens
cagcggccgccggctccccccgc

SEQ ID NO: 49086 - DNA, 18 bp, Homo sapiens
cagcggccctagccccac

SEQ ID NO: 49087 - DNA, 20 bp, Homo sapiens
cagtggccccaaccgcgcac

SEQ ID NO: 49088 - DNA, 20 bp, Homo sapiens
agcggccccggctccggcgc

SEQ ID NO: 49089 - DNA, 22 bp, Homo sapiens
tgacggccccagcagtccccac

SEQ ID NO: 49090 - DNA, 21 bp, Homo sapiens
cagcagcctggcgatgctcac

SEQ ID NO: 49091 - DNA, 18 bp, Homo sapiens
gcggccccggcgcgccgc

SEQ ID NO: 49092 - DNA, 19 bp, Homo sapiens
gccggtcccagcgcgtccc

SEQ ID NO: 49093 - DNA, 18 bp, Homo sapiens
gcggccccggcccaggac

SEQ ID NO: 49094 - DNA, 20 bp, Homo sapiens
cagtggcccagcacattcca

SEQ ID NO: 49095 - DNA, 19 bp, Homo sapiens
gcggccccagctcagctgc

SEQ ID NO: 49096 - DNA, 18 bp, Homo sapiens
cagcggcctcagctcagc

SEQ ID NO: 49097 - DNA, 21 bp, Homo sapiens
cagcgaccccagctcctccac

SEQ ID NO: 49098 - DNA, 20 bp, Homo sapiens
cagccgccccagcctctggc

SEQ ID NO: 49099 - DNA, 21 bp, Homo sapiens
gcgccccagcggatctcgccc

SEQ ID NO: 49100 - DNA, 17 bp, Homo sapiens
cagcgacccccgcgccc

SEQ ID NO: 49101 - DNA, 19 bp, Homo sapiens
cagcggctccaggcactgc

SEQ ID NO: 49102 - DNA, 20 bp, Homo sapiens
cagcgacctcacccgcctgc

SEQ ID NO: 49103 - DNA, 21 bp, Homo sapiens
cagcagttccagaaagcccac

SEQ ID NO: 49104 - DNA, 17 bp, Homo sapiens
gcggccccagctcgccc

SEQ ID NO: 49105 - DNA, 22 bp, Homo sapiens
cagcggcctcaggctcagggcc

SEQ ID NO: 49106 - DNA, 21 bp, Homo sapiens
gaccccagctctcgaagtcac

SEQ ID NO: 49107 - DNA, 18 bp, Homo sapiens
acggccccggcgcgcgcc

SEQ ID NO: 49108 - DNA, 17 bp, Homo sapiens
gcggcccccgctccggc

SEQ ID NO: 49109 - DNA, 26 bp, Homo sapiens
cagcggccacggccagcaccgtccgc

SEQ ID NO: 49110 - DNA, 19 bp, Homo sapiens
cggccctggtgacacccac

SEQ ID NO: 49111 - DNA, 22 bp, Homo sapiens
cagcggccccgtggcctcccgc

SEQ ID NO: 49112 - DNA, 21 bp, Homo sapiens
cagcggcctcacgcctcccgc

SEQ ID NO: 49113 - DNA, 21 bp, Homo sapiens
cagtggatcctggccccccac

SEQ ID NO: 49114 - DNA, 18 bp, Homo sapiens
gcggccccgggcactccc

SEQ ID NO: 49115 - DNA, 19 bp, Homo sapiens
agtggtcccagcccttcac

SEQ ID NO: 49116 - DNA, 18 bp, Homo sapiens
ggccccagcccctcaacg

SEQ ID NO: 49117 - DNA, 24 bp, Homo sapiens
cagtggctcgggccccacgcccac

SEQ ID NO: 49118 - DNA, 18 bp, Homo sapiens
gctgccctggccaacgcc

SEQ ID NO: 49119 - DNA, 21 bp, Homo sapiens
gctctccagcccgacgcccac

SEQ ID NO: 49120 - DNA, 20 bp, Homo sapiens
cagcagccccagccactcca

SEQ ID NO: 49121 - DNA, 19 bp, Homo sapiens
cagcagccccagcgcgccc

SEQ ID NO: 49122 - DNA, 17 bp, Homo sapiens
gcggccccagcccgggc

SEQ ID NO: 49123 - DNA, 15 bp, Homo sapiens
cagcagccccgcgcc

SEQ ID NO: 49124 - DNA, 21 bp, Homo sapiens
cagcggccgcagaaagcccac

SEQ ID NO: 49125 - DNA, 25 bp, Homo sapiens
cagcggccccgggctctctctccac

SEQ ID NO: 49126 - DNA, 19 bp, Homo sapiens
cagcggctccgctcaacgc

SEQ ID NO: 49127 - DNA, 21 bp, Homo sapiens
agcggccccggctccaagcac

SEQ ID NO: 49128 - DNA, 22 bp, Homo sapiens
cagcggccgcagcagcgcctca

SEQ ID NO: 49129 - DNA, 18 bp, Homo sapiens
cagcggccctcggccacc

SEQ ID NO: 49130 - DNA, 21 bp, Homo sapiens
cagcgtccccagcacacccac

SEQ ID NO: 49131 - DNA, 19 bp, Homo sapiens
gcggccccgcagaccctca

SEQ ID NO: 49132 - DNA, 22 bp, Homo sapiens
cagcggcctcagcttcaggcgc

SEQ ID NO: 49133 - DNA, 65 bp, Plantago asiatica mosaic virus
gttcgaacaccgctgggccggctttgacttcttcgacggcctgctcaaccctgcggcactcgaac

SEQ ID NO: 49134 - DNA, 24 bp, Plantago asiatica mosaic virus
cggcctgctcaaccctgcggcact

SEQ ID NO: 49135 - DNA, 24 bp, Homo sapiens
ggtgctgcttggtcactctgggca

SEQ ID NO: 49136 - DNA, 22 bp, Homo sapiens
ggcctgctcatcttcccgcact

SEQ ID NO: 49137 - DNA, 20 bp, Homo sapiens
cgtcctgctcagcctctgca

SEQ ID NO: 49138 - DNA, 16 bp, Homo sapiens
ggcctgcttgcgcgcc

SEQ ID NO: 49139 - DNA, 20 bp, Homo sapiens
cagcgtgatcggccctgcgg

SEQ ID NO: 49140 - DNA, 17 bp, Homo sapiens
cggcctctcccgcggcc

SEQ ID NO: 49141 - DNA, 21 bp, Homo sapiens
ggcccgctcggccgggcgcgc

SEQ ID NO: 49142 - DNA, 19 bp, Homo sapiens
cctgctcagtctggaaact

SEQ ID NO: 49143 - DNA, 23 bp, Homo sapiens
cggcctgctcagcctgcagcgct

SEQ ID NO: 49144 - DNA, 20 bp, Homo sapiens
ggtttttcaaccccaggact

SEQ ID NO: 49145 - DNA, 25 bp, Homo sapiens
ggcctgcctcagcctcccaaagtgc

SEQ ID NO: 49146 - DNA, 19 bp, Homo sapiens
ggtttgatcaacccctgac

SEQ ID NO: 49147 - DNA, 19 bp, Homo sapiens
ggcctgcatggccctgcaa

SEQ ID NO: 49148 - DNA, 21 bp, Homo sapiens
ggcgcgcggtcctgcggcgct

SEQ ID NO: 49149 - DNA, 19 bp, Homo sapiens
cggcccgctcagctgccgc

SEQ ID NO: 49150 - DNA, 18 bp, Homo sapiens
ggcctgctcaatctgcaa

SEQ ID NO: 49151 - DNA, 20 bp, Homo sapiens
ggcctgcctgacctggccac

SEQ ID NO: 49152 - DNA, 20 bp, Homo sapiens
ggtctgttgaaccctgccgg

SEQ ID NO: 49153 - DNA, 20 bp, Homo sapiens
cagcctggctccctgcggca

SEQ ID NO: 49154 - DNA, 21 bp, Homo sapiens
ggcctgctcagtgggggcact

SEQ ID NO: 49155 - DNA, 23 bp, Homo sapiens
cggcctgctcgaccttcgaccct

SEQ ID NO: 49156 - DNA, 19 bp, Homo sapiens
cggcctgctgggcgcgtgc

SEQ ID NO: 49157 - DNA, 20 bp, Homo sapiens
ggcctgctgggccaggcact

SEQ ID NO: 49158 - DNA, 22 bp, Homo sapiens
cggcccccagccctgcggcact

SEQ ID NO: 49159 - DNA, 19 bp, Homo sapiens
ggccttcttctgcggcact

SEQ ID NO: 49160 - DNA, 21 bp, Homo sapiens
ggtccgcggtcctgcggcgct

SEQ ID NO: 49161 - DNA, 20 bp, Homo sapiens
ggcctgctcaagtttgaagc

SEQ ID NO: 49162 - DNA, 21 bp, Homo sapiens
cgacctgctcaactgcgcact

SEQ ID NO: 49163 - DNA, 17 bp, Homo sapiens
cggcccgctcggcccgc

SEQ ID NO: 49164 - DNA, 20 bp, Homo sapiens
gcctgctcagtcctgggact

SEQ ID NO: 49165 - DNA, 19 bp, Homo sapiens
cagcctgctcaacctgtaa

SEQ ID NO: 49166 - DNA, 21 bp, Homo sapiens
gcctgctcagtcccgacagca

SEQ ID NO: 49167 - DNA, 84 bp, Bovine herpesvirus 4
tatcatgaattgattatgtctgatattattttcatggcccacatgagggcccatgatcctctaaggacaagatcactcatggtg

SEQ ID NO: 49168 - DNA, 24 bp, Bovine herpesvirus 4
tatgtctgatattattttcatggc

SEQ ID NO: 49169 - DNA, 18 bp, Homo sapiens
tatgatctgatgtcatgg

SEQ ID NO: 49170 - DNA, 19 bp, Homo sapiens
tgtctgatactgtcttggc

SEQ ID NO: 49171 - DNA, 21 bp, Homo sapiens
tatgttctggatatttcatgg

SEQ ID NO: 49172 - DNA, 20 bp, Homo sapiens
tatgtctgattccagtatgg

SEQ ID NO: 49173 - DNA, 16 bp, Homo sapiens
tgtctgataatcatgg

SEQ ID NO: 49174 - DNA, 20 bp, Homo sapiens
tatgtctgggttattttatg

SEQ ID NO: 49175 - DNA, 19 bp, Homo sapiens
tgtcccatattttcatggc

SEQ ID NO: 49176 - DNA, 24 bp, Homo sapiens
tatgtctggtactaaataaatggc

SEQ ID NO: 49177 - DNA, 65 bp, Human herpesvirus 5
ggcgttcaggccttaatactagccgcatcttacctgtcggcagcatgtatcggggctccgacgcc

SEQ ID NO: 49178 - DNA, 24 bp, Human herpesvirus 5
cagcatgtatcggggctccgacgc

SEQ ID NO: 49179 - DNA, 23 bp, Homo sapiens
cagcgggcgcggggctctggtgc

SEQ ID NO: 49180 - DNA, 20 bp, Homo sapiens
gcggccagggggctctgacg

SEQ ID NO: 49181 - DNA, 18 bp, Homo sapiens
tgtcccgggctccggcgc

SEQ ID NO: 49182 - DNA, 20 bp, Homo sapiens
caccatccagggctctggcg

SEQ ID NO: 49183 - DNA, 17 bp, Homo sapiens
gcggtgtcggggctccg

SEQ ID NO: 49184 - DNA, 17 bp, Homo sapiens
cagatgtatcgcctgag

SEQ ID NO: 49185 - DNA, 18 bp, Homo sapiens
cagcgtatgtcggggctc

SEQ ID NO: 49186 - DNA, 22 bp, Homo sapiens
cagggcgcaggggctccggcgc

SEQ ID NO: 49187 - DNA, 20 bp, Homo sapiens
gcggaccggggctccggcgc

SEQ ID NO: 49188 - DNA, 72 bp, Human herpesvirus 5
cgccgaaaaatgcttgtctggctgaggttggtgtcgctaatgccacttttttgtctcgcttcaatgtcggtg

SEQ ID NO: 49189 - DNA, 24 bp, Human herpesvirus 5
cacttttttgtctcgcttcaatgt

SEQ ID NO: 49190 - DNA, 18 bp, Homo sapiens
cacttttttgtttctctc

SEQ ID NO: 49191 - DNA, 17 bp, Homo sapiens
cttttttagcttcagtg

SEQ ID NO: 49192 - DNA, 19 bp, Homo sapiens
ttttttgctccttcaatgt

SEQ ID NO: 49193 - DNA, 18 bp, Homo sapiens
cacttttttccttcagtg

SEQ ID NO: 49194 - DNA, 21 bp, Homo sapiens
ctttttttctggcttcagtgt

SEQ ID NO: 49195 - DNA, 20 bp, Homo sapiens
cctttaacttgcttcaatgt

SEQ ID NO: 49196 - DNA, 23 bp, Homo sapiens
ttttttgtctcaaaaatcaatgt

SEQ ID NO: 49197 - DNA, 20 bp, Homo sapiens
ttttttgtcccgcttaatgt

SEQ ID NO: 49198 - DNA, 20 bp, Homo sapiens
ttctttgtctactataatgt

SEQ ID NO: 49199 - DNA, 21 bp, Homo sapiens
ttttttgtctctcccttttgt

SEQ ID NO: 49200 - DNA, 21 bp, Homo sapiens
cttgcattttcgctttaatgt

SEQ ID NO: 49201 - DNA, 17 bp, Homo sapiens
cacttttttgtttcctt

SEQ ID NO: 49202 - DNA, 65 bp, Human herpesvirus 5
gagaaaatctgtgattctctatgagtgttatttttattatccttttggggactacgatttttctt

SEQ ID NO: 49203 - DNA, 24 bp, Human herpesvirus 5
tctgtgattctctatgagtgttat

SEQ ID NO: 49204 - DNA, 23 bp, Homo sapiens
tctgtgattatttatttagttat

SEQ ID NO: 49205 - DNA, 22 bp, Homo sapiens
tctgtgatgttcttcacgttat

SEQ ID NO: 49206 - DNA, 16 bp, Homo sapiens
tctgtattctctagtt

SEQ ID NO: 49207 - DNA, 16 bp, Homo sapiens
tctgtagatgagtgtt

SEQ ID NO: 49208 - DNA, 21 bp, Homo sapiens
ctgtggttttctgagtgttat

SEQ ID NO: 49209 - DNA, 20 bp, Homo sapiens
tctgtgattctcttggcctt

SEQ ID NO: 49210 - DNA, 19 bp, Homo sapiens
tctgggttctctattctgt

SEQ ID NO: 49211 - DNA, 20 bp, Homo sapiens
tgtgattctctgtggcatgt

SEQ ID NO: 49212 - DNA, 19 bp, Homo sapiens
tgtgattctctgttcatgt

SEQ ID NO: 49213 - DNA, 67 bp, Human herpesvirus 5
ggtccgcatggctccggactcgtttatcgtgagcttcatgatttctacgggtatctgcagctggacc

SEQ ID NO: 49214 - DNA, 22 bp, Human herpesvirus 5
tacgggtatctgcagctggacc

SEQ ID NO: 49215 - DNA, 18 bp, Homo sapiens
gggtatctcttcagagcc

SEQ ID NO: 49216 - DNA, 18 bp, Homo sapiens
cgggtggcaagttggacc

SEQ ID NO: 49217 - DNA, 15 bp, Homo sapiens
gagcagcagctggac

SEQ ID NO: 49218 - DNA, 17 bp, Homo sapiens
ggcgccgcggctggacc

SEQ ID NO: 49219 - DNA, 15 bp, Homo sapiens
gggctctggctggac

SEQ ID NO: 49220 - DNA, 19 bp, Homo sapiens
cgggcgcggcggctggacc

SEQ ID NO: 49221 - DNA, 17 bp, Homo sapiens
tacggtatctgcataag

SEQ ID NO: 49222 - DNA, 22 bp, Homo sapiens
actcctcatctgcagctggacc

SEQ ID NO: 49223 - DNA, 20 bp, Homo sapiens
cactccttctgcagctggac

SEQ ID NO: 49224 - DNA, 15 bp, Homo sapiens
gggtatcactggacc

SEQ ID NO: 49225 - DNA, 20 bp, Homo sapiens
tgaggtctggcagctgggcc

SEQ ID NO: 49226 - DNA, 18 bp, Homo sapiens
ggcatggtctgcagctgg

SEQ ID NO: 49227 - DNA, 19 bp, Homo sapiens
tacgaggatccctggctgg

SEQ ID NO: 49228 - DNA, 18 bp, Homo sapiens
tacagcctttgcagctgg

SEQ ID NO: 49229 - DNA, 19 bp, Homo sapiens
cacgggtacagtggctgga

SEQ ID NO: 49230 - DNA, 18 bp, Homo sapiens
cacggtcttgcagctgga

SEQ ID NO: 49231 - DNA, 19 bp, Homo sapiens
gggtctgcggggctgggcc

SEQ ID NO: 49232 - DNA, 19 bp, Homo sapiens
tacgggtacctctttggac

SEQ ID NO: 49233 - DNA, 17 bp, Homo sapiens
gggtatctagacgggcc

SEQ ID NO: 49234 - DNA, 20 bp, Homo sapiens
cacgtcgctctgcagctgga

SEQ ID NO: 49235 - DNA, 18 bp, Homo sapiens
tacaggccaggcagctgg

SEQ ID NO: 49236 - DNA, 19 bp, Homo sapiens
cacgtggctgcagctggac

SEQ ID NO: 49237 - DNA, 22 bp, Homo sapiens
cagctgactctgcagctgggcc

SEQ ID NO: 49238 - DNA, 17 bp, Homo sapiens
caggctgcagctgggcc

SEQ ID NO: 49239 - DNA, 17 bp, Homo sapiens
gggtatggagctggacc

SEQ ID NO: 49240 - DNA, 17 bp, Homo sapiens
ggaaacgcagctggacc

SEQ ID NO: 49241 - DNA, 15 bp, Homo sapiens
gggttgcagctggac

SEQ ID NO: 49242 - DNA, 15 bp, Homo sapiens
gggcatcagctggac

SEQ ID NO: 49243 - DNA, 16 bp, Homo sapiens
gggcagctagctggac

SEQ ID NO: 49244 - DNA, 19 bp, Homo sapiens
cgggtggaacggctggacc

SEQ ID NO: 49245 - DNA, 18 bp, Homo sapiens
gggccccacagctggacc

SEQ ID NO: 49246 - DNA, 18 bp, Homo sapiens
gggttccacagctgggcc

SEQ ID NO: 49247 - DNA, 17 bp, Homo sapiens
ggatgctgcagctggac

SEQ ID NO: 49248 - DNA, 21 bp, Homo sapiens
aggtccttctgcagctgggcc

SEQ ID NO: 49249 - DNA, 17 bp, Homo sapiens
gaggctgcagctggacc

SEQ ID NO: 49250 - DNA, 18 bp, Homo sapiens
caaggctgtggctggacc

SEQ ID NO: 49251 - DNA, 19 bp, Homo sapiens
cgggcggaacggctggacc

SEQ ID NO: 49252 - DNA, 19 bp, Homo sapiens
caggtatctggcaaaggcc

SEQ ID NO: 49253 - DNA, 19 bp, Homo sapiens
gggtagcctgggctggacc

SEQ ID NO: 49254 - DNA, 76 bp, Human herpesvirus 5
gtcgttttgttcaccgtcgctgtgcaacgcgtgaaacaagagcgtgatgcgcaccttcggcggtatgaagaacgat

SEQ ID NO: 49255 - DNA, 24 bp, Human herpesvirus 5
caccgtcgctgtgcaacgcgtgaa

SEQ ID NO: 49256 - DNA, 21 bp, Homo sapiens
cactgcgcgctgtgtgtgtga

SEQ ID NO: 49257 - DNA, 25 bp, Homo sapiens
caccgctgcggcaacgatgtgtgaa

SEQ ID NO: 49258 - DNA, 21 bp, Homo sapiens
accgccgccgccggacgcgtg

SEQ ID NO: 49259 - DNA, 18 bp, Homo sapiens
cactgttgctgtgctgca

SEQ ID NO: 49260 - DNA, 18 bp, Homo sapiens
caccgtcgctgtgctgcg

SEQ ID NO: 49261 - DNA, 18 bp, Homo sapiens
cctcgctgtgtgacactg

SEQ ID NO: 49262 - DNA, 21 bp, Homo sapiens
cgctgcgctgtgttctgcgtg

SEQ ID NO: 49263 - DNA, 78 bp, Swinepox virus
cgtataagagccacaggtttcatttatcaatgtttattgtatataaatagaatatcgatatgtgctcttattctaacg

SEQ ID NO: 49264 - DNA, 24 bp, Swinepox virus
taagagccacaggtttcatttatc

SEQ ID NO: 49265 - DNA, 22 bp, Homo sapiens
aaagtcactaagaatcatttat

SEQ ID NO: 49266 - DNA, 18 bp, Homo sapiens
aaagctgcaggtttcatc

SEQ ID NO: 49267 - DNA, 16 bp, Homo sapiens
agagctgatctcattt

SEQ ID NO: 49268 - DNA, 20 bp, Homo sapiens
agagggctgttccatttatc

SEQ ID NO: 49269 - DNA, 16 bp, Homo sapiens
gagccacagcatttat

SEQ ID NO: 49270 - DNA, 24 bp, Homo sapiens
tgaagccacagtcagctgtttatc

SEQ ID NO: 49271 - DNA, 21 bp, Homo sapiens
taagaaccaagctttatttat

SEQ ID NO: 49272 - DNA, 18 bp, Homo sapiens
gagattggtttcatttat

SEQ ID NO: 49273 - DNA, 21 bp, Homo sapiens
agagtttgggtttcacagatc

SEQ ID NO: 49274 - DNA, 19 bp, Homo sapiens
taagagctctgggtttcac

SEQ ID NO: 49275 - DNA, 20 bp, Homo sapiens
taagagcatgggtttcattt

SEQ ID NO: 49276 - DNA, 22 bp, Homo sapiens
taagagacatgggcacattatc

SEQ ID NO: 49277 - DNA, 65 bp, Swinepox virus
ttattaatagatagagtatacgaaacaatattatttttgggtaaaacggatctatctagtgatga

SEQ ID NO: 49278 - DNA, 24 bp, Swinepox virus
tagagtatacgaaacaatattatt

SEQ ID NO: 49279 - DNA, 22 bp, Homo sapiens
tagagtttgacacaatattatt

SEQ ID NO: 49280 - DNA, 62 bp, Cherry green ring mottle virus
cagtgagggctttgatctgtttctttccgatccttatcagaattttcgcaagcctcttactg

SEQ ID NO: 49281 - DNA, 19 bp, Cherry green ring mottle virus
tttcgcaagcctcttactg

SEQ ID NO: 49282 - DNA, 19 bp, Homo sapiens
ttccaagctcttcttactg

SEQ ID NO: 49283 - DNA, 16 bp, Homo sapiens
tttcacagccctactg

SEQ ID NO: 49284 - DNA, 18 bp, Homo sapiens
tttcccaagccccacctg

SEQ ID NO: 49285 - DNA, 20 bp, Homo sapiens
tttcccaagccccagaactg

SEQ ID NO: 49286 - DNA, 18 bp, Homo sapiens
ttccgcaaatgtttactg

SEQ ID NO: 49287 - DNA, 18 bp, Homo sapiens
tttcacaagcctcctctg

SEQ ID NO: 49288 - DNA, 18 bp, Homo sapiens
tttcacactttcttactg

SEQ ID NO: 49289 - DNA, 19 bp, Homo sapiens
tttcacaagcctttcactg

SEQ ID NO: 49290 - DNA, 18 bp, Homo sapiens
tttcacaagctcagcact

SEQ ID NO: 49291 - DNA, 18 bp, Homo sapiens
tctcgtggagccttactg

SEQ ID NO: 49292 - DNA, 16 bp, Homo sapiens
tttcacaaacctactg

SEQ ID NO: 49293 - DNA, 16 bp, Homo sapiens
tttccaggcctcactg

SEQ ID NO: 49294 - DNA, 17 bp, Homo sapiens
tttccaagcctcagctg

SEQ ID NO: 49295 - DNA, 19 bp, Homo sapiens
tttcttaagctcattactg

SEQ ID NO: 49296 - DNA, 20 bp, Homo sapiens
tttcgcaagcattttagctg

SEQ ID NO: 49297 - DNA, 20 bp, Homo sapiens
tctcgcaagcagcactactg

SEQ ID NO: 49298 - DNA, 17 bp, Homo sapiens
tcccacaaatcttactg

SEQ ID NO: 49299 - DNA, 16 bp, Homo sapiens
ttcacatctcttactg

SEQ ID NO: 49300 - DNA, 16 bp, Homo sapiens
ttccgagccccttctg

SEQ ID NO: 49301 - DNA, 18 bp, Homo sapiens
tttcacaagctcatcctg

SEQ ID NO: 49302 - DNA, 19 bp, Homo sapiens
tttctaaagcctcttgctg

SEQ ID NO: 49303 - DNA, 20 bp, Homo sapiens
tttcgcaacctactcatctg

SEQ ID NO: 49304 - DNA, 76 bp, Cherry green ring mottle virus
tagttttcgttgtgagctttttgatttatgtctccagtaaatttggcaataggtctcctagcattcagcattactg

SEQ ID NO: 49305 - DNA, 24 bp, Cherry green ring mottle virus
caataggtctcctagcattcagca

SEQ ID NO: 49306 - DNA, 18 bp, Homo sapiens
caaaggtctcctaaaagc

SEQ ID NO: 49307 - DNA, 19 bp, Homo sapiens
caaaaggtccccattcagc

SEQ ID NO: 49308 - DNA, 18 bp, Homo sapiens
cagtaggcttctagcacc

SEQ ID NO: 49309 - DNA, 18 bp, Homo sapiens
aatagatctgccattcag

SEQ ID NO: 49310 - DNA, 21 bp, Homo sapiens
ggttctcctaggtcttcagca

SEQ ID NO: 49311 - DNA, 20 bp, Homo sapiens
taggttcatagcattcagca

SEQ ID NO: 49312 - DNA, 19 bp, Homo sapiens
gggtcctaggggttcagca

SEQ ID NO: 49313 - DNA, 17 bp, Homo sapiens
aaaaggctggcattcag

SEQ ID NO: 49314 - DNA, 19 bp, Homo sapiens
aatgggtctctggcatcca

SEQ ID NO: 49315 - DNA, 18 bp, Homo sapiens
ggtctcctcctcatcagc

SEQ ID NO: 49316 - DNA, 26 bp, Homo sapiens
caacaggtttccttagtgtgctgaag

SEQ ID NO: 49317 - DNA, 22 bp, Homo sapiens
caatggtttcatccattcagca

SEQ ID NO: 49318 - DNA, 29 bp, Homo sapiens
caataggtctgctggtctatgctgaatgc

SEQ ID NO: 49319 - DNA, 18 bp, Homo sapiens
cagtgcctggcattcagc

SEQ ID NO: 49320 - DNA, 20 bp, Homo sapiens
aggtctcctgcctcctcggc

SEQ ID NO: 49321 - DNA, 17 bp, Homo sapiens
caatgggtctcctccag

SEQ ID NO: 49322 - DNA, 15 bp, Homo sapiens
caggtctcagttcag

SEQ ID NO: 49323 - DNA, 18 bp, Homo sapiens
caggtctcctgcgctagc

SEQ ID NO: 49324 - DNA, 23 bp, Homo sapiens
cgaggggaaggtagcattcagca

SEQ ID NO: 49325 - DNA, 15 bp, Homo sapiens
aataggtgcattcag

SEQ ID NO: 49326 - DNA, 29 bp, Homo sapiens
caacaggtctccattggtgtgctgaatgc

SEQ ID NO: 49327 - DNA, 26 bp, Homo sapiens
caatagtctcctgactccctgttcag

SEQ ID NO: 49328 - DNA, 21 bp, Homo sapiens
tgataggtctcttagctagca

SEQ ID NO: 49329 - DNA, 20 bp, Homo sapiens
ataggtctccagctcttcag

SEQ ID NO: 49330 - DNA, 17 bp, Homo sapiens
caataggtctttagttc

SEQ ID NO: 49331 - DNA, 78 bp, Cherry green ring mottle virus
gctttggcccttcagtttgccaatttcttaacaagcttgggtttgagatagaatctgcaaaagaggaggatacagagc

SEQ ID NO: 49332 - DNA, 24 bp, Cherry green ring mottle virus
tgagatagaatctgcaaaagagga

SEQ ID NO: 49333 - DNA, 20 bp, Homo sapiens
gagatagaaggaagaagagg

SEQ ID NO: 49334 - DNA, 18 bp, Homo sapiens
gagatggtacaaaagggg

SEQ ID NO: 49335 - DNA, 22 bp, Homo sapiens
tgagaagcagcacaaaagagga

SEQ ID NO: 49336 - DNA, 18 bp, Homo sapiens
tgaggaagacaaaagagg

SEQ ID NO: 49337 - DNA, 21 bp, Homo sapiens
tgaggtagcacacaaaaaggg

SEQ ID NO: 49338 - DNA, 24 bp, Homo sapiens
tgagacagctaagctaggggagga

SEQ ID NO: 49339 - DNA, 19 bp, Homo sapiens
tgagatagggtctctaaga

SEQ ID NO: 49340 - DNA, 20 bp, Homo sapiens
tgggaagaggacaaaagagg

SEQ ID NO: 49341 - DNA, 18 bp, Homo sapiens
tgagaagaatctgagagg

SEQ ID NO: 49342 - DNA, 16 bp, Homo sapiens
tgagtagaacaaggag

SEQ ID NO: 49343 - DNA, 23 bp, Homo sapiens
tgaggatggtccgtaaaagagga

SEQ ID NO: 49344 - DNA, 19 bp, Homo sapiens
tgagacagagagaaagggg

SEQ ID NO: 49345 - DNA, 22 bp, Homo sapiens
tgagacaggacgtgggggagga

SEQ ID NO: 49346 - DNA, 22 bp, Homo sapiens
tgaatagaatctgtaatatagg

SEQ ID NO: 49347 - DNA, 21 bp, Homo sapiens
tgggacaggtgggaaagagga

SEQ ID NO: 49348 - DNA, 20 bp, Homo sapiens
gagcaatttgcaaaagggga

SEQ ID NO: 49349 - DNA, 23 bp, Homo sapiens
tgagacagaaaaacaagggagga

SEQ ID NO: 49350 - DNA, 21 bp, Homo sapiens
tgagtaggagccaaaagagga

SEQ ID NO: 49351 - DNA, 23 bp, Homo sapiens
tgggaaagaggactgggagagga

SEQ ID NO: 49352 - DNA, 23 bp, Homo sapiens
tgagggtagaggttcaggagagg

SEQ ID NO: 49353 - DNA, 22 bp, Homo sapiens
tgagatgggatctgtggggagg

SEQ ID NO: 49354 - DNA, 21 bp, Homo sapiens
tgaggaagaacacaaagagga

SEQ ID NO: 49355 - DNA, 18 bp, Homo sapiens
aggtagctgcacaaaagg

SEQ ID NO: 49356 - DNA, 18 bp, Homo sapiens
gagatggaatcaaagagg

SEQ ID NO: 49357 - DNA, 21 bp, Homo sapiens
tgggacagctccaaaagagga

SEQ ID NO: 49358 - DNA, 23 bp, Homo sapiens
tgaggaggattagtaaaagagga

SEQ ID NO: 49359 - DNA, 24 bp, Homo sapiens
tgaggtgagagcaagcaaagagga

SEQ ID NO: 49360 - DNA, 22 bp, Homo sapiens
tgagatcaattgtaaaggagga

SEQ ID NO: 49361 - DNA, 24 bp, Homo sapiens
tgggaaggaggcctgaggagagga

SEQ ID NO: 49362 - DNA, 24 bp, Homo sapiens
tgagataagggatgggggagagga

SEQ ID NO: 49363 - DNA, 18 bp, Homo sapiens
tgagctagagtcaagagg

SEQ ID NO: 49364 - DNA, 16 bp, Homo sapiens
tgagataggctgagag

SEQ ID NO: 49365 - DNA, 19 bp, Homo sapiens
tgaaatagatgatgagagg

SEQ ID NO: 49366 - DNA, 19 bp, Homo sapiens
tagaagccaagaaagagga

SEQ ID NO: 49367 - DNA, 24 bp, Homo sapiens
tgagataaagaggacaaaggggga

SEQ ID NO: 49368 - DNA, 23 bp, Homo sapiens
tgagacagaaagtataaggagga

SEQ ID NO: 49369 - DNA, 18 bp, Homo sapiens
cgagatggagaaaagagg

SEQ ID NO: 49370 - DNA, 62 bp, Cherry green ring mottle virus
gttaccttcatttctgctcacactgatcttcaagagatagttgggcctgatttgtacgtggc

SEQ ID NO: 49371 - DNA, 24 bp, Cherry green ring mottle virus
taccttcatttctgctcacactga

SEQ ID NO: 49372 - DNA, 18 bp, Homo sapiens
cttcacttctttcactga

SEQ ID NO: 49373 - DNA, 20 bp, Homo sapiens
cctttattcagccacactga

SEQ ID NO: 49374 - DNA, 15 bp, Homo sapiens
ttcatttctgcactg

SEQ ID NO: 49375 - DNA, 20 bp, Homo sapiens
acctccattgctcatgctga

SEQ ID NO: 49376 - DNA, 19 bp, Homo sapiens
ccttctgtcctcatgctga

SEQ ID NO: 49377 - DNA, 19 bp, Homo sapiens
taccttcattccattactg

SEQ ID NO: 49378 - DNA, 22 bp, Homo sapiens
tacatttatttccatacactga

SEQ ID NO: 49379 - DNA, 17 bp, Homo sapiens
cttcaggactcacactg

SEQ ID NO: 49380 - DNA, 20 bp, Homo sapiens
ctttatttctgctgctctga

SEQ ID NO: 49381 - DNA, 18 bp, Homo sapiens
ttcattcccctatactga

SEQ ID NO: 49382 - DNA, 19 bp, Homo sapiens
cccacactgcttacattga

SEQ ID NO: 49383 - DNA, 16 bp, Homo sapiens
ttcatttctgctcctg

SEQ ID NO: 49384 - DNA, 18 bp, Homo sapiens
tacctccatttagcactg

SEQ ID NO: 49385 - DNA, 17 bp, Homo sapiens
tcttccttctcacactg

SEQ ID NO: 49386 - DNA, 21 bp, Homo sapiens
cctcgtttaaatacacactga

SEQ ID NO: 49387 - DNA, 19 bp, Homo sapiens
ttcatttccacagcactga

SEQ ID NO: 49388 - DNA, 17 bp, Homo sapiens
ccttcaccttcacactg

SEQ ID NO: 49389 - DNA, 16 bp, Homo sapiens
cttcatttggccactg

SEQ ID NO: 49390 - DNA, 16 bp, Homo sapiens
ttcatttctgcctctg

SEQ ID NO: 49391 - DNA, 16 bp, Homo sapiens
cttcactctcacattg

SEQ ID NO: 49392 - DNA, 21 bp, Homo sapiens
actttcatttctgaaggctga

SEQ ID NO: 49393 - DNA, 24 bp, Homo sapiens
tacttttctttctgctgctgctga

SEQ ID NO: 49394 - DNA, 19 bp, Homo sapiens
cttcattcaaatacactga

SEQ ID NO: 49395 - DNA, 18 bp, Homo sapiens
atttcgtttaccacactg

SEQ ID NO: 49396 - DNA, 19 bp, Homo sapiens
cttcattttcctcacgctg

SEQ ID NO: 49397 - DNA, 18 bp, Homo sapiens
ctcatcatgtcacactga

SEQ ID NO: 49398 - DNA, 21 bp, Homo sapiens
ctttatttctgcccatcttga

SEQ ID NO: 49399 - DNA, 19 bp, Homo sapiens
ccggattctgttcacactg

SEQ ID NO: 49400 - DNA, 20 bp, Homo sapiens
cttctgtgtcgctcacactg

SEQ ID NO: 49401 - DNA, 24 bp, Homo sapiens
tactttcatttctgctatccctga

SEQ ID NO: 49402 - DNA, 21 bp, Homo sapiens
cctttgttacagtcacactga

SEQ ID NO: 49403 - DNA, 18 bp, Homo sapiens
ttcatttcttctgactga

SEQ ID NO: 49404 - DNA, 73 bp, Cherry green ring mottle virus
gagccttaggcctccaacggattttggcaagccattactgtttgcggctgccggcgtctctttggccctgctc

SEQ ID NO: 49405 - DNA, 24 bp, Cherry green ring mottle virus
ctgccggcgtctctttggccctgc

SEQ ID NO: 49406 - DNA, 21 bp, Homo sapiens
tgcccgcgtagcaggccctgc

SEQ ID NO: 49407 - DNA, 15 bp, Homo sapiens
ctgccggcgtggcct

SEQ ID NO: 49408 - DNA, 17 bp, Homo sapiens
ggcgtcttcccgcctgc

SEQ ID NO: 49409 - DNA, 19 bp, Homo sapiens
gtcccttttttggccctgc

SEQ ID NO: 49410 - DNA, 18 bp, Homo sapiens
ctgagcctttggtcctgc

SEQ ID NO: 49411 - DNA, 19 bp, Homo sapiens
ctgctggggtcttaacttg

SEQ ID NO: 49412 - DNA, 21 bp, Homo sapiens
ctgcacggcgaagtggctctg

SEQ ID NO: 49413 - DNA, 23 bp, Homo sapiens
ctgttagcgtcagcccagccctg

SEQ ID NO: 49414 - DNA, 20 bp, Homo sapiens
tgtcagcgtctctaggctgc

SEQ ID NO: 49415 - DNA, 23 bp, Homo sapiens
ctgccggcctctcccacttctgc

SEQ ID NO: 49416 - DNA, 18 bp, Homo sapiens
tgctggctcttggccctg

SEQ ID NO: 49417 - DNA, 26 bp, Homo sapiens
ctgccggcgtcttcttctcctcctgc

SEQ ID NO: 49418 - DNA, 21 bp, Homo sapiens
tgctggtgtctcttttgaggc

SEQ ID NO: 49419 - DNA, 25 bp, Homo sapiens
ctgctggcttctccccgatgtcctg

SEQ ID NO: 49420 - DNA, 20 bp, Homo sapiens
tgccgcgcacgatggccttg

SEQ ID NO: 49421 - DNA, 20 bp, Homo sapiens
ctgctgctgtttcttcgtgc

SEQ ID NO: 49422 - DNA, 20 bp, Homo sapiens
cggcgtctcggcggctctgc

SEQ ID NO: 49423 - DNA, 18 bp, Homo sapiens
ctgctggagtctcttcct

SEQ ID NO: 49424 - DNA, 18 bp, Homo sapiens
ctgctggttccagccctg

SEQ ID NO: 49425 - DNA, 15 bp, Homo sapiens
ggctctctctacctg

SEQ ID NO: 49426 - DNA, 19 bp, Homo sapiens
cagctgtgctttggccctg

SEQ ID NO: 49427 - DNA, 17 bp, Homo sapiens
cggcgtctctatcctgc

SEQ ID NO: 49428 - DNA, 20 bp, Homo sapiens
ctgccggcttctgcttttgc

SEQ ID NO: 49429 - DNA, 22 bp, Homo sapiens
ctgctggggttccagggccctg

SEQ ID NO: 49430 - DNA, 21 bp, Homo sapiens
ctgccggctttcagccgcctg

SEQ ID NO: 49431 - DNA, 22 bp, Homo sapiens
ctgagcctctttttggccttgc

SEQ ID NO: 49432 - DNA, 97 bp, Alcelaphine herpesvirus 1
atggcacttaaaattgactgttcaaccctactccaagttctcttgcttgttttggcaagagttatggagcagcctaatagtttaacttatgagtcat

SEQ ID NO: 49433 - DNA, 24 bp, Alcelaphine herpesvirus 1
atggagcagcctaatagtttaact

SEQ ID NO: 49434 - DNA, 17 bp, Homo sapiens
tggagcagcccgtagtt

SEQ ID NO: 49435 - DNA, 17 bp, Homo sapiens
tggagcagctctaagtt

SEQ ID NO: 49436 - DNA, 19 bp, Homo sapiens
atggagcaacctaggagct

SEQ ID NO: 49437 - DNA, 21 bp, Homo sapiens
atgaagcagtctgatgggtct

SEQ ID NO: 49438 - DNA, 17 bp, Homo sapiens
atggggcagcctaatgc

SEQ ID NO: 49439 - DNA, 15 bp, Homo sapiens
atggagccagtttaa

SEQ ID NO: 49440 - DNA, 17 bp, Homo sapiens
tggggcagcccagagtt

SEQ ID NO: 49441 - DNA, 19 bp, Homo sapiens
atggagcacctggcagaac

SEQ ID NO: 49442 - DNA, 23 bp, Homo sapiens
atgaagcagcaacattagtttaa

SEQ ID NO: 49443 - DNA, 61 bp, Ovine adenovirus A
aagatctctaacaaaaagctgtctttaccacaagcaagagagtcagctgcaaagaactctt

SEQ ID NO: 49444 - DNA, 24 bp, Ovine adenovirus A
tctctaacaaaaagctgtctttac

SEQ ID NO: 49445 - DNA, 18 bp, Homo sapiens
ctctggaaagctgtcttt

SEQ ID NO: 49446 - DNA, 21 bp, Homo sapiens
tctctattagaaagccgcttt

SEQ ID NO: 49447 - DNA, 19 bp, Homo sapiens
tctccaacaattgtcttta

SEQ ID NO: 49448 - DNA, 17 bp, Homo sapiens
tctctacaaaaagcagt

SEQ ID NO: 49449 - DNA, 18 bp, Homo sapiens
aacaaaaaactgatttta

SEQ ID NO: 49450 - DNA, 23 bp, Homo sapiens
tccaacaagaagccataacttta

SEQ ID NO: 49451 - DNA, 18 bp, Homo sapiens
tccccaaagctgttttta

SEQ ID NO: 49452 - DNA, 18 bp, Homo sapiens
tctctgacagtgccttta

SEQ ID NO: 49453 - DNA, 16 bp, Homo sapiens
taacaaaaatgtcttt

SEQ ID NO: 49454 - DNA, 18 bp, Homo sapiens
tctaacatgctatcttta

SEQ ID NO: 49455 - DNA, 18 bp, Homo sapiens
tctctacagaagccttta

SEQ ID NO: 49456 - DNA, 20 bp, Homo sapiens
tctctagagaaactatcttt

SEQ ID NO: 49457 - DNA, 25 bp, Homo sapiens
tctctaacaaaaatgccacacatac

SEQ ID NO: 49458 - DNA, 18 bp, Homo sapiens
taacaaaaacctgtttta

SEQ ID NO: 49459 - DNA, 18 bp, Homo sapiens
tctctgccagtgtcttta

SEQ ID NO: 49460 - DNA, 17 bp, Homo sapiens
tcctaactctgtcttta

SEQ ID NO: 49461 - DNA, 21 bp, Homo sapiens
tctctaacatgagttgtttta

SEQ ID NO: 49462 - DNA, 20 bp, Homo sapiens
tctaacaggccaatctttac

SEQ ID NO: 49463 - DNA, 23 bp, Homo sapiens
tctttacaaaacactgtctttac

SEQ ID NO: 49464 - DNA, 16 bp, Homo sapiens
tctctaacctgtcttt

SEQ ID NO: 49465 - DNA, 17 bp, Homo sapiens
tcttacacctgtcttta

SEQ ID NO: 49466 - DNA, 18 bp, Homo sapiens
tctaacaaagagcagcct

SEQ ID NO: 49467 - DNA, 17 bp, Homo sapiens
tctctacagaaagctat

SEQ ID NO: 49468 - DNA, 21 bp, Homo sapiens
tctctaataaatgtgccttta

SEQ ID NO: 49469 - DNA, 64 bp, Bovine adenovirus D
tgtttcttttcaaaatgtgttgcagctagtttccatttaccagttaaaagacaaaaaggagata

SEQ ID NO: 49470 - DNA, 21 bp, Bovine adenovirus D
ttaaaagacaaaaaggagata

SEQ ID NO: 49471 - DNA, 21 bp, Homo sapiens
ttaaaagaaaaaaaaaaagat

SEQ ID NO: 49472 - DNA, 15 bp, Homo sapiens
ttaaaagacaaagag

SEQ ID NO: 49473 - DNA, 15 bp, Homo sapiens
tcaaaagacagagat

SEQ ID NO: 49474 - DNA, 20 bp, Homo sapiens
ttaaaaaataaaaggaaata

SEQ ID NO: 49475 - DNA, 15 bp, Homo sapiens
ctaaaagacaaggaa

SEQ ID NO: 49476 - DNA, 17 bp, Homo sapiens
ttaaaagaaaagaggag

SEQ ID NO: 49477 - DNA, 21 bp, Homo sapiens
ttaaaaaataaaaagaaaata

SEQ ID NO: 49478 - DNA, 22 bp, Homo sapiens
taaaagacaggaaaagagagat

SEQ ID NO: 49479 - DNA, 15 bp, Homo sapiens
tcaaaagacaggaga

SEQ ID NO: 49480 - DNA, 21 bp, Homo sapiens
ttaaaagaaaactaaggagat

SEQ ID NO: 49481 - DNA, 17 bp, Homo sapiens
aaagacaagaaaagata

SEQ ID NO: 49482 - DNA, 15 bp, Homo sapiens
tcaaaagacaggaaa

SEQ ID NO: 49483 - DNA, 21 bp, Homo sapiens
ttaaaagaccaagaaaagata

SEQ ID NO: 49484 - DNA, 18 bp, Homo sapiens
ctaaaagacaaggaagag

SEQ ID NO: 49485 - DNA, 18 bp, Homo sapiens
ttaaaatacaaggagata

SEQ ID NO: 49486 - DNA, 21 bp, Homo sapiens
ttaacagacaaagaagaaata

SEQ ID NO: 49487 - DNA, 20 bp, Homo sapiens
ttaaaaaacaaaagaaaata

SEQ ID NO: 49488 - DNA, 16 bp, Homo sapiens
ttaaaagacagaggaa

SEQ ID NO: 49489 - DNA, 19 bp, Homo sapiens
tcaagagacaggaaagaag

SEQ ID NO: 49490 - DNA, 18 bp, Homo sapiens
ctaaaagacagaagggag

SEQ ID NO: 49491 - DNA, 18 bp, Homo sapiens
aaaaacaaagagaaaata

SEQ ID NO: 49492 - DNA, 18 bp, Homo sapiens
ttaaaaaacaagggaaat

SEQ ID NO: 49493 - DNA, 23 bp, Homo sapiens
tcaaaaaaatacaaaaggagata

SEQ ID NO: 49494 - DNA, 18 bp, Homo sapiens
gacataaaaaaggagata

SEQ ID NO: 49495 - DNA, 20 bp, Homo sapiens
ttaaaagacaaaggaagaga

SEQ ID NO: 49496 - DNA, 15 bp, Homo sapiens
taaaagacaggaaat

SEQ ID NO: 49497 - DNA, 19 bp, Homo sapiens
ttaggagacagcagaagat

SEQ ID NO: 49498 - DNA, 20 bp, Homo sapiens
tcaagggacaggaaggagat

SEQ ID NO: 49499 - DNA, 19 bp, Homo sapiens
taaaagacaattgtagata

SEQ ID NO: 49500 - DNA, 18 bp, Homo sapiens
ttaaaagacaaggaaata

SEQ ID NO: 49501 - DNA, 20 bp, Homo sapiens
tcaaaagacaaagagaaaat

SEQ ID NO: 49502 - DNA, 18 bp, Homo sapiens
agacaaagaaaaggagat

SEQ ID NO: 49503 - DNA, 21 bp, Homo sapiens
ttaaaagctccccaggagata

SEQ ID NO: 49504 - DNA, 17 bp, Homo sapiens
aaaaacagaagaagata

SEQ ID NO: 49505 - DNA, 20 bp, Homo sapiens
tcaaaggacaggaaggagat

SEQ ID NO: 49506 - DNA, 15 bp, Homo sapiens
ttaaaagacagagac

SEQ ID NO: 49507 - DNA, 21 bp, Homo sapiens
ttaaaaaacaaagtcaagata

SEQ ID NO: 49508 - DNA, 20 bp, Homo sapiens
ttaaaagagcaaaagaaata

SEQ ID NO: 49509 - DNA, 78 bp, Bovine adenovirus D
ctttacacactttatagaacagggaaatttacatttacaagtaatatttcccttcaacagtctttgaaaagtgtacag

SEQ ID NO: 49510 - DNA, 24 bp, Bovine adenovirus D
tagaacagggaaatttacatttac

SEQ ID NO: 49511 - DNA, 22 bp, Homo sapiens
tagagtcacagtttacatttac

SEQ ID NO: 49512 - DNA, 20 bp, Homo sapiens
tagaacaagggaaacattta

SEQ ID NO: 49513 - DNA, 20 bp, Homo sapiens
acaaagaaaatttacattta

SEQ ID NO: 49514 - DNA, 19 bp, Homo sapiens
aaacagggaaataaattac

SEQ ID NO: 49515 - DNA, 18 bp, Homo sapiens
aggagaaatttacattta

SEQ ID NO: 49516 - DNA, 21 bp, Homo sapiens
aactaggaaatttgcatttac

SEQ ID NO: 49517 - DNA, 19 bp, Homo sapiens
tagagcagtgaaacattta

SEQ ID NO: 49518 - DNA, 24 bp, Homo sapiens
agaacagggaggtctcacagttta

SEQ ID NO: 49519 - DNA, 18 bp, Homo sapiens
taggagggtttacattta

SEQ ID NO: 49520 - DNA, 19 bp, Homo sapiens
gaatagggaaattcatcat

SEQ ID NO: 49521 - DNA, 17 bp, Homo sapiens
acagggaagcacattta

SEQ ID NO: 49522 - DNA, 15 bp, Homo sapiens
caggatttacattta

SEQ ID NO: 49523 - DNA, 60 bp, Human herpesvirus 8
gccaggtttccattgccacccgggcgaaaacaagccgggtagtttcaggggtcatctggc

SEQ ID NO: 49524 - DNA, 24 bp, Human herpesvirus 8
tttccattgccacccgggcgaaaa

SEQ ID NO: 49525 - DNA, 21 bp, Homo sapiens
tttccattttattcagccggg

SEQ ID NO: 49526 - DNA, 23 bp, Homo sapiens
tttctaggaggacccgggcgaaa

SEQ ID NO: 49527 - DNA, 23 bp, Homo sapiens
tttccatttgttacacaaggaaa

SEQ ID NO: 49528 - DNA, 25 bp, Homo sapiens
ttcccattgtcatttccatgtaaaa

SEQ ID NO: 49529 - DNA, 20 bp, Homo sapiens
cactgccacttccatgaaaa

SEQ ID NO: 49530 - DNA, 19 bp, Homo sapiens
tttccatctgctgggggcg

SEQ ID NO: 49531 - DNA, 20 bp, Homo sapiens
tttccattggcaacagcggg

SEQ ID NO: 49532 - DNA, 19 bp, Homo sapiens
tttccattttactcagcaa

SEQ ID NO: 49533 - DNA, 20 bp, Homo sapiens
tttccattccattcatgaaa

SEQ ID NO: 49534 - DNA, 24 bp, Homo sapiens
cattgccacccccagtagtgggga

SEQ ID NO: 49535 - DNA, 21 bp, Homo sapiens
tttccattccatctagcaaaa

SEQ ID NO: 49536 - DNA, 25 bp, Homo sapiens
tttctgttcccacttttagtgaaaa

SEQ ID NO: 49537 - DNA, 20 bp, Homo sapiens
tttctgttaccacctgaggg

SEQ ID NO: 49538 - DNA, 23 bp, Homo sapiens
tctccattgtaaaatggcgaaaa

SEQ ID NO: 49539 - DNA, 24 bp, Homo sapiens
tttccattctcatttcctagtgaa

SEQ ID NO: 49540 - DNA, 16 bp, Homo sapiens
tttcttgccacccgaa

SEQ ID NO: 49541 - DNA, 19 bp, Homo sapiens
tctctgttgccacccgcgg

SEQ ID NO: 49542 - DNA, 19 bp, Homo sapiens
ttcccattgctgtcctgga

SEQ ID NO: 49543 - DNA, 24 bp, Homo sapiens
cttccattcctctccgggtggaaa

SEQ ID NO: 49544 - DNA, 22 bp, Homo sapiens
tttccattcccatcctatagaa

SEQ ID NO: 49545 - DNA, 18 bp, Homo sapiens
tttccattactaccagga

SEQ ID NO: 49546 - DNA, 25 bp, Homo sapiens
tctccgttgctgcctccttagaggg

SEQ ID NO: 49547 - DNA, 17 bp, Homo sapiens
ttcccagtcccgggcga

SEQ ID NO: 49548 - DNA, 18 bp, Homo sapiens
ttctcattgccacccaaa

SEQ ID NO: 49549 - DNA, 18 bp, Homo sapiens
tttccacttgctgccaag

SEQ ID NO: 49550 - DNA, 22 bp, Homo sapiens
tttccatttcaaacaagtgaaa

SEQ ID NO: 49551 - DNA, 19 bp, Homo sapiens
tttccattgtgatgaacga

SEQ ID NO: 49552 - DNA, 21 bp, Homo sapiens
tttccattcccaccgcggccg

SEQ ID NO: 49553 - DNA, 24 bp, Homo sapiens
tttccattgtcttgcccatgggga

SEQ ID NO: 49554 - DNA, 25 bp, Homo sapiens
tctccattgtcataaaagctgaaaa

SEQ ID NO: 49555 - DNA, 21 bp, Homo sapiens
ttccaccaggccttgggtgaa

SEQ ID NO: 49556 - DNA, 19 bp, Homo sapiens
tttccattttacaagctga

SEQ ID NO: 49557 - DNA, 22 bp, Homo sapiens
tttccattgctgctgtaacaaa

SEQ ID NO: 49558 - DNA, 19 bp, Homo sapiens
tctccattgccatcaggga

SEQ ID NO: 49559 - DNA, 21 bp, Homo sapiens
tttccattcctcaggtgggga

SEQ ID NO: 49560 - DNA, 103 bp, Bovine adenovirus D
acatgataagacaattcgtgaattccatttaagtgaacagccaagttttgtacaaaatgccacatgttccttaaaagctgtttaagaatggaaaccttcatgt

SEQ ID NO: 49561 - DNA, 24 bp, Bovine adenovirus D
taagtgaacagccaagttttgtac

SEQ ID NO: 49562 - DNA, 23 bp, Homo sapiens
taagtgaacacttaaaactgtac

SEQ ID NO: 49563 - DNA, 20 bp, Homo sapiens
aggggacagccaagccaggc

SEQ ID NO: 49564 - DNA, 19 bp, Homo sapiens
gtgaggagtcaggctctgc

SEQ ID NO: 49565 - DNA, 23 bp, Homo sapiens
taaggaacctggaggttttgtac

SEQ ID NO: 49566 - DNA, 19 bp, Homo sapiens
taagtgaatgcctgaaagt

SEQ ID NO: 49567 - DNA, 18 bp, Homo sapiens
gtgggcagccagctctgt

SEQ ID NO: 49568 - DNA, 20 bp, Homo sapiens
agtgagtagccaagccaggc

SEQ ID NO: 49569 - DNA, 22 bp, Homo sapiens
aagtgaacagttaatcacttat

SEQ ID NO: 49570 - DNA, 20 bp, Homo sapiens
gtggcagccaagcgacatgt

SEQ ID NO: 49571 - DNA, 18 bp, Homo sapiens
gtaaacagttaagtcagc

SEQ ID NO: 49572 - DNA, 21 bp, Homo sapiens
agtaaacagccgggctggtgc

SEQ ID NO: 49573 - DNA, 17 bp, Homo sapiens
gtgaaagccaagcccca

SEQ ID NO: 49574 - DNA, 18 bp, Homo sapiens
aggagaaaccagttttgt

SEQ ID NO: 49575 - DNA, 20 bp, Homo sapiens
taagtgatggccagtcctgc

SEQ ID NO: 49576 - DNA, 86 bp, Human herpesvirus 7
tttttcctctgtttttgcttgacgttcaaattttgggtcgtctttaacctgctcttgacttaaataagcttctacggtcagaaaaa

SEQ ID NO: 49577 - DNA, 24 bp, Human herpesvirus 7
cctctgtttttgcttgacgttcaa

SEQ ID NO: 49578 - DNA, 19 bp, Homo sapiens
tgttttgcttttcattcaa

SEQ ID NO: 49579 - DNA, 20 bp, Homo sapiens
tctgttcttgctcctcttca

SEQ ID NO: 49580 - DNA, 17 bp, Homo sapiens
cctctgttttttttgac

SEQ ID NO: 49581 - DNA, 19 bp, Homo sapiens
cctgtttttgtttgtttcc

SEQ ID NO: 49582 - DNA, 23 bp, Homo sapiens
cctctgttttctgctactcagtt

SEQ ID NO: 49583 - DNA, 18 bp, Homo sapiens
tctgtttttattcccatt

SEQ ID NO: 49584 - DNA, 20 bp, Homo sapiens
tctatttttgtatgtttcaa

SEQ ID NO: 49585 - DNA, 22 bp, Homo sapiens
cctcgttttgcaaaatgttcaa

SEQ ID NO: 49586 - DNA, 22 bp, Homo sapiens
cctctgttttttagaaattcaa

SEQ ID NO: 49587 - DNA, 17 bp, Homo sapiens
tgtttttgctttcccca

SEQ ID NO: 49588 - DNA, 24 bp, Homo sapiens
cctttgttttgctgctttgttcaa

SEQ ID NO: 49589 - DNA, 20 bp, Homo sapiens
ctctgtttggggaatgttca

SEQ ID NO: 49590 - DNA, 19 bp, Homo sapiens
tttttagcctgacgttcaa

SEQ ID NO: 49591 - DNA, 19 bp, Homo sapiens
tctgttttttttgcattca

SEQ ID NO: 49592 - DNA, 19 bp, Homo sapiens
cctctagtttttggtttga

SEQ ID NO: 49593 - DNA, 18 bp, Homo sapiens
tctgcttttgcttgctca

SEQ ID NO: 49594 - DNA, 18 bp, Homo sapiens
tcggtttttgcttgcaca

SEQ ID NO: 49595 - DNA, 22 bp, Homo sapiens
ccttgttttttgctctgttcaa

SEQ ID NO: 49596 - DNA, 24 bp, Homo sapiens
cctctgtctttgctgctactttca

SEQ ID NO: 49597 - DNA, 23 bp, Homo sapiens
ctttgattttgctttttattcaa

SEQ ID NO: 49598 - DNA, 20 bp, Homo sapiens
tctgtctttgtgattcttca

SEQ ID NO: 49599 - DNA, 22 bp, Homo sapiens
cctctaattcttgcttggcgtt

SEQ ID NO: 49600 - DNA, 18 bp, Homo sapiens
ctctgtttgagatgttca

SEQ ID NO: 49601 - DNA, 19 bp, Homo sapiens
tctgtttttcttgatttca

SEQ ID NO: 49602 - DNA, 21 bp, Homo sapiens
cctttgtttttgtttgtgtcc

SEQ ID NO: 49603 - DNA, 18 bp, Homo sapiens
tctgtttttgcttacatt

SEQ ID NO: 49604 - DNA, 20 bp, Homo sapiens
tcggttttctcctgtgttca

SEQ ID NO: 49605 - DNA, 19 bp, Homo sapiens
tctgatcttgcttgatgtt

SEQ ID NO: 49606 - DNA, 19 bp, Homo sapiens
tctgtttttatcttgagtt

SEQ ID NO: 49607 - DNA, 18 bp, Homo sapiens
ctcttttttgctctttca

SEQ ID NO: 49608 - DNA, 18 bp, Homo sapiens
cctgccacccttgacgtt

SEQ ID NO: 49609 - DNA, 17 bp, Homo sapiens
tgtttttgctggctcaa

SEQ ID NO: 49610 - DNA, 20 bp, Homo sapiens
tctgtttttgcctgaccccc

SEQ ID NO: 49611 - DNA, 21 bp, Homo sapiens
ctttgattttgctcttctcaa

SEQ ID NO: 49612 - DNA, 18 bp, Homo sapiens
cccttgccttggcgttca

SEQ ID NO: 49613 - DNA, 19 bp, Homo sapiens
cctttatttttgctgatca

SEQ ID NO: 49614 - DNA, 18 bp, Homo sapiens
cctctgtttctaacactg

SEQ ID NO: 49615 - DNA, 19 bp, Homo sapiens
attctcagcttggcgttca

SEQ ID NO: 49616 - DNA, 77 bp, Human herpesvirus 7
ggagcaagccattttaaaatctccgttacagttgaatggtccaagtctattcgaagtgcagattttccgctttctct

SEQ ID NO: 49617 - DNA, 24 bp, Human herpesvirus 7
ttcgaagtgcagattttccgcttt

SEQ ID NO: 49618 - DNA, 22 bp, Homo sapiens
gaattgcagattctagagcttt

SEQ ID NO: 49619 - DNA, 15 bp, Homo sapiens
aagtgcaaactgctt

SEQ ID NO: 49620 - DNA, 21 bp, Homo sapiens
gaggtgcagatagcttgcttt

SEQ ID NO: 49621 - DNA, 22 bp, Homo sapiens
ttcttggtagattttctgcttt

SEQ ID NO: 49622 - DNA, 17 bp, Homo sapiens
ttctagcaaattttccg

SEQ ID NO: 49623 - DNA, 20 bp, Homo sapiens
gaaatgcaatagctcgcttt

SEQ ID NO: 49624 - DNA, 105 bp, Melanoplus sanguinipes entomopoxvirus
gcctaaattattatctaaaatagcataaggtgggtaagctgtatataatatatcacattgttgaatatgatttcttatttctttatcatttttattaatataggc

SEQ ID NO: 49625 - DNA, 24 bp, Melanoplus sanguinipes entomopoxvirus
tctaaaatagcataaggtgggtaa

SEQ ID NO: 49626 - DNA, 18 bp, Homo sapiens
tctaggatagcacagtag

SEQ ID NO: 49627 - DNA, 19 bp, Homo sapiens
acagcatgggggtgggtaa

SEQ ID NO: 49628 - DNA, 21 bp, Homo sapiens
tctaaagtgacataagaatgg

SEQ ID NO: 49629 - DNA, 18 bp, Homo sapiens
taaaatggcacagaatga

SEQ ID NO: 49630 - DNA, 21 bp, Homo sapiens
taaaatagcatattttagtga

SEQ ID NO: 49631 - DNA, 23 bp, Homo sapiens
tctaaaatatatgctcaaagtaa

SEQ ID NO: 49632 - DNA, 19 bp, Homo sapiens
tctaagatagctgtaaggc

SEQ ID NO: 49633 - DNA, 21 bp, Homo sapiens
taaaatagcaagttcaggtga

SEQ ID NO: 49634 - DNA, 21 bp, Homo sapiens
taaaataagcatttaaggtaa

SEQ ID NO: 49635 - DNA, 22 bp, Homo sapiens
tctgagaggacatgggtgggta

SEQ ID NO: 49636 - DNA, 20 bp, Homo sapiens
tctaaagaagcataagctaa

SEQ ID NO: 49637 - DNA, 17 bp, Homo sapiens
tctgaaatagcacggta

SEQ ID NO: 49638 - DNA, 19 bp, Homo sapiens
tctggggagcagatgggta

SEQ ID NO: 49639 - DNA, 22 bp, Homo sapiens
tctaacatagcatatgaggtga

SEQ ID NO: 49640 - DNA, 16 bp, Homo sapiens
aaacagtaaggtgggt

SEQ ID NO: 49641 - DNA, 20 bp, Homo sapiens
caaaatagttacgtgggtaa

SEQ ID NO: 49642 - DNA, 20 bp, Homo sapiens
taaaatagcattgtatgtga

SEQ ID NO: 49643 - DNA, 19 bp, Homo sapiens
taaaataggaggtgggtaa

SEQ ID NO: 49644 - DNA, 23 bp, Homo sapiens
tctgacgatagggaaggtgggta

SEQ ID NO: 49645 - DNA, 18 bp, Homo sapiens
taaaatagcctgagatga

SEQ ID NO: 49646 - DNA, 20 bp, Homo sapiens
tctaaggtagaccttgggta

SEQ ID NO: 49647 - DNA, 23 bp, Homo sapiens
tctggggtagctcacatgggtaa

SEQ ID NO: 49648 - DNA, 16 bp, Homo sapiens
tctgaaatagcagggc

SEQ ID NO: 49649 - DNA, 21 bp, Homo sapiens
taaaaagaccataggtgggta

SEQ ID NO: 49650 - DNA, 20 bp, Homo sapiens
tctaaaatggcattagataa

SEQ ID NO: 49651 - DNA, 17 bp, Homo sapiens
tctaaagagcataaaat

SEQ ID NO: 49652 - DNA, 16 bp, Homo sapiens
tctaaaatagctgaat

SEQ ID NO: 49653 - DNA, 19 bp, Homo sapiens
taaattagacagtgggtaa

SEQ ID NO: 49654 - DNA, 22 bp, Homo sapiens
tctagaagccttgggtgggtaa

SEQ ID NO: 49655 - DNA, 18 bp, Homo sapiens
taaaatggcataagttga

SEQ ID NO: 49656 - DNA, 24 bp, Homo sapiens
cctaaaatgtagattaaggtgggt

SEQ ID NO: 49657 - DNA, 18 bp, Homo sapiens
taaaatagcaaaacagat

SEQ ID NO: 49658 - DNA, 16 bp, Homo sapiens
tctaaaatgcgtgagc

SEQ ID NO: 49659 - DNA, 21 bp, Homo sapiens
tctaaagtagcaatggaagta

SEQ ID NO: 49660 - DNA, 18 bp, Homo sapiens
taaaatagcataacctag

SEQ ID NO: 49661 - DNA, 17 bp, Homo sapiens
taaaatggctaaaatgg

SEQ ID NO: 49662 - DNA, 90 bp, Macaca mulatta rhadinovirus
cgatatagtacgcgcctgccgggagaaacatcccctgaaccgcgggggtgaccgtatactatgtttcctagagccgtgcgtaccatgtcg

SEQ ID NO: 49663 - DNA, 24 bp, Macaca mulatta rhadinovirus
tagtacgcgcctgccgggagaaac

SEQ ID NO: 49664 - DNA, 18 bp, Homo sapiens
tagtacgctctgtcatga

SEQ ID NO: 49665 - DNA, 16 bp, Homo sapiens
gtgcgcgcctggggag

SEQ ID NO: 49666 - DNA, 21 bp, Homo sapiens
gtgcacgcctgtaatcccaga

SEQ ID NO: 49667 - DNA, 19 bp, Homo sapiens
gcgcctgccagaggggaga

SEQ ID NO: 49668 - DNA, 22 bp, Homo sapiens
gtgcgcgcctgtccggcgggag

SEQ ID NO: 49669 - DNA, 77 bp, Melanoplus sanguinipes entomopoxvirus
aatataacattatcaatattatcaatattatcaaaaaaatttgatataatattatgatcatgtaatggtgttatatt

SEQ ID NO: 49670 - DNA, 24 bp, Melanoplus sanguinipes entomopoxvirus
tataacattatcaatattatcaat

SEQ ID NO: 49671 - DNA, 19 bp, Homo sapiens
aacattatcagctatcaat

SEQ ID NO: 49672 - DNA, 17 bp, Homo sapiens
aacattatcaatgctca

SEQ ID NO: 49673 - DNA, 68 bp, Human herpesvirus 5
tccccgtgggctccacgcgttttccaccctttcctggaggggtccggaacaccgtgaatccacgggga

SEQ ID NO: 49674 - DNA, 21 bp, Human herpesvirus 5
aacaccgtgaatccacgggga

SEQ ID NO: 49675 - DNA, 20 bp, Homo sapiens
acaccgtttattccacgggg

SEQ ID NO: 49676 - DNA, 18 bp, Homo sapiens
accgtgggaccacgggga

SEQ ID NO: 49677 - DNA, 18 bp, Homo sapiens
aacacagcagcacgggga

SEQ ID NO: 49678 - DNA, 17 bp, Homo sapiens
caccgtgaattgcaggg

SEQ ID NO: 49679 - DNA, 16 bp, Homo sapiens
aacacacaccacgggg

SEQ ID NO: 49680 - DNA, 18 bp, Homo sapiens
aacaccgtgaacaccagg

SEQ ID NO: 49681 - DNA, 17 bp, Homo sapiens
accatgaatacactgga

SEQ ID NO: 49682 - DNA, 19 bp, Homo sapiens
acagtgacctccacgggga

SEQ ID NO: 49683 - DNA, 16 bp, Homo sapiens
acacgtgcccacgggg

SEQ ID NO: 49684 - DNA, 18 bp, Homo sapiens
catgactgtccacgggga

SEQ ID NO: 49685 - DNA, 20 bp, Homo sapiens
aacacctgtggacacaggga

SEQ ID NO: 49686 - DNA, 17 bp, Homo sapiens
caccatgaataaaagga

SEQ ID NO: 49687 - DNA, 19 bp, Homo sapiens
aacactgagcccttgggga

SEQ ID NO: 49688 - DNA, 15 bp, Homo sapiens
aacagcgccacgggg

SEQ ID NO: 49689 - DNA, 19 bp, Homo sapiens
acgccggagcccacgggga

SEQ ID NO: 49690 - DNA, 16 bp, Homo sapiens
caccgtaatcccggga

SEQ ID NO: 49691 - DNA, 20 bp, Homo sapiens
catcgtcaaatccgtgggga

SEQ ID NO: 49692 - DNA, 15 bp, Homo sapiens
cacctgcccacgggg

SEQ ID NO: 49693 - DNA, 18 bp, Homo sapiens
aacactctgaatccaggg

SEQ ID NO: 49694 - DNA, 17 bp, Homo sapiens
aacacttgaatccagga

SEQ ID NO: 49695 - DNA, 24 bp, Homo sapiens
cactgtgaatctcgtattggggat

SEQ ID NO: 49696 - DNA, 18 bp, Homo sapiens
ccgcgaacgcaggcgggg

SEQ ID NO: 49697 - DNA, 18 bp, Homo sapiens
caccgtgaccgcccgggg

SEQ ID NO: 49698 - DNA, 18 bp, Homo sapiens
acctgaatccaacaggga

SEQ ID NO: 49699 - DNA, 16 bp, Homo sapiens
aacagtgaacacgggg

SEQ ID NO: 49700 - DNA, 17 bp, Homo sapiens
acatatgaacacgggga

SEQ ID NO: 49701 - DNA, 18 bp, Homo sapiens
acagccggctccacgggg

SEQ ID NO: 49702 - DNA, 18 bp, Homo sapiens
acactgtgaacacaggga

SEQ ID NO: 49703 - DNA, 20 bp, Homo sapiens
aacaccatgagcgctgggga

SEQ ID NO: 49704 - DNA, 17 bp, Homo sapiens
acaccatgaccatgggg

SEQ ID NO: 49705 - DNA, 17 bp, Homo sapiens
cacctaaccccacgggg

SEQ ID NO: 49706 - DNA, 16 bp, Homo sapiens
cacagttccacgggga

SEQ ID NO: 49707 - DNA, 16 bp, Homo sapiens
cactgtcccacgggga

SEQ ID NO: 49708 - DNA, 18 bp, Homo sapiens
gcgaagggtccacgggga

SEQ ID NO: 49709 - DNA, 19 bp, Homo sapiens
accactcttcccacgggga

SEQ ID NO: 49710 - DNA, 20 bp, Homo sapiens
acaccgtgcagtcatcacga

SEQ ID NO: 49711 - DNA, 19 bp, Homo sapiens
aacattgggaacacaggga

SEQ ID NO: 49712 - DNA, 17 bp, Homo sapiens
aaccctgtgaattggga

SEQ ID NO: 49713 - DNA, 21 bp, Homo sapiens
acaccgcggcttccgcgggga

SEQ ID NO: 49714 - DNA, 17 bp, Homo sapiens
aacaccgtggactgggg

SEQ ID NO: 49715 - DNA, 19 bp, Homo sapiens
ggacctgttgccacgggga

SEQ ID NO: 49716 - DNA, 131 bp, Human herpesvirus 5
agtctggccgagcggcgccatcttggaggaggggcgagtcgcgggcaccgcctcggtaccccctggccgaggcgagtccgcggtcgccgcctgttccgtgatgctacctagagggcgctgtcgaggcgact

SEQ ID NO: 49717 - DNA, 24 bp, Human herpesvirus 5
cgagtccgcggtcgccgcctgttc

SEQ ID NO: 49718 - DNA, 22 bp, Homo sapiens
cgagctcaacagctgcctgttc

SEQ ID NO: 49719 - DNA, 21 bp, Homo sapiens
cgagtttccgatgcgcctgtt

SEQ ID NO: 49720 - DNA, 24 bp, Homo sapiens
cgggctctgcggagcagcctgttc

SEQ ID NO: 49721 - DNA, 24 bp, Homo sapiens
gagtccgctgtcgcccagcaggtt

SEQ ID NO: 49722 - DNA, 19 bp, Homo sapiens
gccgctccccccgcctgtt

SEQ ID NO: 49723 - DNA, 17 bp, Homo sapiens
cgggtccgcggtcctgc

SEQ ID NO: 49724 - DNA, 20 bp, Homo sapiens
agccgcgttgctgcctgttc

SEQ ID NO: 49725 - DNA, 22 bp, Homo sapiens
gagtctgggggatgccctgttc

SEQ ID NO: 49726 - DNA, 72 bp, Human herpesvirus 5
tctcgacggttctctcgctcgtcatgccgttctgagctccgacatggcggacgagagaaaatggcgtcgaga

SEQ ID NO: 49727 - DNA, 24 bp, Human herpesvirus 5
gacggttctctcgctcgtcatgcc

SEQ ID NO: 49728 - DNA, 18 bp, Homo sapiens
acggttctctcctcgtgc

SEQ ID NO: 49729 - DNA, 19 bp, Homo sapiens
ggtctctcgctgcagttgc

SEQ ID NO: 49730 - DNA, 15 bp, Homo sapiens
ggttctctcctgtgc

SEQ ID NO: 49731 - DNA, 22 bp, Homo sapiens
gacggttccctccgcccatgtc

SEQ ID NO: 49732 - DNA, 20 bp, Homo sapiens
cggttctccgctccgcaacc

SEQ ID NO: 49733 - DNA, 92 bp, Variola virus
aatttatcgattagtcttaatgatacactaagtatatacacagaatcagaacctgtgtttatagtggatccattcattactcttgataaatt

SEQ ID NO: 49734 - DNA, 24 bp, Variola virus
tttatagtggatccattcattact

SEQ ID NO: 49735 - DNA, 23 bp, Homo sapiens
tttacatgcatccattcattact

SEQ ID NO: 49736 - DNA, 22 bp, Homo sapiens
tttatggtgatccacttctact

SEQ ID NO: 49737 - DNA, 21 bp, Homo sapiens
ttatagtggctatttgttact

SEQ ID NO: 49738 - DNA, 25 bp, Homo sapiens
tttacaaccaaatctgttcattact

SEQ ID NO: 49739 - DNA, 20 bp, Homo sapiens
tttacagtgagaattcatta

SEQ ID NO: 49740 - DNA, 19 bp, Homo sapiens
taatggaccattcattact

SEQ ID NO: 49741 - DNA, 23 bp, Homo sapiens
tttatagtgggacctgagctact

SEQ ID NO: 49742 - DNA, 17 bp, Homo sapiens
taatgattattcattac

SEQ ID NO: 49743 - DNA, 18 bp, Homo sapiens
agtgtgatccatttatta

SEQ ID NO: 49744 - DNA, 80 bp, Gallid herpesvirus 2
tactgttttattggtagtttatgtatcgacgctttcccaaaatggatctggatgtatctatgctaccttggtggacagta

SEQ ID NO: 49745 - DNA, 24 bp, Gallid herpesvirus 2
tggatgtatctatgctaccttggt

SEQ ID NO: 49746 - DNA, 24 bp, Homo sapiens
tggatatatcaggtatatcttggt

SEQ ID NO: 49747 - DNA, 25 bp, Homo sapiens
tggagtgtctgtgctgggtaccaag

SEQ ID NO: 49748 - DNA, 23 bp, Homo sapiens
tgggtggcctaggctaccttggt

SEQ ID NO: 49749 - DNA, 23 bp, Homo sapiens
tggctgtatttataccacttggt

SEQ ID NO: 49750 - DNA, 64 bp, Gallid herpesvirus 2
gcttcacacgtttctaccaagcccaagattcgatcggtagtaggaacccgcaattgtgtgacgt

SEQ ID NO: 49751 - DNA, 24 bp, Gallid herpesvirus 2
tagtaggaacccgcaattgtgtga

SEQ ID NO: 49752 - DNA, 23 bp, Homo sapiens
tagcaggagcccgctggcagtga

SEQ ID NO: 49753 - DNA, 23 bp, Homo sapiens
taataggagcctgtaattacgtg

SEQ ID NO: 49754 - DNA, 21 bp, Homo sapiens
gtaggaattcacaattagtga

SEQ ID NO: 49755 - DNA, 21 bp, Homo sapiens
taataggaattaaatgtgtga

SEQ ID NO: 49756 - DNA, 20 bp, Homo sapiens
gtgggtcaccagttgtgtga

SEQ ID NO: 49757 - DNA, 21 bp, Homo sapiens
tagtaggagctcacagacatg

SEQ ID NO: 49758 - DNA, 16 bp, Homo sapiens
cagtagggactgtgtg

SEQ ID NO: 49759 - DNA, 66 bp, Gallid herpesvirus 3
gcgttcgcaccgcgaaccaatataagattatatatataatatattattggcgcaaggtgcgaacgc

SEQ ID NO: 49760 - DNA, 24 bp, Gallid herpesvirus 3
tattattggcgcaaggtgcgaacg

SEQ ID NO: 49761 - DNA, 21 bp, Homo sapiens
tattattgtgcagaaaaaacg

SEQ ID NO: 49762 - DNA, 19 bp, Homo sapiens
tattattgggtccatggtg

SEQ ID NO: 49763 - DNA, 21 bp, Homo sapiens
tattattgtgcaaaggaggaa

SEQ ID NO: 49764 - DNA, 19 bp, Homo sapiens
tattattgctgcaaggaac

SEQ ID NO: 49765 - DNA, 22 bp, Homo sapiens
ctggagcagcgaggtgcgaacg

SEQ ID NO: 49766 - DNA, 130 bp, Gallid herpesvirus 3
gtccgaggccgccggggaggaggttgtgggggcgggaggatgtgtgggggaagggaagggggagacggccgaaacctacgcgttcgccgcggcgtccgatccgggatcgctcccgacggggctctcgttc

SEQ ID NO: 49767 - DNA, 24 bp, Gallid herpesvirus 3
cgcgttcgccgcggcgtccgatcc

SEQ ID NO: 49768 - DNA, 18 bp, Homo sapiens
cgcgctcgccgcggcttc

SEQ ID NO: 49769 - DNA, 63 bp, Gallid herpesvirus 2
agcttgttattggctcccggcccagttgatggagctgccatgttgggagaaacaaagcaagtt

SEQ ID NO: 49770 - DNA, 24 bp, Gallid herpesvirus 2
tgccatgttgggagaaacaaagca

SEQ ID NO: 49771 - DNA, 20 bp, Homo sapiens
gccagcccgaggagtggagc

SEQ ID NO: 49772 - DNA, 22 bp, Homo sapiens
tgcctgtttcttaaacagagca

SEQ ID NO: 49773 - DNA, 17 bp, Homo sapiens
acctgagggacaaagca

SEQ ID NO: 49774 - DNA, 20 bp, Homo sapiens
ccagcctgggagacagagca

SEQ ID NO: 49775 - DNA, 21 bp, Homo sapiens
gcctctggggagaaacaaggc

SEQ ID NO: 49776 - DNA, 21 bp, Homo sapiens
tgtcctggctgggagcgaagc

SEQ ID NO: 49777 - DNA, 18 bp, Homo sapiens
tgcagttggaaacagagc

SEQ ID NO: 49778 - DNA, 19 bp, Homo sapiens
tgccacgtgagagcagagc

SEQ ID NO: 49779 - DNA, 19 bp, Homo sapiens
tgcttgtaagaaacaaggc

SEQ ID NO: 49780 - DNA, 19 bp, Homo sapiens
tgcttgttctcaacaaagc

SEQ ID NO: 49781 - DNA, 22 bp, Homo sapiens
ccatatccagggagacaaagca

SEQ ID NO: 49782 - DNA, 21 bp, Homo sapiens
gctggtgttgggagacagagc

SEQ ID NO: 49783 - DNA, 21 bp, Homo sapiens
gccgccgctgggagacgaggc

SEQ ID NO: 49784 - DNA, 19 bp, Homo sapiens
tgccatgtgtatacaagaa

SEQ ID NO: 49785 - DNA, 19 bp, Homo sapiens
tattattagaaataaagca

SEQ ID NO: 49786 - DNA, 18 bp, Homo sapiens
tgcttgttgggaggaagc

SEQ ID NO: 49787 - DNA, 22 bp, Homo sapiens
tgcatgtgtgtggaacaaagca

SEQ ID NO: 49788 - DNA, 22 bp, Homo sapiens
tgccaaggaccaagaaacaaag

SEQ ID NO: 49789 - DNA, 19 bp, Homo sapiens
tgccaggacgaagcaaagc

SEQ ID NO: 49790 - DNA, 15 bp, Homo sapiens
tgccattaggcaaag

SEQ ID NO: 49791 - DNA, 19 bp, Homo sapiens
ccaacctgggagacagagc

SEQ ID NO: 49792 - DNA, 16 bp, Homo sapiens
gcctgggagacagagc

SEQ ID NO: 49793 - DNA, 20 bp, Homo sapiens
tgccgggaaaaatggaaaca

SEQ ID NO: 49794 - DNA, 21 bp, Homo sapiens
tgctggggtggagaaacagag

SEQ ID NO: 49795 - DNA, 19 bp, Homo sapiens
ccagcctgggaaacaaagc

SEQ ID NO: 49796 - DNA, 21 bp, Homo sapiens
tgctagatgccagagacaaag

SEQ ID NO: 49797 - DNA, 18 bp, Homo sapiens
gccatgggggaaacaaag

SEQ ID NO: 49798 - DNA, 22 bp, Homo sapiens
tggcatatcgggaggcaaagca

SEQ ID NO: 49799 - DNA, 17 bp, Homo sapiens
gcctgggagacagagca

SEQ ID NO: 49800 - DNA, 22 bp, Homo sapiens
tgtgggctaaagaaacaaggca

SEQ ID NO: 49801 - DNA, 18 bp, Homo sapiens
tgctgcgggaagggacaa

SEQ ID NO: 49802 - DNA, 19 bp, Homo sapiens
tgcagttgagaggcaaagc

SEQ ID NO: 49803 - DNA, 22 bp, Homo sapiens
gctccctgggggaagcagggca

SEQ ID NO: 49804 - DNA, 18 bp, Homo sapiens
tgctgctgggagtgaagc

SEQ ID NO: 49805 - DNA, 18 bp, Homo sapiens
tgctagttggcacaaagc

SEQ ID NO: 49806 - DNA, 21 bp, Homo sapiens
gccatgttgggggcacaagca

SEQ ID NO: 49807 - DNA, 21 bp, Homo sapiens
gctataaaaagaaacaaagca

SEQ ID NO: 49808 - DNA, 20 bp, Homo sapiens
ccagcagaagagaaacagag

SEQ ID NO: 49809 - DNA, 17 bp, Homo sapiens
tgctgttggaagcaaag

SEQ ID NO: 49810 - DNA, 18 bp, Homo sapiens
ccaggccgggagacaaag

SEQ ID NO: 49811 - DNA, 18 bp, Homo sapiens
gccatgttgatgcagagc

SEQ ID NO: 49812 - DNA, 18 bp, Homo sapiens
tgctgtgtggtacaaagc

SEQ ID NO: 49813 - DNA, 16 bp, Homo sapiens
gccagggagacagagc

SEQ ID NO: 49814 - DNA, 17 bp, Homo sapiens
gcctgagagacagagca

SEQ ID NO: 49815 - DNA, 25 bp, Homo sapiens
tgctaggaacactggggacagagca

SEQ ID NO: 49816 - DNA, 20 bp, Homo sapiens
atgttaagtgaaataaggca

SEQ ID NO: 49817 - DNA, 23 bp, Homo sapiens
tgtcaataaaaagaagcaaagca

SEQ ID NO: 49818 - DNA, 18 bp, Homo sapiens
tgctattgcaaacaaagc

SEQ ID NO: 49819 - DNA, 22 bp, Homo sapiens
atgttaggagggaagtaaagca

SEQ ID NO: 49820 - DNA, 26 bp, Homo sapiens
tgccatgtttccatcaaagtagagca

SEQ ID NO: 49821 - DNA, 19 bp, Homo sapiens
ccagcctgggaaacagagc

SEQ ID NO: 49822 - DNA, 18 bp, Homo sapiens
tgccaaggccacagaagc

SEQ ID NO: 49823 - DNA, 18 bp, Homo sapiens
tgtaaaagaaacaaggca

SEQ ID NO: 49824 - DNA, 17 bp, Homo sapiens
tacctggggaaacaaag

SEQ ID NO: 49825 - DNA, 18 bp, Homo sapiens
tgtcggctgagacaaagc

SEQ ID NO: 49826 - DNA, 19 bp, Homo sapiens
tgcatcctggggatgaagc

SEQ ID NO: 49827 - DNA, 20 bp, Homo sapiens
gccgtactgggagcgaggca

SEQ ID NO: 49828 - DNA, 20 bp, Homo sapiens
tgtgatattgggagacaaag

SEQ ID NO: 49829 - DNA, 23 bp, Homo sapiens
ccatgctgaccagaaacaaagca

SEQ ID NO: 49830 - DNA, 19 bp, Homo sapiens
tgctatgttgggagatcca

SEQ ID NO: 49831 - DNA, 22 bp, Homo sapiens
tgctatgaagagaaataaagca

SEQ ID NO: 49832 - DNA, 19 bp, Homo sapiens
tgcaatgaaagaaacaaag

SEQ ID NO: 49833 - DNA, 18 bp, Homo sapiens
tgccagtgcaggcaaggc

SEQ ID NO: 49834 - DNA, 19 bp, Homo sapiens
ccagcctgggagacagagc

SEQ ID NO: 49835 - DNA, 23 bp, Homo sapiens
cgccaggaatggggaagcaaggc

SEQ ID NO: 49836 - DNA, 73 bp, Gallid herpesvirus 2
tctggatggtggatttgacgatttcagcgacgtatgtcgtacatatctagtcaacttaacgtctatttccgga

SEQ ID NO: 49837 - DNA, 24 bp, Gallid herpesvirus 2
gtggatttgacgatttcagcgacg

SEQ ID NO: 49838 - DNA, 16 bp, Homo sapiens
gtggctttgtcagcga

SEQ ID NO: 49839 - DNA, 62 bp, Chimpanzee cytomegalovirus
gccgcgggcgtgcagggaggccgaagcggcggccggagccgtgcagaaacacgtacgtacgc

SEQ ID NO: 49840 - DNA, 24 bp, Chimpanzee cytomegalovirus
ggcgtgcagggaggccgaagcggc

SEQ ID NO: 49841 - DNA, 21 bp, Homo sapiens
gccgtgcagggaggctcctgc

SEQ ID NO: 49842 - DNA, 23 bp, Homo sapiens
ggctgcagggatggcaaggcggc

SEQ ID NO: 49843 - DNA, 21 bp, Homo sapiens
gtcgcgggaggccggagcggc

SEQ ID NO: 49844 - DNA, 27 bp, Homo sapiens
ggtgtgcaaggaggtggcgccgcttcg

SEQ ID NO: 49845 - DNA, 18 bp, Homo sapiens
ggtgcgcagggaggctgc

SEQ ID NO: 49846 - DNA, 29 bp, Homo sapiens
ggcctgcagggaggtctgcgccgcttcgg

SEQ ID NO: 49847 - DNA, 24 bp, Homo sapiens
ggcgttcagctcggccgaagcggc

SEQ ID NO: 49848 - DNA, 23 bp, Homo sapiens
ggcgggcgggggacaaaagcggc

SEQ ID NO: 49849 - DNA, 22 bp, Homo sapiens
cgtgtgacctggccgaagtggc

SEQ ID NO: 49850 - DNA, 18 bp, Homo sapiens
ggcgtgcaggggcggcgg

SEQ ID NO: 49851 - DNA, 21 bp, Homo sapiens
ggttcgctgggccgaagtggc

SEQ ID NO: 49852 - DNA, 19 bp, Homo sapiens
ggtgcgcagggaggcaggc

SEQ ID NO: 49853 - DNA, 19 bp, Homo sapiens
gggtgcagggagcaggcgg

SEQ ID NO: 49854 - DNA, 23 bp, Homo sapiens
gggtgtggggaggccggaggggc

SEQ ID NO: 49855 - DNA, 18 bp, Homo sapiens
gtggcagggagccagcgg

SEQ ID NO: 49856 - DNA, 22 bp, Homo sapiens
ggctgtggggagagaaagcggc

SEQ ID NO: 49857 - DNA, 26 bp, Homo sapiens
ggcgtgcgggaggccggaggggcggc

SEQ ID NO: 49858 - DNA, 24 bp, Homo sapiens
ggcgtgcgggaggccgggcgcggc

SEQ ID NO: 49859 - DNA, 29 bp, Homo sapiens
ggtgtgcagagggggtggcgccgcttcgg

SEQ ID NO: 49860 - DNA, 17 bp, Homo sapiens
gtgtcagggaggcctgc

SEQ ID NO: 49861 - DNA, 23 bp, Homo sapiens
agcaccttgggaggccgaggcgg

SEQ ID NO: 49862 - DNA, 21 bp, Homo sapiens
agcgtgcgggggctgggcggc

SEQ ID NO: 49863 - DNA, 22 bp, Homo sapiens
ggcgtgcagcggagggagcggc

SEQ ID NO: 49864 - DNA, 24 bp, Homo sapiens
ggcgtgcaggcgggcgttccgggc

SEQ ID NO: 49865 - DNA, 25 bp, Homo sapiens
ggcgtcaggggagacctggggcggc

SEQ ID NO: 49866 - DNA, 23 bp, Homo sapiens
ggatggtaaggggctgaagcggc

SEQ ID NO: 49867 - DNA, 20 bp, Homo sapiens
ggttgcacctgccgaagcgg

SEQ ID NO: 49868 - DNA, 22 bp, Homo sapiens
ggcctccacaggccgaggcggc

SEQ ID NO: 49869 - DNA, 29 bp, Homo sapiens
ggtgtgcagggagctgggtgccgcttcgg

SEQ ID NO: 49870 - DNA, 22 bp, Homo sapiens
gggtgcaggggtggggagcggc

SEQ ID NO: 49871 - DNA, 20 bp, Homo sapiens
ggcaaaagaggctgaggtgg

SEQ ID NO: 49872 - DNA, 18 bp, Homo sapiens
agcgtgtgggggaagcgg

SEQ ID NO: 49873 - DNA, 21 bp, Homo sapiens
ggagtgcaggggtggggcggc

SEQ ID NO: 49874 - DNA, 16 bp, Homo sapiens
ggctgcgcccgaagcg

SEQ ID NO: 49875 - DNA, 23 bp, Homo sapiens
ggctgtagggaggccactgaggc

SEQ ID NO: 49876 - DNA, 18 bp, Homo sapiens
gggtgcggggaggccggg

SEQ ID NO: 49877 - DNA, 27 bp, Homo sapiens
ggctgtgctcggagtggcgccgcttcg

SEQ ID NO: 49878 - DNA, 19 bp, Homo sapiens
ggcgtgcagggggctgggc

SEQ ID NO: 49879 - DNA, 21 bp, Homo sapiens
ggcgtgggggaggcccccagc

SEQ ID NO: 49880 - DNA, 19 bp, Homo sapiens
ggtgtgcaggaaggccagg

SEQ ID NO: 49881 - DNA, 22 bp, Homo sapiens
ggctgcagggaggcactgtggc

SEQ ID NO: 49882 - DNA, 22 bp, Homo sapiens
ggctgtggggaggggaggtggc

SEQ ID NO: 49883 - DNA, 19 bp, Homo sapiens
gcgtgcaggggggctgagc

SEQ ID NO: 49884 - DNA, 23 bp, Homo sapiens
agcagtttgggaggccgaggtgg

SEQ ID NO: 49885 - DNA, 21 bp, Homo sapiens
ggcgtgcagggcgagggcggc

SEQ ID NO: 49886 - DNA, 21 bp, Homo sapiens
gcgtgcagggagcccagtggc

SEQ ID NO: 49887 - DNA, 20 bp, Homo sapiens
ggcgggcggtgccgaagcgg

SEQ ID NO: 49888 - DNA, 19 bp, Homo sapiens
gggcagggaggccttgagc

SEQ ID NO: 49889 - DNA, 18 bp, Homo sapiens
ggcttgtggggaaagcgg

SEQ ID NO: 49890 - DNA, 20 bp, Homo sapiens
ggtgtgcaggtgaggctgga

SEQ ID NO: 49891 - DNA, 20 bp, Homo sapiens
ggcggtgcggggaggtgcgg

SEQ ID NO: 49892 - DNA, 23 bp, Homo sapiens
ggcttgcagggcgtcgaggcggc

SEQ ID NO: 49893 - DNA, 20 bp, Homo sapiens
gtgcaggagcacgaagcggc

SEQ ID NO: 49894 - DNA, 87 bp, Tupaia herpesvirus
gttcaggcggcggggctcgacgacggaccggacggtacagttgtaccggagccgatagtcgtagtaactagacccgaccgtgaggac

SEQ ID NO: 49895 - DNA, 24 bp, Tupaia herpesvirus
aggcggcggggctcgacgacggac

SEQ ID NO: 49896 - DNA, 22 bp, Homo sapiens
ggcggcgggcaccgggcggcgg

SEQ ID NO: 49897 - DNA, 19 bp, Homo sapiens
aggcggcggtggccgcggg

SEQ ID NO: 49898 - DNA, 16 bp, Homo sapiens
aggcggcgggcggcgg

SEQ ID NO: 49899 - DNA, 23 bp, Homo sapiens
aggcggcgcggcgattgcggcgg

SEQ ID NO: 49900 - DNA, 17 bp, Homo sapiens
ggcgacgggggcgacgg

SEQ ID NO: 49901 - DNA, 22 bp, Homo sapiens
aggcggcggcgctgtcgggcgg

SEQ ID NO: 49902 - DNA, 19 bp, Homo sapiens
aggcggcggaggaggtgga

SEQ ID NO: 49903 - DNA, 19 bp, Homo sapiens
ggcagcggggctcatggga

SEQ ID NO: 49904 - DNA, 18 bp, Homo sapiens
ggcggcggggctcgcggg

SEQ ID NO: 49905 - DNA, 20 bp, Homo sapiens
aggcagcggcactgcggtgg

SEQ ID NO: 49906 - DNA, 23 bp, Homo sapiens
ggcggcggcggcggcggcggcgg

SEQ ID NO: 49907 - DNA, 18 bp, Homo sapiens
ggcggtggggctcggaga

SEQ ID NO: 49908 - DNA, 20 bp, Homo sapiens
ggcgctggggctcggcggcg

SEQ ID NO: 49909 - DNA, 24 bp, Homo sapiens
ggcggcggcggctcggcgcctcgg

SEQ ID NO: 49910 - DNA, 20 bp, Homo sapiens
aggtggcggggccggcgcgg

SEQ ID NO: 49911 - DNA, 16 bp, Homo sapiens
ggcggcggagccgcgg

SEQ ID NO: 49912 - DNA, 20 bp, Homo sapiens
aggcggcggcggcggcgcgg

SEQ ID NO: 49913 - DNA, 17 bp, Homo sapiens
ggcgggcggcgcgacgg

SEQ ID NO: 49914 - DNA, 19 bp, Homo sapiens
aggcggcggcggcgggcgg

SEQ ID NO: 49915 - DNA, 19 bp, Homo sapiens
ggtggcggggcccgggcgg

SEQ ID NO: 49916 - DNA, 17 bp, Homo sapiens
ggcggcgcggcgaccgg

SEQ ID NO: 49917 - DNA, 19 bp, Homo sapiens
ggcggcgaagaggcggcgg

SEQ ID NO: 49918 - DNA, 19 bp, Homo sapiens
aggcgcggggagcggcgga

SEQ ID NO: 49919 - DNA, 19 bp, Homo sapiens
ggctggcggggcttacagg

SEQ ID NO: 49920 - DNA, 19 bp, Homo sapiens
ggcagcgggaagccggcgg

SEQ ID NO: 49921 - DNA, 17 bp, Homo sapiens
aggcggcggggccggcg

SEQ ID NO: 49922 - DNA, 21 bp, Homo sapiens
aggggcggggcggggcggtgg

SEQ ID NO: 49923 - DNA, 18 bp, Homo sapiens
gcggcgggagcccggcgg

SEQ ID NO: 49924 - DNA, 18 bp, Homo sapiens
aggcggcaggggaggcgg

SEQ ID NO: 49925 - DNA, 22 bp, Homo sapiens
ggcggcggggctacctgtacgg

SEQ ID NO: 49926 - DNA, 23 bp, Homo sapiens
ggcggcggggagtggagcggcgg

SEQ ID NO: 49927 - DNA, 20 bp, Homo sapiens
ggcggcggcggctccccggg

SEQ ID NO: 49928 - DNA, 21 bp, Homo sapiens
ggcggcgggcccgggcggcgg

SEQ ID NO: 49929 - DNA, 25 bp, Homo sapiens
ggcggcggcggcggtggcggcggac

SEQ ID NO: 49930 - DNA, 20 bp, Homo sapiens
ggcggcgggctgcgcggcgg

SEQ ID NO: 49931 - DNA, 17 bp, Homo sapiens
ggcggcggcgaggacgg

SEQ ID NO: 49932 - DNA, 18 bp, Homo sapiens
gcggcggacgcgacggac

SEQ ID NO: 49933 - DNA, 16 bp, Homo sapiens
aggcagcgggcggcgg

SEQ ID NO: 49934 - DNA, 16 bp, Homo sapiens
aggcgcggggcggcgg

SEQ ID NO: 49935 - DNA, 19 bp, Homo sapiens
ggtgggcggggccagacgg

SEQ ID NO: 49936 - DNA, 17 bp, Homo sapiens
aggcggcgggattccgg

SEQ ID NO: 49937 - DNA, 21 bp, Homo sapiens
ggcggcggcggcaggcggcgg

SEQ ID NO: 49938 - DNA, 28 bp, Homo sapiens
ggcggcggcggctgcgtggtggtggcgg

SEQ ID NO: 49939 - DNA, 18 bp, Homo sapiens
ggcggcggtggcgcggac

SEQ ID NO: 49940 - DNA, 21 bp, Homo sapiens
ggcggcggcggcgggcggcgg

SEQ ID NO: 49941 - DNA, 19 bp, Homo sapiens
ggtggctgggctcgaccac

SEQ ID NO: 49942 - DNA, 16 bp, Homo sapiens
ggcggcgggggcgcgg

SEQ ID NO: 49943 - DNA, 24 bp, Homo sapiens
ggcagcgggaggggaggtggcgga

SEQ ID NO: 49944 - DNA, 22 bp, Homo sapiens
ggcggcgggcttgctgccggac

SEQ ID NO: 49945 - DNA, 21 bp, Homo sapiens
aggcgcggggctggcccgcgg

SEQ ID NO: 49946 - DNA, 15 bp, Homo sapiens
aggcggcgggcgcgg

SEQ ID NO: 49947 - DNA, 21 bp, Homo sapiens
aggggcggggctcgtaaggac

SEQ ID NO: 49948 - DNA, 19 bp, Homo sapiens
ggcagtggggctcccagga

SEQ ID NO: 49949 - DNA, 17 bp, Homo sapiens
ggggcggggcggcgcgg

SEQ ID NO: 49950 - DNA, 22 bp, Homo sapiens
gggtgccggggctcatcgccgg

SEQ ID NO: 49951 - DNA, 21 bp, Homo sapiens
ggcggcgcggggtcgcggcgg

SEQ ID NO: 49952 - DNA, 20 bp, Homo sapiens
ggcggcgcggctcggctagg

SEQ ID NO: 49953 - DNA, 18 bp, Homo sapiens
ggcggcgggcggcacgga

SEQ ID NO: 49954 - DNA, 15 bp, Homo sapiens
ggcggcgggctccgg

SEQ ID NO: 49955 - DNA, 19 bp, Homo sapiens
agcggcggagcgcggcgga

SEQ ID NO: 49956 - DNA, 20 bp, Homo sapiens
aggcggcgggccgggggcgg

SEQ ID NO: 49957 - DNA, 20 bp, Homo sapiens
aggcggcgggactccaggac

SEQ ID NO: 49958 - DNA, 20 bp, Homo sapiens
aggcggcggcggctgctcgg

SEQ ID NO: 49959 - DNA, 20 bp, Homo sapiens
ggcggcgggggtcgcgctgg

SEQ ID NO: 49960 - DNA, 20 bp, Homo sapiens
ggcgctggggctcgcggggg

SEQ ID NO: 49961 - DNA, 16 bp, Homo sapiens
ggcggcgggctcggga

SEQ ID NO: 49962 - DNA, 18 bp, Homo sapiens
ggtcgcggggctccgtgg

SEQ ID NO: 49963 - DNA, 20 bp, Homo sapiens
ggcagtgggcgccgacggac

SEQ ID NO: 49964 - DNA, 20 bp, Homo sapiens
ggcggcggcacgggcggcgg

SEQ ID NO: 49965 - DNA, 21 bp, Homo sapiens
ggcggcggggcgcgcgagcga

SEQ ID NO: 49966 - DNA, 20 bp, Homo sapiens
ggcggcaggggcgcgggcgg

SEQ ID NO: 49967 - DNA, 19 bp, Homo sapiens
aggcagcggcggcggcgga

SEQ ID NO: 49968 - DNA, 21 bp, Homo sapiens
aggcggcggctgtggcggcgg

SEQ ID NO: 49969 - DNA, 15 bp, Homo sapiens
ggcggcggggtccgg

SEQ ID NO: 49970 - DNA, 19 bp, Homo sapiens
aggcgcggggctggtgcgg

SEQ ID NO: 49971 - DNA, 19 bp, Homo sapiens
ggcggcggggcgtccgcgg

SEQ ID NO: 49972 - DNA, 24 bp, Homo sapiens
ggcggcgaggatccgggcggcgga

SEQ ID NO: 49973 - DNA, 19 bp, Homo sapiens
ggcgccggggctccctcgg

SEQ ID NO: 49974 - DNA, 20 bp, Homo sapiens
aggcggcggtggctcggcca

SEQ ID NO: 49975 - DNA, 20 bp, Homo sapiens
ggcggcggagcccctggcgg

SEQ ID NO: 49976 - DNA, 17 bp, Homo sapiens
ggcggcgggggcggcgg

SEQ ID NO: 49977 - DNA, 21 bp, Homo sapiens
aggggcggggctctccagtgg

SEQ ID NO: 49978 - DNA, 20 bp, Homo sapiens
ggcggcggggggagaggcgg

SEQ ID NO: 49979 - DNA, 19 bp, Homo sapiens
ggcggtggggccaatgggg

SEQ ID NO: 49980 - DNA, 18 bp, Homo sapiens
gggtgcggggctcccggg

SEQ ID NO: 49981 - DNA, 19 bp, Homo sapiens
aggcggcgggctctccggg

SEQ ID NO: 49982 - DNA, 20 bp, Homo sapiens
aggcggcgggtcagcggcgg

SEQ ID NO: 49983 - DNA, 17 bp, Homo sapiens
aggcgcggggctgccgg

SEQ ID NO: 49984 - DNA, 20 bp, Homo sapiens
ggcgctggggctcgatgcgg

SEQ ID NO: 49985 - DNA, 20 bp, Homo sapiens
ggcagcggatgcagcggtgg

SEQ ID NO: 49986 - DNA, 18 bp, Homo sapiens
ggcggctgggctcgcgga

SEQ ID NO: 49987 - DNA, 18 bp, Homo sapiens
ggcggcggggcgcgcggg

SEQ ID NO: 49988 - DNA, 19 bp, Homo sapiens
aggcggcagggctgagtgg

SEQ ID NO: 49989 - DNA, 19 bp, Homo sapiens
aggttggtggggccgcggg

SEQ ID NO: 49990 - DNA, 18 bp, Homo sapiens
agctggcggggcgcacgg

SEQ ID NO: 49991 - DNA, 17 bp, Homo sapiens
agcggcggaggcggcgg

SEQ ID NO: 49992 - DNA, 19 bp, Homo sapiens
ggcggcgggctggcggcgg

SEQ ID NO: 49993 - DNA, 20 bp, Homo sapiens
ggccggcggggctgtgccgg

SEQ ID NO: 49994 - DNA, 21 bp, Homo sapiens
ggtggccggggggcggcggac

SEQ ID NO: 49995 - DNA, 18 bp, Homo sapiens
ggcgccggggctcagcgg

SEQ ID NO: 49996 - DNA, 63 bp, Tupaia herpesvirus
cccgtcgcgttgggttgcagccgcaagcggacgctggggggagcggtggccagagcgagcggg

SEQ ID NO: 49997 - DNA, 24 bp, Tupaia herpesvirus
tcgcgttgggttgcagccgcaagc

SEQ ID NO: 49998 - DNA, 18 bp, Homo sapiens
tagtgctgtggccgcaag

SEQ ID NO: 49999 - DNA, 16 bp, Homo sapiens
gcttgcggccgcaggc

SEQ ID NO: 50000 - DNA, 19 bp, Homo sapiens
gttgggctgcattcaaagc

SEQ ID NO: 50001 - DNA, 21 bp, Homo sapiens
ttggtgcgagcagccgcgggc

SEQ ID NO: 50002 - DNA, 18 bp, Homo sapiens
gcgagtgcggctgcaggc

SEQ ID NO: 50003 - DNA, 18 bp, Homo sapiens
ttgggtgggcagctgcag

SEQ ID NO: 50004 - DNA, 23 bp, Homo sapiens
tcgcgctgggcgtgctcgtgggc

SEQ ID NO: 50005 - DNA, 21 bp, Homo sapiens
gcagttcctctggttgcaggc

SEQ ID NO: 50006 - DNA, 19 bp, Homo sapiens
gttggctgtggctgcaagc

SEQ ID NO: 50007 - DNA, 22 bp, Homo sapiens
tcgcgctgcctggccggccgca

SEQ ID NO: 50008 - DNA, 16 bp, Homo sapiens
gcgaagttgcagctgc

SEQ ID NO: 50009 - DNA, 61 bp, Tupaia herpesvirus
gggcgccgccacccccgaccgggggagcggtcgtcgctcgccgggcgggggggaagcgccc

SEQ ID NO: 50010 - DNA, 24 bp, Tupaia herpesvirus
tcgccgggcgggggggaagcgccc

SEQ ID NO: 50011 - DNA, 18 bp, Homo sapiens
tctcgggcagagggggcg

SEQ ID NO: 50012 - DNA, 16 bp, Homo sapiens
gccggcggggggcgcc

SEQ ID NO: 50013 - DNA, 19 bp, Homo sapiens
tcgccgaggcgtgggtgcc

SEQ ID NO: 50014 - DNA, 19 bp, Homo sapiens
tcgctgggtgggtgggagc

SEQ ID NO: 50015 - DNA, 17 bp, Homo sapiens
gccggggcagggggtgc

SEQ ID NO: 50016 - DNA, 19 bp, Homo sapiens
tcgtgggcgggaaggtgcc

SEQ ID NO: 50017 - DNA, 19 bp, Homo sapiens
gcagggggaagggaagcgc

SEQ ID NO: 50018 - DNA, 18 bp, Homo sapiens
gccgggcggcgggggcgc

SEQ ID NO: 50019 - DNA, 21 bp, Homo sapiens
cgccggtactcgggaggcgcc

SEQ ID NO: 50020 - DNA, 27 bp, Homo sapiens
gccgggcggggtcgcctgggcgcttcc

SEQ ID NO: 50021 - DNA, 19 bp, Homo sapiens
tcaccggagcgggaggtgc

SEQ ID NO: 50022 - DNA, 22 bp, Homo sapiens
tcgccgggcgggcgggctgcgc

SEQ ID NO: 50023 - DNA, 17 bp, Homo sapiens
tcccgggcggagggcgc

SEQ ID NO: 50024 - DNA, 19 bp, Homo sapiens
gctgggcagggctgggtgc

SEQ ID NO: 50025 - DNA, 21 bp, Homo sapiens
ccgccggggccggaggtgccc

SEQ ID NO: 50026 - DNA, 20 bp, Homo sapiens
tcaccgggtggggcggagcg

SEQ ID NO: 50027 - DNA, 20 bp, Homo sapiens
cgccgggcgggggctcgccc

SEQ ID NO: 50028 - DNA, 19 bp, Homo sapiens
gctggggaaccaagcgccc

SEQ ID NO: 50029 - DNA, 21 bp, Homo sapiens
cgctgggcgggacaaagtgcc

SEQ ID NO: 50030 - DNA, 18 bp, Homo sapiens
cagtcgggaggaggcgcc

SEQ ID NO: 50031 - DNA, 17 bp, Homo sapiens
tctccgggcggaagcgc

SEQ ID NO: 50032 - DNA, 25 bp, Homo sapiens
tcgcgggcgggggaccccggcgccc

SEQ ID NO: 50033 - DNA, 20 bp, Homo sapiens
ccgccgggcggtaaagtgcc

SEQ ID NO: 50034 - DNA, 18 bp, Homo sapiens
tctccgtacgggggagcg

SEQ ID NO: 50035 - DNA, 21 bp, Homo sapiens
ccgccgggcggccgggcgccc

SEQ ID NO: 50036 - DNA, 20 bp, Homo sapiens
cctggggtaaagggaagtgc

SEQ ID NO: 50037 - DNA, 18 bp, Homo sapiens
cgccgggcccggggcgcc

SEQ ID NO: 50038 - DNA, 23 bp, Homo sapiens
tcgtaggaggagggggagcgccc

SEQ ID NO: 50039 - DNA, 24 bp, Homo sapiens
cctgggtgggagaagggagcgtcc

SEQ ID NO: 50040 - DNA, 20 bp, Homo sapiens
gccgggcgggggtgcgcgcc

SEQ ID NO: 50041 - DNA, 19 bp, Homo sapiens
gctgggcagaggagtgtcc

SEQ ID NO: 50042 - DNA, 18 bp, Homo sapiens
tctccggcggggagcgcc

SEQ ID NO: 50043 - DNA, 19 bp, Homo sapiens
tctccggaatgggaagcgc

SEQ ID NO: 50044 - DNA, 20 bp, Homo sapiens
gccgggcggggggctgaccc

SEQ ID NO: 50045 - DNA, 22 bp, Homo sapiens
gctggcggggggcggcgcgccc

SEQ ID NO: 50046 - DNA, 19 bp, Homo sapiens
ccgccgggtgggcagcgcc

SEQ ID NO: 50047 - DNA, 18 bp, Homo sapiens
tcccgggcgggggaggcc

SEQ ID NO: 50048 - DNA, 20 bp, Homo sapiens
gctgggcgccggggaagcgc

SEQ ID NO: 50049 - DNA, 17 bp, Homo sapiens
cgccgcggggaggtgcc

SEQ ID NO: 50050 - DNA, 131 bp, Murid herpesvirus 4
ttcagggccccacaaatttcatatttccagcagcctttccaccccccgtgagtcttccccacagaaactgcatagaactaacttgtgacacagaaaggtgtttgaaaccaggtgatgttatgaaactgaag

SEQ ID NO: 50051 - DNA, 24 bp, Murid herpesvirus 4
atagaactaacttgtgacacagaa

SEQ ID NO: 50052 - DNA, 15 bp, Homo sapiens
agaactgtgacacag

SEQ ID NO: 50053 - DNA, 22 bp, Homo sapiens
atagaacctggggggcacagaa

SEQ ID NO: 50054 - DNA, 20 bp, Homo sapiens
caggactggttctgacacag

SEQ ID NO: 50055 - DNA, 19 bp, Homo sapiens
taaaactaactcgaggcag

SEQ ID NO: 50056 - DNA, 20 bp, Homo sapiens
acagagctaacttgtgcaga

SEQ ID NO: 50057 - DNA, 19 bp, Homo sapiens
acagaactgaagacacgga

SEQ ID NO: 50058 - DNA, 17 bp, Homo sapiens
taaaactaggacacaga

SEQ ID NO: 50059 - DNA, 22 bp, Homo sapiens
agaattatactttgacacagaa

SEQ ID NO: 50060 - DNA, 18 bp, Homo sapiens
acagagctgagacacaga

SEQ ID NO: 50061 - DNA, 22 bp, Homo sapiens
taaaactaactgtgacgacaga

SEQ ID NO: 50062 - DNA, 22 bp, Homo sapiens
agaatctgcatgtgacacagaa

SEQ ID NO: 50063 - DNA, 24 bp, Homo sapiens
ataaaactaactatatacacagaa

SEQ ID NO: 50064 - DNA, 23 bp, Homo sapiens
atagattggccataaacacagaa

SEQ ID NO: 50065 - DNA, 21 bp, Homo sapiens
caggactggtgggacacagaa

SEQ ID NO: 50066 - DNA, 20 bp, Homo sapiens
atagagctaactcagtaaca

SEQ ID NO: 50067 - DNA, 18 bp, Homo sapiens
ccaatttgtgacatagaa

SEQ ID NO: 50068 - DNA, 17 bp, Homo sapiens
tagaaccagcacacgga

SEQ ID NO: 50069 - DNA, 15 bp, Homo sapiens
tagaatgtgacacag

SEQ ID NO: 50070 - DNA, 21 bp, Homo sapiens
ataaaactgaacagtgcagaa

SEQ ID NO: 50071 - DNA, 21 bp, Homo sapiens
aaactaactttaacattagaa

SEQ ID NO: 50072 - DNA, 15 bp, Homo sapiens
tagactaactcacag

SEQ ID NO: 50073 - DNA, 86 bp, Molluscum contagiosum virus
cggcggctggacctgcgccagcgcctgtccgtgggcggcatcctgatgacggcagacggcaagttcctggtgtgccagcggcgccg

SEQ ID NO: 50074 - DNA, 24 bp, Molluscum contagiosum virus
acggcagacggcaagttcctggtg

SEQ ID NO: 50075 - DNA, 19 bp, Homo sapiens
ggtggacggcaagggagtg

SEQ ID NO: 50076 - DNA, 21 bp, Homo sapiens
cggtggcggccggccctggtg

SEQ ID NO: 50077 - DNA, 18 bp, Homo sapiens
cggcagacggcgggcggt

SEQ ID NO: 50078 - DNA, 19 bp, Homo sapiens
acggcagggcgctcctggt

SEQ ID NO: 50079 - DNA, 21 bp, Homo sapiens
cgatggatgggagtcctggtg

SEQ ID NO: 50080 - DNA, 20 bp, Homo sapiens
cggtggaggcaagtcctctg

SEQ ID NO: 50081 - DNA, 17 bp, Homo sapiens
ggtaacaagttcttggt

SEQ ID NO: 50082 - DNA, 19 bp, Homo sapiens
ggtagctggcaagtcaggc

SEQ ID NO: 50083 - DNA, 17 bp, Homo sapiens
ggcttcaggttcctggt

SEQ ID NO: 50084 - DNA, 22 bp, Homo sapiens
cgccagagccttgttcctggtg

SEQ ID NO: 50085 - DNA, 16 bp, Homo sapiens
ggcacggcccctggtg

SEQ ID NO: 50086 - DNA, 21 bp, Homo sapiens
ggcagacagccctgcctggtg

SEQ ID NO: 50087 - DNA, 17 bp, Homo sapiens
cggcaacgcttcctggt

SEQ ID NO: 50088 - DNA, 18 bp, Homo sapiens
cggtagacggtaagttcc

SEQ ID NO: 50089 - DNA, 22 bp, Homo sapiens
ggtgtgacggcacttcctggtg

SEQ ID NO: 50090 - DNA, 18 bp, Homo sapiens
ggcagaggcaggtccctg

SEQ ID NO: 50091 - DNA, 18 bp, Homo sapiens
ggcagatgagtcctggtg

SEQ ID NO: 50092 - DNA, 92 bp, Molluscum contagiosum virus
ggcagcgcttgtttcgcatgcacagccgctttctgggcgcgtgcgagcggcgcgcgctgagcgcggagctggcgttgccgagcgagcacgcc

SEQ ID NO: 50093 - DNA, 24 bp, Molluscum contagiosum virus
tgagcgcggagctggcgttgccga

SEQ ID NO: 50094 - DNA, 18 bp, Homo sapiens
tgggcgcgggcgctgccg

SEQ ID NO: 50095 - DNA, 18 bp, Homo sapiens
tgggcgcggagcgcgtgc

SEQ ID NO: 50096 - DNA, 19 bp, Homo sapiens
tgagtcggggctggcgtgc

SEQ ID NO: 50097 - DNA, 20 bp, Homo sapiens
cggagcggttggcgttgccg

SEQ ID NO: 50098 - DNA, 18 bp, Homo sapiens
tggcgcggagctggccgc

SEQ ID NO: 50099 - DNA, 21 bp, Homo sapiens
gcgcggagcccagactgccga

SEQ ID NO: 50100 - DNA, 18 bp, Homo sapiens
tggcgcggagctgcgaac

SEQ ID NO: 50101 - DNA, 16 bp, Homo sapiens
tgggccggagctgggc

SEQ ID NO: 50102 - DNA, 16 bp, Homo sapiens
gcgcggagcgctgccg

SEQ ID NO: 50103 - DNA, 22 bp, Homo sapiens
tgggcgtggagccggcagccga

SEQ ID NO: 50104 - DNA, 17 bp, Homo sapiens
gagcgcggggtctgccg

SEQ ID NO: 50105 - DNA, 21 bp, Homo sapiens
tgagtgcggagctaggaacga

SEQ ID NO: 50106 - DNA, 18 bp, Homo sapiens
tgaggtggagctgggctg

SEQ ID NO: 50107 - DNA, 19 bp, Homo sapiens
gagcgcggggctcccgccg

SEQ ID NO: 50108 - DNA, 16 bp, Homo sapiens
cgggcgcggagttgcc

SEQ ID NO: 50109 - DNA, 18 bp, Homo sapiens
gcgtggagctggtggctg

SEQ ID NO: 50110 - DNA, 21 bp, Homo sapiens
tgagtgaggagctggatatgc

SEQ ID NO: 50111 - DNA, 21 bp, Homo sapiens
tgatgcattatctggcgttgc

SEQ ID NO: 50112 - DNA, 22 bp, Homo sapiens
tgggcggggggctttcggctga

SEQ ID NO: 50113 - DNA, 21 bp, Homo sapiens
tgagcgcggagatggtcagtt

SEQ ID NO: 50114 - DNA, 22 bp, Homo sapiens
tgggcatggagctgaaagatgc

SEQ ID NO: 50115 - DNA, 20 bp, Homo sapiens
tgggcgcggagctggggcca

SEQ ID NO: 50116 - DNA, 20 bp, Homo sapiens
tggctgcggagctggcgcca

SEQ ID NO: 50117 - DNA, 23 bp, Homo sapiens
tgggcggggccgcagcgttgccg

SEQ ID NO: 50118 - DNA, 104 bp, Camelpox virus
gaaaaggaggagaacacggataaagttagcgctcagaatatctcattcaaatccatgaataaactatatgggcgatattctgccgtgtttaaagattccttttt

SEQ ID NO: 50119 - DNA, 24 bp, Camelpox virus
tagcgctcagaatatctcattcaa

SEQ ID NO: 50120 - DNA, 25 bp, Homo sapiens
tagtgctcaaaatattcttgctcaa

SEQ ID NO: 50121 - DNA, 21 bp, Homo sapiens
taacgttttcaatctcattca

SEQ ID NO: 50122 - DNA, 16 bp, Homo sapiens
tagcggtcacctcatt

SEQ ID NO: 50123 - DNA, 18 bp, Homo sapiens
gccacacaatatctcatt

SEQ ID NO: 50124 - DNA, 21 bp, Homo sapiens
agcgcaaaatattttattcaa

SEQ ID NO: 50125 - DNA, 17 bp, Homo sapiens
taggctcagaatatgtc

SEQ ID NO: 50126 - DNA, 20 bp, Homo sapiens
cacaagaatatcttgttcaa

SEQ ID NO: 50127 - DNA, 21 bp, Homo sapiens
taggctaagaatatcttgttc

SEQ ID NO: 50128 - DNA, 104 bp, Aichi virus
gggatgaaacctctactgccctaggaatgccaggcaggtaccccacctccgggtgggatctgagcctgggctaattgtctacgggtagtttcatttccaatcct

SEQ ID NO: 50129 - DNA, 24 bp, Aichi virus
tgggatctgagcctgggctaattg

SEQ ID NO: 50130 - DNA, 19 bp, Homo sapiens
taggatttgagcctgggcc

SEQ ID NO: 50131 - DNA, 23 bp, Homo sapiens
tggaatctgagttttccatattg

SEQ ID NO: 50132 - DNA, 26 bp, Homo sapiens
tgggatctaagcctggagttaaattg

SEQ ID NO: 50133 - DNA, 19 bp, Homo sapiens
tgggatctgagctgggcca

SEQ ID NO: 50134 - DNA, 21 bp, Homo sapiens
tgggctgggttgggctgattg

SEQ ID NO: 50135 - DNA, 18 bp, Homo sapiens
tgggatctggtcctgtct

SEQ ID NO: 50136 - DNA, 63 bp, Aichi virus
gagaaggtgttccgctgtggctgccaacctggtaacaggtgccccagtgtgcgtaaccttctt

SEQ ID NO: 50137 - DNA, 24 bp, Aichi virus
tgccccagtgtgcgtaaccttctt

SEQ ID NO: 50138 - DNA, 16 bp, Homo sapiens
gcccggtcaaccttct

SEQ ID NO: 50139 - DNA, 21 bp, Homo sapiens
tggcccagtgtgtgtctcctt

SEQ ID NO: 50140 - DNA, 16 bp, Homo sapiens
tgcacagtgtaacctt

SEQ ID NO: 50141 - DNA, 18 bp, Homo sapiens
ccccagtatgaattttct

SEQ ID NO: 50142 - DNA, 16 bp, Homo sapiens
tgcccggctaactttc

SEQ ID NO: 50143 - DNA, 22 bp, Homo sapiens
gccccagtgttcaccaaacctt

SEQ ID NO: 50144 - DNA, 19 bp, Homo sapiens
cctcctctgtgaccttctt

SEQ ID NO: 50145 - DNA, 17 bp, Homo sapiens
ccagtatgagttttctt

SEQ ID NO: 50146 - DNA, 16 bp, Homo sapiens
tacctcagtgcacctt

SEQ ID NO: 50147 - DNA, 22 bp, Homo sapiens
tacctcagaatgtggccttctt

SEQ ID NO: 50148 - DNA, 17 bp, Homo sapiens
cagtgtacgcctttctt

SEQ ID NO: 50149 - DNA, 18 bp, Homo sapiens
cctcagtccggaccttct

SEQ ID NO: 50150 - DNA, 69 bp, Camelpox virus
gtatatagatgtcaatgaagagtacacagaagcagctgcagcaacttctgtactagtggcagattgtgc

SEQ ID NO: 50151 - DNA, 24 bp, Camelpox virus
tagatgtcaatgaagagtacacag

SEQ ID NO: 50152 - DNA, 24 bp, Homo sapiens
tagaatgttgctcggggtacacag

SEQ ID NO: 50153 - DNA, 17 bp, Homo sapiens
gatgtcaactggccaca

SEQ ID NO: 50154 - DNA, 17 bp, Homo sapiens
agatgtcagtgagagca

SEQ ID NO: 50155 - DNA, 18 bp, Homo sapiens
tagagtcaatgaaaaata

SEQ ID NO: 50156 - DNA, 20 bp, Homo sapiens
gtcaatgggagagtacacag

SEQ ID NO: 50157 - DNA, 20 bp, Homo sapiens
aggtgtcaatgaggactcca

SEQ ID NO: 50158 - DNA, 17 bp, Homo sapiens
tagatgtagtgtacaca

SEQ ID NO: 50159 - DNA, 19 bp, Homo sapiens
gtacatggagggtacacag

SEQ ID NO: 50160 - DNA, 18 bp, Homo sapiens
taaatgttaatgaagaac

SEQ ID NO: 50161 - DNA, 23 bp, Homo sapiens
cagatgtcagtgactccagacac

SEQ ID NO: 50162 - DNA, 18 bp, Homo sapiens
taaatgtcaatgttaaat

SEQ ID NO: 50163 - DNA, 17 bp, Homo sapiens
agatgtcagtgaaggta

SEQ ID NO: 50164 - DNA, 19 bp, Homo sapiens
agatgtcagtgacagcgca

SEQ ID NO: 50165 - DNA, 21 bp, Homo sapiens
tagttgtcaatgaactcacag

SEQ ID NO: 50166 - DNA, 24 bp, Homo sapiens
tagatgccaaagttttagtgtaca

SEQ ID NO: 50167 - DNA, 18 bp, Homo sapiens
tagatgtcatggatcaca

SEQ ID NO: 50168 - DNA, 66 bp, Human papillomavirus type 7
catgtttgtcagcatatttgcattgcatgtttcaaattgctaggtcaaagttccctgccaaaaatg

SEQ ID NO: 50169 - DNA, 24 bp, Human papillomavirus type 7
ctaggtcaaagttccctgccaaaa

SEQ ID NO: 50170 - DNA, 20 bp, Homo sapiens
ctaagtcagggttctcatgc

SEQ ID NO: 50171 - DNA, 18 bp, Homo sapiens
ccaggtcagagttagctg

SEQ ID NO: 50172 - DNA, 23 bp, Homo sapiens
ccaggtcagcccagattgccaaa

SEQ ID NO: 50173 - DNA, 22 bp, Homo sapiens
ctagatcagggttcagtgacaa

SEQ ID NO: 50174 - DNA, 20 bp, Homo sapiens
ggtcagagggagtgccaaaa

SEQ ID NO: 50175 - DNA, 16 bp, Homo sapiens
caggttctccctgcca

SEQ ID NO: 50176 - DNA, 20 bp, Homo sapiens
taggaaagttccttgtcaaa

SEQ ID NO: 50177 - DNA, 18 bp, Homo sapiens
ctgggcaggtccctgcca

SEQ ID NO: 50178 - DNA, 21 bp, Homo sapiens
ggtaccaagcctttgccaaaa

SEQ ID NO: 50179 - DNA, 17 bp, Homo sapiens
taaggtcaaagtggcca

SEQ ID NO: 50180 - DNA, 16 bp, Homo sapiens
ctaggccagctgccaa

SEQ ID NO: 50181 - DNA, 17 bp, Homo sapiens
taggtcgaaatgccaaa

SEQ ID NO: 50182 - DNA, 16 bp, Homo sapiens
ctaagtttccctgcca

SEQ ID NO: 50183 - DNA, 17 bp, Homo sapiens
agtcaagggtctgccaa

SEQ ID NO: 50184 - DNA, 19 bp, Homo sapiens
ggttttatttctgccaaaa

SEQ ID NO: 50185 - DNA, 18 bp, Homo sapiens
tagatcaaagtttccctg

SEQ ID NO: 50186 - DNA, 18 bp, Homo sapiens
ctggatcagagttcccca

SEQ ID NO: 50187 - DNA, 17 bp, Homo sapiens
ccaggtcagagggccaa

SEQ ID NO: 50188 - DNA, 21 bp, Homo sapiens
ctaggctgatggcccctgcca

SEQ ID NO: 50189 - DNA, 22 bp, Homo sapiens
ctaggttaacagttctaccaaa

SEQ ID NO: 50190 - DNA, 17 bp, Homo sapiens
ctaggtcagggttctgc

SEQ ID NO: 50191 - DNA, 18 bp, Homo sapiens
ccaggttagagtcccctg

SEQ ID NO: 50192 - DNA, 18 bp, Homo sapiens
ctaggttcttccctgcca

SEQ ID NO: 50193 - DNA, 22 bp, Homo sapiens
ctgggtcagggctcctgccaaa

SEQ ID NO: 50194 - DNA, 26 bp, Homo sapiens
taggccaaggttccagcttttcaaaa

SEQ ID NO: 50195 - DNA, 21 bp, Homo sapiens
ctagttaagactccctgtcaa

SEQ ID NO: 50196 - DNA, 18 bp, Homo sapiens
ctaggtcaaaatgctaaa

SEQ ID NO: 50197 - DNA, 19 bp, Homo sapiens
ctagattaaagtggccaaa

SEQ ID NO: 50198 - DNA, 22 bp, Homo sapiens
caggtcccctcccctgctaaaa

SEQ ID NO: 50199 - DNA, 15 bp, Homo sapiens
agtcccccctgccaa

SEQ ID NO: 50200 - DNA, 18 bp, Homo sapiens
caggtcaagaatgccaaa

SEQ ID NO: 50201 - DNA, 19 bp, Homo sapiens
tgaggtcaaaggggccaaa

SEQ ID NO: 50202 - DNA, 20 bp, Homo sapiens
ctaggccagagttctcttgc

SEQ ID NO: 50203 - DNA, 21 bp, Homo sapiens
ctgggacaggggtccctgcca

SEQ ID NO: 50204 - DNA, 19 bp, Homo sapiens
ctaggccaggacccgttgc

SEQ ID NO: 50205 - DNA, 19 bp, Homo sapiens
caggtcaaggtcaggcctg

SEQ ID NO: 50206 - DNA, 17 bp, Homo sapiens
ggggtccctctgccaaa

SEQ ID NO: 50207 - DNA, 16 bp, Homo sapiens
ccaggttctcctgcca

SEQ ID NO: 50208 - DNA, 60 bp, Human papillomavirus type 7
ccaaacttgcttttaggcacatagttttactgcataaacatttagctaatagcagtttgg

SEQ ID NO: 50209 - DNA, 24 bp, Human papillomavirus type 7
acttgcttttaggcacatagtttt

SEQ ID NO: 50210 - DNA, 23 bp, Homo sapiens
acttgcctttgttgtatagtttt

SEQ ID NO: 50211 - DNA, 20 bp, Homo sapiens
ttgttttacacaatagtttt

SEQ ID NO: 50212 - DNA, 22 bp, Homo sapiens
ctgcttttatgacaatggtttt

SEQ ID NO: 50213 - DNA, 21 bp, Homo sapiens
ttgttttaataacatagtttt

SEQ ID NO: 50214 - DNA, 21 bp, Homo sapiens
gcttttagttgaagtagtttt

SEQ ID NO: 50215 - DNA, 21 bp, Homo sapiens
actttctaactacatagtttt

SEQ ID NO: 50216 - DNA, 70 bp, Human herpesvirus 8
gccacagaggtctctgctagtttgggccagcgaaacgggctatcccggtccggtggaggcagtctgtcgc

SEQ ID NO: 50217 - DNA, 24 bp, Human herpesvirus 8
tgctagtttgggccagcgaaacgg

SEQ ID NO: 50218 - DNA, 18 bp, Homo sapiens
tgctatttgggctagtca

SEQ ID NO: 50219 - DNA, 17 bp, Homo sapiens
tgcagtttgggctggaa

SEQ ID NO: 50220 - DNA, 17 bp, Homo sapiens
tgctgtttgggctggcg

SEQ ID NO: 50221 - DNA, 20 bp, Homo sapiens
gcttgaacctggcggggcgg

SEQ ID NO: 50222 - DNA, 19 bp, Homo sapiens
gcagcagccagcggggcgg

SEQ ID NO: 50223 - DNA, 21 bp, Homo sapiens
gctgcagggccagcggggcgg

SEQ ID NO: 50224 - DNA, 70 bp, Peanut chlorotic streak virus
gtagagatattgtttaatgaaattaacaatcctattaaggaattgttaaaaagaattaaacaagaggtac

SEQ ID NO: 50225 - DNA, 24 bp, Peanut chlorotic streak virus
tattgtttaatgaaattaacaatc

SEQ ID NO: 50226 - DNA, 21 bp, Homo sapiens
tattgttcaggaataacaatc

SEQ ID NO: 50227 - DNA, 21 bp, Homo sapiens
ttgtcatatgaattaacaatc

SEQ ID NO: 50228 - DNA, 70 bp, Peanut chlorotic streak virus
aataatagatctattaagacaaagcactgcggaaacgcataacaggcttagtcaaatagaatctatagtt

SEQ ID NO: 50229 - DNA, 24 bp, Peanut chlorotic streak virus
cataacaggcttagtcaaatagaa

SEQ ID NO: 50230 - DNA, 18 bp, Homo sapiens
ataacaggttacaataga

SEQ ID NO: 50231 - DNA, 19 bp, Homo sapiens
catcacaggcttgggtcaa

SEQ ID NO: 50232 - DNA, 23 bp, Homo sapiens
caaacaggcccaggtgagtagaa

SEQ ID NO: 50233 - DNA, 20 bp, Homo sapiens
acaggtctggttaaatagaa

SEQ ID NO: 50234 - DNA, 20 bp, Homo sapiens
cgaacaggccatcagaatag

SEQ ID NO: 50235 - DNA, 19 bp, Homo sapiens
cataacagattaaaataga

SEQ ID NO: 50236 - DNA, 18 bp, Homo sapiens
taacaggaataaatagaa

SEQ ID NO: 50237 - DNA, 23 bp, Homo sapiens
ataacagggctttttaaaatgga

SEQ ID NO: 50238 - DNA, 20 bp, Homo sapiens
acagaaaaagtcaaatggaa

SEQ ID NO: 50239 - DNA, 20 bp, Homo sapiens
aggccactggtcaaatagaa

SEQ ID NO: 50240 - DNA, 18 bp, Homo sapiens
aggctgaagcaaatagaa

SEQ ID NO: 50241 - DNA, 19 bp, Homo sapiens
caggcccatccaaatggaa

SEQ ID NO: 50242 - DNA, 18 bp, Homo sapiens
tgaacaggctagagtaga

SEQ ID NO: 50243 - DNA, 17 bp, Homo sapiens
acagcaagtcaaatgga

SEQ ID NO: 50244 - DNA, 22 bp, Homo sapiens
acaatttagaggtcaaatagaa

SEQ ID NO: 50245 - DNA, 22 bp, Homo sapiens
ataacaggattagtttttagaa

SEQ ID NO: 50246 - DNA, 19 bp, Homo sapiens
catacagagggagtcaaat

SEQ ID NO: 50247 - DNA, 21 bp, Homo sapiens
tgaggtcccagtcagatagaa

SEQ ID NO: 50248 - DNA, 19 bp, Homo sapiens
ggcattaagtcaaatagaa

SEQ ID NO: 50249 - DNA, 18 bp, Homo sapiens
ggtggtaatcaaatagaa

SEQ ID NO: 50250 - DNA, 19 bp, Homo sapiens
caacaggcagtggaatgga

SEQ ID NO: 50251 - DNA, 21 bp, Homo sapiens
caaaacaggaaacaaatagaa

SEQ ID NO: 50252 - DNA, 21 bp, Homo sapiens
acaggcgcctctcaaatagaa

SEQ ID NO: 50253 - DNA, 19 bp, Homo sapiens
taacagggcctccaaatag

SEQ ID NO: 50254 - DNA, 18 bp, Homo sapiens
gacggagtccaaatagaa

SEQ ID NO: 50255 - DNA, 90 bp, Human enterovirus C
aggtacctttgtacgcctgttttatatcccttcccccgtaactttagaagcttatcaaaagttcaatagcaggggtacaagccagtacct

SEQ ID NO: 50256 - DNA, 24 bp, Human enterovirus C
ttcaatagcaggggtacaagccag

SEQ ID NO: 50257 - DNA, 24 bp, Homo sapiens
ttcagtggccatgaagcaagccag

SEQ ID NO: 50258 - DNA, 19 bp, Homo sapiens
ttcaatagtggaggcaaag

SEQ ID NO: 50259 - DNA, 17 bp, Homo sapiens
ttcagaagcagaagtca

SEQ ID NO: 50260 - DNA, 22 bp, Homo sapiens
ttcagtgcggggcgcaagccag

SEQ ID NO: 50261 - DNA, 23 bp, Homo sapiens
ttctgtagccaaaagcaagccag

SEQ ID NO: 50262 - DNA, 16 bp, Homo sapiens
ttcagagcaggagagc

SEQ ID NO: 50263 - DNA, 18 bp, Homo sapiens
tagcaggaggaaagccag

SEQ ID NO: 50264 - DNA, 15 bp, Homo sapiens
ttcaatagagaagcc

SEQ ID NO: 50265 - DNA, 75 bp, Gallid herpesvirus 3
gaaacatttcagtctctctggcatctgacaacggctacgcgccactcagatgccaaaacagactggatgcgtttc

SEQ ID NO: 50266 - DNA, 24 bp, Gallid herpesvirus 3
tggcatctgacaacggctacgcgc

SEQ ID NO: 50267 - DNA, 17 bp, Homo sapiens
caactgcagcggctacg

SEQ ID NO: 50268 - DNA, 18 bp, Homo sapiens
tggcatctggcagtagct

SEQ ID NO: 50269 - DNA, 19 bp, Homo sapiens
tggcatctgatagcagggc

SEQ ID NO: 50270 - DNA, 23 bp, Homo sapiens
tggcatctgaagtgggacaatgc

SEQ ID NO: 50271 - DNA, 26 bp, Homo sapiens
tggcatctggcacatagtaagtgcgc

SEQ ID NO: 50272 - DNA, 19 bp, Homo sapiens
ggctccggcggctacgcgc

SEQ ID NO: 50273 - DNA, 18 bp, Homo sapiens
tggtgcaacggctgtgcg

SEQ ID NO: 50274 - DNA, 16 bp, Homo sapiens
ggcatctggactacgg

SEQ ID NO: 50275 - DNA, 22 bp, Homo sapiens
tggcacctggtggcagcttgcg

SEQ ID NO: 50276 - DNA, 22 bp, Homo sapiens
tggcgccgccgcggctacgcgc

SEQ ID NO: 50277 - DNA, 23 bp, Homo sapiens
tggcatctgggcttggctgtgcg

SEQ ID NO: 50278 - DNA, 19 bp, Homo sapiens
tgccatctgacgatggcgc

SEQ ID NO: 50279 - DNA, 93 bp, Human enterovirus C
ttgggtgtccgtgtttccctttatattcatactggctgcttatggtgacaatttacgaattgttaccatatagctattggattggccacccag

SEQ ID NO: 50280 - DNA, 24 bp, Human enterovirus C
taccatatagctattggattggcc

SEQ ID NO: 50281 - DNA, 19 bp, Homo sapiens
atataactcaagggattgg

SEQ ID NO: 50282 - DNA, 20 bp, Homo sapiens
caccatgtagaccaggttgg

SEQ ID NO: 50283 - DNA, 21 bp, Homo sapiens
tacctgtagctatttttgggc

SEQ ID NO: 50284 - DNA, 17 bp, Homo sapiens
atatagctggacttggc

SEQ ID NO: 50285 - DNA, 15 bp, Homo sapiens
atatagcctgttggc

SEQ ID NO: 50286 - DNA, 23 bp, Homo sapiens
taccatatactattctgcttggc

SEQ ID NO: 50287 - DNA, 81 bp, Gallid herpesvirus 3
tcggaccgctgcgattccatccttcgactagcgacttgttatggcgggtaatagccggacgacggagtctcggcggttcga

SEQ ID NO: 50288 - DNA, 24 bp, Gallid herpesvirus 3
gggtaatagccggacgacggagtc

SEQ ID NO: 50289 - DNA, 20 bp, Homo sapiens
gggtaacaggcagatggagt

SEQ ID NO: 50290 - DNA, 24 bp, Homo sapiens
gggtggtgaagacaacgatggagt

SEQ ID NO: 50291 - DNA, 24 bp, Homo sapiens
gggtgatgagtcggaaacaaagtc

SEQ ID NO: 50292 - DNA, 20 bp, Homo sapiens
gggtaatactggaaaggggt

SEQ ID NO: 50293 - DNA, 75 bp, Human adenovirus E
gaccgcatgaatcaagacatgtaaaccgtgtgtgtatgttaaatgtctttaataaacagcactttcatgttacac

SEQ ID NO: 50294 - DNA, 24 bp, Human adenovirus E
catgtaaaccgtgtgtgtatgtta

SEQ ID NO: 50295 - DNA, 23 bp, Homo sapiens
catgtgggcacgtgtgtgtggtt

SEQ ID NO: 50296 - DNA, 22 bp, Homo sapiens
catgtaatgcaggatgtatgtt

SEQ ID NO: 50297 - DNA, 18 bp, Homo sapiens
taaactgtgtgtgtgtgt

SEQ ID NO: 50298 - DNA, 17 bp, Homo sapiens
catgtaaacctggctgt

SEQ ID NO: 50299 - DNA, 21 bp, Homo sapiens
gtctaggccgtgtgtggcata

SEQ ID NO: 50300 - DNA, 18 bp, Homo sapiens
tgtaagtgcttgtatgtt

SEQ ID NO: 50301 - DNA, 22 bp, Homo sapiens
catgtgtgatacaggtgtgtgt

SEQ ID NO: 50302 - DNA, 18 bp, Homo sapiens
atatagactgtgtgtata

SEQ ID NO: 50303 - DNA, 19 bp, Homo sapiens
tgcgtgcgtgtgtgtgtgt

SEQ ID NO: 50304 - DNA, 21 bp, Homo sapiens
atgtgtgtgtgtgtgtgtgtt

SEQ ID NO: 50305 - DNA, 22 bp, Homo sapiens
tataaatagcctgtgtatgtta

SEQ ID NO: 50306 - DNA, 21 bp, Homo sapiens
atgtagacagtgtgtgcacat

SEQ ID NO: 50307 - DNA, 22 bp, Homo sapiens
tgcaagtgcgtgagtgtgtgtt

SEQ ID NO: 50308 - DNA, 87 bp, Gallid herpesvirus 3
cctttggaaacgcatccagtctgttttggcatctgagtggcgcgtagccgttgtcagatgccagagagactgaaatgtttctcgagg

SEQ ID NO: 50309 - DNA, 24 bp, Gallid herpesvirus 3
tgttttggcatctgagtggcgcgt

SEQ ID NO: 50310 - DNA, 22 bp, Homo sapiens
tgttttggttgtctgggtttgg

SEQ ID NO: 50311 - DNA, 19 bp, Homo sapiens
tgttttggtatctgtagtg

SEQ ID NO: 50312 - DNA, 20 bp, Homo sapiens
tgttttggaatttgagtgca

SEQ ID NO: 50313 - DNA, 21 bp, Homo sapiens
tgtcttggcatttggggtcgt

SEQ ID NO: 50314 - DNA, 65 bp, Alcelaphine herpesvirus 1
tgtgacatctgggacaaagaaactattttaccttttcaggtatgagactttaccctattgacaca

SEQ ID NO: 50315 - DNA, 24 bp, Alcelaphine herpesvirus 1
tgggacaaagaaactattttacct

SEQ ID NO: 50316 - DNA, 18 bp, Homo sapiens
gggacaaagaagatactt

SEQ ID NO: 50317 - DNA, 18 bp, Homo sapiens
cgggcaaattattttacc

SEQ ID NO: 50318 - DNA, 23 bp, Homo sapiens
tggggcaaaggcagctcccacct

SEQ ID NO: 50319 - DNA, 21 bp, Homo sapiens
ggacaaagaggttactaatct

SEQ ID NO: 50320 - DNA, 18 bp, Homo sapiens
ggagaaatgactttacct

SEQ ID NO: 50321 - DNA, 19 bp, Homo sapiens
tggaacaaaggaaatactt

SEQ ID NO: 50322 - DNA, 18 bp, Homo sapiens
tgggacaaagaaaattct

SEQ ID NO: 50323 - DNA, 20 bp, Homo sapiens
ggacaaaggaccaattacct

SEQ ID NO: 50324 - DNA, 20 bp, Homo sapiens
tgggacaaagaactgactct

SEQ ID NO: 50325 - DNA, 17 bp, Homo sapiens
tgagacaactattttac

SEQ ID NO: 50326 - DNA, 23 bp, Homo sapiens
gggacaaagtttgatttttacct

SEQ ID NO: 50327 - DNA, 22 bp, Homo sapiens
tggagcaaagaaatagccgcct

SEQ ID NO: 50328 - DNA, 16 bp, Homo sapiens
ggacaaagactaattt

SEQ ID NO: 50329 - DNA, 19 bp, Homo sapiens
tgggatgaagaaactttac

SEQ ID NO: 50330 - DNA, 20 bp, Homo sapiens
tgggaaagaggacatcttac

SEQ ID NO: 50331 - DNA, 18 bp, Homo sapiens
ggacagagaaatccactt

SEQ ID NO: 50332 - DNA, 23 bp, Homo sapiens
tgggactagggagcctcctacct

SEQ ID NO: 50333 - DNA, 82 bp, Human herpesvirus 8
tcctgtccgctgtgtggaccatgacgcttgacctgggactagattgcaccggcaaagcccaggcgattcccatgcgacagga

SEQ ID NO: 50334 - DNA, 24 bp, Human herpesvirus 8
gacctgggactagattgcaccggc

SEQ ID NO: 50335 - DNA, 18 bp, Homo sapiens
aacctggggctgcactgg

SEQ ID NO: 50336 - DNA, 20 bp, Homo sapiens
ctgggactggcacagtcggc

SEQ ID NO: 50337 - DNA, 18 bp, Homo sapiens
gacctgggaactggctgg

SEQ ID NO: 50338 - DNA, 23 bp, Homo sapiens
gacctgggacctgggacagtggc

SEQ ID NO: 50339 - DNA, 20 bp, Homo sapiens
cctgggactgccttgctggc

SEQ ID NO: 50340 - DNA, 23 bp, Homo sapiens
gagctgggactgggcaagctggc

SEQ ID NO: 50341 - DNA, 18 bp, Homo sapiens
cctgggacaggattgagg

SEQ ID NO: 50342 - DNA, 20 bp, Homo sapiens
ccttgggttagatctctcgg

SEQ ID NO: 50343 - DNA, 19 bp, Homo sapiens
gacctgggaccggactggc

SEQ ID NO: 50344 - DNA, 20 bp, Homo sapiens
gacctggggctagggcatgg

SEQ ID NO: 50345 - DNA, 21 bp, Homo sapiens
gacccggggctgggctgccgg

SEQ ID NO: 50346 - DNA, 19 bp, Homo sapiens
cctgggactagcccgctgg

SEQ ID NO: 50347 - DNA, 18 bp, Homo sapiens
cctgggacgaggcggggc

SEQ ID NO: 50348 - DNA, 23 bp, Homo sapiens
gacctgggattggggtgcagggc

SEQ ID NO: 50349 - DNA, 16 bp, Homo sapiens
cctgggaccaggccgg

SEQ ID NO: 50350 - DNA, 18 bp, Homo sapiens
tgggaccagattgagggc

SEQ ID NO: 50351 - DNA, 23 bp, Homo sapiens
gacttgggttgatcctaactggc

SEQ ID NO: 50352 - DNA, 25 bp, Homo sapiens
cctgggaccagctcctttgcatcgg

SEQ ID NO: 50353 - DNA, 19 bp, Homo sapiens
gacctggagctgctgctgg

SEQ ID NO: 50354 - DNA, 19 bp, Homo sapiens
gacctggaggctgcaaggc

SEQ ID NO: 50355 - DNA, 18 bp, Homo sapiens
gacctgggctggatgggc

SEQ ID NO: 50356 - DNA, 20 bp, Homo sapiens
cctgggacagtgcggctggc

SEQ ID NO: 50357 - DNA, 23 bp, Homo sapiens
gacctgggcctggggagcttggc

SEQ ID NO: 50358 - DNA, 22 bp, Homo sapiens
gacttggattgccagcaccggc

SEQ ID NO: 50359 - DNA, 18 bp, Homo sapiens
gacctgggctgacattgg

SEQ ID NO: 50360 - DNA, 19 bp, Homo sapiens
gacctgggactggagctgg

SEQ ID NO: 50361 - DNA, 21 bp, Homo sapiens
gacctgggctgggggcccggc

SEQ ID NO: 50362 - DNA, 21 bp, Homo sapiens
gacctggggcggtgtcctggc

SEQ ID NO: 50363 - DNA, 19 bp, Homo sapiens
gacctggggcaggcccgac

SEQ ID NO: 50364 - DNA, 88 bp, Human herpesvirus 8
cgtgaatgggggcagtgcacgcaccaggatccagactggtccaagcgtctgggtcgtggcgcctttggcataatcgtccctatctccg

SEQ ID NO: 50365 - DNA, 24 bp, Human herpesvirus 8
acgcaccaggatccagactggtcc

SEQ ID NO: 50366 - DNA, 18 bp, Homo sapiens
gcaccagaatccagtact

SEQ ID NO: 50367 - DNA, 19 bp, Homo sapiens
gcacttgcatcagactggt

SEQ ID NO: 50368 - DNA, 17 bp, Homo sapiens
ccaggatcgagagaatc

SEQ ID NO: 50369 - DNA, 22 bp, Homo sapiens
accatcgtaaccagactggtcc

SEQ ID NO: 50370 - DNA, 21 bp, Homo sapiens
gctacaacatcagactggtcc

SEQ ID NO: 50371 - DNA, 20 bp, Homo sapiens
cacaccaggatctgaaaatc

SEQ ID NO: 50372 - DNA, 18 bp, Homo sapiens
acactgatgggactggtc

SEQ ID NO: 50373 - DNA, 15 bp, Homo sapiens
accaggatgatggtc

SEQ ID NO: 50374 - DNA, 16 bp, Homo sapiens
gcaccaggaggctggt

SEQ ID NO: 50375 - DNA, 20 bp, Homo sapiens
gcaccaggatctagcacatc

SEQ ID NO: 50376 - DNA, 21 bp, Homo sapiens
acgatgttggccagactggtc

SEQ ID NO: 50377 - DNA, 19 bp, Homo sapiens
accaccaggagcactggtc

SEQ ID NO: 50378 - DNA, 20 bp, Homo sapiens
cgcgcaggatccggaagggc

SEQ ID NO: 50379 - DNA, 21 bp, Homo sapiens
cgcaccagggtggcgtggtcc

SEQ ID NO: 50380 - DNA, 16 bp, Homo sapiens
gcaccggattcaaggt

SEQ ID NO: 50381 - DNA, 17 bp, Homo sapiens
accaggattcactgtcc

SEQ ID NO: 50382 - DNA, 18 bp, Homo sapiens
cgcctcaggatccagggt

SEQ ID NO: 50383 - DNA, 24 bp, Homo sapiens
gcgaccagtccaatcaggctggtc

SEQ ID NO: 50384 - DNA, 17 bp, Homo sapiens
acgtccaggatctggcc

SEQ ID NO: 50385 - DNA, 21 bp, Homo sapiens
accattttgaccagactggtc

SEQ ID NO: 50386 - DNA, 20 bp, Homo sapiens
acgcgccggatccaggttgg

SEQ ID NO: 50387 - DNA, 17 bp, Homo sapiens
gcaccagaaggctggtc

SEQ ID NO: 50388 - DNA, 23 bp, Homo sapiens
cgcactgggcgttgggactggtc

SEQ ID NO: 50389 - DNA, 21 bp, Homo sapiens
acggccaggatcacgtggtcc

SEQ ID NO: 50390 - DNA, 17 bp, Homo sapiens
acccaattcagactggt

SEQ ID NO: 50391 - DNA, 17 bp, Homo sapiens
gcacccctagactggtc

SEQ ID NO: 50392 - DNA, 19 bp, Homo sapiens
gctcaggatccacgccttc

SEQ ID NO: 50393 - DNA, 22 bp, Homo sapiens
acattcagtgttggactggtcc

SEQ ID NO: 50394 - DNA, 15 bp, Homo sapiens
gcaccagggactggt

SEQ ID NO: 50395 - DNA, 22 bp, Homo sapiens
gcaccagtccccgggttggtcc

SEQ ID NO: 50396 - DNA, 21 bp, Homo sapiens
cgcgccgggatccagggctcc

SEQ ID NO: 50397 - DNA, 16 bp, Homo sapiens
gcaccagagactggtc

SEQ ID NO: 50398 - DNA, 16 bp, Homo sapiens
cgcgccaggacccggt

SEQ ID NO: 50399 - DNA, 19 bp, Homo sapiens
gcaccactcgagactggtc

SEQ ID NO: 50400 - DNA, 18 bp, Homo sapiens
ccaggatctagaaccttc

SEQ ID NO: 50401 - DNA, 22 bp, Homo sapiens
acgtatccggatccagtgtggt

SEQ ID NO: 50402 - DNA, 16 bp, Homo sapiens
acacaccagggctggt

SEQ ID NO: 50403 - DNA, 17 bp, Homo sapiens
acgcgccggggaccggc

SEQ ID NO: 50404 - DNA, 16 bp, Homo sapiens
gcccgggagactggtc

SEQ ID NO: 50405 - DNA, 16 bp, Homo sapiens
caccaggatctgggcc

SEQ ID NO: 50406 - DNA, 18 bp, Homo sapiens
gcggtcaggatccctggt

SEQ ID NO: 50407 - DNA, 18 bp, Homo sapiens
gcccaggatctacccttc

SEQ ID NO: 50408 - DNA, 21 bp, Homo sapiens
acgcggcaggatccgggaggc

SEQ ID NO: 50409 - DNA, 18 bp, Homo sapiens
gctgccaggatctagact

SEQ ID NO: 50410 - DNA, 19 bp, Homo sapiens
cgctgggatccaggcttcc

SEQ ID NO: 50411 - DNA, 18 bp, Homo sapiens
accaccaggatctgtaac

SEQ ID NO: 50412 - DNA, 23 bp, Homo sapiens
gcacgttcccgccagactggtcc

SEQ ID NO: 50413 - DNA, 21 bp, Homo sapiens
cctctggattcagactggtcc

SEQ ID NO: 50414 - DNA, 22 bp, Homo sapiens
acagtgtgagttcagactggtc

SEQ ID NO: 50415 - DNA, 22 bp, Homo sapiens
gctggatccagccagcctggtc

SEQ ID NO: 50416 - DNA, 72 bp, Cricket paralysis virus
ggtttatgtcaaaggagaaggtgattttaattgcacctgaagcaaccctaggtcttccctttgatgtgagct

SEQ ID NO: 50417 - DNA, 24 bp, Cricket paralysis virus
tatgtcaaaggagaaggtgatttt

SEQ ID NO: 50418 - DNA, 21 bp, Homo sapiens
tggtaaagggaaggtgatttt

SEQ ID NO: 50419 - DNA, 19 bp, Homo sapiens
tatgtcaaaggaaaaaggt

SEQ ID NO: 50420 - DNA, 23 bp, Homo sapiens
atgtcaaaggagacgattatttt

SEQ ID NO: 50421 - DNA, 19 bp, Homo sapiens
tatgtcaaagtagaagctg

SEQ ID NO: 50422 - DNA, 22 bp, Homo sapiens
tgtcttggatattggtgatttt

SEQ ID NO: 50423 - DNA, 17 bp, Homo sapiens
tatgtaaaggagaggtg

SEQ ID NO: 50424 - DNA, 21 bp, Homo sapiens
tatgtcgggggatttgatttt

SEQ ID NO: 50425 - DNA, 23 bp, Homo sapiens
atgttaaaggggagaacaatttt

SEQ ID NO: 50426 - DNA, 20 bp, Homo sapiens
tgtaaaggagaagggatttt

SEQ ID NO: 50427 - DNA, 75 bp, Cricket paralysis virus
cgccactgccgctcaggtacagtaggacataccccaaatattgggttccactcgtagagaagaaaattagtggcg

SEQ ID NO: 50428 - DNA, 24 bp, Cricket paralysis virus
ctcaggtacagtaggacatacccc

SEQ ID NO: 50429 - DNA, 18 bp, Homo sapiens
catgtagctgacataccc

SEQ ID NO: 50430 - DNA, 19 bp, Homo sapiens
ctcaggtacaaggtgttcc

SEQ ID NO: 50431 - DNA, 16 bp, Homo sapiens
ctcaggtacatacata

SEQ ID NO: 50432 - DNA, 22 bp, Homo sapiens
ctcaagtatggtaaaagtgtcc

SEQ ID NO: 50433 - DNA, 15 bp, Homo sapiens
ctcagatataggcac

SEQ ID NO: 50434 - DNA, 18 bp, Homo sapiens
tcatgtacagtaagtcat

SEQ ID NO: 50435 - DNA, 19 bp, Homo sapiens
tcaggtacatagggtacac

SEQ ID NO: 50436 - DNA, 17 bp, Homo sapiens
ggtacaataaatgtacc

SEQ ID NO: 50437 - DNA, 22 bp, Homo sapiens
tcaggtacatgggcgtggaccc

SEQ ID NO: 50438 - DNA, 20 bp, Homo sapiens
ccagggataggacatgctcc

SEQ ID NO: 50439 - DNA, 21 bp, Homo sapiens
ccaggtacagtctgtcatgcc

SEQ ID NO: 50440 - DNA, 19 bp, Homo sapiens
tcaggctgttgtaggacat

SEQ ID NO: 50441 - DNA, 20 bp, Homo sapiens
ctcaggtaagtgactcagcc

SEQ ID NO: 50442 - DNA, 21 bp, Homo sapiens
tcaggtactagaatttacata

SEQ ID NO: 50443 - DNA, 20 bp, Homo sapiens
caggtgtggtggcatacccc

SEQ ID NO: 50444 - DNA, 22 bp, Homo sapiens
ctcaggcaggtgggatgtgccc

SEQ ID NO: 50445 - DNA, 18 bp, Homo sapiens
ctcagtacagtagggccc

SEQ ID NO: 50446 - DNA, 17 bp, Homo sapiens
cccaggtacggtagtcc

SEQ ID NO: 50447 - DNA, 24 bp, Homo sapiens
tcaggtactgtgtcaagatgtgcc

SEQ ID NO: 50448 - DNA, 18 bp, Homo sapiens
ctcaggtacagtgtaagg

SEQ ID NO: 50449 - DNA, 17 bp, Homo sapiens
aggtatagaacaccacc

SEQ ID NO: 50450 - DNA, 16 bp, Homo sapiens
ggcacagtgatatccc

SEQ ID NO: 50451 - DNA, 17 bp, Homo sapiens
ctcaagtactagcccat

SEQ ID NO: 50452 - DNA, 19 bp, Homo sapiens
ctcaggtacagagaacccc

SEQ ID NO: 50453 - DNA, 16 bp, Homo sapiens
tcagatacgcacacat

SEQ ID NO: 50454 - DNA, 21 bp, Homo sapiens
ctcaggtattaaccatgcccc

SEQ ID NO: 50455 - DNA, 20 bp, Homo sapiens
ctcaggcatactcatactcc

SEQ ID NO: 50456 - DNA, 18 bp, Homo sapiens
ctcaggtaccagtggcat

SEQ ID NO: 50457 - DNA, 21 bp, Homo sapiens
caggtacagccgaccatgccc

SEQ ID NO: 50458 - DNA, 19 bp, Homo sapiens
ctcaggtacgatggccgcc

SEQ ID NO: 50459 - DNA, 20 bp, Homo sapiens
ctcaggacatggcgtactcc

SEQ ID NO: 50460 - DNA, 17 bp, Homo sapiens
ctcaggtatggtacacc

SEQ ID NO: 50461 - DNA, 22 bp, Homo sapiens
ctcaggtatggggcagaatccc

SEQ ID NO: 50462 - DNA, 75 bp, Cricket paralysis virus
gtgacctggaaatgctccccgtgagaaaccttgtttaaacgcacttggaccttctccggcctcagcgccaggcat

SEQ ID NO: 50463 - DNA, 24 bp, Cricket paralysis virus
ttggaccttctccggcctcagcgc

SEQ ID NO: 50464 - DNA, 21 bp, Homo sapiens
gacctttttgcctttcagtgc

SEQ ID NO: 50465 - DNA, 18 bp, Homo sapiens
ttgggtttctcctcagca

SEQ ID NO: 50466 - DNA, 21 bp, Homo sapiens
ttggaccttctctgctggagc

SEQ ID NO: 50467 - DNA, 18 bp, Homo sapiens
ttggctttctccgggacg

SEQ ID NO: 50468 - DNA, 19 bp, Homo sapiens
tggaccttctctggaggcg

SEQ ID NO: 50469 - DNA, 19 bp, Homo sapiens
gaccttctcaagatggcgc

SEQ ID NO: 50470 - DNA, 22 bp, Homo sapiens
ttggaccttcactggttctggc

SEQ ID NO: 50471 - DNA, 21 bp, Homo sapiens
ttggtcttctccccaacagcg

SEQ ID NO: 50472 - DNA, 109 bp, Cricket paralysis virus
gtttggacttagacttgctctatgttacaattgggaggagcgtgacttaccattggtcgttgatgacgttaattccaaacaaaaacaacaacaacaacttagtttaaat

SEQ ID NO: 50473 - DNA, 24 bp, Cricket paralysis virus
acttgctctatgttacaattggga

SEQ ID NO: 50474 - DNA, 19 bp, Homo sapiens
ttgtctatgttatcatgga

SEQ ID NO: 50475 - DNA, 18 bp, Homo sapiens
tctctgcttgaattggga

SEQ ID NO: 50476 - DNA, 23 bp, Homo sapiens
cttgctctgtgtctgactttggg

SEQ ID NO: 50477 - DNA, 18 bp, Homo sapiens
ctgctctcctaattggga

SEQ ID NO: 50478 - DNA, 22 bp, Homo sapiens
acttgctctcatgttgctttgg

SEQ ID NO: 50479 - DNA, 19 bp, Homo sapiens
acttgctctgctgtctggg

SEQ ID NO: 50480 - DNA, 17 bp, Homo sapiens
ctgcttttgtaattggg

SEQ ID NO: 50481 - DNA, 23 bp, Homo sapiens
acttgcctatgttgctactggga

SEQ ID NO: 50482 - DNA, 17 bp, Homo sapiens
cttgctctaagcttggg

SEQ ID NO: 50483 - DNA, 26 bp, Homo sapiens
ttgccctatgtgatgcccggttggga

SEQ ID NO: 50484 - DNA, 24 bp, Homo sapiens
cttgctctagactaaatagttggg

SEQ ID NO: 50485 - DNA, 20 bp, Homo sapiens
ttactgcattgtaattggga

SEQ ID NO: 50486 - DNA, 18 bp, Homo sapiens
gctcgtgttataattggg

SEQ ID NO: 50487 - DNA, 89 bp, Amsacta moorei entomopoxvirus
ataatcatcttttaaattatttataatatcttctaaatcatttaatttgttaattatagaagtattatctatattttcaagaatattat

SEQ ID NO: 50488 - DNA, 24 bp, Amsacta moorei entomopoxvirus
tataatatcttctaaatcatttaa

SEQ ID NO: 50489 - DNA, 21 bp, Homo sapiens
ataatatcttatcttcattta

SEQ ID NO: 50490 - DNA, 25 bp, Homo sapiens
tataacattttctgaattcacttaa

SEQ ID NO: 50491 - DNA, 22 bp, Homo sapiens
ataatatcttctaaattactta

SEQ ID NO: 50492 - DNA, 23 bp, Homo sapiens
tataattcttctaaatatcattt

SEQ ID NO: 50493 - DNA, 18 bp, Homo sapiens
tacaatatcttctaaatc

SEQ ID NO: 50494 - DNA, 22 bp, Homo sapiens
tacaatattattaaatcattta

SEQ ID NO: 50495 - DNA, 61 bp, Amsacta moorei entomopoxvirus
gatcaattggaatgtttaataaaagtttgtctaatttcatatttaaaattctaaattgatc

SEQ ID NO: 50496 - DNA, 24 bp, Amsacta moorei entomopoxvirus
ttcatatttaaaattctaaattga

SEQ ID NO: 50497 - DNA, 18 bp, Homo sapiens
ttcatatttaagaattct

SEQ ID NO: 50498 - DNA, 23 bp, Homo sapiens
ttcatacttgattccaaaattga

SEQ ID NO: 50499 - DNA, 18 bp, Homo sapiens
ttcacatttaaaattact

SEQ ID NO: 50500 - DNA, 25 bp, Homo sapiens
ttcatatttgaaattcaattcattg

SEQ ID NO: 50501 - DNA, 23 bp, Homo sapiens
ttcatatttgcagcccaaattga

SEQ ID NO: 50502 - DNA, 20 bp, Homo sapiens
tacataaaattctaagttga

SEQ ID NO: 50503 - DNA, 22 bp, Homo sapiens
ttcatcttaagttctaaattga

SEQ ID NO: 50504 - DNA, 18 bp, Homo sapiens
ttcatctttaaaattcca

SEQ ID NO: 50505 - DNA, 73 bp, Amsacta moorei entomopoxvirus
gttaattgcattattaataatattgataatattattattaatattattaatactattagtaagatcagttaat

SEQ ID NO: 50506 - DNA, 24 bp, Amsacta moorei entomopoxvirus
ttaatactattagtaagatcagtt

SEQ ID NO: 50507 - DNA, 23 bp, Homo sapiens
ttaatacattagtaagcagagtt

SEQ ID NO: 50508 - DNA, 22 bp, Homo sapiens
ttaatgtattagtcaaccagtt

SEQ ID NO: 50509 - DNA, 24 bp, Homo sapiens
ttagtacaggcctacagatcagtt

SEQ ID NO: 50510 - DNA, 21 bp, Homo sapiens
ttaatactattcctgtcagtt

SEQ ID NO: 50511 - DNA, 19 bp, Homo sapiens
ttagtactattagttagat

SEQ ID NO: 50512 - DNA, 74 bp, Bovine herpesvirus 4
ggtttatgtcacgtgaccaacacccgtaaccttacagtctcactcaacaacccctgtccaggtgacaaacaacc

SEQ ID NO: 50513 - DNA, 24 bp, Bovine herpesvirus 4
tatgtcacgtgaccaacacccgta

SEQ ID NO: 50514 - DNA, 18 bp, Homo sapiens
gtcacatgagacacctgt

SEQ ID NO: 50515 - DNA, 18 bp, Homo sapiens
tatgtcacgtggcctgca

SEQ ID NO: 50516 - DNA, 24 bp, Homo sapiens
tatgccacattcttaacatttgta

SEQ ID NO: 50517 - DNA, 19 bp, Homo sapiens
tgtcctcaccaacacctgt

SEQ ID NO: 50518 - DNA, 23 bp, Homo sapiens
tatatacacatgctgacacccgt

SEQ ID NO: 50519 - DNA, 118 bp, Fowlpox virus
gttttatgtgtgttaatattattattgctgggttatatatatagaactgtcaggataaaatatacctacggtgtatatatttaaatctaaaataataagaaaataacaaaaataaaat

SEQ ID NO: 50520 - DNA, 24 bp, Fowlpox virus
tatagaactgtcaggataaaatat

SEQ ID NO: 50521 - DNA, 21 bp, Homo sapiens
tacggaactgtccatagagat

SEQ ID NO: 50522 - DNA, 21 bp, Homo sapiens
tataaaacggggataaaatat

SEQ ID NO: 50523 - DNA, 18 bp, Homo sapiens
aaacttgggataaaatat

SEQ ID NO: 50524 - DNA, 24 bp, Homo sapiens
tataagaaaatgcggataaaatat

SEQ ID NO: 50525 - DNA, 20 bp, Homo sapiens
catagaactatataaaatat

SEQ ID NO: 50526 - DNA, 21 bp, Homo sapiens
tataaggctgtcaaactaaaa

SEQ ID NO: 50527 - DNA, 20 bp, Homo sapiens
tatacaactgtcatcagata

SEQ ID NO: 50528 - DNA, 17 bp, Homo sapiens
tgagaacccaggataaa

SEQ ID NO: 50529 - DNA, 20 bp, Homo sapiens
tatagaactattcaaagata

SEQ ID NO: 50530 - DNA, 19 bp, Homo sapiens
taagaactctgataaaata

SEQ ID NO: 50531 - DNA, 18 bp, Homo sapiens
gaaaccaggatgaaatat

SEQ ID NO: 50532 - DNA, 24 bp, Homo sapiens
tatagaacatccaaaataagatat

SEQ ID NO: 50533 - DNA, 18 bp, Homo sapiens
tagaaatgtggataaaat

SEQ ID NO: 50534 - DNA, 64 bp, Ictalurid herpesvirus 1
cgttgatgtattgtgtccatgtgtatcaaataaactttttggttcaccagagaccgtatcaatg

SEQ ID NO: 50535 - DNA, 24 bp, Ictalurid herpesvirus 1
tattgtgtccatgtgtatcaaata

SEQ ID NO: 50536 - DNA, 19 bp, Homo sapiens
tatttgtccatgggaacaa

SEQ ID NO: 50537 - DNA, 18 bp, Homo sapiens
tattgtgttttccacata

SEQ ID NO: 50538 - DNA, 19 bp, Homo sapiens
tactgtgtttatatgtgta

SEQ ID NO: 50539 - DNA, 24 bp, Homo sapiens
tattgtgtccagttcccccaaata

SEQ ID NO: 50540 - DNA, 23 bp, Homo sapiens
tattgtgtctgtggtacagtcaa

SEQ ID NO: 50541 - DNA, 24 bp, Homo sapiens
tattgtattcacttttgtcaaata

SEQ ID NO: 50542 - DNA, 21 bp, Homo sapiens
tattgtgctgatgagtcaaat

SEQ ID NO: 50543 - DNA, 16 bp, Homo sapiens
ttggtcccatgcatca

SEQ ID NO: 50544 - DNA, 17 bp, Homo sapiens
tattgtggttgtatatc

SEQ ID NO: 50545 - DNA, 22 bp, Homo sapiens
tgtgtctggtggtaatcaaata

SEQ ID NO: 50546 - DNA, 21 bp, Homo sapiens
ttgtgtccgtgtgtacccaat

SEQ ID NO: 50547 - DNA, 20 bp, Homo sapiens
cattgtgtctgtgtgactca

SEQ ID NO: 50548 - DNA, 15 bp, Homo sapiens
tattgtgctatcaaa

SEQ ID NO: 50549 - DNA, 69 bp, Avian carcinoma virus
ctgaggggaccatgatatgtataggcgaaaggcggggcttcggttgtacgcggttaggagtcccctcag

SEQ ID NO: 50550 - DNA, 23 bp, Avian carcinoma virus
tacgcggttaggagtcccctcag

SEQ ID NO: 50551 - DNA, 19 bp, Homo sapiens
ggttaggaaaggccctcag

SEQ ID NO: 50552 - DNA, 18 bp, Homo sapiens
gccatcgcgggtcccctc

SEQ ID NO: 50553 - DNA, 18 bp, Homo sapiens
tacgcggttgcctcctca

SEQ ID NO: 50554 - DNA, 19 bp, Homo sapiens
gctggttgcaagccctcag

SEQ ID NO: 50555 - DNA, 18 bp, Homo sapiens
tgagtgcagggtcccctc

SEQ ID NO: 50556 - DNA, 19 bp, Homo sapiens
cgcggttaggcgggccctc

SEQ ID NO: 50557 - DNA, 16 bp, Homo sapiens
gcggggtgtcccctca

SEQ ID NO: 50558 - DNA, 19 bp, Homo sapiens
acgcggtctccatcctctc

SEQ ID NO: 50559 - DNA, 21 bp, Homo sapiens
cgaggctgggagtcccctcag

SEQ ID NO: 50560 - DNA, 21 bp, Homo sapiens
gcgcttcaggagtcccttcag

SEQ ID NO: 50561 - DNA, 90 bp, Avian carcinoma virus
acttagaataccccaaactagactccgtgtgatagctggttggatcgttaatcggacggctggcacacggaatgtaggaggtcgctgagt

SEQ ID NO: 50562 - DNA, 24 bp, Avian carcinoma virus
ggacggctggcacacggaatgtag

SEQ ID NO: 50563 - DNA, 15 bp, Homo sapiens
ggctggcacagagta

SEQ ID NO: 50564 - DNA, 21 bp, Homo sapiens
ggacggcctggtgtggggtag

SEQ ID NO: 50565 - DNA, 19 bp, Homo sapiens
ggaggctggcacatgatgt

SEQ ID NO: 50566 - DNA, 17 bp, Homo sapiens
ggaggctggcacgtgca

SEQ ID NO: 50567 - DNA, 19 bp, Homo sapiens
ggacggctgggcagaggta

SEQ ID NO: 50568 - DNA, 20 bp, Homo sapiens
ggaggctggcatgaccctgt

SEQ ID NO: 50569 - DNA, 24 bp, Homo sapiens
ggacggctcgagctgggagtgtag

SEQ ID NO: 50570 - DNA, 17 bp, Homo sapiens
gacggtggcgggatgta

SEQ ID NO: 50571 - DNA, 20 bp, Homo sapiens
agatggctggcatgtaaatg

SEQ ID NO: 50572 - DNA, 16 bp, Homo sapiens
ggaggctggggaatgt

SEQ ID NO: 50573 - DNA, 127 bp, Bovine herpesvirus 4
cagtgtttcaaaagtagcataaacactatccattccaagtctgtagagtaacaagtgtttcaggtataaatgctgcactgggttgatattggactggggtaaaaaatatagtgaattttgagacctg

SEQ ID NO: 50574 - DNA, 24 bp, Bovine herpesvirus 4
cactgggttgatattggactgggg

SEQ ID NO: 50575 - DNA, 21 bp, Homo sapiens
cacggggttgatggggtgggg

SEQ ID NO: 50576 - DNA, 19 bp, Homo sapiens
cactgggatgaaaactggg

SEQ ID NO: 50577 - DNA, 21 bp, Homo sapiens
ctgggttggcggaggctgggg

SEQ ID NO: 50578 - DNA, 18 bp, Homo sapiens
actggagttgggactggg

SEQ ID NO: 50579 - DNA, 21 bp, Homo sapiens
ctgggttggacatgactgggg

SEQ ID NO: 50580 - DNA, 21 bp, Homo sapiens
cactgggtgatgttggatggg

SEQ ID NO: 50581 - DNA, 22 bp, Homo sapiens
cactgggtgggtaggtgtgggg

SEQ ID NO: 50582 - DNA, 23 bp, Homo sapiens
cactgggtttattgaaactgggg

SEQ ID NO: 50583 - DNA, 16 bp, Homo sapiens
gcttattggactgggg

SEQ ID NO: 50584 - DNA, 21 bp, Homo sapiens
actgggttgagctgactgggg

SEQ ID NO: 50585 - DNA, 21 bp, Homo sapiens
cactgggctgggaagttgggg

SEQ ID NO: 50586 - DNA, 16 bp, Homo sapiens
ctggggttggactggg

SEQ ID NO: 50587 - DNA, 17 bp, Homo sapiens
ctgggttgggtgctggg

SEQ ID NO: 50588 - DNA, 21 bp, Homo sapiens
ctgggctgccccaggctgggg

SEQ ID NO: 50589 - DNA, 23 bp, Homo sapiens
catagggtttctaaggactgggg

SEQ ID NO: 50590 - DNA, 25 bp, Homo sapiens
cacagggttgattgatcagttgggg

SEQ ID NO: 50591 - DNA, 21 bp, Homo sapiens
tgggtattctgtggactgggg

SEQ ID NO: 50592 - DNA, 15 bp, Homo sapiens
gggttgtagactggg

SEQ ID NO: 50593 - DNA, 95 bp, Ateline herpesvirus 3
atattgtttcctagatatgctggcagtttgtatgattttaattgttgggaacaactaagtgcaaaaaaattagcaaaagaatttagaaaccttat

SEQ ID NO: 50594 - DNA, 24 bp, Ateline herpesvirus 3
taagtgcaaaaaaattagcaaaag

SEQ ID NO: 50595 - DNA, 20 bp, Homo sapiens
taagtgcacagaaaaaagca

SEQ ID NO: 50596 - DNA, 18 bp, Homo sapiens
aagtgcaaaaaaggcaaa

SEQ ID NO: 50597 - DNA, 17 bp, Homo sapiens
taagtgaaaaaaattag

SEQ ID NO: 50598 - DNA, 18 bp, Homo sapiens
aagtgcaaaaaacaaaaa

SEQ ID NO: 50599 - DNA, 20 bp, Homo sapiens
taagtgcaaaaggtaacaaa

SEQ ID NO: 50600 - DNA, 17 bp, Homo sapiens
taaggcaaaaaaattaa

SEQ ID NO: 50601 - DNA, 19 bp, Homo sapiens
caagtgcaaaactcaagca

SEQ ID NO: 50602 - DNA, 17 bp, Homo sapiens
aggcaaatgtagcaaaa

SEQ ID NO: 50603 - DNA, 16 bp, Homo sapiens
taagtgcaaaagcaaa

SEQ ID NO: 50604 - DNA, 21 bp, Homo sapiens
taagtgcaaaaaaagcaaaaa

SEQ ID NO: 50605 - DNA, 24 bp, Homo sapiens
aatgcaaagaaaactactcaaaag

SEQ ID NO: 50606 - DNA, 16 bp, Homo sapiens
taagtgcaataaccag

SEQ ID NO: 50607 - DNA, 25 bp, Homo sapiens
taagtgcaatagagttaaaaattaa

SEQ ID NO: 50608 - DNA, 25 bp, Homo sapiens
taagtgcagaaaagtttattagaaa

SEQ ID NO: 50609 - DNA, 19 bp, Homo sapiens
taagagcaaaaggacagca

SEQ ID NO: 50610 - DNA, 21 bp, Homo sapiens
agtgcagaaaaatttctcaaa

SEQ ID NO: 50611 - DNA, 18 bp, Homo sapiens
taagtacaaaaaaatcaa

SEQ ID NO: 50612 - DNA, 19 bp, Homo sapiens
agtgcaaaaatagcagaag

SEQ ID NO: 50613 - DNA, 129 bp, Ateline herpesvirus 3
gacttgggtcttgcaacgctacactctggcaatcatccaacagaaatttgtctaaagagctctagaggaaagattttgtataatatggcatgcgctagagatgtttttttattatgcaaggacccagtt

SEQ ID NO: 50614 - DNA, 24 bp, Ateline herpesvirus 3
tggcatgcgctagagatgtttttt

SEQ ID NO: 50615 - DNA, 24 bp, Homo sapiens
tggcatttactgaaggtgtttttt

SEQ ID NO: 50616 - DNA, 22 bp, Homo sapiens
gcatgtgaatttaatgtttttt

SEQ ID NO: 50617 - DNA, 20 bp, Homo sapiens
tggtgcaagagatgtttttt

SEQ ID NO: 50618 - DNA, 17 bp, Homo sapiens
tggcagtgctagagatg

SEQ ID NO: 50619 - DNA, 17 bp, Homo sapiens
tggcttgcgttgctttt

SEQ ID NO: 50620 - DNA, 22 bp, Homo sapiens
tgggtgcatttggatgtttttt

SEQ ID NO: 50621 - DNA, 81 bp, Ateline herpesvirus 3
ttattgttggaaaaattttagcccaaaacattgacatagcgtcgttgttttacacaatgttagaatgtgttgaaaaaatga

SEQ ID NO: 50622 - DNA, 21 bp, Ateline herpesvirus 3
tagaatgtgttgaaaaaatga

SEQ ID NO: 50623 - DNA, 18 bp, Homo sapiens
agaatatataaaaaatga

SEQ ID NO: 50624 - DNA, 19 bp, Homo sapiens
gaaaagccttgaaagaatg

SEQ ID NO: 50625 - DNA, 18 bp, Homo sapiens
gaatgctatgaaaaatga

SEQ ID NO: 50626 - DNA, 20 bp, Homo sapiens
tagaacatgagaaaaagtga

SEQ ID NO: 50627 - DNA, 20 bp, Homo sapiens
taaaatgtagtaaaaaatga

SEQ ID NO: 50628 - DNA, 20 bp, Homo sapiens
tagaatgtgtgttacaatga

SEQ ID NO: 50629 - DNA, 20 bp, Homo sapiens
gaatgtatacttaaaaatga

SEQ ID NO: 50630 - DNA, 19 bp, Homo sapiens
agaatgaaaaaaaaaatga

SEQ ID NO: 50631 - DNA, 18 bp, Homo sapiens
agaatgtgaagaaaatga

SEQ ID NO: 50632 - DNA, 17 bp, Homo sapiens
aaatgtgcttaaaatga

SEQ ID NO: 50633 - DNA, 20 bp, Homo sapiens
cagaaacattgaaaaaatga

SEQ ID NO: 50634 - DNA, 19 bp, Homo sapiens
cagacatttgaaaaaatga

SEQ ID NO: 50635 - DNA, 19 bp, Homo sapiens
tagaatgtctctgaaaatg

SEQ ID NO: 50636 - DNA, 22 bp, Homo sapiens
gaatgcatggctggaaaaatga

SEQ ID NO: 50637 - DNA, 18 bp, Homo sapiens
tgtgttttgaaaaaatga

SEQ ID NO: 50638 - DNA, 19 bp, Homo sapiens
aatgtcctgaaaaaggtga

SEQ ID NO: 50639 - DNA, 19 bp, Homo sapiens
gaatgggaagaaaaaatga

SEQ ID NO: 50640 - DNA, 19 bp, Homo sapiens
cagagtagccaaaaaaatg

SEQ ID NO: 50641 - DNA, 19 bp, Homo sapiens
agaattctgtgaaaaaatg

SEQ ID NO: 50642 - DNA, 19 bp, Homo sapiens
tagatgtgttgcatcatga

SEQ ID NO: 50643 - DNA, 19 bp, Homo sapiens
tagaagtactgaaaaatga

SEQ ID NO: 50644 - DNA, 18 bp, Homo sapiens
agaatgtgtctcaagtga

SEQ ID NO: 50645 - DNA, 21 bp, Homo sapiens
gaatatgtagaatcaaaatga

SEQ ID NO: 50646 - DNA, 18 bp, Homo sapiens
aaatgcatcagaaaaatg

SEQ ID NO: 50647 - DNA, 19 bp, Homo sapiens
gattgtgggaaaaaaatga

SEQ ID NO: 50648 - DNA, 19 bp, Homo sapiens
gaatgtgttgatctgatga

SEQ ID NO: 50649 - DNA, 19 bp, Homo sapiens
tagagatgtgtaaaaatga

SEQ ID NO: 50650 - DNA, 20 bp, Homo sapiens
gaatgtgttcccagaaatga

SEQ ID NO: 50651 - DNA, 17 bp, Homo sapiens
cagactttgaaaaaatg

SEQ ID NO: 50652 - DNA, 22 bp, Homo sapiens
taaaatgtgaaaacaaaaatga

SEQ ID NO: 50653 - DNA, 20 bp, Homo sapiens
cagaatatatggaaagaatg

SEQ ID NO: 50654 - DNA, 22 bp, Homo sapiens
tagaatatgcaatttaaaaatg

SEQ ID NO: 50655 - DNA, 19 bp, Homo sapiens
tagaatgtgttcaagaaac

SEQ ID NO: 50656 - DNA, 19 bp, Homo sapiens
gagagtgaagaaaaaatga

SEQ ID NO: 50657 - DNA, 18 bp, Homo sapiens
cagaatgtgtaccaatga

SEQ ID NO: 50658 - DNA, 23 bp, Homo sapiens
tagaatgttgttgatttttaatg

SEQ ID NO: 50659 - DNA, 20 bp, Homo sapiens
cagaataatggaaaaaatga

SEQ ID NO: 50660 - DNA, 19 bp, Homo sapiens
tgtgcacagtgaaaaaatg

SEQ ID NO: 50661 - DNA, 20 bp, Homo sapiens
taaaatgtgttgattctatg

SEQ ID NO: 50662 - DNA, 18 bp, Homo sapiens
gactgtgcagaaaaatga

SEQ ID NO: 50663 - DNA, 22 bp, Homo sapiens
tagaatgctaaatggaaaatga

SEQ ID NO: 50664 - DNA, 21 bp, Homo sapiens
taaaatgtagttgaagaatga

SEQ ID NO: 50665 - DNA, 20 bp, Homo sapiens
gattgtgggaaaaaaaatga

SEQ ID NO: 50666 - DNA, 19 bp, Homo sapiens
aaatgtgttatagaaatga

SEQ ID NO: 50667 - DNA, 68 bp, Ateline herpesvirus 3
aaccaatctcaaaagttacttgtgctaagtatttcaaagatacagaagacttttttcatgagctggtt

SEQ ID NO: 50668 - DNA, 24 bp, Ateline herpesvirus 3
tctcaaaagttacttgtgctaagt

SEQ ID NO: 50669 - DNA, 17 bp, Homo sapiens
aagacactgtgctaggt

SEQ ID NO: 50670 - DNA, 18 bp, Homo sapiens
tcttaaaagttatttgtg

SEQ ID NO: 50671 - DNA, 19 bp, Homo sapiens
tctcagaagtcacttcaag

SEQ ID NO: 50672 - DNA, 17 bp, Homo sapiens
tcaaaagtacttgtgct

SEQ ID NO: 50673 - DNA, 19 bp, Homo sapiens
tccaaagttacttccaagt

SEQ ID NO: 50674 - DNA, 16 bp, Homo sapiens
tcaaaagtttgctaag

SEQ ID NO: 50675 - DNA, 23 bp, Homo sapiens
tcaaaaattacaattgtttgagt

SEQ ID NO: 50676 - DNA, 23 bp, Homo sapiens
tctgagagttacttgaggcaagt

SEQ ID NO: 50677 - DNA, 16 bp, Homo sapiens
tctcaaactgtgctaa

SEQ ID NO: 50678 - DNA, 19 bp, Homo sapiens
tcaaaagttcttatcaagt

SEQ ID NO: 50679 - DNA, 22 bp, Homo sapiens
tcaaaggatctctgtgctaggt

SEQ ID NO: 50680 - DNA, 84 bp, Rat cytomegalovirus
aggacgcggccccgacggccaccccgacgaagaaacggacgacgccggccgcggcccgggagtaggcgtcgggatagcggtcct

SEQ ID NO: 50681 - DNA, 24 bp, Rat cytomegalovirus
gccccgacggccaccccgacgaag

SEQ ID NO: 50682 - DNA, 17 bp, Homo sapiens
gctccgacggcacccga

SEQ ID NO: 50683 - DNA, 18 bp, Homo sapiens
gccccgacgccgggcgcg

SEQ ID NO: 50684 - DNA, 22 bp, Homo sapiens
accccgacgactctcggcgaag

SEQ ID NO: 50685 - DNA, 20 bp, Homo sapiens
gccccgactgccacgggccg

SEQ ID NO: 50686 - DNA, 18 bp, Homo sapiens
gccccggcggccaccccg

SEQ ID NO: 50687 - DNA, 21 bp, Homo sapiens
gcctgcaccaccccgatgaag

SEQ ID NO: 50688 - DNA, 19 bp, Homo sapiens
cccggcagccaccgccgcg

SEQ ID NO: 50689 - DNA, 19 bp, Homo sapiens
gcctcgtggccacccccac

SEQ ID NO: 50690 - DNA, 17 bp, Homo sapiens
gccccgacggcgcctca

SEQ ID NO: 50691 - DNA, 20 bp, Homo sapiens
gcccccggtcggcccgacga

SEQ ID NO: 50692 - DNA, 16 bp, Homo sapiens
gccccaacggcggcga

SEQ ID NO: 50693 - DNA, 20 bp, Homo sapiens
gccccgactgccacccacca

SEQ ID NO: 50694 - DNA, 20 bp, Homo sapiens
gcctggccgggccccgacga

SEQ ID NO: 50695 - DNA, 21 bp, Homo sapiens
cccgaagtggtcccgacgaag

SEQ ID NO: 50696 - DNA, 18 bp, Homo sapiens
gccccgacggccgtccga

SEQ ID NO: 50697 - DNA, 18 bp, Homo sapiens
ccctcgacggccgcctcg

SEQ ID NO: 50698 - DNA, 17 bp, Homo sapiens
gccccgacggccttccg

SEQ ID NO: 50699 - DNA, 21 bp, Homo sapiens
gccccgtggccacccttcccg

SEQ ID NO: 50700 - DNA, 19 bp, Homo sapiens
gccctggggccaccccaca

SEQ ID NO: 50701 - DNA, 23 bp, Homo sapiens
gccccgacgactgcccttccccg

SEQ ID NO: 50702 - DNA, 22 bp, Homo sapiens
gccccgacggctgcgggccccg

SEQ ID NO: 50703 - DNA, 22 bp, Homo sapiens
gccccggcgaccacctccttca

SEQ ID NO: 50704 - DNA, 65 bp, Rat cytomegalovirus
cgggtctcggccacggtggcgaccaggggcacctcccggacctcgccggagtgggcgacgacccg

SEQ ID NO: 50705 - DNA, 22 bp, Rat cytomegalovirus
cgccggagtgggcgacgacccg

SEQ ID NO: 50706 - DNA, 18 bp, Homo sapiens
cgccggagtgcggctccg

SEQ ID NO: 50707 - DNA, 22 bp, Homo sapiens
gccggagtgcacccgcgacccg

SEQ ID NO: 50708 - DNA, 17 bp, Homo sapiens
cgatgtgcgacgactcg

SEQ ID NO: 50709 - DNA, 18 bp, Homo sapiens
gcggagctccacgacccg

SEQ ID NO: 50710 - DNA, 19 bp, Homo sapiens
accggagtggcggagtccg

SEQ ID NO: 50711 - DNA, 17 bp, Homo sapiens
cagctggagcgcgaccc

SEQ ID NO: 50712 - DNA, 18 bp, Homo sapiens
cgccggagtgtgcggcaa

SEQ ID NO: 50713 - DNA, 18 bp, Homo sapiens
gccggaggggagcaagcc

SEQ ID NO: 50714 - DNA, 21 bp, Homo sapiens
gctggagcagaaggcggcccg

SEQ ID NO: 50715 - DNA, 18 bp, Homo sapiens
cgcccgagtgggcgatcg

SEQ ID NO: 50716 - DNA, 21 bp, Homo sapiens
gctgtggcgggcgacgacccg

SEQ ID NO: 50717 - DNA, 20 bp, Homo sapiens
cgctggaagatgacgacccg

SEQ ID NO: 50718 - DNA, 18 bp, Homo sapiens
gatcgtggcgacgactcg

SEQ ID NO: 50719 - DNA, 19 bp, Homo sapiens
gccggggcagcacggcccg

SEQ ID NO: 50720 - DNA, 17 bp, Homo sapiens
ccggggggaacgacccg

SEQ ID NO: 50721 - DNA, 19 bp, Homo sapiens
gccggagtgggggtcctcg

SEQ ID NO: 50722 - DNA, 19 bp, Homo sapiens
caccggagcgaacggcccg

SEQ ID NO: 50723 - DNA, 18 bp, Homo sapiens
cgctggagcgggtcgccg

SEQ ID NO: 50724 - DNA, 19 bp, Homo sapiens
cctggggtggctccgcccg

SEQ ID NO: 50725 - DNA, 19 bp, Homo sapiens
gccggagtcacgtgacccg

SEQ ID NO: 50726 - DNA, 18 bp, Homo sapiens
gccggagtcgggaacgcc

SEQ ID NO: 50727 - DNA, 19 bp, Homo sapiens
cgccgcgggcgacggcccg

SEQ ID NO: 50728 - DNA, 20 bp, Homo sapiens
gccgaagtgggagcggcccg

SEQ ID NO: 50729 - DNA, 23 bp, Homo sapiens
cgccggagctgctgccgggcccg

SEQ ID NO: 50730 - DNA, 18 bp, Homo sapiens
cgccggaggggtgacgcc

SEQ ID NO: 50731 - DNA, 20 bp, Homo sapiens
cgcgtggaacagacgacccg

SEQ ID NO: 50732 - DNA, 22 bp, Homo sapiens
gccagagctcctcggtgacccg

SEQ ID NO: 50733 - DNA, 20 bp, Homo sapiens
cgtgtgggcgaggtgacccg

SEQ ID NO: 50734 - DNA, 17 bp, Homo sapiens
cgtcggagcggcggccc

SEQ ID NO: 50735 - DNA, 21 bp, Homo sapiens
cactgatcgggcgacgatccg

SEQ ID NO: 50736 - DNA, 21 bp, Homo sapiens
ccggagtggagccaaggcccg

SEQ ID NO: 50737 - DNA, 21 bp, Homo sapiens
cgacggagtgccccaggcccg

SEQ ID NO: 50738 - DNA, 19 bp, Homo sapiens
gctggagcggggccgcccg

SEQ ID NO: 50739 - DNA, 19 bp, Homo sapiens
gcccgtgttcgacgacccg

SEQ ID NO: 50740 - DNA, 23 bp, Homo sapiens
caccggagaaaactgacgacccg

SEQ ID NO: 50741 - DNA, 19 bp, Homo sapiens
gccagcacaggcgacggcc

SEQ ID NO: 50742 - DNA, 21 bp, Homo sapiens
cgctggggcgggggcggcccg

SEQ ID NO: 50743 - DNA, 19 bp, Homo sapiens
cctgggcaaaggcggcccg

SEQ ID NO: 50744 - DNA, 82 bp, Rat cytomegalovirus
gccgcggcgctccatgaggagccagagcccgccggggaaggcggccccgtgccgctcctcctcctcctggaggcgccgccgc

SEQ ID NO: 50745 - DNA, 24 bp, Rat cytomegalovirus
tgaggagccagagcccgccgggga

SEQ ID NO: 50746 - DNA, 20 bp, Homo sapiens
tggggagccagcgtccgtgg

SEQ ID NO: 50747 - DNA, 19 bp, Homo sapiens
tgaggagctgagggtgggg

SEQ ID NO: 50748 - DNA, 21 bp, Homo sapiens
tgggaggccagagagtcgggg

SEQ ID NO: 50749 - DNA, 21 bp, Homo sapiens
tgaggagcatggagggtgggg

SEQ ID NO: 50750 - DNA, 20 bp, Homo sapiens
tgagaggccagagccaaggg

SEQ ID NO: 50751 - DNA, 22 bp, Homo sapiens
tgagcgagccaaggagctgggg

SEQ ID NO: 50752 - DNA, 20 bp, Homo sapiens
tgagagccagcctgtcgggg

SEQ ID NO: 50753 - DNA, 24 bp, Homo sapiens
tggggcgccgggagaatcctgggg

SEQ ID NO: 50754 - DNA, 18 bp, Homo sapiens
tgggggccagagccccgg

SEQ ID NO: 50755 - DNA, 18 bp, Homo sapiens
cgggagctggagccgggg

SEQ ID NO: 50756 - DNA, 19 bp, Homo sapiens
tgaggagcaggagtgaggg

SEQ ID NO: 50757 - DNA, 16 bp, Homo sapiens
ggggcgcccgccgggg

SEQ ID NO: 50758 - DNA, 19 bp, Homo sapiens
cggggagccaggcctgggg

SEQ ID NO: 50759 - DNA, 20 bp, Homo sapiens
ggagccagacgctgttgggg

SEQ ID NO: 50760 - DNA, 18 bp, Homo sapiens
tgaggagccgagtcaggg

SEQ ID NO: 50761 - DNA, 22 bp, Homo sapiens
tgaggggtcagggctggctgga

SEQ ID NO: 50762 - DNA, 19 bp, Homo sapiens
tggggagccagggctgggg

SEQ ID NO: 50763 - DNA, 16 bp, Homo sapiens
tgaggaccagagaggg

SEQ ID NO: 50764 - DNA, 17 bp, Homo sapiens
ggggctgcccgccgggg

SEQ ID NO: 50765 - DNA, 19 bp, Homo sapiens
tgggagccacaggctgggg

SEQ ID NO: 50766 - DNA, 19 bp, Homo sapiens
agggcagagcccgctgggg

SEQ ID NO: 50767 - DNA, 22 bp, Homo sapiens
tggggagccaggggatcgggga

SEQ ID NO: 50768 - DNA, 18 bp, Homo sapiens
gaggagccggggccgggg

SEQ ID NO: 50769 - DNA, 19 bp, Homo sapiens
tgaggagccgaagccaagg

SEQ ID NO: 50770 - DNA, 20 bp, Homo sapiens
tgaggagccagagatccggg

SEQ ID NO: 50771 - DNA, 16 bp, Homo sapiens
tgaggagccaagcggg

SEQ ID NO: 50772 - DNA, 20 bp, Homo sapiens
gaggagccccgcgctgggga

SEQ ID NO: 50773 - DNA, 22 bp, Homo sapiens
taaggagccaggaggaatgggg

SEQ ID NO: 50774 - DNA, 18 bp, Homo sapiens
gaggagccaggatcgggg

SEQ ID NO: 50775 - DNA, 19 bp, Homo sapiens
cgggagccagagtccaggg

SEQ ID NO: 50776 - DNA, 19 bp, Homo sapiens
tgggagccagaggttgggg

SEQ ID NO: 50777 - DNA, 25 bp, Homo sapiens
tgagggccagagctggatccccggg

SEQ ID NO: 50778 - DNA, 20 bp, Homo sapiens
tgaggagcgcggggcctggg

SEQ ID NO: 50779 - DNA, 17 bp, Homo sapiens
aggagccagggctgggg

SEQ ID NO: 50780 - DNA, 19 bp, Homo sapiens
gaggagccttctgccgggg

SEQ ID NO: 50781 - DNA, 20 bp, Homo sapiens
tgaggggccagggaccggga

SEQ ID NO: 50782 - DNA, 24 bp, Homo sapiens
tgaggagctgtgagtaatctgggg

SEQ ID NO: 50783 - DNA, 25 bp, Homo sapiens
tgaggagccagaggctagcatagga

SEQ ID NO: 50784 - DNA, 27 bp, Homo sapiens
gaggagccggagtgggatccccggcgg

SEQ ID NO: 50785 - DNA, 19 bp, Homo sapiens
tggggagccagagacctag

SEQ ID NO: 50786 - DNA, 20 bp, Homo sapiens
aggggccggggcccaccagg

SEQ ID NO: 50787 - DNA, 20 bp, Homo sapiens
tgaggggcctgggcccgggg

SEQ ID NO: 50788 - DNA, 20 bp, Homo sapiens
tgaggagccggcagcggggg

SEQ ID NO: 50789 - DNA, 23 bp, Homo sapiens
tgaggagccagaagaagtgggga

SEQ ID NO: 50790 - DNA, 21 bp, Homo sapiens
tgaggagctggatatgcgggg

SEQ ID NO: 50791 - DNA, 18 bp, Homo sapiens
tggggagtccagctgggg

SEQ ID NO: 50792 - DNA, 21 bp, Homo sapiens
tgagaagctggagctccgtgg

SEQ ID NO: 50793 - DNA, 21 bp, Homo sapiens
tgaggagccaggctttgggga

SEQ ID NO: 50794 - DNA, 19 bp, Homo sapiens
gaggggccggagccagggg

SEQ ID NO: 50795 - DNA, 22 bp, Homo sapiens
aggagccagctggaggctgggg

SEQ ID NO: 50796 - DNA, 21 bp, Homo sapiens
tgaggagctgggaaatgggga

SEQ ID NO: 50797 - DNA, 19 bp, Homo sapiens
tgaggagccaggagtgggg

SEQ ID NO: 50798 - DNA, 22 bp, Homo sapiens
tgaggagccagtgtttctccga

SEQ ID NO: 50799 - DNA, 24 bp, Homo sapiens
ggagccagagccccaaggctgggg

SEQ ID NO: 50800 - DNA, 21 bp, Homo sapiens
tgaggagcaggggctcatggg

SEQ ID NO: 50801 - DNA, 19 bp, Homo sapiens
ggggcagcccacgccgggg

SEQ ID NO: 50802 - DNA, 20 bp, Homo sapiens
tggggagccaggacctcagg

SEQ ID NO: 50803 - DNA, 22 bp, Homo sapiens
tgcggggccggggtgccgggga

SEQ ID NO: 50804 - DNA, 18 bp, Homo sapiens
tgaggagctggaggctgg

SEQ ID NO: 50805 - DNA, 18 bp, Homo sapiens
tgggagccagggccccgg

SEQ ID NO: 50806 - DNA, 22 bp, Homo sapiens
tggggggccagggccaccaggg

SEQ ID NO: 50807 - DNA, 22 bp, Homo sapiens
tgaggagccaggcctgccgggg

SEQ ID NO: 50808 - DNA, 25 bp, Homo sapiens
tgggaggccagagctcgctctcggg

SEQ ID NO: 50809 - DNA, 27 bp, Homo sapiens
gaggggccggagatggatccccggcgg

SEQ ID NO: 50810 - DNA, 16 bp, Homo sapiens
tgagggccagagaggg

SEQ ID NO: 50811 - DNA, 28 bp, Homo sapiens
tgagaagccaggacattgcctgccgggg

SEQ ID NO: 50812 - DNA, 22 bp, Homo sapiens
tggggagccagggttccccgga

SEQ ID NO: 50813 - DNA, 19 bp, Homo sapiens
tgaggagccgggagctccg

SEQ ID NO: 50814 - DNA, 29 bp, Homo sapiens
tgaggagcacagagctggatccccggcgg

SEQ ID NO: 50815 - DNA, 17 bp, Homo sapiens
tgaggagcagggcctgg

SEQ ID NO: 50816 - DNA, 20 bp, Homo sapiens
tgaggagctgcggtccgcgg

SEQ ID NO: 50817 - DNA, 23 bp, Homo sapiens
gaggagccagggggctgcgggga

SEQ ID NO: 50818 - DNA, 20 bp, Homo sapiens
gaggggggcgcccgccgggg

SEQ ID NO: 50819 - DNA, 21 bp, Homo sapiens
tggggagtgatgagccgggga

SEQ ID NO: 50820 - DNA, 19 bp, Homo sapiens
tgaggagcagagcaagggg

SEQ ID NO: 50821 - DNA, 17 bp, Homo sapiens
gagggccagggccaggg

SEQ ID NO: 50822 - DNA, 20 bp, Homo sapiens
tggggaaccagagcctggga

SEQ ID NO: 50823 - DNA, 18 bp, Homo sapiens
gaggggccagagctggga

SEQ ID NO: 50824 - DNA, 20 bp, Homo sapiens
gaggagccctgcgctgggga

SEQ ID NO: 50825 - DNA, 19 bp, Homo sapiens
tgagggaccagagctggga

SEQ ID NO: 50826 - DNA, 24 bp, Homo sapiens
tgaggggccagagctgtcgaaggg

SEQ ID NO: 50827 - DNA, 24 bp, Homo sapiens
tgagaggccagagcgggcgtgggg

SEQ ID NO: 50828 - DNA, 24 bp, Homo sapiens
tggggaaccagggagcgctgggga

SEQ ID NO: 50829 - DNA, 20 bp, Homo sapiens
gaggagcccggcgccgggga

SEQ ID NO: 50830 - DNA, 22 bp, Homo sapiens
tgaggagccaggtgcctttagg

SEQ ID NO: 50831 - DNA, 20 bp, Homo sapiens
gaggagccccacgctgggga

SEQ ID NO: 50832 - DNA, 126 bp, African swine fever virus
taatgttggttcatgaagataaagtgtgccaaagaaacttttataaacaaatgattaatgtaggtgctagtcgtgtgtacttaaacagggtattctatagccaagtattttctatagccagtatta

SEQ ID NO: 50833 - DNA, 24 bp, African swine fever virus
tgaagataaagtgtgccaaagaaa

SEQ ID NO: 50834 - DNA, 21 bp, Homo sapiens
tgaagataacagtgggcagaa

SEQ ID NO: 50835 - DNA, 16 bp, Homo sapiens
tgaagataaatgcaga

SEQ ID NO: 50836 - DNA, 20 bp, Homo sapiens
gaagataacttacctgaaga

SEQ ID NO: 50837 - DNA, 22 bp, Homo sapiens
tgaagaagtaatagccaaagaa

SEQ ID NO: 50838 - DNA, 18 bp, Homo sapiens
tgaagacagaatacaaag

SEQ ID NO: 50839 - DNA, 19 bp, Homo sapiens
gaaatagcatcccaaagaa

SEQ ID NO: 50840 - DNA, 22 bp, Homo sapiens
tgaagatataggctcagggaaa

SEQ ID NO: 50841 - DNA, 21 bp, Homo sapiens
tgagaataaagtgagctggaa

SEQ ID NO: 50842 - DNA, 17 bp, Homo sapiens
tgaagataaagtaagaa

SEQ ID NO: 50843 - DNA, 24 bp, Homo sapiens
tgaagataaaatggggctgggaaa

SEQ ID NO: 50844 - DNA, 23 bp, Homo sapiens
tgaagaaaacaaaaccaaagaaa

SEQ ID NO: 50845 - DNA, 22 bp, Homo sapiens
gaacactggtgtgccaagggaa

SEQ ID NO: 50846 - DNA, 20 bp, Homo sapiens
taaggtggtttccaaagaaa

SEQ ID NO: 50847 - DNA, 23 bp, Homo sapiens
tgaatataagttggctaaagaaa

SEQ ID NO: 50848 - DNA, 21 bp, Homo sapiens
tgaaaatggctacccaaagaa

SEQ ID NO: 50849 - DNA, 19 bp, Homo sapiens
aaagagtgtgccagagaaa

SEQ ID NO: 50850 - DNA, 22 bp, Homo sapiens
taaagataaaatgcttgaggaa

SEQ ID NO: 50851 - DNA, 19 bp, Homo sapiens
tgaagacagagcttgcaga

SEQ ID NO: 50852 - DNA, 21 bp, Homo sapiens
tgaggatggaagtgccaaaaa

SEQ ID NO: 50853 - DNA, 19 bp, Homo sapiens
agataaaaatacaaagaaa

SEQ ID NO: 50854 - DNA, 19 bp, Homo sapiens
tgaagaatggtcaccaaag

SEQ ID NO: 50855 - DNA, 21 bp, Homo sapiens
tgagataaggggcaccaaaga

SEQ ID NO: 50856 - DNA, 20 bp, Homo sapiens
tgaaataaacgtgccaggga

SEQ ID NO: 50857 - DNA, 18 bp, Homo sapiens
gaagtaaaatgccaagga

SEQ ID NO: 50858 - DNA, 21 bp, Homo sapiens
tgaaaataaagcaagcgaaga

SEQ ID NO: 50859 - DNA, 21 bp, Homo sapiens
tgaagttaaagtgcttggaaa

SEQ ID NO: 50860 - DNA, 23 bp, Homo sapiens
tgaagacaaagaaatagaagaaa

SEQ ID NO: 50861 - DNA, 20 bp, Homo sapiens
taaagatgaggaccaaagaa

SEQ ID NO: 50862 - DNA, 24 bp, Homo sapiens
tgaacatgagcaagcgcaaagaaa

SEQ ID NO: 50863 - DNA, 22 bp, Homo sapiens
tggggacaatgccccaaagaaa

SEQ ID NO: 50864 - DNA, 23 bp, Homo sapiens
tgagataaagagttccagggaaa

SEQ ID NO: 50865 - DNA, 21 bp, Homo sapiens
tgaagacagagtctgggagaa

SEQ ID NO: 50866 - DNA, 21 bp, Homo sapiens
tgaaaataaactatgaagaaa

SEQ ID NO: 50867 - DNA, 18 bp, Homo sapiens
tgaagacaggccagggaa

SEQ ID NO: 50868 - DNA, 19 bp, Homo sapiens
gagagatttgtgccaagga

SEQ ID NO: 50869 - DNA, 20 bp, Homo sapiens
tgaagataagtgtgccgcag

SEQ ID NO: 50870 - DNA, 19 bp, Homo sapiens
tgagggacagtgccaaaga

SEQ ID NO: 50871 - DNA, 19 bp, Homo sapiens
gataaaatgttctgaagaa

SEQ ID NO: 50872 - DNA, 22 bp, Homo sapiens
tgagataatggatgccaaagaa

SEQ ID NO: 50873 - DNA, 23 bp, Homo sapiens
tggagataaaggtgttcactaga

SEQ ID NO: 50874 - DNA, 17 bp, Homo sapiens
tgaggataaagttgcca

SEQ ID NO: 50875 - DNA, 21 bp, Homo sapiens
tggagataaaggccctagaaa

SEQ ID NO: 50876 - DNA, 20 bp, Homo sapiens
tgaagacagggcctgaagaa

SEQ ID NO: 50877 - DNA, 23 bp, Homo sapiens
tgagaggtaaagtgtgcaggaaa

SEQ ID NO: 50878 - DNA, 18 bp, Homo sapiens
tgaagacagggcctagaa

SEQ ID NO: 50879 - DNA, 24 bp, Homo sapiens
tggagggaaagtgtagaaaagaaa

SEQ ID NO: 50880 - DNA, 18 bp, Homo sapiens
tgaagacagatcccagag

SEQ ID NO: 50881 - DNA, 21 bp, Homo sapiens
tgaagataaaagctgagagaa

SEQ ID NO: 50882 - DNA, 23 bp, Homo sapiens
tgaagatgaagttgttcctcaag

SEQ ID NO: 50883 - DNA, 23 bp, Homo sapiens
tgatagatgatggtccaaagaaa

SEQ ID NO: 50884 - DNA, 23 bp, Homo sapiens
tgaagagaggagcatcaaagaaa

SEQ ID NO: 50885 - DNA, 76 bp, Meleagrid herpesvirus 1
cgccgtggacaggtttagcgctttttctcgccgcgccgtcacttcgcggtcttatcacgctttagaccacagggcg

SEQ ID NO: 50886 - DNA, 24 bp, Meleagrid herpesvirus 1
acaggtttagcgctttttctcgcc

SEQ ID NO: 50887 - DNA, 21 bp, Homo sapiens
acatgtttagtgtttcctcgc

SEQ ID NO: 50888 - DNA, 22 bp, Homo sapiens
acatgtttacatgattttctcg

SEQ ID NO: 50889 - DNA, 20 bp, Homo sapiens
agatttcctctttttctcgc

SEQ ID NO: 50890 - DNA, 17 bp, Homo sapiens
agtttggcgcttccggc

SEQ ID NO: 50891 - DNA, 17 bp, Homo sapiens
cagcatccgctttttct

SEQ ID NO: 50892 - DNA, 17 bp, Homo sapiens
caggtctttccttttct

SEQ ID NO: 50893 - DNA, 22 bp, Homo sapiens
aagcaaagcgctttttcttgcc

SEQ ID NO: 50894 - DNA, 117 bp, Human herpesvirus 6
cgacaacgtcgggcgcgttcagagtcctgtaccgtgtgcgactgagacacgtagtgttcaaactctaccttctaaaatcacacctcggtggaaagatcgtgcggcgtatcgttgtcg

SEQ ID NO: 50895 - DNA, 24 bp, Human herpesvirus 6
taaaatcacacctcggtggaaaga

SEQ ID NO: 50896 - DNA, 18 bp, Homo sapiens
aaaatcacactttataaa

SEQ ID NO: 50897 - DNA, 17 bp, Homo sapiens
aaaattacacctcaggg

SEQ ID NO: 50898 - DNA, 19 bp, Homo sapiens
atcacaccttcctgttgga

SEQ ID NO: 50899 - DNA, 19 bp, Homo sapiens
taaaatcacgcttcagaga

SEQ ID NO: 50900 - DNA, 18 bp, Homo sapiens
taaaatcaccctggagga

SEQ ID NO: 50901 - DNA, 21 bp, Homo sapiens
taaaaacacacagaaagggaa

SEQ ID NO: 50902 - DNA, 21 bp, Homo sapiens
taaaatcagcacttccagagg

SEQ ID NO: 50903 - DNA, 19 bp, Homo sapiens
taagatcacaccaggaaga

SEQ ID NO: 50904 - DNA, 19 bp, Homo sapiens
aaaatcatacctctaaaga

SEQ ID NO: 50905 - DNA, 22 bp, Homo sapiens
taaaattacactttatggaaaa

SEQ ID NO: 50906 - DNA, 22 bp, Homo sapiens
taaaacatgcctcccagaaaga

SEQ ID NO: 50907 - DNA, 18 bp, Homo sapiens
aaaatcacattctaatgg

SEQ ID NO: 50908 - DNA, 18 bp, Homo sapiens
taaaatcacgctcggaga

SEQ ID NO: 50909 - DNA, 23 bp, Homo sapiens
aaatcacacttcctactcagagg

SEQ ID NO: 50910 - DNA, 18 bp, Homo sapiens
aaaatcacgcctctggga

SEQ ID NO: 50911 - DNA, 20 bp, Homo sapiens
aaatcacattttcttgggga

SEQ ID NO: 50912 - DNA, 17 bp, Homo sapiens
aaatcactggtggaaag

SEQ ID NO: 50913 - DNA, 22 bp, Homo sapiens
taaagtcacaccctcccttgaa

SEQ ID NO: 50914 - DNA, 21 bp, Homo sapiens
aaatcacagctgttggtgaga

SEQ ID NO: 50915 - DNA, 16 bp, Homo sapiens
aaaatcacacagggaa

SEQ ID NO: 50916 - DNA, 22 bp, Homo sapiens
aaatcacaagggagtggagaga

SEQ ID NO: 50917 - DNA, 24 bp, Homo sapiens
taaaatcatgtacttgtagacaga

SEQ ID NO: 50918 - DNA, 18 bp, Homo sapiens
taaaagtcacgtggaaag

SEQ ID NO: 50919 - DNA, 21 bp, Homo sapiens
taaaatcacacttataaaaga

SEQ ID NO: 50920 - DNA, 17 bp, Homo sapiens
tcacacctcaaaaaaga

SEQ ID NO: 50921 - DNA, 23 bp, Homo sapiens
taaaacttgcagctctggaaaga

SEQ ID NO: 50922 - DNA, 22 bp, Homo sapiens
taaaatacagaaattggaaaga

SEQ ID NO: 50923 - DNA, 17 bp, Homo sapiens
tcacagaggtggaaaga

SEQ ID NO: 50924 - DNA, 23 bp, Homo sapiens
taaaatcattctgaccctaggga

SEQ ID NO: 50925 - DNA, 17 bp, Homo sapiens
aaaatcacaccgggaga

SEQ ID NO: 50926 - DNA, 21 bp, Homo sapiens
taaaatcaatcaccaggaaag

SEQ ID NO: 50927 - DNA, 23 bp, Homo sapiens
taaaattgcacatcttaaaaaga

SEQ ID NO: 50928 - DNA, 18 bp, Homo sapiens
taaaatcacacttaaaag

SEQ ID NO: 50929 - DNA, 17 bp, Homo sapiens
aaatcgacggtggaaag

SEQ ID NO: 50930 - DNA, 23 bp, Homo sapiens
caaagtcacattccttggaaaga

SEQ ID NO: 50931 - DNA, 22 bp, Homo sapiens
taaaaccacaaaggtggggaga

SEQ ID NO: 50932 - DNA, 22 bp, Homo sapiens
caagatcacaccggacaaggga

SEQ ID NO: 50933 - DNA, 21 bp, Homo sapiens
taaaatcacacatctgataaa

SEQ ID NO: 50934 - DNA, 18 bp, Homo sapiens
aaaatcacatctcaggaa

SEQ ID NO: 50935 - DNA, 17 bp, Homo sapiens
taaaatcatggtggaag

SEQ ID NO: 50936 - DNA, 19 bp, Homo sapiens
aaaatcacagcgtggagag

SEQ ID NO: 50937 - DNA, 20 bp, Homo sapiens
tcacacctcgggcacctgga

SEQ ID NO: 50938 - DNA, 19 bp, Homo sapiens
acagcgctcggtggaagga

SEQ ID NO: 50939 - DNA, 16 bp, Homo sapiens
taaaatcatggtggaa

SEQ ID NO: 50940 - DNA, 67 bp, Rat cytomegalovirus
ggaaacgggacacaatggactttgcaacgtatatgtctttgatttactgcatatccgtcttttatcc

SEQ ID NO: 50941 - DNA, 24 bp, Rat cytomegalovirus
ttactgcatatccgtcttttatcc

SEQ ID NO: 50942 - DNA, 20 bp, Homo sapiens
ctgtataaaggcttttatcc

SEQ ID NO: 50943 - DNA, 18 bp, Homo sapiens
ctactgctgtcttttgtc

SEQ ID NO: 50944 - DNA, 19 bp, Homo sapiens
ccttaattcgtcttttatc

SEQ ID NO: 50945 - DNA, 16 bp, Homo sapiens
ttactgcatctttgat

SEQ ID NO: 50946 - DNA, 23 bp, Homo sapiens
ttattacatatccttccatttat

SEQ ID NO: 50947 - DNA, 21 bp, Homo sapiens
ttactacattcacttttgtcc

SEQ ID NO: 50948 - DNA, 64 bp, Rat cytomegalovirus
agacatacgagccagtgtacagcgtattgtctctccatttcaaagtactgttgttcgtatctct

SEQ ID NO: 50949 - DNA, 24 bp, Rat cytomegalovirus
tttcaaagtactgttgttcgtatc

SEQ ID NO: 50950 - DNA, 22 bp, Homo sapiens
tttcaaagtatttgttaattgt

SEQ ID NO: 50951 - DNA, 21 bp, Homo sapiens
tttcaagtgctgttgcctcat

SEQ ID NO: 50952 - DNA, 19 bp, Homo sapiens
tttcagatactgttgtgtc

SEQ ID NO: 50953 - DNA, 18 bp, Homo sapiens
tttcaaggtgctattgtt

SEQ ID NO: 50954 - DNA, 18 bp, Homo sapiens
tttcaaagtacttttatt

SEQ ID NO: 50955 - DNA, 19 bp, Homo sapiens
tttcaaagactgtagttgt

SEQ ID NO: 50956 - DNA, 21 bp, Homo sapiens
tttcaaagtacagtttaatgt

SEQ ID NO: 50957 - DNA, 21 bp, Homo sapiens
tttcaaaagtatctgtgttgt

SEQ ID NO: 50958 - DNA, 19 bp, Homo sapiens
tttcaaagtactttgctgt

SEQ ID NO: 50959 - DNA, 18 bp, Homo sapiens
tttcaaagtctgtgtgtc

SEQ ID NO: 50960 - DNA, 20 bp, Homo sapiens
tttcaaagtactattaatgt

SEQ ID NO: 50961 - DNA, 22 bp, Homo sapiens
tttcaagtactgtaactgtgtc

SEQ ID NO: 50962 - DNA, 73 bp, Rat cytomegalovirus
gttgtcatgtatcgttgtgtttggctgatattgtgacgggcgaactgtcaaaaaaaaacacatattagacaac

SEQ ID NO: 50963 - DNA, 24 bp, Rat cytomegalovirus
tgtcatgtatcgttgtgtttggct

SEQ ID NO: 50964 - DNA, 21 bp, Homo sapiens
tgtcttgtaggatgtttggct

SEQ ID NO: 50965 - DNA, 21 bp, Homo sapiens
tgtcatgtatgtggcctttgg

SEQ ID NO: 50966 - DNA, 19 bp, Homo sapiens
tgtcaggtgtctggtttgg

SEQ ID NO: 50967 - DNA, 19 bp, Homo sapiens
tgtatgtgttgtctatggc

SEQ ID NO: 50968 - DNA, 22 bp, Homo sapiens
tgtcatgtatagtttactggct

SEQ ID NO: 50969 - DNA, 25 bp, Homo sapiens
tgttgtatgttgtaccttattggct

SEQ ID NO: 50970 - DNA, 130 bp, Human herpesvirus 6
atagcgaagaaaaatacatctgatcgccaaatggcgatcagtactctgacgctcatcttttccgtaaccggcgtgtgtgtagactgtcgttttggtggtcagatattaagtctgcgtaattctttcctct

SEQ ID NO: 50971 - DNA, 24 bp, Human herpesvirus 6
tgtgtagactgtcgttttggtggt

SEQ ID NO: 50972 - DNA, 19 bp, Homo sapiens
tgtgtggcgctggtggtgg

SEQ ID NO: 50973 - DNA, 20 bp, Homo sapiens
tgtgtgggttgtgttctggt

SEQ ID NO: 50974 - DNA, 21 bp, Homo sapiens
tgtgggggctgtcaccgtggt

SEQ ID NO: 50975 - DNA, 19 bp, Homo sapiens
tgtgtggcactggtggtgg

SEQ ID NO: 50976 - DNA, 73 bp, Human herpesvirus 6
tccggccgggtcacttgttctcataaaagcggtctatctccactccgctcagccggaccgtacccggaccgga

SEQ ID NO: 50977 - DNA, 24 bp, Human herpesvirus 6
tcacttgttctcataaaagcggtc

SEQ ID NO: 50978 - DNA, 23 bp, Homo sapiens
tcattttgttttcataagcaatc

SEQ ID NO: 50979 - DNA, 30 bp, Homo sapiens
tcacctgcagtggttttgtgaaagcggtcg

SEQ ID NO: 50980 - DNA, 18 bp, Homo sapiens
ttgttctctaaaagaggt

SEQ ID NO: 50981 - DNA, 19 bp, Homo sapiens
tcacttgtttttaaaagca

SEQ ID NO: 50982 - DNA, 22 bp, Homo sapiens
tcacttgttctcaatcagagtc

SEQ ID NO: 50983 - DNA, 18 bp, Homo sapiens
tcatttgttcccatgggt

SEQ ID NO: 50984 - DNA, 18 bp, Homo sapiens
cacttgttcttcagtggt

SEQ ID NO: 50985 - DNA, 24 bp, Homo sapiens
tcatttattctcatacttatgggt

SEQ ID NO: 50986 - DNA, 19 bp, Homo sapiens
tccttgtcccagaagtggt

SEQ ID NO: 50987 - DNA, 66 bp, Human herpesvirus 5
gtcgcaaagcgcgcgggcagccacggcccagactgcggtcgcgatggcccggagcgcgctcgccac

SEQ ID NO: 50988 - DNA, 24 bp, Human herpesvirus 5
tcgcgatggcccggagcgcgctcg

SEQ ID NO: 50989 - DNA, 21 bp, Homo sapiens
gcggcgaagtgagcgcgctcg

SEQ ID NO: 50990 - DNA, 27 bp, Homo sapiens
tcgcgatggctcgagtgcgagcgcgct

SEQ ID NO: 50991 - DNA, 19 bp, Homo sapiens
gcgcggtgggtgcgcgctc

SEQ ID NO: 50992 - DNA, 18 bp, Homo sapiens
cagcggcggggcgcgctc

SEQ ID NO: 50993 - DNA, 21 bp, Homo sapiens
tcgcgggggcctgcgcgctcg

SEQ ID NO: 50994 - DNA, 18 bp, Homo sapiens
gcgcgcacggagcgtgct

SEQ ID NO: 50995 - DNA, 18 bp, Homo sapiens
tcgcaatggtctggactc

SEQ ID NO: 50996 - DNA, 23 bp, Homo sapiens
tcggccctcccggagcgcgctcg

SEQ ID NO: 50997 - DNA, 63 bp, Human herpesvirus 5
gggagacggcgcagccagtgtttttaaagataaaacaaggcacgtggtctgtgcggctctccc

SEQ ID NO: 50998 - DNA, 23 bp, Human herpesvirus 5
cacgtggtctgtgcggctctccc

SEQ ID NO: 50999 - DNA, 19 bp, Homo sapiens
cgccacagtgtggctctcc

SEQ ID NO: 51000 - DNA, 15 bp, Homo sapiens
cgtggccggctctcc

SEQ ID NO: 51001 - DNA, 19 bp, Homo sapiens
tggtctgttaacacctttc

SEQ ID NO: 51002 - DNA, 17 bp, Homo sapiens
cgtggcctgcctcttcc

SEQ ID NO: 51003 - DNA, 19 bp, Homo sapiens
gtgggtctgtgtcatttcc

SEQ ID NO: 51004 - DNA, 17 bp, Homo sapiens
cactggtctgtgcctcc

SEQ ID NO: 51005 - DNA, 20 bp, Homo sapiens
cacgtggctctgcagcactc

SEQ ID NO: 51006 - DNA, 19 bp, Homo sapiens
gtggcacctgtggctctcc

SEQ ID NO: 51007 - DNA, 18 bp, Homo sapiens
gtggtctgggcagagtcc

SEQ ID NO: 51008 - DNA, 17 bp, Homo sapiens
cacgtggcttcctctcc

SEQ ID NO: 51009 - DNA, 21 bp, Homo sapiens
catgatctccagtgtggttct

SEQ ID NO: 51010 - DNA, 20 bp, Homo sapiens
cacgtggtctgagtgggtct

SEQ ID NO: 51011 - DNA, 18 bp, Homo sapiens
gtggtctggcaggagtcc

SEQ ID NO: 51012 - DNA, 21 bp, Homo sapiens
cgtggtttgtttacctctccc

SEQ ID NO: 51013 - DNA, 24 bp, Homo sapiens
cacctggtctgtgcctggagctcc

SEQ ID NO: 51014 - DNA, 15 bp, Homo sapiens
cgcgggtgggctctc

SEQ ID NO: 51015 - DNA, 17 bp, Homo sapiens
tgaccgtgtggctctcc

SEQ ID NO: 51016 - DNA, 17 bp, Homo sapiens
gtgatctggaatctccc

SEQ ID NO: 51017 - DNA, 20 bp, Homo sapiens
cgcgctgcggcggctcttcc

SEQ ID NO: 51018 - DNA, 18 bp, Homo sapiens
cgctggtgtgcggctctc

SEQ ID NO: 51019 - DNA, 18 bp, Homo sapiens
cgggtctggagcctctcc

SEQ ID NO: 51020 - DNA, 22 bp, Homo sapiens
cacatggtccacaaggttttct

SEQ ID NO: 51021 - DNA, 20 bp, Homo sapiens
gtatgttgtgcggctctccc

SEQ ID NO: 51022 - DNA, 15 bp, Homo sapiens
cgtggtgggctctcc

SEQ ID NO: 51023 - DNA, 17 bp, Homo sapiens
cactggtctgtgcaccc

SEQ ID NO: 51024 - DNA, 20 bp, Homo sapiens
catgggtctgtgtcagactc

SEQ ID NO: 51025 - DNA, 17 bp, Homo sapiens
cgcgggtggggctctcc

SEQ ID NO: 51026 - DNA, 20 bp, Homo sapiens
gtgatccatgaggttttctc

SEQ ID NO: 51027 - DNA, 17 bp, Homo sapiens
cacgtggcctcttctcc

SEQ ID NO: 51028 - DNA, 20 bp, Homo sapiens
gtggtctgtgtccagttccc

SEQ ID NO: 51029 - DNA, 22 bp, Homo sapiens
catttggtctgcggtattctct

SEQ ID NO: 51030 - DNA, 20 bp, Homo sapiens
cacgtgttctgtgcacattc

SEQ ID NO: 51031 - DNA, 16 bp, Homo sapiens
cactcggtgtgcggct

SEQ ID NO: 51032 - DNA, 19 bp, Homo sapiens
cgtgtgtctgtggattctc

SEQ ID NO: 51033 - DNA, 18 bp, Homo sapiens
acgtggtcagtcagctcc

SEQ ID NO: 51034 - DNA, 20 bp, Homo sapiens
cacgtggcttgtgcaagacc

SEQ ID NO: 51035 - DNA, 19 bp, Homo sapiens
tggtctcaggagctctccc

SEQ ID NO: 51036 - DNA, 23 bp, Homo sapiens
cacgtggtcagttttcatctccc

SEQ ID NO: 51037 - DNA, 18 bp, Homo sapiens
cgtggtctggcaatgtct

SEQ ID NO: 51038 - DNA, 22 bp, Homo sapiens
cacctggccctgtggctctccc

SEQ ID NO: 51039 - DNA, 17 bp, Homo sapiens
gtggtcttggactctcc

SEQ ID NO: 51040 - DNA, 18 bp, Homo sapiens
caggatcagtgcggctct

SEQ ID NO: 51041 - DNA, 18 bp, Homo sapiens
cgctgcaagcgcggctct

SEQ ID NO: 51042 - DNA, 17 bp, Homo sapiens
cacgtgtctgtacctcc

SEQ ID NO: 51043 - DNA, 22 bp, Homo sapiens
cactggtctgtgcctggagccc

SEQ ID NO: 51044 - DNA, 20 bp, Homo sapiens
gtggacggaatgcggctctc

SEQ ID NO: 51045 - DNA, 19 bp, Homo sapiens
cgtggtctgcaggtctccc

SEQ ID NO: 51046 - DNA, 19 bp, Homo sapiens
cacgtgctcctgctcttcc

SEQ ID NO: 51047 - DNA, 19 bp, Homo sapiens
gtggtctgtcttacctctc

SEQ ID NO: 51048 - DNA, 18 bp, Homo sapiens
tggtctgttctaacttcc

SEQ ID NO: 51049 - DNA, 18 bp, Homo sapiens
cgtggtctctgaagttct

SEQ ID NO: 51050 - DNA, 22 bp, Homo sapiens
catgtgtctgtgctggagtctc

SEQ ID NO: 51051 - DNA, 16 bp, Homo sapiens
cacgtgtctgtgcctc

SEQ ID NO: 51052 - DNA, 19 bp, Homo sapiens
gctggggcctggctctccc

SEQ ID NO: 51053 - DNA, 17 bp, Homo sapiens
gtggtctgtgcatatcc

SEQ ID NO: 51054 - DNA, 21 bp, Homo sapiens
gtggggtctgtgaatgcttcc

SEQ ID NO: 51055 - DNA, 18 bp, Homo sapiens
gtggtctgagtgaggccc

SEQ ID NO: 51056 - DNA, 20 bp, Homo sapiens
cactggacccctggctctcc

SEQ ID NO: 51057 - DNA, 20 bp, Homo sapiens
actcaggcatgtggctctcc

SEQ ID NO: 51058 - DNA, 25 bp, Homo sapiens
acttggtctgctcgaaggttttctc

SEQ ID NO: 51059 - DNA, 19 bp, Homo sapiens
gtgggccagtggctctccc

SEQ ID NO: 51060 - DNA, 19 bp, Homo sapiens
cggggtctgtgaacctctc

SEQ ID NO: 51061 - DNA, 18 bp, Homo sapiens
catatggtctaggcttct

SEQ ID NO: 51062 - DNA, 16 bp, Homo sapiens
gtggggccggctctcc

SEQ ID NO: 51063 - DNA, 19 bp, Homo sapiens
gtgggccgcgcggctctcc

SEQ ID NO: 51064 - DNA, 17 bp, Homo sapiens
cgtggtcggcgtcttcc

SEQ ID NO: 51065 - DNA, 18 bp, Homo sapiens
acgtggggatgtggctct

SEQ ID NO: 51066 - DNA, 20 bp, Homo sapiens
acctggtctgtatggtttcc

SEQ ID NO: 51067 - DNA, 17 bp, Homo sapiens
cactggtctgtgtaccc

SEQ ID NO: 51068 - DNA, 62 bp, Fowlpox virus
gataacggcactaatattaacttatctaaagggctaacacctttacatatagcgcccaaatc

SEQ ID NO: 51069 - DNA, 24 bp, Fowlpox virus
cggcactaatattaacttatctaa

SEQ ID NO: 51070 - DNA, 17 bp, Homo sapiens
ggcaccaattttatcta

SEQ ID NO: 51071 - DNA, 17 bp, Homo sapiens
ggcactaatattgctca

SEQ ID NO: 51072 - DNA, 19 bp, Homo sapiens
cggcactatcattgtactt

SEQ ID NO: 51073 - DNA, 20 bp, Homo sapiens
ggcattagcatccctatcta

SEQ ID NO: 51074 - DNA, 18 bp, Homo sapiens
ggcactaatgattggctt

SEQ ID NO: 51075 - DNA, 21 bp, Homo sapiens
ggcacaatattaacgcctcta

SEQ ID NO: 51076 - DNA, 61 bp, Fowlpox virus
tatagagattatcagtatccaagacactaataaacacgtagcttgtataactattactata

SEQ ID NO: 51077 - DNA, 24 bp, Fowlpox virus
tagagattatcagtatccaagaca

SEQ ID NO: 51078 - DNA, 22 bp, Homo sapiens
tagagatttctagactaagaca

SEQ ID NO: 51079 - DNA, 21 bp, Homo sapiens
tacagatttaaatccaagaca

SEQ ID NO: 51080 - DNA, 21 bp, Homo sapiens
taggtatttatttatccaaga

SEQ ID NO: 51081 - DNA, 19 bp, Homo sapiens
tagagattgcggtaaagac

SEQ ID NO: 51082 - DNA, 21 bp, Homo sapiens
gagaatatcagtatttataca

SEQ ID NO: 51083 - DNA, 18 bp, Homo sapiens
tagagatttcagaacaag

SEQ ID NO: 51084 - DNA, 20 bp, Homo sapiens
agagattgtcaaccaagaca

SEQ ID NO: 51085 - DNA, 22 bp, Homo sapiens
agatacgtatgtatccaagaca

SEQ ID NO: 51086 - DNA, 17 bp, Homo sapiens
gagattatgatccgaga

SEQ ID NO: 51087 - DNA, 17 bp, Homo sapiens
agaggttgtcagcacca

SEQ ID NO: 51088 - DNA, 17 bp, Homo sapiens
tagaggttgccaagaca

SEQ ID NO: 51089 - DNA, 21 bp, Homo sapiens
cagagattatgtgtcgggaca

SEQ ID NO: 51090 - DNA, 21 bp, Homo sapiens
gagattattagccaggagaca

SEQ ID NO: 51091 - DNA, 18 bp, Homo sapiens
tagtgacaggtatccaag

SEQ ID NO: 51092 - DNA, 21 bp, Homo sapiens
gaggattatcagaatagagac

SEQ ID NO: 51093 - DNA, 18 bp, Homo sapiens
gatatcaaagccaagaca

SEQ ID NO: 51094 - DNA, 21 bp, Homo sapiens
cagagatttgcagattcaaga

SEQ ID NO: 51095 - DNA, 23 bp, Homo sapiens
tagaggattcaacatctgggaca

SEQ ID NO: 51096 - DNA, 67 bp, Fowlpox virus
tacgtttttcattcttctagaaacatttgaactattattagacaatggagaaaagtgaatatacgta

SEQ ID NO: 51097 - DNA, 24 bp, Fowlpox virus
tttttcattcttctagaaacattt

SEQ ID NO: 51098 - DNA, 24 bp, Homo sapiens
ttttgcattcactctgaaacattt

SEQ ID NO: 51099 - DNA, 22 bp, Homo sapiens
ttttttttttttctagaaacat

SEQ ID NO: 51100 - DNA, 22 bp, Homo sapiens
tttttcatttttctcaaaacat

SEQ ID NO: 51101 - DNA, 24 bp, Homo sapiens
ttttgcattctacatgaaacattt

SEQ ID NO: 51102 - DNA, 25 bp, Homo sapiens
tttttcatttcaacaggaaacattt

SEQ ID NO: 51103 - DNA, 18 bp, Homo sapiens
ttttttactctctagaaa

SEQ ID NO: 51104 - DNA, 19 bp, Homo sapiens
ttttttgttcttccaaaaa

SEQ ID NO: 51105 - DNA, 24 bp, Homo sapiens
tttttcaatctgtgaaaaacattt

SEQ ID NO: 51106 - DNA, 22 bp, Homo sapiens
tttttcatccttctaaacattt

SEQ ID NO: 51107 - DNA, 19 bp, Homo sapiens
tttttcatttttccagaaa

SEQ ID NO: 51108 - DNA, 71 bp, Fowlpox virus
gatgagacaggtttactttagatagcggtactgatgtccacacgcgttagataaatataataaatctcatc

SEQ ID NO: 51109 - DNA, 24 bp, Fowlpox virus
tttagatagcggtactgatgtcca

SEQ ID NO: 51110 - DNA, 17 bp, Homo sapiens
tttagtagcggtattaa

SEQ ID NO: 51111 - DNA, 23 bp, Homo sapiens
tttagatattataactttgatgt

SEQ ID NO: 51112 - DNA, 21 bp, Homo sapiens
tttagcacactgctgatgtcc

SEQ ID NO: 51113 - DNA, 19 bp, Homo sapiens
tttagatagtggtacgaat

SEQ ID NO: 51114 - DNA, 24 bp, Homo sapiens
tttaaatagccatcatgatgtcca

SEQ ID NO: 51115 - DNA, 22 bp, Homo sapiens
taggtggcgatctcgatgtcca

SEQ ID NO: 51116 - DNA, 69 bp, Diatraea saccharalis densovirus
accgcaaactcccgtcgaagctggagccgtgtgcaaaacaggatgtagctaggcagcggaccgttgggt

SEQ ID NO: 51117 - DNA, 24 bp, Diatraea saccharalis densovirus
tcgaagctggagccgtgtgcaaaa

SEQ ID NO: 51118 - DNA, 15 bp, Homo sapiens
ccgaagctgggtgcg

SEQ ID NO: 51119 - DNA, 18 bp, Homo sapiens
gaagtccgagtgtgcaaa

SEQ ID NO: 51120 - DNA, 20 bp, Homo sapiens
tcgaggctggagcaggggtg

SEQ ID NO: 51121 - DNA, 18 bp, Homo sapiens
gaagctggagatcaagtg

SEQ ID NO: 51122 - DNA, 16 bp, Homo sapiens
tcaaagaccgtgtgca

SEQ ID NO: 51123 - DNA, 17 bp, Homo sapiens
ccggggctggagctgca

SEQ ID NO: 51124 - DNA, 19 bp, Homo sapiens
cgaagctggagaggtcgta

SEQ ID NO: 51125 - DNA, 17 bp, Homo sapiens
cgaggctggagcgcggc

SEQ ID NO: 51126 - DNA, 18 bp, Homo sapiens
gctggaggagcagtgcaa

SEQ ID NO: 51127 - DNA, 21 bp, Homo sapiens
gagcctggggctgtgtgcaaa

SEQ ID NO: 51128 - DNA, 18 bp, Homo sapiens
tcgaagctggaggtggtg

SEQ ID NO: 51129 - DNA, 18 bp, Homo sapiens
tcaaagctggttagtgca

SEQ ID NO: 51130 - DNA, 20 bp, Homo sapiens
tctgagctggagctgctggc

SEQ ID NO: 51131 - DNA, 21 bp, Homo sapiens
tcagggctggagctgtgggca

SEQ ID NO: 51132 - DNA, 18 bp, Homo sapiens
agctggaactaggtagca

SEQ ID NO: 51133 - DNA, 19 bp, Homo sapiens
gaagctggaggaccaggcg

SEQ ID NO: 51134 - DNA, 16 bp, Homo sapiens
tcgaagctggagtgca

SEQ ID NO: 51135 - DNA, 16 bp, Homo sapiens
tcaagctggaactgca

SEQ ID NO: 51136 - DNA, 17 bp, Homo sapiens
tcgaggctgcagtgcaa

SEQ ID NO: 51137 - DNA, 17 bp, Homo sapiens
ccgagctggagctgtgc

SEQ ID NO: 51138 - DNA, 18 bp, Homo sapiens
gaagctggcagtgaaaaa

SEQ ID NO: 51139 - DNA, 19 bp, Homo sapiens
gaagctgggtggcagtgtg

SEQ ID NO: 51140 - DNA, 18 bp, Homo sapiens
cggagctggagccgcagc

SEQ ID NO: 51141 - DNA, 18 bp, Homo sapiens
cgaggctggagccgcaca

SEQ ID NO: 51142 - DNA, 16 bp, Homo sapiens
gaagctagagagtgca

SEQ ID NO: 51143 - DNA, 18 bp, Homo sapiens
tcggggctgggccgcata

SEQ ID NO: 51144 - DNA, 18 bp, Homo sapiens
gagggctgctgtgtgcaa

SEQ ID NO: 51145 - DNA, 17 bp, Homo sapiens
ccggggctggccgtgcg

SEQ ID NO: 51146 - DNA, 21 bp, Homo sapiens
ccggggctggagctgcaccgc

SEQ ID NO: 51147 - DNA, 19 bp, Homo sapiens
tcggagctggagcagctgt

SEQ ID NO: 51148 - DNA, 18 bp, Homo sapiens
tcggggctggagcccggc

SEQ ID NO: 51149 - DNA, 21 bp, Homo sapiens
gaagctggcgtcacgcccaaa

SEQ ID NO: 51150 - DNA, 71 bp, Mushroom bacilliform virus
cttcgaaatcttcaaccccggaggcggcaaaacacacgcgccgtcgaaggaggaacaagaagaagtcgaag

SEQ ID NO: 51151 - DNA, 24 bp, Mushroom bacilliform virus
tcgaaatcttcaaccccggaggcg

SEQ ID NO: 51152 - DNA, 20 bp, Homo sapiens
ccgaaggtcagtcccggagg

SEQ ID NO: 51153 - DNA, 21 bp, Homo sapiens
tcgaaatctcttgaccctccg

SEQ ID NO: 51154 - DNA, 17 bp, Homo sapiens
gaatcttttcccggagg

SEQ ID NO: 51155 - DNA, 18 bp, Homo sapiens
tcttcagccccggaggcg

SEQ ID NO: 51156 - DNA, 19 bp, Homo sapiens
tcaaatcttcaaccctgcg

SEQ ID NO: 51157 - DNA, 19 bp, Homo sapiens
tcaagtctttgaccccaaa

SEQ ID NO: 51158 - DNA, 20 bp, Homo sapiens
tcagatcttcaactctccca

SEQ ID NO: 51159 - DNA, 24 bp, Homo sapiens
tcgaaatctgcagctctcctcccg

SEQ ID NO: 51160 - DNA, 22 bp, Homo sapiens
tcgtgatctgctcccggaggcg

SEQ ID NO: 51161 - DNA, 18 bp, Homo sapiens
gaaatcttaacccccaag

SEQ ID NO: 51162 - DNA, 110 bp, Diatraea saccharalis densovirus
ctcttagagtatcgccaccgacgacgacgacggcagtcgagcgcggcttcgccgcggcagcttcgctgcctcgactgccgtcgtcgtcgtcggtggcgatactctaagag

SEQ ID NO: 51163 - DNA, 24 bp, Diatraea saccharalis densovirus
acggcagtcgagcgcggcttcgcc

SEQ ID NO: 51164 - DNA, 26 bp, Homo sapiens
cggcagtcggtgcgctggcgaagccg

SEQ ID NO: 51165 - DNA, 18 bp, Homo sapiens
cggggtcgagcgcagcgc

SEQ ID NO: 51166 - DNA, 21 bp, Homo sapiens
cgtggttgagcgccggcggcc

SEQ ID NO: 51167 - DNA, 18 bp, Homo sapiens
cggcggcgggcgcggact

SEQ ID NO: 51168 - DNA, 19 bp, Homo sapiens
acggtagttgagcgtggct

SEQ ID NO: 51169 - DNA, 23 bp, Homo sapiens
cggcggcgggcgcggggcaggcc

SEQ ID NO: 51170 - DNA, 18 bp, Homo sapiens
acggcagtcgatggttcg

SEQ ID NO: 51171 - DNA, 17 bp, Homo sapiens
cggcggcgggcgcggcc

SEQ ID NO: 51172 - DNA, 20 bp, Homo sapiens
cggcggcgggcgcggctgcc

SEQ ID NO: 51173 - DNA, 22 bp, Homo sapiens
cggcggttttactcggcttcgc

SEQ ID NO: 51174 - DNA, 20 bp, Homo sapiens
cggggtcgagcgcccctgcc

SEQ ID NO: 51175 - DNA, 19 bp, Homo sapiens
ggcagtcgcgcgcgcggct

SEQ ID NO: 51176 - DNA, 23 bp, Homo sapiens
ggcagtcgggcggccctcgtgcc

SEQ ID NO: 51177 - DNA, 23 bp, Homo sapiens
ggctgttgagggcaatgtttcgc

SEQ ID NO: 51178 - DNA, 18 bp, Homo sapiens
gcagtcgagcgccacggc

SEQ ID NO: 51179 - DNA, 18 bp, Homo sapiens
cggcggcgagcgcggatc

SEQ ID NO: 51180 - DNA, 23 bp, Homo sapiens
cggcagtcgcagtgttcacagcc

SEQ ID NO: 51181 - DNA, 17 bp, Homo sapiens
ggcagaggcggcttcgc

SEQ ID NO: 51182 - DNA, 18 bp, Homo sapiens
acggcggtgagcgcgggc

SEQ ID NO: 51183 - DNA, 106 bp, Mushroom bacilliform virus
ttcattctcggtgtaatggtatctatgagaacttcggtttgtcgcttgacttgttagtcggacgattagaatctgaggaaactgataggtatgcacggacaatgga

SEQ ID NO: 51184 - DNA, 24 bp, Mushroom bacilliform virus
tctcggtgtaatggtatctatgag

SEQ ID NO: 51185 - DNA, 21 bp, Homo sapiens
tctgttatcatggtatctgtg

SEQ ID NO: 51186 - DNA, 19 bp, Homo sapiens
cctcggtgtagtggtgtct

SEQ ID NO: 51187 - DNA, 19 bp, Homo sapiens
tcttggtgtggatgccatg

SEQ ID NO: 51188 - DNA, 19 bp, Homo sapiens
tcttggttgtaatctatga

SEQ ID NO: 51189 - DNA, 19 bp, Homo sapiens
tctggtgtgagtcctatga

SEQ ID NO: 51190 - DNA, 23 bp, Homo sapiens
tctcagtgtgatgaaagagtgag

SEQ ID NO: 51191 - DNA, 18 bp, Homo sapiens
tctcgttgtaatgaatga

SEQ ID NO: 51192 - DNA, 88 bp, Diatraea saccharalis densovirus
gagacagcaacatgagtgaaagagatagcatgaaaacaaaccttgaaataatttatgcgtaattttattatcttgttattgtgacctc

SEQ ID NO: 51193 - DNA, 24 bp, Diatraea saccharalis densovirus
tgagtgaaagagatagcatgaaaa

SEQ ID NO: 51194 - DNA, 23 bp, Homo sapiens
tgatgaaagaaacactatgaaaa

SEQ ID NO: 51195 - DNA, 21 bp, Homo sapiens
tgggtgcagagaccatgaaaa

SEQ ID NO: 51196 - DNA, 19 bp, Homo sapiens
tgagtgaagaaattatgaa

SEQ ID NO: 51197 - DNA, 19 bp, Homo sapiens
tggtggaagcagcatgaaa

SEQ ID NO: 51198 - DNA, 20 bp, Homo sapiens
tgagtgaaacaggttccacg

SEQ ID NO: 51199 - DNA, 18 bp, Homo sapiens
tgagtaaagtgcatgaaa

SEQ ID NO: 51200 - DNA, 20 bp, Homo sapiens
gagtgaaaggagtccatgaa

SEQ ID NO: 51201 - DNA, 19 bp, Homo sapiens
tgagtgaaggaatgagtga

SEQ ID NO: 51202 - DNA, 19 bp, Homo sapiens
tgagggaagagataggaaa

SEQ ID NO: 51203 - DNA, 17 bp, Homo sapiens
gtgaaaagccagcatga

SEQ ID NO: 51204 - DNA, 18 bp, Homo sapiens
agtgaaagggatccagga

SEQ ID NO: 51205 - DNA, 21 bp, Homo sapiens
tgaggtggtgggtagcatgaa

SEQ ID NO: 51206 - DNA, 19 bp, Homo sapiens
gagtgagagagaaaggaaa

SEQ ID NO: 51207 - DNA, 17 bp, Homo sapiens
tgaggaaagagaacgca

SEQ ID NO: 51208 - DNA, 17 bp, Homo sapiens
agtggaagagatagatg

SEQ ID NO: 51209 - DNA, 21 bp, Homo sapiens
agtgaagccatagcatgaaaa

SEQ ID NO: 51210 - DNA, 20 bp, Homo sapiens
tgagtgaaggggcacaacac

SEQ ID NO: 51211 - DNA, 21 bp, Homo sapiens
taagtgaaaggggtcacaaaa

SEQ ID NO: 51212 - DNA, 23 bp, Homo sapiens
tgagtggcagattttcatgaaaa

SEQ ID NO: 51213 - DNA, 17 bp, Homo sapiens
tgagtgaagagaactga

SEQ ID NO: 51214 - DNA, 19 bp, Homo sapiens
tgagtgaaggggaacgaaa

SEQ ID NO: 51215 - DNA, 17 bp, Homo sapiens
agtgggaatgcatgaaa

SEQ ID NO: 51216 - DNA, 20 bp, Homo sapiens
tgagtgaagaggaggcagga

SEQ ID NO: 51217 - DNA, 17 bp, Homo sapiens
gtgaaagagacaataga

SEQ ID NO: 51218 - DNA, 19 bp, Homo sapiens
tgagtggaaagataactaa

SEQ ID NO: 51219 - DNA, 19 bp, Homo sapiens
tggtggaagagacaggaaa

SEQ ID NO: 51220 - DNA, 16 bp, Homo sapiens
tgagtgaagacaaatg

SEQ ID NO: 51221 - DNA, 18 bp, Homo sapiens
tgagtaaagagaaagaga

SEQ ID NO: 51222 - DNA, 19 bp, Homo sapiens
gagtgaaagggagaggctg

SEQ ID NO: 51223 - DNA, 19 bp, Homo sapiens
tgagtgggtagagagcaga

SEQ ID NO: 51224 - DNA, 21 bp, Homo sapiens
tgagtaaaggatgctgatgaa

SEQ ID NO: 51225 - DNA, 19 bp, Homo sapiens
tgaggagggagataactga

SEQ ID NO: 51226 - DNA, 20 bp, Homo sapiens
tgggtaagaaaggcatgaaa

SEQ ID NO: 51227 - DNA, 21 bp, Homo sapiens
tgagggaaagcaatagcatga

SEQ ID NO: 51228 - DNA, 19 bp, Homo sapiens
tggtgaaagaggcactgaa

SEQ ID NO: 51229 - DNA, 21 bp, Homo sapiens
agtggaagagatatacataaa

SEQ ID NO: 51230 - DNA, 19 bp, Homo sapiens
tgagcgagagagacagacg

SEQ ID NO: 51231 - DNA, 22 bp, Homo sapiens
tgagtgaaacagattcacaaaa

SEQ ID NO: 51232 - DNA, 21 bp, Homo sapiens
tgggttggaagataaccatga

SEQ ID NO: 51233 - DNA, 22 bp, Homo sapiens
gtgaactgagatagcatgaaaa

SEQ ID NO: 51234 - DNA, 22 bp, Homo sapiens
tgagtgaaagaggctgtgcaga

SEQ ID NO: 51235 - DNA, 19 bp, Homo sapiens
gtgaaagagctcactgaaa

SEQ ID NO: 51236 - DNA, 22 bp, Homo sapiens
tgtagtgggaggccacatgaaa

SEQ ID NO: 51237 - DNA, 20 bp, Homo sapiens
tgaatgaaagagctctgaaa

SEQ ID NO: 51238 - DNA, 20 bp, Homo sapiens
tgagtgaagagatgtctgaa

SEQ ID NO: 51239 - DNA, 131 bp, Melanoplus sanguinipes entomopoxvirus
gattataacactacttggactaactgatactacatatgttccaatttgtttataagcatatactgtatcttctgatatttgcttagcttcatttaacatttgttcaggattttcaactacatattttaatt

SEQ ID NO: 51240 - DNA, 24 bp, Melanoplus sanguinipes entomopoxvirus
tataagcatatactgtatcttctg

SEQ ID NO: 51241 - DNA, 21 bp, Homo sapiens
taagcatattgtgaaattctg

SEQ ID NO: 51242 - DNA, 19 bp, Homo sapiens
taaacatatacatcttctg

SEQ ID NO: 51243 - DNA, 21 bp, Homo sapiens
tatgagcatacactgccactg

SEQ ID NO: 51244 - DNA, 22 bp, Homo sapiens
tattagcatatattacactctg

SEQ ID NO: 51245 - DNA, 20 bp, Homo sapiens
tacaagtatatactgaagct

SEQ ID NO: 51246 - DNA, 18 bp, Homo sapiens
aagcatatgtaacttctg

SEQ ID NO: 51247 - DNA, 18 bp, Homo sapiens
taagcatatgtgtgtcct

SEQ ID NO: 51248 - DNA, 20 bp, Homo sapiens
aacaaatactgtattttctg

SEQ ID NO: 51249 - DNA, 19 bp, Homo sapiens
tatatgcatatcatcttct

SEQ ID NO: 51250 - DNA, 127 bp, Melanoplus sanguinipes entomopoxvirus
cattaatagtttttttaccatttgcaataaaatctctcatatcataaatattataaaatgtagcattatctatttttaatttattactatcatattttgttttctttttggtaaatgaccgtttatg

SEQ ID NO: 51251 - DNA, 24 bp, Melanoplus sanguinipes entomopoxvirus
ttaatagtttttttaccatttgca

SEQ ID NO: 51252 - DNA, 18 bp, Homo sapiens
taatagttttttgtttgc

SEQ ID NO: 51253 - DNA, 22 bp, Homo sapiens
ttaatggatttttacctttgca

SEQ ID NO: 51254 - DNA, 20 bp, Homo sapiens
cagttactttatcatttgca

SEQ ID NO: 51255 - DNA, 130 bp, Paramecium bursaria Chlorella virus 1
aaaactcgtaccaacggcaaaaatttcgaagattagaggagatgaatgcgacacatctggtgattttattatttgtatgattcagactcttttgtccagaaaatataatgcttttgatggtatcgggtgt

SEQ ID NO: 51256 - DNA, 24 bp, Paramecium bursaria Chlorella virus 1
ttatttgtatgattcagactcttt

SEQ ID NO: 51257 - DNA, 19 bp, Homo sapiens
ttatggaatttagactctt

SEQ ID NO: 51258 - DNA, 23 bp, Homo sapiens
ttgtattttgttttagactcttt

SEQ ID NO: 51259 - DNA, 21 bp, Homo sapiens
tttgtagagactggactcttt

SEQ ID NO: 51260 - DNA, 19 bp, Homo sapiens
ttatttgatgattcaatac

SEQ ID NO: 51261 - DNA, 19 bp, Homo sapiens
tttgtatgaaaatctcttt

SEQ ID NO: 51262 - DNA, 60 bp, Paramecium bursaria Chlorella virus 1
cttacaaaaaaattggattcaatattattggagacgataaaaaatccaagaaacaagaag

SEQ ID NO: 51263 - DNA, 21 bp, Paramecium bursaria Chlorella virus 1
aaaaatccaagaaacaagaag

SEQ ID NO: 51264 - DNA, 18 bp, Homo sapiens
aaaaatccaagttacaag

SEQ ID NO: 51265 - DNA, 18 bp, Homo sapiens
aaaaatccaaaaaattag

SEQ ID NO: 51266 - DNA, 19 bp, Homo sapiens
aaaatccaacaataagaag

SEQ ID NO: 51267 - DNA, 18 bp, Homo sapiens
aaaacccaagaataccag

SEQ ID NO: 51268 - DNA, 19 bp, Homo sapiens
aaaaccctcctacaagaag

SEQ ID NO: 51269 - DNA, 24 bp, Homo sapiens
aatccaaggagcaaaccaagaagc

SEQ ID NO: 51270 - DNA, 21 bp, Homo sapiens
aaaaacccaagacactggaag

SEQ ID NO: 51271 - DNA, 22 bp, Homo sapiens
aaaatccaaggaaatacagaag

SEQ ID NO: 51272 - DNA, 18 bp, Homo sapiens
aatcagggaaacaagaag

SEQ ID NO: 51273 - DNA, 17 bp, Homo sapiens
aaaaatccagaaaccag

SEQ ID NO: 51274 - DNA, 19 bp, Homo sapiens
aaaacccaaaacaaagaag

SEQ ID NO: 51275 - DNA, 19 bp, Homo sapiens
atctatgagaaacaagaag

SEQ ID NO: 51276 - DNA, 18 bp, Homo sapiens
acacagagaaacaagaag

SEQ ID NO: 51277 - DNA, 17 bp, Homo sapiens
ggaaatccaagaaaaag

SEQ ID NO: 51278 - DNA, 18 bp, Homo sapiens
aaaacctgggaaacaaga

SEQ ID NO: 51279 - DNA, 21 bp, Homo sapiens
aaaaatccaagaagtgggaag

SEQ ID NO: 51280 - DNA, 22 bp, Homo sapiens
aaaaacccaagggctccagaag

SEQ ID NO: 51281 - DNA, 21 bp, Homo sapiens
aaaactccaagaagacagaga

SEQ ID NO: 51282 - DNA, 23 bp, Homo sapiens
aaaaatccaatgttacagggaag

SEQ ID NO: 51283 - DNA, 18 bp, Homo sapiens
aaaaatgcaagaaactag

SEQ ID NO: 51284 - DNA, 18 bp, Homo sapiens
aaaactgagaaacaagaa

SEQ ID NO: 51285 - DNA, 23 bp, Homo sapiens
aaaaatcctcacaaaacaagaag

SEQ ID NO: 51286 - DNA, 20 bp, Homo sapiens
aaaaatccaggatgaacaag

SEQ ID NO: 51287 - DNA, 20 bp, Homo sapiens
aaaaatccaatagaatcaaa

SEQ ID NO: 51288 - DNA, 21 bp, Homo sapiens
aaaaatccaacaaatggcaag

SEQ ID NO: 51289 - DNA, 15 bp, Homo sapiens
aaaaatccaagcaag

SEQ ID NO: 51290 - DNA, 18 bp, Homo sapiens
aatcctaaaaacaagaag

SEQ ID NO: 51291 - DNA, 18 bp, Homo sapiens
aaacccatgaacaagaag

SEQ ID NO: 51292 - DNA, 22 bp, Homo sapiens
aaaatccacagaaggcaagaag

SEQ ID NO: 51293 - DNA, 17 bp, Homo sapiens
aatccaagacaaggaag

SEQ ID NO: 51294 - DNA, 21 bp, Homo sapiens
aaaaatccaaaagtcaagaag

SEQ ID NO: 51295 - DNA, 20 bp, Homo sapiens
aaacacctggaaacaagaag

SEQ ID NO: 51296 - DNA, 17 bp, Homo sapiens
aaaatccaaacaggaag

SEQ ID NO: 51297 - DNA, 20 bp, Homo sapiens
aaaaaccaagaaaccaaaag

SEQ ID NO: 51298 - DNA, 22 bp, Homo sapiens
aaaaatccaatagacactgaag

SEQ ID NO: 51299 - DNA, 22 bp, Homo sapiens
aaaattccaagaactgtcaaag

SEQ ID NO: 51300 - DNA, 20 bp, Homo sapiens
aaaaatccaactcacagaag

SEQ ID NO: 51301 - DNA, 18 bp, Homo sapiens
aaaaatctgaaaacaaga

SEQ ID NO: 51302 - DNA, 18 bp, Homo sapiens
aaaaatcagaaacagaag

SEQ ID NO: 51303 - DNA, 20 bp, Homo sapiens
aaaaatctgtaaacaagaag

SEQ ID NO: 51304 - DNA, 21 bp, Homo sapiens
aaaatcacaacagacaagaag

SEQ ID NO: 51305 - DNA, 19 bp, Homo sapiens
aaaatccaagatcaggaag

SEQ ID NO: 51306 - DNA, 21 bp, Homo sapiens
aaaaagtccaagaggcacaag

SEQ ID NO: 51307 - DNA, 16 bp, Homo sapiens
aaaaatccagcaagaa

SEQ ID NO: 51308 - DNA, 23 bp, Homo sapiens
aaaaatcctaagaacactaaaag

SEQ ID NO: 51309 - DNA, 18 bp, Homo sapiens
aatccaaaagtcaagaag

SEQ ID NO: 51310 - DNA, 20 bp, Homo sapiens
aaaagccaggaaccaagaag

SEQ ID NO: 51311 - DNA, 19 bp, Homo sapiens
aaaaaccaagaaaaccaag

SEQ ID NO: 51312 - DNA, 17 bp, Homo sapiens
aaaactccaagaacaag

SEQ ID NO: 51313 - DNA, 19 bp, Homo sapiens
aaaattggagaaacaagaa

SEQ ID NO: 51314 - DNA, 22 bp, Homo sapiens
aatccaaaacagagacaagaag

SEQ ID NO: 51315 - DNA, 122 bp, Barley mild mosaic virus
tgcctttccggcagagcatcccctggcatcgacactcacgcgatcgcaatcaactgacttaatcctcggttttgcaatcatatagtgagttctacccctggacgtgttcccccggaactgca

SEQ ID NO: 51316 - DNA, 24 bp, Barley mild mosaic virus
tttgcaatcatatagtgagttcta

SEQ ID NO: 51317 - DNA, 20 bp, Homo sapiens
tctgcaatcatagaaaagtt

SEQ ID NO: 51318 - DNA, 22 bp, Homo sapiens
tttgcaatttgtgcaaagttct

SEQ ID NO: 51319 - DNA, 23 bp, Homo sapiens
tttgcaatcgatgtgattgtcta

SEQ ID NO: 51320 - DNA, 21 bp, Homo sapiens
tttgcaatcctatgtgttcta

SEQ ID NO: 51321 - DNA, 18 bp, Homo sapiens
gcaatcatgtacatctct

SEQ ID NO: 51322 - DNA, 111 bp, Barley mild mosaic virus
ccacaattagctattcgtgtactagcatcatcggatacgcctatcctgcacttaagcctgcaggacgctatcaggtccgctgactgttaccatttgtgtagctcgttgtgg

SEQ ID NO: 51323 - DNA, 24 bp, Barley mild mosaic virus
tagcatcatcggatacgcctatcc

SEQ ID NO: 51324 - DNA, 23 bp, Homo sapiens
gctatcatcaatcctgcctgtcc

SEQ ID NO: 51325 - DNA, 22 bp, Homo sapiens
gcaccatctcaggtgcctgtcc

SEQ ID NO: 51326 - DNA, 100 bp, Melanoplus sanguinipes entomopoxvirus
tataaatgatgtttgtgaatatatattatctgatacataattaaaaataccatcatagcatgatgatattgtagtattttttttaaatatattatttata

SEQ ID NO: 51327 - DNA, 24 bp, Melanoplus sanguinipes entomopoxvirus
taaatgatgtttgtgaatatatat

SEQ ID NO: 51328 - DNA, 21 bp, Homo sapiens
taaataaacatgaatatatat

SEQ ID NO: 51329 - DNA, 22 bp, Homo sapiens
atgaataccgatgaatatatat

SEQ ID NO: 51330 - DNA, 23 bp, Homo sapiens
atggtgtttatataaatatatat

SEQ ID NO: 51331 - DNA, 18 bp, Homo sapiens
atgtgtgtgagtatatat

SEQ ID NO: 51332 - DNA, 21 bp, Homo sapiens
aatgatgtttgatttaaatat

SEQ ID NO: 51333 - DNA, 19 bp, Homo sapiens
tgaatgcatgtgcatatat

SEQ ID NO: 51334 - DNA, 20 bp, Homo sapiens
taaatggtatgaatatatat

SEQ ID NO: 51335 - DNA, 20 bp, Homo sapiens
taaatgttgtctgtatatat

SEQ ID NO: 51336 - DNA, 63 bp, Melanoplus sanguinipes entomopoxvirus
ttattataaattctgttgtataattataattataattataattattaatacattttataataa

SEQ ID NO: 51337 - DNA, 24 bp, Melanoplus sanguinipes entomopoxvirus
tctgttgtataattataattataa

SEQ ID NO: 51338 - DNA, 22 bp, Homo sapiens
ctaccatatagttataattata

SEQ ID NO: 51339 - DNA, 18 bp, Homo sapiens
ctgttgtataagattata

SEQ ID NO: 51340 - DNA, 21 bp, Homo sapiens
tctgttgtaatgcttattata

SEQ ID NO: 51341 - DNA, 106 bp, Gallid herpesvirus 2
tctcattgttatgtagttgtgatttattaaacatattttttataactctagtattctccgagttacttatatatttatttgtcagacaataatgcaatagtggaga

SEQ ID NO: 51342 - DNA, 24 bp, Gallid herpesvirus 2
tattaaacatattttttataactc

SEQ ID NO: 51343 - DNA, 25 bp, Homo sapiens
tatttaacatatttggcaataactc

SEQ ID NO: 51344 - DNA, 19 bp, Homo sapiens
tattaaacttatttcctat

SEQ ID NO: 51345 - DNA, 21 bp, Homo sapiens
ttaaacatagagtatataact

SEQ ID NO: 51346 - DNA, 19 bp, Homo sapiens
taaacatatttcttagctc

SEQ ID NO: 51347 - DNA, 68 bp, Lumpy skin disease virus
cttattgtatagaatatcatgacgattgggaagccgttattaatcaattggtagatttatacgatgag

SEQ ID NO: 51348 - DNA, 24 bp, Lumpy skin disease virus
tagaatatcatgacgattgggaag

SEQ ID NO: 51349 - DNA, 17 bp, Homo sapiens
atcatgggactgggaag

SEQ ID NO: 51350 - DNA, 24 bp, Homo sapiens
tagaatatttacacatttgggaag

SEQ ID NO: 51351 - DNA, 15 bp, Homo sapiens
caccatgttgggaag

SEQ ID NO: 51352 - DNA, 24 bp, Homo sapiens
tagaatattttggtctttgggaag

SEQ ID NO: 51353 - DNA, 21 bp, Homo sapiens
tagaatattctggtcgttgga

SEQ ID NO: 51354 - DNA, 21 bp, Homo sapiens
tagaatattctggtctttggg

SEQ ID NO: 51355 - DNA, 20 bp, Homo sapiens
tagaatattgtatgacatgg

SEQ ID NO: 51356 - DNA, 21 bp, Homo sapiens
tagaatagtcatggtgctgag

SEQ ID NO: 51357 - DNA, 18 bp, Homo sapiens
gaataccatgatggtggg

SEQ ID NO: 51358 - DNA, 20 bp, Homo sapiens
caggatgtcatgacatggga

SEQ ID NO: 51359 - DNA, 71 bp, Lumpy skin disease virus
tattgtactgtttaggaaaaactgatttttcaaatataaaatctataatagaagttccggtcactacaata

SEQ ID NO: 51360 - DNA, 24 bp, Lumpy skin disease virus
taggaaaaactgatttttcaaata

SEQ ID NO: 51361 - DNA, 21 bp, Homo sapiens
taggaaaaatttctcttttca

SEQ ID NO: 51362 - DNA, 20 bp, Homo sapiens
tagggaaaactatctcaaat

SEQ ID NO: 51363 - DNA, 25 bp, Homo sapiens
ggcaagaactgaggagtctcaaata

SEQ ID NO: 51364 - DNA, 18 bp, Homo sapiens
ggaagggtgatttttcaa

SEQ ID NO: 51365 - DNA, 18 bp, Homo sapiens
caggggaaactgattttt

SEQ ID NO: 51366 - DNA, 23 bp, Homo sapiens
taggaaaaactcatacataaata

SEQ ID NO: 51367 - DNA, 22 bp, Homo sapiens
ggaaaatatttattttcaaata

SEQ ID NO: 51368 - DNA, 23 bp, Homo sapiens
agaaaaactgaactacacaaata

SEQ ID NO: 51369 - DNA, 19 bp, Homo sapiens
ggaatactgttttcaaata

SEQ ID NO: 51370 - DNA, 18 bp, Homo sapiens
ggaaaggctgatcttaca

SEQ ID NO: 51371 - DNA, 21 bp, Homo sapiens
ggaaaggcctgatttcaaata

SEQ ID NO: 51372 - DNA, 21 bp, Homo sapiens
taggagaagctaattcaaata

SEQ ID NO: 51373 - DNA, 18 bp, Homo sapiens
ggaaaaactgatatccaa

SEQ ID NO: 51374 - DNA, 20 bp, Homo sapiens
taggagttatttttcaaata

SEQ ID NO: 51375 - DNA, 18 bp, Homo sapiens
taagaaaaattgattctc

SEQ ID NO: 51376 - DNA, 23 bp, Homo sapiens
aggaaagacactggcttcaaata

SEQ ID NO: 51377 - DNA, 18 bp, Homo sapiens
taggagaaactgattcct

SEQ ID NO: 51378 - DNA, 18 bp, Homo sapiens
taggagaagctgatctct

SEQ ID NO: 51379 - DNA, 18 bp, Homo sapiens
ggaaaccatttttcaaat

SEQ ID NO: 51380 - DNA, 60 bp, Alcelaphine herpesvirus 1
ctggagccaaggggatggagatggcatcgtgtgggctgaattctttctcttggtttgcag

SEQ ID NO: 51381 - DNA, 24 bp, Alcelaphine herpesvirus 1
tgaattctttctcttggtttgcag

SEQ ID NO: 51382 - DNA, 19 bp, Homo sapiens
ttctttcttacatttgcag

SEQ ID NO: 51383 - DNA, 22 bp, Homo sapiens
tggatcctttttcttttggcag

SEQ ID NO: 51384 - DNA, 19 bp, Homo sapiens
ttctttttcctttttgcag

SEQ ID NO: 51385 - DNA, 22 bp, Homo sapiens
tgatttctttctgcatttgcag

SEQ ID NO: 51386 - DNA, 18 bp, Homo sapiens
tgagtttttctcttggtc

SEQ ID NO: 51387 - DNA, 20 bp, Homo sapiens
taaattctttctttatcagt

SEQ ID NO: 51388 - DNA, 21 bp, Homo sapiens
tgaattcctttccatttgcag

SEQ ID NO: 51389 - DNA, 22 bp, Homo sapiens
tgggttctttctctggtctcag

SEQ ID NO: 51390 - DNA, 20 bp, Homo sapiens
tgaattctttcttgtatagt

SEQ ID NO: 51391 - DNA, 18 bp, Homo sapiens
tgagttctttcctgagca

SEQ ID NO: 51392 - DNA, 19 bp, Homo sapiens
tgggttcttcctgtggctt

SEQ ID NO: 51393 - DNA, 22 bp, Homo sapiens
tgaattctttactcttggctca

SEQ ID NO: 51394 - DNA, 19 bp, Homo sapiens
ttctttctttccagtgcag

SEQ ID NO: 51395 - DNA, 18 bp, Homo sapiens
tgaattctttcactttgg

SEQ ID NO: 51396 - DNA, 19 bp, Homo sapiens
tgagttctttcaccctgca

SEQ ID NO: 51397 - DNA, 18 bp, Homo sapiens
tgaattctttccagtgca

SEQ ID NO: 51398 - DNA, 21 bp, Homo sapiens
tgaactttttcttggctgcag

SEQ ID NO: 51399 - DNA, 23 bp, Homo sapiens
tgggttcttttctccctctgcag

SEQ ID NO: 51400 - DNA, 18 bp, Homo sapiens
tgggctctttccctttgt

SEQ ID NO: 51401 - DNA, 21 bp, Homo sapiens
taaattctttctcttttcttg

SEQ ID NO: 51402 - DNA, 70 bp, Sheeppox virus
ccttattttataaaatatcatgacgattgggaagctgttattaatcaattggtagatttatacgatgagg

SEQ ID NO: 51403 - DNA, 24 bp, Sheeppox virus
taaaatatcatgacgattgggaag

SEQ ID NO: 51404 - DNA, 21 bp, Homo sapiens
taaaatgtggcaattgggaag

SEQ ID NO: 51405 - DNA, 21 bp, Homo sapiens
aatatttacacatttgggaag

SEQ ID NO: 51406 - DNA, 23 bp, Homo sapiens
caagatatcatgaaaccaggaag

SEQ ID NO: 51407 - DNA, 22 bp, Homo sapiens
taaaatatcatggcagactcag

SEQ ID NO: 51408 - DNA, 20 bp, Homo sapiens
taaaataccatgaataggga

SEQ ID NO: 51409 - DNA, 120 bp, Snakehead retrovirus
ggtggcatcccttcatatcgcccctaggtctagttcactggagttggatggagaagttcgtgcaaccggtgataaggctcgagggttggaaagaactgaaggaggaattgctgacacacc

SEQ ID NO: 51410 - DNA, 24 bp, Snakehead retrovirus
ataaggctcgagggttggaaagaa

SEQ ID NO: 51411 - DNA, 17 bp, Homo sapiens
aggcttgggggaaagaa

SEQ ID NO: 51412 - DNA, 22 bp, Homo sapiens
agggaacctagggttggggaga

SEQ ID NO: 51413 - DNA, 19 bp, Homo sapiens
ggcccgagggtctaaagaa

SEQ ID NO: 51414 - DNA, 17 bp, Homo sapiens
aaggcaagttgggaaga

SEQ ID NO: 51415 - DNA, 18 bp, Homo sapiens
aggacgagggttggggag

SEQ ID NO: 51416 - DNA, 19 bp, Homo sapiens
aagctttgggggaacagaa

SEQ ID NO: 51417 - DNA, 18 bp, Homo sapiens
taaggctgagagaaagaa

SEQ ID NO: 51418 - DNA, 20 bp, Homo sapiens
taaggttgagggggaaggaa

SEQ ID NO: 51419 - DNA, 17 bp, Homo sapiens
ataagacttgaggctgg

SEQ ID NO: 51420 - DNA, 21 bp, Homo sapiens
ggattggagggcttgggaaga

SEQ ID NO: 51421 - DNA, 22 bp, Homo sapiens
aaggaaggaaggggttggaaag

SEQ ID NO: 51422 - DNA, 17 bp, Homo sapiens
ataaggtcgggggctga

SEQ ID NO: 51423 - DNA, 18 bp, Homo sapiens
aaggctcgggccgaggag

SEQ ID NO: 51424 - DNA, 17 bp, Homo sapiens
ggcagggttggaaagaa

SEQ ID NO: 51425 - DNA, 17 bp, Homo sapiens
aaggttcgatgggagaa

SEQ ID NO: 51426 - DNA, 16 bp, Homo sapiens
aggcttggctggaaga

SEQ ID NO: 51427 - DNA, 21 bp, Homo sapiens
aggcaagaagggttggaggga

SEQ ID NO: 51428 - DNA, 19 bp, Homo sapiens
agcctttggggttggaaag

SEQ ID NO: 51429 - DNA, 17 bp, Homo sapiens
agggtcgggggggaaag

SEQ ID NO: 51430 - DNA, 18 bp, Homo sapiens
ataaggttgaaggaggaa

SEQ ID NO: 51431 - DNA, 19 bp, Homo sapiens
ggctgaaaagggggaagaa

SEQ ID NO: 51432 - DNA, 21 bp, Homo sapiens
aaggaagagggttgggaagaa

SEQ ID NO: 51433 - DNA, 19 bp, Homo sapiens
aggctggaggatcattaga

SEQ ID NO: 51434 - DNA, 22 bp, Homo sapiens
acagggctgaagagttggagag

SEQ ID NO: 51435 - DNA, 21 bp, Homo sapiens
ggctggagggtcacgggagag

SEQ ID NO: 51436 - DNA, 16 bp, Homo sapiens
ataaggctggtggaag

SEQ ID NO: 51437 - DNA, 19 bp, Homo sapiens
taaaggcttgggataaaga

SEQ ID NO: 51438 - DNA, 19 bp, Homo sapiens
ataaggctgggataaaaga

SEQ ID NO: 51439 - DNA, 20 bp, Homo sapiens
ggaagggaggggttggagag

SEQ ID NO: 51440 - DNA, 19 bp, Homo sapiens
taaggctggggctgtggga

SEQ ID NO: 51441 - DNA, 18 bp, Homo sapiens
ggctgaaagcagaaagaa

SEQ ID NO: 51442 - DNA, 21 bp, Homo sapiens
ataaggcctcgggagaaggaa

SEQ ID NO: 51443 - DNA, 21 bp, Homo sapiens
aggtcatttagttggaaggaa

SEQ ID NO: 51444 - DNA, 15 bp, Homo sapiens
taaggctgaattgaa

SEQ ID NO: 51445 - DNA, 18 bp, Homo sapiens
ataaggcctgagggtgga

SEQ ID NO: 51446 - DNA, 17 bp, Homo sapiens
aggctcctttggaaaga

SEQ ID NO: 51447 - DNA, 20 bp, Homo sapiens
ataaggtttcaagtggagga

SEQ ID NO: 51448 - DNA, 21 bp, Homo sapiens
agggaacctggggttggaaag

SEQ ID NO: 51449 - DNA, 16 bp, Homo sapiens
ggctaggctcggaaga

SEQ ID NO: 51450 - DNA, 17 bp, Homo sapiens
aggctaaattgggaaga

SEQ ID NO: 51451 - DNA, 20 bp, Homo sapiens
aggcttaagggttatttaga

SEQ ID NO: 51452 - DNA, 18 bp, Homo sapiens
gaaaggcttgtggaaaga

SEQ ID NO: 51453 - DNA, 22 bp, Homo sapiens
ataaggcttggtgtgttgagaa

SEQ ID NO: 51454 - DNA, 19 bp, Homo sapiens
ggccccagggttggggaga

SEQ ID NO: 51455 - DNA, 20 bp, Homo sapiens
agcagggagggttggaagga

SEQ ID NO: 51456 - DNA, 18 bp, Homo sapiens
aaggcttgaggatccagg

SEQ ID NO: 51457 - DNA, 17 bp, Homo sapiens
aggggagggttgggaag

SEQ ID NO: 51458 - DNA, 21 bp, Homo sapiens
ggaaggtggggttggagggaa

SEQ ID NO: 51459 - DNA, 18 bp, Homo sapiens
caaggacaggttggagag

SEQ ID NO: 51460 - DNA, 22 bp, Homo sapiens
agggttggaggagtgggaagaa

SEQ ID NO: 51461 - DNA, 18 bp, Homo sapiens
aggagaaggttggaggga

SEQ ID NO: 51462 - DNA, 21 bp, Homo sapiens
aagggttttaaagttggaaag

SEQ ID NO: 51463 - DNA, 20 bp, Homo sapiens
aaggctgattttggaaagaa

SEQ ID NO: 51464 - DNA, 17 bp, Homo sapiens
ggcttgaggaagcaaga

SEQ ID NO: 51465 - DNA, 19 bp, Homo sapiens
taaggctgaggcagagaga

SEQ ID NO: 51466 - DNA, 19 bp, Homo sapiens
atagggctgagaggatggg

SEQ ID NO: 51467 - DNA, 18 bp, Homo sapiens
ataaggcttgagtgtgag

SEQ ID NO: 51468 - DNA, 93 bp, Snakehead retrovirus
cctatgatacatatgctcttaatgtacttgtttactgtttatacgcacccaagtaacaactgtatttaattataacctatgtgaatcataagg

SEQ ID NO: 51469 - DNA, 24 bp, Snakehead retrovirus
taatgtacttgtttactgtttata

SEQ ID NO: 51470 - DNA, 18 bp, Homo sapiens
taatgtacatgtactact

SEQ ID NO: 51471 - DNA, 21 bp, Homo sapiens
atgtgttaatttactgtttat

SEQ ID NO: 51472 - DNA, 19 bp, Homo sapiens
atgtacttgtgcatttata

SEQ ID NO: 51473 - DNA, 18 bp, Homo sapiens
taatgtatttatttacta

SEQ ID NO: 51474 - DNA, 17 bp, Homo sapiens
taatgacttgtttgctg

SEQ ID NO: 51475 - DNA, 92 bp, Human herpesvirus 5
gtagcgagcgtgaggaaacaaaatagcgtcactgtggccaccatggcataaatgactgaacgatgactaaagtggaagcctgacgccgtgac

SEQ ID NO: 51476 - DNA, 24 bp, Human herpesvirus 5
tgactaaagtggaagcctgacgcc

SEQ ID NO: 51477 - DNA, 20 bp, Homo sapiens
tggctaaagtgagagaggcc

SEQ ID NO: 51478 - DNA, 21 bp, Homo sapiens
tggctggggcggaagctgagc

SEQ ID NO: 51479 - DNA, 19 bp, Homo sapiens
tgattaaaggaacctgacg

SEQ ID NO: 51480 - DNA, 18 bp, Homo sapiens
tgctggggtggaagcctg

SEQ ID NO: 51481 - DNA, 22 bp, Homo sapiens
tgactaaagggaggaatcggcc

SEQ ID NO: 51482 - DNA, 20 bp, Homo sapiens
tgatagggtggaagcgaaac

SEQ ID NO: 51483 - DNA, 19 bp, Homo sapiens
tgacacccagagcctgacg

SEQ ID NO: 51484 - DNA, 23 bp, Homo sapiens
tgtactgggagaagcctgatgcc

SEQ ID NO: 51485 - DNA, 19 bp, Homo sapiens
gactgcaacaggcctgacg

SEQ ID NO: 51486 - DNA, 19 bp, Homo sapiens
ctaaagtgggagtaatcgc

SEQ ID NO: 51487 - DNA, 19 bp, Homo sapiens
tgacaaagtaagctgatgc

SEQ ID NO: 51488 - DNA, 26 bp, Homo sapiens
tgctggagtggaagatttgaggcgcc

SEQ ID NO: 51489 - DNA, 61 bp, Human herpesvirus 5
tccatacgtttttgggaaagttgggctcggcccaacgcaacagacctaggcacacgatgga

SEQ ID NO: 51490 - DNA, 24 bp, Human herpesvirus 5
tttttgggaaagttgggctcggcc

SEQ ID NO: 51491 - DNA, 20 bp, Homo sapiens
tttttggagacggagctcgg

SEQ ID NO: 51492 - DNA, 22 bp, Homo sapiens
tttttgggggggtgggaggagc

SEQ ID NO: 51493 - DNA, 21 bp, Homo sapiens
tttttgggaagaagccttggc

SEQ ID NO: 51494 - DNA, 25 bp, Homo sapiens
tttttggcaaagtcagtccttggcc

SEQ ID NO: 51495 - DNA, 18 bp, Homo sapiens
tccggagttgggcttggc

SEQ ID NO: 51496 - DNA, 23 bp, Homo sapiens
tctttgggaaggtgacatttggc

SEQ ID NO: 51497 - DNA, 18 bp, Homo sapiens
tctttgggagggcctcgg

SEQ ID NO: 51498 - DNA, 18 bp, Homo sapiens
tttttgggaagctactgg

SEQ ID NO: 51499 - DNA, 16 bp, Homo sapiens
tctttggggggctcgg

SEQ ID NO: 51500 - DNA, 17 bp, Homo sapiens
tctttgggaagaacacc

SEQ ID NO: 51501 - DNA, 19 bp, Homo sapiens
tttttggaaaaggctttgg

SEQ ID NO: 51502 - DNA, 20 bp, Homo sapiens
ttttttggaaagttagggtc

SEQ ID NO: 51503 - DNA, 28 bp, Homo sapiens
tttttgggagaggtgttgctggccgagc

SEQ ID NO: 51504 - DNA, 21 bp, Homo sapiens
ttttgggaagtgtgtttggct

SEQ ID NO: 51505 - DNA, 24 bp, Homo sapiens
ttcttggggctgccgggcttggcc

SEQ ID NO: 51506 - DNA, 23 bp, Homo sapiens
tttttgggaaagatgaatgggcc

SEQ ID NO: 51507 - DNA, 99 bp, Human herpesvirus 5
tcattaagcaagacagcgtcagacgcacgctggaaaagagctgctccaaccggtgcggcaacaccagccagcaaaaggcgcagacgctcataaggatga

SEQ ID NO: 51508 - DNA, 24 bp, Human herpesvirus 5
tgcggcaacaccagccagcaaaag

SEQ ID NO: 51509 - DNA, 20 bp, Homo sapiens
tgtggggcaccagcccacaa

SEQ ID NO: 51510 - DNA, 19 bp, Homo sapiens
tgtggcaccaccagccgca

SEQ ID NO: 51511 - DNA, 16 bp, Homo sapiens
cggcaacagcaaagca

SEQ ID NO: 51512 - DNA, 21 bp, Homo sapiens
tgcggcaatatcagaacccaa

SEQ ID NO: 51513 - DNA, 19 bp, Homo sapiens
gctcaggcaccagccagca

SEQ ID NO: 51514 - DNA, 23 bp, Homo sapiens
tgtggaacaggtcccagcaaaag

SEQ ID NO: 51515 - DNA, 16 bp, Homo sapiens
gggacacagccagcaa

SEQ ID NO: 51516 - DNA, 19 bp, Homo sapiens
tgcggcaacttccctccag

SEQ ID NO: 51517 - DNA, 18 bp, Homo sapiens
gacagtcaccagccagca

SEQ ID NO: 51518 - DNA, 19 bp, Homo sapiens
gcggcaacccctgctggca

SEQ ID NO: 51519 - DNA, 20 bp, Homo sapiens
tgcggcaaacaccaaagcaa

SEQ ID NO: 51520 - DNA, 23 bp, Homo sapiens
tgcggtcagcgctgcaacaaaag

SEQ ID NO: 51521 - DNA, 18 bp, Homo sapiens
tgtggtcataccagccag

SEQ ID NO: 51522 - DNA, 19 bp, Homo sapiens
tgcgccaacaccagccgca

SEQ ID NO: 51523 - DNA, 18 bp, Homo sapiens
tgctggggcagccagcaa

SEQ ID NO: 51524 - DNA, 17 bp, Homo sapiens
tacggcaacactgcgag

SEQ ID NO: 51525 - DNA, 16 bp, Homo sapiens
tgcggcaaccctccag

SEQ ID NO: 51526 - DNA, 18 bp, Homo sapiens
tgtggaaaaaccagcaaa

SEQ ID NO: 51527 - DNA, 17 bp, Homo sapiens
gcgcagaaccagccagc

SEQ ID NO: 51528 - DNA, 22 bp, Homo sapiens
tgctgcgagcagccagcagaag

SEQ ID NO: 51529 - DNA, 87 bp, Molluscum contagiosum virus
catcgcgcggggcacgcacttcacgccgcgcgcccacggcagcgtccgagggcgggcgctgccgtgggcgcgcggcgcccccagatg

SEQ ID NO: 51530 - DNA, 24 bp, Molluscum contagiosum virus
tgccgtgggcgcgcggcgccccca

SEQ ID NO: 51531 - DNA, 19 bp, Homo sapiens
tgccgtgggcgcgagtccc

SEQ ID NO: 51532 - DNA, 18 bp, Homo sapiens
tgccgggggcgcgcggcg

SEQ ID NO: 51533 - DNA, 17 bp, Homo sapiens
ccgtgagccggcgctcc

SEQ ID NO: 51534 - DNA, 21 bp, Homo sapiens
tgccgtggtgcctgccttcca

SEQ ID NO: 51535 - DNA, 19 bp, Homo sapiens
tgctgtgggcgcactggac

SEQ ID NO: 51536 - DNA, 16 bp, Homo sapiens
tgccatggagacggcg

SEQ ID NO: 51537 - DNA, 19 bp, Homo sapiens
tgctgcgggcactgccccc

SEQ ID NO: 51538 - DNA, 20 bp, Homo sapiens
tgctgtgggtgctgcgtacc

SEQ ID NO: 51539 - DNA, 19 bp, Homo sapiens
tgccgtggtgcattcctcc

SEQ ID NO: 51540 - DNA, 18 bp, Homo sapiens
tgccgtgcgcgcagcccc

SEQ ID NO: 51541 - DNA, 22 bp, Homo sapiens
tgctgtcgcggcggcgcctcca

SEQ ID NO: 51542 - DNA, 16 bp, Homo sapiens
gctgtgggcgcacccc

SEQ ID NO: 51543 - DNA, 15 bp, Homo sapiens
tgccgtggccgcccc

SEQ ID NO: 51544 - DNA, 21 bp, Homo sapiens
gctggcggtgcgcggcgctcc

SEQ ID NO: 51545 - DNA, 21 bp, Homo sapiens
atggagcgtgcggcgccccca

SEQ ID NO: 51546 - DNA, 19 bp, Homo sapiens
tgccgcggccggcgccccc

SEQ ID NO: 51547 - DNA, 26 bp, Homo sapiens
tgccgtggatgctgaccctgttccca

SEQ ID NO: 51548 - DNA, 20 bp, Homo sapiens
tgctgtgaggcgccctcccc

SEQ ID NO: 51549 - DNA, 19 bp, Homo sapiens
tgccgtgggcgctcgggcc

SEQ ID NO: 51550 - DNA, 19 bp, Homo sapiens
gctgtgggcgcggggctcc

SEQ ID NO: 51551 - DNA, 20 bp, Homo sapiens
gctgtggggtgagcgccccc

SEQ ID NO: 51552 - DNA, 19 bp, Homo sapiens
gccgtgggccagcgtctcc

SEQ ID NO: 51553 - DNA, 19 bp, Homo sapiens
tgctggccgccggcgctcc

SEQ ID NO: 51554 - DNA, 19 bp, Homo sapiens
ccgcctccgcggcgccccc

SEQ ID NO: 51555 - DNA, 19 bp, Homo sapiens
gtgggcgccgacccctcca

SEQ ID NO: 51556 - DNA, 17 bp, Homo sapiens
tgccgtggggtggcccc

SEQ ID NO: 51557 - DNA, 18 bp, Homo sapiens
gcttgcgcgcggcgcccc

SEQ ID NO: 51558 - DNA, 20 bp, Homo sapiens
tgccgagagcctggcgcccc

SEQ ID NO: 51559 - DNA, 21 bp, Homo sapiens
tgcgcaggcgcggcgccccca

SEQ ID NO: 51560 - DNA, 22 bp, Homo sapiens
tgtcatggcacacaggtgttcc

SEQ ID NO: 51561 - DNA, 17 bp, Homo sapiens
tgccgtgggcggcgtcc

SEQ ID NO: 51562 - DNA, 17 bp, Homo sapiens
gccgtgggcggcgtccc

SEQ ID NO: 51563 - DNA, 17 bp, Homo sapiens
tgccgtgggcggcatcc

SEQ ID NO: 51564 - DNA, 16 bp, Homo sapiens
gccgtgggcggcgtcc

SEQ ID NO: 51565 - DNA, 16 bp, Homo sapiens
gccgtggacggcgtcc

SEQ ID NO: 51566 - DNA, 18 bp, Homo sapiens
tgccatgggcggcgtccc

SEQ ID NO: 51567 - DNA, 24 bp, Homo sapiens
tgccatggtgagtaggtgcttcca

SEQ ID NO: 51568 - DNA, 19 bp, Homo sapiens
tgccgcgggagtaacggcg

SEQ ID NO: 51569 - DNA, 77 bp, Human papillomavirus type 53
caccagaatggatagaaagacaaacacagttacaacatagctttgaggactgtcaatttgaactatctaaaatggtg

SEQ ID NO: 51570 - DNA, 24 bp, Human papillomavirus type 53
agacaaacacagttacaacatagc

SEQ ID NO: 51571 - DNA, 21 bp, Homo sapiens
agaccagcctgggcaacatag

SEQ ID NO: 51572 - DNA, 21 bp, Homo sapiens
agaccagcctagacaacatag

SEQ ID NO: 51573 - DNA, 21 bp, Homo sapiens
agaccagcttaggcaacatag

SEQ ID NO: 51574 - DNA, 18 bp, Homo sapiens
aaacacagttattcacag

SEQ ID NO: 51575 - DNA, 22 bp, Homo sapiens
agaccagcttgggcaacatagc

SEQ ID NO: 51576 - DNA, 18 bp, Homo sapiens
aacaaatgcagttaacag

SEQ ID NO: 51577 - DNA, 21 bp, Homo sapiens
caaatgcagttacatcatagc

SEQ ID NO: 51578 - DNA, 20 bp, Homo sapiens
aggcagacacagtcattcat

SEQ ID NO: 51579 - DNA, 27 bp, Homo sapiens
aaacaaacaccaaagcttacaatatag

SEQ ID NO: 51580 - DNA, 22 bp, Homo sapiens
agaccagcctgggcaacatagc

SEQ ID NO: 51581 - DNA, 19 bp, Homo sapiens
agacaaacagcacagcaca

SEQ ID NO: 51582 - DNA, 21 bp, Homo sapiens
agaccagcctcagcaacatag

SEQ ID NO: 51583 - DNA, 22 bp, Homo sapiens
agacaaacaggttacaatgtag

SEQ ID NO: 51584 - DNA, 23 bp, Homo sapiens
aaacagacatagttacaaagagc

SEQ ID NO: 51585 - DNA, 19 bp, Homo sapiens
agaccagcctgtacaacat

SEQ ID NO: 51586 - DNA, 23 bp, Homo sapiens
agaaagcaaccagccaacatagc

SEQ ID NO: 51587 - DNA, 20 bp, Homo sapiens
gagcaaaattacaacatggc

SEQ ID NO: 51588 - DNA, 22 bp, Homo sapiens
agaccaatctgggcaacatagc

SEQ ID NO: 51589 - DNA, 21 bp, Homo sapiens
agaccagcctaggcaacatag

SEQ ID NO: 51590 - DNA, 22 bp, Homo sapiens
agaccagtctgggcaacatagc

SEQ ID NO: 51591 - DNA, 15 bp, Homo sapiens
agacaaaccacacat

SEQ ID NO: 51592 - DNA, 21 bp, Homo sapiens
agaccagcttgggcaacatag

SEQ ID NO: 51593 - DNA, 20 bp, Homo sapiens
agacaaacataacatacaca

SEQ ID NO: 51594 - DNA, 20 bp, Homo sapiens
agaccagctgggcaacatag

SEQ ID NO: 51595 - DNA, 20 bp, Homo sapiens
acagacatatacaacatggc

SEQ ID NO: 51596 - DNA, 18 bp, Homo sapiens
acaaacacacacacatag

SEQ ID NO: 51597 - DNA, 21 bp, Homo sapiens
agaccagtctgggcaacatag

SEQ ID NO: 51598 - DNA, 22 bp, Homo sapiens
agacaaacatgtaagccatggc

SEQ ID NO: 51599 - DNA, 19 bp, Homo sapiens
caaagcaatacaacatagc

SEQ ID NO: 51600 - DNA, 21 bp, Homo sapiens
gacggggtagttacaacatgc

SEQ ID NO: 51601 - DNA, 18 bp, Homo sapiens
cagcctggacaacatagc

SEQ ID NO: 51602 - DNA, 20 bp, Homo sapiens
aaacaaaggaccaacatagc

SEQ ID NO: 51603 - DNA, 22 bp, Homo sapiens
agaccagcctgagcaacatagc

SEQ ID NO: 51604 - DNA, 20 bp, Homo sapiens
gacaaggcacttaacatagc

SEQ ID NO: 51605 - DNA, 19 bp, Homo sapiens
agatgaagacagttacaca

SEQ ID NO: 51606 - DNA, 22 bp, Homo sapiens
agaccagtctggacaacatagc

SEQ ID NO: 51607 - DNA, 24 bp, Homo sapiens
agacaatgtgccacaaaacatagc

SEQ ID NO: 51608 - DNA, 22 bp, Homo sapiens
agaccaacctggacaacatagc

SEQ ID NO: 51609 - DNA, 19 bp, Homo sapiens
agatgcaacacaggcatag

SEQ ID NO: 51610 - DNA, 23 bp, Homo sapiens
gacgcagtgggttacaacgtagc

SEQ ID NO: 51611 - DNA, 22 bp, Homo sapiens
agaccagcctaggcaacatagc

SEQ ID NO: 51612 - DNA, 16 bp, Homo sapiens
aaacaaacacaacata

SEQ ID NO: 51613 - DNA, 21 bp, Homo sapiens
agaccagtctaagcaacatag

SEQ ID NO: 51614 - DNA, 130 bp, Turkey adenovirus 3
ttctcatcgcttttcttacttaacagattgcaaaaataaaacaatattaccgcttgttgatgaaaattgtgaattaatgctagttaatgatgagatatgtgtagttgtaaaatgttactgtgatgaagaa

SEQ ID NO: 51615 - DNA, 23 bp, Turkey adenovirus 3
taaaatgttactgtgatgaagaa

SEQ ID NO: 51616 - DNA, 15 bp, Homo sapiens
aaatgctgatgaaga

SEQ ID NO: 51617 - DNA, 18 bp, Homo sapiens
taaaatgtcactctgaga

SEQ ID NO: 51618 - DNA, 18 bp, Homo sapiens
atgttactgtgtgcaaag

SEQ ID NO: 51619 - DNA, 19 bp, Homo sapiens
taaaatgctactgagaaga

SEQ ID NO: 51620 - DNA, 22 bp, Homo sapiens
aaaatgttacttcttctaagaa

SEQ ID NO: 51621 - DNA, 19 bp, Homo sapiens
taaagtgtcaccactgaag

SEQ ID NO: 51622 - DNA, 20 bp, Homo sapiens
aaatgctactgcacaataga

SEQ ID NO: 51623 - DNA, 21 bp, Homo sapiens
taaaactgttctaatgaagaa

SEQ ID NO: 51624 - DNA, 18 bp, Homo sapiens
atgtatacagatgaagaa

SEQ ID NO: 51625 - DNA, 18 bp, Homo sapiens
taaaacgctgtggtgaag

SEQ ID NO: 51626 - DNA, 18 bp, Homo sapiens
tgtttgctgaatgaagaa

SEQ ID NO: 51627 - DNA, 24 bp, Homo sapiens
taaaatgtcattatctctgaagaa

SEQ ID NO: 51628 - DNA, 16 bp, Homo sapiens
aaatgttactgaaaga

SEQ ID NO: 51629 - DNA, 18 bp, Homo sapiens
taaagtgttactgtgaca

SEQ ID NO: 51630 - DNA, 21 bp, Homo sapiens
aaatgttgcagtgatgaagaa

SEQ ID NO: 51631 - DNA, 23 bp, Homo sapiens
taaaatgttggctgtgtgttgaa

SEQ ID NO: 51632 - DNA, 18 bp, Homo sapiens
tgcttctgtgatggagaa

SEQ ID NO: 51633 - DNA, 18 bp, Homo sapiens
aaatgttactttggagaa

SEQ ID NO: 51634 - DNA, 20 bp, Homo sapiens
aaatcttactgtgtgcttga

SEQ ID NO: 51635 - DNA, 20 bp, Homo sapiens
aaatgttatatatttgaaga

SEQ ID NO: 51636 - DNA, 21 bp, Homo sapiens
aaaatgttactggaataagga

SEQ ID NO: 51637 - DNA, 20 bp, Homo sapiens
aaaatgttattcgcgaagaa

SEQ ID NO: 51638 - DNA, 19 bp, Homo sapiens
aaaataacagtgatgaaga

SEQ ID NO: 51639 - DNA, 21 bp, Homo sapiens
taaaatgtttagtgtgaggaa

SEQ ID NO: 51640 - DNA, 21 bp, Homo sapiens
taaaatgtttataaagaagaa

SEQ ID NO: 51641 - DNA, 15 bp, Homo sapiens
tgcttggatgaagaa

SEQ ID NO: 51642 - DNA, 22 bp, Homo sapiens
taaaatgtctctaaagatgaag

SEQ ID NO: 51643 - DNA, 20 bp, Homo sapiens
aaaatgttgctgtgaaaaga

SEQ ID NO: 51644 - DNA, 18 bp, Homo sapiens
gttactattaatggagaa

SEQ ID NO: 51645 - DNA, 21 bp, Homo sapiens
aaatgttaagctgaatgaaga

SEQ ID NO: 51646 - DNA, 20 bp, Homo sapiens
taaagtgctaccaatggaga

SEQ ID NO: 51647 - DNA, 19 bp, Homo sapiens
aaatgtcacaaggatgaag

SEQ ID NO: 51648 - DNA, 18 bp, Homo sapiens
atgcagctgtgatggaga

SEQ ID NO: 51649 - DNA, 21 bp, Homo sapiens
taaaatgttgtgattactaga

SEQ ID NO: 51650 - DNA, 24 bp, Homo sapiens
taaaatgttcaagattgtgaagaa

SEQ ID NO: 51651 - DNA, 17 bp, Homo sapiens
taagatgttactggata

SEQ ID NO: 51652 - DNA, 17 bp, Homo sapiens
aatgcaggtgatgaaga

SEQ ID NO: 51653 - DNA, 20 bp, Homo sapiens
caaaatggggctgatgaaga

SEQ ID NO: 51654 - DNA, 18 bp, Homo sapiens
aaatgttactgtgtggag

SEQ ID NO: 51655 - DNA, 72 bp, Turkey adenovirus 3
gcttgtgttgcaacagcgctaaaaaatgagaacaagagagactttttacataatagcttttgcaataaatgc

SEQ ID NO: 51656 - DNA, 24 bp, Turkey adenovirus 3
tgtgttgcaacagcgctaaaaaat

SEQ ID NO: 51657 - DNA, 21 bp, Homo sapiens
tgtgttgcaacaacctgaaaa

SEQ ID NO: 51658 - DNA, 24 bp, Homo sapiens
tgtgttgcaacattgttcttaaaa

SEQ ID NO: 51659 - DNA, 21 bp, Homo sapiens
tgtgttgttagcttaaaaaat

SEQ ID NO: 51660 - DNA, 25 bp, Homo sapiens
tgcccagccaatggcgctggaaaat

SEQ ID NO: 51661 - DNA, 24 bp, Homo sapiens
tgtagaaatccagtgctaaaaaat

SEQ ID NO: 51662 - DNA, 24 bp, Homo sapiens
tgtgatgcaacagtgtaagcaaaa

SEQ ID NO: 51663 - DNA, 15 bp, Homo sapiens
tgtgttgactaaaaa

SEQ ID NO: 51664 - DNA, 19 bp, Homo sapiens
tgtttgcaacagcaacaaa

SEQ ID NO: 51665 - DNA, 18 bp, Homo sapiens
gtgttgcagcagccagct

SEQ ID NO: 51666 - DNA, 16 bp, Homo sapiens
tgtgttgcaactgcca

SEQ ID NO: 51667 - DNA, 69 bp, Turkey adenovirus 3
gaattaaccaatagagacacgtttgacacagaagctgtgttgctgacggtctatattctgtttgtattc

SEQ ID NO: 51668 - DNA, 24 bp, Turkey adenovirus 3
ttgctgacggtctatattctgttt

SEQ ID NO: 51669 - DNA, 17 bp, Homo sapiens
ttgtctgacttctgttt

SEQ ID NO: 51670 - DNA, 20 bp, Homo sapiens
ttacttactatattctgttt

SEQ ID NO: 51671 - DNA, 80 bp, Turkey adenovirus 3
ttgtttgtgttctgaagcttatcagttattatataagaaatgcctttcttattgatagattgtttacgaagcagaagcag

SEQ ID NO: 51672 - DNA, 24 bp, Turkey adenovirus 3
tagattgtttacgaagcagaagca

SEQ ID NO: 51673 - DNA, 19 bp, Homo sapiens
tgttcacaggggcagaggc

SEQ ID NO: 51674 - DNA, 19 bp, Homo sapiens
agattgtttgcactgcgga

SEQ ID NO: 51675 - DNA, 19 bp, Homo sapiens
gatttttaaaacagaagca

SEQ ID NO: 51676 - DNA, 23 bp, Homo sapiens
tagattttttctctccagaagca

SEQ ID NO: 51677 - DNA, 20 bp, Homo sapiens
gatacactgaggcagaagca

SEQ ID NO: 51678 - DNA, 22 bp, Homo sapiens
gattgtttgcaccgcctgggca

SEQ ID NO: 51679 - DNA, 21 bp, Homo sapiens
ttggaaacagaggcagaagca

SEQ ID NO: 51680 - DNA, 19 bp, Homo sapiens
gatgtctatggagcagaag

SEQ ID NO: 51681 - DNA, 19 bp, Homo sapiens
tgttgcagaagcaggagca

SEQ ID NO: 51682 - DNA, 20 bp, Homo sapiens
gattggttaattcagaagca

SEQ ID NO: 51683 - DNA, 24 bp, Homo sapiens
agatttgcccgtggggcagaagca

SEQ ID NO: 51684 - DNA, 73 bp, Turkey adenovirus 3
atatctgtaagttgtattctttttatcgaagcagagtttcctccggtttagttaggaagaagttaaatgatgt

SEQ ID NO: 51685 - DNA, 24 bp, Turkey adenovirus 3
tgtaagttgtattctttttatcga

SEQ ID NO: 51686 - DNA, 24 bp, Homo sapiens
tgaccatgatattctttttattga

SEQ ID NO: 51687 - DNA, 22 bp, Homo sapiens
tataagctgatttgttcttttt

SEQ ID NO: 51688 - DNA, 23 bp, Homo sapiens
tggaagttgctaccttttattga

SEQ ID NO: 51689 - DNA, 114 bp, Human T-lymphotropic virus 2
ggagactcaccttggggatccatcctctccaagcggcctcggttgagacgccttccgtgggaccgtctcccggcctcggcacctcctgaactgctcctcccaaggtaagtctcc

SEQ ID NO: 51690 - DNA, 24 bp, Human T-lymphotropic virus 2
tcggcacctcctgaactgctcctc

SEQ ID NO: 51691 - DNA, 22 bp, Homo sapiens
ggtcactgctgaactgtttctc

SEQ ID NO: 51692 - DNA, 23 bp, Homo sapiens
tcggcccctgggggctgctcctc

SEQ ID NO: 51693 - DNA, 20 bp, Homo sapiens
tcggtcctcctgagccgact

SEQ ID NO: 51694 - DNA, 24 bp, Homo sapiens
tcgtcacctcctgggatgcgtctc

SEQ ID NO: 51695 - DNA, 18 bp, Homo sapiens
gcaccttaagtgctcctc

SEQ ID NO: 51696 - DNA, 16 bp, Homo sapiens
tcagcaccactgttcc

SEQ ID NO: 51697 - DNA, 19 bp, Homo sapiens
tcggccctcctgataccct

SEQ ID NO: 51698 - DNA, 19 bp, Homo sapiens
tcagtgcctgtaactgctc

SEQ ID NO: 51699 - DNA, 15 bp, Homo sapiens
tcagcacctctggct

SEQ ID NO: 51700 - DNA, 22 bp, Homo sapiens
acctttttctgaactgcttctc

SEQ ID NO: 51701 - DNA, 17 bp, Homo sapiens
ggcacctgggaactgct

SEQ ID NO: 51702 - DNA, 21 bp, Homo sapiens
tcgtgcctccagctgctcctc

SEQ ID NO: 51703 - DNA, 22 bp, Homo sapiens
ggcccctcctgaggctgggctc

SEQ ID NO: 51704 - DNA, 19 bp, Homo sapiens
tcggcagctccctgctcct

SEQ ID NO: 51705 - DNA, 22 bp, Homo sapiens
tcaagctcctgaattgcttctc

SEQ ID NO: 51706 - DNA, 16 bp, Homo sapiens
ggacctcctatctcct

SEQ ID NO: 51707 - DNA, 20 bp, Homo sapiens
ggcgccacacactgctcctc

SEQ ID NO: 51708 - DNA, 20 bp, Homo sapiens
tcggcagctcctgaacttct

SEQ ID NO: 51709 - DNA, 19 bp, Homo sapiens
tcgtactcacactgctcct

SEQ ID NO: 51710 - DNA, 20 bp, Homo sapiens
ggcacctctttaacaagctc

SEQ ID NO: 51711 - DNA, 24 bp, Homo sapiens
tcgcgcctctccctcttgctcctc

SEQ ID NO: 51712 - DNA, 20 bp, Homo sapiens
ggctcctgaagctgctcctc

SEQ ID NO: 51713 - DNA, 20 bp, Homo sapiens
tcgaacttgaactgctcttc

SEQ ID NO: 51714 - DNA, 20 bp, Homo sapiens
tcggcacctgctggggtctc

SEQ ID NO: 51715 - DNA, 21 bp, Homo sapiens
tcggcttttcacctgctcctc

SEQ ID NO: 51716 - DNA, 80 bp, Human T-lymphotropic virus 2
cccaaggtaagtctcctctcaggtcgagctcggctgccccttaggtagtcgctccccgagggtctttagagacacccggg

SEQ ID NO: 51717 - DNA, 24 bp, Human T-lymphotropic virus 2
tccccgagggtctttagagacacc

SEQ ID NO: 51718 - DNA, 17 bp, Homo sapiens
cccgtgcctggagacac

SEQ ID NO: 51719 - DNA, 22 bp, Homo sapiens
tccccaaggcaccgggggacac

SEQ ID NO: 51720 - DNA, 15 bp, Homo sapiens
gaggctagagacacc

SEQ ID NO: 51721 - DNA, 18 bp, Homo sapiens
ccctgaggtctctcagca

SEQ ID NO: 51722 - DNA, 18 bp, Homo sapiens
tcccctggttagagatac

SEQ ID NO: 51723 - DNA, 19 bp, Homo sapiens
tccccgagggcgccccgac

SEQ ID NO: 51724 - DNA, 18 bp, Homo sapiens
cctggggatagagacacc

SEQ ID NO: 51725 - DNA, 20 bp, Homo sapiens
tccttggaggcctgagatac

SEQ ID NO: 51726 - DNA, 21 bp, Homo sapiens
tccccgaggcgttacgacgcc

SEQ ID NO: 51727 - DNA, 19 bp, Homo sapiens
tccccaagggttcagacac

SEQ ID NO: 51728 - DNA, 20 bp, Homo sapiens
tcctccatctttagggacac

SEQ ID NO: 51729 - DNA, 20 bp, Homo sapiens
cccttgatgacttggagaca

SEQ ID NO: 51730 - DNA, 21 bp, Homo sapiens
ccctcgaggcccagagatgcc

SEQ ID NO: 51731 - DNA, 20 bp, Homo sapiens
tccccgggggcctccggcac

SEQ ID NO: 51732 - DNA, 20 bp, Homo sapiens
cccgagggctccgtggagac

SEQ ID NO: 51733 - DNA, 19 bp, Homo sapiens
ccaaggcctttggagatac

SEQ ID NO: 51734 - DNA, 20 bp, Homo sapiens
cccgagggccctggaaggca

SEQ ID NO: 51735 - DNA, 22 bp, Homo sapiens
tccccagggtgggggggacacc

SEQ ID NO: 51736 - DNA, 16 bp, Homo sapiens
tccccgagggagggac

SEQ ID NO: 51737 - DNA, 21 bp, Homo sapiens
cctgagggtccggcaaggcac

SEQ ID NO: 51738 - DNA, 23 bp, Homo sapiens
tctccggggggtcccctggcacc

SEQ ID NO: 51739 - DNA, 19 bp, Homo sapiens
cctcgagggtctgggacac

SEQ ID NO: 51740 - DNA, 21 bp, Homo sapiens
tccttgaaggtgatggacacc

SEQ ID NO: 51741 - DNA, 18 bp, Homo sapiens
tccccgagggtcttgcag

SEQ ID NO: 51742 - DNA, 21 bp, Homo sapiens
tccccagggtccatggacgcc

SEQ ID NO: 51743 - DNA, 20 bp, Homo sapiens
cctggatctcttagagacac

SEQ ID NO: 51744 - DNA, 22 bp, Homo sapiens
tccaccttcctttggaggcacc

SEQ ID NO: 51745 - DNA, 18 bp, Homo sapiens
ccctcgggggtctttgac

SEQ ID NO: 51746 - DNA, 22 bp, Homo sapiens
ccttgggggctctgccagcacc

SEQ ID NO: 51747 - DNA, 21 bp, Homo sapiens
tcccagaggaccagggacacc

SEQ ID NO: 51748 - DNA, 22 bp, Homo sapiens
cccaagggtctcagagggacac

SEQ ID NO: 51749 - DNA, 19 bp, Homo sapiens
ccgagggtcactaagatac

SEQ ID NO: 51750 - DNA, 22 bp, Homo sapiens
tcctgagtgcctgcagagacac

SEQ ID NO: 51751 - DNA, 20 bp, Homo sapiens
cccccgaggggcagaggcac

SEQ ID NO: 51752 - DNA, 20 bp, Homo sapiens
tcctggggggtctttacaga

SEQ ID NO: 51753 - DNA, 24 bp, Homo sapiens
tccttgagggtacttcttgtacac

SEQ ID NO: 51754 - DNA, 24 bp, Homo sapiens
tcttcgggggttccctgagacgcc

SEQ ID NO: 51755 - DNA, 21 bp, Homo sapiens
tccgcgaggggacgagacacc

SEQ ID NO: 51756 - DNA, 17 bp, Homo sapiens
tctcccgagggtgagag

SEQ ID NO: 51757 - DNA, 16 bp, Homo sapiens
tctccaggtcagagac

SEQ ID NO: 51758 - DNA, 22 bp, Homo sapiens
tccctcaggatcttggggacac

SEQ ID NO: 51759 - DNA, 16 bp, Homo sapiens
tcctccagggtctaca

SEQ ID NO: 51760 - DNA, 17 bp, Homo sapiens
gagggggcagagacacc

SEQ ID NO: 51761 - DNA, 19 bp, Homo sapiens
tctccacggttagagacac

SEQ ID NO: 51762 - DNA, 94 bp, Human T-lymphotropic virus 2
cctagcgctgaaaaacaaggctctgacgattaccccctgcccataaaatttgcctagtcaaaataaaagatgccgagtctataaaagcgcaagg

SEQ ID NO: 51763 - DNA, 24 bp, Human T-lymphotropic virus 2
tcaaaataaaagatgccgagtcta

SEQ ID NO: 51764 - DNA, 19 bp, Homo sapiens
tcaaaataaggatgtgtcc

SEQ ID NO: 51765 - DNA, 20 bp, Homo sapiens
tcaaaacaaaagtacacagt

SEQ ID NO: 51766 - DNA, 16 bp, Homo sapiens
aaataaaagatgcagt

SEQ ID NO: 51767 - DNA, 23 bp, Homo sapiens
aaaaaaaaagatggaactgtcta

SEQ ID NO: 51768 - DNA, 23 bp, Homo sapiens
ccaaaataagagaacctgagtct

SEQ ID NO: 51769 - DNA, 18 bp, Homo sapiens
tcaaaataaaaaatgtct

SEQ ID NO: 51770 - DNA, 19 bp, Homo sapiens
tcaaaataaaagctgcgga

SEQ ID NO: 51771 - DNA, 19 bp, Homo sapiens
ataaaagatgaagcagtct

SEQ ID NO: 51772 - DNA, 23 bp, Homo sapiens
ccaaaatagaagacaagacgtct

SEQ ID NO: 51773 - DNA, 18 bp, Homo sapiens
tcaaaataagagatgagt

SEQ ID NO: 51774 - DNA, 22 bp, Homo sapiens
tcaaaacaagggcacaaggtct

SEQ ID NO: 51775 - DNA, 20 bp, Homo sapiens
aaaataaaataggcaagtct

SEQ ID NO: 51776 - DNA, 19 bp, Homo sapiens
tcaaaataaaaatgccagt

SEQ ID NO: 51777 - DNA, 21 bp, Homo sapiens
aaaataaaaggctgctggtct

SEQ ID NO: 51778 - DNA, 21 bp, Homo sapiens
aaataaaagatgtgtgttcta

SEQ ID NO: 51779 - DNA, 22 bp, Homo sapiens
tcaaaataaaaatggccagtct

SEQ ID NO: 51780 - DNA, 19 bp, Homo sapiens
tcaagacaagagcaagtct

SEQ ID NO: 51781 - DNA, 20 bp, Homo sapiens
aaaataaaatgatgtccaaa

SEQ ID NO: 51782 - DNA, 17 bp, Homo sapiens
tcaaaaaaaagatgcca

SEQ ID NO: 51783 - DNA, 17 bp, Homo sapiens
tcaaaaagaagatgcca

SEQ ID NO: 51784 - DNA, 108 bp, Ectromelia virus
aagaatctgttatatggtatagggagagtataaaacattaaatgcccgtacttattaaagtattcagtagccaatcctaactctttcgaatacttattaattgctctt

SEQ ID NO: 51785 - DNA, 24 bp, Ectromelia virus
tctgttatatggtatagggagagt

SEQ ID NO: 51786 - DNA, 17 bp, Homo sapiens
tggaatatggggagagt

SEQ ID NO: 51787 - DNA, 23 bp, Homo sapiens
tctgttatcatggtatctgtggg

SEQ ID NO: 51788 - DNA, 20 bp, Homo sapiens
tctgctatgtggtttgcggg

SEQ ID NO: 51789 - DNA, 20 bp, Homo sapiens
ctgttaggagtggggagagt

SEQ ID NO: 51790 - DNA, 23 bp, Homo sapiens
tctgtgctcttggtggggagagt

SEQ ID NO: 51791 - DNA, 20 bp, Homo sapiens
tgtttaaaaaaagggagagt

SEQ ID NO: 51792 - DNA, 22 bp, Homo sapiens
tctgttgaaatagagggagagt

SEQ ID NO: 51793 - DNA, 20 bp, Homo sapiens
tctgttatgagggctgaggg

SEQ ID NO: 51794 - DNA, 88 bp, Lumpy skin disease virus
ttgttttaaattgttgatttattaaagaatatagtttggcaactatataaatgaatttttgagaatttaagtcattattttgaaacaa

SEQ ID NO: 51795 - DNA, 24 bp, Lumpy skin disease virus
tgatttattaaagaatatagtttg

SEQ ID NO: 51796 - DNA, 22 bp, Homo sapiens
tgatttattagagtgttacagt

SEQ ID NO: 51797 - DNA, 20 bp, Homo sapiens
tgatttattagatgaatata

SEQ ID NO: 51798 - DNA, 22 bp, Homo sapiens
tgatttattacgaacaggtttg

SEQ ID NO: 51799 - DNA, 22 bp, Homo sapiens
tgatttattaaagcaagacgtt

SEQ ID NO: 51800 - DNA, 19 bp, Homo sapiens
tgatttatagagaatatag

SEQ ID NO: 51801 - DNA, 97 bp, Cowpox virus
tgagtcaattggtagagttttataacgaggtcgctaactggctgttaagagatgagacctcgcctattcctgataacttctttatacagttgaaaca

SEQ ID NO: 51802 - DNA, 24 bp, Cowpox virus
agtcaattggtagagttttataac

SEQ ID NO: 51803 - DNA, 18 bp, Homo sapiens
agtcaactggtggagagc

SEQ ID NO: 51804 - DNA, 18 bp, Homo sapiens
caaagcagagttttataa

SEQ ID NO: 51805 - DNA, 21 bp, Homo sapiens
agttaattggcagagaaatta

SEQ ID NO: 51806 - DNA, 23 bp, Homo sapiens
agtaattggtttacatttataac

SEQ ID NO: 51807 - DNA, 21 bp, Homo sapiens
agacagaagtgagttttataa

SEQ ID NO: 51808 - DNA, 18 bp, Homo sapiens
gcctcaagagttttataa

SEQ ID NO: 51809 - DNA, 73 bp, Cowpox virus
gatttctaagttacttctgcagcatataactaaacacgttagtgttctttattgtttgggtaaaacagatttc

SEQ ID NO: 51810 - DNA, 24 bp, Cowpox virus
agttacttctgcagcatataacta

SEQ ID NO: 51811 - DNA, 22 bp, Homo sapiens
aattatttcagcacatataact

SEQ ID NO: 51812 - DNA, 16 bp, Homo sapiens
agtacttgcatataac

SEQ ID NO: 51813 - DNA, 18 bp, Homo sapiens
gttgcttacaacatataa

SEQ ID NO: 51814 - DNA, 18 bp, Homo sapiens
agttcttctgcagcccat

SEQ ID NO: 51815 - DNA, 21 bp, Homo sapiens
gttgcttctcaattataacta

SEQ ID NO: 51816 - DNA, 23 bp, Homo sapiens
agttgttttctgaccacataact

SEQ ID NO: 51817 - DNA, 23 bp, Homo sapiens
gttatttctaagtgcatataact

SEQ ID NO: 51818 - DNA, 23 bp, Homo sapiens
agttccttctgcagtgttttcct

SEQ ID NO: 51819 - DNA, 22 bp, Homo sapiens
gttgtttctgcagaaataacta

SEQ ID NO: 51820 - DNA, 88 bp, Camelpox virus
tttctcgaatatacgggccaagttagaatctccagtaactaccatagtgggatatcatccagcagctagagaccgccaattcgagaaa

SEQ ID NO: 51821 - DNA, 88 bp, Camelpox virus; identical to SEQ ID NO: 51820

SEQ ID NO: 51822 - DNA, 21 bp, Homo sapiens
tcgagtgtgagccaagttaga

SEQ ID NO: 51823 - DNA, 17 bp, Homo sapiens
gaatatgggcaagttag

SEQ ID NO: 51824 - DNA, 24 bp, Homo sapiens
tcaatatacccaaaaaagttagaa

SEQ ID NO: 51825 - DNA, 16 bp, Homo sapiens
gaatacactccaagtt

SEQ ID NO: 51826 - DNA, 80 bp, Human herpesvirus 8
tccatatttcctgacttgtgtcttgacttgcgtcgattgggatgggggtgtgggatgggggtgtgggatgggggtgtggg

SEQ ID NO: 51827 - DNA, 24 bp, Human herpesvirus 8
tgggatgggggtgtgggatggggg

SEQ ID NO: 51828 - DNA, 30 bp, Homo sapiens
tggggctgggggtggggatgggatgggggc

SEQ ID NO: 51829 - DNA, 21 bp, Homo sapiens
tgggatgggggtggggaaggg

SEQ ID NO: 51830 - DNA, 19 bp, Homo sapiens
tgaggtgggggtgaggggg

SEQ ID NO: 51831 - DNA, 25 bp, Homo sapiens
taggatggggggagtggggtggggg

SEQ ID NO: 51832 - DNA, 21 bp, Homo sapiens
tggggtgggggctgtcagggg

SEQ ID NO: 51833 - DNA, 21 bp, Homo sapiens
tggggtggggaggggtggggg

SEQ ID NO: 51834 - DNA, 22 bp, Homo sapiens
tggggagggggtgcagtggggg

SEQ ID NO: 51835 - DNA, 17 bp, Homo sapiens
tgggggggggtgggggg

SEQ ID NO: 51836 - DNA, 22 bp, Homo sapiens
ggggtgggggcagtgatggggg

SEQ ID NO: 51837 - DNA, 23 bp, Homo sapiens
tggggtgggggtgggggtggggg

SEQ ID NO: 51838 - DNA, 17 bp, Homo sapiens
tgggggtgggggtgggg

SEQ ID NO: 51839 - DNA, 26 bp, Homo sapiens
tgggcaactagagtgtggggtggggg

SEQ ID NO: 51840 - DNA, 20 bp, Homo sapiens
ggcggtggcgggggtggggg

SEQ ID NO: 51841 - DNA, 21 bp, Homo sapiens
ggggtggggggtaggtggggg

SEQ ID NO: 51842 - DNA, 21 bp, Homo sapiens
tggggtgggggtggggacagg

SEQ ID NO: 51843 - DNA, 19 bp, Homo sapiens
tgggggtgttggggtgggg

SEQ ID NO: 51844 - DNA, 26 bp, Homo sapiens
tggggggggggttgggggggtggggg

SEQ ID NO: 51845 - DNA, 18 bp, Homo sapiens
tgggggcatggggtgggg

SEQ ID NO: 51846 - DNA, 16 bp, Homo sapiens
gggatgggggttgggg

SEQ ID NO: 51847 - DNA, 21 bp, Homo sapiens
tgggtgggagtgggatggggg

SEQ ID NO: 51848 - DNA, 21 bp, Homo sapiens
tgggagtgggggaggtggggg

SEQ ID NO: 51849 - DNA, 24 bp, Homo sapiens
tgggggtgggacccgggatggggg

SEQ ID NO: 51850 - DNA, 19 bp, Homo sapiens
tgaggtggggttggtgggg

SEQ ID NO: 51851 - DNA, 20 bp, Homo sapiens
ggggtgggggtgtggaaggg

SEQ ID NO: 51852 - DNA, 16 bp, Homo sapiens
tggtggggcggtgggg

SEQ ID NO: 51853 - DNA, 22 bp, Homo sapiens
tggggcgggggtgacccggggg

SEQ ID NO: 51854 - DNA, 26 bp, Homo sapiens
tggggtgagggcacggcgggtggggg

SEQ ID NO: 51855 - DNA, 22 bp, Homo sapiens
tgggtgtggggcatgatggggg

SEQ ID NO: 51856 - DNA, 23 bp, Homo sapiens
tgggatgggggtgtgggtggggg

SEQ ID NO: 51857 - DNA, 19 bp, Homo sapiens
tgggctgggggtactgggg

SEQ ID NO: 51858 - DNA, 22 bp, Homo sapiens
tggggaggaaaggggatggggg

SEQ ID NO: 51859 - DNA, 19 bp, Homo sapiens
tgggtggggaggggtgggg

SEQ ID NO: 51860 - DNA, 22 bp, Homo sapiens
tggggtgggggtggtgagtggg

SEQ ID NO: 51861 - DNA, 18 bp, Homo sapiens
ggggtggggggggtgggg

SEQ ID NO: 51862 - DNA, 23 bp, Homo sapiens
tggggtgagggagaggatggggg

SEQ ID NO: 51863 - DNA, 22 bp, Homo sapiens
tgggtcatgtgtggggtggggg

SEQ ID NO: 51864 - DNA, 22 bp, Homo sapiens
tggaacaagtgtggggtggggg

SEQ ID NO: 51865 - DNA, 22 bp, Homo sapiens
tgggggaaacctggggtggggg

SEQ ID NO: 51866 - DNA, 21 bp, Homo sapiens
tggtggtgggggcggtggggg

SEQ ID NO: 51867 - DNA, 20 bp, Homo sapiens
tggggggggggtgtgtgggg

SEQ ID NO: 51868 - DNA, 23 bp, Homo sapiens
gggtgaagggtgtggggtggggg

SEQ ID NO: 51869 - DNA, 18 bp, Homo sapiens
tggggtgggggtggggtg

SEQ ID NO: 51870 - DNA, 18 bp, Homo sapiens
tggagatgggggtggggg

SEQ ID NO: 51871 - DNA, 21 bp, Homo sapiens
tgggatggggtgaagtggggg

SEQ ID NO: 51872 - DNA, 21 bp, Homo sapiens
tgggacgggggcccatggggg

SEQ ID NO: 51873 - DNA, 21 bp, Homo sapiens
tggggtgggggtgggtgtggg

SEQ ID NO: 51874 - DNA, 21 bp, Homo sapiens
tgggtgggggtggggtggggg

SEQ ID NO: 51875 - DNA, 20 bp, Homo sapiens
gggatgggggtgggtggggg

SEQ ID NO: 51876 - DNA, 23 bp, Homo sapiens
ggggtggggaggggggatggggg

SEQ ID NO: 51877 - DNA, 21 bp, Homo sapiens
ggtggggtcgggggatggggg

SEQ ID NO: 51878 - DNA, 19 bp, Homo sapiens
aggggtggatgggatgggg

SEQ ID NO: 51879 - DNA, 24 bp, Homo sapiens
tgggaatgggggtgggggtggggg

SEQ ID NO: 51880 - DNA, 22 bp, Homo sapiens
tggggtagggtaggggtggggg

SEQ ID NO: 51881 - DNA, 20 bp, Homo sapiens
tgggatggggtgtggtgggg

SEQ ID NO: 51882 - DNA, 21 bp, Homo sapiens
tggggtagggtgggatggggg

SEQ ID NO: 51883 - DNA, 21 bp, Homo sapiens
gggatgggcagtgggtggggg

SEQ ID NO: 51884 - DNA, 18 bp, Homo sapiens
tgggctggaggggtgggg

SEQ ID NO: 51885 - DNA, 15 bp, Homo sapiens
gatggggggtggggg

SEQ ID NO: 51886 - DNA, 21 bp, Homo sapiens
tggggtgggggctgaaggggg

SEQ ID NO: 51887 - DNA, 18 bp, Homo sapiens
tggggtgggggtgggagg

SEQ ID NO: 51888 - DNA, 18 bp, Homo sapiens
ggggtggggggcgtgggg

SEQ ID NO: 51889 - DNA, 24 bp, Homo sapiens
tgggggtggggtagagggtggggg

SEQ ID NO: 51890 - DNA, 22 bp, Homo sapiens
ggggtgggggtgggggtggggg

SEQ ID NO: 51891 - DNA, 23 bp, Homo sapiens
tggggtgggagacgggatggggg

SEQ ID NO: 51892 - DNA, 21 bp, Homo sapiens
tgggatgtgggggcatggggg

SEQ ID NO: 51893 - DNA, 22 bp, Homo sapiens
tggggtgggggtggctacaggg

SEQ ID NO: 51894 - DNA, 27 bp, Homo sapiens
tgggatggggagtgaggctggtggggg

SEQ ID NO: 51895 - DNA, 19 bp, Homo sapiens
tgggtgggggtgtaggggg

SEQ ID NO: 51896 - DNA, 22 bp, Homo sapiens
tggtgtgggggtgtggaacagg

SEQ ID NO: 51897 - DNA, 22 bp, Homo sapiens
tggggtggggaggagatggggg

SEQ ID NO: 51898 - DNA, 24 bp, Homo sapiens
ggaggtgggccatgagggtggggg

SEQ ID NO: 51899 - DNA, 24 bp, Homo sapiens
tgggatgtgggtgaggggtggggg

SEQ ID NO: 51900 - DNA, 23 bp, Homo sapiens
tggggtaggagtgagggtggggg

SEQ ID NO: 51901 - DNA, 21 bp, Homo sapiens
tggggtgggggtggggacggg

SEQ ID NO: 51902 - DNA, 23 bp, Homo sapiens
aggatgtgggtgtggggtggggg

SEQ ID NO: 51903 - DNA, 22 bp, Homo sapiens
tggggtgggggtaggttggggg

SEQ ID NO: 51904 - DNA, 20 bp, Homo sapiens
tgggttgggggtggaggggg

SEQ ID NO: 51905 - DNA, 23 bp, Homo sapiens
ggggtggggggttagggtggggg

SEQ ID NO: 51906 - DNA, 19 bp, Homo sapiens
taggatggtgggggtgggg

SEQ ID NO: 51907 - DNA, 21 bp, Homo sapiens
tgggaggatgggggatggggg

SEQ ID NO: 51908 - DNA, 19 bp, Homo sapiens
tgggtgggggtgtgggatg

SEQ ID NO: 51909 - DNA, 22 bp, Homo sapiens
tgggagtggggtcgggtggggg

SEQ ID NO: 51910 - DNA, 21 bp, Homo sapiens
tgggatggggctggaaggggg

SEQ ID NO: 51911 - DNA, 25 bp, Homo sapiens
tgggatgtgctattggggatggggg

SEQ ID NO: 51912 - DNA, 21 bp, Homo sapiens
tggggtggggggtggcttggg

SEQ ID NO: 51913 - DNA, 20 bp, Homo sapiens
gggatgggtgggggtggggg

SEQ ID NO: 51914 - DNA, 15 bp, Homo sapiens
tgggtgggggtgggg

SEQ ID NO: 51915 - DNA, 18 bp, Homo sapiens
tgggagggggtgacgggg

SEQ ID NO: 51916 - DNA, 20 bp, Homo sapiens
gggttgggggtgtgacaggg

SEQ ID NO: 51917 - DNA, 18 bp, Homo sapiens
tgggatgaggggtggggg

SEQ ID NO: 51918 - DNA, 89 bp, Human herpesvirus 8
tccagtgtaagcaagtcgatttgaatgacataggcgacaaagtgaggtggcatttgtcagaagtttcaaagtcgtgtaagaacattgga

SEQ ID NO: 51919 - DNA, 24 bp, Human herpesvirus 8
tgaatgacataggcgacaaagtga

SEQ ID NO: 51920 - DNA, 21 bp, Homo sapiens
tgaatgggttagcacaaagtg

SEQ ID NO: 51921 - DNA, 19 bp, Homo sapiens
tgatgacatagggacagtg

SEQ ID NO: 51922 - DNA, 19 bp, Homo sapiens
aatgacacaaaataaagtg

SEQ ID NO: 51923 - DNA, 21 bp, Homo sapiens
tgaataacttggataaagtga

SEQ ID NO: 51924 - DNA, 21 bp, Homo sapiens
tgaatgacatgcgtgatgttg

SEQ ID NO: 51925 - DNA, 20 bp, Homo sapiens
tgaatgacaggccgggagtg

SEQ ID NO: 51926 - DNA, 24 bp, Homo sapiens
gaatgacatcgagtgacaaagtga

SEQ ID NO: 51927 - DNA, 23 bp, Homo sapiens
taaatgactcacagacagggtga

SEQ ID NO: 51928 - DNA, 21 bp, Homo sapiens
gagtggcataggcatgggtga

SEQ ID NO: 51929 - DNA, 20 bp, Homo sapiens
gaatggtaagagcaaagtga

SEQ ID NO: 51930 - DNA, 22 bp, Homo sapiens
tgaaggaaacatggcaaagtga

SEQ ID NO: 51931 - DNA, 20 bp, Homo sapiens
tgatgggcaaggcaaagtga

SEQ ID NO: 51932 - DNA, 22 bp, Homo sapiens
gatgtaaacggtggcaaagtga

SEQ ID NO: 51933 - DNA, 18 bp, Homo sapiens
tgaatgacacaggtgaca

SEQ ID NO: 51934 - DNA, 17 bp, Homo sapiens
tgacacaggcaaggtga

SEQ ID NO: 51935 - DNA, 21 bp, Homo sapiens
tgggtgacatagatattgtga

SEQ ID NO: 51936 - DNA, 19 bp, Homo sapiens
gacgtaggcgacaaaaaga

SEQ ID NO: 51937 - DNA, 19 bp, Homo sapiens
tgaatatgaggacaaagtg

SEQ ID NO: 51938 - DNA, 93 bp, Human herpesvirus 8
tgcactacctatctgctcattcgttgtttcggttctgtgtttgtctgattcttagatagtgttgaggtaattctagaaagcggattgagtgta

SEQ ID NO: 51939 - DNA, 24 bp, Human herpesvirus 8
tagtgttgaggtaattctagaaag

SEQ ID NO: 51940 - DNA, 18 bp, Homo sapiens
tagtgttgaggaaattct

SEQ ID NO: 51941 - DNA, 19 bp, Homo sapiens
gtgacttataattctagaa

SEQ ID NO: 51942 - DNA, 17 bp, Homo sapiens
tagtgttgtgtgcctag

SEQ ID NO: 51943 - DNA, 17 bp, Homo sapiens
gtgttggggaattccag

SEQ ID NO: 51944 - DNA, 18 bp, Homo sapiens
tagtgttgggctcagaaa

SEQ ID NO: 51945 - DNA, 17 bp, Homo sapiens
gtgtttggcactagaaa

SEQ ID NO: 51946 - DNA, 19 bp, Homo sapiens
taggttgaggtgaaataga

SEQ ID NO: 51947 - DNA, 23 bp, Homo sapiens
tagtggtgaggtaaaggcaaaag

SEQ ID NO: 51948 - DNA, 19 bp, Homo sapiens
gtgatgagatcccctagaa

SEQ ID NO: 51949 - DNA, 70 bp, Human herpesvirus 8
gggtaaatgacaatgggggtaaatgacaatggggcgcttggtgacacatttgccccaccgtcgcctgccc

SEQ ID NO: 51950 - DNA, 24 bp, Human herpesvirus 8
aatgacaatgggggtaaatgacaa

SEQ ID NO: 51951 - DNA, 16 bp, Homo sapiens
tgacaagggggagaca

SEQ ID NO: 51952 - DNA, 16 bp, Homo sapiens
caatggggcaagacaa

SEQ ID NO: 51953 - DNA, 20 bp, Homo sapiens
aatgacatgaaaagtggcaa

SEQ ID NO: 51954 - DNA, 24 bp, Homo sapiens
aatgaagagaaaaggtagatgaca

SEQ ID NO: 51955 - DNA, 20 bp, Homo sapiens
aacgacgtgtgtaaatgaca

SEQ ID NO: 51956 - DNA, 18 bp, Homo sapiens
tggaactcataaatgaca

SEQ ID NO: 51957 - DNA, 18 bp, Homo sapiens
aatgaacaaggatggcaa

SEQ ID NO: 51958 - DNA, 19 bp, Homo sapiens
atgcaatgggaattgatga

SEQ ID NO: 51959 - DNA, 22 bp, Homo sapiens
aatgcatgaattttaaatgaca

SEQ ID NO: 51960 - DNA, 18 bp, Homo sapiens
atgacaattaaggtgaca

SEQ ID NO: 51961 - DNA, 25 bp, Homo sapiens
atggcaatgggaaaagcagatggca

SEQ ID NO: 51962 - DNA, 21 bp, Homo sapiens
aatgaatacagaggtgagtga

SEQ ID NO: 51963 - DNA, 18 bp, Homo sapiens
atgaagatgggggaataa

SEQ ID NO: 51964 - DNA, 16 bp, Homo sapiens
gacaatacagaaatga

SEQ ID NO: 51965 - DNA, 18 bp, Homo sapiens
aatgagatgggggagata

SEQ ID NO: 51966 - DNA, 24 bp, Homo sapiens
aatgacaaaacaattaaatgacaa

SEQ ID NO: 51967 - DNA, 17 bp, Homo sapiens
atgacaatggaatgaca

SEQ ID NO: 51968 - DNA, 25 bp, Homo sapiens
atgacaatctctaaggtgaatgaca

SEQ ID NO: 51969 - DNA, 17 bp, Homo sapiens
atgacaggagaggtgac

SEQ ID NO: 51970 - DNA, 17 bp, Homo sapiens
tgaagaaataaatgaca

SEQ ID NO: 51971 - DNA, 18 bp, Homo sapiens
acagtcaataaatgacaa

SEQ ID NO: 51972 - DNA, 17 bp, Homo sapiens
atgaacagaggtgaatg

SEQ ID NO: 51973 - DNA, 22 bp, Homo sapiens
atgacaatgggggtcatcccca

SEQ ID NO: 51974 - DNA, 21 bp, Homo sapiens
gacaaggcttgtaggtgacaa

SEQ ID NO: 51975 - DNA, 20 bp, Homo sapiens
aatggcaatggtcatcctga

SEQ ID NO: 51976 - DNA, 22 bp, Homo sapiens
tggcaatgggagattttggaca

SEQ ID NO: 51977 - DNA, 20 bp, Homo sapiens
gacagtgtgggtaagtggca

SEQ ID NO: 51978 - DNA, 18 bp, Homo sapiens
aatgacattaaaatgaca

SEQ ID NO: 51979 - DNA, 19 bp, Homo sapiens
aatgacaaatgagtggcaa

SEQ ID NO: 51980 - DNA, 22 bp, Homo sapiens
aatgacaatccacaagtggcaa

SEQ ID NO: 51981 - DNA, 23 bp, Homo sapiens
aatgacagaaaagtaagtggcaa

SEQ ID NO: 51982 - DNA, 19 bp, Homo sapiens
aatggtcacgtaaatgaca

SEQ ID NO: 51983 - DNA, 18 bp, Homo sapiens
tggcaatggaagggatga

SEQ ID NO: 51984 - DNA, 20 bp, Homo sapiens
aatgacaagacagatggcaa

SEQ ID NO: 51985 - DNA, 18 bp, Homo sapiens
tggcagtaaaaatgacaa

SEQ ID NO: 51986 - DNA, 18 bp, Homo sapiens
gataatgggggtgagaca

SEQ ID NO: 51987 - DNA, 20 bp, Homo sapiens
acaatcaacagaagtgacaa

SEQ ID NO: 51988 - DNA, 22 bp, Homo sapiens
aatgcaatggactggatgacaa

SEQ ID NO: 51989 - DNA, 18 bp, Homo sapiens
atgacaatgtggaagaca

SEQ ID NO: 51990 - DNA, 23 bp, Homo sapiens
atgacaactaatttgagtggtaa

SEQ ID NO: 51991 - DNA, 19 bp, Homo sapiens
atgaggatgaggatgatga

SEQ ID NO: 51992 - DNA, 19 bp, Homo sapiens
atgaaatggcaaaatgaca

SEQ ID NO: 51993 - DNA, 25 bp, Homo sapiens
atggaaatggagctgcaagtgacaa

SEQ ID NO: 51994 - DNA, 21 bp, Homo sapiens
tgcaagtcttggtagatgaca

SEQ ID NO: 51995 - DNA, 21 bp, Homo sapiens
aatagcactacaggtaaatga

SEQ ID NO: 51996 - DNA, 19 bp, Homo sapiens
tggcaatgggggtcaacaa

SEQ ID NO: 51997 - DNA, 20 bp, Homo sapiens
aatgaaaatgggtatgatga

SEQ ID NO: 51998 - DNA, 19 bp, Homo sapiens
tgataaagagaaatgacaa

SEQ ID NO: 51999 - DNA, 18 bp, Homo sapiens
tgacaatggaattgatga

SEQ ID NO: 52000 - DNA, 18 bp, Homo sapiens
aatagcaatggaatgaca

SEQ ID NO: 52001 - DNA, 19 bp, Homo sapiens
aataacacagtgaatgaca

SEQ ID NO: 52002 - DNA, 21 bp, Homo sapiens
aatcacatcttgtaaatgaca

SEQ ID NO: 52003 - DNA, 88 bp, Variola virus
tttctcgaatatacgggccaagttagaatctccagtaactaccatagtgggatatcatccagcagctagagaccgtcaattcgagaaa

SEQ ID NO: 52004 - DNA, 60 bp, Variola virus
tcagagattattgtcttatattctttcttgttatccgatataaatttaataagactttga

SEQ ID NO: 52005 - DNA, 22 bp, Variola virus
tataaatttaataagactttga

SEQ ID NO: 52006 - DNA, 21 bp, Homo sapiens
tataaatttatgaagctttga

SEQ ID NO: 52007 - DNA, 17 bp, Homo sapiens
tataaaataagactttg

SEQ ID NO: 52008 - DNA, 17 bp, Homo sapiens
aaactcaaagactttga

SEQ ID NO: 52009 - DNA, 23 bp, Homo sapiens
tacaaatttaataaagcctttga

SEQ ID NO: 52010 - DNA, 21 bp, Homo sapiens
tgaaatttaataagcatttga

SEQ ID NO: 52011 - DNA, 22 bp, Homo sapiens
tacaaattactgtgagactttg

SEQ ID NO: 52012 - DNA, 19 bp, Homo sapiens
tataaatttcagactttga

SEQ ID NO: 52013 - DNA, 103 bp, Myxoma virus
gatataatctaaacgacgtagaaggcgtgtttccttggaactactatctaagctgcaaaataggtgaaacaaaaagtcacgcgttacactggaagcgtatatc

SEQ ID NO: 52014 - DNA, 24 bp, Myxoma virus
taagctgcaaaataggtgaaacaa

SEQ ID NO: 52015 - DNA, 17 bp, Homo sapiens
agctgcaatgtaaagca

SEQ ID NO: 52016 - DNA, 18 bp, Homo sapiens
gcttgcaaaacacaagtg

SEQ ID NO: 52017 - DNA, 18 bp, Homo sapiens
aggtgcgaaaacaggtaa

SEQ ID NO: 52018 - DNA, 20 bp, Homo sapiens
aagctgcaaaactttattga

SEQ ID NO: 52019 - DNA, 15 bp, Homo sapiens
taagctacaagatga

SEQ ID NO: 52020 - DNA, 18 bp, Homo sapiens
taagctgcagtatgaaca

SEQ ID NO: 52021 - DNA, 18 bp, Homo sapiens
agctgtgaaataggcaca

SEQ ID NO: 52022 - DNA, 21 bp, Homo sapiens
taagttacaaaatagagtcaa

SEQ ID NO: 52023 - DNA, 19 bp, Homo sapiens
gctgcaaaagatgcagatg

SEQ ID NO: 52024 - DNA, 16 bp, Homo sapiens
agtgcaatgtgaaaca

SEQ ID NO: 52025 - DNA, 19 bp, Homo sapiens
taatttgcaaaatacagtg

SEQ ID NO: 52026 - DNA, 19 bp, Homo sapiens
taagctgcagaaatggaaa

SEQ ID NO: 52027 - DNA, 19 bp, Homo sapiens
taagcgcaaaaggagatga

SEQ ID NO: 52028 - DNA, 22 bp, Homo sapiens
agctgcaagtcttttgaaacaa

SEQ ID NO: 52029 - DNA, 19 bp, Homo sapiens
taagctcagaagtaggtga

SEQ ID NO: 52030 - DNA, 22 bp, Homo sapiens
caagcaaattacagagtaggtg

SEQ ID NO: 52031 - DNA, 20 bp, Homo sapiens
ctgcaaaaggttttggaaca

SEQ ID NO: 52032 - DNA, 18 bp, Homo sapiens
tgactgcaggataaataa

SEQ ID NO: 52033 - DNA, 20 bp, Homo sapiens
taagctgcaaaaaaagatga

SEQ ID NO: 52034 - DNA, 18 bp, Homo sapiens
aggtgcaggaataggtaa

SEQ ID NO: 52035 - DNA, 21 bp, Homo sapiens
agctgcaaagtgccctggaca

SEQ ID NO: 52036 - DNA, 19 bp, Homo sapiens
taagctgcacaattgagta

SEQ ID NO: 52037 - DNA, 19 bp, Homo sapiens
aactgcaaagtacagataa

SEQ ID NO: 52038 - DNA, 20 bp, Homo sapiens
agctgcaaaatcattagtaa

SEQ ID NO: 52039 - DNA, 23 bp, Homo sapiens
agctgcaaggctgagaagaggtg

SEQ ID NO: 52040 - DNA, 19 bp, Homo sapiens
taagctgcataatagtatg

SEQ ID NO: 52041 - DNA, 18 bp, Homo sapiens
aagctgcaggcggggaca

SEQ ID NO: 52042 - DNA, 18 bp, Homo sapiens
taaactgcagaaaataga

SEQ ID NO: 52043 - DNA, 18 bp, Homo sapiens
tgactgcaaagaaaatga

SEQ ID NO: 52044 - DNA, 19 bp, Homo sapiens
taagctgcaagcaaagatg

SEQ ID NO: 52045 - DNA, 20 bp, Homo sapiens
taagctacaaaaattaaatg

SEQ ID NO: 52046 - DNA, 19 bp, Homo sapiens
taaactgcaaggtatgaac

SEQ ID NO: 52047 - DNA, 21 bp, Homo sapiens
aagttgcaaaatatttggtga

SEQ ID NO: 52048 - DNA, 19 bp, Homo sapiens
caagttgcagaacaagtga

SEQ ID NO: 52049 - DNA, 21 bp, Homo sapiens
gcttgcaacaccatgaaacaa

SEQ ID NO: 52050 - DNA, 19 bp, Homo sapiens
taagctgcagtgtaataca

SEQ ID NO: 52051 - DNA, 23 bp, Homo sapiens
taagcttgcaaaaacaaaagcaa

SEQ ID NO: 52052 - DNA, 18 bp, Homo sapiens
taagcagcaaagtcaaca

SEQ ID NO: 52053 - DNA, 23 bp, Homo sapiens
taagctgcaaaaagaaagttaca

SEQ ID NO: 52054 - DNA, 18 bp, Homo sapiens
taagctgcaacgtacatg

SEQ ID NO: 52055 - DNA, 18 bp, Homo sapiens
taagctcagaatagctga

SEQ ID NO: 52056 - DNA, 18 bp, Homo sapiens
taagctgcaagatgggga

SEQ ID NO: 52057 - DNA, 19 bp, Homo sapiens
caagctgcagaagaggcaa

SEQ ID NO: 52058 - DNA, 20 bp, Homo sapiens
taagtgcaaaataagggtaa

SEQ ID NO: 52059 - DNA, 19 bp, Homo sapiens
taagctgcaaatctggtga

SEQ ID NO: 52060 - DNA, 22 bp, Homo sapiens
gctgcagagtccagtgaaacaa

SEQ ID NO: 52061 - DNA, 18 bp, Homo sapiens
taagtgcaaaaaaagcaa

SEQ ID NO: 52062 - DNA, 18 bp, Homo sapiens
taagctcagaataagtaa

SEQ ID NO: 52063 - DNA, 24 bp, Homo sapiens
taagttgcaaaataaactaaggta

SEQ ID NO: 52064 - DNA, 21 bp, Homo sapiens
taagctgcatcagtggaacaa

SEQ ID NO: 52065 - DNA, 21 bp, Homo sapiens
taagctgataaggtgaaacaa

SEQ ID NO: 52066 - DNA, 19 bp, Homo sapiens
aagctgtacatgtgaaaca

SEQ ID NO: 52067 - DNA, 19 bp, Homo sapiens
aactgcaaagatctaggca

SEQ ID NO: 52068 - DNA, 22 bp, Homo sapiens
taagctgccagataggaagcca

SEQ ID NO: 52069 - DNA, 18 bp, Homo sapiens
aactgcaagtttagggaa

SEQ ID NO: 52070 - DNA, 19 bp, Homo sapiens
agctgcaagatgtggatga

SEQ ID NO: 52071 - DNA, 23 bp, Homo sapiens
taagtgcagaaccaacaaaacaa

SEQ ID NO: 52072 - DNA, 17 bp, Homo sapiens
aactgcaaggtatgaac

SEQ ID NO: 52073 - DNA, 22 bp, Homo sapiens
caagctgcagagtggagcgtga

SEQ ID NO: 52074 - DNA, 20 bp, Homo sapiens
agctgcaaaaacaaaaacaa

SEQ ID NO: 52075 - DNA, 20 bp, Homo sapiens
taagctgcaagggaaggtga

SEQ ID NO: 52076 - DNA, 23 bp, Homo sapiens
tgactgcaaagtgtgagaggcga

SEQ ID NO: 52077 - DNA, 17 bp, Homo sapiens
agctgcaaattgaaaca

SEQ ID NO: 52078 - DNA, 17 bp, Homo sapiens
agctgcaaggggagaca

SEQ ID NO: 52079 - DNA, 15 bp, Homo sapiens
taaactgaggtgaaa

SEQ ID NO: 52080 - DNA, 24 bp, Homo sapiens
taagctgcaaaggagactggaaca

SEQ ID NO: 52081 - DNA, 19 bp, Homo sapiens
aactgcaaaatccaaaatg

SEQ ID NO: 52082 - DNA, 19 bp, Homo sapiens
agctgcaaaaattaaataa

SEQ ID NO: 52083 - DNA, 21 bp, Homo sapiens
taagctgcaaatctatagcaa

SEQ ID NO: 52084 - DNA, 22 bp, Homo sapiens
taagctgcaaataccaaaggtg

SEQ ID NO: 52085 - DNA, 18 bp, Homo sapiens
agctgcaaaataatgtga

SEQ ID NO: 52086 - DNA, 22 bp, Homo sapiens
taatttgcaaaacaaaaagcga

SEQ ID NO: 52087 - DNA, 22 bp, Homo sapiens
agctgcagagaggcgtggaaca

SEQ ID NO: 52088 - DNA, 19 bp, Homo sapiens
gctgcaaaaaaaaaaacaa

SEQ ID NO: 52089 - DNA, 21 bp, Homo sapiens
gctgcaaaataatttaaacaa

SEQ ID NO: 52090 - DNA, 24 bp, Homo sapiens
taagctgcatgcacacagagatga

SEQ ID NO: 52091 - DNA, 20 bp, Homo sapiens
aactgcaaggatacaaacaa

SEQ ID NO: 52092 - DNA, 22 bp, Homo sapiens
taagctgctaaaaactaaaaca

SEQ ID NO: 52093 - DNA, 19 bp, Homo sapiens
tgactgcaaagtgtccaca

SEQ ID NO: 52094 - DNA, 20 bp, Homo sapiens
agctgcaaggatgtaagtga

SEQ ID NO: 52095 - DNA, 16 bp, Homo sapiens
agctgcaaggaaaaca

SEQ ID NO: 52096 - DNA, 19 bp, Homo sapiens
aactgcaaggtatgaacaa

SEQ ID NO: 52097 - DNA, 19 bp, Homo sapiens
taagcttcaaaatagataa

SEQ ID NO: 52098 - DNA, 20 bp, Homo sapiens
agcttgcaaaacccaaggga

SEQ ID NO: 52099 - DNA, 62 bp, Variola virus
gaaattagagtttgtacattaagcaacatgtctttaaatgtggctacaaacttttccttttc

SEQ ID NO: 52100 - DNA, 22 bp, Variola virus
tggctacaaacttttccttttc

SEQ ID NO: 52101 - DNA, 21 bp, Homo sapiens
tggcataaccaacttcctttt

SEQ ID NO: 52102 - DNA, 17 bp, Homo sapiens
tggctcaatgccctttt

SEQ ID NO: 52103 - DNA, 16 bp, Homo sapiens
tgtctactttcctttt

SEQ ID NO: 52104 - DNA, 19 bp, Homo sapiens
tggcttcactgtccttttc

SEQ ID NO: 52105 - DNA, 16 bp, Homo sapiens
tggctttcttcctttt

SEQ ID NO: 52106 - DNA, 18 bp, Homo sapiens
gcaacttcttttcctttt

SEQ ID NO: 52107 - DNA, 21 bp, Homo sapiens
tgactatgcctcttccttttc

SEQ ID NO: 52108 - DNA, 18 bp, Homo sapiens
taaccatttttccttttc

SEQ ID NO: 52109 - DNA, 22 bp, Homo sapiens
tggctacaaattaaaatttttc

SEQ ID NO: 52110 - DNA, 17 bp, Homo sapiens
tggccttttttcctttt

SEQ ID NO: 52111 - DNA, 17 bp, Homo sapiens
tggcaaactttcctttt

SEQ ID NO: 52112 - DNA, 21 bp, Homo sapiens
tggccacaagctttttttttc

SEQ ID NO: 52113 - DNA, 18 bp, Homo sapiens
gctactattttccttttc

SEQ ID NO: 52114 - DNA, 21 bp, Homo sapiens
tggctgtttttttttcctttt

SEQ ID NO: 52115 - DNA, 19 bp, Homo sapiens
cggccaaactttttttttt

SEQ ID NO: 52116 - DNA, 22 bp, Homo sapiens
tgggtacaaactgaacattttc

SEQ ID NO: 52117 - DNA, 19 bp, Homo sapiens
tggtttgcttttccttttc

SEQ ID NO: 52118 - DNA, 24 bp, Homo sapiens
ggctacaaaaacgctttccttttc

SEQ ID NO: 52119 - DNA, 21 bp, Homo sapiens
tggcacaaactccaggttttc

SEQ ID NO: 52120 - DNA, 22 bp, Homo sapiens
tggcggtgaacgcttcctttcc

SEQ ID NO: 52121 - DNA, 15 bp, Homo sapiens
agctacattcctttt

SEQ ID NO: 52122 - DNA, 16 bp, Homo sapiens
gctagcctttcctttt

SEQ ID NO: 52123 - DNA, 21 bp, Homo sapiens
tggttttccaccttccttttc

SEQ ID NO: 52124 - DNA, 22 bp, Homo sapiens
ggcctgttggcttttccttttc

SEQ ID NO: 52125 - DNA, 15 bp, Homo sapiens
tgactattccttttc

SEQ ID NO: 52126 - DNA, 21 bp, Homo sapiens
tggttaaattttttccttttc

SEQ ID NO: 52127 - DNA, 16 bp, Homo sapiens
gctacattttcctttt

SEQ ID NO: 52128 - DNA, 21 bp, Homo sapiens
tggtcataaacatcccttttc

SEQ ID NO: 52129 - DNA, 20 bp, Homo sapiens
tgatccaaactttttctttt

SEQ ID NO: 52130 - DNA, 20 bp, Homo sapiens
tggcccaaactttttttttt

SEQ ID NO: 52131 - DNA, 20 bp, Homo sapiens
tggtgcaaattcttcccttt

SEQ ID NO: 52132 - DNA, 15 bp, Homo sapiens
tggccttttcctttt

SEQ ID NO: 52133 - DNA, 17 bp, Homo sapiens
ggctatgtctccttttc

SEQ ID NO: 52134 - DNA, 20 bp, Homo sapiens
tggctgtgtacctccttttc

SEQ ID NO: 52135 - DNA, 16 bp, Homo sapiens
gcctacttttcctttt

SEQ ID NO: 52136 - DNA, 17 bp, Homo sapiens
ggctgccttttcctttt

SEQ ID NO: 52137 - DNA, 20 bp, Homo sapiens
tgggtacaaacttgcctttc

SEQ ID NO: 52138 - DNA, 20 bp, Homo sapiens
tgacttttttttttcctttt

SEQ ID NO: 52139 - DNA, 21 bp, Homo sapiens
tgattattccttttccttttc

SEQ ID NO: 52140 - DNA, 20 bp, Homo sapiens
tggctacattcctccttttc

SEQ ID NO: 52141 - DNA, 21 bp, Homo sapiens
tgactgcaagtttctcctttc

SEQ ID NO: 52142 - DNA, 20 bp, Homo sapiens
tggttactttctttcctttt

SEQ ID NO: 52143 - DNA, 17 bp, Homo sapiens
gctacaaacttactttc

SEQ ID NO: 52144 - DNA, 19 bp, Homo sapiens
ggcttgttttttccttttc

SEQ ID NO: 52145 - DNA, 18 bp, Homo sapiens
tggtcacaaactcctttt

SEQ ID NO: 52146 - DNA, 18 bp, Homo sapiens
gctacatgcttccttttc

SEQ ID NO: 52147 - DNA, 19 bp, Homo sapiens
tggcttggatttccttctc

SEQ ID NO: 52148 - DNA, 21 bp, Homo sapiens
tggcactcctggtttcctttt

SEQ ID NO: 52149 - DNA, 21 bp, Homo sapiens
tggttcgacctcttccttttc

SEQ ID NO: 52150 - DNA, 19 bp, Homo sapiens
tggctccatcctccttttc

SEQ ID NO: 52151 - DNA, 19 bp, Homo sapiens
tggctacacagttcctttc

SEQ ID NO: 52152 - DNA, 21 bp, Homo sapiens
tggtacaaacttccaactttc

SEQ ID NO: 52153 - DNA, 16 bp, Homo sapiens
tggcttttttcctttt

SEQ ID NO: 52154 - DNA, 19 bp, Homo sapiens
tggactacttcttcctttt

SEQ ID NO: 52155 - DNA, 21 bp, Homo sapiens
tgtctactttcttttcctttt

SEQ ID NO: 52156 - DNA, 21 bp, Homo sapiens
tggacaacctttttccttttc

SEQ ID NO: 52157 - DNA, 17 bp, Homo sapiens
ggctacaaactttcctc

SEQ ID NO: 52158 - DNA, 21 bp, Homo sapiens
tggcttttttatttccttttc

SEQ ID NO: 52159 - DNA, 20 bp, Homo sapiens
gctgcaaacttttgcctttt

SEQ ID NO: 52160 - DNA, 18 bp, Homo sapiens
tggctagaattttccttt

SEQ ID NO: 52161 - DNA, 17 bp, Homo sapiens
gctacaaatccattttc

SEQ ID NO: 52162 - DNA, 16 bp, Homo sapiens
tagctactttcctttt

SEQ ID NO: 52163 - DNA, 21 bp, Homo sapiens
gcaggtaaacttttccttttc

SEQ ID NO: 52164 - DNA, 19 bp, Homo sapiens
tggccgcagccctcctttt

SEQ ID NO: 52165 - DNA, 21 bp, Homo sapiens
tggctgatgatctctcctttt

SEQ ID NO: 52166 - DNA, 21 bp, Homo sapiens
tggcagcaggagctccttttc

SEQ ID NO: 52167 - DNA, 20 bp, Homo sapiens
tggctacagggtttcatttt

SEQ ID NO: 52168 - DNA, 19 bp, Homo sapiens
tggctgaaacctccttttc

SEQ ID NO: 52169 - DNA, 18 bp, Homo sapiens
ggctacaaacctcttttc

SEQ ID NO: 52170 - DNA, 61 bp, Vaccinia virus
attgtttgtattcattcaatgtctctttttcagaaattagtttagagtcgaatactgcaat

SEQ ID NO: 52171 - DNA, 24 bp, Vaccinia virus
tttgtattcattcaatgtctcttt

SEQ ID NO: 52172 - DNA, 20 bp, Homo sapiens
ttgtattcatatttctcttt

SEQ ID NO: 52173 - DNA, 16 bp, Homo sapiens
tttgtattcttctgcc

SEQ ID NO: 52174 - DNA, 22 bp, Homo sapiens
tttgtgttctctttgtctcttt

SEQ ID NO: 52175 - DNA, 21 bp, Homo sapiens
tttatattcatttccacacct

SEQ ID NO: 52176 - DNA, 20 bp, Homo sapiens
tttgtattcattttgaatgt

SEQ ID NO: 52177 - DNA, 20 bp, Homo sapiens
tttgtatttcttcgtcgcct

SEQ ID NO: 52178 - DNA, 17 bp, Homo sapiens
tttgtgttcttcaatgt

SEQ ID NO: 52179 - DNA, 17 bp, Homo sapiens
tttgtattgttcaatgt

SEQ ID NO: 52180 - DNA, 84 bp, Vaccinia virus
tagagttaagagagattagagtttgtacattaagcaacatgtctctaaatgtggctacaaacttttccttttccacatcatcta

SEQ ID NO: 52181 - DNA, 84 bp, Vaccinia virus; identical to SEQ ID NO: 52180

SEQ ID NO: 52182 - DNA, 24 bp, Homo sapiens
tggcataaccaacttcctttttca

SEQ ID NO: 52183 - DNA, 18 bp, Homo sapiens
tggctttcttccttttcc

SEQ ID NO: 52184 - DNA, 22 bp, Homo sapiens
tgattacaagccgacttttcca

SEQ ID NO: 52185 - DNA, 22 bp, Homo sapiens
tggcaccagtttttcttttcca

SEQ ID NO: 52186 - DNA, 24 bp, Homo sapiens
tggctacaaattaaaatttttcca

SEQ ID NO: 52187 - DNA, 21 bp, Homo sapiens
ggctgcagggattcttttcca

SEQ ID NO: 52188 - DNA, 18 bp, Homo sapiens
tggttataacttttccct

SEQ ID NO: 52189 - DNA, 19 bp, Homo sapiens
tggcaggcaacacttttcc

SEQ ID NO: 52190 - DNA, 22 bp, Homo sapiens
tagctataaatttttcccttcc

SEQ ID NO: 52191 - DNA, 21 bp, Homo sapiens
tggcatagattcccctttcca

SEQ ID NO: 52192 - DNA, 18 bp, Homo sapiens
tggctgaaacctttttcc

SEQ ID NO: 52193 - DNA, 22 bp, Homo sapiens
tgggtacaaacttgcctttcca

SEQ ID NO: 52194 - DNA, 23 bp, Homo sapiens
tgactgcaagtttctcctttcca

SEQ ID NO: 52195 - DNA, 18 bp, Homo sapiens
tggctcaaacttttgacc

SEQ ID NO: 52196 - DNA, 23 bp, Homo sapiens
tggttactttctttcctttttca

SEQ ID NO: 52197 - DNA, 21 bp, Homo sapiens
tagctacaggcttttattttt

SEQ ID NO: 52198 - DNA, 17 bp, Homo sapiens
gctacaaatttcatttc

SEQ ID NO: 52199 - DNA, 23 bp, Homo sapiens
tgcctacagggttttcttttcca

SEQ ID NO: 52200 - DNA, 24 bp, Homo sapiens
tggtgtgcactgtttcctttttca

SEQ ID NO: 52201 - DNA, 17 bp, Homo sapiens
tggctaaaacttttact

SEQ ID NO: 52202 - DNA, 18 bp, Homo sapiens
tggccacaaattttctcc

SEQ ID NO: 52203 - DNA, 24 bp, Homo sapiens
tggctacaaatttggcgatttcca

SEQ ID NO: 52204 - DNA, 20 bp, Homo sapiens
tggtttcaaacttttcttct

SEQ ID NO: 52205 - DNA, 20 bp, Homo sapiens
gctacaaattttgtgctttc

SEQ ID NO: 52206 - DNA, 17 bp, Homo sapiens
tagctactttccttttc

SEQ ID NO: 52207 - DNA, 24 bp, Homo sapiens
tggctgatgatctctcctttttca

SEQ ID NO: 52208 - DNA, 61 bp, Camelpox virus
attgtttgtattcattcaatgtctccttttcagaaattagtttagagtcgaatactgcaat

SEQ ID NO: 52209 - DNA, 24 bp, Camelpox virus
tttgtattcattcaatgtctcctt

SEQ ID NO: 52210 - DNA, 24 bp, Homo sapiens
tttatattcattccttatctcctt

SEQ ID NO: 52211 - DNA, 19 bp, Homo sapiens
tatttattccagcctcctt

SEQ ID NO: 52212 - DNA, 18 bp, Homo sapiens
ttgtaaaacattcaatgt

SEQ ID NO: 52213 - DNA, 16 bp, Homo sapiens
tctgtttctgtctcct

SEQ ID NO: 52214 - DNA, 21 bp, Homo sapiens
tttgcattcgactgtttcctt

SEQ ID NO: 52215 - DNA, 21 bp, Homo sapiens
tttgtatttactcaaaccctt

SEQ ID NO: 52216 - DNA, 21 bp, Homo sapiens
tctgttcatcctcctctcctt

SEQ ID NO: 52217 - DNA, 21 bp, Homo sapiens
tttgtatttcttcgtcgcctt

SEQ ID NO: 52218 - DNA, 24 bp, Homo sapiens
tttgaatctggtcaatgtctcctt

SEQ ID NO: 52219 - DNA, 20 bp, Homo sapiens
tttgtattccattcttttct

SEQ ID NO: 52220 - DNA, 22 bp, Homo sapiens
ttcgtattactgatgtttcctt

SEQ ID NO: 52221 - DNA, 84 bp, Cowpox virus
tagagttaagagaaattagagtttgtacattaagcaacatgtctctaaatgtggctacaaacttttccttttccacatcatcta

SEQ ID NO: 52222 - DNA, 66 bp, Fowlpox virus
aacatcctaatactttatttgttttaaagctattaaagagttctaacaatatcatttttggatgtt

SEQ ID NO: 52223 - DNA, 23 bp, Fowlpox virus
taacaatatcatttttggatgtt

SEQ ID NO: 52224 - DNA, 20 bp, Homo sapiens
taacaatatcattttaaaac

SEQ ID NO: 52225 - DNA, 19 bp, Homo sapiens
caatatcacttgcagtgtt

SEQ ID NO: 52226 - DNA, 21 bp, Homo sapiens
acagtatcatttctgtctgtt

SEQ ID NO: 52227 - DNA, 21 bp, Homo sapiens
taacaggaatccttggatgtt

SEQ ID NO: 52228 - DNA, 23 bp, Homo sapiens
taacagtatgcaccttggatgtt

SEQ ID NO: 52229 - DNA, 20 bp, Homo sapiens
aacaatatcacctgggtgtt

SEQ ID NO: 52230 - DNA, 21 bp, Homo sapiens
acaatatcatcggcaggtgtt

SEQ ID NO: 52231 - DNA, 22 bp, Homo sapiens
aacaaagctatttttggatgtt

SEQ ID NO: 52232 - DNA, 66 bp, Fowlpox virus
aggtttacctattttatcacgattgatatctgattatattgtgtacaagtaaaataattactacct

SEQ ID NO: 52233 - DNA, 24 bp, Fowlpox virus
tattgtgtacaagtaaaataatta

SEQ ID NO: 52234 - DNA, 21 bp, Homo sapiens
tatgctacagtaaaataatta

SEQ ID NO: 52235 - DNA, 18 bp, Homo sapiens
tattgtgctatcaagtaa

SEQ ID NO: 52236 - DNA, 62 bp, Camelpox virus
tcagagtataaattttagaaataacattagcaaattgttgtgcgttgatgtcgttattctga

SEQ ID NO: 52237 - DNA, 22 bp, Camelpox virus
tgcgttgatgtcgttattctga

SEQ ID NO: 52238 - DNA, 15 bp, Homo sapiens
gttgtgtttattctg

SEQ ID NO: 52239 - DNA, 20 bp, Homo sapiens
tgtgctgatttgtattctga

SEQ ID NO: 52240 - DNA, 19 bp, Homo sapiens
tgctttggtgtcaccctga

SEQ ID NO: 52241 - DNA, 18 bp, Homo sapiens
gttggcattgttattctg

SEQ ID NO: 52242 - DNA, 22 bp, Homo sapiens
cgttgatgagatgatattttga

SEQ ID NO: 52243 - DNA, 21 bp, Homo sapiens
tgctttgatgtctagtccctg

SEQ ID NO: 52244 - DNA, 16 bp, Homo sapiens
tgcgttgatctcactg

SEQ ID NO: 52245 - DNA, 16 bp, Homo sapiens
gtgtgagtctattctg

SEQ ID NO: 52246 - DNA, 20 bp, Homo sapiens
tgccttggtgtctatcctga

SEQ ID NO: 52247 - DNA, 21 bp, Homo sapiens
tgcattgatgtgtgatctctg

SEQ ID NO: 52248 - DNA, 19 bp, Homo sapiens
tgtgttgttgtcactctga

SEQ ID NO: 52249 - DNA, 17 bp, Homo sapiens
gttgatgttttagtctg

SEQ ID NO: 52250 - DNA, 28 bp, Homo sapiens
tgcattgatgtctgtaacttattttgat

SEQ ID NO: 52251 - DNA, 21 bp, Homo sapiens
tgtgttgatgttagcatctga

SEQ ID NO: 52252 - DNA, 63 bp, Gallid herpesvirus 2
cttacgaggatctccttaaattcgagtccagtaattcctttgagtgacgggaagccttacgag

SEQ ID NO: 52253 - DNA, 19 bp, Gallid herpesvirus 2
tgacgggaagccttacgag

SEQ ID NO: 52254 - DNA, 17 bp, Homo sapiens
tgcgggaagctccagag

SEQ ID NO: 52255 - DNA, 15 bp, Homo sapiens
gacgggacttacgag

SEQ ID NO: 52256 - DNA, 18 bp, Homo sapiens
gacgggaagcccttggag

SEQ ID NO: 52257 - DNA, 17 bp, Homo sapiens
cggcgggaagccgcgag

SEQ ID NO: 52258 - DNA, 19 bp, Homo sapiens
tgacaggaggcatcttgag

SEQ ID NO: 52259 - DNA, 21 bp, Homo sapiens
tgacaggaggtgcctcctgag

SEQ ID NO: 52260 - DNA, 18 bp, Homo sapiens
tggcgggaagcctcaacg

SEQ ID NO: 52261 - DNA, 19 bp, Homo sapiens
taacgggaggcacacagag

SEQ ID NO: 52262 - DNA, 17 bp, Homo sapiens
tgacgggacagcacaag

SEQ ID NO: 52263 - DNA, 19 bp, Homo sapiens
tgacaggaagactgctgag

SEQ ID NO: 52264 - DNA, 18 bp, Homo sapiens
tggcaggaagccgccaag

SEQ ID NO: 52265 - DNA, 18 bp, Homo sapiens
tgagggagaaagcctgag

SEQ ID NO: 52266 - DNA, 18 bp, Homo sapiens
tgcgggaagctcctcacg

SEQ ID NO: 52267 - DNA, 18 bp, Homo sapiens
tgactggaaacctgtgag

SEQ ID NO: 52268 - DNA, 17 bp, Homo sapiens
tgatgggaagcccagag

SEQ ID NO: 52269 - DNA, 18 bp, Homo sapiens
gacgggaaggctggcgag

SEQ ID NO: 52270 - DNA, 19 bp, Homo sapiens
tgaggggaagcctcccaag

SEQ ID NO: 52271 - DNA, 20 bp, Homo sapiens
tgacggaagaggactgcgag

SEQ ID NO: 52272 - DNA, 17 bp, Homo sapiens
tgacgagacaccgcgag

SEQ ID NO: 52273 - DNA, 18 bp, Homo sapiens
tggcggcagtcccacgag

SEQ ID NO: 52274 - DNA, 16 bp, Homo sapiens
tgcgggaagccttgag

SEQ ID NO: 52275 - DNA, 16 bp, Homo sapiens
tgacggtgcccacgag

SEQ ID NO: 52276 - DNA, 18 bp, Homo sapiens
tgatgggaaacctgtgag

SEQ ID NO: 52277 - DNA, 81 bp, Gallid herpesvirus 2
cccttgttaagatatgatgcaataaatacacgacatgaaactttcatttattgacgaattgcaccatttaaactatttggg

SEQ ID NO: 52278 - DNA, 24 bp, Gallid herpesvirus 2
tatgatgcaataaatacacgacat

SEQ ID NO: 52279 - DNA, 22 bp, Homo sapiens
tatgatgctggtgaatacacaa

SEQ ID NO: 52280 - DNA, 16 bp, Homo sapiens
tatggtgcaataagac

SEQ ID NO: 52281 - DNA, 18 bp, Homo sapiens
tatgatgcattaaaagca

SEQ ID NO: 52282 - DNA, 18 bp, Homo sapiens
tatgatataataaataca

SEQ ID NO: 52283 - DNA, 17 bp, Homo sapiens
atgctcaaatacatgac

SEQ ID NO: 52284 - DNA, 23 bp, Homo sapiens
tatgatgctaataaatgacacaa

SEQ ID NO: 52285 - DNA, 67 bp, Sulfolobus virus SIRV-2
aaaacttttacggtggagaattattaaattactaaacatattagtaatttatactgttcatagtttt

SEQ ID NO: 52286 - DNA, 24 bp, Sulfolobus virus SIRV-2
tacggtggagaattattaaattac

SEQ ID NO: 52287 - DNA, 18 bp, Homo sapiens
ggtggcattattaaatta

SEQ ID NO: 52288 - DNA, 17 bp, Homo sapiens
tacggtgagaaagatta

SEQ ID NO: 52289 - DNA, 21 bp, Homo sapiens
ggtgaggagagttcaaattac

SEQ ID NO: 52290 - DNA, 71 bp, Sulfolobus virus SIRV-1
tgcgtaaatttcgcaactaatgagataaattggaaattccaatttttttcgtttttttcgtttttttcgca

SEQ ID NO: 52291 - DNA, 24 bp, Sulfolobus virus SIRV-1
tttttcgtttttttcgtttttttc

SEQ ID NO: 52292 - DNA, 25 bp, Homo sapiens
tttttgcgttttttcttcatttttc

SEQ ID NO: 52293 - DNA, 23 bp, Homo sapiens
ttttttgttctttttgttttttt

SEQ ID NO: 52294 - DNA, 22 bp, Homo sapiens
ttttttttttttttcatttttc

SEQ ID NO: 52295 - DNA, 19 bp, Homo sapiens
tttcgtttttcgttttttt

SEQ ID NO: 52296 - DNA, 21 bp, Homo sapiens
tttttcgttttttttgttttt

SEQ ID NO: 52297 - DNA, 23 bp, Homo sapiens
ttttttgcttttttccccccctt

SEQ ID NO: 52298 - DNA, 22 bp, Homo sapiens
tttttcctttttttcttttttt

SEQ ID NO: 52299 - DNA, 19 bp, Homo sapiens
tttttcgtttttttgcttt

SEQ ID NO: 52300 - DNA, 22 bp, Homo sapiens
tttttctttttttcattctttt

SEQ ID NO: 52301 - DNA, 19 bp, Homo sapiens
tcgtttttttttctttttt

SEQ ID NO: 52302 - DNA, 22 bp, Homo sapiens
tttttctttttttccttttttt

SEQ ID NO: 52303 - DNA, 24 bp, Homo sapiens
ttttcctttttttttcattttttc

SEQ ID NO: 52304 - DNA, 22 bp, Homo sapiens
tttttccttttttctttttttc

SEQ ID NO: 52305 - DNA, 27 bp, Homo sapiens
tttttcatttcccaatttgtttttttc

SEQ ID NO: 52306 - DNA, 21 bp, Homo sapiens
ttttttttttttttcgctttt

SEQ ID NO: 52307 - DNA, 23 bp, Homo sapiens
tttttcgcttttaatgttttttt

SEQ ID NO: 52308 - DNA, 22 bp, Homo sapiens
ttttttttttttttcatttttt

SEQ ID NO: 52309 - DNA, 22 bp, Homo sapiens
tttttttttttccccgcttttc

SEQ ID NO: 52310 - DNA, 23 bp, Homo sapiens
ttttttttttttttccttttttt

SEQ ID NO: 52311 - DNA, 20 bp, Homo sapiens
ttttttttttttttcgtttt

SEQ ID NO: 52312 - DNA, 20 bp, Homo sapiens
tccgttttttttgttttttt

SEQ ID NO: 52313 - DNA, 22 bp, Homo sapiens
ttttccgtttttttggtttttc

SEQ ID NO: 52314 - DNA, 22 bp, Homo sapiens
tttttctttttttccttttttc

SEQ ID NO: 52315 - DNA, 24 bp, Homo sapiens
ttttttttttttttcccctttttc

SEQ ID NO: 52316 - DNA, 23 bp, Homo sapiens
tttttcttttttttcattttttt

SEQ ID NO: 52317 - DNA, 21 bp, Homo sapiens
ttttttttttttttcgctttc

SEQ ID NO: 52318 - DNA, 20 bp, Homo sapiens
tttttttttttttccgtttc

SEQ ID NO: 52319 - DNA, 23 bp, Homo sapiens
ttcttcttcttttttgttttttt

SEQ ID NO: 52320 - DNA, 21 bp, Homo sapiens
tttttcctttttttctttttt

SEQ ID NO: 52321 - DNA, 22 bp, Homo sapiens
cttttcgtttttttgttttttt

SEQ ID NO: 52322 - DNA, 19 bp, Homo sapiens
tttccgtttttgttttttt

SEQ ID NO: 52323 - DNA, 23 bp, Homo sapiens
tttttcttttccccatttttttc

SEQ ID NO: 52324 - DNA, 24 bp, Homo sapiens
tttcttttcttttttgtttttttc

SEQ ID NO: 52325 - DNA, 24 bp, Homo sapiens
ttttttttttttttcggctttttt

SEQ ID NO: 52326 - DNA, 23 bp, Homo sapiens
tttcttttttttctccttttttt

SEQ ID NO: 52327 - DNA, 22 bp, Homo sapiens
tttttcattttttttttttttt

SEQ ID NO: 52328 - DNA, 22 bp, Homo sapiens
tttttctttttttcattttttt

SEQ ID NO: 52329 - DNA, 23 bp, Homo sapiens
tttttcatttttttttccttttc

SEQ ID NO: 52330 - DNA, 23 bp, Homo sapiens
tttttgatttttttctttttttc

SEQ ID NO: 52331 - DNA, 20 bp, Homo sapiens
ttttttttttttttcgtttc

SEQ ID NO: 52332 - DNA, 23 bp, Homo sapiens
tttttgtttttttctcccttttc

SEQ ID NO: 52333 - DNA, 69 bp, Rous sarcoma virus
ctgaggggaccatgatgtgtataggcgtcaagcggggcttcggttgtacgcggataggaatcccctcag

SEQ ID NO: 52334 - DNA, 23 bp, Rous sarcoma virus
tacgcggataggaatcccctcag

SEQ ID NO: 52335 - DNA, 15 bp, Homo sapiens
tacacgaaatcccct

SEQ ID NO: 52336 - DNA, 19 bp, Homo sapiens
cacgcgggtccaccccctc

SEQ ID NO: 52337 - DNA, 21 bp, Homo sapiens
cacagtgaggaatcccttcag

SEQ ID NO: 52338 - DNA, 21 bp, Homo sapiens
gcctgggcatcatcccctcag

SEQ ID NO: 52339 - DNA, 19 bp, Homo sapiens
acactggggatcccctcag

SEQ ID NO: 52340 - DNA, 18 bp, Homo sapiens
ggctgggaatcccctcag

SEQ ID NO: 52341 - DNA, 20 bp, Homo sapiens
tacgatggtggtaatcccct

SEQ ID NO: 52342 - DNA, 17 bp, Homo sapiens
tacgcggaggggcctca

SEQ ID NO: 52343 - DNA, 111 bp, Rous sarcoma virus
gatggcgtcttccctgttttgcccttagactattcgagttgcctctgtggattagggctggaggcagcacggatagtctgatggccaaataaggcaggcaagacagctatt

SEQ ID NO: 52344 - DNA, 22 bp, Rous sarcoma virus
taaggcaggcaagacagctatt

SEQ ID NO: 52345 - DNA, 20 bp, Homo sapiens
aaggcaggcgaggccaggcc

SEQ ID NO: 52346 - DNA, 21 bp, Homo sapiens
tgagtaggcaagacatttatt

SEQ ID NO: 52347 - DNA, 19 bp, Homo sapiens
taaggcaggcaagggcact

SEQ ID NO: 52348 - DNA, 19 bp, Homo sapiens
tgaagcaaaagtagctatt

SEQ ID NO: 52349 - DNA, 19 bp, Homo sapiens
aggaggcaagatgtctatt

SEQ ID NO: 52350 - DNA, 20 bp, Homo sapiens
gcaggcaagttacggctatt

SEQ ID NO: 52351 - DNA, 18 bp, Homo sapiens
ggcaggcagtgacgagct

SEQ ID NO: 52352 - DNA, 21 bp, Homo sapiens
agagctccactgacagctatt

SEQ ID NO: 52353 - DNA, 19 bp, Homo sapiens
taaggcaggaggggaagct

SEQ ID NO: 52354 - DNA, 20 bp, Homo sapiens
ggcaaagctgggcagctatt

SEQ ID NO: 52355 - DNA, 19 bp, Homo sapiens
taaagcaggtaagaatact

SEQ ID NO: 52356 - DNA, 19 bp, Homo sapiens
taaggtaggaaagacaact

SEQ ID NO: 52357 - DNA, 18 bp, Homo sapiens
aggcaggcaaagcacatt

SEQ ID NO: 52358 - DNA, 17 bp, Homo sapiens
aaggcaggcaggatgct

SEQ ID NO: 52359 - DNA, 16 bp, Homo sapiens
caaggcaggcaggcta

SEQ ID NO: 52360 - DNA, 17 bp, Homo sapiens
taaggcaggcagatggc

SEQ ID NO: 52361 - DNA, 17 bp, Homo sapiens
aggggaaggcagctatt

SEQ ID NO: 52362 - DNA, 17 bp, Homo sapiens
taaggcaggagctagct

SEQ ID NO: 52363 - DNA, 18 bp, Homo sapiens
aggtcggagtcagctatt

SEQ ID NO: 52364 - DNA, 18 bp, Homo sapiens
taaggcaggcggatcacc

SEQ ID NO: 52365 - DNA, 22 bp, Homo sapiens
caagaatttgaaggcagctatt

SEQ ID NO: 52366 - DNA, 20 bp, Homo sapiens
taaggcaggcaggagagact

SEQ ID NO: 52367 - DNA, 19 bp, Homo sapiens
aaggcaggtgccaattatt

SEQ ID NO: 52368 - DNA, 18 bp, Homo sapiens
ggaaagtccaagacagct

SEQ ID NO: 52369 - DNA, 18 bp, Homo sapiens
taaggcaggaagatcgct

SEQ ID NO: 52370 - DNA, 18 bp, Homo sapiens
aaggcaggcaaggcagcc

SEQ ID NO: 52371 - DNA, 20 bp, Homo sapiens
taaggcaaagcatggctatt

SEQ ID NO: 52372 - DNA, 17 bp, Homo sapiens
taaggcaggaactggct

SEQ ID NO: 52373 - DNA, 20 bp, Homo sapiens
aggcaggcaaaaatgctatt

SEQ ID NO: 52374 - DNA, 20 bp, Homo sapiens
aagaaacaaagacagttatt

SEQ ID NO: 52375 - DNA, 19 bp, Homo sapiens
caaggcaggcaaacccact

SEQ ID NO: 52376 - DNA, 19 bp, Homo sapiens
aaggcagggtgcagttatt

SEQ ID NO: 52377 - DNA, 19 bp, Homo sapiens
ggtgaggaaggcagctatt

SEQ ID NO: 52378 - DNA, 19 bp, Homo sapiens
aggcaggaaaacagctatt

SEQ ID NO: 52379 - DNA, 77 bp, Sulfolobus virus SIRV-2
ttgtaatttccaatttacataactaattgaaataattttacaagatgaacaattaattggaattttggaatttacaa

SEQ ID NO: 52380 - DNA, 24 bp, Sulfolobus virus SIRV-2
ttaattggaattttggaatttaca

SEQ ID NO: 52381 - DNA, 22 bp, Homo sapiens
ttaattgtaattaaaatttaca

SEQ ID NO: 52382 - DNA, 23 bp, Homo sapiens
ttaatagggaatacgaatttaca

SEQ ID NO: 52383 - DNA, 21 bp, Homo sapiens
ttaattggaattcttttctct

SEQ ID NO: 52384 - DNA, 22 bp, Homo sapiens
ttaattagaattatggaattta

SEQ ID NO: 52385 - DNA, 22 bp, Homo sapiens
ttaaatgaagttggaatttaca

SEQ ID NO: 52386 - DNA, 19 bp, Homo sapiens
ttaatctcttggaatttac

SEQ ID NO: 52387 - DNA, 64 bp, Sulfolobus virus SIRV-2
aattggaattttggaatttacaattttattaactttttgtaataattttccaagatgtacaatt

SEQ ID NO: 52388 - DNA, 24 bp, Sulfolobus virus SIRV-2
taataattttccaagatgtacaat

SEQ ID NO: 52389 - DNA, 20 bp, Homo sapiens
taatggtcttccaaagatat

SEQ ID NO: 52390 - DNA, 19 bp, Homo sapiens
taatatttttagatgtaca

SEQ ID NO: 52391 - DNA, 20 bp, Homo sapiens
aatttgtgaagatgtacaat

SEQ ID NO: 52392 - DNA, 18 bp, Homo sapiens
taataagtttccaaaata

SEQ ID NO: 52393 - DNA, 19 bp, Homo sapiens
taagaattttccaaaagta

SEQ ID NO: 52394 - DNA, 23 bp, Homo sapiens
aataattttccaagtcttccaat

SEQ ID NO: 52395 - DNA, 19 bp, Homo sapiens
ataattctccagcatcaca

SEQ ID NO: 52396 - DNA, 20 bp, Homo sapiens
taatgatttttcaagatgca

SEQ ID NO: 52397 - DNA, 19 bp, Homo sapiens
ttctccatatgtgtacaat

SEQ ID NO: 52398 - DNA, 18 bp, Homo sapiens
taataatttcccaatagt

SEQ ID NO: 52399 - DNA, 80 bp, Sulfolobus virus SIRV-1
aagaaagctttaaagttaaatatcctgcagatacgatttttccatctgaagttggtatttgttatagaaaaagttatctt

SEQ ID NO: 52400 - DNA, 24 bp, Sulfolobus virus SIRV-1
aagctttaaagttaaatatcctgc

SEQ ID NO: 52401 - DNA, 18 bp, Homo sapiens
agctgtgagaatatcctg

SEQ ID NO: 52402 - DNA, 19 bp, Homo sapiens
agctttgcagttttccctg

SEQ ID NO: 52403 - DNA, 26 bp, Homo sapiens
agctttaaatgagtcaagtattctgc

SEQ ID NO: 52404 - DNA, 18 bp, Homo sapiens
agttttcagtttatcctg

SEQ ID NO: 52405 - DNA, 18 bp, Homo sapiens
agttttaaagtgctcctg

SEQ ID NO: 52406 - DNA, 21 bp, Homo sapiens
ggactcttattaaatatcctg

SEQ ID NO: 52407 - DNA, 19 bp, Homo sapiens
agttttaaagttatttcct

SEQ ID NO: 52408 - DNA, 22 bp, Homo sapiens
aagctttaaaattgcgtcttgc

SEQ ID NO: 52409 - DNA, 18 bp, Homo sapiens
aagctttaaagtatcttg

SEQ ID NO: 52410 - DNA, 24 bp, Homo sapiens
aagctttactgagaaatattttgc

SEQ ID NO: 52411 - DNA, 19 bp, Homo sapiens
agcttttaaagttaaatat

SEQ ID NO: 52412 - DNA, 19 bp, Homo sapiens
gctttaaagttgtgacctg

SEQ ID NO: 52413 - DNA, 16 bp, Homo sapiens
gctttaaaattagctg

SEQ ID NO: 52414 - DNA, 17 bp, Homo sapiens
gcttcaacaatatcctg

SEQ ID NO: 52415 - DNA, 18 bp, Homo sapiens
agcttcttaaatatcttg

SEQ ID NO: 52416 - DNA, 70 bp, Swinepox virus
tgtataacgaggttgctgaatggatattacgagataatacatctccatcacctaataatttctttaaaca

SEQ ID NO: 52417 - DNA, 24 bp, Swinepox virus
tataacgaggttgctgaatggata

SEQ ID NO: 52418 - DNA, 19 bp, Homo sapiens
taatacagttgaatggata

SEQ ID NO: 52419 - DNA, 22 bp, Homo sapiens
tacagcgcctgctgctgaatgg

SEQ ID NO: 52420 - DNA, 17 bp, Homo sapiens
acgatgactgaatggat

SEQ ID NO: 52421 - DNA, 66 bp, Yaba-like disease virus
tatctatcgttggcatttcaagttccgatacacattttattccataaataatgctatttgaagata

SEQ ID NO: 52422 - DNA, 24 bp, Yaba-like disease virus
tctatcgttggcatttcaagttcc

SEQ ID NO: 52423 - DNA, 17 bp, Homo sapiens
gttgaatgccaagttcc

SEQ ID NO: 52424 - DNA, 21 bp, Homo sapiens
tctttcaaggtttcaagttcc

SEQ ID NO: 52425 - DNA, 23 bp, Homo sapiens
tctatcttggcattgtgtggttc

SEQ ID NO: 52426 - DNA, 20 bp, Homo sapiens
ctaaagaggcatttcaggtt

SEQ ID NO: 52427 - DNA, 20 bp, Homo sapiens
tattattggcattttaaagt

SEQ ID NO: 52428 - DNA, 17 bp, Homo sapiens
tcttggagtttcaagtt

SEQ ID NO: 52429 - DNA, 19 bp, Homo sapiens
tatcattgtttttcgagtt

SEQ ID NO: 52430 - DNA, 18 bp, Homo sapiens
tcagagcattttaagttc

SEQ ID NO: 52431 - DNA, 18 bp, Homo sapiens
tctattttggtcaagttc

SEQ ID NO: 52432 - DNA, 21 bp, Homo sapiens
tctcacagcattttaagttcc

SEQ ID NO: 52433 - DNA, 19 bp, Homo sapiens
tctatcattagttcaagtt

SEQ ID NO: 52434 - DNA, 24 bp, Homo sapiens
tctatcattggtatccattgttcc

SEQ ID NO: 52435 - DNA, 22 bp, Homo sapiens
tctatttttaaaaatcaagttc

SEQ ID NO: 52436 - DNA, 64 bp, Yaba-like disease virus
tagcttttattgaatccaaaacatcagttaacaaacaagctaccaaaggatttgtcataagttg

SEQ ID NO: 52437 - DNA, 24 bp, Yaba-like disease virus
ttgaatccaaaacatcagttaaca

SEQ ID NO: 52438 - DNA, 19 bp, Homo sapiens
ttgagaccaaaacaatcaa

SEQ ID NO: 52439 - DNA, 21 bp, Homo sapiens
ttgactctgggacatcaatca

SEQ ID NO: 52440 - DNA, 19 bp, Homo sapiens
ttgaacctaaaacatcagc

SEQ ID NO: 52441 - DNA, 17 bp, Homo sapiens
ttgagccaaaacaacag

SEQ ID NO: 52442 - DNA, 18 bp, Homo sapiens
tgaatccaagacagcaac

SEQ ID NO: 52443 - DNA, 22 bp, Homo sapiens
ttggaccaaaacagatccaaca

SEQ ID NO: 52444 - DNA, 21 bp, Homo sapiens
tgaatccagaagcacttaaca

SEQ ID NO: 52445 - DNA, 18 bp, Homo sapiens
ttaaatccaaagtcaatc

SEQ ID NO: 52446 - DNA, 18 bp, Homo sapiens
ttgaatccaggcagcagc

SEQ ID NO: 52447 - DNA, 19 bp, Homo sapiens
ttggatccaaaacatgtta

SEQ ID NO: 52448 - DNA, 18 bp, Homo sapiens
ttgaacccagaataccag

SEQ ID NO: 52449 - DNA, 22 bp, Homo sapiens
tgagtctaaaacatcaggtcaa

SEQ ID NO: 52450 - DNA, 20 bp, Homo sapiens
ttgatcttcaacatcagtta

SEQ ID NO: 52451 - DNA, 19 bp, Homo sapiens
tgaatccaaaatgaatcag

SEQ ID NO: 52452 - DNA, 62 bp, Human herpesvirus 6
gtatgaaactttatgaggaactggtgagaaataacttacggttatgatttcggtttcgtcgc

SEQ ID NO: 52453 - DNA, 24 bp, Human herpesvirus 6
aactttatgaggaactggtgagaa

SEQ ID NO: 52454 - DNA, 22 bp, Homo sapiens
aactttacggggttcatgggga

SEQ ID NO: 52455 - DNA, 16 bp, Homo sapiens
ctttatgagaggtgag

SEQ ID NO: 52456 - DNA, 18 bp, Homo sapiens
actttatgaatagtggtg

SEQ ID NO: 52457 - DNA, 22 bp, Homo sapiens
ctttatgaggaggtcgtgggag

SEQ ID NO: 52458 - DNA, 18 bp, Homo sapiens
aacttatgaggggaagtg

SEQ ID NO: 52459 - DNA, 19 bp, Homo sapiens
actttgcagctggtgagaa

SEQ ID NO: 52460 - DNA, 19 bp, Homo sapiens
tttaagagggaagtaagaa

SEQ ID NO: 52461 - DNA, 20 bp, Homo sapiens
actctatgggggacagagga

SEQ ID NO: 52462 - DNA, 21 bp, Homo sapiens
aacttcatggtggtggtggga

SEQ ID NO: 52463 - DNA, 20 bp, Homo sapiens
tttataaggaatctgaagag

SEQ ID NO: 52464 - DNA, 15 bp, Homo sapiens
ctctacgctggtgag

SEQ ID NO: 52465 - DNA, 20 bp, Homo sapiens
ctttatgaggaataggagaa

SEQ ID NO: 52466 - DNA, 18 bp, Homo sapiens
tttataaaccatggtgag

SEQ ID NO: 52467 - DNA, 19 bp, Homo sapiens
tttatgaggaaacttttaa

SEQ ID NO: 52468 - DNA, 16 bp, Homo sapiens
ctctatgaggagtgga

SEQ ID NO: 52469 - DNA, 18 bp, Homo sapiens
aactttatggagggggaa

SEQ ID NO: 52470 - DNA, 19 bp, Homo sapiens
tttgtgaggaacaagtgag

SEQ ID NO: 52471 - DNA, 19 bp, Homo sapiens
tttatgaagaaactaagag

SEQ ID NO: 52472 - DNA, 16 bp, Homo sapiens
ctttgtgagaatgaga

SEQ ID NO: 52473 - DNA, 18 bp, Homo sapiens
aactgtgtgaggaaggga

SEQ ID NO: 52474 - DNA, 18 bp, Homo sapiens
aactctatgagggaggga

SEQ ID NO: 52475 - DNA, 17 bp, Homo sapiens
ttcatgaggagtgtgga

SEQ ID NO: 52476 - DNA, 17 bp, Homo sapiens
ctttatgaggctgagga

SEQ ID NO: 52477 - DNA, 17 bp, Homo sapiens
aacttcatgaggaaagg

SEQ ID NO: 52478 - DNA, 21 bp, Homo sapiens
aactttttgagggataatgaa

SEQ ID NO: 52479 - DNA, 16 bp, Homo sapiens
aactttataggaatga

SEQ ID NO: 52480 - DNA, 19 bp, Homo sapiens
cttatgaggagaaattaga

SEQ ID NO: 52481 - DNA, 19 bp, Homo sapiens
tttatgaaggaaccgtgaa

SEQ ID NO: 52482 - DNA, 19 bp, Homo sapiens
aactctgggagctggtgag

SEQ ID NO: 52483 - DNA, 20 bp, Homo sapiens
ctttacgagggaggcggaga

SEQ ID NO: 52484 - DNA, 19 bp, Homo sapiens
ttatgaaacactggtggga

SEQ ID NO: 52485 - DNA, 19 bp, Homo sapiens
aactttatgagaattccag

SEQ ID NO: 52486 - DNA, 16 bp, Homo sapiens
ctttatgaggaaaaga

SEQ ID NO: 52487 - DNA, 21 bp, Homo sapiens
actgtatgaggacaaagggag

SEQ ID NO: 52488 - DNA, 19 bp, Homo sapiens
aacttttgtgaggaatagg

SEQ ID NO: 52489 - DNA, 18 bp, Homo sapiens
ctttatgagggggcagag

SEQ ID NO: 52490 - DNA, 20 bp, Homo sapiens
tttatgaagccatctgagag

SEQ ID NO: 52491 - DNA, 130 bp, Human herpesvirus 6
cacaaaatgattagatgcttaacttacttaataactatacttaactatacttatagactaaacttaacttatcaactatacttaatttttaggtccttataatgtgaactaaataatcaactgttttgtg

SEQ ID NO: 52492 - DNA, 24 bp, Human herpesvirus 6
tatacttaactatacttatagact

SEQ ID NO: 52493 - DNA, 18 bp, Homo sapiens
catacttaaccttataga

SEQ ID NO: 52494 - DNA, 22 bp, Homo sapiens
tactgaacagtcattatagact

SEQ ID NO: 52495 - DNA, 18 bp, Homo sapiens
tgacttaattatactcat

SEQ ID NO: 52496 - DNA, 19 bp, Homo sapiens
ttaactcataccatagact

SEQ ID NO: 52497 - DNA, 112 bp, Hendra virus
tctcagtagtagtaagtctcactggtgatgggatacaagtgcaagttccttttcaaatggtgctcaaatctaaggatcctcttgctgaataggctatctactatgcactgga

SEQ ID NO: 52498 - DNA, 24 bp, Hendra virus
tcttgctgaataggctatctacta

SEQ ID NO: 52499 - DNA, 22 bp, Homo sapiens
ccttgctgcattgttatctgct

SEQ ID NO: 52500 - DNA, 15 bp, Homo sapiens
ctgctgaacgcatct

SEQ ID NO: 52501 - DNA, 21 bp, Homo sapiens
tcttgctgaggggcatcggct

SEQ ID NO: 52502 - DNA, 22 bp, Homo sapiens
tcctgctgagtgggtcattact

SEQ ID NO: 52503 - DNA, 21 bp, Homo sapiens
tcttgctggtaatatattgct

SEQ ID NO: 52504 - DNA, 21 bp, Homo sapiens
tcttgctaatgggttcctcta

SEQ ID NO: 52505 - DNA, 20 bp, Homo sapiens
tcttgctgaaaacagttact

SEQ ID NO: 52506 - DNA, 17 bp, Homo sapiens
tcttctgggtagactat

SEQ ID NO: 52507 - DNA, 19 bp, Homo sapiens
ttgatgaataggttcacta

SEQ ID NO: 52508 - DNA, 19 bp, Homo sapiens
tcttgctggagacaggtct

SEQ ID NO: 52509 - DNA, 18 bp, Homo sapiens
ccttgctgagtagatgct

SEQ ID NO: 52510 - DNA, 18 bp, Homo sapiens
ttgctgaattacacctct

SEQ ID NO: 52511 - DNA, 23 bp, Homo sapiens
tcttactgccagcgttatctact

SEQ ID NO: 52512 - DNA, 86 bp, Human papillomavirus type 54
gtaataatgttgtatacagtaagttggttaacatgttggtttttattatccatgttattatggcaatgtattacaacagcatttac

SEQ ID NO: 52513 - DNA, 24 bp, Human papillomavirus type 54
tattatggcaatgtattacaacag

SEQ ID NO: 52514 - DNA, 21 bp, Homo sapiens
tattatggcacatgtgttaca

SEQ ID NO: 52515 - DNA, 18 bp, Homo sapiens
ttatacagtattacaaca

SEQ ID NO: 52516 - DNA, 23 bp, Homo sapiens
ttatggcatatctgaaacagcag

SEQ ID NO: 52517 - DNA, 20 bp, Homo sapiens
ctatggcaatgtagtttaca

SEQ ID NO: 52518 - DNA, 71 bp, Human papillomavirus type 54
attgtacatactatattgtaaaacaaccagccaatactgctgctatgtgtatatagtgaggtatgtatggt

SEQ ID NO: 52519 - DNA, 24 bp, Human papillomavirus type 54
tgctatgtgtatatagtgaggtat

SEQ ID NO: 52520 - DNA, 18 bp, Homo sapiens
tgccgtgaatagtgaggt

SEQ ID NO: 52521 - DNA, 19 bp, Homo sapiens
tgcatatgtgtgtgtgcat

SEQ ID NO: 52522 - DNA, 21 bp, Homo sapiens
tgctatgtgcatatgggaagt

SEQ ID NO: 52523 - DNA, 23 bp, Homo sapiens
tgtctgtgtgtatatacatgtat

SEQ ID NO: 52524 - DNA, 18 bp, Homo sapiens
tgtatgtgtatgtatgtg

SEQ ID NO: 52525 - DNA, 16 bp, Homo sapiens
tgctatgcgtgtgtgg

SEQ ID NO: 52526 - DNA, 16 bp, Homo sapiens
tgtatgtgtacatgta

SEQ ID NO: 52527 - DNA, 16 bp, Homo sapiens
tgtgtaaagtgaggta

SEQ ID NO: 52528 - DNA, 24 bp, Homo sapiens
tgtatgtgtagcagggtgaggtat

SEQ ID NO: 52529 - DNA, 17 bp, Homo sapiens
tgctatatgtgtgtgag

SEQ ID NO: 52530 - DNA, 19 bp, Homo sapiens
cacggatgtagtgaggtat

SEQ ID NO: 52531 - DNA, 18 bp, Homo sapiens
tgtctatgtgtgtgtgta

SEQ ID NO: 52532 - DNA, 18 bp, Homo sapiens
tgcatgtgtatatatgtg

SEQ ID NO: 52533 - DNA, 19 bp, Homo sapiens
tgcatgtgtatgtgtgcat

SEQ ID NO: 52534 - DNA, 16 bp, Homo sapiens
tgttatgtggtaaggt

SEQ ID NO: 52535 - DNA, 17 bp, Homo sapiens
tgttatgtgtatatgtg

SEQ ID NO: 52536 - DNA, 19 bp, Homo sapiens
tgtgcagctggtgaggtat

SEQ ID NO: 52537 - DNA, 16 bp, Homo sapiens
tgcatgtgtgtatgtg

SEQ ID NO: 52538 - DNA, 18 bp, Homo sapiens
tgcatgtgtatgtatgtg

SEQ ID NO: 52539 - DNA, 16 bp, Homo sapiens
tgtatgtgtatatgtg

SEQ ID NO: 52540 - DNA, 19 bp, Homo sapiens
tgtgtatatggcacaaggt

SEQ ID NO: 52541 - DNA, 17 bp, Homo sapiens
tgccatgtgtgtgtggt

SEQ ID NO: 52542 - DNA, 21 bp, Homo sapiens
tgtatgtgtatatgtctgtat

SEQ ID NO: 52543 - DNA, 22 bp, Homo sapiens
tgttctgtgtatatataagtat

SEQ ID NO: 52544 - DNA, 18 bp, Homo sapiens
tgtatgtgtatatatgtg

SEQ ID NO: 52545 - DNA, 19 bp, Homo sapiens
tgttatgtgtatatatgta

SEQ ID NO: 52546 - DNA, 17 bp, Homo sapiens
tgtctgtatatatagtg

SEQ ID NO: 52547 - DNA, 18 bp, Homo sapiens
tgcatatgtgtgtatgtg

SEQ ID NO: 52548 - DNA, 114 bp, Infectious spleen and kidney necrosis virus
tgcactgcggtcatcgtctccacggtccactcctcctcaagctctttggcagacggcacatactcatcggccgcggggcgtagagtggccagtgtagaattgaccgtgtctgta

SEQ ID NO: 52549 - DNA, 24 bp, Infectious spleen and kidney necrosis virus
tccacggtccactcctcctcaagc

SEQ ID NO: 52550 - DNA, 23 bp, Homo sapiens
cggcctagagctcctcctcgggc

SEQ ID NO: 52551 - DNA, 25 bp, Homo sapiens
cccaccttcatgtttcttttcaagc

SEQ ID NO: 52552 - DNA, 16 bp, Homo sapiens
ggttcctccccacagc

SEQ ID NO: 52553 - DNA, 20 bp, Homo sapiens
tcctggctgcttcctcctca

SEQ ID NO: 52554 - DNA, 20 bp, Homo sapiens
gctgcagctcctcctcaggc

SEQ ID NO: 52555 - DNA, 18 bp, Homo sapiens
tccacggcccgctcctcc

SEQ ID NO: 52556 - DNA, 21 bp, Homo sapiens
agcctagctttctcctcaagc

SEQ ID NO: 52557 - DNA, 23 bp, Homo sapiens
tccagggctacctcctccttaag

SEQ ID NO: 52558 - DNA, 21 bp, Homo sapiens
acagcccactccttctcaggc

SEQ ID NO: 52559 - DNA, 18 bp, Homo sapiens
caaccgcttctcctcaag

SEQ ID NO: 52560 - DNA, 22 bp, Homo sapiens
tccctctccctcctcctcaggc

SEQ ID NO: 52561 - DNA, 22 bp, Homo sapiens
ccctgcctgctcctccttgagc

SEQ ID NO: 52562 - DNA, 19 bp, Homo sapiens
cacagtcagttcctcaagc

SEQ ID NO: 52563 - DNA, 23 bp, Homo sapiens
tccacagtccatttcatacaggc

SEQ ID NO: 52564 - DNA, 16 bp, Homo sapiens
cacagtccagctcaag

SEQ ID NO: 52565 - DNA, 18 bp, Homo sapiens
tcccggcgcctcctcaag

SEQ ID NO: 52566 - DNA, 18 bp, Homo sapiens
acagagctcttcctcaag

SEQ ID NO: 52567 - DNA, 22 bp, Homo sapiens
tccatggcccactgagcaacct

SEQ ID NO: 52568 - DNA, 21 bp, Homo sapiens
catggtctacctcgttcaggc

SEQ ID NO: 52569 - DNA, 19 bp, Homo sapiens
tccactgtcctccctcaag

SEQ ID NO: 52570 - DNA, 18 bp, Homo sapiens
cacggacacctcctcaag

SEQ ID NO: 52571 - DNA, 18 bp, Homo sapiens
cccactcctcctcctcag

SEQ ID NO: 52572 - DNA, 19 bp, Homo sapiens
cacacccttcttcctcaag

SEQ ID NO: 52573 - DNA, 75 bp, Murid herpesvirus 4
ggttctctgttaatgactcatcccataagtggtggtctggtgaccaagaacttagtctgaagggtcacagcgacc

SEQ ID NO: 52574 - DNA, 24 bp, Murid herpesvirus 4
ttaatgactcatcccataagtggt

SEQ ID NO: 52575 - DNA, 27 bp, Homo sapiens
taatgactcattttattaccacttatg

SEQ ID NO: 52576 - DNA, 17 bp, Homo sapiens
tgactcatcccacactg

SEQ ID NO: 52577 - DNA, 66 bp, Murid herpesvirus 4
cactttctgtggtgccttatgaatcagacctagctacacttttctgattcatgtgctacctctgtg

SEQ ID NO: 52578 - DNA, 24 bp, Murid herpesvirus 4
tctgtggtgccttatgaatcagac

SEQ ID NO: 52579 - DNA, 20 bp, Homo sapiens
tctgtgtgttagtgaatcag

SEQ ID NO: 52580 - DNA, 23 bp, Homo sapiens
tctgtggtcttttaattgaagac

SEQ ID NO: 52581 - DNA, 19 bp, Homo sapiens
tgtggtgccttgatcagac

SEQ ID NO: 52582 - DNA, 22 bp, Homo sapiens
tctgtgctgccccacgttggac

SEQ ID NO: 52583 - DNA, 20 bp, Homo sapiens
tggtcttcttgtgagtcaga

SEQ ID NO: 52584 - DNA, 23 bp, Homo sapiens
tctgtagtgttgtagaaatcgga

SEQ ID NO: 52585 - DNA, 18 bp, Homo sapiens
tctgtggtgcctgagcag

SEQ ID NO: 52586 - DNA, 16 bp, Homo sapiens
tgtgtgcagaatcaga

SEQ ID NO: 52587 - DNA, 17 bp, Homo sapiens
tggggggcatgaatcag

SEQ ID NO: 52588 - DNA, 17 bp, Homo sapiens
tctgtgctgcccatcag

SEQ ID NO: 52589 - DNA, 23 bp, Homo sapiens
tctgtagtgctggaatgagtcag

SEQ ID NO: 52590 - DNA, 18 bp, Homo sapiens
tctgtggttccagtcaga

SEQ ID NO: 52591 - DNA, 16 bp, Homo sapiens
tatgggatgaatcaga

SEQ ID NO: 52592 - DNA, 18 bp, Homo sapiens
tctgtggtgtcattaaca

SEQ ID NO: 52593 - DNA, 89 bp, Human herpesvirus 6
tatgggaatattctggtaaaagtgcatgtatcaattttagtcgtttttggatttctgtaatgttacgatttgctatgtgtattttcatg

SEQ ID NO: 52594 - DNA, 24 bp, Human herpesvirus 6
aaagtgcatgtatcaattttagtc

SEQ ID NO: 52595 - DNA, 23 bp, Homo sapiens
aagtgcatgtttgggacagcagt

SEQ ID NO: 52596 - DNA, 22 bp, Homo sapiens
aaagatgcaaacagttttagtc

SEQ ID NO: 52597 - DNA, 21 bp, Homo sapiens
agtgcaggcccaattttggtc

SEQ ID NO: 52598 - DNA, 18 bp, Homo sapiens
aaagtgcaggtgttcagt

SEQ ID NO: 52599 - DNA, 18 bp, Homo sapiens
aaagtgcagatttttagt

SEQ ID NO: 52600 - DNA, 27 bp, Homo sapiens
aaagtgcatatgttggtgtagctagtc

SEQ ID NO: 52601 - DNA, 19 bp, Homo sapiens
aaagtgcattgtcttcagt

SEQ ID NO: 52602 - DNA, 21 bp, Homo sapiens
agagctgtaacaaattttagt

SEQ ID NO: 52603 - DNA, 23 bp, Homo sapiens
aaagtgcagtgtatcttagagtc

SEQ ID NO: 52604 - DNA, 20 bp, Homo sapiens
aagtgcatatattttctagt

SEQ ID NO: 52605 - DNA, 20 bp, Homo sapiens
aaaatgcaaacagttttagt

SEQ ID NO: 52606 - DNA, 100 bp, Foot-and-mouth disease virus SAT 2
gcggggccgaaagccacgttctctgaaccttgcgtgtgtgcaaccccagcacggtaatactgtcatgaaacacactttaaggtaacactgagactggtac

SEQ ID NO: 52607 - DNA, 24 bp, Foot-and-mouth disease virus SAT 2
tctctgaaccttgcgtgtgtgcaa

SEQ ID NO: 52608 - DNA, 19 bp, Homo sapiens
tgagcgactactgtgtgca

SEQ ID NO: 52609 - DNA, 16 bp, Homo sapiens
cctctgaggtgtgtgc

SEQ ID NO: 52610 - DNA, 16 bp, Homo sapiens
cctctgtgtgtgtgtg

SEQ ID NO: 52611 - DNA, 19 bp, Homo sapiens
tgaggcttccaatgtgcaa

SEQ ID NO: 52612 - DNA, 19 bp, Homo sapiens
tcctgtccgtgtgtgtgca

SEQ ID NO: 52613 - DNA, 18 bp, Homo sapiens
tctctgaatctttgccgc

SEQ ID NO: 52614 - DNA, 24 bp, Homo sapiens
cctctgaacagactgtgtgtgcaa

SEQ ID NO: 52615 - DNA, 21 bp, Homo sapiens
tctctgtcgtgtgtgtgtgtg

SEQ ID NO: 52616 - DNA, 16 bp, Homo sapiens
tgaatgttgtgtgcaa

SEQ ID NO: 52617 - DNA, 17 bp, Homo sapiens
tctgaaccatgtatgtg

SEQ ID NO: 52618 - DNA, 23 bp, Homo sapiens
tctttgtattcgtgtgtgtgcaa

SEQ ID NO: 52619 - DNA, 22 bp, Homo sapiens
cctgggttttgtacgtatgcaa

SEQ ID NO: 52620 - DNA, 17 bp, Homo sapiens
tctaactcctgtgtgca

SEQ ID NO: 52621 - DNA, 21 bp, Homo sapiens
tctctggatcttgtatgtgca

SEQ ID NO: 52622 - DNA, 19 bp, Homo sapiens
cctgggtgctgcgtgtgtg

SEQ ID NO: 52623 - DNA, 21 bp, Homo sapiens
ctgagcacctgctgtgtgcaa

SEQ ID NO: 52624 - DNA, 19 bp, Homo sapiens
tcagaatactgtgtgtgca

SEQ ID NO: 52625 - DNA, 20 bp, Homo sapiens
tctctgaaatttttggtgca

SEQ ID NO: 52626 - DNA, 19 bp, Homo sapiens
cctctgaatcttacgtgta

SEQ ID NO: 52627 - DNA, 20 bp, Homo sapiens
cctctggatttccatgtgca

SEQ ID NO: 52628 - DNA, 20 bp, Homo sapiens
tcttttaaccttgctgtgca

SEQ ID NO: 52629 - DNA, 22 bp, Homo sapiens
tcactgggaagctgtgtgtgca

SEQ ID NO: 52630 - DNA, 20 bp, Homo sapiens
tctgaacttttcgcgtgcaa

SEQ ID NO: 52631 - DNA, 25 bp, Homo sapiens
tctctgaacttatttaaaatgtgtg

SEQ ID NO: 52632 - DNA, 21 bp, Homo sapiens
ctttgaatcttctcatgtgta

SEQ ID NO: 52633 - DNA, 19 bp, Homo sapiens
tctgaaccttgtccttgta

SEQ ID NO: 52634 - DNA, 84 bp, Fowlpox virus
gacgtattaacttttccatcttctatattaggattagttgttttatactttcttctattataattgagttgttgtttttacgtc

SEQ ID NO: 52635 - DNA, 24 bp, Fowlpox virus
tctatattaggattagttgtttta

SEQ ID NO: 52636 - DNA, 18 bp, Homo sapiens
tattaggtagttgtttta

SEQ ID NO: 52637 - DNA, 19 bp, Homo sapiens
ttaggattatctgatttta

SEQ ID NO: 52638 - DNA, 21 bp, Homo sapiens
cctatattaggataaggtttt

SEQ ID NO: 52639 - DNA, 86 bp, Fowlpox virus
tgtagttttagtgtatagatattatacagatttgatttatctattatatcgctttccatgtgtataagctatttactattattcca

SEQ ID NO: 52640 - DNA, 24 bp, Fowlpox virus
tatacagatttgatttatctatta

SEQ ID NO: 52641 - DNA, 18 bp, Homo sapiens
tatacagatttgcttttc

SEQ ID NO: 52642 - DNA, 20 bp, Homo sapiens
acagatgcctatatctatta

SEQ ID NO: 52643 - DNA, 22 bp, Homo sapiens
tatacagatgttgatttactct

SEQ ID NO: 52644 - DNA, 109 bp, Fowlpox virus
gattagttatattctatgtaataataacgattacatgtatataacatatactatttctattttcttatgttatataaaaaagttatttatttacataataagacttttc

SEQ ID NO: 52645 - DNA, 24 bp, Fowlpox virus
tctatgtaataataacgattacat

SEQ ID NO: 52646 - DNA, 22 bp, Homo sapiens
tctatgtaataatgatgagaac

SEQ ID NO: 52647 - DNA, 23 bp, Homo sapiens
tctatgcacatatgtgattacat

SEQ ID NO: 52648 - DNA, 22 bp, Homo sapiens
tatgtaataatggtgaacacat

SEQ ID NO: 52649 - DNA, 86 bp, Simian T-lymphotropic virus 1
gtccgccgtctaggtaagtttagagctcaggtcgagaccgggcctttgtccggcgctcccttagagcctacctagactcagccggc

SEQ ID NO: 52650 - DNA, 65 bp, Simian T-lymphotropic virus 1
gccgccctacctgaggccgccatccacgccggttgagtcgcgttctgccgcctcccgcctgtggt

SEQ ID NO: 52651 - DNA, 21 bp, Simian T-lymphotropic virus 1
ctgccgcctcccgcctgtggt

SEQ ID NO: 52652 - DNA, 16 bp, Homo sapiens
ctgccgccgcccatgg

SEQ ID NO: 52653 - DNA, 19 bp, Homo sapiens
ccgccgcctcctcacgggt

SEQ ID NO: 52654 - DNA, 19 bp, Homo sapiens
gccgcctccttggtgtggt

SEQ ID NO: 52655 - DNA, 19 bp, Homo sapiens
ctgccgccgccatcttggt

SEQ ID NO: 52656 - DNA, 19 bp, Homo sapiens
ccgccgcctctcgccgggt

SEQ ID NO: 52657 - DNA, 18 bp, Homo sapiens
ctgccgcctacccgagct

SEQ ID NO: 52658 - DNA, 22 bp, Homo sapiens
ctgcccctccccgctctgtggt

SEQ ID NO: 52659 - DNA, 17 bp, Homo sapiens
ctgccgcctcccgccgc

SEQ ID NO: 52660 - DNA, 20 bp, Homo sapiens
ctgccgcctgcccgcccagc

SEQ ID NO: 52661 - DNA, 16 bp, Homo sapiens
ccgctgcctcccacgg

SEQ ID NO: 52662 - DNA, 16 bp, Homo sapiens
ctgcctctcccgccgc

SEQ ID NO: 52663 - DNA, 25 bp, Homo sapiens
ctgccgcctctctccaccacaggcg

SEQ ID NO: 52664 - DNA, 23 bp, Homo sapiens
ctgccgcctctgcgcaggcgcgt

SEQ ID NO: 52665 - DNA, 20 bp, Homo sapiens
ctgccccaaatacctgtggt

SEQ ID NO: 52666 - DNA, 16 bp, Homo sapiens
ctgtgcctcccagcgg

SEQ ID NO: 52667 - DNA, 16 bp, Homo sapiens
ccgccgcctcctcagg

SEQ ID NO: 52668 - DNA, 20 bp, Homo sapiens
gccgcctctcccggagtggt

SEQ ID NO: 52669 - DNA, 19 bp, Homo sapiens
ctgccgccgtctgcgccgc

SEQ ID NO: 52670 - DNA, 18 bp, Homo sapiens
ctgccgcctccgctccgt

SEQ ID NO: 52671 - DNA, 22 bp, Homo sapiens
ctgccgccgcccgcgggcgcgt

SEQ ID NO: 52672 - DNA, 25 bp, Homo sapiens
ccgccgccttctggtaccacaggcg

SEQ ID NO: 52673 - DNA, 25 bp, Homo sapiens
ccgccgcctcttgctaccacaggcg

SEQ ID NO: 52674 - DNA, 20 bp, Homo sapiens
ctgctgtctcaccctgtggt

SEQ ID NO: 52675 - DNA, 20 bp, Homo sapiens
ctgccgccttcgacccaggt

SEQ ID NO: 52676 - DNA, 19 bp, Homo sapiens
ctgccgccctccccggggt

SEQ ID NO: 52677 - DNA, 21 bp, Homo sapiens
ctgcccgcctcccgcagcagt

SEQ ID NO: 52678 - DNA, 21 bp, Homo sapiens
ctgcagcctctggtgtgtggt

SEQ ID NO: 52679 - DNA, 18 bp, Homo sapiens
ctgtcgccccccgcgagc

SEQ ID NO: 52680 - DNA, 19 bp, Homo sapiens
ctgccgcctccggccacgt

SEQ ID NO: 52681 - DNA, 17 bp, Homo sapiens
ctgctgccacccgccgc

SEQ ID NO: 52682 - DNA, 18 bp, Homo sapiens
cgtcgcctctcgcgccgc

SEQ ID NO: 52683 - DNA, 25 bp, Homo sapiens
ctgccgcctctctcaaccacaggcg

SEQ ID NO: 52684 - DNA, 18 bp, Homo sapiens
ctgccgtctccttcgcct

SEQ ID NO: 52685 - DNA, 17 bp, Homo sapiens
gccgcctctcgccgggt

SEQ ID NO: 52686 - DNA, 17 bp, Homo sapiens
ccgccgcctcccggcag

SEQ ID NO: 52687 - DNA, 18 bp, Homo sapiens
ctgtcgcctcccagtcct

SEQ ID NO: 52688 - DNA, 21 bp, Homo sapiens
gcatcctctttcgcctgtggt

SEQ ID NO: 52689 - DNA, 16 bp, Homo sapiens
ccgcctcctccccggt

SEQ ID NO: 52690 - DNA, 20 bp, Homo sapiens
gccgcctctcccagcatggt

SEQ ID NO: 52691 - DNA, 22 bp, Homo sapiens
ctgccacctccctgaccatggt

SEQ ID NO: 52692 - DNA, 18 bp, Homo sapiens
ctgttgccgcccgcccgc

SEQ ID NO: 52693 - DNA, 19 bp, Homo sapiens
ctgctgcctcccgagcagt

SEQ ID NO: 52694 - DNA, 15 bp, Homo sapiens
ccgcctcccgcgggt

SEQ ID NO: 52695 - DNA, 24 bp, Homo sapiens
ctgccgcctctggtaccacaggcg

SEQ ID NO: 52696 - DNA, 19 bp, Homo sapiens
ccgccgcctctccgcaggt

SEQ ID NO: 52697 - DNA, 18 bp, Homo sapiens
tgctgccatccccatggt

SEQ ID NO: 52698 - DNA, 15 bp, Homo sapiens
ccgccgcctcctgtg

SEQ ID NO: 52699 - DNA, 19 bp, Homo sapiens
ctgccgccgtctgctccgt

SEQ ID NO: 52700 - DNA, 19 bp, Homo sapiens
ctgccgcctgagatgtggt

SEQ ID NO: 52701 - DNA, 15 bp, Homo sapiens
ccgccgcctcccggg

SEQ ID NO: 52702 - DNA, 20 bp, Homo sapiens
ctgcctcctcccgtgatggt

SEQ ID NO: 52703 - DNA, 20 bp, Homo sapiens
ctgccgcctgccgcgcctgt

SEQ ID NO: 52704 - DNA, 20 bp, Homo sapiens
ctgctgcctcccacagcgat

SEQ ID NO: 52705 - DNA, 19 bp, Homo sapiens
ccgccgccttcttgctggt

SEQ ID NO: 52706 - DNA, 16 bp, Homo sapiens
gccgcctctcgcgggc

SEQ ID NO: 52707 - DNA, 17 bp, Homo sapiens
gctgcctcccagccggt

SEQ ID NO: 52708 - DNA, 18 bp, Homo sapiens
ctgcagcctctccagggt

SEQ ID NO: 52709 - DNA, 20 bp, Homo sapiens
ctgttctctcccaccatggt

SEQ ID NO: 52710 - DNA, 18 bp, Homo sapiens
ctgctgccacctgctggt

SEQ ID NO: 52711 - DNA, 18 bp, Homo sapiens
ctgtcccctccctgtggt

SEQ ID NO: 52712 - DNA, 18 bp, Homo sapiens
tgtcacctcccgcacagt

SEQ ID NO: 52713 - DNA, 15 bp, Homo sapiens
ctgccacctcctgtg

SEQ ID NO: 52714 - DNA, 20 bp, Homo sapiens
ctgcggcctcccggggccgt

SEQ ID NO: 52715 - DNA, 25 bp, Homo sapiens
ctgccgcctctctctaccacaggcg

SEQ ID NO: 52716 - DNA, 15 bp, Homo sapiens
ctgccgcctgccggt

SEQ ID NO: 52717 - DNA, 18 bp, Homo sapiens
ccgccgtctcccgccggt

SEQ ID NO: 52718 - DNA, 20 bp, Homo sapiens
ctgttgccacccgcggcgat

SEQ ID NO: 52719 - DNA, 20 bp, Homo sapiens
tgtcgcctcccggagctggt

SEQ ID NO: 52720 - DNA, 20 bp, Homo sapiens
ctgtcatctcttcctatggt

SEQ ID NO: 52721 - DNA, 18 bp, Homo sapiens
ctgtccctctcgcccgcg

SEQ ID NO: 52722 - DNA, 21 bp, Homo sapiens
ctgcctttcctgccacggagt

SEQ ID NO: 52723 - DNA, 16 bp, Homo sapiens
ctgccgcctcctcggg

SEQ ID NO: 52724 - DNA, 19 bp, Homo sapiens
ctgccgcccctggggtggt

SEQ ID NO: 52725 - DNA, 21 bp, Homo sapiens
ctgccgccgtcctgccgccgt

SEQ ID NO: 52726 - DNA, 21 bp, Homo sapiens
ctgccgccgtctcgccgcccg

SEQ ID NO: 52727 - DNA, 18 bp, Homo sapiens
ctgccacctgccgcgcgt

SEQ ID NO: 52728 - DNA, 17 bp, Homo sapiens
ctgccgcccctgcttgt

SEQ ID NO: 52729 - DNA, 16 bp, Homo sapiens
ctgctgccacctgtag

SEQ ID NO: 52730 - DNA, 25 bp, Homo sapiens
ctgccgccatctgctaccacaggcg

SEQ ID NO: 52731 - DNA, 20 bp, Homo sapiens
tgtcgcctcccgccctaggt

SEQ ID NO: 52732 - DNA, 19 bp, Homo sapiens
ctgtctcctccactgtggt

SEQ ID NO: 52733 - DNA, 16 bp, Homo sapiens
ctgccgctcccgccgc

SEQ ID NO: 52734 - DNA, 21 bp, Homo sapiens
ctgtggctccctgcctgtggt

SEQ ID NO: 52735 - DNA, 21 bp, Homo sapiens
ctgccgccttcctgggcctgt

SEQ ID NO: 52736 - DNA, 20 bp, Homo sapiens
ccgccgcctcccgctcaggt

SEQ ID NO: 52737 - DNA, 19 bp, Homo sapiens
ctgccgccttgtcactggt

SEQ ID NO: 52738 - DNA, 20 bp, Homo sapiens
gctgcctcccgtacagcggt

SEQ ID NO: 52739 - DNA, 18 bp, Homo sapiens
ctgtccctccccccaggt

SEQ ID NO: 52740 - DNA, 19 bp, Homo sapiens
ctcccgcctcctccatggt

SEQ ID NO: 52741 - DNA, 18 bp, Homo sapiens
ctgctcgcctcccgtgat

SEQ ID NO: 52742 - DNA, 17 bp, Homo sapiens
ctgtctcccgcctcggt

SEQ ID NO: 52743 - DNA, 16 bp, Homo sapiens
ctgctgccacctgtga

SEQ ID NO: 52744 - DNA, 16 bp, Homo sapiens
tgccgccgcccgtggc

SEQ ID NO: 52745 - DNA, 19 bp, Homo sapiens
gccgcctccagcaggtggt

SEQ ID NO: 52746 - DNA, 18 bp, Homo sapiens
ctgctgccaccctgtggt

SEQ ID NO: 52747 - DNA, 18 bp, Homo sapiens
ctgctggcctcccttggt

SEQ ID NO: 52748 - DNA, 21 bp, Homo sapiens
ctactgctcatgacctgtggt

SEQ ID NO: 52749 - DNA, 20 bp, Homo sapiens
ctgccgcccctcgcgcaggt

SEQ ID NO: 52750 - DNA, 24 bp, Homo sapiens
ctgccgcccctgctaccacaggcg

SEQ ID NO: 52751 - DNA, 18 bp, Homo sapiens
ccgccgcctcccggcagt

SEQ ID NO: 52752 - DNA, 19 bp, Homo sapiens
tgctgtctgcacccgtggt

SEQ ID NO: 52753 - DNA, 19 bp, Homo sapiens
ccgccgcctcccgccctgt

SEQ ID NO: 52754 - DNA, 16 bp, Homo sapiens
ctgctgctcccgccgc

SEQ ID NO: 52755 - DNA, 18 bp, Homo sapiens
tgtccacatgcctgtggt

SEQ ID NO: 52756 - DNA, 18 bp, Homo sapiens
ccgccgcctcctctcggt

SEQ ID NO: 52757 - DNA, 19 bp, Homo sapiens
ctcccgcctcccgtcccac

SEQ ID NO: 52758 - DNA, 17 bp, Homo sapiens
ccgcctcctgcccgagt

SEQ ID NO: 52759 - DNA, 19 bp, Homo sapiens
ccgccgcctccgtgctggt

SEQ ID NO: 52760 - DNA, 20 bp, Homo sapiens
ctgccgccccccgccgccat

SEQ ID NO: 52761 - DNA, 20 bp, Homo sapiens
ctgccgccattctgacctgt

SEQ ID NO: 52762 - DNA, 18 bp, Homo sapiens
ctggactccgcctgtggt

SEQ ID NO: 52763 - DNA, 18 bp, Homo sapiens
ctgcagcctcccgggggt

SEQ ID NO: 52764 - DNA, 18 bp, Homo sapiens
ctcccgcctctccgtggt

SEQ ID NO: 52765 - DNA, 15 bp, Homo sapiens
ctgccgcctcgctgt

SEQ ID NO: 52766 - DNA, 18 bp, Homo sapiens
ctgccacctgcttgtggt

SEQ ID NO: 52767 - DNA, 17 bp, Homo sapiens
ctcccgcctcccgcggc

SEQ ID NO: 52768 - DNA, 23 bp, Homo sapiens
ctgtggtcctccttgcctgtggt

SEQ ID NO: 52769 - DNA, 18 bp, Homo sapiens
ctgccagttccctgtggt

SEQ ID NO: 52770 - DNA, 17 bp, Homo sapiens
ctgccctctcctgtggc

SEQ ID NO: 52771 - DNA, 18 bp, Homo sapiens
ctgcctttcctgccgcgg

SEQ ID NO: 52772 - DNA, 20 bp, Homo sapiens
ctgccgccgccggcggtggt

SEQ ID NO: 52773 - DNA, 16 bp, Homo sapiens
ctgcgcctcctcgcgg

SEQ ID NO: 52774 - DNA, 16 bp, Homo sapiens
ctaccgccttcctggg

SEQ ID NO: 52775 - DNA, 22 bp, Homo sapiens
ctgcctttcccgtccaccaggt

SEQ ID NO: 52776 - DNA, 21 bp, Homo sapiens
ccgccgcctcccgcgccggcg

SEQ ID NO: 52777 - DNA, 19 bp, Homo sapiens
ctgcctactgtcctgtggt

SEQ ID NO: 52778 - DNA, 16 bp, Homo sapiens
ctgccacctcctcggg

SEQ ID NO: 52779 - DNA, 105 bp, Fowlpox virus
gaatatgaattctatatctacagcattttctttatagttaatgttgtaattatcggttatacattgaacaattgatataagtgttgttttgtgcttttcatattc

SEQ ID NO: 52780 - DNA, 24 bp, Fowlpox virus
tacattgaacaattgatataagtg

SEQ ID NO: 52781 - DNA, 21 bp, Homo sapiens
tacattcaattcatataagtg

SEQ ID NO: 52782 - DNA, 73 bp, Rat cytomegalovirus
cctgtgcttcgcccggatggacgagagcctcacctccgtgatggcgtcctcgccgtccagcacgaagaacagg

SEQ ID NO: 52783 - DNA, 24 bp, Rat cytomegalovirus
tggcgtcctcgccgtccagcacga

SEQ ID NO: 52784 - DNA, 19 bp, Homo sapiens
ggcgtccccctccagcgcg

SEQ ID NO: 52785 - DNA, 24 bp, Homo sapiens
gctgtcctcgccgggctgggcgcg

SEQ ID NO: 52786 - DNA, 27 bp, Homo sapiens
tggcgtcctcgtctatcgccggcgcga

SEQ ID NO: 52787 - DNA, 18 bp, Homo sapiens
tggtgtccacgccgtcca

SEQ ID NO: 52788 - DNA, 24 bp, Homo sapiens
ggcgtcctcgcgcaccgcggcgcg

SEQ ID NO: 52789 - DNA, 22 bp, Homo sapiens
tggaccggggccgtccagtacg

SEQ ID NO: 52790 - DNA, 72 bp, Monkeypox virus
tttccatatcatcattgtgtaaactaaataacgttttctatggcatttaataaggcattggatatgtggaaa

SEQ ID NO: 52791 - DNA, 24 bp, Monkeypox virus
tgtgtaaactaaataacgttttct

SEQ ID NO: 52792 - DNA, 23 bp, Homo sapiens
tgtgtaaatctagacatttttct

SEQ ID NO: 52793 - DNA, 20 bp, Homo sapiens
tgtgtgaactaaataaacat

SEQ ID NO: 52794 - DNA, 87 bp, Rat cytomegalovirus
agatctgcggcacgcactgcatcaccggcctctcggtcacgtcgaagaacaggtacagggaggtgcagatcatgcgcacgcagctct

SEQ ID NO: 52795 - DNA, 24 bp, Rat cytomegalovirus
tacagggaggtgcagatcatgcgc

SEQ ID NO: 52796 - DNA, 20 bp, Homo sapiens
gggagggccagatcatgtgc

SEQ ID NO: 52797 - DNA, 16 bp, Homo sapiens
cagggaggtgtaggcg

SEQ ID NO: 52798 - DNA, 16 bp, Homo sapiens
agggatgtgcagacgc

SEQ ID NO: 52799 - DNA, 20 bp, Homo sapiens
gggaggtgtggagcaggtgc

SEQ ID NO: 52800 - DNA, 20 bp, Homo sapiens
ggtgagccgagatcgtgtgc

SEQ ID NO: 52801 - DNA, 23 bp, Homo sapiens
tgaggggggtgcagaagacctgc

SEQ ID NO: 52802 - DNA, 19 bp, Homo sapiens
cagggacaggaagatcatg

SEQ ID NO: 52803 - DNA, 21 bp, Homo sapiens
cagggaggttggaaccagtgc

SEQ ID NO: 52804 - DNA, 20 bp, Homo sapiens
ggaggtgcgcctcggtgcgc

SEQ ID NO: 52805 - DNA, 15 bp, Homo sapiens
agggaggtcagatgc

SEQ ID NO: 52806 - DNA, 18 bp, Homo sapiens
cagggaggtgcagagggc

SEQ ID NO: 52807 - DNA, 76 bp, Hendra virus
tttttcttattgtcttcagatgagccttattacttcatctcatcagattataaattttctaataaattaagaaaaa

SEQ ID NO: 52808 - DNA, 24 bp, Hendra virus
tcagattataaattttctaataaa

SEQ ID NO: 52809 - DNA, 19 bp, Homo sapiens
tcagattataagttaccaa

SEQ ID NO: 52810 - DNA, 19 bp, Homo sapiens
caggtaaattttctaataa

SEQ ID NO: 52811 - DNA, 25 bp, Homo sapiens
tcaaattataaatttatattataaa

SEQ ID NO: 52812 - DNA, 18 bp, Homo sapiens
tcaaatattttctaataa

SEQ ID NO: 52813 - DNA, 24 bp, Homo sapiens
tcagcgtgagaattttctaataaa

SEQ ID NO: 52814 - DNA, 20 bp, Homo sapiens
tcagattatcaaattttcta

SEQ ID NO: 52815 - DNA, 23 bp, Homo sapiens
tcagatttattttcctctaataa

SEQ ID NO: 52816 - DNA, 18 bp, Homo sapiens
tcagattctaaattctaa

SEQ ID NO: 52817 - DNA, 83 bp, Variola virus
aattagacgtaagttccgcttgggaattttttaacgctaaagagttaacgttaatcgtacacccaacgtatttacatctagtt

SEQ ID NO: 52818 - DNA, 24 bp, Variola virus
acgtaagttccgcttgggaatttt

SEQ ID NO: 52819 - DNA, 18 bp, Homo sapiens
gtaatatttgggaatttt

SEQ ID NO: 52820 - DNA, 23 bp, Homo sapiens
cgaaagttcataaagggaatttt

SEQ ID NO: 52821 - DNA, 21 bp, Homo sapiens
gtaagttccacacagaatttt

SEQ ID NO: 52822 - DNA, 20 bp, Homo sapiens
gtaagttcagtggtcatttt

SEQ ID NO: 52823 - DNA, 22 bp, Homo sapiens
gtaattttcagcgtggaatttt

SEQ ID NO: 52824 - DNA, 81 bp, Tupaia paramyxovirus
ctgttgtttaaaagaaagtagacagtgatacggtgaaccagtagccaaaacaaaatttaatattatcagattaaacagcag

SEQ ID NO: 52825 - DNA, 24 bp, Tupaia paramyxovirus
taaaagaaagtagacagtgatacg

SEQ ID NO: 52826 - DNA, 22 bp, Homo sapiens
tgaagaaagtaggtaagcagtg

SEQ ID NO: 52827 - DNA, 19 bp, Homo sapiens
taagagaaaggagacagtg

SEQ ID NO: 52828 - DNA, 20 bp, Homo sapiens
taaagaaaagtaggcaagat

SEQ ID NO: 52829 - DNA, 19 bp, Homo sapiens
taaaaaaaagtagcatgta

SEQ ID NO: 52830 - DNA, 22 bp, Homo sapiens
caagagaaagtagacagataca

SEQ ID NO: 52831 - DNA, 20 bp, Homo sapiens
taaaagaaagtaggtaaatg

SEQ ID NO: 52832 - DNA, 23 bp, Homo sapiens
taaaagaaaggacgcatggtacg

SEQ ID NO: 52833 - DNA, 24 bp, Homo sapiens
taaaaggcaacagctagtgatacg

SEQ ID NO: 52834 - DNA, 20 bp, Homo sapiens
taaaagcaagtagtacagta

SEQ ID NO: 52835 - DNA, 17 bp, Homo sapiens
aaaaaagtgaaagtgat

SEQ ID NO: 52836 - DNA, 17 bp, Homo sapiens
gaaagcaggtggataca

SEQ ID NO: 52837 - DNA, 21 bp, Homo sapiens
gaatagataaacagtgatacg

SEQ ID NO: 52838 - DNA, 90 bp, Tupaia paramyxovirus
ttgaagcttttatattaaacatgcgatctaatcaaccctaggcaaacacactaagtttaagactaaaactgaagagatcgcaggctttaa

SEQ ID NO: 52839 - DNA, 24 bp, Tupaia paramyxovirus
aatcaaccctaggcaaacacacta

SEQ ID NO: 52840 - DNA, 19 bp, Homo sapiens
tcaacccttgcatgcacta

SEQ ID NO: 52841 - DNA, 19 bp, Homo sapiens
aaccactaagaacacacta

SEQ ID NO: 52842 - DNA, 22 bp, Homo sapiens
aatcaagcacagcaaacacgct

SEQ ID NO: 52843 - DNA, 18 bp, Homo sapiens
tcaaccctggggaagcac

SEQ ID NO: 52844 - DNA, 24 bp, Homo sapiens
aatcaaccctggttgagagtcact

SEQ ID NO: 52845 - DNA, 21 bp, Homo sapiens
caaccctaggaccaggtacta

SEQ ID NO: 52846 - DNA, 17 bp, Homo sapiens
ccctaaacaacacacta

SEQ ID NO: 52847 - DNA, 19 bp, Homo sapiens
ccttcagataaacacacta

SEQ ID NO: 52848 - DNA, 18 bp, Homo sapiens
aaccctaaaaaacacact

SEQ ID NO: 52849 - DNA, 21 bp, Homo sapiens
aactctaggatgaacacacta

SEQ ID NO: 52850 - DNA, 21 bp, Homo sapiens
tcaccacttcaaaacacacta

SEQ ID NO: 52851 - DNA, 17 bp, Homo sapiens
aatcaatccaggcaaca

SEQ ID NO: 52852 - DNA, 17 bp, Homo sapiens
aaccatagaaacacact

SEQ ID NO: 52853 - DNA, 20 bp, Homo sapiens
aatcaatcctatggcagaca

SEQ ID NO: 52854 - DNA, 23 bp, Homo sapiens
tcaaccctgacatctgtgcacta

SEQ ID NO: 52855 - DNA, 19 bp, Homo sapiens
ccaaccttccaacacacta

SEQ ID NO: 52856 - DNA, 17 bp, Homo sapiens
tcaaccctggccagact

SEQ ID NO: 52857 - DNA, 23 bp, Homo sapiens
aatcaataacttaaaacacacta

SEQ ID NO: 52858 - DNA, 22 bp, Homo sapiens
atcagtcttcacaaacacacta

SEQ ID NO: 52859 - DNA, 21 bp, Homo sapiens
atcagcctgccacacacacta

SEQ ID NO: 52860 - DNA, 93 bp, Human adenovirus C
ttgctcccaaacctcagcgcctcccaaaagacatatttcctgcagattcactcaaatatggaacattcccagctgctacaacaaacagagcga

SEQ ID NO: 52861 - DNA, 24 bp, Human adenovirus C
aaatatggaacattcccagctgct

SEQ ID NO: 52862 - DNA, 22 bp, Homo sapiens
aatgtggaatggttcaactgct

SEQ ID NO: 52863 - DNA, 25 bp, Homo sapiens
aatatgtgatgcatttttagctgct

SEQ ID NO: 52864 - DNA, 24 bp, Homo sapiens
aaatatggaatattgcacagtgct

SEQ ID NO: 52865 - DNA, 19 bp, Homo sapiens
aatatagaacatttttcag

SEQ ID NO: 52866 - DNA, 20 bp, Homo sapiens
tagaacacctggtagctgct

SEQ ID NO: 52867 - DNA, 24 bp, Homo sapiens
aaatatagaactatcagtcagttg

SEQ ID NO: 52868 - DNA, 17 bp, Homo sapiens
tggaacccccagctgct

SEQ ID NO: 52869 - DNA, 19 bp, Homo sapiens
tgggattctaccagctgct

SEQ ID NO: 52870 - DNA, 19 bp, Homo sapiens
aaatattggacattcccag

SEQ ID NO: 52871 - DNA, 21 bp, Homo sapiens
aaatacgggatcgaggctgct

SEQ ID NO: 52872 - DNA, 20 bp, Homo sapiens
aaatatggggcattcaaact

SEQ ID NO: 52873 - DNA, 18 bp, Homo sapiens
aaatatgaaatacagctg

SEQ ID NO: 52874 - DNA, 15 bp, Homo sapiens
aaataggaacatttg

SEQ ID NO: 52875 - DNA, 20 bp, Homo sapiens
aaatatggtacatttgacag

SEQ ID NO: 52876 - DNA, 18 bp, Homo sapiens
atggaattaccagctgct

SEQ ID NO: 52877 - DNA, 22 bp, Homo sapiens
aaaagtggaacattttgaagct

SEQ ID NO: 52878 - DNA, 19 bp, Homo sapiens
tgcaatatttccagctgct

SEQ ID NO: 52879 - DNA, 16 bp, Homo sapiens
aaatctggaacatttg

SEQ ID NO: 52880 - DNA, 16 bp, Homo sapiens
aaaaatggaacatctg

SEQ ID NO: 52881 - DNA, 68 bp, Fowl adenovirus A
atacagctttgattcttctgatcgtcttgacggtgttcacgggcgcggtggtagctttgatgttgtat

SEQ ID NO: 52882 - DNA, 17 bp, Fowl adenovirus A
tagctttgatgttgtat

SEQ ID NO: 52883 - DNA, 18 bp, Homo sapiens
cagcttaaatgtttgtat

SEQ ID NO: 52884 - DNA, 18 bp, Homo sapiens
tagttttgatgcgtgtat

SEQ ID NO: 52885 - DNA, 18 bp, Homo sapiens
tagctttgaaggcagcat

SEQ ID NO: 52886 - DNA, 19 bp, Homo sapiens
tagctctgacatcctgtat

SEQ ID NO: 52887 - DNA, 65 bp, Human adenovirus D
gcgtctgcagcattgtctgcctggtcatcaccttcctgcagctcatcgactggtgctgcgcgcgc

SEQ ID NO: 52888 - DNA, 24 bp, Human adenovirus D
tctgcagcattgtctgcctggtca

SEQ ID NO: 52889 - DNA, 15 bp, Homo sapiens
tctcagctgcctggt

SEQ ID NO: 52890 - DNA, 19 bp, Homo sapiens
cctgtagtgaggcctggtc

SEQ ID NO: 52891 - DNA, 19 bp, Homo sapiens
tctgtagcactgtctgctg

SEQ ID NO: 52892 - DNA, 19 bp, Homo sapiens
ctgtgaccctctgtctggt

SEQ ID NO: 52893 - DNA, 18 bp, Homo sapiens
tctgcagcagtaactggt

SEQ ID NO: 52894 - DNA, 19 bp, Homo sapiens
tctgcagcgttgtctgccc

SEQ ID NO: 52895 - DNA, 16 bp, Homo sapiens
tcagcagcattgtggt

SEQ ID NO: 52896 - DNA, 18 bp, Homo sapiens
ctgcagcatctctttggt

SEQ ID NO: 52897 - DNA, 16 bp, Homo sapiens
cgcagcatccttggtc

SEQ ID NO: 52898 - DNA, 22 bp, Homo sapiens
cctgcggtgtcagtgcctggtc

SEQ ID NO: 52899 - DNA, 19 bp, Homo sapiens
tctgggcgagctgcctggt

SEQ ID NO: 52900 - DNA, 20 bp, Homo sapiens
tctggttgactttgcctggt

SEQ ID NO: 52901 - DNA, 18 bp, Homo sapiens
tctcaggactgtctggtc

SEQ ID NO: 52902 - DNA, 20 bp, Homo sapiens
tacagcaagacttgcctggt

SEQ ID NO: 52903 - DNA, 16 bp, Homo sapiens
tctgcgactgcctggt

SEQ ID NO: 52904 - DNA, 19 bp, Homo sapiens
tgcaacattgtggggtggt

SEQ ID NO: 52905 - DNA, 19 bp, Homo sapiens
tctgcagcattttttgatc

SEQ ID NO: 52906 - DNA, 20 bp, Homo sapiens
ctgcagtcactgcctggtca

SEQ ID NO: 52907 - DNA, 16 bp, Homo sapiens
tctgcagcgctgtggt

SEQ ID NO: 52908 - DNA, 18 bp, Homo sapiens
tctgtggcgttgcctagc

SEQ ID NO: 52909 - DNA, 22 bp, Homo sapiens
tctgagttccgcactgcctggt

SEQ ID NO: 52910 - DNA, 60 bp, Fowl adenovirus A
ttttgcttatgcagagtcggcaagctttggaaaggagcttgcgccgctgcgtaagtgaag

SEQ ID NO: 52911 - DNA, 24 bp, Fowl adenovirus A
tatgcagagtcggcaagctttgga

SEQ ID NO: 52912 - DNA, 15 bp, Homo sapiens
atgcagagtcctttg

SEQ ID NO: 52913 - DNA, 20 bp, Homo sapiens
gcagagtagatagctttgga

SEQ ID NO: 52914 - DNA, 21 bp, Homo sapiens
tggaaagtggcaagctttgga

SEQ ID NO: 52915 - DNA, 19 bp, Homo sapiens
gatgggaacaagctttgga

SEQ ID NO: 52916 - DNA, 23 bp, Homo sapiens
tgcagagtcggtgatgctatgga

SEQ ID NO: 52917 - DNA, 20 bp, Homo sapiens
tatgtggaataggctttgga

SEQ ID NO: 52918 - DNA, 21 bp, Homo sapiens
tgcagagctcggtgacaatga

SEQ ID NO: 52919 - DNA, 17 bp, Homo sapiens
tgcagggccagctttgg

SEQ ID NO: 52920 - DNA, 19 bp, Homo sapiens
tgcagaggcccactttgga

SEQ ID NO: 52921 - DNA, 22 bp, Homo sapiens
tattagaggtataagctttgga

SEQ ID NO: 52922 - DNA, 19 bp, Homo sapiens
tgcaggggtggggctttgg

SEQ ID NO: 52923 - DNA, 114 bp, Human adenovirus D
tgctgtaaagccagaaagaaatctaggaggcccatctacaggccagtgattggggaacctcagccactccaagtggatggaggcttaaggaatcttcttttctcttttacagta

SEQ ID NO: 52924 - DNA, 24 bp, Human adenovirus D
caagtggatggaggcttaaggaat

SEQ ID NO: 52925 - DNA, 22 bp, Homo sapiens
caagtggaatggaggtatgtgg

SEQ ID NO: 52926 - DNA, 16 bp, Homo sapiens
gtggatggaggcagga

SEQ ID NO: 52927 - DNA, 18 bp, Homo sapiens
tgactggaatttaaggaa

SEQ ID NO: 52928 - DNA, 19 bp, Homo sapiens
agggggccagggcttaagg

SEQ ID NO: 52929 - DNA, 15 bp, Homo sapiens
gtgaatggggaggaa

SEQ ID NO: 52930 - DNA, 17 bp, Homo sapiens
gtggtggagcctcaggg

SEQ ID NO: 52931 - DNA, 20 bp, Homo sapiens
caagtggaggaggaggagga

SEQ ID NO: 52932 - DNA, 26 bp, Homo sapiens
tgagtggatggtggtcttctgggaat

SEQ ID NO: 52933 - DNA, 18 bp, Homo sapiens
caggtgggtggaggtcaa

SEQ ID NO: 52934 - DNA, 17 bp, Homo sapiens
aagtgatggggcaggaa

SEQ ID NO: 52935 - DNA, 18 bp, Homo sapiens
agtgtggagacctttagg

SEQ ID NO: 52936 - DNA, 18 bp, Homo sapiens
caagcggatggaggtgga

SEQ ID NO: 52937 - DNA, 22 bp, Homo sapiens
caggtggaggggaagataggga

SEQ ID NO: 52938 - DNA, 16 bp, Homo sapiens
aagggatggagctgga

SEQ ID NO: 52939 - DNA, 18 bp, Homo sapiens
gtggatggagccgtcagg

SEQ ID NO: 52940 - DNA, 20 bp, Homo sapiens
tgagtggatgtgggttctga

SEQ ID NO: 52941 - DNA, 22 bp, Homo sapiens
tgagtgggtagagagcagagga

SEQ ID NO: 52942 - DNA, 25 bp, Homo sapiens
cagatggatgctgggcttgaggaat

SEQ ID NO: 52943 - DNA, 18 bp, Homo sapiens
tgggtggatgaccaggaa

SEQ ID NO: 52944 - DNA, 22 bp, Homo sapiens
caggtagatggacagggaagga

SEQ ID NO: 52945 - DNA, 16 bp, Homo sapiens
caagtggaaggaaagg

SEQ ID NO: 52946 - DNA, 17 bp, Homo sapiens
agtggatgggggtaagg

SEQ ID NO: 52947 - DNA, 18 bp, Homo sapiens
tgaggggatggagaggga

SEQ ID NO: 52948 - DNA, 23 bp, Homo sapiens
caaatggatgacagctggggaat

SEQ ID NO: 52949 - DNA, 20 bp, Homo sapiens
caagggatggaggtggggga

SEQ ID NO: 52950 - DNA, 15 bp, Homo sapiens
gtggatggaggcaga

SEQ ID NO: 52951 - DNA, 19 bp, Homo sapiens
aagtggatggactggaagg

SEQ ID NO: 52952 - DNA, 18 bp, Homo sapiens
caggtggatggggatgga

SEQ ID NO: 52953 - DNA, 20 bp, Homo sapiens
aatatttgagaggcttaagg

SEQ ID NO: 52954 - DNA, 17 bp, Homo sapiens
caagtggatgcaaggga

SEQ ID NO: 52955 - DNA, 19 bp, Homo sapiens
caagtggaatggacaggaa

SEQ ID NO: 52956 - DNA, 18 bp, Homo sapiens
caagttggaaacttgagg

SEQ ID NO: 52957 - DNA, 17 bp, Homo sapiens
aagtggatggcagaagg

SEQ ID NO: 52958 - DNA, 22 bp, Homo sapiens
tgagtggatgggggtggctgga

SEQ ID NO: 52959 - DNA, 18 bp, Homo sapiens
gtggatggaggcaagaat

SEQ ID NO: 52960 - DNA, 18 bp, Homo sapiens
aagtggtgacttaaggaa

SEQ ID NO: 52961 - DNA, 18 bp, Homo sapiens
tgagtggtggggccggaa

SEQ ID NO: 52962 - DNA, 18 bp, Homo sapiens
gtggatggaggaaagaat

SEQ ID NO: 52963 - DNA, 20 bp, Homo sapiens
tggtttgggaggcttgagga

SEQ ID NO: 52964 - DNA, 19 bp, Homo sapiens
aagggatggggtgggaagg

SEQ ID NO: 52965 - DNA, 77 bp, Beet yellows virus
catacgaatatacgataggaggaaagaagttcctggtcaaggatgcttgggtttttcctctaataaaagagtgtatg

SEQ ID NO: 52966 - DNA, 24 bp, Beet yellows virus
ggaggaaagaagttcctggtcaag

SEQ ID NO: 52967 - DNA, 20 bp, Homo sapiens
gggagaaaggggttgcctag

SEQ ID NO: 52968 - DNA, 19 bp, Homo sapiens
ggaggaaagaggattctga

SEQ ID NO: 52969 - DNA, 20 bp, Homo sapiens
ggaggagggagttaggtgca

SEQ ID NO: 52970 - DNA, 16 bp, Homo sapiens
ggaggcagcctggtca

SEQ ID NO: 52971 - DNA, 19 bp, Homo sapiens
ggaggggagaggctcctgg

SEQ ID NO: 52972 - DNA, 24 bp, Homo sapiens
ggaggagacaggttcagcgacaag

SEQ ID NO: 52973 - DNA, 19 bp, Homo sapiens
ggaggggagttcccatcca

SEQ ID NO: 52974 - DNA, 21 bp, Homo sapiens
agaggaaggacgatggtcaag

SEQ ID NO: 52975 - DNA, 17 bp, Homo sapiens
ggagggaggtcctggtc

SEQ ID NO: 52976 - DNA, 24 bp, Homo sapiens
ggaggagagagcttcttcccccag

SEQ ID NO: 52977 - DNA, 18 bp, Homo sapiens
ggaggaagggattcctgg

SEQ ID NO: 52978 - DNA, 20 bp, Homo sapiens
ggagaaggggtctggtcaag

SEQ ID NO: 52979 - DNA, 17 bp, Homo sapiens
ggggaaagaattctcaa

SEQ ID NO: 52980 - DNA, 21 bp, Homo sapiens
agaggaaagggaagggtcaag

SEQ ID NO: 52981 - DNA, 18 bp, Homo sapiens
ggggaagaaagcagtcaa

SEQ ID NO: 52982 - DNA, 17 bp, Homo sapiens
ggaggaaaggggtgcaa

SEQ ID NO: 52983 - DNA, 17 bp, Homo sapiens
ggaggaaacaagttggc

SEQ ID NO: 52984 - DNA, 19 bp, Homo sapiens
ggagagagaaaatggtcaa

SEQ ID NO: 52985 - DNA, 20 bp, Homo sapiens
ggaggaaagaagattcccag

SEQ ID NO: 52986 - DNA, 22 bp, Homo sapiens
ggtggaaagaagtttccaaaca

SEQ ID NO: 52987 - DNA, 19 bp, Homo sapiens
gcaggaaagaagtttctga

SEQ ID NO: 52988 - DNA, 21 bp, Homo sapiens
gaaggggccttgccctggtca

SEQ ID NO: 52989 - DNA, 18 bp, Homo sapiens
ggagggagtgctggtcaa

SEQ ID NO: 52990 - DNA, 21 bp, Homo sapiens
ggaggaaagagggttcctcat

SEQ ID NO: 52991 - DNA, 20 bp, Homo sapiens
ggaggcagacccctcctggt

SEQ ID NO: 52992 - DNA, 20 bp, Homo sapiens
ggaagtttagtttggtcaag

SEQ ID NO: 52993 - DNA, 24 bp, Homo sapiens
ggaggaaaggaaggaggtgggtca

SEQ ID NO: 52994 - DNA, 20 bp, Homo sapiens
ggagagagaggtcaccttgg

SEQ ID NO: 52995 - DNA, 19 bp, Homo sapiens
gaaggaagaagttccccat

SEQ ID NO: 52996 - DNA, 19 bp, Homo sapiens
ggaggaaggaggctcccag

SEQ ID NO: 52997 - DNA, 18 bp, Homo sapiens
ggaggaaggaagtcccgg

SEQ ID NO: 52998 - DNA, 20 bp, Homo sapiens
ggaggaaaggaaagggttgg

SEQ ID NO: 52999 - DNA, 15 bp, Homo sapiens
ggggagaagttctga

SEQ ID NO: 53000 - DNA, 22 bp, Homo sapiens
ggagggtgggagggcagtcaag

SEQ ID NO: 53001 - DNA, 25 bp, Homo sapiens
ggggagaaaagttcttcgcttgaca

SEQ ID NO: 53002 - DNA, 21 bp, Homo sapiens
ggaggaaagggggttgattca

SEQ ID NO: 53003 - DNA, 19 bp, Homo sapiens
ggagggcaggggttcccgg

SEQ ID NO: 53004 - DNA, 17 bp, Homo sapiens
ggggggaatctggtcaa

SEQ ID NO: 53005 - DNA, 20 bp, Homo sapiens
ggaggaaagaggctgcctgg

SEQ ID NO: 53006 - DNA, 22 bp, Homo sapiens
ggagaaatatttcctggttaag

SEQ ID NO: 53007 - DNA, 20 bp, Homo sapiens
ggaggaaagggggtcccaga

SEQ ID NO: 53008 - DNA, 20 bp, Homo sapiens
ggagcagagaagttccctgc

SEQ ID NO: 53009 - DNA, 24 bp, Homo sapiens
gaagggaaggagtttgtaaccaag

SEQ ID NO: 53010 - DNA, 18 bp, Homo sapiens
gaggaaggaagttccatg

SEQ ID NO: 53011 - DNA, 16 bp, Homo sapiens
ggaagaaagaggtcaa

SEQ ID NO: 53012 - DNA, 18 bp, Homo sapiens
gaaggaagaagttccaga

SEQ ID NO: 53013 - DNA, 22 bp, Homo sapiens
ggaggaggcagctgtggtcaag

SEQ ID NO: 53014 - DNA, 20 bp, Homo sapiens
ggaggaaaacccgcctggtc

SEQ ID NO: 53015 - DNA, 19 bp, Homo sapiens
ggagggaagaggcttttgg

SEQ ID NO: 53016 - DNA, 21 bp, Homo sapiens
ggcggaaggagttttccccgg

SEQ ID NO: 53017 - DNA, 15 bp, Homo sapiens
ggaggaagatggtca

SEQ ID NO: 53018 - DNA, 22 bp, Homo sapiens
ggagggaggaagtccccccaag

SEQ ID NO: 53019 - DNA, 17 bp, Homo sapiens
ggagagagaagttctgg

SEQ ID NO: 53020 - DNA, 17 bp, Homo sapiens
ggagggaagagttcggg

SEQ ID NO: 53021 - DNA, 20 bp, Homo sapiens
ggaggaaagagagttcatca

SEQ ID NO: 53022 - DNA, 22 bp, Homo sapiens
ggaggaaagagtgtgtctcaag

SEQ ID NO: 53023 - DNA, 18 bp, Homo sapiens
ggggaagagaagttcttg

SEQ ID NO: 53024 - DNA, 18 bp, Homo sapiens
ggaggaaagaagtactcc

SEQ ID NO: 53025 - DNA, 17 bp, Homo sapiens
agaggagagaggtttgg

SEQ ID NO: 53026 - DNA, 78 bp, Camelpox virus
attaatcactgattcctttttcgatgccggacaatagcacaattgtttagctttggactctatgtattcaggattaat

SEQ ID NO: 53027 - DNA, 24 bp, Camelpox virus
tcactgattcctttttcgatgccg

SEQ ID NO: 53028 - DNA, 18 bp, Homo sapiens
tcattgatttctctttca

SEQ ID NO: 53029 - DNA, 20 bp, Homo sapiens
ctgattccttttcttctccg

SEQ ID NO: 53030 - DNA, 18 bp, Homo sapiens
ctaattcctcaccaaatg

SEQ ID NO: 53031 - DNA, 17 bp, Homo sapiens
tcactggtcctttttca

SEQ ID NO: 53032 - DNA, 19 bp, Homo sapiens
cactggttttctttcgatg

SEQ ID NO: 53033 - DNA, 16 bp, Homo sapiens
tcaatgattccttgcc

SEQ ID NO: 53034 - DNA, 20 bp, Homo sapiens
tcactgattcttttcctttg

SEQ ID NO: 53035 - DNA, 20 bp, Homo sapiens
tgattcctttttcattcagc

SEQ ID NO: 53036 - DNA, 20 bp, Homo sapiens
tcactgattcttttgcattg

SEQ ID NO: 53037 - DNA, 20 bp, Homo sapiens
tgattcctcatctgatgtcg

SEQ ID NO: 53038 - DNA, 17 bp, Homo sapiens
ctgattccttatcattg

SEQ ID NO: 53039 - DNA, 68 bp, Meleagrid herpesvirus 1
cgccttacaggggtgtggtagtgcagggtctgcctgctcggcaagaccgctccccggcaaccgaggcg

SEQ ID NO: 53040 - DNA, 24 bp, Meleagrid herpesvirus 1
cggcaagaccgctccccggcaacc

SEQ ID NO: 53041 - DNA, 19 bp, Homo sapiens
cggggccgctcccaggacc

SEQ ID NO: 53042 - DNA, 25 bp, Homo sapiens
cggcgggagcgctcccccggcggcc

SEQ ID NO: 53043 - DNA, 17 bp, Homo sapiens
gggaccgctccccacaa

SEQ ID NO: 53044 - DNA, 22 bp, Homo sapiens
cggagagactgccgcggcaacc

SEQ ID NO: 53045 - DNA, 21 bp, Homo sapiens
cggtgaaccgctccgcgcacc

SEQ ID NO: 53046 - DNA, 23 bp, Homo sapiens
agccacgccgtttcccggcaacc

SEQ ID NO: 53047 - DNA, 19 bp, Homo sapiens
ggcgagactcgccggcaac

SEQ ID NO: 53048 - DNA, 23 bp, Homo sapiens
ggcgagctgctttcacagcaacc

SEQ ID NO: 53049 - DNA, 22 bp, Homo sapiens
agctccccgctccctggcagcc

SEQ ID NO: 53050 - DNA, 17 bp, Homo sapiens
gcagggcacccccggca

SEQ ID NO: 53051 - DNA, 18 bp, Homo sapiens
gcagcatccccggcagcc

SEQ ID NO: 53052 - DNA, 20 bp, Homo sapiens
cggcagggcgctcccccagc

SEQ ID NO: 53053 - DNA, 19 bp, Homo sapiens
ggcaagaccgctttcccac

SEQ ID NO: 53054 - DNA, 21 bp, Homo sapiens
cggcgcgctgccccggcaacc

SEQ ID NO: 53055 - DNA, 17 bp, Homo sapiens
cagcaggcccccggcgc

SEQ ID NO: 53056 - DNA, 20 bp, Homo sapiens
ggcaagacgttcgtatcggc

SEQ ID NO: 53057 - DNA, 18 bp, Homo sapiens
ggcaagactgtccctggc

SEQ ID NO: 53058 - DNA, 19 bp, Homo sapiens
cggcgcgaccgctctccag

SEQ ID NO: 53059 - DNA, 19 bp, Homo sapiens
ggcaagactctagaccaac

SEQ ID NO: 53060 - DNA, 19 bp, Homo sapiens
ggtgggacccctccccgac

SEQ ID NO: 53061 - DNA, 21 bp, Homo sapiens
ggggagaccgcttcccaaacc

SEQ ID NO: 53062 - DNA, 19 bp, Homo sapiens
ggtaaaggtcgcccccagc

SEQ ID NO: 53063 - DNA, 25 bp, Homo sapiens
ggcaagacagtcttttccttggcaa

SEQ ID NO: 53064 - DNA, 22 bp, Homo sapiens
cggcaaggtggctccaggtggc

SEQ ID NO: 53065 - DNA, 18 bp, Homo sapiens
ggaagggccgctccccgg

SEQ ID NO: 53066 - DNA, 18 bp, Homo sapiens
cgggggaccgctctcagc

SEQ ID NO: 53067 - DNA, 19 bp, Homo sapiens
ggcttaagctccggcaacc

SEQ ID NO: 53068 - DNA, 22 bp, Homo sapiens
cggccgagggcccttctggcaa

SEQ ID NO: 53069 - DNA, 19 bp, Homo sapiens
gcgggaccgctccgcgggc

SEQ ID NO: 53070 - DNA, 19 bp, Homo sapiens
cggcgaggctgcccccggc

SEQ ID NO: 53071 - DNA, 18 bp, Homo sapiens
cagcaaggtactggcaac

SEQ ID NO: 53072 - DNA, 20 bp, Homo sapiens
cggccaggtcgctcccctac

SEQ ID NO: 53073 - DNA, 19 bp, Homo sapiens
ggcagggccgctcccggac

SEQ ID NO: 53074 - DNA, 131 bp, Melanoplus sanguinipes entomopoxvirus
aaaccatccaatccactaccaatagctggcatattaagtgtagttatattattttttatacaatattctcgtaataattctatagcatcttcatactgttttaatgttggttttttataagatgatggttt

SEQ ID NO: 53075 - DNA, 24 bp, Melanoplus sanguinipes entomopoxvirus
tggcatattaagtgtagttatatt

SEQ ID NO: 53076 - DNA, 23 bp, Homo sapiens
tggtgtactaagacagttatatt

SEQ ID NO: 53077 - DNA, 21 bp, Homo sapiens
tggcatatttgtcattgtatt

SEQ ID NO: 53078 - DNA, 23 bp, Homo sapiens
tagcatattaagctcattgtatt

SEQ ID NO: 53079 - DNA, 16 bp, Homo sapiens
tggcatgtgaattata

SEQ ID NO: 53080 - DNA, 18 bp, Homo sapiens
ggcatattgggtggccat

SEQ ID NO: 53081 - DNA, 23 bp, Homo sapiens
tagtgtattagtgttgttatatt

SEQ ID NO: 53082 - DNA, 19 bp, Homo sapiens
tgacatattaggcttatat

SEQ ID NO: 53083 - DNA, 18 bp, Homo sapiens
tgggtattaagtgtcatt

SEQ ID NO: 53084 - DNA, 18 bp, Homo sapiens
tagcatattaagtttaat

SEQ ID NO: 53085 - DNA, 72 bp, Ovine adenovirus A
accactggaaagcttctacctctggacatgtgttatatacaatccagtcatactgagagtgagtcttgtggt

SEQ ID NO: 53086 - DNA, 24 bp, Ovine adenovirus A
tggaaagcttctacctctggacat

SEQ ID NO: 53087 - DNA, 23 bp, Homo sapiens
ggagaggcctagtctctggacat

SEQ ID NO: 53088 - DNA, 20 bp, Homo sapiens
tggaaagcatttcttcttgg

SEQ ID NO: 53089 - DNA, 18 bp, Homo sapiens
ggaaagcttctacccaca

SEQ ID NO: 53090 - DNA, 17 bp, Homo sapiens
tggaaacttctgccaga

SEQ ID NO: 53091 - DNA, 24 bp, Homo sapiens
tggaaaacttttgtcgagaaacat

SEQ ID NO: 53092 - DNA, 18 bp, Homo sapiens
tggaaagctctgctgtca

SEQ ID NO: 53093 - DNA, 18 bp, Homo sapiens
tggaaagcttcagttgaa

SEQ ID NO: 53094 - DNA, 21 bp, Homo sapiens
tggaagccttctcctggacat

SEQ ID NO: 53095 - DNA, 21 bp, Homo sapiens
gaaggcttctaccttacacat

SEQ ID NO: 53096 - DNA, 18 bp, Homo sapiens
tgggaagcttccatggca

SEQ ID NO: 53097 - DNA, 24 bp, Homo sapiens
tggagatttgcttattctggacat

SEQ ID NO: 53098 - DNA, 18 bp, Homo sapiens
tggaagcttctgcactaa

SEQ ID NO: 53099 - DNA, 18 bp, Homo sapiens
ggaaagcttttatttaga

SEQ ID NO: 53100 - DNA, 23 bp, Homo sapiens
tgaaaagcttctgctcccaacat

SEQ ID NO: 53101 - DNA, 19 bp, Homo sapiens
tggaaagcttttcatagca

SEQ ID NO: 53102 - DNA, 18 bp, Homo sapiens
tggggagcttctattcca

SEQ ID NO: 53103 - DNA, 23 bp, Homo sapiens
tggagtgtacacattctggacat

SEQ ID NO: 53104 - DNA, 20 bp, Homo sapiens
tggagagaatttctggacat

SEQ ID NO: 53105 - DNA, 21 bp, Homo sapiens
ggagagcttctacctagagca

SEQ ID NO: 53106 - DNA, 20 bp, Homo sapiens
ggtgagcatgctctggacat

SEQ ID NO: 53107 - DNA, 18 bp, Homo sapiens
tggggagctcctacactg

SEQ ID NO: 53108 - DNA, 20 bp, Homo sapiens
tgaaaagcttttattccctg

SEQ ID NO: 53109 - DNA, 20 bp, Homo sapiens
tggaaagctttactttaaga

SEQ ID NO: 53110 - DNA, 18 bp, Homo sapiens
tggaaggctctaccactg

SEQ ID NO: 53111 - DNA, 68 bp, Ovine adenovirus A
aacctgttaagctgagatggctgcatttttggagaaataatgtgcagcttagcttgaattttaaggtt

SEQ ID NO: 53112 - DNA, 24 bp, Ovine adenovirus A
tgttaagctgagatggctgcattt

SEQ ID NO: 53113 - DNA, 23 bp, Homo sapiens
tgttaagcagtttgtttgcattt

SEQ ID NO: 53114 - DNA, 17 bp, Homo sapiens
tggtaggctgagatgct

SEQ ID NO: 53115 - DNA, 22 bp, Homo sapiens
tgttagctgagattgagcattt

SEQ ID NO: 53116 - DNA, 16 bp, Homo sapiens
tgttaagtgtctgcat

SEQ ID NO: 53117 - DNA, 18 bp, Homo sapiens
tgttaagctgaggttgca

SEQ ID NO: 53118 - DNA, 19 bp, Homo sapiens
tattaagtttagctgcatt

SEQ ID NO: 53119 - DNA, 15 bp, Homo sapiens
tgttagctgagaact

SEQ ID NO: 53120 - DNA, 15 bp, Homo sapiens
tgtaagctgaggcat

SEQ ID NO: 53121 - DNA, 18 bp, Homo sapiens
tgttgagtgaggtggtac

SEQ ID NO: 53122 - DNA, 93 bp, Melanoplus sanguinipes entomopoxvirus
tatttgttttaagtacatcaccaaaaatttctttataattcattttattaatgtattatattttcaattttatgattttatatataataaatg

SEQ ID NO: 53123 - DNA, 24 bp, Melanoplus sanguinipes entomopoxvirus
tttaagtacatcaccaaaaatttc

SEQ ID NO: 53124 - DNA, 21 bp, Homo sapiens
tctaggcacaaccaaaaattt

SEQ ID NO: 53125 - DNA, 21 bp, Homo sapiens
tttaagttacaccaagatttc

SEQ ID NO: 53126 - DNA, 22 bp, Homo sapiens
atacaccacctccagaaatttc

SEQ ID NO: 53127 - DNA, 22 bp, Homo sapiens
atactttatcaccaaagatttc

SEQ ID NO: 53128 - DNA, 23 bp, Homo sapiens
ttcaagtacattaccacttattt

SEQ ID NO: 53129 - DNA, 21 bp, Homo sapiens
tttaagtattcacaaaaattt

SEQ ID NO: 53130 - DNA, 19 bp, Homo sapiens
tttaagggtgtcaccaaaa

SEQ ID NO: 53131 - DNA, 24 bp, Homo sapiens
tttaaatacattacgtacaatttc

SEQ ID NO: 53132 - DNA, 23 bp, Homo sapiens
tttaagtccttcacaaaaatttc

SEQ ID NO: 53133 - DNA, 67 bp, Simian type D virus 1
gcgcagttcccgaggggtcatttcttatcataaaataataaaaagggggacctgtccggagctgcgc

SEQ ID NO: 53134 - DNA, 24 bp, Simian type D virus 1
ttcccgaggggtcatttcttatca

SEQ ID NO: 53135 - DNA, 18 bp, Homo sapiens
ctcctgaacatttcttat

SEQ ID NO: 53136 - DNA, 17 bp, Homo sapiens
ttccctaagtttcttat

SEQ ID NO: 53137 - DNA, 23 bp, Homo sapiens
ttctcaggagcactttcttatca

SEQ ID NO: 53138 - DNA, 19 bp, Homo sapiens
ttctgaggggtcattccct

SEQ ID NO: 53139 - DNA, 20 bp, Homo sapiens
ttccagggtagttttcttat

SEQ ID NO: 53140 - DNA, 18 bp, Homo sapiens
ttctaaggggtctcttat

SEQ ID NO: 53141 - DNA, 18 bp, Homo sapiens
gaggagtcaccctctgtc

SEQ ID NO: 53142 - DNA, 75 bp, Fowlpox virus
ttggttctttgaacatcttggtcgaaaagtaggtattttctatcttttgatttatccgtacactcgtgtagccag

SEQ ID NO: 53143 - DNA, 24 bp, Fowlpox virus
tcttttgatttatccgtacactcg

SEQ ID NO: 53144 - DNA, 20 bp, Homo sapiens
tcttttgattttccaacact

SEQ ID NO: 53145 - DNA, 21 bp, Homo sapiens
tcttgaggagatctgtacact

SEQ ID NO: 53146 - DNA, 21 bp, Homo sapiens
tcttttgactttctgaataca

SEQ ID NO: 53147 - DNA, 17 bp, Homo sapiens
tcttttgatttattgta

SEQ ID NO: 53148 - DNA, 93 bp, Fowlpox virus
cgtctgaatatccaaagttatcaggtctagtgtaatctacaaaatcagaacagtaattggcatctaaatgatcactacaaactttcatgtacg

SEQ ID NO: 53149 - DNA, 24 bp, Fowlpox virus
tctgaatatccaaagttatcaggt

SEQ ID NO: 53150 - DNA, 17 bp, Homo sapiens
aatatctattatcaggt

SEQ ID NO: 53151 - DNA, 22 bp, Homo sapiens
tctgaatatacaacgtgtgggt

SEQ ID NO: 53152 - DNA, 21 bp, Homo sapiens
tctgaatagtctgggttcagg

SEQ ID NO: 53153 - DNA, 18 bp, Homo sapiens
tctgatatccaatgcggg

SEQ ID NO: 53154 - DNA, 18 bp, Homo sapiens
tgaatatttaaaattacc

SEQ ID NO: 53155 - DNA, 18 bp, Homo sapiens
atatccaagaatcaaggt

SEQ ID NO: 53156 - DNA, 17 bp, Homo sapiens
tgactatccaaaaaagg

SEQ ID NO: 53157 - DNA, 19 bp, Homo sapiens
tctgaatatcctgaggtta

SEQ ID NO: 53158 - DNA, 68 bp, Paramecium bursaria Chlorella virus 1
acttgattcaaagtcgggattttttcggttgaatttcgtatcgacaaattactgagttcgttcaatgt

SEQ ID NO: 53159 - DNA, 24 bp, Paramecium bursaria Chlorella virus 1
tcaaagtcgggattttttcggttg

SEQ ID NO: 53160 - DNA, 21 bp, Homo sapiens
agatgggatttcatcatgttg

SEQ ID NO: 53161 - DNA, 21 bp, Homo sapiens
gctgggatttcctaggggttg

SEQ ID NO: 53162 - DNA, 20 bp, Homo sapiens
gtcaggatccgactcggttg

SEQ ID NO: 53163 - DNA, 20 bp, Homo sapiens
tctgagttgggattttggtc

SEQ ID NO: 53164 - DNA, 19 bp, Homo sapiens
tcaaagtctggggtttttt

SEQ ID NO: 53165 - DNA, 23 bp, Homo sapiens
aaagtaagacttttttttggttg

SEQ ID NO: 53166 - DNA, 18 bp, Homo sapiens
tcaaaattggggtttcct

SEQ ID NO: 53167 - DNA, 126 bp, Fowlpox virus
gccattctctacaaggtaaagacccgggagtctgtaagcatatagatgacataatggtatcacaatgatccgtttcataattattagaaaatatttccggacagtctttatcggattctttattgc

SEQ ID NO: 53168 - DNA, 24 bp, Fowlpox virus
tgtaagcatatagatgacataatg

SEQ ID NO: 53169 - DNA, 17 bp, Homo sapiens
taagcataatacataat

SEQ ID NO: 53170 - DNA, 18 bp, Homo sapiens
gctattgatgacatgatg

SEQ ID NO: 53171 - DNA, 126 bp, Fowlpox virus
tccgtctaaaacataactttctgtaccatagggtatcttttgtaaatcaagaatagaacccggtctaaacgataatgatttgcaaggttctcctggtactattacgaatttttttttagcttcggg

SEQ ID NO: 53172 - DNA, 24 bp, Fowlpox virus
tctaaaacataactttctgtacca

SEQ ID NO: 53173 - DNA, 19 bp, Homo sapiens
caaaacatcctttttctgt

SEQ ID NO: 53174 - DNA, 21 bp, Homo sapiens
tctaaaacattgcaactactg

SEQ ID NO: 53175 - DNA, 19 bp, Homo sapiens
taaaacatatactgtctgt

SEQ ID NO: 53176 - DNA, 16 bp, Homo sapiens
caaaactctttctgta

SEQ ID NO: 53177 - DNA, 17 bp, Homo sapiens
tctaaaacatgtcttct

SEQ ID NO: 53178 - DNA, 18 bp, Homo sapiens
taagacatagctctctat

SEQ ID NO: 53179 - DNA, 24 bp, Homo sapiens
tctaaggcaggaacatctgtacca

SEQ ID NO: 53180 - DNA, 19 bp, Homo sapiens
tctaaaacatcattcatac

SEQ ID NO: 53181 - DNA, 22 bp, Homo sapiens
taaaaataactttgctttacca

SEQ ID NO: 53182 - DNA, 21 bp, Homo sapiens
tccaaaacatggtaccactgc

SEQ ID NO: 53183 - DNA, 18 bp, Homo sapiens
tctaaacataactagctg

SEQ ID NO: 53184 - DNA, 20 bp, Homo sapiens
tctagacataacttcagacc

SEQ ID NO: 53185 - DNA, 19 bp, Homo sapiens
tctaggacaagacttccta

SEQ ID NO: 53186 - DNA, 22 bp, Homo sapiens
tcagaaacatgaatctgtacca

SEQ ID NO: 53187 - DNA, 18 bp, Homo sapiens
taaaacatgcctttgtac

SEQ ID NO: 53188 - DNA, 21 bp, Homo sapiens
tctaaaacaggtttcagtcca

SEQ ID NO: 53189 - DNA, 23 bp, Homo sapiens
tctaaaacgtgccttagtgtcca

SEQ ID NO: 53190 - DNA, 18 bp, Homo sapiens
tctaaaacaaaactacta

SEQ ID NO: 53191 - DNA, 22 bp, Homo sapiens
tctagggcataactcccaacca

SEQ ID NO: 53192 - DNA, 16 bp, Homo sapiens
taaaacatttctctgt

SEQ ID NO: 53193 - DNA, 18 bp, Homo sapiens
taaaacataaactttcca

SEQ ID NO: 53194 - DNA, 21 bp, Homo sapiens
tctaaaacagtaacttaaacc

SEQ ID NO: 53195 - DNA, 21 bp, Homo sapiens
tcttgaaataactttgtacca

SEQ ID NO: 53196 - DNA, 20 bp, Homo sapiens
tctaaaacagaactgggctg

SEQ ID NO: 53197 - DNA, 17 bp, Homo sapiens
ctaagacatctttctgt

SEQ ID NO: 53198 - DNA, 19 bp, Homo sapiens
tctagtacatgtcctgtac

SEQ ID NO: 53199 - DNA, 19 bp, Homo sapiens
ctgaaacataactatactg

SEQ ID NO: 53200 - DNA, 60 bp, Amsacta moorei entomopoxvirus
taataaaaatatatggccaaagttattccgaagataaaaaatataaatattctaatatta

SEQ ID NO: 53201 - DNA, 24 bp, Amsacta moorei entomopoxvirus
taaaaaatataaatattctaatat

SEQ ID NO: 53202 - DNA, 24 bp, Homo sapiens
taaaaaatataagccacctaatat

SEQ ID NO: 53203 - DNA, 66 bp, Melanoplus sanguinipes entomopoxvirus
caatataaataaattatcttttattatttcttttttaatataagttaaaattttaccagtatattg

SEQ ID NO: 53204 - DNA, 24 bp, Melanoplus sanguinipes entomopoxvirus
taagttaaaattttaccagtatat

SEQ ID NO: 53205 - DNA, 18 bp, Homo sapiens
agttaaaattttatccaa

SEQ ID NO: 53206 - DNA, 19 bp, Homo sapiens
taagtcagaagccagtata

SEQ ID NO: 53207 - DNA, 19 bp, Homo sapiens
agttatgatttaccagtat

SEQ ID NO: 53208 - DNA, 19 bp, Homo sapiens
taaattaaaagagaccagt

SEQ ID NO: 53209 - DNA, 73 bp, Human papillomavirus type 66
aaaggtaacgtgtaatcgccatatattgcaaccattgatttttgtgtaatttgtgtgtttgcgctttgctttt

SEQ ID NO: 53210 - DNA, 24 bp, Human papillomavirus type 66
taatttgtgtgtttgcgctttgct

SEQ ID NO: 53211 - DNA, 25 bp, Homo sapiens
taatttgtgtgtgtgcacgagggct

SEQ ID NO: 53212 - DNA, 21 bp, Homo sapiens
taatttgtgtttttgtttttg

SEQ ID NO: 53213 - DNA, 17 bp, Homo sapiens
tttgtgtgtttcgcttt

SEQ ID NO: 53214 - DNA, 17 bp, Homo sapiens
atttgtgtgtcttttgc

SEQ ID NO: 53215 - DNA, 16 bp, Homo sapiens
taatttgtatggcttt

SEQ ID NO: 53216 - DNA, 20 bp, Homo sapiens
taatttgtgttttgcgcttt

SEQ ID NO: 53217 - DNA, 16 bp, Homo sapiens
tttgcgtggcttttgc

SEQ ID NO: 53218 - DNA, 102 bp, Cercopithecine herpesvirus 7
gctgcgccccctaactatacaagcacgcaggtgcaaaccgaaaaccgtagcgtttccacgacttatgtacctccgtggttggaacacgaaagcaactgcagt

SEQ ID NO: 53219 - DNA, 24 bp, Cercopithecine herpesvirus 7
tacaagcacgcaggtgcaaaccga

SEQ ID NO: 53220 - DNA, 24 bp, Homo sapiens
caagagcgcaggcgcaagggaccg

SEQ ID NO: 53221 - DNA, 22 bp, Homo sapiens
taaagcacgcaggtagagccga

SEQ ID NO: 53222 - DNA, 19 bp, Homo sapiens
cacgcagcagggcaggtcg

SEQ ID NO: 53223 - DNA, 21 bp, Homo sapiens
aagcacacactacaagactga

SEQ ID NO: 53224 - DNA, 19 bp, Homo sapiens
aagtaccaatgcaaactga

SEQ ID NO: 53225 - DNA, 20 bp, Homo sapiens
tacaaacacaggctgtgggc

SEQ ID NO: 53226 - DNA, 20 bp, Homo sapiens
caaacacgtggctgggccga

SEQ ID NO: 53227 - DNA, 19 bp, Homo sapiens
tacaagtactaacagaagc

SEQ ID NO: 53228 - DNA, 18 bp, Homo sapiens
tacaagcaccaggatgac

SEQ ID NO: 53229 - DNA, 22 bp, Homo sapiens
caagcacggggtcacactccga

SEQ ID NO: 53230 - DNA, 18 bp, Homo sapiens
caggcacgaagcgggccg

SEQ ID NO: 53231 - DNA, 19 bp, Homo sapiens
agcgtcaggtgcaggccga

SEQ ID NO: 53232 - DNA, 25 bp, Homo sapiens
tacaagcagtgggtgagcaaagccg

SEQ ID NO: 53233 - DNA, 21 bp, Homo sapiens
caagcagcgggcgccgagccg

SEQ ID NO: 53234 - DNA, 26 bp, Homo sapiens
tacaggcacggggcggcaagggccga

SEQ ID NO: 53235 - DNA, 22 bp, Homo sapiens
caagcactgcgcgcgggggccg

SEQ ID NO: 53236 - DNA, 22 bp, Homo sapiens
tacaagcatcatgtgagaccga

SEQ ID NO: 53237 - DNA, 89 bp, Cercopithecine herpesvirus 7
gtcaggcatgtttgcgcatatataaaaacatacaacatacacgtaattttttggtgtttaaaacaaattgtattgtacatgaaattgac

SEQ ID NO: 53238 - DNA, 24 bp, Cercopithecine herpesvirus 7
ttaaaacaaattgtattgtacatg

SEQ ID NO: 53239 - DNA, 19 bp, Homo sapiens
aacaaatttactgtacatg

SEQ ID NO: 53240 - DNA, 26 bp, Homo sapiens
ttaaaacacattgtttcacatacatg

SEQ ID NO: 53241 - DNA, 22 bp, Homo sapiens
ctaggacaaaatactgtacatg

SEQ ID NO: 53242 - DNA, 22 bp, Homo sapiens
ttaaaacaagattagcactgta

SEQ ID NO: 53243 - DNA, 18 bp, Homo sapiens
ttaaaacaaattgttaca

SEQ ID NO: 53244 - DNA, 26 bp, Homo sapiens
ttaaaacaaaattgtaaccagccatg

SEQ ID NO: 53245 - DNA, 92 bp, Human herpesvirus 5
ccacgtcgttatcagcgtgctgtgtcacgccgtctcggccagcagcgtcaagatcgacgtgactattttgcaacgcaagattgacgagatgg

SEQ ID NO: 53246 - DNA, 24 bp, Human herpesvirus 5
caagatcgacgtgactattttgca

SEQ ID NO: 53247 - DNA, 19 bp, Homo sapiens
gatgagtgtatattttgca

SEQ ID NO: 53248 - DNA, 18 bp, Homo sapiens
caagattgggtgactacc

SEQ ID NO: 53249 - DNA, 21 bp, Homo sapiens
caacatcgatgtggccaggca

SEQ ID NO: 53250 - DNA, 18 bp, Homo sapiens
agggtcgacgcgagctgc

SEQ ID NO: 53251 - DNA, 19 bp, Homo sapiens
caggatcgacatgattctg

SEQ ID NO: 53252 - DNA, 18 bp, Homo sapiens
caagatgacttattttgc

SEQ ID NO: 53253 - DNA, 16 bp, Homo sapiens
ggagatcgacgttttg

SEQ ID NO: 53254 - DNA, 20 bp, Homo sapiens
aaatcaatggttattttgca

SEQ ID NO: 53255 - DNA, 21 bp, Homo sapiens
caaaattgataacattttgca

SEQ ID NO: 53256 - DNA, 19 bp, Homo sapiens
aaatccttcactattttgc

SEQ ID NO: 53257 - DNA, 15 bp, Homo sapiens
aaatcaactattttg

SEQ ID NO: 53258 - DNA, 21 bp, Homo sapiens
aagatctggcactattttgca

SEQ ID NO: 53259 - DNA, 81 bp, Gallid herpesvirus 3
gggtaatacgaattttgaattttgggagtatctgtcaagtatattcaactcttgaataaccacgaccaggcgtagctatcc

SEQ ID NO: 53260 - DNA, 24 bp, Gallid herpesvirus 3
tgggagtatctgtcaagtatattc

SEQ ID NO: 53261 - DNA, 16 bp, Homo sapiens
tgggagtatcttcagt

SEQ ID NO: 53262 - DNA, 26 bp, Homo sapiens
tgggatatctgtcaccttaaatattc

SEQ ID NO: 53263 - DNA, 19 bp, Homo sapiens
gaaatatgtcaagtgtatt

SEQ ID NO: 53264 - DNA, 17 bp, Homo sapiens
ggagtcctgagtatatt

SEQ ID NO: 53265 - DNA, 22 bp, Homo sapiens
tgggatatacttaagtatattc

SEQ ID NO: 53266 - DNA, 21 bp, Homo sapiens
tggagagttttgagtatattc

SEQ ID NO: 53267 - DNA, 71 bp, Gallid herpesvirus 3
cgctataccgtcctttaaattagacaaggtgcgcgtctctaaacctataattcccggtagcggtataagcg

SEQ ID NO: 53268 - DNA, 24 bp, Gallid herpesvirus 3
tttaaattagacaaggtgcgcgtc

SEQ ID NO: 53269 - DNA, 17 bp, Homo sapiens
tttaaattaggaaggta

SEQ ID NO: 53270 - DNA, 20 bp, Homo sapiens
tttaaattagacagtgggta

SEQ ID NO: 53271 - DNA, 22 bp, Homo sapiens
tttaaatttgacaaacactgtc

SEQ ID NO: 53272 - DNA, 21 bp, Homo sapiens
tttaaattgagtaaggtaagc

SEQ ID NO: 53273 - DNA, 63 bp, Porcine adenovirus C
ggcgaccgttgtgtggagttagaaaagagcacggacaccgtgcagggtccctacagcgccgcc

SEQ ID NO: 53274 - DNA, 24 bp, Porcine adenovirus C
gaccgttgtgtggagttagaaaag

SEQ ID NO: 53275 - DNA, 18 bp, Homo sapiens
gaccgctgtgtaggaaaa

SEQ ID NO: 53276 - DNA, 19 bp, Homo sapiens
gcggcagcggagttagaaa

SEQ ID NO: 53277 - DNA, 23 bp, Homo sapiens
cgcagccagtggagttaggaaag

SEQ ID NO: 53278 - DNA, 21 bp, Homo sapiens
gactgtgcaagagttgggaga

SEQ ID NO: 53279 - DNA, 19 bp, Homo sapiens
ctgttttgggttagaaaag

SEQ ID NO: 53280 - DNA, 23 bp, Homo sapiens
gttgttttgataacttagaaaag

SEQ ID NO: 53281 - DNA, 22 bp, Homo sapiens
gctgttggagcagttagaaaag

SEQ ID NO: 53282 - DNA, 17 bp, Homo sapiens
gctgtgtgtggtagaaa

SEQ ID NO: 53283 - DNA, 17 bp, Homo sapiens
gactgttgtgtgggcag

SEQ ID NO: 53284 - DNA, 19 bp, Homo sapiens
gttgtgtgtgtgctcagaa

SEQ ID NO: 53285 - DNA, 19 bp, Homo sapiens
ccgtgtgtggtggccaaaa

SEQ ID NO: 53286 - DNA, 20 bp, Homo sapiens
gactgcaggagttaggaaag

SEQ ID NO: 53287 - DNA, 19 bp, Homo sapiens
gactgtgttgcttagaaaa

SEQ ID NO: 53288 - DNA, 19 bp, Homo sapiens
gaccgttggtatgaagaag

SEQ ID NO: 53289 - DNA, 18 bp, Homo sapiens
gttggtaagttagagaag

SEQ ID NO: 53290 - DNA, 18 bp, Homo sapiens
gctgttgaccaagttaga

SEQ ID NO: 53291 - DNA, 18 bp, Homo sapiens
ccattgtgtgcgtggaaa

SEQ ID NO: 53292 - DNA, 21 bp, Homo sapiens
gttgtgtgcatgctaggaaag

SEQ ID NO: 53293 - DNA, 17 bp, Homo sapiens
cgctaatggagttagaa

SEQ ID NO: 53294 - DNA, 19 bp, Homo sapiens
ttgtgtggggtccataaag

SEQ ID NO: 53295 - DNA, 23 bp, Homo sapiens
gactgttatgtggagaacttaaa

SEQ ID NO: 53296 - DNA, 17 bp, Homo sapiens
gactgtgtgtgtgctga

SEQ ID NO: 53297 - DNA, 83 bp, Lymphocystis disease virus 1
gcagatctgttaacgcctgtagaacaatggactattattaaaaagtcattatttacaagctttacaaaagttgatggattagc

SEQ ID NO: 53298 - DNA, 24 bp, Lymphocystis disease virus 1
ttaacgcctgtagaacaatggact

SEQ ID NO: 53299 - DNA, 17 bp, Homo sapiens
ttaagcccaacaatgga

SEQ ID NO: 53300 - DNA, 17 bp, Homo sapiens
cctcaagacaatggact

SEQ ID NO: 53301 - DNA, 67 bp, Lymphocystis disease virus 1
tcaaattgaagatcatccaacagcgtatcattttttaatgtatgcaaaagatagaggcttaatttga

SEQ ID NO: 53302 - DNA, 24 bp, Lymphocystis disease virus 1
tgcaaaagatagaggcttaatttg

SEQ ID NO: 53303 - DNA, 19 bp, Homo sapiens
tgcaggaggtagaggctta

SEQ ID NO: 53304 - DNA, 17 bp, Homo sapiens
tgtgaaagataaggctt

SEQ ID NO: 53305 - DNA, 23 bp, Homo sapiens
tgcaaaatattgcacttaatttg

SEQ ID NO: 53306 - DNA, 21 bp, Homo sapiens
tgcaaaagattgaggcagaat

SEQ ID NO: 53307 - DNA, 17 bp, Homo sapiens
tgcaggagaagaggcct

SEQ ID NO: 53308 - DNA, 23 bp, Homo sapiens
tgcaaaagatatcatgtaatttg

SEQ ID NO: 53309 - DNA, 20 bp, Homo sapiens
tgcaaaaggctcttaatttg

SEQ ID NO: 53310 - DNA, 77 bp, Sheeppox virus
tgttgagatatgtacattaataaatatattccagaatcattttttgttatattattatccaaagtctatccccaaca

SEQ ID NO: 53311 - DNA, 24 bp, Sheeppox virus
ttatattattatccaaagtctatc

SEQ ID NO: 53312 - DNA, 22 bp, Homo sapiens
ttatgttatttccaaagccatc

SEQ ID NO: 53313 - DNA, 17 bp, Homo sapiens
ttatctccaagtctatc

SEQ ID NO: 53314 - DNA, 18 bp, Homo sapiens
ttatatatcaaagtctat

SEQ ID NO: 53315 - DNA, 19 bp, Homo sapiens
ttatattattatccacagc

SEQ ID NO: 53316 - DNA, 19 bp, Homo sapiens
ctaatatccaaagtttatc

SEQ ID NO: 53317 - DNA, 22 bp, Homo sapiens
ttatattcttatccaaactgtc

SEQ ID NO: 53318 - DNA, 84 bp, Sheeppox virus
gttttttttgtatttatatacaacaacacatagtttgtactaatgacagagtttatagtgttttttataaatatctaaaataac

SEQ ID NO: 53319 - DNA, 24 bp, Sheeppox virus
tatagtgttttttataaatatcta

SEQ ID NO: 53320 - DNA, 22 bp, Homo sapiens
gttacatttttataaatatcta

SEQ ID NO: 53321 - DNA, 20 bp, Homo sapiens
atatattttataaatatcta

SEQ ID NO: 53322 - DNA, 18 bp, Homo sapiens
gtgtacgtataaatatct

SEQ ID NO: 53323 - DNA, 17 bp, Homo sapiens
tagtgtaatataaatat

SEQ ID NO: 53324 - DNA, 22 bp, Homo sapiens
atagtgttttcctcaagtatct

SEQ ID NO: 53325 - DNA, 19 bp, Homo sapiens
tattctttataagtatcta

SEQ ID NO: 53326 - DNA, 24 bp, Homo sapiens
tatagtgctttaagaaaaatgtct

SEQ ID NO: 53327 - DNA, 123 bp, Variola virus
acctctttctgatggagtcgtaaaaagttttatctctttctctcttcgatggtctcacaaaaaatattaaacctctttctgatggagtcgtaaaaagttttatctctttctctcttcgatggt

SEQ ID NO: 53328 - DNA, 24 bp, Variola virus
tgatggagtcgtaaaaagttttat

SEQ ID NO: 53329 - DNA, 19 bp, Homo sapiens
tgatggaggttgtaagagt

SEQ ID NO: 53330 - DNA, 20 bp, Homo sapiens
atggacctaagaagttttat

SEQ ID NO: 53331 - DNA, 18 bp, Homo sapiens
tgatggagtctcttttta

SEQ ID NO: 53332 - DNA, 67 bp, Ectromelia virus
gtgagtatatattatctcgtccttggtttacatggatcagagtgagatacaatatctgaatacgtac

SEQ ID NO: 53333 - DNA, 24 bp, Ectromelia virus
tatattatctcgtccttggtttac

SEQ ID NO: 53334 - DNA, 17 bp, Homo sapiens
tatattatctgtctctg

SEQ ID NO: 53335 - DNA, 15 bp, Homo sapiens
ttatcccttggttta

SEQ ID NO: 53336 - DNA, 17 bp, Homo sapiens
atcttgtcctaatctac

SEQ ID NO: 53337 - DNA, 21 bp, Homo sapiens
tattttatctcgttccagatt

SEQ ID NO: 53338 - DNA, 76 bp, Ectromelia virus
tatcgcatttattggagacgtaacaatgtagcgcattgtttcctcgtctatctatatgttttgataagttgcgata

SEQ ID NO: 53339 - DNA, 24 bp, Ectromelia virus
tcgcatttattggagacgtaacaa

SEQ ID NO: 53340 - DNA, 18 bp, Homo sapiens
gcatttattggtagacat

SEQ ID NO: 53341 - DNA, 18 bp, Homo sapiens
tcgctttattgggtgcgt

SEQ ID NO: 53342 - DNA, 20 bp, Homo sapiens
tcgtatttattggaaaagca

SEQ ID NO: 53343 - DNA, 17 bp, Homo sapiens
catttattgctacataa

SEQ ID NO: 53344 - DNA, 17 bp, Homo sapiens
tccatttattagtaaca

SEQ ID NO: 53345 - DNA, 18 bp, Homo sapiens
tcatatttattggagagc

SEQ ID NO: 53346 - DNA, 20 bp, Homo sapiens
attcattaaatatgtaacaa

SEQ ID NO: 53347 - DNA, 28 bp, Homo sapiens
gcatttattgtcactaagatgtagcaat

SEQ ID NO: 53348 - DNA, 18 bp, Homo sapiens
tctattttggacgtaaca

SEQ ID NO: 53349 - DNA, 81 bp, Melanoplus sanguinipes entomopoxvirus
tttctaagaatttacaatctaaaatagtacatgattcacaatttaattctattaatgttgatggtaaattacatttagaaa

SEQ ID NO: 53350 - DNA, 24 bp, Melanoplus sanguinipes entomopoxvirus
taattctattaatgttgatggtaa

SEQ ID NO: 53351 - DNA, 17 bp, Homo sapiens
taattcatgttgatggt

SEQ ID NO: 53352 - DNA, 22 bp, Homo sapiens
taattccgttgatgtcttagta

SEQ ID NO: 53353 - DNA, 15 bp, Homo sapiens
ttctatctgatggta

SEQ ID NO: 53354 - DNA, 22 bp, Homo sapiens
taattcaattactcaatggtaa

SEQ ID NO: 53355 - DNA, 18 bp, Homo sapiens
attctattaatggtctgg

SEQ ID NO: 53356 - DNA, 20 bp, Homo sapiens
taattctgtgaattgatggt

SEQ ID NO: 53357 - DNA, 23 bp, Homo sapiens
taattctataattccattggtaa

SEQ ID NO: 53358 - DNA, 22 bp, Homo sapiens
taattttacaacttgatggtaa

SEQ ID NO: 53359 - DNA, 18 bp, Homo sapiens
taactctacattgatggt

SEQ ID NO: 53360 - DNA, 17 bp, Homo sapiens
ttccatgttgatggtaa

SEQ ID NO: 53361 - DNA, 99 bp, Human herpesvirus 5
ttttctccgtacaagaaatggacgtcacttgagcagacacagtttcatcgaccacgacagtctcatgatctgactacctctgacccgccaacgagaaaa

SEQ ID NO: 53362 - DNA, 24 bp, Human herpesvirus 5
tacaagaaatggacgtcacttgag

SEQ ID NO: 53363 - DNA, 20 bp, Homo sapiens
aagaaatggacgctaacgag

SEQ ID NO: 53364 - DNA, 24 bp, Homo sapiens
tacagaaatggggggcagcttgag

SEQ ID NO: 53365 - DNA, 19 bp, Homo sapiens
agaactgggtgcacccgag

SEQ ID NO: 53366 - DNA, 16 bp, Homo sapiens
caagaggatcacttga

SEQ ID NO: 53367 - DNA, 17 bp, Homo sapiens
agaaatggaagtttgag

SEQ ID NO: 53368 - DNA, 24 bp, Homo sapiens
tacaaaaaatgtaaaatatttgag

SEQ ID NO: 53369 - DNA, 26 bp, Homo sapiens
tacaagaaatgcacaggtattttgag

SEQ ID NO: 53370 - DNA, 22 bp, Homo sapiens
cacaagaagtgggcaacatgag

SEQ ID NO: 53371 - DNA, 21 bp, Homo sapiens
aaggagggcagatcacttgag

SEQ ID NO: 53372 - DNA, 19 bp, Homo sapiens
gaagtggacgtccccccag

SEQ ID NO: 53373 - DNA, 20 bp, Homo sapiens
acaagggcgggtcacttgag

SEQ ID NO: 53374 - DNA, 22 bp, Homo sapiens
acaaggcagtggacgtcacttg

SEQ ID NO: 53375 - DNA, 23 bp, Homo sapiens
agaggggaactcactcacttgag

SEQ ID NO: 53376 - DNA, 17 bp, Homo sapiens
tacaaagacatcatttg

SEQ ID NO: 53377 - DNA, 19 bp, Homo sapiens
tacaggaaatggaggtgca

SEQ ID NO: 53378 - DNA, 15 bp, Homo sapiens
aagaggatcacttga

SEQ ID NO: 53379 - DNA, 19 bp, Homo sapiens
tacaagaaatgtgctctga

SEQ ID NO: 53380 - DNA, 82 bp, Human herpesvirus 5
cccgtctccctctgtggtcgtgggtggtgcgagagtacacgatgggtggctctcgtctcgggggaccacagggggagggggg

SEQ ID NO: 53381 - DNA, 24 bp, Human herpesvirus 5
ctctcgtctcgggggaccacaggg

SEQ ID NO: 53382 - DNA, 22 bp, Homo sapiens
ctcaagagtggggactgcaggg

SEQ ID NO: 53383 - DNA, 20 bp, Homo sapiens
tctctctcaaaactgcaggg

SEQ ID NO: 53384 - DNA, 17 bp, Homo sapiens
gtctcggggaccacagg

SEQ ID NO: 53385 - DNA, 15 bp, Homo sapiens
gccagggccacaggg

SEQ ID NO: 53386 - DNA, 18 bp, Homo sapiens
tcgcgtcccggccgcagg

SEQ ID NO: 53387 - DNA, 18 bp, Homo sapiens
ctccgtctcgggggcggg

SEQ ID NO: 53388 - DNA, 21 bp, Homo sapiens
tctcgcctcctggccacaggg

SEQ ID NO: 53389 - DNA, 23 bp, Homo sapiens
ccctcgaggcaggggtcgtgggg

SEQ ID NO: 53390 - DNA, 21 bp, Homo sapiens
ctcctgtctcaaactgcaggg

SEQ ID NO: 53391 - DNA, 16 bp, Homo sapiens
gtctaagaccacaggg

SEQ ID NO: 53392 - DNA, 20 bp, Homo sapiens
tcgcctggtagaccacaggg

SEQ ID NO: 53393 - DNA, 20 bp, Homo sapiens
ctcccgtcggggactgcggg

SEQ ID NO: 53394 - DNA, 18 bp, Homo sapiens
ctctctgtctgccacagg

SEQ ID NO: 53395 - DNA, 24 bp, Homo sapiens
ctttcgtctggggaccagtcaggg

SEQ ID NO: 53396 - DNA, 26 bp, Homo sapiens
tctcatcttgggggatctgtacaggg

SEQ ID NO: 53397 - DNA, 23 bp, Homo sapiens
ctctttggtctggggttatgggg

SEQ ID NO: 53398 - DNA, 18 bp, Homo sapiens
ctcttcttagaccacagg

SEQ ID NO: 53399 - DNA, 22 bp, Homo sapiens
ctctcttcagaggactgcaggg

SEQ ID NO: 53400 - DNA, 22 bp, Homo sapiens
ctctctctgcttggccacgggg

SEQ ID NO: 53401 - DNA, 19 bp, Homo sapiens
ctcatcaggggaccatagg

SEQ ID NO: 53402 - DNA, 26 bp, Homo sapiens
ctcccacctctcgggggactgcaggg

SEQ ID NO: 53403 - DNA, 19 bp, Homo sapiens
ctccgtgggggccacaggg

SEQ ID NO: 53404 - DNA, 20 bp, Homo sapiens
tctctcccagggtcacaggg

SEQ ID NO: 53405 - DNA, 21 bp, Homo sapiens
ctcttgtctgggggaaccggg

SEQ ID NO: 53406 - DNA, 69 bp, Human herpesvirus 5
ggcatgtcggccgacaaatcgcagctgtcttcgccgccgcagctgtagcagttaacgtcgccggcctcc

SEQ ID NO: 53407 - DNA, 24 bp, Human herpesvirus 5
tgtagcagttaacgtcgccggcct

SEQ ID NO: 53408 - DNA, 23 bp, Homo sapiens
tgcagcagttggcagtgcggcct

SEQ ID NO: 53409 - DNA, 23 bp, Homo sapiens
tgtaacagtgttcttgctggtct

SEQ ID NO: 53410 - DNA, 71 bp, Yaba-like disease virus
aatcacatatataatacttctaatatgtaaagaaataatatgttacaatagcggcgatgatatgtatgatt

SEQ ID NO: 53411 - DNA, 24 bp, Yaba-like disease virus
caatagcggcgatgatatgtatga

SEQ ID NO: 53412 - DNA, 20 bp, Homo sapiens
aacagcggcggtggctttgt

SEQ ID NO: 53413 - DNA, 18 bp, Homo sapiens
acgataatgatatgtatg

SEQ ID NO: 53414 - DNA, 23 bp, Homo sapiens
tgatagctgcaaaatatgtatga

SEQ ID NO: 53415 - DNA, 25 bp, Homo sapiens
cagtggcgatgatgattctctatga

SEQ ID NO: 53416 - DNA, 19 bp, Homo sapiens
ggagaacaaatatgtatga

SEQ ID NO: 53417 - DNA, 18 bp, Homo sapiens
tagaggcggtgatgcatg

SEQ ID NO: 53418 - DNA, 19 bp, Homo sapiens
tagcggcgatggcagctga

SEQ ID NO: 53419 - DNA, 21 bp, Homo sapiens
tgagcaagtatgatatgtatg

SEQ ID NO: 53420 - DNA, 19 bp, Homo sapiens
caagtggtgaatatgtatg

SEQ ID NO: 53421 - DNA, 111 bp, Vaccinia virus
catcttttaccaacacaaagggtggatatttgttcattggagttgataataatacacacaaagtatttggattcacggtgggttacgactacctcagactggtagagaatg

SEQ ID NO: 53422 - DNA, 24 bp, Vaccinia virus
tcttttaccaacacaaagggtgga

SEQ ID NO: 53423 - DNA, 24 bp, Homo sapiens
tctttatactacatatagggtgga

SEQ ID NO: 53424 - DNA, 19 bp, Homo sapiens
tcttctaccagcacgatgg

SEQ ID NO: 53425 - DNA, 24 bp, Homo sapiens
tctcttgctgagggcaagggtgga

SEQ ID NO: 53426 - DNA, 16 bp, Homo sapiens
tcttttacaggtgtga

SEQ ID NO: 53427 - DNA, 24 bp, Homo sapiens
tcttttacaaacacgacttaaaga

SEQ ID NO: 53428 - DNA, 22 bp, Homo sapiens
tcttttactggtagaaaagtgg

SEQ ID NO: 53429 - DNA, 25 bp, Homo sapiens
ttttaccaactccttaaaggggtgg

SEQ ID NO: 53430 - DNA, 18 bp, Homo sapiens
tctcttaccaacacgggg

SEQ ID NO: 53431 - DNA, 17 bp, Homo sapiens
tcttttaccagcaggtg

SEQ ID NO: 53432 - DNA, 21 bp, Homo sapiens
tcttttattacccagggtgga

SEQ ID NO: 53433 - DNA, 22 bp, Homo sapiens
ctctggccagtatgaagggtgg

SEQ ID NO: 53434 - DNA, 22 bp, Homo sapiens
tcttttaccaaccagcctaggg

SEQ ID NO: 53435 - DNA, 19 bp, Homo sapiens
tcttttaccagagcaagga

SEQ ID NO: 53436 - DNA, 18 bp, Homo sapiens
ttttaccagacatgaggg

SEQ ID NO: 53437 - DNA, 17 bp, Homo sapiens
tcttttaccaatgagga

SEQ ID NO: 53438 - DNA, 18 bp, Homo sapiens
ttttaccaacaaagcctg

SEQ ID NO: 53439 - DNA, 21 bp, Homo sapiens
tttttccagaaatagggtgga

SEQ ID NO: 53440 - DNA, 19 bp, Homo sapiens
tcttttaccagtactacaa

SEQ ID NO: 53441 - DNA, 20 bp, Homo sapiens
accaaagcacaaagggtgga

SEQ ID NO: 53442 - DNA, 19 bp, Homo sapiens
ttttaccaatgtggttgga

SEQ ID NO: 53443 - DNA, 64 bp, Vaccinia virus
gtacgcgtgtcgattcatcaaggtatataaacctggggatgaggctacctcgacatacgtgtgc

SEQ ID NO: 53444 - DNA, 24 bp, Vaccinia virus
acgcgtgtcgattcatcaaggtat

SEQ ID NO: 53445 - DNA, 18 bp, Homo sapiens
gtgttatcatcaaggtat

SEQ ID NO: 53446 - DNA, 19 bp, Homo sapiens
cgcgtgtcggttcgtcggc

SEQ ID NO: 53447 - DNA, 22 bp, Homo sapiens
cacgtgtgtatggaatcaaggt

SEQ ID NO: 53448 - DNA, 21 bp, Homo sapiens
acgtgtgttgactttatcaag

SEQ ID NO: 53449 - DNA, 129 bp, Yaba-like disease virus
tacctttaggtgttaggatatatcaattatacagtaccgatatattttttgaaaattttatttatcgaactagcacattggtatttgagaatgtagatatatcagacgataataaaacatttgaatgtg

SEQ ID NO: 53450 - DNA, 17 bp, Yaba-like disease virus
taaaacatttgaatgtg

SEQ ID NO: 53451 - DNA, 18 bp, Homo sapiens
taaaacatttaaatagtg

SEQ ID NO: 53452 - DNA, 20 bp, Homo sapiens
taaaacacttgaaatctgtg

SEQ ID NO: 53453 - DNA, 18 bp, Homo sapiens
caaaacacctgcaatgtg

SEQ ID NO: 53454 - DNA, 18 bp, Homo sapiens
taaaacatttaaaatgtg

SEQ ID NO: 53455 - DNA, 72 bp, Swinepox virus
cttcatttacagtaaatataggcatatatccaaaatctatatatgctttgtccgtagatactataaatgtag

SEQ ID NO: 53456 - DNA, 24 bp, Swinepox virus
tgctttgtccgtagatactataaa

SEQ ID NO: 53457 - DNA, 26 bp, Homo sapiens
tgctttattcttacaaatactgtaaa

SEQ ID NO: 53458 - DNA, 19 bp, Homo sapiens
tgctttattcgtaggtcta

SEQ ID NO: 53459 - DNA, 21 bp, Homo sapiens
tgctttgccccagtgtactat

SEQ ID NO: 53460 - DNA, 22 bp, Homo sapiens
tgctttatttccttagtactat

SEQ ID NO: 53461 - DNA, 18 bp, Homo sapiens
tgctttgtcagatataca

SEQ ID NO: 53462 - DNA, 22 bp, Homo sapiens
ctttgtgaaaggatactataaa

SEQ ID NO: 53463 - DNA, 19 bp, Homo sapiens
tgctttgtctgtaggcact

SEQ ID NO: 53464 - DNA, 25 bp, Homo sapiens
tgccttgtctgtaaacagctgtaaa

SEQ ID NO: 53465 - DNA, 22 bp, Homo sapiens
tgttttgccttcctactataaa

SEQ ID NO: 53466 - DNA, 68 bp, Gallid herpesvirus 2
gaccagtcagccgcgaacggaaataacgccgaatcgagctcctctaattccgataaccggctgttgtc

SEQ ID NO: 53467 - DNA, 24 bp, Gallid herpesvirus 2
agtcagccgcgaacggaaataacg

SEQ ID NO: 53468 - DNA, 19 bp, Homo sapiens
agtcagccccgggactgac

SEQ ID NO: 53469 - DNA, 18 bp, Homo sapiens
agtcagctctgaacgaaa

SEQ ID NO: 53470 - DNA, 26 bp, Homo sapiens
agtcagcctgggctccgcaaataacg

SEQ ID NO: 53471 - DNA, 19 bp, Homo sapiens
agtcagcctgaatgggaaa

SEQ ID NO: 53472 - DNA, 76 bp, Clover yellow mosaic virus
ggcttggcccatcaactgctaaactgattagggagactttaaacatccccttagaaggcacgggagacgccgagct

SEQ ID NO: 53473 - DNA, 24 bp, Clover yellow mosaic virus
ttagaaggcacgggagacgccgag

SEQ ID NO: 53474 - DNA, 21 bp, Homo sapiens
ttagcgggcacggggaggagc

SEQ ID NO: 53475 - DNA, 18 bp, Homo sapiens
aggaggtaggagacgtcg

SEQ ID NO: 53476 - DNA, 20 bp, Homo sapiens
aggggcgggagacgggcgag

SEQ ID NO: 53477 - DNA, 19 bp, Homo sapiens
ttagaaggcacattgctga

SEQ ID NO: 53478 - DNA, 18 bp, Homo sapiens
ctagaaggcagaggatgc

SEQ ID NO: 53479 - DNA, 22 bp, Homo sapiens
agaaggcatcagaggcgctgag

SEQ ID NO: 53480 - DNA, 27 bp, Homo sapiens
ttagaaggtttgctgtggggtgccgag

SEQ ID NO: 53481 - DNA, 19 bp, Homo sapiens
ttagaaggagcggagccga

SEQ ID NO: 53482 - DNA, 62 bp, Paramecium bursaria Chlorella virus 1
acagacagttctttgtgaacgacattttctcgtgtagaactcttgaagaacttttcgtctgt

SEQ ID NO: 53483 - DNA, 24 bp, Paramecium bursaria Chlorella virus 1
tagaactcttgaagaacttttcgt

SEQ ID NO: 53484 - DNA, 19 bp, Homo sapiens
gaacttttgaagtcccctt

SEQ ID NO: 53485 - DNA, 18 bp, Homo sapiens
cagaactccaatttttcg

SEQ ID NO: 53486 - DNA, 61 bp, Murid herpesvirus 4
ggtgtgtgggcggcgtacaacatgcgcatatttgcgcagcacaagtacaatttcacgtatt

SEQ ID NO: 53487 - DNA, 24 bp, Murid herpesvirus 4
cagcacaagtacaatttcacgtat

SEQ ID NO: 53488 - DNA, 23 bp, Homo sapiens
cagcacaaagtacaatccagtat

SEQ ID NO: 53489 - DNA, 21 bp, Homo sapiens
cagcatgagtacaatcaacat

SEQ ID NO: 53490 - DNA, 18 bp, Homo sapiens
caccacagaatttcacgt

SEQ ID NO: 53491 - DNA, 21 bp, Homo sapiens
cagcttgagttttcttcacgt

SEQ ID NO: 53492 - DNA, 19 bp, Homo sapiens
agcacaaatataatttaca

SEQ ID NO: 53493 - DNA, 19 bp, Homo sapiens
cagctgagtatttcacgta

SEQ ID NO: 53494 - DNA, 21 bp, Homo sapiens
gccactctcaatttcatgtat

SEQ ID NO: 53495 - DNA, 18 bp, Homo sapiens
gcaagtacaattttacat

SEQ ID NO: 53496 - DNA, 22 bp, Homo sapiens
gcacaagttggttttagcgtat

SEQ ID NO: 53497 - DNA, 17 bp, Homo sapiens
gcacagtacaattcagt

SEQ ID NO: 53498 - DNA, 18 bp, Homo sapiens
cacaggtacttcacgtat

SEQ ID NO: 53499 - DNA, 131 bp, Murid herpesvirus 4
aggatttttgcaactcttctaaggatatagtgagtttcatgatcttcaccaaagcacaaaacacccgtcaggtcatagggtttgggagataccatgagcctgactatagataatagaggattgcttgtgct

SEQ ID NO: 53500 - DNA, 24 bp, Murid herpesvirus 4
taccatgagcctgactatagataa

SEQ ID NO: 53501 - DNA, 18 bp, Homo sapiens
catgtggcctgactgtag

SEQ ID NO: 53502 - DNA, 17 bp, Homo sapiens
catgggtgccatagata

SEQ ID NO: 53503 - DNA, 15 bp, Homo sapiens
taccatgagctagat

SEQ ID NO: 53504 - DNA, 20 bp, Homo sapiens
taccatgatgcttcacagat

SEQ ID NO: 53505 - DNA, 20 bp, Homo sapiens
taccatgagcttcttagata

SEQ ID NO: 53506 - DNA, 19 bp, Homo sapiens
taccatgagcttcgtgact

SEQ ID NO: 53507 - DNA, 18 bp, Homo sapiens
taccatgagccagattat

SEQ ID NO: 53508 - DNA, 21 bp, Homo sapiens
ccagggcctggttatagacaa

SEQ ID NO: 53509 - DNA, 17 bp, Homo sapiens
ccatgaagatatagata

SEQ ID NO: 53510 - DNA, 18 bp, Homo sapiens
cctgagcctggcccacag

SEQ ID NO: 53511 - DNA, 23 bp, Homo sapiens
taccatgagcttatatatagata

SEQ ID NO: 53512 - DNA, 18 bp, Homo sapiens
cagagcctgacacacaga

SEQ ID NO: 53513 - DNA, 18 bp, Homo sapiens
catgagcctggcctataa

SEQ ID NO: 53514 - DNA, 19 bp, Homo sapiens
tacctgatttactatagat

SEQ ID NO: 53515 - DNA, 119 bp, Melanoplus sanguinipes entomopoxvirus
ttacataaggtttttacaaatattgacttgttatttattaaacaaatgggacatataacactttcattaaatttaatataatatttattcaatatttttttataatttaacttatgtaa

SEQ ID NO: 53516 - DNA, 24 bp, Melanoplus sanguinipes entomopoxvirus
tataatatttattcaatatttttt

SEQ ID NO: 53517 - DNA, 19 bp, Homo sapiens
taatatttattcatatttt

SEQ ID NO: 53518 - DNA, 20 bp, Homo sapiens
tataacatttattcatattt

SEQ ID NO: 53519 - DNA, 127 bp, Spleen focus-forming virus
gggtacacgaaaacagctaacgttgggccaaacaagatatctgcggtaagcagtttcggccccggcccggggccaagaacagatggtccccagatatggcccaaccctcagcagtttcttaagaccc

SEQ ID NO: 53520 - DNA, 24 bp, Spleen focus-forming virus
acgttgggccaaacaagatatctg

SEQ ID NO: 53521 - DNA, 17 bp, Homo sapiens
gttgggccaagaggtct

SEQ ID NO: 53522 - DNA, 19 bp, Homo sapiens
gttgggccgaacagcagat

SEQ ID NO: 53523 - DNA, 16 bp, Homo sapiens
gctgggccagcacctg

SEQ ID NO: 53524 - DNA, 19 bp, Homo sapiens
gttgggccacacagccctg

SEQ ID NO: 53525 - DNA, 19 bp, Homo sapiens
gttgggctgaaaacatctg

SEQ ID NO: 53526 - DNA, 20 bp, Homo sapiens
gttggaccaggcagaatctg

SEQ ID NO: 53527 - DNA, 16 bp, Homo sapiens
gttgggccagagatct

SEQ ID NO: 53528 - DNA, 79 bp, Spleen focus-forming virus
ggttagttcaatttgttaaagacaggatctcagtagtccaggctttagtcctgactcaacaataccaccagctaaaacc

SEQ ID NO: 53529 - DNA, 24 bp, Spleen focus-forming virus
ttagtcctgactcaacaataccac

SEQ ID NO: 53530 - DNA, 20 bp, Homo sapiens
ttagtcctgctcgaaaacac

SEQ ID NO: 53531 - DNA, 16 bp, Homo sapiens
ttagcatgacaatacc

SEQ ID NO: 53532 - DNA, 18 bp, Homo sapiens
ttagttctgcctcaacaa

SEQ ID NO: 53533 - DNA, 20 bp, Homo sapiens
gtgccattcaacaatactac

SEQ ID NO: 53534 - DNA, 15 bp, Homo sapiens
gtcctgactcaacca

SEQ ID NO: 53535 - DNA, 82 bp, Rice stripe virus
atagaaaatcaaaaacaatgaatggtgctaagcaccacatccggatgtggtgcgtagcaccattttcataacattaatctat

SEQ ID NO: 53536 - DNA, 24 bp, Rice stripe virus
tgcgtagcaccattttcataacat

SEQ ID NO: 53537 - DNA, 18 bp, Homo sapiens
tgtgtacaccattacaca

SEQ ID NO: 53538 - DNA, 21 bp, Homo sapiens
tgtgtagcaccaaactaacat

SEQ ID NO: 53539 - DNA, 16 bp, Homo sapiens
gtagtcattcataaca

SEQ ID NO: 53540 - DNA, 18 bp, Homo sapiens
tgtgtacatcattttcac

SEQ ID NO: 53541 - DNA, 65 bp, Rice stripe virus
gagcagaacaaaccacatcaagtgcatagcacaagatgttagcatactccggaactggttatctc

SEQ ID NO: 53542 - DNA, 24 bp, Rice stripe virus
caagatgttagcatactccggaac

SEQ ID NO: 53543 - DNA, 16 bp, Homo sapiens
caagatgtcagctgga

SEQ ID NO: 53544 - DNA, 21 bp, Homo sapiens
tgaatgttagcatatgaaaga

SEQ ID NO: 53545 - DNA, 18 bp, Homo sapiens
tgagatgttagcaatact

SEQ ID NO: 53546 - DNA, 18 bp, Homo sapiens
agatgttagcatcctgga

SEQ ID NO: 53547 - DNA, 19 bp, Homo sapiens
tgaatgttagacactggga

SEQ ID NO: 53548 - DNA, 18 bp, Homo sapiens
aaatgttagcatatcaaa

SEQ ID NO: 53549 - DNA, 17 bp, Homo sapiens
gatgttagtatatggaa

SEQ ID NO: 53550 - DNA, 20 bp, Homo sapiens
agggtgttagcaggcttgga

SEQ ID NO: 53551 - DNA, 21 bp, Homo sapiens
caaggtcgagccttactccgg

SEQ ID NO: 53552 - DNA, 20 bp, Homo sapiens
aggggttagccttcctggaa

SEQ ID NO: 53553 - DNA, 19 bp, Homo sapiens
caagatgtttccactttgg

SEQ ID NO: 53554 - DNA, 18 bp, Homo sapiens
tgagatgtggctccggaa

SEQ ID NO: 53555 - DNA, 20 bp, Homo sapiens
caagacactgtactctggaa

SEQ ID NO: 53556 - DNA, 21 bp, Homo sapiens
gatgtcaggaatgctccggaa

SEQ ID NO: 53557 - DNA, 19 bp, Homo sapiens
aagatgttagtctgaagaa

SEQ ID NO: 53558 - DNA, 23 bp, Homo sapiens
tgaaatgttagtatacttaaaga

SEQ ID NO: 53559 - DNA, 16 bp, Homo sapiens
aagatgttacatccgg

SEQ ID NO: 53560 - DNA, 17 bp, Homo sapiens
gatgttagatgctggaa

SEQ ID NO: 53561 - DNA, 16 bp, Homo sapiens
aagatgttatcatgga

SEQ ID NO: 53562 - DNA, 17 bp, Homo sapiens
atgttggcgactccgga

SEQ ID NO: 53563 - DNA, 126 bp, Monkeypox virus
gtgctttaacgtcaatggtacaaattttatcctcgctttgtgtatcatattcgtctctagtataaaattctatattcaaattatcatgcgatgtgtatacgctaacggtatcaataaacggagcac

SEQ ID NO: 53564 - DNA, 24 bp, Monkeypox virus
aatggtacaaattttatcctcgct

SEQ ID NO: 53565 - DNA, 22 bp, Homo sapiens
aatagtacaaattcctattgct

SEQ ID NO: 53566 - DNA, 20 bp, Homo sapiens
aatagtacaaattttgtccc

SEQ ID NO: 53567 - DNA, 21 bp, Homo sapiens
atggacatgtttatccttgct

SEQ ID NO: 53568 - DNA, 18 bp, Homo sapiens
tggttcaaattttgccct

SEQ ID NO: 53569 - DNA, 21 bp, Homo sapiens
gccttaaattttattttcgct

SEQ ID NO: 53570 - DNA, 22 bp, Homo sapiens
tggtataggatttaccctcgct

SEQ ID NO: 53571 - DNA, 21 bp, Homo sapiens
ggcaatgattttatccttgct

SEQ ID NO: 53572 - DNA, 18 bp, Homo sapiens
tggtatggatttcacctc

SEQ ID NO: 53573 - DNA, 22 bp, Homo sapiens
atggtacaaattttgcaaagcc

SEQ ID NO: 53574 - DNA, 18 bp, Homo sapiens
aatggtgtaaatcttatc

SEQ ID NO: 53575 - DNA, 99 bp, Avian carcinoma virus
ggccggaccgttgattccctgacgactacgagcacatgcatgaagcagaaggcttcatttggtgaccccgacgtgatcgttagggaatagtggtcggcc

SEQ ID NO: 53576 - DNA, 24 bp, Avian carcinoma virus
tccctgacgactacgagcacatgc

SEQ ID NO: 53577 - DNA, 16 bp, Homo sapiens
cctgagaaagcacatg

SEQ ID NO: 53578 - DNA, 20 bp, Homo sapiens
cctgcagactgagcacatgc

SEQ ID NO: 53579 - DNA, 16 bp, Homo sapiens
tccctgacacacgcat

SEQ ID NO: 53580 - DNA, 20 bp, Homo sapiens
tccctgacgatctatacatg

SEQ ID NO: 53581 - DNA, 17 bp, Homo sapiens
ccttgctagagcacatg

SEQ ID NO: 53582 - DNA, 20 bp, Homo sapiens
tccctgaccacaccctcatg

SEQ ID NO: 53583 - DNA, 25 bp, Homo sapiens
tccctgacgatctataacctacatg

SEQ ID NO: 53584 - DNA, 22 bp, Homo sapiens
tccctgacgtcactttacatgc

SEQ ID NO: 53585 - DNA, 60 bp, Avian carcinoma virus
ctgagtgacgtcggagggagctccacggccgggggccaagataccctaccgagaactcag

SEQ ID NO: 53586 - DNA, 19 bp, Avian carcinoma virus
taccctaccgagaactcag

SEQ ID NO: 53587 - DNA, 15 bp, Homo sapiens
caccccggaactcag

SEQ ID NO: 53588 - DNA, 17 bp, Homo sapiens
taccctacagaaaccag

SEQ ID NO: 53589 - DNA, 19 bp, Homo sapiens
accttcaccgagaactcag

SEQ ID NO: 53590 - DNA, 18 bp, Homo sapiens
tactctaccaaatatcag

SEQ ID NO: 53591 - DNA, 18 bp, Homo sapiens
tacccaagagaaactcag

SEQ ID NO: 53592 - DNA, 18 bp, Homo sapiens
cctctcccaagaactcag

SEQ ID NO: 53593 - DNA, 18 bp, Homo sapiens
taccctaccaaaattcag

SEQ ID NO: 53594 - DNA, 17 bp, Homo sapiens
cacccacaggaactcag

SEQ ID NO: 53595 - DNA, 17 bp, Homo sapiens
acccccaatgaactcag

SEQ ID NO: 53596 - DNA, 17 bp, Homo sapiens
acccttaaagaactcag

SEQ ID NO: 53597 - DNA, 19 bp, Homo sapiens
taccccaccaacccctcag

SEQ ID NO: 53598 - DNA, 19 bp, Homo sapiens
taccctagtctaaactcag

SEQ ID NO: 53599 - DNA, 21 bp, Homo sapiens
caccctacccccacaactcag

SEQ ID NO: 53600 - DNA, 17 bp, Homo sapiens
tactttaccaaactcag

SEQ ID NO: 53601 - DNA, 17 bp, Homo sapiens
caccctaccgaaaccag

SEQ ID NO: 53602 - DNA, 16 bp, Homo sapiens
actctagaaaactcag

SEQ ID NO: 53603 - DNA, 17 bp, Homo sapiens
cactctcccaaactcag

SEQ ID NO: 53604 - DNA, 22 bp, Homo sapiens
taccctacaggagattattcag

SEQ ID NO: 53605 - DNA, 18 bp, Homo sapiens
cacctgcacagaactcag

SEQ ID NO: 53606 - DNA, 16 bp, Homo sapiens
acccttccaaactcag

SEQ ID NO: 53607 - DNA, 16 bp, Homo sapiens
cacccagagaactcag

SEQ ID NO: 53608 - DNA, 21 bp, Homo sapiens
caccctactccacctgctcag

SEQ ID NO: 53609 - DNA, 130 bp, Vaccinia virus
ccacctgttttaacatataataggcaggagatagatatccgtcattgcaatattccttttcgtaggcacacaatctaatattgataaaatctccattctcttctctgcatttattatcttgtttcggtgg

SEQ ID NO: 53610 - DNA, 24 bp, Vaccinia virus
taatattgataaaatctccattct

SEQ ID NO: 53611 - DNA, 19 bp, Homo sapiens
actgtaaaatctctgttct

SEQ ID NO: 53612 - DNA, 18 bp, Homo sapiens
tattgtattctctccatt

SEQ ID NO: 53613 - DNA, 25 bp, Homo sapiens
taatattgagttttatttccattct

SEQ ID NO: 53614 - DNA, 20 bp, Homo sapiens
atattataaatttccattct

SEQ ID NO: 53615 - DNA, 23 bp, Homo sapiens
taatattaataaaacccaattct

SEQ ID NO: 53616 - DNA, 25 bp, Homo sapiens
taatattgttaaaacaaaaaccatt

SEQ ID NO: 53617 - DNA, 21 bp, Homo sapiens
taatttggtacactccattct

SEQ ID NO: 53618 - DNA, 19 bp, Homo sapiens
tattgataagatgaccatt

SEQ ID NO: 53619 - DNA, 22 bp, Homo sapiens
taatattagtgggctccattct

SEQ ID NO: 53620 - DNA, 17 bp, Homo sapiens
taaaattgatctccatt

SEQ ID NO: 53621 - DNA, 23 bp, Homo sapiens
acattgatagaaatccctgttct

SEQ ID NO: 53622 - DNA, 18 bp, Homo sapiens
tgtataagtctccattct

SEQ ID NO: 53623 - DNA, 19 bp, Homo sapiens
tattaaactgctccattct

SEQ ID NO: 53624 - DNA, 19 bp, Homo sapiens
tattgataacaacctcatt

SEQ ID NO: 53625 - DNA, 21 bp, Homo sapiens
atattgataatttatcattct

SEQ ID NO: 53626 - DNA, 61 bp, Hendra virus
ctaaatagtttaatccaataaattgaggataatcaattcttgcattgcataaactcgttag

SEQ ID NO: 53627 - DNA, 22 bp, Hendra virus
ttgcattgcataaactcgttag

SEQ ID NO: 53628 - DNA, 18 bp, Homo sapiens
cattgcatagaacgttag

SEQ ID NO: 53629 - DNA, 17 bp, Homo sapiens
ttgcttgcataaagaca

SEQ ID NO: 53630 - DNA, 20 bp, Homo sapiens
ttgcattgcagaaatgccag

SEQ ID NO: 53631 - DNA, 23 bp, Homo sapiens
ctgcattgcataagcctgactag

SEQ ID NO: 53632 - DNA, 21 bp, Homo sapiens
tcgcattgcatctggggttag

SEQ ID NO: 53633 - DNA, 17 bp, Homo sapiens
ttgcattgcataattca

SEQ ID NO: 53634 - DNA, 19 bp, Homo sapiens
ttacgttgcaactcgttag

SEQ ID NO: 53635 - DNA, 17 bp, Homo sapiens
ttgcttgcataaataca

SEQ ID NO: 53636 - DNA, 20 bp, Homo sapiens
ttgcattgcaaatctcttag

SEQ ID NO: 53637 - DNA, 20 bp, Homo sapiens
ttgcattatataggttcgtt

SEQ ID NO: 53638 - DNA, 69 bp, Vaccinia virus
acacgactgtggtagatttgttctatagagccggttgccgcaaatagatagaactaccaatatgtctgt

SEQ ID NO: 53639 - DNA, 24 bp, Vaccinia virus
tgtggtagatttgttctatagagc

SEQ ID NO: 53640 - DNA, 24 bp, Homo sapiens
tgtagtaggtttgtttacaccagc

SEQ ID NO: 53641 - DNA, 25 bp, Homo sapiens
tggtggatttgttttaatacagagc

SEQ ID NO: 53642 - DNA, 17 bp, Homo sapiens
tgtggtaatttgcatag

SEQ ID NO: 53643 - DNA, 17 bp, Homo sapiens
tggtagatgttgtggag

SEQ ID NO: 53644 - DNA, 21 bp, Homo sapiens
tgtggtaatttgttacagagc

SEQ ID NO: 53645 - DNA, 20 bp, Homo sapiens
gtagacatgttctatagagc

SEQ ID NO: 53646 - DNA, 78 bp, Vaccinia virus
acagtttgaaaaataacagtatcatttaaacatttaacttgcggggttaatttcacaactttactgtttttaagctgt

SEQ ID NO: 53647 - DNA, 24 bp, Vaccinia virus
aacagtatcatttaaacatttaac

SEQ ID NO: 53648 - DNA, 20 bp, Homo sapiens
gtatgaacccaaacatttaa

SEQ ID NO: 53649 - DNA, 17 bp, Homo sapiens
cagtatcattatcattt

SEQ ID NO: 53650 - DNA, 21 bp, Homo sapiens
acagtatcatcactttcattt

SEQ ID NO: 53651 - DNA, 16 bp, Homo sapiens
aacagtatcacattta

SEQ ID NO: 53652 - DNA, 24 bp, Homo sapiens
aacagaagacagaaaacatttaac

SEQ ID NO: 53653 - DNA, 19 bp, Homo sapiens
agtatcatggtccatttaa

SEQ ID NO: 53654 - DNA, 21 bp, Homo sapiens
acagtaggttctaaacattta

SEQ ID NO: 53655 - DNA, 19 bp, Homo sapiens
cagtaccattcactgattt

SEQ ID NO: 53656 - DNA, 21 bp, Homo sapiens
acagtattcatcacatttaac

SEQ ID NO: 53657 - DNA, 20 bp, Homo sapiens
agtatcaattgacacctaac

SEQ ID NO: 53658 - DNA, 23 bp, Homo sapiens
aacagtacataaaattacattta

SEQ ID NO: 53659 - DNA, 19 bp, Homo sapiens
agtatcatttaacatgcaa

SEQ ID NO: 53660 - DNA, 131 bp, Maize chlorotic dwarf waikavirus
gggacagaaaagagattggaacttttaggatggaacatcagtaaacctacgggaaacagagctatggaactcccaagtactgtaggtccctattggtagttcactaaaagtaaccttctgtgtatgatccc

SEQ ID NO: 53661 - DNA, 24 bp, Maize chlorotic dwarf waikavirus
taggtccctattggtagttcacta

SEQ ID NO: 53662 - DNA, 18 bp, Homo sapiens
taggtccccattggtagt

SEQ ID NO: 53663 - DNA, 19 bp, Homo sapiens
taggtctgctgtgttcact

SEQ ID NO: 53664 - DNA, 84 bp, Maize chlorotic dwarf waikavirus
ccccatttggtgtaacccatatgtgccacctcataatccttttaagggttaaatttggtaagtgttgtggggagccaagagggg

SEQ ID NO: 53665 - DNA, 24 bp, Maize chlorotic dwarf waikavirus
catttggtgtaacccatatgtgcc

SEQ ID NO: 53666 - DNA, 18 bp, Homo sapiens
cacttggtgtgtgtgtgc

SEQ ID NO: 53667 - DNA, 15 bp, Homo sapiens
catttggtgtacgtg

SEQ ID NO: 53668 - DNA, 21 bp, Homo sapiens
catttggtgtcgttcccggcc

SEQ ID NO: 53669 - DNA, 18 bp, Homo sapiens
caattggtgtaatttgtg

SEQ ID NO: 53670 - DNA, 18 bp, Homo sapiens
cattcggtgagtatgtgc

SEQ ID NO: 53671 - DNA, 19 bp, Homo sapiens
attttgtgcatatatgtgc

SEQ ID NO: 53672 - DNA, 23 bp, Homo sapiens
atttggtgctaatttaataagcc

SEQ ID NO: 53673 - DNA, 17 bp, Homo sapiens
ctggtgtaacttatgtg

SEQ ID NO: 53674 - DNA, 15 bp, Homo sapiens
tttggtgtacatgtg

SEQ ID NO: 53675 - DNA, 18 bp, Homo sapiens
catctggtgtggctgtgc

SEQ ID NO: 53676 - DNA, 21 bp, Homo sapiens
tttggtgtaattcaaggatgt

SEQ ID NO: 53677 - DNA, 21 bp, Homo sapiens
atttgctgtggccccctggcc

SEQ ID NO: 53678 - DNA, 22 bp, Homo sapiens
atttgggtaatcccacatggcc

SEQ ID NO: 53679 - DNA, 18 bp, Homo sapiens
tttgatgcccatgtgtgc

SEQ ID NO: 53680 - DNA, 18 bp, Homo sapiens
catttggagtgacctatg

SEQ ID NO: 53681 - DNA, 22 bp, Homo sapiens
catctggtgtgggagatgtgcc

SEQ ID NO: 53682 - DNA, 20 bp, Homo sapiens
catattgttttccatatgtg

SEQ ID NO: 53683 - DNA, 18 bp, Homo sapiens
cacttggtgtggccgtgt

SEQ ID NO: 53684 - DNA, 85 bp, Human herpesvirus 8
gcagctggggtggaagtctgaaaaagggaaaggggaggtgagcagagtgcccagttagtctccgacccgccgtccgccctactgt

SEQ ID NO: 53685 - DNA, 24 bp, Human herpesvirus 8
ttagtctccgacccgccgtccgcc

SEQ ID NO: 53686 - DNA, 20 bp, Homo sapiens
ttagtttccacccaccttgc

SEQ ID NO: 53687 - DNA, 21 bp, Homo sapiens
ttagtctccgattcatgaacc

SEQ ID NO: 53688 - DNA, 22 bp, Homo sapiens
gtctcatccacctgctgtctgc

SEQ ID NO: 53689 - DNA, 15 bp, Homo sapiens
gtctcccgccgccgc

SEQ ID NO: 53690 - DNA, 20 bp, Homo sapiens
ttagtctctacccttcctgc

SEQ ID NO: 53691 - DNA, 21 bp, Homo sapiens
tcagtctccggagtgtctgcc

SEQ ID NO: 53692 - DNA, 19 bp, Homo sapiens
ttagcctctgacttgcacc

SEQ ID NO: 53693 - DNA, 129 bp, Beet soil-borne mosaic virus
gttcttagctgatgatggcattgaagctgtatattacgaagatgcacaaggtatgacttatgatgtggttaccattgtgcttaaggatgagtttgacgacgatgccatctgtgatagcaatgtgagagc

SEQ ID NO: 53694 - DNA, 24 bp, Beet soil-borne mosaic virus
ttgaagctgtatattacgaagatg

SEQ ID NO: 53695 - DNA, 23 bp, Homo sapiens
ttggagctgtatgacaatggatg

SEQ ID NO: 53696 - DNA, 23 bp, Homo sapiens
ttggagctgtacgacaatggatg

SEQ ID NO: 53697 - DNA, 25 bp, Homo sapiens
ttaaggctgtatatttcacttgatg

SEQ ID NO: 53698 - DNA, 109 bp, Beet soil-borne mosaic virus
ggttatttaggcattaaaaatgttatatgtttcggcgaccctgcacaaggtattaactttaaggcagggtctgctgttaactataactttcctgttattgctgagtgct

SEQ ID NO: 53699 - DNA, 24 bp, Beet soil-borne mosaic virus
aggcagggtctgctgttaactata

SEQ ID NO: 53700 - DNA, 20 bp, Homo sapiens
ggcggggcctgctgtttcct

SEQ ID NO: 53701 - DNA, 20 bp, Homo sapiens
aggcagggtaacgtgactgt

SEQ ID NO: 53702 - DNA, 17 bp, Homo sapiens
aggcaggatcttgatta

SEQ ID NO: 53703 - DNA, 19 bp, Homo sapiens
ggcagggttgactagctgt

SEQ ID NO: 53704 - DNA, 20 bp, Homo sapiens
aggcaggtctgcaagtgcta

SEQ ID NO: 53705 - DNA, 22 bp, Homo sapiens
ggcagggtcttggaaaggctgt

SEQ ID NO: 53706 - DNA, 20 bp, Homo sapiens
aggcaggagtcgatggctat

SEQ ID NO: 53707 - DNA, 23 bp, Homo sapiens
ggtcagggtctgcaagccactat

SEQ ID NO: 53708 - DNA, 23 bp, Homo sapiens
ggcagggtctggagtttaactat

SEQ ID NO: 53709 - DNA, 22 bp, Homo sapiens
aggtgggtctgctcagtcctat

SEQ ID NO: 53710 - DNA, 19 bp, Homo sapiens
ggcagggtcgggcgccgtt

SEQ ID NO: 53711 - DNA, 20 bp, Homo sapiens
agacagggtctctgataact

SEQ ID NO: 53712 - DNA, 20 bp, Homo sapiens
ggctctttgttgttaactat

SEQ ID NO: 53713 - DNA, 19 bp, Homo sapiens
agattttgctgttaattat

SEQ ID NO: 53714 - DNA, 18 bp, Homo sapiens
gggcgtttgttaactata

SEQ ID NO: 53715 - DNA, 20 bp, Homo sapiens
aggcaaggtttgtttcctgt

SEQ ID NO: 53716 - DNA, 20 bp, Homo sapiens
ggcagggctctctgagctat

SEQ ID NO: 53717 - DNA, 17 bp, Homo sapiens
ggcagggcctgccctat

SEQ ID NO: 53718 - DNA, 18 bp, Homo sapiens
aggcagagtctggtgcta

SEQ ID NO: 53719 - DNA, 20 bp, Homo sapiens
aggagggtctgggggactgt

SEQ ID NO: 53720 - DNA, 19 bp, Homo sapiens
aggcagggtattgttccat

SEQ ID NO: 53721 - DNA, 23 bp, Homo sapiens
ggcagggttggtttctgcagcta

SEQ ID NO: 53722 - DNA, 22 bp, Homo sapiens
agccagggtctgttgcatccat

SEQ ID NO: 53723 - DNA, 127 bp, Beet soil-borne mosaic virus
taaaatggtgttatgtttaccagtcaaacagttactcgacggggtgttttcgggtagaatggacacttttctgattgatgacatatttagtcgctctgtagactatggtaagtaccacactatgtta

SEQ ID NO: 53724 - DNA, 24 bp, Beet soil-borne mosaic virus
tgattgatgacatatttagtcgct

SEQ ID NO: 53725 - DNA, 16 bp, Homo sapiens
tgattgaacatttagt

SEQ ID NO: 53726 - DNA, 19 bp, Homo sapiens
gattgatggcatatcctgt

SEQ ID NO: 53727 - DNA, 70 bp, Beet soil-borne mosaic virus
tcggggttgccacggctgatctcataaactcctgcaatggtggtgggaaatcagttgttggtaataacga

SEQ ID NO: 53728 - DNA, 20 bp, Beet soil-borne mosaic virus
tcagttgttggtaataacga

SEQ ID NO: 53729 - DNA, 19 bp, Homo sapiens
tcagctgtaacaataacga

SEQ ID NO: 53730 - DNA, 16 bp, Homo sapiens
cagttattgaataacg

SEQ ID NO: 53731 - DNA, 24 bp, Homo sapiens
tcagttgttggttttgttaaacga

SEQ ID NO: 53732 - DNA, 18 bp, Homo sapiens
tcagctgtccacttaacg

SEQ ID NO: 53733 - DNA, 18 bp, Homo sapiens
ccagttaagaaataacga

SEQ ID NO: 53734 - DNA, 17 bp, Homo sapiens
tcagttgctggtgccga

SEQ ID NO: 53735 - DNA, 19 bp, Homo sapiens
tcagtaatctattggtaat

SEQ ID NO: 53736 - DNA, 87 bp, Fowlpox virus
tatactatctgaagaatatataataactgatatagtattatcagctatatcatacaaggattgttatatattttctaaaaatgtata

SEQ ID NO: 53737 - DNA, 24 bp, Fowlpox virus
tatcatacaaggattgttatatat

SEQ ID NO: 53738 - DNA, 22 bp, Homo sapiens
tatcatgcaagtatctatatat

SEQ ID NO: 53739 - DNA, 19 bp, Homo sapiens
atacaaggaaatactatat

SEQ ID NO: 53740 - DNA, 20 bp, Homo sapiens
tatgatacaaggattaacat

SEQ ID NO: 53741 - DNA, 75 bp, Fowlpox virus
agatccttggttattatattccttatactagtagaatagttacttagttaatgatgtaattctaacaagaaatct

SEQ ID NO: 53742 - DNA, 24 bp, Fowlpox virus
tccttggttattatattccttata

SEQ ID NO: 53743 - DNA, 20 bp, Homo sapiens
ttggttcatatcctcttata

SEQ ID NO: 53744 - DNA, 21 bp, Homo sapiens
ttggttattacctgttttata

SEQ ID NO: 53745 - DNA, 28 bp, Homo sapiens
cttggctattaccagtagttccttatat

SEQ ID NO: 53746 - DNA, 20 bp, Homo sapiens
ccttggagcgcatgttcctt

SEQ ID NO: 53747 - DNA, 20 bp, Homo sapiens
cttggttgtttgctccttat

SEQ ID NO: 53748 - DNA, 21 bp, Homo sapiens
tcatggctattatttcttata

SEQ ID NO: 53749 - DNA, 70 bp, Fowlpox virus
tctggctctgttattgtacccgatataacggtaatactaatttatctaaatatgatgtataagagttaga

SEQ ID NO: 53750 - DNA, 24 bp, Fowlpox virus
tattgtacccgatataacggtaat

SEQ ID NO: 53751 - DNA, 19 bp, Homo sapiens
ttgccccaacagtggtaat

SEQ ID NO: 53752 - DNA, 111 bp, Fowlpox virus
agcgataaaagtaatagaaaacactataccatgtctaccgataatatgaagattatattcataaagtcgtagataattaaagagaagtttaaatttattataaattatcct

SEQ ID NO: 53753 - DNA, 24 bp, Fowlpox virus
tagaaaacactataccatgtctac

SEQ ID NO: 53754 - DNA, 21 bp, Homo sapiens
tagacagcagtgccatgtcta

SEQ ID NO: 53755 - DNA, 20 bp, Homo sapiens
gaggagaccccaccatgtct

SEQ ID NO: 53756 - DNA, 20 bp, Homo sapiens
gaaaacacttatggccttgc

SEQ ID NO: 53757 - DNA, 24 bp, Homo sapiens
gaaaacactatacctaagttctac

SEQ ID NO: 53758 - DNA, 23 bp, Homo sapiens
tagaaaatgcttaaaatgtctac

SEQ ID NO: 53759 - DNA, 19 bp, Homo sapiens
aaaaacactatatgcatat

SEQ ID NO: 53760 - DNA, 20 bp, Homo sapiens
tacaaaacactgcccagtct

SEQ ID NO: 53761 - DNA, 21 bp, Homo sapiens
tagaaaacgctgtagccaggt

SEQ ID NO: 53762 - DNA, 20 bp, Homo sapiens
tagaaaacactacacaatgc

SEQ ID NO: 53763 - DNA, 17 bp, Homo sapiens
tagaaaacacaatgtct

SEQ ID NO: 53764 - DNA, 17 bp, Homo sapiens
aaaaacactatacatgt

SEQ ID NO: 53765 - DNA, 21 bp, Homo sapiens
taggaaacctctgccatgtct

SEQ ID NO: 53766 - DNA, 19 bp, Homo sapiens
taaaaaacactgtacctgt

SEQ ID NO: 53767 - DNA, 17 bp, Homo sapiens
aaacactattcccccac

SEQ ID NO: 53768 - DNA, 22 bp, Homo sapiens
aagaacacgtttccatgtctac

SEQ ID NO: 53769 - DNA, 20 bp, Homo sapiens
tagaaaacagtataccacat

SEQ ID NO: 53770 - DNA, 17 bp, Homo sapiens
gaaaacacaatacatgt

SEQ ID NO: 53771 - DNA, 15 bp, Homo sapiens
agaaaacactatgct

SEQ ID NO: 53772 - DNA, 19 bp, Homo sapiens
aaaaaacccatcatgtcta

SEQ ID NO: 53773 - DNA, 17 bp, Homo sapiens
tagaaaacactacatgt

SEQ ID NO: 53774 - DNA, 19 bp, Homo sapiens
gaagcaacacacatgtcta

SEQ ID NO: 53775 - DNA, 87 bp, Ectromelia virus
gtgagatagtcatggagactacatcagattacgaggatgtcgtttttactttgtggatgatgaactatgtagccgtgactccatcat

SEQ ID NO: 53776 - DNA, 24 bp, Ectromelia virus
ctttgtggatgatgaactatgtag

SEQ ID NO: 53777 - DNA, 20 bp, Homo sapiens
ttgtggacttgactatgtag

SEQ ID NO: 53778 - DNA, 19 bp, Homo sapiens
ctttgtggctgagtgtgta

SEQ ID NO: 53779 - DNA, 18 bp, Homo sapiens
ctttgtggaggatggact

SEQ ID NO: 53780 - DNA, 19 bp, Homo sapiens
ctttgtggagatgggtgca

SEQ ID NO: 53781 - DNA, 19 bp, Homo sapiens
tttgaggatgatgactctg

SEQ ID NO: 53782 - DNA, 21 bp, Homo sapiens
ctttgtggatgagtggagcag

SEQ ID NO: 53783 - DNA, 22 bp, Homo sapiens
ctttgtggattattccgtatgt

SEQ ID NO: 53784 - DNA, 18 bp, Homo sapiens
tttgtggatgaggaaacc

SEQ ID NO: 53785 - DNA, 129 bp, Ectromelia virus
tggaagactgtacaaggaattgatgaagttcgatgatgttgctatacggtactatggaattgataaaattaatgagattatcgaggctatgagcgaaggagaccactacatcaatcttacagaagtcca

SEQ ID NO: 53786 - DNA, 24 bp, Ectromelia virus
tgagcgaaggagaccactacatca

SEQ ID NO: 53787 - DNA, 21 bp, Homo sapiens
tgagcaaaggaatctgtatca

SEQ ID NO: 53788 - DNA, 24 bp, Homo sapiens
tggctgaaggagatttcaatatca

SEQ ID NO: 53789 - DNA, 22 bp, Homo sapiens
tgagcggacgacccctacatca

SEQ ID NO: 53790 - DNA, 18 bp, Homo sapiens
cgggcgggggagaccacc

SEQ ID NO: 53791 - DNA, 18 bp, Homo sapiens
tgacgagggagaccacca

SEQ ID NO: 53792 - DNA, 61 bp, Camelpox virus
cagtatcatttaaacatttaacttgcggggttgatctcacaactttattgtttttgaactg

SEQ ID NO: 53793 - DNA, 24 bp, Camelpox virus
tcacaactttattgtttttgaact

SEQ ID NO: 53794 - DNA, 17 bp, Homo sapiens
acaactctattgtaaac

SEQ ID NO: 53795 - DNA, 22 bp, Homo sapiens
caactttattcttccttgaact

SEQ ID NO: 53796 - DNA, 20 bp, Homo sapiens
aactttattaagtctgaact

SEQ ID NO: 53797 - DNA, 17 bp, Homo sapiens
tcacaaccttgtcatga

SEQ ID NO: 53798 - DNA, 24 bp, Homo sapiens
tcacagcttattgcagcctgaact

SEQ ID NO: 53799 - DNA, 16 bp, Homo sapiens
tcacaactttgttttt

SEQ ID NO: 53800 - DNA, 17 bp, Homo sapiens
tcacaactattgtactg

SEQ ID NO: 53801 - DNA, 22 bp, Homo sapiens
caaattaattagtttttgaact

SEQ ID NO: 53802 - DNA, 20 bp, Homo sapiens
tcacaactcttcgatttgaa

SEQ ID NO: 53803 - DNA, 20 bp, Homo sapiens
tcacagctttattgtataga

SEQ ID NO: 53804 - DNA, 21 bp, Homo sapiens
tcaaaactttattgaaaaact

SEQ ID NO: 53805 - DNA, 18 bp, Homo sapiens
ctgtcttgtttttgaact

SEQ ID NO: 53806 - DNA, 18 bp, Homo sapiens
tccaactttattgacaac

SEQ ID NO: 53807 - DNA, 22 bp, Homo sapiens
tcagaacttaattttttgaact

SEQ ID NO: 53808 - DNA, 22 bp, Homo sapiens
tcacaactgttattgaagaact

SEQ ID NO: 53809 - DNA, 63 bp, Camelpox virus
agatccgtgagaaatacgtttagccgcctttaatagaggaaatcccaccgcctttctggatct

SEQ ID NO: 53810 - DNA, 24 bp, Camelpox virus
tgagaaatacgtttagccgccttt

SEQ ID NO: 53811 - DNA, 17 bp, Homo sapiens
tgagaaataagtttcca

SEQ ID NO: 53812 - DNA, 23 bp, Homo sapiens
tgggaaaatgtttaaccatcttt

SEQ ID NO: 53813 - DNA, 18 bp, Homo sapiens
gagaaatatgcttgcctt

SEQ ID NO: 53814 - DNA, 18 bp, Homo sapiens
tgaaaaatatattgcctt

SEQ ID NO: 53815 - DNA, 19 bp, Homo sapiens
tgagaaatgcgtttgtggc

SEQ ID NO: 53816 - DNA, 64 bp, Variola virus
gttaatctcacaactttactgtttttgaactgttcaaaatatagcatagatccgtgagaaatac

SEQ ID NO: 53817 - DNA, 23 bp, Variola virus
tagcatagatccgtgagaaatac

SEQ ID NO: 53818 - DNA, 16 bp, Homo sapiens
gcctagcctgagaaat

SEQ ID NO: 53819 - DNA, 22 bp, Homo sapiens
tagccattgttgtgagaaatac

SEQ ID NO: 53820 - DNA, 18 bp, Homo sapiens
taacatagatcaagtaag

SEQ ID NO: 53821 - DNA, 22 bp, Homo sapiens
acatagtgatgctgagaaatac

SEQ ID NO: 53822 - DNA, 16 bp, Homo sapiens
agcatggcgagaaata

SEQ ID NO: 53823 - DNA, 19 bp, Homo sapiens
cagcattgatgtgagaaat

SEQ ID NO: 53824 - DNA, 20 bp, Homo sapiens
gcataggtgttcagaaatac

SEQ ID NO: 53825 - DNA, 18 bp, Homo sapiens
gcacatctgtgagaaata

SEQ ID NO: 53826 - DNA, 17 bp, Homo sapiens
acatagatacagaaata

SEQ ID NO: 53827 - DNA, 22 bp, Homo sapiens
tagcgtaatgtatgagaaatac

SEQ ID NO: 53828 - DNA, 18 bp, Homo sapiens
agcatagagagcagaaat

SEQ ID NO: 53829 - DNA, 17 bp, Homo sapiens
tagcattaggagaaata

SEQ ID NO: 53830 - DNA, 18 bp, Homo sapiens
agcatgattgagaaatac

SEQ ID NO: 53831 - DNA, 19 bp, Homo sapiens
agtatagcgtgagaaatac

SEQ ID NO: 53832 - DNA, 18 bp, Homo sapiens
tagatatggtgagaaata

SEQ ID NO: 53833 - DNA, 20 bp, Homo sapiens
agcatagtagtagagaaata

SEQ ID NO: 53834 - DNA, 19 bp, Homo sapiens
tagtataaagtgagaaata

SEQ ID NO: 53835 - DNA, 18 bp, Homo sapiens
tagcacagatacatgtag

SEQ ID NO: 53836 - DNA, 20 bp, Homo sapiens
tagagtatagtgagaaatac

SEQ ID NO: 53837 - DNA, 21 bp, Homo sapiens
gcataaaggaaagagaaatac

SEQ ID NO: 53838 - DNA, 15 bp, Homo sapiens
tagcatagattgaaa

SEQ ID NO: 53839 - DNA, 23 bp, Homo sapiens
tagcatagattcagcttcaagaa

SEQ ID NO: 53840 - DNA, 19 bp, Homo sapiens
tagatgaaaatgagaaata

SEQ ID NO: 53841 - DNA, 18 bp, Homo sapiens
tagcataagatgtgagaa

SEQ ID NO: 53842 - DNA, 130 bp, Variola virus
ccacctgttttaacatataataggcaggagatagatatccgtcattgcaatattccttctcgtaggcacacaatcgaatattgataaaatctccattctcttctctgcatttattatcttgtcttggtgg

SEQ ID NO: 53843 - DNA, 24 bp, Variola virus
taataggcaggagatagatatccg

SEQ ID NO: 53844 - DNA, 19 bp, Homo sapiens
taataagcaggaagatgtc

SEQ ID NO: 53845 - DNA, 24 bp, Homo sapiens
taaaaggcaggagaatataatccg

SEQ ID NO: 53846 - DNA, 20 bp, Homo sapiens
ataggcaggggggatcaaac

SEQ ID NO: 53847 - DNA, 17 bp, Homo sapiens
taggcaggagatatctc

SEQ ID NO: 53848 - DNA, 19 bp, Homo sapiens
taataggcagggagaaaac

SEQ ID NO: 53849 - DNA, 20 bp, Homo sapiens
aggcaggagacacgattatc

SEQ ID NO: 53850 - DNA, 18 bp, Homo sapiens
aataggtaggggatagat

SEQ ID NO: 53851 - DNA, 21 bp, Homo sapiens
taatcaatgtaagatagatat

SEQ ID NO: 53852 - DNA, 62 bp, Vaccinia virus
catgtagtaagtgtcgattgtaataaggaactgatgcctattaggacagatactactatttg

SEQ ID NO: 53853 - DNA, 22 bp, Vaccinia virus
ttaggacagatactactatttg

SEQ ID NO: 53854 - DNA, 16 bp, Homo sapiens
tcaggaactactattt

SEQ ID NO: 53855 - DNA, 20 bp, Homo sapiens
taggatggatattactattc

SEQ ID NO: 53856 - DNA, 18 bp, Homo sapiens
ttagtgcaggtactacca

SEQ ID NO: 53857 - DNA, 17 bp, Homo sapiens
ttagaataccactattt

SEQ ID NO: 53858 - DNA, 17 bp, Homo sapiens
ttaggacagatatatct

SEQ ID NO: 53859 - DNA, 60 bp, Vaccinia virus
ctgtgtccaaggtaaaatcgtgtttgtgtagttttcacaatgatgccatcatagatatag

SEQ ID NO: 53860 - DNA, 24 bp, Vaccinia virus
tccaaggtaaaatcgtgtttgtgt

SEQ ID NO: 53861 - DNA, 22 bp, Homo sapiens
tccaagttaaaatgatttgtgt

SEQ ID NO: 53862 - DNA, 17 bp, Homo sapiens
tccaaggcagaatgtgt

SEQ ID NO: 53863 - DNA, 19 bp, Homo sapiens
tcccaggtgaaatctgtgt

SEQ ID NO: 53864 - DNA, 23 bp, Homo sapiens
ccaaactctaattgtgtttgtgt

SEQ ID NO: 53865 - DNA, 20 bp, Homo sapiens
tccaaggtaaggttttgcct

SEQ ID NO: 53866 - DNA, 19 bp, Homo sapiens
caaggtaagtgctttgtgt

SEQ ID NO: 53867 - DNA, 22 bp, Homo sapiens
tccagtgtgtgtgtgtttgtgt

SEQ ID NO: 53868 - DNA, 24 bp, Homo sapiens
tccaaggtggaatggccaacgtgt

SEQ ID NO: 53869 - DNA, 19 bp, Homo sapiens
tcccaggtgagtgtttgtg

SEQ ID NO: 53870 - DNA, 22 bp, Homo sapiens
tccaagtaaaatcaaacagtgt

SEQ ID NO: 53871 - DNA, 18 bp, Homo sapiens
aagtaaaatcctatgtgt

SEQ ID NO: 53872 - DNA, 15 bp, Homo sapiens
aagtaaaatcttgtg

SEQ ID NO: 53873 - DNA, 21 bp, Homo sapiens
tccagggcaagtggtttgtgt

SEQ ID NO: 53874 - DNA, 22 bp, Homo sapiens
cagggcaaaatctatgcagtgt

SEQ ID NO: 53875 - DNA, 22 bp, Homo sapiens
tccaaggtgaaaccctctgtgt

SEQ ID NO: 53876 - DNA, 98 bp, Vaccinia virus
gtcattcatttagaatggttgttgggctttatcaagtgtattagtcagcatcagcatctggctattatgtttaaagatgacaatattattatgaagac

SEQ ID NO: 53877 - DNA, 24 bp, Vaccinia virus
tattatgtttaaagatgacaatat

SEQ ID NO: 53878 - DNA, 18 bp, Homo sapiens
tatatcagatgacaatat

SEQ ID NO: 53879 - DNA, 19 bp, Homo sapiens
tattatgtttaaggaatga

SEQ ID NO: 53880 - DNA, 21 bp, Homo sapiens
tatttccaaagatggcaatat

SEQ ID NO: 53881 - DNA, 126 bp, Variola virus
tgagaatattgatgattttttttaagatgatatttactttttatatgcttgcattacagaataatattcacaggtattattaaaatgagtatcggagctacattaccatatcatcatccatgctca

SEQ ID NO: 53882 - DNA, 24 bp, Variola virus
tgatatttactttttatatgcttg

SEQ ID NO: 53883 - DNA, 25 bp, Homo sapiens
tgatattctacctcctgtgtgcttg

SEQ ID NO: 53884 - DNA, 18 bp, Homo sapiens
atatttactttttaaact

SEQ ID NO: 53885 - DNA, 22 bp, Homo sapiens
tgcatttttttttatatgcttg

SEQ ID NO: 53886 - DNA, 22 bp, Homo sapiens
atacaggctttttatatgcttg

SEQ ID NO: 53887 - DNA, 20 bp, Homo sapiens
tgattttactttttttactt

SEQ ID NO: 53888 - DNA, 19 bp, Homo sapiens
tgatatttactgagtgctt

SEQ ID NO: 53889 - DNA, 26 bp, Homo sapiens
tgagatttgccctccatatgtgcttg

SEQ ID NO: 53890 - DNA, 60 bp, Ovine adenovirus A
gtgccgccatctaatgtgtttagagaccgtgagggtcaagaagcagaacagatgcgccac

SEQ ID NO: 53891 - DNA, 23 bp, Ovine adenovirus A
aagaagcagaacagatgcgccac

SEQ ID NO: 53892 - DNA, 19 bp, Homo sapiens
aagaagcaggactgaatgc

SEQ ID NO: 53893 - DNA, 20 bp, Homo sapiens
aagaagcagagacaagccac

SEQ ID NO: 53894 - DNA, 26 bp, Homo sapiens
aagaagcagggtgaccccggcgccac

SEQ ID NO: 53895 - DNA, 19 bp, Homo sapiens
aagaagcagggacaggcgc

SEQ ID NO: 53896 - DNA, 17 bp, Homo sapiens
gaagcagaacgacccgc

SEQ ID NO: 53897 - DNA, 17 bp, Homo sapiens
aagaagcagaagggaac

SEQ ID NO: 53898 - DNA, 19 bp, Homo sapiens
agaagcaggacagaggagc

SEQ ID NO: 53899 - DNA, 18 bp, Homo sapiens
aggagcagaacaggccca

SEQ ID NO: 53900 - DNA, 20 bp, Homo sapiens
gaaggagaacagaccaaagc

SEQ ID NO: 53901 - DNA, 17 bp, Homo sapiens
aagaagcaggatgtcac

SEQ ID NO: 53902 - DNA, 17 bp, Homo sapiens
aagaggcagaacagagc

SEQ ID NO: 53903 - DNA, 20 bp, Homo sapiens
aaaaagcagagcagagagcg

SEQ ID NO: 53904 - DNA, 16 bp, Homo sapiens
agaagcagcagtggcc

SEQ ID NO: 53905 - DNA, 17 bp, Homo sapiens
gagcagagaacgcgcca

SEQ ID NO: 53906 - DNA, 16 bp, Homo sapiens
aagaagcagaaagtgc

SEQ ID NO: 53907 - DNA, 17 bp, Homo sapiens
aaggaacagaacagaac

SEQ ID NO: 53908 - DNA, 17 bp, Homo sapiens
aaggagagaacacacca

SEQ ID NO: 53909 - DNA, 18 bp, Homo sapiens
aagaagcagcactggcca

SEQ ID NO: 53910 - DNA, 16 bp, Homo sapiens
agaagcagaggagcca

SEQ ID NO: 53911 - DNA, 17 bp, Homo sapiens
aagaagcagaatagcca

SEQ ID NO: 53912 - DNA, 17 bp, Homo sapiens
aagaagcaaagcagcac

SEQ ID NO: 53913 - DNA, 16 bp, Homo sapiens
aagaagcacaatgcac

SEQ ID NO: 53914 - DNA, 15 bp, Homo sapiens
aagaagcaagataca

SEQ ID NO: 53915 - DNA, 15 bp, Homo sapiens
agaagcagaaaggca

SEQ ID NO: 53916 - DNA, 20 bp, Homo sapiens
gaagcagaaacagactttac

SEQ ID NO: 53917 - DNA, 18 bp, Homo sapiens
agaacagaatggatgaac

SEQ ID NO: 53918 - DNA, 20 bp, Homo sapiens
aaaagcagaatgattttcac

SEQ ID NO: 53919 - DNA, 17 bp, Homo sapiens
aagaagcagcaatccac

SEQ ID NO: 53920 - DNA, 25 bp, Homo sapiens
aagaaatagaacagagttgggttgc

SEQ ID NO: 53921 - DNA, 20 bp, Homo sapiens
aagaagcagagtagtacgcc

SEQ ID NO: 53922 - DNA, 23 bp, Homo sapiens
agaagtggagggatgtgggccac

SEQ ID NO: 53923 - DNA, 19 bp, Homo sapiens
aagcagcagagtgtgctca

SEQ ID NO: 53924 - DNA, 19 bp, Homo sapiens
aagaagcagaggagaaaac

SEQ ID NO: 53925 - DNA, 19 bp, Homo sapiens
aagcagcagatctgtgcca

SEQ ID NO: 53926 - DNA, 20 bp, Homo sapiens
gaagcagaatagtcagccac

SEQ ID NO: 53927 - DNA, 20 bp, Homo sapiens
gaagcagagctgaaagccac

SEQ ID NO: 53928 - DNA, 16 bp, Homo sapiens
gaaacagaacagccca

SEQ ID NO: 53929 - DNA, 22 bp, Homo sapiens
gaagcagaaatgacagtgtcgc

SEQ ID NO: 53930 - DNA, 20 bp, Homo sapiens
aagaagcaaagttatagcca

SEQ ID NO: 53931 - DNA, 18 bp, Homo sapiens
aggggcggaccgcgccac

SEQ ID NO: 53932 - DNA, 21 bp, Homo sapiens
aggagcagaacacagcagcac

SEQ ID NO: 53933 - DNA, 18 bp, Homo sapiens
aagaagcaaggcaggcac

SEQ ID NO: 53934 - DNA, 18 bp, Homo sapiens
agaaggggaacaaaccgc

SEQ ID NO: 53935 - DNA, 18 bp, Homo sapiens
aagaagcaagtattgcca

SEQ ID NO: 53936 - DNA, 20 bp, Homo sapiens
gaagcaaaacaagaatccac

SEQ ID NO: 53937 - DNA, 18 bp, Homo sapiens
aaggacagaacagtccca

SEQ ID NO: 53938 - DNA, 20 bp, Homo sapiens
aaggacagaacacagctcac

SEQ ID NO: 53939 - DNA, 16 bp, Homo sapiens
agaaggaacacgccac

SEQ ID NO: 53940 - DNA, 18 bp, Homo sapiens
aaggagcagacacattac

SEQ ID NO: 53941 - DNA, 20 bp, Homo sapiens
agaagcaggactgagaacca

SEQ ID NO: 53942 - DNA, 19 bp, Homo sapiens
aagaagcagacggcaacgc

SEQ ID NO: 53943 - DNA, 17 bp, Homo sapiens
agaagcagagagagcgc

SEQ ID NO: 53944 - DNA, 26 bp, Homo sapiens
agaagcaggatggcaaatggtgtcgc

SEQ ID NO: 53945 - DNA, 17 bp, Homo sapiens
agaacagaacagtggac

SEQ ID NO: 53946 - DNA, 20 bp, Homo sapiens
gaagcagagacagagagcac

SEQ ID NO: 53947 - DNA, 17 bp, Homo sapiens
agaagcaggaatgcccc

SEQ ID NO: 53948 - DNA, 21 bp, Homo sapiens
agaacagagcagcaaaagcca

SEQ ID NO: 53949 - DNA, 22 bp, Homo sapiens
agaaggggaacagactgagggc

SEQ ID NO: 53950 - DNA, 17 bp, Homo sapiens
aggggcagaacacacca

SEQ ID NO: 53951 - DNA, 20 bp, Homo sapiens
aaaaagcagaaccaactcgc

SEQ ID NO: 53952 - DNA, 20 bp, Homo sapiens
aagaagcagaattacaccac

SEQ ID NO: 53953 - DNA, 22 bp, Homo sapiens
aagaagcagagaaataggccac

SEQ ID NO: 53954 - DNA, 20 bp, Homo sapiens
gaaggagactgctgcgccac

SEQ ID NO: 53955 - DNA, 18 bp, Homo sapiens
agaatgcagagcagtcac

SEQ ID NO: 53956 - DNA, 18 bp, Homo sapiens
gaagggaacagatgaagc

SEQ ID NO: 53957 - DNA, 21 bp, Homo sapiens
agaaggtagaacagaggacac

SEQ ID NO: 53958 - DNA, 22 bp, Homo sapiens
aaaaagcagggcagttcttcca

SEQ ID NO: 53959 - DNA, 21 bp, Homo sapiens
gaaggcagaacattctgtcac

SEQ ID NO: 53960 - DNA, 18 bp, Homo sapiens
aagaagcagggcaggcac

SEQ ID NO: 53961 - DNA, 21 bp, Homo sapiens
agagggcagaacagatagggc

SEQ ID NO: 53962 - DNA, 16 bp, Homo sapiens
agaagcaaagtacacc

SEQ ID NO: 53963 - DNA, 16 bp, Homo sapiens
agaagcagagaagcca

SEQ ID NO: 53964 - DNA, 20 bp, Homo sapiens
aggagcaaaacacaaggcca

SEQ ID NO: 53965 - DNA, 18 bp, Homo sapiens
gagcagagatcacgccac

SEQ ID NO: 53966 - DNA, 20 bp, Homo sapiens
agaggcagatcccacgccac

SEQ ID NO: 53967 - DNA, 20 bp, Homo sapiens
gaaggagagccctgcgccac

SEQ ID NO: 53968 - DNA, 21 bp, Homo sapiens
aagaagcagagtcagggaggc

SEQ ID NO: 53969 - DNA, 22 bp, Homo sapiens
agaagcagtgtaacacagtcac

SEQ ID NO: 53970 - DNA, 18 bp, Homo sapiens
aggaacagacaggtgtcg

SEQ ID NO: 53971 - DNA, 24 bp, Homo sapiens
agaaggcagaacagctaacagcca

SEQ ID NO: 53972 - DNA, 16 bp, Homo sapiens
agaaacagagtggcca

SEQ ID NO: 53973 - DNA, 19 bp, Homo sapiens
agaagcagagagaccaacc

SEQ ID NO: 53974 - DNA, 22 bp, Homo sapiens
aagaagcaaatggaagacttgc

SEQ ID NO: 53975 - DNA, 22 bp, Homo sapiens
agaagcagagggaatgggttgc

SEQ ID NO: 53976 - DNA, 19 bp, Homo sapiens
ggaaagcagaatctgccac

SEQ ID NO: 53977 - DNA, 21 bp, Homo sapiens
aaaaagcagcttacacagatg

SEQ ID NO: 53978 - DNA, 16 bp, Homo sapiens
gaagcaggaatgcacc

SEQ ID NO: 53979 - DNA, 22 bp, Homo sapiens
gaagcagagcagctctcgccac

SEQ ID NO: 53980 - DNA, 22 bp, Homo sapiens
aagaagcagaaagacccctcca

SEQ ID NO: 53981 - DNA, 21 bp, Homo sapiens
aagaagcagagaggtgagagc

SEQ ID NO: 53982 - DNA, 15 bp, Homo sapiens
gaagcagagagccca

SEQ ID NO: 53983 - DNA, 15 bp, Homo sapiens
agaagcagacagcac

SEQ ID NO: 53984 - DNA, 17 bp, Homo sapiens
agaagcagaaccaacca

SEQ ID NO: 53985 - DNA, 18 bp, Homo sapiens
agaaggcaggacagatgc

SEQ ID NO: 53986 - DNA, 19 bp, Homo sapiens
agaagcaggacaggtgggc

SEQ ID NO: 53987 - DNA, 21 bp, Homo sapiens
aagaagcagggtgtcagacac

SEQ ID NO: 53988 - DNA, 20 bp, Homo sapiens
gaaggcagaaaagtcgccac

SEQ ID NO: 53989 - DNA, 20 bp, Homo sapiens
agaggcagaggccacgccac

SEQ ID NO: 53990 - DNA, 17 bp, Homo sapiens
aagaagcagacccggcc

SEQ ID NO: 53991 - DNA, 19 bp, Homo sapiens
gaggcagaggttgcgccac

SEQ ID NO: 53992 - DNA, 20 bp, Homo sapiens
aaaaagcagagtgcatttgc

SEQ ID NO: 53993 - DNA, 18 bp, Homo sapiens
gagcggagatcgcgccac

SEQ ID NO: 53994 - DNA, 17 bp, Homo sapiens
aagaagcaggagaggca

SEQ ID NO: 53995 - DNA, 16 bp, Homo sapiens
gaagcaaagcaagcca

SEQ ID NO: 53996 - DNA, 21 bp, Homo sapiens
gaagcagaagttatctgccac

SEQ ID NO: 53997 - DNA, 23 bp, Homo sapiens
gaaacagaatgcaccagcgccac

SEQ ID NO: 53998 - DNA, 16 bp, Homo sapiens
agaagcagatgagcca

SEQ ID NO: 53999 - DNA, 19 bp, Homo sapiens
aagaagcgggcagtgagcc

SEQ ID NO: 54000 - DNA, 18 bp, Homo sapiens
agagcagaacacaggcca

SEQ ID NO: 54001 - DNA, 18 bp, Homo sapiens
agaagcagagagatttac

SEQ ID NO: 54002 - DNA, 20 bp, Homo sapiens
agaagtagaaccaatgctgc

SEQ ID NO: 54003 - DNA, 19 bp, Homo sapiens
gaaacgggacagatgccgc

SEQ ID NO: 54004 - DNA, 15 bp, Homo sapiens
aagaagcagagtgca

SEQ ID NO: 54005 - DNA, 19 bp, Homo sapiens
gaagcagatacactgctgc

SEQ ID NO: 54006 - DNA, 21 bp, Homo sapiens
agaagcagaaggaacaagtgc

SEQ ID NO: 54007 - DNA, 20 bp, Homo sapiens
agaagcagggagaaatccgc

SEQ ID NO: 54008 - DNA, 21 bp, Homo sapiens
aaggaacagaacacaagccac

SEQ ID NO: 54009 - DNA, 19 bp, Homo sapiens
gaagcagagagagtgccgc

SEQ ID NO: 54010 - DNA, 18 bp, Homo sapiens
aagaacagaacactctgc

SEQ ID NO: 54011 - DNA, 23 bp, Homo sapiens
agaagcagcggcagagggaacgc

SEQ ID NO: 54012 - DNA, 23 bp, Homo sapiens
aaggagcagaacatgccgaccac

SEQ ID NO: 54013 - DNA, 25 bp, Homo sapiens
aagaagcaggactcctacatgccac

SEQ ID NO: 54014 - DNA, 19 bp, Homo sapiens
agaagcagaaagagaaaca

SEQ ID NO: 54015 - DNA, 22 bp, Homo sapiens
agaagcagggcagtgaagtcac

SEQ ID NO: 54016 - DNA, 20 bp, Homo sapiens
aagaacagagtgacaactgc

SEQ ID NO: 54017 - DNA, 17 bp, Homo sapiens
agaaacagaaaatgcca

SEQ ID NO: 54018 - DNA, 22 bp, Homo sapiens
agaagcagagcagagagggcca

SEQ ID NO: 54019 - DNA, 17 bp, Homo sapiens
agaagcagagcaaccca

SEQ ID NO: 54020 - DNA, 19 bp, Homo sapiens
agaagcagaagagggatgc

SEQ ID NO: 54021 - DNA, 22 bp, Homo sapiens
agaagcaagagataagtgctgc

SEQ ID NO: 54022 - DNA, 15 bp, Homo sapiens
agaagcaggacggcc

SEQ ID NO: 54023 - DNA, 20 bp, Homo sapiens
agaggcacagacactgctac

SEQ ID NO: 54024 - DNA, 19 bp, Homo sapiens
aagaagcagagacattgcc

SEQ ID NO: 54025 - DNA, 19 bp, Homo sapiens
agaaccagaatgtgaccgc

SEQ ID NO: 54026 - DNA, 19 bp, Homo sapiens
gaatgcaggtgcgcgccac

SEQ ID NO: 54027 - DNA, 17 bp, Homo sapiens
aggagcagaacaggcac

SEQ ID NO: 54028 - DNA, 18 bp, Homo sapiens
aagaggcaaaacaatggc

SEQ ID NO: 54029 - DNA, 20 bp, Homo sapiens
aagaaacagaagctcgccac

SEQ ID NO: 54030 - DNA, 16 bp, Homo sapiens
gaagcagaatacatca

SEQ ID NO: 54031 - DNA, 23 bp, Homo sapiens
aagaagcaggagagacagagcca

SEQ ID NO: 54032 - DNA, 17 bp, Homo sapiens
agcaggacaaacaccac

SEQ ID NO: 54033 - DNA, 15 bp, Homo sapiens
gaagcagaactggcc

SEQ ID NO: 54034 - DNA, 16 bp, Homo sapiens
agaagcagtgcaccac

SEQ ID NO: 54035 - DNA, 19 bp, Homo sapiens
agaagcaggctggtgccac

SEQ ID NO: 54036 - DNA, 19 bp, Homo sapiens
gaatgcaggtgtgcgccac

SEQ ID NO: 54037 - DNA, 18 bp, Homo sapiens
aagaagcagggagaccgc

SEQ ID NO: 54038 - DNA, 18 bp, Homo sapiens
aagcagaggctgcgccac

SEQ ID NO: 54039 - DNA, 20 bp, Homo sapiens
aagaagcaggtggacgaggc

SEQ ID NO: 54040 - DNA, 16 bp, Homo sapiens
aaaagcagaacacacc

SEQ ID NO: 54041 - DNA, 21 bp, Homo sapiens
aagaagcagacaagtgactgc

SEQ ID NO: 54042 - DNA, 20 bp, Homo sapiens
aagagcaggtgccgcgccac

SEQ ID NO: 54043 - DNA, 16 bp, Homo sapiens
aaaaagcaggcagtgc

SEQ ID NO: 54044 - DNA, 22 bp, Homo sapiens
aagaagcagcaccagcagctgc

SEQ ID NO: 54045 - DNA, 18 bp, Homo sapiens
aagaagcagacatggcca

SEQ ID NO: 54046 - DNA, 20 bp, Homo sapiens
agaagcagagtgagaatcac

SEQ ID NO: 54047 - DNA, 21 bp, Homo sapiens
aagaagcaggggagatgtggc

SEQ ID NO: 54048 - DNA, 17 bp, Homo sapiens
aagacagcaggacggcc

SEQ ID NO: 54049 - DNA, 19 bp, Homo sapiens
agaagcggaacagatgaac

SEQ ID NO: 54050 - DNA, 18 bp, Homo sapiens
aagaaacagaaaacgtca

SEQ ID NO: 54051 - DNA, 17 bp, Homo sapiens
agaagcaaaacacatcg

SEQ ID NO: 54052 - DNA, 18 bp, Homo sapiens
gactagaacagatgtcca

SEQ ID NO: 54053 - DNA, 21 bp, Homo sapiens
aaaaagcagaacaaagatcac

SEQ ID NO: 54054 - DNA, 19 bp, Homo sapiens
gaatgcaggggcgcgccac

SEQ ID NO: 54055 - DNA, 16 bp, Homo sapiens
gaagcagaagccgcca

SEQ ID NO: 54056 - DNA, 21 bp, Homo sapiens
aagaaacaggatgacagtcac

SEQ ID NO: 54057 - DNA, 18 bp, Homo sapiens
aagaagcaaatggaacac

SEQ ID NO: 54058 - DNA, 18 bp, Homo sapiens
agaagcaggccagagtgc

SEQ ID NO: 54059 - DNA, 68 bp, Variola virus
atggagatacaacgtgaaatactttattactccattaaataatgtatcacttacgataatgtctctat

SEQ ID NO: 54060 - DNA, 24 bp, Variola virus
taatgtatcacttacgataatgtc

SEQ ID NO: 54061 - DNA, 19 bp, Homo sapiens
tgtatcactttgatgtgtc

SEQ ID NO: 54062 - DNA, 24 bp, Homo sapiens
taatgtattcacttaaatctatgt

SEQ ID NO: 54063 - DNA, 22 bp, Homo sapiens
taatgcagaacatgataatgtc

SEQ ID NO: 54064 - DNA, 21 bp, Homo sapiens
taatgtattactttttaatgt

SEQ ID NO: 54065 - DNA, 25 bp, Homo sapiens
taatgtatcattattcctttatgtc

SEQ ID NO: 54066 - DNA, 19 bp, Homo sapiens
tgtatcactgcaaaatgtc

SEQ ID NO: 54067 - DNA, 73 bp, Variola virus
aagatgataaaaacacgtttattttatatgtcaaccattactaaaaaatatattgttctgtttttgttttctt

SEQ ID NO: 54068 - DNA, 24 bp, Variola virus
aacacgtttattttatatgtcaac

SEQ ID NO: 54069 - DNA, 21 bp, Homo sapiens
caggtttattttatactcaac

SEQ ID NO: 54070 - DNA, 22 bp, Homo sapiens
aacacatttacctcatgtcaac

SEQ ID NO: 54071 - DNA, 21 bp, Homo sapiens
catttttatttcatcatcaac

SEQ ID NO: 54072 - DNA, 19 bp, Homo sapiens
aacacgcttattgttgtgt

SEQ ID NO: 54073 - DNA, 19 bp, Homo sapiens
cgtttatttttatatgcaa

SEQ ID NO: 54074 - DNA, 19 bp, Homo sapiens
aacaggtttattttataca

SEQ ID NO: 54075 - DNA, 17 bp, Homo sapiens
aacacgttcacctatgt

SEQ ID NO: 54076 - DNA, 23 bp, Homo sapiens
aacactttatttttcaagtcaac

SEQ ID NO: 54077 - DNA, 21 bp, Homo sapiens
acgtttatttgcatttgtcaa

SEQ ID NO: 54078 - DNA, 20 bp, Homo sapiens
aacatatttacctatgtcaa

SEQ ID NO: 54079 - DNA, 17 bp, Homo sapiens
aacacgtttacttgtca

SEQ ID NO: 54080 - DNA, 23 bp, Homo sapiens
cacatacatctttatatgttaac

SEQ ID NO: 54081 - DNA, 20 bp, Homo sapiens
catgtttatttcctttcaac

SEQ ID NO: 54082 - DNA, 20 bp, Homo sapiens
cactttattttaaaatcaac

SEQ ID NO: 54083 - DNA, 125 bp, Foot-and-mouth disease virus O
ctcacaacaccgcgtggccatttttagagctggattgtgcggacaaacgccgcttcacgcacctcgcgtgaccggccagtactcttaccactttccgcctacttggtcgtcagcgctgttttggg

SEQ ID NO: 54084 - DNA, 24 bp, Foot-and-mouth disease virus O
gagctggattgtgcggacaaacgc

SEQ ID NO: 54085 - DNA, 23 bp, Homo sapiens
gagcgggttacacggatgaacgc

SEQ ID NO: 54086 - DNA, 22 bp, Homo sapiens
gctggattagtgcccctacaaa

SEQ ID NO: 54087 - DNA, 17 bp, Homo sapiens
agctggatgtggtggca

SEQ ID NO: 54088 - DNA, 19 bp, Homo sapiens
gcggctgcgcgggcggacg

SEQ ID NO: 54089 - DNA, 17 bp, Homo sapiens
gagctggtgaggcaagg

SEQ ID NO: 54090 - DNA, 25 bp, Homo sapiens
gagctggatgtattcggataaatgc

SEQ ID NO: 54091 - DNA, 15 bp, Homo sapiens
gagctggatacagac

SEQ ID NO: 54092 - DNA, 71 bp, Human herpesvirus 4
cggggacacctgcacgagacccctgggctctcaggaactccgcccaggtcttgccaattggggtgatcctg

SEQ ID NO: 54093 - DNA, 24 bp, Human herpesvirus 4
acccctgggctctcaggaactccg

SEQ ID NO: 54094 - DNA, 18 bp, Homo sapiens
cccctgggcttcggctcc

SEQ ID NO: 54095 - DNA, 19 bp, Homo sapiens
cccctgggtcccagattct

SEQ ID NO: 54096 - DNA, 19 bp, Homo sapiens
cctgggcctcagggagccg

SEQ ID NO: 54097 - DNA, 16 bp, Homo sapiens
cctgggctgcaggctc

SEQ ID NO: 54098 - DNA, 18 bp, Homo sapiens
ccccgggctcctggcttc

SEQ ID NO: 54099 - DNA, 27 bp, Homo sapiens
cccctgggcactgctctgcggagttcc

SEQ ID NO: 54100 - DNA, 26 bp, Homo sapiens
ccctggactctcgcctgcggagttcc

SEQ ID NO: 54101 - DNA, 19 bp, Homo sapiens
cctggctctcagaagtccg

SEQ ID NO: 54102 - DNA, 28 bp, Homo sapiens
actcctgggctgggctctgcggagttcc

SEQ ID NO: 54103 - DNA, 23 bp, Homo sapiens
cctcctgggcttcctgggggctc

SEQ ID NO: 54104 - DNA, 18 bp, Homo sapiens
ccccggtcccaggaactc

SEQ ID NO: 54105 - DNA, 24 bp, Homo sapiens
acccctgggttctattgcggagtc

SEQ ID NO: 54106 - DNA, 26 bp, Homo sapiens
cctgggcctgggctctgcggagttcc

SEQ ID NO: 54107 - DNA, 29 bp, Homo sapiens
acccttggattctccctctgcggagttcc

SEQ ID NO: 54108 - DNA, 21 bp, Homo sapiens
cctgggctcctcactcctccg

SEQ ID NO: 54109 - DNA, 20 bp, Homo sapiens
cccctgggcttctggcagct

SEQ ID NO: 54110 - DNA, 18 bp, Homo sapiens
ccccgggctccgggctcc

SEQ ID NO: 54111 - DNA, 16 bp, Homo sapiens
ccgggctccgggctcc

SEQ ID NO: 54112 - DNA, 22 bp, Homo sapiens
ccctgagcgcgcaggggcttcg

SEQ ID NO: 54113 - DNA, 16 bp, Homo sapiens
cctgggctcggcactc

SEQ ID NO: 54114 - DNA, 22 bp, Homo sapiens
cccctggggcaggcaggggctc

SEQ ID NO: 54115 - DNA, 17 bp, Homo sapiens
ccctgggctttgaaccc

SEQ ID NO: 54116 - DNA, 17 bp, Homo sapiens
ccctgatacaggaactc

SEQ ID NO: 54117 - DNA, 18 bp, Homo sapiens
acccctgggctgcttgga

SEQ ID NO: 54118 - DNA, 24 bp, Homo sapiens
cccctgggctccgtccgcggagtc

SEQ ID NO: 54119 - DNA, 18 bp, Homo sapiens
acccctggttagggctcc

SEQ ID NO: 54120 - DNA, 22 bp, Homo sapiens
acccctgggtcacagaacttcg

SEQ ID NO: 54121 - DNA, 19 bp, Homo sapiens
cctgggctttctctctccg

SEQ ID NO: 54122 - DNA, 17 bp, Homo sapiens
ccccgggctctgactcc

SEQ ID NO: 54123 - DNA, 21 bp, Homo sapiens
actcctgggttcggcatgctc

SEQ ID NO: 54124 - DNA, 18 bp, Homo sapiens
ctctggctctcaggttcc

SEQ ID NO: 54125 - DNA, 18 bp, Homo sapiens
acccctgggcagaactcc

SEQ ID NO: 54126 - DNA, 20 bp, Homo sapiens
acccctgggactgtgggctc

SEQ ID NO: 54127 - DNA, 21 bp, Homo sapiens
actcctgggctcacagtttcc

SEQ ID NO: 54128 - DNA, 24 bp, Homo sapiens
cccctggctctcaactgcggagtc

SEQ ID NO: 54129 - DNA, 21 bp, Homo sapiens
cctcctggactgggagctccg

SEQ ID NO: 54130 - DNA, 19 bp, Homo sapiens
ccctgggctctcggcaccc

SEQ ID NO: 54131 - DNA, 28 bp, Homo sapiens
actcctgggctcccatctgcggagttcc

SEQ ID NO: 54132 - DNA, 22 bp, Homo sapiens
cctctgcaccctgggagttccg

SEQ ID NO: 54133 - DNA, 19 bp, Homo sapiens
cctgggccgaggggcttcg

SEQ ID NO: 54134 - DNA, 17 bp, Homo sapiens
ctgggctcttaaacacc

SEQ ID NO: 54135 - DNA, 16 bp, Homo sapiens
ccccgggctccggctc

SEQ ID NO: 54136 - DNA, 29 bp, Homo sapiens
acgcctgggctctgcctctgcggagttcc

SEQ ID NO: 54137 - DNA, 18 bp, Homo sapiens
ccctctgcccaggaactc

SEQ ID NO: 54138 - DNA, 21 bp, Homo sapiens
acctatgggctggtgacttcg

SEQ ID NO: 54139 - DNA, 22 bp, Homo sapiens
cccctggggttctcagggcctc

SEQ ID NO: 54140 - DNA, 20 bp, Homo sapiens
cctgggctttgcaggaagct

SEQ ID NO: 54141 - DNA, 24 bp, Homo sapiens
cccctgggctccaactgcggagtc

SEQ ID NO: 54142 - DNA, 28 bp, Homo sapiens
acccctgggccttcatctgcggagttcc

SEQ ID NO: 54143 - DNA, 21 bp, Homo sapiens
acccctggttctccacatctc

SEQ ID NO: 54144 - DNA, 15 bp, Homo sapiens
ctgggctctggccca

SEQ ID NO: 54145 - DNA, 20 bp, Homo sapiens
cctctgggctccagcagccg

SEQ ID NO: 54146 - DNA, 18 bp, Homo sapiens
ccctgggctccagatctc

SEQ ID NO: 54147 - DNA, 21 bp, Homo sapiens
actcctgggtccccgactccg

SEQ ID NO: 54148 - DNA, 28 bp, Homo sapiens
cctctgggctccgggtctgcggagttcc

SEQ ID NO: 54149 - DNA, 17 bp, Homo sapiens
cccctgggccagaagct

SEQ ID NO: 54150 - DNA, 20 bp, Homo sapiens
acccctgggttctccacacc

SEQ ID NO: 54151 - DNA, 20 bp, Homo sapiens
cctgctcaagtcaggaactc

SEQ ID NO: 54152 - DNA, 24 bp, Homo sapiens
acccctgggtgactctgcggagtc

SEQ ID NO: 54153 - DNA, 16 bp, Homo sapiens
acccctgggttccgga

SEQ ID NO: 54154 - DNA, 15 bp, Homo sapiens
ccctgggctccactc

SEQ ID NO: 54155 - DNA, 15 bp, Homo sapiens
ccccgggctcgactc

SEQ ID NO: 54156 - DNA, 21 bp, Homo sapiens
acccctggttccctggctccg

SEQ ID NO: 54157 - DNA, 17 bp, Homo sapiens
ctgggctccggctcacg

SEQ ID NO: 54158 - DNA, 24 bp, Homo sapiens
actcctgggctctggcgcggagtc

SEQ ID NO: 54159 - DNA, 19 bp, Homo sapiens
acccctgtgctctaccctc

SEQ ID NO: 54160 - DNA, 19 bp, Homo sapiens
ccctgggcacagaatgctc

SEQ ID NO: 54161 - DNA, 18 bp, Homo sapiens
actcctgggctttcggga

SEQ ID NO: 54162 - DNA, 26 bp, Homo sapiens
cccagggctctcgcctgcggagttcc

SEQ ID NO: 54163 - DNA, 25 bp, Homo sapiens
actcctgggctctcgccgcggagtc

SEQ ID NO: 54164 - DNA, 18 bp, Homo sapiens
acccctgggcttccagaa

SEQ ID NO: 54165 - DNA, 19 bp, Homo sapiens
ctgggctcctcaggctccg

SEQ ID NO: 54166 - DNA, 17 bp, Homo sapiens
ccctgggctgcggctcc

SEQ ID NO: 54167 - DNA, 17 bp, Homo sapiens
cctgggtcctcaggact

SEQ ID NO: 54168 - DNA, 21 bp, Homo sapiens
actcctgggctccagtgatct

SEQ ID NO: 54169 - DNA, 20 bp, Homo sapiens
ccccgggctgccgggctccg

SEQ ID NO: 54170 - DNA, 24 bp, Homo sapiens
cccctgggctccacctgcggagtc

SEQ ID NO: 54171 - DNA, 27 bp, Homo sapiens
cccctggattttccttcgcggagttcc

SEQ ID NO: 54172 - DNA, 18 bp, Homo sapiens
ctgggctcctgacacccg

SEQ ID NO: 54173 - DNA, 22 bp, Homo sapiens
acctctgggctccttttggctc

SEQ ID NO: 54174 - DNA, 19 bp, Homo sapiens
ccctgggttaagagcttcg

SEQ ID NO: 54175 - DNA, 24 bp, Homo sapiens
ccccgggctctcaactgcggagtc

SEQ ID NO: 54176 - DNA, 28 bp, Homo sapiens
actcctgggctccttgctgcggagttcc

SEQ ID NO: 54177 - DNA, 27 bp, Homo sapiens
ccctgggctctccctttgcggagttcc

SEQ ID NO: 54178 - DNA, 16 bp, Homo sapiens
cctgagctctgaactc

SEQ ID NO: 54179 - DNA, 18 bp, Homo sapiens
cctacttcaggaactccg

SEQ ID NO: 54180 - DNA, 23 bp, Homo sapiens
cccctgggctttgatgacttctc

SEQ ID NO: 54181 - DNA, 21 bp, Homo sapiens
ccctttgggctcttggccact

SEQ ID NO: 54182 - DNA, 63 bp, Ectromelia virus
agatccatgagaaatacgtttagccgcctttaatagaggaaatcccaccgcctttctggatct

SEQ ID NO: 54183 - DNA, 24 bp, Ectromelia virus
tccatgagaaatacgtttagccgc

SEQ ID NO: 54184 - DNA, 19 bp, Homo sapiens
tccatgaggcaatatgctt

SEQ ID NO: 54185 - DNA, 21 bp, Homo sapiens
tccatgagaaaggctgcccgc

SEQ ID NO: 54186 - DNA, 23 bp, Homo sapiens
tccatgaaggaatgttgtcctgc

SEQ ID NO: 54187 - DNA, 17 bp, Homo sapiens
tcctgagaaatgcttgc

SEQ ID NO: 54188 - DNA, 22 bp, Homo sapiens
cctgtgggaaggggctagccgc

SEQ ID NO: 54189 - DNA, 21 bp, Homo sapiens
tccatgagaactgtccagggc

SEQ ID NO: 54190 - DNA, 18 bp, Homo sapiens
catgagaaatagtatcca

SEQ ID NO: 54191 - DNA, 23 bp, Homo sapiens
tccttgagaaatacacgatccgc

SEQ ID NO: 54192 - DNA, 17 bp, Homo sapiens
tccatgaaagtcaggcg

SEQ ID NO: 54193 - DNA, 17 bp, Homo sapiens
tccatgaggaaaaccac

SEQ ID NO: 54194 - DNA, 15 bp, Homo sapiens
tgagaaatgttcacc

SEQ ID NO: 54195 - DNA, 16 bp, Homo sapiens
tccatgagaaatggcc

SEQ ID NO: 54196 - DNA, 17 bp, Homo sapiens
ccatgagaaatcagagc

SEQ ID NO: 54197 - DNA, 21 bp, Homo sapiens
tccatgaggactatgtaaagc

SEQ ID NO: 54198 - DNA, 24 bp, Homo sapiens
tccatgagtaagtgcgtcaagggc

SEQ ID NO: 54199 - DNA, 64 bp, Ectromelia virus
gttaatctcacaactttactgtttttgaactgttcaaaatatagcatagatccatgagaaatac

SEQ ID NO: 54200 - DNA, 23 bp, Ectromelia virus
tagcatagatccatgagaaatac

SEQ ID NO: 54201 - DNA, 18 bp, Homo sapiens
tagcatggataccatgaa

SEQ ID NO: 54202 - DNA, 20 bp, Homo sapiens
agcatccccatgagaaatac

SEQ ID NO: 54203 - DNA, 20 bp, Homo sapiens
agcatttcaatgagaaatac

SEQ ID NO: 54204 - DNA, 18 bp, Homo sapiens
acatatgtatgagaaata

SEQ ID NO: 54205 - DNA, 21 bp, Homo sapiens
agcatcttaaaatgagaaata

SEQ ID NO: 54206 - DNA, 21 bp, Homo sapiens
tagcataaatctagccacatg

SEQ ID NO: 54207 - DNA, 19 bp, Homo sapiens
tagtcaccatgagagatac

SEQ ID NO: 54208 - DNA, 98 bp, Frog adenovirus 1
tgggaacttcaggagctgacttagaaaatattgttttatctcttgggctgcattcaggttttttaggcatttttgataaacatttccccgggttctta

SEQ ID NO: 54209 - DNA, 24 bp, Frog adenovirus 1
caggagctgacttagaaaatattg

SEQ ID NO: 54210 - DNA, 24 bp, Homo sapiens
caggactctactgggaaaatattg

SEQ ID NO: 54211 - DNA, 19 bp, Homo sapiens
ggtgctgacttggagaaaa

SEQ ID NO: 54212 - DNA, 20 bp, Homo sapiens
agtagctgagaaaaatattg

SEQ ID NO: 54213 - DNA, 20 bp, Homo sapiens
ggtgctgttagaaaatgttg

SEQ ID NO: 54214 - DNA, 62 bp, Polyomavirus muris
ctgggaataataactttctagtccatgatacaaagaagttgaatagacctgaaacagcccag

SEQ ID NO: 54215 - DNA, 23 bp, Polyomavirus muris
tgaatagacctgaaacagcccag

SEQ ID NO: 54216 - DNA, 21 bp, Homo sapiens
gaatagggtctgatagcccag

SEQ ID NO: 54217 - DNA, 18 bp, Homo sapiens
gaatagacctggagacag

SEQ ID NO: 54218 - DNA, 18 bp, Homo sapiens
gaccttgaaacagtccag

SEQ ID NO: 54219 - DNA, 20 bp, Homo sapiens
tgaatagatttgagcaacag

SEQ ID NO: 54220 - DNA, 17 bp, Homo sapiens
gaatagaagaaaacagc

SEQ ID NO: 54221 - DNA, 23 bp, Homo sapiens
taaatagaaagcaagcagcccag

SEQ ID NO: 54222 - DNA, 23 bp, Homo sapiens
tgagggacctagacccagcccag

SEQ ID NO: 54223 - DNA, 21 bp, Homo sapiens
tgaataggagaggcagcccag

SEQ ID NO: 54224 - DNA, 18 bp, Homo sapiens
tgaatggagcctggacag

SEQ ID NO: 54225 - DNA, 23 bp, Homo sapiens
tgaagactaaggaaacagcccag

SEQ ID NO: 54226 - DNA, 20 bp, Homo sapiens
tggtaagaaaaacagcccag

SEQ ID NO: 54227 - DNA, 21 bp, Homo sapiens
gatccagctggggcagcccag

SEQ ID NO: 54228 - DNA, 21 bp, Homo sapiens
tgaacagacccacaagctcag

SEQ ID NO: 54229 - DNA, 21 bp, Homo sapiens
tgaagggactgagcagcccag

SEQ ID NO: 54230 - DNA, 18 bp, Homo sapiens
tgagacccgagcagctca

SEQ ID NO: 54231 - DNA, 17 bp, Homo sapiens
tgatagacctggaacag

SEQ ID NO: 54232 - DNA, 19 bp, Homo sapiens
tggataaacttgaaacagc

SEQ ID NO: 54233 - DNA, 19 bp, Homo sapiens
gaagggagagacagcccag

SEQ ID NO: 54234 - DNA, 17 bp, Homo sapiens
tggacagacctgatgcc

SEQ ID NO: 54235 - DNA, 16 bp, Homo sapiens
agacatgacagcccag

SEQ ID NO: 54236 - DNA, 17 bp, Homo sapiens
tgaagaggcccagccca

SEQ ID NO: 54237 - DNA, 18 bp, Homo sapiens
tgaataggccagaaaaag

SEQ ID NO: 54238 - DNA, 17 bp, Homo sapiens
acaggaccacagcccag

SEQ ID NO: 54239 - DNA, 20 bp, Homo sapiens
tgaagactgaggcagcccag

SEQ ID NO: 54240 - DNA, 21 bp, Homo sapiens
tgagggactgaggcagcccag

SEQ ID NO: 54241 - DNA, 17 bp, Homo sapiens
tgaaaagacctgagcag

SEQ ID NO: 54242 - DNA, 16 bp, Homo sapiens
tgaatagacactggcc

SEQ ID NO: 54243 - DNA, 22 bp, Homo sapiens
tgcgtaggcttgctcaacccag

SEQ ID NO: 54244 - DNA, 23 bp, Homo sapiens
tgagaaggccggccgcagcccag

SEQ ID NO: 54245 - DNA, 21 bp, Homo sapiens
gaaagctttggggcagcccag

SEQ ID NO: 54246 - DNA, 21 bp, Homo sapiens
tagataggaaaggcagcccag

SEQ ID NO: 54247 - DNA, 21 bp, Homo sapiens
tgaatagactgtccttcccag

SEQ ID NO: 54248 - DNA, 19 bp, Homo sapiens
gatcctggaaacagtccag

SEQ ID NO: 54249 - DNA, 19 bp, Homo sapiens
tgagtagagaacagcccag

SEQ ID NO: 54250 - DNA, 22 bp, Homo sapiens
taaatagacttggaatgatccc

SEQ ID NO: 54251 - DNA, 21 bp, Homo sapiens
gaataggttccagcagcccag

SEQ ID NO: 54252 - DNA, 17 bp, Homo sapiens
tgaatagacttaaggcc

SEQ ID NO: 54253 - DNA, 15 bp, Homo sapiens
cagcccacagcccag

SEQ ID NO: 54254 - DNA, 21 bp, Homo sapiens
tgggaagacctgaaccaccag

SEQ ID NO: 54255 - DNA, 66 bp, Frog adenovirus 1
gagattgtactatttgtatacgcatctttaataaaagttttgaataaacaattgagtacttgtttc

SEQ ID NO: 54256 - DNA, 24 bp, Frog adenovirus 1
gattgtactatttgtatacgcatc

SEQ ID NO: 54257 - DNA, 18 bp, Homo sapiens
aattgtacatatacgcat

SEQ ID NO: 54258 - DNA, 20 bp, Homo sapiens
gattgtttttgtatatgcat

SEQ ID NO: 54259 - DNA, 18 bp, Homo sapiens
attgtaccatgtgtgcat

SEQ ID NO: 54260 - DNA, 20 bp, Homo sapiens
gattgttttcgtatatgcat

SEQ ID NO: 54261 - DNA, 100 bp, Polyomavirus muris
gtgggaaattaggaaacagtgaggttaaagccgcaaaagcttgaggagttacttctacagctgctaaggcttctgcttctgttaaacctccataaactac

SEQ ID NO: 54262 - DNA, 24 bp, Polyomavirus muris
taggaaacagtgaggttaaagccg

SEQ ID NO: 54263 - DNA, 24 bp, Homo sapiens
caggaaacatgcccaggttaaagc

SEQ ID NO: 54264 - DNA, 18 bp, Homo sapiens
ggagacagtgagccagcc

SEQ ID NO: 54265 - DNA, 22 bp, Homo sapiens
ggggggtgggcgtctaaagccg

SEQ ID NO: 54266 - DNA, 18 bp, Homo sapiens
taggaaacaatgaggtta

SEQ ID NO: 54267 - DNA, 16 bp, Homo sapiens
ggaaagcagtcaaagc

SEQ ID NO: 54268 - DNA, 19 bp, Homo sapiens
gggaacagtgagggaaaag

SEQ ID NO: 54269 - DNA, 21 bp, Homo sapiens
ggagacagtgaggtccttccg

SEQ ID NO: 54270 - DNA, 21 bp, Homo sapiens
taggaaacatgggatttggtt

SEQ ID NO: 54271 - DNA, 19 bp, Homo sapiens
gggaacagtggggcctaag

SEQ ID NO: 54272 - DNA, 18 bp, Homo sapiens
ggaaacagtggagtgagc

SEQ ID NO: 54273 - DNA, 22 bp, Homo sapiens
ggcaaacagtgaaactaagggc

SEQ ID NO: 54274 - DNA, 19 bp, Homo sapiens
tagaaaacggaatgaggct

SEQ ID NO: 54275 - DNA, 20 bp, Homo sapiens
taggaaaaatatattaaagc

SEQ ID NO: 54276 - DNA, 21 bp, Homo sapiens
taggaaacatgaaacaagggc

SEQ ID NO: 54277 - DNA, 17 bp, Homo sapiens
ggaaatatgagcaaagc

SEQ ID NO: 54278 - DNA, 24 bp, Homo sapiens
aggaaacagaagatgttaaagccg

SEQ ID NO: 54279 - DNA, 19 bp, Homo sapiens
ggaaacagatgagaagccg

SEQ ID NO: 54280 - DNA, 18 bp, Homo sapiens
tagtaaacagtaaaagtt

SEQ ID NO: 54281 - DNA, 23 bp, Homo sapiens
ggagaatgaggtgaggttagagc

SEQ ID NO: 54282 - DNA, 16 bp, Homo sapiens
aggaagcggatgaagc

SEQ ID NO: 54283 - DNA, 18 bp, Homo sapiens
taggaaacgctggctggc

SEQ ID NO: 54284 - DNA, 65 bp, Paramecium bursaria Chlorella virus 1
aagtgatataaggggaatacacatgagtaatcaaaacccagcacatactctcctcgaattcattt

SEQ ID NO: 54285 - DNA, 24 bp, Paramecium bursaria Chlorella virus 1
taaggggaatacacatgagtaatc

SEQ ID NO: 54286 - DNA, 22 bp, Homo sapiens
aagggaattatcatgggtaatc

SEQ ID NO: 54287 - DNA, 15 bp, Homo sapiens
aagggaatacatggt

SEQ ID NO: 54288 - DNA, 21 bp, Homo sapiens
taagggtaatatatacagagt

SEQ ID NO: 54289 - DNA, 19 bp, Homo sapiens
taaggggaaagcattcagt

SEQ ID NO: 54290 - DNA, 17 bp, Homo sapiens
aggggaatacgtatggc

SEQ ID NO: 54291 - DNA, 16 bp, Homo sapiens
ggggaataggagtaat

SEQ ID NO: 54292 - DNA, 23 bp, Homo sapiens
caaggggagtgctgggagtgatc

SEQ ID NO: 54293 - DNA, 21 bp, Homo sapiens
caaggggagtatgatccatga

SEQ ID NO: 54294 - DNA, 18 bp, Homo sapiens
agggggacacacactgat

SEQ ID NO: 54295 - DNA, 20 bp, Homo sapiens
taaggggaaaacctaaaagt

SEQ ID NO: 54296 - DNA, 21 bp, Homo sapiens
taagaggaatgtttggtaatc

SEQ ID NO: 54297 - DNA, 17 bp, Homo sapiens
aggggaatgcaatgagc

SEQ ID NO: 54298 - DNA, 18 bp, Homo sapiens
aaggggaatacagttaat

SEQ ID NO: 54299 - DNA, 68 bp, Paramecium bursaria Chlorella virus 1
cccagcacatactctcctcgaattcatttctcctaccagttgtgagtcgacgaccatcgcctactggg

SEQ ID NO: 54300 - DNA, 24 bp, Paramecium bursaria Chlorella virus 1
tgagtcgacgaccatcgcctactg

SEQ ID NO: 54301 - DNA, 21 bp, Homo sapiens
tgagtcgagattgtgccactg

SEQ ID NO: 54302 - DNA, 21 bp, Homo sapiens
tgagtcgagatcgtgccactg

SEQ ID NO: 54303 - DNA, 21 bp, Homo sapiens
tgagtcgagatcgcgccactg

SEQ ID NO: 54304 - DNA, 21 bp, Homo sapiens
tgagtcgagatcatgccactg

SEQ ID NO: 54305 - DNA, 18 bp, Homo sapiens
tgagtcgagatcgcacca

SEQ ID NO: 54306 - DNA, 20 bp, Homo sapiens
tgagtgacgaccacggcgct

SEQ ID NO: 54307 - DNA, 21 bp, Homo sapiens
tgagtcgagatcgcaccactg

SEQ ID NO: 54308 - DNA, 21 bp, Homo sapiens
tgagtcgacgatcacttgact

SEQ ID NO: 54309 - DNA, 62 bp, Paramecium bursaria Chlorella virus 1
tgtttggtccggtagatatggcaaatcccaaccccagggccgtatctgaaaagtatcaagca

SEQ ID NO: 54310 - DNA, 24 bp, Paramecium bursaria Chlorella virus 1
ggtagatatggcaaatcccaaccc

SEQ ID NO: 54311 - DNA, 21 bp, Homo sapiens
ggtaggcatggcaagctgcca

SEQ ID NO: 54312 - DNA, 23 bp, Homo sapiens
ggtagatagggagctccttagcc

SEQ ID NO: 54313 - DNA, 24 bp, Homo sapiens
ggtagatatgtgtgaaaactgtcc

SEQ ID NO: 54314 - DNA, 22 bp, Homo sapiens
ggagacccagaagtcccagtcc

SEQ ID NO: 54315 - DNA, 23 bp, Homo sapiens
ggaagaaaccaaaatcccaaccc

SEQ ID NO: 54316 - DNA, 18 bp, Homo sapiens
ggagagcaaatcctggcc

SEQ ID NO: 54317 - DNA, 20 bp, Homo sapiens
tataacgtaaatcccagtcc

SEQ ID NO: 54318 - DNA, 19 bp, Homo sapiens
ggcagaaaaggtcccaacc

SEQ ID NO: 54319 - DNA, 22 bp, Homo sapiens
gtagatataagtttcctggccc

SEQ ID NO: 54320 - DNA, 22 bp, Homo sapiens
ggtgaacaaagaatcccaatcc

SEQ ID NO: 54321 - DNA, 20 bp, Homo sapiens
ggcaaaaagcaaatcttaac

SEQ ID NO: 54322 - DNA, 17 bp, Homo sapiens
gatagacccaaatccca

SEQ ID NO: 54323 - DNA, 19 bp, Homo sapiens
gtagcaaacaaatttcaac

SEQ ID NO: 54324 - DNA, 18 bp, Homo sapiens
ggtgtggtaatcccaacc

SEQ ID NO: 54325 - DNA, 18 bp, Homo sapiens
agtagacaaaaatcccaa

SEQ ID NO: 54326 - DNA, 18 bp, Homo sapiens
ggtggtgggaatcccaac

SEQ ID NO: 54327 - DNA, 83 bp, Meleagrid herpesvirus 1
gttttagacctatacggtaatgcaacatccatcatccggtgacggaaatatagatggagcgccaatcgccgatagtttgatac

SEQ ID NO: 54328 - DNA, 24 bp, Meleagrid herpesvirus 1
tagatggagcgccaatcgccgata

SEQ ID NO: 54329 - DNA, 19 bp, Homo sapiens
tagctggagcgctggacca

SEQ ID NO: 54330 - DNA, 19 bp, Homo sapiens
agatggagcaggcgtcgat

SEQ ID NO: 54331 - DNA, 18 bp, Homo sapiens
agatggagccactcgccg

SEQ ID NO: 54332 - DNA, 97 bp, Cactus virus X
gcccttagtcatccatgctgtggccggtgcaggaaagaccaccctgattaggcaatttctacaccaacactcggccacgaatgctcagacgctgggc

SEQ ID NO: 54333 - DNA, 24 bp, Cactus virus X
tccatgctgtggccggtgcaggaa

SEQ ID NO: 54334 - DNA, 25 bp, Homo sapiens
tctgtgcagtggccagccataggaa

SEQ ID NO: 54335 - DNA, 20 bp, Homo sapiens
catattgttaagtgcaggaa

SEQ ID NO: 54336 - DNA, 17 bp, Homo sapiens
tgctgtggccgggccgg

SEQ ID NO: 54337 - DNA, 19 bp, Homo sapiens
ccatgctgccgagtgcggg

SEQ ID NO: 54338 - DNA, 21 bp, Homo sapiens
tccactgtcaccggtgcggga

SEQ ID NO: 54339 - DNA, 18 bp, Homo sapiens
gctggggctggtgcagga

SEQ ID NO: 54340 - DNA, 22 bp, Homo sapiens
tccctgagtttgctggtgcagg

SEQ ID NO: 54341 - DNA, 23 bp, Homo sapiens
tccatgctctggcaggacaggaa

SEQ ID NO: 54342 - DNA, 21 bp, Homo sapiens
ctgtttgatcatgtgcaggaa

SEQ ID NO: 54343 - DNA, 21 bp, Homo sapiens
cctgtgtggaagtggtgtagg

SEQ ID NO: 54344 - DNA, 19 bp, Homo sapiens
tgctggttgggtgcaggaa

SEQ ID NO: 54345 - DNA, 19 bp, Homo sapiens
atactgtggtgcttgggga

SEQ ID NO: 54346 - DNA, 22 bp, Homo sapiens
tccggctgtggcctgagcggga

SEQ ID NO: 54347 - DNA, 18 bp, Homo sapiens
gctatgccgtggtgcagg

SEQ ID NO: 54348 - DNA, 20 bp, Homo sapiens
atgcccagggccggtgtggg

SEQ ID NO: 54349 - DNA, 20 bp, Homo sapiens
ccatgctggccaagtgcagg

SEQ ID NO: 54350 - DNA, 22 bp, Homo sapiens
tcctgctgtgggaatctaggaa

SEQ ID NO: 54351 - DNA, 24 bp, Homo sapiens
tctgtgctgcggtctctgctcagg

SEQ ID NO: 54352 - DNA, 17 bp, Homo sapiens
tgctgtggttgtaggaa

SEQ ID NO: 54353 - DNA, 22 bp, Homo sapiens
tccatgctgagcacagcgggga

SEQ ID NO: 54354 - DNA, 18 bp, Homo sapiens
catatttggggtgcagga

SEQ ID NO: 54355 - DNA, 19 bp, Homo sapiens
tccatgccgtgagtaggga

SEQ ID NO: 54356 - DNA, 23 bp, Homo sapiens
tctctgctgtggtgctgggcagg

SEQ ID NO: 54357 - DNA, 24 bp, Homo sapiens
tccagtgcatgtgactggtgcagg

SEQ ID NO: 54358 - DNA, 22 bp, Homo sapiens
catgctgctggacaggtgggaa

SEQ ID NO: 54359 - DNA, 20 bp, Homo sapiens
cctgtgctgctgggtgcagg

SEQ ID NO: 54360 - DNA, 17 bp, Homo sapiens
tcctgctgtggccgagg

SEQ ID NO: 54361 - DNA, 19 bp, Homo sapiens
tccctgctgtggtcgcagg

SEQ ID NO: 54362 - DNA, 20 bp, Homo sapiens
tccttgtcctgtggtgcagg

SEQ ID NO: 54363 - DNA, 18 bp, Homo sapiens
tgtctgctccgtgcggga

SEQ ID NO: 54364 - DNA, 19 bp, Homo sapiens
tccaaggcccggtgcagga

SEQ ID NO: 54365 - DNA, 16 bp, Homo sapiens
cccaggctggtgcagg

SEQ ID NO: 54366 - DNA, 16 bp, Homo sapiens
ctgtcagctgcaggaa

SEQ ID NO: 54367 - DNA, 24 bp, Homo sapiens
tccatgctgtgcctctactaggaa

SEQ ID NO: 54368 - DNA, 20 bp, Homo sapiens
ccgtcctgctggtgcaggaa

SEQ ID NO: 54369 - DNA, 23 bp, Homo sapiens
tccatgctgtgacccacagcagg

SEQ ID NO: 54370 - DNA, 21 bp, Homo sapiens
catgctgtgtgacctcaggaa

SEQ ID NO: 54371 - DNA, 131 bp, Human herpesvirus 6
gcgcgattaggttagattcggaaaccatagctgtccatgagattttcaatccggagttaagtaaactgcttaacttgcactcgaaaacagtctacatgtccgacctatgcgcttttatttctggttgtgtt

SEQ ID NO: 54372 - DNA, 24 bp, Human herpesvirus 6
tccatgagattttcaatccggagt

SEQ ID NO: 54373 - DNA, 17 bp, Homo sapiens
catgagattatcggaat

SEQ ID NO: 54374 - DNA, 17 bp, Homo sapiens
cacgagatttttcagag

SEQ ID NO: 54375 - DNA, 17 bp, Homo sapiens
tcctgagatttttggag

SEQ ID NO: 54376 - DNA, 21 bp, Homo sapiens
tccatgaaatttttgataacc

SEQ ID NO: 54377 - DNA, 25 bp, Homo sapiens
ccatgagatatagagaatctggggt

SEQ ID NO: 54378 - DNA, 21 bp, Homo sapiens
tccatgggcaaggtccggagt

SEQ ID NO: 54379 - DNA, 18 bp, Homo sapiens
tccatagagatatctggg

SEQ ID NO: 54380 - DNA, 17 bp, Homo sapiens
ccatggatagtccggag

SEQ ID NO: 54381 - DNA, 19 bp, Homo sapiens
tgagaattttgcccagagt

SEQ ID NO: 54382 - DNA, 19 bp, Homo sapiens
catgaattttcaggcagaa

SEQ ID NO: 54383 - DNA, 18 bp, Homo sapiens
tccacgagattttaggag

SEQ ID NO: 54384 - DNA, 79 bp, Human herpesvirus 6
ggaattgatgtccagtgcgttcattcaacacagagtaatgttgaataattgttattgtatcgctgtcatcttcaatgcc

SEQ ID NO: 54385 - DNA, 24 bp, Human herpesvirus 6
ttgaataattgttattgtatcgct

SEQ ID NO: 54386 - DNA, 19 bp, Homo sapiens
ttgaaagattgttatccgc

SEQ ID NO: 54387 - DNA, 18 bp, Homo sapiens
ttgaataattgttattat

SEQ ID NO: 54388 - DNA, 17 bp, Homo sapiens
ttgaatattgtcattgt

SEQ ID NO: 54389 - DNA, 21 bp, Homo sapiens
aataattgttattcatcatct

SEQ ID NO: 54390 - DNA, 18 bp, Homo sapiens
ttgagttattgttactgt

SEQ ID NO: 54391 - DNA, 19 bp, Homo sapiens
tcgagtaattgttgctcgc

SEQ ID NO: 54392 - DNA, 104 bp, Swinepox virus
tcactatacgagggatataaagaatttctagatcctaaactgaaacagtttttgaatgataattgtacatatagaggatatagagatttttttttgtataatga

SEQ ID NO: 54393 - DNA, 24 bp, Swinepox virus
attgtacatatagaggatatagag

SEQ ID NO: 54394 - DNA, 21 bp, Homo sapiens
attatatatagagatatagag

SEQ ID NO: 54395 - DNA, 17 bp, Homo sapiens
ttatacatatggaaaga

SEQ ID NO: 54396 - DNA, 17 bp, Homo sapiens
ttgtactgtagagaaca

SEQ ID NO: 54397 - DNA, 23 bp, Homo sapiens
ttgtaaatattacttatatagag

SEQ ID NO: 54398 - DNA, 20 bp, Homo sapiens
ttctacatatagaaagctag

SEQ ID NO: 54399 - DNA, 18 bp, Homo sapiens
attgtacatatagaggat

SEQ ID NO: 54400 - DNA, 17 bp, Homo sapiens
attgtacatgcaggata

SEQ ID NO: 54401 - DNA, 21 bp, Homo sapiens
attgatatccaggatatagag

SEQ ID NO: 54402 - DNA, 21 bp, Homo sapiens
attgtaagtgaaaatatagag

SEQ ID NO: 54403 - DNA, 17 bp, Homo sapiens
ttgtacatatgaggata

SEQ ID NO: 54404 - DNA, 20 bp, Homo sapiens
attgtacatgtagcaggata

SEQ ID NO: 54405 - DNA, 100 bp, Swinepox virus
atacacagatttattgtaaagctatatcatattcaaactctagttatatattgatatattgggaagatgaatatggtggttatatatatgataatggtat

SEQ ID NO: 54406 - DNA, 24 bp, Swinepox virus
tattgggaagatgaatatggtggt

SEQ ID NO: 54407 - DNA, 21 bp, Homo sapiens
ttgggaaggtgagaacacagt

SEQ ID NO: 54408 - DNA, 25 bp, Homo sapiens
ttggggaggtggtaataatggtggt

SEQ ID NO: 54409 - DNA, 17 bp, Homo sapiens
tattgggaagattgggt

SEQ ID NO: 54410 - DNA, 19 bp, Homo sapiens
ttgggaaatgaaaaagggt

SEQ ID NO: 54411 - DNA, 23 bp, Homo sapiens
cattgggccctggatatggtggt

SEQ ID NO: 54412 - DNA, 18 bp, Homo sapiens
tattgaggagatgaatat

SEQ ID NO: 54413 - DNA, 23 bp, Homo sapiens
tattgggagatggagtttgtggt

SEQ ID NO: 54414 - DNA, 19 bp, Homo sapiens
tgggaagatgagacgttgg

SEQ ID NO: 54415 - DNA, 21 bp, Homo sapiens
ttgttgtgtgagtatggtggt

SEQ ID NO: 54416 - DNA, 26 bp, Homo sapiens
ttgggaagggaattaattgtggtggt

SEQ ID NO: 54417 - DNA, 22 bp, Homo sapiens
tattgtgaagcactatggtggt

SEQ ID NO: 54418 - DNA, 22 bp, Homo sapiens
tattgggaagattaaatgaggt

SEQ ID NO: 54419 - DNA, 79 bp, Cowpox virus
gtctccttaaagcttctgatggtaactgtgttacatgtgctccgtcatacgtaaatgccttcttaagctatttggaaac

SEQ ID NO: 54420 - DNA, 24 bp, Cowpox virus
tgatggtaactgtgttacatgtgc

SEQ ID NO: 54421 - DNA, 22 bp, Homo sapiens
tggtggttatggattacatgtg

SEQ ID NO: 54422 - DNA, 15 bp, Homo sapiens
atggtagccacatgt

SEQ ID NO: 54423 - DNA, 21 bp, Homo sapiens
tgatggcagttgtggatgtgc

SEQ ID NO: 54424 - DNA, 17 bp, Homo sapiens
tggtaactgtgtcatgt

SEQ ID NO: 54425 - DNA, 24 bp, Homo sapiens
tggtggcaacccccggacatgtgc

SEQ ID NO: 54426 - DNA, 20 bp, Homo sapiens
gatggtggctgtgctatgtg

SEQ ID NO: 54427 - DNA, 21 bp, Homo sapiens
tgaggtaactgtaaaatgtgc

SEQ ID NO: 54428 - DNA, 18 bp, Homo sapiens
tgatggtattgccatgtg

SEQ ID NO: 54429 - DNA, 21 bp, Homo sapiens
tgatggtaacagatccatgtg

SEQ ID NO: 54430 - DNA, 22 bp, Homo sapiens
tgatggtatcaaaggtgtgtgc

SEQ ID NO: 54431 - DNA, 18 bp, Homo sapiens
tgtggtaacttctgtgtg

SEQ ID NO: 54432 - DNA, 24 bp, Homo sapiens
tgatggtatctaatgcccatgtgc

SEQ ID NO: 54433 - DNA, 16 bp, Homo sapiens
atggtaacttcatgtg

SEQ ID NO: 54434 - DNA, 103 bp, Melanoplus sanguinipes entomopoxvirus
tttatatacttatttaaaatatacatatattattcctataaacattaaaatagcatgtaaaatgggaaaagatgaatatgatattgaaaatataatttgtaaa

SEQ ID NO: 54435 - DNA, 24 bp, Melanoplus sanguinipes entomopoxvirus
taaaatgggaaaagatgaatatga

SEQ ID NO: 54436 - DNA, 16 bp, Homo sapiens
taaaataggagaatat

SEQ ID NO: 54437 - DNA, 18 bp, Homo sapiens
taaaatgggaaaggagtg

SEQ ID NO: 54438 - DNA, 19 bp, Homo sapiens
aatgggaaaggatttatga

SEQ ID NO: 54439 - DNA, 16 bp, Homo sapiens
atggggaagatgtatg

SEQ ID NO: 54440 - DNA, 17 bp, Homo sapiens
atggccaatgaatatga

SEQ ID NO: 54441 - DNA, 21 bp, Homo sapiens
aaatggaagaacatgaaagtg

SEQ ID NO: 54442 - DNA, 18 bp, Homo sapiens
aaaatgggggataatatg

SEQ ID NO: 54443 - DNA, 24 bp, Homo sapiens
taaaatgagaaataaagaatgtga

SEQ ID NO: 54444 - DNA, 20 bp, Homo sapiens
taagatggaaaaggagatga

SEQ ID NO: 54445 - DNA, 24 bp, Homo sapiens
taaaatgggggcgggggaagtatg

SEQ ID NO: 54446 - DNA, 18 bp, Homo sapiens
taaaatggtgaaggatga

SEQ ID NO: 54447 - DNA, 28 bp, Homo sapiens
taaaatggaggaattgtagatgagtatg

SEQ ID NO: 54448 - DNA, 18 bp, Homo sapiens
taaaatgggaagaggtga

SEQ ID NO: 54449 - DNA, 17 bp, Homo sapiens
aaatgggaaaggacatg

SEQ ID NO: 54450 - DNA, 23 bp, Homo sapiens
tagtaaaccaaagatgaatatga

SEQ ID NO: 54451 - DNA, 26 bp, Homo sapiens
taaaatgaggggaaatcaaaatatga

SEQ ID NO: 54452 - DNA, 18 bp, Homo sapiens
aaaatgggaagagaatga

SEQ ID NO: 54453 - DNA, 22 bp, Homo sapiens
aaatgtggagaaaaaaatatga

SEQ ID NO: 54454 - DNA, 19 bp, Homo sapiens
tggaagaatggtgaatatg

SEQ ID NO: 54455 - DNA, 23 bp, Homo sapiens
taagatgagaaaagaaaatgtga

SEQ ID NO: 54456 - DNA, 23 bp, Homo sapiens
caaaatggaaagaggtgagtatg

SEQ ID NO: 54457 - DNA, 23 bp, Homo sapiens
atgggaaagtaggcagaatgtga

SEQ ID NO: 54458 - DNA, 19 bp, Homo sapiens
tgaatgggaatttaatatg

SEQ ID NO: 54459 - DNA, 24 bp, Homo sapiens
aaaatgaaataaaagatggatatg

SEQ ID NO: 54460 - DNA, 18 bp, Homo sapiens
taaaatgagaaagtatga

SEQ ID NO: 54461 - DNA, 22 bp, Homo sapiens
taaaatgaggagagatgaatat

SEQ ID NO: 54462 - DNA, 19 bp, Homo sapiens
taaaatgagaaggggatga

SEQ ID NO: 54463 - DNA, 20 bp, Homo sapiens
tgggaaggagatggatgtga

SEQ ID NO: 54464 - DNA, 23 bp, Homo sapiens
taaaatggggaaatgacatctga

SEQ ID NO: 54465 - DNA, 19 bp, Homo sapiens
taaaatgggagtggacatg

SEQ ID NO: 54466 - DNA, 21 bp, Homo sapiens
gggatgcaaagatgaatatga

SEQ ID NO: 54467 - DNA, 20 bp, Homo sapiens
atgggaaaggaagaggtatg

SEQ ID NO: 54468 - DNA, 19 bp, Homo sapiens
tgggggaaggtgaacatga

SEQ ID NO: 54469 - DNA, 108 bp, Melanoplus sanguinipes entomopoxvirus
gttgtatattcaaatttagaatatttagatgcatcatattgtggtttgacttcattcaattatacaaatgtatttccaaatcttaaatatctaaacttatcatacaat

SEQ ID NO: 54470 - DNA, 24 bp, Melanoplus sanguinipes entomopoxvirus
tagatgcatcatattgtggtttga

SEQ ID NO: 54471 - DNA, 21 bp, Homo sapiens
gattcatcagtcatggtttga

SEQ ID NO: 54472 - DNA, 24 bp, Homo sapiens
tagatcattgtttctttggtttga

SEQ ID NO: 54473 - DNA, 19 bp, Homo sapiens
gagcatcatattagagtgg

SEQ ID NO: 54474 - DNA, 17 bp, Homo sapiens
taaatgcattgtaattt

SEQ ID NO: 54475 - DNA, 17 bp, Homo sapiens
tagatgcatttatttgg

SEQ ID NO: 54476 - DNA, 18 bp, Homo sapiens
tagatgtgcatattttgg

SEQ ID NO: 54477 - DNA, 23 bp, Homo sapiens
tacatgcattgtaagcactttga

SEQ ID NO: 54478 - DNA, 16 bp, Homo sapiens
taggtgcatcatgttt

SEQ ID NO: 54479 - DNA, 23 bp, Homo sapiens
agatgcatcggcctgtggtttga

SEQ ID NO: 54480 - DNA, 122 bp, Jembrana disease virus
gctcccgctcagtctgttagtcctcctagttcgaatccttttgcatattctctctcccacttttcaaaatcaaagagggtggactgtggggagaaagggaacaggtggggacgaccgggagc

SEQ ID NO: 54481 - DNA, 24 bp, Jembrana disease virus
gctcagtctgttagtcctcctagt

SEQ ID NO: 54482 - DNA, 19 bp, Homo sapiens
gccagtcttcccctcttag

SEQ ID NO: 54483 - DNA, 23 bp, Homo sapiens
gctcaatctgtagtgctcctggt

SEQ ID NO: 54484 - DNA, 24 bp, Homo sapiens
gcttccagatttggttctcctagt

SEQ ID NO: 54485 - DNA, 21 bp, Homo sapiens
gcttggtctgttatttcagcc

SEQ ID NO: 54486 - DNA, 21 bp, Homo sapiens
gctctgtcttttcctcctagt

SEQ ID NO: 54487 - DNA, 22 bp, Homo sapiens
gctaggtccccttcctcctagt

SEQ ID NO: 54488 - DNA, 19 bp, Homo sapiens
gctgagtctgtcatcctag

SEQ ID NO: 54489 - DNA, 17 bp, Homo sapiens
gctcagtctttagtcct

SEQ ID NO: 54490 - DNA, 18 bp, Homo sapiens
cttgagaccatagtcctc

SEQ ID NO: 54491 - DNA, 18 bp, Homo sapiens
gctgggtctgccctcctg

SEQ ID NO: 54492 - DNA, 19 bp, Homo sapiens
actcagtctgttttcttag

SEQ ID NO: 54493 - DNA, 89 bp, Human herpesvirus 7
accttagtgtattttttgggttattgcaaatttatgtgttctctttgtatagagattttagtgtcgaaaattcaaatttacagcaaggt

SEQ ID NO: 54494 - DNA, 24 bp, Human herpesvirus 7
ttttttgggttattgcaaatttat

SEQ ID NO: 54495 - DNA, 21 bp, Homo sapiens
ttttttggattgttgtcaaat

SEQ ID NO: 54496 - DNA, 22 bp, Homo sapiens
ttttttgggtataaaaatttat

SEQ ID NO: 54497 - DNA, 22 bp, Homo sapiens
ttttttgggctgtcaattttat

SEQ ID NO: 54498 - DNA, 18 bp, Homo sapiens
ctttttgggttgatggaa

SEQ ID NO: 54499 - DNA, 21 bp, Homo sapiens
ttttttgggttcataatttat

SEQ ID NO: 54500 - DNA, 23 bp, Homo sapiens
ttttttgagtttgacaaatttat

SEQ ID NO: 54501 - DNA, 24 bp, Homo sapiens
ttttttgggttaaacagtatttat

SEQ ID NO: 54502 - DNA, 18 bp, Homo sapiens
ttgggttactttatttat

SEQ ID NO: 54503 - DNA, 65 bp, Human herpesvirus 7
gcggctcaaatatgcctgttttgtgcattatatagacaaaataggctctgtatggaatatgccgc

SEQ ID NO: 54504 - DNA, 24 bp, Human herpesvirus 7
gctcaaatatgcctgttttgtgca

SEQ ID NO: 54505 - DNA, 18 bp, Homo sapiens
aaatataccacctctgtg

SEQ ID NO: 54506 - DNA, 18 bp, Homo sapiens
tcaaatgtgtccgtttta

SEQ ID NO: 54507 - DNA, 21 bp, Homo sapiens
gccaaatgtgttacttgtgca

SEQ ID NO: 54508 - DNA, 17 bp, Homo sapiens
tcaaactgtgctttgtg

SEQ ID NO: 54509 - DNA, 21 bp, Homo sapiens
gctcaagtgtcctgtgaagtg

SEQ ID NO: 54510 - DNA, 20 bp, Homo sapiens
gcttgtatatgcctggggcg

SEQ ID NO: 54511 - DNA, 18 bp, Homo sapiens
actcaaatgtgcctgagc

SEQ ID NO: 54512 - DNA, 20 bp, Homo sapiens
tcaggtaatgcttttgtgca

SEQ ID NO: 54513 - DNA, 21 bp, Homo sapiens
gctcaggtatcctcccctgtg

SEQ ID NO: 54514 - DNA, 18 bp, Homo sapiens
tcaagtatgcttgtccta

SEQ ID NO: 54515 - DNA, 23 bp, Homo sapiens
gctcaaatgtgtactaagctgtg

SEQ ID NO: 54516 - DNA, 20 bp, Homo sapiens
gcttggagatgcctgtcctg

SEQ ID NO: 54517 - DNA, 22 bp, Homo sapiens
gctctaatgtgtctgtccagca

SEQ ID NO: 54518 - DNA, 22 bp, Homo sapiens
ctcaagtatctgcttttgtgca

SEQ ID NO: 54519 - DNA, 20 bp, Homo sapiens
actcaaatgtgccaggtgta

SEQ ID NO: 54520 - DNA, 23 bp, Homo sapiens
gcttgcatgtgtgtgcttgtgca

SEQ ID NO: 54521 - DNA, 21 bp, Homo sapiens
tctaatatgccaggcagtgtg

SEQ ID NO: 54522 - DNA, 21 bp, Homo sapiens
cttgaatatggttgttttgtg

SEQ ID NO: 54523 - DNA, 17 bp, Homo sapiens
aaacatgactttgtgca

SEQ ID NO: 54524 - DNA, 17 bp, Homo sapiens
gctcaaattgctttgta

SEQ ID NO: 54525 - DNA, 121 bp, Foot-and-mouth disease virus C
ctcacgacaccgcgtggccattttagctggattgtgcggacgaacaccgcttgcgcttctcgcgtgaccggttagtactcttaccaccttccgcctacttggttgttagcgctgtcctggg

SEQ ID NO: 54526 - DNA, 24 bp, Foot-and-mouth disease virus C
tagctggattgtgcggacgaacac

SEQ ID NO: 54527 - DNA, 19 bp, Homo sapiens
tagctggatgtggtggtac

SEQ ID NO: 54528 - DNA, 20 bp, Homo sapiens
tagctgggattacagacgaa

SEQ ID NO: 54529 - DNA, 18 bp, Homo sapiens
cagctggattgtatcaga

SEQ ID NO: 54530 - DNA, 19 bp, Homo sapiens
tagctgggtgtggcagcac

SEQ ID NO: 54531 - DNA, 18 bp, Homo sapiens
gctgggcctgggcggaca

SEQ ID NO: 54532 - DNA, 19 bp, Homo sapiens
tagctggatgttgtccaga

SEQ ID NO: 54533 - DNA, 18 bp, Homo sapiens
tagctggactacaggcgg

SEQ ID NO: 54534 - DNA, 18 bp, Homo sapiens
agctgggactatgggtga

SEQ ID NO: 54535 - DNA, 19 bp, Homo sapiens
tagccggatgtggtggcgg

SEQ ID NO: 54536 - DNA, 18 bp, Homo sapiens
gctttgtgcggatgagca

SEQ ID NO: 54537 - DNA, 18 bp, Homo sapiens
tagctgaatatggatgga

SEQ ID NO: 54538 - DNA, 90 bp, Woolly monkey sarcoma virus
gccgtcccgattaaccgattccccgcacggagcaccgcggaccacccgaccgcgagccgactcctggagttcgttcctcatttcgacggc

SEQ ID NO: 54539 - DNA, 24 bp, Woolly monkey sarcoma virus
taaccgattccccgcacggagcac

SEQ ID NO: 54540 - DNA, 21 bp, Homo sapiens
cctattccttgaccaaagcac

SEQ ID NO: 54541 - DNA, 17 bp, Homo sapiens
gatttcccacaaagcac

SEQ ID NO: 54542 - DNA, 21 bp, Homo sapiens
taaccgatttttcccatgcgg

SEQ ID NO: 54543 - DNA, 18 bp, Homo sapiens
ccgcaccgcacggagcac

SEQ ID NO: 54544 - DNA, 20 bp, Homo sapiens
taaccgattatgtacaggag

SEQ ID NO: 54545 - DNA, 21 bp, Homo sapiens
caacagccctgcacggagcac

SEQ ID NO: 54546 - DNA, 17 bp, Homo sapiens
gatccctgcacggggca

SEQ ID NO: 54547 - DNA, 20 bp, Homo sapiens
cgagcctccccgcacggagc

SEQ ID NO: 54548 - DNA, 87 bp, Foot-and-mouth disease virus C
gttttaccgtctgtcccgacgttaaagggaggtaaccacaagcatactgccgccttccccggcgttaacgggatgcaaccgtaagac

SEQ ID NO: 54549 - DNA, 24 bp, Foot-and-mouth disease virus C
ccccggcgttaacgggatgcaacc

SEQ ID NO: 54550 - DNA, 19 bp, Homo sapiens
ccctggcaggcaggatgca

SEQ ID NO: 54551 - DNA, 22 bp, Homo sapiens
ccctggggctgaggatgcagcc

SEQ ID NO: 54552 - DNA, 18 bp, Homo sapiens
ggcgttaacccacccaac

SEQ ID NO: 54553 - DNA, 17 bp, Homo sapiens
ggtgctatgatgcaacc

SEQ ID NO: 54554 - DNA, 17 bp, Homo sapiens
ggcaccagggatgcaac

SEQ ID NO: 54555 - DNA, 21 bp, Homo sapiens
cctggcgtggcaaacacaacc

SEQ ID NO: 54556 - DNA, 18 bp, Homo sapiens
ccctgggttaacagcaac

SEQ ID NO: 54557 - DNA, 18 bp, Homo sapiens
agccctggggatgcagcc

SEQ ID NO: 54558 - DNA, 19 bp, Homo sapiens
cctcggtgtcaacagcagc

SEQ ID NO: 54559 - DNA, 18 bp, Homo sapiens
ggcattaaacaggtgacc

SEQ ID NO: 54560 - DNA, 18 bp, Homo sapiens
ccccggcgtggcggctgc

SEQ ID NO: 54561 - DNA, 16 bp, Homo sapiens
ccggcgctgagtgcac

SEQ ID NO: 54562 - DNA, 18 bp, Homo sapiens
ccccggcgtggcgaaggc

SEQ ID NO: 54563 - DNA, 18 bp, Homo sapiens
ccgccggccgggatgcac

SEQ ID NO: 54564 - DNA, 20 bp, Homo sapiens
ggccttagacatctgcaacc

SEQ ID NO: 54565 - DNA, 20 bp, Homo sapiens
cctgacgttaacggttaacc

SEQ ID NO: 54566 - DNA, 20 bp, Homo sapiens
ccccggcgctggcagctggc

SEQ ID NO: 54567 - DNA, 17 bp, Homo sapiens
cccggcgttgggtgtgc

SEQ ID NO: 54568 - DNA, 21 bp, Homo sapiens
ccagcgtttccatggggatgc

SEQ ID NO: 54569 - DNA, 113 bp, Pepper ringspot virus
tgtaaaaagaaaatgcgagtgcaagaactgtggttggtttcctgcgatatcagttcaacctgattacgtggaagtctacttctgttgtggcatgaagcatttacaaaagtgca

SEQ ID NO: 54570 - DNA, 24 bp, Pepper ringspot virus
tggcatgaagcatttacaaaagtg

SEQ ID NO: 54571 - DNA, 23 bp, Homo sapiens
gctattagctgtttacaaaagtg

SEQ ID NO: 54572 - DNA, 19 bp, Homo sapiens
tggcatgaacccaggaagt

SEQ ID NO: 54573 - DNA, 25 bp, Homo sapiens
tgacatgaaggataatgcaagagtg

SEQ ID NO: 54574 - DNA, 22 bp, Homo sapiens
tggcgtgggattcacaaaggtg

SEQ ID NO: 54575 - DNA, 20 bp, Homo sapiens
gcattatatttacaaaggtg

SEQ ID NO: 54576 - DNA, 24 bp, Homo sapiens
tggtaggagtttgttacaaaagtg

SEQ ID NO: 54577 - DNA, 18 bp, Homo sapiens
gctgtactttacaaaagt

SEQ ID NO: 54578 - DNA, 21 bp, Homo sapiens
gcatgaaacagcacaggagtg

SEQ ID NO: 54579 - DNA, 18 bp, Homo sapiens
tggtatgaagcatttcaa

SEQ ID NO: 54580 - DNA, 23 bp, Homo sapiens
tggcatgagtcatgactcaagtg

SEQ ID NO: 54581 - DNA, 65 bp, Human herpesvirus 2
tccggcaacatcaccgcggccgtgcggatgctccaaagcctgtccacgtatgccgtgccgccgga

SEQ ID NO: 54582 - DNA, 17 bp, Human herpesvirus 2
tatgccgtgccgccgga

SEQ ID NO: 54583 - DNA, 16 bp, Homo sapiens
cgccgtgctgccggat

SEQ ID NO: 54584 - DNA, 19 bp, Homo sapiens
tatgccatgcttcacttgg

SEQ ID NO: 54585 - DNA, 19 bp, Homo sapiens
catgccgcccgcccgccgg

SEQ ID NO: 54586 - DNA, 20 bp, Homo sapiens
tataccgtacagcagtcgga

SEQ ID NO: 54587 - DNA, 18 bp, Homo sapiens
atgccatggtgcgccgga

SEQ ID NO: 54588 - DNA, 62 bp, Human herpesvirus 2
gcccccgtctgtcgcctctcccttttttccccccctcaaagaacgtggtgttgggcgccggc

SEQ ID NO: 54589 - DNA, 24 bp, Human herpesvirus 2
cccgtctgtcgcctctcccttttt

SEQ ID NO: 54590 - DNA, 23 bp, Homo sapiens
cccggccctctctctttcttttt

SEQ ID NO: 54591 - DNA, 18 bp, Homo sapiens
tgtccctctctccttttt

SEQ ID NO: 54592 - DNA, 23 bp, Homo sapiens
ccctttctttcctttcctttttt

SEQ ID NO: 54593 - DNA, 19 bp, Homo sapiens
ccggtttcttctccctttt

SEQ ID NO: 54594 - DNA, 23 bp, Homo sapiens
ccctttgtcagttcttccttttt

SEQ ID NO: 54595 - DNA, 20 bp, Homo sapiens
gtttgcttacttcccttttt

SEQ ID NO: 54596 - DNA, 22 bp, Homo sapiens
gtggctcagcttctcccttttt

SEQ ID NO: 54597 - DNA, 22 bp, Homo sapiens
cccttcctctctcttccttttt

SEQ ID NO: 54598 - DNA, 24 bp, Homo sapiens
cccgttttttgggccccccttttt

SEQ ID NO: 54599 - DNA, 24 bp, Homo sapiens
cgtctgtccttttcgtttcttttt

SEQ ID NO: 54600 - DNA, 18 bp, Homo sapiens
gcttgaccttcccttttt

SEQ ID NO: 54601 - DNA, 19 bp, Homo sapiens
gtccccgccctctcttttt

SEQ ID NO: 54602 - DNA, 22 bp, Homo sapiens
cccatctgtcccctcccttttt

SEQ ID NO: 54603 - DNA, 19 bp, Homo sapiens
tctgtctctctctctcttt

SEQ ID NO: 54604 - DNA, 19 bp, Homo sapiens
gtctctcccaccccttttt

SEQ ID NO: 54605 - DNA, 19 bp, Homo sapiens
tctgttgtgcacccttttt

SEQ ID NO: 54606 - DNA, 23 bp, Homo sapiens
cctctttctcactctcccttttt

SEQ ID NO: 54607 - DNA, 26 bp, Homo sapiens
cccgtctgtcagccccttttcttttt

SEQ ID NO: 54608 - DNA, 20 bp, Homo sapiens
tctcccccatctctcttttt

SEQ ID NO: 54609 - DNA, 19 bp, Homo sapiens
tccctctctctctcttttt

SEQ ID NO: 54610 - DNA, 21 bp, Homo sapiens
cccctcaagctttcccttttt

SEQ ID NO: 54611 - DNA, 18 bp, Homo sapiens
cctgctctctcccttttt

SEQ ID NO: 54612 - DNA, 24 bp, Homo sapiens
ccgtctggttgtttttcccttttt

SEQ ID NO: 54613 - DNA, 20 bp, Homo sapiens
tctatcacttttcccttttt

SEQ ID NO: 54614 - DNA, 18 bp, Homo sapiens
cctgttcccccccttttt

SEQ ID NO: 54615 - DNA, 20 bp, Homo sapiens
tgtcagcaaattcccttttt

SEQ ID NO: 54616 - DNA, 20 bp, Homo sapiens
ccgtctgtgtcttccttttt

SEQ ID NO: 54617 - DNA, 23 bp, Homo sapiens
ccagcatcggcttttcccttttt

SEQ ID NO: 54618 - DNA, 22 bp, Homo sapiens
ccgccagggcctctcctttttt

SEQ ID NO: 54619 - DNA, 18 bp, Homo sapiens
cccgtctgtctcctttcc

SEQ ID NO: 54620 - DNA, 21 bp, Homo sapiens
tctgttttcccctttcttttt

SEQ ID NO: 54621 - DNA, 69 bp, Digitaria streak virus
cttcctttgatgtagcatgatcaatgatgtcacgcatgacatcgtccttattgtgtttcttctcggaag

SEQ ID NO: 54622 - DNA, 24 bp, Digitaria streak virus
tagcatgatcaatgatgtcacgca

SEQ ID NO: 54623 - DNA, 22 bp, Homo sapiens
tagcatgaatcaatacggtgca

SEQ ID NO: 54624 - DNA, 21 bp, Homo sapiens
gcatgatcatggctcactgca

SEQ ID NO: 54625 - DNA, 16 bp, Homo sapiens
tagcatgattatgtgc

SEQ ID NO: 54626 - DNA, 21 bp, Homo sapiens
gcatgatcagggctcactgca

SEQ ID NO: 54627 - DNA, 20 bp, Homo sapiens
tagcataatcaaaatcatgt

SEQ ID NO: 54628 - DNA, 21 bp, Homo sapiens
gcatgatctgtgctcactgca

SEQ ID NO: 54629 - DNA, 17 bp, Homo sapiens
acgtgatcaatggtccg

SEQ ID NO: 54630 - DNA, 20 bp, Homo sapiens
tagtgtgatcaactgataca

SEQ ID NO: 54631 - DNA, 15 bp, Homo sapiens
tagcatgattaatat

SEQ ID NO: 54632 - DNA, 24 bp, Homo sapiens
tagcatgagtggtgaaatgctgca

SEQ ID NO: 54633 - DNA, 16 bp, Homo sapiens
tagatgatcaatgtgt

SEQ ID NO: 54634 - DNA, 18 bp, Homo sapiens
accctaacagtgatgtca

SEQ ID NO: 54635 - DNA, 103 bp, Fowlpox virus
ttcttttaaatacgtatcacagtttaatgctttacttataagctttgtatttttagaattataatacttagttaatacctttactctgtctacgttgaaagaa

SEQ ID NO: 54636 - DNA, 24 bp, Fowlpox virus
taatacttagttaatacctttact

SEQ ID NO: 54637 - DNA, 18 bp, Homo sapiens
tcagttaatatttttact

SEQ ID NO: 54638 - DNA, 23 bp, Homo sapiens
taatacatgttagtacctttact

SEQ ID NO: 54639 - DNA, 16 bp, Homo sapiens
tactcatacctttact

SEQ ID NO: 54640 - DNA, 17 bp, Homo sapiens
ttagggacacctttact

SEQ ID NO: 54641 - DNA, 130 bp, Gallid herpesvirus 3
gcgggcgctcgctaggccgcccggaaatgcgtagcggacccgtgcgcgcatgcgcgcagtcgacatttgcgagcatgcgcgcggcggaccctagcgagcatgcgcgcggcggaccctagcgagcatgcgc

SEQ ID NO: 54642 - DNA, 24 bp, Gallid herpesvirus 3
cgagcatgcgcgcggcggacccta

SEQ ID NO: 54643 - DNA, 18 bp, Homo sapiens
cgcgcgtgcgtgcggcgg

SEQ ID NO: 54644 - DNA, 21 bp, Homo sapiens
cgggcagcgcgcactgaccct

SEQ ID NO: 54645 - DNA, 17 bp, Homo sapiens
cgagtgtgcgcgcgcgg

SEQ ID NO: 54646 - DNA, 21 bp, Homo sapiens
gcagagaggcggcggacccta

SEQ ID NO: 54647 - DNA, 21 bp, Homo sapiens
cgagcgcggcgcgcgggtcct

SEQ ID NO: 54648 - DNA, 24 bp, Homo sapiens
cgaggcgcgcgcgcggcggaccct

SEQ ID NO: 54649 - DNA, 19 bp, Homo sapiens
gcatgcgctccgggcccta

SEQ ID NO: 54650 - DNA, 20 bp, Homo sapiens
gcgcgcagcttgcggatcct

SEQ ID NO: 54651 - DNA, 19 bp, Homo sapiens
cgggcagcgcctggatcct

SEQ ID NO: 54652 - DNA, 22 bp, Homo sapiens
cgggcttgcgcgcggcgcccct

SEQ ID NO: 54653 - DNA, 17 bp, Homo sapiens
cgagcatgtgccggcgg

SEQ ID NO: 54654 - DNA, 20 bp, Homo sapiens
gagcatgcagtggcacaggg

SEQ ID NO: 54655 - DNA, 20 bp, Homo sapiens
cgagtgcgtgcgcggcgtcc

SEQ ID NO: 54656 - DNA, 79 bp, Gallid herpesvirus 3
gtcgccggtttaaatactcattcggaagccgtgggtggcgcctcgcgtaccccagaccgttgtgttataaaacccagac

SEQ ID NO: 54657 - DNA, 24 bp, Gallid herpesvirus 3
taccccagaccgttgtgttataaa

SEQ ID NO: 54658 - DNA, 18 bp, Homo sapiens
taccctacgttgtcataa

SEQ ID NO: 54659 - DNA, 17 bp, Homo sapiens
cagaccaccattataaa

SEQ ID NO: 54660 - DNA, 15 bp, Homo sapiens
caggctgtatcataa

SEQ ID NO: 54661 - DNA, 20 bp, Homo sapiens
ccagattctaatgttataaa

SEQ ID NO: 54662 - DNA, 19 bp, Homo sapiens
ccagaggtcagtgttataa

SEQ ID NO: 54663 - DNA, 19 bp, Homo sapiens
tacatcagaccactttatg

SEQ ID NO: 54664 - DNA, 17 bp, Homo sapiens
tactccaggttgtgtta

SEQ ID NO: 54665 - DNA, 22 bp, Homo sapiens
taccccaaacttagagattatg

SEQ ID NO: 54666 - DNA, 20 bp, Homo sapiens
ccctgggacagttgttataa

SEQ ID NO: 54667 - DNA, 24 bp, Homo sapiens
tacccgagactgggtaattataaa

SEQ ID NO: 54668 - DNA, 123 bp, Human herpesvirus 6
gtggtcctaaaagtttttgccagtcagacagttgtttcggatacagtaagacgggatataatgccgcgtttccaaatctattgcctccgtatctgtacgaatgcggccaaaataatggactgt

SEQ ID NO: 54669 - DNA, 24 bp, Human herpesvirus 6
taaaagtttttgccagtcagacag

SEQ ID NO: 54670 - DNA, 22 bp, Homo sapiens
taaaagtttattgccagaatag

SEQ ID NO: 54671 - DNA, 18 bp, Homo sapiens
agcagctgccagttagac

SEQ ID NO: 54672 - DNA, 17 bp, Homo sapiens
aagctgctggtcagaca

SEQ ID NO: 54673 - DNA, 18 bp, Homo sapiens
agtttttgtcagtcatga

SEQ ID NO: 54674 - DNA, 18 bp, Homo sapiens
tttttgctaaaaagacag

SEQ ID NO: 54675 - DNA, 19 bp, Homo sapiens
aaagttctctatcagacag

SEQ ID NO: 54676 - DNA, 20 bp, Homo sapiens
agaggctgtcagtcagacag

SEQ ID NO: 54677 - DNA, 21 bp, Homo sapiens
taaaagttttgtgctgctcag

SEQ ID NO: 54678 - DNA, 20 bp, Homo sapiens
taaaattttttgtcagtcag

SEQ ID NO: 54679 - DNA, 20 bp, Homo sapiens
aaagcttttgcaaatgacag

SEQ ID NO: 54680 - DNA, 18 bp, Homo sapiens
gtccctttagtcagacag

SEQ ID NO: 54681 - DNA, 20 bp, Homo sapiens
aagtggggccagtcagacag

SEQ ID NO: 54682 - DNA, 21 bp, Homo sapiens
aaagttttttggtagagacag

SEQ ID NO: 54683 - DNA, 17 bp, Homo sapiens
agttttgccagccacac

SEQ ID NO: 54684 - DNA, 20 bp, Homo sapiens
aagtagttttggtcagacag

SEQ ID NO: 54685 - DNA, 24 bp, Homo sapiens
ggaagccagcggccagtcaggcag

SEQ ID NO: 54686 - DNA, 17 bp, Homo sapiens
taaaagtttttgttgtc

SEQ ID NO: 54687 - DNA, 73 bp, Ectromelia virus
ataatcaacataacctcatcatctattaactgataacggttagttataatagggataaaggattaatgattat

SEQ ID NO: 54688 - DNA, 24 bp, Ectromelia virus
taatagggataaaggattaatgat

SEQ ID NO: 54689 - DNA, 19 bp, Homo sapiens
atagggacaaaggggcaac

SEQ ID NO: 54690 - DNA, 21 bp, Homo sapiens
taatagggggagaagagaatg

SEQ ID NO: 54691 - DNA, 19 bp, Homo sapiens
taataggtgaaattaatga

SEQ ID NO: 54692 - DNA, 20 bp, Homo sapiens
agaccctgaggattaatgat

SEQ ID NO: 54693 - DNA, 74 bp, Camelpox virus
acagatgatctgagtaatatacctctgttatatatttaatgttcacggtcttagtatttttagatatcaattgt

SEQ ID NO: 54694 - DNA, 74 bp, Camelpox virus; identical to SEQ ID NO: 54693

SEQ ID NO: 54695 - DNA, 16 bp, Homo sapiens
acaggtatttttagat

SEQ ID NO: 54696 - DNA, 17 bp, Homo sapiens
ttcacagatatttttag

SEQ ID NO: 54697 - DNA, 69 bp, Monkeypox virus
atcgtattgtggttatatggctacaatttcataatgagttgaagtcagtgtcctatgatcaatgacgat

SEQ ID NO: 54698 - DNA, 24 bp, Monkeypox virus
tgtggttatatggctacaatttca

SEQ ID NO: 54699 - DNA, 17 bp, Homo sapiens
tggttaagtgcaatttc

SEQ ID NO: 54700 - DNA, 22 bp, Homo sapiens
gtgtgaaatggttgcaatttca

SEQ ID NO: 54701 - DNA, 18 bp, Homo sapiens
gctgtatggctatgattt

SEQ ID NO: 54702 - DNA, 22 bp, Homo sapiens
tgtggttgcagagtcaatttca

SEQ ID NO: 54703 - DNA, 131 bp, Equine herpesvirus 4
tgcttcacaaaattacattaataaaacatgtttttaattattaattccggtgtggtttgtgttagtgggcgggttagtgggcgggttagtgggcgggttagtgggcgggttagtgggcgggttagtgggcg

SEQ ID NO: 54704 - DNA, 24 bp, Equine herpesvirus 4
tacattaataaaacatgtttttaa

SEQ ID NO: 54705 - DNA, 23 bp, Homo sapiens
cattgcttctaacatgtttttaa

SEQ ID NO: 54706 - DNA, 19 bp, Homo sapiens
tacattgacaaaacaggct

SEQ ID NO: 54707 - DNA, 23 bp, Homo sapiens
cacagcatcaaaacatgttttta

SEQ ID NO: 54708 - DNA, 21 bp, Homo sapiens
tacattaacaaagtctgtttt

SEQ ID NO: 54709 - DNA, 21 bp, Homo sapiens
acattaataaaacacatccct

SEQ ID NO: 54710 - DNA, 21 bp, Homo sapiens
cacattaataaatatttttaa

SEQ ID NO: 54711 - DNA, 23 bp, Homo sapiens
acattgataagacatgttcccaa

SEQ ID NO: 54712 - DNA, 19 bp, Homo sapiens
attaataaaacaaatcttt

SEQ ID NO: 54713 - DNA, 23 bp, Homo sapiens
tacattaataaaatgtgattttt

SEQ ID NO: 54714 - DNA, 22 bp, Homo sapiens
tacattagtgaaacatcttttt

SEQ ID NO: 54715 - DNA, 22 bp, Homo sapiens
tacattaatgaaatgtttccaa

SEQ ID NO: 54716 - DNA, 18 bp, Homo sapiens
tacattaaaaaaacacat

SEQ ID NO: 54717 - DNA, 22 bp, Homo sapiens
tacattcacaaacatgttttta

SEQ ID NO: 54718 - DNA, 19 bp, Homo sapiens
tacattaacacagttttta

SEQ ID NO: 54719 - DNA, 131 bp, Equine herpesvirus 4
ggcgggttagtgggcgggttagtgggcgggttagtgggcgggttagtgggcgggttagtgggcgggttagtgggtcctgctcctccccttcctgctcctccccttccgcttgcgtcacttccgcttccggt

SEQ ID NO: 54720 - DNA, 24 bp, Equine herpesvirus 4
tagtgggcgggttagtgggcgggt

SEQ ID NO: 54721 - DNA, 18 bp, Homo sapiens
gtgggtgggttagctgca

SEQ ID NO: 54722 - DNA, 16 bp, Homo sapiens
gtgggcagggggtggg

SEQ ID NO: 54723 - DNA, 15 bp, Homo sapiens
gggcgggtgggcggg

SEQ ID NO: 54724 - DNA, 18 bp, Homo sapiens
taggggcgggcgggcggg

SEQ ID NO: 54725 - DNA, 16 bp, Homo sapiens
gtggggggagggcggg

SEQ ID NO: 54726 - DNA, 16 bp, Homo sapiens
tagtggcggtgggcgg

SEQ ID NO: 54727 - DNA, 20 bp, Homo sapiens
gtggcgcaggctgggcgggt

SEQ ID NO: 54728 - DNA, 18 bp, Homo sapiens
tggggggtggcgggcggg

SEQ ID NO: 54729 - DNA, 125 bp, Equine herpesvirus 2
atggaaaggggggcgaggcagggcagcgggcgggggaggacgatgagaggatggacgagggggtcccggaggagggagccccccgctcgccccacccgcccccgttcgcccactacgaggtctat

SEQ ID NO: 54730 - DNA, 24 bp, Equine herpesvirus 2
cccccgttcgcccactacgaggtc

SEQ ID NO: 54731 - DNA, 19 bp, Homo sapiens
cccccgttccttcccgggt

SEQ ID NO: 54732 - DNA, 20 bp, Homo sapiens
cccgtccgccacccggggtc

SEQ ID NO: 54733 - DNA, 18 bp, Homo sapiens
cctccgctcgctcactcg

SEQ ID NO: 54734 - DNA, 20 bp, Homo sapiens
ccctttgttcacacaaagtc

SEQ ID NO: 54735 - DNA, 20 bp, Homo sapiens
cagacacccactgtgaggtc

SEQ ID NO: 54736 - DNA, 20 bp, Homo sapiens
cccccgtttgaacacggggt

SEQ ID NO: 54737 - DNA, 19 bp, Homo sapiens
ccctcgttcgccaccaagt

SEQ ID NO: 54738 - DNA, 21 bp, Homo sapiens
cccccgtttcctattgacgtc

SEQ ID NO: 54739 - DNA, 20 bp, Homo sapiens
cccgtccgtcggcccgaggt

SEQ ID NO: 54740 - DNA, 22 bp, Homo sapiens
catctcacacccactgtggggt

SEQ ID NO: 54741 - DNA, 23 bp, Homo sapiens
ccctgttccctggagatgaggtc

SEQ ID NO: 54742 - DNA, 61 bp, Ectromelia virus
ttaacttcgcaataatttctggttagataacgcactctaccagtcaagtcaatgatattag

SEQ ID NO: 54743 - DNA, 24 bp, Ectromelia virus
tcgcaataatttctggttagataa

SEQ ID NO: 54744 - DNA, 21 bp, Homo sapiens
gcaaaaatgtcagttagataa

SEQ ID NO: 54745 - DNA, 20 bp, Homo sapiens
gcaataactgtcttggatga

SEQ ID NO: 54746 - DNA, 20 bp, Homo sapiens
tcgtgattatttctagccag

SEQ ID NO: 54747 - DNA, 22 bp, Homo sapiens
gcaataatttaattttggatag

SEQ ID NO: 54748 - DNA, 23 bp, Homo sapiens
tcacaataattttgaaatgataa

SEQ ID NO: 54749 - DNA, 61 bp, Tupaia herpesvirus
agcgccggcggctggcgagcggcggcggccacgcgcgctgctcgccgcgttgcgcggcgtt

SEQ ID NO: 54750 - DNA, 21 bp, Tupaia herpesvirus
ctcgccgcgttgcgcggcgtt

SEQ ID NO: 54751 - DNA, 18 bp, Homo sapiens
ctcctccagcgcggcgtt

SEQ ID NO: 54752 - DNA, 18 bp, Homo sapiens
gctgacgccggcggcgtt

SEQ ID NO: 54753 - DNA, 18 bp, Homo sapiens
ctcgtccagcacggcgtt

SEQ ID NO: 54754 - DNA, 19 bp, Homo sapiens
ctcgccgcgttagcggcgt

SEQ ID NO: 54755 - DNA, 84 bp, Tupaia herpesvirus
tgccggagatgcacgccatcttcgaggagtacccggacctggagcagaagtacctgagcctcatgaagatgcccatcaccggca

SEQ ID NO: 54756 - DNA, 24 bp, Tupaia herpesvirus
acgccatcttcgaggagtacccgg

SEQ ID NO: 54757 - DNA, 18 bp, Homo sapiens
acgccgcccgggtacccg

SEQ ID NO: 54758 - DNA, 21 bp, Homo sapiens
gctttcttcccgggtacccgg

SEQ ID NO: 54759 - DNA, 22 bp, Homo sapiens
gccgtttccccagggtgcctgg

SEQ ID NO: 54760 - DNA, 22 bp, Homo sapiens
gcccagccgcgggggtacccgg

SEQ ID NO: 54761 - DNA, 21 bp, Homo sapiens
acgcgtcttcgaggaccccgg

SEQ ID NO: 54762 - DNA, 15 bp, Homo sapiens
cgccatcttggagtc

SEQ ID NO: 54763 - DNA, 21 bp, Homo sapiens
gccatcccagggggtgtccgg

SEQ ID NO: 54764 - DNA, 20 bp, Homo sapiens
caccatctttggggcctcgg

SEQ ID NO: 54765 - DNA, 18 bp, Homo sapiens
cgccatctccggggcccg

SEQ ID NO: 54766 - DNA, 16 bp, Homo sapiens
acgtctccgggtaccc

SEQ ID NO: 54767 - DNA, 17 bp, Homo sapiens
acaccatctttggtgca

SEQ ID NO: 54768 - DNA, 21 bp, Homo sapiens
ccatcttcgtcctgtgcctgg

SEQ ID NO: 54769 - DNA, 18 bp, Homo sapiens
tctcagaggagtactcgg

SEQ ID NO: 54770 - DNA, 97 bp, Simian type D virus 1
ttcccactccctcctccagggcctgcttcgacgatcccgcgggccgggatacgtggcgcccgaacagggacctggaaacgagggactccgtgaggaa

SEQ ID NO: 54771 - DNA, 24 bp, Simian type D virus 1
cctccagggcctgcttcgacgatc

SEQ ID NO: 54772 - DNA, 18 bp, Homo sapiens
cttcagggcctgacttcg

SEQ ID NO: 54773 - DNA, 21 bp, Homo sapiens
cttagggcctgctgagcagat

SEQ ID NO: 54774 - DNA, 18 bp, Homo sapiens
cccccagggcctgcttca

SEQ ID NO: 54775 - DNA, 22 bp, Homo sapiens
cctccagggcctggctgggatc

SEQ ID NO: 54776 - DNA, 19 bp, Homo sapiens
cctccagggttcaagtgat

SEQ ID NO: 54777 - DNA, 25 bp, Homo sapiens
cctccaggttctgtgtctcgtgatc

SEQ ID NO: 54778 - DNA, 19 bp, Homo sapiens
ccgccagggccgcggcgat

SEQ ID NO: 54779 - DNA, 18 bp, Homo sapiens
cccccagggtctgctgtc

SEQ ID NO: 54780 - DNA, 21 bp, Homo sapiens
ccccggggcccacagatgatc

SEQ ID NO: 54781 - DNA, 19 bp, Homo sapiens
cctccagggttcaagcgat

SEQ ID NO: 54782 - DNA, 19 bp, Homo sapiens
cctccaggcttcaagcgat

SEQ ID NO: 54783 - DNA, 26 bp, Homo sapiens
ccttcgggaccttggggctggtgatc

SEQ ID NO: 54784 - DNA, 21 bp, Homo sapiens
ctgccagggcctgttgggatc

SEQ ID NO: 54785 - DNA, 24 bp, Homo sapiens
ccccagaacagcgctttggcgatc

SEQ ID NO: 54786 - DNA, 19 bp, Homo sapiens
cctcagggcctgctttgac

SEQ ID NO: 54787 - DNA, 17 bp, Homo sapiens
ccttcagagcctgcacg

SEQ ID NO: 54788 - DNA, 16 bp, Homo sapiens
tccaggcctaaatgat

SEQ ID NO: 54789 - DNA, 19 bp, Homo sapiens
cctccggggctcaagcgat

SEQ ID NO: 54790 - DNA, 17 bp, Homo sapiens
cctccagggcttcttca

SEQ ID NO: 54791 - DNA, 19 bp, Homo sapiens
cctccagagctcaggtgat

SEQ ID NO: 54792 - DNA, 19 bp, Homo sapiens
ctccaggggctgcttgccg

SEQ ID NO: 54793 - DNA, 21 bp, Homo sapiens
ctccagggttagcgccccgcg

SEQ ID NO: 54794 - DNA, 18 bp, Homo sapiens
cctccagggcatgcgttc

SEQ ID NO: 54795 - DNA, 131 bp, Melanoplus sanguinipes entomopoxvirus
ggattttatatctgatatcacaaaatatcaataatgtatcaaaaatatcaatatccaatgtccaataaaggattttatatctgatatcacaaaatatcaataatgtatcaaaaatatcaatatctaatacc

SEQ ID NO: 54796 - DNA, 24 bp, Melanoplus sanguinipes entomopoxvirus
tatctgatatcacaaaatatcaat

SEQ ID NO: 54797 - DNA, 20 bp, Homo sapiens
tatttgatatgacaaaatat

SEQ ID NO: 54798 - DNA, 17 bp, Homo sapiens
tctgaacagaatatcaa

SEQ ID NO: 54799 - DNA, 15 bp, Homo sapiens
tgacacaaaatatca

SEQ ID NO: 54800 - DNA, 20 bp, Homo sapiens
tcaaatatcacaaaatgtca

SEQ ID NO: 54801 - DNA, 20 bp, Homo sapiens
tcaatacacaaaatatcaat

SEQ ID NO: 54802 - DNA, 18 bp, Homo sapiens
tatcctgacaaaatatca

SEQ ID NO: 54803 - DNA, 24 bp, Homo sapiens
tctaatattatacagactatcaat

SEQ ID NO: 54804 - DNA, 21 bp, Homo sapiens
tatctggtattcaatatcaat

SEQ ID NO: 54805 - DNA, 68 bp, Meleagrid herpesvirus 1
agggaaggtttgactcgcctctcccagcccaggaccaaaacgggcgaagaagcgacagaatccgtcct

SEQ ID NO: 54806 - DNA, 22 bp, Meleagrid herpesvirus 1
aagaagcgacagaatccgtcct

SEQ ID NO: 54807 - DNA, 22 bp, Homo sapiens
aaaaggtacttgaatccgtcct

SEQ ID NO: 54808 - DNA, 20 bp, Homo sapiens
aagaatccatcatctgtcct

SEQ ID NO: 54809 - DNA, 21 bp, Homo sapiens
aagagcgacaggtgtgttcct

SEQ ID NO: 54810 - DNA, 18 bp, Homo sapiens
aagagtgacagaatctgt

SEQ ID NO: 54811 - DNA, 24 bp, Homo sapiens
aagaagcagtagaatcacaagcct

SEQ ID NO: 54812 - DNA, 20 bp, Homo sapiens
aagcagcgacagtccctcct

SEQ ID NO: 54813 - DNA, 23 bp, Homo sapiens
aagaagcaattttttcctgttct

SEQ ID NO: 54814 - DNA, 17 bp, Homo sapiens
agaagtgagtccgtcct

SEQ ID NO: 54815 - DNA, 18 bp, Homo sapiens
aaaacatttgaatccgtc

SEQ ID NO: 54816 - DNA, 19 bp, Homo sapiens
agagcgacaggccaggcct

SEQ ID NO: 54817 - DNA, 16 bp, Homo sapiens
aagaaacggcaagtcc

SEQ ID NO: 54818 - DNA, 20 bp, Homo sapiens
agaagtaacctccccgtcct

SEQ ID NO: 54819 - DNA, 16 bp, Homo sapiens
agaggcaacagaagtc

SEQ ID NO: 54820 - DNA, 21 bp, Homo sapiens
gaggcgacagaggcaggtcct

SEQ ID NO: 54821 - DNA, 21 bp, Homo sapiens
aaggggccgagtccccgtcct

SEQ ID NO: 54822 - DNA, 17 bp, Homo sapiens
aaaaagcggcaaagtcc

SEQ ID NO: 54823 - DNA, 20 bp, Homo sapiens
agaaatgacagacagatccc

SEQ ID NO: 54824 - DNA, 21 bp, Homo sapiens
aaagcgacggatgcgagtcct

SEQ ID NO: 54825 - DNA, 20 bp, Homo sapiens
agaagtacccgtcccgtcct

SEQ ID NO: 54826 - DNA, 18 bp, Homo sapiens
aggagctagatccgtcct

SEQ ID NO: 54827 - DNA, 19 bp, Homo sapiens
gaggcctccagtccgtcct

SEQ ID NO: 54828 - DNA, 19 bp, Homo sapiens
agaggcggcagtccgtcct

SEQ ID NO: 54829 - DNA, 18 bp, Homo sapiens
aaaaagcggcaggaaatc

SEQ ID NO: 54830 - DNA, 17 bp, Homo sapiens
aaagctcagtctgtcct

SEQ ID NO: 54831 - DNA, 19 bp, Homo sapiens
agaagcgaggagcgctcct

SEQ ID NO: 54832 - DNA, 22 bp, Homo sapiens
aagatagctcaaaatctgttct

SEQ ID NO: 54833 - DNA, 20 bp, Homo sapiens
gaatgacagaatcagggcct

SEQ ID NO: 54834 - DNA, 15 bp, Homo sapiens
agcggaatccgtcct

SEQ ID NO: 54835 - DNA, 18 bp, Homo sapiens
aaaaagacaaaatctgtc

SEQ ID NO: 54836 - DNA, 18 bp, Homo sapiens
aagagctgacagaatatc

SEQ ID NO: 54837 - DNA, 22 bp, Homo sapiens
aagaagcgtggactcttgtcct

SEQ ID NO: 54838 - DNA, 19 bp, Homo sapiens
agggacagaatgccattct

SEQ ID NO: 54839 - DNA, 19 bp, Homo sapiens
aagaagcgatgcccttcct

SEQ ID NO: 54840 - DNA, 20 bp, Homo sapiens
agaagcaaagcatctttgtc

SEQ ID NO: 54841 - DNA, 15 bp, Homo sapiens
aagaagcacagacca

SEQ ID NO: 54842 - DNA, 20 bp, Homo sapiens
agaggcggtgaccgcgtcct

SEQ ID NO: 54843 - DNA, 103 bp, Meleagrid herpesvirus 1
aacataccaatgtcgatctcatacttatggtaggttcaagtcacgacaggccgcgtgttacacacaacccccatttcactgtgaaatcccgcattcggttgtt

SEQ ID NO: 54844 - DNA, 24 bp, Meleagrid herpesvirus 1
tctcatacttatggtaggttcaag

SEQ ID NO: 54845 - DNA, 21 bp, Homo sapiens
tctctgcctcctgggttcaag

SEQ ID NO: 54846 - DNA, 23 bp, Homo sapiens
tcatacttttgcatgacttcaag

SEQ ID NO: 54847 - DNA, 18 bp, Homo sapiens
tctcatacttaggtatgc

SEQ ID NO: 54848 - DNA, 17 bp, Homo sapiens
tcataattatggcccaa

SEQ ID NO: 54849 - DNA, 21 bp, Homo sapiens
tcttgaactcctgggttcaag

SEQ ID NO: 54850 - DNA, 21 bp, Homo sapiens
tctcgaactcctgggttcaag

SEQ ID NO: 54851 - DNA, 21 bp, Homo sapiens
tctcgaactgctgggttcaag

SEQ ID NO: 54852 - DNA, 21 bp, Homo sapiens
tctcgaactcctaggttcaag

SEQ ID NO: 54853 - DNA, 19 bp, Homo sapiens
tctgtacttatggtaccca

SEQ ID NO: 54854 - DNA, 22 bp, Homo sapiens
tctttacacaggtgggttcaag

SEQ ID NO: 54855 - DNA, 23 bp, Homo sapiens
tcatgttttattttaggttcaag

SEQ ID NO: 54856 - DNA, 21 bp, Homo sapiens
tctcaaactcctgggttcaag

SEQ ID NO: 54857 - DNA, 19 bp, Homo sapiens
tcatacttgtgaaacttca

SEQ ID NO: 54858 - DNA, 20 bp, Homo sapiens
tcatattacttaggttcaag

SEQ ID NO: 54859 - DNA, 21 bp, Homo sapiens
tctcaaacccctgggttcaag

SEQ ID NO: 54860 - DNA, 64 bp, Gallid herpesvirus 3
gctatgataagcggaggaaaacctgcctgattccttgggcggggatccttgtgcgctgtcttgc

SEQ ID NO: 54861 - DNA, 24 bp, Gallid herpesvirus 3
tatgataagcggaggaaaacctgc

SEQ ID NO: 54862 - DNA, 22 bp, Homo sapiens
tatgcataatggggaaacctgc

SEQ ID NO: 54863 - DNA, 19 bp, Homo sapiens
tgataaacggaatacctgc

SEQ ID NO: 54864 - DNA, 18 bp, Homo sapiens
tgatgggaggaaatttgc

SEQ ID NO: 54865 - DNA, 21 bp, Homo sapiens
catgatgagcagagagatctg

SEQ ID NO: 54866 - DNA, 18 bp, Homo sapiens
tatgaggaagaaaatttg

SEQ ID NO: 54867 - DNA, 21 bp, Homo sapiens
tgataatggaggaaaatttgc

SEQ ID NO: 54868 - DNA, 21 bp, Homo sapiens
tgacaagcccataaaacctgc

SEQ ID NO: 54869 - DNA, 19 bp, Homo sapiens
gatgagtggggaaacctgc

SEQ ID NO: 54870 - DNA, 18 bp, Homo sapiens
tgataagccaaaaacctg

SEQ ID NO: 54871 - DNA, 20 bp, Homo sapiens
tgataagaaatgaaacctgc

SEQ ID NO: 54872 - DNA, 22 bp, Homo sapiens
tatgcacctagaggaaaacttg

SEQ ID NO: 54873 - DNA, 25 bp, Homo sapiens
tatgataaagctaattaagaatctg

SEQ ID NO: 54874 - DNA, 18 bp, Homo sapiens
catggtaatggaaacctg

SEQ ID NO: 54875 - DNA, 98 bp, Marburg virus
taggttatcgttgagattaaaaagactacgttacgttttctctgatgacaagtgacaaaatttcgtagttaaatttctagaatgtcaatgtgaatgta

SEQ ID NO: 54876 - DNA, 24 bp, Marburg virus
tgacaaaatttcgtagttaaattt

SEQ ID NO: 54877 - DNA, 19 bp, Homo sapiens
tgacaaaattattgtaatt

SEQ ID NO: 54878 - DNA, 17 bp, Homo sapiens
tgacagaatttcatgct

SEQ ID NO: 54879 - DNA, 18 bp, Homo sapiens
tgacaaaaattcagaatt

SEQ ID NO: 54880 - DNA, 28 bp, Homo sapiens
tgacaaaactttaataaaagttaaattt

SEQ ID NO: 54881 - DNA, 18 bp, Homo sapiens
tgacaaaattttgtagct

SEQ ID NO: 54882 - DNA, 22 bp, Homo sapiens
tgacaaaatttcatttaaattt

SEQ ID NO: 54883 - DNA, 18 bp, Homo sapiens
tggcaaaattctgtagct

SEQ ID NO: 54884 - DNA, 60 bp, Gallid herpesvirus 3
taactgtcccggcgtgcctccatctgctgagtcccgtgcagactggcatgaggatggttg

SEQ ID NO: 54885 - DNA, 17 bp, Gallid herpesvirus 3
tggcatgaggatggttg

SEQ ID NO: 54886 - DNA, 18 bp, Homo sapiens
tggcagggcgaggggttg

SEQ ID NO: 54887 - DNA, 20 bp, Homo sapiens
tgttatgagcaggatggttg

SEQ ID NO: 54888 - DNA, 19 bp, Homo sapiens
tgtcatgagaatcaggttg

SEQ ID NO: 54889 - DNA, 18 bp, Homo sapiens
tggctgtggacaaggttg

SEQ ID NO: 54890 - DNA, 18 bp, Homo sapiens
tggaagatgagatggttg

SEQ ID NO: 54891 - DNA, 18 bp, Homo sapiens
tgggatgagaatgagttg

SEQ ID NO: 54892 - DNA, 18 bp, Homo sapiens
tgacatgaaccctggttg

SEQ ID NO: 54893 - DNA, 18 bp, Homo sapiens
tgggtgagaacatggttg

SEQ ID NO: 54894 - DNA, 20 bp, Homo sapiens
ggtatgaagacaggtggttg

SEQ ID NO: 54895 - DNA, 18 bp, Homo sapiens
tggcgtgacaatgagttg

SEQ ID NO: 54896 - DNA, 19 bp, Homo sapiens
tggcatgacgctgaggttg

SEQ ID NO: 54897 - DNA, 80 bp, Alcelaphine herpesvirus 1
cgagttaaattacataagtcccgagttctcgggacaagatggcgtgtcccgagttctagggacctacttgtttgtacttg

SEQ ID NO: 54898 - DNA, 24 bp, Alcelaphine herpesvirus 1
tcccgagttctagggacctacttg

SEQ ID NO: 54899 - DNA, 20 bp, Homo sapiens
tccagagttctggggaccca

SEQ ID NO: 54900 - DNA, 24 bp, Homo sapiens
tcctgggctcaaacaacctgcttg

SEQ ID NO: 54901 - DNA, 22 bp, Homo sapiens
ccccgagtttagaatctgcttg

SEQ ID NO: 54902 - DNA, 24 bp, Homo sapiens
tcctgagctcaagtgatttgcttg

SEQ ID NO: 54903 - DNA, 18 bp, Homo sapiens
ccccgagttctgggggac

SEQ ID NO: 54904 - DNA, 16 bp, Homo sapiens
tcctgagctccctact

SEQ ID NO: 54905 - DNA, 17 bp, Homo sapiens
agcaaaggacctatttg

SEQ ID NO: 54906 - DNA, 60 bp, Rat cytomegalovirus
gagggccgggtgtccgaagccgacctccagcggtaccgggaggccgtcgacaccgccctc

SEQ ID NO: 54907 - DNA, 21 bp, Rat cytomegalovirus
gaggccgtcgacaccgccctc

SEQ ID NO: 54908 - DNA, 20 bp, Homo sapiens
ggccatcagacattgtcctc

SEQ ID NO: 54909 - DNA, 21 bp, Homo sapiens
gaggccgtttacactgctctc

SEQ ID NO: 54910 - DNA, 18 bp, Homo sapiens
gaagccacagctgccctc

SEQ ID NO: 54911 - DNA, 19 bp, Homo sapiens
aaggccatgcattgccttc

SEQ ID NO: 54912 - DNA, 21 bp, Homo sapiens
aggccgggccacgccgccctc

SEQ ID NO: 54913 - DNA, 18 bp, Homo sapiens
ggcctcggccaccacccc

SEQ ID NO: 54914 - DNA, 20 bp, Homo sapiens
gggtcctcttcgccgccctc

SEQ ID NO: 54915 - DNA, 24 bp, Homo sapiens
gaggccgccatcttaactgccctc

SEQ ID NO: 54916 - DNA, 16 bp, Homo sapiens
gaggatgaaccgccct

SEQ ID NO: 54917 - DNA, 19 bp, Homo sapiens
gaacccaggcgccgccctc

SEQ ID NO: 54918 - DNA, 21 bp, Homo sapiens
gaggctttcttttccgccctc

SEQ ID NO: 54919 - DNA, 18 bp, Homo sapiens
aggccgccgcccgccttc

SEQ ID NO: 54920 - DNA, 17 bp, Homo sapiens
ggccggccaccgccctc

SEQ ID NO: 54921 - DNA, 17 bp, Homo sapiens
gggcccccgccgccctc

SEQ ID NO: 54922 - DNA, 20 bp, Homo sapiens
gagagcctgcggccgccctc

SEQ ID NO: 54923 - DNA, 19 bp, Homo sapiens
gaggccgccgccgcctctc

SEQ ID NO: 54924 - DNA, 21 bp, Homo sapiens
gagcgccccggcgccgccctc

SEQ ID NO: 54925 - DNA, 17 bp, Homo sapiens
aggcccctgccgccctc

SEQ ID NO: 54926 - DNA, 20 bp, Homo sapiens
gggccgtcgtccaggccttc

SEQ ID NO: 54927 - DNA, 22 bp, Homo sapiens
gaggccgctgatgcggcggctc

SEQ ID NO: 54928 - DNA, 18 bp, Homo sapiens
gaggccgcggccgccgcc

SEQ ID NO: 54929 - DNA, 18 bp, Homo sapiens
aaggccaacactgtcctc

SEQ ID NO: 54930 - DNA, 19 bp, Homo sapiens
aaggccggccttcgtcctc

SEQ ID NO: 54931 - DNA, 22 bp, Homo sapiens
gaggccgcggcgccgctgtctc

SEQ ID NO: 54932 - DNA, 19 bp, Homo sapiens
aaggccacgggtcgctctc

SEQ ID NO: 54933 - DNA, 17 bp, Homo sapiens
ggcggagcaccgccctc

SEQ ID NO: 54934 - DNA, 15 bp, Homo sapiens
aggccccgccgccct

SEQ ID NO: 54935 - DNA, 22 bp, Homo sapiens
gaggccgtcagacactgggctc

SEQ ID NO: 54936 - DNA, 19 bp, Homo sapiens
aaggccgcactcgcactgc

SEQ ID NO: 54937 - DNA, 19 bp, Homo sapiens
ggcggtggccaccgccctc

SEQ ID NO: 54938 - DNA, 17 bp, Homo sapiens
ggccgtcaaccgtcctc

SEQ ID NO: 54939 - DNA, 15 bp, Homo sapiens
gaccgtcgccgcccc

SEQ ID NO: 54940 - DNA, 18 bp, Homo sapiens
ggccgtcacacaacactc

SEQ ID NO: 54941 - DNA, 17 bp, Homo sapiens
gggccgccgccgccctc

SEQ ID NO: 54942 - DNA, 18 bp, Homo sapiens
aaggccattcactgccct

SEQ ID NO: 54943 - DNA, 21 bp, Homo sapiens
gaggccgcccgggtcgctctc

SEQ ID NO: 54944 - DNA, 17 bp, Homo sapiens
gaggccgcggtgccctc

SEQ ID NO: 54945 - DNA, 23 bp, Homo sapiens
gagaccacacaaacactgtcctc

SEQ ID NO: 54946 - DNA, 25 bp, Homo sapiens
gaggccgcatggcggcaccgtcctc

SEQ ID NO: 54947 - DNA, 18 bp, Homo sapiens
gaggccgcgcgacgccct

SEQ ID NO: 54948 - DNA, 20 bp, Homo sapiens
gggtccccgtcgccgccctc

SEQ ID NO: 54949 - DNA, 18 bp, Homo sapiens
agctgtgaccccgccctc

SEQ ID NO: 54950 - DNA, 20 bp, Homo sapiens
gaggccgccgaaggcctctc

SEQ ID NO: 54951 - DNA, 19 bp, Homo sapiens
aaggccactcgctgccctc

SEQ ID NO: 54952 - DNA, 18 bp, Homo sapiens
aggctgtcccccgccctc

SEQ ID NO: 54953 - DNA, 18 bp, Homo sapiens
ggcgccgtcaccgccctc

SEQ ID NO: 54954 - DNA, 18 bp, Homo sapiens
gaggccgccggcttcctc

SEQ ID NO: 54955 - DNA, 21 bp, Homo sapiens
gagcccgccgccaccgccctc

SEQ ID NO: 54956 - DNA, 18 bp, Homo sapiens
gagcccagagccgccctc

SEQ ID NO: 54957 - DNA, 20 bp, Homo sapiens
gaggccggggacccgccctc

SEQ ID NO: 54958 - DNA, 20 bp, Homo sapiens
ggcgctgtccccacgccctc

SEQ ID NO: 54959 - DNA, 18 bp, Homo sapiens
ggccatcggcaccaggct

SEQ ID NO: 54960 - DNA, 19 bp, Homo sapiens
gagaccgtccccggctctc

SEQ ID NO: 54961 - DNA, 20 bp, Homo sapiens
gagagccggctcccgccctc

SEQ ID NO: 54962 - DNA, 20 bp, Homo sapiens
gcagcgtcgacactgccctc

SEQ ID NO: 54963 - DNA, 18 bp, Homo sapiens
gaagccggctccgccctc

SEQ ID NO: 54964 - DNA, 16 bp, Homo sapiens
gaagggtaccgccctc

SEQ ID NO: 54965 - DNA, 19 bp, Homo sapiens
gagtgtggataccgccctc

SEQ ID NO: 54966 - DNA, 15 bp, Homo sapiens
ggcgccgaccgccct

SEQ ID NO: 54967 - DNA, 18 bp, Homo sapiens
gaggccgtggccaccacc

SEQ ID NO: 54968 - DNA, 17 bp, Homo sapiens
aggacgagcaccgccct

SEQ ID NO: 54969 - DNA, 20 bp, Homo sapiens
gaaggtcccacattgccctc

SEQ ID NO: 54970 - DNA, 20 bp, Homo sapiens
gaggccatcacacagccctc

SEQ ID NO: 54971 - DNA, 19 bp, Homo sapiens
gaggccacaagctgctctc

SEQ ID NO: 54972 - DNA, 19 bp, Homo sapiens
gaggccgtgcggcgccgct

SEQ ID NO: 54973 - DNA, 18 bp, Homo sapiens
gaggccactgccgccctc

SEQ ID NO: 54974 - DNA, 17 bp, Homo sapiens
gggccgtcgccactcct

SEQ ID NO: 54975 - DNA, 16 bp, Homo sapiens
gggcgccaccgccctc

SEQ ID NO: 54976 - DNA, 18 bp, Homo sapiens
gggtcagatgccgccctc

SEQ ID NO: 54977 - DNA, 23 bp, Homo sapiens
gaggccatttgtcatttgccttc

SEQ ID NO: 54978 - DNA, 20 bp, Homo sapiens
gaggctgcggcaccgccctc

SEQ ID NO: 54979 - DNA, 18 bp, Homo sapiens
gacgcgctcgccgccctc

SEQ ID NO: 54980 - DNA, 22 bp, Homo sapiens
gaggccgtcgcatcaaatcctc

SEQ ID NO: 54981 - DNA, 18 bp, Homo sapiens
gaggccgctgcctgccct

SEQ ID NO: 54982 - DNA, 21 bp, Homo sapiens
ggcgcttggtcagccgccctc

SEQ ID NO: 54983 - DNA, 111 bp, Rat cytomegalovirus
ccgcgctcctgcccccggtcttctacgagcccgtggtggactacgcggcctacatcaacctggccgagctctacgtcttcgtctggtaccgggaccacgagttctccgcgg

SEQ ID NO: 54984 - DNA, 24 bp, Rat cytomegalovirus
cccccggtcttctacgagcccgtg

SEQ ID NO: 54985 - DNA, 21 bp, Homo sapiens
ccctggtgctacgagtccgtg

SEQ ID NO: 54986 - DNA, 27 bp, Homo sapiens
cccccggtgggtctgtgcacgggctcg

SEQ ID NO: 54987 - DNA, 25 bp, Homo sapiens
ccctcggcttccctattggcctgtg

SEQ ID NO: 54988 - DNA, 22 bp, Homo sapiens
cccctggtctaccgactctgtg

SEQ ID NO: 54989 - DNA, 20 bp, Homo sapiens
cccggtcttctcggaccgtg

SEQ ID NO: 54990 - DNA, 19 bp, Homo sapiens
cgttcttctactacttgtg

SEQ ID NO: 54991 - DNA, 27 bp, Homo sapiens
ccccgatcttgtctgtgcacgggctcg

SEQ ID NO: 54992 - DNA, 28 bp, Homo sapiens
cccttggtcctccctgtgcacgggctcg

SEQ ID NO: 54993 - DNA, 22 bp, Homo sapiens
cccttggtgtccgcagcccgtg

SEQ ID NO: 54994 - DNA, 22 bp, Homo sapiens
ccctcagtccacggggcccgtg

SEQ ID NO: 54995 - DNA, 21 bp, Homo sapiens
cctggtcctctccagcttgtg

SEQ ID NO: 54996 - DNA, 25 bp, Homo sapiens
ccctggtcttctaaatgcctccgtg

SEQ ID NO: 54997 - DNA, 18 bp, Homo sapiens
ccagtctaggagcctgtg

SEQ ID NO: 54998 - DNA, 20 bp, Homo sapiens
cctggtctgtctgtcctgtg

SEQ ID NO: 54999 - DNA, 20 bp, Homo sapiens
gcctccgctacgagcctgtg

SEQ ID NO: 55000 - DNA, 18 bp, Homo sapiens
cctcggtcttctgcacgc

SEQ ID NO: 55001 - DNA, 22 bp, Homo sapiens
cctccgggctgcctggcctgtg

SEQ ID NO: 55002 - DNA, 86 bp, Rat cytomegalovirus
aacgcgctgcccggcgagcggtccgcggccgccgccgagacccgagccgcgtcctcggacccgcgctcggaccgggacgacgcgtt

SEQ ID NO: 55003 - DNA, 24 bp, Rat cytomegalovirus
tcggacccgcgctcggaccgggac

SEQ ID NO: 55004 - DNA, 23 bp, Homo sapiens
tcggggtccgcgccgccgccggg

SEQ ID NO: 55005 - DNA, 19 bp, Homo sapiens
ccggcccaggcggaccggg

SEQ ID NO: 55006 - DNA, 19 bp, Homo sapiens
ggactcgcgctcggacggg

SEQ ID NO: 55007 - DNA, 18 bp, Homo sapiens
tcggaccggcgctcggac

SEQ ID NO: 55008 - DNA, 18 bp, Homo sapiens
ggacccgcccccgccggg

SEQ ID NO: 55009 - DNA, 18 bp, Homo sapiens
tcggacctcgggccggga

SEQ ID NO: 55010 - DNA, 26 bp, Homo sapiens
tcagactcgcgctttcccagcgggac

SEQ ID NO: 55011 - DNA, 22 bp, Homo sapiens
gacgccgcgctcgggccgggac

SEQ ID NO: 55012 - DNA, 17 bp, Homo sapiens
tcggaccccgctggggg

SEQ ID NO: 55013 - DNA, 23 bp, Homo sapiens
tcggaccccgcggacgcgctggg

SEQ ID NO: 55014 - DNA, 19 bp, Homo sapiens
ggacctgctgcatcgggac

SEQ ID NO: 55015 - DNA, 20 bp, Homo sapiens
tcggaccgacgcgggccggg

SEQ ID NO: 55016 - DNA, 21 bp, Homo sapiens
tccgacccgcgctccttggac

SEQ ID NO: 55017 - DNA, 20 bp, Homo sapiens
tctgacctgcaggatcggga

SEQ ID NO: 55018 - DNA, 18 bp, Homo sapiens
tcggcgccgcggaccggg

SEQ ID NO: 55019 - DNA, 20 bp, Homo sapiens
ggactcgtggctccggagga

SEQ ID NO: 55020 - DNA, 64 bp, Murine osteosarcoma virus
tttgcgcctgcgtctgtatctgtactagttagctaactagatctgtatctggcggttccgtgaa

SEQ ID NO: 55021 - DNA, 24 bp, Murine osteosarcoma virus
ctagatctgtatctggcggttccg

SEQ ID NO: 55022 - DNA, 18 bp, Homo sapiens
aatttgtatctgataatt

SEQ ID NO: 55023 - DNA, 20 bp, Homo sapiens
ctagatttgttctaactctc

SEQ ID NO: 55024 - DNA, 19 bp, Homo sapiens
ctagatctgtgtatatctg

SEQ ID NO: 55025 - DNA, 19 bp, Homo sapiens
taaatctgtaaaatggttc

SEQ ID NO: 55026 - DNA, 22 bp, Homo sapiens
taggtatgtatctgggcaagct

SEQ ID NO: 55027 - DNA, 25 bp, Homo sapiens
ctagattagtgtctgattgcggaac

SEQ ID NO: 55028 - DNA, 18 bp, Homo sapiens
ctggaacatggcggttcc

SEQ ID NO: 55029 - DNA, 19 bp, Homo sapiens
gatttgtatctgaaaagct

SEQ ID NO: 55030 - DNA, 15 bp, Homo sapiens
ctagatctgtgctcc

SEQ ID NO: 55031 - DNA, 62 bp, Murine osteosarcoma virus
tgggagacgtctcagaggcatcgggggccatttttgtggcccaatctgtatctgagaacccg

SEQ ID NO: 55032 - DNA, 24 bp, Murine osteosarcoma virus
tctcagaggcatcgggggccattt

SEQ ID NO: 55033 - DNA, 20 bp, Homo sapiens
agaagcattttcaaccattt

SEQ ID NO: 55034 - DNA, 19 bp, Homo sapiens
tcaaaggcattaagcattt

SEQ ID NO: 55035 - DNA, 27 bp, Homo sapiens
tcttcagaggcattgctggactcattt

SEQ ID NO: 55036 - DNA, 23 bp, Homo sapiens
tcagaggcatcggtaatacattt

SEQ ID NO: 55037 - DNA, 19 bp, Homo sapiens
tctcagaggtgtcggcgac

SEQ ID NO: 55038 - DNA, 17 bp, Homo sapiens
tctcagaggatcaaaaa

SEQ ID NO: 55039 - DNA, 16 bp, Homo sapiens
tcagaggcatgacatt

SEQ ID NO: 55040 - DNA, 19 bp, Homo sapiens
tctcagggctactgccatt

SEQ ID NO: 55041 - DNA, 71 bp, Murine osteosarcoma virus
gaaggatacgtggttctattgggcggcgaggggccgaaacgctcctctcctccatctgaatttttgctttc

SEQ ID NO: 55042 - DNA, 24 bp, Murine osteosarcoma virus
tattgggcggcgaggggccgaaac

SEQ ID NO: 55043 - DNA, 21 bp, Homo sapiens
ctgggcgagcgcggggggccg

SEQ ID NO: 55044 - DNA, 19 bp, Homo sapiens
ttgggcggcgcgtcggggc

SEQ ID NO: 55045 - DNA, 20 bp, Homo sapiens
ttgagcaagttggggccgaa

SEQ ID NO: 55046 - DNA, 17 bp, Homo sapiens
tgggcagccagggccga

SEQ ID NO: 55047 - DNA, 21 bp, Homo sapiens
tactgggcactgggctgaggc

SEQ ID NO: 55048 - DNA, 17 bp, Homo sapiens
tactggggcggggccga

SEQ ID NO: 55049 - DNA, 21 bp, Homo sapiens
tattaggcgaacctggggggc

SEQ ID NO: 55050 - DNA, 21 bp, Homo sapiens
ttgggcggcggcggcggctga

SEQ ID NO: 55051 - DNA, 17 bp, Homo sapiens
attgggggcggggccga

SEQ ID NO: 55052 - DNA, 18 bp, Homo sapiens
ggctggcgagggagggaa

SEQ ID NO: 55053 - DNA, 18 bp, Homo sapiens
attgggcggcgaaggagc

SEQ ID NO: 55054 - DNA, 18 bp, Homo sapiens
ttgggcgagacagtcgaa

SEQ ID NO: 55055 - DNA, 18 bp, Homo sapiens
ctcagggcgaggggctga

SEQ ID NO: 55056 - DNA, 19 bp, Homo sapiens
tgggcggcgaggggtgcga

SEQ ID NO: 55057 - DNA, 92 bp, Alcelaphine herpesvirus 1
tgctacctttaaaccttatgtagactgggacagtaaagcacagcttgggtcagcttgtcacttttctttaatctttttccggtttagtagca

SEQ ID NO: 55058 - DNA, 24 bp, Alcelaphine herpesvirus 1
tacctttaaaccttatgtagactg

SEQ ID NO: 55059 - DNA, 20 bp, Homo sapiens
ctttaaacttcaaaagactg

SEQ ID NO: 55060 - DNA, 16 bp, Homo sapiens
ctttaaaatgtagact

SEQ ID NO: 55061 - DNA, 17 bp, Homo sapiens
tacctttaaatcatata

SEQ ID NO: 55062 - DNA, 22 bp, Homo sapiens
tacctttaaaatttctcagctg

SEQ ID NO: 55063 - DNA, 19 bp, Homo sapiens
cctttaaattttgtgaccg

SEQ ID NO: 55064 - DNA, 18 bp, Homo sapiens
cctttggaactgtagact

SEQ ID NO: 55065 - DNA, 17 bp, Homo sapiens
cctttaaactcaagact

SEQ ID NO: 55066 - DNA, 19 bp, Homo sapiens
cctgtaaacccataggctg

SEQ ID NO: 55067 - DNA, 24 bp, Homo sapiens
tacctctaggcctgtgtgcggctg

SEQ ID NO: 55068 - DNA, 21 bp, Homo sapiens
ccttcaaatgctcctggactg

SEQ ID NO: 55069 - DNA, 21 bp, Homo sapiens
ccttcaaatcctcctggactg

SEQ ID NO: 55070 - DNA, 72 bp, Banana mild mosaic virus
gggaagataatttcagttgaagaagaagttgtgaagtacgtttcagagcatggtctagaaattcattacccc

SEQ ID NO: 55071 - DNA, 24 bp, Banana mild mosaic virus
tcagagcatggtctagaaattcat

SEQ ID NO: 55072 - DNA, 23 bp, Homo sapiens
tcagagcctgtcaggaaattcat

SEQ ID NO: 55073 - DNA, 16 bp, Homo sapiens
gcatgtccaaattcat

SEQ ID NO: 55074 - DNA, 19 bp, Homo sapiens
aggcattttagaaattcat

SEQ ID NO: 55075 - DNA, 19 bp, Homo sapiens
aggacatggaaaaattcat

SEQ ID NO: 55076 - DNA, 18 bp, Homo sapiens
gatcaggtggaaattcat

SEQ ID NO: 55077 - DNA, 18 bp, Homo sapiens
gagaaatcagaaattcat

SEQ ID NO: 55078 - DNA, 20 bp, Homo sapiens
gagagtatcatgaaattcat

SEQ ID NO: 55079 - DNA, 24 bp, Homo sapiens
ccagagcatgggaaccaagttcat

SEQ ID NO: 55080 - DNA, 17 bp, Homo sapiens
gccatctggaaattcat

SEQ ID NO: 55081 - DNA, 18 bp, Homo sapiens
tcagaacatggtctagaa

SEQ ID NO: 55082 - DNA, 21 bp, Homo sapiens
tcagagcaggatagagaaatt

SEQ ID NO: 55083 - DNA, 21 bp, Homo sapiens
tcagaatgtggaaaaattcat

SEQ ID NO: 55084 - DNA, 17 bp, Homo sapiens
ccagagcaccagaaatt

SEQ ID NO: 55085 - DNA, 17 bp, Homo sapiens
ccggagcaccagaaatt

SEQ ID NO: 55086 - DNA, 68 bp, Ictalurid herpesvirus 1
cggggcagtttgtgtacaagaactgcgagatggtgcacatcgcgccgttctttgtagcggcggccctg

SEQ ID NO: 55087 - DNA, 24 bp, Ictalurid herpesvirus 1
tacaagaactgcgagatggtgcac

SEQ ID NO: 55088 - DNA, 18 bp, Homo sapiens
tacaaaactgcggggcca

SEQ ID NO: 55089 - DNA, 21 bp, Homo sapiens
acaggatcacagagatggtgc

SEQ ID NO: 55090 - DNA, 17 bp, Homo sapiens
aagaaccaaatggtgca

SEQ ID NO: 55091 - DNA, 16 bp, Homo sapiens
gagctgcaagagtgca

SEQ ID NO: 55092 - DNA, 17 bp, Homo sapiens
caagaactgcagaggac

SEQ ID NO: 55093 - DNA, 22 bp, Homo sapiens
acagggactgtgatcatagtac

SEQ ID NO: 55094 - DNA, 17 bp, Homo sapiens
caggaactgcatgtgtg

SEQ ID NO: 55095 - DNA, 23 bp, Homo sapiens
tacaagaactgtgtgcaaagtgc

SEQ ID NO: 55096 - DNA, 19 bp, Homo sapiens
tacaagaactgcaggtcca

SEQ ID NO: 55097 - DNA, 20 bp, Homo sapiens
actgcagtgagatggtgcac

SEQ ID NO: 55098 - DNA, 16 bp, Homo sapiens
aagaactgtgaaggta

SEQ ID NO: 55099 - DNA, 22 bp, Homo sapiens
taaagaactgtgagaatagcac

SEQ ID NO: 55100 - DNA, 20 bp, Homo sapiens
gaacaacactgaggtggtgc

SEQ ID NO: 55101 - DNA, 21 bp, Homo sapiens
taaagaagcatacagatggtg

SEQ ID NO: 55102 - DNA, 20 bp, Homo sapiens
caagagctcgctctgtgcgc

SEQ ID NO: 55103 - DNA, 20 bp, Homo sapiens
tacaagaattatcagtgtgc

SEQ ID NO: 55104 - DNA, 18 bp, Homo sapiens
aagggctgcgaaaggcgc

SEQ ID NO: 55105 - DNA, 18 bp, Homo sapiens
caagagctgggagggggc

SEQ ID NO: 55106 - DNA, 25 bp, Homo sapiens
cacgaggacacccaggatggtgcac

SEQ ID NO: 55107 - DNA, 17 bp, Homo sapiens
tacaagaattgtagtgc

SEQ ID NO: 55108 - DNA, 20 bp, Homo sapiens
tacaagatttgtgaggtcca

SEQ ID NO: 55109 - DNA, 22 bp, Homo sapiens
cacaagaactgtgagaaatcca

SEQ ID NO: 55110 - DNA, 18 bp, Homo sapiens
tacagtggcaatggtgca

SEQ ID NO: 55111 - DNA, 18 bp, Homo sapiens
caagaactgtaggtgtac

SEQ ID NO: 55112 - DNA, 126 bp, Banana mild mosaic virus
cccttttcagtacaaaggcaaaccctatctcgctaattacatcaagaagaaaagtcacagattcaagaaagagctcgtgcctattttgcttgaattgggtgtggaggttgaagtggaggaggaggg

SEQ ID NO: 55113 - DNA, 24 bp, Banana mild mosaic virus
tacatcaagaagaaaagtcacaga

SEQ ID NO: 55114 - DNA, 22 bp, Homo sapiens
catcctacctaaaagtcataga

SEQ ID NO: 55115 - DNA, 18 bp, Homo sapiens
acatcaggaagaaaacag

SEQ ID NO: 55116 - DNA, 22 bp, Homo sapiens
tacatcaggagggacagtcaca

SEQ ID NO: 55117 - DNA, 21 bp, Homo sapiens
tacaacagattaagtcacaga

SEQ ID NO: 55118 - DNA, 18 bp, Homo sapiens
tacatcaaggtgaagagt

SEQ ID NO: 55119 - DNA, 20 bp, Homo sapiens
tccagggaggaaagtcacag

SEQ ID NO: 55120 - DNA, 20 bp, Homo sapiens
cataaggaggctgtcacaga

SEQ ID NO: 55121 - DNA, 22 bp, Homo sapiens
acatcaaggaaaatagttgcag

SEQ ID NO: 55122 - DNA, 17 bp, Homo sapiens
aagaagaaattcataga

SEQ ID NO: 55123 - DNA, 18 bp, Homo sapiens
tcaagaaggcaacacgga

SEQ ID NO: 55124 - DNA, 21 bp, Homo sapiens
tcaagaagtaaaatcctacag

SEQ ID NO: 55125 - DNA, 19 bp, Homo sapiens
atctttaaaagagtcacag

SEQ ID NO: 55126 - DNA, 20 bp, Homo sapiens
tacacaggaagaagtcacag

SEQ ID NO: 55127 - DNA, 19 bp, Homo sapiens
tacatgagaagaaacatca

SEQ ID NO: 55128 - DNA, 25 bp, Homo sapiens
acattaagaaaaattaagtcacaga

SEQ ID NO: 55129 - DNA, 24 bp, Homo sapiens
tacatgaaatcattaagtcacaga

SEQ ID NO: 55130 - DNA, 22 bp, Homo sapiens
acatcaagaaggttagtgtaga

SEQ ID NO: 55131 - DNA, 18 bp, Homo sapiens
agcaaatgaagtcacaga

SEQ ID NO: 55132 - DNA, 17 bp, Homo sapiens
cacatcaagaggacaga

SEQ ID NO: 55133 - DNA, 18 bp, Homo sapiens
catcagctgagtcacaga

SEQ ID NO: 55134 - DNA, 21 bp, Homo sapiens
tcaagaaacccacagtcacag

SEQ ID NO: 55135 - DNA, 18 bp, Homo sapiens
catcaagaggaggctcag

SEQ ID NO: 55136 - DNA, 18 bp, Homo sapiens
caccaggaaagtcacaga

SEQ ID NO: 55137 - DNA, 18 bp, Homo sapiens
catccagaagaaaggcca

SEQ ID NO: 55138 - DNA, 19 bp, Homo sapiens
ccaaaaagagaagttgcag

SEQ ID NO: 55139 - DNA, 19 bp, Homo sapiens
tgatcaagaagatgcacag

SEQ ID NO: 55140 - DNA, 21 bp, Homo sapiens
tacattaagaaaagctttcac

SEQ ID NO: 55141 - DNA, 20 bp, Homo sapiens
tcaagaagaaacccggcaga

SEQ ID NO: 55142 - DNA, 17 bp, Homo sapiens
catcgagaaaaatccag

SEQ ID NO: 55143 - DNA, 19 bp, Homo sapiens
catcaagaaggaaaagtca

SEQ ID NO: 55144 - DNA, 21 bp, Homo sapiens
catcaagacattggtcacaga

SEQ ID NO: 55145 - DNA, 21 bp, Homo sapiens
atcagagcatgaagtcacaga

SEQ ID NO: 55146 - DNA, 18 bp, Homo sapiens
atcaaaaaaagttacaga

SEQ ID NO: 55147 - DNA, 21 bp, Homo sapiens
tacaacagactaagtcacaga

SEQ ID NO: 55148 - DNA, 18 bp, Homo sapiens
cattaaggtgaaaagtca

SEQ ID NO: 55149 - DNA, 19 bp, Homo sapiens
catcaacattaagtcacag

SEQ ID NO: 55150 - DNA, 22 bp, Homo sapiens
cattttacagaagagtcacaga

SEQ ID NO: 55151 - DNA, 21 bp, Homo sapiens
cacatcatcaaaggtcacaga

SEQ ID NO: 55152 - DNA, 18 bp, Homo sapiens
tcaagaagagggcccaga

SEQ ID NO: 55153 - DNA, 85 bp, Meleagrid herpesvirus 1
tctggcgggttattggtggaaggctgtaacaatgtctgtgtcataatcgaactgaaaacttgcagattttaccgcaacctcaaga

SEQ ID NO: 55154 - DNA, 24 bp, Meleagrid herpesvirus 1
ttggtggaaggctgtaacaatgtc

SEQ ID NO: 55155 - DNA, 19 bp, Homo sapiens
ttgttggaggttgtgatgt

SEQ ID NO: 55156 - DNA, 21 bp, Homo sapiens
tcggtggagggtgacagtgtc

SEQ ID NO: 55157 - DNA, 22 bp, Homo sapiens
ctggtggaaaacaaaatgatgt

SEQ ID NO: 55158 - DNA, 18 bp, Homo sapiens
ttggttgaaaaacaatgt

SEQ ID NO: 55159 - DNA, 19 bp, Homo sapiens
ctggtgactgtaatagtgt

SEQ ID NO: 55160 - DNA, 25 bp, Homo sapiens
ttggtagagggtagcaacatagtgt

SEQ ID NO: 55161 - DNA, 18 bp, Homo sapiens
ttggtcgagggctgtaac

SEQ ID NO: 55162 - DNA, 22 bp, Homo sapiens
ctggtggacacttgatagtgtc

SEQ ID NO: 55163 - DNA, 24 bp, Homo sapiens
ttggtggagagttctgtagatgtc

SEQ ID NO: 55164 - DNA, 19 bp, Homo sapiens
ttgttggaggttgcgatgt

SEQ ID NO: 55165 - DNA, 21 bp, Homo sapiens
ttgatggaaaagcagtgatgt

SEQ ID NO: 55166 - DNA, 16 bp, Homo sapiens
ttggtggaggctaatg

SEQ ID NO: 55167 - DNA, 126 bp, Meleagrid herpesvirus 1
gggcttgtagttatacgttcgacaccattaaaaaagaaggctatatgtacagactttcatcgattggcatcaatgatgtatctcagatcagaatataggctttatgattcgggtatgtgcaagccc

SEQ ID NO: 55168 - DNA, 24 bp, Meleagrid herpesvirus 1
tacgttcgacaccattaaaaaaga

SEQ ID NO: 55169 - DNA, 18 bp, Homo sapiens
ttcgacatttaaaaaaga

SEQ ID NO: 55170 - DNA, 22 bp, Homo sapiens
tacattcgactcccaaagaaga

SEQ ID NO: 55171 - DNA, 20 bp, Homo sapiens
gcttcacaccgttaaaaaag

SEQ ID NO: 55172 - DNA, 18 bp, Homo sapiens
tacattcgacaccttcaa

SEQ ID NO: 55173 - DNA, 16 bp, Homo sapiens
gttagacaccataaag

SEQ ID NO: 55174 - DNA, 21 bp, Homo sapiens
gttacaaaaccattaaaggag

SEQ ID NO: 55175 - DNA, 66 bp, Meleagrid herpesvirus 1
cgatttaaaaaggggcagtctgcaaagtttatcgcgggtgtaatgtagacaccgcctgttaggttg

SEQ ID NO: 55176 - DNA, 17 bp, Meleagrid herpesvirus 1
caccgcctgttaggttg

SEQ ID NO: 55177 - DNA, 18 bp, Homo sapiens
caccggctatgcaggttg

SEQ ID NO: 55178 - DNA, 20 bp, Homo sapiens
caccaggtctggttaggttg

SEQ ID NO: 55179 - DNA, 20 bp, Homo sapiens
caccagctgtctttgggttg

SEQ ID NO: 55180 - DNA, 18 bp, Homo sapiens
cacctgccccttaggttg

SEQ ID NO: 55181 - DNA, 19 bp, Homo sapiens
cacctgcctgccaccgttg

SEQ ID NO: 55182 - DNA, 19 bp, Homo sapiens
caccaccttgttaaggttg

SEQ ID NO: 55183 - DNA, 19 bp, Homo sapiens
cactgcccgctccacgttg

SEQ ID NO: 55184 - DNA, 18 bp, Homo sapiens
actgcctgccaacagttg

SEQ ID NO: 55185 - DNA, 24 bp, Homo sapiens
cactgccatcaaatattaggttgc

SEQ ID NO: 55186 - DNA, 19 bp, Homo sapiens
caccacctggtactggttg

SEQ ID NO: 55187 - DNA, 80 bp, Ribgrass mosaic virus
tgtcgcaatcgtatcaaactcaggcggcaagagatactgttagacagcagttctctaaccttctgagtgcgattgtgaca

SEQ ID NO: 55188 - DNA, 17 bp, Ribgrass mosaic virus
tgagtgcgattgtgaca

SEQ ID NO: 55189 - DNA, 18 bp, Homo sapiens
agtgcaaccgttgtgaca

SEQ ID NO: 55190 - DNA, 20 bp, Homo sapiens
tgaatacatttattgtgaca

SEQ ID NO: 55191 - DNA, 18 bp, Homo sapiens
tgagtgcggttgctgaca

SEQ ID NO: 55192 - DNA, 19 bp, Homo sapiens
tgactgtgaacttatgaca

SEQ ID NO: 55193 - DNA, 18 bp, Homo sapiens
tgaatgcatctgttgaca

SEQ ID NO: 55194 - DNA, 79 bp, Ribgrass mosaic virus
ccgttgtacgagtctctcatgaagtcctttgatactagaaataggatcattgaaactgaagaagagtcgcgtccatcgg

SEQ ID NO: 55195 - DNA, 24 bp, Ribgrass mosaic virus
atgaagtcctttgatactagaaat

SEQ ID NO: 55196 - DNA, 23 bp, Homo sapiens
atgtagttcactatactagaaat

SEQ ID NO: 55197 - DNA, 19 bp, Homo sapiens
atgaagtcatttgcggaga

SEQ ID NO: 55198 - DNA, 20 bp, Homo sapiens
tgaaatccacaactggaaat

SEQ ID NO: 55199 - DNA, 18 bp, Homo sapiens
gaagtcctgacagactag

SEQ ID NO: 55200 - DNA, 22 bp, Homo sapiens
atgaagtccttttactggaaat

SEQ ID NO: 55201 - DNA, 16 bp, Homo sapiens
atggagcccactagaa

SEQ ID NO: 55202 - DNA, 21 bp, Homo sapiens
tggggtcctttgaagccaaaa

SEQ ID NO: 55203 - DNA, 20 bp, Homo sapiens
tgaagtcaactgctagaaat

SEQ ID NO: 55204 - DNA, 18 bp, Homo sapiens
tgagtccttttcctggaa

SEQ ID NO: 55205 - DNA, 75 bp, Ribgrass mosaic virus
tcgaaacctgttatttcctggatcacctgttaacgtacgcgtggcgtatattacagtgggaataactaaaagtga

SEQ ID NO: 55206 - DNA, 24 bp, Ribgrass mosaic virus
tattacagtgggaataactaaaag

SEQ ID NO: 55207 - DNA, 18 bp, Homo sapiens
tgatgtaaataactaaaa

SEQ ID NO: 55208 - DNA, 20 bp, Homo sapiens
tacagtgggaagataaaaag

SEQ ID NO: 55209 - DNA, 18 bp, Homo sapiens
tattacagtgggaattac

SEQ ID NO: 55210 - DNA, 21 bp, Homo sapiens
tacatacataataactaaaag

SEQ ID NO: 55211 - DNA, 71 bp, Bovine polyomavirus
aagaaaaggtattcgccctctgctggtcaaggctcagcaatgcctatagagggaataaattaccatttctt

SEQ ID NO: 55212 - DNA, 24 bp, Bovine polyomavirus
aaaggtattcgccctctgctggtc

SEQ ID NO: 55213 - DNA, 23 bp, Homo sapiens
aagcgtatcgccttctgctggtc

SEQ ID NO: 55214 - DNA, 16 bp, Homo sapiens
aaaagtactttgctgg

SEQ ID NO: 55215 - DNA, 24 bp, Homo sapiens
tgaagttggcgccctctgctggtc

SEQ ID NO: 55216 - DNA, 17 bp, Homo sapiens
aaggtattattgctggt

SEQ ID NO: 55217 - DNA, 22 bp, Homo sapiens
aaaagtatttacaattgctggt

SEQ ID NO: 55218 - DNA, 24 bp, Homo sapiens
aaaggtattttccacagtgtggtc

SEQ ID NO: 55219 - DNA, 20 bp, Homo sapiens
ggtgagacactttgctggtc

SEQ ID NO: 55220 - DNA, 24 bp, Homo sapiens
aagggacagtggcctctgctggtc

SEQ ID NO: 55221 - DNA, 22 bp, Homo sapiens
ggaggtgctgtgcctgctggtc

SEQ ID NO: 55222 - DNA, 20 bp, Homo sapiens
aggttttcgccctctgaggt

SEQ ID NO: 55223 - DNA, 18 bp, Homo sapiens
ggaggtattccctttgct

SEQ ID NO: 55224 - DNA, 22 bp, Homo sapiens
aaaggtattcatcctcgtaact

SEQ ID NO: 55225 - DNA, 23 bp, Homo sapiens
ggaggtgtccgcccttccggggt

SEQ ID NO: 55226 - DNA, 18 bp, Homo sapiens
ggaggtggtcgccctccg

SEQ ID NO: 55227 - DNA, 21 bp, Homo sapiens
aggtatttgccctctgatgtc

SEQ ID NO: 55228 - DNA, 22 bp, Homo sapiens
aggtatttgccctccataagtc

SEQ ID NO: 55229 - DNA, 18 bp, Homo sapiens
aaaagtatttgccttctg

SEQ ID NO: 55230 - DNA, 22 bp, Homo sapiens
aggtattcatttttactctggt

SEQ ID NO: 55231 - DNA, 62 bp, Bovine polyomavirus
ggtacatcaataagtttggacaagaggaaacttgtattccaaaatgactttattatggtact

SEQ ID NO: 55232 - DNA, 24 bp, Bovine polyomavirus
tcaataagtttggacaagaggaaa

SEQ ID NO: 55233 - DNA, 23 bp, Homo sapiens
tcagggagtttggacccgcagaa

SEQ ID NO: 55234 - DNA, 18 bp, Homo sapiens
ataagacctgagaggaaa

SEQ ID NO: 55235 - DNA, 21 bp, Homo sapiens
tcaataaagtttgggtgggga

SEQ ID NO: 55236 - DNA, 23 bp, Homo sapiens
tcaataacttaaaaaaggggaaa

SEQ ID NO: 55237 - DNA, 18 bp, Homo sapiens
attccgggacaagaggaa

SEQ ID NO: 55238 - DNA, 18 bp, Homo sapiens
tcaataaatttggatagg

SEQ ID NO: 55239 - DNA, 20 bp, Homo sapiens
gtggtggtcacaagaggaaa

SEQ ID NO: 55240 - DNA, 19 bp, Homo sapiens
taaggcagaaacaagagga

SEQ ID NO: 55241 - DNA, 21 bp, Homo sapiens
aatgagtttggaacacctgga

SEQ ID NO: 55242 - DNA, 24 bp, Homo sapiens
tccataagtttggggacctgggga

SEQ ID NO: 55243 - DNA, 21 bp, Homo sapiens
tcagtaagtttggcacagaga

SEQ ID NO: 55244 - DNA, 19 bp, Homo sapiens
tcaattaaagtaagaggaa

SEQ ID NO: 55245 - DNA, 18 bp, Homo sapiens
tcaataaatttggagaag

SEQ ID NO: 55246 - DNA, 17 bp, Homo sapiens
caagtggaccaagagga

SEQ ID NO: 55247 - DNA, 18 bp, Homo sapiens
taaggctgatgagaggaa

SEQ ID NO: 55248 - DNA, 17 bp, Homo sapiens
tcaatgagttagaggaa

SEQ ID NO: 55249 - DNA, 16 bp, Homo sapiens
aacaagttggaggagg

SEQ ID NO: 55250 - DNA, 18 bp, Homo sapiens
agcctggacaagaggaaa

SEQ ID NO: 55251 - DNA, 18 bp, Homo sapiens
aataagttgtggtgagga

SEQ ID NO: 55252 - DNA, 22 bp, Homo sapiens
tcagtaagtctggggtctgaaa

SEQ ID NO: 55253 - DNA, 21 bp, Homo sapiens
tcaatgagttggacaagatga

SEQ ID NO: 55254 - DNA, 18 bp, Homo sapiens
aatatgtgagaagaggaa

SEQ ID NO: 55255 - DNA, 22 bp, Homo sapiens
tcaggggttctgaaaagaggaa

SEQ ID NO: 55256 - DNA, 22 bp, Homo sapiens
tcaaaaatgatgacaaggggaa

SEQ ID NO: 55257 - DNA, 20 bp, Homo sapiens
tcaatccgagggacaagagg

SEQ ID NO: 55258 - DNA, 17 bp, Homo sapiens
tcaagaagcttgagagg

SEQ ID NO: 55259 - DNA, 17 bp, Homo sapiens
taaatttggacatggaa

SEQ ID NO: 55260 - DNA, 18 bp, Homo sapiens
agtgaaaagcaagaggaa

SEQ ID NO: 55261 - DNA, 15 bp, Homo sapiens
aagtaacaagaggaa

SEQ ID NO: 55262 - DNA, 18 bp, Homo sapiens
gtaggactcaagaggaaa

SEQ ID NO: 55263 - DNA, 19 bp, Homo sapiens
caataaagttacaagagga

SEQ ID NO: 55264 - DNA, 16 bp, Homo sapiens
tcagaagcttgagagg

SEQ ID NO: 55265 - DNA, 18 bp, Homo sapiens
agttctgggcaagaggaa

SEQ ID NO: 55266 - DNA, 18 bp, Homo sapiens
agcttggagaatgaggaa

SEQ ID NO: 55267 - DNA, 19 bp, Homo sapiens
taagttctagaagaggaaa

SEQ ID NO: 55268 - DNA, 17 bp, Homo sapiens
aataagtgtgagaggaa

SEQ ID NO: 55269 - DNA, 19 bp, Homo sapiens
tcaataagattcagaggaa

SEQ ID NO: 55270 - DNA, 61 bp, Marburg virus
tggtgatagattaatccttgaagtaacttttttatatattatagaggaactaatattacta

SEQ ID NO: 55271 - DNA, 21 bp, Marburg virus
atagaggaactaatattacta

SEQ ID NO: 55272 - DNA, 18 bp, Homo sapiens
aggaactagatattacta

SEQ ID NO: 55273 - DNA, 20 bp, Homo sapiens
tagaggaattccatatatta

SEQ ID NO: 55274 - DNA, 20 bp, Homo sapiens
aggacagtataatattacta

SEQ ID NO: 55275 - DNA, 17 bp, Homo sapiens
gaggacttttattacta

SEQ ID NO: 55276 - DNA, 19 bp, Homo sapiens
gagatttgctaatattact

SEQ ID NO: 55277 - DNA, 17 bp, Homo sapiens
gaggaactgcacttcta

SEQ ID NO: 55278 - DNA, 18 bp, Homo sapiens
cagagatacgatattact

SEQ ID NO: 55279 - DNA, 18 bp, Homo sapiens
agaggaactaaaattcta

SEQ ID NO: 55280 - DNA, 20 bp, Homo sapiens
aaagaacttttgatattact

SEQ ID NO: 55281 - DNA, 16 bp, Homo sapiens
taaaggaacaattact

SEQ ID NO: 55282 - DNA, 20 bp, Homo sapiens
atagagaaaaataaattact

SEQ ID NO: 55283 - DNA, 19 bp, Homo sapiens
acagaggaaaatacttact

SEQ ID NO: 55284 - DNA, 18 bp, Homo sapiens
atagaggagccagctatt

SEQ ID NO: 55285 - DNA, 22 bp, Homo sapiens
ataaaggaatgcaactaatatt

SEQ ID NO: 55286 - DNA, 17 bp, Homo sapiens
tagaggtgatattacta

SEQ ID NO: 55287 - DNA, 21 bp, Homo sapiens
atagtggaactaattctcact

SEQ ID NO: 55288 - DNA, 18 bp, Homo sapiens
acagaggagtgactacta

SEQ ID NO: 55289 - DNA, 19 bp, Homo sapiens
tagggggactaatattgcc

SEQ ID NO: 55290 - DNA, 17 bp, Homo sapiens
cagagttaatattacta

SEQ ID NO: 55291 - DNA, 20 bp, Homo sapiens
atagaggaacatgtcttcta

SEQ ID NO: 55292 - DNA, 23 bp, Homo sapiens
tagaagaactggtcctcatacta

SEQ ID NO: 55293 - DNA, 130 bp, Marburg virus
gaatcaactaacaacatagaaaacatatttatccttgtgtaattctcggcttagttggaattaacttttgttgcaattcaagacgcttattcatagtagattatatgattttttataagtttaagatatc

SEQ ID NO: 55294 - DNA, 24 bp, Marburg virus
tagaaaacatatttatccttgtgt

SEQ ID NO: 55295 - DNA, 24 bp, Homo sapiens
taaaagacatatttacagacatgt

SEQ ID NO: 55296 - DNA, 21 bp, Homo sapiens
tagaaaacatatttagcatgt

SEQ ID NO: 55297 - DNA, 18 bp, Homo sapiens
tagaaaacacaacttgtg

SEQ ID NO: 55298 - DNA, 24 bp, Homo sapiens
cagaaaacatagtgttttttgtgt

SEQ ID NO: 55299 - DNA, 21 bp, Homo sapiens
tagagattattttccttgtgt

SEQ ID NO: 55300 - DNA, 101 bp, Lumpy skin disease virus
tattactgcaagattttgattttttatttggttttgtcatacaagctttagttttcacattgccagcttttacttcattctcatctgtattattagtagta

SEQ ID NO: 55301 - DNA, 24 bp, Lumpy skin disease virus
ttcacattgccagcttttacttca

SEQ ID NO: 55302 - DNA, 18 bp, Homo sapiens
ttcacattttcagatttt

SEQ ID NO: 55303 - DNA, 18 bp, Homo sapiens
ttcacttgtcaggctctt

SEQ ID NO: 55304 - DNA, 19 bp, Homo sapiens
catattgccagtttatttc

SEQ ID NO: 55305 - DNA, 17 bp, Homo sapiens
ttaccaaccatacttca

SEQ ID NO: 55306 - DNA, 18 bp, Homo sapiens
ctcgcattgtcttacttc

SEQ ID NO: 55307 - DNA, 19 bp, Homo sapiens
ttccattgatttttacttc

SEQ ID NO: 55308 - DNA, 25 bp, Homo sapiens
ttcactttgccagttttttttttca

SEQ ID NO: 55309 - DNA, 19 bp, Homo sapiens
ttcatgctgccagcatttt

SEQ ID NO: 55310 - DNA, 19 bp, Homo sapiens
ttcacattgaaagctttta

SEQ ID NO: 55311 - DNA, 19 bp, Homo sapiens
ttgcaaagcttttatttca

SEQ ID NO: 55312 - DNA, 30 bp, Homo sapiens
ttcacatttttggtgcagtatttatttcat

SEQ ID NO: 55313 - DNA, 18 bp, Homo sapiens
ttcacactgtcaacactt

SEQ ID NO: 55314 - DNA, 18 bp, Homo sapiens
ttcatgttgccagctttc

SEQ ID NO: 55315 - DNA, 21 bp, Homo sapiens
ttcacatttccacacagcttc

SEQ ID NO: 55316 - DNA, 22 bp, Homo sapiens
ttcacatttccatatcatactt

SEQ ID NO: 55317 - DNA, 19 bp, Homo sapiens
ttcaattgccagctccctc

SEQ ID NO: 55318 - DNA, 21 bp, Homo sapiens
ttcacattgctagtattttcc

SEQ ID NO: 55319 - DNA, 23 bp, Homo sapiens
ttcactttgcccagcgctacttc

SEQ ID NO: 55320 - DNA, 22 bp, Homo sapiens
ttcacatttccattgtatttca

SEQ ID NO: 55321 - DNA, 20 bp, Homo sapiens
acattgccagttaatctttt

SEQ ID NO: 55322 - DNA, 18 bp, Homo sapiens
ttcacatttcagcttcca

SEQ ID NO: 55323 - DNA, 19 bp, Homo sapiens
ttcacatttccatgacttc

SEQ ID NO: 55324 - DNA, 22 bp, Homo sapiens
ttcacattccccaactgcttca

SEQ ID NO: 55325 - DNA, 18 bp, Homo sapiens
attgccagcaattcttca

SEQ ID NO: 55326 - DNA, 22 bp, Homo sapiens
ttcacatttcacagcagtgctt

SEQ ID NO: 55327 - DNA, 21 bp, Homo sapiens
catgtgcagttctttacttca

SEQ ID NO: 55328 - DNA, 19 bp, Homo sapiens
ttcacattttgcagacttc

SEQ ID NO: 55329 - DNA, 22 bp, Homo sapiens
ctcacattgctggccaatttca

SEQ ID NO: 55330 - DNA, 18 bp, Homo sapiens
ttcacattgcagctactc

SEQ ID NO: 55331 - DNA, 21 bp, Homo sapiens
ttcacacttgttagcttgacc

SEQ ID NO: 55332 - DNA, 109 bp, Variola virus
aatgaatgcctgcctgtattataatatacataagttaatagtttttatcatatttttctaatactatataaaaatatcattatgtataatcattactgtcgctatcatt

SEQ ID NO: 55333 - DNA, 24 bp, Variola virus
taatatacataagttaatagtttt

SEQ ID NO: 55334 - DNA, 24 bp, Homo sapiens
taatatactaagttaagccagttt

SEQ ID NO: 55335 - DNA, 18 bp, Homo sapiens
aatatacataagttgtct

SEQ ID NO: 55336 - DNA, 24 bp, Homo sapiens
taacatacatagtaatttagtttt

SEQ ID NO: 55337 - DNA, 27 bp, Homo sapiens
taatattacaagtcagttaatggtttt

SEQ ID NO: 55338 - DNA, 64 bp, Camelpox virus
ttttatagtatatacgttattgtcaaaatctaaacaaatattggcataatacctatctataaga

SEQ ID NO: 55339 - DNA, 24 bp, Camelpox virus
tagtatatacgttattgtcaaaat

SEQ ID NO: 55340 - DNA, 22 bp, Homo sapiens
agtatataaaaactgtcaaaat

SEQ ID NO: 55341 - DNA, 22 bp, Homo sapiens
gtataatggttaatgtcaaaat

SEQ ID NO: 55342 - DNA, 17 bp, Homo sapiens
atatatacgttacacaa

SEQ ID NO: 55343 - DNA, 65 bp, Variola virus
caatattgtattgttatattattagtttatattactgaattaataatataaaattcccaatcttg

SEQ ID NO: 55344 - DNA, 19 bp, Variola virus
tataaaattcccaatcttg

SEQ ID NO: 55345 - DNA, 18 bp, Homo sapiens
tataaaatacccagtctc

SEQ ID NO: 55346 - DNA, 18 bp, Homo sapiens
ataaaattccaaatcttg

SEQ ID NO: 55347 - DNA, 18 bp, Homo sapiens
taaaaattccccttcctg

SEQ ID NO: 55348 - DNA, 19 bp, Homo sapiens
tatgaaattccctttcccg

SEQ ID NO: 55349 - DNA, 91 bp, Turnip vein-clearing virus
tcggcgttgtcgcaatcgtaccaaacacaagctgcgagagacactgttagacagcaattctcaaacttgttaagtgcggttgtgacgccga

SEQ ID NO: 55350 - DNA, 24 bp, Turnip vein-clearing virus
tcaaacttgttaagtgcggttgtg

SEQ ID NO: 55351 - DNA, 19 bp, Homo sapiens
aaacttgttaagttgcagt

SEQ ID NO: 55352 - DNA, 20 bp, Homo sapiens
caaaatgaggtgcggttgtg

SEQ ID NO: 55353 - DNA, 21 bp, Homo sapiens
tcaaactttttaaaaattgtg

SEQ ID NO: 55354 - DNA, 21 bp, Homo sapiens
tcaaactgtgcactggttgtg

SEQ ID NO: 55355 - DNA, 17 bp, Homo sapiens
tcaaacttgttggtgcg

SEQ ID NO: 55356 - DNA, 22 bp, Homo sapiens
tcaaacttgtgctgcagttgtg

SEQ ID NO: 55357 - DNA, 23 bp, Homo sapiens
tcaaatttgctaagtgccctttg

SEQ ID NO: 55358 - DNA, 20 bp, Homo sapiens
tcaagcatgttgagtgaggt

SEQ ID NO: 55359 - DNA, 62 bp, Turnip vein-clearing virus
gaccgttgccattagaagtcaaattcagcttttgctgagtgagctttctaatggacatggtt

SEQ ID NO: 55360 - DNA, 24 bp, Turnip vein-clearing virus
tgccattagaagtcaaattcagct

SEQ ID NO: 55361 - DNA, 18 bp, Homo sapiens
tgccattaggaggtaaat

SEQ ID NO: 55362 - DNA, 20 bp, Homo sapiens
cattaacttgtcaaattcag

SEQ ID NO: 55363 - DNA, 19 bp, Homo sapiens
tgccttagaagttaaatcc

SEQ ID NO: 55364 - DNA, 19 bp, Homo sapiens
tgcctttgaaggattcagc

SEQ ID NO: 55365 - DNA, 17 bp, Homo sapiens
tgccagttaaattcggc

SEQ ID NO: 55366 - DNA, 21 bp, Homo sapiens
tgtcattagaaggtaacagct

SEQ ID NO: 55367 - DNA, 18 bp, Homo sapiens
tgccatgcagaattcagc

SEQ ID NO: 55368 - DNA, 84 bp, Turnip vein-clearing virus
tcgaaaccccttatttcctggatcacctgttaacgcacgtttgacgtgtattacagtgggaataagtaaaagtgagaggttcga

SEQ ID NO: 55369 - DNA, 24 bp, Turnip vein-clearing virus
tattacagtgggaataagtaaaag

SEQ ID NO: 55370 - DNA, 17 bp, Homo sapiens
ttacaatgggaaagtaa

SEQ ID NO: 55371 - DNA, 20 bp, Homo sapiens
ctactgaaagtaagtaaaag

SEQ ID NO: 55372 - DNA, 19 bp, Homo sapiens
tacagtgggaagataaaaa

SEQ ID NO: 55373 - DNA, 25 bp, Homo sapiens
tattacagaggggttgtggtaaaag

SEQ ID NO: 55374 - DNA, 21 bp, Homo sapiens
tacttggggaataagtaaaag

SEQ ID NO: 55375 - DNA, 22 bp, Homo sapiens
tactgtgggccatgagtaaaag

SEQ ID NO: 55376 - DNA, 18 bp, Homo sapiens
tattcggtgggaaacaag

SEQ ID NO: 55377 - DNA, 22 bp, Homo sapiens
tattcaagcaggtaagtaaaag

SEQ ID NO: 55378 - DNA, 23 bp, Homo sapiens
tattacatgggaatgtgtgtaaa

SEQ ID NO: 55379 - DNA, 62 bp, Crucifer tobamovirus
gaccgtggccatcaggagtcaaattcagcttttgctgagtgagctttccagtggacatggtc

SEQ ID NO: 55380 - DNA, 24 bp, Crucifer tobamovirus
tgagtgagctttccagtggacatg

SEQ ID NO: 55381 - DNA, 18 bp, Homo sapiens
tgagtgagtcttttgatg

SEQ ID NO: 55382 - DNA, 19 bp, Homo sapiens
tgaggagctttcccttcat

SEQ ID NO: 55383 - DNA, 17 bp, Homo sapiens
tgagtgatttttcagtg

SEQ ID NO: 55384 - DNA, 18 bp, Homo sapiens
tgaatgagttttctggtg

SEQ ID NO: 55385 - DNA, 19 bp, Homo sapiens
tgagtgagtttatcagatg

SEQ ID NO: 55386 - DNA, 21 bp, Homo sapiens
tgggttggctttctggacatg

SEQ ID NO: 55387 - DNA, 23 bp, Homo sapiens
tgagtgagttgtctttgattatg

SEQ ID NO: 55388 - DNA, 19 bp, Homo sapiens
atgacacctttccagtgga

SEQ ID NO: 55389 - DNA, 19 bp, Homo sapiens
tgaggagctccatggacat

SEQ ID NO: 55390 - DNA, 21 bp, Homo sapiens
tgagtgaggtaattggatatg

SEQ ID NO: 55391 - DNA, 23 bp, Homo sapiens
tgggtgagcatgctctggacatg

SEQ ID NO: 55392 - DNA, 18 bp, Homo sapiens
tgagtgagtttgggatat

SEQ ID NO: 55393 - DNA, 20 bp, Homo sapiens
gagtgggctttccagctcca

SEQ ID NO: 55394 - DNA, 64 bp, Leek white stripe virus
cccccaggcatattcaatagggacagtgttaatttactgtcgcatactgaattgtttgttgggg

SEQ ID NO: 55395 - DNA, 24 bp, Leek white stripe virus
tcgcatactgaattgtttgttggg

SEQ ID NO: 55396 - DNA, 18 bp, Homo sapiens
tactgaattgttatatgg

SEQ ID NO: 55397 - DNA, 20 bp, Homo sapiens
catgttgggttgtttattgg

SEQ ID NO: 55398 - DNA, 18 bp, Homo sapiens
tcccatactgaattgtgg

SEQ ID NO: 55399 - DNA, 16 bp, Homo sapiens
gcatactgagctctgg

SEQ ID NO: 55400 - DNA, 67 bp, Human adenovirus B
tgcgggggcaacatatccttcacccgccgctacctgctcttccaccacggggtgaacttcccccgca

SEQ ID NO: 55401 - DNA, 24 bp, Human adenovirus B
tccaccacggggtgaacttccccc

SEQ ID NO: 55402 - DNA, 19 bp, Homo sapiens
tcccccgtggtcttcttcc

SEQ ID NO: 55403 - DNA, 19 bp, Homo sapiens
tccctgccaagacttcccc

SEQ ID NO: 55404 - DNA, 18 bp, Homo sapiens
tccatcacagagttttcc

SEQ ID NO: 55405 - DNA, 26 bp, Homo sapiens
tctaccacaggcaaacagttttttcc

SEQ ID NO: 55406 - DNA, 26 bp, Homo sapiens
tctaccacaggcaaacagttttctcc

SEQ ID NO: 55407 - DNA, 21 bp, Homo sapiens
tcctgtcatgggggactcttc

SEQ ID NO: 55408 - DNA, 18 bp, Homo sapiens
accgtggggcgaaatccc

SEQ ID NO: 55409 - DNA, 18 bp, Homo sapiens
ccaagatgtgaacttccc

SEQ ID NO: 55410 - DNA, 21 bp, Homo sapiens
tccaccaccgcctccttcccc

SEQ ID NO: 55411 - DNA, 21 bp, Homo sapiens
tccaccactgaggcttctccc

SEQ ID NO: 55412 - DNA, 16 bp, Homo sapiens
tccgccacaaacttcc

SEQ ID NO: 55413 - DNA, 19 bp, Homo sapiens
tcggccgcggggtgaacct

SEQ ID NO: 55414 - DNA, 22 bp, Homo sapiens
tccttacggggtgggaccggcc

SEQ ID NO: 55415 - DNA, 18 bp, Homo sapiens
cccgtcacggggtgctcc

SEQ ID NO: 55416 - DNA, 22 bp, Homo sapiens
ccactggacatcaaacttcccc

SEQ ID NO: 55417 - DNA, 17 bp, Homo sapiens
tccaccatgggcctccc

SEQ ID NO: 55418 - DNA, 19 bp, Homo sapiens
tccccatggggcctcttcc

SEQ ID NO: 55419 - DNA, 20 bp, Homo sapiens
cacaggttgtgaactttccc

SEQ ID NO: 55420 - DNA, 19 bp, Homo sapiens
tctaccacgggggccttcc

SEQ ID NO: 55421 - DNA, 21 bp, Homo sapiens
caccgcgagtgtgcttccccc

SEQ ID NO: 55422 - DNA, 18 bp, Homo sapiens
cccatatgaacttcctcc

SEQ ID NO: 55423 - DNA, 19 bp, Homo sapiens
cacatgctgtgacttcccc

SEQ ID NO: 55424 - DNA, 22 bp, Homo sapiens
tccaccgcagtccccttccccc

SEQ ID NO: 55425 - DNA, 19 bp, Homo sapiens
tcctccacggaatttcccc

SEQ ID NO: 55426 - DNA, 18 bp, Homo sapiens
tccaacaccgaacttccc

SEQ ID NO: 55427 - DNA, 19 bp, Homo sapiens
tccccacaggactttcctc

SEQ ID NO: 55428 - DNA, 17 bp, Homo sapiens
tccacacggggctttcc

SEQ ID NO: 55429 - DNA, 21 bp, Homo sapiens
ccgttggaatgaagttttccc

SEQ ID NO: 55430 - DNA, 17 bp, Homo sapiens
ccatgatggtcttcccc

SEQ ID NO: 55431 - DNA, 20 bp, Homo sapiens
tccgttacgggacttcctcc

SEQ ID NO: 55432 - DNA, 22 bp, Homo sapiens
tccaccacgcgggtctgctccc

SEQ ID NO: 55433 - DNA, 18 bp, Homo sapiens
ccacgctgaactttcccc

SEQ ID NO: 55434 - DNA, 20 bp, Homo sapiens
tctgcccggggtgatggccc

SEQ ID NO: 55435 - DNA, 17 bp, Homo sapiens
ccttcaggaacttcccc

SEQ ID NO: 55436 - DNA, 18 bp, Homo sapiens
tccctacacataaacttc

SEQ ID NO: 55437 - DNA, 25 bp, Homo sapiens
tcctcacggggccaaatggtttccc

SEQ ID NO: 55438 - DNA, 18 bp, Homo sapiens
tccacccgtcgcttcccc

SEQ ID NO: 55439 - DNA, 18 bp, Homo sapiens
tccactacagtgaaactt

SEQ ID NO: 55440 - DNA, 17 bp, Homo sapiens
tccaccacggggggtcc

SEQ ID NO: 55441 - DNA, 17 bp, Homo sapiens
cccaccacacaaacttc

SEQ ID NO: 55442 - DNA, 15 bp, Homo sapiens
accaagataacttcc

SEQ ID NO: 55443 - DNA, 20 bp, Homo sapiens
tccaaataagggacttcccc

SEQ ID NO: 55444 - DNA, 24 bp, Homo sapiens
tccaattccctgtgaactttctcc

SEQ ID NO: 55445 - DNA, 22 bp, Homo sapiens
tccccacagaactgggtttccc

SEQ ID NO: 55446 - DNA, 20 bp, Homo sapiens
caccacgcagggcttccccc

SEQ ID NO: 55447 - DNA, 21 bp, Homo sapiens
ccactggcttgaatttctccc

SEQ ID NO: 55448 - DNA, 17 bp, Homo sapiens
tccatcaccaaacttcc

SEQ ID NO: 55449 - DNA, 18 bp, Homo sapiens
ccgcacaaggttttcccc

SEQ ID NO: 55450 - DNA, 23 bp, Homo sapiens
ccatctgggctaggacttccccc

SEQ ID NO: 55451 - DNA, 23 bp, Homo sapiens
ccaccacggggtgtgacacctcc

SEQ ID NO: 55452 - DNA, 18 bp, Homo sapiens
tccgccgcgggtgaactc

SEQ ID NO: 55453 - DNA, 68 bp, Human adenovirus B
tgtcttgcattactaccgtcacctccacagcccctattacagcccgcaagtctcggcagaaaaagaca

SEQ ID NO: 55454 - DNA, 24 bp, Human adenovirus B
cattactaccgtcacctccacagc

SEQ ID NO: 55455 - DNA, 20 bp, Homo sapiens
ttactggtgtcactccacag

SEQ ID NO: 55456 - DNA, 16 bp, Homo sapiens
ctacgccttccacagc

SEQ ID NO: 55457 - DNA, 18 bp, Homo sapiens
ctccgtcgcctccacagc

SEQ ID NO: 55458 - DNA, 21 bp, Homo sapiens
tcacgctgtcaccttcatagc

SEQ ID NO: 55459 - DNA, 18 bp, Homo sapiens
cattcctaccgtcacctc

SEQ ID NO: 55460 - DNA, 19 bp, Homo sapiens
atttctactttctccacag

SEQ ID NO: 55461 - DNA, 16 bp, Homo sapiens
cactccacctccacag

SEQ ID NO: 55462 - DNA, 19 bp, Homo sapiens
attactaccgtatgtccac

SEQ ID NO: 55463 - DNA, 18 bp, Homo sapiens
cctccagcatctccacag

SEQ ID NO: 55464 - DNA, 21 bp, Homo sapiens
cactacacacatctccacagc

SEQ ID NO: 55465 - DNA, 18 bp, Homo sapiens
tcactgttgtcccacagc

SEQ ID NO: 55466 - DNA, 25 bp, Homo sapiens
cattactactgtatcataggacagc

SEQ ID NO: 55467 - DNA, 19 bp, Homo sapiens
ccaatcttacctccacagc

SEQ ID NO: 55468 - DNA, 23 bp, Homo sapiens
cactgccttctcgcctccacagc

SEQ ID NO: 55469 - DNA, 17 bp, Homo sapiens
ctgccgcagcccacagc

SEQ ID NO: 55470 - DNA, 21 bp, Homo sapiens
tacacagttcatttccacagc

SEQ ID NO: 55471 - DNA, 61 bp, Gallid herpesvirus 2
gttgtactgaaattcgtgagtaatatataaaaccataatgcaatagatcattcagtaaaac

SEQ ID NO: 55472 - DNA, 23 bp, Gallid herpesvirus 2
tgcaatagatcattcagtaaaac

SEQ ID NO: 55473 - DNA, 19 bp, Homo sapiens
tgcaacaggtcatgttcaa

SEQ ID NO: 55474 - DNA, 20 bp, Homo sapiens
tgcaacagatcactaaataa

SEQ ID NO: 55475 - DNA, 18 bp, Homo sapiens
tgcaatgaaacagtaaaa

SEQ ID NO: 55476 - DNA, 18 bp, Homo sapiens
acagtacaatcagtaaaa

SEQ ID NO: 55477 - DNA, 22 bp, Homo sapiens
gcatacaatcatttagtaaaac

SEQ ID NO: 55478 - DNA, 16 bp, Homo sapiens
tagatcatcagaaaac

SEQ ID NO: 55479 - DNA, 22 bp, Homo sapiens
gcttggtattattcagtaaaac

SEQ ID NO: 55480 - DNA, 19 bp, Homo sapiens
tgcaaagatcatttgtaaa

SEQ ID NO: 55481 - DNA, 17 bp, Homo sapiens
tgcaaaatcattagtaa

SEQ ID NO: 55482 - DNA, 16 bp, Homo sapiens
tgcagagatcaccagc

SEQ ID NO: 55483 - DNA, 18 bp, Homo sapiens
tgcaatagttcacaaagt

SEQ ID NO: 55484 - DNA, 18 bp, Homo sapiens
tagacagattcagtaaaa

SEQ ID NO: 55485 - DNA, 18 bp, Homo sapiens
tgcaataatccataaagc

SEQ ID NO: 55486 - DNA, 17 bp, Homo sapiens
caatagttccagtaaaa

SEQ ID NO: 55487 - DNA, 23 bp, Homo sapiens
tgcagaggacagggcagtaaaac

SEQ ID NO: 55488 - DNA, 20 bp, Homo sapiens
tacaatagattgcagcaaaa

SEQ ID NO: 55489 - DNA, 15 bp, Homo sapiens
tgcaataatcagtaa

SEQ ID NO: 55490 - DNA, 17 bp, Homo sapiens
tggaataaatcttcagt

SEQ ID NO: 55491 - DNA, 20 bp, Homo sapiens
tgcaaagggttcagtaaaac

SEQ ID NO: 55492 - DNA, 19 bp, Homo sapiens
caatagatcattgagagaa

SEQ ID NO: 55493 - DNA, 16 bp, Homo sapiens
tgcagtaaatcacagt

SEQ ID NO: 55494 - DNA, 18 bp, Homo sapiens
tgcaataggacaataaaa

SEQ ID NO: 55495 - DNA, 20 bp, Homo sapiens
tgtaatagaccattagaaaa

SEQ ID NO: 55496 - DNA, 20 bp, Homo sapiens
tgcagtgggcattcagtaaa

SEQ ID NO: 55497 - DNA, 15 bp, Homo sapiens
tagattcagtaaaac

SEQ ID NO: 55498 - DNA, 18 bp, Homo sapiens
tgcatagatcataaaaaa

SEQ ID NO: 55499 - DNA, 19 bp, Homo sapiens
tacaataggtcactgaagc

SEQ ID NO: 55500 - DNA, 21 bp, Homo sapiens
tacaatgggccccagtaaaac

SEQ ID NO: 55501 - DNA, 19 bp, Homo sapiens
tacgatagatcatttcaat

SEQ ID NO: 55502 - DNA, 84 bp, Ovine pulmonary adenocarcinoma virus
agggacctctgattctcctgtgacgcatgccgatcctatcgattggaaatctgaggaaccggtatgggtcgatcagtggcccct

SEQ ID NO: 55503 - DNA, 24 bp, Ovine pulmonary adenocarcinoma virus
tgaggaaccggtatgggtcgatca

SEQ ID NO: 55504 - DNA, 19 bp, Homo sapiens
gaggccgaggcaggtcgat

SEQ ID NO: 55505 - DNA, 22 bp, Homo sapiens
tgggggtccggtatgcacctcg

SEQ ID NO: 55506 - DNA, 18 bp, Homo sapiens
tgagaagatgatgggtcg

SEQ ID NO: 55507 - DNA, 21 bp, Homo sapiens
tgaggaaccgagtgtgtccac

SEQ ID NO: 55508 - DNA, 21 bp, Homo sapiens
tggggaagccgatgttggtca

SEQ ID NO: 55509 - DNA, 16 bp, Homo sapiens
tgaggaactggtgggt

SEQ ID NO: 55510 - DNA, 18 bp, Homo sapiens
tggggagccagtatatca

SEQ ID NO: 55511 - DNA, 21 bp, Homo sapiens
tggggaaccgagtgtgtccac

SEQ ID NO: 55512 - DNA, 21 bp, Homo sapiens
tgaggaactgagtgtgtccac

SEQ ID NO: 55513 - DNA, 66 bp, Ectromelia virus
accacatgacaatgaacaaacctaagacagattatgctttatgcttgttgtgttgtaatatgtggt

SEQ ID NO: 55514 - DNA, 24 bp, Ectromelia virus
catgacaatgaacaaacctaagac

SEQ ID NO: 55515 - DNA, 21 bp, Homo sapiens
catgaaaaaacaaacctaaga

SEQ ID NO: 55516 - DNA, 21 bp, Homo sapiens
atgagaatgaacaggaacaag

SEQ ID NO: 55517 - DNA, 17 bp, Homo sapiens
ataacataaaacctaag

SEQ ID NO: 55518 - DNA, 17 bp, Homo sapiens
catacagtgaacaaacc

SEQ ID NO: 55519 - DNA, 23 bp, Homo sapiens
tgacttacgtgcaaacctaagac

SEQ ID NO: 55520 - DNA, 21 bp, Homo sapiens
atgataataaacataaaagac

SEQ ID NO: 55521 - DNA, 19 bp, Homo sapiens
tgaaaggtaaacctaagac

SEQ ID NO: 55522 - DNA, 21 bp, Homo sapiens
tgggcataagcaaacctaaga

SEQ ID NO: 55523 - DNA, 18 bp, Homo sapiens
tgacaatggacaacgcct

SEQ ID NO: 55524 - DNA, 21 bp, Homo sapiens
atgataatgaacaagtgaaag

SEQ ID NO: 55525 - DNA, 20 bp, Homo sapiens
tgacaatgagcagacaatag

SEQ ID NO: 55526 - DNA, 18 bp, Homo sapiens
atgacagtaacctaagac

SEQ ID NO: 55527 - DNA, 21 bp, Homo sapiens
atggtgatgacaaaccccaga

SEQ ID NO: 55528 - DNA, 24 bp, Homo sapiens
catgacaactgaataattagaaga

SEQ ID NO: 55529 - DNA, 22 bp, Homo sapiens
atgataatgaacatgtgaaaga

SEQ ID NO: 55530 - DNA, 23 bp, Homo sapiens
tgacaataagtaaacttcgagac

SEQ ID NO: 55531 - DNA, 21 bp, Homo sapiens
atgacaatgatgacacagaga

SEQ ID NO: 55532 - DNA, 17 bp, Homo sapiens
acaccgaaacctaagac

SEQ ID NO: 55533 - DNA, 19 bp, Homo sapiens
catgacaatgtaccccaag

SEQ ID NO: 55534 - DNA, 21 bp, Homo sapiens
catcacaccaaaacctaagac

SEQ ID NO: 55535 - DNA, 25 bp, Homo sapiens
tgacaatgatgctacaatctgggac

SEQ ID NO: 55536 - DNA, 16 bp, Homo sapiens
gacaataaacctgaga

SEQ ID NO: 55537 - DNA, 66 bp, Meleagrid herpesvirus 1
gccgcagctcacatgccgccttccgcgcttgcctaggcgcgagtgtgagaggaggcgggttgcggc

SEQ ID NO: 55538 - DNA, 21 bp, Meleagrid herpesvirus 1
tgagaggaggcgggttgcggc

SEQ ID NO: 55539 - DNA, 20 bp, Homo sapiens
agaggaggggcccctgtggc

SEQ ID NO: 55540 - DNA, 17 bp, Homo sapiens
tgagaggacgcgttggg

SEQ ID NO: 55541 - DNA, 17 bp, Homo sapiens
gagaggagggaaggtgg

SEQ ID NO: 55542 - DNA, 16 bp, Homo sapiens
tgagagaaggtcccgg

SEQ ID NO: 55543 - DNA, 17 bp, Homo sapiens
gagaggaggcggagcgg

SEQ ID NO: 55544 - DNA, 19 bp, Homo sapiens
cgggaggaggcagggtggc

SEQ ID NO: 55545 - DNA, 19 bp, Homo sapiens
aagcggggtgggttgtggc

SEQ ID NO: 55546 - DNA, 16 bp, Homo sapiens
tgaggggagggggtgg

SEQ ID NO: 55547 - DNA, 19 bp, Homo sapiens
tgagaggaggtggcttggc

SEQ ID NO: 55548 - DNA, 20 bp, Homo sapiens
tgagaggaggcgtgaggggc

SEQ ID NO: 55549 - DNA, 17 bp, Homo sapiens
tgagtggaggccagtgg

SEQ ID NO: 55550 - DNA, 16 bp, Homo sapiens
tgagaggaggctggac

SEQ ID NO: 55551 - DNA, 16 bp, Homo sapiens
cgggaggaggcggggc

SEQ ID NO: 55552 - DNA, 18 bp, Homo sapiens
tgagaggagcggaagagc

SEQ ID NO: 55553 - DNA, 16 bp, Homo sapiens
tgagaggagggttcgg

SEQ ID NO: 55554 - DNA, 18 bp, Homo sapiens
gagaggaggcggcgaggc

SEQ ID NO: 55555 - DNA, 18 bp, Homo sapiens
tgagaggagggcagaggc

SEQ ID NO: 55556 - DNA, 20 bp, Homo sapiens
gaggaggcggagggagcggc

SEQ ID NO: 55557 - DNA, 19 bp, Homo sapiens
tgagcggagccgattgcgg

SEQ ID NO: 55558 - DNA, 19 bp, Homo sapiens
tgaggggatgaggttgcgg

SEQ ID NO: 55559 - DNA, 17 bp, Homo sapiens
gagaggcgggggggcgg

SEQ ID NO: 55560 - DNA, 18 bp, Homo sapiens
gagggagggccgggtggc

SEQ ID NO: 55561 - DNA, 18 bp, Homo sapiens
gagaggtgagattgcggc

SEQ ID NO: 55562 - DNA, 19 bp, Homo sapiens
tgagaggaaggtgttaggc

SEQ ID NO: 55563 - DNA, 20 bp, Homo sapiens
tggaggaggtggcccagggc

SEQ ID NO: 55564 - DNA, 18 bp, Homo sapiens
gagaggcgggcgatgggc

SEQ ID NO: 55565 - DNA, 18 bp, Homo sapiens
tggaggaggcctaagctg

SEQ ID NO: 55566 - DNA, 21 bp, Homo sapiens
tgggagcaggcgggtcctggc

SEQ ID NO: 55567 - DNA, 23 bp, Homo sapiens
tgggaggaggcggggaggaaggc

SEQ ID NO: 55568 - DNA, 19 bp, Homo sapiens
tgagggaaggcggcggggc

SEQ ID NO: 55569 - DNA, 18 bp, Homo sapiens
gagggggtggagctgcgg

SEQ ID NO: 55570 - DNA, 18 bp, Homo sapiens
gaggggaggcgacttggc

SEQ ID NO: 55571 - DNA, 21 bp, Homo sapiens
gagaggaggcggaaggagggc

SEQ ID NO: 55572 - DNA, 16 bp, Homo sapiens
tgaggggagacggggc

SEQ ID NO: 55573 - DNA, 20 bp, Homo sapiens
tgagaggatgtgggtctcgg

SEQ ID NO: 55574 - DNA, 19 bp, Homo sapiens
gagaagtcgaggttgcggc

SEQ ID NO: 55575 - DNA, 19 bp, Homo sapiens
tgagagagggcggggaggc

SEQ ID NO: 55576 - DNA, 18 bp, Homo sapiens
tgagaggaggtgtggggc

SEQ ID NO: 55577 - DNA, 21 bp, Homo sapiens
tgggaggaagccatgcctggc

SEQ ID NO: 55578 - DNA, 18 bp, Homo sapiens
tgcaggggagggggcggc

SEQ ID NO: 55579 - DNA, 18 bp, Homo sapiens
gagaggagagcctgcggc

SEQ ID NO: 55580 - DNA, 17 bp, Homo sapiens
tgagaggcaggcggtgc

SEQ ID NO: 55581 - DNA, 17 bp, Homo sapiens
gagggggcggctgcggc

SEQ ID NO: 55582 - DNA, 18 bp, Homo sapiens
gagaggagggctagtggc

SEQ ID NO: 55583 - DNA, 17 bp, Homo sapiens
gaggggaggcggcgggc

SEQ ID NO: 55584 - DNA, 15 bp, Homo sapiens
tgaaggaggcggggg

SEQ ID NO: 55585 - DNA, 16 bp, Homo sapiens
cgggaggaggcggggg

SEQ ID NO: 55586 - DNA, 19 bp, Homo sapiens
gagagggggcgaagacggc

SEQ ID NO: 55587 - DNA, 17 bp, Homo sapiens
gaggggcaggaggcggc

SEQ ID NO: 55588 - DNA, 17 bp, Homo sapiens
tggaggaggcgggaagc

SEQ ID NO: 55589 - DNA, 15 bp, Homo sapiens
gaggggcactgcggc

SEQ ID NO: 55590 - DNA, 19 bp, Homo sapiens
gagaggaggcttggatggc

SEQ ID NO: 55591 - DNA, 16 bp, Homo sapiens
agggaggggggcgcgg

SEQ ID NO: 55592 - DNA, 20 bp, Homo sapiens
agaggaggtactgctgtggc

SEQ ID NO: 55593 - DNA, 22 bp, Homo sapiens
tgggaggaggcaggcttgtggc

SEQ ID NO: 55594 - DNA, 20 bp, Homo sapiens
tgagagaggcggatgaaggc

SEQ ID NO: 55595 - DNA, 17 bp, Homo sapiens
tgagagggaggccacgg

SEQ ID NO: 55596 - DNA, 19 bp, Homo sapiens
gaggggaggcgggaagggc

SEQ ID NO: 55597 - DNA, 20 bp, Homo sapiens
gagaggagggagcatgcggc

SEQ ID NO: 55598 - DNA, 15 bp, Homo sapiens
gagaggagcctgcgg

SEQ ID NO: 55599 - DNA, 19 bp, Homo sapiens
gagagcgagccgttgtggc

SEQ ID NO: 55600 - DNA, 15 bp, Homo sapiens
tggaggaggcggcgg

SEQ ID NO: 55601 - DNA, 18 bp, Homo sapiens
tgagaggcagggagtggc

SEQ ID NO: 55602 - DNA, 17 bp, Homo sapiens
tgagaagagcactgtgg

SEQ ID NO: 55603 - DNA, 17 bp, Homo sapiens
tgggagaggcaatgtgg

SEQ ID NO: 55604 - DNA, 17 bp, Homo sapiens
tgagacggggcgggcgg

SEQ ID NO: 55605 - DNA, 20 bp, Homo sapiens
cgggaggaggcggggaaagc

SEQ ID NO: 55606 - DNA, 18 bp, Homo sapiens
gaggggaggcgagggggc

SEQ ID NO: 55607 - DNA, 16 bp, Homo sapiens
tgagggaggcggcggg

SEQ ID NO: 55608 - DNA, 18 bp, Homo sapiens
ggagggggttgcaagggc

SEQ ID NO: 55609 - DNA, 23 bp, Homo sapiens
tgggaggcaggcgggaacttggc

SEQ ID NO: 55610 - DNA, 18 bp, Homo sapiens
gagaggaggtggggtggc

SEQ ID NO: 55611 - DNA, 22 bp, Homo sapiens
cgggaggaggcggggagggggc

SEQ ID NO: 55612 - DNA, 20 bp, Homo sapiens
cgggaggaggcgccctgggc

SEQ ID NO: 55613 - DNA, 20 bp, Homo sapiens
gaggaggcggaacccgcggc

SEQ ID NO: 55614 - DNA, 16 bp, Homo sapiens
tgagaggaggggctgc

SEQ ID NO: 55615 - DNA, 16 bp, Homo sapiens
tgagaggagtcggggc

SEQ ID NO: 55616 - DNA, 15 bp, Homo sapiens
tgaaggaggcggggc

SEQ ID NO: 55617 - DNA, 17 bp, Homo sapiens
tgaaaggaggctggtgg

SEQ ID NO: 55618 - DNA, 19 bp, Homo sapiens
tgggaggagacgccacggc

SEQ ID NO: 55619 - DNA, 15 bp, Homo sapiens
tgagagaggcaacgg

SEQ ID NO: 55620 - DNA, 19 bp, Homo sapiens
tggaggaggtggccgcggc

SEQ ID NO: 55621 - DNA, 21 bp, Homo sapiens
tggaggaggcagcaactgtgg

SEQ ID NO: 55622 - DNA, 20 bp, Homo sapiens
tgggaggaggcagtgtaggc

SEQ ID NO: 55623 - DNA, 20 bp, Homo sapiens
tgagaggcggcggagtaggc

SEQ ID NO: 55624 - DNA, 17 bp, Homo sapiens
tgatggggggatcgcgg

SEQ ID NO: 55625 - DNA, 21 bp, Homo sapiens
tgagggaaggcggggacaggc

SEQ ID NO: 55626 - DNA, 16 bp, Homo sapiens
tgacaggaggcggagc

SEQ ID NO: 55627 - DNA, 17 bp, Homo sapiens
tgagaggagggggaggc

SEQ ID NO: 55628 - DNA, 22 bp, Homo sapiens
tgggagcaggccctggggtggc

SEQ ID NO: 55629 - DNA, 20 bp, Homo sapiens
tgaaaggactttattgtggc

SEQ ID NO: 55630 - DNA, 15 bp, Homo sapiens
tgagggaggcgaggg

SEQ ID NO: 55631 - DNA, 20 bp, Homo sapiens
tgggaggaggcgcccgctgg

SEQ ID NO: 55632 - DNA, 17 bp, Homo sapiens
tgggaggaggaggttgc

SEQ ID NO: 55633 - DNA, 18 bp, Homo sapiens
tgagaggaggtgagtggc

SEQ ID NO: 55634 - DNA, 18 bp, Homo sapiens
agaggcaagctgttgcgg

SEQ ID NO: 55635 - DNA, 19 bp, Homo sapiens
tgggaggagactcagtggc

SEQ ID NO: 55636 - DNA, 19 bp, Homo sapiens
tgagaggagcgtccgccgg

SEQ ID NO: 55637 - DNA, 19 bp, Homo sapiens
cgggaggtggaggttgcgg

SEQ ID NO: 55638 - DNA, 16 bp, Homo sapiens
tgggaggaggcaggac

SEQ ID NO: 55639 - DNA, 15 bp, Homo sapiens
tggaggaggcggggc

SEQ ID NO: 55640 - DNA, 21 bp, Homo sapiens
tgagaggagcctctgggcggc

SEQ ID NO: 55641 - DNA, 19 bp, Homo sapiens
tgagaggaggcgctctggc

SEQ ID NO: 55642 - DNA, 19 bp, Homo sapiens
tgagaggaggagaggaggc

SEQ ID NO: 55643 - DNA, 21 bp, Homo sapiens
gagagggggtgctgggggcgg

SEQ ID NO: 55644 - DNA, 16 bp, Homo sapiens
tgagaggagcggctgc

SEQ ID NO: 55645 - DNA, 21 bp, Homo sapiens
tgagaggaggtgagaaggagc

SEQ ID NO: 55646 - DNA, 20 bp, Homo sapiens
tgagaagaggccaacctggc

SEQ ID NO: 55647 - DNA, 16 bp, Homo sapiens
agggaggaggctgcgg

SEQ ID NO: 55648 - DNA, 16 bp, Homo sapiens
tgggaggaggcggcgc

SEQ ID NO: 55649 - DNA, 20 bp, Homo sapiens
tgagaagaggtcagaatggc

SEQ ID NO: 55650 - DNA, 18 bp, Homo sapiens
tgagaggaggaggcaggc

SEQ ID NO: 55651 - DNA, 16 bp, Homo sapiens
tgagaggtgactgcgg

SEQ ID NO: 55652 - DNA, 16 bp, Homo sapiens
tgagaggaggggaagc

SEQ ID NO: 55653 - DNA, 18 bp, Homo sapiens
ggagggggtcaccgcggc

SEQ ID NO: 55654 - DNA, 20 bp, Homo sapiens
taaggggaggcagatgcggc

SEQ ID NO: 55655 - DNA, 19 bp, Homo sapiens
tgagcaggaggtggaaggc

SEQ ID NO: 55656 - DNA, 17 bp, Homo sapiens
gaggggaggcggccggc

SEQ ID NO: 55657 - DNA, 18 bp, Homo sapiens
tggaggagacatttgtgg

SEQ ID NO: 55658 - DNA, 15 bp, Homo sapiens
tgaaggaggcgaggc

SEQ ID NO: 55659 - DNA, 17 bp, Homo sapiens
tgagaggaagaaggtgg

SEQ ID NO: 55660 - DNA, 25 bp, Homo sapiens
tgagaggaagtgggaaagaatgcgg

SEQ ID NO: 55661 - DNA, 18 bp, Homo sapiens
agaggaggcgagagcggc

SEQ ID NO: 55662 - DNA, 19 bp, Homo sapiens
tgggaggaggcggccaggg

SEQ ID NO: 55663 - DNA, 20 bp, Homo sapiens
tgagagcagcaagttgtggc

SEQ ID NO: 55664 - DNA, 18 bp, Homo sapiens
tgacagcactggttgcgg

SEQ ID NO: 55665 - DNA, 15 bp, Homo sapiens
gagaggaggccacgg

SEQ ID NO: 55666 - DNA, 18 bp, Homo sapiens
aggaggcggaggttgcgg

SEQ ID NO: 55667 - DNA, 20 bp, Homo sapiens
tgaaaggaggttttattggc

SEQ ID NO: 55668 - DNA, 20 bp, Homo sapiens
tgggatgaggcggagtttgg

SEQ ID NO: 55669 - DNA, 19 bp, Homo sapiens
tgggaggaagcctcatggc

SEQ ID NO: 55670 - DNA, 15 bp, Homo sapiens
tggaggaggcggtgc

SEQ ID NO: 55671 - DNA, 18 bp, Homo sapiens
tggaggaggcggcccagc

SEQ ID NO: 55672 - DNA, 18 bp, Homo sapiens
tgatgggaggcgagtcgg

SEQ ID NO: 55673 - DNA, 16 bp, Homo sapiens
tggaggaggcgctggg

SEQ ID NO: 55674 - DNA, 18 bp, Homo sapiens
gagaggggggccacgcgg

SEQ ID NO: 55675 - DNA, 19 bp, Homo sapiens
tgagaggaagggcctgtgg

SEQ ID NO: 55676 - DNA, 19 bp, Homo sapiens
gaggggaggtggactaggc

SEQ ID NO: 55677 - DNA, 19 bp, Homo sapiens
tgagggagggcgtcctggc

SEQ ID NO: 55678 - DNA, 16 bp, Homo sapiens
agagggcagattgtgg

SEQ ID NO: 55679 - DNA, 20 bp, Homo sapiens
tggcaggaggcggcaccacg

SEQ ID NO: 55680 - DNA, 18 bp, Homo sapiens
tgagagagggagctgtgg

SEQ ID NO: 55681 - DNA, 20 bp, Homo sapiens
tgagaggcagacctgtgtgg

SEQ ID NO: 55682 - DNA, 19 bp, Homo sapiens
tgagacggaggaacgtggc

SEQ ID NO: 55683 - DNA, 24 bp, Homo sapiens
tgggaggaggtcggggagaggggc

SEQ ID NO: 55684 - DNA, 18 bp, Homo sapiens
tgagaggcaggtggatgc

SEQ ID NO: 55685 - DNA, 18 bp, Homo sapiens
aggcctagcgggttgcgg

SEQ ID NO: 55686 - DNA, 20 bp, Homo sapiens
gaggggcaggccaccttggc

SEQ ID NO: 55687 - DNA, 18 bp, Homo sapiens
gaggggaggcgggctggc

SEQ ID NO: 55688 - DNA, 19 bp, Homo sapiens
gagaggaggtgtcccaggc

SEQ ID NO: 55689 - DNA, 16 bp, Homo sapiens
gagaggaaggttgcgg

SEQ ID NO: 55690 - DNA, 18 bp, Homo sapiens
tgagaggaagtaactggc

SEQ ID NO: 55691 - DNA, 21 bp, Homo sapiens
tgcagaggcagctggttgtgg

SEQ ID NO: 55692 - DNA, 19 bp, Homo sapiens
cgggaggaggaggttgcgg

SEQ ID NO: 55693 - DNA, 89 bp, Chimpanzee cytomegalovirus
tcctcggcgccctcctggtctggatcggctccggtcttaacatcgtctggtggaccggcatggtactcctggccatggacgccctggga

SEQ ID NO: 55694 - DNA, 24 bp, Chimpanzee cytomegalovirus
gtggaccggcatggtactcctggc

SEQ ID NO: 55695 - DNA, 20 bp, Homo sapiens
gtggaccggcagggacctgg

SEQ ID NO: 55696 - DNA, 19 bp, Homo sapiens
ggctggggacactcctggc

SEQ ID NO: 55697 - DNA, 21 bp, Homo sapiens
gtggagtggcatgatcttggc

SEQ ID NO: 55698 - DNA, 21 bp, Homo sapiens
gtgggatggcatgatcttggc

SEQ ID NO: 55699 - DNA, 24 bp, Homo sapiens
gtggcctggtccttccctcctggc

SEQ ID NO: 55700 - DNA, 19 bp, Homo sapiens
gtggactgcataatcctgg

SEQ ID NO: 55701 - DNA, 18 bp, Homo sapiens
gtggagtggctttcctgg

SEQ ID NO: 55702 - DNA, 21 bp, Homo sapiens
gtggaatggcacgatcttggc

SEQ ID NO: 55703 - DNA, 18 bp, Homo sapiens
gtgggtggtggctcctgg

SEQ ID NO: 55704 - DNA, 19 bp, Homo sapiens
gactctacgtgctcctggc

SEQ ID NO: 55705 - DNA, 19 bp, Homo sapiens
gtgggctgcatggtagtgg

SEQ ID NO: 55706 - DNA, 18 bp, Homo sapiens
gtggccgagtactcctgg

SEQ ID NO: 55707 - DNA, 21 bp, Homo sapiens
ggactgaatttgtactcctgg

SEQ ID NO: 55708 - DNA, 23 bp, Homo sapiens
gtggatcgctcccgcctcctggc

SEQ ID NO: 55709 - DNA, 18 bp, Homo sapiens
gtggttggcatggtttgg

SEQ ID NO: 55710 - DNA, 21 bp, Homo sapiens
gtggctcaccgtgctcctggc

SEQ ID NO: 55711 - DNA, 21 bp, Homo sapiens
gtggtcttgggtgctcctggc

SEQ ID NO: 55712 - DNA, 19 bp, Homo sapiens
gcattggcacgatcttggc

SEQ ID NO: 55713 - DNA, 20 bp, Homo sapiens
tggttggcatgatcgctggc

SEQ ID NO: 55714 - DNA, 22 bp, Homo sapiens
gtggaactggaaacactcctgg

SEQ ID NO: 55715 - DNA, 22 bp, Homo sapiens
ggcgcctgatggtgctcctggc

SEQ ID NO: 55716 - DNA, 21 bp, Homo sapiens
gtgcactggcacgatcttggc

SEQ ID NO: 55717 - DNA, 21 bp, Homo sapiens
gtggctcggggagctcctggc

SEQ ID NO: 55718 - DNA, 24 bp, Homo sapiens
gtggcctggtccttcactcctggc

SEQ ID NO: 55719 - DNA, 67 bp, Chimpanzee cytomegalovirus
cgaatactccgagcttccgcctgtataaaataaagagattgggccgacctccgctctgagtgtctcg

SEQ ID NO: 55720 - DNA, 24 bp, Chimpanzee cytomegalovirus
actccgagcttccgcctgtataaa

SEQ ID NO: 55721 - DNA, 18 bp, Homo sapiens
gagtcagctctgtataaa

SEQ ID NO: 55722 - DNA, 20 bp, Homo sapiens
ctccgagcttccggaagcac

SEQ ID NO: 55723 - DNA, 21 bp, Homo sapiens
ccgagcaaggcactgtataaa

SEQ ID NO: 55724 - DNA, 19 bp, Homo sapiens
cttcgggctcccagccatg

SEQ ID NO: 55725 - DNA, 22 bp, Homo sapiens
tctgatctgacacctgtataaa

SEQ ID NO: 55726 - DNA, 19 bp, Homo sapiens
accccgagcttctgctccg

SEQ ID NO: 55727 - DNA, 18 bp, Homo sapiens
accctgagcactgtataa

SEQ ID NO: 55728 - DNA, 20 bp, Homo sapiens
ctcgagcttccgctgcccgc

SEQ ID NO: 55729 - DNA, 16 bp, Homo sapiens
gaacttgcctgtataa

SEQ ID NO: 55730 - DNA, 18 bp, Homo sapiens
ccccgagtttcacctgta

SEQ ID NO: 55731 - DNA, 17 bp, Homo sapiens
ctcgagcttcacctgta

SEQ ID NO: 55732 - DNA, 21 bp, Homo sapiens
actttagcttttgctatataa

SEQ ID NO: 55733 - DNA, 23 bp, Homo sapiens
actccagcttccgtcttctcctg

SEQ ID NO: 55734 - DNA, 20 bp, Homo sapiens
actttaagctttctatataa

SEQ ID NO: 55735 - DNA, 17 bp, Homo sapiens
aagcttcaacgtataaa

SEQ ID NO: 55736 - DNA, 17 bp, Homo sapiens
cttcgaacttccattgt

SEQ ID NO: 55737 - DNA, 18 bp, Homo sapiens
ctccagtgccctgtataa

SEQ ID NO: 55738 - DNA, 20 bp, Homo sapiens
caagatcctgtctgtataaa

SEQ ID NO: 55739 - DNA, 20 bp, Homo sapiens
ctctgaacttcctgaatgta

SEQ ID NO: 55740 - DNA, 18 bp, Homo sapiens
tccttactttgcctgtat

SEQ ID NO: 55741 - DNA, 125 bp, Rabbit fibroma virus
cgcgtattatacagtgttgtctgtttaagatagtaatatggtgtataagtataacgtgtaccaagattatccaactatatatcaacgattacgtaacctacgaataacattacttgtattacgcg

SEQ ID NO: 55742 - DNA, 24 bp, Rabbit fibroma virus
tatacagtgttgtctgtttaagat

SEQ ID NO: 55743 - DNA, 23 bp, Homo sapiens
tatacagtttgatacattaagat

SEQ ID NO: 55744 - DNA, 22 bp, Homo sapiens
tatacaagtgtccatttaagat

SEQ ID NO: 55745 - DNA, 21 bp, Homo sapiens
tataagtgttagttttaagat

SEQ ID NO: 55746 - DNA, 21 bp, Homo sapiens
catgatttgtctgtttgagat

SEQ ID NO: 55747 - DNA, 22 bp, Homo sapiens
tatacagttttgaggttaagat

SEQ ID NO: 55748 - DNA, 17 bp, Homo sapiens
tacagggcttctgttta

SEQ ID NO: 55749 - DNA, 21 bp, Homo sapiens
tatacagtgtgtcacatagat

SEQ ID NO: 55750 - DNA, 18 bp, Homo sapiens
cagtgttgtatataagat

SEQ ID NO: 55751 - DNA, 66 bp, African swine fever virus
ttacaataaaatttagtttaagtagtgctgcaatttctgcgctaaattcactatgatgttttgtaa

SEQ ID NO: 55752 - DNA, 24 bp, African swine fever virus
gctaaattcactatgatgttttgt

SEQ ID NO: 55753 - DNA, 19 bp, Homo sapiens
actaaattcattatttttg

SEQ ID NO: 55754 - DNA, 22 bp, Homo sapiens
gcagaattcagatctgttttgt

SEQ ID NO: 55755 - DNA, 21 bp, Homo sapiens
gctagattcctgacattttgt

SEQ ID NO: 55756 - DNA, 19 bp, Homo sapiens
gctaaatcactgtggtctg

SEQ ID NO: 55757 - DNA, 71 bp, Human herpesvirus 1
ggcccgagtctgcctggctgctgcgtctcgctccgagtgccgaggtgcaaatgcgaccagactgtcgggcc

SEQ ID NO: 55758 - DNA, 24 bp, Human herpesvirus 1
aggtgcaaatgcgaccagactgtc

SEQ ID NO: 55759 - DNA, 26 bp, Homo sapiens
aggtgcaaatgttccatcaggttgtc

SEQ ID NO: 55760 - DNA, 21 bp, Homo sapiens
aagtgcaaataaggggctgtc

SEQ ID NO: 55761 - DNA, 16 bp, Homo sapiens
ggtgcaaatgagactg

SEQ ID NO: 55762 - DNA, 21 bp, Homo sapiens
agggcactgggtcagactgtc

SEQ ID NO: 55763 - DNA, 19 bp, Homo sapiens
ggcccaagatcagactgtc

SEQ ID NO: 55764 - DNA, 20 bp, Homo sapiens
gatgcgagcttcagactgtc

SEQ ID NO: 55765 - DNA, 20 bp, Homo sapiens
gtgcaaatgccagcaactgt

SEQ ID NO: 55766 - DNA, 16 bp, Homo sapiens
aggttcagacagactg

SEQ ID NO: 55767 - DNA, 24 bp, Homo sapiens
aggtgcaagtgtggaaacagttgt

SEQ ID NO: 55768 - DNA, 17 bp, Homo sapiens
ggtccaggacagactgt

SEQ ID NO: 55769 - DNA, 75 bp, Human herpesvirus 1
cgtctctccggagagcggcttggtgcggagctcccgggagctccgcggaagacccaggccgcctcgggtgtaacg

SEQ ID NO: 55770 - DNA, 24 bp, Human herpesvirus 1
ctccggagagcggcttggtgcgga

SEQ ID NO: 55771 - DNA, 21 bp, Homo sapiens
ctcaggaggggacggtgcgga

SEQ ID NO: 55772 - DNA, 17 bp, Homo sapiens
ctccggagggaggtgca

SEQ ID NO: 55773 - DNA, 18 bp, Homo sapiens
ctccgggggatggcgcgg

SEQ ID NO: 55774 - DNA, 19 bp, Homo sapiens
tccggagagcgcgggctgg

SEQ ID NO: 55775 - DNA, 18 bp, Homo sapiens
ctccgggagcggctccgg

SEQ ID NO: 55776 - DNA, 23 bp, Homo sapiens
ctccggaggcggctgcagctgga

SEQ ID NO: 55777 - DNA, 17 bp, Homo sapiens
ggagggggcttgatgga

SEQ ID NO: 55778 - DNA, 19 bp, Homo sapiens
ggggagcttggcgtgtgga

SEQ ID NO: 55779 - DNA, 18 bp, Homo sapiens
ctccggcagggtgggcgg

SEQ ID NO: 55780 - DNA, 17 bp, Homo sapiens
ctctgagagcggcccgg

SEQ ID NO: 55781 - DNA, 19 bp, Homo sapiens
cctggggagcgggcggcgg

SEQ ID NO: 55782 - DNA, 17 bp, Homo sapiens
ctccggagagcggcggg

SEQ ID NO: 55783 - DNA, 18 bp, Homo sapiens
ctctggagtgcggcctgg

SEQ ID NO: 55784 - DNA, 20 bp, Homo sapiens
cggagagcccccgggtgtgg

SEQ ID NO: 55785 - DNA, 18 bp, Homo sapiens
ctccgcggggtggtgcgg

SEQ ID NO: 55786 - DNA, 18 bp, Homo sapiens
ctccagggagcggcctgg

SEQ ID NO: 55787 - DNA, 19 bp, Homo sapiens
ctctgaggagcggctgcgg

SEQ ID NO: 55788 - DNA, 16 bp, Homo sapiens
ctccgggggcggtacg

SEQ ID NO: 55789 - DNA, 18 bp, Homo sapiens
tccggagaggcggctcgg

SEQ ID NO: 55790 - DNA, 18 bp, Homo sapiens
tcgggagagcggggcggg

SEQ ID NO: 55791 - DNA, 19 bp, Homo sapiens
cggaaggtggctttcacgg

SEQ ID NO: 55792 - DNA, 21 bp, Homo sapiens
tcctgggagtacatggtgcgg

SEQ ID NO: 55793 - DNA, 17 bp, Homo sapiens
ctccggagggcgccggg

SEQ ID NO: 55794 - DNA, 18 bp, Homo sapiens
ctccggaggtggctgtgg

SEQ ID NO: 55795 - DNA, 24 bp, Homo sapiens
ctcccgagaggctagtggtgcgga

SEQ ID NO: 55796 - DNA, 17 bp, Homo sapiens
ctcggggagcggccggg

SEQ ID NO: 55797 - DNA, 19 bp, Homo sapiens
ctccggaaggcggcgccgg

SEQ ID NO: 55798 - DNA, 17 bp, Homo sapiens
ctctgaagagtgggtgg

SEQ ID NO: 55799 - DNA, 20 bp, Homo sapiens
ctccggagggctgaagtggg

SEQ ID NO: 55800 - DNA, 18 bp, Homo sapiens
ctccagggagcggcgcgg

SEQ ID NO: 55801 - DNA, 16 bp, Homo sapiens
ggggagcggccatggg

SEQ ID NO: 55802 - DNA, 21 bp, Homo sapiens
cctggagggtgcaggtgtgga

SEQ ID NO: 55803 - DNA, 19 bp, Homo sapiens
ctccgagggcggcccatgg

SEQ ID NO: 55804 - DNA, 20 bp, Homo sapiens
gggactgagcttggtgtgga

SEQ ID NO: 55805 - DNA, 19 bp, Homo sapiens
tccggaagcggcggcgcgg

SEQ ID NO: 55806 - DNA, 21 bp, Homo sapiens
ggagggtggggccagtgtgga

SEQ ID NO: 55807 - DNA, 71 bp, Human herpesvirus 1
ggcccgacagtctggtcgcatttgcacctcggcactcggagcgagacgcagcagccaggcagactcgggcc

SEQ ID NO: 55808 - DNA, 24 bp, Human herpesvirus 1
acgcagcagccaggcagactcggg

SEQ ID NO: 55809 - DNA, 24 bp, Homo sapiens
cgcgggggccgggcgttcagaggg

SEQ ID NO: 55810 - DNA, 18 bp, Homo sapiens
gcggcggcgaggactcgg

SEQ ID NO: 55811 - DNA, 21 bp, Homo sapiens
gcagcagctccgccactcggg

SEQ ID NO: 55812 - DNA, 22 bp, Homo sapiens
agcagcttctggcgggctcggg

SEQ ID NO: 55813 - DNA, 19 bp, Homo sapiens
gcagcagccgggattgagg

SEQ ID NO: 55814 - DNA, 21 bp, Homo sapiens
gccgcagccagcaggcttggg

SEQ ID NO: 55815 - DNA, 22 bp, Homo sapiens
cgcagttggacgcaggctcggg

SEQ ID NO: 55816 - DNA, 19 bp, Homo sapiens
gcagcagttggcagtgcgg

SEQ ID NO: 55817 - DNA, 20 bp, Homo sapiens
cgcagcagctgggaaccggg

SEQ ID NO: 55818 - DNA, 20 bp, Homo sapiens
gcatggtaccgggactcggg

SEQ ID NO: 55819 - DNA, 19 bp, Homo sapiens
cagcagccaggcgtctggg

SEQ ID NO: 55820 - DNA, 22 bp, Homo sapiens
acgtggagccaggcagtgctgg

SEQ ID NO: 55821 - DNA, 16 bp, Homo sapiens
gcagccaggctctggg

SEQ ID NO: 55822 - DNA, 18 bp, Homo sapiens
gcagtggccaggcagcag

SEQ ID NO: 55823 - DNA, 21 bp, Homo sapiens
acccagtggtcaggcagaggg

SEQ ID NO: 55824 - DNA, 21 bp, Homo sapiens
gcagcagcacaggtggacagg

SEQ ID NO: 55825 - DNA, 15 bp, Homo sapiens
gcagccaggacccgg

SEQ ID NO: 55826 - DNA, 19 bp, Homo sapiens
gcagccaggcagacttggg

SEQ ID NO: 55827 - DNA, 18 bp, Homo sapiens
gcagaccgggcactcggg

SEQ ID NO: 55828 - DNA, 19 bp, Homo sapiens
cagtggccaggcagcttgg

SEQ ID NO: 55829 - DNA, 20 bp, Homo sapiens
cgcagcagcagggactcggg

SEQ ID NO: 55830 - DNA, 20 bp, Homo sapiens
gcggctgccggggactcggg

SEQ ID NO: 55831 - DNA, 19 bp, Homo sapiens
acgtggcaccaggtgccag

SEQ ID NO: 55832 - DNA, 21 bp, Homo sapiens
gcagcagccagggctgccggg

SEQ ID NO: 55833 - DNA, 19 bp, Homo sapiens
gcagcagccaggcggctgg

SEQ ID NO: 55834 - DNA, 18 bp, Homo sapiens
acgcagcatccatttcgg

SEQ ID NO: 55835 - DNA, 21 bp, Homo sapiens
gcagcagcccaaagcctcggg

SEQ ID NO: 55836 - DNA, 20 bp, Homo sapiens
gcagcagccggccacacagg

SEQ ID NO: 55837 - DNA, 19 bp, Homo sapiens
gcacagctggggactcggg

SEQ ID NO: 55838 - DNA, 22 bp, Homo sapiens
cagcagccaggacaggctcggg

SEQ ID NO: 55839 - DNA, 23 bp, Homo sapiens
gccggcggccaggcaggaacggg

SEQ ID NO: 55840 - DNA, 18 bp, Homo sapiens
agcagccaggtgacatgg

SEQ ID NO: 55841 - DNA, 18 bp, Homo sapiens
gcagcagccgggtgatgg

SEQ ID NO: 55842 - DNA, 22 bp, Homo sapiens
gcatggtagccaggcagactag

SEQ ID NO: 55843 - DNA, 19 bp, Homo sapiens
cgcagcagctggcagccag

SEQ ID NO: 55844 - DNA, 21 bp, Homo sapiens
gcagcagaccaagggcttggg

SEQ ID NO: 55845 - DNA, 21 bp, Homo sapiens
gcgcgggccagcggactcggg

SEQ ID NO: 55846 - DNA, 15 bp, Homo sapiens
acgcgcagccaggcg

SEQ ID NO: 55847 - DNA, 20 bp, Homo sapiens
gcgcagctgctggactcggg

SEQ ID NO: 55848 - DNA, 18 bp, Homo sapiens
gcggccaatggactcggg

SEQ ID NO: 55849 - DNA, 19 bp, Homo sapiens
gctggcagccaggacctgg

SEQ ID NO: 55850 - DNA, 22 bp, Homo sapiens
acagcaggaaggtggacttggg

SEQ ID NO: 55851 - DNA, 17 bp, Homo sapiens
cgcagcagccggtctgg

SEQ ID NO: 55852 - DNA, 19 bp, Homo sapiens
gcagcagccgcccctcggg

SEQ ID NO: 55853 - DNA, 19 bp, Homo sapiens
acgcagcagcgcaggccgg

SEQ ID NO: 55854 - DNA, 21 bp, Homo sapiens
acagcagcagggagactcggg

SEQ ID NO: 55855 - DNA, 22 bp, Homo sapiens
acgcagcgcccaggcagtcaga

SEQ ID NO: 55856 - DNA, 20 bp, Homo sapiens
gcagcagctgggaccctggg

SEQ ID NO: 55857 - DNA, 22 bp, Homo sapiens
acgcagcagccagttctgcggg

SEQ ID NO: 55858 - DNA, 21 bp, Homo sapiens
agcagccaggcgggctccggg

SEQ ID NO: 55859 - DNA, 23 bp, Homo sapiens
cacagcagccgtccaggctcggg

SEQ ID NO: 55860 - DNA, 18 bp, Homo sapiens
gcagcagcgacggctcgg

SEQ ID NO: 55861 - DNA, 16 bp, Homo sapiens
agcagccacagcttgg

SEQ ID NO: 55862 - DNA, 18 bp, Homo sapiens
cgcagcgccaggcagtgg

SEQ ID NO: 55863 - DNA, 19 bp, Homo sapiens
acgtggagccaggctgagg

SEQ ID NO: 55864 - DNA, 17 bp, Homo sapiens
gcagcagcacctctcgg

SEQ ID NO: 55865 - DNA, 25 bp, Homo sapiens
acgcaagcagagcggtaggctcggg

SEQ ID NO: 55866 - DNA, 19 bp, Homo sapiens
acagtggccttgactcggg

SEQ ID NO: 55867 - DNA, 19 bp, Homo sapiens
cagcagccaggcccccagg

SEQ ID NO: 55868 - DNA, 19 bp, Homo sapiens
gcggcggtcaggcagctcg

SEQ ID NO: 55869 - DNA, 18 bp, Homo sapiens
gcacggcgggggactcgg

SEQ ID NO: 55870 - DNA, 22 bp, Homo sapiens
gcggcggcggcggcggctcggg

SEQ ID NO: 55871 - DNA, 17 bp, Homo sapiens
gcagccaagttcccagg

SEQ ID NO: 55872 - DNA, 22 bp, Homo sapiens
actcagcagccaaggacttggg

SEQ ID NO: 55873 - DNA, 21 bp, Homo sapiens
gccaccccaggcggactcggg

SEQ ID NO: 55874 - DNA, 18 bp, Homo sapiens
gcgacagcataggctcgg

SEQ ID NO: 55875 - DNA, 21 bp, Homo sapiens
acggtggccaggcagcgctgg

SEQ ID NO: 55876 - DNA, 19 bp, Homo sapiens
cagcagccaggcacccagg

SEQ ID NO: 55877 - DNA, 19 bp, Homo sapiens
gcagccaggcccacctggg

SEQ ID NO: 55878 - DNA, 21 bp, Homo sapiens
cgcagcagcaggagcctcggg

SEQ ID NO: 55879 - DNA, 19 bp, Homo sapiens
cacagcagccgggcagagg

SEQ ID NO: 55880 - DNA, 17 bp, Homo sapiens
gcggcagccaggcacag

SEQ ID NO: 55881 - DNA, 18 bp, Homo sapiens
agcggcgaaggactcggg

SEQ ID NO: 55882 - DNA, 17 bp, Homo sapiens
cgcacagccaggcctgg

SEQ ID NO: 55883 - DNA, 75 bp, Human herpesvirus 1
cgttacacccgaggcggcctgggtcttccgcggagctcccgggagctccgcaccaagccgctctccggagagacg

SEQ ID NO: 55884 - DNA, 24 bp, Human herpesvirus 1
cacccgaggcggcctgggtcttcc

SEQ ID NO: 55885 - DNA, 21 bp, Homo sapiens
cacccaaggctgaggtcttcc

SEQ ID NO: 55886 - DNA, 22 bp, Homo sapiens
cacttgtggcggcctgatgctc

SEQ ID NO: 55887 - DNA, 22 bp, Homo sapiens
acccggggtgctaaagggtctt

SEQ ID NO: 55888 - DNA, 23 bp, Homo sapiens
cacctcaggcctgagggttttcc

SEQ ID NO: 55889 - DNA, 19 bp, Homo sapiens
cacttgggcaggggtcttc

SEQ ID NO: 55890 - DNA, 25 bp, Homo sapiens
gaggcagctctcttttggaagaccc

SEQ ID NO: 55891 - DNA, 15 bp, Homo sapiens
gagggggggtcttcc

SEQ ID NO: 55892 - DNA, 21 bp, Homo sapiens
cccttggggaaagggtcttcc

SEQ ID NO: 55893 - DNA, 19 bp, Homo sapiens
cacccagccttgggtcttc

SEQ ID NO: 55894 - DNA, 18 bp, Homo sapiens
cccgggctggaagttttc

SEQ ID NO: 55895 - DNA, 21 bp, Homo sapiens
acctgagtggcttaaatgttc

SEQ ID NO: 55896 - DNA, 25 bp, Homo sapiens
cccggaggcggcttttcggaagacc

SEQ ID NO: 55897 - DNA, 19 bp, Homo sapiens
cactcggggcagcctgagt

SEQ ID NO: 55898 - DNA, 22 bp, Homo sapiens
cacttgaggtggcggaatcttc

SEQ ID NO: 55899 - DNA, 19 bp, Homo sapiens
cactaggggatgggtcttc

SEQ ID NO: 55900 - DNA, 25 bp, Homo sapiens
cccaggcggctcctttcggaagacc

SEQ ID NO: 55901 - DNA, 17 bp, Homo sapiens
cctgaagtggggtcttc

SEQ ID NO: 55902 - DNA, 24 bp, Homo sapiens
cccgaggcggactgtgcaagttcc

SEQ ID NO: 55903 - DNA, 21 bp, Homo sapiens
cactggggcggcctgaagggc

SEQ ID NO: 55904 - DNA, 19 bp, Homo sapiens
ccagttccctgggtcttcc

SEQ ID NO: 55905 - DNA, 23 bp, Homo sapiens
ccctgaggcggctttccggaagc

SEQ ID NO: 55906 - DNA, 19 bp, Homo sapiens
cccaggccgaccggtcttc

SEQ ID NO: 55907 - DNA, 18 bp, Homo sapiens
agcttagcttgggtcttc

SEQ ID NO: 55908 - DNA, 17 bp, Homo sapiens
cccaagtctgggttttc

SEQ ID NO: 55909 - DNA, 17 bp, Homo sapiens
cccgcggcccggttttc

SEQ ID NO: 55910 - DNA, 19 bp, Homo sapiens
caccggggtataggtcttc

SEQ ID NO: 55911 - DNA, 20 bp, Homo sapiens
caccccaggcccagctgggt

SEQ ID NO: 55912 - DNA, 19 bp, Homo sapiens
cctggaggttgggtcttcc

SEQ ID NO: 55913 - DNA, 27 bp, Homo sapiens
cacccggaggtggcttttcggaagacc

SEQ ID NO: 55914 - DNA, 23 bp, Homo sapiens
acctggggctttgggggtcttcc

SEQ ID NO: 55915 - DNA, 19 bp, Homo sapiens
acccaaggcggcctgggcc

SEQ ID NO: 55916 - DNA, 21 bp, Homo sapiens
ccctgggggctggggtcttcc

SEQ ID NO: 55917 - DNA, 30 bp, Homo sapiens
cactggaggcgggccttttctggaagaccc

SEQ ID NO: 55918 - DNA, 25 bp, Homo sapiens
ccgaggcggccttttttggaagacc

SEQ ID NO: 55919 - DNA, 15 bp, Homo sapiens
ccgaggcgggtcttc

SEQ ID NO: 55920 - DNA, 22 bp, Homo sapiens
cccgggctggtctctaaactcc

SEQ ID NO: 55921 - DNA, 18 bp, Homo sapiens
cgaggcggcagcagtttc

SEQ ID NO: 55922 - DNA, 19 bp, Homo sapiens
cacccggcgtgcagtcttc

SEQ ID NO: 55923 - DNA, 18 bp, Homo sapiens
gagtaagacaggtcttcc

SEQ ID NO: 55924 - DNA, 24 bp, Homo sapiens
cacccgaggcagccttttggaagc

SEQ ID NO: 55925 - DNA, 21 bp, Homo sapiens
acctggggtggtctgggtctt

SEQ ID NO: 55926 - DNA, 20 bp, Homo sapiens
cctggcggggcctgggtctt

SEQ ID NO: 55927 - DNA, 20 bp, Homo sapiens
cccaggcgccccggtcttcc

SEQ ID NO: 55928 - DNA, 23 bp, Homo sapiens
acctggggcggaaggagttttcc

SEQ ID NO: 55929 - DNA, 19 bp, Homo sapiens
cactgaggcggcttccctc

SEQ ID NO: 55930 - DNA, 25 bp, Homo sapiens
gaggcggcactctttcggaagaccc

SEQ ID NO: 55931 - DNA, 16 bp, Homo sapiens
cccgggcggcttcctc

SEQ ID NO: 55932 - DNA, 17 bp, Homo sapiens
ccggatcattgggtctt

SEQ ID NO: 55933 - DNA, 21 bp, Homo sapiens
cccttgggaatcttgggtctt

SEQ ID NO: 55934 - DNA, 21 bp, Homo sapiens
caccagctgcttgggtcttcc

SEQ ID NO: 55935 - DNA, 16 bp, Homo sapiens
ccagaccctgggtctt

SEQ ID NO: 55936 - DNA, 18 bp, Homo sapiens
cctgaggcggcccgctgg

SEQ ID NO: 55937 - DNA, 123 bp, Ovine adenovirus 7
tgggcatttttgattgcagatttccaggttttctgcaaaaatctaaaattcaaactgctattattaatacaggtcccagagaacaaggcggaatacactggataacattagcattagaaccca

SEQ ID NO: 55938 - DNA, 24 bp, Ovine adenovirus 7
agagaacaaggcggaatacactgg

SEQ ID NO: 55939 - DNA, 23 bp, Homo sapiens
agagaacaaggtgtgaggcactg

SEQ ID NO: 55940 - DNA, 22 bp, Homo sapiens
aggaacaagacagatatgttgg

SEQ ID NO: 55941 - DNA, 17 bp, Homo sapiens
gagaaggcggaggccgg

SEQ ID NO: 55942 - DNA, 17 bp, Homo sapiens
gagggcaaaatgcactg

SEQ ID NO: 55943 - DNA, 18 bp, Homo sapiens
aaagaacggaatgtactg

SEQ ID NO: 55944 - DNA, 18 bp, Homo sapiens
aaggggaatttacactgg

SEQ ID NO: 55945 - DNA, 25 bp, Homo sapiens
gagaacaaggggcaagcggcactgg

SEQ ID NO: 55946 - DNA, 27 bp, Homo sapiens
agagaatgaagcggaagaagccgctgg

SEQ ID NO: 55947 - DNA, 24 bp, Homo sapiens
agagaacagagtgggaatcattgg

SEQ ID NO: 55948 - DNA, 21 bp, Homo sapiens
agagtaccatgaatacactgg

SEQ ID NO: 55949 - DNA, 19 bp, Homo sapiens
agagatcaaggcagcattg

SEQ ID NO: 55950 - DNA, 21 bp, Homo sapiens
agaggagaaggcagtcgctgg

SEQ ID NO: 55951 - DNA, 23 bp, Homo sapiens
agagactggggtgggcacactgg

SEQ ID NO: 55952 - DNA, 24 bp, Homo sapiens
agagaagcaggttttgtacactgg

SEQ ID NO: 55953 - DNA, 19 bp, Homo sapiens
gaggaggcggaacccgcgg

SEQ ID NO: 55954 - DNA, 23 bp, Homo sapiens
agagaacagggagggagacaagg

SEQ ID NO: 55955 - DNA, 25 bp, Homo sapiens
agggaacaaggcaggagactgctgg

SEQ ID NO: 55956 - DNA, 21 bp, Homo sapiens
aaagaacaaggaatacattgg

SEQ ID NO: 55957 - DNA, 19 bp, Homo sapiens
agagaacaaggcggcgctg

SEQ ID NO: 55958 - DNA, 21 bp, Homo sapiens
acaggactgtggatacactgg

SEQ ID NO: 55959 - DNA, 20 bp, Homo sapiens
gagaccagtgagtacactgg

SEQ ID NO: 55960 - DNA, 18 bp, Homo sapiens
agagaacaggctgggctg

SEQ ID NO: 55961 - DNA, 18 bp, Homo sapiens
gagcaaggcaggcagtgg

SEQ ID NO: 55962 - DNA, 18 bp, Homo sapiens
agggaacaagagacactg

SEQ ID NO: 55963 - DNA, 21 bp, Homo sapiens
agagaacagggaacatactgg

SEQ ID NO: 55964 - DNA, 24 bp, Homo sapiens
agaggaagaaggaaagtacactgg

SEQ ID NO: 55965 - DNA, 20 bp, Homo sapiens
gagaggtggggacacactgg

SEQ ID NO: 55966 - DNA, 21 bp, Homo sapiens
gagagggtgaggtcacactgg

SEQ ID NO: 55967 - DNA, 19 bp, Homo sapiens
agagaacaagcagccactg

SEQ ID NO: 55968 - DNA, 19 bp, Homo sapiens
aaggcaagacatacactgg

SEQ ID NO: 55969 - DNA, 19 bp, Homo sapiens
agaaaacagaaatatgctg

SEQ ID NO: 55970 - DNA, 21 bp, Homo sapiens
gaggccaaggcgggttgctgg

SEQ ID NO: 55971 - DNA, 18 bp, Homo sapiens
agaagtgctgatacactg

SEQ ID NO: 55972 - DNA, 22 bp, Homo sapiens
agaggggcagggcacacactgg

SEQ ID NO: 55973 - DNA, 22 bp, Homo sapiens
agaggggcagggtacacactgg

SEQ ID NO: 55974 - DNA, 22 bp, Homo sapiens
agagaggcagggtacacactgg

SEQ ID NO: 55975 - DNA, 19 bp, Homo sapiens
agagagggcacatacactg

SEQ ID NO: 55976 - DNA, 22 bp, Homo sapiens
agaggggcaaggtacacactgg

SEQ ID NO: 55977 - DNA, 23 bp, Homo sapiens
aaagaataaataaaatacactgg

SEQ ID NO: 55978 - DNA, 19 bp, Homo sapiens
gaacaagatagaacactgg

SEQ ID NO: 55979 - DNA, 20 bp, Homo sapiens
aaggacaaggcagccactgg

SEQ ID NO: 55980 - DNA, 19 bp, Homo sapiens
agagaacagagcggcactg

SEQ ID NO: 55981 - DNA, 92 bp, Ovine adenovirus 7
tgtattacagtagaaagaaatactcaaagtgttcaatgtacctgtgcgggatcgtgcggcttgttttgtatatttttcttatactgttttca

SEQ ID NO: 55982 - DNA, 24 bp, Ovine adenovirus 7
tacagtagaaagaaatactcaaag

SEQ ID NO: 55983 - DNA, 16 bp, Homo sapiens
tgagtagaatactcaa

SEQ ID NO: 55984 - DNA, 18 bp, Homo sapiens
cacagtagggagagaaca

SEQ ID NO: 55985 - DNA, 20 bp, Homo sapiens
atagaaagaaaaacctaaag

SEQ ID NO: 55986 - DNA, 24 bp, Homo sapiens
cagttgaaagaaaatagtccaaag

SEQ ID NO: 55987 - DNA, 19 bp, Homo sapiens
tacatagaaagaaaatcca

SEQ ID NO: 55988 - DNA, 20 bp, Homo sapiens
cagcctggaggtactcaaag

SEQ ID NO: 55989 - DNA, 21 bp, Homo sapiens
agtagaaagaaaaacagaaag

SEQ ID NO: 55990 - DNA, 19 bp, Homo sapiens
tacagtggaaggaaatact

SEQ ID NO: 55991 - DNA, 18 bp, Homo sapiens
tacagtggaagaaatacc

SEQ ID NO: 55992 - DNA, 17 bp, Homo sapiens
tacagtagaaagaatac

SEQ ID NO: 55993 - DNA, 26 bp, Homo sapiens
tacagcaggaggaacacatctcaaag

SEQ ID NO: 55994 - DNA, 21 bp, Homo sapiens
gtggagggaagatactcaaag

SEQ ID NO: 55995 - DNA, 20 bp, Homo sapiens
agcagaaagagcaccttcaa

SEQ ID NO: 55996 - DNA, 19 bp, Homo sapiens
gtaaaggaagtactcaaag

SEQ ID NO: 55997 - DNA, 19 bp, Homo sapiens
gcagaggaagctcactcaa

SEQ ID NO: 55998 - DNA, 24 bp, Homo sapiens
tacaatagaagtatatattcaaag

SEQ ID NO: 55999 - DNA, 21 bp, Homo sapiens
atagaaagagacatttcaaag

SEQ ID NO: 56000 - DNA, 18 bp, Homo sapiens
tacagtggaggaaatact

SEQ ID NO: 56001 - DNA, 20 bp, Homo sapiens
atagaaaaaaatgcttaaag

SEQ ID NO: 56002 - DNA, 15 bp, Homo sapiens
tacagcagaaactca

SEQ ID NO: 56003 - DNA, 19 bp, Homo sapiens
tacagtagaaataaaccaa

SEQ ID NO: 56004 - DNA, 24 bp, Homo sapiens
tacagcaggaagaatagcccaaag

SEQ ID NO: 56005 - DNA, 19 bp, Homo sapiens
tacagtaggagaaaccaaa

SEQ ID NO: 56006 - DNA, 18 bp, Homo sapiens
gtagaaagaggtattcaa

SEQ ID NO: 56007 - DNA, 73 bp, Human herpesvirus 5
actggactcggtttcgctgtagctgtggttcaacctgaacatggctcccagagctgctaggaaccggtccagt

SEQ ID NO: 56008 - DNA, 24 bp, Human herpesvirus 5
ctcccagagctgctaggaaccggt

SEQ ID NO: 56009 - DNA, 17 bp, Homo sapiens
ctcccagagtgctggga

SEQ ID NO: 56010 - DNA, 20 bp, Homo sapiens
tcccagaactgttgcacggt

SEQ ID NO: 56011 - DNA, 17 bp, Homo sapiens
ctcccagagtgctagga

SEQ ID NO: 56012 - DNA, 20 bp, Homo sapiens
cccagaactcgggagccggt

SEQ ID NO: 56013 - DNA, 18 bp, Homo sapiens
ccagagctgttagccaat

SEQ ID NO: 56014 - DNA, 19 bp, Homo sapiens
ctcccagagctgtggaagg

SEQ ID NO: 56015 - DNA, 20 bp, Homo sapiens
ccagagctgtagctgctggt

SEQ ID NO: 56016 - DNA, 19 bp, Homo sapiens
ctcctggagctgctgtgga

SEQ ID NO: 56017 - DNA, 19 bp, Homo sapiens
ccagggcagctaggaggcg

SEQ ID NO: 56018 - DNA, 17 bp, Homo sapiens
ctcccaagctgctggga

SEQ ID NO: 56019 - DNA, 17 bp, Homo sapiens
tctaaagctgttaggaa

SEQ ID NO: 56020 - DNA, 18 bp, Homo sapiens
cagggctgctaggaagcc

SEQ ID NO: 56021 - DNA, 21 bp, Homo sapiens
ctcctaaagctgcccactggt

SEQ ID NO: 56022 - DNA, 18 bp, Homo sapiens
ccagagctgaaggttggt

SEQ ID NO: 56023 - DNA, 19 bp, Homo sapiens
tctcagggttgctaggaac

SEQ ID NO: 56024 - DNA, 23 bp, Homo sapiens
tcctggagtgctagaattggggt

SEQ ID NO: 56025 - DNA, 16 bp, Homo sapiens
cctagagaggaaccgg

SEQ ID NO: 56026 - DNA, 17 bp, Homo sapiens
ctcccagagcgctggga

SEQ ID NO: 56027 - DNA, 21 bp, Homo sapiens
ctcctggggctgccagccagt

SEQ ID NO: 56028 - DNA, 20 bp, Homo sapiens
ctcggagctgctcggtcggt

SEQ ID NO: 56029 - DNA, 22 bp, Homo sapiens
ctctggagctgctggcgccggc

SEQ ID NO: 56030 - DNA, 20 bp, Homo sapiens
tcccagagctgtcgggggaa

SEQ ID NO: 56031 - DNA, 18 bp, Homo sapiens
ccagagcatggaaccggt

SEQ ID NO: 56032 - DNA, 18 bp, Homo sapiens
tcccggagccgctgggaa

SEQ ID NO: 56033 - DNA, 17 bp, Homo sapiens
ctcccaagctgctagga

SEQ ID NO: 56034 - DNA, 73 bp, Paramecium bursaria Chlorella virus 1
cccatacgtgattcgtgatcttttttggtttgtagtatagtaaacctttccactctatcatattgctcgtggg

SEQ ID NO: 56035 - DNA, 24 bp, Paramecium bursaria Chlorella virus 1
aacctttccactctatcatattgc

SEQ ID NO: 56036 - DNA, 21 bp, Homo sapiens
ccttcccactctcagatttgc

SEQ ID NO: 56037 - DNA, 19 bp, Homo sapiens
tttccaccagagatattgc

SEQ ID NO: 56038 - DNA, 21 bp, Homo sapiens
acctttccacttttcaaaagc

SEQ ID NO: 56039 - DNA, 21 bp, Homo sapiens
ccttgccactttcaactttgc

SEQ ID NO: 56040 - DNA, 20 bp, Homo sapiens
ccttcccattctgcttttgc

SEQ ID NO: 56041 - DNA, 18 bp, Homo sapiens
ccttccaaggccatattg

SEQ ID NO: 56042 - DNA, 19 bp, Homo sapiens
cctccctctgttgtattgc

SEQ ID NO: 56043 - DNA, 23 bp, Homo sapiens
ttcccactttaaaagtatattgc

SEQ ID NO: 56044 - DNA, 21 bp, Homo sapiens
acttttccacctatggtctgc

SEQ ID NO: 56045 - DNA, 17 bp, Homo sapiens
cctttccacatacattg

SEQ ID NO: 56046 - DNA, 16 bp, Homo sapiens
tttccacttattattg

SEQ ID NO: 56047 - DNA, 20 bp, Homo sapiens
acctttccctcgtcagttgc

SEQ ID NO: 56048 - DNA, 23 bp, Homo sapiens
cctttccacgtctggccttttgc

SEQ ID NO: 56049 - DNA, 20 bp, Homo sapiens
acctttccatttcatcctgc

SEQ ID NO: 56050 - DNA, 21 bp, Homo sapiens
cctttccattcctccggttgc

SEQ ID NO: 56051 - DNA, 19 bp, Homo sapiens
tttcttttctatcacattg

SEQ ID NO: 56052 - DNA, 21 bp, Homo sapiens
aacctttcctactctgtattg

SEQ ID NO: 56053 - DNA, 17 bp, Homo sapiens
cctttccatttcatctg

SEQ ID NO: 56054 - DNA, 20 bp, Homo sapiens
aacctttctgtgtctatcat

SEQ ID NO: 56055 - DNA, 68 bp, Rabbit fibroma virus
gattatactatgtggctataataaaattacgttctttacgtattatactacacacgttgtaacaaatc

SEQ ID NO: 56056 - DNA, 24 bp, Rabbit fibroma virus
tactatgtggctataataaaatta

SEQ ID NO: 56057 - DNA, 24 bp, Homo sapiens
tactatgactaaataataaaatta

SEQ ID NO: 56058 - DNA, 21 bp, Homo sapiens
tatgtatatataataaaatta

SEQ ID NO: 56059 - DNA, 19 bp, Homo sapiens
tactatgtggctatacaaa

SEQ ID NO: 56060 - DNA, 21 bp, Homo sapiens
ctatgtgagcttctgcaaatt

SEQ ID NO: 56061 - DNA, 22 bp, Homo sapiens
catgttgtccataataaaatta

SEQ ID NO: 56062 - DNA, 20 bp, Homo sapiens
tatgtataacaataaaatta

SEQ ID NO: 56063 - DNA, 23 bp, Homo sapiens
tacttaaaactataataaaatta

SEQ ID NO: 56064 - DNA, 23 bp, Homo sapiens
tactaagttctttaataaaatta

SEQ ID NO: 56065 - DNA, 100 bp, Swinepox virus
tatgaaaggaatagtatttgttaaaaatagaactgtatacgtattaaatacaaatgatccattgatagattttatgtttaaagaatataacccatgcata

SEQ ID NO: 56066 - DNA, 24 bp, Swinepox virus
ttaaaaatagaactgtatacgtat

SEQ ID NO: 56067 - DNA, 17 bp, Homo sapiens
ttaaaaataaactgtat

SEQ ID NO: 56068 - DNA, 19 bp, Homo sapiens
ttaaaaagggaactgtaca

SEQ ID NO: 56069 - DNA, 18 bp, Homo sapiens
ttaaaaatgaactgatac

SEQ ID NO: 56070 - DNA, 24 bp, Homo sapiens
ttaaaaacaggacacgtactgtat

SEQ ID NO: 56071 - DNA, 24 bp, Homo sapiens
ctaaaaatagaacaaatactgtat

SEQ ID NO: 56072 - DNA, 94 bp, Swinepox virus
atgcttaatatctttactacaacccgaaaatgtacatttattaaaacaagtatttaataatggccatgatcgtatcaataaggtattgaaacat

SEQ ID NO: 56073 - DNA, 24 bp, Swinepox virus
tggccatgatcgtatcaataaggt

SEQ ID NO: 56074 - DNA, 19 bp, Homo sapiens
tggtcatggccgtgtcaac

SEQ ID NO: 56075 - DNA, 22 bp, Homo sapiens
tggctgtgaccacaaatggggt

SEQ ID NO: 56076 - DNA, 23 bp, Homo sapiens
tggctttgattagcaaataaggt

SEQ ID NO: 56077 - DNA, 18 bp, Homo sapiens
tggccataaacaatgagg

SEQ ID NO: 56078 - DNA, 21 bp, Homo sapiens
tggccatgcttttcataaggt

SEQ ID NO: 56079 - DNA, 24 bp, Homo sapiens
tggccatgtcgtgtcggggaaggt

SEQ ID NO: 56080 - DNA, 60 bp, Myxoma virus
gagttgttacgtctgcgtctttgtaagttttctaaacagatcaaggcctcgtataaactc

SEQ ID NO: 56081 - DNA, 24 bp, Myxoma virus
tacgtctgcgtctttgtaagtttt

SEQ ID NO: 56082 - DNA, 18 bp, Homo sapiens
tacatttgtgtctttgta

SEQ ID NO: 56083 - DNA, 20 bp, Homo sapiens
cgtctctgtctttgtgcttt

SEQ ID NO: 56084 - DNA, 20 bp, Homo sapiens
gtctttgtgtctttgtcagt

SEQ ID NO: 56085 - DNA, 20 bp, Homo sapiens
tgcatatctttgtaagtttt

SEQ ID NO: 56086 - DNA, 20 bp, Homo sapiens
acgtctgcgtctgtagtttt

SEQ ID NO: 56087 - DNA, 17 bp, Homo sapiens
tctgtgtctttggcttt

SEQ ID NO: 56088 - DNA, 80 bp, Chimpanzee cytomegalovirus
gacaggccccggctatcgcgacatgtcggcgacccacggtcgggtggacgtgtcgcgacatggacgtgcagggggatgtt

SEQ ID NO: 56089 - DNA, 24 bp, Chimpanzee cytomegalovirus
tatcgcgacatgtcggcgacccac

SEQ ID NO: 56090 - DNA, 18 bp, Homo sapiens
tctgacatgtcacttcac

SEQ ID NO: 56091 - DNA, 18 bp, Homo sapiens
catcgcggtgtgtcggcg

SEQ ID NO: 56092 - DNA, 63 bp, Yaba-like disease virus
atacactatgaccaacataacaagtaatacaaaattaaatgttgtggtaacaaaaaggtgtat

SEQ ID NO: 56093 - DNA, 24 bp, Yaba-like disease virus
aatgttgtggtaacaaaaaggtgt

SEQ ID NO: 56094 - DNA, 22 bp, Homo sapiens
tattaaagtaacaaaaaggtgt

SEQ ID NO: 56095 - DNA, 23 bp, Homo sapiens
aatgattactaacaaaaaggtgt

SEQ ID NO: 56096 - DNA, 22 bp, Homo sapiens
aatgttgtgttgataacccagt

SEQ ID NO: 56097 - DNA, 21 bp, Homo sapiens
tgtttgggaaagaaaaggtgt

SEQ ID NO: 56098 - DNA, 23 bp, Homo sapiens
aatgatttgcagcaaggaggtgt

SEQ ID NO: 56099 - DNA, 20 bp, Homo sapiens
aatgttgtggtagtgtaagg

SEQ ID NO: 56100 - DNA, 17 bp, Homo sapiens
atgtagtggtaacaggt

SEQ ID NO: 56101 - DNA, 130 bp, Feline immunodeficiency virus
gagagtgattgaggaagtgaagctagagcaatagaaagctgttaagcagaactcctgctgacctaaatagggaagcagtagcagacgctgctaacagtgagtatctctagtgaagcggactcgagctcat

SEQ ID NO: 56102 - DNA, 24 bp, Feline immunodeficiency virus
tgttaagcagaactcctgctgacc

SEQ ID NO: 56103 - DNA, 17 bp, Homo sapiens
ttaagcaggactttgtg

SEQ ID NO: 56104 - DNA, 25 bp, Homo sapiens
tgttaaacgggactcaaggctgacc

SEQ ID NO: 56105 - DNA, 19 bp, Homo sapiens
tgttaagcaaggttctgac

SEQ ID NO: 56106 - DNA, 19 bp, Homo sapiens
ttagtcagagctcctgctg

SEQ ID NO: 56107 - DNA, 22 bp, Homo sapiens
tgttcatgttttcctgctgacc

SEQ ID NO: 56108 - DNA, 17 bp, Homo sapiens
gttaagcaggacttgac

SEQ ID NO: 56109 - DNA, 22 bp, Homo sapiens
tgttggtcatctcctgctggcc

SEQ ID NO: 56110 - DNA, 19 bp, Homo sapiens
tgttaagcagcaatgtgac

SEQ ID NO: 56111 - DNA, 22 bp, Homo sapiens
tgtgaatcagtgctcctgctga

SEQ ID NO: 56112 - DNA, 24 bp, Homo sapiens
tgttaagcagcactccagctgacc

SEQ ID NO: 56113 - DNA, 20 bp, Homo sapiens
tggaaaggctcctgctggcc

SEQ ID NO: 56114 - DNA, 22 bp, Homo sapiens
tgtagagttcctcctgctgacc

SEQ ID NO: 56115 - DNA, 21 bp, Homo sapiens
tgtgggcagaacttctaggct

SEQ ID NO: 56116 - DNA, 17 bp, Homo sapiens
gttaggcagaactggct

SEQ ID NO: 56117 - DNA, 22 bp, Homo sapiens
tgtgggcagaacttcattgctg

SEQ ID NO: 56118 - DNA, 18 bp, Homo sapiens
tgtggagcagaacctgac

SEQ ID NO: 56119 - DNA, 15 bp, Homo sapiens
tgtaagcactgctga

SEQ ID NO: 56120 - DNA, 18 bp, Homo sapiens
tgttaagcaggtcttgcc

SEQ ID NO: 56121 - DNA, 129 bp, Paramecium bursaria Chlorella virus 1
attgtttcatattattgcatgtccaacaacaactgacgcaattaccttcgacgtatcctacggtgttatttagtctgtcaataccatttcgaagagtatcagtcgtttgttgtccacagtaaaagcaat

SEQ ID NO: 56122 - DNA, 24 bp, Paramecium bursaria Chlorella virus 1
tcaataccatttcgaagagtatca

SEQ ID NO: 56123 - DNA, 17 bp, Homo sapiens
tcaatatcacttcgaga

SEQ ID NO: 56124 - DNA, 18 bp, Homo sapiens
tcaataccttccaagtgt

SEQ ID NO: 56125 - DNA, 20 bp, Homo sapiens
aatatcaactccaagagtat

SEQ ID NO: 56126 - DNA, 24 bp, Homo sapiens
tcaaaatcacatccaagagtatca

SEQ ID NO: 56127 - DNA, 20 bp, Homo sapiens
tcaataccatttcaagaata

SEQ ID NO: 56128 - DNA, 23 bp, Homo sapiens
tcagtggcatcctaagagtatca

SEQ ID NO: 56129 - DNA, 130 bp, B19 virus
ttccggaattagggttggctctgggccagcgcttggggttgacgtgccactaagacaagcggcgcgccgcttgtcttagtgtcaaggcaaccccaagcaagctggcccagagccaaccctaattccggaa

SEQ ID NO: 56130 - DNA, 24 bp, B19 virus
aggcaaccccaagcaagctggccc

SEQ ID NO: 56131 - DNA, 24 bp, Homo sapiens
agctgaccccaagccgaagggtcc

SEQ ID NO: 56132 - DNA, 21 bp, Homo sapiens
aggcagtgcaggggctggccc

SEQ ID NO: 56133 - DNA, 22 bp, Homo sapiens
aggcaacccctgggcaccatcc

SEQ ID NO: 56134 - DNA, 19 bp, Homo sapiens
agacaacttcaagcaagct

SEQ ID NO: 56135 - DNA, 24 bp, Homo sapiens
aagcagacagcagcaggctggccc

SEQ ID NO: 56136 - DNA, 17 bp, Homo sapiens
gcacagcgggctggccc

SEQ ID NO: 56137 - DNA, 21 bp, Homo sapiens
ggctgaccccaggcaggcgcc

SEQ ID NO: 56138 - DNA, 23 bp, Homo sapiens
aggcagccccaagccatcctgcc

SEQ ID NO: 56139 - DNA, 21 bp, Homo sapiens
agccagcctcaggcacagccc

SEQ ID NO: 56140 - DNA, 29 bp, Homo sapiens
ggcagccccaagcagccagtgttggcccg

SEQ ID NO: 56141 - DNA, 24 bp, Homo sapiens
ggcaacccccagcccagccggccc

SEQ ID NO: 56142 - DNA, 23 bp, Homo sapiens
aggcagctcctggccgctggccc

SEQ ID NO: 56143 - DNA, 19 bp, Homo sapiens
agggagccccacgctggcc

SEQ ID NO: 56144 - DNA, 16 bp, Homo sapiens
ggcagcccagctggcc

SEQ ID NO: 56145 - DNA, 19 bp, Homo sapiens
ggaagccacaacaagctgg

SEQ ID NO: 56146 - DNA, 22 bp, Homo sapiens
aggccagccccgagacaggccc

SEQ ID NO: 56147 - DNA, 20 bp, Homo sapiens
ggcgccccctctgctggccc

SEQ ID NO: 56148 - DNA, 18 bp, Homo sapiens
agccagccccaagctgct

SEQ ID NO: 56149 - DNA, 19 bp, Homo sapiens
ggagccccttcaagctggc

SEQ ID NO: 56150 - DNA, 21 bp, Homo sapiens
aggcgccccaagccgggggcc

SEQ ID NO: 56151 - DNA, 22 bp, Homo sapiens
aggcaacctcagctgtggaccc

SEQ ID NO: 56152 - DNA, 22 bp, Homo sapiens
aggcgccccaagccagcaggcc

SEQ ID NO: 56153 - DNA, 25 bp, Homo sapiens
aagcaacctcaggttcagactggcc

SEQ ID NO: 56154 - DNA, 18 bp, Homo sapiens
ggctaaccccaggcggcc

SEQ ID NO: 56155 - DNA, 20 bp, Homo sapiens
ggaggccccaagccccgccc

SEQ ID NO: 56156 - DNA, 19 bp, Homo sapiens
aggcagatcccagctggcc

SEQ ID NO: 56157 - DNA, 20 bp, Homo sapiens
ggcagccccaagccaggccc

SEQ ID NO: 56158 - DNA, 20 bp, Homo sapiens
aggggccccgggagctggcc

SEQ ID NO: 56159 - DNA, 22 bp, Homo sapiens
aggccagccccaggtcaggtcc

SEQ ID NO: 56160 - DNA, 19 bp, Homo sapiens
aggcaacccaggcagagct

SEQ ID NO: 56161 - DNA, 18 bp, Homo sapiens
agcaaccccgagcttctg

SEQ ID NO: 56162 - DNA, 19 bp, Homo sapiens
ggctggccccaagtggtcc

SEQ ID NO: 56163 - DNA, 21 bp, Homo sapiens
ggcagcgccgcgaagctggcc

SEQ ID NO: 56164 - DNA, 19 bp, Homo sapiens
ggcaaccccagccaaagct

SEQ ID NO: 56165 - DNA, 19 bp, Homo sapiens
aagcaacctcaggcaaact

SEQ ID NO: 56166 - DNA, 17 bp, Homo sapiens
gcaaccccactgctggc

SEQ ID NO: 56167 - DNA, 22 bp, Homo sapiens
ggcagcccggcgacgctggccc

SEQ ID NO: 56168 - DNA, 20 bp, Homo sapiens
ggcggccccggcgctggccc

SEQ ID NO: 56169 - DNA, 19 bp, Homo sapiens
agggggccccatactggcc

SEQ ID NO: 56170 - DNA, 19 bp, Homo sapiens
aggcagcccaagcaggggc

SEQ ID NO: 56171 - DNA, 19 bp, Homo sapiens
ggcagcagcaagctggccc

SEQ ID NO: 56172 - DNA, 18 bp, Homo sapiens
agcttccacagctggccc

SEQ ID NO: 56173 - DNA, 24 bp, Homo sapiens
aggctggcctcctcccgctggccc

SEQ ID NO: 56174 - DNA, 22 bp, Homo sapiens
agccaaccctgatgctcctggc

SEQ ID NO: 56175 - DNA, 19 bp, Homo sapiens
agcaaccccgagctctgcc

SEQ ID NO: 56176 - DNA, 21 bp, Homo sapiens
aggcggcggcaaggctggccc

SEQ ID NO: 56177 - DNA, 18 bp, Homo sapiens
aggtaaccccaagcaggc

SEQ ID NO: 56178 - DNA, 23 bp, Homo sapiens
aggtgctccaagaacactggccc

SEQ ID NO: 56179 - DNA, 20 bp, Homo sapiens
aggcaaccccgggacaggct

SEQ ID NO: 56180 - DNA, 20 bp, Homo sapiens
ggccgaccccgggctccggc

SEQ ID NO: 56181 - DNA, 22 bp, Homo sapiens
agccagccccaggctcaggtgc

SEQ ID NO: 56182 - DNA, 17 bp, Homo sapiens
gcaacaaagcaagctgg

SEQ ID NO: 56183 - DNA, 21 bp, Homo sapiens
agacaaccctaggccaagtcc

SEQ ID NO: 56184 - DNA, 20 bp, Homo sapiens
ggcagccccaagctcaatgg

SEQ ID NO: 56185 - DNA, 21 bp, Homo sapiens
agcagccccatgcgctggccc

SEQ ID NO: 56186 - DNA, 23 bp, Homo sapiens
agacagcttgcctcagctggccc

SEQ ID NO: 56187 - DNA, 26 bp, Homo sapiens
ggccagtcccaagcatagcctggccc

SEQ ID NO: 56188 - DNA, 22 bp, Homo sapiens
aggcattcccaagcaccacatg

SEQ ID NO: 56189 - DNA, 20 bp, Homo sapiens
ggctagcctcaagcaaatct

SEQ ID NO: 56190 - DNA, 17 bp, Homo sapiens
agggaccccaagtctgg

SEQ ID NO: 56191 - DNA, 19 bp, Homo sapiens
aggtgacccaagactggcc

SEQ ID NO: 56192 - DNA, 19 bp, Homo sapiens
aggcaggcccaagcacatg

SEQ ID NO: 56193 - DNA, 17 bp, Homo sapiens
ggctccaaagctggccc

SEQ ID NO: 56194 - DNA, 22 bp, Homo sapiens
gggatccctgccaagctggccc

SEQ ID NO: 56195 - DNA, 21 bp, Homo sapiens
ggcagcccgtccagctggccc

SEQ ID NO: 56196 - DNA, 24 bp, Homo sapiens
aagcaaccctagaggcagttggcc

SEQ ID NO: 56197 - DNA, 20 bp, Homo sapiens
ggccgccccaagcgccgccc

SEQ ID NO: 56198 - DNA, 18 bp, Homo sapiens
ggcaacccccggcaagcc

SEQ ID NO: 56199 - DNA, 21 bp, Homo sapiens
ggcggcctcggcggctggccc

SEQ ID NO: 56200 - DNA, 23 bp, Homo sapiens
ggcgtcctgcccgtcgctggccc

SEQ ID NO: 56201 - DNA, 20 bp, Homo sapiens
ggccggccctgccactggcc

SEQ ID NO: 56202 - DNA, 20 bp, Homo sapiens
ggccggccccgagcagagct

SEQ ID NO: 56203 - DNA, 21 bp, Homo sapiens
agatgaccccaaactttctgg

SEQ ID NO: 56204 - DNA, 19 bp, Homo sapiens
aggcaacctgagcacaggc

SEQ ID NO: 56205 - DNA, 18 bp, Homo sapiens
gcagccccaaactggtcc

SEQ ID NO: 56206 - DNA, 22 bp, Homo sapiens
aggccaggaggcaggctggccc

SEQ ID NO: 56207 - DNA, 23 bp, Homo sapiens
agcaacttcccctcagctggccc

SEQ ID NO: 56208 - DNA, 19 bp, Homo sapiens
aggggaccggaagctggcc

SEQ ID NO: 56209 - DNA, 17 bp, Homo sapiens
gcagcccaagctggtcc

SEQ ID NO: 56210 - DNA, 17 bp, Homo sapiens
gacaaccccaagaggct

SEQ ID NO: 56211 - DNA, 24 bp, Homo sapiens
aggcatctatcgccaagctggccc

SEQ ID NO: 56212 - DNA, 20 bp, Homo sapiens
ggcccagactgggctggccc

SEQ ID NO: 56213 - DNA, 20 bp, Homo sapiens
agcgcccaagcaggctggcc

SEQ ID NO: 56214 - DNA, 20 bp, Homo sapiens
aggaaccccaggagctggcc

SEQ ID NO: 56215 - DNA, 17 bp, Homo sapiens
ggttccaagcaagtagc

SEQ ID NO: 56216 - DNA, 24 bp, Homo sapiens
aggtaactagcctggagctggccc

SEQ ID NO: 56217 - DNA, 21 bp, Homo sapiens
gacgaccccaagtttgcgccc

SEQ ID NO: 56218 - DNA, 21 bp, Homo sapiens
ggcagccccgctggctggccc

SEQ ID NO: 56219 - DNA, 22 bp, Homo sapiens
agttaaccccaggtaactggcc

SEQ ID NO: 56220 - DNA, 23 bp, Homo sapiens
aggagtcctggggccagctggcc

SEQ ID NO: 56221 - DNA, 22 bp, Homo sapiens
agcagcccttgtgcaagctggc

SEQ ID NO: 56222 - DNA, 19 bp, Homo sapiens
ggcatccagggagctggcc

SEQ ID NO: 56223 - DNA, 21 bp, Homo sapiens
aggcaacctcaagccctcagg

SEQ ID NO: 56224 - DNA, 19 bp, Homo sapiens
agcggccccaagcgagtcc

SEQ ID NO: 56225 - DNA, 24 bp, Homo sapiens
aggtgaccccaaaaaccactggcc

SEQ ID NO: 56226 - DNA, 17 bp, Homo sapiens
agccaacccaggctggc

SEQ ID NO: 56227 - DNA, 20 bp, Homo sapiens
aagtaaccccaagtaacaag

SEQ ID NO: 56228 - DNA, 22 bp, Homo sapiens
agcagtagccctaggctggccc

SEQ ID NO: 56229 - DNA, 21 bp, Homo sapiens
agccagccttccatgctggcc

SEQ ID NO: 56230 - DNA, 23 bp, Homo sapiens
ggcggggtggggcaagctggccc

SEQ ID NO: 56231 - DNA, 23 bp, Homo sapiens
ggctggccctggagccgctggcc

SEQ ID NO: 56232 - DNA, 21 bp, Homo sapiens
ggcagccctggccagctggcc

SEQ ID NO: 56233 - DNA, 17 bp, Homo sapiens
ggaacctcctgctggcc

SEQ ID NO: 56234 - DNA, 16 bp, Homo sapiens
agcaaccccaggccgc

SEQ ID NO: 56235 - DNA, 22 bp, Homo sapiens
agctggcctcaaactcctggcc

SEQ ID NO: 56236 - DNA, 18 bp, Homo sapiens
aggaaactgaggctggcc

SEQ ID NO: 56237 - DNA, 21 bp, Homo sapiens
ggctgcaggctaggctggccc

SEQ ID NO: 56238 - DNA, 76 bp, Molluscum contagiosum virus
tgttccgcgtgagagccattcttaatccagtagagacggctaaagagaggggtgtggctacatgcaacgcaggaca

SEQ ID NO: 56239 - DNA, 24 bp, Molluscum contagiosum virus
tgtggctacatgcaacgcaggaca

SEQ ID NO: 56240 - DNA, 19 bp, Homo sapiens
tgtggctataatgtaaacg

SEQ ID NO: 56241 - DNA, 23 bp, Homo sapiens
tgggctggcgctggtgcaggaca

SEQ ID NO: 56242 - DNA, 23 bp, Homo sapiens
tgtggcacatgcagtagccagca

SEQ ID NO: 56243 - DNA, 18 bp, Homo sapiens
tgtgactgcagggcagga

SEQ ID NO: 56244 - DNA, 20 bp, Homo sapiens
tgtagctataatgggcagga

SEQ ID NO: 56245 - DNA, 23 bp, Homo sapiens
tgtggcgtgcagcaagcaggaca

SEQ ID NO: 56246 - DNA, 17 bp, Homo sapiens
gtggctacatgcggcag

SEQ ID NO: 56247 - DNA, 19 bp, Homo sapiens
tgtggctaaatggcaggac

SEQ ID NO: 56248 - DNA, 22 bp, Homo sapiens
tgtggctatatcacaaatggca

SEQ ID NO: 56249 - DNA, 25 bp, Homo sapiens
tgtggctaccgcagcatgtgggaca

SEQ ID NO: 56250 - DNA, 19 bp, Homo sapiens
tggctacatgcagaaagca

SEQ ID NO: 56251 - DNA, 17 bp, Homo sapiens
gtggctatgtacaggac

SEQ ID NO: 56252 - DNA, 18 bp, Homo sapiens
tgtggccacatgcccgga

SEQ ID NO: 56253 - DNA, 21 bp, Homo sapiens
tgtgcctgtatgcaacaggca

SEQ ID NO: 56254 - DNA, 24 bp, Homo sapiens
tgtggccaacgacgacgcagggca

SEQ ID NO: 56255 - DNA, 18 bp, Homo sapiens
tgtggctacatgaaacca

SEQ ID NO: 56256 - DNA, 24 bp, Homo sapiens
tgtggccacatgtggcccagggca

SEQ ID NO: 56257 - DNA, 18 bp, Homo sapiens
tgtggctgcaagcaggac

SEQ ID NO: 56258 - DNA, 64 bp, Molluscum contagiosum virus
tgtaatcgtcacgtgaactccaaggtcgagctgactcggacactggaggtgagtcacgcttgca

SEQ ID NO: 56259 - DNA, 24 bp, Molluscum contagiosum virus
ggacactggaggtgagtcacgctt

SEQ ID NO: 56260 - DNA, 18 bp, Homo sapiens
ggcactggagtggcacct

SEQ ID NO: 56261 - DNA, 17 bp, Homo sapiens
ggcactggagtggcaac

SEQ ID NO: 56262 - DNA, 21 bp, Homo sapiens
ggggactggaggtgggtcgct

SEQ ID NO: 56263 - DNA, 22 bp, Homo sapiens
ggcgttagggaatcacgtgctt

SEQ ID NO: 56264 - DNA, 18 bp, Homo sapiens
ggacgctggaggtgcagt

SEQ ID NO: 56265 - DNA, 16 bp, Homo sapiens
ggacacgaaagtcacg

SEQ ID NO: 56266 - DNA, 23 bp, Homo sapiens
ggacactggagggagggcgtcct

SEQ ID NO: 56267 - DNA, 17 bp, Homo sapiens
ggcactggaggcgggcc

SEQ ID NO: 56268 - DNA, 20 bp, Homo sapiens
ggtgttggaggtgggtggct

SEQ ID NO: 56269 - DNA, 23 bp, Homo sapiens
ggcattagaaacacgtcacgctt

SEQ ID NO: 56270 - DNA, 19 bp, Homo sapiens
ggacaccggaggtgggtac

SEQ ID NO: 56271 - DNA, 19 bp, Homo sapiens
ggatttgggggctcacgct

SEQ ID NO: 56272 - DNA, 17 bp, Homo sapiens
ggacactggggttggcc

SEQ ID NO: 56273 - DNA, 90 bp, Sheeppox virus
aaggaatcgtatttattaaaaatagaaatgtgtatattttacacacaaatgatgaattaatagatttcttatttaaggagtatgatcctt

SEQ ID NO: 56274 - DNA, 24 bp, Sheeppox virus
aatcgtatttattaaaaatagaaa

SEQ ID NO: 56275 - DNA, 19 bp, Homo sapiens
cgtattccaagaaatagaa

SEQ ID NO: 56276 - DNA, 19 bp, Homo sapiens
gcttgtattaaaaatagaa

SEQ ID NO: 56277 - DNA, 18 bp, Homo sapiens
gtatcattaaaaatagaa

SEQ ID NO: 56278 - DNA, 21 bp, Homo sapiens
aatcctatcacaaaatagaaa

SEQ ID NO: 56279 - DNA, 60 bp, Gallid herpesvirus 3
gcgaccccagccacgcacgaacagagtttaacggaagcgtcgtttgcgggataaggttgt

SEQ ID NO: 56280 - DNA, 18 bp, Gallid herpesvirus 3
tttgcgggataaggttgt

SEQ ID NO: 56281 - DNA, 17 bp, Homo sapiens
tttgcagagtaggttgt

SEQ ID NO: 56282 - DNA, 18 bp, Homo sapiens
tctgcggggtacacggct

SEQ ID NO: 56283 - DNA, 16 bp, Homo sapiens
tttgcaaataggttgt

SEQ ID NO: 56284 - DNA, 19 bp, Homo sapiens
tttgcaggagctgagttgt

SEQ ID NO: 56285 - DNA, 18 bp, Homo sapiens
ttgtgggatgaaaattgt

SEQ ID NO: 56286 - DNA, 18 bp, Homo sapiens
tctggaaacaagggttgt

SEQ ID NO: 56287 - DNA, 16 bp, Homo sapiens
cttgcgggagagttgt

SEQ ID NO: 56288 - DNA, 16 bp, Homo sapiens
tctgcgggatcattgt

SEQ ID NO: 56289 - DNA, 18 bp, Homo sapiens
tttgtgagataaaactgt

SEQ ID NO: 56290 - DNA, 18 bp, Homo sapiens
tttgcagataccagttgt

SEQ ID NO: 56291 - DNA, 17 bp, Homo sapiens
tttgcgggacaggaggt

SEQ ID NO: 56292 - DNA, 15 bp, Homo sapiens
tttgcgggatgttgt

SEQ ID NO: 56293 - DNA, 20 bp, Homo sapiens
tttgcagaactccaggttgt

SEQ ID NO: 56294 - DNA, 15 bp, Homo sapiens
tttggggaaggttgt

SEQ ID NO: 56295 - DNA, 17 bp, Homo sapiens
tttgcggacatagttgt

SEQ ID NO: 56296 - DNA, 17 bp, Homo sapiens
cctgagggtaaggttgt

SEQ ID NO: 56297 - DNA, 70 bp, Yaba-like disease virus
tatatctattgtaattttacaagttataggaataatcgctatatttttttgtatattactttttgatgta

SEQ ID NO: 56298 - DNA, 17 bp, Yaba-like disease virus
tattactttttgatgta

SEQ ID NO: 56299 - DNA, 18 bp, Homo sapiens
tattactctttagatgta

SEQ ID NO: 56300 - DNA, 20 bp, Homo sapiens
tactactcagggctgatgta

SEQ ID NO: 56301 - DNA, 19 bp, Homo sapiens
tattactttgaatgatgta

SEQ ID NO: 56302 - DNA, 20 bp, Homo sapiens
tattacttaaaattgatgta

SEQ ID NO: 56303 - DNA, 126 bp, Yaba-like disease virus
tttatatattcattacagtaagatggtgataaattagttattacaacacacaaaaatattaataatatcatgttttttgttgataatatagtttattattcattttacagttttgttttatataaa

SEQ ID NO: 56304 - DNA, 24 bp, Yaba-like disease virus
taatatagtttattattcatttta

SEQ ID NO: 56305 - DNA, 22 bp, Homo sapiens
taatataatttattatgctctt

SEQ ID NO: 56306 - DNA, 20 bp, Homo sapiens
ataataaattattcatttta

SEQ ID NO: 56307 - DNA, 23 bp, Homo sapiens
taatataatcatgattcatttta

SEQ ID NO: 56308 - DNA, 23 bp, Homo sapiens
taacatatcaattattcatttta

SEQ ID NO: 56309 - DNA, 60 bp, Camelpox virus
gcatttatcgtctcaattataatattactaaagtataataggagaaaaaatatataatgt

SEQ ID NO: 56310 - DNA, 24 bp, Camelpox virus
taataggagaaaaaatatataatg

SEQ ID NO: 56311 - DNA, 19 bp, Homo sapiens
taataggagaaaaggcata

SEQ ID NO: 56312 - DNA, 18 bp, Homo sapiens
ataggagtttatataatg

SEQ ID NO: 56313 - DNA, 26 bp, Homo sapiens
caataggaggaagctaacatgtaatg

SEQ ID NO: 56314 - DNA, 18 bp, Homo sapiens
ggatttaaatatataatg

SEQ ID NO: 56315 - DNA, 20 bp, Homo sapiens
taggagaaaaggataaaatg

SEQ ID NO: 56316 - DNA, 62 bp, Camelpox virus
tgatacattgattaatgaaagaacttataatgcctcaaatgttccagtagttacgtgtttcg

SEQ ID NO: 56317 - DNA, 20 bp, Camelpox virus
tccagtagttacgtgtttcg

SEQ ID NO: 56318 - DNA, 19 bp, Homo sapiens
tccgcttctctgtgtttcg

SEQ ID NO: 56319 - DNA, 18 bp, Homo sapiens
tccagtagctgctgcatt

SEQ ID NO: 56320 - DNA, 17 bp, Homo sapiens
tctggtattacgtgtct

SEQ ID NO: 56321 - DNA, 18 bp, Homo sapiens
tccaataacaatgtttcg

SEQ ID NO: 56322 - DNA, 21 bp, Homo sapiens
tccagcagttaaagagattcg

SEQ ID NO: 56323 - DNA, 18 bp, Homo sapiens
tccagtaagtttatgttt

SEQ ID NO: 56324 - DNA, 21 bp, Homo sapiens
tccagtagtcaatgtatttcg

SEQ ID NO: 56325 - DNA, 16 bp, Homo sapiens
tccagtagttgccctt

SEQ ID NO: 56326 - DNA, 15 bp, Homo sapiens
tccagtagtgcatct

SEQ ID NO: 56327 - DNA, 15 bp, Homo sapiens
tccagtagctgcttc

SEQ ID NO: 56328 - DNA, 19 bp, Homo sapiens
tccaatagttttagtttcg

SEQ ID NO: 56329 - DNA, 62 bp, Camelpox virus
tttttacactattaagttttattgctactaaccgtagtaattttattaatgcagtataaaaa

SEQ ID NO: 56330 - DNA, 24 bp, Camelpox virus
tattaagttttattgctactaacc

SEQ ID NO: 56331 - DNA, 18 bp, Homo sapiens
taagtttcactgctgact

SEQ ID NO: 56332 - DNA, 21 bp, Homo sapiens
tattaagtatgaacattgcta

SEQ ID NO: 56333 - DNA, 22 bp, Homo sapiens
tattaagttttgctcaaggacc

SEQ ID NO: 56334 - DNA, 18 bp, Homo sapiens
tattaggttatattgcca

SEQ ID NO: 56335 - DNA, 18 bp, Homo sapiens
cattaagttttactgacc

SEQ ID NO: 56336 - DNA, 24 bp, Homo sapiens
attaagaacacattgctactggcc

SEQ ID NO: 56337 - DNA, 131 bp, Tobacco necrosis satellite virus
ggttcacaatgttagtgatggggcgctgaaagatgcgtagctacccttctggagccacttcctggtggtaagcagaaatccaagggtacggtggtacggtggaaagcagtcccagctctgcattgggaacc

SEQ ID NO: 56338 - DNA, 24 bp, Tobacco necrosis satellite virus
tggtaagcagaaatccaagggtac

SEQ ID NO: 56339 - DNA, 17 bp, Homo sapiens
ggtaggcaacaagggta

SEQ ID NO: 56340 - DNA, 19 bp, Homo sapiens
ggtaagcaggggtccaaga

SEQ ID NO: 56341 - DNA, 23 bp, Homo sapiens
tggaaagcagaagtctaagaggc

SEQ ID NO: 56342 - DNA, 19 bp, Homo sapiens
tggtaggcagaggcccgag

SEQ ID NO: 56343 - DNA, 23 bp, Homo sapiens
tggtaagcagacgacgtttggta

SEQ ID NO: 56344 - DNA, 17 bp, Homo sapiens
tgggcagggcccaaggg

SEQ ID NO: 56345 - DNA, 23 bp, Homo sapiens
tagaatcagaggtctaagggtac

SEQ ID NO: 56346 - DNA, 23 bp, Homo sapiens
tggtgagcagaaatgtcggaggt

SEQ ID NO: 56347 - DNA, 22 bp, Homo sapiens
tggtaagcaggggtccctgtgc

SEQ ID NO: 56348 - DNA, 15 bp, Homo sapiens
tggtaagcagagggc

SEQ ID NO: 56349 - DNA, 20 bp, Homo sapiens
gtaagcagaaatctgaaggt

SEQ ID NO: 56350 - DNA, 23 bp, Homo sapiens
ggtagaaaaggatctaagggtac

SEQ ID NO: 56351 - DNA, 23 bp, Homo sapiens
caaactgtggggatccaagggta

SEQ ID NO: 56352 - DNA, 16 bp, Homo sapiens
ggtagagtccaagggt

SEQ ID NO: 56353 - DNA, 20 bp, Homo sapiens
tggcaagcagaaatgaggta

SEQ ID NO: 56354 - DNA, 18 bp, Homo sapiens
ggagaggaatccaagggt

SEQ ID NO: 56355 - DNA, 21 bp, Homo sapiens
ggtagtgcatgatccaagggt

SEQ ID NO: 56356 - DNA, 60 bp, Duck adenovirus A
agttgaaagcattgatgaaatccttaggcatagccggtaattttctcgggactttcgact

SEQ ID NO: 56357 - DNA, 24 bp, Duck adenovirus A
ttgaaagcattgatgaaatcctta

SEQ ID NO: 56358 - DNA, 25 bp, Homo sapiens
ttgaaagctttaaataaggatcctt

SEQ ID NO: 56359 - DNA, 15 bp, Homo sapiens
ttgaaagaaaatcct

SEQ ID NO: 56360 - DNA, 16 bp, Homo sapiens
aaagcataaaatcctt

SEQ ID NO: 56361 - DNA, 18 bp, Homo sapiens
tgaaagcagaaaatcctt

SEQ ID NO: 56362 - DNA, 20 bp, Homo sapiens
gcaaaaggatgaaattctta

SEQ ID NO: 56363 - DNA, 19 bp, Homo sapiens
ttgaaagcattaatgaaat

SEQ ID NO: 56364 - DNA, 18 bp, Homo sapiens
ttggtagcaaaaatcctt

SEQ ID NO: 56365 - DNA, 67 bp, Petunia vein clearing virus
catgcgtgaagaagataagagggaatccacttttcagtagtggtcctatgtgtctaaagcatgcgtg

SEQ ID NO: 56366 - DNA, 24 bp, Petunia vein clearing virus
tcctatgtgtctaaagcatgcgtg

SEQ ID NO: 56367 - DNA, 21 bp, Homo sapiens
ctttgtgtgtgtgcatgcgtg

SEQ ID NO: 56368 - DNA, 18 bp, Homo sapiens
ctggtgtgtgcacgcgtg

SEQ ID NO: 56369 - DNA, 19 bp, Homo sapiens
ctatgtgtcaggcactgtg

SEQ ID NO: 56370 - DNA, 19 bp, Homo sapiens
tcactgtgtgtgcatgtgt

SEQ ID NO: 56371 - DNA, 18 bp, Homo sapiens
tcctatgtgtgcatgtgt

SEQ ID NO: 56372 - DNA, 18 bp, Homo sapiens
tatgtgcgtgcatgtgtg

SEQ ID NO: 56373 - DNA, 25 bp, Homo sapiens
tccatatccaaacaaagcatgtgtg

SEQ ID NO: 56374 - DNA, 25 bp, Homo sapiens
tcctgtgtgtctaggaaactttgtg

SEQ ID NO: 56375 - DNA, 17 bp, Homo sapiens
ctatgtgtgcacgcatg

SEQ ID NO: 56376 - DNA, 18 bp, Homo sapiens
tcctgtgtctctaaagca

SEQ ID NO: 56377 - DNA, 22 bp, Homo sapiens
tcctatgtatttacaaggcgtg

SEQ ID NO: 56378 - DNA, 21 bp, Homo sapiens
cttctgtgtctaacaggggtg

SEQ ID NO: 56379 - DNA, 76 bp, Petunia vein clearing virus
gctttttctattatggcattttgtaataatgctctgtccactatcgagtctgtattattaagtgtgataagtgtgc

SEQ ID NO: 56380 - DNA, 24 bp, Petunia vein clearing virus
tggcattttgtaataatgctctgt

SEQ ID NO: 56381 - DNA, 19 bp, Homo sapiens
tggcacttttgtactctat

SEQ ID NO: 56382 - DNA, 21 bp, Homo sapiens
tggcctttcagagtgctctgt

SEQ ID NO: 56383 - DNA, 19 bp, Homo sapiens
tggtgttttgtaaaacact

SEQ ID NO: 56384 - DNA, 18 bp, Homo sapiens
ggcatttgtgatgctctg

SEQ ID NO: 56385 - DNA, 20 bp, Homo sapiens
tggtgttttttgtgctctgt

SEQ ID NO: 56386 - DNA, 25 bp, Homo sapiens
tgtattttgtaataatgcaacatgt

SEQ ID NO: 56387 - DNA, 21 bp, Homo sapiens
tggcactggctggtgctctgt

SEQ ID NO: 56388 - DNA, 18 bp, Homo sapiens
tagcattttgtagtaatg

SEQ ID NO: 56389 - DNA, 22 bp, Homo sapiens
tgagtatttgttaatgctctgt

SEQ ID NO: 56390 - DNA, 18 bp, Homo sapiens
ggtgctgatgatgctctg

SEQ ID NO: 56391 - DNA, 16 bp, Homo sapiens
tggtttttgtaactct

SEQ ID NO: 56392 - DNA, 19 bp, Homo sapiens
tggcatttgtacatctctg

SEQ ID NO: 56393 - DNA, 93 bp, Petunia vein clearing virus
attatcatcaataaaatgtttgtgtgaataactctctcttgtttccaaactctcaaaatggtagttcgatcctaatattaaattgaaggtgat

SEQ ID NO: 56394 - DNA, 24 bp, Petunia vein clearing virus
tgtgaataactctctcttgtttcc

SEQ ID NO: 56395 - DNA, 19 bp, Homo sapiens
tgtaataattctcttgctt

SEQ ID NO: 56396 - DNA, 16 bp, Homo sapiens
tgagaataacttgttt

SEQ ID NO: 56397 - DNA, 19 bp, Homo sapiens
tgtggataacctctgcctc

SEQ ID NO: 56398 - DNA, 20 bp, Homo sapiens
tgtggatacagccttgtttc

SEQ ID NO: 56399 - DNA, 20 bp, Homo sapiens
tgaatgactgacttgtttcc

SEQ ID NO: 56400 - DNA, 19 bp, Homo sapiens
tgaataattctgctgtttc

SEQ ID NO: 56401 - DNA, 21 bp, Homo sapiens
gtgaatgaacacccttgtttc

SEQ ID NO: 56402 - DNA, 17 bp, Homo sapiens
tgtgagaactctctctc

SEQ ID NO: 56403 - DNA, 18 bp, Homo sapiens
tgtgaatggctgtctcct

SEQ ID NO: 56404 - DNA, 21 bp, Homo sapiens
tgagaataactttacttgttt

SEQ ID NO: 56405 - DNA, 17 bp, Homo sapiens
tgtgaataacctctccc

SEQ ID NO: 56406 - DNA, 19 bp, Homo sapiens
tgtaaatagttttctctcc

SEQ ID NO: 56407 - DNA, 21 bp, Homo sapiens
tggaatttcactcttgtttcc

SEQ ID NO: 56408 - DNA, 22 bp, Homo sapiens
tgtgaaagggagtcttgtttcc

SEQ ID NO: 56409 - DNA, 25 bp, Homo sapiens
tgtgaataatttatagcctctttcc

SEQ ID NO: 56410 - DNA, 22 bp, Homo sapiens
tgtgaacagttctttcggcttc

SEQ ID NO: 56411 - DNA, 19 bp, Homo sapiens
tgaaggttctcttgtttcc

SEQ ID NO: 56412 - DNA, 22 bp, Homo sapiens
tgtgaatagtttctcagttttc

SEQ ID NO: 56413 - DNA, 18 bp, Homo sapiens
tatgaataactcgtgttt

SEQ ID NO: 56414 - DNA, 25 bp, Homo sapiens
tgtaaataacagaagatttgtttcc

SEQ ID NO: 56415 - DNA, 23 bp, Homo sapiens
tggacgtactttctcttgtttcc

SEQ ID NO: 56416 - DNA, 19 bp, Homo sapiens
tgtgaaatagctcccgttt

SEQ ID NO: 56417 - DNA, 19 bp, Homo sapiens
tgtgggtaactcctgcttc

SEQ ID NO: 56418 - DNA, 23 bp, Homo sapiens
tgtgaacagagctttttgtttcc

SEQ ID NO: 56419 - DNA, 20 bp, Homo sapiens
tgtgagtcacttcctgtttc

SEQ ID NO: 56420 - DNA, 22 bp, Homo sapiens
tgtgaattgactctctcagtct

SEQ ID NO: 56421 - DNA, 20 bp, Homo sapiens
tgtgaataacctcagtattc

SEQ ID NO: 56422 - DNA, 22 bp, Homo sapiens
tatgagtgactctctcctatct

SEQ ID NO: 56423 - DNA, 84 bp, Melanoplus sanguinipes entomopoxvirus
atgaacatataagatacaatgactttagtaatttacattcttcacgattaacaattatttttacaaattttgattttattttat

SEQ ID NO: 56424 - DNA, 24 bp, Melanoplus sanguinipes entomopoxvirus
taagatacaatgactttagtaatt

SEQ ID NO: 56425 - DNA, 21 bp, Homo sapiens
gatgtctgtactttagtaatt

SEQ ID NO: 56426 - DNA, 17 bp, Homo sapiens
gaaacaatgacttaata

SEQ ID NO: 56427 - DNA, 19 bp, Homo sapiens
gatgcaatgactcagaatt

SEQ ID NO: 56428 - DNA, 22 bp, Homo sapiens
aaggtacaatgactaagcaatt

SEQ ID NO: 56429 - DNA, 20 bp, Homo sapiens
taagattgatgactttcagt

SEQ ID NO: 56430 - DNA, 130 bp, B19 virus
ttccggaattagggttggctctgggccagcttgcttggggttgccttgacactaagacaagcggcgcgccgcttgtcttagtggcacgtcaaccccaagcgctggcccagagccaaccctaattccggaa

SEQ ID NO: 56431 - DNA, 24 bp, B19 virus
ttagtggcacgtcaaccccaagcg

SEQ ID NO: 56432 - DNA, 22 bp, Homo sapiens
tgagcaccttgtcaaccccaag

SEQ ID NO: 56433 - DNA, 98 bp, B19 virus
ttcccgccttatgcaaatgggcagccattttaagtgtttcactataattttattggtcagttttgtaacggttaaaatgggcggagcgtaggcgggga

SEQ ID NO: 56434 - DNA, 24 bp, B19 virus
agccattttaagtgtttcactata

SEQ ID NO: 56435 - DNA, 20 bp, Homo sapiens
ccattttagttctcactata

SEQ ID NO: 56436 - DNA, 21 bp, Homo sapiens
agccactttaaattctttgct

SEQ ID NO: 56437 - DNA, 19 bp, Homo sapiens
gccattttaggtgaactat

SEQ ID NO: 56438 - DNA, 18 bp, Homo sapiens
gccatttaaagtgtttca

SEQ ID NO: 56439 - DNA, 18 bp, Homo sapiens
agccatctttttcattat

SEQ ID NO: 56440 - DNA, 23 bp, Homo sapiens
gctattttaagcaatcttgctat

SEQ ID NO: 56441 - DNA, 20 bp, Homo sapiens
accattttaagtgttaccat

SEQ ID NO: 56442 - DNA, 15 bp, Homo sapiens
accatttgtttcact

SEQ ID NO: 56443 - DNA, 15 bp, Homo sapiens
accatttttttcact

SEQ ID NO: 56444 - DNA, 19 bp, Homo sapiens
gctttttgagtctcactat

SEQ ID NO: 56445 - DNA, 18 bp, Homo sapiens
gcattttgcatcactata

SEQ ID NO: 56446 - DNA, 20 bp, Homo sapiens
gccattcttgcattgctata

SEQ ID NO: 56447 - DNA, 16 bp, Homo sapiens
agccattctggtcact

SEQ ID NO: 56448 - DNA, 24 bp, Homo sapiens
agcattttaactatttttgctata

SEQ ID NO: 56449 - DNA, 23 bp, Homo sapiens
agctatcttaaggatattactat

SEQ ID NO: 56450 - DNA, 22 bp, Homo sapiens
gcacatttgttattttcactat

SEQ ID NO: 56451 - DNA, 23 bp, Homo sapiens
agccattctgatgagttcactat

SEQ ID NO: 56452 - DNA, 82 bp, Murray Valley encephalitis virus
gatcttctgctctattccaacatcagtcacaaggcaccgagcgccgaacactgtgactgatgggggagaagaccacaggatc

SEQ ID NO: 56453 - DNA, 24 bp, Murray Valley encephalitis virus
aacactgtgactgatgggggagaa

SEQ ID NO: 56454 - DNA, 15 bp, Homo sapiens
ctggacccgggagaa

SEQ ID NO: 56455 - DNA, 22 bp, Homo sapiens
acactgatgtgtggtgggggag

SEQ ID NO: 56456 - DNA, 17 bp, Homo sapiens
ctgtggctatgggggag

SEQ ID NO: 56457 - DNA, 18 bp, Homo sapiens
accttgggaatgggggag

SEQ ID NO: 56458 - DNA, 18 bp, Homo sapiens
acactgaggctgagagag

SEQ ID NO: 56459 - DNA, 16 bp, Homo sapiens
acactggatgggagag

SEQ ID NO: 56460 - DNA, 22 bp, Homo sapiens
aacactgttgttgatggtccgg

SEQ ID NO: 56461 - DNA, 16 bp, Homo sapiens
acacgtgacaagggag

SEQ ID NO: 56462 - DNA, 17 bp, Homo sapiens
ccgttggtgggggagaa

SEQ ID NO: 56463 - DNA, 19 bp, Homo sapiens
tgctgctgtcgggggagaa

SEQ ID NO: 56464 - DNA, 18 bp, Homo sapiens
acactgtggctgaaagaa

SEQ ID NO: 56465 - DNA, 19 bp, Homo sapiens
actgtggctgaagcgaggg

SEQ ID NO: 56466 - DNA, 17 bp, Homo sapiens
tgtgtgattaggggaga

SEQ ID NO: 56467 - DNA, 18 bp, Homo sapiens
acacagcccatgggggag

SEQ ID NO: 56468 - DNA, 16 bp, Homo sapiens
tgtgttggggggagaa

SEQ ID NO: 56469 - DNA, 18 bp, Homo sapiens
ctgggattgataaaagaa

SEQ ID NO: 56470 - DNA, 17 bp, Homo sapiens
cactgtattgataaagg

SEQ ID NO: 56471 - DNA, 20 bp, Homo sapiens
gtaactcaagggtgggggag

SEQ ID NO: 56472 - DNA, 17 bp, Homo sapiens
ctgtggatagaggagaa

SEQ ID NO: 56473 - DNA, 20 bp, Homo sapiens
actcgtaggatgggggagaa

SEQ ID NO: 56474 - DNA, 18 bp, Homo sapiens
ctgtgggaaaggggagaa

SEQ ID NO: 56475 - DNA, 16 bp, Homo sapiens
aacactgtacagggag

SEQ ID NO: 56476 - DNA, 18 bp, Homo sapiens
tgtgactgtattggggaa

SEQ ID NO: 56477 - DNA, 21 bp, Homo sapiens
aacactgtggatgttagggaa

SEQ ID NO: 56478 - DNA, 15 bp, Homo sapiens
actatgactggagaa

SEQ ID NO: 56479 - DNA, 17 bp, Homo sapiens
actgtggccaggggaga

SEQ ID NO: 56480 - DNA, 16 bp, Homo sapiens
ctggagaatgggggag

SEQ ID NO: 56481 - DNA, 18 bp, Homo sapiens
ctgtgatgagatatagaa

SEQ ID NO: 56482 - DNA, 21 bp, Homo sapiens
aacactgtgacaaagggagag

SEQ ID NO: 56483 - DNA, 23 bp, Homo sapiens
aacactgtgacggatcctgggga

SEQ ID NO: 56484 - DNA, 20 bp, Homo sapiens
aacactgtgatgatggtgag

SEQ ID NO: 56485 - DNA, 20 bp, Homo sapiens
aacactgtggtatgtggggg

SEQ ID NO: 56486 - DNA, 18 bp, Homo sapiens
acacctgtggctggggaa

SEQ ID NO: 56487 - DNA, 19 bp, Homo sapiens
cacttgagaagaggggaga

SEQ ID NO: 56488 - DNA, 20 bp, Homo sapiens
acatgtggctgggactgggg

SEQ ID NO: 56489 - DNA, 18 bp, Homo sapiens
actggagggaggggggaa

SEQ ID NO: 56490 - DNA, 19 bp, Homo sapiens
caatgtgactggaacagaa

SEQ ID NO: 56491 - DNA, 15 bp, Homo sapiens
acactgtgaggggag

SEQ ID NO: 56492 - DNA, 18 bp, Homo sapiens
cactttgattgaagagaa

SEQ ID NO: 56493 - DNA, 20 bp, Homo sapiens
cactgtgagctaagggggag

SEQ ID NO: 56494 - DNA, 19 bp, Homo sapiens
aacatggtgactgagaggg

SEQ ID NO: 56495 - DNA, 22 bp, Homo sapiens
cactgtgacttagactggagga

SEQ ID NO: 56496 - DNA, 20 bp, Homo sapiens
aacactgagacatgggagag

SEQ ID NO: 56497 - DNA, 18 bp, Homo sapiens
aacactgtggctgcaggg

SEQ ID NO: 56498 - DNA, 23 bp, Homo sapiens
acttgtgactgatgtgtaaagaa

SEQ ID NO: 56499 - DNA, 21 bp, Homo sapiens
aacacagtgatcccaggggag

SEQ ID NO: 56500 - DNA, 19 bp, Homo sapiens
catgtgacttcggggagaa

SEQ ID NO: 56501 - DNA, 18 bp, Homo sapiens
aaccttgtattgggggag

SEQ ID NO: 56502 - DNA, 18 bp, Homo sapiens
ctgggaggtgggggagaa

SEQ ID NO: 56503 - DNA, 23 bp, Homo sapiens
aacaccgggaggggtgggggaga

SEQ ID NO: 56504 - DNA, 16 bp, Homo sapiens
acactgtactggggaa

SEQ ID NO: 56505 - DNA, 18 bp, Homo sapiens
actgtggctggaagagaa

SEQ ID NO: 56506 - DNA, 18 bp, Homo sapiens
ctgtaaagaaggggggaa

SEQ ID NO: 56507 - DNA, 17 bp, Homo sapiens
actgtgctctgggagag

SEQ ID NO: 56508 - DNA, 17 bp, Homo sapiens
ctgggaaatgggggaga

SEQ ID NO: 56509 - DNA, 18 bp, Homo sapiens
cactgtgcccaggggaga

SEQ ID NO: 56510 - DNA, 19 bp, Homo sapiens
aacactgtgtttctggagg

SEQ ID NO: 56511 - DNA, 19 bp, Homo sapiens
ctgtgactgacttttggaa

SEQ ID NO: 56512 - DNA, 17 bp, Homo sapiens
actgtgtggtgggagag

SEQ ID NO: 56513 - DNA, 18 bp, Homo sapiens
cactgtatggtgggggag

SEQ ID NO: 56514 - DNA, 23 bp, Homo sapiens
aacactgtgattagaccacagaa

SEQ ID NO: 56515 - DNA, 18 bp, Homo sapiens
ctgtggtttgggggagaa

SEQ ID NO: 56516 - DNA, 18 bp, Homo sapiens
ctgtgactgattctggaa

SEQ ID NO: 56517 - DNA, 19 bp, Homo sapiens
actgtgatgagagggagaa

SEQ ID NO: 56518 - DNA, 19 bp, Homo sapiens
aacaatgtgactgggagag

SEQ ID NO: 56519 - DNA, 20 bp, Homo sapiens
cactgtgactgataatggag

SEQ ID NO: 56520 - DNA, 19 bp, Homo sapiens
ataactagggatgggggag

SEQ ID NO: 56521 - DNA, 18 bp, Homo sapiens
caccgggtggtgggggag

SEQ ID NO: 56522 - DNA, 19 bp, Homo sapiens
caggatgttggtgggggag

SEQ ID NO: 56523 - DNA, 17 bp, Homo sapiens
cattgtgactgtgaggg

SEQ ID NO: 56524 - DNA, 18 bp, Homo sapiens
acactggggagggggaga

SEQ ID NO: 56525 - DNA, 24 bp, Homo sapiens
acactgtggcagagcagaagggag

SEQ ID NO: 56526 - DNA, 24 bp, Homo sapiens
aacactgtgtttggtgtcattggg

SEQ ID NO: 56527 - DNA, 17 bp, Homo sapiens
tgttgtaatgggggaga

SEQ ID NO: 56528 - DNA, 17 bp, Homo sapiens
actgtgactacggagaa

SEQ ID NO: 56529 - DNA, 18 bp, Homo sapiens
tgttctctaatgggggag

SEQ ID NO: 56530 - DNA, 20 bp, Homo sapiens
aacactgtgttctgggagag

SEQ ID NO: 56531 - DNA, 21 bp, Homo sapiens
acactgtggtgagctggagag

SEQ ID NO: 56532 - DNA, 17 bp, Homo sapiens
cagtgtgggagggggag

SEQ ID NO: 56533 - DNA, 22 bp, Homo sapiens
cactgatggctgagagtggaga

SEQ ID NO: 56534 - DNA, 16 bp, Homo sapiens
actggagatgggggag

SEQ ID NO: 56535 - DNA, 21 bp, Homo sapiens
aacactgtgcttggcggggaa

SEQ ID NO: 56536 - DNA, 21 bp, Homo sapiens
ctgtgactgacttcttgggag

SEQ ID NO: 56537 - DNA, 23 bp, Homo sapiens
aacactgtaactgaaacacagaa

SEQ ID NO: 56538 - DNA, 17 bp, Homo sapiens
cactgtgctcaggggag

SEQ ID NO: 56539 - DNA, 22 bp, Homo sapiens
aacctgtgactcagtgggagag

SEQ ID NO: 56540 - DNA, 19 bp, Homo sapiens
gactgtggtggtgggagaa

SEQ ID NO: 56541 - DNA, 18 bp, Homo sapiens
tgtgctggtgggggggaa

SEQ ID NO: 56542 - DNA, 17 bp, Homo sapiens
acactgtggttaaagga

SEQ ID NO: 56543 - DNA, 21 bp, Homo sapiens
aacattagtggttagggagaa

SEQ ID NO: 56544 - DNA, 17 bp, Homo sapiens
ctgtgaccaggggggag

SEQ ID NO: 56545 - DNA, 21 bp, Homo sapiens
acacatccccagatgggggag

SEQ ID NO: 56546 - DNA, 18 bp, Homo sapiens
acgctgtgctgcagaggg

SEQ ID NO: 56547 - DNA, 18 bp, Homo sapiens
aacagtgtggaggggaga

SEQ ID NO: 56548 - DNA, 18 bp, Homo sapiens
aacgtttgactgacagaa

SEQ ID NO: 56549 - DNA, 24 bp, Homo sapiens
acactgtgactgctgccttgtgag

SEQ ID NO: 56550 - DNA, 18 bp, Homo sapiens
cactgtgatgagggggag

SEQ ID NO: 56551 - DNA, 18 bp, Homo sapiens
aacacagtggaggggaga

SEQ ID NO: 56552 - DNA, 19 bp, Homo sapiens
aacctgtgacaagggagag

SEQ ID NO: 56553 - DNA, 16 bp, Homo sapiens
cattgtgacagaagaa

SEQ ID NO: 56554 - DNA, 18 bp, Homo sapiens
aacatttgactgacagga

SEQ ID NO: 56555 - DNA, 16 bp, Homo sapiens
aacactggatgggagg

SEQ ID NO: 56556 - DNA, 18 bp, Homo sapiens
ctgtgactggctggggag

SEQ ID NO: 56557 - DNA, 21 bp, Homo sapiens
aacatgtggctgcagggagag

SEQ ID NO: 56558 - DNA, 22 bp, Homo sapiens
cactaagtcctggtgggggaga

SEQ ID NO: 56559 - DNA, 18 bp, Homo sapiens
acactgtgactggtgcag

SEQ ID NO: 56560 - DNA, 19 bp, Homo sapiens
actgtgacatgaattggag

SEQ ID NO: 56561 - DNA, 18 bp, Homo sapiens
aacctgtggctaggggaa

SEQ ID NO: 56562 - DNA, 17 bp, Homo sapiens
cactgtgatgccggggg

SEQ ID NO: 56563 - DNA, 23 bp, Homo sapiens
aacactgtggatggcatggggaa

SEQ ID NO: 56564 - DNA, 22 bp, Homo sapiens
aacattgtgactatgtaatgaa

SEQ ID NO: 56565 - DNA, 19 bp, Homo sapiens
cacagtggcggcgggggaa

SEQ ID NO: 56566 - DNA, 16 bp, Homo sapiens
actgtgacttggggag

SEQ ID NO: 56567 - DNA, 17 bp, Homo sapiens
actgtggtgtgggggaa

SEQ ID NO: 56568 - DNA, 16 bp, Homo sapiens
tgtaaatgggggagaa

SEQ ID NO: 56569 - DNA, 15 bp, Homo sapiens
catgtgactggagag

SEQ ID NO: 56570 - DNA, 17 bp, Homo sapiens
ctgtggccctgggagga

SEQ ID NO: 56571 - DNA, 15 bp, Homo sapiens
cactgtgacgggaga

SEQ ID NO: 56572 - DNA, 20 bp, Homo sapiens
cactgtgagctgggataggg

SEQ ID NO: 56573 - DNA, 18 bp, Homo sapiens
ctgtgggcgaagggagaa

SEQ ID NO: 56574 - DNA, 16 bp, Homo sapiens
ctgtggaaaggggaga

SEQ ID NO: 56575 - DNA, 20 bp, Homo sapiens
acactttgactgtaagagga

SEQ ID NO: 56576 - DNA, 16 bp, Homo sapiens
actgtgaagaggggag

SEQ ID NO: 56577 - DNA, 20 bp, Homo sapiens
aacatgtgaccatgtgggag

SEQ ID NO: 56578 - DNA, 77 bp, Vaccinia virus
tatcaagatgtgtatgtttgtgaaaattgtggagacatagcagcacaaatcaagggtattaatacatgtcttagatg

SEQ ID NO: 56579 - DNA, 24 bp, Vaccinia virus
cagcacaaatcaagggtattaata

SEQ ID NO: 56580 - DNA, 22 bp, Homo sapiens
cagcgcatgattggatattaat

SEQ ID NO: 56581 - DNA, 22 bp, Homo sapiens
cagcagaagtcaagggtcatta

SEQ ID NO: 56582 - DNA, 16 bp, Homo sapiens
gcagatcagagcatta

SEQ ID NO: 56583 - DNA, 21 bp, Homo sapiens
actacaaatcaagccacagta

SEQ ID NO: 56584 - DNA, 24 bp, Homo sapiens
agcagaatcaagagtagattaata

SEQ ID NO: 56585 - DNA, 18 bp, Homo sapiens
cacataaggagtattaat

SEQ ID NO: 56586 - DNA, 27 bp, Homo sapiens
cagcacacattaggaatactattaata

SEQ ID NO: 56587 - DNA, 20 bp, Homo sapiens
acacaaatcaatttttaata

SEQ ID NO: 56588 - DNA, 20 bp, Homo sapiens
gcacaaacgagccagcaata

SEQ ID NO: 56589 - DNA, 18 bp, Homo sapiens
cagcacaatcaaggtgta

SEQ ID NO: 56590 - DNA, 18 bp, Homo sapiens
cagcacaaggtagggatt

SEQ ID NO: 56591 - DNA, 74 bp, Amsacta moorei entomopoxvirus
cctaatttattaagatcagatggattataacatgtttctgaatatctaaaatctattacaatttttaaattagg

SEQ ID NO: 56592 - DNA, 24 bp, Amsacta moorei entomopoxvirus
taaaatctattacaatttttaaat

SEQ ID NO: 56593 - DNA, 19 bp, Homo sapiens
aaatctccccaatttttaa

SEQ ID NO: 56594 - DNA, 21 bp, Homo sapiens
aatgtattacaatttttaaat

SEQ ID NO: 56595 - DNA, 20 bp, Homo sapiens
aaatctcccaatttttaaat

SEQ ID NO: 56596 - DNA, 19 bp, Homo sapiens
taagatctattacaatttt

SEQ ID NO: 56597 - DNA, 82 bp, Amsacta moorei entomopoxvirus
atttatatatatttctctttctatataatatcctctatttttttcgaaaatatttatagcaacataaggtggaattttaaat

SEQ ID NO: 56598 - DNA, 24 bp, Amsacta moorei entomopoxvirus
tatatatttctctttctatataat

SEQ ID NO: 56599 - DNA, 23 bp, Homo sapiens
tatatatttcccttacatataat

SEQ ID NO: 56600 - DNA, 18 bp, Homo sapiens
tatagggcctctttctat

SEQ ID NO: 56601 - DNA, 18 bp, Homo sapiens
tatatatatttctttcta

SEQ ID NO: 56602 - DNA, 18 bp, Homo sapiens
tatatatttccctgccat

SEQ ID NO: 56603 - DNA, 22 bp, Homo sapiens
tataatggtatctttctatata

SEQ ID NO: 56604 - DNA, 22 bp, Homo sapiens
tatatatttatctttatatata

SEQ ID NO: 56605 - DNA, 18 bp, Homo sapiens
tatatatttttctttcca

SEQ ID NO: 56606 - DNA, 18 bp, Homo sapiens
tatatatttctcttttct

SEQ ID NO: 56607 - DNA, 72 bp, Equine herpesvirus 1
accatataaacgaagccaaactacagagagtgccgtcaacgatgtttttattggttactcgttttgggtggt

SEQ ID NO: 56608 - DNA, 24 bp, Equine herpesvirus 1
taaacgaagccaaactacagagag

SEQ ID NO: 56609 - DNA, 16 bp, Homo sapiens
gaagccctacagagag

SEQ ID NO: 56610 - DNA, 19 bp, Homo sapiens
tgaccataaactacagaga

SEQ ID NO: 56611 - DNA, 21 bp, Homo sapiens
taaattaagccaaagttggag

SEQ ID NO: 56612 - DNA, 22 bp, Homo sapiens
aaacgaagccgtgctgggggag

SEQ ID NO: 56613 - DNA, 19 bp, Homo sapiens
gaagccaagactgagggag

SEQ ID NO: 56614 - DNA, 19 bp, Homo sapiens
gaagccaagcacaccagag

SEQ ID NO: 56615 - DNA, 18 bp, Homo sapiens
aacgaagctaaactacag

SEQ ID NO: 56616 - DNA, 19 bp, Homo sapiens
gaagccaagccataaagag

SEQ ID NO: 56617 - DNA, 15 bp, Homo sapiens
taaacgaagctacag

SEQ ID NO: 56618 - DNA, 18 bp, Homo sapiens
taaatgaaccaaactcag

SEQ ID NO: 56619 - DNA, 77 bp, Equine herpesvirus 1
gccccgagtcgcgtggatgagcaacgctaaacaacaaccgttttttcgctaccgctcccccagccggggctcggagc

SEQ ID NO: 56620 - DNA, 24 bp, Equine herpesvirus 1
tgagcaacgctaaacaacaaccgt

SEQ ID NO: 56621 - DNA, 17 bp, Homo sapiens
gaacaaccaacaactgt

SEQ ID NO: 56622 - DNA, 24 bp, Homo sapiens
tgattgtaactaagtaacaaccgt

SEQ ID NO: 56623 - DNA, 72 bp, Equine herpesvirus 1
accacccaaaacgagtaaccaataaaaacatcgttgacggcactctctgtagtttggcttcgtttatatggt

SEQ ID NO: 56624 - DNA, 18 bp, Equine herpesvirus 1
tggcttcgtttatatggt

SEQ ID NO: 56625 - DNA, 15 bp, Homo sapiens
tggcatctacatggt

SEQ ID NO: 56626 - DNA, 20 bp, Homo sapiens
tggcctcactcctgtgtggt

SEQ ID NO: 56627 - DNA, 18 bp, Homo sapiens
tggcttcataccacaggt

SEQ ID NO: 56628 - DNA, 19 bp, Homo sapiens
tggcctcatgctatgtggt

SEQ ID NO: 56629 - DNA, 17 bp, Homo sapiens
tggctcacatttgtggt

SEQ ID NO: 56630 - DNA, 15 bp, Homo sapiens
tggcattcatatggt

SEQ ID NO: 56631 - DNA, 16 bp, Homo sapiens
tggcttcgctcagggt

SEQ ID NO: 56632 - DNA, 17 bp, Homo sapiens
tgtttcattcatatggt

SEQ ID NO: 56633 - DNA, 15 bp, Homo sapiens
tggcattcacatggt

SEQ ID NO: 56634 - DNA, 17 bp, Homo sapiens
tggcttcgttcaaaggt

SEQ ID NO: 56635 - DNA, 17 bp, Homo sapiens
tggcttcaccccatggt

SEQ ID NO: 56636 - DNA, 15 bp, Homo sapiens
tagcttctacatggt

SEQ ID NO: 56637 - DNA, 18 bp, Homo sapiens
tggctcaagctgtatggt

SEQ ID NO: 56638 - DNA, 17 bp, Homo sapiens
tggcctttttatgtggt

SEQ ID NO: 56639 - DNA, 17 bp, Homo sapiens
tgttttccttatatggt

SEQ ID NO: 56640 - DNA, 15 bp, Homo sapiens
tggccttcatatggt

SEQ ID NO: 56641 - DNA, 19 bp, Homo sapiens
tggctccatcagctatggt

SEQ ID NO: 56642 - DNA, 17 bp, Homo sapiens
tggcttcatcgattggt

SEQ ID NO: 56643 - DNA, 20 bp, Homo sapiens
tggctcttgcatacaatggt

SEQ ID NO: 56644 - DNA, 16 bp, Homo sapiens
tgtcttctcacatggt

SEQ ID NO: 56645 - DNA, 20 bp, Homo sapiens
tggcttcatccccaaatggt

SEQ ID NO: 56646 - DNA, 16 bp, Homo sapiens
tggctgttcacatggt

SEQ ID NO: 56647 - DNA, 18 bp, Homo sapiens
tgatcacatttatatggt

SEQ ID NO: 56648 - DNA, 16 bp, Homo sapiens
tggctccgtccacggt

SEQ ID NO: 56649 - DNA, 16 bp, Homo sapiens
tggcttagtacatggt

SEQ ID NO: 56650 - DNA, 18 bp, Homo sapiens
tggcttcgatgatacggt

SEQ ID NO: 56651 - DNA, 17 bp, Homo sapiens
tggctcgcccaggtggt

SEQ ID NO: 56652 - DNA, 17 bp, Homo sapiens
tggtcttcacacatggt

SEQ ID NO: 56653 - DNA, 69 bp, Sheeppox virus
tacattataatataactaactgtttaaacaatgatggtgttaaaactaaacttgttacattgtgatgta

SEQ ID NO: 56654 - DNA, 24 bp, Sheeppox virus
ttaaaactaaacttgttacattgt

SEQ ID NO: 56655 - DNA, 21 bp, Homo sapiens
aaaactaaacttaaaatttgt

SEQ ID NO: 56656 - DNA, 19 bp, Homo sapiens
ttaaaaccaagcttcattg

SEQ ID NO: 56657 - DNA, 19 bp, Homo sapiens
actgaacaagttacattgt

SEQ ID NO: 56658 - DNA, 19 bp, Homo sapiens
ttaaaacaaacatacattg

SEQ ID NO: 56659 - DNA, 18 bp, Homo sapiens
ttaaaacaaaacttgtta

SEQ ID NO: 56660 - DNA, 16 bp, Homo sapiens
aacttttgttacattg

SEQ ID NO: 56661 - DNA, 18 bp, Homo sapiens
actaaacttgtccacggt

SEQ ID NO: 56662 - DNA, 24 bp, Homo sapiens
ttaaaactaaaatactaccattgt

SEQ ID NO: 56663 - DNA, 121 bp, Fowl adenovirus D
ttatgtgggggatgttcttggggatgctttgcgggccaggcgatttggatttcgcgggttactgggactggtatttccgtgtttgtaacgcgagggttccttaataaatgtcttttcgtaa

SEQ ID NO: 56664 - DNA, 24 bp, Fowl adenovirus D
taacgcgagggttccttaataaat

SEQ ID NO: 56665 - DNA, 19 bp, Homo sapiens
acaaatttccttaataaat

SEQ ID NO: 56666 - DNA, 19 bp, Homo sapiens
gacattttccttaataaat

SEQ ID NO: 56667 - DNA, 19 bp, Homo sapiens
acgcgagggtttccccaat

SEQ ID NO: 56668 - DNA, 81 bp, Bovine adenovirus D
acagtagaaaaaaatacacaaagcgtacaatgtacgtgttcaggagcatgtggtttattttgtgtgttctttttatattgt

SEQ ID NO: 56669 - DNA, 24 bp, Bovine adenovirus D
aagcgtacaatgtacgtgttcagg

SEQ ID NO: 56670 - DNA, 17 bp, Homo sapiens
gcgtgtgtatgttcagg

SEQ ID NO: 56671 - DNA, 16 bp, Homo sapiens
aagctgtggtgtccag

SEQ ID NO: 56672 - DNA, 21 bp, Homo sapiens
aaggtacaaaacatgttcagg

SEQ ID NO: 56673 - DNA, 22 bp, Homo sapiens
acgtgcttgcagcgtgttcagg

SEQ ID NO: 56674 - DNA, 17 bp, Homo sapiens
gctacaatgtatgatag

SEQ ID NO: 56675 - DNA, 18 bp, Homo sapiens
aagcggcgatgtgtccaa

SEQ ID NO: 56676 - DNA, 16 bp, Homo sapiens
aagcggcaaatgttca

SEQ ID NO: 56677 - DNA, 74 bp, Tobacco mosaic virus
gcgaaccccacgactgccgaaacgttagatgctactcgtagagtagacgacgcaacggtggccataaggagcgc

SEQ ID NO: 56678 - DNA, 24 bp, Tobacco mosaic virus
tagacgacgcaacggtggccataa

SEQ ID NO: 56679 - DNA, 17 bp, Homo sapiens
taggtgagcagtggcca

SEQ ID NO: 56680 - DNA, 23 bp, Homo sapiens
tagataatgcacaaaagccataa

SEQ ID NO: 56681 - DNA, 18 bp, Homo sapiens
tagacagtgcaaaccata

SEQ ID NO: 56682 - DNA, 19 bp, Homo sapiens
tagacgtgaccaaccatag

SEQ ID NO: 56683 - DNA, 20 bp, Homo sapiens
tagcgtccgcggtggtggcc

SEQ ID NO: 56684 - DNA, 21 bp, Homo sapiens
gaggagcaagtggtggccata

SEQ ID NO: 56685 - DNA, 16 bp, Homo sapiens
tagacacgatggccat

SEQ ID NO: 56686 - DNA, 22 bp, Homo sapiens
tagacagctggacggtggccat

SEQ ID NO: 56687 - DNA, 71 bp, Tobacco mosaic virus
gatcagaggaaccggatcttataatcggagctctttcgagagctcttctggtttggtttggacctctggtc

SEQ ID NO: 56688 - DNA, 24 bp, Tobacco mosaic virus
tcttctggtttggtttggacctct

SEQ ID NO: 56689 - DNA, 15 bp, Homo sapiens
tcttctggctgaccc

SEQ ID NO: 56690 - DNA, 16 bp, Homo sapiens
tggtgtggagacctct

SEQ ID NO: 56691 - DNA, 20 bp, Homo sapiens
tcttctaggttgtagggttt

SEQ ID NO: 56692 - DNA, 20 bp, Homo sapiens
tcttttggtttgctttttgg

SEQ ID NO: 56693 - DNA, 18 bp, Homo sapiens
ttctggttttggatctct

SEQ ID NO: 56694 - DNA, 17 bp, Homo sapiens
tcctggtttggggtttc

SEQ ID NO: 56695 - DNA, 19 bp, Homo sapiens
tctgtttggtttggtttga

SEQ ID NO: 56696 - DNA, 19 bp, Homo sapiens
tctgctggtttgaagtctc

SEQ ID NO: 56697 - DNA, 21 bp, Homo sapiens
tctgctggtttgggggcttct

SEQ ID NO: 56698 - DNA, 18 bp, Homo sapiens
ttcttgtttggtttgaac

SEQ ID NO: 56699 - DNA, 19 bp, Homo sapiens
ttcgggtttggtggcctct

SEQ ID NO: 56700 - DNA, 19 bp, Homo sapiens
ttctggttgtggaacctct

SEQ ID NO: 56701 - DNA, 21 bp, Homo sapiens
cttctggttctgaggacttct

SEQ ID NO: 56702 - DNA, 19 bp, Homo sapiens
tcgttctggtttttgatct

SEQ ID NO: 56703 - DNA, 17 bp, Homo sapiens
ttctgatttggagtctc

SEQ ID NO: 56704 - DNA, 17 bp, Homo sapiens
ctctggtttttggtgac

SEQ ID NO: 56705 - DNA, 23 bp, Homo sapiens
tctttggtttggcatctgcctct

SEQ ID NO: 56706 - DNA, 20 bp, Homo sapiens
cttccccctggtttgggcct

SEQ ID NO: 56707 - DNA, 22 bp, Homo sapiens
tcttctggcttgtagggtttct

SEQ ID NO: 56708 - DNA, 16 bp, Homo sapiens
tcttctgctttggcct

SEQ ID NO: 56709 - DNA, 19 bp, Homo sapiens
ttctggtatggccagacct

SEQ ID NO: 56710 - DNA, 20 bp, Homo sapiens
ttctggttttcctgacttct

SEQ ID NO: 56711 - DNA, 21 bp, Homo sapiens
ccttctgggcattgggtctct

SEQ ID NO: 56712 - DNA, 82 bp, Japanese encephalitis virus
gatcttctgctctatctcaacatcagctactaggcacagagcgccgaagtatgtagctggtggtgaggaagaacacaggatc

SEQ ID NO: 56713 - DNA, 24 bp, Japanese encephalitis virus
tagctggtggtgaggaagaacaca

SEQ ID NO: 56714 - DNA, 19 bp, Homo sapiens
gctaaggaggaagaacaca

SEQ ID NO: 56715 - DNA, 20 bp, Homo sapiens
tggctgttgaccaaagaaca

SEQ ID NO: 56716 - DNA, 19 bp, Homo sapiens
tagctggggttcaggacac

SEQ ID NO: 56717 - DNA, 19 bp, Homo sapiens
tgattggtgataagagcac

SEQ ID NO: 56718 - DNA, 21 bp, Homo sapiens
tggtgagccaggaggagcaca

SEQ ID NO: 56719 - DNA, 17 bp, Homo sapiens
tggtggtggcaggcaca

SEQ ID NO: 56720 - DNA, 21 bp, Homo sapiens
gcaagtatgaggaagaataca

SEQ ID NO: 56721 - DNA, 16 bp, Homo sapiens
ggtggtgagggaacac

SEQ ID NO: 56722 - DNA, 20 bp, Homo sapiens
gctggggtgaggagacccca

SEQ ID NO: 56723 - DNA, 21 bp, Homo sapiens
tagctggctgggctggggcac

SEQ ID NO: 56724 - DNA, 23 bp, Homo sapiens
cagccagactgaggaagaacaca

SEQ ID NO: 56725 - DNA, 19 bp, Homo sapiens
tagctggctgtgggggcac

SEQ ID NO: 56726 - DNA, 18 bp, Homo sapiens
agctgacaggaagaacac

SEQ ID NO: 56727 - DNA, 22 bp, Homo sapiens
tacctggcagtgggaggaagaa

SEQ ID NO: 56728 - DNA, 19 bp, Homo sapiens
tggtgggccggaagaacac

SEQ ID NO: 56729 - DNA, 17 bp, Homo sapiens
tagttggtgagggacac

SEQ ID NO: 56730 - DNA, 18 bp, Homo sapiens
ggaggtggggaagaacac

SEQ ID NO: 56731 - DNA, 20 bp, Homo sapiens
gctggtgtatctaagaacac

SEQ ID NO: 56732 - DNA, 18 bp, Homo sapiens
ggaggtgaggaagggcac

SEQ ID NO: 56733 - DNA, 19 bp, Homo sapiens
tagctggttgtggtggcac

SEQ ID NO: 56734 - DNA, 17 bp, Homo sapiens
gctggtggtgcagacac

SEQ ID NO: 56735 - DNA, 16 bp, Homo sapiens
gctggtggaggagaca

SEQ ID NO: 56736 - DNA, 18 bp, Homo sapiens
tagctggtgctggggaag

SEQ ID NO: 56737 - DNA, 24 bp, Homo sapiens
cagctggtggtggggcagtggcac

SEQ ID NO: 56738 - DNA, 17 bp, Homo sapiens
gcctggtgagggaacac

SEQ ID NO: 56739 - DNA, 19 bp, Homo sapiens
tggtggtattggagaatac

SEQ ID NO: 56740 - DNA, 19 bp, Homo sapiens
tagctgggtggacagaaca

SEQ ID NO: 56741 - DNA, 24 bp, Homo sapiens
tggtggtgtagtgggaagggcaca

SEQ ID NO: 56742 - DNA, 24 bp, Homo sapiens
tagctggggtgaaaagcagaagaa

SEQ ID NO: 56743 - DNA, 22 bp, Homo sapiens
tagtggtggtaaaatggaagaa

SEQ ID NO: 56744 - DNA, 20 bp, Homo sapiens
agctggtggttaagaataca

SEQ ID NO: 56745 - DNA, 18 bp, Homo sapiens
ggccatgaggaaggacac

SEQ ID NO: 56746 - DNA, 19 bp, Homo sapiens
gcttggtgaggaagggcac

SEQ ID NO: 56747 - DNA, 18 bp, Homo sapiens
gctggtggcaaagaacac

SEQ ID NO: 56748 - DNA, 22 bp, Homo sapiens
cagctggagagggaaggacgca

SEQ ID NO: 56749 - DNA, 131 bp, Ovine adenovirus A
ccattgccgaaggcacaacccgccgccgacgcagagcagagcgccgccgcaggcgtcgtcaagcaacgagcgcaatgcgagccgccagagctctagtcaggtcagctaggcggcgtttagccaggcgaggg

SEQ ID NO: 56750 - DNA, 24 bp, Ovine adenovirus A
agcgcaatgcgagccgccagagct

SEQ ID NO: 56751 - DNA, 18 bp, Homo sapiens
agcgcaatgcgagctaga

SEQ ID NO: 56752 - DNA, 19 bp, Homo sapiens
acggctgggctgccagagc

SEQ ID NO: 56753 - DNA, 21 bp, Homo sapiens
gcaacctctgccgccagggct

SEQ ID NO: 56754 - DNA, 25 bp, Homo sapiens
gcagtacaccagagctgccagggct

SEQ ID NO: 56755 - DNA, 21 bp, Homo sapiens
agcgagatgcgggccagagct

SEQ ID NO: 56756 - DNA, 19 bp, Homo sapiens
agcgcggggcgagccgggc

SEQ ID NO: 56757 - DNA, 22 bp, Homo sapiens
agcccaaagccccgccagggct

SEQ ID NO: 56758 - DNA, 18 bp, Homo sapiens
agcgcaatgcaggctgcc

SEQ ID NO: 56759 - DNA, 20 bp, Homo sapiens
cgcagtgcgagccgtctgct

SEQ ID NO: 56760 - DNA, 23 bp, Homo sapiens
agcgcaagccccagcctagagct

SEQ ID NO: 56761 - DNA, 20 bp, Homo sapiens
gcaatgcagacgctggagct

SEQ ID NO: 56762 - DNA, 23 bp, Homo sapiens
gcctgcggggagccgccagagct

SEQ ID NO: 56763 - DNA, 20 bp, Homo sapiens
gcccagaacctgtcagggct

SEQ ID NO: 56764 - DNA, 22 bp, Homo sapiens
agccaatgcgaggggtggggct

SEQ ID NO: 56765 - DNA, 82 bp, Murid herpesvirus 4
aattgcatcaaccaccctgcgccctagtgtgacctcaaaaaagagcctggaacctactgggtgtgttatctgatgtgcgatt

SEQ ID NO: 56766 - DNA, 21 bp, Murid herpesvirus 4
tgtgttatctgatgtgcgatt

SEQ ID NO: 56767 - DNA, 18 bp, Homo sapiens
tgagttatctaaaatgtg

SEQ ID NO: 56768 - DNA, 20 bp, Homo sapiens
tggttatctgaatgtggatt

SEQ ID NO: 56769 - DNA, 18 bp, Homo sapiens
tgtgcttggggtgcgatt

SEQ ID NO: 56770 - DNA, 21 bp, Homo sapiens
gtgttgtctaatgtagtgatt

SEQ ID NO: 56771 - DNA, 18 bp, Homo sapiens
tgtgtttctgatgtccaa

SEQ ID NO: 56772 - DNA, 18 bp, Homo sapiens
tgtgttttctgatgcaca

SEQ ID NO: 56773 - DNA, 22 bp, Homo sapiens
tgtgttactgatcccactgatt

SEQ ID NO: 56774 - DNA, 60 bp, Paramecium bursaria Chlorella virus 1
aagtgtcatttgaccctgaatgacgaataaaataaaagtgtcattggtcatctgtcagtt

SEQ ID NO: 56775 - DNA, 20 bp, Paramecium bursaria Chlorella virus 1
tcattggtcatctgtcagtt

SEQ ID NO: 56776 - DNA, 16 bp, Homo sapiens
actgagtctgtcagtt

SEQ ID NO: 56777 - DNA, 18 bp, Homo sapiens
actgtttatctgtcagtt

SEQ ID NO: 56778 - DNA, 17 bp, Homo sapiens
tcatgaagctgtcagtt

SEQ ID NO: 56779 - DNA, 20 bp, Homo sapiens
tcattggcatctagtgagtt

SEQ ID NO: 56780 - DNA, 18 bp, Homo sapiens
tcattagcagagtcagtt

SEQ ID NO: 56781 - DNA, 16 bp, Homo sapiens
attgatcatctcaatt

SEQ ID NO: 56782 - DNA, 18 bp, Homo sapiens
ccgttccctctgtcagtt

SEQ ID NO: 56783 - DNA, 16 bp, Homo sapiens
actaatcctgtcagtt

SEQ ID NO: 56784 - DNA, 21 bp, Homo sapiens
tcactggtgttactgttggtt

SEQ ID NO: 56785 - DNA, 22 bp, Homo sapiens
tcattggtaacaaaactcagtt

SEQ ID NO: 56786 - DNA, 17 bp, Homo sapiens
attgattcctgtcagtt

SEQ ID NO: 56787 - DNA, 16 bp, Homo sapiens
cattgtcctgtcagtt

SEQ ID NO: 56788 - DNA, 17 bp, Homo sapiens
tcattgtcattgtcgtt

SEQ ID NO: 56789 - DNA, 17 bp, Homo sapiens
tctttggtcattcagtt

SEQ ID NO: 56790 - DNA, 17 bp, Homo sapiens
tcattggcatccaagct

SEQ ID NO: 56791 - DNA, 16 bp, Homo sapiens
tcttggtcatttcagt

SEQ ID NO: 56792 - DNA, 18 bp, Homo sapiens
caaaagcatctgtcagtt

SEQ ID NO: 56793 - DNA, 21 bp, Homo sapiens
cattggtcaggctggtcagtt

SEQ ID NO: 56794 - DNA, 17 bp, Homo sapiens
tcattggtttgtaagtt

SEQ ID NO: 56795 - DNA, 18 bp, Homo sapiens
tcattagttcatgcagtt

SEQ ID NO: 56796 - DNA, 20 bp, Homo sapiens
ttggtttttgtctgtcagtt

SEQ ID NO: 56797 - DNA, 17 bp, Homo sapiens
attggcaccattcagtt

SEQ ID NO: 56798 - DNA, 18 bp, Homo sapiens
atcttcacactgtcagtt

SEQ ID NO: 56799 - DNA, 19 bp, Homo sapiens
tcatttccacctgtcagtt

SEQ ID NO: 56800 - DNA, 16 bp, Homo sapiens
tcattggttatcagtt

SEQ ID NO: 56801 - DNA, 20 bp, Homo sapiens
tcagcgcccatctgttggtt

SEQ ID NO: 56802 - DNA, 17 bp, Homo sapiens
tcatttcactgtcagtt

SEQ ID NO: 56803 - DNA, 15 bp, Homo sapiens
cattggtcgtcaatt

SEQ ID NO: 56804 - DNA, 21 bp, Homo sapiens
tcattggtcattcctttggtt

SEQ ID NO: 56805 - DNA, 19 bp, Homo sapiens
tcattagtcaaaaccagtt

SEQ ID NO: 56806 - DNA, 18 bp, Homo sapiens
actgattttctgtcagtt

SEQ ID NO: 56807 - DNA, 17 bp, Homo sapiens
tcaatggtttgtcagtt

SEQ ID NO: 56808 - DNA, 18 bp, Homo sapiens
tcaatggttacatcagtt

SEQ ID NO: 56809 - DNA, 19 bp, Homo sapiens
tcctcaacatctgtcggtt

SEQ ID NO: 56810 - DNA, 18 bp, Homo sapiens
tcatggtcatcaaaagtt

SEQ ID NO: 56811 - DNA, 18 bp, Homo sapiens
tcactggtcgtcgaagtt

SEQ ID NO: 56812 - DNA, 19 bp, Homo sapiens
ttgtgtctcactgtcagtt

SEQ ID NO: 56813 - DNA, 16 bp, Homo sapiens
cattggtttatcagtt

SEQ ID NO: 56814 - DNA, 20 bp, Homo sapiens
tcatctgccttttgtcagtt

SEQ ID NO: 56815 - DNA, 17 bp, Homo sapiens
tcattggtctttcagct

SEQ ID NO: 56816 - DNA, 16 bp, Homo sapiens
tcattttctgtcagtt

SEQ ID NO: 56817 - DNA, 18 bp, Homo sapiens
tcattggccgacgtagtt

SEQ ID NO: 56818 - DNA, 19 bp, Homo sapiens
tcagttaggtctgtcagtt

SEQ ID NO: 56819 - DNA, 91 bp, Acute bee paralysis virus
gaatattattattgaaattatgtgagccacgtagcaatcaagtcatgtttttgtcactacgtttactcatctaatgtagataattttgttt

SEQ ID NO: 56820 - DNA, 22 bp, Acute bee paralysis virus
tctaatgtagataattttgttt

SEQ ID NO: 56821 - DNA, 21 bp, Homo sapiens
tctaatgtgagaatattgttt

SEQ ID NO: 56822 - DNA, 21 bp, Homo sapiens
tctaatgtagaaggcccattt

SEQ ID NO: 56823 - DNA, 17 bp, Homo sapiens
atgaaataattttgttt

SEQ ID NO: 56824 - DNA, 22 bp, Homo sapiens
tctcaatgtgatatttttgttt

SEQ ID NO: 56825 - DNA, 19 bp, Homo sapiens
tctaagtagataacatgtt

SEQ ID NO: 56826 - DNA, 19 bp, Homo sapiens
taatgtagataatttgttt

SEQ ID NO: 56827 - DNA, 67 bp, Acute bee paralysis virus
aacaacttataacacgatgttacccgaagaaaccattttagtgtaacatttaagattagaagtagtt

SEQ ID NO: 56828 - DNA, 24 bp, Acute bee paralysis virus
ttagtgtaacatttaagattagaa

SEQ ID NO: 56829 - DNA, 21 bp, Homo sapiens
ttagtgcagcattctatatag

SEQ ID NO: 56830 - DNA, 18 bp, Homo sapiens
atgtaacagctaattaga

SEQ ID NO: 56831 - DNA, 17 bp, Homo sapiens
gtgtaacattagtccag

SEQ ID NO: 56832 - DNA, 89 bp, Chimpanzee cytomegalovirus
gcgcctcggtctgagaaccggcctagcgttcggaccgcagtcgagacagatgacggtccgagccactgagcggttcccagccctggcgc

SEQ ID NO: 56833 - DNA, 24 bp, Chimpanzee cytomegalovirus
tagcgttcggaccgcagtcgagac

SEQ ID NO: 56834 - DNA, 21 bp, Homo sapiens
cagctgcggaccgcggtcgag

SEQ ID NO: 56835 - DNA, 18 bp, Homo sapiens
cagcgttcgggctggaga

SEQ ID NO: 56836 - DNA, 118 bp, Paramecium bursaria Chlorella virus 1
gtcttcgttgaaaactatgcatttatattgttttttaaccgccgttaagtggcgaaagatactttttgcatatacatatgcggttttaacgttttggacatagttcatatcgattaac

SEQ ID NO: 56837 - DNA, 24 bp, Paramecium bursaria Chlorella virus 1
tttgcatatacatatgcggtttta

SEQ ID NO: 56838 - DNA, 23 bp, Homo sapiens
tttgcatatacatcatgtcagtt

SEQ ID NO: 56839 - DNA, 24 bp, Homo sapiens
tttgcatatagtttctgtgtttta

SEQ ID NO: 56840 - DNA, 18 bp, Homo sapiens
ttgtatatacatatatag

SEQ ID NO: 56841 - DNA, 25 bp, Homo sapiens
tttgcataaatgaaaactggtttta

SEQ ID NO: 56842 - DNA, 25 bp, Homo sapiens
tttgcatatgggtatgacaaggttt

SEQ ID NO: 56843 - DNA, 23 bp, Homo sapiens
tttgtatatagatatacagtttt

SEQ ID NO: 56844 - DNA, 23 bp, Homo sapiens
tttccatgtagttgagcggtttt

SEQ ID NO: 56845 - DNA, 16 bp, Homo sapiens
tttgcaaatgcagttt

SEQ ID NO: 56846 - DNA, 20 bp, Homo sapiens
tttgacatatacatgtttca

SEQ ID NO: 56847 - DNA, 20 bp, Homo sapiens
tttgcatatggggcagtttt

SEQ ID NO: 56848 - DNA, 25 bp, Homo sapiens
tgtatatacatatatgaaaggtttt

SEQ ID NO: 56849 - DNA, 20 bp, Homo sapiens
tttgcatgtgctcggtttta

SEQ ID NO: 56850 - DNA, 22 bp, Homo sapiens
tgcatatgtatatacaacttta

SEQ ID NO: 56851 - DNA, 73 bp, Paramecium bursaria Chlorella virus 1
ttgtatttttcaagacgtattttttgttttatttcttctattgtcatatttgatgcgtattcaaaaaaatcaa

SEQ ID NO: 56852 - DNA, 24 bp, Paramecium bursaria Chlorella virus 1
tttgatgcgtattcaaaaaaatca

SEQ ID NO: 56853 - DNA, 22 bp, Homo sapiens
tttgatgtgtttccaaaaatca

SEQ ID NO: 56854 - DNA, 22 bp, Homo sapiens
tttggcaccttcagaaaaatca

SEQ ID NO: 56855 - DNA, 18 bp, Homo sapiens
tttgatgcgtgtatcaaa

SEQ ID NO: 56856 - DNA, 22 bp, Homo sapiens
tttaatgtgtatgcaaaaatca

SEQ ID NO: 56857 - DNA, 17 bp, Homo sapiens
tttgtgcgtcccaaaaa

SEQ ID NO: 56858 - DNA, 21 bp, Homo sapiens
tggtgcgtcctcaaaaaatca

SEQ ID NO: 56859 - DNA, 105 bp, Maize chlorotic mottle virus
gccacagaaccgcactgtgttcaggtgtatacaggctggtcagtttgctgcattgggcagcgccgctgacaagcaaatgtattccccaggacgattcattgtggc

SEQ ID NO: 56860 - DNA, 24 bp, Maize chlorotic mottle virus
tgacaagcaaatgtattccccagg

SEQ ID NO: 56861 - DNA, 17 bp, Homo sapiens
gcagcgtgttccccagg

SEQ ID NO: 56862 - DNA, 24 bp, Homo sapiens
tgactagcaaatgaggagcctggg

SEQ ID NO: 56863 - DNA, 19 bp, Homo sapiens
tgaggggcaggccccccag

SEQ ID NO: 56864 - DNA, 22 bp, Homo sapiens
tgctgagtgaatgcattccagg

SEQ ID NO: 56865 - DNA, 22 bp, Homo sapiens
tgatgagaaaatgcacctcagg

SEQ ID NO: 56866 - DNA, 20 bp, Homo sapiens
gacaagcagggttcctcagg

SEQ ID NO: 56867 - DNA, 22 bp, Homo sapiens
tgacagatgctttttccccagg

SEQ ID NO: 56868 - DNA, 19 bp, Homo sapiens
tggcaagtcaaaaccccag

SEQ ID NO: 56869 - DNA, 23 bp, Homo sapiens
tgacaaacaaatgtgaagacagg

SEQ ID NO: 56870 - DNA, 18 bp, Homo sapiens
gcaaatacattttccagg

SEQ ID NO: 56871 - DNA, 20 bp, Homo sapiens
agcaaatctgtgtccccagg

SEQ ID NO: 56872 - DNA, 20 bp, Homo sapiens
gcaggcgcggcttccccagg

SEQ ID NO: 56873 - DNA, 16 bp, Homo sapiens
tgacaagcacatgcca

SEQ ID NO: 56874 - DNA, 18 bp, Homo sapiens
gacaagcggggcccccag

SEQ ID NO: 56875 - DNA, 22 bp, Homo sapiens
aagcaaatggaagatcttcagg

SEQ ID NO: 56876 - DNA, 21 bp, Homo sapiens
gcacggtggaaattccccagg

SEQ ID NO: 56877 - DNA, 16 bp, Homo sapiens
gcagtgcttccccagg

SEQ ID NO: 56878 - DNA, 19 bp, Homo sapiens
tgagagctgtattccccag

SEQ ID NO: 56879 - DNA, 19 bp, Homo sapiens
caggcagggcacccccagg

SEQ ID NO: 56880 - DNA, 20 bp, Homo sapiens
acgggcaaatgttctccagg

SEQ ID NO: 56881 - DNA, 16 bp, Homo sapiens
gcaaaagctccccagg

SEQ ID NO: 56882 - DNA, 21 bp, Homo sapiens
agcaaatgctttgacccctgg

SEQ ID NO: 56883 - DNA, 19 bp, Homo sapiens
acaagcaaatattttcagg

SEQ ID NO: 56884 - DNA, 23 bp, Homo sapiens
tgggaagtggacgtccccccagg

SEQ ID NO: 56885 - DNA, 22 bp, Homo sapiens
tgacagcaaacagaacttcagg

SEQ ID NO: 56886 - DNA, 21 bp, Homo sapiens
tgaaaggcaaatgtggtcagg

SEQ ID NO: 56887 - DNA, 22 bp, Homo sapiens
tgggaagcaaatggggctcagg

SEQ ID NO: 56888 - DNA, 24 bp, Homo sapiens
tgacaagctggttctcacctcagg

SEQ ID NO: 56889 - DNA, 17 bp, Homo sapiens
gcagatgtgtccccagg

SEQ ID NO: 56890 - DNA, 19 bp, Homo sapiens
tgacaagcaatgcctcaga

SEQ ID NO: 56891 - DNA, 22 bp, Homo sapiens
tgacaagggagtacattccagg

SEQ ID NO: 56892 - DNA, 25 bp, Homo sapiens
tgacaagcggtgtgacacccccagg

SEQ ID NO: 56893 - DNA, 22 bp, Homo sapiens
tgacaagcagaggcctcccagg

SEQ ID NO: 56894 - DNA, 19 bp, Homo sapiens
tgaaagcaaatgaccttag

SEQ ID NO: 56895 - DNA, 23 bp, Homo sapiens
tgagggcagccacgttccccagg

SEQ ID NO: 56896 - DNA, 71 bp, Melanoplus sanguinipes entomopoxvirus
attaaatcattaatttctttatttgataatcgtttgactggcatatcaaataaattttttaatcctttagt

SEQ ID NO: 56897 - DNA, 24 bp, Melanoplus sanguinipes entomopoxvirus
tcattaatttctttatttgataat

SEQ ID NO: 56898 - DNA, 18 bp, Homo sapiens
taatttctttattaaaca

SEQ ID NO: 56899 - DNA, 21 bp, Homo sapiens
tcatttgtttctttattcaat

SEQ ID NO: 56900 - DNA, 19 bp, Homo sapiens
tcattaattttttcatcta

SEQ ID NO: 56901 - DNA, 19 bp, Homo sapiens
tcattaatttctgtaactg

SEQ ID NO: 56902 - DNA, 78 bp, Melanoplus sanguinipes entomopoxvirus
tattttagctatatcttttcctttataatatacttcaccaatagtagtatataaaaggtgaatttgattgttattata

SEQ ID NO: 56903 - DNA, 24 bp, Melanoplus sanguinipes entomopoxvirus
taaaaggtgaatttgattgttatt

SEQ ID NO: 56904 - DNA, 18 bp, Homo sapiens
aaaaggtgagtggctgtt

SEQ ID NO: 56905 - DNA, 19 bp, Homo sapiens
taaaaggtaaatttctgtt

SEQ ID NO: 56906 - DNA, 17 bp, Homo sapiens
aaaagtgaatttttgtt

SEQ ID NO: 56907 - DNA, 21 bp, Homo sapiens
taaagggtgaacttgagagct

SEQ ID NO: 56908 - DNA, 22 bp, Homo sapiens
taaaaggtgaaatataattgtt

SEQ ID NO: 56909 - DNA, 23 bp, Homo sapiens
taaaagagtgaatttttcatgtt

SEQ ID NO: 56910 - DNA, 17 bp, Homo sapiens
aaaaggtggaatgttat

SEQ ID NO: 56911 - DNA, 18 bp, Homo sapiens
aaggcttctttgattgtt

SEQ ID NO: 56912 - DNA, 23 bp, Homo sapiens
taaaaggtgaaatgttccttatt

SEQ ID NO: 56913 - DNA, 19 bp, Homo sapiens
aggtgaatttgaaaaggct

SEQ ID NO: 56914 - DNA, 23 bp, Homo sapiens
taaaaggtggcttactccttatt

SEQ ID NO: 56915 - DNA, 18 bp, Homo sapiens
tgaaggatgaatttgatt

SEQ ID NO: 56916 - DNA, 19 bp, Homo sapiens
taaaaggtgagttcttatt

SEQ ID NO: 56917 - DNA, 18 bp, Homo sapiens
aaaggtaaatttgatgtt

SEQ ID NO: 56918 - DNA, 21 bp, Homo sapiens
taaaaggttgatttgagtgtt

SEQ ID NO: 56919 - DNA, 22 bp, Homo sapiens
aaaagtaaatggtttgattgtt

SEQ ID NO: 56920 - DNA, 130 bp, Parvovirus H1
agatacatacgttcgctatggaccaagtggtaccggttggttgctaagctcgaacaagacggctaagccggtccggttggttgagcgcaaccaaccggtaccacttggtccatagcgaacgtatgtatct

SEQ ID NO: 56921 - DNA, 24 bp, Parvovirus H1
ttggttgagcgcaaccaaccggta

SEQ ID NO: 56922 - DNA, 28 bp, Homo sapiens
ttggttgataagctggtgtaccggttgg

SEQ ID NO: 56923 - DNA, 22 bp, Homo sapiens
ttggctgagcgcatcattggta

SEQ ID NO: 56924 - DNA, 15 bp, Homo sapiens
ctggtcccaaccagc

SEQ ID NO: 56925 - DNA, 18 bp, Homo sapiens
ttggttgagctaaccacc

SEQ ID NO: 56926 - DNA, 69 bp, Parvovirus H1
taatatggtaggttaactgtaaaaaataatagaacttttggaataaatatagttagttggttaatgtta

SEQ ID NO: 56927 - DNA, 24 bp, Parvovirus H1
tggtaggttaactgtaaaaaataa

SEQ ID NO: 56928 - DNA, 21 bp, Homo sapiens
tgataggtgctagtagaaaat

SEQ ID NO: 56929 - DNA, 19 bp, Homo sapiens
aggctaattgtaaaaaata

SEQ ID NO: 56930 - DNA, 18 bp, Homo sapiens
tgggaggttaacaaaaat

SEQ ID NO: 56931 - DNA, 24 bp, Homo sapiens
tggaggtccggttgtaaaaaataa

SEQ ID NO: 56932 - DNA, 60 bp, Rabbit fibroma virus
tattgctttattacttcatttttattataaataactgataaaaaagtactaccagcgata

SEQ ID NO: 56933 - DNA, 22 bp, Rabbit fibroma virus
taaaaaagtactaccagcgata

SEQ ID NO: 56934 - DNA, 17 bp, Homo sapiens
aaaaaaactcagcgata

SEQ ID NO: 56935 - DNA, 21 bp, Homo sapiens
taaaaaaatactgtcacaata

SEQ ID NO: 56936 - DNA, 21 bp, Homo sapiens
taaaaaaatactgccctgata

SEQ ID NO: 56937 - DNA, 17 bp, Homo sapiens
taaaaaagtacatgcaa

SEQ ID NO: 56938 - DNA, 17 bp, Homo sapiens
aaaaatactccagtgat

SEQ ID NO: 56939 - DNA, 18 bp, Homo sapiens
taaaaaagtacttgacag

SEQ ID NO: 56940 - DNA, 17 bp, Homo sapiens
aaaaaatactacacaat

SEQ ID NO: 56941 - DNA, 19 bp, Homo sapiens
aaaggaactttcagcgata

SEQ ID NO: 56942 - DNA, 20 bp, Homo sapiens
aaaaaaaaactccagtgata

SEQ ID NO: 56943 - DNA, 19 bp, Homo sapiens
aaaagagcaggcaccagcg

SEQ ID NO: 56944 - DNA, 70 bp, Rabbit fibroma virus
tataataatatacaataatcttttctgtgtgtaagataacgcgtttaagtatataagtatatagtttata

SEQ ID NO: 56945 - DNA, 24 bp, Rabbit fibroma virus
taatatacaataatcttttctgtg

SEQ ID NO: 56946 - DNA, 19 bp, Homo sapiens
tattcactacttttctgtg

SEQ ID NO: 56947 - DNA, 23 bp, Homo sapiens
taatacacaatgacgcaactgtg

SEQ ID NO: 56948 - DNA, 28 bp, Homo sapiens
taatatacagtacatgacatcttctgtg

SEQ ID NO: 56949 - DNA, 23 bp, Homo sapiens
aatatacaataatttagtttgtg

SEQ ID NO: 56950 - DNA, 24 bp, Homo sapiens
atatacaatagtccttgttctgtg

SEQ ID NO: 56951 - DNA, 108 bp, Melanoplus sanguinipes entomopoxvirus
ttagcaccatatccaaaataattgtacatttaaatataaaaattttaagttttttaaaaaccaataattcatgtttaaatattaaacaatttcttttcttttttctaa

SEQ ID NO: 56952 - DNA, 24 bp, Melanoplus sanguinipes entomopoxvirus
tgtacatttaaatataaaaatttt

SEQ ID NO: 56953 - DNA, 19 bp, Homo sapiens
tacatttaaatataaaaat

SEQ ID NO: 56954 - DNA, 25 bp, Homo sapiens
tgtccatttaaacacaaagaatttt

SEQ ID NO: 56955 - DNA, 18 bp, Homo sapiens
tgtacatttaagcataaa

SEQ ID NO: 56956 - DNA, 18 bp, Homo sapiens
tgtacatttacatacaaa

SEQ ID NO: 56957 - DNA, 82 bp, Melanoplus sanguinipes entomopoxvirus
aaaataattgtacatttaaatataaaaattttaagttttttaaaaaccaataattcatgtttaaatattaaacaatttcttt

SEQ ID NO: 56958 - DNA, 64 bp, Human herpesvirus 4
gggtggtgtctgcagcaaaagaggaacttgcccaggcagtcagttattttgcatgccacctccc

SEQ ID NO: 56959 - DNA, 20 bp, Human herpesvirus 4
tattttgcatgccacctccc

SEQ ID NO: 56960 - DNA, 18 bp, Homo sapiens
ccctgccgtgccacctcc

SEQ ID NO: 56961 - DNA, 19 bp, Homo sapiens
tattctgcagctacctccc

SEQ ID NO: 56962 - DNA, 19 bp, Homo sapiens
cattttgcctgcaaccatc

SEQ ID NO: 56963 - DNA, 19 bp, Homo sapiens
atccctagtgccacctccc

SEQ ID NO: 56964 - DNA, 22 bp, Homo sapiens
tattttgctcccaaagcctccc

SEQ ID NO: 56965 - DNA, 18 bp, Homo sapiens
tatttccaccccacctcc

SEQ ID NO: 56966 - DNA, 17 bp, Homo sapiens
ttctacccccacctccc

SEQ ID NO: 56967 - DNA, 19 bp, Homo sapiens
tatcttgcatccagcttcc

SEQ ID NO: 56968 - DNA, 20 bp, Homo sapiens
tattctgcagatgccctctc

SEQ ID NO: 56969 - DNA, 17 bp, Homo sapiens
tattttgcatcacgtcc

SEQ ID NO: 56970 - DNA, 16 bp, Homo sapiens
tactttgcagccttcc

SEQ ID NO: 56971 - DNA, 16 bp, Homo sapiens
attttccacacctccc

SEQ ID NO: 56972 - DNA, 20 bp, Homo sapiens
tattctgccgttacacctcc

SEQ ID NO: 56973 - DNA, 16 bp, Homo sapiens
ttttgcactcactccc

SEQ ID NO: 56974 - DNA, 20 bp, Homo sapiens
tattctgcatccaattttcc

SEQ ID NO: 56975 - DNA, 16 bp, Homo sapiens
tactttgcatccttcc

SEQ ID NO: 56976 - DNA, 20 bp, Homo sapiens
ctttgcagaacctgcctccc

SEQ ID NO: 56977 - DNA, 21 bp, Homo sapiens
tactttgctaccaagcctccc

SEQ ID NO: 56978 - DNA, 18 bp, Homo sapiens
tattttacaatgcttcct

SEQ ID NO: 56979 - DNA, 18 bp, Homo sapiens
tctgtcctgccacctccc

SEQ ID NO: 56980 - DNA, 15 bp, Homo sapiens
ttttgcacccctccc

SEQ ID NO: 56981 - DNA, 20 bp, Homo sapiens
tatcctgattgtcacctccc

SEQ ID NO: 56982 - DNA, 18 bp, Homo sapiens
taaactgtgccaccttcc

SEQ ID NO: 56983 - DNA, 19 bp, Homo sapiens
tatctcttccccacctccc

SEQ ID NO: 56984 - DNA, 19 bp, Homo sapiens
caccatggtgccacctccc

SEQ ID NO: 56985 - DNA, 20 bp, Homo sapiens
ttttgcacaaccaattttcc

SEQ ID NO: 56986 - DNA, 22 bp, Homo sapiens
ctttgcacatgccccacctccc

SEQ ID NO: 56987 - DNA, 24 bp, Homo sapiens
attttgcatccataggccatttcc

SEQ ID NO: 56988 - DNA, 19 bp, Homo sapiens
attttagtctaccacctcc

SEQ ID NO: 56989 - DNA, 19 bp, Homo sapiens
cttggctctgccaccttcc

SEQ ID NO: 56990 - DNA, 19 bp, Homo sapiens
tattctgcctcagcctccc

SEQ ID NO: 56991 - DNA, 19 bp, Homo sapiens
attttgcacaaacactccc

SEQ ID NO: 56992 - DNA, 17 bp, Homo sapiens
attctgcagctgcctcc

SEQ ID NO: 56993 - DNA, 17 bp, Homo sapiens
ctctgttgtcacctccc

SEQ ID NO: 56994 - DNA, 20 bp, Homo sapiens
tattttgctcacaacttccc

SEQ ID NO: 56995 - DNA, 18 bp, Homo sapiens
tctaccattgccacctcc

SEQ ID NO: 56996 - DNA, 21 bp, Homo sapiens
tattctgcaggatagacctcc

SEQ ID NO: 56997 - DNA, 19 bp, Homo sapiens
cattttgcttctgcctcct

SEQ ID NO: 56998 - DNA, 18 bp, Homo sapiens
attttcatgccacttccc

SEQ ID NO: 56999 - DNA, 23 bp, Homo sapiens
tattttacaacagaagtcacctc

SEQ ID NO: 57000 - DNA, 21 bp, Homo sapiens
cattttgcactcctatttctc

SEQ ID NO: 57001 - DNA, 19 bp, Homo sapiens
tattctgcatccatttctc

SEQ ID NO: 57002 - DNA, 18 bp, Homo sapiens
cattttccaccaccttcc

SEQ ID NO: 57003 - DNA, 21 bp, Homo sapiens
ttttgcaccccagcgtctccc

SEQ ID NO: 57004 - DNA, 19 bp, Homo sapiens
cattacacatgccatctcc

SEQ ID NO: 57005 - DNA, 19 bp, Homo sapiens
ttttgcataaccatttccc

SEQ ID NO: 57006 - DNA, 17 bp, Homo sapiens
tattttacattcacctc

SEQ ID NO: 57007 - DNA, 19 bp, Homo sapiens
tatttcctccctacctccc

SEQ ID NO: 57008 - DNA, 16 bp, Homo sapiens
ttttgcaccccctccc

SEQ ID NO: 57009 - DNA, 18 bp, Homo sapiens
tactttgcatagtacctc

SEQ ID NO: 57010 - DNA, 19 bp, Homo sapiens
tatttccaatgccacctcc

SEQ ID NO: 57011 - DNA, 17 bp, Homo sapiens
tattttgccacccactc

SEQ ID NO: 57012 - DNA, 16 bp, Homo sapiens
ttcttcatcacctccc

SEQ ID NO: 57013 - DNA, 19 bp, Homo sapiens
cattactgatgccacctcc

SEQ ID NO: 57014 - DNA, 20 bp, Homo sapiens
cattctgcctgccaccttcc

SEQ ID NO: 57015 - DNA, 17 bp, Homo sapiens
tattctgaacacctccc

SEQ ID NO: 57016 - DNA, 17 bp, Homo sapiens
ttttgccaccatctccc

SEQ ID NO: 57017 - DNA, 19 bp, Homo sapiens
tattttgcaacccattccc

SEQ ID NO: 57018 - DNA, 22 bp, Homo sapiens
cattttgctataatccacctcc

SEQ ID NO: 57019 - DNA, 16 bp, Homo sapiens
tattctgggccacctc

SEQ ID NO: 57020 - DNA, 18 bp, Homo sapiens
tctgccctgccacttccc

SEQ ID NO: 57021 - DNA, 19 bp, Homo sapiens
catttcaaatgccacctcc

SEQ ID NO: 57022 - DNA, 18 bp, Homo sapiens
tatctcccaagctacctc

SEQ ID NO: 57023 - DNA, 18 bp, Homo sapiens
tattctgcttcagcctcc

SEQ ID NO: 57024 - DNA, 19 bp, Homo sapiens
tcttgctatgtcacctccc

SEQ ID NO: 57025 - DNA, 16 bp, Homo sapiens
tatttcaccacctccc

SEQ ID NO: 57026 - DNA, 19 bp, Homo sapiens
attttgcataagcccttcc

SEQ ID NO: 57027 - DNA, 21 bp, Homo sapiens
tattttacaatgtaacctccc

SEQ ID NO: 57028 - DNA, 18 bp, Homo sapiens
cttggctctgccacctcc

SEQ ID NO: 57029 - DNA, 18 bp, Homo sapiens
actttgcatgctgtctcc

SEQ ID NO: 57030 - DNA, 19 bp, Homo sapiens
tattttgctgtgcaactcc

SEQ ID NO: 57031 - DNA, 18 bp, Homo sapiens
ttttactcgccaccttcc

SEQ ID NO: 57032 - DNA, 19 bp, Homo sapiens
tattctgccgccacctccc

SEQ ID NO: 57033 - DNA, 17 bp, Homo sapiens
tattctgctcggcctcc

SEQ ID NO: 57034 - DNA, 18 bp, Homo sapiens
tcttgcactgccacctcc

SEQ ID NO: 57035 - DNA, 20 bp, Homo sapiens
ttttgcactcgtgacctccc

SEQ ID NO: 57036 - DNA, 15 bp, Homo sapiens
tattctgctgacctc

SEQ ID NO: 57037 - DNA, 19 bp, Homo sapiens
tattttgctacctactccc

SEQ ID NO: 57038 - DNA, 117 bp, Human herpesvirus 4
tgggggcttcatgatcccaccgcctttcccgatgatgatgacaaccgcggctgtctgaagcggctgacgaaatcggttgagattctgatgagaggcttgggggggtctttgccctca

SEQ ID NO: 57039 - DNA, 24 bp, Human herpesvirus 4
ttgagattctgatgagaggcttgg

SEQ ID NO: 57040 - DNA, 19 bp, Homo sapiens
ttgaaattttggtgagagg

SEQ ID NO: 57041 - DNA, 16 bp, Homo sapiens
agattccagaggcttg

SEQ ID NO: 57042 - DNA, 19 bp, Homo sapiens
ttgagttcagggaggcttg

SEQ ID NO: 57043 - DNA, 77 bp, Leek yellow stripe potyvirus
gagtaagtctgaagcctttatggtgtataagcggcccgaattttgataacccacctttaccctgcgacggagtgctc

SEQ ID NO: 57044 - DNA, 24 bp, Leek yellow stripe potyvirus
ataacccacctttaccctgcgacg

SEQ ID NO: 57045 - DNA, 19 bp, Homo sapiens
acccacctgcctccctgcg

SEQ ID NO: 57046 - DNA, 16 bp, Homo sapiens
cctcacccccctgcga

SEQ ID NO: 57047 - DNA, 19 bp, Homo sapiens
cccacctttatgcttggcg

SEQ ID NO: 57048 - DNA, 17 bp, Homo sapiens
ataacccatcttaccct

SEQ ID NO: 57049 - DNA, 66 bp, Leek yellow stripe potyvirus
tcgagctgttcatttgaagacactgagagtggttaaccatgtgtgtgttcctatgttgcagtaaga

SEQ ID NO: 57050 - DNA, 24 bp, Leek yellow stripe potyvirus
gagctgttcatttgaagacactga

SEQ ID NO: 57051 - DNA, 19 bp, Homo sapiens
agctgttcaacagacattg

SEQ ID NO: 57052 - DNA, 24 bp, Homo sapiens
gagctgttggtgtccagggcactg

SEQ ID NO: 57053 - DNA, 18 bp, Homo sapiens
gagctgatgaagatgctg

SEQ ID NO: 57054 - DNA, 21 bp, Homo sapiens
gctgcaaggtggggacactga

SEQ ID NO: 57055 - DNA, 21 bp, Homo sapiens
gagctgtccatttagtactga

SEQ ID NO: 57056 - DNA, 19 bp, Homo sapiens
agctgtttgtttgaagaca

SEQ ID NO: 57057 - DNA, 20 bp, Homo sapiens
gctgttcattcaaacgctga

SEQ ID NO: 57058 - DNA, 20 bp, Homo sapiens
ggctgcagtgaagacactga

SEQ ID NO: 57059 - DNA, 19 bp, Homo sapiens
gagctgtttgtcttaactg

SEQ ID NO: 57060 - DNA, 22 bp, Homo sapiens
ggactgtcaaaggagacactga

SEQ ID NO: 57061 - DNA, 16 bp, Homo sapiens
gagctgctcaggcact

SEQ ID NO: 57062 - DNA, 18 bp, Homo sapiens
gagctattttagacattg

SEQ ID NO: 57063 - DNA, 22 bp, Homo sapiens
gcctgacacctggggacactga

SEQ ID NO: 57064 - DNA, 23 bp, Homo sapiens
gagcagttcattttggcacactg

SEQ ID NO: 57065 - DNA, 23 bp, Homo sapiens
gagcagttgctatggagacactg

SEQ ID NO: 57066 - DNA, 19 bp, Homo sapiens
gagctgctccaagacgctg

SEQ ID NO: 57067 - DNA, 22 bp, Homo sapiens
ggctgcatcctggggacactga

SEQ ID NO: 57068 - DNA, 22 bp, Homo sapiens
gagctgtctgcggagggcactg

SEQ ID NO: 57069 - DNA, 16 bp, Homo sapiens
gattgttcagacactg

SEQ ID NO: 57070 - DNA, 19 bp, Homo sapiens
gagctgtcgaagggcgctg

SEQ ID NO: 57071 - DNA, 24 bp, Homo sapiens
gagctcttcatttgaatacaactg

SEQ ID NO: 57072 - DNA, 21 bp, Homo sapiens
agctgtttgggcagacactga

SEQ ID NO: 57073 - DNA, 22 bp, Homo sapiens
gagctgtcatgactggcactga

SEQ ID NO: 57074 - DNA, 19 bp, Homo sapiens
gagctgttcattagcattg

SEQ ID NO: 57075 - DNA, 70 bp, Chimpanzee cytomegalovirus
acgggtcatccgacaaacatgatgcacttcgtggtcaggcagctgatgatgtacccgcgtctgatcccgt

SEQ ID NO: 57076 - DNA, 24 bp, Chimpanzee cytomegalovirus
atgatgtacccgcgtctgatcccg

SEQ ID NO: 57077 - DNA, 21 bp, Homo sapiens
atggggcaccgtctgattccg

SEQ ID NO: 57078 - DNA, 19 bp, Homo sapiens
atgatgtatccttgctctg

SEQ ID NO: 57079 - DNA, 24 bp, Homo sapiens
atggtgtacgctaacatgatcccg

SEQ ID NO: 57080 - DNA, 18 bp, Homo sapiens
atgttgtccagtctgatc

SEQ ID NO: 57081 - DNA, 19 bp, Homo sapiens
tgatgtaccctgaggtccg

SEQ ID NO: 57082 - DNA, 60 bp, Macaca mulatta rhadinovirus
tctgctggtacaaggaatggccgttaccggttgacgttgattttatgtactacctacagg

SEQ ID NO: 57083 - DNA, 24 bp, Macaca mulatta rhadinovirus
cgttgattttatgtactacctaca

SEQ ID NO: 57084 - DNA, 23 bp, Homo sapiens
ccttgatttttattttacctaca

SEQ ID NO: 57085 - DNA, 22 bp, Homo sapiens
gttgatttgtgtaagcgtccta

SEQ ID NO: 57086 - DNA, 20 bp, Homo sapiens
gttgatttttgatgcattac

SEQ ID NO: 57087 - DNA, 23 bp, Homo sapiens
gttaattttaactaatgcctaca

SEQ ID NO: 57088 - DNA, 130 bp, Mice minute virus
atacatgtgttcgctatgagcgaactggtactggttggttgctctgctcaaccaaccagaccggcaaagccggtctggttggttgagcgcaaccaaccagtaccagttcgctcatagcgaacacatgtat

SEQ ID NO: 57089 - DNA, 24 bp, Mice minute virus
tggttggttgagcgcaaccaacca

SEQ ID NO: 57090 - DNA, 19 bp, Homo sapiens
tggttggttaaaagtcaac

SEQ ID NO: 57091 - DNA, 19 bp, Homo sapiens
tggttggctgaatgaccaa

SEQ ID NO: 57092 - DNA, 20 bp, Homo sapiens
tggttggtgggcgagagcca

SEQ ID NO: 57093 - DNA, 18 bp, Homo sapiens
tggttggtgaactggcca

SEQ ID NO: 57094 - DNA, 21 bp, Homo sapiens
tggttggtaggcagtcaacca

SEQ ID NO: 57095 - DNA, 20 bp, Homo sapiens
tgtttggttgagactgacca

SEQ ID NO: 57096 - DNA, 20 bp, Homo sapiens
tggtggttgagtgtcgcgcc

SEQ ID NO: 57097 - DNA, 18 bp, Homo sapiens
tggttggttgcggaggca

SEQ ID NO: 57098 - DNA, 20 bp, Homo sapiens
tggctggctgcagccaacca

SEQ ID NO: 57099 - DNA, 21 bp, Homo sapiens
tggttggctttcagttgacca

SEQ ID NO: 57100 - DNA, 23 bp, Homo sapiens
tggttggtggatgtgctcagcca

SEQ ID NO: 57101 - DNA, 20 bp, Homo sapiens
tggtcggcttggcggccaac

SEQ ID NO: 57102 - DNA, 19 bp, Homo sapiens
tggttggtgggagcagcca

SEQ ID NO: 57103 - DNA, 69 bp, Lymantria dispar cypovirus 14
tatgcttggtcgttggtttggtagaagaggagcacttccatcactgccaaaatatcacttaccatcata

SEQ ID NO: 57104 - DNA, 24 bp, Lymantria dispar cypovirus 14
tcactgccaaaatatcacttacca

SEQ ID NO: 57105 - DNA, 17 bp, Homo sapiens
cactgccaaagtctacc

SEQ ID NO: 57106 - DNA, 19 bp, Homo sapiens
tcattaccaaaaacttgcc

SEQ ID NO: 57107 - DNA, 19 bp, Homo sapiens
tgtcatttacatcacttac

SEQ ID NO: 57108 - DNA, 22 bp, Homo sapiens
ccactgccagaatggacacact

SEQ ID NO: 57109 - DNA, 19 bp, Homo sapiens
tcactgccaggacaccact

SEQ ID NO: 57110 - DNA, 18 bp, Homo sapiens
tcattgccaaaacagcca

SEQ ID NO: 57111 - DNA, 18 bp, Homo sapiens
ctgcacaatcacttatca

SEQ ID NO: 57112 - DNA, 22 bp, Homo sapiens
tcactgccggtgccagttgcca

SEQ ID NO: 57113 - DNA, 21 bp, Homo sapiens
tcactgccaggaatactcact

SEQ ID NO: 57114 - DNA, 17 bp, Homo sapiens
tgccaaaaaatttacca

SEQ ID NO: 57115 - DNA, 16 bp, Homo sapiens
actgccaatccactta

SEQ ID NO: 57116 - DNA, 19 bp, Homo sapiens
ccactgccaagactttgcc

SEQ ID NO: 57117 - DNA, 21 bp, Homo sapiens
actgccaacgttcagttgcca

SEQ ID NO: 57118 - DNA, 19 bp, Homo sapiens
tcctgacctatcacttacc

SEQ ID NO: 57119 - DNA, 18 bp, Homo sapiens
tcacagccaaaataagac

SEQ ID NO: 57120 - DNA, 25 bp, Homo sapiens
tcactgccacggggccaggacttac

SEQ ID NO: 57121 - DNA, 21 bp, Homo sapiens
tcactgccgggatcacagcca

SEQ ID NO: 57122 - DNA, 16 bp, Homo sapiens
ccactgccaagatcct

SEQ ID NO: 57123 - DNA, 20 bp, Homo sapiens
actgccaagatatatcctca

SEQ ID NO: 57124 - DNA, 23 bp, Homo sapiens
tcactgacaaaatattgaaacca

SEQ ID NO: 57125 - DNA, 25 bp, Homo sapiens
cactgccagagcctgtctgtttacc

SEQ ID NO: 57126 - DNA, 71 bp, Human herpesvirus 8
ggccacaggatgtagatcgcagacactgaaacgctgaaacacagcattaagctgcaataccgccgatggcc

SEQ ID NO: 57127 - DNA, 23 bp, Human herpesvirus 8
aagctgcaataccgccgatggcc

SEQ ID NO: 57128 - DNA, 20 bp, Homo sapiens
agctgcaatactcagcaggc

SEQ ID NO: 57129 - DNA, 19 bp, Homo sapiens
gctgcgcagcacgatggcc

SEQ ID NO: 57130 - DNA, 18 bp, Homo sapiens
gctgcaatgtgctcgcgg

SEQ ID NO: 57131 - DNA, 23 bp, Homo sapiens
aagctgcgactgcggcaatggcc

SEQ ID NO: 57132 - DNA, 20 bp, Homo sapiens
aagctgcagtgcaggaaagc

SEQ ID NO: 57133 - DNA, 20 bp, Homo sapiens
agctgcaagctccaatggcc

SEQ ID NO: 57134 - DNA, 20 bp, Homo sapiens
aagctgcaagcccctgggcc

SEQ ID NO: 57135 - DNA, 18 bp, Homo sapiens
aagctgcagtacagtggc

SEQ ID NO: 57136 - DNA, 26 bp, Homo sapiens
aagctgcaatgtgtgttggccatcgg

SEQ ID NO: 57137 - DNA, 21 bp, Homo sapiens
aaggtgcaataccagcattgg

SEQ ID NO: 57138 - DNA, 19 bp, Homo sapiens
agctgcaacacagtgtggc

SEQ ID NO: 57139 - DNA, 17 bp, Homo sapiens
agctgcaagcccgtggc

SEQ ID NO: 57140 - DNA, 18 bp, Homo sapiens
aagctgcaaaccacgtgg

SEQ ID NO: 57141 - DNA, 24 bp, Homo sapiens
aagctgcaatgattgcaaatatgc

SEQ ID NO: 57142 - DNA, 23 bp, Homo sapiens
gctgcaatacttctggccatcgg

SEQ ID NO: 57143 - DNA, 21 bp, Homo sapiens
gctgtgatacctgcaataacc

SEQ ID NO: 57144 - DNA, 19 bp, Homo sapiens
aagctgcaatattccagat

SEQ ID NO: 57145 - DNA, 22 bp, Homo sapiens
agctgcaatgacgaacattggc

SEQ ID NO: 57146 - DNA, 19 bp, Homo sapiens
agcctgggccgccgatggc

SEQ ID NO: 57147 - DNA, 25 bp, Homo sapiens
aagctgcaatacttctggccatcgg

SEQ ID NO: 57148 - DNA, 18 bp, Homo sapiens
gctgcgatgacccatggc

SEQ ID NO: 57149 - DNA, 18 bp, Homo sapiens
aagctgcaacgtacatgg

SEQ ID NO: 57150 - DNA, 19 bp, Homo sapiens
aactgcgatatcaatggcc

SEQ ID NO: 57151 - DNA, 23 bp, Homo sapiens
aagctgtgaaacctgcaatggcc

SEQ ID NO: 57152 - DNA, 22 bp, Homo sapiens
gctgcaatatttgcaaacatgc

SEQ ID NO: 57153 - DNA, 21 bp, Homo sapiens
gctgcaatgccagaacaaggc

SEQ ID NO: 57154 - DNA, 28 bp, Homo sapiens
aagctgcaattctgggtcggccatcggc

SEQ ID NO: 57155 - DNA, 22 bp, Homo sapiens
aagctgcagcacaactgggtgg

SEQ ID NO: 57156 - DNA, 25 bp, Homo sapiens
aagctgcaagtgctgccaatgagcc

SEQ ID NO: 57157 - DNA, 20 bp, Homo sapiens
aagctacagtgccgaaggcc

SEQ ID NO: 57158 - DNA, 18 bp, Homo sapiens
aagctgcaacacatctgg

SEQ ID NO: 57159 - DNA, 17 bp, Homo sapiens
gctgcatgcaccgatgg

SEQ ID NO: 57160 - DNA, 28 bp, Homo sapiens
aagctgcaaaaagtggttggccatcggc

SEQ ID NO: 57161 - DNA, 17 bp, Homo sapiens
gctgcaatcccagaggc

SEQ ID NO: 57162 - DNA, 19 bp, Homo sapiens
aagctgcaagactgcaaac

SEQ ID NO: 57163 - DNA, 23 bp, Homo sapiens
aagctgcagtgactgcacacagc

SEQ ID NO: 57164 - DNA, 25 bp, Homo sapiens
aagctgcaatatccttggccatcgg

SEQ ID NO: 57165 - DNA, 20 bp, Homo sapiens
agcttcagcgcaccgatggc

SEQ ID NO: 57166 - DNA, 26 bp, Homo sapiens
aagctgcaatatagtttggccatcgg

SEQ ID NO: 57167 - DNA, 19 bp, Homo sapiens
agctgcactaccaccaggc

SEQ ID NO: 57168 - DNA, 25 bp, Homo sapiens
agctgcaatggccacagtgatggcc

SEQ ID NO: 57169 - DNA, 19 bp, Homo sapiens
agctgcaaactgcagagcc

SEQ ID NO: 57170 - DNA, 21 bp, Homo sapiens
aagctgcaattctgcaagagc

SEQ ID NO: 57171 - DNA, 19 bp, Homo sapiens
aactgcaaagcgcgatggc

SEQ ID NO: 57172 - DNA, 90 bp, Human herpesvirus 8
atggcacgcgccgccagcaaatttaagtcctggtggctcacctgccaggtaaacaaggttaaagtgggtttgctggccttgcgttgccat

SEQ ID NO: 57173 - DNA, 24 bp, Human herpesvirus 8
cgccagcaaatttaagtcctggtg

SEQ ID NO: 57174 - DNA, 21 bp, Homo sapiens
gcccagtaaaacttcctggtg

SEQ ID NO: 57175 - DNA, 25 bp, Homo sapiens
cgccagcaagtttgtgttcccagtg

SEQ ID NO: 57176 - DNA, 17 bp, Homo sapiens
cagcaaatgccctggtg

SEQ ID NO: 57177 - DNA, 19 bp, Homo sapiens
cgccagggtcagtcctggt

SEQ ID NO: 57178 - DNA, 20 bp, Homo sapiens
acaatcatcaagtcctggtg

SEQ ID NO: 57179 - DNA, 21 bp, Homo sapiens
gcaggtctgggggtcctggtg

SEQ ID NO: 57180 - DNA, 21 bp, Homo sapiens
gccgcagatttaagttaagtg

SEQ ID NO: 57181 - DNA, 21 bp, Homo sapiens
cactagcaggcactcctggtg

SEQ ID NO: 57182 - DNA, 18 bp, Homo sapiens
cctagcaaattgcctggt

SEQ ID NO: 57183 - DNA, 17 bp, Homo sapiens
gctacaaatttaggtcc

SEQ ID NO: 57184 - DNA, 23 bp, Homo sapiens
gccagtggtcctccttcctggtg

SEQ ID NO: 57185 - DNA, 17 bp, Homo sapiens
gccaacgggtcctggtg

SEQ ID NO: 57186 - DNA, 20 bp, Homo sapiens
gcccagcagcagtcctggtg

SEQ ID NO: 57187 - DNA, 18 bp, Homo sapiens
agcaaattagttctggtg

SEQ ID NO: 57188 - DNA, 16 bp, Homo sapiens
gcatcaggtcctggtg

SEQ ID NO: 57189 - DNA, 62 bp, Amsacta moorei entomopoxvirus
atccgtctgtgttataactaaaatcttcaaattcgattaattttatatatggatattcggat

SEQ ID NO: 57190 - DNA, 17 bp, Amsacta moorei entomopoxvirus
tatatggatattcggat

SEQ ID NO: 57191 - DNA, 18 bp, Homo sapiens
tatatggagaattcggat

SEQ ID NO: 57192 - DNA, 18 bp, Homo sapiens
tacatggaatatatggat

SEQ ID NO: 57193 - DNA, 66 bp, Equine herpesvirus 2
gacaacatatcatactcgcatgcacacccccccccatcaaggtaagtttgtgagatgttatgtgtc

SEQ ID NO: 57194 - DNA, 24 bp, Equine herpesvirus 2
tatcatactcgcatgcacaccccc

SEQ ID NO: 57195 - DNA, 17 bp, Homo sapiens
tatctacttacacaccc

SEQ ID NO: 57196 - DNA, 20 bp, Homo sapiens
cattacacatgcacatttcc

SEQ ID NO: 57197 - DNA, 20 bp, Homo sapiens
atcatacttctcatgtctcc

SEQ ID NO: 57198 - DNA, 24 bp, Homo sapiens
tatcatactcagtatattcaatgc

SEQ ID NO: 57199 - DNA, 22 bp, Homo sapiens
tcatactctctgtgataccccc

SEQ ID NO: 57200 - DNA, 17 bp, Homo sapiens
tcatacttgatacacac

SEQ ID NO: 57201 - DNA, 18 bp, Homo sapiens
cacggtcgcatgcacacc

SEQ ID NO: 57202 - DNA, 18 bp, Homo sapiens
tatcatacatgtgaaccc

SEQ ID NO: 57203 - DNA, 17 bp, Homo sapiens
tcatatcaccgcgcccc

SEQ ID NO: 57204 - DNA, 20 bp, Homo sapiens
tcaagttctttgacaccccc

SEQ ID NO: 57205 - DNA, 18 bp, Homo sapiens
tatcatacacacaaaaca

SEQ ID NO: 57206 - DNA, 19 bp, Homo sapiens
catcatacttgatacacac

SEQ ID NO: 57207 - DNA, 21 bp, Homo sapiens
taccagtgacgcatgcatgcc

SEQ ID NO: 57208 - DNA, 19 bp, Homo sapiens
atcatatacatgcacgccc

SEQ ID NO: 57209 - DNA, 18 bp, Homo sapiens
cacaccatgcacacctcc

SEQ ID NO: 57210 - DNA, 95 bp, Human herpesvirus 5
ggccaatagccaatattgatttatgctatataaccaatgaataatatggctaatggccaatattgattcaatgtatagatcgatatgcattggcc

SEQ ID NO: 57211 - DNA, 24 bp, Human herpesvirus 5
ttcaatgtatagatcgatatgcat

SEQ ID NO: 57212 - DNA, 24 bp, Homo sapiens
ttcagtgcataggcagacatgcat

SEQ ID NO: 57213 - DNA, 21 bp, Homo sapiens
ttcaatgtagaggtcatgcac

SEQ ID NO: 57214 - DNA, 23 bp, Homo sapiens
ttcatgtatgtatatatatgcat

SEQ ID NO: 57215 - DNA, 21 bp, Homo sapiens
aatgtatagattccccaacat

SEQ ID NO: 57216 - DNA, 18 bp, Homo sapiens
ttcaatgtatgattgaca

SEQ ID NO: 57217 - DNA, 20 bp, Homo sapiens
aatgtataggtcatttgcat

SEQ ID NO: 57218 - DNA, 19 bp, Homo sapiens
ttcatgtatagatctttat

SEQ ID NO: 57219 - DNA, 23 bp, Homo sapiens
tcaatgtatagtagcatatgcat

SEQ ID NO: 57220 - DNA, 21 bp, Homo sapiens
ttcaatgtgcatctctgtatg

SEQ ID NO: 57221 - DNA, 18 bp, Homo sapiens
tgtacttccaatatgcat

SEQ ID NO: 57222 - DNA, 97 bp, Melanoplus sanguinipes entomopoxvirus
ttaatcatatcataattaagtaatttttctttatctagaagtaaattcaatttatatttagcaatacaaattctatttgaaattatcatattattaa

SEQ ID NO: 57223 - DNA, 24 bp, Melanoplus sanguinipes entomopoxvirus
tatttagcaatacaaattctattt

SEQ ID NO: 57224 - DNA, 18 bp, Homo sapiens
tacttggcaatacaaact

SEQ ID NO: 57225 - DNA, 24 bp, Homo sapiens
tatttagttatacaaatcacattt

SEQ ID NO: 57226 - DNA, 18 bp, Homo sapiens
tttagcaaaataaatcct

SEQ ID NO: 57227 - DNA, 73 bp, Lactate dehydrogenase-elevating virus
gtgcccttctcgccttcattttcttctgctgtcgagcagttaggaattgtatgagctggagatataagtgcac

SEQ ID NO: 57228 - DNA, 24 bp, Lactate dehydrogenase-elevating virus
aattgtatgagctggagatataag

SEQ ID NO: 57229 - DNA, 22 bp, Homo sapiens
gtagtagcagtggggatataag

SEQ ID NO: 57230 - DNA, 22 bp, Homo sapiens
aattgtataagctactcataag

SEQ ID NO: 57231 - DNA, 21 bp, Homo sapiens
ttgtgtttgtggagatataag

SEQ ID NO: 57232 - DNA, 17 bp, Homo sapiens
aattgtgtggctggaaa

SEQ ID NO: 57233 - DNA, 89 bp, Mouse parvovirus 1
tgggtaaaagggtggaagggtggttggttggtattcccttagacttgatgttaaggaccaaaaaaacaataaaatctttttaaaaccta

SEQ ID NO: 57234 - DNA, 24 bp, Mouse parvovirus 1
taaggaccaaaaaaacaataaaat

SEQ ID NO: 57235 - DNA, 17 bp, Homo sapiens
caaggaccaagaaacaa

SEQ ID NO: 57236 - DNA, 18 bp, Homo sapiens
caaggaccactaataaaa

SEQ ID NO: 57237 - DNA, 19 bp, Homo sapiens
aaggaccagaaaggcaaca

SEQ ID NO: 57238 - DNA, 19 bp, Homo sapiens
taagcaccaaaaatcccaa

SEQ ID NO: 57239 - DNA, 19 bp, Homo sapiens
aagaccaaaaaaacgccaa

SEQ ID NO: 57240 - DNA, 21 bp, Homo sapiens
taaggactaaaaacaataaaa

SEQ ID NO: 57241 - DNA, 19 bp, Homo sapiens
taaagaccaaagaaaaaca

SEQ ID NO: 57242 - DNA, 17 bp, Homo sapiens
aggccaaaaaaccacaa

SEQ ID NO: 57243 - DNA, 18 bp, Homo sapiens
taagaaccatggcaataa

SEQ ID NO: 57244 - DNA, 69 bp, Tomato leaf curl virus - Vietnam
ggttctgtattaagtcagtttatgttttgggtaagatctggatggatgagaacattaagacgaagaatc

SEQ ID NO: 57245 - DNA, 24 bp, Tomato leaf curl virus - Vietnam
tattaagtcagtttatgttttggg

SEQ ID NO: 57246 - DNA, 17 bp, Homo sapiens
tattaagcagtttgtgt

SEQ ID NO: 57247 - DNA, 19 bp, Homo sapiens
tattaagccagtttgtgtt

SEQ ID NO: 57248 - DNA, 84 bp, Rhopalosiphum padi virus
tagcttgccttaagcagtctttatatcttctgtatattattttaaagtttataggagcaaagttcgctttactcgcaatagcta

SEQ ID NO: 57249 - DNA, 24 bp, Rhopalosiphum padi virus
aagcagtctttatatcttctgtat

SEQ ID NO: 57250 - DNA, 17 bp, Homo sapiens
agcagtcctgtttctgt

SEQ ID NO: 57251 - DNA, 21 bp, Homo sapiens
aagcagtctttgcatttcagt

SEQ ID NO: 57252 - DNA, 22 bp, Homo sapiens
gcgctctccgcctcttctgtat

SEQ ID NO: 57253 - DNA, 20 bp, Homo sapiens
gcagtctttatataacccat

SEQ ID NO: 57254 - DNA, 23 bp, Homo sapiens
aacagtctttatgtaggctgtat

SEQ ID NO: 57255 - DNA, 21 bp, Homo sapiens
aagcagactttatatcagcat

SEQ ID NO: 57256 - DNA, 22 bp, Homo sapiens
aagcagtcattccattttgtgt

SEQ ID NO: 57257 - DNA, 76 bp, Rhopalosiphum padi virus
aaaagaacctataatcccttcgcacaccgcgtcacaccgcgctatatgctgctcattaggaattacggctcctttt

SEQ ID NO: 57258 - DNA, 24 bp, Rhopalosiphum padi virus
tatgctgctcattaggaattacgg

SEQ ID NO: 57259 - DNA, 21 bp, Homo sapiens
tatgcttttctaaaattacgg

SEQ ID NO: 57260 - DNA, 21 bp, Homo sapiens
tgctgctcaatggggattcgg

SEQ ID NO: 57261 - DNA, 18 bp, Homo sapiens
tgctgctcattggttgcg

SEQ ID NO: 57262 - DNA, 73 bp, Zaire Ebola virus
gtgtgacttggattggaaatgtggagaaaaaatcgggacccatttctaggttgttcacaatccaagtacagac

SEQ ID NO: 57263 - DNA, 24 bp, Zaire Ebola virus
tgacttggattggaaatgtggaga

SEQ ID NO: 57264 - DNA, 19 bp, Homo sapiens
ctctatggaaatgtggaga

SEQ ID NO: 57265 - DNA, 24 bp, Homo sapiens
tgcacttggagcagaaatgtggag

SEQ ID NO: 57266 - DNA, 17 bp, Homo sapiens
tgggttggattggggag

SEQ ID NO: 57267 - DNA, 21 bp, Homo sapiens
ggattccaggagatgtggaga

SEQ ID NO: 57268 - DNA, 17 bp, Homo sapiens
cctgtgggaatgtggag

SEQ ID NO: 57269 - DNA, 22 bp, Homo sapiens
tgcttggattggctggtgggga

SEQ ID NO: 57270 - DNA, 19 bp, Homo sapiens
tgacttggatgggtccggg

SEQ ID NO: 57271 - DNA, 18 bp, Homo sapiens
tgacttggaatggcggag

SEQ ID NO: 57272 - DNA, 24 bp, Homo sapiens
tgacttgaacagtacagtgtggag

SEQ ID NO: 57273 - DNA, 20 bp, Homo sapiens
tgatttggatcgggattgga

SEQ ID NO: 57274 - DNA, 18 bp, Homo sapiens
tggattgaaaatgtggag

SEQ ID NO: 57275 - DNA, 23 bp, Homo sapiens
acttggattgggaggtatgggga

SEQ ID NO: 57276 - DNA, 22 bp, Homo sapiens
ttgtttggaaattgatgtggag

SEQ ID NO: 57277 - DNA, 19 bp, Homo sapiens
acttgaacccgggatgtgg

SEQ ID NO: 57278 - DNA, 19 bp, Homo sapiens
ttggatctaaatgtggaga

SEQ ID NO: 57279 - DNA, 19 bp, Homo sapiens
acttttttggggtgtggag

SEQ ID NO: 57280 - DNA, 24 bp, Homo sapiens
tgacctggatctcctgtgtgggga

SEQ ID NO: 57281 - DNA, 22 bp, Homo sapiens
tggcttaggacaagtgtggaga

SEQ ID NO: 57282 - DNA, 20 bp, Homo sapiens
tgacctgggttggaaggtag

SEQ ID NO: 57283 - DNA, 22 bp, Homo sapiens
tgacttagggagatgtgtggag

SEQ ID NO: 57284 - DNA, 18 bp, Homo sapiens
ttgggggtggtgtggaga

SEQ ID NO: 57285 - DNA, 16 bp, Homo sapiens
tggattggattgggaa

SEQ ID NO: 57286 - DNA, 18 bp, Homo sapiens
tgacttggggttggggag

SEQ ID NO: 57287 - DNA, 22 bp, Homo sapiens
ctggatcaagacaatgtggaga

SEQ ID NO: 57288 - DNA, 22 bp, Homo sapiens
tgactcggggtaaatgtgggga

SEQ ID NO: 57289 - DNA, 20 bp, Homo sapiens
ctgggatgggagatgtggag

SEQ ID NO: 57290 - DNA, 19 bp, Homo sapiens
tgacttgggtggaaccggg

SEQ ID NO: 57291 - DNA, 21 bp, Homo sapiens
ctggattggaagttgcctgag

SEQ ID NO: 57292 - DNA, 20 bp, Homo sapiens
gacttgagaaaatgtggaga

SEQ ID NO: 57293 - DNA, 18 bp, Homo sapiens
ttggattggcgcatggag

SEQ ID NO: 57294 - DNA, 16 bp, Homo sapiens
cttggaggatgtggag

SEQ ID NO: 57295 - DNA, 19 bp, Homo sapiens
tgaactttgaagtgtggag

SEQ ID NO: 57296 - DNA, 72 bp, Zaire Ebola virus
gaaagatcataactaataacattacaaataatcctactataatcaatacggtgattcaaatgttaatctttc

SEQ ID NO: 57297 - DNA, 18 bp, Zaire Ebola virus
ttcaaatgttaatctttc

SEQ ID NO: 57298 - DNA, 16 bp, Homo sapiens
ttcaaatgttcctttc

SEQ ID NO: 57299 - DNA, 17 bp, Homo sapiens
ttcaaatgttaattttc

SEQ ID NO: 57300 - DNA, 17 bp, Homo sapiens
ctcaaatgcgttctttc

SEQ ID NO: 57301 - DNA, 18 bp, Homo sapiens
ttcaaatgtttgcctttc

SEQ ID NO: 57302 - DNA, 18 bp, Homo sapiens
ttcaaacgtgcccctttc

SEQ ID NO: 57303 - DNA, 17 bp, Homo sapiens
ttcaaagctaatctttc

SEQ ID NO: 57304 - DNA, 18 bp, Homo sapiens
ttcaaatgtttgactttc

SEQ ID NO: 57305 - DNA, 17 bp, Homo sapiens
ctcaaatgttttctttc

SEQ ID NO: 57306 - DNA, 18 bp, Homo sapiens
tccgcctgttaatctttc

SEQ ID NO: 57307 - DNA, 17 bp, Homo sapiens
ctcaaatgctgactttc

SEQ ID NO: 57308 - DNA, 20 bp, Homo sapiens
ttcaaacgtacaatactttc

SEQ ID NO: 57309 - DNA, 21 bp, Homo sapiens
ctcaaatgtatgtaatctttc

SEQ ID NO: 57310 - DNA, 17 bp, Homo sapiens
tccaaatccaatctttc

SEQ ID NO: 57311 - DNA, 96 bp, Zaire Ebola virus
gcccttctaattaagaaaaaatcggcgatgaagattaagccgacagtgagcgtaatcttcatctctcttagattatttgttttccagagtaggggt

SEQ ID NO: 57312 - DNA, 24 bp, Zaire Ebola virus
taagaaaaaatcggcgatgaagat

SEQ ID NO: 57313 - DNA, 17 bp, Homo sapiens
aaaaatcggcctggaga

SEQ ID NO: 57314 - DNA, 18 bp, Homo sapiens
taaaaaaaattcggagat

SEQ ID NO: 57315 - DNA, 20 bp, Homo sapiens
agaaaaaaaattagatgaag

SEQ ID NO: 57316 - DNA, 20 bp, Homo sapiens
gaaaaaaattgcataaagat

SEQ ID NO: 57317 - DNA, 17 bp, Homo sapiens
taagaaaaaattgcgat

SEQ ID NO: 57318 - DNA, 22 bp, Homo sapiens
aagaaagcccaatgatgaagat

SEQ ID NO: 57319 - DNA, 25 bp, Homo sapiens
taaaaaaaaatcctgccatgaagat

SEQ ID NO: 57320 - DNA, 20 bp, Homo sapiens
agaaaatttaggatgaagat

SEQ ID NO: 57321 - DNA, 20 bp, Homo sapiens
agaggaaacgacatgaagat

SEQ ID NO: 57322 - DNA, 20 bp, Homo sapiens
gaaaagggacaaatgaagat

SEQ ID NO: 57323 - DNA, 23 bp, Homo sapiens
taagacaaagtgacaatgaagat

SEQ ID NO: 57324 - DNA, 20 bp, Homo sapiens
aagaaaaaatcaacagagga

SEQ ID NO: 57325 - DNA, 22 bp, Homo sapiens
taagaaatgaggacatgaagat

SEQ ID NO: 57326 - DNA, 19 bp, Homo sapiens
gaaaaaatttaatgaagat

SEQ ID NO: 57327 - DNA, 21 bp, Homo sapiens
agaagaaacttgcatgaagat

SEQ ID NO: 57328 - DNA, 23 bp, Homo sapiens
taagagggatacaccatgaagat

SEQ ID NO: 57329 - DNA, 22 bp, Homo sapiens
gaaaaaacaaactgatggggat

SEQ ID NO: 57330 - DNA, 22 bp, Homo sapiens
aatcggcggacgcgggaagata

SEQ ID NO: 57331 - DNA, 19 bp, Homo sapiens
aagaaaagtcaatgaagat

SEQ ID NO: 57332 - DNA, 61 bp, Human adenovirus E
gccattttcgcgcgaaaactgaatgaggaagtgaaaatctgagtaatttcgcgtttatggc

SEQ ID NO: 57333 - DNA, 22 bp, Human adenovirus E
tgagtaatttcgcgtttatggc

SEQ ID NO: 57334 - DNA, 16 bp, Homo sapiens
tgagaatttcacatgg

SEQ ID NO: 57335 - DNA, 16 bp, Homo sapiens
tgagtaattttcacgg

SEQ ID NO: 57336 - DNA, 19 bp, Homo sapiens
tgagtaacacagtttatgg

SEQ ID NO: 57337 - DNA, 19 bp, Homo sapiens
tgagtaattcacctgtggc

SEQ ID NO: 57338 - DNA, 112 bp, Human adenovirus E
tatttgccgagggccgagtagactttgaccgatcacgtgggggtttcgattaccgtgtttttcacctaaatttccgcgtacggtgtcaaagtccggtgtttttacgtaggtg

SEQ ID NO: 57339 - DNA, 24 bp, Human adenovirus E
tgtcaaagtccggtgtttttacgt

SEQ ID NO: 57340 - DNA, 21 bp, Homo sapiens
tgtgaagtccgatgcttgcgt

SEQ ID NO: 57341 - DNA, 17 bp, Homo sapiens
tgtcagagctggtgttt

SEQ ID NO: 57342 - DNA, 24 bp, Homo sapiens
tgtcacagatggctgtttttacgt

SEQ ID NO: 57343 - DNA, 24 bp, Homo sapiens
tgtcacagacggctgtttttacgt

SEQ ID NO: 57344 - DNA, 22 bp, Homo sapiens
gttaaagtcatttattttacgt

SEQ ID NO: 57345 - DNA, 77 bp, Human adenovirus E
ccttcttcaataatataccttcaaactttttgtgcgcgttaatatgcaaatgaggcgtttgaatttggggaggaagg

SEQ ID NO: 57346 - DNA, 24 bp, Human adenovirus E
taatataccttcaaactttttgtg

SEQ ID NO: 57347 - DNA, 22 bp, Homo sapiens
tataccttttaatctgcttgtg

SEQ ID NO: 57348 - DNA, 29 bp, Homo sapiens
atatacctttcagctatgtttttttgtgc

SEQ ID NO: 57349 - DNA, 24 bp, Homo sapiens
taatacaccttcaagagcagagtg

SEQ ID NO: 57350 - DNA, 87 bp, Human adenovirus B
ccatcatcaataatataccttaaacttttggtgcgtgttaatatgcaaatgaggcgtttgaatttggggagggtgaaaggtgattgg

SEQ ID NO: 57351 - DNA, 24 bp, Human adenovirus B
taccttaaacttttggtgcgtgtt

SEQ ID NO: 57352 - DNA, 18 bp, Homo sapiens
ttaaacttttagattgtt

SEQ ID NO: 57353 - DNA, 19 bp, Homo sapiens
ttaaacttttgtagaacat

SEQ ID NO: 57354 - DNA, 21 bp, Homo sapiens
taccttaaactgttggatatt

SEQ ID NO: 57355 - DNA, 18 bp, Homo sapiens
ttaaacccaatgcgtgtt

SEQ ID NO: 57356 - DNA, 21 bp, Homo sapiens
ccttaagcttttgaccgtgtt

SEQ ID NO: 57357 - DNA, 17 bp, Homo sapiens
ttaaacttttggatgtt

SEQ ID NO: 57358 - DNA, 74 bp, Ateline herpesvirus 3
tatgttttctgctaccaagtacacaataggttgatttaaaacactgaatgtaactaagtaaataggtaaacatg

SEQ ID NO: 57359 - DNA, 24 bp, Ateline herpesvirus 3
tgaatgtaactaagtaaataggta

SEQ ID NO: 57360 - DNA, 23 bp, Homo sapiens
taaatgtaacattctaaataggt

SEQ ID NO: 57361 - DNA, 18 bp, Homo sapiens
gaatgcaagtagatgggt

SEQ ID NO: 57362 - DNA, 23 bp, Homo sapiens
tgaatgtaactgacattgaggta

SEQ ID NO: 57363 - DNA, 20 bp, Homo sapiens
gaatgtaactggtccggggt

SEQ ID NO: 57364 - DNA, 18 bp, Homo sapiens
tgaaagtagcaaataggt

SEQ ID NO: 57365 - DNA, 22 bp, Homo sapiens
tgaatggacaacacaaataggt

SEQ ID NO: 57366 - DNA, 19 bp, Homo sapiens
tgaatgtaactggtaccta

SEQ ID NO: 57367 - DNA, 22 bp, Homo sapiens
tgcatgtaactaaaagtgggta

SEQ ID NO: 57368 - DNA, 20 bp, Homo sapiens
tgaatagttagtaaataggt

SEQ ID NO: 57369 - DNA, 21 bp, Homo sapiens
tgaattatatttaaataggta

SEQ ID NO: 57370 - DNA, 18 bp, Homo sapiens
tgagtgtaaccaagaggt

SEQ ID NO: 57371 - DNA, 72 bp, West Nile virus
gctgcgaggtgatccacgtaagccctcagaaccgtctcggaaggaggaccccacgtgctttagcctcaaagc

SEQ ID NO: 57372 - DNA, 24 bp, West Nile virus
tccacgtaagccctcagaaccgtc

SEQ ID NO: 57373 - DNA, 26 bp, Homo sapiens
tccacatagctcaggtcagagccgtc

SEQ ID NO: 57374 - DNA, 18 bp, Homo sapiens
tctgcgaaagccctcaaa

SEQ ID NO: 57375 - DNA, 17 bp, Homo sapiens
cactaggcccttaacca

SEQ ID NO: 57376 - DNA, 21 bp, Homo sapiens
cacctggccctcagagctgtc

SEQ ID NO: 57377 - DNA, 18 bp, Homo sapiens
tccacgtaggcctcagaa

SEQ ID NO: 57378 - DNA, 20 bp, Homo sapiens
gtatgagcctcagaactgtc

SEQ ID NO: 57379 - DNA, 18 bp, Homo sapiens
tccacgaagccctcggcc

SEQ ID NO: 57380 - DNA, 79 bp, West Nile virus
ggatcttctgctctgcacaaccagccacacggcacagtgcgccgacataggtggctggtggtgctagaacacaggatct

SEQ ID NO: 57381 - DNA, 24 bp, West Nile virus
cgacataggtggctggtggtgcta

SEQ ID NO: 57382 - DNA, 20 bp, Homo sapiens
caacagcagctggtggtgct

SEQ ID NO: 57383 - DNA, 17 bp, Homo sapiens
gactgtgtggtggtgct

SEQ ID NO: 57384 - DNA, 18 bp, Homo sapiens
cagaggtgggacggtgct

SEQ ID NO: 57385 - DNA, 21 bp, Homo sapiens
gacctgggagggggtggtgct

SEQ ID NO: 57386 - DNA, 16 bp, Homo sapiens
cataggtggcatgggc

SEQ ID NO: 57387 - DNA, 20 bp, Homo sapiens
cgacatgggggctagtgctg

SEQ ID NO: 57388 - DNA, 21 bp, Homo sapiens
gaataggtgtggtgtggtgct

SEQ ID NO: 57389 - DNA, 17 bp, Homo sapiens
acataggtggcttgggt

SEQ ID NO: 57390 - DNA, 18 bp, Homo sapiens
cacatccacctggtggtg

SEQ ID NO: 57391 - DNA, 23 bp, Homo sapiens
caacgtaggtggcaggaggtgct

SEQ ID NO: 57392 - DNA, 20 bp, Homo sapiens
gacataggttggtccctgct

SEQ ID NO: 57393 - DNA, 17 bp, Homo sapiens
cggcaaggtggttggtg

SEQ ID NO: 57394 - DNA, 20 bp, Homo sapiens
cggcatggtggcgggtgctg

SEQ ID NO: 57395 - DNA, 20 bp, Homo sapiens
gacatagatggtgcctgctg

SEQ ID NO: 57396 - DNA, 21 bp, Homo sapiens
gatgtaggtggtttagtgcta

SEQ ID NO: 57397 - DNA, 18 bp, Homo sapiens
gatggcagtggtggtgct

SEQ ID NO: 57398 - DNA, 20 bp, Homo sapiens
gacatggtgtggctggggtg

SEQ ID NO: 57399 - DNA, 17 bp, Homo sapiens
taggtgctggtggtgct

SEQ ID NO: 57400 - DNA, 18 bp, Homo sapiens
ggcgccgctggtggtgct

SEQ ID NO: 57401 - DNA, 76 bp, Human herpesvirus 5
ttgtgacgtagcaattatcgtattgtgcatgtgtcgttcatcacagagtttagtatactaatatgaagcgtcgcga

SEQ ID NO: 57402 - DNA, 24 bp, Human herpesvirus 5
agagtttagtatactaatatgaag

SEQ ID NO: 57403 - DNA, 24 bp, Homo sapiens
aaagaaacttatattaatatgaag

SEQ ID NO: 57404 - DNA, 21 bp, Homo sapiens
agagtttagtaggggctgaag

SEQ ID NO: 57405 - DNA, 20 bp, Homo sapiens
gagctttatttaatatgaag

SEQ ID NO: 57406 - DNA, 23 bp, Homo sapiens
agagtttagtttgttagaacact

SEQ ID NO: 57407 - DNA, 64 bp, Human herpesvirus 8
gtcaaccagggcaccctcccccaccgagtgctttaatgcggagaggaatggtggcctggttgac

SEQ ID NO: 57408 - DNA, 24 bp, Human herpesvirus 8
cagggcaccctcccccaccgagtg

SEQ ID NO: 57409 - DNA, 19 bp, Homo sapiens
gggccttttcccccacaag

SEQ ID NO: 57410 - DNA, 30 bp, Homo sapiens
cagggtacttccttctccttgcactcggtg

SEQ ID NO: 57411 - DNA, 30 bp, Homo sapiens
cagggcttcttctttgccctgcactcggtg

SEQ ID NO: 57412 - DNA, 15 bp, Homo sapiens
agggcaccctccgag

SEQ ID NO: 57413 - DNA, 22 bp, Homo sapiens
gggccaagggccccaccgggtg

SEQ ID NO: 57414 - DNA, 23 bp, Homo sapiens
agggaccgccaggtcaccgagtg

SEQ ID NO: 57415 - DNA, 23 bp, Homo sapiens
gggcatcttcctttcaccaagtg

SEQ ID NO: 57416 - DNA, 18 bp, Homo sapiens
cagggcacacttcctcac

SEQ ID NO: 57417 - DNA, 23 bp, Homo sapiens
cagggtgccctccccagcactcg

SEQ ID NO: 57418 - DNA, 20 bp, Homo sapiens
cagggcggcctcccccgtcg

SEQ ID NO: 57419 - DNA, 24 bp, Homo sapiens
cagggcagcctcctcctgcactcg

SEQ ID NO: 57420 - DNA, 24 bp, Homo sapiens
tgaggcgccctccccgtgcactcg

SEQ ID NO: 57421 - DNA, 26 bp, Homo sapiens
gggcacccttccctgcagcactcggt

SEQ ID NO: 57422 - DNA, 20 bp, Homo sapiens
ggtgcatctgtcaccgagtg

SEQ ID NO: 57423 - DNA, 23 bp, Homo sapiens
gggccgccctcccctggcactcg

SEQ ID NO: 57424 - DNA, 26 bp, Homo sapiens
ggggtccctccccttgtgcactcggt

SEQ ID NO: 57425 - DNA, 23 bp, Homo sapiens
cagggcctctctcctggcactcg

SEQ ID NO: 57426 - DNA, 21 bp, Homo sapiens
gggcacctgcccctgtcccag

SEQ ID NO: 57427 - DNA, 24 bp, Homo sapiens
cagggcaccctcgcctggcactcg

SEQ ID NO: 57428 - DNA, 24 bp, Homo sapiens
caggtgcctttccccatgcactcg

SEQ ID NO: 57429 - DNA, 26 bp, Homo sapiens
agggcaccttctcctgtgcactcggt

SEQ ID NO: 57430 - DNA, 19 bp, Homo sapiens
cagggcaccttctgacagt

SEQ ID NO: 57431 - DNA, 22 bp, Homo sapiens
aggcaccctcctcctgcactcg

SEQ ID NO: 57432 - DNA, 27 bp, Homo sapiens
caaggcacctttccccaagcactcggt

SEQ ID NO: 57433 - DNA, 20 bp, Homo sapiens
cagggcaccctgccctcgag

SEQ ID NO: 57434 - DNA, 23 bp, Homo sapiens
cagggcactctctccagcactcg

SEQ ID NO: 57435 - DNA, 23 bp, Homo sapiens
agggttccctcccctggcactcg

SEQ ID NO: 57436 - DNA, 27 bp, Homo sapiens
cagggcacctctcccctagcactcggt

SEQ ID NO: 57437 - DNA, 27 bp, Homo sapiens
agtgcaccctcccctggtgcactcggt

SEQ ID NO: 57438 - DNA, 21 bp, Homo sapiens
cagggaccctccccactcgtg

SEQ ID NO: 57439 - DNA, 23 bp, Homo sapiens
gggcacccaccccggcccgagtg

SEQ ID NO: 57440 - DNA, 105 bp, Human herpesvirus 8
ttgtttttgaacatgtggcacacgctgcaatgtactgccatgaaaggtggttctatatccaccacttggcgtctgccgaagtcagtgccacaatttcattaacaa

SEQ ID NO: 57441 - DNA, 24 bp, Human herpesvirus 8
tcagtgccacaatttcattaacaa

SEQ ID NO: 57442 - DNA, 19 bp, Homo sapiens
tcaggcactttcattaaca

SEQ ID NO: 57443 - DNA, 19 bp, Homo sapiens
tcagtaccacagttttact

SEQ ID NO: 57444 - DNA, 18 bp, Homo sapiens
gtacacacagtttcatta

SEQ ID NO: 57445 - DNA, 22 bp, Homo sapiens
agtgtcactctgacattaacaa

SEQ ID NO: 57446 - DNA, 20 bp, Homo sapiens
atgtcacaggccattaacaa

SEQ ID NO: 57447 - DNA, 19 bp, Homo sapiens
tcagtgccttcctcattaa

SEQ ID NO: 57448 - DNA, 23 bp, Homo sapiens
tcagtgccaagataaactaacaa

SEQ ID NO: 57449 - DNA, 25 bp, Homo sapiens
agtgccacaagagaagcattgacaa

SEQ ID NO: 57450 - DNA, 19 bp, Homo sapiens
tcagtgacataactccact

SEQ ID NO: 57451 - DNA, 18 bp, Homo sapiens
gtgcaacactttcattaa

SEQ ID NO: 57452 - DNA, 20 bp, Homo sapiens
tcagtgcctgcaatttgcac

SEQ ID NO: 57453 - DNA, 20 bp, Homo sapiens
tcagtgccagaatcagaaca

SEQ ID NO: 57454 - DNA, 17 bp, Homo sapiens
tcagtgccacagccact

SEQ ID NO: 57455 - DNA, 20 bp, Homo sapiens
cagtgccataattacaacaa

SEQ ID NO: 57456 - DNA, 106 bp, Hendra virus
gtgtttcccttataaactccattatgtagtttattaatatctagagctattctttattaagtaataaatctgtattagattattatataatctctataatcaacac

SEQ ID NO: 57457 - DNA, 24 bp, Hendra virus
actccattatgtagtttattaata

SEQ ID NO: 57458 - DNA, 19 bp, Homo sapiens
ctccaagggtttattaata

SEQ ID NO: 57459 - DNA, 18 bp, Homo sapiens
acatcattatgtagttta

SEQ ID NO: 57460 - DNA, 19 bp, Homo sapiens
acatcattatgtagtgcat

SEQ ID NO: 57461 - DNA, 19 bp, Homo sapiens
tccattacatttattaata

SEQ ID NO: 57462 - DNA, 16 bp, Homo sapiens
actccatttctattaa

SEQ ID NO: 57463 - DNA, 18 bp, Homo sapiens
actgcgttatgtagttta

SEQ ID NO: 57464 - DNA, 130 bp, Nipah virus
aataactgtatttctcactcttgctcttagttagtcattgtgtctaataattattattacagtacaaggtattatgaattcaaagatacgcaataaatctgatatcagcatagagtagaaaattgttgtt

SEQ ID NO: 57465 - DNA, 24 bp, Nipah virus
tcttgctcttagttagtcattgtg

SEQ ID NO: 57466 - DNA, 16 bp, Homo sapiens
ttgctgtggtcattgt

SEQ ID NO: 57467 - DNA, 19 bp, Homo sapiens
ttgttcattaatcattgtg

SEQ ID NO: 57468 - DNA, 131 bp, Human herpesvirus 1
tcttcccccccatcaccccgcaatttgcacccagcctttaactacattaaattgggttcgattggcaatgttgtctcccggttgatttttgggtgggtggggagtgggtgggtggggagtgggtgggtggg

SEQ ID NO: 57469 - DNA, 24 bp, Human herpesvirus 1
tcccggttgatttttgggtgggtg

SEQ ID NO: 57470 - DNA, 18 bp, Homo sapiens
tcctggatgggggtgggt

SEQ ID NO: 57471 - DNA, 21 bp, Homo sapiens
agttgatttttgcacatagtg

SEQ ID NO: 57472 - DNA, 18 bp, Homo sapiens
tcccggctctgggtgggt

SEQ ID NO: 57473 - DNA, 17 bp, Homo sapiens
ggctctttgggtgggtg

SEQ ID NO: 57474 - DNA, 23 bp, Homo sapiens
tcctggttgactggtaatgggtg

SEQ ID NO: 57475 - DNA, 21 bp, Homo sapiens
ggtttatttggggggtgggtg

SEQ ID NO: 57476 - DNA, 21 bp, Homo sapiens
agttgatttttgtatatcgtg

SEQ ID NO: 57477 - DNA, 16 bp, Homo sapiens
cctgttgatttgggtg

SEQ ID NO: 57478 - DNA, 102 bp, Melanoplus sanguinipes entomopoxvirus
gttatgaaaattttaatatttcttcattacagtatatacctaaatctattaaaatattagattgtagtgatactaatatagaagattttaaatttttagaac

SEQ ID NO: 57479 - DNA, 24 bp, Melanoplus sanguinipes entomopoxvirus
tgaaaattttaatatttcttcatt

SEQ ID NO: 57480 - DNA, 24 bp, Homo sapiens
tgagaattttaattttcccacatt

SEQ ID NO: 57481 - DNA, 23 bp, Homo sapiens
tgaaaactttcatatttttcatt

SEQ ID NO: 57482 - DNA, 22 bp, Homo sapiens
aaaagttttccatttcttcatt

SEQ ID NO: 57483 - DNA, 20 bp, Homo sapiens
gaaatacatatttcttcatt

SEQ ID NO: 57484 - DNA, 26 bp, Homo sapiens
tgaaaattttattaaaatccttcatt

SEQ ID NO: 57485 - DNA, 21 bp, Homo sapiens
tggaaatttaaatatttcttc

SEQ ID NO: 57486 - DNA, 19 bp, Homo sapiens
tgaagttttaatatttctt

SEQ ID NO: 57487 - DNA, 87 bp, Equine herpesvirus 2
tggcagagccttgtttcgttgtacatgctgggtgaatcgctcatgcaagtcttgagctctatgatataacacaatctggtctctcca

SEQ ID NO: 57488 - DNA, 23 bp, Equine herpesvirus 2
tataacacaatctggtctctcca

SEQ ID NO: 57489 - DNA, 20 bp, Homo sapiens
ataacacaaagtcctttcca

SEQ ID NO: 57490 - DNA, 18 bp, Homo sapiens
tacatacacttggtctct

SEQ ID NO: 57491 - DNA, 21 bp, Homo sapiens
ataacacagggcagatctctc

SEQ ID NO: 57492 - DNA, 21 bp, Homo sapiens
tagcagaatccaacctcttca

SEQ ID NO: 57493 - DNA, 18 bp, Homo sapiens
tataaccaatgacctctc

SEQ ID NO: 57494 - DNA, 18 bp, Homo sapiens
acacaatcttgccttcca

SEQ ID NO: 57495 - DNA, 18 bp, Homo sapiens
tataacactgtctcatct

SEQ ID NO: 57496 - DNA, 18 bp, Homo sapiens
ataacacaaacaacctct

SEQ ID NO: 57497 - DNA, 22 bp, Homo sapiens
cataacacgtccattttctcca

SEQ ID NO: 57498 - DNA, 18 bp, Homo sapiens
tataatacaatctactct

SEQ ID NO: 57499 - DNA, 27 bp, Homo sapiens
tataacacaaatctgaaggtttcttca

SEQ ID NO: 57500 - DNA, 23 bp, Homo sapiens
aacacaatctctctctctctcca

SEQ ID NO: 57501 - DNA, 18 bp, Homo sapiens
taaacacaatctaagtct

SEQ ID NO: 57502 - DNA, 19 bp, Homo sapiens
taacacaatctgaactttc

SEQ ID NO: 57503 - DNA, 18 bp, Homo sapiens
cacagtctgccctctcca

SEQ ID NO: 57504 - DNA, 20 bp, Homo sapiens
tataacacaacattgtctcc

SEQ ID NO: 57505 - DNA, 24 bp, Homo sapiens
tatattgcaatctaatgagtctct

SEQ ID NO: 57506 - DNA, 19 bp, Homo sapiens
tatcacacaatcctattct

SEQ ID NO: 57507 - DNA, 18 bp, Homo sapiens
taacaaatataatctctc

SEQ ID NO: 57508 - DNA, 19 bp, Homo sapiens
tataacacagtcgccatct

SEQ ID NO: 57509 - DNA, 17 bp, Homo sapiens
ataacataatctgactc

SEQ ID NO: 57510 - DNA, 19 bp, Homo sapiens
tataacatatttgatccct

SEQ ID NO: 57511 - DNA, 21 bp, Homo sapiens
taacacaagctcacagcctct

SEQ ID NO: 57512 - DNA, 21 bp, Homo sapiens
tataagacagtctagtctttc

SEQ ID NO: 57513 - DNA, 21 bp, Homo sapiens
taacacaagccataaatctct

SEQ ID NO: 57514 - DNA, 20 bp, Homo sapiens
taaacacaattgaggactct

SEQ ID NO: 57515 - DNA, 20 bp, Homo sapiens
tgaacacaattcctaactct

SEQ ID NO: 57516 - DNA, 17 bp, Homo sapiens
taacaggggtctctcca

SEQ ID NO: 57517 - DNA, 19 bp, Homo sapiens
aacctatgccctctctcca

SEQ ID NO: 57518 - DNA, 21 bp, Homo sapiens
tataattgtgaagtctctcca

SEQ ID NO: 57519 - DNA, 19 bp, Homo sapiens
cacaatctacagtgttcca

SEQ ID NO: 57520 - DNA, 18 bp, Homo sapiens
tgaacacaatctgacacc

SEQ ID NO: 57521 - DNA, 22 bp, Homo sapiens
tataatgtcatctgcctctcca

SEQ ID NO: 57522 - DNA, 23 bp, Homo sapiens
tataatcataaagtttctctcca

SEQ ID NO: 57523 - DNA, 20 bp, Homo sapiens
ataacacagcctgctttcca

SEQ ID NO: 57524 - DNA, 17 bp, Homo sapiens
taagacacaatctgact

SEQ ID NO: 57525 - DNA, 19 bp, Homo sapiens
taacacaatctcaaaatct

SEQ ID NO: 57526 - DNA, 18 bp, Homo sapiens
tattacacagcccctctc

SEQ ID NO: 57527 - DNA, 16 bp, Homo sapiens
taaccattggtctctc

SEQ ID NO: 57528 - DNA, 22 bp, Homo sapiens
tatgacacactcacacactcca

SEQ ID NO: 57529 - DNA, 21 bp, Homo sapiens
tataacactggacagtctttc

SEQ ID NO: 57530 - DNA, 16 bp, Homo sapiens
taaccaatctggttct

SEQ ID NO: 57531 - DNA, 20 bp, Homo sapiens
aacacaatcatgcctttcca

SEQ ID NO: 57532 - DNA, 17 bp, Homo sapiens
cataacacattctctcc

SEQ ID NO: 57533 - DNA, 70 bp, Camelpox virus
ttcctggttggtattgcgctaccgattcttcacagactgaagactgtcgagattgtgtaccaaaaaggag

SEQ ID NO: 57534 - DNA, 24 bp, Camelpox virus
tattgcgctaccgattcttcacag

SEQ ID NO: 57535 - DNA, 22 bp, Homo sapiens
ttgcgctactgcagggtcacag

SEQ ID NO: 57536 - DNA, 17 bp, Homo sapiens
ttgcgttatccctcaca

SEQ ID NO: 57537 - DNA, 21 bp, Homo sapiens
ttgctgcgacactcttcacag

SEQ ID NO: 57538 - DNA, 65 bp, Camelpox virus
ctccatgcaaactatctaaatgtaattagtcatgatcatggtaccgtataattatattgctggag

SEQ ID NO: 57539 - DNA, 24 bp, Camelpox virus
aatgtaattagtcatgatcatggt

SEQ ID NO: 57540 - DNA, 18 bp, Homo sapiens
aatgtaattagttaagat

SEQ ID NO: 57541 - DNA, 17 bp, Homo sapiens
aatgtaattagtatggt

SEQ ID NO: 57542 - DNA, 85 bp, Langat virus
gcggttcttgttctccctgagccaccatcacctagacacagatagtctgaaaaggaggtgatgcgtgtctcggaaaaacacccgc

SEQ ID NO: 57543 - DNA, 24 bp, Langat virus
tccctgagccaccatcacctagac

SEQ ID NO: 57544 - DNA, 18 bp, Homo sapiens
tctctgaccacaccacct

SEQ ID NO: 57545 - DNA, 15 bp, Homo sapiens
tccctgagcctcaag

SEQ ID NO: 57546 - DNA, 18 bp, Homo sapiens
ctgagccatcatcccaga

SEQ ID NO: 57547 - DNA, 17 bp, Homo sapiens
tccctgaccaccatcac

SEQ ID NO: 57548 - DNA, 21 bp, Homo sapiens
tccctgagctgcagaggagac

SEQ ID NO: 57549 - DNA, 17 bp, Homo sapiens
tccctgagccgtcaccc

SEQ ID NO: 57550 - DNA, 19 bp, Homo sapiens
tccctgagcacactgttca

SEQ ID NO: 57551 - DNA, 18 bp, Homo sapiens
tccctgagtcggccaaga

SEQ ID NO: 57552 - DNA, 23 bp, Homo sapiens
tctctgaaccacacagtttttag

SEQ ID NO: 57553 - DNA, 17 bp, Homo sapiens
cctgagccatcccagac

SEQ ID NO: 57554 - DNA, 18 bp, Homo sapiens
tccctgagacaccaagac

SEQ ID NO: 57555 - DNA, 22 bp, Homo sapiens
tccctgagctgcatagaaagac

SEQ ID NO: 57556 - DNA, 18 bp, Homo sapiens
tctctgagccaccatccc

SEQ ID NO: 57557 - DNA, 22 bp, Homo sapiens
tccctgagccttggtcctggac

SEQ ID NO: 57558 - DNA, 17 bp, Homo sapiens
cccctgcatcacctgga

SEQ ID NO: 57559 - DNA, 20 bp, Homo sapiens
tccctaagtcccggcctgga

SEQ ID NO: 57560 - DNA, 21 bp, Homo sapiens
ccctgagccatcatgtcagac

SEQ ID NO: 57561 - DNA, 16 bp, Homo sapiens
cctgagccaacctgga

SEQ ID NO: 57562 - DNA, 23 bp, Homo sapiens
tccctgaggcgctctgcttagac

SEQ ID NO: 57563 - DNA, 21 bp, Homo sapiens
tccctgagtcataatccccaa

SEQ ID NO: 57564 - DNA, 24 bp, Homo sapiens
ctcgggccgcccacaatgtctaga

SEQ ID NO: 57565 - DNA, 21 bp, Homo sapiens
tccctgagctgtgcattccag

SEQ ID NO: 57566 - DNA, 19 bp, Homo sapiens
cctgatcacccaactggac

SEQ ID NO: 57567 - DNA, 22 bp, Homo sapiens
ccctgagccacgacatctggac

SEQ ID NO: 57568 - DNA, 20 bp, Homo sapiens
cctgtcaacccatcacctag

SEQ ID NO: 57569 - DNA, 17 bp, Homo sapiens
tcccagaagtcacctag

SEQ ID NO: 57570 - DNA, 18 bp, Homo sapiens
tcccagtcatcacctaga

SEQ ID NO: 57571 - DNA, 22 bp, Homo sapiens
tccctgagcggagaacctagac

SEQ ID NO: 57572 - DNA, 24 bp, Homo sapiens
tccctaagccagatgatcttagac

SEQ ID NO: 57573 - DNA, 22 bp, Homo sapiens
tccctgagtcaccttgctggac

SEQ ID NO: 57574 - DNA, 25 bp, Homo sapiens
tccctaagcctagatacatctagac

SEQ ID NO: 57575 - DNA, 94 bp, Ateline herpesvirus 3
caagtcaataaaacactattatgttcaccctgaatcaatcactctgttgcatttataacaaaaaagtaataatgtttatgtaaatatagacttg

SEQ ID NO: 57576 - DNA, 24 bp, Ateline herpesvirus 3
tattatgttcaccctgaatcaatc

SEQ ID NO: 57577 - DNA, 22 bp, Homo sapiens
cattgtgggcactgaatcaatc

SEQ ID NO: 57578 - DNA, 17 bp, Homo sapiens
ttatgttcaccataatc

SEQ ID NO: 57579 - DNA, 16 bp, Homo sapiens
tatttgttcacctaaa

SEQ ID NO: 57580 - DNA, 20 bp, Homo sapiens
cattttcaccctgaattaat

SEQ ID NO: 57581 - DNA, 22 bp, Homo sapiens
tatcagaccattctgaatcaat

SEQ ID NO: 57582 - DNA, 18 bp, Homo sapiens
tgttcactttaaatcaat

SEQ ID NO: 57583 - DNA, 19 bp, Homo sapiens
tattaatgtttgaatcaat

SEQ ID NO: 57584 - DNA, 20 bp, Homo sapiens
tgttcccattttgaatcaat

SEQ ID NO: 57585 - DNA, 19 bp, Homo sapiens
ttatgtttgcaccatcaat

SEQ ID NO: 57586 - DNA, 75 bp, Equine herpesvirus 4
gtttatactacactgcaggcgtatgcacagcgataaaggtgtatgttgtgaacttaaaagcagctgagtataaac

SEQ ID NO: 57587 - DNA, 24 bp, Equine herpesvirus 4
tacactgcaggcgtatgcacagcg

SEQ ID NO: 57588 - DNA, 17 bp, Homo sapiens
catgcaggcgtctgagc

SEQ ID NO: 57589 - DNA, 22 bp, Homo sapiens
cactctggctccatgcacagcg

SEQ ID NO: 57590 - DNA, 19 bp, Homo sapiens
actgtagaaaggcacagcg

SEQ ID NO: 57591 - DNA, 19 bp, Homo sapiens
ctgcaggcgtactccacag

SEQ ID NO: 57592 - DNA, 21 bp, Homo sapiens
tacactggaggcccaatggcg

SEQ ID NO: 57593 - DNA, 18 bp, Homo sapiens
actgcaggcaaggcggcg

SEQ ID NO: 57594 - DNA, 18 bp, Homo sapiens
tgcgctgcgctgcacagc

SEQ ID NO: 57595 - DNA, 17 bp, Homo sapiens
cacactgcagagcacag

SEQ ID NO: 57596 - DNA, 17 bp, Homo sapiens
tacacagcaagtgtgca

SEQ ID NO: 57597 - DNA, 21 bp, Homo sapiens
tgactgcaggtgtggccggcg

SEQ ID NO: 57598 - DNA, 22 bp, Homo sapiens
acactgcagggcctcagcacag

SEQ ID NO: 57599 - DNA, 21 bp, Homo sapiens
tacctgcagaagggcacagcg

SEQ ID NO: 57600 - DNA, 16 bp, Homo sapiens
tgctgcaatgcacagc

SEQ ID NO: 57601 - DNA, 21 bp, Homo sapiens
acactgcacattgatgcacag

SEQ ID NO: 57602 - DNA, 22 bp, Homo sapiens
tgcgggcgcacgacgcacggcg

SEQ ID NO: 57603 - DNA, 21 bp, Homo sapiens
cagtgcaggcggcccatggcg

SEQ ID NO: 57604 - DNA, 19 bp, Homo sapiens
actgcaggccaccatggcg

SEQ ID NO: 57605 - DNA, 83 bp, Equine herpesvirus 1
tctcgaagcactctatattagagcgaaacaagcagtactttgacctaccccgtagcgcttcttatagagtttcgcgctagaga

SEQ ID NO: 57606 - DNA, 24 bp, Equine herpesvirus 1
tctatattagagcgaaacaagcag

SEQ ID NO: 57607 - DNA, 19 bp, Homo sapiens
tatacttgacaacaagcag

SEQ ID NO: 57608 - DNA, 21 bp, Homo sapiens
tctatattgggcaaaaagcag

SEQ ID NO: 57609 - DNA, 21 bp, Homo sapiens
tacaacaagtggaacaagcag

SEQ ID NO: 57610 - DNA, 22 bp, Homo sapiens
tctacattggagtttctggcag

SEQ ID NO: 57611 - DNA, 24 bp, Homo sapiens
tctatttagagtaacagtaggcag

SEQ ID NO: 57612 - DNA, 20 bp, Homo sapiens
accagtggtgaaacaagcag

SEQ ID NO: 57613 - DNA, 21 bp, Homo sapiens
tcatacacatgagacaagcag

SEQ ID NO: 57614 - DNA, 21 bp, Homo sapiens
tctatgtacagagacaagcag

SEQ ID NO: 57615 - DNA, 23 bp, Homo sapiens
tatattagaaacatgatgagcag

SEQ ID NO: 57616 - DNA, 21 bp, Homo sapiens
tctatttacaaaaacaagcag

SEQ ID NO: 57617 - DNA, 21 bp, Homo sapiens
tctaaattagggcctgagcag

SEQ ID NO: 57618 - DNA, 27 bp, Homo sapiens
tccatattgggctgcaagaataagcag

SEQ ID NO: 57619 - DNA, 23 bp, Homo sapiens
tctaaattagaacttgtgggcag

SEQ ID NO: 57620 - DNA, 17 bp, Homo sapiens
tccaaaagcgaaataag

SEQ ID NO: 57621 - DNA, 19 bp, Homo sapiens
tctatatgaagacaaacag

SEQ ID NO: 57622 - DNA, 131 bp, Bovine herpesvirus 1
cccccccgtccgcccgcgagtaaaggctgtctaattttttccgcacgcccgcgcctgtcttcttagggaggggaaggaggggagggaggggaaggaggggagggaggggaaggaggggagggaggggaagg

SEQ ID NO: 57623 - DNA, 24 bp, Bovine herpesvirus 1
tctaattttttccgcacgcccgcg

SEQ ID NO: 57624 - DNA, 17 bp, Homo sapiens
taattttttcccccgac

SEQ ID NO: 57625 - DNA, 18 bp, Homo sapiens
tctgattttttctgcacg

SEQ ID NO: 57626 - DNA, 116 bp, Bovine herpesvirus 1
ggggagggaggggaaggaggggagggaggggaaggaggggattcgggccggccgaggattcgggccggccgagcgagcgggccaaagctccggctcccccttccccctcccgcccc

SEQ ID NO: 57627 - DNA, 24 bp, Bovine herpesvirus 1
cgggccaaagctccggctccccct

SEQ ID NO: 57628 - DNA, 24 bp, Homo sapiens
cgggcgtgagggccggctcctcct

SEQ ID NO: 57629 - DNA, 20 bp, Homo sapiens
gggctgggtctcctccccct

SEQ ID NO: 57630 - DNA, 20 bp, Homo sapiens
gggctgggctccaacacccc

SEQ ID NO: 57631 - DNA, 20 bp, Homo sapiens
cgggccgggctcggctcccc

SEQ ID NO: 57632 - DNA, 21 bp, Homo sapiens
gggccaaggaaaacttcccct

SEQ ID NO: 57633 - DNA, 22 bp, Homo sapiens
cgcggcgtctccggctcctcct

SEQ ID NO: 57634 - DNA, 20 bp, Homo sapiens
ggccggcggcggctccccct

SEQ ID NO: 57635 - DNA, 21 bp, Homo sapiens
gggccaaagtgctcttgcatc

SEQ ID NO: 57636 - DNA, 19 bp, Homo sapiens
gggctgaacttccaacccc

SEQ ID NO: 57637 - DNA, 18 bp, Homo sapiens
ggcctggcgggctccccc

SEQ ID NO: 57638 - DNA, 17 bp, Homo sapiens
gggcagagctccagccc

SEQ ID NO: 57639 - DNA, 20 bp, Homo sapiens
caggccggagctccgggctc

SEQ ID NO: 57640 - DNA, 15 bp, Homo sapiens
cgggcccggctcccc

SEQ ID NO: 57641 - DNA, 18 bp, Homo sapiens
caggccaaggctctctcc

SEQ ID NO: 57642 - DNA, 17 bp, Homo sapiens
gggctcaagcgatcccc

SEQ ID NO: 57643 - DNA, 22 bp, Homo sapiens
cgggctccggccccggctcccc

SEQ ID NO: 57644 - DNA, 19 bp, Homo sapiens
cgagccaaggacttttccc

SEQ ID NO: 57645 - DNA, 18 bp, Homo sapiens
gggtcaaagctctgctcc

SEQ ID NO: 57646 - DNA, 23 bp, Homo sapiens
aggcagaggctccggctcctcct

SEQ ID NO: 57647 - DNA, 21 bp, Homo sapiens
cggtctagcgtccggctcccc

SEQ ID NO: 57648 - DNA, 21 bp, Homo sapiens
ggtccaggaagagctccccct

SEQ ID NO: 57649 - DNA, 22 bp, Homo sapiens
caggccaaaggggcttctccct

SEQ ID NO: 57650 - DNA, 18 bp, Homo sapiens
gggttaaagctccttccc

SEQ ID NO: 57651 - DNA, 21 bp, Homo sapiens
gccggggctccagccacctct

SEQ ID NO: 57652 - DNA, 24 bp, Homo sapiens
cgtggccaggcgccggctcctcct

SEQ ID NO: 57653 - DNA, 24 bp, Homo sapiens
cgggctgcagctccggctcggcct

SEQ ID NO: 57654 - DNA, 17 bp, Homo sapiens
cgggccaagctccttct

SEQ ID NO: 57655 - DNA, 21 bp, Homo sapiens
ggctgagggccagctcctcct

SEQ ID NO: 57656 - DNA, 21 bp, Homo sapiens
gggccaaagcttgctgaccct

SEQ ID NO: 57657 - DNA, 23 bp, Homo sapiens
ggctcaaagttcctgctccccct

SEQ ID NO: 57658 - DNA, 18 bp, Homo sapiens
cgggccaaggctccggct

SEQ ID NO: 57659 - DNA, 20 bp, Homo sapiens
gggcctaaagtgatcctcct

SEQ ID NO: 57660 - DNA, 23 bp, Homo sapiens
cgggccaaggcttggtcagctcc

SEQ ID NO: 57661 - DNA, 19 bp, Homo sapiens
ggcttctccggctcctcct

SEQ ID NO: 57662 - DNA, 22 bp, Homo sapiens
gggccaaatgcttcacatgtcc

SEQ ID NO: 57663 - DNA, 18 bp, Homo sapiens
gggctcagcagctccccc

SEQ ID NO: 57664 - DNA, 21 bp, Homo sapiens
ggctggagaccagctccctct

SEQ ID NO: 57665 - DNA, 17 bp, Homo sapiens
cgggccagcagctcccc

SEQ ID NO: 57666 - DNA, 20 bp, Homo sapiens
cgggttttccggctcttcct

SEQ ID NO: 57667 - DNA, 22 bp, Homo sapiens
cgtggctaaggttgggctcccc

SEQ ID NO: 57668 - DNA, 17 bp, Homo sapiens
ggctctctggctccccc

SEQ ID NO: 57669 - DNA, 22 bp, Homo sapiens
cgggccggagccccccgcccct

SEQ ID NO: 57670 - DNA, 24 bp, Homo sapiens
cgagctccttctccggctcctcct

SEQ ID NO: 57671 - DNA, 20 bp, Homo sapiens
cggccccttcggctccctct

SEQ ID NO: 57672 - DNA, 24 bp, Homo sapiens
cggattgaggctcctgctccccct

SEQ ID NO: 57673 - DNA, 19 bp, Homo sapiens
cgggctcgggctccggctc

SEQ ID NO: 57674 - DNA, 21 bp, Homo sapiens
cgggccaagctgcctccctct

SEQ ID NO: 57675 - DNA, 18 bp, Homo sapiens
gggccgaagccccgcccc

SEQ ID NO: 57676 - DNA, 23 bp, Homo sapiens
cgaggtcagagccagctccctct

SEQ ID NO: 57677 - DNA, 18 bp, Homo sapiens
ggccaaagctcctttccc

SEQ ID NO: 57678 - DNA, 22 bp, Homo sapiens
ggacccggctctggctcctcct

SEQ ID NO: 57679 - DNA, 131 bp, Human adenovirus E
caccaacgccaccgtcgcgacctttctgaatctaatactaccacccacaccggaggtgagctccgaggtcaaccaacctctgggatttactacggcccctgggaggtggttgggttaataacgctaggcct

SEQ ID NO: 57680 - DNA, 24 bp, Human adenovirus E
tgggatttactacggcccctggga

SEQ ID NO: 57681 - DNA, 21 bp, Homo sapiens
tgggatttcttgtggcttggg

SEQ ID NO: 57682 - DNA, 24 bp, Homo sapiens
tgggattttcgtattttcctggga

SEQ ID NO: 57683 - DNA, 22 bp, Homo sapiens
tgggatctgggcggtccctggg

SEQ ID NO: 57684 - DNA, 21 bp, Homo sapiens
tgggatttgcttggggtggga

SEQ ID NO: 57685 - DNA, 19 bp, Homo sapiens
gggatttactattggtggg

SEQ ID NO: 57686 - DNA, 23 bp, Homo sapiens
taggaggacctgtggcccctggg

SEQ ID NO: 57687 - DNA, 21 bp, Homo sapiens
tggaatttactaattactggg

SEQ ID NO: 57688 - DNA, 25 bp, Homo sapiens
tgggattcactgcggggatcccagg

SEQ ID NO: 57689 - DNA, 21 bp, Homo sapiens
gacagcctgtggcccctggga

SEQ ID NO: 57690 - DNA, 21 bp, Homo sapiens
tggcatttgtgccccctggga

SEQ ID NO: 57691 - DNA, 18 bp, Homo sapiens
tgggattcactgtctggg

SEQ ID NO: 57692 - DNA, 22 bp, Homo sapiens
tggggtgggcaggcccctggga

SEQ ID NO: 57693 - DNA, 22 bp, Homo sapiens
cgggcgctggcggcccctggga

SEQ ID NO: 57694 - DNA, 20 bp, Homo sapiens
tgggatttggtgccagtggg

SEQ ID NO: 57695 - DNA, 22 bp, Homo sapiens
tggggtctagacctccctggga

SEQ ID NO: 57696 - DNA, 18 bp, Homo sapiens
tgggatctgctggctggg

SEQ ID NO: 57697 - DNA, 22 bp, Homo sapiens
tgagatccaagtggttcttggg

SEQ ID NO: 57698 - DNA, 101 bp, Molluscum contagiosum virus
ggacgcgtgagtgtgcatgtctctctctccttcgcgggcccgtctttgtggagacgggcctctgtcttttggaacgtgctcggggcgcttaccgcgcgtcc

SEQ ID NO: 57699 - DNA, 24 bp, Molluscum contagiosum virus
acgggcctctgtcttttggaacgt

SEQ ID NO: 57700 - DNA, 18 bp, Homo sapiens
gggcctctgtcttatctg

SEQ ID NO: 57701 - DNA, 18 bp, Homo sapiens
gggtctctagtcttagaa

SEQ ID NO: 57702 - DNA, 19 bp, Homo sapiens
ggcttgatttttggaatgt

SEQ ID NO: 57703 - DNA, 21 bp, Homo sapiens
actggcctctgtttttgcgaa

SEQ ID NO: 57704 - DNA, 20 bp, Homo sapiens
caggcctctgtccccggcgt

SEQ ID NO: 57705 - DNA, 16 bp, Homo sapiens
cgggcctgccctttgg

SEQ ID NO: 57706 - DNA, 21 bp, Homo sapiens
gagcctaccactttggaatgt

SEQ ID NO: 57707 - DNA, 19 bp, Homo sapiens
ggtctcagccttggagcgt

SEQ ID NO: 57708 - DNA, 18 bp, Homo sapiens
gggcctctgtttatagaa

SEQ ID NO: 57709 - DNA, 18 bp, Homo sapiens
aggcctctgtctttaaac

SEQ ID NO: 57710 - DNA, 21 bp, Homo sapiens
cgtgccttccatttggggcgt

SEQ ID NO: 57711 - DNA, 125 bp, Sheeppox virus
tagaaaatttatttattagctcgtttagtgctaaatcatcatcaacaacttcattgttttcatcttttttcttttttatgatgattgataacaacgatatagaagctaatattacagaaggtcta

SEQ ID NO: 57712 - DNA, 24 bp, Sheeppox virus
tttattagctcgtttagtgctaaa

SEQ ID NO: 57713 - DNA, 30 bp, Homo sapiens
tttatcagctcttcacctttggtgctaaat

SEQ ID NO: 57714 - DNA, 18 bp, Homo sapiens
tttattagctttttaata

SEQ ID NO: 57715 - DNA, 18 bp, Homo sapiens
tttattagctgttcaata

SEQ ID NO: 57716 - DNA, 19 bp, Homo sapiens
tttattagcctgttgctaa

SEQ ID NO: 57717 - DNA, 23 bp, Homo sapiens
cttattagcttcacagagtgcta

SEQ ID NO: 57718 - DNA, 22 bp, Homo sapiens
tttattagttagtttgtactaa

SEQ ID NO: 57719 - DNA, 22 bp, Homo sapiens
tttatcagctcctgatgtgcta

SEQ ID NO: 57720 - DNA, 89 bp, Sheeppox virus
tcattaaattcagttttataatctttttttattacctcacagcattcgcgtatcattattaaaatttccaactcattattatttaatga

SEQ ID NO: 57721 - DNA, 24 bp, Sheeppox virus
tcagttttataatctttttttatt

SEQ ID NO: 57722 - DNA, 22 bp, Homo sapiens
tcagttttttaatccacttatt

SEQ ID NO: 57723 - DNA, 18 bp, Homo sapiens
tcagtttcctttttttat

SEQ ID NO: 57724 - DNA, 91 bp, Gallid herpesvirus 3
ccggcaagcactcgtccgaaggaggacacgccacgcgacccgattcccagccgcttcgcgcccggctacttcttcgcctgcagtccgccgg

SEQ ID NO: 57725 - DNA, 24 bp, Gallid herpesvirus 3
aagcactcgtccgaaggaggacac

SEQ ID NO: 57726 - DNA, 19 bp, Homo sapiens
gtccaggggaggaggacac

SEQ ID NO: 57727 - DNA, 20 bp, Homo sapiens
agctcttgtggtggaggaca

SEQ ID NO: 57728 - DNA, 22 bp, Homo sapiens
aagcatttatttgaaggaggac

SEQ ID NO: 57729 - DNA, 16 bp, Homo sapiens
gcagctgaaggaggac

SEQ ID NO: 57730 - DNA, 19 bp, Homo sapiens
gcacccgtttgaaccagga

SEQ ID NO: 57731 - DNA, 20 bp, Homo sapiens
agtgctcatctaaaggacac

SEQ ID NO: 57732 - DNA, 22 bp, Homo sapiens
agccacgccaggaggaggacac

SEQ ID NO: 57733 - DNA, 20 bp, Homo sapiens
acacttgctgcaggaggaca

SEQ ID NO: 57734 - DNA, 21 bp, Homo sapiens
gcaggacatgggggaggacac

SEQ ID NO: 57735 - DNA, 22 bp, Homo sapiens
aagcaaaggtgaaggaggacac

SEQ ID NO: 57736 - DNA, 21 bp, Homo sapiens
gcactgggggatggaggacac

SEQ ID NO: 57737 - DNA, 19 bp, Homo sapiens
gcacccgtctgaggccaga

SEQ ID NO: 57738 - DNA, 21 bp, Homo sapiens
agcattagatgaggaggacac

SEQ ID NO: 57739 - DNA, 19 bp, Homo sapiens
aagcactctagaaggggga

SEQ ID NO: 57740 - DNA, 19 bp, Homo sapiens
agcgctcgtccagggaagg

SEQ ID NO: 57741 - DNA, 16 bp, Homo sapiens
gcgctcgcaggaggac

SEQ ID NO: 57742 - DNA, 21 bp, Homo sapiens
agcattttcattaaaggacac

SEQ ID NO: 57743 - DNA, 23 bp, Homo sapiens
agctgagctcctgagggaggaca

SEQ ID NO: 57744 - DNA, 19 bp, Homo sapiens
agtgctcgtccagtgagga

SEQ ID NO: 57745 - DNA, 21 bp, Homo sapiens
cactcctgggagggaggacac

SEQ ID NO: 57746 - DNA, 24 bp, Homo sapiens
gcactcgtgtgaatcttcagacac

SEQ ID NO: 57747 - DNA, 24 bp, Homo sapiens
aaggactcgtccgaagactgggca

SEQ ID NO: 57748 - DNA, 71 bp, Gallid herpesvirus 3
ctcccatctttccctgacggcatctaaccgttaaaatacgacgtcaggcaccgtaagggaaaaaatggaag

SEQ ID NO: 57749 - DNA, 24 bp, Gallid herpesvirus 3
tctttccctgacggcatctaaccg

SEQ ID NO: 57750 - DNA, 18 bp, Homo sapiens
tcttttccgactgcacct

SEQ ID NO: 57751 - DNA, 22 bp, Homo sapiens
tctttccctaactccattctaa

SEQ ID NO: 57752 - DNA, 21 bp, Homo sapiens
cttccctgatggtagccatct

SEQ ID NO: 57753 - DNA, 22 bp, Homo sapiens
tcttttttggtaagcatctaac

SEQ ID NO: 57754 - DNA, 19 bp, Homo sapiens
tctttccctgaggttttcc

SEQ ID NO: 57755 - DNA, 17 bp, Homo sapiens
tccttccctgaccttcc

SEQ ID NO: 57756 - DNA, 84 bp, Gallid herpesvirus 3
cgcgggggaaggtcggtccatttcgctcctattccgcaccttcgtttggaacagaagcattacacacaccgccatttccccgcg

SEQ ID NO: 57757 - DNA, 24 bp, Gallid herpesvirus 3
ttggaacagaagcattacacacac

SEQ ID NO: 57758 - DNA, 21 bp, Homo sapiens
tcggggtaggaattcacacac

SEQ ID NO: 57759 - DNA, 22 bp, Homo sapiens
ttggaatagagcagtaatcaca

SEQ ID NO: 57760 - DNA, 18 bp, Homo sapiens
ttggggaagaacacacac

SEQ ID NO: 57761 - DNA, 24 bp, Homo sapiens
ttagaaattaagcattatgtacac

SEQ ID NO: 57762 - DNA, 17 bp, Homo sapiens
ttggaatgttacacaca

SEQ ID NO: 57763 - DNA, 19 bp, Homo sapiens
tggagtagaagcatgatac

SEQ ID NO: 57764 - DNA, 21 bp, Homo sapiens
ttgggtacagaaaacacacac

SEQ ID NO: 57765 - DNA, 20 bp, Homo sapiens
gaacagaaaatctgtacaca

SEQ ID NO: 57766 - DNA, 21 bp, Homo sapiens
ttgtgaccctgttacacacac

SEQ ID NO: 57767 - DNA, 21 bp, Homo sapiens
ttgtcaaagtgttacacacac

SEQ ID NO: 57768 - DNA, 16 bp, Homo sapiens
gggacagaacacacac

SEQ ID NO: 57769 - DNA, 20 bp, Homo sapiens
ttggaatggtttcacacaca

SEQ ID NO: 57770 - DNA, 19 bp, Homo sapiens
ttggaggggaaatcacaca

SEQ ID NO: 57771 - DNA, 23 bp, Homo sapiens
tggaatagaagcatttgttgcac

SEQ ID NO: 57772 - DNA, 19 bp, Homo sapiens
tggaacagaaccccataca

SEQ ID NO: 57773 - DNA, 17 bp, Homo sapiens
ggaacagaaatcacaca

SEQ ID NO: 57774 - DNA, 20 bp, Homo sapiens
ggggcagagtgactacacac

SEQ ID NO: 57775 - DNA, 21 bp, Homo sapiens
ttggacacagacaatcacaca

SEQ ID NO: 57776 - DNA, 22 bp, Homo sapiens
ttagagtagaagctgactacac

SEQ ID NO: 57777 - DNA, 21 bp, Homo sapiens
tggaatggaaaaaaccacaca

SEQ ID NO: 57778 - DNA, 21 bp, Homo sapiens
ttgggacgaggaagcacacac

SEQ ID NO: 57779 - DNA, 16 bp, Homo sapiens
ttggaacaaagcaaca

SEQ ID NO: 57780 - DNA, 18 bp, Homo sapiens
tggagcagaagcaggcac

SEQ ID NO: 57781 - DNA, 16 bp, Homo sapiens
ggagcagaatacacac

SEQ ID NO: 57782 - DNA, 21 bp, Homo sapiens
ttggaacagaagtccttgcac

SEQ ID NO: 57783 - DNA, 19 bp, Homo sapiens
ttgggccagggccacacac

SEQ ID NO: 57784 - DNA, 20 bp, Homo sapiens
ttagaacagaaaaatgtaca

SEQ ID NO: 57785 - DNA, 21 bp, Homo sapiens
ttggagatggaatgtacacac

SEQ ID NO: 57786 - DNA, 18 bp, Homo sapiens
ttggagggaaaacacaca

SEQ ID NO: 57787 - DNA, 22 bp, Homo sapiens
ttggaacagaggctctgactac

SEQ ID NO: 57788 - DNA, 17 bp, Homo sapiens
tggggcagaagcaacac

SEQ ID NO: 57789 - DNA, 26 bp, Homo sapiens
ttggaacagcagctacaattgtacac

SEQ ID NO: 57790 - DNA, 64 bp, Molluscum contagiosum virus
gggctgtgctagcacgcgccacgaggaggtcacggctccgcgcgtgcaaacgcagacaacgccc

SEQ ID NO: 57791 - DNA, 24 bp, Molluscum contagiosum virus
tagcacgcgccacgaggaggtcac

SEQ ID NO: 57792 - DNA, 22 bp, Homo sapiens
tagcgtagtgtcccaaggtcac

SEQ ID NO: 57793 - DNA, 19 bp, Homo sapiens
gcatgcgccataaaggtca

SEQ ID NO: 57794 - DNA, 20 bp, Homo sapiens
acgtgcgtgcgtggaggtca

SEQ ID NO: 57795 - DNA, 18 bp, Homo sapiens
gcgccccagtgaggtcac

SEQ ID NO: 57796 - DNA, 20 bp, Homo sapiens
gcacgcgctcgtgggtccac

SEQ ID NO: 57797 - DNA, 19 bp, Homo sapiens
gccgtgtccaaggaggtca

SEQ ID NO: 57798 - DNA, 19 bp, Homo sapiens
cgcgccacgtttgagtcac

SEQ ID NO: 57799 - DNA, 21 bp, Homo sapiens
tagcacgtgtcacgaggaagt

SEQ ID NO: 57800 - DNA, 18 bp, Homo sapiens
acgcgtacagggaggtca

SEQ ID NO: 57801 - DNA, 22 bp, Homo sapiens
gctgactaagtgaggaggtcac

SEQ ID NO: 57802 - DNA, 89 bp, Molluscum contagiosum virus
ggttggtactcccgcgcgccgggggagaagtgcgcgcgcggcaacaacgccttgcgccgcgcgcgcaaccgcggccgtcgagaacaacc

SEQ ID NO: 57803 - DNA, 24 bp, Molluscum contagiosum virus
gcgccgcgcgcgcaaccgcggccg

SEQ ID NO: 57804 - DNA, 20 bp, Homo sapiens
gccagcggtggccgcggccg

SEQ ID NO: 57805 - DNA, 17 bp, Homo sapiens
gcgtcgcgcgcgcgccg

SEQ ID NO: 57806 - DNA, 20 bp, Homo sapiens
gcctcgcggtcccgtggccg

SEQ ID NO: 57807 - DNA, 17 bp, Homo sapiens
gcgccgcggtgcaacca

SEQ ID NO: 57808 - DNA, 16 bp, Homo sapiens
gcccgcgcgcgcgcgc

SEQ ID NO: 57809 - DNA, 21 bp, Homo sapiens
gcccgcgcgcgtccgggcggc

SEQ ID NO: 57810 - DNA, 21 bp, Homo sapiens
gccgcatcgcgcccgcggccg

SEQ ID NO: 57811 - DNA, 19 bp, Homo sapiens
gcctgcgcgccccgcggcc

SEQ ID NO: 57812 - DNA, 16 bp, Homo sapiens
gcgccgcgccgcagcc

SEQ ID NO: 57813 - DNA, 24 bp, Homo sapiens
gcgccgcgccccacgctgcggccg

SEQ ID NO: 57814 - DNA, 20 bp, Homo sapiens
cgcctcagcagccgcggccg

SEQ ID NO: 57815 - DNA, 25 bp, Homo sapiens
gctccgcgcgcgggctacgcggccg

SEQ ID NO: 57816 - DNA, 18 bp, Homo sapiens
gcgccgcgcgcgggctcc

SEQ ID NO: 57817 - DNA, 23 bp, Homo sapiens
gccctgcgcgcgcgtgcgtgccg

SEQ ID NO: 57818 - DNA, 18 bp, Homo sapiens
gcgctgcgcgcacgagca

SEQ ID NO: 57819 - DNA, 21 bp, Homo sapiens
gccgcgcgcgggctgcggccg

SEQ ID NO: 57820 - DNA, 19 bp, Homo sapiens
gcgccgcgccgcagcttcg

SEQ ID NO: 57821 - DNA, 21 bp, Homo sapiens
gcgctgcgcgccgcaacctcg

SEQ ID NO: 57822 - DNA, 18 bp, Homo sapiens
gcgacgcgcgcgcctggc

SEQ ID NO: 57823 - DNA, 16 bp, Homo sapiens
gcgccgcgcgccgcgg

SEQ ID NO: 57824 - DNA, 19 bp, Homo sapiens
gcgccgcggcgcgcgggcc

SEQ ID NO: 57825 - DNA, 22 bp, Homo sapiens
gcgcccgccccggccgcggccg

SEQ ID NO: 57826 - DNA, 22 bp, Homo sapiens
gcccgcggggcggtcgcggccg

SEQ ID NO: 57827 - DNA, 22 bp, Homo sapiens
gcgccgcgcgggcgggcagccg

SEQ ID NO: 57828 - DNA, 21 bp, Homo sapiens
gctccgcgcgcgcggcgtgcc

SEQ ID NO: 57829 - DNA, 15 bp, Homo sapiens
gcgccggcgcgcggc

SEQ ID NO: 57830 - DNA, 21 bp, Homo sapiens
gcgccgcgcgggcagagagcc

SEQ ID NO: 57831 - DNA, 16 bp, Homo sapiens
gcgccgcgcgccggcc

SEQ ID NO: 57832 - DNA, 17 bp, Homo sapiens
gcgtcgcgcgcgccagc

SEQ ID NO: 57833 - DNA, 24 bp, Homo sapiens
gcgcttgccggagaaccgcggccg

SEQ ID NO: 57834 - DNA, 21 bp, Homo sapiens
ccgctgctgggaccgcggccg

SEQ ID NO: 57835 - DNA, 18 bp, Homo sapiens
gccccgcgcgcgcggcga

SEQ ID NO: 57836 - DNA, 23 bp, Homo sapiens
gcgccgcgcgccgaccacttccg

SEQ ID NO: 57837 - DNA, 16 bp, Homo sapiens
gcgccgcgccgcgcgc

SEQ ID NO: 57838 - DNA, 22 bp, Homo sapiens
gccgcgccggccaccgcggccg

SEQ ID NO: 57839 - DNA, 22 bp, Homo sapiens
gcgttgcccggctccgcggccg

SEQ ID NO: 57840 - DNA, 21 bp, Homo sapiens
gcgctgctccacccgcggccg

SEQ ID NO: 57841 - DNA, 24 bp, Homo sapiens
gcgcggcgtgtcaggctgcggccg

SEQ ID NO: 57842 - DNA, 25 bp, Homo sapiens
gcgccgcgcgcccggccgcgctccg

SEQ ID NO: 57843 - DNA, 19 bp, Homo sapiens
gcgccgcgcggcgctggcc

SEQ ID NO: 57844 - DNA, 24 bp, Homo sapiens
gcgccgggcccatcaccgcggccg

SEQ ID NO: 57845 - DNA, 17 bp, Homo sapiens
gcgccggcgcgcagcca

SEQ ID NO: 57846 - DNA, 21 bp, Homo sapiens
gcgccgcgtctcgggtggccg

SEQ ID NO: 57847 - DNA, 15 bp, Homo sapiens
gccgcgcgcagcggc

SEQ ID NO: 57848 - DNA, 19 bp, Homo sapiens
gcgccgcgcgagcgccgcc

SEQ ID NO: 57849 - DNA, 21 bp, Homo sapiens
gcgccgcggcgggtgcggccg

SEQ ID NO: 57850 - DNA, 17 bp, Homo sapiens
gcgccgcgcgccggccg

SEQ ID NO: 57851 - DNA, 24 bp, Homo sapiens
gcgctgtcgccgccgccgcggccg

SEQ ID NO: 57852 - DNA, 23 bp, Homo sapiens
ccgcgcgcatcacgccgcggccg

SEQ ID NO: 57853 - DNA, 17 bp, Homo sapiens
gcgccgcaggccgtggc

SEQ ID NO: 57854 - DNA, 21 bp, Homo sapiens
gccgcgcgtgcggccacgccg

SEQ ID NO: 57855 - DNA, 20 bp, Homo sapiens
gcccggcgcggccgcggccg

SEQ ID NO: 57856 - DNA, 18 bp, Homo sapiens
gcgcgggcagccgcggcc

SEQ ID NO: 57857 - DNA, 19 bp, Homo sapiens
gcgccgcgcggtcccaggc

SEQ ID NO: 57858 - DNA, 21 bp, Homo sapiens
gcaccgtgcttctcgcggccg

SEQ ID NO: 57859 - DNA, 26 bp, Homo sapiens
gcccgctcaatccgcgcgactgcggc

SEQ ID NO: 57860 - DNA, 18 bp, Homo sapiens
gccgcgcgcgcgggggcc

SEQ ID NO: 57861 - DNA, 16 bp, Homo sapiens
gcgcgcgcgcgcgcgc

SEQ ID NO: 57862 - DNA, 22 bp, Homo sapiens
gctgcccgcccgcccgcggccg

SEQ ID NO: 57863 - DNA, 17 bp, Homo sapiens
gcgcggcgcgcgcaggc

SEQ ID NO: 57864 - DNA, 18 bp, Homo sapiens
cgccgcgcgcaggcggcc

SEQ ID NO: 57865 - DNA, 24 bp, Homo sapiens
gcgccgcgcgcccagctcactccg

SEQ ID NO: 57866 - DNA, 19 bp, Homo sapiens
gcggcgcgcgcgcggcggc

SEQ ID NO: 57867 - DNA, 21 bp, Homo sapiens
gcgccgcgcccgcccgggccg

SEQ ID NO: 57868 - DNA, 21 bp, Homo sapiens
gctcgcgcgcgctgacatggc

SEQ ID NO: 57869 - DNA, 18 bp, Homo sapiens
gcgtgcgcgcgcgacgcg

SEQ ID NO: 57870 - DNA, 23 bp, Homo sapiens
gctccgcgcgcgttcacgggccg

SEQ ID NO: 57871 - DNA, 18 bp, Homo sapiens
gcgtcgcgtgcgcagccg

SEQ ID NO: 57872 - DNA, 22 bp, Homo sapiens
gctcgtgccgaattcgcggccg

SEQ ID NO: 57873 - DNA, 23 bp, Homo sapiens
gcgccgcggcgcgcggctccggc

SEQ ID NO: 57874 - DNA, 20 bp, Homo sapiens
cgctgcgcgcgcgctcgccg

SEQ ID NO: 57875 - DNA, 18 bp, Homo sapiens
gcgccgcgcgcgggcggc

SEQ ID NO: 57876 - DNA, 18 bp, Homo sapiens
gcgccgcacgcgcaggcc

SEQ ID NO: 57877 - DNA, 20 bp, Homo sapiens
gcgcgtgggactcgcggccg

SEQ ID NO: 57878 - DNA, 24 bp, Homo sapiens
gcgccgcgcgcggtccagaggccg

SEQ ID NO: 57879 - DNA, 21 bp, Homo sapiens
gcgccgttcggagcgcggccg

SEQ ID NO: 57880 - DNA, 25 bp, Homo sapiens
gcgccgcgcagtgcggatgatgccg

SEQ ID NO: 57881 - DNA, 20 bp, Homo sapiens
gcgtcacgcggccgcggccg

SEQ ID NO: 57882 - DNA, 21 bp, Homo sapiens
gcgccgcgcgtgtggcagtcg

SEQ ID NO: 57883 - DNA, 19 bp, Homo sapiens
gcgccgcactgactgcggc

SEQ ID NO: 57884 - DNA, 18 bp, Homo sapiens
gcgccgcgcgcccgggcc

SEQ ID NO: 57885 - DNA, 19 bp, Homo sapiens
gcagccgcgcgcgcagtcg

SEQ ID NO: 57886 - DNA, 23 bp, Homo sapiens
gcggccgccgccgcagccgcggc

SEQ ID NO: 57887 - DNA, 23 bp, Homo sapiens
gcggccccgagcagccgcggccg

SEQ ID NO: 57888 - DNA, 20 bp, Homo sapiens
gcgctgcccgcgcggccacg

SEQ ID NO: 57889 - DNA, 21 bp, Homo sapiens
cgccgccaagagccgcggccg

SEQ ID NO: 57890 - DNA, 19 bp, Homo sapiens
gccgcgcgcgcgggggccg

SEQ ID NO: 57891 - DNA, 20 bp, Homo sapiens
gcgccggtgcgcgccggcgg

SEQ ID NO: 57892 - DNA, 22 bp, Homo sapiens
gccgcggcaccgatcgcggccg

SEQ ID NO: 57893 - DNA, 18 bp, Homo sapiens
gcgtcgcgcgcgagctcc

SEQ ID NO: 57894 - DNA, 79 bp, Amsacta moorei entomopoxvirus
tgcaataaaaattaaattatggaataaccttaatagtaaatagatattatttttttagttcagtatattaggtctcgca

SEQ ID NO: 57895 - DNA, 24 bp, Amsacta moorei entomopoxvirus
taaattatggaataaccttaatag

SEQ ID NO: 57896 - DNA, 20 bp, Homo sapiens
aattatggaatagcccccaa

SEQ ID NO: 57897 - DNA, 21 bp, Homo sapiens
tagattatggaatagaactta

SEQ ID NO: 57898 - DNA, 18 bp, Homo sapiens
taaattatagaataatct

SEQ ID NO: 57899 - DNA, 77 bp, Amsacta moorei entomopoxvirus
aattgaaaagaaatatgaaatgtacaattgtaattttattaaattatataaaaataataatatatttaacggcaatt

SEQ ID NO: 57900 - DNA, 24 bp, Amsacta moorei entomopoxvirus
tatgaaatgtacaattgtaatttt

SEQ ID NO: 57901 - DNA, 17 bp, Homo sapiens
gaaatgtacatttaatt

SEQ ID NO: 57902 - DNA, 22 bp, Homo sapiens
atgaaatgtacagttgactttt

SEQ ID NO: 57903 - DNA, 19 bp, Homo sapiens
gaaatgtacatgagatttt

SEQ ID NO: 57904 - DNA, 18 bp, Homo sapiens
tgaaatgtattgcaattt

SEQ ID NO: 57905 - DNA, 20 bp, Homo sapiens
gaaatgaactatgtaatttt

SEQ ID NO: 57906 - DNA, 21 bp, Homo sapiens
gaaatgtattatcataatttt

SEQ ID NO: 57907 - DNA, 20 bp, Homo sapiens
tgaaatgtattacatttgta

SEQ ID NO: 57908 - DNA, 21 bp, Homo sapiens
tgaaatgtacgagtatatttt

SEQ ID NO: 57909 - DNA, 69 bp, Bovine adenovirus B
cagcacgccacgctcgccgtcgttgcgtcataaatgacgtggcaaaaatgattggcagttggaccgctg

SEQ ID NO: 57910 - DNA, 24 bp, Bovine adenovirus B
tggcaaaaatgattggcagttgga

SEQ ID NO: 57911 - DNA, 21 bp, Homo sapiens
tggcagggtctgcgcagttgg

SEQ ID NO: 57912 - DNA, 21 bp, Homo sapiens
tggaaaggaaatgcagttgga

SEQ ID NO: 57913 - DNA, 18 bp, Homo sapiens
tggcaaaaattgtgttgg

SEQ ID NO: 57914 - DNA, 21 bp, Homo sapiens
ggcagaggctggagcagttgg

SEQ ID NO: 57915 - DNA, 21 bp, Homo sapiens
tgttgaaaatgacaaagttgg

SEQ ID NO: 57916 - DNA, 20 bp, Homo sapiens
gcaaagatggtgacagttgg

SEQ ID NO: 57917 - DNA, 17 bp, Homo sapiens
gcagatgtggcagttgg

SEQ ID NO: 57918 - DNA, 15 bp, Homo sapiens
tggcaaaaagagttg

SEQ ID NO: 57919 - DNA, 22 bp, Homo sapiens
ggcaggaactcaaggcagttgg

SEQ ID NO: 57920 - DNA, 21 bp, Homo sapiens
tggcaaaagtcatgaacttgg

SEQ ID NO: 57921 - DNA, 20 bp, Homo sapiens
gcaaaaatttgcacggttgg

SEQ ID NO: 57922 - DNA, 19 bp, Homo sapiens
tgacaagaagggcagttgg

SEQ ID NO: 57923 - DNA, 21 bp, Homo sapiens
tggaaatggggcacagttgga

SEQ ID NO: 57924 - DNA, 85 bp, Rabbit fibroma virus
ttttccaatttcgtaagtcgtctacaaaaacatatacaaactgtatctagatgataggattattatgtggcggaacaatggaaaa

SEQ ID NO: 57925 - DNA, 24 bp, Rabbit fibroma virus
gatgataggattattatgtggcgg

SEQ ID NO: 57926 - DNA, 16 bp, Homo sapiens
tgacagggttatgtgg

SEQ ID NO: 57927 - DNA, 17 bp, Homo sapiens
gatggtaggattaatgt

SEQ ID NO: 57928 - DNA, 22 bp, Homo sapiens
gatgatagggtattattttagg

SEQ ID NO: 57929 - DNA, 20 bp, Homo sapiens
gatggtggtctgtgtggcgg

SEQ ID NO: 57930 - DNA, 22 bp, Homo sapiens
tgacaggcagtgagtgtggcgg

SEQ ID NO: 57931 - DNA, 23 bp, Homo sapiens
gatcgtgagcagttatgtggtgg

SEQ ID NO: 57932 - DNA, 85 bp, Grapevine trichovirus B
aggttggctttaaaaatggctaagttaggtcaaaaggaacctcaagtgatgtttgacttcaactctggtcttaatctgttaacct

SEQ ID NO: 57933 - DNA, 24 bp, Grapevine trichovirus B
taagttaggtcaaaaggaacctca

SEQ ID NO: 57934 - DNA, 17 bp, Homo sapiens
tagaacaaaggaacctc

SEQ ID NO: 57935 - DNA, 23 bp, Homo sapiens
taagttaggcacactgagaatct

SEQ ID NO: 57936 - DNA, 19 bp, Homo sapiens
agtttaagagaaggaacct

SEQ ID NO: 57937 - DNA, 17 bp, Homo sapiens
tgattaggtcaggccct

SEQ ID NO: 57938 - DNA, 16 bp, Homo sapiens
taagctagggggacct

SEQ ID NO: 57939 - DNA, 21 bp, Homo sapiens
tgattgggtcaaaaggctcct

SEQ ID NO: 57940 - DNA, 21 bp, Homo sapiens
tagactccaagaggaacctca

SEQ ID NO: 57941 - DNA, 18 bp, Homo sapiens
taagcttggttaaaagga

SEQ ID NO: 57942 - DNA, 19 bp, Homo sapiens
agcctcaaaaggggcctca

SEQ ID NO: 57943 - DNA, 22 bp, Homo sapiens
gttatagacaaaaggagtttca

SEQ ID NO: 57944 - DNA, 18 bp, Homo sapiens
taagtaaaaaggaacttc

SEQ ID NO: 57945 - DNA, 18 bp, Homo sapiens
taagttggtcaaaaggaa

SEQ ID NO: 57946 - DNA, 16 bp, Homo sapiens
taagttaggcaaagga

SEQ ID NO: 57947 - DNA, 22 bp, Homo sapiens
aagtacgtcaaaaggagcctca

SEQ ID NO: 57948 - DNA, 18 bp, Homo sapiens
aggtcaaagggagtctca

SEQ ID NO: 57949 - DNA, 16 bp, Homo sapiens
agttaggtcagatctc

SEQ ID NO: 57950 - DNA, 23 bp, Homo sapiens
taagttaggatcatgaggttcct

SEQ ID NO: 57951 - DNA, 16 bp, Homo sapiens
taagttaagtgaacct

SEQ ID NO: 57952 - DNA, 19 bp, Homo sapiens
gtttttgaaaggaacctca

SEQ ID NO: 57953 - DNA, 21 bp, Homo sapiens
tgattaggtcatggggggcct

SEQ ID NO: 57954 - DNA, 20 bp, Homo sapiens
gtgtgtgaaaaggaacctca

SEQ ID NO: 57955 - DNA, 21 bp, Homo sapiens
gttaggtcagaagtatgctca

SEQ ID NO: 57956 - DNA, 96 bp, Junonia coenia densovirus
gtattgccaccgacgacgacgacggcagtccctgccggcgaagccggccgccgcgaagcggcaagggactgccgtcgtcgtcgtcggtggcaatac

SEQ ID NO: 57957 - DNA, 24 bp, Junonia coenia densovirus
acggcagtccctgccggcgaagcc

SEQ ID NO: 57958 - DNA, 26 bp, Homo sapiens
cgacagtcccgtgaagttggcttcgc

SEQ ID NO: 57959 - DNA, 23 bp, Homo sapiens
cggcggatcggcaaaggcgaggc

SEQ ID NO: 57960 - DNA, 19 bp, Homo sapiens
ggcagcccttgtccccagc

SEQ ID NO: 57961 - DNA, 18 bp, Homo sapiens
cggcagccctggcagagc

SEQ ID NO: 57962 - DNA, 19 bp, Homo sapiens
acggcgtccctgctccagc

SEQ ID NO: 57963 - DNA, 22 bp, Homo sapiens
cggcagcccctgcccgcgcggc

SEQ ID NO: 57964 - DNA, 19 bp, Homo sapiens
acggcggccctgccacagc

SEQ ID NO: 57965 - DNA, 23 bp, Homo sapiens
acggaggtccgcgcggcgaagcc

SEQ ID NO: 57966 - DNA, 21 bp, Homo sapiens
gcaggtgcgcgccggcgaggc

SEQ ID NO: 57967 - DNA, 19 bp, Homo sapiens
ggcatccctgcccaggggc

SEQ ID NO: 57968 - DNA, 19 bp, Homo sapiens
acggcagctcctgccgagc

SEQ ID NO: 57969 - DNA, 22 bp, Homo sapiens
ggcagtccctgcagtcggcttg

SEQ ID NO: 57970 - DNA, 20 bp, Homo sapiens
acgtggtccccacctggagc

SEQ ID NO: 57971 - DNA, 24 bp, Homo sapiens
cggcggcccctgccccgcagagcc

SEQ ID NO: 57972 - DNA, 21 bp, Homo sapiens
ggcagtttttgccagatcaag

SEQ ID NO: 57973 - DNA, 17 bp, Homo sapiens
agcagtcctgagctgag

SEQ ID NO: 57974 - DNA, 17 bp, Homo sapiens
cggtggtccctgcagcg

SEQ ID NO: 57975 - DNA, 17 bp, Homo sapiens
ggcatccctgctggtgc

SEQ ID NO: 57976 - DNA, 19 bp, Homo sapiens
cggggtccctgccctgggc

SEQ ID NO: 57977 - DNA, 18 bp, Homo sapiens
gcgcgccgccggcggggc

SEQ ID NO: 57978 - DNA, 23 bp, Homo sapiens
acggcagacccctgaaacgaagc

SEQ ID NO: 57979 - DNA, 20 bp, Homo sapiens
acggcagtctctggctgggc

SEQ ID NO: 57980 - DNA, 20 bp, Homo sapiens
acggcagccctgccaatggc

SEQ ID NO: 57981 - DNA, 21 bp, Homo sapiens
ggcagtcccttgtcaggcggc

SEQ ID NO: 57982 - DNA, 22 bp, Homo sapiens
acggcagcccctggcccggagc

SEQ ID NO: 57983 - DNA, 17 bp, Homo sapiens
ggagtccctagagaagc

SEQ ID NO: 57984 - DNA, 19 bp, Homo sapiens
acggcagtcctgctgcggc

SEQ ID NO: 57985 - DNA, 17 bp, Homo sapiens
ggcagtcccaggtgaag

SEQ ID NO: 57986 - DNA, 19 bp, Homo sapiens
ggcagtcctgcctagtaag

SEQ ID NO: 57987 - DNA, 22 bp, Homo sapiens
cggggtcccgccaggcgaggcc

SEQ ID NO: 57988 - DNA, 19 bp, Homo sapiens
cgtgcagagctcggcgaag

SEQ ID NO: 57989 - DNA, 18 bp, Homo sapiens
ggcagcccctggcagcga

SEQ ID NO: 57990 - DNA, 18 bp, Homo sapiens
agtccctgtacaacagcc

SEQ ID NO: 57991 - DNA, 22 bp, Homo sapiens
ggcagtccctgtcactggggcc

SEQ ID NO: 57992 - DNA, 19 bp, Homo sapiens
ggtagtccctgctggagcc

SEQ ID NO: 57993 - DNA, 17 bp, Homo sapiens
ggagtccctggccaagc

SEQ ID NO: 57994 - DNA, 19 bp, Homo sapiens
acagcagttccttaggagc

SEQ ID NO: 57995 - DNA, 16 bp, Homo sapiens
gcagtcccactggagc

SEQ ID NO: 57996 - DNA, 18 bp, Homo sapiens
cggcggctgcagtgaggc

SEQ ID NO: 57997 - DNA, 20 bp, Homo sapiens
ggcagccccttcggtggagc

SEQ ID NO: 57998 - DNA, 23 bp, Homo sapiens
cggcagtccttgccgtgacatgc

SEQ ID NO: 57999 - DNA, 17 bp, Homo sapiens
cggcagccgggcggagc

SEQ ID NO: 58000 - DNA, 24 bp, Homo sapiens
cggcagtccctgccccggtgggcc

SEQ ID NO: 58001 - DNA, 22 bp, Homo sapiens
gacagtccctgctcagtgagcc

SEQ ID NO: 58002 - DNA, 17 bp, Homo sapiens
ggtagtgccgacggagc

SEQ ID NO: 58003 - DNA, 23 bp, Homo sapiens
cagtggtccctgcataccaggcc

SEQ ID NO: 58004 - DNA, 17 bp, Homo sapiens
ggcagtctccggcgaag

SEQ ID NO: 58005 - DNA, 17 bp, Homo sapiens
ggcactgccggcgaggc

SEQ ID NO: 58006 - DNA, 16 bp, Homo sapiens
gcagtcccaccggggc

SEQ ID NO: 58007 - DNA, 23 bp, Homo sapiens
ggcggtccctgcccacgaggagc

SEQ ID NO: 58008 - DNA, 19 bp, Homo sapiens
acgccagtccctcagaagc

SEQ ID NO: 58009 - DNA, 24 bp, Homo sapiens
acggcagtttctggggtcggcttg

SEQ ID NO: 58010 - DNA, 21 bp, Homo sapiens
cggccgtctgtgtgcggggcc

SEQ ID NO: 58011 - DNA, 17 bp, Homo sapiens
cagtcccttagggaagc

SEQ ID NO: 58012 - DNA, 23 bp, Homo sapiens
ggcagcccctgccattataagcc

SEQ ID NO: 58013 - DNA, 16 bp, Homo sapiens
ggcagcaccggcgaag

SEQ ID NO: 58014 - DNA, 16 bp, Homo sapiens
acggcagtccccggca

SEQ ID NO: 58015 - DNA, 17 bp, Homo sapiens
cggctgcaccggcggag

SEQ ID NO: 58016 - DNA, 21 bp, Homo sapiens
ggcagccctgtcgccggcttg

SEQ ID NO: 58017 - DNA, 22 bp, Homo sapiens
ggggtcgcgcgccggcggggcc

SEQ ID NO: 58018 - DNA, 16 bp, Homo sapiens
gcagctgccggcggag

SEQ ID NO: 58019 - DNA, 71 bp, Junonia coenia densovirus
ttgaccttctgagctgatgtctactgacctgatgatggagaggatccgaagaccttggagctgaaggtgga

SEQ ID NO: 58020 - DNA, 24 bp, Junonia coenia densovirus
gaccttctgagctgatgtctactg

SEQ ID NO: 58021 - DNA, 18 bp, Homo sapiens
ccttctgagctaaaatgc

SEQ ID NO: 58022 - DNA, 19 bp, Homo sapiens
cttctgagcctgcctgctg

SEQ ID NO: 58023 - DNA, 18 bp, Homo sapiens
gactttctaagccactgc

SEQ ID NO: 58024 - DNA, 23 bp, Homo sapiens
gaccttcttgcccttgtttgctg

SEQ ID NO: 58025 - DNA, 23 bp, Homo sapiens
gaccttctgggcttaagcaatgc

SEQ ID NO: 58026 - DNA, 21 bp, Homo sapiens
cttctgagcaggattcaactg

SEQ ID NO: 58027 - DNA, 22 bp, Homo sapiens
gaccttctaggaccttctactg

SEQ ID NO: 58028 - DNA, 20 bp, Homo sapiens
ttctgggttggtgtctactg

SEQ ID NO: 58029 - DNA, 21 bp, Homo sapiens
gaccttctggagttgtccccg

SEQ ID NO: 58030 - DNA, 17 bp, Homo sapiens
cctttgagctgacacct

SEQ ID NO: 58031 - DNA, 22 bp, Homo sapiens
gaccttcctgattcgtctactg

SEQ ID NO: 58032 - DNA, 21 bp, Homo sapiens
tctgacaactgatgtttgctg

SEQ ID NO: 58033 - DNA, 25 bp, Homo sapiens
gaccctctggccggcctgtctgctg

SEQ ID NO: 58034 - DNA, 84 bp, Human herpesvirus 4
gactgaattttcgcagtctcttttccctcttcccttgttattcccatagaattacagtgaggttacacaggtggagattcagtt

SEQ ID NO: 58035 - DNA, 24 bp, Human herpesvirus 4
attacagtgaggttacacaggtgg

SEQ ID NO: 58036 - DNA, 24 bp, Homo sapiens
actacagtgggtgggagtgggtgg

SEQ ID NO: 58037 - DNA, 19 bp, Homo sapiens
cagtgagattgcaccactg

SEQ ID NO: 58038 - DNA, 21 bp, Homo sapiens
ttacaatgaggttacccatgg

SEQ ID NO: 58039 - DNA, 24 bp, Homo sapiens
attacagtaggtagggttaggtgg

SEQ ID NO: 58040 - DNA, 19 bp, Homo sapiens
tacagtggaagacaggtgg

SEQ ID NO: 58041 - DNA, 23 bp, Homo sapiens
attatggcgaggcttccgggtgg

SEQ ID NO: 58042 - DNA, 18 bp, Homo sapiens
gtggtggttacacaggtg

SEQ ID NO: 58043 - DNA, 18 bp, Homo sapiens
agtgggtggtacaggtgg

SEQ ID NO: 58044 - DNA, 17 bp, Homo sapiens
cagtttcacacaggtgg

SEQ ID NO: 58045 - DNA, 23 bp, Homo sapiens
tcacgagccctttatacaggtgg

SEQ ID NO: 58046 - DNA, 20 bp, Homo sapiens
gtggtgatcagcacaggtgg

SEQ ID NO: 58047 - DNA, 84 bp, Chimpanzee cytomegalovirus
acgacggctacagctcgcggtcgaagccgtcgcccgacagatagtcgaagatgagcgcgagaccgtacaggtagtagtcgacgt

SEQ ID NO: 58048 - DNA, 24 bp, Chimpanzee cytomegalovirus
gaagatgagcgcgagaccgtacag

SEQ ID NO: 58049 - DNA, 18 bp, Homo sapiens
aaagatgagtgtgacaca

SEQ ID NO: 58050 - DNA, 17 bp, Homo sapiens
gaagggagcgcgaggcc

SEQ ID NO: 58051 - DNA, 19 bp, Homo sapiens
agatgagctgggagaacag

SEQ ID NO: 58052 - DNA, 16 bp, Homo sapiens
gaagatgagtgagaac

SEQ ID NO: 58053 - DNA, 18 bp, Homo sapiens
gaggatgagcgcttccgc

SEQ ID NO: 58054 - DNA, 18 bp, Homo sapiens
gaaggtgagcgcagggcg

SEQ ID NO: 58055 - DNA, 22 bp, Homo sapiens
gaggatgagcgccaggttcccg

SEQ ID NO: 58056 - DNA, 24 bp, Homo sapiens
gagtgagcgcacgcaaccgtgcag

SEQ ID NO: 58057 - DNA, 18 bp, Homo sapiens
gaagacgagtgtgagcgt

SEQ ID NO: 58058 - DNA, 21 bp, Homo sapiens
gaagatgagcatgaggaggta

SEQ ID NO: 58059 - DNA, 73 bp, Chimpanzee cytomegalovirus
aggcgaaggctttcgccactcctatcttgaaagcgtgtcattctttatgataggcgtgacgatgtctccgcct

SEQ ID NO: 58060 - DNA, 24 bp, Chimpanzee cytomegalovirus
tgataggcgtgacgatgtctccgc

SEQ ID NO: 58061 - DNA, 22 bp, Homo sapiens
gacaccacaggtgatgtctccg

SEQ ID NO: 58062 - DNA, 18 bp, Homo sapiens
tggtaggcgtggcaatgc

SEQ ID NO: 58063 - DNA, 18 bp, Homo sapiens
tgataggcagtgatttct

SEQ ID NO: 58064 - DNA, 120 bp, Frog adenovirus 1
ttggatcccaatgtcttgttcagaatgctgctagatgcttataagctcgagaagcagtacaagagtaaactgcagtctcgtgctgcatcgcagtctactatttaaccacttgggggccaa

SEQ ID NO: 58065 - DNA, 24 bp, Frog adenovirus 1
actgcagtctcgtgctgcatcgca

SEQ ID NO: 58066 - DNA, 20 bp, Homo sapiens
actgcagttttctgtctgca

SEQ ID NO: 58067 - DNA, 19 bp, Homo sapiens
ctgtgtcccatatctgcat

SEQ ID NO: 58068 - DNA, 21 bp, Homo sapiens
ctgtggcctcgtgactcctgc

SEQ ID NO: 58069 - DNA, 16 bp, Homo sapiens
tgcatctgctgcatcg

SEQ ID NO: 58070 - DNA, 19 bp, Homo sapiens
tgcagtctcgtagttgtcg

SEQ ID NO: 58071 - DNA, 18 bp, Homo sapiens
ctgcagtctctgctgggc

SEQ ID NO: 58072 - DNA, 16 bp, Homo sapiens
tgcatcactgcattgc

SEQ ID NO: 58073 - DNA, 24 bp, Homo sapiens
ctgcagattcaattatgcattgca

SEQ ID NO: 58074 - DNA, 18 bp, Homo sapiens
actgcagtcttgtgatca

SEQ ID NO: 58075 - DNA, 67 bp, Triatoma virus
gatgaactgtcctcaacaagtatgaaaagcaattatttgtgaagttacttgttgttgtaagattatt

SEQ ID NO: 58076 - DNA, 20 bp, Triatoma virus
cttgttgttgtaagattatt

SEQ ID NO: 58077 - DNA, 19 bp, Homo sapiens
ctcgtttctgcagattatt

SEQ ID NO: 58078 - DNA, 19 bp, Homo sapiens
ttgttgttatatacagatt

SEQ ID NO: 58079 - DNA, 18 bp, Homo sapiens
ttgctgttgtataagatt

SEQ ID NO: 58080 - DNA, 18 bp, Homo sapiens
ttgctgttgtcccagatt

SEQ ID NO: 58081 - DNA, 19 bp, Homo sapiens
cttgttgttgttggggact

SEQ ID NO: 58082 - DNA, 18 bp, Homo sapiens
ctcgttgttgtttcgatt

SEQ ID NO: 58083 - DNA, 19 bp, Homo sapiens
cctgccgcatgagattatt

SEQ ID NO: 58084 - DNA, 18 bp, Homo sapiens
cttgttattgttcaaatt

SEQ ID NO: 58085 - DNA, 19 bp, Homo sapiens
ttgttgttgttgtattatt

SEQ ID NO: 58086 - DNA, 20 bp, Homo sapiens
ttgttgttactatgattatt

SEQ ID NO: 58087 - DNA, 21 bp, Homo sapiens
cttgctgtcagtcagattatt

SEQ ID NO: 58088 - DNA, 19 bp, Homo sapiens
ttgttgttgttgcatcatt

SEQ ID NO: 58089 - DNA, 19 bp, Homo sapiens
ttgttgttgcgcgagcatt

SEQ ID NO: 58090 - DNA, 106 bp, Triatoma virus
cctgcaggcattttgtgaaaagggtaaagtatgaaagctactctcagaaaagtacttatgtattgatgagagccttaaaatgactttatattcacaaaactgctgg

SEQ ID NO: 58091 - DNA, 24 bp, Triatoma virus
ttgatgagagccttaaaatgactt

SEQ ID NO: 58092 - DNA, 27 bp, Homo sapiens
ttgatgaggtaagagttgaaatgactt

SEQ ID NO: 58093 - DNA, 21 bp, Homo sapiens
ttgagagaggttaagtgactt

SEQ ID NO: 58094 - DNA, 20 bp, Homo sapiens
ttaatgaggccccaaagtga

SEQ ID NO: 58095 - DNA, 25 bp, Homo sapiens
tggtgagagcccaaggggatgactt

SEQ ID NO: 58096 - DNA, 22 bp, Homo sapiens
gatgggggcagtcaaatgactt

SEQ ID NO: 58097 - DNA, 18 bp, Homo sapiens
ctgatgagaaaagtgact

SEQ ID NO: 58098 - DNA, 22 bp, Homo sapiens
ttaatgagagttgacatgactt

SEQ ID NO: 58099 - DNA, 131 bp, Triatoma virus
gcgagaaagcacgcaaatcaaagtctagtgcgtaattcactcactaccggcgtaatttgtggttatgctattgcgttgagagtgttgtgggcgtagtacgggggcttttggtttgtgtgtgattaatatgc

SEQ ID NO: 58100 - DNA, 24 bp, Triatoma virus
tattgcgttgagagtgttgtgggc

SEQ ID NO: 58101 - DNA, 18 bp, Homo sapiens
attgtgtgttgttgtggg

SEQ ID NO: 58102 - DNA, 18 bp, Homo sapiens
tattcgtcctgttgtggg

SEQ ID NO: 58103 - DNA, 60 bp, Sulfolobus virus SIRV-1
catttgtaatagaaaatttaagagaagaaaaagaattcctaaaatttttatatgaaagtg

SEQ ID NO: 58104 - DNA, 24 bp, Sulfolobus virus SIRV-1
tagaaaatttaagagaagaaaaag

SEQ ID NO: 58105 - DNA, 21 bp, Homo sapiens
aaaattctagaggagaaaaag

SEQ ID NO: 58106 - DNA, 23 bp, Homo sapiens
tagaaagatttaaaaagaaaaag

SEQ ID NO: 58107 - DNA, 22 bp, Homo sapiens
gaaaatttagcttaagaaaaag

SEQ ID NO: 58108 - DNA, 19 bp, Homo sapiens
tagaagattcaagatagaa

SEQ ID NO: 58109 - DNA, 20 bp, Homo sapiens
aaaatttaagagtattgaaa

SEQ ID NO: 58110 - DNA, 22 bp, Homo sapiens
gaaaactcgcgggggagaagaa

SEQ ID NO: 58111 - DNA, 20 bp, Homo sapiens
tagagaattcaaacaaagaa

SEQ ID NO: 58112 - DNA, 23 bp, Homo sapiens
cagaaggtaggaggaagaaaaag

SEQ ID NO: 58113 - DNA, 18 bp, Homo sapiens
aaaaatttaaaaaaaaaa

SEQ ID NO: 58114 - DNA, 23 bp, Homo sapiens
agaaaatttaaaaaaagaaaaag

SEQ ID NO: 58115 - DNA, 21 bp, Homo sapiens
agaaagacagaggagaaaaag

SEQ ID NO: 58116 - DNA, 25 bp, Homo sapiens
tagaaaactttattcttaagaagaa

SEQ ID NO: 58117 - DNA, 24 bp, Homo sapiens
agaaaacgttcagggaagagaaag

SEQ ID NO: 58118 - DNA, 20 bp, Homo sapiens
cagaaaaaagaaaagagaag

SEQ ID NO: 58119 - DNA, 20 bp, Homo sapiens
agaaaattcagggagaggaa

SEQ ID NO: 58120 - DNA, 18 bp, Homo sapiens
agaaaattaaaagagaga

SEQ ID NO: 58121 - DNA, 17 bp, Homo sapiens
gaaaataaagaagaaaa

SEQ ID NO: 58122 - DNA, 20 bp, Homo sapiens
tagaaaacttaaaaggaaga

SEQ ID NO: 58123 - DNA, 22 bp, Homo sapiens
cagaaatggtgagaagaaaaag

SEQ ID NO: 58124 - DNA, 23 bp, Homo sapiens
aaaatttaaaagaggggaaaaag

SEQ ID NO: 58125 - DNA, 19 bp, Homo sapiens
tagaaatacagaagaaaaa

SEQ ID NO: 58126 - DNA, 17 bp, Homo sapiens
agagaactaagagaaga

SEQ ID NO: 58127 - DNA, 22 bp, Homo sapiens
tagaaaatttaaaattatgaag

SEQ ID NO: 58128 - DNA, 18 bp, Homo sapiens
tagaaggcaaagaagaaa

SEQ ID NO: 58129 - DNA, 18 bp, Homo sapiens
cagaaaagagaaggaaaa

SEQ ID NO: 58130 - DNA, 21 bp, Homo sapiens
aaaagctcaaggggaagaaaa

SEQ ID NO: 58131 - DNA, 17 bp, Homo sapiens
cagaagataagagaaga

SEQ ID NO: 58132 - DNA, 20 bp, Homo sapiens
cagaaagggaaggaagaaaa

SEQ ID NO: 58133 - DNA, 18 bp, Homo sapiens
agaaaatttaggatgaag

SEQ ID NO: 58134 - DNA, 20 bp, Homo sapiens
cagaaaataaagaggaagaa

SEQ ID NO: 58135 - DNA, 21 bp, Homo sapiens
agaaaatttacaagggaagaa

SEQ ID NO: 58136 - DNA, 20 bp, Homo sapiens
tagagaattcaaaggaagaa

SEQ ID NO: 58137 - DNA, 18 bp, Homo sapiens
tagaaatttaaagagaag

SEQ ID NO: 58138 - DNA, 24 bp, Homo sapiens
tagaaaattaagaaataaaaaaag

SEQ ID NO: 58139 - DNA, 21 bp, Homo sapiens
agaaacaacgtagagaagaaa

SEQ ID NO: 58140 - DNA, 17 bp, Homo sapiens
tagaaaacttgaaaaga

SEQ ID NO: 58141 - DNA, 23 bp, Homo sapiens
taggaatttaggagaaaaaaaag

SEQ ID NO: 58142 - DNA, 18 bp, Homo sapiens
gaaaatggggagaagaaa

SEQ ID NO: 58143 - DNA, 21 bp, Homo sapiens
tagaaaattaaaccaaagaag

SEQ ID NO: 58144 - DNA, 25 bp, Homo sapiens
tagaaaatgctatgagaggaaaaag

SEQ ID NO: 58145 - DNA, 19 bp, Homo sapiens
gaaaatttacttggagaag

SEQ ID NO: 58146 - DNA, 19 bp, Homo sapiens
tagagaacttaagagtaag

SEQ ID NO: 58147 - DNA, 23 bp, Homo sapiens
tagaaaatttaaacatcgagaag

SEQ ID NO: 58148 - DNA, 21 bp, Homo sapiens
gaaagaaacaagaagaaaaag

SEQ ID NO: 58149 - DNA, 20 bp, Homo sapiens
agaaaatttaaattgagaag

SEQ ID NO: 58150 - DNA, 18 bp, Homo sapiens
agaaaatttgagagtaag

SEQ ID NO: 58151 - DNA, 18 bp, Homo sapiens
agaaagaaagaagaaaaa

SEQ ID NO: 58152 - DNA, 19 bp, Homo sapiens
agaaaatttaacagaaaaa

SEQ ID NO: 58153 - DNA, 18 bp, Homo sapiens
cagaagggagagaagaaa

SEQ ID NO: 58154 - DNA, 21 bp, Homo sapiens
taaaaaaacaaagaagaagaa

SEQ ID NO: 58155 - DNA, 19 bp, Homo sapiens
gatttataagagaagaaaa

SEQ ID NO: 58156 - DNA, 16 bp, Homo sapiens
tagaaaataaaagaag

SEQ ID NO: 58157 - DNA, 62 bp, Sulfolobus virus SIRV-1
tagattataaacatagaccttgcctattgaaaggtctagtctatgttgaactattagatcta

SEQ ID NO: 58158 - DNA, 24 bp, Sulfolobus virus SIRV-1
tataaacatagaccttgcctattg

SEQ ID NO: 58159 - DNA, 18 bp, Homo sapiens
caaacatagactttttct

SEQ ID NO: 58160 - DNA, 18 bp, Homo sapiens
tataaacataggccctgc

SEQ ID NO: 58161 - DNA, 22 bp, Homo sapiens
tataaacatagatctttctatt

SEQ ID NO: 58162 - DNA, 18 bp, Homo sapiens
tatatgcatagaccattg

SEQ ID NO: 58163 - DNA, 16 bp, Homo sapiens
acgtagacctccattg

SEQ ID NO: 58164 - DNA, 69 bp, Macaca mulatta rhadinovirus
cgggaaactgcgttttggataatgtgcaggacgtatgttcgtacggtcctccagaacgccgcgtacccg

SEQ ID NO: 58165 - DNA, 24 bp, Macaca mulatta rhadinovirus
tgcgttttggataatgtgcaggac

SEQ ID NO: 58166 - DNA, 18 bp, Homo sapiens
ttttggataatgcatgac

SEQ ID NO: 58167 - DNA, 18 bp, Homo sapiens
tgcgtgtgcgtgtgcagg

SEQ ID NO: 58168 - DNA, 21 bp, Homo sapiens
tgcttttggatgaggttgggg

SEQ ID NO: 58169 - DNA, 19 bp, Homo sapiens
tgtgttttggaaaatgaga

SEQ ID NO: 58170 - DNA, 18 bp, Homo sapiens
tgtgttttggaattggga

SEQ ID NO: 58171 - DNA, 20 bp, Homo sapiens
tgcgttttggggtggtcagg

SEQ ID NO: 58172 - DNA, 19 bp, Homo sapiens
tgcgttttgatgatggagg

SEQ ID NO: 58173 - DNA, 22 bp, Homo sapiens
tgcggtgatcctggtgtgcagg

SEQ ID NO: 58174 - DNA, 21 bp, Homo sapiens
tgtgttttggaaatctaaagg

SEQ ID NO: 58175 - DNA, 20 bp, Homo sapiens
tgggttctggatgtgcagga

SEQ ID NO: 58176 - DNA, 18 bp, Homo sapiens
gtgtctgtgtgtgcagga

SEQ ID NO: 58177 - DNA, 67 bp, Macaca mulatta rhadinovirus
tttggattgtaagcgctatcacgtatgcgacgggggacgcaactgcgtgatcgtgtacactcgcgaa

SEQ ID NO: 58178 - DNA, 24 bp, Macaca mulatta rhadinovirus
tggattgtaagcgctatcacgtat

SEQ ID NO: 58179 - DNA, 23 bp, Homo sapiens
tggatgtaggtagaatcacgtat

SEQ ID NO: 58180 - DNA, 67 bp, Fowlpox virus
tataacgtctaacttacaacacggtcataatagaatccctattaacatgttgtatatagatgtcgta

SEQ ID NO: 58181 - DNA, 24 bp, Fowlpox virus
taacgtctaacttacaacacggtc

SEQ ID NO: 58182 - DNA, 17 bp, Homo sapiens
taactctgacttacaac

SEQ ID NO: 58183 - DNA, 22 bp, Homo sapiens
gcctagaagaacacaacatggt

SEQ ID NO: 58184 - DNA, 17 bp, Homo sapiens
taacgtttaactacaac

SEQ ID NO: 58185 - DNA, 17 bp, Homo sapiens
gtccaacttgactggtc

SEQ ID NO: 58186 - DNA, 78 bp, Cowpox virus
atgatttagttactttaataaccgttagacataaaattgattctatgaaaactgtgtttcaggtatttaacgaatcat

SEQ ID NO: 58187 - DNA, 21 bp, Cowpox virus
ttcaggtatttaacgaatcat

SEQ ID NO: 58188 - DNA, 22 bp, Homo sapiens
ttcaggtatttggggactacat

SEQ ID NO: 58189 - DNA, 22 bp, Homo sapiens
ttcaagtatgactaagaatcat

SEQ ID NO: 58190 - DNA, 18 bp, Homo sapiens
ttcagatattcgagtcat

SEQ ID NO: 58191 - DNA, 21 bp, Homo sapiens
aggcatctgaatacgagtcat

SEQ ID NO: 58192 - DNA, 19 bp, Homo sapiens
ttcaggtattttgtagaat

SEQ ID NO: 58193 - DNA, 15 bp, Homo sapiens
ttcaagcatgaatca

SEQ ID NO: 58194 - DNA, 21 bp, Homo sapiens
ttcaggtattaataacttcat

SEQ ID NO: 58195 - DNA, 18 bp, Homo sapiens
ttcagatatttaacgaat

SEQ ID NO: 58196 - DNA, 18 bp, Homo sapiens
caggtattctttaatcat

SEQ ID NO: 58197 - DNA, 19 bp, Homo sapiens
ttcagagtataagaatcat

SEQ ID NO: 58198 - DNA, 20 bp, Homo sapiens
ttcaagtattttgaaatcat

SEQ ID NO: 58199 - DNA, 22 bp, Homo sapiens
ttcagtatttgaactaaatcat

SEQ ID NO: 58200 - DNA, 19 bp, Homo sapiens
ttcaagtatctacagtcat

SEQ ID NO: 58201 - DNA, 18 bp, Homo sapiens
tccaggtatcccagtcat

SEQ ID NO: 58202 - DNA, 23 bp, Homo sapiens
ttcaagtagccccagcgagtcat

SEQ ID NO: 58203 - DNA, 18 bp, Homo sapiens
ttcaggtacttagaaacc

SEQ ID NO: 58204 - DNA, 127 bp, Vaccinia virus
ctaatatagttaatagtgtactacaaacaggcgatggtaaaaagactcttcgtcttcccaaaatgttagagacggaaatagttgtcaagattctctatcgccctaatataccattaaaaattgttag

SEQ ID NO: 58205 - DNA, 24 bp, Vaccinia virus
tagtgtactacaaacaggcgatgg

SEQ ID NO: 58206 - DNA, 23 bp, Homo sapiens
tagtgcactatggatgcctttgg

SEQ ID NO: 58207 - DNA, 17 bp, Homo sapiens
gtgttacagggcgatgg

SEQ ID NO: 58208 - DNA, 18 bp, Homo sapiens
tagtatactataagcagg

SEQ ID NO: 58209 - DNA, 19 bp, Homo sapiens
tgcagacgaacaggcggtg

SEQ ID NO: 58210 - DNA, 21 bp, Homo sapiens
taatgtactacgagcgtaagg

SEQ ID NO: 58211 - DNA, 24 bp, Homo sapiens
tagtgtttgcaaacagccctctgg

SEQ ID NO: 58212 - DNA, 20 bp, Homo sapiens
gtgaactgcagagacaatgg

SEQ ID NO: 58213 - DNA, 131 bp, Macaca mulatta rhadinovirus
gttcttaaatagcagccagggccttaccgaccagttttcgtgtcctcttggcgcggctctgcctatatatgccacggaatctgtcagttggtgtaagccctgccatcgctgtgatatttttattgcgttgc

SEQ ID NO: 58214 - DNA, 24 bp, Macaca mulatta rhadinovirus
tctgtcagttggtgtaagccctgc

SEQ ID NO: 58215 - DNA, 22 bp, Homo sapiens
gtcagttgtaatgggagttctg

SEQ ID NO: 58216 - DNA, 19 bp, Homo sapiens
tctttcagtttgagccctg

SEQ ID NO: 58217 - DNA, 16 bp, Homo sapiens
tctgcagtaaagccct

SEQ ID NO: 58218 - DNA, 20 bp, Homo sapiens
tctgtcagctggcttccttg

SEQ ID NO: 58219 - DNA, 20 bp, Homo sapiens
tcttcagttttaaagccctg

SEQ ID NO: 58220 - DNA, 24 bp, Homo sapiens
ctgtcagttggcgggcagtcttgc

SEQ ID NO: 58221 - DNA, 21 bp, Homo sapiens
tgtcagttggtgtgtcaaagc

SEQ ID NO: 58222 - DNA, 19 bp, Homo sapiens
tggcagttggtttccttgc

SEQ ID NO: 58223 - DNA, 15 bp, Homo sapiens
tcagtcggagccctg

SEQ ID NO: 58224 - DNA, 24 bp, Homo sapiens
tgcagttggtgagatgggccctgc

SEQ ID NO: 58225 - DNA, 23 bp, Homo sapiens
tccgctgctggtgtgagtcttgc

SEQ ID NO: 58226 - DNA, 87 bp, Macaca mulatta rhadinovirus
tctgctattcgcctacctagggaaacctcgaaaaaaatcctaaatttaacgtttttggttgccctgagtgttgggcgaattgaaaga

SEQ ID NO: 58227 - DNA, 24 bp, Macaca mulatta rhadinovirus
gggaaacctcgaaaaaaatcctaa

SEQ ID NO: 58228 - DNA, 20 bp, Homo sapiens
gggagccccgaaaccgccta

SEQ ID NO: 58229 - DNA, 19 bp, Homo sapiens
gggcaaaaaaaaaaatcct

SEQ ID NO: 58230 - DNA, 20 bp, Homo sapiens
gggaatgagaaaaatcctaa

SEQ ID NO: 58231 - DNA, 24 bp, Homo sapiens
aggaagaagcaaagggaatcctaa

SEQ ID NO: 58232 - DNA, 21 bp, Homo sapiens
gggaatacttaaaaatcctaa

SEQ ID NO: 58233 - DNA, 21 bp, Homo sapiens
gggaaaaaaaaaaagtcctaa

SEQ ID NO: 58234 - DNA, 19 bp, Homo sapiens
gagaaaccttgggaaccct

SEQ ID NO: 58235 - DNA, 22 bp, Homo sapiens
gggaaacctatgaacatcctaa

SEQ ID NO: 58236 - DNA, 16 bp, Homo sapiens
aggaaacctaaattct

SEQ ID NO: 58237 - DNA, 77 bp, African swine fever virus
ggaatttttcttggttttcgggtgtgattttatattcatgtagaaagtgtttcacacctgaggagaagaatctttcc

SEQ ID NO: 58238 - DNA, 24 bp, African swine fever virus
tttttcttggttttcgggtgtgat

SEQ ID NO: 58239 - DNA, 23 bp, Homo sapiens
tttttcttggttttgttgctgat

SEQ ID NO: 58240 - DNA, 19 bp, Homo sapiens
tttttcttggtcttttggc

SEQ ID NO: 58241 - DNA, 22 bp, Homo sapiens
tttttctttgttttctagtgat

SEQ ID NO: 58242 - DNA, 22 bp, Homo sapiens
ttttgcttggttttgaagtgat

SEQ ID NO: 58243 - DNA, 19 bp, Homo sapiens
tttttctggtttttgaggt

SEQ ID NO: 58244 - DNA, 20 bp, Homo sapiens
tttttcttggttctttgtat

SEQ ID NO: 58245 - DNA, 25 bp, Homo sapiens
ctttttttggttttcattccttgat

SEQ ID NO: 58246 - DNA, 19 bp, Homo sapiens
tttttcttggtttctggat

SEQ ID NO: 58247 - DNA, 24 bp, Homo sapiens
ttttttttggctttgcagggtgat

SEQ ID NO: 58248 - DNA, 18 bp, Homo sapiens
tttttctggtttttggat

SEQ ID NO: 58249 - DNA, 21 bp, Homo sapiens
ttcttctttggactgggtgtg

SEQ ID NO: 58250 - DNA, 18 bp, Homo sapiens
ttttttttggttttgggc

SEQ ID NO: 58251 - DNA, 20 bp, Homo sapiens
tttttcttggctttttgtat

SEQ ID NO: 58252 - DNA, 19 bp, Homo sapiens
ttttttttggttttcaggt

SEQ ID NO: 58253 - DNA, 87 bp, Tupaia herpesvirus
tcgaattcaaacgtgcgacagtggctattggttcgggcgaccggaacccgttaggtcgttcatgtttctgtgcacatttgaattcga

SEQ ID NO: 58254 - DNA, 24 bp, Tupaia herpesvirus
ttcatgtttctgtgcacatttgaa

SEQ ID NO: 58255 - DNA, 16 bp, Homo sapiens
tgtttctgcaaatttg

SEQ ID NO: 58256 - DNA, 25 bp, Homo sapiens
ttcatgctttttgtgttatggtgaa

SEQ ID NO: 58257 - DNA, 19 bp, Homo sapiens
atgtttcaaggcatttgaa

SEQ ID NO: 58258 - DNA, 23 bp, Homo sapiens
cgtttctgtgtcagcattttgaa

SEQ ID NO: 58259 - DNA, 20 bp, Homo sapiens
atgtttctgtggaaattttg

SEQ ID NO: 58260 - DNA, 22 bp, Homo sapiens
ttcatgttttgtttctgtttga

SEQ ID NO: 58261 - DNA, 19 bp, Homo sapiens
ttcctgtttctgtgtaaca

SEQ ID NO: 58262 - DNA, 23 bp, Homo sapiens
ttctgagggcctgtgcatttgaa

SEQ ID NO: 58263 - DNA, 23 bp, Homo sapiens
ttcatgttttatgtatgtttgaa

SEQ ID NO: 58264 - DNA, 18 bp, Homo sapiens
tgttcactagcacatttg

SEQ ID NO: 58265 - DNA, 19 bp, Homo sapiens
atatttctaaacatttgaa

SEQ ID NO: 58266 - DNA, 20 bp, Homo sapiens
ttcattttctgtggctcttg

SEQ ID NO: 58267 - DNA, 20 bp, Homo sapiens
ttcatatttctgtcattttg

SEQ ID NO: 58268 - DNA, 21 bp, Homo sapiens
ttcctgtttcctgcttgtttg

SEQ ID NO: 58269 - DNA, 16 bp, Homo sapiens
tattttgcacatttga

SEQ ID NO: 58270 - DNA, 68 bp, Horseradish curly top virus
acgcgcatgttgaagtcgaggtgtccacacaagtagttgtgtgtacctaacgctcttgcccagcacgt

SEQ ID NO: 58271 - DNA, 24 bp, Horseradish curly top virus
ttgaagtcgaggtgtccacacaag

SEQ ID NO: 58272 - DNA, 18 bp, Homo sapiens
ttgaagccgggaggcaca

SEQ ID NO: 58273 - DNA, 17 bp, Homo sapiens
ttggagcgaagcgtgca

SEQ ID NO: 58274 - DNA, 19 bp, Homo sapiens
ttggagtcaaggtgtccca

SEQ ID NO: 58275 - DNA, 18 bp, Homo sapiens
ttgaggttgaggtgccac

SEQ ID NO: 58276 - DNA, 21 bp, Homo sapiens
ttaaagtcaaaacttcacaca

SEQ ID NO: 58277 - DNA, 23 bp, Homo sapiens
ttgtagtcaacagttcacacaag

SEQ ID NO: 58278 - DNA, 62 bp, Horseradish curly top virus
atcggcccactcttgcatttcttcggggacgtttgtgaaggaggagagaggatacggcggat

SEQ ID NO: 58279 - DNA, 24 bp, Horseradish curly top virus
tgaaggaggagagaggatacggcg

SEQ ID NO: 58280 - DNA, 18 bp, Homo sapiens
ggaggagagaggggcagc

SEQ ID NO: 58281 - DNA, 19 bp, Homo sapiens
tgaagaggagaggggctgc

SEQ ID NO: 58282 - DNA, 16 bp, Homo sapiens
ggaggagaagggaggc

SEQ ID NO: 58283 - DNA, 21 bp, Homo sapiens
aggaggaggagggggtcacgg

SEQ ID NO: 58284 - DNA, 21 bp, Homo sapiens
tgaaggaagaggggggaaacg

SEQ ID NO: 58285 - DNA, 19 bp, Homo sapiens
aggaggaggaggggcgggc

SEQ ID NO: 58286 - DNA, 19 bp, Homo sapiens
gagggaggagagggatgcg

SEQ ID NO: 58287 - DNA, 19 bp, Homo sapiens
gaaggaggagggagttagg

SEQ ID NO: 58288 - DNA, 17 bp, Homo sapiens
tgaaggagggaggggat

SEQ ID NO: 58289 - DNA, 18 bp, Homo sapiens
tgaaggagcagagagggc

SEQ ID NO: 58290 - DNA, 18 bp, Homo sapiens
aggaggaggaggaggtgg

SEQ ID NO: 58291 - DNA, 19 bp, Homo sapiens
tgaggagaggagggaggat

SEQ ID NO: 58292 - DNA, 22 bp, Homo sapiens
tggaggaggaggaggagaagcg

SEQ ID NO: 58293 - DNA, 18 bp, Homo sapiens
aggaggaggggaggaggc

SEQ ID NO: 58294 - DNA, 17 bp, Homo sapiens
ggaggggaggggatcag

SEQ ID NO: 58295 - DNA, 21 bp, Homo sapiens
gaaggaggggggaggatggcg

SEQ ID NO: 58296 - DNA, 18 bp, Homo sapiens
tgaggaggaggaggcggc

SEQ ID NO: 58297 - DNA, 19 bp, Homo sapiens
aggaggaggaggcggcggc

SEQ ID NO: 58298 - DNA, 19 bp, Homo sapiens
tgaaggagggggtgaggga

SEQ ID NO: 58299 - DNA, 17 bp, Homo sapiens
tggaggaggaggaggat

SEQ ID NO: 58300 - DNA, 18 bp, Homo sapiens
aggagggggagagggggc

SEQ ID NO: 58301 - DNA, 18 bp, Homo sapiens
tggaggaggagaggagat

SEQ ID NO: 58302 - DNA, 19 bp, Homo sapiens
gagggaggagagagggcac

SEQ ID NO: 58303 - DNA, 19 bp, Homo sapiens
aggaggaggaggaggcggc

SEQ ID NO: 58304 - DNA, 19 bp, Homo sapiens
ggaggagagaggaaaacag

SEQ ID NO: 58305 - DNA, 18 bp, Homo sapiens
tgaaggaggaggcggggc

SEQ ID NO: 58306 - DNA, 18 bp, Homo sapiens
tgaaggagggggagagga

SEQ ID NO: 58307 - DNA, 20 bp, Homo sapiens
gggggaggagaggtcgggcg

SEQ ID NO: 58308 - DNA, 18 bp, Homo sapiens
tgaaggaggagtggggac

SEQ ID NO: 58309 - DNA, 18 bp, Homo sapiens
aggaggaggagggagagc

SEQ ID NO: 58310 - DNA, 19 bp, Homo sapiens
tgaaggaagagacagacgg

SEQ ID NO: 58311 - DNA, 18 bp, Homo sapiens
tgaagaggagagagatgg

SEQ ID NO: 58312 - DNA, 22 bp, Homo sapiens
ggaggaggagaggcgctctgcg

SEQ ID NO: 58313 - DNA, 21 bp, Homo sapiens
gagggaggggaggccacggcg

SEQ ID NO: 58314 - DNA, 17 bp, Homo sapiens
tggaggaggagagggat

SEQ ID NO: 58315 - DNA, 18 bp, Homo sapiens
tgaagggagagagaggac

SEQ ID NO: 58316 - DNA, 20 bp, Homo sapiens
aaggaggagaggggagccaa

SEQ ID NO: 58317 - DNA, 17 bp, Homo sapiens
aggaggagagagtcggc

SEQ ID NO: 58318 - DNA, 17 bp, Homo sapiens
ggaggaggaggagggac

SEQ ID NO: 58319 - DNA, 16 bp, Homo sapiens
aggaggaggaggaggc

SEQ ID NO: 58320 - DNA, 19 bp, Homo sapiens
aggaggaggaggcggtggc

SEQ ID NO: 58321 - DNA, 21 bp, Homo sapiens
aggaggaggaggaaggcggcg

SEQ ID NO: 58322 - DNA, 19 bp, Homo sapiens
tgaaggaggtgagggtggc

SEQ ID NO: 58323 - DNA, 16 bp, Homo sapiens
ggaggaggaggaggac

SEQ ID NO: 58324 - DNA, 21 bp, Homo sapiens
tgaagaggggagaggatacaa

SEQ ID NO: 58325 - DNA, 19 bp, Homo sapiens
tgaagaggagagggggtgc

SEQ ID NO: 58326 - DNA, 18 bp, Homo sapiens
aagggggagagggtgcag

SEQ ID NO: 58327 - DNA, 16 bp, Homo sapiens
aggaggagagagaggc

SEQ ID NO: 58328 - DNA, 18 bp, Homo sapiens
ggaggaggaggaggcggc

SEQ ID NO: 58329 - DNA, 18 bp, Homo sapiens
tgagggggaagagaggat

SEQ ID NO: 58330 - DNA, 18 bp, Homo sapiens
tgaaggaggaagggagga

SEQ ID NO: 58331 - DNA, 18 bp, Homo sapiens
tgggggaggggagaagat

SEQ ID NO: 58332 - DNA, 18 bp, Homo sapiens
tgagggaggagaggcccg

SEQ ID NO: 58333 - DNA, 22 bp, Homo sapiens
ggaggaggaggaagagaaggcg

SEQ ID NO: 58334 - DNA, 21 bp, Homo sapiens
tgaggcaggagagagcaagcg

SEQ ID NO: 58335 - DNA, 15 bp, Homo sapiens
ggaggaggaggacgc

SEQ ID NO: 58336 - DNA, 18 bp, Homo sapiens
tgaggaggaggggggaca

SEQ ID NO: 58337 - DNA, 15 bp, Homo sapiens
ggaggaggaggcagc

SEQ ID NO: 58338 - DNA, 18 bp, Homo sapiens
aggaggaaaggatgcggc

SEQ ID NO: 58339 - DNA, 22 bp, Homo sapiens
tgagggggcagaggggacacag

SEQ ID NO: 58340 - DNA, 19 bp, Homo sapiens
ggaggaggagaggagacag

SEQ ID NO: 58341 - DNA, 21 bp, Homo sapiens
aggaggaggaggggggcagcg

SEQ ID NO: 58342 - DNA, 20 bp, Homo sapiens
tggaggagggagaggatcag

SEQ ID NO: 58343 - DNA, 17 bp, Homo sapiens
ggaggaggaagaggggc

SEQ ID NO: 58344 - DNA, 22 bp, Homo sapiens
gaaggaggagaggaaccattgg

SEQ ID NO: 58345 - DNA, 20 bp, Homo sapiens
ggaggaggagggacacggcg

SEQ ID NO: 58346 - DNA, 19 bp, Homo sapiens
tgggggaggagagaggata

SEQ ID NO: 58347 - DNA, 21 bp, Homo sapiens
aggaggaggagaggcagttgg

SEQ ID NO: 58348 - DNA, 17 bp, Homo sapiens
gaagggggggaggggca

SEQ ID NO: 58349 - DNA, 17 bp, Homo sapiens
ggaggaggagaggtggc

SEQ ID NO: 58350 - DNA, 23 bp, Homo sapiens
ggaggaggaggcgagccgcagcg

SEQ ID NO: 58351 - DNA, 93 bp, Horseradish curly top virus
gttcccttctatgataatggatttggccttatggctgtcggcaacaggcctgccaaagtaatcatcggcccactcttgcatttcttcggggac

SEQ ID NO: 58352 - DNA, 24 bp, Horseradish curly top virus
tatgataatggatttggccttatg

SEQ ID NO: 58353 - DNA, 20 bp, Homo sapiens
tgatacatgttggccttatg

SEQ ID NO: 58354 - DNA, 16 bp, Homo sapiens
tgattaacctggcctt

SEQ ID NO: 58355 - DNA, 19 bp, Homo sapiens
tgatagtgcctgccttatg

SEQ ID NO: 58356 - DNA, 22 bp, Homo sapiens
tgataatggcattaaggttatg

SEQ ID NO: 58357 - DNA, 17 bp, Homo sapiens
atgattgatttggcctt

SEQ ID NO: 58358 - DNA, 18 bp, Homo sapiens
tatgataaggaaacttat

SEQ ID NO: 58359 - DNA, 130 bp, Equine herpesvirus 4
ggataaataatcgtattattgtaatagggaaatttaggggaggggtttcaatggtgggcagagctaaacttaacaccaatggaaagcttgcctaatcgctcacattaatttagattttcgacttgtgtcc

SEQ ID NO: 58360 - DNA, 24 bp, Equine herpesvirus 4
aatcgtattattgtaatagggaaa

SEQ ID NO: 58361 - DNA, 20 bp, Homo sapiens
gtatccacagaatagggaaa

SEQ ID NO: 58362 - DNA, 17 bp, Homo sapiens
tcgtactatgcacaggg

SEQ ID NO: 58363 - DNA, 18 bp, Homo sapiens
gtattattgtcatagaga

SEQ ID NO: 58364 - DNA, 22 bp, Homo sapiens
gtctattgaacaaatagggaaa

SEQ ID NO: 58365 - DNA, 16 bp, Homo sapiens
tcatattactagggaa

SEQ ID NO: 58366 - DNA, 19 bp, Homo sapiens
cgtattagatttagggaaa

SEQ ID NO: 58367 - DNA, 19 bp, Homo sapiens
gtatgattgtgatagggaa

SEQ ID NO: 58368 - DNA, 76 bp, Rat cytomegalovirus
acgcgacaacttcgagaacctcggggtctccgcggccgacctggccgagatagaccgcgactcggaggtcgtccgt

SEQ ID NO: 58369 - DNA, 24 bp, Rat cytomegalovirus
cgagatagaccgcgactcggaggt

SEQ ID NO: 58370 - DNA, 20 bp, Homo sapiens
agatggatcttctcggaggt

SEQ ID NO: 58371 - DNA, 17 bp, Homo sapiens
cgagagcggttcggagg

SEQ ID NO: 58372 - DNA, 21 bp, Homo sapiens
gagatagacctggtgtggggt

SEQ ID NO: 58373 - DNA, 93 bp, Rat cytomegalovirus
gcgcaccgccgccgagatcgagtgtcagaagtccaagcgcgtcgtggaggccctggacgtcgtcatcctgaagctcgtcgtcggcgagttcgc

SEQ ID NO: 58374 - DNA, 24 bp, Rat cytomegalovirus
tcagaagtccaagcgcgtcgtgga

SEQ ID NO: 58375 - DNA, 20 bp, Homo sapiens
agaagtccagttaccttgga

SEQ ID NO: 58376 - DNA, 21 bp, Homo sapiens
tcagacaccagtgcgtcgtgg

SEQ ID NO: 58377 - DNA, 24 bp, Homo sapiens
tcagaagttcaagtcaactatgga

SEQ ID NO: 58378 - DNA, 19 bp, Homo sapiens
caggggtccaggcgcgccg

SEQ ID NO: 58379 - DNA, 21 bp, Homo sapiens
ccagaagttcaactacgtgga

SEQ ID NO: 58380 - DNA, 18 bp, Homo sapiens
ccagaagtctgggcatgg

SEQ ID NO: 58381 - DNA, 16 bp, Homo sapiens
gaagtctgcgccatgg

SEQ ID NO: 58382 - DNA, 19 bp, Homo sapiens
tcagaagttccggaggtgg

SEQ ID NO: 58383 - DNA, 17 bp, Homo sapiens
gaagggcgcgtcgtgga

SEQ ID NO: 58384 - DNA, 21 bp, Homo sapiens
tcagaaatccgagtgtagtgg

SEQ ID NO: 58385 - DNA, 19 bp, Homo sapiens
caaaccaagcgcgttgtgg

SEQ ID NO: 58386 - DNA, 19 bp, Homo sapiens
gaagtccaggcgctctcgg

SEQ ID NO: 58387 - DNA, 22 bp, Homo sapiens
tcgggagtcctaaggcgggtgg

SEQ ID NO: 58388 - DNA, 27 bp, Homo sapiens
tcagaagctcaggtgtgtgcaagtgga

SEQ ID NO: 58389 - DNA, 21 bp, Homo sapiens
tcggaggtcaggaaccgtgga

SEQ ID NO: 58390 - DNA, 20 bp, Homo sapiens
tcagaagtgtagcagtgtgg

SEQ ID NO: 58391 - DNA, 16 bp, Homo sapiens
tcagaagcccaaggtg

SEQ ID NO: 58392 - DNA, 20 bp, Homo sapiens
tcagaaattcaagattgtgg

SEQ ID NO: 58393 - DNA, 17 bp, Homo sapiens
tcagaagtccaagagtg

SEQ ID NO: 58394 - DNA, 19 bp, Homo sapiens
tcagaagtccaggcttgtc

SEQ ID NO: 58395 - DNA, 85 bp, Paramecium bursaria Chlorella virus 1
caagatgaatcggtgaagtctccatagagtgccttatttgtacagcaagtttctaaattacttgggttttcatcacaacgtcttg

SEQ ID NO: 58396 - DNA, 24 bp, Paramecium bursaria Chlorella virus 1
gtgaagtctccatagagtgcctta

SEQ ID NO: 58397 - DNA, 21 bp, Homo sapiens
gtgaggttccctcgtgcctta

SEQ ID NO: 58398 - DNA, 17 bp, Homo sapiens
gtgaaatcctgagagtg

SEQ ID NO: 58399 - DNA, 18 bp, Homo sapiens
tggggtctccatagaatg

SEQ ID NO: 58400 - DNA, 18 bp, Homo sapiens
gtgaagcctttgtggctt

SEQ ID NO: 58401 - DNA, 23 bp, Homo sapiens
gtaaagtcttcataaaagacctt

SEQ ID NO: 58402 - DNA, 19 bp, Homo sapiens
gtggtgtctccattgaggc

SEQ ID NO: 58403 - DNA, 22 bp, Homo sapiens
gtgaagtcttcaaggagacccc

SEQ ID NO: 58404 - DNA, 19 bp, Homo sapiens
atgaagtcttcataggatg

SEQ ID NO: 58405 - DNA, 25 bp, Homo sapiens
gtgaagtctttccccatctgcttta

SEQ ID NO: 58406 - DNA, 18 bp, Homo sapiens
tgaagtctttatggagta

SEQ ID NO: 58407 - DNA, 20 bp, Homo sapiens
cgatctctatagagtgcctt

SEQ ID NO: 58408 - DNA, 17 bp, Homo sapiens
gtgaagcctccatggtg

SEQ ID NO: 58409 - DNA, 18 bp, Homo sapiens
gtgaagccttcatagagc

SEQ ID NO: 58410 - DNA, 18 bp, Homo sapiens
gtgagtctccacatggtg

SEQ ID NO: 58411 - DNA, 23 bp, Homo sapiens
tgaagtctttatcgagtgcctta

SEQ ID NO: 58412 - DNA, 18 bp, Homo sapiens
gtgggatcttcataaagt

SEQ ID NO: 58413 - DNA, 19 bp, Homo sapiens
gtgaagtctccagggagca

SEQ ID NO: 58414 - DNA, 130 bp, Paramecium bursaria Chlorella virus 1
cgggttctggtgcgggtttcggtgcgggttctggcgcgggttctggcgcgggttctggcgcgggtttcggtgcgggtttcggtgcgggtttcggtgcgggtttcggtgcgggtttcggtgcgggtttcgg

SEQ ID NO: 58415 - DNA, 24 bp, Paramecium bursaria Chlorella virus 1
gtttcggtgcgggtttcggtgcgg

SEQ ID NO: 58416 - DNA, 18 bp, Homo sapiens
gcttcggtgtctggtgcg

SEQ ID NO: 58417 - DNA, 25 bp, Homo sapiens
gctttggtgcgggtgggctgtgcgg

SEQ ID NO: 58418 - DNA, 19 bp, Homo sapiens
cagatgggttttggtgtgg

SEQ ID NO: 58419 - DNA, 116 bp, Bovine herpesvirus 1
ggggcgggagggggaagggggagccggagctttggcccgctcgctcggccggcccgaatcctcggccggcccgaatcccctccttcccctccctcccctccttcccctccctcccc

SEQ ID NO: 58420 - DNA, 24 bp, Bovine herpesvirus 1
agggggagccggagctttggcccg

SEQ ID NO: 58421 - DNA, 19 bp, Homo sapiens
aaggggcttcggctttggc

SEQ ID NO: 58422 - DNA, 24 bp, Homo sapiens
gggggagccgggggagggggtccg

SEQ ID NO: 58423 - DNA, 19 bp, Homo sapiens
aggggaagctggcctggcc

SEQ ID NO: 58424 - DNA, 21 bp, Homo sapiens
gagggagctaaggtttttggc

SEQ ID NO: 58425 - DNA, 15 bp, Homo sapiens
aggggaggccttggc

SEQ ID NO: 58426 - DNA, 21 bp, Homo sapiens
agggggagttggggtctcccg

SEQ ID NO: 58427 - DNA, 22 bp, Homo sapiens
agggggagtcgggggcagaacc

SEQ ID NO: 58428 - DNA, 26 bp, Homo sapiens
ggcgggagccgggggccgcgggctcg

SEQ ID NO: 58429 - DNA, 21 bp, Homo sapiens
agggggagccgcggaggggcc

SEQ ID NO: 58430 - DNA, 18 bp, Homo sapiens
aggggaagttggagtctg

SEQ ID NO: 58431 - DNA, 21 bp, Homo sapiens
gggggagcggggccgctcccg

SEQ ID NO: 58432 - DNA, 20 bp, Homo sapiens
gagggagctggggctggggc

SEQ ID NO: 58433 - DNA, 19 bp, Homo sapiens
aggcggagccggggctccg

SEQ ID NO: 58434 - DNA, 22 bp, Homo sapiens
ggggagccggggcaggggctcg

SEQ ID NO: 58435 - DNA, 21 bp, Homo sapiens
ggtgggagccggaatggggcc

SEQ ID NO: 58436 - DNA, 17 bp, Homo sapiens
aggggaagctggaggcc

SEQ ID NO: 58437 - DNA, 17 bp, Homo sapiens
aggggggccggggaccc

SEQ ID NO: 58438 - DNA, 17 bp, Homo sapiens
ggaggagccgggcaggg

SEQ ID NO: 58439 - DNA, 20 bp, Homo sapiens
ggaggggccggggcactctg

SEQ ID NO: 58440 - DNA, 23 bp, Homo sapiens
ggcggggctggccccctggcccg

SEQ ID NO: 58441 - DNA, 24 bp, Homo sapiens
aggggaagtcggagagaaagctcg

SEQ ID NO: 58442 - DNA, 21 bp, Homo sapiens
agggggagtggggaggcggcc

SEQ ID NO: 58443 - DNA, 19 bp, Homo sapiens
aggggaagccggggctccg

SEQ ID NO: 58444 - DNA, 18 bp, Homo sapiens
ggaggagccggggctgcg

SEQ ID NO: 58445 - DNA, 19 bp, Homo sapiens
agagggagctggggcattg

SEQ ID NO: 58446 - DNA, 15 bp, Homo sapiens
aggggagccggggcc

SEQ ID NO: 58447 - DNA, 21 bp, Homo sapiens
gggcggagccgggcgcgcccg

SEQ ID NO: 58448 - DNA, 18 bp, Homo sapiens
agagaaagggggctttgg

SEQ ID NO: 58449 - DNA, 19 bp, Homo sapiens
agggggagctggagttagg

SEQ ID NO: 58450 - DNA, 20 bp, Homo sapiens
agggggagccgggggtcgct

SEQ ID NO: 58451 - DNA, 18 bp, Homo sapiens
gggcgggccggggcgtcg

SEQ ID NO: 58452 - DNA, 19 bp, Homo sapiens
aggaggagccggagcgctg

SEQ ID NO: 58453 - DNA, 21 bp, Homo sapiens
gggggagcggggaggcgcccg

SEQ ID NO: 58454 - DNA, 18 bp, Homo sapiens
gggggagttgagcattgg

SEQ ID NO: 58455 - DNA, 18 bp, Homo sapiens
gggggccggagccgggcc

SEQ ID NO: 58456 - DNA, 23 bp, Homo sapiens
aggagaaggtgggctttggctcg

SEQ ID NO: 58457 - DNA, 20 bp, Homo sapiens
agggggaggttggggaaggc

SEQ ID NO: 58458 - DNA, 21 bp, Homo sapiens
aaggggagctggggtctctag

SEQ ID NO: 58459 - DNA, 16 bp, Homo sapiens
aaggatggagctttgg

SEQ ID NO: 58460 - DNA, 19 bp, Homo sapiens
agggggggcggagcttaga

SEQ ID NO: 58461 - DNA, 22 bp, Homo sapiens
agggaggagccggaaccgcccg

SEQ ID NO: 58462 - DNA, 19 bp, Homo sapiens
aggaggagttggagccctg

SEQ ID NO: 58463 - DNA, 21 bp, Homo sapiens
agggggaggtggagttgtacc

SEQ ID NO: 58464 - DNA, 21 bp, Homo sapiens
agggggagccgtggctgaggc

SEQ ID NO: 58465 - DNA, 19 bp, Homo sapiens
gggggaactggggctccca

SEQ ID NO: 58466 - DNA, 20 bp, Homo sapiens
agggtggggcccactttggc

SEQ ID NO: 58467 - DNA, 19 bp, Homo sapiens
aggaggagccggggccgcc

SEQ ID NO: 58468 - DNA, 18 bp, Homo sapiens
gggggagcgggggggccc

SEQ ID NO: 58469 - DNA, 18 bp, Homo sapiens
aggggagctggcaggccc

SEQ ID NO: 58470 - DNA, 15 bp, Homo sapiens
gagggagccggggcc

SEQ ID NO: 58471 - DNA, 17 bp, Homo sapiens
agggggaaccaccttgg

SEQ ID NO: 58472 - DNA, 21 bp, Homo sapiens
gggcggagccggggcctctcc

SEQ ID NO: 58473 - DNA, 20 bp, Homo sapiens
gggggagcggggcggtgccc

SEQ ID NO: 58474 - DNA, 21 bp, Homo sapiens
gggggagctgggggatccctg

SEQ ID NO: 58475 - DNA, 25 bp, Homo sapiens
gggggagccggaccgccaaagcccg

SEQ ID NO: 58476 - DNA, 18 bp, Homo sapiens
aggggcagccctttggcc

SEQ ID NO: 58477 - DNA, 17 bp, Homo sapiens
agggggagtgaccttgg

SEQ ID NO: 58478 - DNA, 19 bp, Homo sapiens
agggggagctgggccaccc

SEQ ID NO: 58479 - DNA, 20 bp, Homo sapiens
gggggcgccggagccgtgcc

SEQ ID NO: 58480 - DNA, 20 bp, Homo sapiens
agggggagctggagggtctg

SEQ ID NO: 58481 - DNA, 17 bp, Homo sapiens
gggggagctggacagcc

SEQ ID NO: 58482 - DNA, 17 bp, Homo sapiens
gggggagccgggcactg

SEQ ID NO: 58483 - DNA, 17 bp, Homo sapiens
gggggagctgggcactg

SEQ ID NO: 58484 - DNA, 18 bp, Homo sapiens
aggggagccgggccgccc

SEQ ID NO: 58485 - DNA, 18 bp, Homo sapiens
aggaggggctggatgcct

SEQ ID NO: 58486 - DNA, 20 bp, Homo sapiens
agggggagccgtggctgggc

SEQ ID NO: 58487 - DNA, 19 bp, Homo sapiens
agggggcgccggagaaccc

SEQ ID NO: 58488 - DNA, 22 bp, Homo sapiens
agggggagcaggagctgcctcg

SEQ ID NO: 58489 - DNA, 24 bp, Homo sapiens
gggggagggttgggggcagctggc

SEQ ID NO: 58490 - DNA, 19 bp, Homo sapiens
agggtggagttgggagcct

SEQ ID NO: 58491 - DNA, 120 bp, Vaccinia virus
gatttggccaaatgtatccatcataatctgggttataaacgggtgtaaacaagaatatatgtttatattttttaactagtgtagaaaacagagatagtaaatagatagtttttccagatc

SEQ ID NO: 58492 - DNA, 24 bp, Vaccinia virus
taactagtgtagaaaacagagata

SEQ ID NO: 58493 - DNA, 18 bp, Homo sapiens
tgaatggggaaaacagag

SEQ ID NO: 58494 - DNA, 18 bp, Homo sapiens
actagtgtgaaacaagat

SEQ ID NO: 58495 - DNA, 20 bp, Homo sapiens
tgtaaaaggaaacagagata

SEQ ID NO: 58496 - DNA, 21 bp, Homo sapiens
actaaatctagaaacagagat

SEQ ID NO: 58497 - DNA, 18 bp, Homo sapiens
gctggtaaagacagagat

SEQ ID NO: 58498 - DNA, 16 bp, Homo sapiens
actgtgaagcagagat

SEQ ID NO: 58499 - DNA, 18 bp, Homo sapiens
taactaatgtagaaagca

SEQ ID NO: 58500 - DNA, 17 bp, Homo sapiens
taactatgtagaaagac

SEQ ID NO: 58501 - DNA, 19 bp, Homo sapiens
taatcaagaggacagagat

SEQ ID NO: 58502 - DNA, 19 bp, Homo sapiens
ctagggtagaaaaaacaga

SEQ ID NO: 58503 - DNA, 18 bp, Homo sapiens
tagtgtaacccagggata

SEQ ID NO: 58504 - DNA, 17 bp, Homo sapiens
taaatagtgtaggcaga

SEQ ID NO: 58505 - DNA, 20 bp, Homo sapiens
ctagttttgtagacagagat

SEQ ID NO: 58506 - DNA, 20 bp, Homo sapiens
atgcctggaaggcagagata

SEQ ID NO: 58507 - DNA, 18 bp, Homo sapiens
taagtagtgtacagagat

SEQ ID NO: 58508 - DNA, 18 bp, Homo sapiens
taaatgtagaatagagat

SEQ ID NO: 58509 - DNA, 23 bp, Homo sapiens
acctgtctcccaaaacagagata

SEQ ID NO: 58510 - DNA, 22 bp, Homo sapiens
taattagtataacttagagata

SEQ ID NO: 58511 - DNA, 17 bp, Homo sapiens
ctagtgtaaattgagat

SEQ ID NO: 58512 - DNA, 15 bp, Homo sapiens
ctaggtgacagagat

SEQ ID NO: 58513 - DNA, 20 bp, Homo sapiens
tagtccccgaaaacagggat

SEQ ID NO: 58514 - DNA, 22 bp, Homo sapiens
actggggatggggaacagagat

SEQ ID NO: 58515 - DNA, 20 bp, Homo sapiens
tagtgtgcgcaacagggata

SEQ ID NO: 58516 - DNA, 19 bp, Homo sapiens
gtgcttagagaacagagat

SEQ ID NO: 58517 - DNA, 17 bp, Homo sapiens
atgccaaaacagagata

SEQ ID NO: 58518 - DNA, 21 bp, Homo sapiens
actggtaccaaaacagagata

SEQ ID NO: 58519 - DNA, 78 bp, Turkey adenovirus 3
ttatgtaaacaagtttataagttgtgaagaagatagtaaattttcctttttttaatttataggcgagcccatacatga

SEQ ID NO: 58520 - DNA, 24 bp, Turkey adenovirus 3
taagttgtgaagaagatagtaaat

SEQ ID NO: 58521 - DNA, 19 bp, Homo sapiens
taagttgctgaagggagat

SEQ ID NO: 58522 - DNA, 23 bp, Homo sapiens
taagctgtggagttcaagtaaat

SEQ ID NO: 58523 - DNA, 20 bp, Homo sapiens
taagctgtggagaggaagca

SEQ ID NO: 58524 - DNA, 24 bp, Homo sapiens
agttgtgaagattttcaggtaaat

SEQ ID NO: 58525 - DNA, 20 bp, Homo sapiens
taagttgtggtgaggagagt

SEQ ID NO: 58526 - DNA, 19 bp, Homo sapiens
ttgtgaagaagtttctagt

SEQ ID NO: 58527 - DNA, 19 bp, Homo sapiens
taagtttgaagaagctagt

SEQ ID NO: 58528 - DNA, 19 bp, Homo sapiens
agtttgtgaagaatgaagt

SEQ ID NO: 58529 - DNA, 23 bp, Homo sapiens
taagttgcgagggagtaggaaat

SEQ ID NO: 58530 - DNA, 130 bp, Human adenovirus B
agaccctgagtggtatactgtctctgtccgtggtcctgacggttccatccgcactgctaataacacttttatttttgctgagatgtgcgatctgaccatgttcatgagcaaacagtataacctatggcct

SEQ ID NO: 58531 - DNA, 24 bp, Human adenovirus B
tgagatgtgcgatctgaccatgtt

SEQ ID NO: 58532 - DNA, 25 bp, Homo sapiens
agatgtgcgatctgtccctcatgtt

SEQ ID NO: 58533 - DNA, 23 bp, Homo sapiens
tgagatgtgttgtccttcatgtt

SEQ ID NO: 58534 - DNA, 60 bp, Amsacta moorei entomopoxvirus
aatatagtacctaaaggatattattctcaaatacaagaacaagttcctgataattatatt

SEQ ID NO: 58535 - DNA, 24 bp, Amsacta moorei entomopoxvirus
tatagtacctaaaggatattattc

SEQ ID NO: 58536 - DNA, 18 bp, Homo sapiens
tagtacttaaaaaatatt

SEQ ID NO: 58537 - DNA, 20 bp, Homo sapiens
tatagcacctgagatttatt

SEQ ID NO: 58538 - DNA, 20 bp, Homo sapiens
aatactgggggatattattc

SEQ ID NO: 58539 - DNA, 23 bp, Homo sapiens
tagtaccttcccagatattgttc

SEQ ID NO: 58540 - DNA, 92 bp, Amsacta moorei entomopoxvirus
gtaattatatataatataatctatataataatatttatttattgttaaatacaataacatattttatatataatatattatttatatattat

SEQ ID NO: 58541 - DNA, 24 bp, Amsacta moorei entomopoxvirus
tataatataatctatataataata

SEQ ID NO: 58542 - DNA, 21 bp, Homo sapiens
tataatctaatctatacaaca

SEQ ID NO: 58543 - DNA, 17 bp, Homo sapiens
taacataatctaataat

SEQ ID NO: 58544 - DNA, 24 bp, Homo sapiens
tataatatatatttccatataata

SEQ ID NO: 58545 - DNA, 18 bp, Homo sapiens
tacaaactatataataat

SEQ ID NO: 58546 - DNA, 22 bp, Homo sapiens
taatataacccactatataata

SEQ ID NO: 58547 - DNA, 21 bp, Homo sapiens
aatataattaatacaataata

SEQ ID NO: 58548 - DNA, 69 bp, Melanoplus sanguinipes entomopoxvirus
tttatacatcacatcatttttgtcatttaaatcttttaatcctaaaaaatgtccaatttgatgtgtaaa

SEQ ID NO: 58549 - DNA, 24 bp, Melanoplus sanguinipes entomopoxvirus
tacatcacatcatttttgtcattt

SEQ ID NO: 58550 - DNA, 24 bp, Homo sapiens
tacattttcaacactttgtcattt

SEQ ID NO: 58551 - DNA, 18 bp, Homo sapiens
actcatatcctgtcattt

SEQ ID NO: 58552 - DNA, 18 bp, Homo sapiens
catcagtcatttttgtca

SEQ ID NO: 58553 - DNA, 17 bp, Homo sapiens
catcacacatttttaca

SEQ ID NO: 58554 - DNA, 18 bp, Homo sapiens
tacatccatcatgaatgt

SEQ ID NO: 58555 - DNA, 19 bp, Homo sapiens
tacatcacaatgtgacatt

SEQ ID NO: 58556 - DNA, 22 bp, Homo sapiens
tacatcacattatctgacactt

SEQ ID NO: 58557 - DNA, 16 bp, Homo sapiens
acatcgtttgtcatct

SEQ ID NO: 58558 - DNA, 20 bp, Homo sapiens
tacattgcatcattttctgt

SEQ ID NO: 58559 - DNA, 24 bp, Homo sapiens
acatcacatatgtctttgtcattt

SEQ ID NO: 58560 - DNA, 20 bp, Homo sapiens
tacattacatcatctcattt

SEQ ID NO: 58561 - DNA, 19 bp, Homo sapiens
tacatcatctcatttttat

SEQ ID NO: 58562 - DNA, 18 bp, Homo sapiens
tacatcacattaatttgt

SEQ ID NO: 58563 - DNA, 19 bp, Homo sapiens
tacatcatatcatttatgt

SEQ ID NO: 58564 - DNA, 20 bp, Homo sapiens
tcagttcatttttgtcattt

SEQ ID NO: 58565 - DNA, 18 bp, Homo sapiens
acatcaccttgcttcatt

SEQ ID NO: 58566 - DNA, 21 bp, Homo sapiens
acatcattaaaactgtcattt

SEQ ID NO: 58567 - DNA, 20 bp, Homo sapiens
atctttcatttttgtcattt

SEQ ID NO: 58568 - DNA, 18 bp, Homo sapiens
taatcacatcatttttat

SEQ ID NO: 58569 - DNA, 68 bp, Ustilago maydis virus H1
cggtctttccgttatggaaggtttgcttacggtccacgtaggttctccgaccttgcgaggaaagattg

SEQ ID NO: 58570 - DNA, 24 bp, Ustilago maydis virus H1
tggaaggtttgcttacggtccacg

SEQ ID NO: 58571 - DNA, 20 bp, Homo sapiens
tggagggtttgctcagccca

SEQ ID NO: 58572 - DNA, 18 bp, Homo sapiens
ggaaccgtttacggtcca

SEQ ID NO: 58573 - DNA, 18 bp, Homo sapiens
tgggaggtttgctttgcc

SEQ ID NO: 58574 - DNA, 61 bp, Saimiriine herpesvirus 2
gattagatctaagttgctagtcatgcacgttttaagctctatgacatagcatattctagtt

SEQ ID NO: 58575 - DNA, 20 bp, Saimiriine herpesvirus 2
tgacatagcatattctagtt

SEQ ID NO: 58576 - DNA, 18 bp, Homo sapiens
gacatactaattctagtt

SEQ ID NO: 58577 - DNA, 19 bp, Homo sapiens
acaagtcattattctagtt

SEQ ID NO: 58578 - DNA, 21 bp, Homo sapiens
tggcataacatattcacagtt

SEQ ID NO: 58579 - DNA, 19 bp, Homo sapiens
tgacataacataggaagtt

SEQ ID NO: 58580 - DNA, 19 bp, Homo sapiens
tgcattacaaattctagtt

SEQ ID NO: 58581 - DNA, 17 bp, Homo sapiens
tgacacagcaaccagtt

SEQ ID NO: 58582 - DNA, 19 bp, Homo sapiens
gacatagcatgctaaagtt

SEQ ID NO: 58583 - DNA, 17 bp, Homo sapiens
tgacacagctcatagtt

SEQ ID NO: 58584 - DNA, 20 bp, Homo sapiens
tgatatagacccttctagtt

SEQ ID NO: 58585 - DNA, 17 bp, Homo sapiens
gacagcaagttctagtt

SEQ ID NO: 58586 - DNA, 17 bp, Homo sapiens
gactacatattctggtt

SEQ ID NO: 58587 - DNA, 17 bp, Homo sapiens
gacatagcactctggtt

SEQ ID NO: 58588 - DNA, 20 bp, Homo sapiens
tgacacagttgactctagtt

SEQ ID NO: 58589 - DNA, 18 bp, Homo sapiens
tgcacaggtattctagtt

SEQ ID NO: 58590 - DNA, 18 bp, Homo sapiens
tgcatagcccttctagtt

SEQ ID NO: 58591 - DNA, 21 bp, Homo sapiens
tgacacagcatgaaactggtt

SEQ ID NO: 58592 - DNA, 18 bp, Homo sapiens
gatgcaacaattctagtt

SEQ ID NO: 58593 - DNA, 18 bp, Homo sapiens
gatgaagctattctagtt

SEQ ID NO: 58594 - DNA, 19 bp, Homo sapiens
gatctagaatattctagtt

SEQ ID NO: 58595 - DNA, 17 bp, Homo sapiens
gacataacaatctggtt

SEQ ID NO: 58596 - DNA, 18 bp, Homo sapiens
tgatacggcactctagtt

SEQ ID NO: 58597 - DNA, 20 bp, Homo sapiens
taacatagtgacctctagtt

SEQ ID NO: 58598 - DNA, 17 bp, Homo sapiens
tgactgcatttctagtt

SEQ ID NO: 58599 - DNA, 20 bp, Homo sapiens
tgacaaggcatcttctagtt

SEQ ID NO: 58600 - DNA, 17 bp, Homo sapiens
tgacaacacatttagtt

SEQ ID NO: 58601 - DNA, 18 bp, Homo sapiens
tgactaaacactctagtt

SEQ ID NO: 58602 - DNA, 17 bp, Homo sapiens
acatagcatattaagtt

SEQ ID NO: 58603 - DNA, 19 bp, Homo sapiens
tgacatagattccttagtt

SEQ ID NO: 58604 - DNA, 64 bp, Ateline herpesvirus 3
tgacataagccttgggatctttgtgtctgtctaatgtcactgcttagatctaggctactggtca

SEQ ID NO: 58605 - DNA, 21 bp, Ateline herpesvirus 3
ttagatctaggctactggtca

SEQ ID NO: 58606 - DNA, 18 bp, Homo sapiens
tcagatctgaaatggtca

SEQ ID NO: 58607 - DNA, 19 bp, Homo sapiens
tcagatctggctggggtca

SEQ ID NO: 58608 - DNA, 17 bp, Homo sapiens
ttagatccagacaaggt

SEQ ID NO: 58609 - DNA, 21 bp, Homo sapiens
ttagatctatcagcatggtca

SEQ ID NO: 58610 - DNA, 18 bp, Homo sapiens
tcagatctaggctgcctg

SEQ ID NO: 58611 - DNA, 21 bp, Homo sapiens
ctagatcttcactttgctggt

SEQ ID NO: 58612 - DNA, 19 bp, Homo sapiens
tcagatctgggctcttcca

SEQ ID NO: 58613 - DNA, 17 bp, Homo sapiens
gatctctgcactggtca

SEQ ID NO: 58614 - DNA, 17 bp, Homo sapiens
tcagatcttcacctggt

SEQ ID NO: 58615 - DNA, 16 bp, Homo sapiens
ttaaattagactggtc

SEQ ID NO: 58616 - DNA, 20 bp, Homo sapiens
gataaataggctactggtca

SEQ ID NO: 58617 - DNA, 18 bp, Homo sapiens
ttaaatctagcaagtggt

SEQ ID NO: 58618 - DNA, 19 bp, Homo sapiens
ttagatctaggctaaaaat

SEQ ID NO: 58619 - DNA, 19 bp, Homo sapiens
ttaaatctgggcttttctg

SEQ ID NO: 58620 - DNA, 21 bp, Homo sapiens
ttagatccaggtctgaagtca

SEQ ID NO: 58621 - DNA, 89 bp, Human herpesvirus 5
cgtccgcctgtacgcggaccgatcaccagaaggcggacattgggctgtggttcatgtttctggtttttggactgtgttcgtggttggcg

SEQ ID NO: 58622 - DNA, 24 bp, Human herpesvirus 5
tttctggtttttggactgtgttcg

SEQ ID NO: 58623 - DNA, 19 bp, Homo sapiens
tggtttttggtcatgttcg

SEQ ID NO: 58624 - DNA, 24 bp, Homo sapiens
tttctggtttttgaggttagtccg

SEQ ID NO: 58625 - DNA, 61 bp, Human herpesvirus 5
gtattttattgggaatattggcggggataaacctgtttcggatgtttacccttaatcttac

SEQ ID NO: 58626 - DNA, 24 bp, Human herpesvirus 5
tgtttcggatgtttacccttaatc

SEQ ID NO: 58627 - DNA, 24 bp, Homo sapiens
tgtttcgggcgactttttcttaat

SEQ ID NO: 58628 - DNA, 19 bp, Homo sapiens
gtttggatgtttgtcccct

SEQ ID NO: 58629 - DNA, 17 bp, Homo sapiens
tattttggataccctta

SEQ ID NO: 58630 - DNA, 77 bp, Ground squirrel hepatitis virus
accgcggagcttatagccgcctgccttgctcgctgctggacaggagctcggttgttgggcactgataactccgtggt

SEQ ID NO: 58631 - DNA, 24 bp, Ground squirrel hepatitis virus
tagccgcctgccttgctcgctgct

SEQ ID NO: 58632 - DNA, 20 bp, Homo sapiens
gcctgcttgcgcgcgctgct

SEQ ID NO: 58633 - DNA, 22 bp, Homo sapiens
gccgccgcctcagctcgctgct

SEQ ID NO: 58634 - DNA, 23 bp, Homo sapiens
gctctctgccttggcaacatgct

SEQ ID NO: 58635 - DNA, 17 bp, Homo sapiens
cggctgctcgctcgctg

SEQ ID NO: 58636 - DNA, 17 bp, Homo sapiens
agctgcctgcctgctgc

SEQ ID NO: 58637 - DNA, 22 bp, Homo sapiens
tagcccctgcctccgacttgct

SEQ ID NO: 58638 - DNA, 17 bp, Homo sapiens
ccaggccgctcgctgct

SEQ ID NO: 58639 - DNA, 20 bp, Homo sapiens
gctgcctgcctctccgtgct

SEQ ID NO: 58640 - DNA, 16 bp, Homo sapiens
gctgcctgcctgcact

SEQ ID NO: 58641 - DNA, 22 bp, Homo sapiens
gccgccagctcatcccgctgct

SEQ ID NO: 58642 - DNA, 18 bp, Homo sapiens
gctgcctgccctgaagct

SEQ ID NO: 58643 - DNA, 22 bp, Homo sapiens
gccgcctggcagagccgctgct

SEQ ID NO: 58644 - DNA, 22 bp, Homo sapiens
gctgcttgcccacagggctgct

SEQ ID NO: 58645 - DNA, 19 bp, Homo sapiens
gccgctgctacacgctgct

SEQ ID NO: 58646 - DNA, 16 bp, Homo sapiens
gctgcctgccctgtgc

SEQ ID NO: 58647 - DNA, 20 bp, Homo sapiens
gcctgcctgggcacgttgct

SEQ ID NO: 58648 - DNA, 25 bp, Homo sapiens
taactgcctgcctgggcacgttgct

SEQ ID NO: 58649 - DNA, 16 bp, Homo sapiens
cctgcctctcactgct

SEQ ID NO: 58650 - DNA, 18 bp, Homo sapiens
gccgcctgtttccctgct

SEQ ID NO: 58651 - DNA, 17 bp, Homo sapiens
gccgcctgctttgggct

SEQ ID NO: 58652 - DNA, 70 bp, Ground squirrel hepatitis virus
aaaggttgacgggcattcttaattatgttgctccttttaccaaatgtggttatgctgctttactgccttt

SEQ ID NO: 58653 - DNA, 24 bp, Ground squirrel hepatitis virus
gggcattcttaattatgttgctcc

SEQ ID NO: 58654 - DNA, 23 bp, Homo sapiens
gggcattctctggagagcttgct

SEQ ID NO: 58655 - DNA, 19 bp, Homo sapiens
gggatttccaaatgttgct

SEQ ID NO: 58656 - DNA, 17 bp, Homo sapiens
gggcatttttaatatgt

SEQ ID NO: 58657 - DNA, 15 bp, Homo sapiens
gggcttcttaatgct

SEQ ID NO: 58658 - DNA, 15 bp, Homo sapiens
ggcattcttagtgct

SEQ ID NO: 58659 - DNA, 18 bp, Homo sapiens
gggcatgtcatgttgctc

SEQ ID NO: 58660 - DNA, 21 bp, Homo sapiens
ggcattccctggtgttgttcc

SEQ ID NO: 58661 - DNA, 23 bp, Homo sapiens
gagcgttcttaattattagtgtc

SEQ ID NO: 58662 - DNA, 21 bp, Homo sapiens
gggcattcataattaaatgtt

SEQ ID NO: 58663 - DNA, 16 bp, Homo sapiens
ggtcattcatgttgct

SEQ ID NO: 58664 - DNA, 19 bp, Homo sapiens
gggcattcttagctctgct

SEQ ID NO: 58665 - DNA, 77 bp, Saimiriine herpesvirus 2
gatgtacattccaacactgctgccatatttttggagaaattcaatatggatatgatattatttgcagtatgtatatc

SEQ ID NO: 58666 - DNA, 24 bp, Saimiriine herpesvirus 2
tgtacattccaacactgctgccat

SEQ ID NO: 58667 - DNA, 22 bp, Homo sapiens
tgtacatttgaacacacggctg

SEQ ID NO: 58668 - DNA, 20 bp, Homo sapiens
tgtagtttcaacactgcaac

SEQ ID NO: 58669 - DNA, 23 bp, Homo sapiens
tgtacatttacagtatttgctgc

SEQ ID NO: 58670 - DNA, 22 bp, Homo sapiens
tgtacatttctacaacgtccat

SEQ ID NO: 58671 - DNA, 22 bp, Homo sapiens
tgcacattctgtcccctgccat

SEQ ID NO: 58672 - DNA, 26 bp, Homo sapiens
tgtacatttccatgtgaataagccat

SEQ ID NO: 58673 - DNA, 19 bp, Homo sapiens
tgtacattttgacattgcc

SEQ ID NO: 58674 - DNA, 21 bp, Homo sapiens
tgtagattccagggctgccat

SEQ ID NO: 58675 - DNA, 24 bp, Homo sapiens
tgtacatttcagcatttgcatcat

SEQ ID NO: 58676 - DNA, 16 bp, Homo sapiens
tgacattccagcagct

SEQ ID NO: 58677 - DNA, 21 bp, Homo sapiens
tgtaattcgtctggctgccat

SEQ ID NO: 58678 - DNA, 26 bp, Homo sapiens
tgtacactctaatgaaatcactgcta

SEQ ID NO: 58679 - DNA, 17 bp, Homo sapiens
tgttgttccaacagctg

SEQ ID NO: 58680 - DNA, 19 bp, Homo sapiens
tgtacattcctatgttcca

SEQ ID NO: 58681 - DNA, 24 bp, Homo sapiens
tgttatttcctaatttgctgccat

SEQ ID NO: 58682 - DNA, 19 bp, Homo sapiens
tgtacattttatcactgct

SEQ ID NO: 58683 - DNA, 18 bp, Homo sapiens
tgtattccaacacaggcc

SEQ ID NO: 58684 - DNA, 16 bp, Homo sapiens
tgcacattctactgcc

SEQ ID NO: 58685 - DNA, 68 bp, Tupaia paramyxovirus
acattgagtatctaaattatacaagtattaaaaatactagatttgtgtagttttaaaataaataatgt

SEQ ID NO: 58686 - DNA, 24 bp, Tupaia paramyxovirus
taaattatacaagtattaaaaata

SEQ ID NO: 58687 - DNA, 20 bp, Homo sapiens
taaattatacatagtatcaa

SEQ ID NO: 58688 - DNA, 18 bp, Homo sapiens
aattatacaaggttcaaa

SEQ ID NO: 58689 - DNA, 24 bp, Homo sapiens
taaattacacaatgaataaaaata

SEQ ID NO: 58690 - DNA, 21 bp, Homo sapiens
taaattttacaagtatgtaaa

SEQ ID NO: 58691 - DNA, 21 bp, Homo sapiens
taaataatacaagtactaaaa

SEQ ID NO: 58692 - DNA, 66 bp, Tupaia paramyxovirus
actagtcacaaatcagatcaatggtcaaagatcttcggaatccaaactattactccagggataagt

SEQ ID NO: 58693 - DNA, 24 bp, Tupaia paramyxovirus
tccaaactattactccagggataa

SEQ ID NO: 58694 - DNA, 22 bp, Homo sapiens
tctgaactattattcaggataa

SEQ ID NO: 58695 - DNA, 18 bp, Homo sapiens
tccaaatgaccagggata

SEQ ID NO: 58696 - DNA, 19 bp, Homo sapiens
tcagaactaaacagggata

SEQ ID NO: 58697 - DNA, 19 bp, Homo sapiens
tccaactattactcttcag

SEQ ID NO: 58698 - DNA, 21 bp, Homo sapiens
tccaaactattttctatctcc

SEQ ID NO: 58699 - DNA, 19 bp, Homo sapiens
aaactatcacttaaagtga

SEQ ID NO: 58700 - DNA, 21 bp, Homo sapiens
tccaaactgttactgtctcgg

SEQ ID NO: 58701 - DNA, 21 bp, Homo sapiens
tccaggtgacctcagggataa

SEQ ID NO: 58702 - DNA, 21 bp, Homo sapiens
ctcaattattcacagggataa

SEQ ID NO: 58703 - DNA, 21 bp, Homo sapiens
tcccagaatccttccagggat

SEQ ID NO: 58704 - DNA, 20 bp, Homo sapiens
ccagtcagtactccagggat

SEQ ID NO: 58705 - DNA, 21 bp, Homo sapiens
tccaaacctattagactggat

SEQ ID NO: 58706 - DNA, 22 bp, Homo sapiens
tccaaacttattacttttatgg

SEQ ID NO: 58707 - DNA, 21 bp, Homo sapiens
tcctggctcgaccagggataa

SEQ ID NO: 58708 - DNA, 18 bp, Homo sapiens
tccaaatattactcctgg

SEQ ID NO: 58709 - DNA, 24 bp, Homo sapiens
tccacactattacttcccctttgg

SEQ ID NO: 58710 - DNA, 23 bp, Homo sapiens
tccaaacttattaggaaggataa

SEQ ID NO: 58711 - DNA, 19 bp, Homo sapiens
aaaccaagttcagggataa

SEQ ID NO: 58712 - DNA, 21 bp, Homo sapiens
caaactattactgttccatag

SEQ ID NO: 58713 - DNA, 23 bp, Homo sapiens
cccaaactgtaacttttagggat

SEQ ID NO: 58714 - DNA, 75 bp, Lumpy skin disease virus
gattagttaatatcgatgatttaataaagggagccataagtgttaaagttcttacattaaatgatgttattagtc

SEQ ID NO: 58715 - DNA, 24 bp, Lumpy skin disease virus
ttacattaaatgatgttattagtc

SEQ ID NO: 58716 - DNA, 18 bp, Homo sapiens
cattagatggccattagt

SEQ ID NO: 58717 - DNA, 20 bp, Homo sapiens
ttacattaattgatgttatt

SEQ ID NO: 58718 - DNA, 22 bp, Homo sapiens
ttacaataaatgatgaaatagt

SEQ ID NO: 58719 - DNA, 23 bp, Homo sapiens
ttacattagataacttcttagtc

SEQ ID NO: 58720 - DNA, 61 bp, Lumpy skin disease virus
gcgttactcttcccacttataatattttaggaaaacaaatatttttaagccaaagtttcgt

SEQ ID NO: 58721 - DNA, 24 bp, Lumpy skin disease virus
tactcttcccacttataatatttt

SEQ ID NO: 58722 - DNA, 20 bp, Homo sapiens
ttcccacataacaatatttt

SEQ ID NO: 58723 - DNA, 23 bp, Homo sapiens
tactcttcctgcataaatatttt

SEQ ID NO: 58724 - DNA, 20 bp, Homo sapiens
tactcttccttttgtaacat

SEQ ID NO: 58725 - DNA, 17 bp, Homo sapiens
actctttcccaatattt

SEQ ID NO: 58726 - DNA, 22 bp, Homo sapiens
tactctttcctcttaaatattt

SEQ ID NO: 58727 - DNA, 19 bp, Homo sapiens
cctttcccattaatatttt

SEQ ID NO: 58728 - DNA, 17 bp, Homo sapiens
ctcttccttaaatattt

SEQ ID NO: 58729 - DNA, 20 bp, Homo sapiens
ctcttcccacactttatttt

SEQ ID NO: 58730 - DNA, 19 bp, Homo sapiens
ttcccacttaaaatatttt

SEQ ID NO: 58731 - DNA, 21 bp, Homo sapiens
ctcttccatttatcaatattt

SEQ ID NO: 58732 - DNA, 19 bp, Homo sapiens
tactcttccctattaacat

SEQ ID NO: 58733 - DNA, 23 bp, Homo sapiens
tatccttcccactgatccatttt

SEQ ID NO: 58734 - DNA, 63 bp, Sheeppox virus
tttatttattaaatatagacgatcccataaaatataatgaggttagtttatagaataggaaga

SEQ ID NO: 58735 - DNA, 24 bp, Sheeppox virus
tatttattaaatatagacgatccc

SEQ ID NO: 58736 - DNA, 25 bp, Homo sapiens
tatttattaaccaaagggatgatcc

SEQ ID NO: 58737 - DNA, 19 bp, Homo sapiens
tatctattaaatgcaatcc

SEQ ID NO: 58738 - DNA, 19 bp, Homo sapiens
tttattaaatacaaattcc

SEQ ID NO: 58739 - DNA, 130 bp, Goose parvovirus
cgtgacttccggtcatgtgacttccggtgacgtgtttccggctgttaggttgaccacgcgcatgccgcgcggtcagcccaatagttaagccggaaacacgtcaccggaagtcacatgaccggaagtcacg

SEQ ID NO: 58740 - DNA, 24 bp, Goose parvovirus
tcagcccaatagttaagccggaaa

SEQ ID NO: 58741 - DNA, 16 bp, Homo sapiens
agcccagtaactggaa

SEQ ID NO: 58742 - DNA, 17 bp, Homo sapiens
tcagctcaaagttaaac

SEQ ID NO: 58743 - DNA, 19 bp, Homo sapiens
gcttcagtcaaggctggaa

SEQ ID NO: 58744 - DNA, 16 bp, Homo sapiens
caatagttaagggaaa

SEQ ID NO: 58745 - DNA, 21 bp, Homo sapiens
tcagcccagggcatgctggga

SEQ ID NO: 58746 - DNA, 16 bp, Homo sapiens
acccaatagttacaga

SEQ ID NO: 58747 - DNA, 15 bp, Homo sapiens
acccaatagttagga

SEQ ID NO: 58748 - DNA, 22 bp, Homo sapiens
tcagcccagtcaccacactgga

SEQ ID NO: 58749 - DNA, 22 bp, Homo sapiens
cagcctgggaggggagccggaa

SEQ ID NO: 58750 - DNA, 22 bp, Homo sapiens
cagtatttcagttaagctggga

SEQ ID NO: 58751 - DNA, 22 bp, Homo sapiens
tcagcccaagagtgtgtgggaa

SEQ ID NO: 58752 - DNA, 23 bp, Homo sapiens
tcatccacagctttaagccggaa

SEQ ID NO: 58753 - DNA, 19 bp, Homo sapiens
tcagcccaggcaaagccgg

SEQ ID NO: 58754 - DNA, 18 bp, Homo sapiens
gcccaagccaggggccgg

SEQ ID NO: 58755 - DNA, 19 bp, Homo sapiens
cagcccggtagcaagccgg

SEQ ID NO: 58756 - DNA, 19 bp, Homo sapiens
tcagcccagggttcctgga

SEQ ID NO: 58757 - DNA, 18 bp, Homo sapiens
tcaagcccaggcagctgg

SEQ ID NO: 58758 - DNA, 25 bp, Homo sapiens
tcagcccaactggagcggctggaaa

SEQ ID NO: 58759 - DNA, 18 bp, Homo sapiens
ccagcccagtgcctggaa

SEQ ID NO: 58760 - DNA, 24 bp, Homo sapiens
ccagcccagttttaagggccggaa

SEQ ID NO: 58761 - DNA, 17 bp, Homo sapiens
tcagcccaggaggcgga

SEQ ID NO: 58762 - DNA, 110 bp, Alcelaphine herpesvirus 1
gtatttggtggagtcgtaaagctgacagagtccctgggtgcgctgggctgcccgcactgaagtaaagttaaactcactccctagacaggttttgagctccaccacgtaac

SEQ ID NO: 58763 - DNA, 24 bp, Alcelaphine herpesvirus 1
aagctgacagagtccctgggtgcg

SEQ ID NO: 58764 - DNA, 19 bp, Homo sapiens
gctcagcgtcctgggtgcg

SEQ ID NO: 58765 - DNA, 22 bp, Homo sapiens
gctgcaaaggattctgggtgcg

SEQ ID NO: 58766 - DNA, 19 bp, Homo sapiens
aagctgacggagctccctg

SEQ ID NO: 58767 - DNA, 17 bp, Homo sapiens
agctgcatgctgggtgc

SEQ ID NO: 58768 - DNA, 17 bp, Homo sapiens
agtgacagagtcaggtg

SEQ ID NO: 58769 - DNA, 16 bp, Homo sapiens
agctgctccctgggtg

SEQ ID NO: 58770 - DNA, 22 bp, Homo sapiens
gctgtgcagggtcccaggtgcg

SEQ ID NO: 58771 - DNA, 20 bp, Homo sapiens
aagtgggcagagtcccggcg

SEQ ID NO: 58772 - DNA, 19 bp, Homo sapiens
gctggcagggccccaggtg

SEQ ID NO: 58773 - DNA, 16 bp, Homo sapiens
tgcaggtccctgggtg

SEQ ID NO: 58774 - DNA, 17 bp, Homo sapiens
aagctggtaagtccctg

SEQ ID NO: 58775 - DNA, 17 bp, Homo sapiens
aagctggcagagtcctg

SEQ ID NO: 58776 - DNA, 20 bp, Homo sapiens
agccggcggaggcaggtgcg

SEQ ID NO: 58777 - DNA, 18 bp, Homo sapiens
agctgcagggtccctaaa

SEQ ID NO: 58778 - DNA, 19 bp, Homo sapiens
agttggcagagcctagatg

SEQ ID NO: 58779 - DNA, 19 bp, Homo sapiens
aagttgacagaggtagaat

SEQ ID NO: 58780 - DNA, 16 bp, Homo sapiens
gctgcagagtccagtg

SEQ ID NO: 58781 - DNA, 23 bp, Homo sapiens
gctgacagattctcttccttgtg

SEQ ID NO: 58782 - DNA, 22 bp, Homo sapiens
aagctgacagagtcctattatg

SEQ ID NO: 58783 - DNA, 20 bp, Homo sapiens
gcagacaggaggtgggtgcg

SEQ ID NO: 58784 - DNA, 17 bp, Homo sapiens
tggcagagtcctggctg

SEQ ID NO: 58785 - DNA, 17 bp, Homo sapiens
agcctggcccctgggtg

SEQ ID NO: 58786 - DNA, 22 bp, Homo sapiens
aagttggaagagtccccttgcg

SEQ ID NO: 58787 - DNA, 16 bp, Homo sapiens
gctgacaactgggtgc

SEQ ID NO: 58788 - DNA, 17 bp, Homo sapiens
aagttgtcagagtcctg

SEQ ID NO: 58789 - DNA, 19 bp, Homo sapiens
gctggtagatgtccaggcg

SEQ ID NO: 58790 - DNA, 18 bp, Homo sapiens
agcggacagagtcaggtg

SEQ ID NO: 58791 - DNA, 18 bp, Homo sapiens
aagctggcaggttccccg

SEQ ID NO: 58792 - DNA, 20 bp, Homo sapiens
aagtgaacttgtcctgggtg

SEQ ID NO: 58793 - DNA, 19 bp, Homo sapiens
aagctgacagaggctcctg

SEQ ID NO: 58794 - DNA, 17 bp, Homo sapiens
gctgcatatcctgggtg

SEQ ID NO: 58795 - DNA, 23 bp, Homo sapiens
gctggcagagtcctagccaagtg

SEQ ID NO: 58796 - DNA, 18 bp, Homo sapiens
agcggcagcactgggtgc

SEQ ID NO: 58797 - DNA, 21 bp, Homo sapiens
aaggtgatggggtcccgggcg

SEQ ID NO: 58798 - DNA, 20 bp, Homo sapiens
agctgacagagtcctggatg

SEQ ID NO: 58799 - DNA, 130 bp, Ectromelia virus
gttagagacggaaatagttgtcaagattctctatcgtcctaatataccattaaaaattgttagatttttccgcaataacatggtaactggaatagagatagccgatagatctgttatttcagtcgctgat

SEQ ID NO: 58800 - DNA, 24 bp, Ectromelia virus
taacatggtaactggaatagagat

SEQ ID NO: 58801 - DNA, 18 bp, Homo sapiens
taacatggtgcctggtac

SEQ ID NO: 58802 - DNA, 25 bp, Homo sapiens
taacatggtgggttggagttaggat

SEQ ID NO: 58803 - DNA, 19 bp, Homo sapiens
taacgtggcaactgtacag

SEQ ID NO: 58804 - DNA, 18 bp, Homo sapiens
caacatggtgactgagag

SEQ ID NO: 58805 - DNA, 19 bp, Homo sapiens
catggtaaggtgtggagat

SEQ ID NO: 58806 - DNA, 18 bp, Homo sapiens
taacatgataaacatgga

SEQ ID NO: 58807 - DNA, 16 bp, Homo sapiens
taactggctagaatag

SEQ ID NO: 58808 - DNA, 16 bp, Homo sapiens
atggtaactatagaga

SEQ ID NO: 58809 - DNA, 21 bp, Homo sapiens
aacatgtcttgggatagagat

SEQ ID NO: 58810 - DNA, 18 bp, Homo sapiens
ataatttgggatagagat

SEQ ID NO: 58811 - DNA, 22 bp, Homo sapiens
atgactacattggaatagagat

SEQ ID NO: 58812 - DNA, 79 bp, Simian-Human immunodeficiency virus
gagaggctggcagattgagccctgggaggttctctccagcactagcaggtagagcctgggtgttccctgctagactctc

SEQ ID NO: 58813 - DNA, 24 bp, Simian-Human immunodeficiency virus
tagagcctgggtgttccctgctag

SEQ ID NO: 58814 - DNA, 23 bp, Homo sapiens
tagagcctgagactaggcctgct

SEQ ID NO: 58815 - DNA, 22 bp, Homo sapiens
tagaacctgttttccctgctag

SEQ ID NO: 58816 - DNA, 17 bp, Homo sapiens
taaagcttgtccttgct

SEQ ID NO: 58817 - DNA, 21 bp, Homo sapiens
taggcctgggtacaagctgct

SEQ ID NO: 58818 - DNA, 19 bp, Homo sapiens
gagcctggcccgatccctg

SEQ ID NO: 58819 - DNA, 17 bp, Homo sapiens
ctggggcagcctgctag

SEQ ID NO: 58820 - DNA, 22 bp, Homo sapiens
tacagccttaccttcctgctag

SEQ ID NO: 58821 - DNA, 19 bp, Homo sapiens
tagagcctgcggttgtgct

SEQ ID NO: 58822 - DNA, 20 bp, Homo sapiens
aagcttgacacccctgttag

SEQ ID NO: 58823 - DNA, 16 bp, Homo sapiens
gagccaggtgttcctg

SEQ ID NO: 58824 - DNA, 15 bp, Homo sapiens
gccaggcccctgcta

SEQ ID NO: 58825 - DNA, 17 bp, Homo sapiens
gagcccgggtgtttctg

SEQ ID NO: 58826 - DNA, 23 bp, Homo sapiens
tagacttgggcctagatcttgct

SEQ ID NO: 58827 - DNA, 18 bp, Homo sapiens
gatctgggtgttcttgct

SEQ ID NO: 58828 - DNA, 18 bp, Homo sapiens
taggcctgggtgtttctg

SEQ ID NO: 58829 - DNA, 61 bp, Simian-Human immunodeficiency virus
cacgcttgcttgcttaaagccctcttcaataaagctgccattttagaagtaagctagtgtg

SEQ ID NO: 58830 - DNA, 24 bp, Simian-Human immunodeficiency virus
gcttgcttgcttaaagccctcttc

SEQ ID NO: 58831 - DNA, 18 bp, Homo sapiens
gcccttagggccctcttc

SEQ ID NO: 58832 - DNA, 21 bp, Homo sapiens
acttgcttgcttggttttctt

SEQ ID NO: 58833 - DNA, 18 bp, Homo sapiens
gctgtttgctcaactctt

SEQ ID NO: 58834 - DNA, 23 bp, Homo sapiens
gcttgcttgcctccgcacctctt

SEQ ID NO: 58835 - DNA, 23 bp, Homo sapiens
gcctgtcccccaaagtcctcttc

SEQ ID NO: 58836 - DNA, 17 bp, Homo sapiens
ttgcctgccactttctt

SEQ ID NO: 58837 - DNA, 19 bp, Homo sapiens
gcttgtttcctcccctctt

SEQ ID NO: 58838 - DNA, 22 bp, Homo sapiens
gcgtgcacagggggccctcttc

SEQ ID NO: 58839 - DNA, 22 bp, Homo sapiens
gcttattgagaaagcccttttc

SEQ ID NO: 58840 - DNA, 22 bp, Homo sapiens
gcttgctgtctccatccttttc

SEQ ID NO: 58841 - DNA, 20 bp, Homo sapiens
gcctgcttgaagccctcttc

SEQ ID NO: 58842 - DNA, 22 bp, Homo sapiens
gcttactcttagggtcctcttc

SEQ ID NO: 58843 - DNA, 85 bp, Simian-Human immunodeficiency virus
aagaccctggtctgttaggaccctttctgctttgggaaaccgaagcaggaaaatccctagcagattggcgcctgaacagggactt

SEQ ID NO: 58844 - DNA, 24 bp, Simian-Human immunodeficiency virus
tgttaggaccctttctgctttggg

SEQ ID NO: 58845 - DNA, 21 bp, Homo sapiens
ggggcccttctgacttttggg

SEQ ID NO: 58846 - DNA, 18 bp, Homo sapiens
tgttggacactgctttgg

SEQ ID NO: 58847 - DNA, 17 bp, Homo sapiens
tgtaggatcctttctgc

SEQ ID NO: 58848 - DNA, 20 bp, Homo sapiens
tgttaggactctttcatagg

SEQ ID NO: 58849 - DNA, 21 bp, Homo sapiens
gttggaattttttgctttggg

SEQ ID NO: 58850 - DNA, 24 bp, Homo sapiens
tattaggatttttgtgattttggg

SEQ ID NO: 58851 - DNA, 19 bp, Homo sapiens
tgtggggaccaagctttgg

SEQ ID NO: 58852 - DNA, 62 bp, Myxoma virus
gccatacagtggaccaatacgggataatgtttgtcctcgcaattggatagaaacgtagtggc

SEQ ID NO: 58853 - DNA, 24 bp, Myxoma virus
cagtggaccaatacgggataatgt

SEQ ID NO: 58854 - DNA, 22 bp, Homo sapiens
cagtggacaaatgaacgaatgt

SEQ ID NO: 58855 - DNA, 21 bp, Homo sapiens
cagtggaacagaatataatgt

SEQ ID NO: 58856 - DNA, 25 bp, Homo sapiens
cagtggactgagtgtttggtagtgt

SEQ ID NO: 58857 - DNA, 16 bp, Homo sapiens
cagtgatcagaataat

SEQ ID NO: 58858 - DNA, 18 bp, Homo sapiens
gtggcagcgggataatgt

SEQ ID NO: 58859 - DNA, 131 bp, Vaccinia virus
tggtttgatatttcatatactatttataagatatccatatcatcattgtgtaaactaaataacgtcttctatgtatttagtaaggacattggatatgtggaaaagtatgatggtgcatggaagttagtaca

SEQ ID NO: 58860 - DNA, 24 bp, Vaccinia virus
tatttcatatactatttataagat

SEQ ID NO: 58861 - DNA, 21 bp, Homo sapiens
tacttcatatataaataagat

SEQ ID NO: 58862 - DNA, 21 bp, Homo sapiens
atttcatatattatccttaag

SEQ ID NO: 58863 - DNA, 19 bp, Homo sapiens
ttcattacatttataagat

SEQ ID NO: 58864 - DNA, 19 bp, Homo sapiens
tattttatatactatttac

SEQ ID NO: 58865 - DNA, 18 bp, Homo sapiens
acacactatttgtaagat

SEQ ID NO: 58866 - DNA, 100 bp, Vaccinia virus
gtccgctgtttccgttaataatactattttcgtaactggcggattattcataaataactctaatagcacgatcgtggttaacaatatggaaaaacttgac

SEQ ID NO: 58867 - DNA, 24 bp, Vaccinia virus
taatagcacgatcgtggttaacaa

SEQ ID NO: 58868 - DNA, 17 bp, Homo sapiens
gcacatcacgttaacaa

SEQ ID NO: 58869 - DNA, 17 bp, Homo sapiens
tagcatgaaagttaaca

SEQ ID NO: 58870 - DNA, 19 bp, Homo sapiens
taatagtcacgattctgat

SEQ ID NO: 58871 - DNA, 16 bp, Homo sapiens
taatagcacagtcaac

SEQ ID NO: 58872 - DNA, 24 bp, Homo sapiens
taatagcctgatattcattaacaa

SEQ ID NO: 58873 - DNA, 22 bp, Homo sapiens
tagcagcatcttgggttaacaa

SEQ ID NO: 58874 - DNA, 18 bp, Homo sapiens
taatagcaccattacagt

SEQ ID NO: 58875 - DNA, 21 bp, Homo sapiens
taatagcattgtcttttaaca

SEQ ID NO: 58876 - DNA, 18 bp, Homo sapiens
taatagcactgtaactaa

SEQ ID NO: 58877 - DNA, 20 bp, Homo sapiens
tgacggtgttctggttaaca

SEQ ID NO: 58878 - DNA, 16 bp, Homo sapiens
cagcaggatggttaac

SEQ ID NO: 58879 - DNA, 18 bp, Homo sapiens
taatagcattatcggtgg

SEQ ID NO: 58880 - DNA, 18 bp, Homo sapiens
taatagcaagattgtaat

SEQ ID NO: 58881 - DNA, 62 bp, Hepatitis GB virus C
ggtggtggatgggtgatgacagggttggtaggtcgtaaatcccggtcatcctggtagccact

SEQ ID NO: 58882 - DNA, 24 bp, Hepatitis GB virus C
tggtggatgggtgatgacagggtt

SEQ ID NO: 58883 - DNA, 18 bp, Homo sapiens
tggtggatgggtgagaca

SEQ ID NO: 58884 - DNA, 16 bp, Homo sapiens
tggtgatgggtggggt

SEQ ID NO: 58885 - DNA, 18 bp, Homo sapiens
ggtggaaagtggtagggt

SEQ ID NO: 58886 - DNA, 16 bp, Homo sapiens
tggtggatggtgaagg

SEQ ID NO: 58887 - DNA, 23 bp, Homo sapiens
tggtggggtggcagaatggggtt

SEQ ID NO: 58888 - DNA, 19 bp, Homo sapiens
tgggggatgggtgttgggt

SEQ ID NO: 58889 - DNA, 16 bp, Homo sapiens
tgggggtgagacaggg

SEQ ID NO: 58890 - DNA, 20 bp, Homo sapiens
ggtgggtcattgacagggtt

SEQ ID NO: 58891 - DNA, 18 bp, Homo sapiens
tggtggatgggtactggt

SEQ ID NO: 58892 - DNA, 23 bp, Homo sapiens
tggtggggggtgacatttgggtt

SEQ ID NO: 58893 - DNA, 107 bp, Cowpox virus
cgtgctactgagatatactaccgatatagagtataatgatttagttactttaataaccgttagacataaaattgattctatgaaaactgtgtttcaggtatttaacg

SEQ ID NO: 58894 - DNA, 107 bp, Cowpox virus; identical to SEQ ID NO: 58893

SEQ ID NO: 58895 - DNA, 20 bp, Homo sapiens
taaagtataatggttcaact

SEQ ID NO: 58896 - DNA, 18 bp, Homo sapiens
agagtataatgatctgct

SEQ ID NO: 58897 - DNA, 18 bp, Homo sapiens
tagagtataatgtcagtt

SEQ ID NO: 58898 - DNA, 19 bp, Homo sapiens
tagaatataatggtcaatt

SEQ ID NO: 58899 - DNA, 20 bp, Homo sapiens
taggtataatggtttcagtt

SEQ ID NO: 58900 - DNA, 77 bp, Arctic ground squirrel hepatitis B virus
accgcggacgtcatcgccgcctgccttgctcgctgctggacaggagctcggctgttgggcactgacaactccgtggt

SEQ ID NO: 58901 - DNA, 24 bp, Arctic ground squirrel hepatitis B virus
tcgccgcctgccttgctcgctgct

SEQ ID NO: 58902 - DNA, 24 bp, Homo sapiens
tcgatcgcctgcccccccgctgct

SEQ ID NO: 58903 - DNA, 18 bp, Homo sapiens
tcgctgcctgccgtggct

SEQ ID NO: 58904 - DNA, 23 bp, Homo sapiens
tcgccgccgccggtcctgctgct

SEQ ID NO: 58905 - DNA, 22 bp, Homo sapiens
tcgtcgccgcctcgcgtctgct

SEQ ID NO: 58906 - DNA, 17 bp, Homo sapiens
tcccgcctgccttgctc

SEQ ID NO: 58907 - DNA, 23 bp, Homo sapiens
tcgctgctgctgctgccgctgct

SEQ ID NO: 58908 - DNA, 21 bp, Homo sapiens
ccttgtctgctgaccgctgct

SEQ ID NO: 58909 - DNA, 21 bp, Homo sapiens
ccgccgcctcagctcgctgct

SEQ ID NO: 58910 - DNA, 19 bp, Homo sapiens
tcactgcctccttgttgct

SEQ ID NO: 58911 - DNA, 21 bp, Homo sapiens
tcgctcgcttgcttgcttgct

SEQ ID NO: 58912 - DNA, 21 bp, Homo sapiens
gcccctgtcgctttcgctgct

SEQ ID NO: 58913 - DNA, 23 bp, Homo sapiens
tcgctgccggcggacacgctgct

SEQ ID NO: 58914 - DNA, 21 bp, Homo sapiens
gcctcctgcctctaatctgct

SEQ ID NO: 58915 - DNA, 20 bp, Homo sapiens
cgctgctttctggagctgct

SEQ ID NO: 58916 - DNA, 23 bp, Homo sapiens
ccgccgcctgcgtcgtcgctgct

SEQ ID NO: 58917 - DNA, 20 bp, Homo sapiens
tcgcgcctgcctccacactg

SEQ ID NO: 58918 - DNA, 19 bp, Homo sapiens
tcgccgcctcccgcgctgc

SEQ ID NO: 58919 - DNA, 19 bp, Homo sapiens
tcccgcctgctggcgctgc

SEQ ID NO: 58920 - DNA, 23 bp, Homo sapiens
tcgctgctgctcccgccgctgct

SEQ ID NO: 58921 - DNA, 21 bp, Homo sapiens
tcgcctctccctctcgctgct

SEQ ID NO: 58922 - DNA, 24 bp, Homo sapiens
ccgctgcctgcttctgcaattgct

SEQ ID NO: 58923 - DNA, 21 bp, Homo sapiens
gctcctgctccttctgctgct

SEQ ID NO: 58924 - DNA, 20 bp, Homo sapiens
gctgtcctgtctatcctgct

SEQ ID NO: 58925 - DNA, 21 bp, Homo sapiens
gctgctttccctggggctgct

SEQ ID NO: 58926 - DNA, 19 bp, Homo sapiens
tcgccgcctgctttgggct

SEQ ID NO: 58927 - DNA, 67 bp, Infectious spleen and kidney necrosis virus
ggaaatgcgccagagggtgatgctgggtcgcacggcgccaactgacaggtatctactggacttttcc

SEQ ID NO: 58928 - DNA, 24 bp, Infectious spleen and kidney necrosis virus
tgacaggtatctactggacttttc

SEQ ID NO: 58929 - DNA, 21 bp, Homo sapiens
aggtatctgtctctgactttt

SEQ ID NO: 58930 - DNA, 18 bp, Homo sapiens
tgacaggtagtaactttt

SEQ ID NO: 58931 - DNA, 21 bp, Homo sapiens
taacaggtgcgctgggttttt

SEQ ID NO: 58932 - DNA, 22 bp, Homo sapiens
tgacaggattgactaacttttc

SEQ ID NO: 58933 - DNA, 20 bp, Homo sapiens
tgacaagtatttgtcctttc

SEQ ID NO: 58934 - DNA, 20 bp, Homo sapiens
acaggtattttgagactttt

SEQ ID NO: 58935 - DNA, 18 bp, Homo sapiens
tgacaggtacttgctgaa

SEQ ID NO: 58936 - DNA, 18 bp, Homo sapiens
gacagaaactggactttt

SEQ ID NO: 58937 - DNA, 22 bp, Homo sapiens
tgcaggtatcttcctgtttttc

SEQ ID NO: 58938 - DNA, 19 bp, Homo sapiens
tgacaggttttggtctctt

SEQ ID NO: 58939 - DNA, 27 bp, Homo sapiens
tgacaggtggtttatctcaggcttttc

SEQ ID NO: 58940 - DNA, 18 bp, Homo sapiens
ggtattactggacttttc

SEQ ID NO: 58941 - DNA, 19 bp, Homo sapiens
acaggtattcctgtttttc

SEQ ID NO: 58942 - DNA, 19 bp, Homo sapiens
tgacagggatcaggctttt

SEQ ID NO: 58943 - DNA, 88 bp, Infectious spleen and kidney necrosis virus
gtataatcagtttgatgttgtgcatttaatacccatcgcagtatccaaggacactgtggcggcaaatgattacattacattgcagtac

SEQ ID NO: 58944 - DNA, 24 bp, Infectious spleen and kidney necrosis virus
tggcggcaaatgattacattacat

SEQ ID NO: 58945 - DNA, 23 bp, Homo sapiens
tggtgacaaacacaacattgcat

SEQ ID NO: 58946 - DNA, 17 bp, Homo sapiens
tggtgcaaatgattgca

SEQ ID NO: 58947 - DNA, 19 bp, Homo sapiens
tggcggcagggaaatacat

SEQ ID NO: 58948 - DNA, 71 bp, Infectious spleen and kidney necrosis virus
gtgcggtgcacgttgacatcatgttcaaagtaggcgaggctgtggacaacgagctgacgctgacaccggat

SEQ ID NO: 58949 - DNA, 24 bp, Infectious spleen and kidney necrosis virus
tgtggacaacgagctgacgctgac

SEQ ID NO: 58950 - DNA, 15 bp, Homo sapiens
gtggacctgacgctg

SEQ ID NO: 58951 - DNA, 20 bp, Homo sapiens
tgtagacaaggctggcgctg

SEQ ID NO: 58952 - DNA, 20 bp, Homo sapiens
tgtggacagtgagcagccaa

SEQ ID NO: 58953 - DNA, 18 bp, Homo sapiens
tgagggtagcgacgctga

SEQ ID NO: 58954 - DNA, 21 bp, Homo sapiens
tgtggacagcaggacttgctg

SEQ ID NO: 58955 - DNA, 20 bp, Homo sapiens
tgtggacaacgaaccacatg

SEQ ID NO: 58956 - DNA, 18 bp, Homo sapiens
tgtggacagagagctgca

SEQ ID NO: 58957 - DNA, 21 bp, Homo sapiens
tgtggacactgagtacatgac

SEQ ID NO: 58958 - DNA, 16 bp, Homo sapiens
tgtgacggtgacgctg

SEQ ID NO: 58959 - DNA, 20 bp, Homo sapiens
gtggacagggatggtgctga

SEQ ID NO: 58960 - DNA, 18 bp, Homo sapiens
tgtggaaagagacgctga

SEQ ID NO: 58961 - DNA, 20 bp, Homo sapiens
tgtggacagcagggctcggc

SEQ ID NO: 58962 - DNA, 107 bp, Ectromelia virus
cgtactactgagatatactaccgatatagagtataatgatttagttactttaataaccgttagacataaaattgattctatgaaaactgtgtttcaggtatttaacg

SEQ ID NO: 58963 - DNA, 127 bp, Hepatitis GB virus A
agggtacgtctatcggtccggctggcccgaaaggcggtggatcctgtgtgttagggttcgtaggtggtaaatcccagcacaggtggtaatcgctatagggcaggcttatcccggtgaccgcttccct

SEQ ID NO: 58964 - DNA, 24 bp, Hepatitis GB virus A
ccagcacaggtggtaatcgctata

SEQ ID NO: 58965 - DNA, 18 bp, Homo sapiens
cacaggtggtttgcgtat

SEQ ID NO: 58966 - DNA, 17 bp, Homo sapiens
ccagcacagctgaggct

SEQ ID NO: 58967 - DNA, 17 bp, Homo sapiens
cagacaatgaagtcgct

SEQ ID NO: 58968 - DNA, 20 bp, Homo sapiens
gcacaggtaagttctgctat

SEQ ID NO: 58969 - DNA, 16 bp, Homo sapiens
cagcacaggtgggtca

SEQ ID NO: 58970 - DNA, 20 bp, Homo sapiens
caggcaggtggtgtagcact

SEQ ID NO: 58971 - DNA, 20 bp, Homo sapiens
cagtacagtaatatgctata

SEQ ID NO: 58972 - DNA, 22 bp, Homo sapiens
cagttcaggtggtggttctata

SEQ ID NO: 58973 - DNA, 60 bp, Hepatitis GB virus A
ggggcctccggtgtgaataagccctcgtctggagcatcagacgttaaactgagacgtccc

SEQ ID NO: 58974 - DNA, 24 bp, Hepatitis GB virus A
cctccggtgtgaataagccctcgt

SEQ ID NO: 58975 - DNA, 21 bp, Homo sapiens
cctccggcgctcagccctcgt

SEQ ID NO: 58976 - DNA, 22 bp, Homo sapiens
cctccagtgtgtgtcctctcgt

SEQ ID NO: 58977 - DNA, 22 bp, Homo sapiens
cctccggtctgagggtcctcgt

SEQ ID NO: 58978 - DNA, 23 bp, Homo sapiens
cctccagtcccctgggcccttgt

SEQ ID NO: 58979 - DNA, 15 bp, Homo sapiens
cctccgtgtgccctc

SEQ ID NO: 58980 - DNA, 21 bp, Homo sapiens
cctcggccactaggccctcgt

SEQ ID NO: 58981 - DNA, 19 bp, Homo sapiens
ctctgatgtgaatggccct

SEQ ID NO: 58982 - DNA, 68 bp, Hepatitis GB virus A
ccccacgtatggcaacgccgcttaaaacccttcggggacagctatgcgggttgacaatgccagtgggg

SEQ ID NO: 58983 - DNA, 24 bp, Hepatitis GB virus A
tatggcaacgccgcttaaaaccct

SEQ ID NO: 58984 - DNA, 20 bp, Homo sapiens
tatggcactgtcacttaaaa

SEQ ID NO: 58985 - DNA, 20 bp, Homo sapiens
ggcatgggctttaaaaccct

SEQ ID NO: 58986 - DNA, 25 bp, Homo sapiens
catggcaatgttggactcagatcct

SEQ ID NO: 58987 - DNA, 23 bp, Homo sapiens
tatggcaacattttctaagtcct

SEQ ID NO: 58988 - DNA, 17 bp, Homo sapiens
gcaactcgattaaaacc

SEQ ID NO: 58989 - DNA, 19 bp, Homo sapiens
tatggtaagccgcccaccc

SEQ ID NO: 58990 - DNA, 23 bp, Homo sapiens
tatggtagtgtctgtaaaaccct

SEQ ID NO: 58991 - DNA, 19 bp, Homo sapiens
tatggcaggctgcttaacc

SEQ ID NO: 58992 - DNA, 94 bp, Hepatitis GB virus A
gcggcgccgtgctacaggcggcaaggggaaaaatccttcgggtgaccccgggtggcattccctcccttagcagcatgagtgtggtggtagctgc

SEQ ID NO: 58993 - DNA, 24 bp, Hepatitis GB virus A
gtggcattccctcccttagcagca

SEQ ID NO: 58994 - DNA, 23 bp, Homo sapiens
gtgacattccctccatctttggc

SEQ ID NO: 58995 - DNA, 21 bp, Homo sapiens
gtggtgtgccctcacccagca

SEQ ID NO: 58996 - DNA, 18 bp, Homo sapiens
gtgttgttccctccctca

SEQ ID NO: 58997 - DNA, 25 bp, Homo sapiens
gtggcattttcacttcatggtagca

SEQ ID NO: 58998 - DNA, 16 bp, Homo sapiens
gtggcattgctagcag

SEQ ID NO: 58999 - DNA, 22 bp, Homo sapiens
gtggcattttcactttctcgca

SEQ ID NO: 59000 - DNA, 20 bp, Homo sapiens
gtgggattccctccttctta

SEQ ID NO: 59001 - DNA, 22 bp, Homo sapiens
gtggcatttcttcatagaagca

SEQ ID NO: 59002 - DNA, 20 bp, Homo sapiens
gtggcatcttcctcccaggc

SEQ ID NO: 59003 - DNA, 21 bp, Homo sapiens
gtggcattcacctccccagca

SEQ ID NO: 59004 - DNA, 23 bp, Homo sapiens
tggcatttctccctttagcagca

SEQ ID NO: 59005 - DNA, 17 bp, Homo sapiens
ggcgttcgcttagcagc

SEQ ID NO: 59006 - DNA, 22 bp, Homo sapiens
gtggcatttactcgctttagca

SEQ ID NO: 59007 - DNA, 16 bp, Homo sapiens
gtgacattcttggcag

SEQ ID NO: 59008 - DNA, 20 bp, Homo sapiens
tggtataaactttagcagca

SEQ ID NO: 59009 - DNA, 30 bp, Homo sapiens
gtggcattttgttctgtttcttagcagcat

SEQ ID NO: 59010 - DNA, 20 bp, Homo sapiens
gtgacattcccttcaaggca

SEQ ID NO: 59011 - DNA, 18 bp, Homo sapiens
gtagcatttccctggcag

SEQ ID NO: 59012 - DNA, 18 bp, Homo sapiens
gtagcatttcctttggca

SEQ ID NO: 59013 - DNA, 19 bp, Homo sapiens
gtgacattctctctgggca

SEQ ID NO: 59014 - DNA, 19 bp, Homo sapiens
gtggcattcctgccctggc

SEQ ID NO: 59015 - DNA, 26 bp, Homo sapiens
gcggcatttcttcagttacagcagca

SEQ ID NO: 59016 - DNA, 17 bp, Homo sapiens
gtgtattccctctagca

SEQ ID NO: 59017 - DNA, 17 bp, Homo sapiens
gtggcattctcccggca

SEQ ID NO: 59018 - DNA, 26 bp, Homo sapiens
tgacttagttcctttctttagcagca

SEQ ID NO: 59019 - DNA, 16 bp, Homo sapiens
gtggcttctctagcag

SEQ ID NO: 59020 - DNA, 18 bp, Homo sapiens
ctcctctcccttagcggc

SEQ ID NO: 59021 - DNA, 17 bp, Homo sapiens
gtggcatctcttttgca

SEQ ID NO: 59022 - DNA, 26 bp, Homo sapiens
atggcatttattagcccttggtggca

SEQ ID NO: 59023 - DNA, 18 bp, Homo sapiens
atggcattctcttgtcag

SEQ ID NO: 59024 - DNA, 21 bp, Homo sapiens
tggcattccctcttcatagca

SEQ ID NO: 59025 - DNA, 18 bp, Homo sapiens
gtggcactccatggcagc

SEQ ID NO: 59026 - DNA, 21 bp, Homo sapiens
gtgacattttctcctccagca

SEQ ID NO: 59027 - DNA, 19 bp, Homo sapiens
tggcgttctctccctagca

SEQ ID NO: 59028 - DNA, 18 bp, Homo sapiens
gtgtattccctcccgcag

SEQ ID NO: 59029 - DNA, 22 bp, Homo sapiens
gtggcattcttcaccttcagca

SEQ ID NO: 59030 - DNA, 21 bp, Homo sapiens
gtggtctcctcccttagtggc

SEQ ID NO: 59031 - DNA, 18 bp, Homo sapiens
gtggcattctccttcctc

SEQ ID NO: 59032 - DNA, 19 bp, Homo sapiens
gtggttttcctcttcagca

SEQ ID NO: 59033 - DNA, 22 bp, Homo sapiens
gtggtattttgttccagcagca

SEQ ID NO: 59034 - DNA, 73 bp, Diatraea saccharalis densovirus
ggtccgctgcctagctacatcctgttttgcacacggctccagcttcgacgggagtttgcggtcaagcgaggtc

SEQ ID NO: 59035 - DNA, 24 bp, Diatraea saccharalis densovirus
cgacgggagtttgcggtcaagcga

SEQ ID NO: 59036 - DNA, 18 bp, Homo sapiens
gggagcccgggtcgggcg

SEQ ID NO: 59037 - DNA, 20 bp, Homo sapiens
cgggagttaagtcgcaagcg

SEQ ID NO: 59038 - DNA, 20 bp, Homo sapiens
gagggctccttggtcaagcg

SEQ ID NO: 59039 - DNA, 18 bp, Homo sapiens
gacgggagtttgtgggcc

SEQ ID NO: 59040 - DNA, 16 bp, Homo sapiens
cgggagtttgcgagcg

SEQ ID NO: 59041 - DNA, 19 bp, Homo sapiens
caggagtttgcgctcagca

SEQ ID NO: 59042 - DNA, 66 bp, Fowlpox virus
gatatctcattatttgattatgtagcgccaggagctgttatattaagtcaatctaatcactctatc

SEQ ID NO: 59043 - DNA, 24 bp, Fowlpox virus
tgttatattaagtcaatctaatca

SEQ ID NO: 59044 - DNA, 19 bp, Homo sapiens
tgttttattaagtcaggct

SEQ ID NO: 59045 - DNA, 19 bp, Homo sapiens
tgttaaattaagtcaaact

SEQ ID NO: 59046 - DNA, 18 bp, Homo sapiens
tcagagtcagtctaatca

SEQ ID NO: 59047 - DNA, 69 bp, Lymphocystis disease virus 1
ctttcaaccataaataatgtcgttgttttaaatttatatcgatgaactaattttaaatctggtggaaag

SEQ ID NO: 59048 - DNA, 24 bp, Lymphocystis disease virus 1
accataaataatgtcgttgtttta

SEQ ID NO: 59049 - DNA, 22 bp, Homo sapiens
accataaatgaattttgtttta

SEQ ID NO: 59050 - DNA, 17 bp, Homo sapiens
ccataaataatatcttg

SEQ ID NO: 59051 - DNA, 20 bp, Homo sapiens
accataaataattatatttt

SEQ ID NO: 59052 - DNA, 20 bp, Homo sapiens
ataaataataagtcgtttta

SEQ ID NO: 59053 - DNA, 20 bp, Homo sapiens
cataaataatgcccatttta

SEQ ID NO: 59054 - DNA, 18 bp, Homo sapiens
accaaaataatgtacatt

SEQ ID NO: 59055 - DNA, 20 bp, Homo sapiens
cctggataatgtcaatgctt

SEQ ID NO: 59056 - DNA, 23 bp, Homo sapiens
actataagctaatgtgttgtttt

SEQ ID NO: 59057 - DNA, 24 bp, Homo sapiens
accattaaatggtgtcaggtttta

SEQ ID NO: 59058 - DNA, 19 bp, Homo sapiens
accacagataatgtctttg

SEQ ID NO: 59059 - DNA, 17 bp, Homo sapiens
accataaacaaggtgtt

SEQ ID NO: 59060 - DNA, 18 bp, Homo sapiens
cataaataatgtctagtt

SEQ ID NO: 59061 - DNA, 18 bp, Homo sapiens
cataaataatgttggctg

SEQ ID NO: 59062 - DNA, 108 bp, Bovine herpesvirus 4
ttgtatatattatagtttcattatgggcattttatcatacctctgcacctttcaactgactaactgcagatgaaaaataaaatatcacccaagctaagatagtatcaa

SEQ ID NO: 59063 - DNA, 24 bp, Bovine herpesvirus 4
taactgcagatgaaaaataaaata

SEQ ID NO: 59064 - DNA, 20 bp, Homo sapiens
actgcagtaataataaaata

SEQ ID NO: 59065 - DNA, 22 bp, Homo sapiens
aacatgtatgaaaaataaaata

SEQ ID NO: 59066 - DNA, 18 bp, Homo sapiens
actgcagatcaatgataa

SEQ ID NO: 59067 - DNA, 18 bp, Homo sapiens
tacagtgagaaataaaat

SEQ ID NO: 59068 - DNA, 17 bp, Homo sapiens
tgctgaaaaataaaata

SEQ ID NO: 59069 - DNA, 21 bp, Homo sapiens
tgcctgatgaaaaataaaata

SEQ ID NO: 59070 - DNA, 20 bp, Homo sapiens
ctacagatattagtaaaata

SEQ ID NO: 59071 - DNA, 19 bp, Homo sapiens
taacttgatgaaaaataaa

SEQ ID NO: 59072 - DNA, 18 bp, Homo sapiens
aactgcagaaaatagaat

SEQ ID NO: 59073 - DNA, 18 bp, Homo sapiens
cacatgaaagataaaata

SEQ ID NO: 59074 - DNA, 22 bp, Homo sapiens
taactacagattccttaaaata

SEQ ID NO: 59075 - DNA, 22 bp, Homo sapiens
actgcaaatacaaaataaaata

SEQ ID NO: 59076 - DNA, 19 bp, Homo sapiens
aactgcagatattaaaata

SEQ ID NO: 59077 - DNA, 20 bp, Homo sapiens
taacagatgagagaaataaa

SEQ ID NO: 59078 - DNA, 19 bp, Homo sapiens
ctgcaaaataaataaaata

SEQ ID NO: 59079 - DNA, 22 bp, Homo sapiens
ctgattgataaaaaataaaata

SEQ ID NO: 59080 - DNA, 23 bp, Homo sapiens
gcaaatgaatggggaataaaata

SEQ ID NO: 59081 - DNA, 22 bp, Homo sapiens
taactgatggcaaaataaaata

SEQ ID NO: 59082 - DNA, 74 bp, Human adenovirus D
tgcccagcagcagcagtagcccctctgtgcccagttccatcatcgccgaggagaactgctggccctgctggccg

SEQ ID NO: 59083 - DNA, 24 bp, Human adenovirus D
cgaggagaactgctggccctgctg

SEQ ID NO: 59084 - DNA, 26 bp, Homo sapiens
cgggtagggctgctggccggaggctg

SEQ ID NO: 59085 - DNA, 21 bp, Homo sapiens
cgaagggaactgctgggactg

SEQ ID NO: 59086 - DNA, 20 bp, Homo sapiens
cgaggaaaattttcttgctg

SEQ ID NO: 59087 - DNA, 16 bp, Homo sapiens
cgaggggacaccctgc

SEQ ID NO: 59088 - DNA, 23 bp, Homo sapiens
ggggggtggccatagccctgctg

SEQ ID NO: 59089 - DNA, 15 bp, Homo sapiens
cgggagtggccctgc

SEQ ID NO: 59090 - DNA, 21 bp, Homo sapiens
caaggagagttctgcctgctg

SEQ ID NO: 59091 - DNA, 22 bp, Homo sapiens
cgaggagagacatgttctgctg

SEQ ID NO: 59092 - DNA, 20 bp, Homo sapiens
ggggactgctggagcagctg

SEQ ID NO: 59093 - DNA, 23 bp, Homo sapiens
gaggagaaacaactgtcttgctg

SEQ ID NO: 59094 - DNA, 21 bp, Homo sapiens
cggggaaaactgcaaatgctg

SEQ ID NO: 59095 - DNA, 18 bp, Homo sapiens
ccaggacctggccctgct

SEQ ID NO: 59096 - DNA, 22 bp, Homo sapiens
cgaggggggagcagccctgctg

SEQ ID NO: 59097 - DNA, 18 bp, Homo sapiens
ggagatgctggtcttgct

SEQ ID NO: 59098 - DNA, 18 bp, Homo sapiens
caagggaagctggccctg

SEQ ID NO: 59099 - DNA, 18 bp, Homo sapiens
gagcagaatgtctttgct

SEQ ID NO: 59100 - DNA, 20 bp, Homo sapiens
aaggggattcagccctgctg

SEQ ID NO: 59101 - DNA, 21 bp, Homo sapiens
gagggaatgagctccctgctg

SEQ ID NO: 59102 - DNA, 22 bp, Homo sapiens
gacggagctgctggttctgctg

SEQ ID NO: 59103 - DNA, 18 bp, Homo sapiens
gaggagaatggctcagct

SEQ ID NO: 59104 - DNA, 18 bp, Homo sapiens
gggaccccttccctgctg

SEQ ID NO: 59105 - DNA, 18 bp, Homo sapiens
gaggagctggtggccctg

SEQ ID NO: 59106 - DNA, 20 bp, Homo sapiens
gaggagtccttgccctgctg

SEQ ID NO: 59107 - DNA, 20 bp, Homo sapiens
gggggggcacagccctgctg

SEQ ID NO: 59108 - DNA, 18 bp, Homo sapiens
gagaattcagccctgctg

SEQ ID NO: 59109 - DNA, 22 bp, Homo sapiens
aaggagaacttaaactttgctg

SEQ ID NO: 59110 - DNA, 21 bp, Homo sapiens
gaagagaagaatgttctgctg

SEQ ID NO: 59111 - DNA, 17 bp, Homo sapiens
gagggtgaggccctgct

SEQ ID NO: 59112 - DNA, 60 bp, Human adenovirus D
ctcgtcgcttgacagcaccgccgcagccgcggcagccgcagccgccatgacagcgacgag

SEQ ID NO: 59113 - DNA, 24 bp, Human adenovirus D
cagccgcagccgccatgacagcga

SEQ ID NO: 59114 - DNA, 17 bp, Homo sapiens
accgcagccgccccgcg

SEQ ID NO: 59115 - DNA, 22 bp, Homo sapiens
cagccgcggctgcaggggagag

SEQ ID NO: 59116 - DNA, 18 bp, Homo sapiens
cagccgcagcctccggac

SEQ ID NO: 59117 - DNA, 21 bp, Homo sapiens
cagccgccgccgccgttacag

SEQ ID NO: 59118 - DNA, 20 bp, Homo sapiens
agccacagccagcagcagcg

SEQ ID NO: 59119 - DNA, 19 bp, Homo sapiens
cagccgcaagcgggtagcg

SEQ ID NO: 59120 - DNA, 23 bp, Homo sapiens
cagccgcagccagggaagtggcg

SEQ ID NO: 59121 - DNA, 21 bp, Homo sapiens
accgcagccgccgccgccgcg

SEQ ID NO: 59122 - DNA, 20 bp, Homo sapiens
gccgcagccgctgccgttcg

SEQ ID NO: 59123 - DNA, 19 bp, Homo sapiens
cagtgcagccgccgacccg

SEQ ID NO: 59124 - DNA, 19 bp, Homo sapiens
gcagcggcggcgacagcga

SEQ ID NO: 59125 - DNA, 20 bp, Homo sapiens
cagccgccgccgccgtggcg

SEQ ID NO: 59126 - DNA, 23 bp, Homo sapiens
cagccccagccaccctgacggcg

SEQ ID NO: 59127 - DNA, 21 bp, Homo sapiens
gctgcagccgccagcacccga

SEQ ID NO: 59128 - DNA, 21 bp, Homo sapiens
agccgcagcctggggcagtga

SEQ ID NO: 59129 - DNA, 18 bp, Homo sapiens
cagccacagcggcagtga

SEQ ID NO: 59130 - DNA, 19 bp, Homo sapiens
cagccgcagccgctgctga

SEQ ID NO: 59131 - DNA, 20 bp, Homo sapiens
cagccgcggcggtcgcggcg

SEQ ID NO: 59132 - DNA, 17 bp, Homo sapiens
cagccgcggccgccgcg

SEQ ID NO: 59133 - DNA, 23 bp, Homo sapiens
cagccgccgccgccgccgccgcg

SEQ ID NO: 59134 - DNA, 19 bp, Homo sapiens
gccgcagccgctgacccga

SEQ ID NO: 59135 - DNA, 20 bp, Homo sapiens
cagcagcagctgtagaagcg

SEQ ID NO: 59136 - DNA, 24 bp, Homo sapiens
cagccgccgccgccgctgctgcga

SEQ ID NO: 59137 - DNA, 19 bp, Homo sapiens
gctgcagccgctatcccag

SEQ ID NO: 59138 - DNA, 22 bp, Homo sapiens
cagccgcagccgcaggacccga

SEQ ID NO: 59139 - DNA, 23 bp, Homo sapiens
cagccgccgccgccgccccgcga

SEQ ID NO: 59140 - DNA, 19 bp, Homo sapiens
cagccgccgccgccgtcgc

SEQ ID NO: 59141 - DNA, 19 bp, Homo sapiens
cagccccagctgccaccac

SEQ ID NO: 59142 - DNA, 16 bp, Homo sapiens
cagccgccgccgccgc

SEQ ID NO: 59143 - DNA, 19 bp, Homo sapiens
gcggcggcggcgacagcga

SEQ ID NO: 59144 - DNA, 22 bp, Homo sapiens
cagctccggctcccaacagcga

SEQ ID NO: 59145 - DNA, 18 bp, Homo sapiens
cagccgcagccctaacga

SEQ ID NO: 59146 - DNA, 19 bp, Homo sapiens
cagctgcagccgccgtcgc

SEQ ID NO: 59147 - DNA, 18 bp, Homo sapiens
gccgcagccgccgccgcg

SEQ ID NO: 59148 - DNA, 19 bp, Homo sapiens
cagccgcaacctaacggcg

SEQ ID NO: 59149 - DNA, 19 bp, Homo sapiens
cagccgcgcctgctggagc

SEQ ID NO: 59150 - DNA, 16 bp, Homo sapiens
gccgcagctgacagcg

SEQ ID NO: 59151 - DNA, 19 bp, Homo sapiens
gcagccactggcatggcag

SEQ ID NO: 59152 - DNA, 21 bp, Homo sapiens
cagccgcggatgctggcccga

SEQ ID NO: 59153 - DNA, 22 bp, Homo sapiens
cagccgcaaggactggcagtga

SEQ ID NO: 59154 - DNA, 23 bp, Homo sapiens
cagccgccgccgccgccacagcg

SEQ ID NO: 59155 - DNA, 19 bp, Homo sapiens
gcagccgccgtaaatccga

SEQ ID NO: 59156 - DNA, 19 bp, Homo sapiens
cagacgcagcgcgacagcg

SEQ ID NO: 59157 - DNA, 18 bp, Homo sapiens
gccgcagcacaggcagcg

SEQ ID NO: 59158 - DNA, 24 bp, Homo sapiens
cagccgctgggacagtgacagcga

SEQ ID NO: 59159 - DNA, 22 bp, Homo sapiens
gccgcagccgctgggacagtga

SEQ ID NO: 59160 - DNA, 19 bp, Homo sapiens
gccgcggctgctctggcga

SEQ ID NO: 59161 - DNA, 22 bp, Homo sapiens
cagccgcagaaactggcagtga

SEQ ID NO: 59162 - DNA, 20 bp, Homo sapiens
gccgcagctcccacctctga

SEQ ID NO: 59163 - DNA, 18 bp, Homo sapiens
actcgcagccgccgcgcg

SEQ ID NO: 59164 - DNA, 21 bp, Homo sapiens
gccgcagctccggtgtccgcg

SEQ ID NO: 59165 - DNA, 21 bp, Homo sapiens
cagcggcagccgctgggcatg

SEQ ID NO: 59166 - DNA, 26 bp, Homo sapiens
cagccccagccgccacagctacagcg

SEQ ID NO: 59167 - DNA, 20 bp, Homo sapiens
cagccgccgccgccgccgcg

SEQ ID NO: 59168 - DNA, 18 bp, Homo sapiens
gcccgcagccgccgctga

SEQ ID NO: 59169 - DNA, 22 bp, Homo sapiens
cagctgccgccgcctccctgcg

SEQ ID NO: 59170 - DNA, 22 bp, Homo sapiens
cagccgcatccccccggcggcg

SEQ ID NO: 59171 - DNA, 16 bp, Homo sapiens
cagccgccgccgcagc

SEQ ID NO: 59172 - DNA, 19 bp, Homo sapiens
gccgcagcagccctggcga

SEQ ID NO: 59173 - DNA, 18 bp, Homo sapiens
cagccgcgctgcgcggcg

SEQ ID NO: 59174 - DNA, 16 bp, Homo sapiens
cagcggcagccacgcg

SEQ ID NO: 59175 - DNA, 20 bp, Homo sapiens
gcccggccgccacctagtga

SEQ ID NO: 59176 - DNA, 19 bp, Homo sapiens
gccgcagccgccgccatcg

SEQ ID NO: 59177 - DNA, 24 bp, Homo sapiens
cagccgcagcccgccttcaaagcg

SEQ ID NO: 59178 - DNA, 24 bp, Homo sapiens
cagccgcagccccgggcccgggcg

SEQ ID NO: 59179 - DNA, 18 bp, Homo sapiens
gctgccgccgccatagcg

SEQ ID NO: 59180 - DNA, 22 bp, Homo sapiens
cagccgcggctggctatcgcga

SEQ ID NO: 59181 - DNA, 19 bp, Homo sapiens
gcagcgacagtgacagcga

SEQ ID NO: 59182 - DNA, 20 bp, Homo sapiens
cagctgcagccgctgctgcg

SEQ ID NO: 59183 - DNA, 19 bp, Homo sapiens
cagcgcaacggtgacagcg

SEQ ID NO: 59184 - DNA, 25 bp, Homo sapiens
cagccacagctgaagccagtggcga

SEQ ID NO: 59185 - DNA, 21 bp, Homo sapiens
gccgcagccgcggctgcagcg

SEQ ID NO: 59186 - DNA, 16 bp, Homo sapiens
gccgcagcccacagcg

SEQ ID NO: 59187 - DNA, 19 bp, Homo sapiens
gctgcgcgtccaacagcga

SEQ ID NO: 59188 - DNA, 22 bp, Homo sapiens
gccatgtcctgtcatgacagcg

SEQ ID NO: 59189 - DNA, 20 bp, Homo sapiens
cagccgctgcgctggtagcg

SEQ ID NO: 59190 - DNA, 19 bp, Homo sapiens
cagccgcagtccgcgggcg

SEQ ID NO: 59191 - DNA, 21 bp, Homo sapiens
cagccgcggccgccacgctcg

SEQ ID NO: 59192 - DNA, 20 bp, Homo sapiens
cagccgcggctgctgctgca

SEQ ID NO: 59193 - DNA, 20 bp, Homo sapiens
agccgcagcagaagacagcg

SEQ ID NO: 59194 - DNA, 23 bp, Homo sapiens
cagccgcagttccactgctgcga

SEQ ID NO: 59195 - DNA, 21 bp, Homo sapiens
cagccgggcccactgcggcga

SEQ ID NO: 59196 - DNA, 19 bp, Homo sapiens
cagctgcagccgcagcacg

SEQ ID NO: 59197 - DNA, 22 bp, Homo sapiens
cagccgcgggcgtcgcgcgcga

SEQ ID NO: 59198 - DNA, 70 bp, Camelpox virus
gggacagaccagacctaggagctattctaccatagcagaacttaggcatggacatactaatatctgtctt

SEQ ID NO: 59199 - DNA, 24 bp, Camelpox virus
aggcatggacatactaatatctgt

SEQ ID NO: 59200 - DNA, 16 bp, Homo sapiens
aggcatgacatatact

SEQ ID NO: 59201 - DNA, 23 bp, Homo sapiens
agggagactatactaatgtttgt

SEQ ID NO: 59202 - DNA, 90 bp, Alcelaphine herpesvirus 1
acaggccgggttttaaaacttactcaggggaattgttttttttagttctgtgaggatctaactctaagttgacacataaattaggcctgt

SEQ ID NO: 59203 - DNA, 24 bp, Alcelaphine herpesvirus 1
tgtgaggatctaactctaagttga

SEQ ID NO: 59204 - DNA, 20 bp, Homo sapiens
tgtggagcagctctaagttg

SEQ ID NO: 59205 - DNA, 18 bp, Homo sapiens
tgtaagaattttaagttg

SEQ ID NO: 59206 - DNA, 22 bp, Homo sapiens
tgtgaagatggccactgggttg

SEQ ID NO: 59207 - DNA, 21 bp, Homo sapiens
tgaggcctgggttctaggttg

SEQ ID NO: 59208 - DNA, 19 bp, Homo sapiens
tgttaggatgactaagttg

SEQ ID NO: 59209 - DNA, 23 bp, Homo sapiens
tgtgaggaatttaattcacttga

SEQ ID NO: 59210 - DNA, 21 bp, Homo sapiens
tgtgaggatcagctccgtctg

SEQ ID NO: 59211 - DNA, 22 bp, Homo sapiens
tgtacataaaattctaagttga

SEQ ID NO: 59212 - DNA, 66 bp, Rhopalosiphum padi virus
attagagaaccacgtaattgggtcaacccgttaataccggtccaccaagccctggaaatctctagt

SEQ ID NO: 59213 - DNA, 24 bp, Rhopalosiphum padi virus
tccaccaagccctggaaatctcta

SEQ ID NO: 59214 - DNA, 20 bp, Homo sapiens
tccaccagtccctggaaccc

SEQ ID NO: 59215 - DNA, 21 bp, Homo sapiens
cctgccgagctctggagccct

SEQ ID NO: 59216 - DNA, 17 bp, Homo sapiens
aaaccctggaagctcta

SEQ ID NO: 59217 - DNA, 16 bp, Homo sapiens
ccaccaagaaatctct

SEQ ID NO: 59218 - DNA, 21 bp, Homo sapiens
tccaccatggaggaaatctct

SEQ ID NO: 59219 - DNA, 22 bp, Homo sapiens
ccagccctgaccaagatttcta

SEQ ID NO: 59220 - DNA, 20 bp, Homo sapiens
tccatcaaaccctggcacct

SEQ ID NO: 59221 - DNA, 21 bp, Homo sapiens
tccgcagagtcctggaaaact

SEQ ID NO: 59222 - DNA, 21 bp, Homo sapiens
tccctcgggccctggaagtcc

SEQ ID NO: 59223 - DNA, 18 bp, Homo sapiens
tccaccaagcgctggaaa

SEQ ID NO: 59224 - DNA, 20 bp, Homo sapiens
tccaccaagcagaagtttct

SEQ ID NO: 59225 - DNA, 19 bp, Homo sapiens
tccaccaagctctgtgtcc

SEQ ID NO: 59226 - DNA, 19 bp, Homo sapiens
tccaccaaggccctggaaa

SEQ ID NO: 59227 - DNA, 19 bp, Homo sapiens
ccaccaagcctgactctct

SEQ ID NO: 59228 - DNA, 23 bp, Homo sapiens
tccactagttctggttcattcta

SEQ ID NO: 59229 - DNA, 16 bp, Homo sapiens
caagccctggagctct

SEQ ID NO: 59230 - DNA, 19 bp, Homo sapiens
cacaggccttgagaaatct

SEQ ID NO: 59231 - DNA, 18 bp, Homo sapiens
ccaccaagccttttctct

SEQ ID NO: 59232 - DNA, 18 bp, Homo sapiens
cctgctatggaaatctct

SEQ ID NO: 59233 - DNA, 21 bp, Homo sapiens
tctgccaggccctggagacct

SEQ ID NO: 59234 - DNA, 15 bp, Homo sapiens
caccagccctgatct

SEQ ID NO: 59235 - DNA, 19 bp, Homo sapiens
ccagggcctggaatctcta

SEQ ID NO: 59236 - DNA, 18 bp, Homo sapiens
tctacctggccctggtct

SEQ ID NO: 59237 - DNA, 22 bp, Homo sapiens
caccaagccattcaaatttcta

SEQ ID NO: 59238 - DNA, 17 bp, Homo sapiens
ccacctgggcaatctct

SEQ ID NO: 59239 - DNA, 19 bp, Homo sapiens
tctgccaagcccagcctct

SEQ ID NO: 59240 - DNA, 25 bp, Homo sapiens
tctgccaagcccctccgcagtctct

SEQ ID NO: 59241 - DNA, 20 bp, Homo sapiens
tccattaagaagaaatctct

SEQ ID NO: 59242 - DNA, 22 bp, Homo sapiens
tctgccaggctctgaaccccta

SEQ ID NO: 59243 - DNA, 24 bp, Homo sapiens
tccacggagccctgagccaagtct

SEQ ID NO: 59244 - DNA, 18 bp, Homo sapiens
cctgccaagcccaagtct

SEQ ID NO: 59245 - DNA, 18 bp, Homo sapiens
tcctgggccctggaccct

SEQ ID NO: 59246 - DNA, 19 bp, Homo sapiens
tctactaaaccccgtctct

SEQ ID NO: 59247 - DNA, 20 bp, Homo sapiens
ccaagccctgggttgttcta

SEQ ID NO: 59248 - DNA, 106 bp, Rhopalosiphum padi virus
gatgttaaatattattagtctcattaacaaaccacgcaactatgtcaacccgctaataccggtctaataggccctggaaattgttaataaataatattgtaacatc

SEQ ID NO: 59249 - DNA, 24 bp, Rhopalosiphum padi virus
taataggccctggaaattgttaat

SEQ ID NO: 59250 - DNA, 18 bp, Homo sapiens
aggcttgaatttgttaat

SEQ ID NO: 59251 - DNA, 15 bp, Homo sapiens
ataagcccagttgtt

SEQ ID NO: 59252 - DNA, 18 bp, Homo sapiens
aacagggggaaattgtta

SEQ ID NO: 59253 - DNA, 18 bp, Homo sapiens
aggtcctggaaactgcca

SEQ ID NO: 59254 - DNA, 20 bp, Homo sapiens
ataggtcctggaaatgagct

SEQ ID NO: 59255 - DNA, 15 bp, Homo sapiens
taggccctgatgtta

SEQ ID NO: 59256 - DNA, 101 bp, Rhopalosiphum padi virus
catatatatgtaatagtctcatcactaacccacgcaactgtgtcaatccgttaataccggtccaacaggccctggaaattagtggcaataacatatatatg

SEQ ID NO: 59257 - DNA, 24 bp, Rhopalosiphum padi virus
tatgtaatagtctcatcactaacc

SEQ ID NO: 59258 - DNA, 24 bp, Homo sapiens
tatgtaataatcttcatcatagcc

SEQ ID NO: 59259 - DNA, 19 bp, Homo sapiens
catgtaacctcatcattaa

SEQ ID NO: 59260 - DNA, 21 bp, Homo sapiens
tatataattaaacacatcact

SEQ ID NO: 59261 - DNA, 21 bp, Homo sapiens
tgtaatagtcacaaagacact

SEQ ID NO: 59262 - DNA, 23 bp, Homo sapiens
catgtaataaataatcgctagcc

SEQ ID NO: 59263 - DNA, 20 bp, Homo sapiens
atgaacatcttatcactaac

SEQ ID NO: 59264 - DNA, 20 bp, Homo sapiens
atgtacagttgtcactgacc

SEQ ID NO: 59265 - DNA, 76 bp, Vaccinia virus
ccgcttctatttactcccgcagcacaatgaaccaacacgggctcgtttcgttgatcacatttagataaaaaggcgg

SEQ ID NO: 59266 - DNA, 76 bp, Vaccinia virus; identical to SEQ ID NO: 59265

SEQ ID NO: 59267 - DNA, 20 bp, Homo sapiens
cgtggctggggccaacacgg

SEQ ID NO: 59268 - DNA, 17 bp, Homo sapiens
cagtcaaaaccaacacg

SEQ ID NO: 59269 - DNA, 17 bp, Homo sapiens
cacagcacaaagacacg

SEQ ID NO: 59270 - DNA, 15 bp, Homo sapiens
gcagcacaccaacag

SEQ ID NO: 59271 - DNA, 21 bp, Homo sapiens
ccgctgcggccgccaacacgg

SEQ ID NO: 59272 - DNA, 16 bp, Homo sapiens
gcagcacaccaacacg

SEQ ID NO: 59273 - DNA, 19 bp, Homo sapiens
gcagcacaggaaaacgcgg

SEQ ID NO: 59274 - DNA, 22 bp, Homo sapiens
gcacaatgtagcactaacatgg

SEQ ID NO: 59275 - DNA, 20 bp, Homo sapiens
cctagccaaggccaacacgg

SEQ ID NO: 59276 - DNA, 16 bp, Homo sapiens
gcagcacaagacacac

SEQ ID NO: 59277 - DNA, 21 bp, Homo sapiens
ccgcagcacagtgaagggtgg

SEQ ID NO: 59278 - DNA, 18 bp, Homo sapiens
ccggtggcaaccaacacg

SEQ ID NO: 59279 - DNA, 16 bp, Homo sapiens
cagtacaatcaacacg

SEQ ID NO: 59280 - DNA, 78 bp, Vaccinia virus
gttaggcaatgtatatttatccatcgtcaaatttaaaacatatttgaacttaacttcagatgatggtgcatccatagc

SEQ ID NO: 59281 - DNA, 24 bp, Vaccinia virus
caatgtatatttatccatcgtcaa

SEQ ID NO: 59282 - DNA, 24 bp, Homo sapiens
tgatgtttatttatcaaatgtcaa

SEQ ID NO: 59283 - DNA, 23 bp, Homo sapiens
caatgtatagttatcataaatca

SEQ ID NO: 59284 - DNA, 18 bp, Homo sapiens
tgatgtatatttgaccac

SEQ ID NO: 59285 - DNA, 16 bp, Homo sapiens
aatgtatccccatcgt

SEQ ID NO: 59286 - DNA, 20 bp, Homo sapiens
caatgtatgttgatcccacc

SEQ ID NO: 59287 - DNA, 22 bp, Homo sapiens
aatgtacatttatttttttcaa

SEQ ID NO: 59288 - DNA, 91 bp, Camelpox virus
atatttttctataatctgtcttttaaacgatggattttccacaaatgcgcctctcaagtccctcatagaatgatacacgtataaaaaatat

SEQ ID NO: 59289 - DNA, 24 bp, Camelpox virus
tccctcatagaatgatacacgtat

SEQ ID NO: 59290 - DNA, 22 bp, Homo sapiens
tctctctgctgtgcatacacgt

SEQ ID NO: 59291 - DNA, 22 bp, Homo sapiens
tcattctccatgatacacgtat

SEQ ID NO: 59292 - DNA, 19 bp, Homo sapiens
catagtctcatacacgtat

SEQ ID NO: 59293 - DNA, 20 bp, Homo sapiens
tctcccatagatgcccatgt

SEQ ID NO: 59294 - DNA, 19 bp, Homo sapiens
tcatggatatgatacccgt

SEQ ID NO: 59295 - DNA, 22 bp, Homo sapiens
tccctcacacctgcctatacgt

SEQ ID NO: 59296 - DNA, 21 bp, Homo sapiens
tccctcacagaatgaggccgt

SEQ ID NO: 59297 - DNA, 18 bp, Homo sapiens
ctcttaaaggatgataca

SEQ ID NO: 59298 - DNA, 19 bp, Homo sapiens
tcatagaatgcactgtcgt

SEQ ID NO: 59299 - DNA, 76 bp, Camelpox virus
ccgcttctatttactcccgcagcacaatgaaccaacacgggctcgtttcgttgatcacatttagataagaaggcgg

SEQ ID NO: 59300 - DNA, 76 bp, Ectromelia virus
ccgcttctatttactcccgcagcacaatgaaccaacacaggctcgttttgttgatcacatttagataaaaaggcgg

SEQ ID NO: 59301 - DNA, 24 bp, Ectromelia virus
ccgcagcacaatgaaccaacacag

SEQ ID NO: 59302 - DNA, 16 bp, Homo sapiens
cagtcaaaaccaacac

SEQ ID NO: 59303 - DNA, 16 bp, Homo sapiens
cacagcacaaagacac

SEQ ID NO: 59304 - DNA, 22 bp, Homo sapiens
ccgcagcaggcacgaggtacag

SEQ ID NO: 59305 - DNA, 19 bp, Homo sapiens
ccgcagcacaacgggacca

SEQ ID NO: 59306 - DNA, 20 bp, Homo sapiens
gcaggaatgagccagtgcag

SEQ ID NO: 59307 - DNA, 22 bp, Homo sapiens
gcagcacagcccagcaatacag

SEQ ID NO: 59308 - DNA, 17 bp, Homo sapiens
acacaattacaacacag

SEQ ID NO: 59309 - DNA, 23 bp, Homo sapiens
ccacagcaatttcaccaacacag

SEQ ID NO: 59310 - DNA, 23 bp, Homo sapiens
cacagcacaaatcctcagcacag

SEQ ID NO: 59311 - DNA, 24 bp, Homo sapiens
ccgcagcacagtgtggttcctcag

SEQ ID NO: 59312 - DNA, 20 bp, Homo sapiens
gcagcacaaggacaatacca

SEQ ID NO: 59313 - DNA, 18 bp, Homo sapiens
cacagcacagaaaacaca

SEQ ID NO: 59314 - DNA, 15 bp, Homo sapiens
gcagcacaccaacac

SEQ ID NO: 59315 - DNA, 20 bp, Homo sapiens
gcagcacatggccattgcag

SEQ ID NO: 59316 - DNA, 17 bp, Homo sapiens
cctagtgcaccaacaca

SEQ ID NO: 59317 - DNA, 18 bp, Homo sapiens
acagtacaatgaaataca

SEQ ID NO: 59318 - DNA, 23 bp, Homo sapiens
ccacagcaatgctgtcagcacag

SEQ ID NO: 59319 - DNA, 18 bp, Homo sapiens
cagccactgaaaccaaca

SEQ ID NO: 59320 - DNA, 24 bp, Homo sapiens
ccacagcacaaacacgtggcacag

SEQ ID NO: 59321 - DNA, 17 bp, Homo sapiens
gcacagagacaacacag

SEQ ID NO: 59322 - DNA, 16 bp, Homo sapiens
ccgcagcactgagcac

SEQ ID NO: 59323 - DNA, 19 bp, Homo sapiens
ccccagctcagtcaacaca

SEQ ID NO: 59324 - DNA, 18 bp, Homo sapiens
gcacaatgcctggcacag

SEQ ID NO: 59325 - DNA, 22 bp, Homo sapiens
ccccagcaatgaactgacacag

SEQ ID NO: 59326 - DNA, 23 bp, Homo sapiens
gcagcacactgggaagagcacag

SEQ ID NO: 59327 - DNA, 74 bp, Monkeypox virus
cgcttctatttactcccgcaacacaatgaaccaacacgggctcgtttcgttgatcacatttagataagaaggcg

SEQ ID NO: 59328 - DNA, 24 bp, Monkeypox virus
tcccgcaacacaatgaaccaacac

SEQ ID NO: 59329 - DNA, 17 bp, Homo sapiens
caacatgacaccaacac

SEQ ID NO: 59330 - DNA, 19 bp, Homo sapiens
tcccgcaaacggtgaaaac

SEQ ID NO: 59331 - DNA, 21 bp, Homo sapiens
tcccacaatgcaatgcttcac

SEQ ID NO: 59332 - DNA, 19 bp, Homo sapiens
tcccgaacacaattctaca

SEQ ID NO: 59333 - DNA, 15 bp, Homo sapiens
tcccgcaacagaaac

SEQ ID NO: 59334 - DNA, 22 bp, Homo sapiens
tcttcaaccacctgaccaacac

SEQ ID NO: 59335 - DNA, 22 bp, Homo sapiens
ccccccagcaatgaactgacac

SEQ ID NO: 59336 - DNA, 130 bp, Variola virus
acggtagaattgataatataaatatgagcattagtatttctgtggattaatagatttctagtatgggatcattaatcatttctaatctctaaatacctcataaaacaaaaaagctattatcaaatactgt

SEQ ID NO: 59337 - DNA, 24 bp, Variola virus
tacctcataaaacaaaaaagctat

SEQ ID NO: 59338 - DNA, 18 bp, Homo sapiens
tacctcataacagtaaac

SEQ ID NO: 59339 - DNA, 22 bp, Homo sapiens
tacctgtaaaacaaaggacagc

SEQ ID NO: 59340 - DNA, 19 bp, Homo sapiens
taccttgttaaaacaaaaa

SEQ ID NO: 59341 - DNA, 19 bp, Homo sapiens
tcataaattcaaaagctat

SEQ ID NO: 59342 - DNA, 23 bp, Homo sapiens
taccatcatcttgggaaagctat

SEQ ID NO: 59343 - DNA, 23 bp, Homo sapiens
tacctcaaaaaaatccaggctat

SEQ ID NO: 59344 - DNA, 17 bp, Homo sapiens
ctcagaaaacaaaggct

SEQ ID NO: 59345 - DNA, 16 bp, Homo sapiens
cacctccagaaaagct

SEQ ID NO: 59346 - DNA, 20 bp, Homo sapiens
acctcataagcaagggggct

SEQ ID NO: 59347 - DNA, 21 bp, Homo sapiens
tacctcatgggaacagaagct

SEQ ID NO: 59348 - DNA, 21 bp, Homo sapiens
tcacaaaacaataatggctat

SEQ ID NO: 59349 - DNA, 23 bp, Homo sapiens
acttcataaaacaacagacagct

SEQ ID NO: 59350 - DNA, 16 bp, Homo sapiens
cacctctaaaaaagct

SEQ ID NO: 59351 - DNA, 18 bp, Homo sapiens
cccataaggaaaaaagct

SEQ ID NO: 59352 - DNA, 18 bp, Homo sapiens
tcataaaaccaaagaact

SEQ ID NO: 59353 - DNA, 20 bp, Homo sapiens
tacctctagaacaaaactac

SEQ ID NO: 59354 - DNA, 19 bp, Homo sapiens
tacctacataaaacaaaaa

SEQ ID NO: 59355 - DNA, 16 bp, Homo sapiens
cctcataaaacaggcc

SEQ ID NO: 59356 - DNA, 19 bp, Homo sapiens
cctcaaacaggaaagctat

SEQ ID NO: 59357 - DNA, 63 bp, Variola virus
attattagacgagttacaaactatttggatagacacatatgcgatcagatatttgctaataat

SEQ ID NO: 59358 - DNA, 24 bp, Variola virus
tgcgatcagatatttgctaataat

SEQ ID NO: 59359 - DNA, 22 bp, Homo sapiens
tgcgatcagagtatcttaaata

SEQ ID NO: 59360 - DNA, 76 bp, Y73 sarcoma virus
gcgggttcttgtattccgtgtgatagatggttggattgataatcgattggctggcatacggaatataggaggtcgc

SEQ ID NO: 59361 - DNA, 24 bp, Y73 sarcoma virus
ttggctggcatacggaatatagga

SEQ ID NO: 59362 - DNA, 18 bp, Homo sapiens
ttggctggatgcagtggg

SEQ ID NO: 59363 - DNA, 21 bp, Homo sapiens
ttggctggcgtagggagagga

SEQ ID NO: 59364 - DNA, 22 bp, Homo sapiens
ctggctggtatgacccatggga

SEQ ID NO: 59365 - DNA, 24 bp, Homo sapiens
ttggctggtagttggattatagga

SEQ ID NO: 59366 - DNA, 19 bp, Homo sapiens
ttagctggcgtggggtagg

SEQ ID NO: 59367 - DNA, 18 bp, Homo sapiens
ttggctgccaaatatagg

SEQ ID NO: 59368 - DNA, 19 bp, Homo sapiens
ttggctagtagaatgtagg

SEQ ID NO: 59369 - DNA, 18 bp, Homo sapiens
ttggctggggaatatagg

SEQ ID NO: 59370 - DNA, 18 bp, Homo sapiens
tggctggcctaatgtagg

SEQ ID NO: 59371 - DNA, 23 bp, Homo sapiens
ttggctggcacatggtggtggga

SEQ ID NO: 59372 - DNA, 69 bp, Y73 sarcoma virus
ctgaggggaccatagcatgtataggcgaaaagcggggcttcggttgtacgcggttaggagtcccctcag

SEQ ID NO: 59373 - DNA, 24 bp, Y73 sarcoma virus
tagcatgtataggcgaaaagcggg

SEQ ID NO: 59374 - DNA, 22 bp, Homo sapiens
tgtatgtggtgaggaaagcggg

SEQ ID NO: 59375 - DNA, 18 bp, Homo sapiens
acatgtattcaggagcgg

SEQ ID NO: 59376 - DNA, 18 bp, Homo sapiens
tagcatgtaaggtagtgg

SEQ ID NO: 59377 - DNA, 23 bp, Homo sapiens
tagcatgtatggcgctatttggg

SEQ ID NO: 59378 - DNA, 15 bp, Homo sapiens
atgtacaggaagcgg

SEQ ID NO: 59379 - DNA, 18 bp, Homo sapiens
acatgtacaaaaaagtgg

SEQ ID NO: 59380 - DNA, 66 bp, Equine infectious anemia virus
gggttttataaatgattataagagtaaaaagaaagttgctgatgctctcataaccttgtataaccc

SEQ ID NO: 59381 - DNA, 24 bp, Equine infectious anemia virus
taaatgattataagagtaaaaaga

SEQ ID NO: 59382 - DNA, 20 bp, Homo sapiens
aatgactccaagtaaaaaga

SEQ ID NO: 59383 - DNA, 22 bp, Homo sapiens
aatgatttaaaaatcaaaaaga

SEQ ID NO: 59384 - DNA, 18 bp, Homo sapiens
aatgacctacagagtaaa

SEQ ID NO: 59385 - DNA, 24 bp, Homo sapiens
taaatgatcatgaaaccaaaaaga

SEQ ID NO: 59386 - DNA, 25 bp, Homo sapiens
taaataattatcttgcgtaaagaga

SEQ ID NO: 59387 - DNA, 19 bp, Homo sapiens
gatacaggagagtaaaaag

SEQ ID NO: 59388 - DNA, 17 bp, Homo sapiens
tgactaagagtaaagag

SEQ ID NO: 59389 - DNA, 18 bp, Homo sapiens
tgatttaagagtaaggag

SEQ ID NO: 59390 - DNA, 18 bp, Homo sapiens
aatgattatagcacaaag

SEQ ID NO: 59391 - DNA, 21 bp, Homo sapiens
gaccacgtgagagtaaaaaga

SEQ ID NO: 59392 - DNA, 20 bp, Homo sapiens
aaatgattagagtaaaaaga

SEQ ID NO: 59393 - DNA, 19 bp, Homo sapiens
gattataaaagtctgaaga

SEQ ID NO: 59394 - DNA, 20 bp, Homo sapiens
attataagatgtcaaaaaga

SEQ ID NO: 59395 - DNA, 65 bp, Equine infectious anemia virus
ctcagtccctgtctctagtttgtctgttcgagatcctacagttggcgcccgaacagggacctgag

SEQ ID NO: 59396 - DNA, 24 bp, Equine infectious anemia virus
tccctgtctctagtttgtctgttc

SEQ ID NO: 59397 - DNA, 21 bp, Homo sapiens
tctctgtttttggcttgtctg

SEQ ID NO: 59398 - DNA, 20 bp, Homo sapiens
ccttgtttctagttcagttc

SEQ ID NO: 59399 - DNA, 18 bp, Homo sapiens
ctgtctctgggtcatgtt

SEQ ID NO: 59400 - DNA, 24 bp, Homo sapiens
tctctgtctctgtctctctctgtt

SEQ ID NO: 59401 - DNA, 22 bp, Homo sapiens
cctgtttctgtccagttttgtt

SEQ ID NO: 59402 - DNA, 20 bp, Homo sapiens
tgtttgttagtttgtctgtt

SEQ ID NO: 59403 - DNA, 16 bp, Homo sapiens
tcactgtctctgttgt

SEQ ID NO: 59404 - DNA, 23 bp, Homo sapiens
tccctgtcactggacacttttgt

SEQ ID NO: 59405 - DNA, 18 bp, Homo sapiens
tccttgtctgtaatttgt

SEQ ID NO: 59406 - DNA, 18 bp, Homo sapiens
tctctgctctggtttgtc

SEQ ID NO: 59407 - DNA, 22 bp, Homo sapiens
tcccatgtctggagtgtctgtt

SEQ ID NO: 59408 - DNA, 22 bp, Homo sapiens
tgtctgcagctgctgtttgttc

SEQ ID NO: 59409 - DNA, 23 bp, Homo sapiens
tccctgtcttggctagacctgtt

SEQ ID NO: 59410 - DNA, 16 bp, Homo sapiens
tgttctcttgtctgtt

SEQ ID NO: 59411 - DNA, 19 bp, Homo sapiens
tcttttaaaacgtctgttc

SEQ ID NO: 59412 - DNA, 17 bp, Homo sapiens
ccttacttttgtctgtt

SEQ ID NO: 59413 - DNA, 18 bp, Homo sapiens
ctctctctagttgatgtt

SEQ ID NO: 59414 - DNA, 19 bp, Homo sapiens
tccctgtcctgggtctgtt

SEQ ID NO: 59415 - DNA, 20 bp, Homo sapiens
ccgtctctgcacttctgttc

SEQ ID NO: 59416 - DNA, 18 bp, Homo sapiens
tctctctttctgcctgtt

SEQ ID NO: 59417 - DNA, 21 bp, Homo sapiens
tccctgtctccagggtttgtt

SEQ ID NO: 59418 - DNA, 23 bp, Homo sapiens
tccctgtctttgttcttaacgtt

SEQ ID NO: 59419 - DNA, 19 bp, Homo sapiens
tccttagtttttgcctgtt

SEQ ID NO: 59420 - DNA, 16 bp, Homo sapiens
tccctgtgtctgctgt

SEQ ID NO: 59421 - DNA, 22 bp, Homo sapiens
cctttctctaggtgatctgttc

SEQ ID NO: 59422 - DNA, 21 bp, Homo sapiens
cttctctaatcccttttgttc

SEQ ID NO: 59423 - DNA, 21 bp, Homo sapiens
ccaaatctagtttgtttgttc

SEQ ID NO: 59424 - DNA, 22 bp, Homo sapiens
atctttggtagtttgtttgttc

SEQ ID NO: 59425 - DNA, 22 bp, Homo sapiens
tccctgccgctttttgtttgtt

SEQ ID NO: 59426 - DNA, 16 bp, Homo sapiens
ccttcttctgtctgtt

SEQ ID NO: 59427 - DNA, 19 bp, Homo sapiens
tcccagtttctaaatttgt

SEQ ID NO: 59428 - DNA, 17 bp, Homo sapiens
tctttgctctagtttgt

SEQ ID NO: 59429 - DNA, 63 bp, Human papillomavirus type 29
tgtagctaaagctaaagcatgcagtgctattgaaatgcatgtagctttacaacaattgcaaca

SEQ ID NO: 59430 - DNA, 24 bp, Human papillomavirus type 29
gctaaagctaaagcatgcagtgct

SEQ ID NO: 59431 - DNA, 21 bp, Homo sapiens
gctggaggcaggtgcagtgct

SEQ ID NO: 59432 - DNA, 22 bp, Homo sapiens
gccagagctaaaatgtagtgct

SEQ ID NO: 59433 - DNA, 18 bp, Homo sapiens
agctaaagctgaagtgct

SEQ ID NO: 59434 - DNA, 22 bp, Homo sapiens
gcaaagctaattgcacggtgct

SEQ ID NO: 59435 - DNA, 22 bp, Homo sapiens
gctaggactgtcgggcagtgct

SEQ ID NO: 59436 - DNA, 24 bp, Homo sapiens
gctgagactaaagcagggatagtg

SEQ ID NO: 59437 - DNA, 22 bp, Homo sapiens
gctgtggctggacagcagtgct

SEQ ID NO: 59438 - DNA, 17 bp, Homo sapiens
gctaaattaaagcatac

SEQ ID NO: 59439 - DNA, 21 bp, Homo sapiens
gctggtagctgaggcagtgct

SEQ ID NO: 59440 - DNA, 21 bp, Homo sapiens
actaaagctaaggctggctgt

SEQ ID NO: 59441 - DNA, 24 bp, Homo sapiens
gctcgggctgagtgccgcagtgct

SEQ ID NO: 59442 - DNA, 22 bp, Homo sapiens
gcagaactgagtgtgcagtgct

SEQ ID NO: 59443 - DNA, 20 bp, Homo sapiens
gctaaagctaaagctataca

SEQ ID NO: 59444 - DNA, 19 bp, Homo sapiens
gctaaagctggacaacagc

SEQ ID NO: 59445 - DNA, 22 bp, Homo sapiens
gctgagctgaggcagcagtgct

SEQ ID NO: 59446 - DNA, 24 bp, Homo sapiens
gctggggcagaggcaggcagtgct

SEQ ID NO: 59447 - DNA, 65 bp, Bovine papillomavirus
gtttggggatgaaccatggtctttgcttgacacaagctgggaccgatatatgtcagaacctaaac

SEQ ID NO: 59448 - DNA, 17 bp, Bovine papillomavirus
tatgtcagaacctaaac

SEQ ID NO: 59449 - DNA, 18 bp, Homo sapiens
tatgtcaagggacctaaa

SEQ ID NO: 59450 - DNA, 18 bp, Homo sapiens
tatgtcaagtaaacctaa

SEQ ID NO: 59451 - DNA, 63 bp, Soil-borne cereal mosaic virus
acattatgcattgtggttttgttgtgtggtttgtttttgcttatattgctatgttgcatgtgt

SEQ ID NO: 59452 - DNA, 24 bp, Soil-borne cereal mosaic virus
tatgcattgtggttttgttgtgtg

SEQ ID NO: 59453 - DNA, 23 bp, Homo sapiens
tgcattgtgtgtgcacacgtgtg

SEQ ID NO: 59454 - DNA, 21 bp, Homo sapiens
tatgcgtgtgtggattgtgtg

SEQ ID NO: 59455 - DNA, 18 bp, Homo sapiens
tgcattgtgttttggaat

SEQ ID NO: 59456 - DNA, 20 bp, Homo sapiens
tgtgttgtggtgtgcatgtg

SEQ ID NO: 59457 - DNA, 19 bp, Homo sapiens
gcatgctttttgttgtgtg

SEQ ID NO: 59458 - DNA, 23 bp, Homo sapiens
tgcatttagttatttgttgtgtg

SEQ ID NO: 59459 - DNA, 19 bp, Homo sapiens
tgtgtgtatgtgttgtgtg

SEQ ID NO: 59460 - DNA, 21 bp, Homo sapiens
tgtgttgtggttggccttgtg

SEQ ID NO: 59461 - DNA, 21 bp, Homo sapiens
tgcgtgtgtgtgtgttgtgtg

SEQ ID NO: 59462 - DNA, 20 bp, Homo sapiens
tgcgttgtgcttttgttctg

SEQ ID NO: 59463 - DNA, 20 bp, Homo sapiens
cattctggttttgttgtgtg

SEQ ID NO: 59464 - DNA, 20 bp, Homo sapiens
tgtcattgtgatgttgtgtg

SEQ ID NO: 59465 - DNA, 79 bp, Soil-borne cereal mosaic virus
gcctatttgtacgggtcgagtacaaacgtggccatcacgatagatggttctgtttttcgaacagatgtaaatcggaggc

SEQ ID NO: 59466 - DNA, 24 bp, Soil-borne cereal mosaic virus
tacgggtcgagtacaaacgtggcc

SEQ ID NO: 59467 - DNA, 25 bp, Homo sapiens
cacgggtcccgcagcgggcgtggcc

SEQ ID NO: 59468 - DNA, 129 bp, Soil-borne cereal mosaic virus
catcacgatagatggttctgtttttcgaacagatgtaaatcggaggcgtcgtgcagtacggtaaactgcacatctatcctctagtttctattgatgtaattgaaaaaagatcaatattttacgatgatg

SEQ ID NO: 59469 - DNA, 24 bp, Soil-borne cereal mosaic virus
gttctgtttttcgaacagatgtaa

SEQ ID NO: 59470 - DNA, 21 bp, Homo sapiens
gttctattttcaagaggtgta

SEQ ID NO: 59471 - DNA, 25 bp, Homo sapiens
gttttgtttttccacatacatgtaa

SEQ ID NO: 59472 - DNA, 15 bp, Homo sapiens
gttctgttttgatgt

SEQ ID NO: 59473 - DNA, 24 bp, Homo sapiens
gttcttcagcaagaatagatgtaa

SEQ ID NO: 59474 - DNA, 21 bp, Homo sapiens
gttttgtttttcaccttatgt

SEQ ID NO: 59475 - DNA, 94 bp, Paramecium bursaria Chlorella virus 1
atacacagtacttgtaatttcttgaaacatctcctcgaatatggcattaactttctttttgtatttagagattacatcagttgacaccgtgtgt

SEQ ID NO: 59476 - DNA, 22 bp, Paramecium bursaria Chlorella virus 1
tacatcagttgacaccgtgtgt

SEQ ID NO: 59477 - DNA, 16 bp, Homo sapiens
tacatcagttagtctg

SEQ ID NO: 59478 - DNA, 17 bp, Homo sapiens
catcagtctacgtgtgt

SEQ ID NO: 59479 - DNA, 22 bp, Homo sapiens
tacagcagttgacaacagatgt

SEQ ID NO: 59480 - DNA, 18 bp, Homo sapiens
catcagctgagaatgtgt

SEQ ID NO: 59481 - DNA, 18 bp, Homo sapiens
catcagatgacaccacgt

SEQ ID NO: 59482 - DNA, 19 bp, Homo sapiens
tacattggttgcaccatgt

SEQ ID NO: 59483 - DNA, 19 bp, Homo sapiens
tacatcagttacatcacat

SEQ ID NO: 59484 - DNA, 16 bp, Homo sapiens
tcagttgaacttgtgt

SEQ ID NO: 59485 - DNA, 16 bp, Homo sapiens
tacaccaagctgtgtg

SEQ ID NO: 59486 - DNA, 20 bp, Homo sapiens
catcagctggtactgtctgt

SEQ ID NO: 59487 - DNA, 19 bp, Homo sapiens
tacatcagctggtttgtgt

SEQ ID NO: 59488 - DNA, 19 bp, Homo sapiens
catcagttagacattgcgc

SEQ ID NO: 59489 - DNA, 17 bp, Homo sapiens
catcagctggcatgtgt

SEQ ID NO: 59490 - DNA, 101 bp, Phocoena spinipinnis papillomavirus
tgttacgtcccactggcacatttaaaaaaaatggtaagagggttcttgtaacatttgatggggatgagagcaatctgatggaatatatgtgttgggaagca

SEQ ID NO: 59491 - DNA, 24 bp, Phocoena spinipinnis papillomavirus
tgagagcaatctgatggaatatat

SEQ ID NO: 59492 - DNA, 25 bp, Homo sapiens
tgagagaaatcttcctcagatatat

SEQ ID NO: 59493 - DNA, 16 bp, Homo sapiens
tgatagcatggaatat

SEQ ID NO: 59494 - DNA, 22 bp, Homo sapiens
tgagagcaaattgtacatatat

SEQ ID NO: 59495 - DNA, 18 bp, Homo sapiens
tgagagcaatcaggatga

SEQ ID NO: 59496 - DNA, 22 bp, Homo sapiens
tgaaggcaatctgtctgtatat

SEQ ID NO: 59497 - DNA, 23 bp, Homo sapiens
tgagggtcaatctctgaatatat

SEQ ID NO: 59498 - DNA, 21 bp, Homo sapiens
tgagagcagcctgggcaatat

SEQ ID NO: 59499 - DNA, 131 bp, Equine herpesvirus 4
gtttgctgcatgcacgcgacaaacacgagattgtgctcgatgaaggttagtcaacgatttatttggttataagcggggatagacgcgcattgatgctacatatgaattaactgcggcgtgttgggggttat

SEQ ID NO: 59500 - DNA, 24 bp, Equine herpesvirus 4
ttgctgcatgcacgcgacaaacac

SEQ ID NO: 59501 - DNA, 18 bp, Homo sapiens
catcacatgtgacaaaca

SEQ ID NO: 59502 - DNA, 22 bp, Homo sapiens
ctgttgcatgcagagagaacac

SEQ ID NO: 59503 - DNA, 23 bp, Homo sapiens
ttactgcatccacatgatagaca

SEQ ID NO: 59504 - DNA, 21 bp, Homo sapiens
ttgctgcaggtgctctcaaca

SEQ ID NO: 59505 - DNA, 20 bp, Homo sapiens
ttgctgcagtgactgggaca

SEQ ID NO: 59506 - DNA, 19 bp, Homo sapiens
ttgcttatgcacactgaca

SEQ ID NO: 59507 - DNA, 18 bp, Homo sapiens
ttgctgcatgggcgctca

SEQ ID NO: 59508 - DNA, 20 bp, Homo sapiens
ctgcgcgccacacgcgacaa

SEQ ID NO: 59509 - DNA, 23 bp, Homo sapiens
ttgctgcagagacagtggcggac

SEQ ID NO: 59510 - DNA, 19 bp, Homo sapiens
ttgctgcacgtattcaaca

SEQ ID NO: 59511 - DNA, 20 bp, Homo sapiens
ctgctgcatgcctgcagaca

SEQ ID NO: 59512 - DNA, 17 bp, Homo sapiens
ctgtatgaacacaaaca

SEQ ID NO: 59513 - DNA, 17 bp, Homo sapiens
tgttgcatgcacagaca

SEQ ID NO: 59514 - DNA, 19 bp, Homo sapiens
ctgccgcacgtggcagaca

SEQ ID NO: 59515 - DNA, 20 bp, Homo sapiens
ctgctgcatgcaacaggaca

SEQ ID NO: 59516 - DNA, 19 bp, Homo sapiens
ctgctgcatgcgtgcaaca

SEQ ID NO: 59517 - DNA, 60 bp, Equine herpesvirus 4
gcccaacggtgcccctttatcgccgtatgaatatgtgaagagcgataacagcacccacgc

SEQ ID NO: 59518 - DNA, 24 bp, Equine herpesvirus 4
caacggtgcccctttatcgccgta

SEQ ID NO: 59519 - DNA, 20 bp, Homo sapiens
caacggtgttcactcgccgt

SEQ ID NO: 59520 - DNA, 20 bp, Homo sapiens
actgtgcccccggggctgta

SEQ ID NO: 59521 - DNA, 20 bp, Homo sapiens
cagcggtgcctttattatca

SEQ ID NO: 59522 - DNA, 20 bp, Homo sapiens
tgacagtgccttctagctgt

SEQ ID NO: 59523 - DNA, 20 bp, Homo sapiens
cagtggtctctagcacctgt

SEQ ID NO: 59524 - DNA, 82 bp, Variola virus
taccgatatacagtataatgatttagttactttaataaccgttagacataaaattgattctatgaaaactgtgtttcaggta

SEQ ID NO: 59525 - DNA, 24 bp, Variola virus
tatacagtataatgatttagttac

SEQ ID NO: 59526 - DNA, 20 bp, Homo sapiens
tatacagtaaaacatagtta

SEQ ID NO: 59527 - DNA, 20 bp, Homo sapiens
tatacagtatacttgagtta

SEQ ID NO: 59528 - DNA, 21 bp, Homo sapiens
tatacagtaaaatgaaacatc

SEQ ID NO: 59529 - DNA, 20 bp, Homo sapiens
tatacagtatatgcggacct

SEQ ID NO: 59530 - DNA, 21 bp, Homo sapiens
tataagtatcaaatttagtta

SEQ ID NO: 59531 - DNA, 20 bp, Homo sapiens
tatacagtatatgatcctgt

SEQ ID NO: 59532 - DNA, 19 bp, Homo sapiens
tacagtatgtgaagaagtt

SEQ ID NO: 59533 - DNA, 18 bp, Homo sapiens
tacacagtataatggtca

SEQ ID NO: 59534 - DNA, 22 bp, Homo sapiens
tacagtataagataacatttac

SEQ ID NO: 59535 - DNA, 22 bp, Homo sapiens
tatgcagagaacaatttagtta

SEQ ID NO: 59536 - DNA, 21 bp, Homo sapiens
tacagtaacaatgtttagtta

SEQ ID NO: 59537 - DNA, 17 bp, Homo sapiens
atacagtataacagtta

SEQ ID NO: 59538 - DNA, 15 bp, Homo sapiens
cagcagatttagtta

SEQ ID NO: 59539 - DNA, 17 bp, Homo sapiens
tacagtataatccagtt

SEQ ID NO: 59540 - DNA, 18 bp, Homo sapiens
tatacagtaagttcagtt

SEQ ID NO: 59541 - DNA, 19 bp, Homo sapiens
gcccccatgatttagttac

SEQ ID NO: 59542 - DNA, 68 bp, Human herpesvirus 2
gggggggtgggcctcgtccccacgcagacccgcgggcaaatgcgagaacgggacccgcgcgcctgcct

SEQ ID NO: 59543 - DNA, 20 bp, Human herpesvirus 2
cgggacccgcgcgcctgcct

SEQ ID NO: 59544 - DNA, 20 bp, Homo sapiens
gggcccacacaagcttgcct

SEQ ID NO: 59545 - DNA, 17 bp, Homo sapiens
cgggaccgcgagtgcct

SEQ ID NO: 59546 - DNA, 18 bp, Homo sapiens
gggaccccctacctgcct

SEQ ID NO: 59547 - DNA, 19 bp, Homo sapiens
cgggacccgcccaccacgc

SEQ ID NO: 59548 - DNA, 17 bp, Homo sapiens
cgggaccctcgccgcct

SEQ ID NO: 59549 - DNA, 19 bp, Homo sapiens
cggtggcgcccgcctgcct

SEQ ID NO: 59550 - DNA, 18 bp, Homo sapiens
cggggccgccgcctgcct

SEQ ID NO: 59551 - DNA, 16 bp, Homo sapiens
ggacgcgcgcctgcct

SEQ ID NO: 59552 - DNA, 16 bp, Homo sapiens
ggatccgcgcccacct

SEQ ID NO: 59553 - DNA, 15 bp, Homo sapiens
caggacacgcctgcc

SEQ ID NO: 59554 - DNA, 20 bp, Homo sapiens
caggacccggattgctgcct

SEQ ID NO: 59555 - DNA, 18 bp, Homo sapiens
ggacccgcgccaccctgc

SEQ ID NO: 59556 - DNA, 19 bp, Homo sapiens
caggacccgcagagcgtct

SEQ ID NO: 59557 - DNA, 19 bp, Homo sapiens
cgggacccacacgctgcct

SEQ ID NO: 59558 - DNA, 20 bp, Homo sapiens
cgggcctccgtcgcctgcct

SEQ ID NO: 59559 - DNA, 20 bp, Homo sapiens
cgggacccgccagagtgtgc

SEQ ID NO: 59560 - DNA, 16 bp, Homo sapiens
cgggacccggcgctgc

SEQ ID NO: 59561 - DNA, 17 bp, Homo sapiens
cgggccccgcgcggcct

SEQ ID NO: 59562 - DNA, 19 bp, Homo sapiens
cgcggcccgcgcggctcct

SEQ ID NO: 59563 - DNA, 20 bp, Homo sapiens
gggacccaggagtcctgcct

SEQ ID NO: 59564 - DNA, 20 bp, Homo sapiens
cggggtccgcgcccgcgccc

SEQ ID NO: 59565 - DNA, 21 bp, Homo sapiens
cggggcccgccatgcgcgcct

SEQ ID NO: 59566 - DNA, 17 bp, Homo sapiens
cagggcagtgcctgcct

SEQ ID NO: 59567 - DNA, 22 bp, Homo sapiens
ggggcccgcgcagccggcacct

SEQ ID NO: 59568 - DNA, 17 bp, Homo sapiens
ggggccacgcccagcct

SEQ ID NO: 59569 - DNA, 17 bp, Homo sapiens
cgggcccgcgcccgcct

SEQ ID NO: 59570 - DNA, 17 bp, Homo sapiens
cgcggcccgcccggcct

SEQ ID NO: 59571 - DNA, 18 bp, Homo sapiens
aggatgctgcgcctgcct

SEQ ID NO: 59572 - DNA, 19 bp, Homo sapiens
gggctccctacacctgcct

SEQ ID NO: 59573 - DNA, 16 bp, Homo sapiens
cggacgccgcctgcct

SEQ ID NO: 59574 - DNA, 19 bp, Homo sapiens
ggagcgccgccgcctgcct

SEQ ID NO: 59575 - DNA, 18 bp, Homo sapiens
cgggcccaccgcctgcct

SEQ ID NO: 59576 - DNA, 19 bp, Homo sapiens
gggggcactgcgcctgcct

SEQ ID NO: 59577 - DNA, 17 bp, Homo sapiens
caggacccagcctgtct

SEQ ID NO: 59578 - DNA, 16 bp, Homo sapiens
cgggacccgcggctgc

SEQ ID NO: 59579 - DNA, 19 bp, Homo sapiens
cgggaacccgcccgcgcct

SEQ ID NO: 59580 - DNA, 18 bp, Homo sapiens
cgggaccgcgcgcgccgc

SEQ ID NO: 59581 - DNA, 19 bp, Homo sapiens
gggacccagcacggggcct

SEQ ID NO: 59582 - DNA, 19 bp, Homo sapiens
cggcacctccagcctgcct

SEQ ID NO: 59583 - DNA, 20 bp, Homo sapiens
cggacctgcccccggcctgc

SEQ ID NO: 59584 - DNA, 18 bp, Homo sapiens
aggaggagccgcctgcct

SEQ ID NO: 59585 - DNA, 17 bp, Homo sapiens
gggaccctggcctgcct

SEQ ID NO: 59586 - DNA, 18 bp, Homo sapiens
cgggtcacccgcctgtct

SEQ ID NO: 59587 - DNA, 18 bp, Homo sapiens
gggacccctgacctgcct

SEQ ID NO: 59588 - DNA, 16 bp, Homo sapiens
aggactccacctgcct

SEQ ID NO: 59589 - DNA, 15 bp, Homo sapiens
gggcccggcctgcct

SEQ ID NO: 59590 - DNA, 18 bp, Homo sapiens
ggaatcccaccactgcct

SEQ ID NO: 59591 - DNA, 18 bp, Homo sapiens
gagccattgcgcctgcct

SEQ ID NO: 59592 - DNA, 17 bp, Homo sapiens
ggacctcgcacctgtct

SEQ ID NO: 59593 - DNA, 17 bp, Homo sapiens
aggaccccagcctgcct

SEQ ID NO: 59594 - DNA, 22 bp, Homo sapiens
cggcgcccgcgcgggggagcct

SEQ ID NO: 59595 - DNA, 18 bp, Homo sapiens
cggagccctcacctgcct

SEQ ID NO: 59596 - DNA, 16 bp, Homo sapiens
cgggaccccgcgtcgc

SEQ ID NO: 59597 - DNA, 16 bp, Homo sapiens
ggggccgcacctgcct

SEQ ID NO: 59598 - DNA, 21 bp, Homo sapiens
cggggcccgcccggatcacct

SEQ ID NO: 59599 - DNA, 18 bp, Homo sapiens
cggggcctgccctggcct

SEQ ID NO: 59600 - DNA, 18 bp, Homo sapiens
caggacagcagcctgcct

SEQ ID NO: 59601 - DNA, 20 bp, Homo sapiens
gggacccggctgcgcggcct

SEQ ID NO: 59602 - DNA, 17 bp, Homo sapiens
cagggcagggcctgcct

SEQ ID NO: 59603 - DNA, 17 bp, Homo sapiens
ggggcacccgcctgcct

SEQ ID NO: 59604 - DNA, 20 bp, Homo sapiens
gggacccggcacccctgcct

SEQ ID NO: 59605 - DNA, 17 bp, Homo sapiens
cgaggccacacctgcct

SEQ ID NO: 59606 - DNA, 21 bp, Homo sapiens
cgggaactcgcgccgctgcct

SEQ ID NO: 59607 - DNA, 16 bp, Homo sapiens
gggaccgtgcctgcct

SEQ ID NO: 59608 - DNA, 19 bp, Homo sapiens
gggacccagaagcatgcct

SEQ ID NO: 59609 - DNA, 20 bp, Homo sapiens
gggcacccgcagctgtctgc

SEQ ID NO: 59610 - DNA, 18 bp, Homo sapiens
gggtgcccagcactgcct

SEQ ID NO: 59611 - DNA, 19 bp, Homo sapiens
cgggctcccgcgcctgcct

SEQ ID NO: 59612 - DNA, 19 bp, Homo sapiens
gggccccgaaggcctgcct

SEQ ID NO: 59613 - DNA, 18 bp, Homo sapiens
ggaacggcgagcctgcct

SEQ ID NO: 59614 - DNA, 18 bp, Homo sapiens
cgggacccggcagtgcct

SEQ ID NO: 59615 - DNA, 16 bp, Homo sapiens
ggggcagcacctgcct

SEQ ID NO: 59616 - DNA, 19 bp, Homo sapiens
cgggatcccctgcctgcct

SEQ ID NO: 59617 - DNA, 20 bp, Homo sapiens
cgggaccctctcacacctgc

SEQ ID NO: 59618 - DNA, 19 bp, Homo sapiens
cgggacccgggacaggcct

SEQ ID NO: 59619 - DNA, 18 bp, Homo sapiens
gggccactcagcctgcct

SEQ ID NO: 59620 - DNA, 20 bp, Homo sapiens
gggacctgcagggcctgcct

SEQ ID NO: 59621 - DNA, 20 bp, Homo sapiens
gggacccaactgccctgcct

SEQ ID NO: 59622 - DNA, 17 bp, Homo sapiens
cggggcccgccctccct

SEQ ID NO: 59623 - DNA, 22 bp, Homo sapiens
ggggctggcccaccccctgcct

SEQ ID NO: 59624 - DNA, 16 bp, Homo sapiens
gggacactgcctgcct

SEQ ID NO: 59625 - DNA, 18 bp, Homo sapiens
cggggccgcgcgccccgc

SEQ ID NO: 59626 - DNA, 18 bp, Homo sapiens
cgggacccggcgtcccgc

SEQ ID NO: 59627 - DNA, 19 bp, Homo sapiens
ggaactgcagggcctgcct

SEQ ID NO: 59628 - DNA, 20 bp, Homo sapiens
caggacccccagctctgcct

SEQ ID NO: 59629 - DNA, 16 bp, Homo sapiens
ggacccgccgcagcct

SEQ ID NO: 59630 - DNA, 17 bp, Homo sapiens
cggggcacgacctgcct

SEQ ID NO: 59631 - DNA, 19 bp, Homo sapiens
cggtactcgccgtctgcct

SEQ ID NO: 59632 - DNA, 18 bp, Homo sapiens
caggacccgtcgcagcct

SEQ ID NO: 59633 - DNA, 18 bp, Homo sapiens
gggtacagctgcctgcct

SEQ ID NO: 59634 - DNA, 18 bp, Homo sapiens
ggggcccagcagccgcct

SEQ ID NO: 59635 - DNA, 18 bp, Homo sapiens
ggaacccagactctgtct

SEQ ID NO: 59636 - DNA, 18 bp, Homo sapiens
caggaccctcagctgcct

SEQ ID NO: 59637 - DNA, 17 bp, Homo sapiens
cgggggctcgcctgcct

SEQ ID NO: 59638 - DNA, 18 bp, Homo sapiens
ggaacccgcgtgcgaccc

SEQ ID NO: 59639 - DNA, 19 bp, Homo sapiens
cgagaccctgcagctgcct

SEQ ID NO: 59640 - DNA, 17 bp, Homo sapiens
gggcccgcacagcgcct

SEQ ID NO: 59641 - DNA, 19 bp, Homo sapiens
cggggcgcgcgcccagccc

SEQ ID NO: 59642 - DNA, 16 bp, Homo sapiens
cgggactcacgcggcc

SEQ ID NO: 59643 - DNA, 19 bp, Homo sapiens
caggacctcctgcctgcct

SEQ ID NO: 59644 - DNA, 19 bp, Homo sapiens
gggaccccagcacctgcct

SEQ ID NO: 59645 - DNA, 15 bp, Homo sapiens
gggcccgcgcggcct

SEQ ID NO: 59646 - DNA, 19 bp, Homo sapiens
ggaatatacatgcctgcct

SEQ ID NO: 59647 - DNA, 17 bp, Homo sapiens
cgggacccgagcgcggc

SEQ ID NO: 59648 - DNA, 16 bp, Homo sapiens
aggacacagcctgcct

SEQ ID NO: 59649 - DNA, 21 bp, Homo sapiens
cgggacccggccgcgccgcct

SEQ ID NO: 59650 - DNA, 17 bp, Homo sapiens
gggacccaggcatgcct

SEQ ID NO: 59651 - DNA, 18 bp, Homo sapiens
cgggtccacactttgcct

SEQ ID NO: 59652 - DNA, 19 bp, Homo sapiens
ggacctcgtgcgcctgcct

SEQ ID NO: 59653 - DNA, 18 bp, Homo sapiens
cgggacccgacattgtgc

SEQ ID NO: 59654 - DNA, 19 bp, Homo sapiens
ggacttggaccacctgcct

SEQ ID NO: 59655 - DNA, 19 bp, Homo sapiens
ggagcagcgctgcctgcct

SEQ ID NO: 59656 - DNA, 19 bp, Homo sapiens
cgggcctgcgtgcctgcct

SEQ ID NO: 59657 - DNA, 21 bp, Homo sapiens
gggacctgccctggagagcct

SEQ ID NO: 59658 - DNA, 16 bp, Homo sapiens
cgggccccgcctgcct

SEQ ID NO: 59659 - DNA, 16 bp, Homo sapiens
gggacctcgcctgcct

SEQ ID NO: 59660 - DNA, 17 bp, Homo sapiens
cgggacccgggctccgc

SEQ ID NO: 59661 - DNA, 18 bp, Homo sapiens
cgggcccagagcctgcct

SEQ ID NO: 59662 - DNA, 16 bp, Homo sapiens
gggacccgcgcggcct

SEQ ID NO: 59663 - DNA, 19 bp, Homo sapiens
caggataggccgcctgcct

SEQ ID NO: 59664 - DNA, 18 bp, Homo sapiens
ggactcgtccacctgcct

SEQ ID NO: 59665 - DNA, 21 bp, Homo sapiens
cggggtcacacacccctgcct

SEQ ID NO: 59666 - DNA, 22 bp, Homo sapiens
cgtgatccgcccacctctgcct

SEQ ID NO: 59667 - DNA, 66 bp, Human papillomavirus type 70
atatattatgtgcacgagcagcataagacatattatgaagtgtttaagcaggatgcacaaatgtat

SEQ ID NO: 59668 - DNA, 24 bp, Human papillomavirus type 70
tattatgtgcacgagcagcataag

SEQ ID NO: 59669 - DNA, 20 bp, Homo sapiens
ttatatgcacgttttataag

SEQ ID NO: 59670 - DNA, 18 bp, Homo sapiens
tgtgcacgagggcttaag

SEQ ID NO: 59671 - DNA, 17 bp, Homo sapiens
tatgtgacaagcagcat

SEQ ID NO: 59672 - DNA, 19 bp, Homo sapiens
ttatgtgttaaagcataag

SEQ ID NO: 59673 - DNA, 22 bp, Homo sapiens
tatgtgcattttagtgcataag

SEQ ID NO: 59674 - DNA, 23 bp, Homo sapiens
cattatgtgcatgacaaaataag

SEQ ID NO: 59675 - DNA, 19 bp, Homo sapiens
ttatatgcattttcataag

SEQ ID NO: 59676 - DNA, 19 bp, Homo sapiens
tatgacggagcagcataag

SEQ ID NO: 59677 - DNA, 61 bp, Human papillomavirus type 70
gtggcagacaaagccaaaacaatgttttaaaaaaaaaggtgttacagtggaggtgtggtac

SEQ ID NO: 59678 - DNA, 22 bp, Human papillomavirus type 70
tgttacagtggaggtgtggtac

SEQ ID NO: 59679 - DNA, 19 bp, Homo sapiens
tgttgcagtggagttcggc

SEQ ID NO: 59680 - DNA, 19 bp, Homo sapiens
tgctgtagtggaggcagtg

SEQ ID NO: 59681 - DNA, 20 bp, Homo sapiens
tgttacatggactatagtac

SEQ ID NO: 59682 - DNA, 19 bp, Homo sapiens
tgctgtagtgggggtgggt

SEQ ID NO: 59683 - DNA, 18 bp, Homo sapiens
ttacagtggagccaaatg

SEQ ID NO: 59684 - DNA, 20 bp, Homo sapiens
tgtgacagtggaggcagggc

SEQ ID NO: 59685 - DNA, 19 bp, Homo sapiens
ttacagtgcatggtggtac

SEQ ID NO: 59686 - DNA, 18 bp, Homo sapiens
gttgtagtggaggaggac

SEQ ID NO: 59687 - DNA, 19 bp, Homo sapiens
tgttgtatgtgggcatggt

SEQ ID NO: 59688 - DNA, 19 bp, Homo sapiens
tgttcatttcagtgtggta

SEQ ID NO: 59689 - DNA, 18 bp, Homo sapiens
tgttatgtggtaaggtat

SEQ ID NO: 59690 - DNA, 21 bp, Homo sapiens
tgttacaggggaggcctgtgc

SEQ ID NO: 59691 - DNA, 19 bp, Homo sapiens
ttacagtggccagtgtggt

SEQ ID NO: 59692 - DNA, 21 bp, Homo sapiens
tgttacaggggagagccttac

SEQ ID NO: 59693 - DNA, 20 bp, Homo sapiens
tgtgggcagtgaggtgtggt

SEQ ID NO: 59694 - DNA, 19 bp, Homo sapiens
tgtttccatggggtgtggt

SEQ ID NO: 59695 - DNA, 19 bp, Homo sapiens
tgttacagggagttaaata

SEQ ID NO: 59696 - DNA, 21 bp, Homo sapiens
tgttgcagtgacaatcagtac

SEQ ID NO: 59697 - DNA, 16 bp, Homo sapiens
tgttactgttgtggta

SEQ ID NO: 59698 - DNA, 19 bp, Homo sapiens
tgttgggtggaggtgaggc

SEQ ID NO: 59699 - DNA, 19 bp, Homo sapiens
tgctatggtggaggcaggc

SEQ ID NO: 59700 - DNA, 18 bp, Homo sapiens
tgttacagggtggggtgc

SEQ ID NO: 59701 - DNA, 20 bp, Homo sapiens
tgtgcagctactgtgtggta

SEQ ID NO: 59702 - DNA, 19 bp, Homo sapiens
tgtacagtgggggtggggt

SEQ ID NO: 59703 - DNA, 19 bp, Homo sapiens
tgtttaagtggtgtggtac

SEQ ID NO: 59704 - DNA, 19 bp, Homo sapiens
tgtacagtggaggaaatac

SEQ ID NO: 59705 - DNA, 21 bp, Homo sapiens
ttatggtggaagctacgtggt

SEQ ID NO: 59706 - DNA, 17 bp, Homo sapiens
tgtcacaggggtgtggt

SEQ ID NO: 59707 - DNA, 16 bp, Homo sapiens
gttacagtaggtggta

SEQ ID NO: 59708 - DNA, 21 bp, Homo sapiens
tgttacagctcttaaggtggt

SEQ ID NO: 59709 - DNA, 16 bp, Homo sapiens
tgttcaatgtgtggta

SEQ ID NO: 59710 - DNA, 18 bp, Homo sapiens
tattacagtggcaatggt

SEQ ID NO: 59711 - DNA, 17 bp, Homo sapiens
tgtttggtcatgtggta

SEQ ID NO: 59712 - DNA, 19 bp, Homo sapiens
tgtttggtggaggtggagt

SEQ ID NO: 59713 - DNA, 60 bp, Human herpesvirus 6
cacgccgctatgggaggcgccgtgtttttcaccaacacgcgcgccgctgcgagacgcgtg

SEQ ID NO: 59714 - DNA, 17 bp, Human herpesvirus 6
ccgctgcgagacgcgtg

SEQ ID NO: 59715 - DNA, 18 bp, Homo sapiens
cgctgcgagccgactgtg

SEQ ID NO: 59716 - DNA, 18 bp, Homo sapiens
ccgccgcgcgcacgcgtg

SEQ ID NO: 59717 - DNA, 19 bp, Homo sapiens
ccgctgcgcagcggcagtg

SEQ ID NO: 59718 - DNA, 19 bp, Homo sapiens
ccgctgcggcaacgatgtg

SEQ ID NO: 59719 - DNA, 20 bp, Homo sapiens
cgcgtgagccgggacgcgtg

SEQ ID NO: 59720 - DNA, 18 bp, Homo sapiens
ccactgcggaaacgagtg

SEQ ID NO: 59721 - DNA, 18 bp, Homo sapiens
ccgctgcagcccaccgtg

SEQ ID NO: 59722 - DNA, 20 bp, Homo sapiens
ccgccgcgtgcgaacgtgtg

SEQ ID NO: 59723 - DNA, 72 bp, Cowpox virus
tgtattcagtatttttggaatcataaaaaataaaaaaagttttaccattttaaaatttaaaaagtatttaca

SEQ ID NO: 59724 - DNA, 72 bp, Cowpox virus; identical to SEQ ID NO: 59723

SEQ ID NO: 59725 - DNA, 16 bp, Homo sapiens
cagtaagaatcataaa

SEQ ID NO: 59726 - DNA, 18 bp, Homo sapiens
cagtattttctaacataa

SEQ ID NO: 59727 - DNA, 20 bp, Homo sapiens
cagtatttttctcataaaaa

SEQ ID NO: 59728 - DNA, 24 bp, Homo sapiens
tcatatttcccagcatcataaaaa

SEQ ID NO: 59729 - DNA, 19 bp, Homo sapiens
agtatttttggtacaaaaa

SEQ ID NO: 59730 - DNA, 21 bp, Homo sapiens
tcagtatttttaggaactaca

SEQ ID NO: 59731 - DNA, 19 bp, Homo sapiens
ccagtagtgggtcataaaa

SEQ ID NO: 59732 - DNA, 18 bp, Homo sapiens
tcagtattctatgtggaa

SEQ ID NO: 59733 - DNA, 20 bp, Homo sapiens
agtattttggactcatgaaa

SEQ ID NO: 59734 - DNA, 18 bp, Homo sapiens
tcagcatttctattcata

SEQ ID NO: 59735 - DNA, 74 bp, Camelpox virus
tgtcttattagttacgcttatttttatgtgttttacgttgctttattatattttataagaatgattgtttgaca

SEQ ID NO: 59736 - DNA, 24 bp, Camelpox virus
tattagttacgcttatttttatgt

SEQ ID NO: 59737 - DNA, 19 bp, Homo sapiens
tattagttaccttattcct

SEQ ID NO: 59738 - DNA, 19 bp, Homo sapiens
tagttacgtttatcaatgt

SEQ ID NO: 59739 - DNA, 24 bp, Homo sapiens
cattagtataatttatttttatgt

SEQ ID NO: 59740 - DNA, 83 bp, Ovine lentivirus
gcgctgctgggggacaggaggagggttcgcagccctgagacttaaagaaggggacgagccctccgcctgaacctgaggagtgc

SEQ ID NO: 59741 - DNA, 24 bp, Ovine lentivirus
tgctgggggacaggaggagggttc

SEQ ID NO: 59742 - DNA, 22 bp, Homo sapiens
tgccgggggatgggggggggtc

SEQ ID NO: 59743 - DNA, 17 bp, Homo sapiens
tgctggggggccgggcc

SEQ ID NO: 59744 - DNA, 20 bp, Homo sapiens
tgctgggggggggggggggc

SEQ ID NO: 59745 - DNA, 17 bp, Homo sapiens
gctggggggcagggggc

SEQ ID NO: 59746 - DNA, 16 bp, Homo sapiens
tgctggggggaggggg

SEQ ID NO: 59747 - DNA, 18 bp, Homo sapiens
tgctggggggcagaggga

SEQ ID NO: 59748 - DNA, 17 bp, Homo sapiens
gctgggggattggggtt

SEQ ID NO: 59749 - DNA, 19 bp, Homo sapiens
tgctgggggggagggggtt

SEQ ID NO: 59750 - DNA, 23 bp, Homo sapiens
tgtggggggcgggagacaatgtc

SEQ ID NO: 59751 - DNA, 17 bp, Homo sapiens
ctgggggacgggggggt

SEQ ID NO: 59752 - DNA, 19 bp, Homo sapiens
tgttgaggggatgggagga

SEQ ID NO: 59753 - DNA, 18 bp, Homo sapiens
tgttgggggacagcgaag

SEQ ID NO: 59754 - DNA, 18 bp, Homo sapiens
tgggggacgggagggagc

SEQ ID NO: 59755 - DNA, 22 bp, Homo sapiens
tgctgggggagggagcagcttc

SEQ ID NO: 59756 - DNA, 22 bp, Homo sapiens
tgctgggggaaggcttccagtt

SEQ ID NO: 59757 - DNA, 21 bp, Homo sapiens
tgctgagggggtggggggctc

SEQ ID NO: 59758 - DNA, 15 bp, Homo sapiens
tgtgggggacagggt

SEQ ID NO: 59759 - DNA, 20 bp, Homo sapiens
tggtggggggtgggagggtc

SEQ ID NO: 59760 - DNA, 18 bp, Homo sapiens
gctgggggacagggggct

SEQ ID NO: 59761 - DNA, 18 bp, Homo sapiens
tgttgggggattgggggg

SEQ ID NO: 59762 - DNA, 23 bp, Homo sapiens
tgctgggggtggggggggggggt

SEQ ID NO: 59763 - DNA, 18 bp, Homo sapiens
tgttggggggtagaggag

SEQ ID NO: 59764 - DNA, 19 bp, Homo sapiens
tgctggggggagggagggt

SEQ ID NO: 59765 - DNA, 21 bp, Homo sapiens
tgcgtggggacaggagggttc

SEQ ID NO: 59766 - DNA, 17 bp, Homo sapiens
tgctggggtacagggga

SEQ ID NO: 59767 - DNA, 18 bp, Homo sapiens
tgctgagggggtgggagg

SEQ ID NO: 59768 - DNA, 28 bp, Homo sapiens
tgctgggggcggtgcggggaggggggtt

SEQ ID NO: 59769 - DNA, 20 bp, Homo sapiens
tgctgggggtgggagggggt

SEQ ID NO: 59770 - DNA, 21 bp, Homo sapiens
ctgggggatgggtgttgggtt

SEQ ID NO: 59771 - DNA, 17 bp, Homo sapiens
tgctgggggaggggagg

SEQ ID NO: 59772 - DNA, 24 bp, Homo sapiens
tgctggggagcagtgcctgggttc

SEQ ID NO: 59773 - DNA, 18 bp, Homo sapiens
gctggggtgaggagggtt

SEQ ID NO: 59774 - DNA, 18 bp, Homo sapiens
tggtggggggcagggatt

SEQ ID NO: 59775 - DNA, 76 bp, Meleagrid herpesvirus 1
gtgtgagcccttcacgtcgggggtgtttgtgtgtttgtgaagcagcataaacagccccgatttgacaggttcgtgc

SEQ ID NO: 59776 - DNA, 24 bp, Meleagrid herpesvirus 1
taaacagccccgatttgacaggtt

SEQ ID NO: 59777 - DNA, 22 bp, Homo sapiens
taaacagctatacatgtaggtt

SEQ ID NO: 59778 - DNA, 15 bp, Homo sapiens
gccccaagacaggtt

SEQ ID NO: 59779 - DNA, 22 bp, Homo sapiens
taaacagctttcagtgcaggtt

SEQ ID NO: 59780 - DNA, 18 bp, Homo sapiens
taaacagctttgagtggt

SEQ ID NO: 59781 - DNA, 19 bp, Homo sapiens
aacagcctcattataggtt

SEQ ID NO: 59782 - DNA, 20 bp, Homo sapiens
aaacagtttcccaacaggtt

SEQ ID NO: 59783 - DNA, 22 bp, Homo sapiens
tgacagccctgaaagttaggtt

SEQ ID NO: 59784 - DNA, 23 bp, Homo sapiens
taaacagctatagagtacaggtt

SEQ ID NO: 59785 - DNA, 68 bp, Meleagrid herpesvirus 1
gaacctgtcaaatcggggctgtttatgctgcttcacaaacacacaaacacccccgacgtgaagggctc

SEQ ID NO: 59786 - DNA, 24 bp, Meleagrid herpesvirus 1
tgtcaaatcggggctgtttatgct

SEQ ID NO: 59787 - DNA, 21 bp, Homo sapiens
tgcagatcggggctgggggct

SEQ ID NO: 59788 - DNA, 17 bp, Homo sapiens
tgtcaaatgggtgtgtt

SEQ ID NO: 59789 - DNA, 17 bp, Homo sapiens
tgtcaggcggggctgct

SEQ ID NO: 59790 - DNA, 18 bp, Homo sapiens
ggtccagctgtttatgct

SEQ ID NO: 59791 - DNA, 17 bp, Homo sapiens
tcaaactcctgtttatg

SEQ ID NO: 59792 - DNA, 72 bp, Meleagrid herpesvirus 1
acgaacctgtcaaatcggggctatttatgctgctccacaaacacacaaacacccccgacatgaagggttcgt

SEQ ID NO: 59793 - DNA, 24 bp, Meleagrid herpesvirus 1
tgtcaaatcggggctatttatgct

SEQ ID NO: 59794 - DNA, 19 bp, Homo sapiens
tatcaaatcttcatttatg

SEQ ID NO: 59795 - DNA, 18 bp, Homo sapiens
tgtaaatcatatttatgc

SEQ ID NO: 59796 - DNA, 125 bp, Friend murine leukemia virus
gttgggccaaacaggatatctgcggtgagcagtttcggccccggcccggggccaagaacagatggtcaccgcggttcggccccggcccggggccaagaacagatggtccccagatatggcccaac

SEQ ID NO: 59797 - DNA, 24 bp, Friend murine leukemia virus
gcccggggccaagaacagatggtc

SEQ ID NO: 59798 - DNA, 21 bp, Homo sapiens
gcccggggactaggaagagcg

SEQ ID NO: 59799 - DNA, 24 bp, Homo sapiens
gctgggggccaagatgcctgggtc

SEQ ID NO: 59800 - DNA, 18 bp, Homo sapiens
cggggccaagggcagggc

SEQ ID NO: 59801 - DNA, 21 bp, Homo sapiens
gctcgggccaggagccagggt

SEQ ID NO: 59802 - DNA, 18 bp, Homo sapiens
ggagccaagaacgtagtc

SEQ ID NO: 59803 - DNA, 21 bp, Homo sapiens
ccggggccgaggccggtggtc

SEQ ID NO: 59804 - DNA, 19 bp, Homo sapiens
gctcggggccaggaggacg

SEQ ID NO: 59805 - DNA, 17 bp, Homo sapiens
ccggggccgggaacgac

SEQ ID NO: 59806 - DNA, 21 bp, Homo sapiens
gcccggggcgggagtcttagt

SEQ ID NO: 59807 - DNA, 19 bp, Homo sapiens
gcccggggccaggagcggt

SEQ ID NO: 59808 - DNA, 21 bp, Homo sapiens
gctgggggcaaggcagatggt

SEQ ID NO: 59809 - DNA, 19 bp, Homo sapiens
gcccggggctgagaagcag

SEQ ID NO: 59810 - DNA, 21 bp, Homo sapiens
gcccggggctgaggaggaagc

SEQ ID NO: 59811 - DNA, 17 bp, Homo sapiens
gcccggggcaaggacag

SEQ ID NO: 59812 - DNA, 16 bp, Homo sapiens
gcccggggacaggggc

SEQ ID NO: 59813 - DNA, 20 bp, Homo sapiens
gcccggggtcaagcaacggc

SEQ ID NO: 59814 - DNA, 19 bp, Homo sapiens
gcccggggcagggaataga

SEQ ID NO: 59815 - DNA, 22 bp, Homo sapiens
gctgggggccaaggaagtggtc

SEQ ID NO: 59816 - DNA, 18 bp, Homo sapiens
gcctgaggttaagaacaa

SEQ ID NO: 59817 - DNA, 17 bp, Homo sapiens
gcccggggccgaggcag

SEQ ID NO: 59818 - DNA, 20 bp, Homo sapiens
cctggggccaaggcagtggt

SEQ ID NO: 59819 - DNA, 20 bp, Homo sapiens
cgtgggccaagcgggtggtc

SEQ ID NO: 59820 - DNA, 25 bp, Homo sapiens
gcccagggttgggggcaccagagtc

SEQ ID NO: 59821 - DNA, 18 bp, Homo sapiens
gcccgggcgccgagaaca

SEQ ID NO: 59822 - DNA, 24 bp, Homo sapiens
gcctcggggctgggggcaggcgtc

SEQ ID NO: 59823 - DNA, 20 bp, Homo sapiens
gctcggggacaggaacagac

SEQ ID NO: 59824 - DNA, 19 bp, Homo sapiens
gcccaggggctgaggtggt

SEQ ID NO: 59825 - DNA, 22 bp, Homo sapiens
gcccggggttggtgacgctgtc

SEQ ID NO: 59826 - DNA, 19 bp, Homo sapiens
gcccggggcgcaggagcag

SEQ ID NO: 59827 - DNA, 18 bp, Homo sapiens
gcaaagaggacagatggt

SEQ ID NO: 59828 - DNA, 22 bp, Homo sapiens
gcctggagccgggatttcggtc

SEQ ID NO: 59829 - DNA, 15 bp, Homo sapiens
ggggaacagatggtc

SEQ ID NO: 59830 - DNA, 19 bp, Homo sapiens
gcccggggccggaggtggc

SEQ ID NO: 59831 - DNA, 100 bp, Human herpesvirus 1
cgccaccctgcgggcgacccggggggtgctctgatagtctcgcgtgcccaaggcccgtgatcggggtacttcgccgccgcgacccgccacccggtgtgcg

SEQ ID NO: 59832 - DNA, 24 bp, Human herpesvirus 1
tacttcgccgccgcgacccgccac

SEQ ID NO: 59833 - DNA, 18 bp, Homo sapiens
cttcgccgccgctcctgc

SEQ ID NO: 59834 - DNA, 17 bp, Homo sapiens
tactcgccgctcgccgc

SEQ ID NO: 59835 - DNA, 19 bp, Homo sapiens
ctgcgcggccgcgacctgc

SEQ ID NO: 59836 - DNA, 16 bp, Homo sapiens
ttcgccgccgccgcca

SEQ ID NO: 59837 - DNA, 18 bp, Homo sapiens
ctccgccgccgccgccgc

SEQ ID NO: 59838 - DNA, 17 bp, Homo sapiens
ttcgctgccgccaccgc

SEQ ID NO: 59839 - DNA, 18 bp, Homo sapiens
ccgtcgccgccgcgccgc

SEQ ID NO: 59840 - DNA, 19 bp, Homo sapiens
ctctgccgcccgctccgcc

SEQ ID NO: 59841 - DNA, 22 bp, Homo sapiens
tacttcgccgactgctcccgcc

SEQ ID NO: 59842 - DNA, 17 bp, Homo sapiens
ttcgccgccgccgccgc

SEQ ID NO: 59843 - DNA, 20 bp, Homo sapiens
cttcgccaccttggccgcca

SEQ ID NO: 59844 - DNA, 20 bp, Homo sapiens
cacttcgctgccctttgcca

SEQ ID NO: 59845 - DNA, 22 bp, Homo sapiens
ctcgcgacccgcgacccgccac

SEQ ID NO: 59846 - DNA, 16 bp, Homo sapiens
ctccagccgcgactcg

SEQ ID NO: 59847 - DNA, 130 bp, Fowl adenovirus D
cctcgtctttggttggctccaatccgattccgagtcgtccgaattgggcatcggagtcttttccctggctccgaatacctgtcgaatctcctcgtcgtcttcgtccgagctcactacccaaagatcgcgg

SEQ ID NO: 59848 - DNA, 24 bp, Fowl adenovirus D
ctccgaatacctgtcgaatctcct

SEQ ID NO: 59849 - DNA, 25 bp, Homo sapiens
tctaatacctgcctcagaatttcct

SEQ ID NO: 59850 - DNA, 23 bp, Homo sapiens
gaatacctcttgaataaattcct

SEQ ID NO: 59851 - DNA, 20 bp, Homo sapiens
tctgaatacctgttctgccc

SEQ ID NO: 59852 - DNA, 18 bp, Homo sapiens
gaatattgggaatctcct

SEQ ID NO: 59853 - DNA, 21 bp, Homo sapiens
ctccaaatatctgggcttcct

SEQ ID NO: 59854 - DNA, 16 bp, Homo sapiens
ctccggctggaatctc

SEQ ID NO: 59855 - DNA, 21 bp, Homo sapiens
tccggtactcaggaatctcct

SEQ ID NO: 59856 - DNA, 22 bp, Homo sapiens
ctctagaatgttcgaatctcct

SEQ ID NO: 59857 - DNA, 18 bp, Homo sapiens
tccaaatgcttgtcgaat

SEQ ID NO: 59858 - DNA, 25 bp, Homo sapiens
ctccgaatctctgcctgggtctcct

SEQ ID NO: 59859 - DNA, 23 bp, Homo sapiens
ctccagatataataaaatctcct

SEQ ID NO: 59860 - DNA, 18 bp, Homo sapiens
tccgaatacctcttgaac

SEQ ID NO: 59861 - DNA, 16 bp, Homo sapiens
ctcggaatcgaatctc

SEQ ID NO: 59862 - DNA, 64 bp, Gallid herpesvirus 3
tccgtccatcggcgtggtgctcgatcccgtcattcggtgatctcaagcaccccgcgaaggagga

SEQ ID NO: 59863 - DNA, 20 bp, Gallid herpesvirus 3
aagcaccccgcgaaggagga

SEQ ID NO: 59864 - DNA, 16 bp, Homo sapiens
gcacccagaaggagga

SEQ ID NO: 59865 - DNA, 17 bp, Homo sapiens
aagcccccagaaggagg

SEQ ID NO: 59866 - DNA, 19 bp, Homo sapiens
aagcacccacctgggggga

SEQ ID NO: 59867 - DNA, 17 bp, Homo sapiens
gccctcagaaaggagga

SEQ ID NO: 59868 - DNA, 19 bp, Homo sapiens
aagcccccgcggaaggagg

SEQ ID NO: 59869 - DNA, 18 bp, Homo sapiens
agcaccccccagggagga

SEQ ID NO: 59870 - DNA, 17 bp, Homo sapiens
aaacaccggaaaggagg

SEQ ID NO: 59871 - DNA, 19 bp, Homo sapiens
aagcagggcgtgaaggagg

SEQ ID NO: 59872 - DNA, 19 bp, Homo sapiens
agaccctgcccaaggagga

SEQ ID NO: 59873 - DNA, 16 bp, Homo sapiens
agcagcagaaggagga

SEQ ID NO: 59874 - DNA, 16 bp, Homo sapiens
aagcatccccagagga

SEQ ID NO: 59875 - DNA, 18 bp, Homo sapiens
aactacccacaaggagga

SEQ ID NO: 59876 - DNA, 17 bp, Homo sapiens
aagcaccccaatgagga

SEQ ID NO: 59877 - DNA, 19 bp, Homo sapiens
aagacactgcaaaggagga

SEQ ID NO: 59878 - DNA, 19 bp, Homo sapiens
agcaccccgcgcaggagga

SEQ ID NO: 59879 - DNA, 20 bp, Homo sapiens
aagcagctcggaagaggagg

SEQ ID NO: 59880 - DNA, 17 bp, Homo sapiens
aaacacggaaaggagga

SEQ ID NO: 59881 - DNA, 17 bp, Homo sapiens
aagccaccccaaggagg

SEQ ID NO: 59882 - DNA, 23 bp, Homo sapiens
aagcacattggaaaaaaggagga

SEQ ID NO: 59883 - DNA, 15 bp, Homo sapiens
aagcaccccaggagg

SEQ ID NO: 59884 - DNA, 18 bp, Homo sapiens
aagtacccccaaaaagga

SEQ ID NO: 59885 - DNA, 21 bp, Homo sapiens
agcacccctgtactggggagg

SEQ ID NO: 59886 - DNA, 15 bp, Homo sapiens
aagaccccaaagagg

SEQ ID NO: 59887 - DNA, 16 bp, Homo sapiens
aagcaccccagagagg

SEQ ID NO: 59888 - DNA, 18 bp, Homo sapiens
aagctcctggcgggagga

SEQ ID NO: 59889 - DNA, 17 bp, Homo sapiens
agaccctgacaaggagg

SEQ ID NO: 59890 - DNA, 20 bp, Homo sapiens
gcaccccggggccggggagg

SEQ ID NO: 59891 - DNA, 21 bp, Homo sapiens
aaacaccctttttcggggagg

SEQ ID NO: 59892 - DNA, 19 bp, Homo sapiens
agcaccgcctggatggagg

SEQ ID NO: 59893 - DNA, 19 bp, Homo sapiens
gcaccccacacccggggga

SEQ ID NO: 59894 - DNA, 19 bp, Homo sapiens
aagcacctcctcaaggagg

SEQ ID NO: 59895 - DNA, 16 bp, Homo sapiens
agcccccaaaagagga

SEQ ID NO: 59896 - DNA, 20 bp, Homo sapiens
agcaccccatccttgaagga

SEQ ID NO: 59897 - DNA, 19 bp, Homo sapiens
aagcacgccagactgagga

SEQ ID NO: 59898 - DNA, 16 bp, Homo sapiens
gcactccacaaaagga

SEQ ID NO: 59899 - DNA, 19 bp, Homo sapiens
aaccaccccgccccaagga

SEQ ID NO: 59900 - DNA, 19 bp, Homo sapiens
gctgccccgcgaagggcgg

SEQ ID NO: 59901 - DNA, 18 bp, Homo sapiens
aagcaaccacaaggagga

SEQ ID NO: 59902 - DNA, 17 bp, Homo sapiens
gcgccccgcgagcagga

SEQ ID NO: 59903 - DNA, 19 bp, Homo sapiens
aacaccccgagaccgggga

SEQ ID NO: 59904 - DNA, 19 bp, Homo sapiens
agcaccagaagaaggagga

SEQ ID NO: 59905 - DNA, 17 bp, Homo sapiens
gctaccacaaaggagga

SEQ ID NO: 59906 - DNA, 20 bp, Homo sapiens
aagcacaaagacaaggggga

SEQ ID NO: 59907 - DNA, 19 bp, Homo sapiens
aagcacccggggcgggggg

SEQ ID NO: 59908 - DNA, 16 bp, Homo sapiens
ggacacacaaaggagg

SEQ ID NO: 59909 - DNA, 15 bp, Homo sapiens
aacaccccgaggagg

SEQ ID NO: 59910 - DNA, 18 bp, Homo sapiens
agctcctgcagaaggagg

SEQ ID NO: 59911 - DNA, 19 bp, Homo sapiens
agcaccccagccttgggga

SEQ ID NO: 59912 - DNA, 19 bp, Homo sapiens
aaacaccagaggaaggagg

SEQ ID NO: 59913 - DNA, 19 bp, Homo sapiens
aagacactaacaaggagga

SEQ ID NO: 59914 - DNA, 17 bp, Homo sapiens
agctccacgaaggggga

SEQ ID NO: 59915 - DNA, 17 bp, Homo sapiens
aaacactgcaaggagga

SEQ ID NO: 59916 - DNA, 18 bp, Homo sapiens
accgcccgggaaggagga

SEQ ID NO: 59917 - DNA, 23 bp, Homo sapiens
aaacaccccgtgagcccagagga

SEQ ID NO: 59918 - DNA, 18 bp, Homo sapiens
agacatcaggaaggagga

SEQ ID NO: 59919 - DNA, 20 bp, Homo sapiens
aagcacccgcaggctgagga

SEQ ID NO: 59920 - DNA, 17 bp, Homo sapiens
agcaccccagacagggg

SEQ ID NO: 59921 - DNA, 19 bp, Homo sapiens
aagtaccagacaaggagga

SEQ ID NO: 59922 - DNA, 16 bp, Homo sapiens
agcacgccaaggagga

SEQ ID NO: 59923 - DNA, 18 bp, Homo sapiens
aacacctgccaaggagga

SEQ ID NO: 59924 - DNA, 21 bp, Homo sapiens
aagcacccctacaacagagga

SEQ ID NO: 59925 - DNA, 15 bp, Homo sapiens
aagcacccacggggg

SEQ ID NO: 59926 - DNA, 21 bp, Homo sapiens
agtcacagacaagaaggagga

SEQ ID NO: 59927 - DNA, 19 bp, Homo sapiens
aagtgccccacgaccgagg

SEQ ID NO: 59928 - DNA, 20 bp, Homo sapiens
gcaccccacggctatgggga

SEQ ID NO: 59929 - DNA, 19 bp, Homo sapiens
aagcacccttggctggagg

SEQ ID NO: 59930 - DNA, 16 bp, Homo sapiens
aagactcagaaggagg

SEQ ID NO: 59931 - DNA, 17 bp, Homo sapiens
aagcaccccgtggcagg

SEQ ID NO: 59932 - DNA, 20 bp, Homo sapiens
aagcaccctccgtgagagga

SEQ ID NO: 59933 - DNA, 20 bp, Homo sapiens
aagcaccaccagaaggagga

SEQ ID NO: 59934 - DNA, 17 bp, Homo sapiens
aagtcaacaaaggagga

SEQ ID NO: 59935 - DNA, 19 bp, Homo sapiens
agaccgtccgcgaaggagg

SEQ ID NO: 59936 - DNA, 16 bp, Homo sapiens
gcaccctgcaaaagga

SEQ ID NO: 59937 - DNA, 23 bp, Homo sapiens
aagcaccctgtccacacggagga

SEQ ID NO: 59938 - DNA, 19 bp, Homo sapiens
aagcacccccaacctgggg

SEQ ID NO: 59939 - DNA, 17 bp, Homo sapiens
aagctcccgaaggagga

SEQ ID NO: 59940 - DNA, 15 bp, Homo sapiens
aagcacggaaggagg

SEQ ID NO: 59941 - DNA, 20 bp, Homo sapiens
aagcaccctccgtccgggga

SEQ ID NO: 59942 - DNA, 19 bp, Homo sapiens
aaacgtccaccaaggagga

SEQ ID NO: 59943 - DNA, 19 bp, Homo sapiens
aagcaccccatcagaagga

SEQ ID NO: 59944 - DNA, 72 bp, Meleagrid herpesvirus 1
gctattaccgtatctaattccgaggatgaagagcgaaattcgtgatcgtaaaaataaaaaatacaagatagt

SEQ ID NO: 59945 - DNA, 24 bp, Meleagrid herpesvirus 1
taccgtatctaattccgaggatga

SEQ ID NO: 59946 - DNA, 20 bp, Homo sapiens
gtatctatagtggaggatga

SEQ ID NO: 59947 - DNA, 20 bp, Homo sapiens
ccatgtctaattcttatatg

SEQ ID NO: 59948 - DNA, 23 bp, Homo sapiens
gcagacaaccattccgagggtga

SEQ ID NO: 59949 - DNA, 21 bp, Homo sapiens
taccctgccatctgaggatga

SEQ ID NO: 59950 - DNA, 21 bp, Homo sapiens
ccgtgtctaattcctccccga

SEQ ID NO: 59951 - DNA, 20 bp, Homo sapiens
gctgtaatctgagaggatga

SEQ ID NO: 59952 - DNA, 22 bp, Homo sapiens
tactgtatctaatgaaaaatga

SEQ ID NO: 59953 - DNA, 131 bp, Rat cytomegalovirus
gaggcggtcggcggaggaggcggcaggaggcggcagaggaggccggagggcgtgggctgccctggccccccgtcgcgccgctctctctccccttttcccgctctctctccccttttcccgcccgcctgccc

SEQ ID NO: 59954 - DNA, 24 bp, Rat cytomegalovirus
aggaggcggcagaggaggccggag

SEQ ID NO: 59955 - DNA, 24 bp, Homo sapiens
ggaggcggcagagggggctgtcgg

SEQ ID NO: 59956 - DNA, 20 bp, Homo sapiens
agaggggacaggagggggag

SEQ ID NO: 59957 - DNA, 22 bp, Homo sapiens
ggaggcggcgggggttccggag

SEQ ID NO: 59958 - DNA, 22 bp, Homo sapiens
ggggtgtggcagagggatacgg

SEQ ID NO: 59959 - DNA, 18 bp, Homo sapiens
aggaggcgtggaggggcc

SEQ ID NO: 59960 - DNA, 18 bp, Homo sapiens
aggaggtggggagcagga

SEQ ID NO: 59961 - DNA, 20 bp, Homo sapiens
ggtggcggcgggagccggag

SEQ ID NO: 59962 - DNA, 21 bp, Homo sapiens
aggaggtggagagagagtggg

SEQ ID NO: 59963 - DNA, 20 bp, Homo sapiens
ggaggcgggaggggggttgg

SEQ ID NO: 59964 - DNA, 18 bp, Homo sapiens
gggagcggcgggaccgga

SEQ ID NO: 59965 - DNA, 17 bp, Homo sapiens
ggaggcgcggaggccga

SEQ ID NO: 59966 - DNA, 16 bp, Homo sapiens
agaaggcggaggccgg

SEQ ID NO: 59967 - DNA, 21 bp, Homo sapiens
gaaggggcgaggggaggccgg

SEQ ID NO: 59968 - DNA, 20 bp, Homo sapiens
ggagccggcagaggctgggg

SEQ ID NO: 59969 - DNA, 18 bp, Homo sapiens
aggaggcggcaggagaga

SEQ ID NO: 59970 - DNA, 18 bp, Homo sapiens
aggaggaggcagggggag

SEQ ID NO: 59971 - DNA, 21 bp, Homo sapiens
aggcaggtggtggggggcagg

SEQ ID NO: 59972 - DNA, 22 bp, Homo sapiens
aggaggtggcggcgggagcggg

SEQ ID NO: 59973 - DNA, 18 bp, Homo sapiens
ggagggcggcaggggagg

SEQ ID NO: 59974 - DNA, 19 bp, Homo sapiens
aggaggcagatggggtcgg

SEQ ID NO: 59975 - DNA, 20 bp, Homo sapiens
aggagggggtaggggaaggg

SEQ ID NO: 59976 - DNA, 20 bp, Homo sapiens
aggggtgtggcagggtgggg

SEQ ID NO: 59977 - DNA, 19 bp, Homo sapiens
aggagcggcaggggaaaga

SEQ ID NO: 59978 - DNA, 18 bp, Homo sapiens
gggggcggcagagcgcgg

SEQ ID NO: 59979 - DNA, 18 bp, Homo sapiens
gaggcggcggaggctgag

SEQ ID NO: 59980 - DNA, 18 bp, Homo sapiens
ggaggcagcagcttggag

SEQ ID NO: 59981 - DNA, 17 bp, Homo sapiens
ggaggtggggaggagac

SEQ ID NO: 59982 - DNA, 16 bp, Homo sapiens
ggagacgaggggccgg

SEQ ID NO: 59983 - DNA, 21 bp, Homo sapiens
aggaggcgtgggggcagtgag

SEQ ID NO: 59984 - DNA, 20 bp, Homo sapiens
agggggcgggagggagtcgg

SEQ ID NO: 59985 - DNA, 16 bp, Homo sapiens
aggagacggcggccgg

SEQ ID NO: 59986 - DNA, 19 bp, Homo sapiens
aggagatggtagaggtgga

SEQ ID NO: 59987 - DNA, 18 bp, Homo sapiens
ggcaggcggccggccgga

SEQ ID NO: 59988 - DNA, 20 bp, Homo sapiens
aggggtgggagggaggccgg

SEQ ID NO: 59989 - DNA, 22 bp, Homo sapiens
agaggcaatatgaggaggttgg

SEQ ID NO: 59990 - DNA, 23 bp, Homo sapiens
ggaggcggcgaaggcgcctgcgg

SEQ ID NO: 59991 - DNA, 20 bp, Homo sapiens
aggggtggtacaggggctgg

SEQ ID NO: 59992 - DNA, 21 bp, Homo sapiens
aggaggcagtgggcttcctgg

SEQ ID NO: 59993 - DNA, 18 bp, Homo sapiens
ggaggcggtagggaacgg

SEQ ID NO: 59994 - DNA, 21 bp, Homo sapiens
aggaggcggcggggggcggag

SEQ ID NO: 59995 - DNA, 19 bp, Homo sapiens
ggaggcggcgggtgggtgg

SEQ ID NO: 59996 - DNA, 20 bp, Homo sapiens
aggaggcagggctgggtcgg

SEQ ID NO: 59997 - DNA, 16 bp, Homo sapiens
ggagcgcggggccgga

SEQ ID NO: 59998 - DNA, 24 bp, Homo sapiens
agaaggtggtggggtatgctggag

SEQ ID NO: 59999 - DNA, 21 bp, Homo sapiens
aggaggcaggcggggtgttgg

SEQ ID NO: 60000 - DNA, 21 bp, Homo sapiens
gggggctggaggaggctggag

SEQ ID NO: 60001 - DNA, 23 bp, Homo sapiens
aggaggtggtgcggggacccgag

SEQ ID NO: 60002 - DNA, 22 bp, Homo sapiens
ggaggcggcggcgggcaaggag

SEQ ID NO: 60003 - DNA, 18 bp, Homo sapiens
gggagcggcggacgcgga

SEQ ID NO: 60004 - DNA, 22 bp, Homo sapiens
aggatggtggcagacatgctgg

SEQ ID NO: 60005 - DNA, 19 bp, Homo sapiens
agcaggcggcagggaagga

SEQ ID NO: 60006 - DNA, 18 bp, Homo sapiens
aggaggtggggaggccag

SEQ ID NO: 60007 - DNA, 17 bp, Homo sapiens
aggaggcggggaggaag

SEQ ID NO: 60008 - DNA, 17 bp, Homo sapiens
ggagagtggcagccgga

SEQ ID NO: 60009 - DNA, 18 bp, Homo sapiens
agggggcggaggaggagg

SEQ ID NO: 60010 - DNA, 20 bp, Homo sapiens
gaggcggcgggggaggggag

SEQ ID NO: 60011 - DNA, 23 bp, Homo sapiens
gggggcggctatcccagccggag

SEQ ID NO: 60012 - DNA, 19 bp, Homo sapiens
agcgggcggcaatcgccgg

SEQ ID NO: 60013 - DNA, 19 bp, Homo sapiens
ggaggcagcagaggtgggg

SEQ ID NO: 60014 - DNA, 18 bp, Homo sapiens
ggcggcggcagagcgggg

SEQ ID NO: 60015 - DNA, 22 bp, Homo sapiens
ggaggcggcggcagggcaagag

SEQ ID NO: 60016 - DNA, 19 bp, Homo sapiens
aggaggccggcagggccgg

SEQ ID NO: 60017 - DNA, 15 bp, Homo sapiens
ggaggcagcggccgg

SEQ ID NO: 60018 - DNA, 20 bp, Homo sapiens
ggagggaaggaggaggctgg

SEQ ID NO: 60019 - DNA, 18 bp, Homo sapiens
aggggtggcaggggcggg

SEQ ID NO: 60020 - DNA, 18 bp, Homo sapiens
aggaggcggcgggtgggg

SEQ ID NO: 60021 - DNA, 17 bp, Homo sapiens
ggaggcggcaggaggga

SEQ ID NO: 60022 - DNA, 18 bp, Homo sapiens
aggagcgcaggaggccgg

SEQ ID NO: 60023 - DNA, 24 bp, Homo sapiens
aggtgggtggcagaggagccggag

SEQ ID NO: 60024 - DNA, 21 bp, Homo sapiens
ggacgcggcagaggagtggag

SEQ ID NO: 60025 - DNA, 22 bp, Homo sapiens
ggagtggcagaggaggtcccag

SEQ ID NO: 60026 - DNA, 18 bp, Homo sapiens
gggggtggtaggaagggg

SEQ ID NO: 60027 - DNA, 19 bp, Homo sapiens
aggaggtggaggagggtgg

SEQ ID NO: 60028 - DNA, 22 bp, Homo sapiens
aggaggcggggagggggggtgg

SEQ ID NO: 60029 - DNA, 16 bp, Homo sapiens
aggaggcggggagggg

SEQ ID NO: 60030 - DNA, 19 bp, Homo sapiens
gggggcggcaagcagcggg

SEQ ID NO: 60031 - DNA, 19 bp, Homo sapiens
aggaggtggcagcggatgg

SEQ ID NO: 60032 - DNA, 20 bp, Homo sapiens
ggagggagctgaggccggag

SEQ ID NO: 60033 - DNA, 22 bp, Homo sapiens
aggaggcggcaggggaggcggg

SEQ ID NO: 60034 - DNA, 17 bp, Homo sapiens
gggggcggcaggagcgg

SEQ ID NO: 60035 - DNA, 19 bp, Homo sapiens
aggaggctgcggggagggg

SEQ ID NO: 60036 - DNA, 26 bp, Homo sapiens
gaggcggcaggcgccgggggctggag

SEQ ID NO: 60037 - DNA, 18 bp, Homo sapiens
ggaagcagggaggctgga

SEQ ID NO: 60038 - DNA, 20 bp, Homo sapiens
ggaggcgagtgtggggccgg

SEQ ID NO: 60039 - DNA, 22 bp, Homo sapiens
ggggcgttggcaaggaggctgg

SEQ ID NO: 60040 - DNA, 22 bp, Homo sapiens
aagaggcggcggcaggccggag

SEQ ID NO: 60041 - DNA, 19 bp, Homo sapiens
ggaggaggcggagggccga

SEQ ID NO: 60042 - DNA, 19 bp, Homo sapiens
ggaggcggcgggcgagggg

SEQ ID NO: 60043 - DNA, 22 bp, Homo sapiens
aggaggaggctgcgggttggag

SEQ ID NO: 60044 - DNA, 18 bp, Homo sapiens
aggaggcggcgagagggc

SEQ ID NO: 60045 - DNA, 21 bp, Homo sapiens
aggggcggcaggcggggctgg

SEQ ID NO: 60046 - DNA, 18 bp, Homo sapiens
ggatgagcaggaggctgg

SEQ ID NO: 60047 - DNA, 22 bp, Homo sapiens
aggatgcggcgccaagccggag

SEQ ID NO: 60048 - DNA, 23 bp, Homo sapiens
ggaggcagcgggggaggctgcgg

SEQ ID NO: 60049 - DNA, 17 bp, Homo sapiens
ggaggcggagagctcgg

SEQ ID NO: 60050 - DNA, 19 bp, Homo sapiens
ggaggggcagagggacaag

SEQ ID NO: 60051 - DNA, 22 bp, Homo sapiens
agggggcaggcagaggagccag

SEQ ID NO: 60052 - DNA, 25 bp, Homo sapiens
aggaaggcaaaaaagggggctggag

SEQ ID NO: 60053 - DNA, 18 bp, Homo sapiens
ggagggtggcagaggtgg

SEQ ID NO: 60054 - DNA, 19 bp, Homo sapiens
ggaggcgggggaggggcgg

SEQ ID NO: 60055 - DNA, 19 bp, Homo sapiens
aggggctgagaggggttgg

SEQ ID NO: 60056 - DNA, 20 bp, Homo sapiens
ggaggcggcagcagggcagg

SEQ ID NO: 60057 - DNA, 22 bp, Homo sapiens
agagggaaggagggggctggag

SEQ ID NO: 60058 - DNA, 17 bp, Homo sapiens
aggaggcggcagtgggg

SEQ ID NO: 60059 - DNA, 22 bp, Homo sapiens
aagaggcggcagaggcgcgcgg

SEQ ID NO: 60060 - DNA, 22 bp, Homo sapiens
agggggcgcagggaatgaggag

SEQ ID NO: 60061 - DNA, 20 bp, Homo sapiens
ggaggggcagaggcatccgg

SEQ ID NO: 60062 - DNA, 21 bp, Homo sapiens
ggaggcggcacagacctggag

SEQ ID NO: 60063 - DNA, 23 bp, Homo sapiens
ggaggcgggagggcgctttggag

SEQ ID NO: 60064 - DNA, 19 bp, Homo sapiens
ggaggcagcagaaatggag

SEQ ID NO: 60065 - DNA, 19 bp, Homo sapiens
ggagggcggcggggaggag

SEQ ID NO: 60066 - DNA, 20 bp, Homo sapiens
ggaggcggcgcgggagcggg

SEQ ID NO: 60067 - DNA, 19 bp, Homo sapiens
aggaggcggaggggaagga

SEQ ID NO: 60068 - DNA, 23 bp, Homo sapiens
aggaggcgcaggggagaatggag

SEQ ID NO: 60069 - DNA, 21 bp, Homo sapiens
ggaagcggcgagaggggccgg

SEQ ID NO: 60070 - DNA, 15 bp, Homo sapiens
aggaggcggcggcgg

SEQ ID NO: 60071 - DNA, 19 bp, Homo sapiens
aggcggcggcggagggcgg

SEQ ID NO: 60072 - DNA, 18 bp, Homo sapiens
ggaggcggcgcgggggaa

SEQ ID NO: 60073 - DNA, 23 bp, Homo sapiens
aggggggtgtggggaggccggag

SEQ ID NO: 60074 - DNA, 17 bp, Homo sapiens
aggggtgctgaggccgg

SEQ ID NO: 60075 - DNA, 24 bp, Homo sapiens
aggaggcgggcgccgccgggccgg

SEQ ID NO: 60076 - DNA, 23 bp, Homo sapiens
aggggttgctcctggggccggag

SEQ ID NO: 60077 - DNA, 18 bp, Homo sapiens
aggaggggcagggaggga

SEQ ID NO: 60078 - DNA, 20 bp, Homo sapiens
agggggtgggggaggcaagg

SEQ ID NO: 60079 - DNA, 18 bp, Homo sapiens
aggaggaggcggggccag

SEQ ID NO: 60080 - DNA, 19 bp, Homo sapiens
aggaggaggcagagaggga

SEQ ID NO: 60081 - DNA, 18 bp, Homo sapiens
ggaggcgagcaggggagg

SEQ ID NO: 60082 - DNA, 21 bp, Homo sapiens
aggaggccgaagaggctggag

SEQ ID NO: 60083 - DNA, 22 bp, Homo sapiens
ggaggcgggagggtaaagggag

SEQ ID NO: 60084 - DNA, 20 bp, Homo sapiens
ggaggcgggagggtaagggg

SEQ ID NO: 60085 - DNA, 18 bp, Homo sapiens
ggaggcggcggcgcagga

SEQ ID NO: 60086 - DNA, 17 bp, Homo sapiens
aggggatggcagagggg

SEQ ID NO: 60087 - DNA, 19 bp, Homo sapiens
ggaggtggcagaggagggg

SEQ ID NO: 60088 - DNA, 20 bp, Homo sapiens
agtgggcggtccgaggccgg

SEQ ID NO: 60089 - DNA, 18 bp, Homo sapiens
ggggggtggaggatgggg

SEQ ID NO: 60090 - DNA, 16 bp, Homo sapiens
aggaggcggccggccg

SEQ ID NO: 60091 - DNA, 18 bp, Homo sapiens
ggaagtggcagaggctga

SEQ ID NO: 60092 - DNA, 21 bp, Homo sapiens
aggggcggcaggcgaagccgg

SEQ ID NO: 60093 - DNA, 19 bp, Homo sapiens
gggggccgcagggcgccag

SEQ ID NO: 60094 - DNA, 21 bp, Homo sapiens
ggagaccaggaagggggctgg

SEQ ID NO: 60095 - DNA, 23 bp, Homo sapiens
aggcagcggtgggagggggctgg

SEQ ID NO: 60096 - DNA, 19 bp, Homo sapiens
ggcaggtggcgggaatcgg

SEQ ID NO: 60097 - DNA, 20 bp, Homo sapiens
ggaggcaggcagggtcccgg

SEQ ID NO: 60098 - DNA, 22 bp, Homo sapiens
ggaggcggggagggtagcatgg

SEQ ID NO: 60099 - DNA, 19 bp, Homo sapiens
aggggacggcagagaggga

SEQ ID NO: 60100 - DNA, 18 bp, Homo sapiens
ggaggcgggcagtcggag

SEQ ID NO: 60101 - DNA, 23 bp, Homo sapiens
ggaggctggcaggaaacgtggag

SEQ ID NO: 60102 - DNA, 19 bp, Homo sapiens
aggaggcggcaggaggagg

SEQ ID NO: 60103 - DNA, 19 bp, Homo sapiens
aggtggcggtggtagctgg

SEQ ID NO: 60104 - DNA, 26 bp, Homo sapiens
ggaggcggccacacgggaggctggag

SEQ ID NO: 60105 - DNA, 24 bp, Homo sapiens
aggagggagcagtggggaggctgg

SEQ ID NO: 60106 - DNA, 18 bp, Homo sapiens
aggaggaggtggaggagg

SEQ ID NO: 60107 - DNA, 18 bp, Homo sapiens
aggaggtggaggaggagg

SEQ ID NO: 60108 - DNA, 18 bp, Homo sapiens
ggagggggcagagagggg

SEQ ID NO: 60109 - DNA, 17 bp, Homo sapiens
ggaggcggcgggcgcgg

SEQ ID NO: 60110 - DNA, 18 bp, Homo sapiens
aggaggggtggagagggg

SEQ ID NO: 60111 - DNA, 21 bp, Homo sapiens
agcccctgcagaggaggccgg

SEQ ID NO: 60112 - DNA, 21 bp, Homo sapiens
agggggttggcatggggccgg

SEQ ID NO: 60113 - DNA, 23 bp, Homo sapiens
ggaggcggcgggcgggacaccgg

SEQ ID NO: 60114 - DNA, 21 bp, Homo sapiens
aggaggcggcggaagggatgg

SEQ ID NO: 60115 - DNA, 22 bp, Homo sapiens
aggtggtggcagaggggctgag

SEQ ID NO: 60116 - DNA, 22 bp, Homo sapiens
agagacagcaggaggaggtcgg

SEQ ID NO: 60117 - DNA, 21 bp, Homo sapiens
ggaggtggcaagggctgccgg

SEQ ID NO: 60118 - DNA, 21 bp, Homo sapiens
aggaggcggggagggggcggg

SEQ ID NO: 60119 - DNA, 19 bp, Homo sapiens
agaaggcggtgggatgggg

SEQ ID NO: 60120 - DNA, 22 bp, Homo sapiens
aggggctggcagcctcctggag

SEQ ID NO: 60121 - DNA, 24 bp, Homo sapiens
aggaggcggaacccgcggccggag

SEQ ID NO: 60122 - DNA, 21 bp, Homo sapiens
agcggagtctgagggggccgg

SEQ ID NO: 60123 - DNA, 21 bp, Homo sapiens
ggaggcggtgggcgaagctgg

SEQ ID NO: 60124 - DNA, 22 bp, Homo sapiens
aggaggcggcggcggcacagag

SEQ ID NO: 60125 - DNA, 18 bp, Homo sapiens
agggggcggcaggcgggg

SEQ ID NO: 60126 - DNA, 17 bp, Homo sapiens
ggaggcggtggggacag

SEQ ID NO: 60127 - DNA, 22 bp, Homo sapiens
aggaggcgacaggacgctggag

SEQ ID NO: 60128 - DNA, 19 bp, Homo sapiens
ggagtggcagggcgcggag

SEQ ID NO: 60129 - DNA, 16 bp, Homo sapiens
aggagggaggggctgg

SEQ ID NO: 60130 - DNA, 22 bp, Homo sapiens
gggtgcagacagaggaggccgg

SEQ ID NO: 60131 - DNA, 21 bp, Homo sapiens
aggaggcggcggcagggctgg

SEQ ID NO: 60132 - DNA, 23 bp, Homo sapiens
gggggtggggaggagacctggag

SEQ ID NO: 60133 - DNA, 18 bp, Homo sapiens
aggaggggtagagagagg

SEQ ID NO: 60134 - DNA, 18 bp, Homo sapiens
ggaggcggcacgccttgg

SEQ ID NO: 60135 - DNA, 18 bp, Homo sapiens
ggaggcggctgaggcagg

SEQ ID NO: 60136 - DNA, 18 bp, Homo sapiens
aggaggtggcagaagcgg

SEQ ID NO: 60137 - DNA, 17 bp, Homo sapiens
ggaggagagggggctgg

SEQ ID NO: 60138 - DNA, 21 bp, Homo sapiens
ggggttggcagaggggtatgg

SEQ ID NO: 60139 - DNA, 21 bp, Homo sapiens
ggaggcggtgcaggctgggag

SEQ ID NO: 60140 - DNA, 17 bp, Homo sapiens
gggggcggggagggcgg

SEQ ID NO: 60141 - DNA, 20 bp, Homo sapiens
gggggcagcaggggacggag

SEQ ID NO: 60142 - DNA, 16 bp, Homo sapiens
agggggcggggagggg

SEQ ID NO: 60143 - DNA, 21 bp, Homo sapiens
agggggcggcagagagcacag

SEQ ID NO: 60144 - DNA, 18 bp, Homo sapiens
aggaggtggaagaacgga

SEQ ID NO: 60145 - DNA, 24 bp, Homo sapiens
ggaggcggccgagggggaggctgg

SEQ ID NO: 60146 - DNA, 18 bp, Homo sapiens
agaggacggggaggctgg

SEQ ID NO: 60147 - DNA, 19 bp, Homo sapiens
aggcaggcggcaggggaga

SEQ ID NO: 60148 - DNA, 19 bp, Homo sapiens
ggaggtggaggagacgcgg

SEQ ID NO: 60149 - DNA, 23 bp, Homo sapiens
aggtggcggcggcaaggccggag

SEQ ID NO: 60150 - DNA, 20 bp, Homo sapiens
aggaagaagagggaggctgg

SEQ ID NO: 60151 - DNA, 17 bp, Homo sapiens
aggaggcggcgggaggc

SEQ ID NO: 60152 - DNA, 17 bp, Homo sapiens
ggaggcggcagggtcgg

SEQ ID NO: 60153 - DNA, 18 bp, Homo sapiens
ggaggcagcgggggtcag

SEQ ID NO: 60154 - DNA, 18 bp, Homo sapiens
aggaggaggcggaggaag

SEQ ID NO: 60155 - DNA, 20 bp, Homo sapiens
gggagcggcggggaccggag

SEQ ID NO: 60156 - DNA, 21 bp, Homo sapiens
aggaggcgatggcagctggag

SEQ ID NO: 60157 - DNA, 18 bp, Homo sapiens
ggggcggcctggccggag

SEQ ID NO: 60158 - DNA, 21 bp, Homo sapiens
aggggtgtggtggaggaaggg

SEQ ID NO: 60159 - DNA, 22 bp, Homo sapiens
aggaggctgtggggccatggag

SEQ ID NO: 60160 - DNA, 20 bp, Homo sapiens
ggtaggtggcagaagtgggg

SEQ ID NO: 60161 - DNA, 22 bp, Homo sapiens
ggcgggcgggcggaggccggag

SEQ ID NO: 60162 - DNA, 19 bp, Homo sapiens
aggaggaggcagggagggg

SEQ ID NO: 60163 - DNA, 19 bp, Homo sapiens
aggaggcggcgcggggagg

SEQ ID NO: 60164 - DNA, 20 bp, Homo sapiens
ggaggcaggcagggcttggg

SEQ ID NO: 60165 - DNA, 21 bp, Homo sapiens
aggaggcggtgagcttgctgg

SEQ ID NO: 60166 - DNA, 17 bp, Homo sapiens
ggaggcggcgggcctgg

SEQ ID NO: 60167 - DNA, 21 bp, Homo sapiens
ggcagccctggaggaggctgg

SEQ ID NO: 60168 - DNA, 20 bp, Homo sapiens
gggggtgcagaaaagtggag

SEQ ID NO: 60169 - DNA, 23 bp, Homo sapiens
ggaggcggtggaggaaccgcgag

SEQ ID NO: 60170 - DNA, 22 bp, Homo sapiens
gggggcggggccgaggccggag

SEQ ID NO: 60171 - DNA, 20 bp, Homo sapiens
ggaagcggcagactatggag

SEQ ID NO: 60172 - DNA, 16 bp, Homo sapiens
ggaggcggcgggccgg

SEQ ID NO: 60173 - DNA, 18 bp, Homo sapiens
aggaggaggagggccgga

SEQ ID NO: 60174 - DNA, 21 bp, Homo sapiens
ggaggcggcaggcggctggag

SEQ ID NO: 60175 - DNA, 20 bp, Homo sapiens
aggaggcggcgagcggcggg

SEQ ID NO: 60176 - DNA, 23 bp, Homo sapiens
ggaggaggcggaggagaaaaaag

SEQ ID NO: 60177 - DNA, 19 bp, Homo sapiens
ggaggaggcagaggagcag

SEQ ID NO: 60178 - DNA, 18 bp, Homo sapiens
ggaggcggcgcaggacgc

SEQ ID NO: 60179 - DNA, 19 bp, Homo sapiens
aggaggcggcgggggccgg

SEQ ID NO: 60180 - DNA, 19 bp, Homo sapiens
ggaggggcagagagagggg

SEQ ID NO: 60181 - DNA, 17 bp, Homo sapiens
aggaggggagaggctgg

SEQ ID NO: 60182 - DNA, 22 bp, Homo sapiens
ggagggaaagaggaggctggag

SEQ ID NO: 60183 - DNA, 17 bp, Homo sapiens
ggaggcgcgcgggcgga

SEQ ID NO: 60184 - DNA, 21 bp, Homo sapiens
agaggggtgaagggaggccgg

SEQ ID NO: 60185 - DNA, 18 bp, Homo sapiens
agggggcggtggaggggc

SEQ ID NO: 60186 - DNA, 19 bp, Homo sapiens
aggaggcaggcagagagga

SEQ ID NO: 60187 - DNA, 22 bp, Homo sapiens
aggaggctgcagctggggttgg

SEQ ID NO: 60188 - DNA, 19 bp, Homo sapiens
aggaggcgcagcttccgga

SEQ ID NO: 60189 - DNA, 19 bp, Homo sapiens
aggagtgtggcaggggagg

SEQ ID NO: 60190 - DNA, 22 bp, Homo sapiens
agagggtggcagaggagtgtgg

SEQ ID NO: 60191 - DNA, 23 bp, Homo sapiens
agaggtggcaggggagggaggag

SEQ ID NO: 60192 - DNA, 24 bp, Homo sapiens
aggaggaggcatgaggggccggag

SEQ ID NO: 60193 - DNA, 18 bp, Homo sapiens
agaaggcggcagggtcgg

SEQ ID NO: 60194 - DNA, 18 bp, Homo sapiens
aggaggcgggggacacag

SEQ ID NO: 60195 - DNA, 22 bp, Homo sapiens
agggggcgcgtggggagtggag

SEQ ID NO: 60196 - DNA, 20 bp, Homo sapiens
ggaggtgggggggacaggag

SEQ ID NO: 60197 - DNA, 17 bp, Homo sapiens
aggaggcggcagatggc

SEQ ID NO: 60198 - DNA, 21 bp, Homo sapiens
aggaggcggcggaggctgaag

SEQ ID NO: 60199 - DNA, 19 bp, Homo sapiens
ggaggcggcggggatgggg

SEQ ID NO: 60200 - DNA, 19 bp, Homo sapiens
aggaggcggcggcagcgga

SEQ ID NO: 60201 - DNA, 19 bp, Homo sapiens
aggaggcggtggtggtgga

SEQ ID NO: 60202 - DNA, 18 bp, Homo sapiens
aggaggtgggagaggagg

SEQ ID NO: 60203 - DNA, 23 bp, Homo sapiens
aggcggcggcagaggaggaggag

SEQ ID NO: 60204 - DNA, 23 bp, Homo sapiens
aggaggcggcggcgactgaggag

SEQ ID NO: 60205 - DNA, 20 bp, Homo sapiens
aggaggcggggggaggtggg

SEQ ID NO: 60206 - DNA, 18 bp, Homo sapiens
aggaggcggaggttgggg

SEQ ID NO: 60207 - DNA, 22 bp, Homo sapiens
ggcaggcggcaggcacatgggg

SEQ ID NO: 60208 - DNA, 22 bp, Homo sapiens
gggggcggcagaagcctgtgag

SEQ ID NO: 60209 - DNA, 19 bp, Homo sapiens
gggggcggcaggggcgcgg

SEQ ID NO: 60210 - DNA, 21 bp, Homo sapiens
aggaggcaggcagaattgggg

SEQ ID NO: 60211 - DNA, 20 bp, Homo sapiens
aggggacagcaggaggctgg

SEQ ID NO: 60212 - DNA, 20 bp, Homo sapiens
aggcaggtggtggggcgtgg

SEQ ID NO: 60213 - DNA, 20 bp, Homo sapiens
ggccctggaggaggctggag

SEQ ID NO: 60214 - DNA, 18 bp, Homo sapiens
aggaggcggcgcagggag

SEQ ID NO: 60215 - DNA, 21 bp, Homo sapiens
aggaggcaggcagaggcagag

SEQ ID NO: 60216 - DNA, 19 bp, Homo sapiens
ggtggtggcaggactggag

SEQ ID NO: 60217 - DNA, 22 bp, Homo sapiens
aggaggaggaaagaggctggag

SEQ ID NO: 60218 - DNA, 22 bp, Homo sapiens
ggcaggccctcagggaggctgg

SEQ ID NO: 60219 - DNA, 20 bp, Homo sapiens
ggaggtggcagggaaagggg

SEQ ID NO: 60220 - DNA, 24 bp, Homo sapiens
gaaggcggcgggactcggggctgg

SEQ ID NO: 60221 - DNA, 17 bp, Homo sapiens
aggaggagaggggctgg

SEQ ID NO: 60222 - DNA, 21 bp, Homo sapiens
aggaggctgtggataacttgg

SEQ ID NO: 60223 - DNA, 20 bp, Homo sapiens
aggggcggcagagcagggag

SEQ ID NO: 60224 - DNA, 26 bp, Homo sapiens
aggaggcggcggtggtcgtggcggag

SEQ ID NO: 60225 - DNA, 17 bp, Homo sapiens
ggaggggcgggggcgag

SEQ ID NO: 60226 - DNA, 20 bp, Homo sapiens
gggggccgaggaggccggag

SEQ ID NO: 60227 - DNA, 18 bp, Homo sapiens
gggggccgaggaggccgg

SEQ ID NO: 60228 - DNA, 16 bp, Homo sapiens
ggggtgaggaggccgg

SEQ ID NO: 60229 - DNA, 17 bp, Homo sapiens
ggaggaggcagagggac

SEQ ID NO: 60230 - DNA, 21 bp, Homo sapiens
ggagggtggcagaggctgggg

SEQ ID NO: 60231 - DNA, 18 bp, Homo sapiens
ggaggtggaggaggctgg

SEQ ID NO: 60232 - DNA, 19 bp, Homo sapiens
ggaggcgggagggggaagg

SEQ ID NO: 60233 - DNA, 18 bp, Homo sapiens
ggaggccaccggggccgg

SEQ ID NO: 60234 - DNA, 18 bp, Homo sapiens
ggaggagatgaggttgga

SEQ ID NO: 60235 - DNA, 21 bp, Homo sapiens
aggagacggcaggggaaagag

SEQ ID NO: 60236 - DNA, 17 bp, Homo sapiens
gggggcggagggaggga

SEQ ID NO: 60237 - DNA, 20 bp, Homo sapiens
aggaggcggaggaggagcag

SEQ ID NO: 60238 - DNA, 19 bp, Homo sapiens
aggaggttgcagaggacgg

SEQ ID NO: 60239 - DNA, 17 bp, Homo sapiens
aggaggcggggggccgg

SEQ ID NO: 60240 - DNA, 19 bp, Homo sapiens
ggcaggcggcaggggcgag

SEQ ID NO: 60241 - DNA, 22 bp, Homo sapiens
aggagggggcggggggccctgg

SEQ ID NO: 60242 - DNA, 17 bp, Homo sapiens
ggaggtggcgggagggg

SEQ ID NO: 60243 - DNA, 23 bp, Homo sapiens
agagggtggggtgggggctggag

SEQ ID NO: 60244 - DNA, 18 bp, Homo sapiens
gggggcggcagatgggag

SEQ ID NO: 60245 - DNA, 22 bp, Homo sapiens
ggaggcggcagaggagttgtgg

SEQ ID NO: 60246 - DNA, 21 bp, Homo sapiens
aggaggtggcaaaggcttagg

SEQ ID NO: 60247 - DNA, 18 bp, Homo sapiens
aggaggcgggcggagggg

SEQ ID NO: 60248 - DNA, 16 bp, Homo sapiens
aggaggcgagggctgg

SEQ ID NO: 60249 - DNA, 19 bp, Homo sapiens
aggaggcggaggggggcgg

SEQ ID NO: 60250 - DNA, 19 bp, Homo sapiens
ggaggcggcggtgagctgg

SEQ ID NO: 60251 - DNA, 19 bp, Homo sapiens
aggaggcggccagggtgga

SEQ ID NO: 60252 - DNA, 18 bp, Homo sapiens
agggggcggagaggccga

SEQ ID NO: 60253 - DNA, 17 bp, Homo sapiens
ggaggctgcaggccgga

SEQ ID NO: 60254 - DNA, 19 bp, Homo sapiens
ggaggaggcagggccctgg

SEQ ID NO: 60255 - DNA, 18 bp, Homo sapiens
ggaggcggagagagctgg

SEQ ID NO: 60256 - DNA, 22 bp, Homo sapiens
agggggcggcagagcttcctgg

SEQ ID NO: 60257 - DNA, 23 bp, Homo sapiens
agggggccgctgggaggccggag

SEQ ID NO: 60258 - DNA, 21 bp, Homo sapiens
aggaggcgggaggacacggag

SEQ ID NO: 60259 - DNA, 17 bp, Homo sapiens
gggagcgaggaggctgg

SEQ ID NO: 60260 - DNA, 19 bp, Homo sapiens
agggggctgctgggccgga

SEQ ID NO: 60261 - DNA, 21 bp, Homo sapiens
aggaggaggtaggagttggag

SEQ ID NO: 60262 - DNA, 20 bp, Homo sapiens
ggcaggtggcagagagtggg

SEQ ID NO: 60263 - DNA, 22 bp, Homo sapiens
agggggctggctttggggctgg

SEQ ID NO: 60264 - DNA, 24 bp, Homo sapiens
aggaggaggcggaggaggacttgg

SEQ ID NO: 60265 - DNA, 19 bp, Homo sapiens
ggaggcaggtaggagctgg

SEQ ID NO: 60266 - DNA, 18 bp, Homo sapiens
aggaggcggtgcaggagg

SEQ ID NO: 60267 - DNA, 18 bp, Homo sapiens
ggaggcggcgtaaacggg

SEQ ID NO: 60268 - DNA, 19 bp, Homo sapiens
aggaggcgggtggcttgga

SEQ ID NO: 60269 - DNA, 18 bp, Homo sapiens
aggagccctggaggccgg

SEQ ID NO: 60270 - DNA, 20 bp, Homo sapiens
ggagctggggtggaggccgg

SEQ ID NO: 60271 - DNA, 19 bp, Homo sapiens
gggggtggcagaggaccaa

SEQ ID NO: 60272 - DNA, 17 bp, Homo sapiens
aggaggcggcagcgggg

SEQ ID NO: 60273 - DNA, 26 bp, Homo sapiens
aggaggcggccgaggcgcaggcggag

SEQ ID NO: 60274 - DNA, 19 bp, Homo sapiens
agggggcgggagagaggga

SEQ ID NO: 60275 - DNA, 20 bp, Homo sapiens
agaggcggcgggggccttgg

SEQ ID NO: 60276 - DNA, 20 bp, Homo sapiens
aggaggggcagaggggccgg

SEQ ID NO: 60277 - DNA, 19 bp, Homo sapiens
aggaggtggagggagagga

SEQ ID NO: 60278 - DNA, 20 bp, Homo sapiens
ggcaggggctggggggctgg

SEQ ID NO: 60279 - DNA, 16 bp, Homo sapiens
agggggcggaggaggg

SEQ ID NO: 60280 - DNA, 19 bp, Homo sapiens
aggaggcggtggtggtggg

SEQ ID NO: 60281 - DNA, 18 bp, Homo sapiens
ggaggcgggggtacctgg

SEQ ID NO: 60282 - DNA, 19 bp, Homo sapiens
ggaggtggtggaggcggag

SEQ ID NO: 60283 - DNA, 18 bp, Homo sapiens
aggaggcggagggggtgg

SEQ ID NO: 60284 - DNA, 23 bp, Homo sapiens
ggagctctcggaggaggccggag

SEQ ID NO: 60285 - DNA, 17 bp, Homo sapiens
aggaggcggggatgggg

SEQ ID NO: 60286 - DNA, 22 bp, Homo sapiens
ggaggcgggtggaggacacgag

SEQ ID NO: 60287 - DNA, 19 bp, Homo sapiens
aggaggcggcggcgggcgg

SEQ ID NO: 60288 - DNA, 18 bp, Homo sapiens
aggaggcggtgacgccgg

SEQ ID NO: 60289 - DNA, 23 bp, Homo sapiens
aggaggctggggcggggccggag

SEQ ID NO: 60290 - DNA, 19 bp, Homo sapiens
ggaggcggcgggggaggag

SEQ ID NO: 60291 - DNA, 22 bp, Homo sapiens
aggagcgcggcaggggccagag

SEQ ID NO: 60292 - DNA, 19 bp, Homo sapiens
aggcggcggcggggaggga

SEQ ID NO: 60293 - DNA, 19 bp, Homo sapiens
aaggaggcctgggggccgg

SEQ ID NO: 60294 - DNA, 20 bp, Homo sapiens
aggaggcgcgccccggccgg

SEQ ID NO: 60295 - DNA, 18 bp, Homo sapiens
aggaggcggcgggagggg

SEQ ID NO: 60296 - DNA, 15 bp, Homo sapiens
ggaggcggaggccag

SEQ ID NO: 60297 - DNA, 19 bp, Homo sapiens
agaggtggcggggcctgga

SEQ ID NO: 60298 - DNA, 22 bp, Homo sapiens
agggggcgggcaggctgtgggg

SEQ ID NO: 60299 - DNA, 22 bp, Homo sapiens
ggaggggtgctgctggccggag

SEQ ID NO: 60300 - DNA, 18 bp, Homo sapiens
ggaggaggcgggggccgg

SEQ ID NO: 60301 - DNA, 18 bp, Homo sapiens
aggaagcggcgggctcgg

SEQ ID NO: 60302 - DNA, 21 bp, Homo sapiens
aggaggcgcagaggggcgtgg

SEQ ID NO: 60303 - DNA, 23 bp, Homo sapiens
aggagctgtataaggggttggag

SEQ ID NO: 60304 - DNA, 23 bp, Homo sapiens
ggaggcgggctggcgggggccgg

SEQ ID NO: 60305 - DNA, 19 bp, Homo sapiens
ggggcggcggcggccggag

SEQ ID NO: 60306 - DNA, 21 bp, Homo sapiens
aggaggcaggcaggtgtgggg

SEQ ID NO: 60307 - DNA, 18 bp, Homo sapiens
aggaggcggtggagagag

SEQ ID NO: 60308 - DNA, 19 bp, Homo sapiens
ggggggcaggtggaggaga

SEQ ID NO: 60309 - DNA, 17 bp, Homo sapiens
ggagacggtggacctgg

SEQ ID NO: 60310 - DNA, 19 bp, Homo sapiens
aggaggtggagaggaaggg

SEQ ID NO: 60311 - DNA, 21 bp, Homo sapiens
aggaggcgacagaggagggag

SEQ ID NO: 60312 - DNA, 18 bp, Homo sapiens
ggaggaggcagggtgggg

SEQ ID NO: 60313 - DNA, 19 bp, Homo sapiens
gaaggcggcgggggaggag

SEQ ID NO: 60314 - DNA, 18 bp, Homo sapiens
aggaggcagcagagggag

SEQ ID NO: 60315 - DNA, 18 bp, Homo sapiens
ggaggcggaagggccgga

SEQ ID NO: 60316 - DNA, 17 bp, Homo sapiens
gaggggaggaggctgga

SEQ ID NO: 60317 - DNA, 17 bp, Homo sapiens
aggggtggtagaggaag

SEQ ID NO: 60318 - DNA, 21 bp, Homo sapiens
agggggcggcagccgggccgg

SEQ ID NO: 60319 - DNA, 19 bp, Homo sapiens
aggagctggcagaggctgg

SEQ ID NO: 60320 - DNA, 16 bp, Homo sapiens
ggggcggcgaggccgg

SEQ ID NO: 60321 - DNA, 99 bp, Human herpesvirus 1
gggtaccacaggtgggtgctttggaaacttgccggtcgccgtgctcctgtgagcttgcgtccctccccggtttcctttgcgctcccgccttccggacct

SEQ ID NO: 60322 - DNA, 24 bp, Human herpesvirus 1
tggaaacttgccggtcgccgtgct

SEQ ID NO: 60323 - DNA, 21 bp, Homo sapiens
ggaagcccctgtcgccgtgct

SEQ ID NO: 60324 - DNA, 23 bp, Homo sapiens
tggaggctgccgccgtctgtgct

SEQ ID NO: 60325 - DNA, 19 bp, Homo sapiens
tggaaacttgctgctctcc

SEQ ID NO: 60326 - DNA, 100 bp, Chimpanzee cytomegalovirus
gccgaaagccgcgtgtcggtgacacgtcgtcttgagacggtgtcttatatatcttcttaagacgccggacatgacgcgcccaagacacgtggattttggc

SEQ ID NO: 60327 - DNA, 24 bp, Chimpanzee cytomegalovirus
ggacatgacgcgcccaagacacgt

SEQ ID NO: 60328 - DNA, 23 bp, Homo sapiens
ggtacatgcagtctgagacacgt

SEQ ID NO: 60329 - DNA, 23 bp, Homo sapiens
ggaggtgacgcgctcggactcgt

SEQ ID NO: 60330 - DNA, 19 bp, Homo sapiens
ggatgtgacctgcccaaga

SEQ ID NO: 60331 - DNA, 89 bp, Chimpanzee cytomegalovirus
tgtacgtatgtcgtgactgtcgcgcgtgtccttgaacgtcagataccggtactgacgcgaggacccgacagcttacgagacattgagca

SEQ ID NO: 60332 - DNA, 24 bp, Chimpanzee cytomegalovirus
tgacgcgaggacccgacagcttac

SEQ ID NO: 60333 - DNA, 19 bp, Homo sapiens
tgactgggaaagacagctt

SEQ ID NO: 60334 - DNA, 19 bp, Homo sapiens
gagggcccctgacagctta

SEQ ID NO: 60335 - DNA, 123 bp, Amsacta moorei entomopoxvirus
tatattatataatattttataaaattagtatttcttttatatattccaattaatagtaaaatatttataaatatagatataattgaactaataatctctattgtaacaatattatataatata

SEQ ID NO: 60336 - DNA, 24 bp, Amsacta moorei entomopoxvirus
tattatataatattttataaaatt

SEQ ID NO: 60337 - DNA, 18 bp, Homo sapiens
tattatataacattttat

SEQ ID NO: 60338 - DNA, 62 bp, Human herpesvirus 6
gtttttcttgtctactggttaacatatacaacaacacaattaacttcctgtaaaagaaaaac

SEQ ID NO: 60339 - DNA, 18 bp, Human herpesvirus 6
ttcctgtaaaagaaaaac

SEQ ID NO: 60340 - DNA, 19 bp, Homo sapiens
ctcctgtaaatgtcaaaac

SEQ ID NO: 60341 - DNA, 20 bp, Homo sapiens
tcccccaaaaaaagaaaaac

SEQ ID NO: 60342 - DNA, 17 bp, Homo sapiens
ctcctgccaagaaaaac

SEQ ID NO: 60343 - DNA, 18 bp, Homo sapiens
tctccacaaaagaaaaac

SEQ ID NO: 60344 - DNA, 18 bp, Homo sapiens
ctccaagaaaagaaaaac

SEQ ID NO: 60345 - DNA, 18 bp, Homo sapiens
tccctgtatacaagaaaa

SEQ ID NO: 60346 - DNA, 17 bp, Homo sapiens
ttcctgcttaaaaaaac

SEQ ID NO: 60347 - DNA, 17 bp, Homo sapiens
ttcctacaaagaaaaac

SEQ ID NO: 60348 - DNA, 18 bp, Homo sapiens
tcctgtaaaaaagaaaac

SEQ ID NO: 60349 - DNA, 18 bp, Homo sapiens
ttctccgcaaagaaaaac

SEQ ID NO: 60350 - DNA, 18 bp, Homo sapiens
ttcccatgtaagaaaaac

SEQ ID NO: 60351 - DNA, 18 bp, Homo sapiens
ttcctgtattaggaaaac

SEQ ID NO: 60352 - DNA, 18 bp, Homo sapiens
ctcctgccttagaaaaac

SEQ ID NO: 60353 - DNA, 15 bp, Homo sapiens
ttcctgtagaaaaac

SEQ ID NO: 60354 - DNA, 18 bp, Homo sapiens
ctcctgtatctaaagaaa

SEQ ID NO: 60355 - DNA, 18 bp, Homo sapiens
ttcctttaaaaaaaaaac

SEQ ID NO: 60356 - DNA, 18 bp, Homo sapiens
ctcctatgccagaaaaac

SEQ ID NO: 60357 - DNA, 18 bp, Homo sapiens
tcgccccaaaagaaaaac

SEQ ID NO: 60358 - DNA, 18 bp, Homo sapiens
ttcccatacaggaaaaac

SEQ ID NO: 60359 - DNA, 18 bp, Homo sapiens
ttcctaaaaaagaaaaac

SEQ ID NO: 60360 - DNA, 22 bp, Homo sapiens
ctcctgcaaaaagggagaaaaa

SEQ ID NO: 60361 - DNA, 19 bp, Homo sapiens
tccccgtaaagggaaaaac

SEQ ID NO: 60362 - DNA, 16 bp, Homo sapiens
ttcctgaaagaaaaac

SEQ ID NO: 60363 - DNA, 18 bp, Homo sapiens
ttcctgtggcagaaaaac

SEQ ID NO: 60364 - DNA, 60 bp, Myxoma virus
cgggtgctccgctcttcgtacctgtagacttggatgtcttttttgatttagctgcacccg

SEQ ID NO: 60365 - DNA, 22 bp, Myxoma virus
ttttttgatttagctgcacccg

SEQ ID NO: 60366 - DNA, 17 bp, Homo sapiens
cttttctacagctgcac

SEQ ID NO: 60367 - DNA, 15 bp, Homo sapiens
ttttttaaagctgca

SEQ ID NO: 60368 - DNA, 22 bp, Homo sapiens
ttctttgagcagcggctgcacc

SEQ ID NO: 60369 - DNA, 18 bp, Homo sapiens
tcttttgatttagcaaca

SEQ ID NO: 60370 - DNA, 20 bp, Homo sapiens
ctttttggcaaagctgcacc

SEQ ID NO: 60371 - DNA, 20 bp, Homo sapiens
tttttgatttcagccacccg

SEQ ID NO: 60372 - DNA, 21 bp, Homo sapiens
tcttttacatagctgcattcg

SEQ ID NO: 60373 - DNA, 94 bp, Myxoma virus
ccgaggtcgtcggtttcgagtatttccactttgtgcataccccccttcattcggcggggtttagactttgtcgattttctaccggcatttacgg

SEQ ID NO: 60374 - DNA, 24 bp, Myxoma virus
tttagactttgtcgattttctacc

SEQ ID NO: 60375 - DNA, 18 bp, Homo sapiens
tttagacttcaccttttt

SEQ ID NO: 60376 - DNA, 17 bp, Homo sapiens
gacttgtcttctctacc

SEQ ID NO: 60377 - DNA, 18 bp, Homo sapiens
tttagatttattttctac

SEQ ID NO: 60378 - DNA, 17 bp, Homo sapiens
tagatgtgattttctac

SEQ ID NO: 60379 - DNA, 23 bp, Homo sapiens
ttcagattatcaaattttctacc

SEQ ID NO: 60380 - DNA, 21 bp, Homo sapiens
tttagtattctcattttctac

SEQ ID NO: 60381 - DNA, 20 bp, Homo sapiens
taggctttgatgttttctac

SEQ ID NO: 60382 - DNA, 86 bp, Beet yellows virus
tgttgttgcgttcgaaaccgaagaggaatcatcggaagctgaacttcctttggtatacctccacgatttcgaattaaacattaaca

SEQ ID NO: 60383 - DNA, 24 bp, Beet yellows virus
agaggaatcatcggaagctgaact

SEQ ID NO: 60384 - DNA, 19 bp, Homo sapiens
agaggaatgttggaacctg

SEQ ID NO: 60385 - DNA, 21 bp, Homo sapiens
aaggcaactggaagctggact

SEQ ID NO: 60386 - DNA, 20 bp, Homo sapiens
agagggagtggggctgaact

SEQ ID NO: 60387 - DNA, 21 bp, Homo sapiens
agagcggctggaagctggact

SEQ ID NO: 60388 - DNA, 19 bp, Homo sapiens
gaggacaggaagctggact

SEQ ID NO: 60389 - DNA, 15 bp, Homo sapiens
gaggaaccagctgaa

SEQ ID NO: 60390 - DNA, 21 bp, Homo sapiens
agaggcaatcattggcaaact

SEQ ID NO: 60391 - DNA, 19 bp, Homo sapiens
agagtaatcatcggggtga

SEQ ID NO: 60392 - DNA, 22 bp, Homo sapiens
agagggtgactggggctgaact

SEQ ID NO: 60393 - DNA, 19 bp, Homo sapiens
agaggaactgtcgggggcc

SEQ ID NO: 60394 - DNA, 18 bp, Homo sapiens
agaggaattctcggggct

SEQ ID NO: 60395 - DNA, 19 bp, Homo sapiens
aaggaatggaaagaagctg

SEQ ID NO: 60396 - DNA, 16 bp, Homo sapiens
agagaaaggagctgaa

SEQ ID NO: 60397 - DNA, 20 bp, Homo sapiens
gaggaatcgccgccggagct

SEQ ID NO: 60398 - DNA, 18 bp, Homo sapiens
agaagacggaggctggac

SEQ ID NO: 60399 - DNA, 20 bp, Homo sapiens
agaggaatccttggatactg

SEQ ID NO: 60400 - DNA, 16 bp, Homo sapiens
agaagaatcagttgaa

SEQ ID NO: 60401 - DNA, 19 bp, Homo sapiens
gaggaatcatcggaagtcc

SEQ ID NO: 60402 - DNA, 22 bp, Homo sapiens
gaggaatcaatgaaggtgaact

SEQ ID NO: 60403 - DNA, 23 bp, Homo sapiens
agggaagatgaagaagctggact

SEQ ID NO: 60404 - DNA, 20 bp, Homo sapiens
agaggaatcttggaggagct

SEQ ID NO: 60405 - DNA, 15 bp, Homo sapiens
agaggagaagctgaa

SEQ ID NO: 60406 - DNA, 124 bp, Beet yellows virus
cgtaaagtgacgtttacgttcgaaaacggagtccaactagtgttcgggatgtatggactcgaacaacggtgcgtttcttccgactacttgtggtttgaaaacgttttcgttggcgcgcactgcg

SEQ ID NO: 60407 - DNA, 24 bp, Beet yellows virus
tcgaaaacggagtccaactagtgt

SEQ ID NO: 60408 - DNA, 20 bp, Homo sapiens
gagacggagtcttgctctgt

SEQ ID NO: 60409 - DNA, 20 bp, Homo sapiens
gagacggagtctcgctctgt

SEQ ID NO: 60410 - DNA, 20 bp, Homo sapiens
gagacggagtctcactctgt

SEQ ID NO: 60411 - DNA, 20 bp, Homo sapiens
gagacggagtctggctctgt

SEQ ID NO: 60412 - DNA, 20 bp, Homo sapiens
gagacggagtctcgctgtgt

SEQ ID NO: 60413 - DNA, 20 bp, Homo sapiens
gagacggagtccttctctgt

SEQ ID NO: 60414 - DNA, 20 bp, Homo sapiens
gagacggagtctcgccctgt

SEQ ID NO: 60415 - DNA, 21 bp, Homo sapiens
tcgaggacggtgttcactagt

SEQ ID NO: 60416 - DNA, 23 bp, Homo sapiens
tctgaaacggagtctcgctctgt

SEQ ID NO: 60417 - DNA, 21 bp, Homo sapiens
cgaggatggggtccaactagt

SEQ ID NO: 60418 - DNA, 20 bp, Homo sapiens
gagacggagtcttactctgt

SEQ ID NO: 60419 - DNA, 24 bp, Homo sapiens
tcaaagtggagtccaaaaacttgt

SEQ ID NO: 60420 - DNA, 22 bp, Homo sapiens
tcgagacggagtctcgctctgt

SEQ ID NO: 60421 - DNA, 20 bp, Homo sapiens
gagacggagtctccctctgt

SEQ ID NO: 60422 - DNA, 24 bp, Homo sapiens
tcagaacggagttcatatacatgt

SEQ ID NO: 60423 - DNA, 22 bp, Homo sapiens
tcgagacggagtctcgctgtgt

SEQ ID NO: 60424 - DNA, 20 bp, Homo sapiens
gagacggagtctcactgtgt

SEQ ID NO: 60425 - DNA, 21 bp, Homo sapiens
aaaacggagtttggctcttgt

SEQ ID NO: 60426 - DNA, 17 bp, Homo sapiens
gaaaacaggagtctgtg

SEQ ID NO: 60427 - DNA, 18 bp, Homo sapiens
gagacggagtctagatgt

SEQ ID NO: 60428 - DNA, 21 bp, Homo sapiens
tcaaaatggagtccacatagt

SEQ ID NO: 60429 - DNA, 60 bp, Marburg virus
cttgtagaattaccgtggatcacaactgttgcatatcttccaaaatatatcttttgcaag

SEQ ID NO: 60430 - DNA, 24 bp, Marburg virus
tgtagaattaccgtggatcacaac

SEQ ID NO: 60431 - DNA, 19 bp, Homo sapiens
tgtagaattgcaggaccca

SEQ ID NO: 60432 - DNA, 23 bp, Homo sapiens
tgtagaattactaaactgtcaca

SEQ ID NO: 60433 - DNA, 20 bp, Homo sapiens
tgtggaaatataaatcacaa

SEQ ID NO: 60434 - DNA, 19 bp, Homo sapiens
gaattaaaattatcacaac

SEQ ID NO: 60435 - DNA, 20 bp, Homo sapiens
tagaattggtacatcacaac

SEQ ID NO: 60436 - DNA, 20 bp, Homo sapiens
tgtagaatttcctcttgtag

SEQ ID NO: 60437 - DNA, 19 bp, Homo sapiens
tgtaagttactgtaaatca

SEQ ID NO: 60438 - DNA, 21 bp, Homo sapiens
tgagaattaccaaaatgtgac

SEQ ID NO: 60439 - DNA, 20 bp, Homo sapiens
tgaggaattaagagatcaca

SEQ ID NO: 60440 - DNA, 21 bp, Homo sapiens
tgtagcatctgcttggatcac

SEQ ID NO: 60441 - DNA, 116 bp, Camelpox virus
tagacttccaagtattaattcgttacagatccatgtatgaaacgagtcgctaattagtgtataattttcattttttataattttgtcatactgctccagaattaataatatctcta

SEQ ID NO: 60442 - DNA, 24 bp, Camelpox virus
tccaagtattaattcgttacagat

SEQ ID NO: 60443 - DNA, 16 bp, Homo sapiens
caagcattaatacaga

SEQ ID NO: 60444 - DNA, 16 bp, Homo sapiens
caagtattattccaga

SEQ ID NO: 60445 - DNA, 19 bp, Homo sapiens
aagtatttaaattacagat

SEQ ID NO: 60446 - DNA, 20 bp, Homo sapiens
caggtattacatttacagat

SEQ ID NO: 60447 - DNA, 16 bp, Homo sapiens
tccaaggatgttacag

SEQ ID NO: 60448 - DNA, 19 bp, Homo sapiens
caagtacttagtgttacag

SEQ ID NO: 60449 - DNA, 27 bp, Homo sapiens
tccaagttttaattcagcaaagcagat

SEQ ID NO: 60450 - DNA, 18 bp, Homo sapiens
caagtatttgccatacag

SEQ ID NO: 60451 - DNA, 128 bp, Paramecium bursaria Chlorella virus 1
gtttcggggaagggggaggagaaggtttcgggggaggaggtggacttgtgacactcgggttatcattaacgatacttacatcggcgcaattccaaaattcttcgggtacagcaccaggttctccacac

SEQ ID NO: 60452 - DNA, 22 bp, Paramecium bursaria Chlorella virus 1
tacagcaccaggttctccacac

SEQ ID NO: 60453 - DNA, 18 bp, Homo sapiens
tacagcaccagggccgca

SEQ ID NO: 60454 - DNA, 18 bp, Homo sapiens
gcactgagttctccacac

SEQ ID NO: 60455 - DNA, 18 bp, Homo sapiens
gcaccaagtcctccacac

SEQ ID NO: 60456 - DNA, 19 bp, Homo sapiens
cacagcaccaatactacac

SEQ ID NO: 60457 - DNA, 21 bp, Homo sapiens
tacagcacagagccaccgcac

SEQ ID NO: 60458 - DNA, 18 bp, Homo sapiens
gcagcctatactccacac

SEQ ID NO: 60459 - DNA, 16 bp, Homo sapiens
tacacaccaggtgcca

SEQ ID NO: 60460 - DNA, 20 bp, Homo sapiens
cagcactctggactccacac

SEQ ID NO: 60461 - DNA, 21 bp, Homo sapiens
taagcatcacagcttctgcac

SEQ ID NO: 60462 - DNA, 18 bp, Homo sapiens
tacacaccaaaactgcac

SEQ ID NO: 60463 - DNA, 20 bp, Homo sapiens
tacagcactcgattctgtac

SEQ ID NO: 60464 - DNA, 20 bp, Homo sapiens
gcaccgcttggactccacac

SEQ ID NO: 60465 - DNA, 19 bp, Homo sapiens
cagcattaagttctcccac

SEQ ID NO: 60466 - DNA, 22 bp, Homo sapiens
taagcgctggctccctccacac

SEQ ID NO: 60467 - DNA, 19 bp, Homo sapiens
acaccaagcttcttcacac

SEQ ID NO: 60468 - DNA, 22 bp, Homo sapiens
cacagcactgaaattctctaca

SEQ ID NO: 60469 - DNA, 17 bp, Homo sapiens
cagcaccagcactccac

SEQ ID NO: 60470 - DNA, 19 bp, Homo sapiens
tacagtaccagattcttca

SEQ ID NO: 60471 - DNA, 17 bp, Homo sapiens
cagcgcctcctccacac

SEQ ID NO: 60472 - DNA, 16 bp, Homo sapiens
tacagcccaccccaca

SEQ ID NO: 60473 - DNA, 17 bp, Homo sapiens
acggcaccaaagtcaca

SEQ ID NO: 60474 - DNA, 22 bp, Homo sapiens
tacagcacatacatgtttacac

SEQ ID NO: 60475 - DNA, 17 bp, Homo sapiens
cagcacgccctccacac

SEQ ID NO: 60476 - DNA, 20 bp, Homo sapiens
gcaagtgctctgtttcacac

SEQ ID NO: 60477 - DNA, 19 bp, Homo sapiens
caccaccaagtctctgcac

SEQ ID NO: 60478 - DNA, 17 bp, Homo sapiens
tacacaccaggggcaca

SEQ ID NO: 60479 - DNA, 20 bp, Homo sapiens
cagcacctaaatctccacac

SEQ ID NO: 60480 - DNA, 19 bp, Homo sapiens
tacagagccaggttcagca

SEQ ID NO: 60481 - DNA, 19 bp, Homo sapiens
cagcatcactgctctgcac

SEQ ID NO: 60482 - DNA, 16 bp, Homo sapiens
cacagcacactccaca

SEQ ID NO: 60483 - DNA, 21 bp, Homo sapiens
tacaggcattattcttcacac

SEQ ID NO: 60484 - DNA, 19 bp, Homo sapiens
cagtacttttcctccacac

SEQ ID NO: 60485 - DNA, 17 bp, Homo sapiens
caagacccttctccaca

SEQ ID NO: 60486 - DNA, 23 bp, Homo sapiens
cacagcactccacccctccacac

SEQ ID NO: 60487 - DNA, 19 bp, Homo sapiens
tacagcaccagttcctgac

SEQ ID NO: 60488 - DNA, 22 bp, Homo sapiens
tacagcaccaaaaaacttgcac

SEQ ID NO: 60489 - DNA, 16 bp, Homo sapiens
cacagtactctccaca

SEQ ID NO: 60490 - DNA, 18 bp, Homo sapiens
cagcatcaagcctccaca

SEQ ID NO: 60491 - DNA, 18 bp, Homo sapiens
gcgggaccaaccccacac

SEQ ID NO: 60492 - DNA, 18 bp, Homo sapiens
tgagcacatttcctccac

SEQ ID NO: 60493 - DNA, 16 bp, Homo sapiens
cacagcgctttccaca

SEQ ID NO: 60494 - DNA, 18 bp, Homo sapiens
agcagcctcttctccaca

SEQ ID NO: 60495 - DNA, 18 bp, Homo sapiens
acacaaaggttctccaca

SEQ ID NO: 60496 - DNA, 19 bp, Homo sapiens
gcaacatggttctccgcac

SEQ ID NO: 60497 - DNA, 18 bp, Homo sapiens
acggcactgtctccacac

SEQ ID NO: 60498 - DNA, 18 bp, Homo sapiens
cacagcgacttctccaca

SEQ ID NO: 60499 - DNA, 15 bp, Homo sapiens
cagcaccatcccaca

SEQ ID NO: 60500 - DNA, 18 bp, Homo sapiens
tacagatgctcctccaca

SEQ ID NO: 60501 - DNA, 15 bp, Homo sapiens
acagcaccaagccac

SEQ ID NO: 60502 - DNA, 18 bp, Homo sapiens
cagcaccagtgccagctc

SEQ ID NO: 60503 - DNA, 17 bp, Homo sapiens
cacagcactgcctgcac

SEQ ID NO: 60504 - DNA, 18 bp, Homo sapiens
tacagtaccaagctacac

SEQ ID NO: 60505 - DNA, 21 bp, Homo sapiens
tactggcagttttctccacac

SEQ ID NO: 60506 - DNA, 19 bp, Homo sapiens
acccctgggttctccacac

SEQ ID NO: 60507 - DNA, 24 bp, Homo sapiens
cacagcaccgggcagaatttacac

SEQ ID NO: 60508 - DNA, 17 bp, Homo sapiens
cagccccaactccacac

SEQ ID NO: 60509 - DNA, 19 bp, Homo sapiens
cagcaccgcccctctccac

SEQ ID NO: 60510 - DNA, 22 bp, Homo sapiens
cagtgtcaggccccagccacac

SEQ ID NO: 60511 - DNA, 19 bp, Homo sapiens
gcagcctggactcctccac

SEQ ID NO: 60512 - DNA, 20 bp, Homo sapiens
tacagcaccaggctccgcac

SEQ ID NO: 60513 - DNA, 19 bp, Homo sapiens
cagcaatttctctccacac

SEQ ID NO: 60514 - DNA, 21 bp, Homo sapiens
tacagtctatgctcttcacac

SEQ ID NO: 60515 - DNA, 18 bp, Homo sapiens
tacagtaggtctccacac

SEQ ID NO: 60516 - DNA, 18 bp, Homo sapiens
cagagccaggccccgcac

SEQ ID NO: 60517 - DNA, 17 bp, Homo sapiens
cagcaccagctccgcac

SEQ ID NO: 60518 - DNA, 16 bp, Homo sapiens
cacagcaccattccac

SEQ ID NO: 60519 - DNA, 18 bp, Homo sapiens
cagcaccaggcactgcac

SEQ ID NO: 60520 - DNA, 16 bp, Homo sapiens
cagtaccaggtccaca

SEQ ID NO: 60521 - DNA, 17 bp, Homo sapiens
tacagactgcccccaca

SEQ ID NO: 60522 - DNA, 20 bp, Homo sapiens
tacaacactaatagctacac

SEQ ID NO: 60523 - DNA, 17 bp, Homo sapiens
cagcaccactgccacac

SEQ ID NO: 60524 - DNA, 19 bp, Homo sapiens
cagcaccaaggggtcgcac

SEQ ID NO: 60525 - DNA, 24 bp, Homo sapiens
tacacaccagatggcactccacac

SEQ ID NO: 60526 - DNA, 19 bp, Homo sapiens
cacagcaccagatgctgca

SEQ ID NO: 60527 - DNA, 22 bp, Homo sapiens
acagcaccggggagggccacac

SEQ ID NO: 60528 - DNA, 17 bp, Homo sapiens
gcatggcctctccacac

SEQ ID NO: 60529 - DNA, 20 bp, Homo sapiens
cagcaccagtctccctgcac

SEQ ID NO: 60530 - DNA, 21 bp, Homo sapiens
acagcaccatttgcttcacac

SEQ ID NO: 60531 - DNA, 18 bp, Homo sapiens
agacatgtgcctccacac

SEQ ID NO: 60532 - DNA, 19 bp, Homo sapiens
catcacctgatctccacac

SEQ ID NO: 60533 - DNA, 19 bp, Homo sapiens
cacagtgtgagtctccaca

SEQ ID NO: 60534 - DNA, 18 bp, Homo sapiens
agacgtgtgcctccacac

SEQ ID NO: 60535 - DNA, 18 bp, Homo sapiens
cagcacgctgccccacac

SEQ ID NO: 60536 - DNA, 19 bp, Homo sapiens
acattaggtgtctccacac

SEQ ID NO: 60537 - DNA, 18 bp, Homo sapiens
acagcaccagaggctgca

SEQ ID NO: 60538 - DNA, 20 bp, Homo sapiens
tacagtgcacgcctccacac

SEQ ID NO: 60539 - DNA, 18 bp, Homo sapiens
gcattcagattctctaca

SEQ ID NO: 60540 - DNA, 23 bp, Homo sapiens
tacaacaccagagtgaatcttca

SEQ ID NO: 60541 - DNA, 17 bp, Homo sapiens
taagcaccagtctgcac

SEQ ID NO: 60542 - DNA, 18 bp, Homo sapiens
gcaccaggtttcagccac

SEQ ID NO: 60543 - DNA, 62 bp, Human herpesvirus 1
gcggggggaggagcggggggaggagcggggggaggagcggggggaggagcggggggaggagc

SEQ ID NO: 60544 - DNA, 22 bp, Human herpesvirus 1
ggggaggagcggggggaggagc

SEQ ID NO: 60545 - DNA, 19 bp, Homo sapiens
ggaggagggtgggaggagc

SEQ ID NO: 60546 - DNA, 21 bp, Homo sapiens
ggggcggggcgtggggggggc

SEQ ID NO: 60547 - DNA, 16 bp, Homo sapiens
ggggagacagggaggg

SEQ ID NO: 60548 - DNA, 21 bp, Homo sapiens
gggaggagcgtcaccagggag

SEQ ID NO: 60549 - DNA, 19 bp, Homo sapiens
ggggaggatggaggggggc

SEQ ID NO: 60550 - DNA, 18 bp, Homo sapiens
ggcgaggggcgacggggg

SEQ ID NO: 60551 - DNA, 19 bp, Homo sapiens
ggggggagaggggatatgg

SEQ ID NO: 60552 - DNA, 20 bp, Homo sapiens
ggggggcgggtggggagaag

SEQ ID NO: 60553 - DNA, 16 bp, Homo sapiens
ggggagggggggaagg

SEQ ID NO: 60554 - DNA, 17 bp, Homo sapiens
ggggagggctgaggagg

SEQ ID NO: 60555 - DNA, 19 bp, Homo sapiens
ggggatggggcgggggagg

SEQ ID NO: 60556 - DNA, 18 bp, Homo sapiens
ggggtggaggagggggag

SEQ ID NO: 60557 - DNA, 22 bp, Homo sapiens
ggggggagtggggtgggggggc

SEQ ID NO: 60558 - DNA, 18 bp, Homo sapiens
ggaggggagcgggcaggg

SEQ ID NO: 60559 - DNA, 19 bp, Homo sapiens
ggggtggggtgggggaagg

SEQ ID NO: 60560 - DNA, 16 bp, Homo sapiens
gggggggtgggaggag

SEQ ID NO: 60561 - DNA, 21 bp, Homo sapiens
ggggaggggccgggcctcagg

SEQ ID NO: 60562 - DNA, 21 bp, Homo sapiens
agggagggagaggggaggggc

SEQ ID NO: 60563 - DNA, 17 bp, Homo sapiens
agggaggagtgggggag

SEQ ID NO: 60564 - DNA, 20 bp, Homo sapiens
ggggagggggtgcagtgggg

SEQ ID NO: 60565 - DNA, 18 bp, Homo sapiens
gggaggaaaatggaggag

SEQ ID NO: 60566 - DNA, 23 bp, Homo sapiens
ggggaggagggggagggaggggc

SEQ ID NO: 60567 - DNA, 19 bp, Homo sapiens
agggaggggccacaggagc

SEQ ID NO: 60568 - DNA, 19 bp, Homo sapiens
gaggaggaggcagggggag

SEQ ID NO: 60569 - DNA, 20 bp, Homo sapiens
ggggaggagtcatttgggag

SEQ ID NO: 60570 - DNA, 19 bp, Homo sapiens
ggggagggggtgggggaga

SEQ ID NO: 60571 - DNA, 17 bp, Homo sapiens
ggggagaaagggagggg

SEQ ID NO: 60572 - DNA, 19 bp, Homo sapiens
ggggaggggagactggagc

SEQ ID NO: 60573 - DNA, 19 bp, Homo sapiens
ggggagcggtggggcttgc

SEQ ID NO: 60574 - DNA, 23 bp, Homo sapiens
ggggaggaggtggcggcgggagc

SEQ ID NO: 60575 - DNA, 16 bp, Homo sapiens
ggggggaaggggggag

SEQ ID NO: 60576 - DNA, 22 bp, Homo sapiens
gggtgggacatgggggaggggc

SEQ ID NO: 60577 - DNA, 20 bp, Homo sapiens
gggagggggaaggggggggc

SEQ ID NO: 60578 - DNA, 15 bp, Homo sapiens
ggggagggggagggg

SEQ ID NO: 60579 - DNA, 17 bp, Homo sapiens
gggggcggggcgaggag

SEQ ID NO: 60580 - DNA, 18 bp, Homo sapiens
gggcgaggagtgagggag

SEQ ID NO: 60581 - DNA, 18 bp, Homo sapiens
ggggaggagtggaatagg

SEQ ID NO: 60582 - DNA, 21 bp, Homo sapiens
ggggagagagcgtgctgggag

SEQ ID NO: 60583 - DNA, 17 bp, Homo sapiens
ggggaggccaagggggg

SEQ ID NO: 60584 - DNA, 21 bp, Homo sapiens
ggtggaggaggacaggggagc

SEQ ID NO: 60585 - DNA, 18 bp, Homo sapiens
ggagaggcactggggagg

SEQ ID NO: 60586 - DNA, 16 bp, Homo sapiens
ggggggaggggagggg

SEQ ID NO: 60587 - DNA, 21 bp, Homo sapiens
ggggcaggagtggggtagggc

SEQ ID NO: 60588 - DNA, 18 bp, Homo sapiens
ggggtggggcggggaggg

SEQ ID NO: 60589 - DNA, 16 bp, Homo sapiens
ggaggagggggaggag

SEQ ID NO: 60590 - DNA, 21 bp, Homo sapiens
ggggagggggtcccagggagc

SEQ ID NO: 60591 - DNA, 17 bp, Homo sapiens
agggaggccggggggag

SEQ ID NO: 60592 - DNA, 19 bp, Homo sapiens
gaggaggatggaagggagg

SEQ ID NO: 60593 - DNA, 20 bp, Homo sapiens
gggcgaggagctgcgggggg

SEQ ID NO: 60594 - DNA, 15 bp, Homo sapiens
gggggcggggagggg

SEQ ID NO: 60595 - DNA, 21 bp, Homo sapiens
ggggaggggcgggggcggggc

SEQ ID NO: 60596 - DNA, 20 bp, Homo sapiens
gggtgggagcggaatggagc

SEQ ID NO: 60597 - DNA, 19 bp, Homo sapiens
aggggggcgagggaggggc

SEQ ID NO: 60598 - DNA, 19 bp, Homo sapiens
gggaaggggctgcggaggg

SEQ ID NO: 60599 - DNA, 19 bp, Homo sapiens
ggggaggaggcggagggag

SEQ ID NO: 60600 - DNA, 19 bp, Homo sapiens
ggggaggagagggcgtggg

SEQ ID NO: 60601 - DNA, 18 bp, Homo sapiens
gaggaggagcgaaggggg

SEQ ID NO: 60602 - DNA, 22 bp, Homo sapiens
ggggaggcggggctggaggagc

SEQ ID NO: 60603 - DNA, 23 bp, Homo sapiens
ggggaggggcgtggctgggggag

SEQ ID NO: 60604 - DNA, 20 bp, Homo sapiens
ggggaggaggggcacagggc

SEQ ID NO: 60605 - DNA, 21 bp, Homo sapiens
ggggcggggtggggggaagag

SEQ ID NO: 60606 - DNA, 18 bp, Homo sapiens
ggggaggaaggcagaggg

SEQ ID NO: 60607 - DNA, 19 bp, Homo sapiens
ggggaggagccgagaggag

SEQ ID NO: 60608 - DNA, 17 bp, Homo sapiens
ggggaggggaggccggg

SEQ ID NO: 60609 - DNA, 18 bp, Homo sapiens
gggcgaggggccgagggg

SEQ ID NO: 60610 - DNA, 22 bp, Homo sapiens
ggggagggggcgggggactgag

SEQ ID NO: 60611 - DNA, 22 bp, Homo sapiens
gaggaggagccggagggggagc

SEQ ID NO: 60612 - DNA, 22 bp, Homo sapiens
gggaaggggcggcggagggggc

SEQ ID NO: 60613 - DNA, 23 bp, Homo sapiens
gggtgggaaaggtggggaggggc

SEQ ID NO: 60614 - DNA, 21 bp, Homo sapiens
ggggagcggcggacgcggagc

SEQ ID NO: 60615 - DNA, 19 bp, Homo sapiens
ggggaggggagggactcgg

SEQ ID NO: 60616 - DNA, 21 bp, Homo sapiens
ggggaggagctgggaaggagc

SEQ ID NO: 60617 - DNA, 17 bp, Homo sapiens
gggaaggagcgggccgg

SEQ ID NO: 60618 - DNA, 21 bp, Homo sapiens
ggggaggagctgggtgacagg

SEQ ID NO: 60619 - DNA, 17 bp, Homo sapiens
ggggagaggggaggagc

SEQ ID NO: 60620 - DNA, 20 bp, Homo sapiens
gggggaatccggggaggggc

SEQ ID NO: 60621 - DNA, 23 bp, Homo sapiens
ggggagggggctgctgggggggg

SEQ ID NO: 60622 - DNA, 21 bp, Homo sapiens
gaggaggggcggggagaggaa

SEQ ID NO: 60623 - DNA, 22 bp, Homo sapiens
ggggaggcagtggggcaaaggc

SEQ ID NO: 60624 - DNA, 19 bp, Homo sapiens
ggggtggagtgggggagaa

SEQ ID NO: 60625 - DNA, 19 bp, Homo sapiens
gggaggcctggggaggagc

SEQ ID NO: 60626 - DNA, 24 bp, Homo sapiens
ggggaggagcgcccggggaggagc

SEQ ID NO: 60627 - DNA, 20 bp, Homo sapiens
ggggaggagcgcccggggag

SEQ ID NO: 60628 - DNA, 20 bp, Homo sapiens
ggggagggccgggccggggc

SEQ ID NO: 60629 - DNA, 16 bp, Homo sapiens
ggagaggaagggggag

SEQ ID NO: 60630 - DNA, 20 bp, Homo sapiens
ggaggaggggtggcctgagc

SEQ ID NO: 60631 - DNA, 17 bp, Homo sapiens
ggggaggggagtaggag

SEQ ID NO: 60632 - DNA, 19 bp, Homo sapiens
gggggggacgggagggagc

SEQ ID NO: 60633 - DNA, 23 bp, Homo sapiens
ggagaggggcggggggcaggggc

SEQ ID NO: 60634 - DNA, 17 bp, Homo sapiens
ggaggaggagggaggag

SEQ ID NO: 60635 - DNA, 24 bp, Homo sapiens
ggggaggaggcgtggggggggggc

SEQ ID NO: 60636 - DNA, 19 bp, Homo sapiens
ggggagcggcctgaggagc

SEQ ID NO: 60637 - DNA, 19 bp, Homo sapiens
gggggcgggtggggggaac

SEQ ID NO: 60638 - DNA, 19 bp, Homo sapiens
gggcgaggggcggaggggg

SEQ ID NO: 60639 - DNA, 18 bp, Homo sapiens
gaggaggggcggccgggg

SEQ ID NO: 60640 - DNA, 23 bp, Homo sapiens
gggaggggcggggacgcaggggc

SEQ ID NO: 60641 - DNA, 19 bp, Homo sapiens
gaggaggggcggggcgggg

SEQ ID NO: 60642 - DNA, 18 bp, Homo sapiens
ggggcggggcgggagggg

SEQ ID NO: 60643 - DNA, 24 bp, Homo sapiens
ggggagtgggcggcgagggggagc

SEQ ID NO: 60644 - DNA, 18 bp, Homo sapiens
ggggaggggcaggggagg

SEQ ID NO: 60645 - DNA, 18 bp, Homo sapiens
ggggcggagcgcgggggg

SEQ ID NO: 60646 - DNA, 20 bp, Homo sapiens
ggggaggagggacggggagc

SEQ ID NO: 60647 - DNA, 18 bp, Homo sapiens
ggagaggggcggggaggg

SEQ ID NO: 60648 - DNA, 18 bp, Homo sapiens
ggggtaggctgggagggg

SEQ ID NO: 60649 - DNA, 24 bp, Homo sapiens
gggaagggctggctggggaggggc

SEQ ID NO: 60650 - DNA, 20 bp, Homo sapiens
ggggagggggggtggggggc

SEQ ID NO: 60651 - DNA, 23 bp, Homo sapiens
gggtgagaaggagggggaggggc

SEQ ID NO: 60652 - DNA, 17 bp, Homo sapiens
ggagagggaggggggag

SEQ ID NO: 60653 - DNA, 19 bp, Homo sapiens
gggagggaggaggaggagc

SEQ ID NO: 60654 - DNA, 19 bp, Homo sapiens
gggaagcgtggggaggagc

SEQ ID NO: 60655 - DNA, 16 bp, Homo sapiens
ggggagggagggggag

SEQ ID NO: 60656 - DNA, 21 bp, Homo sapiens
ggggaggagctggcctcgagc

SEQ ID NO: 60657 - DNA, 19 bp, Homo sapiens
gggaaggggactgggggag

SEQ ID NO: 60658 - DNA, 17 bp, Homo sapiens
ggggggagctgggggag

SEQ ID NO: 60659 - DNA, 16 bp, Homo sapiens
ggggaggtggggggag

SEQ ID NO: 60660 - DNA, 16 bp, Homo sapiens
ggggagcaaggaggag

SEQ ID NO: 60661 - DNA, 19 bp, Homo sapiens
gggggcgggtgaggggagc

SEQ ID NO: 60662 - DNA, 22 bp, Homo sapiens
gggaaggggcgcctgggaggag

SEQ ID NO: 60663 - DNA, 21 bp, Homo sapiens
gggcaggctgaggggaggggc

SEQ ID NO: 60664 - DNA, 19 bp, Homo sapiens
ggggagggcgggcgggggc

SEQ ID NO: 60665 - DNA, 16 bp, Homo sapiens
ggggagaggaggggag

SEQ ID NO: 60666 - DNA, 20 bp, Homo sapiens
gggggagagggtggaggggc

SEQ ID NO: 60667 - DNA, 19 bp, Homo sapiens
agggaggggcgacaagggg

SEQ ID NO: 60668 - DNA, 16 bp, Homo sapiens
ggggaagagaggggag

SEQ ID NO: 60669 - DNA, 22 bp, Homo sapiens
gggaaggggcgggaccacgggc

SEQ ID NO: 60670 - DNA, 17 bp, Homo sapiens
ggggagaattgaggagc

SEQ ID NO: 60671 - DNA, 22 bp, Homo sapiens
ggggaggggtgcctccagggag

SEQ ID NO: 60672 - DNA, 24 bp, Homo sapiens
ggggaggggagggggggagggggc

SEQ ID NO: 60673 - DNA, 15 bp, Homo sapiens
ggggggcaagagggg

SEQ ID NO: 60674 - DNA, 16 bp, Homo sapiens
ggggaggatgggggag

SEQ ID NO: 60675 - DNA, 21 bp, Homo sapiens
ggggcgggcccggggaggagc

SEQ ID NO: 60676 - DNA, 20 bp, Homo sapiens
ggggagcgggcggcgcggag

SEQ ID NO: 60677 - DNA, 19 bp, Homo sapiens
ggggagcggggcggggagc

SEQ ID NO: 60678 - DNA, 20 bp, Homo sapiens
ggggaggagttggggacagg

SEQ ID NO: 60679 - DNA, 21 bp, Homo sapiens
ggggaggagggtacactgggg

SEQ ID NO: 60680 - DNA, 23 bp, Homo sapiens
ggggaggagtcatcaggaggagc

SEQ ID NO: 60681 - DNA, 18 bp, Homo sapiens
ggggcaggggtgggaaga

SEQ ID NO: 60682 - DNA, 20 bp, Homo sapiens
ggggaggcggcgggcgaggg

SEQ ID NO: 60683 - DNA, 18 bp, Homo sapiens
ggggcggagcgggccggg

SEQ ID NO: 60684 - DNA, 25 bp, Homo sapiens
ggggaggggcggcagtggggaggag

SEQ ID NO: 60685 - DNA, 17 bp, Homo sapiens
ggggaggagggggctgg

SEQ ID NO: 60686 - DNA, 18 bp, Homo sapiens
ggggaggagtgacgggag

SEQ ID NO: 60687 - DNA, 17 bp, Homo sapiens
gggggaggggaggggag

SEQ ID NO: 60688 - DNA, 20 bp, Homo sapiens
ggggcggggcggagggggag

SEQ ID NO: 60689 - DNA, 18 bp, Homo sapiens
gggaggggatgggaggag

SEQ ID NO: 60690 - DNA, 21 bp, Homo sapiens
ggggaagggaaagtgggggag

SEQ ID NO: 60691 - DNA, 16 bp, Homo sapiens
ggggaggagggtagag

SEQ ID NO: 60692 - DNA, 19 bp, Homo sapiens
ggggggcagtgggggaagg

SEQ ID NO: 60693 - DNA, 19 bp, Homo sapiens
ggggaggagtggaggggaa

SEQ ID NO: 60694 - DNA, 18 bp, Homo sapiens
ggggggcgggggggtgag

SEQ ID NO: 60695 - DNA, 19 bp, Homo sapiens
aggggagtgaggggaggag

SEQ ID NO: 60696 - DNA, 20 bp, Homo sapiens
gggggtgagtggatcagagc

SEQ ID NO: 60697 - DNA, 22 bp, Homo sapiens
ggggaggagggagagagggggc

SEQ ID NO: 60698 - DNA, 22 bp, Homo sapiens
ggagagggggctggggaggggc

SEQ ID NO: 60699 - DNA, 15 bp, Homo sapiens
gggaaaggggggagg

SEQ ID NO: 60700 - DNA, 17 bp, Homo sapiens
gggaaggatgggagggg

SEQ ID NO: 60701 - DNA, 22 bp, Homo sapiens
gaggaggagtttaaagaggagc

SEQ ID NO: 60702 - DNA, 21 bp, Homo sapiens
ggggaggggagggccctcagc

SEQ ID NO: 60703 - DNA, 20 bp, Homo sapiens
ggggaggaggaatgcaggag

SEQ ID NO: 60704 - DNA, 18 bp, Homo sapiens
gggaggcgggggaggggc

SEQ ID NO: 60705 - DNA, 24 bp, Homo sapiens
ggcgaggagtgggctggcgaggag

SEQ ID NO: 60706 - DNA, 19 bp, Homo sapiens
gggaaggggcgacatggag

SEQ ID NO: 60707 - DNA, 24 bp, Homo sapiens
ggggaggggagcttggggaggggc

SEQ ID NO: 60708 - DNA, 18 bp, Homo sapiens
ggggagggcggtgtggag

SEQ ID NO: 60709 - DNA, 18 bp, Homo sapiens
gggagaggctgggagggg

SEQ ID NO: 60710 - DNA, 21 bp, Homo sapiens
agggaggggatggggaggggc

SEQ ID NO: 60711 - DNA, 21 bp, Homo sapiens
gggaagggcgggctgcttggg

SEQ ID NO: 60712 - DNA, 18 bp, Homo sapiens
ggggaggatgctgaggag

SEQ ID NO: 60713 - DNA, 19 bp, Homo sapiens
gggcggggggtgagggagc

SEQ ID NO: 60714 - DNA, 21 bp, Homo sapiens
ggggagggagggtggaggggc

SEQ ID NO: 60715 - DNA, 22 bp, Homo sapiens
agggaggggcggccagaggagc

SEQ ID NO: 60716 - DNA, 17 bp, Homo sapiens
ggggaggggagggggaa

SEQ ID NO: 60717 - DNA, 21 bp, Homo sapiens
gggtaggggtggggagagggc

SEQ ID NO: 60718 - DNA, 20 bp, Homo sapiens
ggggagagaaagaggaggag

SEQ ID NO: 60719 - DNA, 16 bp, Homo sapiens
agggaggggagggggg

SEQ ID NO: 60720 - DNA, 18 bp, Homo sapiens
ggggagaggcagggggag

SEQ ID NO: 60721 - DNA, 16 bp, Homo sapiens
ggagagggagggggag

SEQ ID NO: 60722 - DNA, 16 bp, Homo sapiens
ggggaggggtggggag

SEQ ID NO: 60723 - DNA, 19 bp, Homo sapiens
ggggggggggggtcccagg

SEQ ID NO: 60724 - DNA, 20 bp, Homo sapiens
ggggaggaagtgggaagagc

SEQ ID NO: 60725 - DNA, 19 bp, Homo sapiens
agggaggggaaaggggggg

SEQ ID NO: 60726 - DNA, 19 bp, Homo sapiens
ggggagggggtggggaagg

SEQ ID NO: 60727 - DNA, 28 bp, Homo sapiens
ggggagggggtggggaaaggggggagcg

SEQ ID NO: 60728 - DNA, 19 bp, Homo sapiens
gaggaggagaactgggggg

SEQ ID NO: 60729 - DNA, 23 bp, Homo sapiens
ggggaggaagtggagatgggggg

SEQ ID NO: 60730 - DNA, 16 bp, Homo sapiens
ggggggtggggagagg

SEQ ID NO: 60731 - DNA, 20 bp, Homo sapiens
agggaggggtgggaccgggc

SEQ ID NO: 60732 - DNA, 19 bp, Homo sapiens
ggaggaggggcccaggagc

SEQ ID NO: 60733 - DNA, 19 bp, Homo sapiens
ggggaggcgacgcggaggg

SEQ ID NO: 60734 - DNA, 21 bp, Homo sapiens
gggagagcccaggggaggggc

SEQ ID NO: 60735 - DNA, 18 bp, Homo sapiens
ggggaggactgagagggg

SEQ ID NO: 60736 - DNA, 17 bp, Homo sapiens
gggggggcggcgggaag

SEQ ID NO: 60737 - DNA, 22 bp, Homo sapiens
ggggcggggcggggtggggggc

SEQ ID NO: 60738 - DNA, 23 bp, Homo sapiens
ggggcggggtggggggcaaggag

SEQ ID NO: 60739 - DNA, 16 bp, Homo sapiens
ggggaggagaggggag

SEQ ID NO: 60740 - DNA, 22 bp, Homo sapiens
gggcaggagcgaccagaggggc

SEQ ID NO: 60741 - DNA, 22 bp, Homo sapiens
gaggaggaggaagaggaggagc

SEQ ID NO: 60742 - DNA, 20 bp, Homo sapiens
ggggcggggcggggacacgg

SEQ ID NO: 60743 - DNA, 29 bp, Homo sapiens
ggggaggaacgggtggctggggaggagcg

SEQ ID NO: 60744 - DNA, 22 bp, Homo sapiens
ggggaggggcaggaaagagggc

SEQ ID NO: 60745 - DNA, 21 bp, Homo sapiens
gggaggcggcaggggaggagc

SEQ ID NO: 60746 - DNA, 20 bp, Homo sapiens
ggggaggggaaggggggggg

SEQ ID NO: 60747 - DNA, 18 bp, Homo sapiens
ggggagcgggcggcggag

SEQ ID NO: 60748 - DNA, 19 bp, Homo sapiens
ggggaggagtagggaacga

SEQ ID NO: 60749 - DNA, 23 bp, Homo sapiens
ggggaggggatgacagcaagggg

SEQ ID NO: 60750 - DNA, 23 bp, Homo sapiens
gagggggcgacgtggggaggggc

SEQ ID NO: 60751 - DNA, 21 bp, Homo sapiens
ggggtgggccccagcggaggg

SEQ ID NO: 60752 - DNA, 17 bp, Homo sapiens
ggggaggggagggcagg

SEQ ID NO: 60753 - DNA, 22 bp, Homo sapiens
ggggaggggcgggtgacggagc

SEQ ID NO: 60754 - DNA, 18 bp, Homo sapiens
ggggaggagtggaggagg

SEQ ID NO: 60755 - DNA, 25 bp, Homo sapiens
gaggaggggcggctaccggaggggc

SEQ ID NO: 60756 - DNA, 20 bp, Homo sapiens
ggtggaggggtgggctgagc

SEQ ID NO: 60757 - DNA, 18 bp, Homo sapiens
ggggggacgcgggggggg

SEQ ID NO: 60758 - DNA, 16 bp, Homo sapiens
ggggggaggagaggag

SEQ ID NO: 60759 - DNA, 20 bp, Homo sapiens
ggggacagatggggaggggc

SEQ ID NO: 60760 - DNA, 22 bp, Homo sapiens
agggaggaaagaaaggggggag

SEQ ID NO: 60761 - DNA, 21 bp, Homo sapiens
ggggagggccgggctcagggc

SEQ ID NO: 60762 - DNA, 19 bp, Homo sapiens
ggggaagagctgtgagggg

SEQ ID NO: 60763 - DNA, 19 bp, Homo sapiens
ggtgaggcgtgggaggggc

SEQ ID NO: 60764 - DNA, 18 bp, Homo sapiens
gggaagggggaggggggc

SEQ ID NO: 60765 - DNA, 17 bp, Homo sapiens
gaggagggctggggggg

SEQ ID NO: 60766 - DNA, 20 bp, Homo sapiens
gggaaggggtggggcctggc

SEQ ID NO: 60767 - DNA, 20 bp, Homo sapiens
ggggcggggtggggccgggc

SEQ ID NO: 60768 - DNA, 19 bp, Homo sapiens
ggggcggggcggggtgggg

SEQ ID NO: 60769 - DNA, 19 bp, Homo sapiens
ggtggaggcagggaggggc

SEQ ID NO: 60770 - DNA, 19 bp, Homo sapiens
agggaggaggctggaggag

SEQ ID NO: 60771 - DNA, 19 bp, Homo sapiens
ggggaggggagggagagag

SEQ ID NO: 60772 - DNA, 17 bp, Homo sapiens
ggggcggccgggggggg

SEQ ID NO: 60773 - DNA, 23 bp, Homo sapiens
ggggggagtcggggggaggaagc

SEQ ID NO: 60774 - DNA, 22 bp, Homo sapiens
agggaggagcggggaacacaag

SEQ ID NO: 60775 - DNA, 23 bp, Homo sapiens
ggggaggaaggtcagggaggagc

SEQ ID NO: 60776 - DNA, 20 bp, Homo sapiens
ggggaggaggggggcacagc

SEQ ID NO: 60777 - DNA, 19 bp, Homo sapiens
gggggggggtggggaagag

SEQ ID NO: 60778 - DNA, 19 bp, Homo sapiens
ggggtggggacggaagggg

SEQ ID NO: 60779 - DNA, 16 bp, Homo sapiens
ggggaggggaggggga

SEQ ID NO: 60780 - DNA, 18 bp, Homo sapiens
agggaggggtgagggagg

SEQ ID NO: 60781 - DNA, 20 bp, Homo sapiens
ggggaggggcaggggagagc

SEQ ID NO: 60782 - DNA, 22 bp, Homo sapiens
ggggaggtggcagaggaggggc

SEQ ID NO: 60783 - DNA, 23 bp, Homo sapiens
ggggaggaggtggtaactggggc

SEQ ID NO: 60784 - DNA, 18 bp, Homo sapiens
gggaaggggcgggagggg

SEQ ID NO: 60785 - DNA, 21 bp, Homo sapiens
ggggaggaacagccgaggggc

SEQ ID NO: 60786 - DNA, 17 bp, Homo sapiens
gggcagggggtgggggg

SEQ ID NO: 60787 - DNA, 20 bp, Homo sapiens
gggaggagggagggaggagc

SEQ ID NO: 60788 - DNA, 16 bp, Homo sapiens
agggggagtggggagg

SEQ ID NO: 60789 - DNA, 22 bp, Homo sapiens
ggggaggagtgaggggaaggag

SEQ ID NO: 60790 - DNA, 18 bp, Homo sapiens
ggggaggagaaggagggg

SEQ ID NO: 60791 - DNA, 20 bp, Homo sapiens
ggggggggcaaggggggggc

SEQ ID NO: 60792 - DNA, 18 bp, Homo sapiens
agggaggggcgggcaggg

SEQ ID NO: 60793 - DNA, 18 bp, Homo sapiens
ggggcaggggggaggggc

SEQ ID NO: 60794 - DNA, 16 bp, Homo sapiens
ggggaggagggacgag

SEQ ID NO: 60795 - DNA, 22 bp, Homo sapiens
ggggcgggggcggggcgagggc

SEQ ID NO: 60796 - DNA, 18 bp, Homo sapiens
ggtgacccgggggaggag

SEQ ID NO: 60797 - DNA, 22 bp, Homo sapiens
gggtgggggttgggggaggggc

SEQ ID NO: 60798 - DNA, 20 bp, Homo sapiens
ggggagagccgagggggggc

SEQ ID NO: 60799 - DNA, 20 bp, Homo sapiens
ggaggtcgggggggaggggc

SEQ ID NO: 60800 - DNA, 16 bp, Homo sapiens
aggggggcgggggggg

SEQ ID NO: 60801 - DNA, 19 bp, Homo sapiens
gggaaggagtcaacagggg

SEQ ID NO: 60802 - DNA, 16 bp, Homo sapiens
gggaaggagggaggag

SEQ ID NO: 60803 - DNA, 20 bp, Homo sapiens
ggagaggggcggggaggggc

SEQ ID NO: 60804 - DNA, 20 bp, Homo sapiens
gggtgaggagtgggccagag

SEQ ID NO: 60805 - DNA, 23 bp, Homo sapiens
ggagaggaggacgagggaggggc

SEQ ID NO: 60806 - DNA, 21 bp, Homo sapiens
ggggaggagggggttctcagg

SEQ ID NO: 60807 - DNA, 20 bp, Homo sapiens
ggcggggtgcggggaggggc

SEQ ID NO: 60808 - DNA, 18 bp, Homo sapiens
ggggatggagcggtcggg

SEQ ID NO: 60809 - DNA, 19 bp, Homo sapiens
ggggaagaggaggaggagc

SEQ ID NO: 60810 - DNA, 19 bp, Homo sapiens
aggagttggcggggggggg

SEQ ID NO: 60811 - DNA, 21 bp, Homo sapiens
gaggaggggcagccgaggggc

SEQ ID NO: 60812 - DNA, 22 bp, Homo sapiens
ggggggcggcgggggggacagc

SEQ ID NO: 60813 - DNA, 22 bp, Homo sapiens
gggaggggcgggggagaggagc

SEQ ID NO: 60814 - DNA, 18 bp, Homo sapiens
ggagaggagcggagggag

SEQ ID NO: 60815 - DNA, 22 bp, Homo sapiens
gggaggggcggggatggggagc

SEQ ID NO: 60816 - DNA, 20 bp, Homo sapiens
gggagggggcagagaggggc

SEQ ID NO: 60817 - DNA, 19 bp, Homo sapiens
ggggggccgggggaggggc

SEQ ID NO: 60818 - DNA, 20 bp, Homo sapiens
ggggaggaggagcggggagc

SEQ ID NO: 60819 - DNA, 16 bp, Homo sapiens
ggggaggagggggcag

SEQ ID NO: 60820 - DNA, 21 bp, Homo sapiens
ggggtgggtagagggaggggc

SEQ ID NO: 60821 - DNA, 20 bp, Homo sapiens
gggcaggggaggggaggggc

SEQ ID NO: 60822 - DNA, 23 bp, Homo sapiens
ggaggatctgtagggggaggggc

SEQ ID NO: 60823 - DNA, 17 bp, Homo sapiens
agggaggccgggagggg

SEQ ID NO: 60824 - DNA, 19 bp, Homo sapiens
ggagaggaggccagagggg

SEQ ID NO: 60825 - DNA, 19 bp, Homo sapiens
ggggaggagaccaggggag

SEQ ID NO: 60826 - DNA, 21 bp, Homo sapiens
ggggagggctgaagaaggagc

SEQ ID NO: 60827 - DNA, 21 bp, Homo sapiens
gggaagggaggtgggaggggc

SEQ ID NO: 60828 - DNA, 19 bp, Homo sapiens
agggaggagcccagagggg

SEQ ID NO: 60829 - DNA, 15 bp, Homo sapiens
ggggggagggaggag

SEQ ID NO: 60830 - DNA, 16 bp, Homo sapiens
ggggaggggagaggag

SEQ ID NO: 60831 - DNA, 17 bp, Homo sapiens
ggggaggggggcaatgg

SEQ ID NO: 60832 - DNA, 18 bp, Homo sapiens
ggggaggagtgtaggggg

SEQ ID NO: 60833 - DNA, 23 bp, Homo sapiens
gggaggggtgggggagagagagc

SEQ ID NO: 60834 - DNA, 16 bp, Homo sapiens
agggaggggtggaggg

SEQ ID NO: 60835 - DNA, 19 bp, Homo sapiens
ggggtggatttgggggagg

SEQ ID NO: 60836 - DNA, 17 bp, Homo sapiens
ggggaggaggggacagg

SEQ ID NO: 60837 - DNA, 23 bp, Homo sapiens
ggggagggtaaagagggaggagc

SEQ ID NO: 60838 - DNA, 22 bp, Homo sapiens
ggggaggggttctcaaaggagc

SEQ ID NO: 60839 - DNA, 20 bp, Homo sapiens
gaggaggggcgggctgggag

SEQ ID NO: 60840 - DNA, 18 bp, Homo sapiens
ggggggtggcaagaggag

SEQ ID NO: 60841 - DNA, 18 bp, Homo sapiens
ggcggggagcccggggag

SEQ ID NO: 60842 - DNA, 17 bp, Homo sapiens
gggaggggagtggggag

SEQ ID NO: 60843 - DNA, 20 bp, Homo sapiens
ggggcgggcggggtgggggc

SEQ ID NO: 60844 - DNA, 17 bp, Homo sapiens
gggggggtggggggagg

SEQ ID NO: 60845 - DNA, 19 bp, Homo sapiens
ggggaggactggggagggc

SEQ ID NO: 60846 - DNA, 19 bp, Homo sapiens
ggggagagggtggagatgg

SEQ ID NO: 60847 - DNA, 17 bp, Homo sapiens
gggggaaaggggggggg

SEQ ID NO: 60848 - DNA, 17 bp, Homo sapiens
ggggaggggagggccag

SEQ ID NO: 60849 - DNA, 16 bp, Homo sapiens
ggagggggaaggggag

SEQ ID NO: 60850 - DNA, 17 bp, Homo sapiens
ggggtggggagggggag

SEQ ID NO: 60851 - DNA, 19 bp, Homo sapiens
gggggaggaggggaggagc

SEQ ID NO: 60852 - DNA, 17 bp, Homo sapiens
ggggagggtgggagagg

SEQ ID NO: 60853 - DNA, 22 bp, Homo sapiens
ggggaggggttggggtgattgg

SEQ ID NO: 60854 - DNA, 19 bp, Homo sapiens
ggtggaggtaggggagggg

SEQ ID NO: 60855 - DNA, 18 bp, Homo sapiens
ggggggagggggccaagc

SEQ ID NO: 60856 - DNA, 17 bp, Homo sapiens
ggggaggagcccaggag

SEQ ID NO: 60857 - DNA, 16 bp, Homo sapiens
gggggatggggaggag

SEQ ID NO: 60858 - DNA, 19 bp, Homo sapiens
ggggaggggccgggagagg

SEQ ID NO: 60859 - DNA, 21 bp, Homo sapiens
ggagaggagcggagcaggggc

SEQ ID NO: 60860 - DNA, 17 bp, Homo sapiens
ggggagaggtgaagggg

SEQ ID NO: 60861 - DNA, 21 bp, Homo sapiens
ggggaggggacgggagggggc

SEQ ID NO: 60862 - DNA, 18 bp, Homo sapiens
ggggagcggcggcgggag

SEQ ID NO: 60863 - DNA, 17 bp, Homo sapiens
gaggaggggaggggagg

SEQ ID NO: 60864 - DNA, 18 bp, Homo sapiens
ggggaggaaggcgagggg

SEQ ID NO: 60865 - DNA, 21 bp, Homo sapiens
ggagagccaagggggaggagc

SEQ ID NO: 60866 - DNA, 19 bp, Homo sapiens
ggggaggagagacaggagg

SEQ ID NO: 60867 - DNA, 18 bp, Homo sapiens
ggcgggcgcggggaggag

SEQ ID NO: 60868 - DNA, 17 bp, Homo sapiens
ggaggggagaagaggag

SEQ ID NO: 60869 - DNA, 17 bp, Homo sapiens
ggggggaggtgaaggag

SEQ ID NO: 60870 - DNA, 24 bp, Homo sapiens
ggggagaggtggggtgtcaggagc

SEQ ID NO: 60871 - DNA, 21 bp, Homo sapiens
gggggggatgaaaagaggagc

SEQ ID NO: 60872 - DNA, 17 bp, Homo sapiens
ggggaggacccaaggag

SEQ ID NO: 60873 - DNA, 21 bp, Homo sapiens
ggggaggagaggggacacagc

SEQ ID NO: 60874 - DNA, 16 bp, Homo sapiens
gggaagggaggaggag

SEQ ID NO: 60875 - DNA, 19 bp, Homo sapiens
gggtgggttgggggggagc

SEQ ID NO: 60876 - DNA, 23 bp, Homo sapiens
ggggagaggtgggttctctgggc

SEQ ID NO: 60877 - DNA, 21 bp, Homo sapiens
agggaggggacagggaggggc

SEQ ID NO: 60878 - DNA, 18 bp, Homo sapiens
gggggcggggtgaagaaa

SEQ ID NO: 60879 - DNA, 19 bp, Homo sapiens
ggggaggagagggaaaagg

SEQ ID NO: 60880 - DNA, 21 bp, Homo sapiens
ggggcggggcgggggacgggc

SEQ ID NO: 60881 - DNA, 17 bp, Homo sapiens
ggggagggggcggtgag

SEQ ID NO: 60882 - DNA, 16 bp, Homo sapiens
ggggagggggtggggg

SEQ ID NO: 60883 - DNA, 16 bp, Homo sapiens
ggggggggggggaggg

SEQ ID NO: 60884 - DNA, 18 bp, Homo sapiens
gggaaggagcttaaggag

SEQ ID NO: 60885 - DNA, 19 bp, Homo sapiens
ggggaagggtgggtacagc

SEQ ID NO: 60886 - DNA, 20 bp, Homo sapiens
gggaagggggaaagaggagc

SEQ ID NO: 60887 - DNA, 19 bp, Homo sapiens
ggggagaagtggggtgggg

SEQ ID NO: 60888 - DNA, 19 bp, Homo sapiens
ggggtaggggaagaggggc

SEQ ID NO: 60889 - DNA, 16 bp, Homo sapiens
gggagaaggggagggg

SEQ ID NO: 60890 - DNA, 19 bp, Homo sapiens
ggggaggagaggggaggag

SEQ ID NO: 60891 - DNA, 20 bp, Homo sapiens
gggtaggagcggggaaggag

SEQ ID NO: 60892 - DNA, 20 bp, Homo sapiens
ggggaggggttggttggagc

SEQ ID NO: 60893 - DNA, 19 bp, Homo sapiens
ggtggaggcaggggagggg

SEQ ID NO: 60894 - DNA, 22 bp, Homo sapiens
ggcggaggagctccccagggag

SEQ ID NO: 60895 - DNA, 23 bp, Homo sapiens
gggtgggagcgggagggaggagc

SEQ ID NO: 60896 - DNA, 17 bp, Homo sapiens
gggggagcgggctgggg

SEQ ID NO: 60897 - DNA, 25 bp, Homo sapiens
ggggaggggcgcccgggggaggggc

SEQ ID NO: 60898 - DNA, 24 bp, Homo sapiens
ggggcggggagaagggggaggggc

SEQ ID NO: 60899 - DNA, 20 bp, Homo sapiens
ggggaggagggggcgagggc

SEQ ID NO: 60900 - DNA, 18 bp, Homo sapiens
ggggaggaagtgggtggg

SEQ ID NO: 60901 - DNA, 16 bp, Homo sapiens
ggggaggggagggagg

SEQ ID NO: 60902 - DNA, 18 bp, Homo sapiens
gaggggagcactggggag

SEQ ID NO: 60903 - DNA, 20 bp, Homo sapiens
ggagagggaaaagggaggag

SEQ ID NO: 60904 - DNA, 17 bp, Homo sapiens
ggggaggggagggagag

SEQ ID NO: 60905 - DNA, 22 bp, Homo sapiens
ggggaggggacagaagaggggc

SEQ ID NO: 60906 - DNA, 20 bp, Homo sapiens
gggggggtgcgggagagggc

SEQ ID NO: 60907 - DNA, 19 bp, Homo sapiens
ggggagggggccaaggggg

SEQ ID NO: 60908 - DNA, 17 bp, Homo sapiens
gaggaggaggagggggg

SEQ ID NO: 60909 - DNA, 20 bp, Homo sapiens
gggcaggagcggggccgggg

SEQ ID NO: 60910 - DNA, 21 bp, Homo sapiens
ggggagcggcggggaccggag

SEQ ID NO: 60911 - DNA, 19 bp, Homo sapiens
ggaggaggaggaggaggag

SEQ ID NO: 60912 - DNA, 17 bp, Homo sapiens
gggggagggaaggggag

SEQ ID NO: 60913 - DNA, 18 bp, Homo sapiens
ggggaggggcggggcagg

SEQ ID NO: 60914 - DNA, 19 bp, Homo sapiens
ggggcctggggggaggggc

SEQ ID NO: 60915 - DNA, 27 bp, Homo sapiens
ggggcggggcctgggaggggaggagcg

SEQ ID NO: 60916 - DNA, 21 bp, Homo sapiens
ggggtggtctcgggggaggag

SEQ ID NO: 60917 - DNA, 15 bp, Homo sapiens
ggggaggggggggag

SEQ ID NO: 60918 - DNA, 22 bp, Homo sapiens
ggggaggggcggggcagggagc

SEQ ID NO: 60919 - DNA, 22 bp, Homo sapiens
gggggggacggggaaggggggc

SEQ ID NO: 60920 - DNA, 20 bp, Homo sapiens
ggggagagagcctgaggagc

SEQ ID NO: 60921 - DNA, 19 bp, Homo sapiens
ggggaggaggcggggctgg

SEQ ID NO: 60922 - DNA, 23 bp, Homo sapiens
ggggggcagcggggaggaagagc

SEQ ID NO: 60923 - DNA, 19 bp, Homo sapiens
gaggaggagcgggcgcggg

SEQ ID NO: 60924 - DNA, 22 bp, Homo sapiens
ggggaggtgcacactgaggagc

SEQ ID NO: 60925 - DNA, 25 bp, Homo sapiens
ggggagagggaaatgggggaggggc

SEQ ID NO: 60926 - DNA, 21 bp, Homo sapiens
gggggtgagatggggaggagc

SEQ ID NO: 60927 - DNA, 20 bp, Homo sapiens
ggagagggcactggaggggc

SEQ ID NO: 60928 - DNA, 17 bp, Homo sapiens
ggggaggaacaaaggag

SEQ ID NO: 60929 - DNA, 21 bp, Homo sapiens
ggggaggagcgaatctcgggc

SEQ ID NO: 60930 - DNA, 19 bp, Homo sapiens
ggagggggataggaggggc

SEQ ID NO: 60931 - DNA, 23 bp, Homo sapiens
ggggtggggtggggatgctgagc

SEQ ID NO: 60932 - DNA, 19 bp, Homo sapiens
ggggagggggagcgagggg

SEQ ID NO: 60933 - DNA, 18 bp, Homo sapiens
ggggaggggctgggcagg

SEQ ID NO: 60934 - DNA, 22 bp, Homo sapiens
ggggggaggggaggggaggggc

SEQ ID NO: 60935 - DNA, 22 bp, Homo sapiens
ggggaggggcgcgcagaggggc

SEQ ID NO: 60936 - DNA, 21 bp, Homo sapiens
ggggaggcggcgggccggggg

SEQ ID NO: 60937 - DNA, 16 bp, Homo sapiens
gggggggcaggggggg

SEQ ID NO: 60938 - DNA, 18 bp, Homo sapiens
ggagaggcctgggagggg

SEQ ID NO: 60939 - DNA, 23 bp, Homo sapiens
ggggaggagagaaggagaggggc

SEQ ID NO: 60940 - DNA, 22 bp, Homo sapiens
ggggaggagggcatcccaggag

SEQ ID NO: 60941 - DNA, 23 bp, Homo sapiens
ggggagggagagtgtggggggag

SEQ ID NO: 60942 - DNA, 19 bp, Homo sapiens
gggggggggggggggggga

SEQ ID NO: 60943 - DNA, 19 bp, Homo sapiens
ggggggggggggggaggaa

SEQ ID NO: 60944 - DNA, 19 bp, Homo sapiens
ggggaggatgtgggggagg

SEQ ID NO: 60945 - DNA, 19 bp, Homo sapiens
ggggaggggtgaggcaagg

SEQ ID NO: 60946 - DNA, 18 bp, Homo sapiens
ggtgaggccagggggagg

SEQ ID NO: 60947 - DNA, 19 bp, Homo sapiens
agggaggaggcagaggagc

SEQ ID NO: 60948 - DNA, 15 bp, Homo sapiens
ggggagggggggggg

SEQ ID NO: 60949 - DNA, 15 bp, Homo sapiens
gggggaggggggggg

SEQ ID NO: 60950 - DNA, 21 bp, Homo sapiens
ggggcaggggggtggaggggc

SEQ ID NO: 60951 - DNA, 19 bp, Homo sapiens
ggggagggagtggaggggg

SEQ ID NO: 60952 - DNA, 18 bp, Homo sapiens
agggaggaggtggagggg

SEQ ID NO: 60953 - DNA, 18 bp, Homo sapiens
ggggagggttgcgggggg

SEQ ID NO: 60954 - DNA, 17 bp, Homo sapiens
gggggggcggggttagg

SEQ ID NO: 60955 - DNA, 17 bp, Homo sapiens
gggagggaggagaggag

SEQ ID NO: 60956 - DNA, 17 bp, Homo sapiens
ggagaggagcaaaggag

SEQ ID NO: 60957 - DNA, 18 bp, Homo sapiens
ggggaggtgcgaatggag

SEQ ID NO: 60958 - DNA, 21 bp, Homo sapiens
gggggaagtgggggagagggc

SEQ ID NO: 60959 - DNA, 19 bp, Homo sapiens
ggggcagggcatggggggg

SEQ ID NO: 60960 - DNA, 21 bp, Homo sapiens
ggggaggtggtgggagagggc

SEQ ID NO: 60961 - DNA, 23 bp, Homo sapiens
ggggcgggggcgggggcgggggc

SEQ ID NO: 60962 - DNA, 19 bp, Homo sapiens
ggggggggaggggaacagc

SEQ ID NO: 60963 - DNA, 17 bp, Homo sapiens
ggggggggcaggagggg

SEQ ID NO: 60964 - DNA, 21 bp, Homo sapiens
ggggaggggtaggccaggagc

SEQ ID NO: 60965 - DNA, 16 bp, Homo sapiens
agggggaggggaggag

SEQ ID NO: 60966 - DNA, 19 bp, Homo sapiens
gggcggggggtggggaagc

SEQ ID NO: 60967 - DNA, 16 bp, Homo sapiens
ggggggcgggaatagg

SEQ ID NO: 60968 - DNA, 19 bp, Homo sapiens
gaggaggaggcatgagggg

SEQ ID NO: 60969 - DNA, 16 bp, Homo sapiens
ggaggggggcggaggg

SEQ ID NO: 60970 - DNA, 20 bp, Homo sapiens
ggggaggggggggcataagc

SEQ ID NO: 60971 - DNA, 17 bp, Homo sapiens
ggggaggcaaggagggg

SEQ ID NO: 60972 - DNA, 22 bp, Homo sapiens
gggggagggggtgcggaggagc

SEQ ID NO: 60973 - DNA, 22 bp, Homo sapiens
ggggagaggtgggacacaaagc

SEQ ID NO: 60974 - DNA, 22 bp, Homo sapiens
gggaggagcggggcgtctgagc

SEQ ID NO: 60975 - DNA, 21 bp, Homo sapiens
gggtaggagcgggttgagagg

SEQ ID NO: 60976 - DNA, 19 bp, Homo sapiens
ggcggaggggtggggctgg

SEQ ID NO: 60977 - DNA, 19 bp, Homo sapiens
ggggagggaagaggggagg

SEQ ID NO: 60978 - DNA, 16 bp, Homo sapiens
gggcaggggagggggg

SEQ ID NO: 60979 - DNA, 18 bp, Homo sapiens
ggggaggagcgcgggagg

SEQ ID NO: 60980 - DNA, 23 bp, Homo sapiens
ggggatgggtggacagctggggg

SEQ ID NO: 60981 - DNA, 22 bp, Homo sapiens
ggggaggatgcggcatctgagc

SEQ ID NO: 60982 - DNA, 20 bp, Homo sapiens
ggggagcggcccacggggag

SEQ ID NO: 60983 - DNA, 16 bp, Homo sapiens
ggggagggaaggggag

SEQ ID NO: 60984 - DNA, 17 bp, Homo sapiens
ggggagggcactaggag

SEQ ID NO: 60985 - DNA, 22 bp, Homo sapiens
ggggaggatgggtgatctgggc

SEQ ID NO: 60986 - DNA, 17 bp, Homo sapiens
gggaagggccggggggg

SEQ ID NO: 60987 - DNA, 18 bp, Homo sapiens
ggggaggcgactggggag

SEQ ID NO: 60988 - DNA, 17 bp, Homo sapiens
ggcggggatggggggag

SEQ ID NO: 60989 - DNA, 17 bp, Homo sapiens
ggggagagtgagggggg

SEQ ID NO: 60990 - DNA, 19 bp, Homo sapiens
ggggaggagacgggcctgg

SEQ ID NO: 60991 - DNA, 16 bp, Homo sapiens
gggaaggggaggaggg

SEQ ID NO: 60992 - DNA, 17 bp, Homo sapiens
ggggggagcaggagggg

SEQ ID NO: 60993 - DNA, 17 bp, Homo sapiens
ggggaggaggggcaaag

SEQ ID NO: 60994 - DNA, 19 bp, Homo sapiens
gggcaggtgggggaggggc

SEQ ID NO: 60995 - DNA, 18 bp, Homo sapiens
ggggagggggctggggag

SEQ ID NO: 60996 - DNA, 18 bp, Homo sapiens
gggaaggggtgtaaggag

SEQ ID NO: 60997 - DNA, 21 bp, Homo sapiens
ggtggggagggaaggaggagc

SEQ ID NO: 60998 - DNA, 16 bp, Homo sapiens
agggagcggggagggg

SEQ ID NO: 60999 - DNA, 19 bp, Homo sapiens
ggggagggtggagatgagg

SEQ ID NO: 61000 - DNA, 18 bp, Homo sapiens
ggagagggctgggagggg

SEQ ID NO: 61001 - DNA, 21 bp, Homo sapiens
ggcggagggccccggaggagc

SEQ ID NO: 61002 - DNA, 22 bp, Homo sapiens
gaggaggagcgggaggaggagc

SEQ ID NO: 61003 - DNA, 19 bp, Homo sapiens
ggggaggtggggggaggag

SEQ ID NO: 61004 - DNA, 16 bp, Homo sapiens
ggggaggggtggagaa

SEQ ID NO: 61005 - DNA, 17 bp, Homo sapiens
ggggaggagagggaagg

SEQ ID NO: 61006 - DNA, 20 bp, Homo sapiens
ggagaggggagaggaggagc

SEQ ID NO: 61007 - DNA, 18 bp, Homo sapiens
gaggaagagttggggggg

SEQ ID NO: 61008 - DNA, 20 bp, Homo sapiens
ggcggggagcggggcttcgg

SEQ ID NO: 61009 - DNA, 21 bp, Homo sapiens
ggggtgggtgggctggggagc

SEQ ID NO: 61010 - DNA, 19 bp, Homo sapiens
ggggagcaagcgggagggg

SEQ ID NO: 61011 - DNA, 17 bp, Homo sapiens
gggagaggggaggggag

SEQ ID NO: 61012 - DNA, 17 bp, Homo sapiens
ggggagggctgggcgag

SEQ ID NO: 61013 - DNA, 20 bp, Homo sapiens
ggtggggcagggggaggggc

SEQ ID NO: 61014 - DNA, 17 bp, Homo sapiens
ggggagcggaggaggag

SEQ ID NO: 61015 - DNA, 21 bp, Homo sapiens
ggggaggaggttgtcaggagc

SEQ ID NO: 61016 - DNA, 19 bp, Homo sapiens
ggggaggagcgcggcccgg

SEQ ID NO: 61017 - DNA, 18 bp, Homo sapiens
gggtgggggcggggaagg

SEQ ID NO: 61018 - DNA, 19 bp, Homo sapiens
ggggtggaggcaggaggag

SEQ ID NO: 61019 - DNA, 20 bp, Homo sapiens
ggggacgggcgggtcggggg

SEQ ID NO: 61020 - DNA, 16 bp, Homo sapiens
ggggggcagtgggaag

SEQ ID NO: 61021 - DNA, 18 bp, Homo sapiens
gggtaggggcaagggggg

SEQ ID NO: 61022 - DNA, 19 bp, Homo sapiens
ggggaggggagggggacgc

SEQ ID NO: 61023 - DNA, 22 bp, Homo sapiens
ggaggctctgtgggggaggggc

SEQ ID NO: 61024 - DNA, 19 bp, Homo sapiens
ggggagggccggccagggc

SEQ ID NO: 61025 - DNA, 20 bp, Homo sapiens
ggggtggggacgcgggggag

SEQ ID NO: 61026 - DNA, 18 bp, Homo sapiens
gaggaggagtggccagag

SEQ ID NO: 61027 - DNA, 18 bp, Homo sapiens
gggagggagtgagagggg

SEQ ID NO: 61028 - DNA, 16 bp, Homo sapiens
ggggggggggggggaa

SEQ ID NO: 61029 - DNA, 23 bp, Homo sapiens
ggagaggggccctgtggaggggc

SEQ ID NO: 61030 - DNA, 17 bp, Homo sapiens
ggtgatggggggaggag

SEQ ID NO: 61031 - DNA, 17 bp, Homo sapiens
gggtgggctgggggagg

SEQ ID NO: 61032 - DNA, 22 bp, Homo sapiens
ggggcggaggaggggaggagcg

SEQ ID NO: 61033 - DNA, 20 bp, Homo sapiens
ggaggaggggcgggcggagc

SEQ ID NO: 61034 - DNA, 19 bp, Homo sapiens
ggagaggagacagggggag

SEQ ID NO: 61035 - DNA, 18 bp, Homo sapiens
ggagaggagactggggag

SEQ ID NO: 61036 - DNA, 21 bp, Homo sapiens
ggggatgggcgggcatggagc

SEQ ID NO: 61037 - DNA, 22 bp, Homo sapiens
ggggaggggagtgcaacagggg

SEQ ID NO: 61038 - DNA, 17 bp, Homo sapiens
gaggaggggagggggag

SEQ ID NO: 61039 - DNA, 20 bp, Homo sapiens
gggcaggactcggggaggag

SEQ ID NO: 61040 - DNA, 19 bp, Homo sapiens
ggagaggggtgggtggggg

SEQ ID NO: 61041 - DNA, 20 bp, Homo sapiens
agggaggaagcgggggaggg

SEQ ID NO: 61042 - DNA, 23 bp, Homo sapiens
gaggaggagcggggcggaggagc

SEQ ID NO: 61043 - DNA, 18 bp, Homo sapiens
ggggggagcaggagaaga

SEQ ID NO: 61044 - DNA, 18 bp, Homo sapiens
ggaggaggaggagaggag

SEQ ID NO: 61045 - DNA, 18 bp, Homo sapiens
gggtgggggcaggagggg

SEQ ID NO: 61046 - DNA, 19 bp, Homo sapiens
ggggagggccctgaggagc

SEQ ID NO: 61047 - DNA, 19 bp, Homo sapiens
ggtgggggcggggaggggc

SEQ ID NO: 61048 - DNA, 19 bp, Homo sapiens
ggggagggcgggaaggagc

SEQ ID NO: 61049 - DNA, 20 bp, Homo sapiens
ggagagggcaggggaggggc

SEQ ID NO: 61050 - DNA, 18 bp, Homo sapiens
ggggagaagtttcggggg

SEQ ID NO: 61051 - DNA, 16 bp, Homo sapiens
ggggaagcgggagggg

SEQ ID NO: 61052 - DNA, 16 bp, Homo sapiens
ggggggggtggggaga

SEQ ID NO: 61053 - DNA, 19 bp, Homo sapiens
gggggggggggggggggaa

SEQ ID NO: 61054 - DNA, 26 bp, Homo sapiens
ggtggaggagcggagattggaggagc

SEQ ID NO: 61055 - DNA, 18 bp, Homo sapiens
agggggagcaccgagggg

SEQ ID NO: 61056 - DNA, 17 bp, Homo sapiens
ggtggaggtggggggag

SEQ ID NO: 61057 - DNA, 18 bp, Homo sapiens
gggaggctagggggggag

SEQ ID NO: 61058 - DNA, 18 bp, Homo sapiens
ggggggcggggtgggggc

SEQ ID NO: 61059 - DNA, 21 bp, Homo sapiens
gggaagggcagaaagaggagc

SEQ ID NO: 61060 - DNA, 21 bp, Homo sapiens
ggggaggtgcaagggaggggc

SEQ ID NO: 61061 - DNA, 19 bp, Homo sapiens
aggggaggggttgaggagc

SEQ ID NO: 61062 - DNA, 17 bp, Homo sapiens
gggaaggggtgggtagg

SEQ ID NO: 61063 - DNA, 21 bp, Homo sapiens
ggggaggagggggattaaagg

SEQ ID NO: 61064 - DNA, 18 bp, Homo sapiens
ggggaggagctctggggg

SEQ ID NO: 61065 - DNA, 21 bp, Homo sapiens
ggggagggggtggggaatgag

SEQ ID NO: 61066 - DNA, 17 bp, Homo sapiens
ggggaggaggtgggaag

SEQ ID NO: 61067 - DNA, 20 bp, Homo sapiens
ggggaggaggggggtggggc

SEQ ID NO: 61068 - DNA, 17 bp, Homo sapiens
ggggcgggggtgggagg

SEQ ID NO: 61069 - DNA, 18 bp, Homo sapiens
ggagaggggcggggaagg

SEQ ID NO: 61070 - DNA, 17 bp, Homo sapiens
gggaaggggaaggggag

SEQ ID NO: 61071 - DNA, 18 bp, Homo sapiens
gggaagggacagggggag

SEQ ID NO: 61072 - DNA, 19 bp, Homo sapiens
ggagagggcagggggggag

SEQ ID NO: 61073 - DNA, 16 bp, Homo sapiens
gggggggccggagggg

SEQ ID NO: 61074 - DNA, 20 bp, Homo sapiens
ggcgaggggcgggaaggggc

SEQ ID NO: 61075 - DNA, 24 bp, Homo sapiens
ggggaggtggcgggaggggggagc

SEQ ID NO: 61076 - DNA, 18 bp, Homo sapiens
ggggaggcggcagaggag

SEQ ID NO: 61077 - DNA, 18 bp, Homo sapiens
gggaaggtgtggggggag

SEQ ID NO: 61078 - DNA, 19 bp, Homo sapiens
aaaaaggggcggggggggg

SEQ ID NO: 61079 - DNA, 20 bp, Homo sapiens
ggggatgcgaggggaggggc

SEQ ID NO: 61080 - DNA, 19 bp, Homo sapiens
ggggaggaggggcgcgggg

SEQ ID NO: 61081 - DNA, 19 bp, Homo sapiens
ggggggaagtggggagggc

SEQ ID NO: 61082 - DNA, 20 bp, Homo sapiens
ggggcgggagtggggagaag

SEQ ID NO: 61083 - DNA, 19 bp, Homo sapiens
ggggaggggagacaggggc

SEQ ID NO: 61084 - DNA, 19 bp, Homo sapiens
ggggggaggcagaaggagc

SEQ ID NO: 61085 - DNA, 15 bp, Homo sapiens
ggggaggggggagag

SEQ ID NO: 61086 - DNA, 17 bp, Homo sapiens
ggggagggcagggggag

SEQ ID NO: 61087 - DNA, 19 bp, Homo sapiens
gggggccaaggggaggagc

SEQ ID NO: 61088 - DNA, 21 bp, Homo sapiens
gggcgaggggcggggaggggc

SEQ ID NO: 61089 - DNA, 15 bp, Homo sapiens
ggggggggggggaag

SEQ ID NO: 61090 - DNA, 19 bp, Homo sapiens
ggggaggaggtggggaaag

SEQ ID NO: 61091 - DNA, 16 bp, Homo sapiens
ggggaggcggggggag

SEQ ID NO: 61092 - DNA, 18 bp, Homo sapiens
ggggaggagggatctgag

SEQ ID NO: 61093 - DNA, 20 bp, Homo sapiens
ggcgagggggtctggggagc

SEQ ID NO: 61094 - DNA, 16 bp, Homo sapiens
gggagggggcggaggg

SEQ ID NO: 61095 - DNA, 20 bp, Homo sapiens
gggcaggagcggaagggagg

SEQ ID NO: 61096 - DNA, 17 bp, Homo sapiens
gggggcggctggaggag

SEQ ID NO: 61097 - DNA, 18 bp, Homo sapiens
ggggcggggcaggaggag

SEQ ID NO: 61098 - DNA, 16 bp, Homo sapiens
ggggagaccggaggag

SEQ ID NO: 61099 - DNA, 19 bp, Homo sapiens
ggggaggactgggctgagc

SEQ ID NO: 61100 - DNA, 18 bp, Homo sapiens
ggggcggggtggggagga

SEQ ID NO: 61101 - DNA, 18 bp, Homo sapiens
ggggaggagggggtgggg

SEQ ID NO: 61102 - DNA, 20 bp, Homo sapiens
gggaaggagtggggtcctgg

SEQ ID NO: 61103 - DNA, 17 bp, Homo sapiens
gggagggggcggcagag

SEQ ID NO: 61104 - DNA, 15 bp, Homo sapiens
ggggagggggaggag

SEQ ID NO: 61105 - DNA, 19 bp, Homo sapiens
gggagggagtggagtggag

SEQ ID NO: 61106 - DNA, 21 bp, Homo sapiens
ggggcggggcgggaagagggc

SEQ ID NO: 61107 - DNA, 22 bp, Homo sapiens
gggcaggggtggtaaaaggagc

SEQ ID NO: 61108 - DNA, 18 bp, Homo sapiens
ggggaggagtggctgggg

SEQ ID NO: 61109 - DNA, 20 bp, Homo sapiens
ggggtgggccaataaggagc

SEQ ID NO: 61110 - DNA, 23 bp, Homo sapiens
ggggaggagtgggtgaacccagc

SEQ ID NO: 61111 - DNA, 22 bp, Homo sapiens
ggggaggaaggctcagaggggc

SEQ ID NO: 61112 - DNA, 17 bp, Homo sapiens
gggaaggagcccgggag

SEQ ID NO: 61113 - DNA, 21 bp, Homo sapiens
gaggaggagcctcagaggagc

SEQ ID NO: 61114 - DNA, 20 bp, Homo sapiens
ggggacggggtttgaggagc

SEQ ID NO: 61115 - DNA, 23 bp, Homo sapiens
gggaggggggtgggaatctgagc

SEQ ID NO: 61116 - DNA, 20 bp, Homo sapiens
gggtgaggagtggggagaaa

SEQ ID NO: 61117 - DNA, 23 bp, Homo sapiens
gggaggaggtggctgggaggggc

SEQ ID NO: 61118 - DNA, 20 bp, Homo sapiens
ggggagggcggggagaagag

SEQ ID NO: 61119 - DNA, 18 bp, Homo sapiens
ggtgaggagcgggagggg

SEQ ID NO: 61120 - DNA, 18 bp, Homo sapiens
ggggtgggcggggggaga

SEQ ID NO: 61121 - DNA, 17 bp, Homo sapiens
ggggagggtggggagag

SEQ ID NO: 61122 - DNA, 16 bp, Homo sapiens
gaggggaggggaggag

SEQ ID NO: 61123 - DNA, 19 bp, Homo sapiens
ggggagggagtcccaggag

SEQ ID NO: 61124 - DNA, 21 bp, Homo sapiens
gaggaggaggagaaggaggag

SEQ ID NO: 61125 - DNA, 18 bp, Homo sapiens
gaggaggggaaggggggg

SEQ ID NO: 61126 - DNA, 18 bp, Homo sapiens
ggggcaggctgggagggg

SEQ ID NO: 61127 - DNA, 22 bp, Homo sapiens
gggaggggggcaggaggaggag

SEQ ID NO: 61128 - DNA, 18 bp, Homo sapiens
ggggagggagtggggagg

SEQ ID NO: 61129 - DNA, 19 bp, Homo sapiens
ggggggtgggggagagagc

SEQ ID NO: 61130 - DNA, 19 bp, Homo sapiens
ggtggagggcagggggagg

SEQ ID NO: 61131 - DNA, 19 bp, Homo sapiens
ggggagggttgggaaggag

SEQ ID NO: 61132 - DNA, 22 bp, Homo sapiens
agggtggggtggggggaggggc

SEQ ID NO: 61133 - DNA, 17 bp, Homo sapiens
ggggaggggcggtgaag

SEQ ID NO: 61134 - DNA, 19 bp, Homo sapiens
gggaggaatgtggggggag

SEQ ID NO: 61135 - DNA, 18 bp, Homo sapiens
ggggaggggtggaggggc

SEQ ID NO: 61136 - DNA, 16 bp, Homo sapiens
ggggggagtggggaag

SEQ ID NO: 61137 - DNA, 20 bp, Homo sapiens
ggggagtggaggggaggggc

SEQ ID NO: 61138 - DNA, 17 bp, Homo sapiens
ggaggacgggggaggag

SEQ ID NO: 61139 - DNA, 16 bp, Homo sapiens
ggggggggggggcggg

SEQ ID NO: 61140 - DNA, 18 bp, Homo sapiens
gggggggggcgggcaggg

SEQ ID NO: 61141 - DNA, 18 bp, Homo sapiens
gggcgaggaggtgggggg

SEQ ID NO: 61142 - DNA, 17 bp, Homo sapiens
gggggaggaggaggagc

SEQ ID NO: 61143 - DNA, 18 bp, Homo sapiens
ggggggcggtggggggaa

SEQ ID NO: 61144 - DNA, 18 bp, Homo sapiens
agggggagggggaggggc

SEQ ID NO: 61145 - DNA, 18 bp, Homo sapiens
ggggagagtggggagagg

SEQ ID NO: 61146 - DNA, 19 bp, Homo sapiens
agggaggaagaggaggggc

SEQ ID NO: 61147 - DNA, 23 bp, Homo sapiens
ggggaggggagggcctccgggag

SEQ ID NO: 61148 - DNA, 17 bp, Homo sapiens
ggtggagggagggggag

SEQ ID NO: 61149 - DNA, 17 bp, Homo sapiens
gggtgggcggggagggg

SEQ ID NO: 61150 - DNA, 23 bp, Homo sapiens
ggggaggcggcacctggaggagc

SEQ ID NO: 61151 - DNA, 18 bp, Homo sapiens
ggggagtgacaaaggggg

SEQ ID NO: 61152 - DNA, 19 bp, Homo sapiens
ggggagagggtgcaggagc

SEQ ID NO: 61153 - DNA, 19 bp, Homo sapiens
ggggaggaggggcactggg

SEQ ID NO: 61154 - DNA, 17 bp, Homo sapiens
agggatagagggggagg

SEQ ID NO: 61155 - DNA, 17 bp, Homo sapiens
agggaggaagggggggg

SEQ ID NO: 61156 - DNA, 23 bp, Homo sapiens
ggggaagagtggtgaggaggggc

SEQ ID NO: 61157 - DNA, 17 bp, Homo sapiens
ggggggaacgaagggag

SEQ ID NO: 61158 - DNA, 17 bp, Homo sapiens
gggaggagctggagggg

SEQ ID NO: 61159 - DNA, 22 bp, Homo sapiens
ggggaggcggcgggggaggagc

SEQ ID NO: 61160 - DNA, 18 bp, Homo sapiens
gggggcgggggggggggc

SEQ ID NO: 61161 - DNA, 23 bp, Homo sapiens
gaggaggggcccagcagaggggc

SEQ ID NO: 61162 - DNA, 21 bp, Homo sapiens
gaggggagcgggcaccgtggg

SEQ ID NO: 61163 - DNA, 21 bp, Homo sapiens
ggagaggagcgggagaggggc

SEQ ID NO: 61164 - DNA, 20 bp, Homo sapiens
ggggaagcgggggggggggc

SEQ ID NO: 61165 - DNA, 22 bp, Homo sapiens
ggaggggcgggcaccggggagc

SEQ ID NO: 61166 - DNA, 17 bp, Homo sapiens
ggggaggggcgtaagag

SEQ ID NO: 61167 - DNA, 17 bp, Homo sapiens
gggaagaaggggagggg

SEQ ID NO: 61168 - DNA, 20 bp, Homo sapiens
ggggggggcggggggcgggc

SEQ ID NO: 61169 - DNA, 19 bp, Homo sapiens
ggagaggggcgggcgcagg

SEQ ID NO: 61170 - DNA, 19 bp, Homo sapiens
ggggaggaggggaaagggc

SEQ ID NO: 61171 - DNA, 17 bp, Homo sapiens
agggaggggtggggtgg

SEQ ID NO: 61172 - DNA, 17 bp, Homo sapiens
ggggacaggggaggggc

SEQ ID NO: 61173 - DNA, 16 bp, Homo sapiens
gggagggagaggggag

SEQ ID NO: 61174 - DNA, 19 bp, Homo sapiens
ggggaggggaggggagggc

SEQ ID NO: 61175 - DNA, 19 bp, Homo sapiens
ggggcggggtggggcaagc

SEQ ID NO: 61176 - DNA, 22 bp, Homo sapiens
gggcgaggggcgggcgaagagc

SEQ ID NO: 61177 - DNA, 21 bp, Homo sapiens
ggggagggggctgccaggagc

SEQ ID NO: 61178 - DNA, 21 bp, Homo sapiens
ggggcgggggtgggagagggc

SEQ ID NO: 61179 - DNA, 18 bp, Homo sapiens
ggggggcagcgggctggg

SEQ ID NO: 61180 - DNA, 19 bp, Homo sapiens
gggaaggagtgggtctggg

SEQ ID NO: 61181 - DNA, 16 bp, Homo sapiens
gggagggggcagggag

SEQ ID NO: 61182 - DNA, 18 bp, Homo sapiens
ggggggagggggaggggc

SEQ ID NO: 61183 - DNA, 22 bp, Homo sapiens
gaggaggcagcagagggaggag

SEQ ID NO: 61184 - DNA, 22 bp, Homo sapiens
ggggaggaggtggggacaaagc

SEQ ID NO: 61185 - DNA, 21 bp, Homo sapiens
ggggagggggggacgcagagc

SEQ ID NO: 61186 - DNA, 17 bp, Homo sapiens
ggggagagggtgggagg

SEQ ID NO: 61187 - DNA, 16 bp, Homo sapiens
ggggggggggggggag

SEQ ID NO: 61188 - DNA, 23 bp, Homo sapiens
gggaggggcagactaggaggagc

SEQ ID NO: 61189 - DNA, 21 bp, Homo sapiens
ggggcaggggcagggaggagc

SEQ ID NO: 61190 - DNA, 18 bp, Homo sapiens
ggggcgggagctagggag

SEQ ID NO: 61191 - DNA, 19 bp, Homo sapiens
gggaggagtgggaaagagc

SEQ ID NO: 61192 - DNA, 19 bp, Homo sapiens
gaggaagggggggaggggc

SEQ ID NO: 61193 - DNA, 22 bp, Homo sapiens
ggggaggatgtgggggacacgc

SEQ ID NO: 61194 - DNA, 18 bp, Homo sapiens
gaggaggagccctggggg

SEQ ID NO: 61195 - DNA, 20 bp, Homo sapiens
ggggagggtggtggaggagc

SEQ ID NO: 61196 - DNA, 18 bp, Homo sapiens
gggtggggctggggggag

SEQ ID NO: 61197 - DNA, 20 bp, Homo sapiens
agggaggagtgggaggttgg

SEQ ID NO: 61198 - DNA, 22 bp, Homo sapiens
gggagggctgactgggaggggc

SEQ ID NO: 61199 - DNA, 22 bp, Homo sapiens
gggaggggcgcggaaggggagc

SEQ ID NO: 61200 - DNA, 76 bp, Human herpesvirus 1
ggggggaggagcggggggaggagcggggggaggagcggggggaggagcggccagacgccgaaaacgggcccccccc

SEQ ID NO: 61201 - DNA, 24 bp, Human herpesvirus 1
agacgccgaaaacgggcccccccc

SEQ ID NO: 61202 - DNA, 23 bp, Homo sapiens
agaggctggaacagacccttccc

SEQ ID NO: 61203 - DNA, 23 bp, Homo sapiens
agacgccgagcacctgggctccc

SEQ ID NO: 61204 - DNA, 16 bp, Homo sapiens
acgccgggccccctcc

SEQ ID NO: 61205 - DNA, 18 bp, Homo sapiens
cgaccgagggagcccccc

SEQ ID NO: 61206 - DNA, 17 bp, Homo sapiens
gccgaggtcgccccccc

SEQ ID NO: 61207 - DNA, 20 bp, Homo sapiens
agaccctgagcccgcttccc

SEQ ID NO: 61208 - DNA, 15 bp, Homo sapiens
agagccgggcccccc

SEQ ID NO: 61209 - DNA, 24 bp, Homo sapiens
agacgccgaggcttccgcgccccc

SEQ ID NO: 61210 - DNA, 18 bp, Homo sapiens
gccaggcgggcccccccc

SEQ ID NO: 61211 - DNA, 18 bp, Homo sapiens
agatgcccagacccctcc

SEQ ID NO: 61212 - DNA, 26 bp, Homo sapiens
agacgccggggtgctgggtgccctcc

SEQ ID NO: 61213 - DNA, 24 bp, Homo sapiens
gacgccgatggcgacagcctctcc

SEQ ID NO: 61214 - DNA, 22 bp, Homo sapiens
gcctgagaaccaagccccctcc

SEQ ID NO: 61215 - DNA, 22 bp, Homo sapiens
agacaccgaagacataacctcc

SEQ ID NO: 61216 - DNA, 20 bp, Homo sapiens
gactcccacgggccccttcc

SEQ ID NO: 61217 - DNA, 20 bp, Homo sapiens
gacgccgagtgcggggtccc

SEQ ID NO: 61218 - DNA, 16 bp, Homo sapiens
gacgccagagcccccc

SEQ ID NO: 61219 - DNA, 22 bp, Homo sapiens
agatgccgggaggccgcccccc

SEQ ID NO: 61220 - DNA, 19 bp, Homo sapiens
caccgaggagccacccccc

SEQ ID NO: 61221 - DNA, 19 bp, Homo sapiens
gccgaggcaggccccctcc

SEQ ID NO: 61222 - DNA, 17 bp, Homo sapiens
agagctgagagcccccc

SEQ ID NO: 61223 - DNA, 17 bp, Homo sapiens
gagccccgggccccccc

SEQ ID NO: 61224 - DNA, 24 bp, Homo sapiens
aaacgccgcgcgtcgggtcctccc

SEQ ID NO: 61225 - DNA, 21 bp, Homo sapiens
agatgctgaaaacagctcacc

SEQ ID NO: 61226 - DNA, 21 bp, Homo sapiens
agacctgaatgaaccccttcc

SEQ ID NO: 61227 - DNA, 15 bp, Homo sapiens
agacgccgggccccc

SEQ ID NO: 61228 - DNA, 18 bp, Homo sapiens
agacgcctgggctcctcc

SEQ ID NO: 61229 - DNA, 21 bp, Homo sapiens
aggcgcagaaggcaggccccc

SEQ ID NO: 61230 - DNA, 18 bp, Homo sapiens
agacccccgggcttcccc

SEQ ID NO: 61231 - DNA, 19 bp, Homo sapiens
aacgctgagggcgaacccc

SEQ ID NO: 61232 - DNA, 21 bp, Homo sapiens
agacgccgagaaatggcgccc

SEQ ID NO: 61233 - DNA, 16 bp, Homo sapiens
agacccagggcccccc

SEQ ID NO: 61234 - DNA, 18 bp, Homo sapiens
agacgccgggtcgccccc

SEQ ID NO: 61235 - DNA, 22 bp, Homo sapiens
agacgccgggcgaggcttttcc

SEQ ID NO: 61236 - DNA, 19 bp, Homo sapiens
agacgccgacgggcactcc

SEQ ID NO: 61237 - DNA, 20 bp, Homo sapiens
agctacccaacgggccctcc

SEQ ID NO: 61238 - DNA, 27 bp, Homo sapiens
agaccccgagaagcacaggccccctcc

SEQ ID NO: 61239 - DNA, 20 bp, Homo sapiens
gacgggcacaggcccctccc

SEQ ID NO: 61240 - DNA, 18 bp, Homo sapiens
gcccggcccgcccccccc

SEQ ID NO: 61241 - DNA, 18 bp, Homo sapiens
cgcccccgggcccccccc

SEQ ID NO: 61242 - DNA, 16 bp, Homo sapiens
cgccgggccccgcccc

SEQ ID NO: 61243 - DNA, 22 bp, Homo sapiens
agacgccagaatggaggatccc

SEQ ID NO: 61244 - DNA, 19 bp, Homo sapiens
gacgcggtgggccccctcc

SEQ ID NO: 61245 - DNA, 20 bp, Homo sapiens
agaggctgagcacaggcccc

SEQ ID NO: 61246 - DNA, 18 bp, Homo sapiens
agagcgacgggccctccc

SEQ ID NO: 61247 - DNA, 20 bp, Homo sapiens
ggacctgccaggcccctccc

SEQ ID NO: 61248 - DNA, 18 bp, Homo sapiens
gagccgaaaatttaggcc

SEQ ID NO: 61249 - DNA, 19 bp, Homo sapiens
agacccggcgaggcccccc

SEQ ID NO: 61250 - DNA, 19 bp, Homo sapiens
agacggcggggccccctcc

SEQ ID NO: 61251 - DNA, 18 bp, Homo sapiens
gacaccgggaccccctcc

SEQ ID NO: 61252 - DNA, 81 bp, Human herpesvirus 1
gccccccgcgggcgcgcgcgcgcgcaaaaaaggcgggcggcggtccgggcggcgtgcgcgcgcgcggcgggcgtggggggc

SEQ ID NO: 61253 - DNA, 24 bp, Human herpesvirus 1
cgggcggcgtgcgcgcgcgcggcg

SEQ ID NO: 61254 - DNA, 18 bp, Homo sapiens
cgggcggcgggcgcgggg

SEQ ID NO: 61255 - DNA, 23 bp, Homo sapiens
ggcggtgtggcggcggtgtggcg

SEQ ID NO: 61256 - DNA, 18 bp, Homo sapiens
cgggcggcggcggcggcg

SEQ ID NO: 61257 - DNA, 25 bp, Homo sapiens
cgggcgggtgcgcccgggcgcggcg

SEQ ID NO: 61258 - DNA, 19 bp, Homo sapiens
cgggcggcggcggctcggc

SEQ ID NO: 61259 - DNA, 20 bp, Homo sapiens
gggcgcggcgacgcgtggcg

SEQ ID NO: 61260 - DNA, 27 bp, Homo sapiens
cgggcggcgggcgcgccgggcgcggcg

SEQ ID NO: 61261 - DNA, 18 bp, Homo sapiens
gggcggcgaggcgcgcgg

SEQ ID NO: 61262 - DNA, 17 bp, Homo sapiens
ggcggcggcgcgcggcg

SEQ ID NO: 61263 - DNA, 19 bp, Homo sapiens
ggcgcgcgtgcgtgcggcg

SEQ ID NO: 61264 - DNA, 17 bp, Homo sapiens
gggtggcggcggcggcg

SEQ ID NO: 61265 - DNA, 21 bp, Homo sapiens
cgggcggcggtgcgggcggcg

SEQ ID NO: 61266 - DNA, 21 bp, Homo sapiens
ggcggcggtggctgcgcggcg

SEQ ID NO: 61267 - DNA, 19 bp, Homo sapiens
cgggcggcggcggggacgg

SEQ ID NO: 61268 - DNA, 24 bp, Homo sapiens
cgggcggcggcggcagcagcggcg

SEQ ID NO: 61269 - DNA, 25 bp, Homo sapiens
gggcggcgggcgtgcaggggcggcg

SEQ ID NO: 61270 - DNA, 18 bp, Homo sapiens
cgggcggcggcggtggcg

SEQ ID NO: 61271 - DNA, 19 bp, Homo sapiens
cgggggcgtctgcgcggcg

SEQ ID NO: 61272 - DNA, 22 bp, Homo sapiens
cggagcgggctcgcgcgcggcg

SEQ ID NO: 61273 - DNA, 21 bp, Homo sapiens
gggcgggcggagcgcgcgcgg

SEQ ID NO: 61274 - DNA, 22 bp, Homo sapiens
aggggcgtgtgcgcgcgtggcg

SEQ ID NO: 61275 - DNA, 21 bp, Homo sapiens
cgggcggctgcggcctcggcg

SEQ ID NO: 61276 - DNA, 19 bp, Homo sapiens
cgggcggcggcggggcggc

SEQ ID NO: 61277 - DNA, 21 bp, Homo sapiens
ggctgctccgcgcgcgcggcg

SEQ ID NO: 61278 - DNA, 20 bp, Homo sapiens
gggcggtgtggagcgcggcg

SEQ ID NO: 61279 - DNA, 22 bp, Homo sapiens
cgggcggcggcggaggtcggcg

SEQ ID NO: 61280 - DNA, 23 bp, Homo sapiens
ggcggcggaggaggcgcgcggcg

SEQ ID NO: 61281 - DNA, 18 bp, Homo sapiens
cggccccgcgcgcgcggc

SEQ ID NO: 61282 - DNA, 20 bp, Homo sapiens
gggcggcgggctgcgcggcg

SEQ ID NO: 61283 - DNA, 21 bp, Homo sapiens
cgggcggcggcggctgcggcg

SEQ ID NO: 61284 - DNA, 23 bp, Homo sapiens
cggggggtgtgcgcgcgccggcg

SEQ ID NO: 61285 - DNA, 21 bp, Homo sapiens
cggcgatccgcgtgcgcggcg

SEQ ID NO: 61286 - DNA, 20 bp, Homo sapiens
gggcggcggcggctgcgtgg

SEQ ID NO: 61287 - DNA, 24 bp, Homo sapiens
gggcgccggcgcgcgcgcgcggcg

SEQ ID NO: 61288 - DNA, 19 bp, Homo sapiens
cgggcggcgggccggcggc

SEQ ID NO: 61289 - DNA, 24 bp, Homo sapiens
cgggcggcggcggagcgggcggcg

SEQ ID NO: 61290 - DNA, 18 bp, Homo sapiens
ggctggcggtgcgcggcg

SEQ ID NO: 61291 - DNA, 16 bp, Homo sapiens
cgggcggcggcggcgg

SEQ ID NO: 61292 - DNA, 18 bp, Homo sapiens
gggtgggtccggcgcggc

SEQ ID NO: 61293 - DNA, 16 bp, Homo sapiens
gagcggcggcgcgcgg

SEQ ID NO: 61294 - DNA, 16 bp, Homo sapiens
cgggcggtggcggcgg

SEQ ID NO: 61295 - DNA, 23 bp, Homo sapiens
cgggcggcgggcggcgggcggcg

SEQ ID NO: 61296 - DNA, 18 bp, Homo sapiens
gcgaggcgcgcgcgcggc

SEQ ID NO: 61297 - DNA, 19 bp, Homo sapiens
cgggtgggtgcgccagggc

SEQ ID NO: 61298 - DNA, 22 bp, Homo sapiens
cgggcgctgtgcgtgcgcgcgg

SEQ ID NO: 61299 - DNA, 20 bp, Homo sapiens
ggttccccgcgcgcgcgcgg

SEQ ID NO: 61300 - DNA, 20 bp, Homo sapiens
cgggtggcgcgcgtcgggcg

SEQ ID NO: 61301 - DNA, 20 bp, Homo sapiens
ggcggcgttggtgcgcggcg

SEQ ID NO: 61302 - DNA, 17 bp, Homo sapiens
gggcggcggcggcggcg

SEQ ID NO: 61303 - DNA, 20 bp, Homo sapiens
cgggcggcgggcagaggcgg

SEQ ID NO: 61304 - DNA, 18 bp, Homo sapiens
gcgcggcgcgcgcgcggc

SEQ ID NO: 61305 - DNA, 24 bp, Homo sapiens
gggcgcagtcacgtgcgcgcggcg

SEQ ID NO: 61306 - DNA, 23 bp, Homo sapiens
cgggcggctccctgcgcgcggcg

SEQ ID NO: 61307 - DNA, 24 bp, Homo sapiens
cgggcggcgtgccgaggaccggcg

SEQ ID NO: 61308 - DNA, 21 bp, Homo sapiens
cgggtggcgtggcgtcatacg

SEQ ID NO: 61309 - DNA, 21 bp, Homo sapiens
caggcggcgggctgtgcggcg

SEQ ID NO: 61310 - DNA, 19 bp, Homo sapiens
agcgcgcgcgcgtgtggcg

SEQ ID NO: 61311 - DNA, 22 bp, Homo sapiens
cgggcggcaggaacgcgcggcg

SEQ ID NO: 61312 - DNA, 25 bp, Homo sapiens
cgggcggcgggcgggtgctgcggcg

SEQ ID NO: 61313 - DNA, 21 bp, Homo sapiens
ggcggcggctgctgcgcggcg

SEQ ID NO: 61314 - DNA, 23 bp, Homo sapiens
cgggcggcgttgcgtcgcgccgg

SEQ ID NO: 61315 - DNA, 18 bp, Homo sapiens
cgggcggctgcgcagggc

SEQ ID NO: 61316 - DNA, 19 bp, Homo sapiens
cgggcggcgggcggcggcg

SEQ ID NO: 61317 - DNA, 21 bp, Homo sapiens
gcgcgcggcgcgtgcgtggcg

SEQ ID NO: 61318 - DNA, 21 bp, Homo sapiens
cgggcggcggcgcgtcctgcg

SEQ ID NO: 61319 - DNA, 18 bp, Homo sapiens
gggcggcgggctggcggc

SEQ ID NO: 61320 - DNA, 23 bp, Homo sapiens
gggcggcggtggagatagcggcg

SEQ ID NO: 61321 - DNA, 24 bp, Homo sapiens
cgggcgagcggcgagcgcgcggcg

SEQ ID NO: 61322 - DNA, 86 bp, Human herpesvirus 1
gcggggggaggagcggggggaggagcggggggaggagcggggggaggagcggggggaggagcggggggaggagcggggggaggagc

SEQ ID NO: 61323 - DNA, 24 bp, Homo sapiens
ggggaggcggggctggaggagcgg

SEQ ID NO: 61324 - DNA, 26 bp, Homo sapiens
ggggaggggcgtggctgggggagtgg

SEQ ID NO: 61325 - DNA, 18 bp, Homo sapiens
ggggaggagcggcggcgg

SEQ ID NO: 61326 - DNA, 25 bp, Homo sapiens
ggggtgggccccagcggaggggcgg

SEQ ID NO: 61327 - DNA, 18 bp, Homo sapiens
ggggaggccggaggggcg

SEQ ID NO: 61328 - DNA, 22 bp, Homo sapiens
ggggacagatggggaggggcgg

SEQ ID NO: 61329 - DNA, 17 bp, Homo sapiens
ggggggagggaggagcg

SEQ ID NO: 61330 - DNA, 21 bp, Homo sapiens
ggggagagtgggacagggtgg

SEQ ID NO: 61331 - DNA, 19 bp, Homo sapiens
ggggggggggggggggagg

SEQ ID NO: 61332 - DNA, 19 bp, Homo sapiens
ggggaggggtggggggcgg

SEQ ID NO: 61333 - DNA, 19 bp, Homo sapiens
ggggtggggcggggggtgg

SEQ ID NO: 61334 - DNA, 19 bp, Homo sapiens
ggtggggagcggagggtgg

SEQ ID NO: 61335 - DNA, 26 bp, Homo sapiens
gggcaggggcgaaaggtggggggtgg

SEQ ID NO: 61336 - DNA, 21 bp, Homo sapiens
ggggcgggcggggggcagtgg

SEQ ID NO: 61337 - DNA, 18 bp, Homo sapiens
ggggtggggcggggggga

SEQ ID NO: 61338 - DNA, 21 bp, Homo sapiens
ggggcggggcgggggggccgg

SEQ ID NO: 61339 - DNA, 131 bp, Paramecium bursaria Chlorella virus 1
gaattgtccttgagcttgtatactctgtttacataccacctgagggttcgggggtacttcgtgatgcggcagatgacaccgggcggcccttagtgattgccagagaacatatacaaccgaagacctcgttt

SEQ ID NO: 61340 - DNA, 24 bp, Paramecium bursaria Chlorella virus 1
tgacaccgggcggcccttagtgat

SEQ ID NO: 61341 - DNA, 18 bp, Homo sapiens
caccgggcggcgggtgat

SEQ ID NO: 61342 - DNA, 23 bp, Homo sapiens
tggcactgggtgtccaacaggat

SEQ ID NO: 61343 - DNA, 20 bp, Homo sapiens
catactgctttcttagtgat

SEQ ID NO: 61344 - DNA, 15 bp, Homo sapiens
tgaaccggcttagtg

SEQ ID NO: 61345 - DNA, 19 bp, Homo sapiens
tgcacctggcctttagtga

SEQ ID NO: 61346 - DNA, 18 bp, Homo sapiens
tgacaccaggcgctggtg

SEQ ID NO: 61347 - DNA, 17 bp, Homo sapiens
ccgggcggcctcactga

SEQ ID NO: 61348 - DNA, 20 bp, Homo sapiens
gggattctgcccttagtgat

SEQ ID NO: 61349 - DNA, 25 bp, Homo sapiens
cctgggcggcctccttgttagtgat

SEQ ID NO: 61350 - DNA, 81 bp, Amsacta moorei entomopoxvirus
ggattctatagatttaataaatccaactgattctactataaaatcaacagatattacagattctatagatttaataaatcc

SEQ ID NO: 61351 - DNA, 24 bp, Amsacta moorei entomopoxvirus
tattacagattctatagatttaat

SEQ ID NO: 61352 - DNA, 18 bp, Homo sapiens
tattattgattctataga

SEQ ID NO: 61353 - DNA, 18 bp, Homo sapiens
tattatggactctataaa

SEQ ID NO: 61354 - DNA, 18 bp, Homo sapiens
tattacagattctaggga

SEQ ID NO: 61355 - DNA, 68 bp, Parsnip yellow fleck virus
gaactgagctttttaattaaagtgaaggacccgggccaaggcctcgccgtcatctactcggctcagtc

SEQ ID NO: 61356 - DNA, 24 bp, Parsnip yellow fleck virus
aaagtgaaggacccgggccaaggc

SEQ ID NO: 61357 - DNA, 30 bp, Homo sapiens
ggagtgaaggattcagtgaggtgccttggc

SEQ ID NO: 61358 - DNA, 20 bp, Homo sapiens
aaggaagaagatggccaagg

SEQ ID NO: 61359 - DNA, 22 bp, Homo sapiens
agtgaagacccatataaaaggc

SEQ ID NO: 61360 - DNA, 18 bp, Homo sapiens
aagtgaaggggctcaggg

SEQ ID NO: 61361 - DNA, 20 bp, Homo sapiens
gtggggaacccaggtgaggc

SEQ ID NO: 61362 - DNA, 19 bp, Homo sapiens
gagggcgcccgggccgagg

SEQ ID NO: 61363 - DNA, 22 bp, Homo sapiens
gtggaggctgcagggccaaggc

SEQ ID NO: 61364 - DNA, 22 bp, Homo sapiens
agtgggggaacccgggtcaagg

SEQ ID NO: 61365 - DNA, 17 bp, Homo sapiens
aggaaagagggccaagg

SEQ ID NO: 61366 - DNA, 17 bp, Homo sapiens
ggagtaaggatccaggc

SEQ ID NO: 61367 - DNA, 20 bp, Homo sapiens
gtgaagaacttggacatggc

SEQ ID NO: 61368 - DNA, 20 bp, Homo sapiens
gaaggacccgcctcccgagg

SEQ ID NO: 61369 - DNA, 19 bp, Homo sapiens
aggaaggagagaccaaggc

SEQ ID NO: 61370 - DNA, 17 bp, Homo sapiens
gaagggggcgccaaggc

SEQ ID NO: 61371 - DNA, 19 bp, Homo sapiens
atgaaggaaagcaccaggg

SEQ ID NO: 61372 - DNA, 25 bp, Homo sapiens
ggagtgaaagaccccaggtgccttg

SEQ ID NO: 61373 - DNA, 21 bp, Homo sapiens
aaagtgaagtggctacaaagg

SEQ ID NO: 61374 - DNA, 23 bp, Homo sapiens
aaaggaggaggaagggtcgaggc

SEQ ID NO: 61375 - DNA, 18 bp, Homo sapiens
aaaggagggatcccaggc

SEQ ID NO: 61376 - DNA, 25 bp, Homo sapiens
aaatgaaggaactgagggctgaggc

SEQ ID NO: 61377 - DNA, 20 bp, Homo sapiens
aggaaggattaggccaaggc

SEQ ID NO: 61378 - DNA, 19 bp, Homo sapiens
aaagtgaagcatctcaagg

SEQ ID NO: 61379 - DNA, 19 bp, Homo sapiens
tggaggatccgagagaggc

SEQ ID NO: 61380 - DNA, 20 bp, Homo sapiens
agggaggggcaaggccaagg

SEQ ID NO: 61381 - DNA, 20 bp, Homo sapiens
atgaggaaaggggccaaggc

SEQ ID NO: 61382 - DNA, 21 bp, Homo sapiens
aagtgaaggggccacacgggc

SEQ ID NO: 61383 - DNA, 18 bp, Homo sapiens
aagtaaagggcctgcggg

SEQ ID NO: 61384 - DNA, 20 bp, Homo sapiens
gcgtaagttcgggccaaggc

SEQ ID NO: 61385 - DNA, 19 bp, Homo sapiens
atgaaggaggccctgaggc

SEQ ID NO: 61386 - DNA, 22 bp, Homo sapiens
ggagtgggggacccgggttagc

SEQ ID NO: 61387 - DNA, 17 bp, Homo sapiens
aggagggacccagaggg

SEQ ID NO: 61388 - DNA, 18 bp, Homo sapiens
ggagtgaaggccttcagg

SEQ ID NO: 61389 - DNA, 24 bp, Homo sapiens
aagtgaagatccggtggtgccttg

SEQ ID NO: 61390 - DNA, 22 bp, Homo sapiens
gcggggcgggcccgggccgagg

SEQ ID NO: 61391 - DNA, 25 bp, Homo sapiens
aagtgaaggtccgacaggtgccttg

SEQ ID NO: 61392 - DNA, 23 bp, Homo sapiens
aagtgaagtgacttgcccgaggc

SEQ ID NO: 61393 - DNA, 21 bp, Homo sapiens
gaaggtgccccgggccgaggc

SEQ ID NO: 61394 - DNA, 25 bp, Homo sapiens
aagtgaaaggatggattattaaggc

SEQ ID NO: 61395 - DNA, 17 bp, Homo sapiens
gcgagccggggccaagg

SEQ ID NO: 61396 - DNA, 20 bp, Homo sapiens
ggagtgaagggtgaaggagg

SEQ ID NO: 61397 - DNA, 20 bp, Homo sapiens
ggagtgaaggacctcgcggc

SEQ ID NO: 61398 - DNA, 22 bp, Homo sapiens
ggagtcaagggtctgccaaggc

SEQ ID NO: 61399 - DNA, 24 bp, Homo sapiens
gtgagagaagccaagggccagggc

SEQ ID NO: 61400 - DNA, 18 bp, Homo sapiens
tgaaggtctgggccaagg

SEQ ID NO: 61401 - DNA, 21 bp, Homo sapiens
aaagtgaggaacctcacaagg

SEQ ID NO: 61402 - DNA, 20 bp, Homo sapiens
aaagcaacccgggtcaaggc

SEQ ID NO: 61403 - DNA, 21 bp, Homo sapiens
aggacaatgccgggccagggc

SEQ ID NO: 61404 - DNA, 25 bp, Homo sapiens
ggagggaggggcccaagcccagggc

SEQ ID NO: 61405 - DNA, 19 bp, Homo sapiens
gtgaaggccaaggctgagg

SEQ ID NO: 61406 - DNA, 18 bp, Homo sapiens
ggagtgagggccccaggc

SEQ ID NO: 61407 - DNA, 18 bp, Homo sapiens
agtgggcggggccaaggc

SEQ ID NO: 61408 - DNA, 20 bp, Homo sapiens
gccagagtccgggccagggc

SEQ ID NO: 61409 - DNA, 16 bp, Homo sapiens
aagtgaaaggccaagg

SEQ ID NO: 61410 - DNA, 24 bp, Homo sapiens
ggagggaggacccggcactggggc

SEQ ID NO: 61411 - DNA, 24 bp, Homo sapiens
aagtgaaagactaaaggtgccttg

SEQ ID NO: 61412 - DNA, 18 bp, Homo sapiens
agtgaaggctcccagggc

SEQ ID NO: 61413 - DNA, 15 bp, Homo sapiens
agcgaagggccaagg

SEQ ID NO: 61414 - DNA, 21 bp, Homo sapiens
aaagctgagggcagccagggc

SEQ ID NO: 61415 - DNA, 19 bp, Homo sapiens
gaaggcgcgaggccaaggc

SEQ ID NO: 61416 - DNA, 23 bp, Homo sapiens
ggagtgaagaggtccaggaaggc

SEQ ID NO: 61417 - DNA, 25 bp, Homo sapiens
aaagtgaagagacttaggtgccttg

SEQ ID NO: 61418 - DNA, 22 bp, Homo sapiens
gtagaaaccaaggggtcagggc

SEQ ID NO: 61419 - DNA, 20 bp, Homo sapiens
gtgaaggatccaggagtggg

SEQ ID NO: 61420 - DNA, 21 bp, Homo sapiens
aaatgaaaaatgggctgaggc

SEQ ID NO: 61421 - DNA, 20 bp, Homo sapiens
aggtgtcaccgggccaaggc

SEQ ID NO: 61422 - DNA, 26 bp, Homo sapiens
ggaatgaaggacctaccttgcggggc

SEQ ID NO: 61423 - DNA, 22 bp, Homo sapiens
aagtgaaaggctgcagagaggc

SEQ ID NO: 61424 - DNA, 18 bp, Homo sapiens
ggagtggggggaccaaga

SEQ ID NO: 61425 - DNA, 22 bp, Homo sapiens
aagtggagacccggccgggggc

SEQ ID NO: 61426 - DNA, 20 bp, Homo sapiens
agtgaaggccggtgcggggc

SEQ ID NO: 61427 - DNA, 22 bp, Homo sapiens
agccccaagcctgggccagggc

SEQ ID NO: 61428 - DNA, 22 bp, Homo sapiens
gaaggtgacagcgggccaaggc

SEQ ID NO: 61429 - DNA, 18 bp, Homo sapiens
gtaaggacccagtaaggc

SEQ ID NO: 61430 - DNA, 19 bp, Homo sapiens
tgagtgaaggactggaggc

SEQ ID NO: 61431 - DNA, 20 bp, Homo sapiens
gaagggaggccgggccgagg

SEQ ID NO: 61432 - DNA, 17 bp, Homo sapiens
ggagtgagggcccgggc

SEQ ID NO: 61433 - DNA, 23 bp, Homo sapiens
aaaggaagaaaaggggccggggc

SEQ ID NO: 61434 - DNA, 23 bp, Homo sapiens
aaactgaaggacctgtccaaggc

SEQ ID NO: 61435 - DNA, 19 bp, Homo sapiens
aaagagaaggaagccaagg

SEQ ID NO: 61436 - DNA, 20 bp, Homo sapiens
agtgaaggccgtgcccaagg

SEQ ID NO: 61437 - DNA, 20 bp, Homo sapiens
gtgaggggaagggccaaggc

SEQ ID NO: 61438 - DNA, 17 bp, Homo sapiens
agtgaagatgggcaagg

SEQ ID NO: 61439 - DNA, 23 bp, Homo sapiens
gtgaaggattccacagccagggc

SEQ ID NO: 61440 - DNA, 22 bp, Homo sapiens
gaaggggaggcaaggccaaggc

SEQ ID NO: 61441 - DNA, 21 bp, Homo sapiens
gtgtggcagccgggccagggc

SEQ ID NO: 61442 - DNA, 17 bp, Homo sapiens
agtggtaggaaccaagg

SEQ ID NO: 61443 - DNA, 27 bp, Homo sapiens
ggaggaaggaccaggctgggtcagggc

SEQ ID NO: 61444 - DNA, 20 bp, Homo sapiens
ggagtgagcgggcgcttagg

SEQ ID NO: 61445 - DNA, 20 bp, Homo sapiens
aaagtggaggttgtccaagg

SEQ ID NO: 61446 - DNA, 20 bp, Homo sapiens
gccagggcccgggccagggc

SEQ ID NO: 61447 - DNA, 20 bp, Homo sapiens
gtccagacttgggccaaggc

SEQ ID NO: 61448 - DNA, 22 bp, Homo sapiens
gaaagctggtctgggccaaggc

SEQ ID NO: 61449 - DNA, 30 bp, Homo sapiens
aaagtgaaagggctccagaggtgccttggc

SEQ ID NO: 61450 - DNA, 20 bp, Homo sapiens
aaagtgaagacctccctggg

SEQ ID NO: 61451 - DNA, 18 bp, Homo sapiens
aaagtgaaggccctgggc

SEQ ID NO: 61452 - DNA, 22 bp, Homo sapiens
aaagtgcaaggaccaaaaaggg

SEQ ID NO: 61453 - DNA, 18 bp, Homo sapiens
aggaaggacccggcgcgc

SEQ ID NO: 61454 - DNA, 23 bp, Homo sapiens
aagtgaagggtcacgatgcgggg

SEQ ID NO: 61455 - DNA, 22 bp, Homo sapiens
agcaccagacccgggtcggggc

SEQ ID NO: 61456 - DNA, 17 bp, Homo sapiens
aaagggagggcccgggc

SEQ ID NO: 61457 - DNA, 19 bp, Homo sapiens
aaagtggagcagcccaagg

SEQ ID NO: 61458 - DNA, 19 bp, Homo sapiens
atgagggacccggcccggc

SEQ ID NO: 61459 - DNA, 17 bp, Homo sapiens
aagtgaaggagcaaagg

SEQ ID NO: 61460 - DNA, 19 bp, Homo sapiens
aaagtgaaggagcaggggc

SEQ ID NO: 61461 - DNA, 131 bp, Ateline herpesvirus 3
tatttgcttgcccgtgatgtgctttgtatttgtttgtatgtagtgctttctttgtaaatgtcacagaaacttctaaaagaggcacctataataaaaatatacatctgtaaaaaattgggttttgtggttag

SEQ ID NO: 61462 - DNA, 24 bp, Ateline herpesvirus 3
tgtttgtatgtagtgctttctttg

SEQ ID NO: 61463 - DNA, 22 bp, Homo sapiens
tgtttgtattttggtttctttg

SEQ ID NO: 61464 - DNA, 24 bp, Homo sapiens
tgtctgtgtcctgtgctttttttg

SEQ ID NO: 61465 - DNA, 22 bp, Homo sapiens
tgtttgtttgtttgtttctttg

SEQ ID NO: 61466 - DNA, 20 bp, Homo sapiens
tttgtatgttggcttctttg

SEQ ID NO: 61467 - DNA, 22 bp, Homo sapiens
tttgtatgtgtgggcttttttg

SEQ ID NO: 61468 - DNA, 19 bp, Homo sapiens
tgttgtatgtagaggcttt

SEQ ID NO: 61469 - DNA, 129 bp, Ectromelia virus
ggtatatatttataaaaaagtttttgattacgatgtcatacgcggaaagaggacacattaacatcatacatcaattaattacattcttataacatcgtaatcaaaagaattgcaattttgatgtatacc

SEQ ID NO: 61470 - DNA, 24 bp, Ectromelia virus
taacatcgtaatcaaaagaattgc

SEQ ID NO: 61471 - DNA, 18 bp, Homo sapiens
catctttcaaaagaattg

SEQ ID NO: 61472 - DNA, 23 bp, Homo sapiens
aacatctctgcccaaaagagttg

SEQ ID NO: 61473 - DNA, 20 bp, Homo sapiens
gtaatcaatttgagagttgc

SEQ ID NO: 61474 - DNA, 21 bp, Homo sapiens
catcataattgaaggaattgc

SEQ ID NO: 61475 - DNA, 24 bp, Homo sapiens
taacatttctaaccggagaattgc

SEQ ID NO: 61476 - DNA, 73 bp, Ectromelia virus
tgtattcagtatttttggaatcataaaaaaataaaaaaagttttactaatttaaaatttaaaaagtatttaca

SEQ ID NO: 61477 - DNA, 85 bp, Yellow fever virus
gtggttctctgcttttcctccagaggtctgtgagcacagtttgctcaagaataagcagacctttggatgacaaacacaaaaccac

SEQ ID NO: 61478 - DNA, 24 bp, Yellow fever virus
tctgcttttcctccagaggtctgt

SEQ ID NO: 61479 - DNA, 23 bp, Homo sapiens
tctgcttttcttcccagccccgt

SEQ ID NO: 61480 - DNA, 27 bp, Homo sapiens
tctgctttttctcttgtacagacctct

SEQ ID NO: 61481 - DNA, 19 bp, Homo sapiens
tgcttttccttcagtcagt

SEQ ID NO: 61482 - DNA, 23 bp, Homo sapiens
tcttcttttccttcttagtctgt

SEQ ID NO: 61483 - DNA, 22 bp, Homo sapiens
tctgctttattttcacatctgt

SEQ ID NO: 61484 - DNA, 16 bp, Homo sapiens
tctgttttcctcctct

SEQ ID NO: 61485 - DNA, 20 bp, Homo sapiens
tgcttctctttaaactctgt

SEQ ID NO: 61486 - DNA, 28 bp, Homo sapiens
tctgcttttcttctctgtacagacctct

SEQ ID NO: 61487 - DNA, 26 bp, Homo sapiens
tgcttttcttctgtatacagacctct

SEQ ID NO: 61488 - DNA, 26 bp, Homo sapiens
tgcttttcttctaaatacagacctct

SEQ ID NO: 61489 - DNA, 21 bp, Homo sapiens
cctggacctccaggggtctgt

SEQ ID NO: 61490 - DNA, 19 bp, Homo sapiens
tctgcttcttgaaggtctg

SEQ ID NO: 61491 - DNA, 17 bp, Homo sapiens
tgttttttcccagaggc

SEQ ID NO: 61492 - DNA, 28 bp, Homo sapiens
tctgcttttactttgtgtacagacctct

SEQ ID NO: 61493 - DNA, 16 bp, Homo sapiens
tcttttttcctcccct

SEQ ID NO: 61494 - DNA, 20 bp, Homo sapiens
tctgcttttccttggaaggt

SEQ ID NO: 61495 - DNA, 28 bp, Homo sapiens
tctgcttttcttttctgtacagacctct

SEQ ID NO: 61496 - DNA, 17 bp, Homo sapiens
tgcttttcttcagaaat

SEQ ID NO: 61497 - DNA, 22 bp, Homo sapiens
tctcttttccttcttcatctgt

SEQ ID NO: 61498 - DNA, 20 bp, Homo sapiens
tctgtttttccccaggaact

SEQ ID NO: 61499 - DNA, 20 bp, Homo sapiens
tctgctttctttcaggacct

SEQ ID NO: 61500 - DNA, 23 bp, Homo sapiens
tctgctcaggaacagaggtctgt

SEQ ID NO: 61501 - DNA, 27 bp, Homo sapiens
tctgcttttcctcgtgtacagacctct

SEQ ID NO: 61502 - DNA, 23 bp, Homo sapiens
tctgtttttttatccattgctgt

SEQ ID NO: 61503 - DNA, 20 bp, Homo sapiens
tctgctttattctctgcctg

SEQ ID NO: 61504 - DNA, 20 bp, Homo sapiens
cttttccttcagagagctgt

SEQ ID NO: 61505 - DNA, 22 bp, Homo sapiens
tctggctttgcgagaggtttgt

SEQ ID NO: 61506 - DNA, 22 bp, Homo sapiens
tctgctttttctgcactgatct

SEQ ID NO: 61507 - DNA, 20 bp, Homo sapiens
tgcattctgcagaggtctgt

SEQ ID NO: 61508 - DNA, 24 bp, Homo sapiens
tgcttttcctctgacttattctgt

SEQ ID NO: 61509 - DNA, 19 bp, Homo sapiens
tctgcttctctttcaggat

SEQ ID NO: 61510 - DNA, 22 bp, Homo sapiens
tgtttttcctcatgtcttctgt

SEQ ID NO: 61511 - DNA, 21 bp, Homo sapiens
tctgctcttccttctctctgt

SEQ ID NO: 61512 - DNA, 21 bp, Homo sapiens
tctgctcttcttaatgtctgt

SEQ ID NO: 61513 - DNA, 17 bp, Homo sapiens
tctctttttctccagaa

SEQ ID NO: 61514 - DNA, 20 bp, Homo sapiens
tctgcttttccttggaagag

SEQ ID NO: 61515 - DNA, 24 bp, Homo sapiens
tctgtctccatgccagaggtctgt

SEQ ID NO: 61516 - DNA, 21 bp, Homo sapiens
tctcttttttttccagaaact

SEQ ID NO: 61517 - DNA, 18 bp, Homo sapiens
tgctcttcctccagttgt

SEQ ID NO: 61518 - DNA, 16 bp, Homo sapiens
cttttccttcaggcct

SEQ ID NO: 61519 - DNA, 22 bp, Homo sapiens
tgcttttcctttaagcaactgt

SEQ ID NO: 61520 - DNA, 24 bp, Homo sapiens
tctgcttctgaaataggggtctgt

SEQ ID NO: 61521 - DNA, 24 bp, Homo sapiens
tctgctttcttctgcgatttctgt

SEQ ID NO: 61522 - DNA, 22 bp, Homo sapiens
ctgactttctccggaggtctgt

SEQ ID NO: 61523 - DNA, 17 bp, Homo sapiens
tctgctttttttcaggt

SEQ ID NO: 61524 - DNA, 22 bp, Homo sapiens
cctgcctccttcagaggtctgt

SEQ ID NO: 61525 - DNA, 19 bp, Homo sapiens
tctgcttctcctccattgt

SEQ ID NO: 61526 - DNA, 15 bp, Homo sapiens
cctgcttttcaggtt

SEQ ID NO: 61527 - DNA, 21 bp, Homo sapiens
gctgggcctccagaggtttgt

SEQ ID NO: 61528 - DNA, 18 bp, Homo sapiens
tgtttctcctccaattgt

SEQ ID NO: 61529 - DNA, 22 bp, Homo sapiens
tgcttttctgctgttaatctgt

SEQ ID NO: 61530 - DNA, 23 bp, Homo sapiens
tctactttttttctaacttctgt

SEQ ID NO: 61531 - DNA, 28 bp, Homo sapiens
tctgcttctccttcttgtacagacctct

SEQ ID NO: 61532 - DNA, 21 bp, Homo sapiens
tctgcttttgtcttcagaaat

SEQ ID NO: 61533 - DNA, 131 bp, Fowl adenovirus D
gcgtaccctgctcgggctgggtaccagcagccgacggagaagcggcggtcggtccagcagacgccgttcccgccccgcttctaccactactcgcgtaatgctggtacgtaccagcccgaagaaggagacgt

SEQ ID NO: 61534 - DNA, 24 bp, Fowl adenovirus D
accctgctcgggctgggtaccagc

SEQ ID NO: 61535 - DNA, 21 bp, Homo sapiens
ccctttccgctgggtgccagc

SEQ ID NO: 61536 - DNA, 19 bp, Homo sapiens
cctgctcgggctgccgggt

SEQ ID NO: 61537 - DNA, 25 bp, Homo sapiens
accctgctctgggctggtttggggc

SEQ ID NO: 61538 - DNA, 18 bp, Homo sapiens
ccctggctgggtgtcagc

SEQ ID NO: 61539 - DNA, 18 bp, Homo sapiens
accctgctttggcccagc

SEQ ID NO: 61540 - DNA, 18 bp, Homo sapiens
ccttgctggggctgggac

SEQ ID NO: 61541 - DNA, 19 bp, Homo sapiens
ccctgctcgggcgcgcggg

SEQ ID NO: 61542 - DNA, 22 bp, Homo sapiens
actcttcttgggctgcaggggt

SEQ ID NO: 61543 - DNA, 18 bp, Homo sapiens
cccggctcgggcgctcag

SEQ ID NO: 61544 - DNA, 20 bp, Homo sapiens
ccgctttagctgggtatcag

SEQ ID NO: 61545 - DNA, 22 bp, Homo sapiens
ccctgtctggggaggtgctagc

SEQ ID NO: 61546 - DNA, 19 bp, Homo sapiens
gctcgggcctgggtgtcag

SEQ ID NO: 61547 - DNA, 17 bp, Homo sapiens
accctgctctgggtacc

SEQ ID NO: 61548 - DNA, 18 bp, Homo sapiens
cctgctcgggctgcgggc

SEQ ID NO: 61549 - DNA, 16 bp, Homo sapiens
ctgctcgggcccccag

SEQ ID NO: 61550 - DNA, 21 bp, Homo sapiens
accccgcttggggcagctggc

SEQ ID NO: 61551 - DNA, 17 bp, Homo sapiens
cctgctgtgggtgccag

SEQ ID NO: 61552 - DNA, 18 bp, Homo sapiens
actctcctcaggtgccag

SEQ ID NO: 61553 - DNA, 18 bp, Homo sapiens
actctgctcgggcccggc

SEQ ID NO: 61554 - DNA, 19 bp, Homo sapiens
ccgctcgggctccaccggc

SEQ ID NO: 61555 - DNA, 20 bp, Homo sapiens
ctgctggtggctataccagc

SEQ ID NO: 61556 - DNA, 19 bp, Homo sapiens
cttgggctggagcagccag

SEQ ID NO: 61557 - DNA, 21 bp, Homo sapiens
ccctgctccggggccaccagc

SEQ ID NO: 61558 - DNA, 20 bp, Homo sapiens
ccctgcacgggccgtccggc

SEQ ID NO: 61559 - DNA, 20 bp, Homo sapiens
accttgctgggctgaagggc

SEQ ID NO: 61560 - DNA, 20 bp, Homo sapiens
ccctgtcttgggtctctggc

SEQ ID NO: 61561 - DNA, 18 bp, Homo sapiens
ccctgcgcgccgagtgcc

SEQ ID NO: 61562 - DNA, 21 bp, Homo sapiens
ccctccttgggctgggacagc

SEQ ID NO: 61563 - DNA, 21 bp, Homo sapiens
ccccgctcgggctcctcaggc

SEQ ID NO: 61564 - DNA, 23 bp, Homo sapiens
acccaggcctgctgggtgtcagc

SEQ ID NO: 61565 - DNA, 18 bp, Homo sapiens
accctgcctgggctgtga

SEQ ID NO: 61566 - DNA, 19 bp, Homo sapiens
accctgctgggagtgtcag

SEQ ID NO: 61567 - DNA, 22 bp, Homo sapiens
ccctgcttgggcttcaaccagc

SEQ ID NO: 61568 - DNA, 19 bp, Homo sapiens
ccctgctctggctgaaggt

SEQ ID NO: 61569 - DNA, 20 bp, Homo sapiens
accctgcctcgggcttcagc

SEQ ID NO: 61570 - DNA, 20 bp, Homo sapiens
accctgtgtcgggcgaacac

SEQ ID NO: 61571 - DNA, 23 bp, Homo sapiens
ccgctcgggctcccggagccggc

SEQ ID NO: 61572 - DNA, 18 bp, Homo sapiens
accctcctcgggctgcga

SEQ ID NO: 61573 - DNA, 23 bp, Homo sapiens
actctgttaggcactgtaccagc

SEQ ID NO: 61574 - DNA, 19 bp, Homo sapiens
ccttcctcgggctgcaggc

SEQ ID NO: 61575 - DNA, 21 bp, Homo sapiens
accctgctctggtcgcccagc

SEQ ID NO: 61576 - DNA, 23 bp, Homo sapiens
tgctccttcttctgggtaccagc

SEQ ID NO: 61577 - DNA, 19 bp, Homo sapiens
accctgctccgggctgcag

SEQ ID NO: 61578 - DNA, 19 bp, Homo sapiens
ccctgcacactggtgtcag

SEQ ID NO: 61579 - DNA, 18 bp, Homo sapiens
ccctgctcctggtgtcag

SEQ ID NO: 61580 - DNA, 23 bp, Homo sapiens
cctgtggaaatctgggtaccagc

SEQ ID NO: 61581 - DNA, 22 bp, Homo sapiens
accctgccgtgtgaggtgtcag

SEQ ID NO: 61582 - DNA, 22 bp, Homo sapiens
ctgctcagggtataggtgtcag

SEQ ID NO: 61583 - DNA, 15 bp, Homo sapiens
cccgctcggctgcca

SEQ ID NO: 61584 - DNA, 20 bp, Homo sapiens
ccttcttgggctgggacagc

SEQ ID NO: 61585 - DNA, 22 bp, Homo sapiens
ctgaacagggctgggtactggc

SEQ ID NO: 61586 - DNA, 18 bp, Homo sapiens
gctcggctcgggcttcag

SEQ ID NO: 61587 - DNA, 21 bp, Homo sapiens
actcgggcattgggtaccagc

SEQ ID NO: 61588 - DNA, 18 bp, Homo sapiens
cctgctcgggctgtgggc

SEQ ID NO: 61589 - DNA, 107 bp, Macaca mulatta rhadinovirus
gacgccgttaataattggcagtaaactgcgaaagggcgtacatcgcagtagtgattttacgatgtgcacacctttccgcggttcaccgccaacaacaaaagcgggtc

SEQ ID NO: 61590 - DNA, 24 bp, Macaca mulatta rhadinovirus
tgtgcacacctttccgcggttcac

SEQ ID NO: 61591 - DNA, 24 bp, Homo sapiens
tgtgcacattttccttaaaaacac

SEQ ID NO: 61592 - DNA, 19 bp, Homo sapiens
tggcacacctttccctggt

SEQ ID NO: 61593 - DNA, 19 bp, Homo sapiens
tgtgtacaccttcatggtt

SEQ ID NO: 61594 - DNA, 20 bp, Homo sapiens
tgtgcacatctgtcaggatt

SEQ ID NO: 61595 - DNA, 20 bp, Homo sapiens
tgtgcacatttgtccgcaat

SEQ ID NO: 61596 - DNA, 20 bp, Homo sapiens
tgtggcacctttccttagcc

SEQ ID NO: 61597 - DNA, 17 bp, Homo sapiens
tgtgcgcccttccagat

SEQ ID NO: 61598 - DNA, 20 bp, Homo sapiens
tgttcacacctttttgaggt

SEQ ID NO: 61599 - DNA, 18 bp, Homo sapiens
tgtgcacacctttcagtt

SEQ ID NO: 61600 - DNA, 19 bp, Homo sapiens
tgtgcacaattttccccca

SEQ ID NO: 61601 - DNA, 18 bp, Homo sapiens
tgtgcacacttctcccac

SEQ ID NO: 61602 - DNA, 65 bp, Paramecium bursaria Chlorella virus 1
cgaatgtatctagttcgttgaagtatgcaactcgcattgcaagatacgtgttagagaatagtttg

SEQ ID NO: 61603 - DNA, 24 bp, Paramecium bursaria Chlorella virus 1
tatctagttcgttgaagtatgcaa

SEQ ID NO: 61604 - DNA, 22 bp, Homo sapiens
tatctggtaccaaagtgtgcaa

SEQ ID NO: 61605 - DNA, 18 bp, Homo sapiens
tatctagttgttggatat

SEQ ID NO: 61606 - DNA, 19 bp, Homo sapiens
tatttaattcgtccatgca

SEQ ID NO: 61607 - DNA, 20 bp, Homo sapiens
tagctggtagtaagtatgca

SEQ ID NO: 61608 - DNA, 20 bp, Homo sapiens
tatccagtcaaatgagtatg

SEQ ID NO: 61609 - DNA, 19 bp, Homo sapiens
cagttcgttgaatatacaa

SEQ ID NO: 61610 - DNA, 17 bp, Homo sapiens
ctagtcaaaagtatgca

SEQ ID NO: 61611 - DNA, 111 bp, Paramecium bursaria Chlorella virus 1
gggcgccgccgccacgaaggagaccctgcgttttttcttcgtaaaaccattcaaatggctcgccgcgaagatgtctgtacctacctacaattgtgagtgttgcaagtgtcc

SEQ ID NO: 61612 - DNA, 24 bp, Paramecium bursaria Chlorella virus 1
accctgcgttttttcttcgtaaaa

SEQ ID NO: 61613 - DNA, 23 bp, Homo sapiens
ccctttttttttttcttcgtaaa

SEQ ID NO: 61614 - DNA, 21 bp, Homo sapiens
accccttcttttttctttgta

SEQ ID NO: 61615 - DNA, 19 bp, Homo sapiens
tggttttctccatgtaaaa

SEQ ID NO: 61616 - DNA, 18 bp, Homo sapiens
tgcgtttcctcttcgtaa

SEQ ID NO: 61617 - DNA, 21 bp, Homo sapiens
tgcgcttttttttccttaaaa

SEQ ID NO: 61618 - DNA, 23 bp, Homo sapiens
accctgcattttttctttttaaa

SEQ ID NO: 61619 - DNA, 19 bp, Homo sapiens
ccttgttagtttcttcgta

SEQ ID NO: 61620 - DNA, 17 bp, Homo sapiens
cccggcgtcctttgtaa

SEQ ID NO: 61621 - DNA, 18 bp, Homo sapiens
ccctgcattttttttgta

SEQ ID NO: 61622 - DNA, 23 bp, Homo sapiens
ccctccgcctttttttttgtaaa

SEQ ID NO: 61623 - DNA, 20 bp, Homo sapiens
cctctgagtttctttgtaaa

SEQ ID NO: 61624 - DNA, 18 bp, Homo sapiens
gttttttcaaccataaaa

SEQ ID NO: 61625 - DNA, 22 bp, Homo sapiens
ccctgctgcctcttctttgtaa

SEQ ID NO: 61626 - DNA, 79 bp, Paramecium bursaria Chlorella virus 1
gtatttatacatatcgtcaatcgtcatttttgtgtaaaatgataattacaaatgacaaatgacactatgtgtaaattac

SEQ ID NO: 61627 - DNA, 17 bp, Paramecium bursaria Chlorella virus 1
cactatgtgtaaattac

SEQ ID NO: 61628 - DNA, 18 bp, Homo sapiens
caccatatgagaaattac

SEQ ID NO: 61629 - DNA, 61 bp, Human papillomavirus type 20
aaccctgcgaaaagaagctgtgctactatattttgctaggcaacatggtatcagcagggtt

SEQ ID NO: 61630 - DNA, 24 bp, Human papillomavirus type 20
aagaagctgtgctactatattttg

SEQ ID NO: 61631 - DNA, 19 bp, Homo sapiens
aagaggctgtgttgccaca

SEQ ID NO: 61632 - DNA, 22 bp, Homo sapiens
aagaaactactactgtattttg

SEQ ID NO: 61633 - DNA, 20 bp, Homo sapiens
gaagctggtttgacattttg

SEQ ID NO: 61634 - DNA, 26 bp, Homo sapiens
aagaagctgctgctactggtctcttg

SEQ ID NO: 61635 - DNA, 22 bp, Homo sapiens
aagaagcacctgttatattttg

SEQ ID NO: 61636 - DNA, 23 bp, Homo sapiens
agaatctgtagttgtatattttg

SEQ ID NO: 61637 - DNA, 18 bp, Homo sapiens
aagcagctgtgatatttt

SEQ ID NO: 61638 - DNA, 19 bp, Homo sapiens
agaaactgtgttgctgact

SEQ ID NO: 61639 - DNA, 19 bp, Homo sapiens
aagaagctagtgctgctat

SEQ ID NO: 61640 - DNA, 18 bp, Homo sapiens
agaagctgtgctgttaca

SEQ ID NO: 61641 - DNA, 18 bp, Homo sapiens
aagaagctgttttattct

SEQ ID NO: 61642 - DNA, 16 bp, Homo sapiens
aagaagcttgtgattt

SEQ ID NO: 61643 - DNA, 67 bp, Human papillomavirus type 20
gatatcaacctgtgcctgtattagctgtgtcagaagccaaagctaaacaggctataggaatggtatt

SEQ ID NO: 61644 - DNA, 24 bp, Human papillomavirus type 20
tgcctgtattagctgtgtcagaag

SEQ ID NO: 61645 - DNA, 22 bp, Homo sapiens
ctgtattaggttgggttagaag

SEQ ID NO: 61646 - DNA, 19 bp, Homo sapiens
tgtctgtgtgtggtcagaa

SEQ ID NO: 61647 - DNA, 17 bp, Homo sapiens
tgcttgtatcagcacag

SEQ ID NO: 61648 - DNA, 20 bp, Homo sapiens
tgctttgttagctgtaacag

SEQ ID NO: 61649 - DNA, 19 bp, Homo sapiens
tgcctgcattaggctggaa

SEQ ID NO: 61650 - DNA, 20 bp, Homo sapiens
cctgtattagtttatagaag

SEQ ID NO: 61651 - DNA, 21 bp, Homo sapiens
tgtctgtgtcagctgtgacag

SEQ ID NO: 61652 - DNA, 21 bp, Homo sapiens
tgcctctgttagcacagccag

SEQ ID NO: 61653 - DNA, 24 bp, Homo sapiens
gcttgttgctcactgtgtcagaag

SEQ ID NO: 61654 - DNA, 19 bp, Homo sapiens
tgcctgataaatgtcagaa

SEQ ID NO: 61655 - DNA, 21 bp, Homo sapiens
gcccacaggctgtgtcagaag

SEQ ID NO: 61656 - DNA, 16 bp, Homo sapiens
tgccctgctgtgtcag

SEQ ID NO: 61657 - DNA, 17 bp, Homo sapiens
tgccctgcctgtgtcag

SEQ ID NO: 61658 - DNA, 79 bp, Human adenovirus A
ctatctaataatataccttatactggactagtgccaatattaaaatgaagtgggcgtagtgtgtaatttgattgggtgg

SEQ ID NO: 61659 - DNA, 24 bp, Human adenovirus A
taccttatactggactagtgccaa

SEQ ID NO: 61660 - DNA, 20 bp, Homo sapiens
accttatattggaaaactag

SEQ ID NO: 61661 - DNA, 19 bp, Homo sapiens
taccctatattggggctaa

SEQ ID NO: 61662 - DNA, 16 bp, Homo sapiens
cttatactggtactgc

SEQ ID NO: 61663 - DNA, 21 bp, Homo sapiens
cctcgctttggctagtgccaa

SEQ ID NO: 61664 - DNA, 19 bp, Homo sapiens
tacctgcctactagtgcca

SEQ ID NO: 61665 - DNA, 19 bp, Homo sapiens
taccttatgtgggtctgcc

SEQ ID NO: 61666 - DNA, 19 bp, Homo sapiens
ctccaagggctagtgccaa

SEQ ID NO: 61667 - DNA, 16 bp, Homo sapiens
cctatactggaaaggc

SEQ ID NO: 61668 - DNA, 20 bp, Homo sapiens
cttatgtgaaaaagtgccaa

SEQ ID NO: 61669 - DNA, 16 bp, Homo sapiens
cttacaactagtgtca

SEQ ID NO: 61670 - DNA, 82 bp, Human adenovirus A
tgtaagtttgggcggatgaggaagtggggcgcggcgtgggagccgggcgcgccggatgtgacgttttagacgccattttaca

SEQ ID NO: 61671 - DNA, 24 bp, Human adenovirus A
tgaggaagtggggcgcggcgtggg

SEQ ID NO: 61672 - DNA, 17 bp, Homo sapiens
agggggtggggcgccgg

SEQ ID NO: 61673 - DNA, 23 bp, Homo sapiens
gggagcggccggtgcggcgtggg

SEQ ID NO: 61674 - DNA, 20 bp, Homo sapiens
gaggggtggggcggggtggg

SEQ ID NO: 61675 - DNA, 17 bp, Homo sapiens
tgaggaggggggcgcgg

SEQ ID NO: 61676 - DNA, 18 bp, Homo sapiens
gaggaggtggggcgcgcg

SEQ ID NO: 61677 - DNA, 21 bp, Homo sapiens
tgagaagtggggtaaagtggg

SEQ ID NO: 61678 - DNA, 21 bp, Homo sapiens
tgagggaggccttggcgtggg

SEQ ID NO: 61679 - DNA, 20 bp, Homo sapiens
gaggagggcggtggtgtggg

SEQ ID NO: 61680 - DNA, 17 bp, Homo sapiens
tggggggtggggggtgg

SEQ ID NO: 61681 - DNA, 20 bp, Homo sapiens
cggggggtgaggggcgtggg

SEQ ID NO: 61682 - DNA, 21 bp, Homo sapiens
gaggagcgagcgcggcgtggg

SEQ ID NO: 61683 - DNA, 22 bp, Homo sapiens
tgaggcgggtgaagggcgtggg

SEQ ID NO: 61684 - DNA, 20 bp, Homo sapiens
taagggagtggggcgcgccg

SEQ ID NO: 61685 - DNA, 21 bp, Homo sapiens
ggggtggggtggtggcgtggg

SEQ ID NO: 61686 - DNA, 16 bp, Homo sapiens
tgggaggtggggcggg

SEQ ID NO: 61687 - DNA, 18 bp, Homo sapiens
taaggaagtgggatgtgg

SEQ ID NO: 61688 - DNA, 22 bp, Homo sapiens
tgaggcagtgggggaatgtggg

SEQ ID NO: 61689 - DNA, 20 bp, Homo sapiens
tggggaagtggggctgatag

SEQ ID NO: 61690 - DNA, 21 bp, Homo sapiens
tgcgggggtggggggcgtggg

SEQ ID NO: 61691 - DNA, 19 bp, Homo sapiens
tgagggggtggggacgcgg

SEQ ID NO: 61692 - DNA, 22 bp, Homo sapiens
tgaggaagggggtaggagtggg

SEQ ID NO: 61693 - DNA, 18 bp, Homo sapiens
tggggaggtggggcacgg

SEQ ID NO: 61694 - DNA, 24 bp, Homo sapiens
tgatggagtggggcgccgagtggg

SEQ ID NO: 61695 - DNA, 18 bp, Homo sapiens
gggtggggagtggcgtgg

SEQ ID NO: 61696 - DNA, 16 bp, Homo sapiens
tgaggaatggggcggg

SEQ ID NO: 61697 - DNA, 18 bp, Homo sapiens
gagggggtggggcggagg

SEQ ID NO: 61698 - DNA, 17 bp, Homo sapiens
tggggaagtgggggcgg

SEQ ID NO: 61699 - DNA, 17 bp, Homo sapiens
tgagggggtgggcgcgg

SEQ ID NO: 61700 - DNA, 24 bp, Homo sapiens
gaggggctcggggcgcggcgtggg

SEQ ID NO: 61701 - DNA, 17 bp, Homo sapiens
ggaggtggggcgcgagg

SEQ ID NO: 61702 - DNA, 21 bp, Homo sapiens
tgagggcgggggcggcgtggg

SEQ ID NO: 61703 - DNA, 22 bp, Homo sapiens
gaggggtgggggtccctgtggg

SEQ ID NO: 61704 - DNA, 17 bp, Homo sapiens
tggggaaatggggcggg

SEQ ID NO: 61705 - DNA, 25 bp, Homo sapiens
tgaggaagtgggagtgtgcagtggg

SEQ ID NO: 61706 - DNA, 24 bp, Homo sapiens
tgaggaagtggcggctggcgtggg

SEQ ID NO: 61707 - DNA, 17 bp, Homo sapiens
cgggaagtggggagtgg

SEQ ID NO: 61708 - DNA, 20 bp, Homo sapiens
tgagggagtggggctgctgg

SEQ ID NO: 61709 - DNA, 18 bp, Homo sapiens
tggggggtgggggcgtgg

SEQ ID NO: 61710 - DNA, 20 bp, Homo sapiens
tggggaggggggcgcgcagg

SEQ ID NO: 61711 - DNA, 15 bp, Homo sapiens
tgaggaaggggggtg

SEQ ID NO: 61712 - DNA, 70 bp, Citrus tristeza virus
agcggacggtagtgctttactaaaagataatactgtggtcgatcgtttagaaggcatgaatcctttggct

SEQ ID NO: 61713 - DNA, 24 bp, Citrus tristeza virus
tagtgctttactaaaagataatac

SEQ ID NO: 61714 - DNA, 20 bp, Homo sapiens
taatgcttttacagataata

SEQ ID NO: 61715 - DNA, 18 bp, Homo sapiens
gccccactgaaggataat

SEQ ID NO: 61716 - DNA, 18 bp, Homo sapiens
cagtgctttattaaagat

SEQ ID NO: 61717 - DNA, 21 bp, Homo sapiens
tagtgctttagttacacagat

SEQ ID NO: 61718 - DNA, 17 bp, Homo sapiens
gcgcttaagagataata

SEQ ID NO: 61719 - DNA, 19 bp, Homo sapiens
taggcatcaaaagataata

SEQ ID NO: 61720 - DNA, 19 bp, Homo sapiens
tagtgctttaatggaaaag

SEQ ID NO: 61721 - DNA, 20 bp, Homo sapiens
tagtgctttattgataaaag

SEQ ID NO: 61722 - DNA, 17 bp, Homo sapiens
tagtgctttataaagat

SEQ ID NO: 61723 - DNA, 18 bp, Homo sapiens
cagtgctttcgagataat

SEQ ID NO: 61724 - DNA, 20 bp, Homo sapiens
tagtgctctgttataaaata

SEQ ID NO: 61725 - DNA, 23 bp, Homo sapiens
tagtgctttcttaaaataaatac

SEQ ID NO: 61726 - DNA, 20 bp, Homo sapiens
tagtgcttcactgaacagat

SEQ ID NO: 61727 - DNA, 61 bp, Citrus tristeza virus
gtcggatcgagttttattcaaagttgttatgggtactaacgttgacgattctcgatgcggc

SEQ ID NO: 61728 - DNA, 24 bp, Citrus tristeza virus
taacgttgacgattctcgatgcgg

SEQ ID NO: 61729 - DNA, 17 bp, Homo sapiens
acgttgacatccctgcg

SEQ ID NO: 61730 - DNA, 24 bp, Homo sapiens
caacgttggcccccagcggtgcgg

SEQ ID NO: 61731 - DNA, 21 bp, Homo sapiens
acattgacctcagtgatgtgg

SEQ ID NO: 61732 - DNA, 114 bp, Melanoplus sanguinipes entomopoxvirus
gtatcaaaaatatcaatatctaatacccaatcaatgtttttatatctgatatcacaaaatatcaataatgtatcaaaaatatcaatatctaatacccaattaatgtttttatat

SEQ ID NO: 61733 - DNA, 24 bp, Melanoplus sanguinipes entomopoxvirus
tcaaaaatatcaatatctaatacc

SEQ ID NO: 61734 - DNA, 20 bp, Homo sapiens
ccaagaatatcaataaatac

SEQ ID NO: 61735 - DNA, 18 bp, Homo sapiens
tcaagaatatcaattccc

SEQ ID NO: 61736 - DNA, 17 bp, Homo sapiens
tcaaaaatatcattcta

SEQ ID NO: 61737 - DNA, 18 bp, Homo sapiens
tcaaaaatatcaaagtcc

SEQ ID NO: 61738 - DNA, 126 bp, Melanoplus sanguinipes entomopoxvirus
tgtttttatatctgatatgttaaaatatcaataatgtatcaaaaatatcaatatctaatacccaatcaatgtttttatatctgatatgttaaaatatcaataatgtatcaaaaatataaataatca

SEQ ID NO: 61739 - DNA, 24 bp, Melanoplus sanguinipes entomopoxvirus
tgatatgttaaaatatcaataatg

SEQ ID NO: 61740 - DNA, 21 bp, Homo sapiens
tgatatgttcaaatgcccaat

SEQ ID NO: 61741 - DNA, 20 bp, Homo sapiens
tgatatgttatgaatctcaa

SEQ ID NO: 61742 - DNA, 16 bp, Homo sapiens
tgatatgttaaatcaa

SEQ ID NO: 61743 - DNA, 63 bp, Sulfolobus virus SIRV-1
ggtaaaagaaagttagaaattaaagaaattagtgatttatatgatgaacaagttttttttact

SEQ ID NO: 61744 - DNA, 24 bp, Sulfolobus virus SIRV-1
tatgatgaacaagttttttttact

SEQ ID NO: 61745 - DNA, 19 bp, Homo sapiens
tgatgaaccagtcagtact

SEQ ID NO: 61746 - DNA, 20 bp, Homo sapiens
tatgatgcatggtctttttt

SEQ ID NO: 61747 - DNA, 19 bp, Homo sapiens
tatgatgagcaggtccctt

SEQ ID NO: 61748 - DNA, 22 bp, Homo sapiens
tgatgaacaagtggaaaatact

SEQ ID NO: 61749 - DNA, 23 bp, Homo sapiens
atgatgggtaaattatttttact

SEQ ID NO: 61750 - DNA, 18 bp, Homo sapiens
tatgatcaacaagttttt

SEQ ID NO: 61751 - DNA, 22 bp, Homo sapiens
tgatgaacaagatgtggctact

SEQ ID NO: 61752 - DNA, 20 bp, Homo sapiens
tatgatgaagacaagagttt

SEQ ID NO: 61753 - DNA, 72 bp, Human papillomavirus type 36
cgtctgaatatgcatctgaaacttggacattagttgacaccagtatagaaacttttagaagcgctccagacg

SEQ ID NO: 61754 - DNA, 24 bp, Human papillomavirus type 36
accagtatagaaacttttagaagc

SEQ ID NO: 61755 - DNA, 22 bp, Homo sapiens
ccagcatagggaagccggaagc

SEQ ID NO: 61756 - DNA, 20 bp, Homo sapiens
accagtataggatattctag

SEQ ID NO: 61757 - DNA, 19 bp, Homo sapiens
agttaggagcttttagaag

SEQ ID NO: 61758 - DNA, 20 bp, Homo sapiens
accagtatcacatttaggag

SEQ ID NO: 61759 - DNA, 18 bp, Homo sapiens
acagaaaatttttagaag

SEQ ID NO: 61760 - DNA, 18 bp, Homo sapiens
accagtaacatttagaag

SEQ ID NO: 61761 - DNA, 22 bp, Homo sapiens
cagtgtggaggccctcagaggc

SEQ ID NO: 61762 - DNA, 19 bp, Homo sapiens
cagtacagaaacacagagc

SEQ ID NO: 61763 - DNA, 20 bp, Homo sapiens
gtataaaaacttaagacggc

SEQ ID NO: 61764 - DNA, 22 bp, Homo sapiens
accagtactatttatttggaag

SEQ ID NO: 61765 - DNA, 22 bp, Homo sapiens
agacatagaagtttttagaagc

SEQ ID NO: 61766 - DNA, 18 bp, Homo sapiens
cagtatagaaatagtaag

SEQ ID NO: 61767 - DNA, 23 bp, Homo sapiens
ccagggtagaaaccaaggggagc

SEQ ID NO: 61768 - DNA, 18 bp, Homo sapiens
accagtatgcaaacaaag

SEQ ID NO: 61769 - DNA, 20 bp, Homo sapiens
ccggcataggggtcaaaagc

SEQ ID NO: 61770 - DNA, 20 bp, Homo sapiens
gtatagaagttttgtagaag

SEQ ID NO: 61771 - DNA, 21 bp, Homo sapiens
agtgtggaattctttagaagc

SEQ ID NO: 61772 - DNA, 19 bp, Homo sapiens
cagtatagaataaaggagc

SEQ ID NO: 61773 - DNA, 20 bp, Homo sapiens
ccagtatagcagttcctcag

SEQ ID NO: 61774 - DNA, 20 bp, Homo sapiens
cagtatagaagaatagaggc

SEQ ID NO: 61775 - DNA, 21 bp, Homo sapiens
cagtatcagagacacaaaagc

SEQ ID NO: 61776 - DNA, 21 bp, Homo sapiens
accaggtggagattccagaag

SEQ ID NO: 61777 - DNA, 18 bp, Homo sapiens
actagtactagaaacttt

SEQ ID NO: 61778 - DNA, 121 bp, Variola virus
tatatattataaaaaagtttttgattacgatgttataagaggaaaaaggacacattaacatcatacatcaattaacattcttataacatcgtaatcaaaagaattgcaattttgatgtata

SEQ ID NO: 61779 - DNA, 24 bp, Variola virus
tatattataaaaaagtttttgatt

SEQ ID NO: 61780 - DNA, 22 bp, Homo sapiens
tatattatcaaaaagtccccaa

SEQ ID NO: 61781 - DNA, 20 bp, Homo sapiens
tatattacaaaaaagttcct

SEQ ID NO: 61782 - DNA, 23 bp, Homo sapiens
tatattatataaaaattctgatt

SEQ ID NO: 61783 - DNA, 24 bp, Homo sapiens
tacaaaacaaaaaggtttttgatt

SEQ ID NO: 61784 - DNA, 61 bp, Garlic virus A
ctcaaagctcatctcttcttcacttgcgtcaacgaatgtaaattagtaagaatagctagag

SEQ ID NO: 61785 - DNA, 24 bp, Garlic virus A
aagctcatctcttcttcacttgcg

SEQ ID NO: 61786 - DNA, 19 bp, Homo sapiens
gctgtttcttcttcccctg

SEQ ID NO: 61787 - DNA, 19 bp, Homo sapiens
aagctcatttctcttaact

SEQ ID NO: 61788 - DNA, 22 bp, Homo sapiens
aagctcttctctttttgacatg

SEQ ID NO: 61789 - DNA, 18 bp, Homo sapiens
aagctcatctctattttc

SEQ ID NO: 61790 - DNA, 23 bp, Homo sapiens
gctcatctctgtgactgcttgcg

SEQ ID NO: 61791 - DNA, 22 bp, Homo sapiens
gctcgctcttctcacagatgcg

SEQ ID NO: 61792 - DNA, 20 bp, Homo sapiens
aacttgtctcttctttcacc

SEQ ID NO: 61793 - DNA, 17 bp, Homo sapiens
gccttcttcttcacttg

SEQ ID NO: 61794 - DNA, 20 bp, Homo sapiens
gctcatctttcctttccttg

SEQ ID NO: 61795 - DNA, 24 bp, Homo sapiens
gcctttgtctcttctttatttgcg

SEQ ID NO: 61796 - DNA, 19 bp, Homo sapiens
aagctcatttcttctccac

SEQ ID NO: 61797 - DNA, 18 bp, Homo sapiens
aagctcatctcttctcca

SEQ ID NO: 61798 - DNA, 18 bp, Homo sapiens
ctcctctccaggcttgcg

SEQ ID NO: 61799 - DNA, 20 bp, Homo sapiens
aagctcatctttgtttttca

SEQ ID NO: 61800 - DNA, 19 bp, Homo sapiens
gcttgttcttcttcaccca

SEQ ID NO: 61801 - DNA, 19 bp, Homo sapiens
agctgtttcttcttccacc

SEQ ID NO: 61802 - DNA, 70 bp, Rabbit fibroma virus
atttgttaatggtctcgatgtaatcgtcgtagctgctacgagataactttttttctgccatttaagagat

SEQ ID NO: 61803 - DNA, 24 bp, Rabbit fibroma virus
ttaatggtctcgatgtaatcgtcg

SEQ ID NO: 61804 - DNA, 22 bp, Homo sapiens
tcaatggtcttgatgtaattgt

SEQ ID NO: 61805 - DNA, 20 bp, Homo sapiens
ttaatggtcttgactgtaac

SEQ ID NO: 61806 - DNA, 68 bp, Rat cytomegalovirus
ttgttagccgcttccttttccatgaaatacaaataataagatcacggaggaaacgaagaatgcaacaa

SEQ ID NO: 61807 - DNA, 24 bp, Rat cytomegalovirus
acggaggaaacgaagaatgcaaca

SEQ ID NO: 61808 - DNA, 18 bp, Homo sapiens
ggaggaaatgaaagaaca

SEQ ID NO: 61809 - DNA, 21 bp, Homo sapiens
acggaggaagcagaggccaca

SEQ ID NO: 61810 - DNA, 15 bp, Homo sapiens
ggggaaaaaaatgca

SEQ ID NO: 61811 - DNA, 19 bp, Homo sapiens
acggaggagtgaggaggca

SEQ ID NO: 61812 - DNA, 18 bp, Homo sapiens
ggaagaaatggaagagca

SEQ ID NO: 61813 - DNA, 17 bp, Homo sapiens
cggagaaacgagaagca

SEQ ID NO: 61814 - DNA, 18 bp, Homo sapiens
gaggaaacgactacaaca

SEQ ID NO: 61815 - DNA, 18 bp, Homo sapiens
ggggggaacgaaaaaaca

SEQ ID NO: 61816 - DNA, 24 bp, Homo sapiens
acggagaaatgaagagagagagca

SEQ ID NO: 61817 - DNA, 17 bp, Homo sapiens
acggaggagacagaggc

SEQ ID NO: 61818 - DNA, 19 bp, Homo sapiens
ggaggaaatctctgcaaca

SEQ ID NO: 61819 - DNA, 18 bp, Homo sapiens
acggaggaagggaaagaa

SEQ ID NO: 61820 - DNA, 21 bp, Homo sapiens
cggaggaaacggaggaaaaca

SEQ ID NO: 61821 - DNA, 17 bp, Homo sapiens
ggaggaaacgggaaggc

SEQ ID NO: 61822 - DNA, 19 bp, Homo sapiens
acggaggaagtggagagca

SEQ ID NO: 61823 - DNA, 20 bp, Homo sapiens
ggaggaaagctcatgtaaca

SEQ ID NO: 61824 - DNA, 17 bp, Homo sapiens
cggaggaaacaaaaggc

SEQ ID NO: 61825 - DNA, 22 bp, Homo sapiens
acggagaaggtggaggaaagca

SEQ ID NO: 61826 - DNA, 18 bp, Homo sapiens
cggggaagggagaatgca

SEQ ID NO: 61827 - DNA, 15 bp, Homo sapiens
gaggaaacgaaggca

SEQ ID NO: 61828 - DNA, 19 bp, Homo sapiens
acggaggaaggaacgggca

SEQ ID NO: 61829 - DNA, 20 bp, Homo sapiens
ggaggaaaagagggaaggca

SEQ ID NO: 61830 - DNA, 17 bp, Homo sapiens
gggggaaacaagggcaa

SEQ ID NO: 61831 - DNA, 16 bp, Homo sapiens
cggaagaaaaggatgc

SEQ ID NO: 61832 - DNA, 19 bp, Homo sapiens
ggaggaaacagacagaacg

SEQ ID NO: 61833 - DNA, 21 bp, Homo sapiens
acggagaagtgatctgtaaca

SEQ ID NO: 61834 - DNA, 18 bp, Homo sapiens
acagaggagacggtaatg

SEQ ID NO: 61835 - DNA, 21 bp, Homo sapiens
ggaggaaacgggcagctggca

SEQ ID NO: 61836 - DNA, 20 bp, Homo sapiens
ggaggaaaagaggcatggca

SEQ ID NO: 61837 - DNA, 16 bp, Homo sapiens
cggaggaaagagagca

SEQ ID NO: 61838 - DNA, 19 bp, Homo sapiens
acggggggaagaatacaac

SEQ ID NO: 61839 - DNA, 19 bp, Homo sapiens
cagagatgaagaatgcaac

SEQ ID NO: 61840 - DNA, 16 bp, Homo sapiens
acagagagagaatgca

SEQ ID NO: 61841 - DNA, 20 bp, Homo sapiens
acggaggaaagatggcagca

SEQ ID NO: 61842 - DNA, 19 bp, Homo sapiens
acggaggaaggaatgggca

SEQ ID NO: 61843 - DNA, 16 bp, Homo sapiens
ggaggaataatgcaac

SEQ ID NO: 61844 - DNA, 21 bp, Homo sapiens
ggagaaaatgggactccaaca

SEQ ID NO: 61845 - DNA, 19 bp, Homo sapiens
acggaggaaggcaggcgac

SEQ ID NO: 61846 - DNA, 19 bp, Homo sapiens
cgggggagagtatgcaaca

SEQ ID NO: 61847 - DNA, 18 bp, Homo sapiens
gggggaaatgaaagaata

SEQ ID NO: 61848 - DNA, 16 bp, Homo sapiens
ggaggaaatgaatgca

SEQ ID NO: 61849 - DNA, 19 bp, Homo sapiens
acggagaaaagtcagtgca

SEQ ID NO: 61850 - DNA, 19 bp, Homo sapiens
ggaggcacaggatgcaaca

SEQ ID NO: 61851 - DNA, 18 bp, Homo sapiens
gggggaaagaatgcaaca

SEQ ID NO: 61852 - DNA, 17 bp, Homo sapiens
ggaagagagaaaaagca

SEQ ID NO: 61853 - DNA, 23 bp, Homo sapiens
acggaggaggggaagggggggca

SEQ ID NO: 61854 - DNA, 21 bp, Homo sapiens
acgaaggaaagaggtgtggca

SEQ ID NO: 61855 - DNA, 17 bp, Homo sapiens
cggtggaacaaatgcaa

SEQ ID NO: 61856 - DNA, 17 bp, Homo sapiens
acggagaagatgaaaca

SEQ ID NO: 61857 - DNA, 17 bp, Homo sapiens
cggaggaaaagaaagca

SEQ ID NO: 61858 - DNA, 17 bp, Homo sapiens
cggaggaaggagaggca

SEQ ID NO: 61859 - DNA, 17 bp, Homo sapiens
cggggagcgagaacgca

SEQ ID NO: 61860 - DNA, 20 bp, Homo sapiens
ggggaaataagaatgcaaca

SEQ ID NO: 61861 - DNA, 64 bp, Shallot virus X
taagtgtgctaaacgccgcagagcaaaacgttataatagatgttttgactgtggtgcctactta

SEQ ID NO: 61862 - DNA, 24 bp, Shallot virus X
tgttttgactgtggtgcctactta

SEQ ID NO: 61863 - DNA, 19 bp, Homo sapiens
tgttttgatggtggcttct

SEQ ID NO: 61864 - DNA, 20 bp, Homo sapiens
tgttttattgatgatgccta

SEQ ID NO: 61865 - DNA, 20 bp, Homo sapiens
tattttgattgtggatgact

SEQ ID NO: 61866 - DNA, 18 bp, Homo sapiens
tgttttgactatgtactt

SEQ ID NO: 61867 - DNA, 21 bp, Homo sapiens
tgctttgattggctgctttgc

SEQ ID NO: 61868 - DNA, 19 bp, Homo sapiens
tgttttactgcaactactt

SEQ ID NO: 61869 - DNA, 20 bp, Homo sapiens
tgttttgattgtggtctcta

SEQ ID NO: 61870 - DNA, 22 bp, Homo sapiens
tgttttgtgtgtgtgtctgctt

SEQ ID NO: 61871 - DNA, 90 bp, Amsacta moorei entomopoxvirus
tctgcaattaaattctgttatcgaagtgggaagatttgtaatcaaattaaaaacttaaaatattacgattaacaagattttttgaccaga

SEQ ID NO: 61872 - DNA, 24 bp, Amsacta moorei entomopoxvirus
tctgttatcgaagtgggaagattt

SEQ ID NO: 61873 - DNA, 19 bp, Homo sapiens
tctgttataggcagagatt

SEQ ID NO: 61874 - DNA, 19 bp, Homo sapiens
tgttttgaagtgggaacat

SEQ ID NO: 61875 - DNA, 66 bp, Equine herpesvirus 4
cgtcactgaaatacgcgcgcgaggaacgccccgacgatcccggatatcgcgcacaggacagcgacg

SEQ ID NO: 61876 - DNA, 22 bp, Equine herpesvirus 4
tatcgcgcacaggacagcgacg

SEQ ID NO: 61877 - DNA, 19 bp, Homo sapiens
cgtcgggaggacagcgacg

SEQ ID NO: 61878 - DNA, 65 bp, Louping ill virus
catggaatgatgcggcacggcgcgacagcgacggggaaatggtcgcacccgacgcaccatccatg

SEQ ID NO: 61879 - DNA, 20 bp, Louping ill virus
cacccgacgcaccatccatg

SEQ ID NO: 61880 - DNA, 17 bp, Homo sapiens
cacccgacctatccatg

SEQ ID NO: 61881 - DNA, 15 bp, Homo sapiens
cccggcccacccacg

SEQ ID NO: 61882 - DNA, 19 bp, Homo sapiens
cacccaacctgcgtccatg

SEQ ID NO: 61883 - DNA, 20 bp, Homo sapiens
ccctatgacagccatccatg

SEQ ID NO: 61884 - DNA, 20 bp, Homo sapiens
cacccgacccccaactcatg

SEQ ID NO: 61885 - DNA, 19 bp, Homo sapiens
caccgcaccactgttcatg

SEQ ID NO: 61886 - DNA, 18 bp, Homo sapiens
cacccaacgagtctcatg

SEQ ID NO: 61887 - DNA, 19 bp, Homo sapiens
caactgggctccatccatg

SEQ ID NO: 61888 - DNA, 24 bp, Homo sapiens
cacccatggccctgattgtccatg

SEQ ID NO: 61889 - DNA, 19 bp, Homo sapiens
caccaccaccccgtccatg

SEQ ID NO: 61890 - DNA, 17 bp, Homo sapiens
cacccatgccccccatg

SEQ ID NO: 61891 - DNA, 18 bp, Homo sapiens
cacccatgcacatacatg

SEQ ID NO: 61892 - DNA, 18 bp, Homo sapiens
actcctcacccatccatg

SEQ ID NO: 61893 - DNA, 18 bp, Homo sapiens
cctcccacaccatccatg

SEQ ID NO: 61894 - DNA, 18 bp, Homo sapiens
cacccacgcccaaccatg

SEQ ID NO: 61895 - DNA, 20 bp, Homo sapiens
cacccgtgtgcatccacatg

SEQ ID NO: 61896 - DNA, 18 bp, Homo sapiens
cccggcacagcatccatg

SEQ ID NO: 61897 - DNA, 16 bp, Homo sapiens
cacccgggcatccacg

SEQ ID NO: 61898 - DNA, 19 bp, Homo sapiens
cactgtcacaccatctatg

SEQ ID NO: 61899 - DNA, 17 bp, Homo sapiens
cacccgcggccaccatg

SEQ ID NO: 61900 - DNA, 20 bp, Homo sapiens
cacatcgagactcatccatg

SEQ ID NO: 61901 - DNA, 18 bp, Homo sapiens
cggcacaggccatccatg

SEQ ID NO: 61902 - DNA, 18 bp, Homo sapiens
cgaccatgtccatccatg

SEQ ID NO: 61903 - DNA, 17 bp, Homo sapiens
cctgagacacatccatg

SEQ ID NO: 61904 - DNA, 19 bp, Homo sapiens
cactgacaaggcatccatg

SEQ ID NO: 61905 - DNA, 20 bp, Homo sapiens
cacccatggcaaattccatg

SEQ ID NO: 61906 - DNA, 16 bp, Homo sapiens
cccgacgccacgcatg

SEQ ID NO: 61907 - DNA, 85 bp, Louping ill virus
gcggttcttgttctccctgagccaccatcacccagacacagatagtctgacaaggaggtgatgtgtgactcggaaaaacacccgc

SEQ ID NO: 61908 - DNA, 68 bp, Cryphonectria hypovirus 1
ggttgctgcacaaccggggctttgcccggggatttcatcccgttcaaggtgaggcccttgtagtaacc

SEQ ID NO: 61909 - DNA, 19 bp, Cryphonectria hypovirus 1
tgaggcccttgtagtaacc

SEQ ID NO: 61910 - DNA, 17 bp, Homo sapiens
tgaggcccctccagacc

SEQ ID NO: 61911 - DNA, 16 bp, Homo sapiens
tgggcccttgcagacc

SEQ ID NO: 61912 - DNA, 17 bp, Homo sapiens
gaggccctgcaccagcc

SEQ ID NO: 61913 - DNA, 15 bp, Homo sapiens
gaggccctagcaacc

SEQ ID NO: 61914 - DNA, 16 bp, Homo sapiens
tgggcccccagtgacc

SEQ ID NO: 61915 - DNA, 17 bp, Homo sapiens
tgaagcccctgataacc

SEQ ID NO: 61916 - DNA, 17 bp, Homo sapiens
tgggcccctgtttcaac

SEQ ID NO: 61917 - DNA, 17 bp, Homo sapiens
tgaggcccatcgagacc

SEQ ID NO: 61918 - DNA, 16 bp, Homo sapiens
tgatgcctacagtaac

SEQ ID NO: 61919 - DNA, 16 bp, Homo sapiens
tgggcttgtagtgacc

SEQ ID NO: 61920 - DNA, 21 bp, Homo sapiens
tgaggccctggagcagaggcc

SEQ ID NO: 61921 - DNA, 18 bp, Homo sapiens
tgagaccctgagcggacc

SEQ ID NO: 61922 - DNA, 17 bp, Homo sapiens
tgagtcctttagcaacc

SEQ ID NO: 61923 - DNA, 18 bp, Homo sapiens
taaggccctttcgatagt

SEQ ID NO: 61924 - DNA, 19 bp, Homo sapiens
tgaggcccttgtagttacc

SEQ ID NO: 61925 - DNA, 19 bp, Homo sapiens
gaggccctcgtgggtggcc

SEQ ID NO: 61926 - DNA, 18 bp, Homo sapiens
tgagcccttgcaatggcc

SEQ ID NO: 61927 - DNA, 16 bp, Homo sapiens
tgagaccctaataacc

SEQ ID NO: 61928 - DNA, 17 bp, Homo sapiens
tggcagccctagtaacc

SEQ ID NO: 61929 - DNA, 18 bp, Homo sapiens
tgagcccccagcataacc

SEQ ID NO: 61930 - DNA, 19 bp, Homo sapiens
aaccttttttgtagtaacc

SEQ ID NO: 61931 - DNA, 19 bp, Homo sapiens
taaggcttcgtcagtaacc

SEQ ID NO: 61932 - DNA, 18 bp, Homo sapiens
tgagtgccatacagtaac

SEQ ID NO: 61933 - DNA, 19 bp, Homo sapiens
tgggtgtccttgtagtgac

SEQ ID NO: 61934 - DNA, 19 bp, Homo sapiens
tgggactcttctaataacc

SEQ ID NO: 61935 - DNA, 19 bp, Homo sapiens
tgaggcccctcaagtggcc

SEQ ID NO: 61936 - DNA, 16 bp, Homo sapiens
tgggcccttggtgacc

SEQ ID NO: 61937 - DNA, 16 bp, Homo sapiens
tgaagcctgcagtgac

SEQ ID NO: 61938 - DNA, 15 bp, Homo sapiens
gaggcccttcagacc

SEQ ID NO: 61939 - DNA, 17 bp, Homo sapiens
gaggcccttcggcaacc

SEQ ID NO: 61940 - DNA, 20 bp, Homo sapiens
tggggccctcggtgagaacc

SEQ ID NO: 61941 - DNA, 19 bp, Homo sapiens
gaggcccctgagagtgacc

SEQ ID NO: 61942 - DNA, 18 bp, Homo sapiens
tgggggccttgcagtgac

SEQ ID NO: 61943 - DNA, 16 bp, Homo sapiens
tgaagcccttgtaacc

SEQ ID NO: 61944 - DNA, 18 bp, Homo sapiens
tgaggctctgtaacaacc

SEQ ID NO: 61945 - DNA, 18 bp, Homo sapiens
tgaagctttccaataacc

SEQ ID NO: 61946 - DNA, 18 bp, Homo sapiens
tgggtcctcagcagtaac

SEQ ID NO: 61947 - DNA, 15 bp, Homo sapiens
gaggttgcagtaacc

SEQ ID NO: 61948 - DNA, 16 bp, Homo sapiens
tgagagccctgtaacc

SEQ ID NO: 61949 - DNA, 17 bp, Homo sapiens
tgaggctctcagacaac

SEQ ID NO: 61950 - DNA, 18 bp, Homo sapiens
tgaggccctggtgacaac

SEQ ID NO: 61951 - DNA, 17 bp, Homo sapiens
tgaagccctttccaacc

SEQ ID NO: 61952 - DNA, 19 bp, Homo sapiens
tgagccccctgtagtaacc

SEQ ID NO: 61953 - DNA, 18 bp, Homo sapiens
tgaggatgccttgtaacc

SEQ ID NO: 61954 - DNA, 18 bp, Homo sapiens
tgagccacagtagtaacc

SEQ ID NO: 61955 - DNA, 16 bp, Homo sapiens
tgaggccttgcagaac

SEQ ID NO: 61956 - DNA, 17 bp, Homo sapiens
tgagttttatagtaacc

SEQ ID NO: 61957 - DNA, 18 bp, Homo sapiens
gaggcccctggagtagcc

SEQ ID NO: 61958 - DNA, 17 bp, Homo sapiens
taaggccctaatgtaac

SEQ ID NO: 61959 - DNA, 19 bp, Homo sapiens
taagttttttgtagtaacc

SEQ ID NO: 61960 - DNA, 19 bp, Homo sapiens
tgaggcccaggtcgtgacc

SEQ ID NO: 61961 - DNA, 18 bp, Homo sapiens
gaggccttgtagatagcc

SEQ ID NO: 61962 - DNA, 21 bp, Homo sapiens
tgaggccccccaggaagtgac

SEQ ID NO: 61963 - DNA, 17 bp, Homo sapiens
gaggccccgtggtaacc

SEQ ID NO: 61964 - DNA, 17 bp, Homo sapiens
tgaggcccctggagacc

SEQ ID NO: 61965 - DNA, 18 bp, Homo sapiens
tgagtgcctgcagtaacc

SEQ ID NO: 61966 - DNA, 18 bp, Homo sapiens
gaggccctatgttagacc

SEQ ID NO: 61967 - DNA, 18 bp, Homo sapiens
tgaagccccacaataacc

SEQ ID NO: 61968 - DNA, 18 bp, Homo sapiens
gaggctcctacagtggcc

SEQ ID NO: 61969 - DNA, 18 bp, Homo sapiens
taaggcccttgagcagcc

SEQ ID NO: 61970 - DNA, 16 bp, Homo sapiens
tgaggtcccgctaacc

SEQ ID NO: 61971 - DNA, 18 bp, Homo sapiens
tggggccctcagcaaacc

SEQ ID NO: 61972 - DNA, 19 bp, Homo sapiens
tggggcctctgtcctaacc

SEQ ID NO: 61973 - DNA, 17 bp, Homo sapiens
tgaggccctgatgcacc

SEQ ID NO: 61974 - DNA, 17 bp, Homo sapiens
gaggccctgcaccaacc

SEQ ID NO: 61975 - DNA, 98 bp, Cryphonectria hypovirus 1
gcagactgaagcgacctatggtgaaaacggatgtaccatctagctgtggagtagtgaccctagaagctaatccgatggttccaccagtcgttgtttgc

SEQ ID NO: 61976 - DNA, 24 bp, Cryphonectria hypovirus 1
tatggtgaaaacggatgtaccatc

SEQ ID NO: 61977 - DNA, 19 bp, Homo sapiens
tggtgaaagtgcccgccat

SEQ ID NO: 61978 - DNA, 19 bp, Homo sapiens
tatggtaaaataagaccat

SEQ ID NO: 61979 - DNA, 19 bp, Homo sapiens
tatggtgaaataaagctgt

SEQ ID NO: 61980 - DNA, 19 bp, Homo sapiens
tgatgaaaaagatatcatc

SEQ ID NO: 61981 - DNA, 19 bp, Homo sapiens
tggtgtggcaggtaccatc

SEQ ID NO: 61982 - DNA, 19 bp, Homo sapiens
tatggtgaaaacctgttgt

SEQ ID NO: 61983 - DNA, 16 bp, Homo sapiens
tggtgaaaggtgccat

SEQ ID NO: 61984 - DNA, 21 bp, Homo sapiens
tggtgaaaatggtgaagtcat

SEQ ID NO: 61985 - DNA, 18 bp, Homo sapiens
tggtgaaaggcagattgt

SEQ ID NO: 61986 - DNA, 18 bp, Homo sapiens
tacggtgaatcgaattgt

SEQ ID NO: 61987 - DNA, 16 bp, Homo sapiens
ggtgaaaacatgtcat

SEQ ID NO: 61988 - DNA, 26 bp, Homo sapiens
tatggtgaaatgccgtcgatggtaca

SEQ ID NO: 61989 - DNA, 18 bp, Homo sapiens
tatggtaagatcaaccat

SEQ ID NO: 61990 - DNA, 17 bp, Homo sapiens
tggtgaagaattaccat

SEQ ID NO: 61991 - DNA, 16 bp, Homo sapiens
tatggcgaggatggca

SEQ ID NO: 61992 - DNA, 18 bp, Homo sapiens
tatgatgaggatgtccat

SEQ ID NO: 61993 - DNA, 21 bp, Homo sapiens
catggtgaaaatgtactccat

SEQ ID NO: 61994 - DNA, 86 bp, Canine distemper virus
atccagacgttgctcctgcattttgagtgtgtcccataagcctccaaaccgctcactcgtgcccacaactccagtgacgcctcgat

SEQ ID NO: 61995 - DNA, 24 bp, Canine distemper virus
cgttgctcctgcattttgagtgtg

SEQ ID NO: 61996 - DNA, 21 bp, Homo sapiens
gttgttttatcactgagtgtg

SEQ ID NO: 61997 - DNA, 20 bp, Homo sapiens
gttgctccttggcaggtgtg

SEQ ID NO: 61998 - DNA, 21 bp, Homo sapiens
gttgctccagtattttcagtg

SEQ ID NO: 61999 - DNA, 18 bp, Homo sapiens
gttgcattttctgagtgt

SEQ ID NO: 62000 - DNA, 17 bp, Homo sapiens
gtggctcctgccagtgt

SEQ ID NO: 62001 - DNA, 17 bp, Homo sapiens
cgttgctcctgcggtgc

SEQ ID NO: 62002 - DNA, 27 bp, Homo sapiens
gctgcttctgcattcagggcgggtgtg

SEQ ID NO: 62003 - DNA, 61 bp, Sulfolobus virus SIRV-2
tgatgagaaagtattcttcactgtagacatgttatattatcagaaacttcaagaattatca

SEQ ID NO: 62004 - DNA, 24 bp, Sulfolobus virus SIRV-2
aagtattcttcactgtagacatgt

SEQ ID NO: 62005 - DNA, 18 bp, Homo sapiens
aagtattcttcactgaga

SEQ ID NO: 62006 - DNA, 22 bp, Homo sapiens
aagtattctttgtgtataatgt

SEQ ID NO: 62007 - DNA, 19 bp, Homo sapiens
aaatatttttcactacatg

SEQ ID NO: 62008 - DNA, 18 bp, Homo sapiens
aagtattcatcatactgt

SEQ ID NO: 62009 - DNA, 23 bp, Homo sapiens
aagtgtccttcacatctatatgt

SEQ ID NO: 62010 - DNA, 22 bp, Homo sapiens
aagtattattcaacagacatgt

SEQ ID NO: 62011 - DNA, 64 bp, Avian encephalomyelitis virus
cctggttcagtatccgggttgtcctgtattgttacggtgtatccgtcttggcacactgaaaggg

SEQ ID NO: 62012 - DNA, 24 bp, Avian encephalomyelitis virus
gttcagtatccgggttgtcctgta

SEQ ID NO: 62013 - DNA, 22 bp, Homo sapiens
gtccggtgtccgactgtcctgt

SEQ ID NO: 62014 - DNA, 20 bp, Homo sapiens
gttcaggatccaagtcctgt

SEQ ID NO: 62015 - DNA, 22 bp, Homo sapiens
attcagtgtttttcatcctgta

SEQ ID NO: 62016 - DNA, 20 bp, Homo sapiens
atttagtgtctgtgtcctgt

SEQ ID NO: 62017 - DNA, 20 bp, Homo sapiens
gtttaatatatgtgtcctgt

SEQ ID NO: 62018 - DNA, 19 bp, Homo sapiens
gttcaggtccaggtcctgt

SEQ ID NO: 62019 - DNA, 23 bp, Homo sapiens
gttcagcatcagttatgtcttgt

SEQ ID NO: 62020 - DNA, 83 bp, Gallid herpesvirus 2
cgtttggatgaagtgattccagaattcgaattagtatcgaccgatgttaaaattttagctgagaagtatcttcaggatgaacg

SEQ ID NO: 62021 - DNA, 24 bp, Gallid herpesvirus 2
tgttaaaattttagctgagaagta

SEQ ID NO: 62022 - DNA, 15 bp, Homo sapiens
tgctaaagctgagag

SEQ ID NO: 62023 - DNA, 19 bp, Homo sapiens
tgctaaaattttagctaag

SEQ ID NO: 62024 - DNA, 24 bp, Homo sapiens
tgtggaattttaagtctgagaagt

SEQ ID NO: 62025 - DNA, 73 bp, Gallid herpesvirus 2
catctgtaattaataggttcctcgatttacatcaaattttgaaagactgttaggactgttgggaaataaggtg

SEQ ID NO: 62026 - DNA, 24 bp, Gallid herpesvirus 2
taggttcctcgatttacatcaaat

SEQ ID NO: 62027 - DNA, 20 bp, Homo sapiens
tagtttccaggttacatcaa

SEQ ID NO: 62028 - DNA, 21 bp, Homo sapiens
ggttcctgcatctgagcatca

SEQ ID NO: 62029 - DNA, 17 bp, Homo sapiens
ggtacaatttacatcaa

SEQ ID NO: 62030 - DNA, 111 bp, Human herpesvirus 2
ttgtaggtgcggataggtctctctacagagctgtataggtgtgacggtccgggacacccaagcccgccgcccctgtgtacagtggctgcggcgacgaccccgctccaacaa

SEQ ID NO: 62031 - DNA, 24 bp, Human herpesvirus 2
tacagtggctgcggcgacgacccc

SEQ ID NO: 62032 - DNA, 18 bp, Homo sapiens
cagtggctggcttgaccc

SEQ ID NO: 62033 - DNA, 23 bp, Homo sapiens
gtggctgcgcacctagacggtcc

SEQ ID NO: 62034 - DNA, 18 bp, Homo sapiens
gtggctgcggcgcgcccc

SEQ ID NO: 62035 - DNA, 21 bp, Homo sapiens
aatggctgttacattgattcc

SEQ ID NO: 62036 - DNA, 20 bp, Homo sapiens
gcggtgctgtgcacaactcc

SEQ ID NO: 62037 - DNA, 17 bp, Homo sapiens
cagtggctcacgtgacc

SEQ ID NO: 62038 - DNA, 17 bp, Homo sapiens
cagtggctaactgacga

SEQ ID NO: 62039 - DNA, 18 bp, Homo sapiens
cagggctgcggcagaaac

SEQ ID NO: 62040 - DNA, 24 bp, Homo sapiens
acggtgctccgcggcggcggcccc

SEQ ID NO: 62041 - DNA, 18 bp, Homo sapiens
tacagtgcttgggagaga

SEQ ID NO: 62042 - DNA, 22 bp, Homo sapiens
caccacctgcggcggcggcccc

SEQ ID NO: 62043 - DNA, 20 bp, Homo sapiens
gtggcggcggcggcgactcc

SEQ ID NO: 62044 - DNA, 19 bp, Homo sapiens
gcggcagtggcggcgaccc

SEQ ID NO: 62045 - DNA, 22 bp, Homo sapiens
cagaggctgcgggcgatggtcc

SEQ ID NO: 62046 - DNA, 22 bp, Homo sapiens
gcggcggggcggcggcggctcc

SEQ ID NO: 62047 - DNA, 19 bp, Homo sapiens
cagtggctggctcggttcc

SEQ ID NO: 62048 - DNA, 21 bp, Homo sapiens
gcggcggctggcggcggcccc

SEQ ID NO: 62049 - DNA, 20 bp, Homo sapiens
gcggcggcggcgacgactcc

SEQ ID NO: 62050 - DNA, 18 bp, Homo sapiens
gcggcggcggcggcggcc

SEQ ID NO: 62051 - DNA, 27 bp, Homo sapiens
cacagtggtggtcagggtggtggcccc

SEQ ID NO: 62052 - DNA, 18 bp, Homo sapiens
cagggctggccacgaccc

SEQ ID NO: 62053 - DNA, 17 bp, Homo sapiens
cagggccgcggcggccc

SEQ ID NO: 62054 - DNA, 21 bp, Homo sapiens
tacagtggctgcggccagccc

SEQ ID NO: 62055 - DNA, 23 bp, Homo sapiens
tacagtggcatgattatgacccc

SEQ ID NO: 62056 - DNA, 21 bp, Homo sapiens
cagtggctgattggcacgacc

SEQ ID NO: 62057 - DNA, 26 bp, Homo sapiens
taagtggctgtgccaacagtggcccc

SEQ ID NO: 62058 - DNA, 18 bp, Homo sapiens
atggccgcggcggcggcc

SEQ ID NO: 62059 - DNA, 21 bp, Homo sapiens
tacagtggtgcagtggtgcga

SEQ ID NO: 62060 - DNA, 20 bp, Homo sapiens
cagtggcctcagatgactcc

SEQ ID NO: 62061 - DNA, 16 bp, Homo sapiens
agtggctgcggcaccc

SEQ ID NO: 62062 - DNA, 20 bp, Homo sapiens
cagcggctggcggcggcccc

SEQ ID NO: 62063 - DNA, 18 bp, Homo sapiens
agtgactgctaggattcc

SEQ ID NO: 62064 - DNA, 21 bp, Homo sapiens
tgagtggctgtgagaagctcc

SEQ ID NO: 62065 - DNA, 20 bp, Homo sapiens
gtggcggcggcggcgacccc

SEQ ID NO: 62066 - DNA, 17 bp, Homo sapiens
cacagtggctgtggtcc

SEQ ID NO: 62067 - DNA, 24 bp, Homo sapiens
tgagtggctgggccaggcggcccc

SEQ ID NO: 62068 - DNA, 18 bp, Homo sapiens
gtggctgcagcaggcccc

SEQ ID NO: 62069 - DNA, 19 bp, Homo sapiens
agtggctgcggcgcgggcc

SEQ ID NO: 62070 - DNA, 20 bp, Homo sapiens
cacagtggctgcctggtccc

SEQ ID NO: 62071 - DNA, 17 bp, Homo sapiens
gtgactgcggcacaccc

SEQ ID NO: 62072 - DNA, 19 bp, Homo sapiens
agtggctgcagctcagacc

SEQ ID NO: 62073 - DNA, 20 bp, Homo sapiens
ggctccgcggcggcggcccc

SEQ ID NO: 62074 - DNA, 22 bp, Homo sapiens
cacggtggctgcacctggcccc

SEQ ID NO: 62075 - DNA, 17 bp, Homo sapiens
tacagtggtgtgggaga

SEQ ID NO: 62076 - DNA, 21 bp, Homo sapiens
tacagtggtgaagatgatccc

SEQ ID NO: 62077 - DNA, 21 bp, Homo sapiens
cacagtggtggagacggctcc

SEQ ID NO: 62078 - DNA, 19 bp, Homo sapiens
cacagtgggctacggtgac

SEQ ID NO: 62079 - DNA, 16 bp, Homo sapiens
cagtggcttgggaacc

SEQ ID NO: 62080 - DNA, 19 bp, Homo sapiens
cagtagccgttgatgatcc

SEQ ID NO: 62081 - DNA, 16 bp, Homo sapiens
agtggctaagtgaccc

SEQ ID NO: 62082 - DNA, 99 bp, Ictalurid herpesvirus 1
ccctgctcacgtacgagttcgatctaatcttcggggtgcgtatgcgaagttgttgcgttacagtgttccattcgtactgtacgttgagcgctaataggg

SEQ ID NO: 62083 - DNA, 24 bp, Ictalurid herpesvirus 1
tacagtgttccattcgtactgtac

SEQ ID NO: 62084 - DNA, 21 bp, Homo sapiens
tacagtatttagcagtgctgt

SEQ ID NO: 62085 - DNA, 20 bp, Homo sapiens
tacaatgttctgctccctgt

SEQ ID NO: 62086 - DNA, 18 bp, Homo sapiens
cagtgttcttctggctgt

SEQ ID NO: 62087 - DNA, 21 bp, Homo sapiens
tacagtgttccttcagtctgc

SEQ ID NO: 62088 - DNA, 16 bp, Homo sapiens
cagtgctccgtctgta

SEQ ID NO: 62089 - DNA, 20 bp, Homo sapiens
tacagtgttctaatttttac

SEQ ID NO: 62090 - DNA, 18 bp, Homo sapiens
tacagtgtgttattgtac

SEQ ID NO: 62091 - DNA, 20 bp, Homo sapiens
agtgttccattataatgtac

SEQ ID NO: 62092 - DNA, 20 bp, Homo sapiens
agtgttcccttatcatgtac

SEQ ID NO: 62093 - DNA, 20 bp, Homo sapiens
tacagtgttccatttctgta

SEQ ID NO: 62094 - DNA, 17 bp, Homo sapiens
cacagtgtgtgtactgt

SEQ ID NO: 62095 - DNA, 15 bp, Homo sapiens
agtgctccaactgta

SEQ ID NO: 62096 - DNA, 19 bp, Homo sapiens
cagtgttccatttctttgc

SEQ ID NO: 62097 - DNA, 20 bp, Homo sapiens
tacatgttccgttcacatgc

SEQ ID NO: 62098 - DNA, 17 bp, Homo sapiens
tgtttcatatactgtac

SEQ ID NO: 62099 - DNA, 68 bp, Ictalurid herpesvirus 1
accgcaggaggtacccgtagtcgttgaaaaattgaaagtggcggctccgtatgtgatcctcctccggt

SEQ ID NO: 62100 - DNA, 17 bp, Ictalurid herpesvirus 1
tgtgatcctcctccggt

SEQ ID NO: 62101 - DNA, 18 bp, Homo sapiens
tgtgaccctctgtctggt

SEQ ID NO: 62102 - DNA, 20 bp, Homo sapiens
tgtaatcctagcacttcggt

SEQ ID NO: 62103 - DNA, 18 bp, Homo sapiens
tgtgacccagcccctggt

SEQ ID NO: 62104 - DNA, 19 bp, Homo sapiens
tgtgatccaccctcttggt

SEQ ID NO: 62105 - DNA, 23 bp, Homo sapiens
tgtaatcccagccttttttggta

SEQ ID NO: 62106 - DNA, 21 bp, Homo sapiens
tgtcctcctcctcctctggta

SEQ ID NO: 62107 - DNA, 20 bp, Homo sapiens
tgtgatccacctgcctcggt

SEQ ID NO: 62108 - DNA, 108 bp, Amsacta moorei entomopoxvirus
tttacatttattaaattaacattatgtttaatacaaaatctatcatgacaattatttacatgtggacagtatttattttttatataaaataatttattatgatgtgga

SEQ ID NO: 62109 - DNA, 24 bp, Amsacta moorei entomopoxvirus
taaattaacattatgtttaataca

SEQ ID NO: 62110 - DNA, 18 bp, Homo sapiens
taaattaaacattatgtt

SEQ ID NO: 62111 - DNA, 23 bp, Homo sapiens
aaattaacattattatgaataca

SEQ ID NO: 62112 - DNA, 19 bp, Homo sapiens
taacattgatatctaatac

SEQ ID NO: 62113 - DNA, 17 bp, Homo sapiens
taaattaacactgttca

SEQ ID NO: 62114 - DNA, 62 bp, Paramecium bursaria Chlorella virus 1
acaagttatggaaataaagaaactcgcatgttttagttttagtctatttctcattctcttgt

SEQ ID NO: 62115 - DNA, 24 bp, Paramecium bursaria Chlorella virus 1
tatggaaataaagaaactcgcatg

SEQ ID NO: 62116 - DNA, 17 bp, Homo sapiens
tggaaataaaaatgcat

SEQ ID NO: 62117 - DNA, 18 bp, Homo sapiens
tggaaataaaaaataaca

SEQ ID NO: 62118 - DNA, 17 bp, Homo sapiens
tggaaataaaggcaccg

SEQ ID NO: 62119 - DNA, 18 bp, Homo sapiens
tatgaaaataaggaaact

SEQ ID NO: 62120 - DNA, 18 bp, Homo sapiens
tatggaaataaagtgacc

SEQ ID NO: 62121 - DNA, 18 bp, Homo sapiens
ggaaataaagggaaaact

SEQ ID NO: 62122 - DNA, 21 bp, Homo sapiens
tatggaactagagaaactcac

SEQ ID NO: 62123 - DNA, 22 bp, Homo sapiens
tggtgtgcaggaaactcgcatg

SEQ ID NO: 62124 - DNA, 16 bp, Homo sapiens
tggaaacagagaagca

SEQ ID NO: 62125 - DNA, 18 bp, Homo sapiens
tatggggttaaagaaact

SEQ ID NO: 62126 - DNA, 23 bp, Homo sapiens
tatggcaatgaagaaaccaaaca

SEQ ID NO: 62127 - DNA, 20 bp, Homo sapiens
ggaaataaagagcgaacatg

SEQ ID NO: 62128 - DNA, 21 bp, Homo sapiens
tatggaaaaggagaaagggca

SEQ ID NO: 62129 - DNA, 19 bp, Homo sapiens
tatggaaatagggaactca

SEQ ID NO: 62130 - DNA, 91 bp, Paramecium bursaria Chlorella virus 1
gcccatcgaacgctcttcgggattataatttcaatgtcatcctctacatcttgaaaccgtagtagccgttgtagagtcgcgcgataatggc

SEQ ID NO: 62131 - DNA, 24 bp, Paramecium bursaria Chlorella virus 1
aaccgtagtagccgttgtagagtc

SEQ ID NO: 62132 - DNA, 21 bp, Homo sapiens
gctgtagaggctgtatggagt

SEQ ID NO: 62133 - DNA, 66 bp, Paramecium bursaria Chlorella virus 1
ggaagtcaagtatttatacacgttgagtgtcatttacatgtgtcatttaagtgtgtcatttgaccc

SEQ ID NO: 62134 - DNA, 24 bp, Paramecium bursaria Chlorella virus 1
tcaagtatttatacacgttgagtg

SEQ ID NO: 62135 - DNA, 26 bp, Homo sapiens
tcaagtatttatgcggtgcactcaag

SEQ ID NO: 62136 - DNA, 19 bp, Homo sapiens
tcaagtatttatagttggt

SEQ ID NO: 62137 - DNA, 19 bp, Homo sapiens
tcaagtgttatggttgagt

SEQ ID NO: 62138 - DNA, 15 bp, Homo sapiens
caagtatttattgag

SEQ ID NO: 62139 - DNA, 21 bp, Homo sapiens
tcaagtatttattatattaag

SEQ ID NO: 62140 - DNA, 21 bp, Homo sapiens
aagtattcaaagtgttgagtg

SEQ ID NO: 62141 - DNA, 20 bp, Homo sapiens
gtacatatgtacgttgagtg

SEQ ID NO: 62142 - DNA, 19 bp, Homo sapiens
gtatttatacacggacatg

SEQ ID NO: 62143 - DNA, 23 bp, Homo sapiens
ccaagtatttgtatgtgtgagtg

SEQ ID NO: 62144 - DNA, 29 bp, Homo sapiens
tcaagtatttatttgtgttcactcaacgt

SEQ ID NO: 62145 - DNA, 18 bp, Homo sapiens
tcaagtatttaatacagt

SEQ ID NO: 62146 - DNA, 21 bp, Homo sapiens
tcaagtatttaggcatcggtg

SEQ ID NO: 62147 - DNA, 22 bp, Homo sapiens
tcaaatatttatagaaggagtg

SEQ ID NO: 62148 - DNA, 25 bp, Homo sapiens
tcaagtactttatctatcttgagtg

SEQ ID NO: 62149 - DNA, 70 bp, Marburg virus
tcactttcagtttttagtttcaactcttattgcgagacttgaacacaattctactaacttcaataagtga

SEQ ID NO: 62150 - DNA, 24 bp, Marburg virus
cttgaacacaattctactaacttc

SEQ ID NO: 62151 - DNA, 21 bp, Homo sapiens
gagcatgattctactaatttc

SEQ ID NO: 62152 - DNA, 18 bp, Homo sapiens
ttgagcacaattctcaac

SEQ ID NO: 62153 - DNA, 18 bp, Homo sapiens
cctgaataccactaactt

SEQ ID NO: 62154 - DNA, 18 bp, Homo sapiens
tgaatattccactaactt

SEQ ID NO: 62155 - DNA, 17 bp, Homo sapiens
gaacacaacactgactt

SEQ ID NO: 62156 - DNA, 20 bp, Homo sapiens
cttgaatacaattctcacta

SEQ ID NO: 62157 - DNA, 21 bp, Homo sapiens
cttgaacaaaatttaacaact

SEQ ID NO: 62158 - DNA, 21 bp, Homo sapiens
cttgaacacaattcctaactc

SEQ ID NO: 62159 - DNA, 25 bp, Homo sapiens
cttgaacatagtttcccagaaactt

SEQ ID NO: 62160 - DNA, 20 bp, Homo sapiens
ctgaatactctactaatttc

SEQ ID NO: 62161 - DNA, 20 bp, Homo sapiens
cctgaacacaaacttgactt

SEQ ID NO: 62162 - DNA, 22 bp, Homo sapiens
cttgaacacagtttaagaactt

SEQ ID NO: 62163 - DNA, 21 bp, Homo sapiens
cttggagcaccacactaactt

SEQ ID NO: 62164 - DNA, 24 bp, Homo sapiens
ctggacacaattctgaccaatttc

SEQ ID NO: 62165 - DNA, 68 bp, Fowlpox virus
tagatataaaactaggtaatctatacacactaaaaagtttttatacattacgatagatattatggata

SEQ ID NO: 62166 - DNA, 24 bp, Fowlpox virus
tataaaactaggtaatctatacac

SEQ ID NO: 62167 - DNA, 22 bp, Homo sapiens
taaaactagatgttttatacac

SEQ ID NO: 62168 - DNA, 19 bp, Homo sapiens
tataaaacttggtttacac

SEQ ID NO: 62169 - DNA, 18 bp, Homo sapiens
tacaagactaggtaagct

SEQ ID NO: 62170 - DNA, 19 bp, Homo sapiens
tataaaacagcaatctata

SEQ ID NO: 62171 - DNA, 17 bp, Homo sapiens
tataaaacctaatctat

SEQ ID NO: 62172 - DNA, 18 bp, Homo sapiens
taaaactagctctataca

SEQ ID NO: 62173 - DNA, 24 bp, Homo sapiens
tataaatatcttgcatctatacac

SEQ ID NO: 62174 - DNA, 18 bp, Homo sapiens
tacaaaactaaatctata

SEQ ID NO: 62175 - DNA, 20 bp, Homo sapiens
taaatctaggtaagtgacac

SEQ ID NO: 62176 - DNA, 19 bp, Homo sapiens
tataaaactagtattatac

SEQ ID NO: 62177 - DNA, 17 bp, Homo sapiens
acttctaatctatacac

SEQ ID NO: 62178 - DNA, 24 bp, Homo sapiens
cataaaactaaatggatttataca

SEQ ID NO: 62179 - DNA, 17 bp, Homo sapiens
taaaactagtaacccat

SEQ ID NO: 62180 - DNA, 19 bp, Homo sapiens
aaactagaaaatttataca

SEQ ID NO: 62181 - DNA, 19 bp, Homo sapiens
tataaaactaactatatac

SEQ ID NO: 62182 - DNA, 24 bp, Homo sapiens
tataaaactatggtaaataaaaca

SEQ ID NO: 62183 - DNA, 16 bp, Homo sapiens
aactaaatctatacac

SEQ ID NO: 62184 - DNA, 20 bp, Homo sapiens
taaaaccaggtaattaaaac

SEQ ID NO: 62185 - DNA, 20 bp, Homo sapiens
tataaaactaagtaacttat

SEQ ID NO: 62186 - DNA, 70 bp, Fowlpox virus
tatataatacctttacaccacgcaactacatatattgctttgtatatgttgtatgaaaggtaattacgta

SEQ ID NO: 62187 - DNA, 24 bp, Fowlpox virus
tataatacctttacaccacgcaac

SEQ ID NO: 62188 - DNA, 23 bp, Homo sapiens
tataatacttctgcacatacaca

SEQ ID NO: 62189 - DNA, 18 bp, Homo sapiens
tagtacctttactgcagc

SEQ ID NO: 62190 - DNA, 23 bp, Homo sapiens
tgaataccttggcccatcatgca

SEQ ID NO: 62191 - DNA, 18 bp, Homo sapiens
tataatactttacagcaa

SEQ ID NO: 62192 - DNA, 22 bp, Homo sapiens
cataatacaaactacaccgcgc

SEQ ID NO: 62193 - DNA, 19 bp, Homo sapiens
taatacctttacaaacagc

SEQ ID NO: 62194 - DNA, 18 bp, Homo sapiens
tataatactttataccac

SEQ ID NO: 62195 - DNA, 16 bp, Homo sapiens
taataccttgcacagc

SEQ ID NO: 62196 - DNA, 89 bp, Reston Ebola virus
ggtctgaggaagattaagaaaaaggcctcgtgttcacttggttgccgtcaagtatcctgtggtttttttctacctaacttcctcatgcc

SEQ ID NO: 62197 - DNA, 24 bp, Reston Ebola virus
aggaagattaagaaaaaggcctcg

SEQ ID NO: 62198 - DNA, 19 bp, Homo sapiens
aggaagactgaggggaggc

SEQ ID NO: 62199 - DNA, 20 bp, Homo sapiens
gaagattaggaagaaaagag

SEQ ID NO: 62200 - DNA, 18 bp, Homo sapiens
ggaggattgagaggcctc

SEQ ID NO: 62201 - DNA, 19 bp, Homo sapiens
ggagagattaagctgaagg

SEQ ID NO: 62202 - DNA, 19 bp, Homo sapiens
ggaaggttaggaaggcccc

SEQ ID NO: 62203 - DNA, 19 bp, Homo sapiens
aggaagactgaggaagaag

SEQ ID NO: 62204 - DNA, 19 bp, Homo sapiens
aggaggagtaagaaaagag

SEQ ID NO: 62205 - DNA, 17 bp, Homo sapiens
aggaagataagaggaag

SEQ ID NO: 62206 - DNA, 17 bp, Homo sapiens
aggaagattaggagagg

SEQ ID NO: 62207 - DNA, 23 bp, Homo sapiens
aggaggatgggaaggaagcctcg

SEQ ID NO: 62208 - DNA, 18 bp, Homo sapiens
agatcgggaagaaaaagg

SEQ ID NO: 62209 - DNA, 21 bp, Homo sapiens
aggaagatgaagaagcactcg

SEQ ID NO: 62210 - DNA, 23 bp, Homo sapiens
aggaaggttaaggaacctcctcg

SEQ ID NO: 62211 - DNA, 23 bp, Homo sapiens
agaaagattgggattgtttgcct

SEQ ID NO: 62212 - DNA, 19 bp, Homo sapiens
agaaagattaagaaggaag

SEQ ID NO: 62213 - DNA, 18 bp, Homo sapiens
ggaggatcaagagaaaac

SEQ ID NO: 62214 - DNA, 16 bp, Homo sapiens
aggaagattaggaggc

SEQ ID NO: 62215 - DNA, 22 bp, Homo sapiens
ggcagggggcaggaaaaggcct

SEQ ID NO: 62216 - DNA, 17 bp, Homo sapiens
gggagagtaagaaaagg

SEQ ID NO: 62217 - DNA, 17 bp, Homo sapiens
aggaagatcaggagagc

SEQ ID NO: 62218 - DNA, 16 bp, Homo sapiens
gaaggcaagaggcctc

SEQ ID NO: 62219 - DNA, 18 bp, Homo sapiens
aggaagttaggaaaaaag

SEQ ID NO: 62220 - DNA, 18 bp, Homo sapiens
aggaaggtaaggaaaaag

SEQ ID NO: 62221 - DNA, 17 bp, Homo sapiens
aggaagattaaggaagg

SEQ ID NO: 62222 - DNA, 20 bp, Homo sapiens
ggaagattaagaaacacaac

SEQ ID NO: 62223 - DNA, 17 bp, Homo sapiens
ggaagattgggaaggtc

SEQ ID NO: 62224 - DNA, 17 bp, Homo sapiens
aggaagataagggaagg

SEQ ID NO: 62225 - DNA, 17 bp, Homo sapiens
aggaagactaggaaggc

SEQ ID NO: 62226 - DNA, 19 bp, Homo sapiens
agggagaccaaaggggcct

SEQ ID NO: 62227 - DNA, 21 bp, Homo sapiens
aggaagatggagggagaagcc

SEQ ID NO: 62228 - DNA, 17 bp, Homo sapiens
ggaagattgagcaagac

SEQ ID NO: 62229 - DNA, 17 bp, Homo sapiens
ggaagattaagggaagc

SEQ ID NO: 62230 - DNA, 21 bp, Homo sapiens
aggaagactgggaatacctcg

SEQ ID NO: 62231 - DNA, 21 bp, Homo sapiens
aggaagatataagggaaaaag

SEQ ID NO: 62232 - DNA, 22 bp, Homo sapiens
agaaaaaggaggaaggaggcct

SEQ ID NO: 62233 - DNA, 17 bp, Homo sapiens
gaagaccaagaaggcct

SEQ ID NO: 62234 - DNA, 19 bp, Homo sapiens
aggaagataaagaggaaag

SEQ ID NO: 62235 - DNA, 20 bp, Homo sapiens
aggaagattgagaacatcct

SEQ ID NO: 62236 - DNA, 88 bp, Reston Ebola virus
gcattgagcactgctaataggtttgtatcacgttaaagatttagagtgtatgaattgtgcagatttaaacttgggttttgccttatgc

SEQ ID NO: 62237 - DNA, 24 bp, Reston Ebola virus
ttgtgcagatttaaacttgggttt

SEQ ID NO: 62238 - DNA, 18 bp, Homo sapiens
ttgtgtggactctgggtt

SEQ ID NO: 62239 - DNA, 21 bp, Homo sapiens
ttgtgcaggagttttgggttt

SEQ ID NO: 62240 - DNA, 20 bp, Homo sapiens
tgtgccaagaacttgggttt

SEQ ID NO: 62241 - DNA, 20 bp, Homo sapiens
gtgggaatgaacttgggttt

SEQ ID NO: 62242 - DNA, 24 bp, Homo sapiens
ttgtagcaactaagacttgggttt

SEQ ID NO: 62243 - DNA, 25 bp, Homo sapiens
ttgtcaggttcctactcttgggttt

SEQ ID NO: 62244 - DNA, 22 bp, Homo sapiens
tgtgtagacaacatttgggttt

SEQ ID NO: 62245 - DNA, 23 bp, Homo sapiens
ttgtggagtggaaatttgggttt

SEQ ID NO: 62246 - DNA, 24 bp, Homo sapiens
ttgtgtggaattaagactgggttt

SEQ ID NO: 62247 - DNA, 18 bp, Homo sapiens
ttgtgcagcacttgggtt

SEQ ID NO: 62248 - DNA, 17 bp, Homo sapiens
ttgggcagatttgggtt

SEQ ID NO: 62249 - DNA, 66 bp, Bovine herpesvirus 4
tctgtccaatcggaagtgaaaccacatctttgtgtcatttttaatcagccccgttaaaggtacaga

SEQ ID NO: 62250 - DNA, 24 bp, Bovine herpesvirus 4
gtcatttttaatcagccccgttaa

SEQ ID NO: 62251 - DNA, 18 bp, Homo sapiens
tcatttttagcaccgtta

SEQ ID NO: 62252 - DNA, 21 bp, Homo sapiens
gccatttttaattgcagttaa

SEQ ID NO: 62253 - DNA, 65 bp, Human herpesvirus 1
gccgccctgcgacacaatcacccgtccgtggtttcgaatctacacgacaggcccgcagacgcggc

SEQ ID NO: 62254 - DNA, 24 bp, Human herpesvirus 1
acacaatcacccgtccgtggtttc

SEQ ID NO: 62255 - DNA, 19 bp, Homo sapiens
acaagttacccaacggttt

SEQ ID NO: 62256 - DNA, 18 bp, Homo sapiens
cacagtcgtccgtgcctt

SEQ ID NO: 62257 - DNA, 22 bp, Homo sapiens
acacagacgctgtccgtggttt

SEQ ID NO: 62258 - DNA, 19 bp, Homo sapiens
acacaatcctttgtagttt

SEQ ID NO: 62259 - DNA, 18 bp, Homo sapiens
cacaatcacttatcacat

SEQ ID NO: 62260 - DNA, 20 bp, Homo sapiens
acacaatttctgcctggttt

SEQ ID NO: 62261 - DNA, 23 bp, Homo sapiens
cacagtgcatccttgatggtttc

SEQ ID NO: 62262 - DNA, 20 bp, Homo sapiens
acaatcacgtttgatggttt

SEQ ID NO: 62263 - DNA, 21 bp, Homo sapiens
acacaatcatcgtcagagtct

SEQ ID NO: 62264 - DNA, 16 bp, Homo sapiens
gaacaatcgtgtggtt

SEQ ID NO: 62265 - DNA, 21 bp, Homo sapiens
cagtcaccccgaggtggtttc

SEQ ID NO: 62266 - DNA, 23 bp, Homo sapiens
acacaatccatttgtgtggtttc

SEQ ID NO: 62267 - DNA, 24 bp, Homo sapiens
acacaatttccgagggaatggttt

SEQ ID NO: 62268 - DNA, 85 bp, Human herpesvirus 1
gacaggcccgcagacgcggctaacacacacgccggcaacccagaccccagtgggttggttgcgcggtcccgtctcctggctagtt

SEQ ID NO: 62269 - DNA, 24 bp, Human herpesvirus 1
ttggttgcgcggtcccgtctcctg

SEQ ID NO: 62270 - DNA, 25 bp, Homo sapiens
ctggttggatactttctgtctcctg

SEQ ID NO: 62271 - DNA, 21 bp, Homo sapiens
ttggtttgtatttgtctcctg

SEQ ID NO: 62272 - DNA, 71 bp, Simian foamy virus
ctctacctctggacttcaggacctgcagactcttagtgagcttgttggccctgaaaatgccggagagggag

SEQ ID NO: 62273 - DNA, 24 bp, Simian foamy virus
tcaggacctgcagactcttagtga

SEQ ID NO: 62274 - DNA, 18 bp, Homo sapiens
tcaggacctcagactcct

SEQ ID NO: 62275 - DNA, 22 bp, Homo sapiens
tcaggacctcagactccccaga

SEQ ID NO: 62276 - DNA, 21 bp, Homo sapiens
tcagagcttttgttcttagtg

SEQ ID NO: 62277 - DNA, 15 bp, Homo sapiens
tcagaccttcttagt

SEQ ID NO: 62278 - DNA, 19 bp, Homo sapiens
aggtgccacctcttggtga

SEQ ID NO: 62279 - DNA, 19 bp, Homo sapiens
tcagacccacttcttagtg

SEQ ID NO: 62280 - DNA, 18 bp, Homo sapiens
agggcttgcagacttagc

SEQ ID NO: 62281 - DNA, 20 bp, Homo sapiens
tcagcacctgcaggcttcag

SEQ ID NO: 62282 - DNA, 23 bp, Homo sapiens
agacctgtgggtctcagcagtga

SEQ ID NO: 62283 - DNA, 20 bp, Homo sapiens
gggtctgcagacttttcctg

SEQ ID NO: 62284 - DNA, 21 bp, Homo sapiens
tcagcacctgtgggttcccag

SEQ ID NO: 62285 - DNA, 67 bp, Rabbit fibroma virus
cacacatgcttccgtatgtcgtatcttgtttaactttttaagtatgatcgacaatagagccagtgtg

SEQ ID NO: 62286 - DNA, 24 bp, Rabbit fibroma virus
tatgatcgacaatagagccagtgt

SEQ ID NO: 62287 - DNA, 15 bp, Homo sapiens
tatgatcgcaccagt

SEQ ID NO: 62288 - DNA, 23 bp, Homo sapiens
tatgatttatccaatgccagtgt

SEQ ID NO: 62289 - DNA, 18 bp, Homo sapiens
tggtcacaatagaggagt

SEQ ID NO: 62290 - DNA, 23 bp, Homo sapiens
atcggtggcaatagagctggtgt

SEQ ID NO: 62291 - DNA, 63 bp, Rabbit fibroma virus
caacgagctagactttgttatggagaaactctaaaaaaaattgttaattaaagtaaatagttg

SEQ ID NO: 62292 - DNA, 24 bp, Rabbit fibroma virus
tagactttgttatggagaaactct

SEQ ID NO: 62293 - DNA, 28 bp, Homo sapiens
agactttgttcaagttctagagtttctc

SEQ ID NO: 62294 - DNA, 23 bp, Homo sapiens
tagatttatgaagaagaaactct

SEQ ID NO: 62295 - DNA, 17 bp, Homo sapiens
gactttgctcagaaact

SEQ ID NO: 62296 - DNA, 21 bp, Homo sapiens
taggcttgtttcaaagaaact

SEQ ID NO: 62297 - DNA, 18 bp, Homo sapiens
tagactttgtcactagga

SEQ ID NO: 62298 - DNA, 29 bp, Homo sapiens
tagacttttttatgcctttagagtttctc

SEQ ID NO: 62299 - DNA, 20 bp, Homo sapiens
gactctgtttcaaaagctct

SEQ ID NO: 62300 - DNA, 17 bp, Homo sapiens
gaccgatggagaagctc

SEQ ID NO: 62301 - DNA, 20 bp, Homo sapiens
gactttgccctggggactct

SEQ ID NO: 62302 - DNA, 75 bp, Rabbit fibroma virus
acagttccgataacgtaaagtcctgacctcttacgcgtatagattttgagacgtctaccgcgttgttgggaatgt

SEQ ID NO: 62303 - DNA, 20 bp, Rabbit fibroma virus
taccgcgttgttgggaatgt

SEQ ID NO: 62304 - DNA, 18 bp, Homo sapiens
accgtgtgcagggaatgt

SEQ ID NO: 62305 - DNA, 23 bp, Homo sapiens
tacctgttagaaggtgggaatgt

SEQ ID NO: 62306 - DNA, 18 bp, Homo sapiens
caccgcggtccgggatgt

SEQ ID NO: 62307 - DNA, 18 bp, Homo sapiens
gctgtcttttgagaatgt

SEQ ID NO: 62308 - DNA, 19 bp, Homo sapiens
gctttgtgggtgggaatgt

SEQ ID NO: 62309 - DNA, 21 bp, Homo sapiens
cactaagtgtgttgggggtgt

SEQ ID NO: 62310 - DNA, 18 bp, Homo sapiens
tactcatcatgggaatgt

SEQ ID NO: 62311 - DNA, 18 bp, Homo sapiens
cactgttggtgggagtgt

SEQ ID NO: 62312 - DNA, 20 bp, Homo sapiens
cctgctgttgttggggatgt

SEQ ID NO: 62313 - DNA, 21 bp, Homo sapiens
ccgcgttggccaggaggatgt

SEQ ID NO: 62314 - DNA, 17 bp, Homo sapiens
caccgtgttggccatgt

SEQ ID NO: 62315 - DNA, 18 bp, Homo sapiens
gcgcccacccgggaatgt

SEQ ID NO: 62316 - DNA, 18 bp, Homo sapiens
ccacgttgatgccaatgt

SEQ ID NO: 62317 - DNA, 18 bp, Homo sapiens
cactgctggtgggaatgt

SEQ ID NO: 62318 - DNA, 18 bp, Homo sapiens
gccttgctttgggaatgt

SEQ ID NO: 62319 - DNA, 19 bp, Homo sapiens
gcattgtaattgggaatgt

SEQ ID NO: 62320 - DNA, 20 bp, Homo sapiens
gctgaggccgtggggaatgt

SEQ ID NO: 62321 - DNA, 18 bp, Homo sapiens
gctgtggtgcaggaatgt

SEQ ID NO: 62322 - DNA, 18 bp, Homo sapiens
gccctgtccagggaatgt

SEQ ID NO: 62323 - DNA, 100 bp, Monkeypox virus
tttttatgggttttacattgctttattatattttataagaatgattgtttgacaatgtcgtagtatagatatattattagaggaggtataattataaaaa

SEQ ID NO: 62324 - DNA, 24 bp, Monkeypox virus
tgtcgtagtatagatatattatta

SEQ ID NO: 62325 - DNA, 16 bp, Homo sapiens
gtaggatatattatta

SEQ ID NO: 62326 - DNA, 115 bp, Cowpox virus
tgttgatacttgatattgataattagtataattagtataattagtataattagtataattactatgtattatatttcattattatgaggatttatgtcatatcatgaaattaata

SEQ ID NO: 62327 - DNA, 24 bp, Cowpox virus
ttgataattagtataattagtata

SEQ ID NO: 62328 - DNA, 20 bp, Homo sapiens
tgatataaaataattagtat

SEQ ID NO: 62329 - DNA, 20 bp, Homo sapiens
ttgataatttggtataatta

SEQ ID NO: 62330 - DNA, 19 bp, Homo sapiens
ttgataatgagtatcatta

SEQ ID NO: 62331 - DNA, 66 bp, African swine fever virus
ttattatatacacagcatacataagtgtatattatttacacttatgtttataactcgacgtaataa

SEQ ID NO: 62332 - DNA, 24 bp, African swine fever virus
cagcatacataagtgtatattatt

SEQ ID NO: 62333 - DNA, 21 bp, Homo sapiens
gctacataaggaagtattatt

SEQ ID NO: 62334 - DNA, 18 bp, Homo sapiens
tacatatgtgaacattat

SEQ ID NO: 62335 - DNA, 18 bp, Homo sapiens
agcatatgacaaatatat

SEQ ID NO: 62336 - DNA, 22 bp, Homo sapiens
gcatacatatttatatgttatt

SEQ ID NO: 62337 - DNA, 23 bp, Homo sapiens
agcatacattggttctgtatatt

SEQ ID NO: 62338 - DNA, 22 bp, Homo sapiens
agcatccacaaagtatattatt

SEQ ID NO: 62339 - DNA, 15 bp, Homo sapiens
agcagtgcatactat

SEQ ID NO: 62340 - DNA, 21 bp, Homo sapiens
atacatatactgtatattatt

SEQ ID NO: 62341 - DNA, 20 bp, Homo sapiens
cattatacataagtcatatt

SEQ ID NO: 62342 - DNA, 91 bp, Human adenovirus D
gatggacggccaggcctccgagcagcgcatcctgcaactgcgcgtccgtcagcagcaggagcgtgccgccaaggagctcctcgatgccatc

SEQ ID NO: 62343 - DNA, 24 bp, Human adenovirus D
tcagcagcaggagcgtgccgccaa

SEQ ID NO: 62344 - DNA, 17 bp, Homo sapiens
agcagcacctgctgcca

SEQ ID NO: 62345 - DNA, 22 bp, Homo sapiens
tcagcagcaggagcgggggccg

SEQ ID NO: 62346 - DNA, 17 bp, Homo sapiens
gcagcagaaacagctgc

SEQ ID NO: 62347 - DNA, 20 bp, Homo sapiens
cagcagtgggatgcatgcca

SEQ ID NO: 62348 - DNA, 18 bp, Homo sapiens
tcagcagcaggggtgcca

SEQ ID NO: 62349 - DNA, 17 bp, Homo sapiens
agtagcagaagtgctgc

SEQ ID NO: 62350 - DNA, 19 bp, Homo sapiens
tcagcagcggggcactgcc

SEQ ID NO: 62351 - DNA, 20 bp, Homo sapiens
ccagcagcagggagggctgc

SEQ ID NO: 62352 - DNA, 18 bp, Homo sapiens
cagcagcaggggagacgc

SEQ ID NO: 62353 - DNA, 17 bp, Homo sapiens
tcatcagcaggaggcca

SEQ ID NO: 62354 - DNA, 21 bp, Homo sapiens
ccagcagcagcacagctgccg

SEQ ID NO: 62355 - DNA, 21 bp, Homo sapiens
ccagcagcaggagcagctccg

SEQ ID NO: 62356 - DNA, 16 bp, Homo sapiens
cagcagcaggggcccg

SEQ ID NO: 62357 - DNA, 18 bp, Homo sapiens
tcagcagcatgagctggc

SEQ ID NO: 62358 - DNA, 18 bp, Homo sapiens
tcagtggcaggagccacc

SEQ ID NO: 62359 - DNA, 20 bp, Homo sapiens
tcagcacaggagcagaggcc

SEQ ID NO: 62360 - DNA, 19 bp, Homo sapiens
gcagcaggggctgcaggcc

SEQ ID NO: 62361 - DNA, 24 bp, Homo sapiens
tcatagcaggaggaagagttgcca

SEQ ID NO: 62362 - DNA, 15 bp, Homo sapiens
gcagcggcgccgcca

SEQ ID NO: 62363 - DNA, 19 bp, Homo sapiens
tcagcggcgggcgtgccgc

SEQ ID NO: 62364 - DNA, 18 bp, Homo sapiens
cagcaggaggagtgctca

SEQ ID NO: 62365 - DNA, 23 bp, Homo sapiens
gcagcaaggagttgagagtgcca

SEQ ID NO: 62366 - DNA, 17 bp, Homo sapiens
tcagcagcagctccgcc

SEQ ID NO: 62367 - DNA, 21 bp, Homo sapiens
tcagcagcagcggcggcggcc

SEQ ID NO: 62368 - DNA, 17 bp, Homo sapiens
tcagaagcaggagccca

SEQ ID NO: 62369 - DNA, 18 bp, Homo sapiens
tcaggagcaggagcgtgc

SEQ ID NO: 62370 - DNA, 19 bp, Homo sapiens
cagcagcaggaagggttgc

SEQ ID NO: 62371 - DNA, 23 bp, Homo sapiens
tcagcagcagggacccctgccaa

SEQ ID NO: 62372 - DNA, 15 bp, Homo sapiens
gcagcagaggccgcc

SEQ ID NO: 62373 - DNA, 18 bp, Homo sapiens
agcagcaggggcagctca

SEQ ID NO: 62374 - DNA, 19 bp, Homo sapiens
tcaggagcaggaggagccg

SEQ ID NO: 62375 - DNA, 23 bp, Homo sapiens
tcggcagcaggtgccgctgcgcc

SEQ ID NO: 62376 - DNA, 17 bp, Homo sapiens
tcagcagcagcagctcc

SEQ ID NO: 62377 - DNA, 18 bp, Homo sapiens
gcagcagggtttacgcca

SEQ ID NO: 62378 - DNA, 20 bp, Homo sapiens
tcggcagtgggagcgcgacc

SEQ ID NO: 62379 - DNA, 20 bp, Homo sapiens
cagcagcagggaggctgcca

SEQ ID NO: 62380 - DNA, 19 bp, Homo sapiens
gcagcaggaagaagtgcca

SEQ ID NO: 62381 - DNA, 18 bp, Homo sapiens
tcagcagcgcggggcggc

SEQ ID NO: 62382 - DNA, 18 bp, Homo sapiens
gcagcggcgttgccgtca

SEQ ID NO: 62383 - DNA, 20 bp, Homo sapiens
tcaggagcgggagaaggccg

SEQ ID NO: 62384 - DNA, 17 bp, Homo sapiens
tcagcagcagagtccca

SEQ ID NO: 62385 - DNA, 18 bp, Homo sapiens
tcaggagcaggggctcca

SEQ ID NO: 62386 - DNA, 17 bp, Homo sapiens
cagcacggcagccgcca

SEQ ID NO: 62387 - DNA, 18 bp, Homo sapiens
agcagaagtcatggtcgc

SEQ ID NO: 62388 - DNA, 21 bp, Homo sapiens
tcagcgtgggattaccgccaa

SEQ ID NO: 62389 - DNA, 19 bp, Homo sapiens
cagcagcagggggcagagc

SEQ ID NO: 62390 - DNA, 18 bp, Homo sapiens
gcagcaggcgccccccaa

SEQ ID NO: 62391 - DNA, 20 bp, Homo sapiens
tcagaagcaggagtggtggc

SEQ ID NO: 62392 - DNA, 23 bp, Homo sapiens
cagcagcagggaaaccgtcgcca

SEQ ID NO: 62393 - DNA, 18 bp, Homo sapiens
cagcagtaggagctgcca

SEQ ID NO: 62394 - DNA, 26 bp, Homo sapiens
ccggcagcaggggcaggctcctgcca

SEQ ID NO: 62395 - DNA, 21 bp, Homo sapiens
ccagcagcatttctgctgcca

SEQ ID NO: 62396 - DNA, 17 bp, Homo sapiens
tcagcagcagggagtgc

SEQ ID NO: 62397 - DNA, 22 bp, Homo sapiens
ccagcagcgggggcacctgcca

SEQ ID NO: 62398 - DNA, 20 bp, Homo sapiens
tcagcagctaagtgccgtca

SEQ ID NO: 62399 - DNA, 20 bp, Homo sapiens
tcagggtaggttcaccgcca

SEQ ID NO: 62400 - DNA, 19 bp, Homo sapiens
gcagcaggggctggtgcca

SEQ ID NO: 62401 - DNA, 20 bp, Homo sapiens
cagcagcagctgagttgcca

SEQ ID NO: 62402 - DNA, 20 bp, Homo sapiens
tcagcagcagggctgctcca

SEQ ID NO: 62403 - DNA, 15 bp, Homo sapiens
agcagcaagatgcca

SEQ ID NO: 62404 - DNA, 19 bp, Homo sapiens
cagcagcaggggggtgcca

SEQ ID NO: 62405 - DNA, 20 bp, Homo sapiens
cagcagcagcagcggctgcc

SEQ ID NO: 62406 - DNA, 19 bp, Homo sapiens
gcagcaggagcagcagcca

SEQ ID NO: 62407 - DNA, 21 bp, Homo sapiens
tcatagcaggagccagggcca

SEQ ID NO: 62408 - DNA, 16 bp, Homo sapiens
cagcggcaggagccca

SEQ ID NO: 62409 - DNA, 21 bp, Homo sapiens
tcagcagcgaggggtgaagcc

SEQ ID NO: 62410 - DNA, 21 bp, Homo sapiens
tcagcagcagcagcagccgcc

SEQ ID NO: 62411 - DNA, 20 bp, Homo sapiens
tcagcaacgggactctgcca

SEQ ID NO: 62412 - DNA, 21 bp, Homo sapiens
agcagcagatgttggtgctgc

SEQ ID NO: 62413 - DNA, 16 bp, Homo sapiens
tcagcagcaagaatgc

SEQ ID NO: 62414 - DNA, 18 bp, Homo sapiens
tcagcagctgggctgcca

SEQ ID NO: 62415 - DNA, 16 bp, Homo sapiens
cagcagcaggggcacc

SEQ ID NO: 62416 - DNA, 16 bp, Homo sapiens
ccagcagcaggattgc

SEQ ID NO: 62417 - DNA, 20 bp, Homo sapiens
tcagcagcggggtgggctca

SEQ ID NO: 62418 - DNA, 18 bp, Homo sapiens
ccagcagcaggggcagcc

SEQ ID NO: 62419 - DNA, 18 bp, Homo sapiens
tcagcacaggaaccgcca

SEQ ID NO: 62420 - DNA, 16 bp, Homo sapiens
agtagcaggagccccc

SEQ ID NO: 62421 - DNA, 16 bp, Homo sapiens
tcagcaacaggaatgc

SEQ ID NO: 62422 - DNA, 18 bp, Homo sapiens
ccagcagcaggggtgaca

SEQ ID NO: 62423 - DNA, 16 bp, Homo sapiens
acagcaggagacgcca

SEQ ID NO: 62424 - DNA, 18 bp, Homo sapiens
tcagcagcaggaggccca

SEQ ID NO: 62425 - DNA, 20 bp, Homo sapiens
tcagcagcagggcggcggcc

SEQ ID NO: 62426 - DNA, 21 bp, Homo sapiens
cagcagcaggagtggccgtca

SEQ ID NO: 62427 - DNA, 21 bp, Homo sapiens
tcagcaggaggggcacacccc

SEQ ID NO: 62428 - DNA, 62 bp, Human herpesvirus 2
caccggaacccaccagaggcggaagccgccttcgcccgtgagggtgcgtgtgttttctggtg

SEQ ID NO: 62429 - DNA, 24 bp, Human herpesvirus 2
ccggaacccaccagaggcggaagc

SEQ ID NO: 62430 - DNA, 17 bp, Homo sapiens
ggaacccgggaggcgga

SEQ ID NO: 62431 - DNA, 16 bp, Homo sapiens
gaacccaggaggcgga

SEQ ID NO: 62432 - DNA, 24 bp, Homo sapiens
cggatcccaccaggaagtgcttcg

SEQ ID NO: 62433 - DNA, 16 bp, Homo sapiens
gggcccaccaggacag

SEQ ID NO: 62434 - DNA, 16 bp, Homo sapiens
gaacccaagaggcgga

SEQ ID NO: 62435 - DNA, 19 bp, Homo sapiens
cccgaacgcaggaggcgga

SEQ ID NO: 62436 - DNA, 19 bp, Homo sapiens
ccagagcccaccagggcag

SEQ ID NO: 62437 - DNA, 23 bp, Homo sapiens
cggaggcgggcagaggcggaggc

SEQ ID NO: 62438 - DNA, 18 bp, Homo sapiens
gaacacaggaggcggaag

SEQ ID NO: 62439 - DNA, 24 bp, Homo sapiens
ccggaacccgcgcggggagggaag

SEQ ID NO: 62440 - DNA, 17 bp, Homo sapiens
ggaacccagtaggcaga

SEQ ID NO: 62441 - DNA, 20 bp, Homo sapiens
ccgcgaacccgggaggcgga

SEQ ID NO: 62442 - DNA, 16 bp, Homo sapiens
gaacccgagaggcgga

SEQ ID NO: 62443 - DNA, 24 bp, Homo sapiens
ccaggcccaaccagaggtgggggc

SEQ ID NO: 62444 - DNA, 24 bp, Homo sapiens
ccggggtccgcgaggcggaggagc

SEQ ID NO: 62445 - DNA, 21 bp, Homo sapiens
ccggagccaaccggaaacgga

SEQ ID NO: 62446 - DNA, 20 bp, Homo sapiens
cggaaacgggaggcgggggc

SEQ ID NO: 62447 - DNA, 18 bp, Homo sapiens
ccgcgcacagaggcggag

SEQ ID NO: 62448 - DNA, 22 bp, Homo sapiens
ccaggatgggggaggcggaagc

SEQ ID NO: 62449 - DNA, 19 bp, Homo sapiens
gaacccgggaggcggaggc

SEQ ID NO: 62450 - DNA, 19 bp, Homo sapiens
cctgaacctgggaggcgga

SEQ ID NO: 62451 - DNA, 19 bp, Homo sapiens
ccggaaccgcaccagaggc

SEQ ID NO: 62452 - DNA, 24 bp, Homo sapiens
gggacacaccagagtagcgcttcg

SEQ ID NO: 62453 - DNA, 17 bp, Homo sapiens
ccggaaaggggcggaag

SEQ ID NO: 62454 - DNA, 22 bp, Homo sapiens
cgggatcagccagagaccgagc

SEQ ID NO: 62455 - DNA, 20 bp, Homo sapiens
ggaagaacagaggcgggagc

SEQ ID NO: 62456 - DNA, 17 bp, Homo sapiens
ggaatccaggaggcgga

SEQ ID NO: 62457 - DNA, 19 bp, Homo sapiens
ccgaggcccaccaaggggg

SEQ ID NO: 62458 - DNA, 23 bp, Homo sapiens
cagggcctggagaaggcggaagc

SEQ ID NO: 62459 - DNA, 23 bp, Homo sapiens
ggaacccagtggggacaggaggc

SEQ ID NO: 62460 - DNA, 18 bp, Homo sapiens
gaacccgggaggcggaag

SEQ ID NO: 62461 - DNA, 17 bp, Homo sapiens
ggaacccaggaggcgga

SEQ ID NO: 62462 - DNA, 29 bp, Homo sapiens
cctgaacccaccatgaggagcgcttccgc

SEQ ID NO: 62463 - DNA, 22 bp, Homo sapiens
ggaccccaccaggcacagaggc

SEQ ID NO: 62464 - DNA, 19 bp, Homo sapiens
cctgaacccaggaggcgga

SEQ ID NO: 62465 - DNA, 19 bp, Homo sapiens
ccagaatccaccaggaggc

SEQ ID NO: 62466 - DNA, 27 bp, Homo sapiens
ggggcccaccagagcaagcgcttccgc

SEQ ID NO: 62467 - DNA, 23 bp, Homo sapiens
ccggagcagcaggaggcggaggc

SEQ ID NO: 62468 - DNA, 19 bp, Homo sapiens
gagcccaggaggcggaggc

SEQ ID NO: 62469 - DNA, 22 bp, Homo sapiens
ccggaaccgccgcgccggaagc

SEQ ID NO: 62470 - DNA, 25 bp, Homo sapiens
cagaacccaccactggagcgcttcg

SEQ ID NO: 62471 - DNA, 19 bp, Homo sapiens
ccggaacccacagggggaa

SEQ ID NO: 62472 - DNA, 19 bp, Homo sapiens
cctgaacccgagaggcgga

SEQ ID NO: 62473 - DNA, 22 bp, Homo sapiens
ccgagtccgaggaggcggaggc

SEQ ID NO: 62474 - DNA, 17 bp, Homo sapiens
ggggccaccagaacaga

SEQ ID NO: 62475 - DNA, 18 bp, Homo sapiens
gaacctgggaagcggaag

SEQ ID NO: 62476 - DNA, 17 bp, Homo sapiens
ggaacccaggaggtgga

SEQ ID NO: 62477 - DNA, 19 bp, Homo sapiens
cccgaacccaggaggcgga

SEQ ID NO: 62478 - DNA, 19 bp, Homo sapiens
cgggacccaccaggggtgc

SEQ ID NO: 62479 - DNA, 19 bp, Homo sapiens
gaacccaggaagcggaggc

SEQ ID NO: 62480 - DNA, 24 bp, Homo sapiens
gaacccaccaggttgagcgcttcg

SEQ ID NO: 62481 - DNA, 20 bp, Homo sapiens
gggcccaccaggagggaagc

SEQ ID NO: 62482 - DNA, 19 bp, Homo sapiens
cccgaacccgggaggcgga

SEQ ID NO: 62483 - DNA, 19 bp, Homo sapiens
ccggggcccaccaggctgg

SEQ ID NO: 62484 - DNA, 24 bp, Homo sapiens
gggacccaccagagtcgacagagc

SEQ ID NO: 62485 - DNA, 18 bp, Homo sapiens
ccctgccaggggcggaag

SEQ ID NO: 62486 - DNA, 26 bp, Homo sapiens
aacccaccagtgatgggtgcttccgc

SEQ ID NO: 62487 - DNA, 19 bp, Homo sapiens
cggaacccaccagctacga

SEQ ID NO: 62488 - DNA, 20 bp, Homo sapiens
ggggcctgccaaacagaagc

SEQ ID NO: 62489 - DNA, 21 bp, Homo sapiens
ggaacccagagtggtgggggc

SEQ ID NO: 62490 - DNA, 20 bp, Homo sapiens
cgcgatccaccaggcggaag

SEQ ID NO: 62491 - DNA, 24 bp, Homo sapiens
ccggaaccttcttctggtgggagc

SEQ ID NO: 62492 - DNA, 22 bp, Homo sapiens
ccggggcccacagcacagaagc

SEQ ID NO: 62493 - DNA, 23 bp, Homo sapiens
gggggccaccagatgacagaagc

SEQ ID NO: 62494 - DNA, 21 bp, Homo sapiens
ggaacccatcagcccccaggc

SEQ ID NO: 62495 - DNA, 22 bp, Homo sapiens
ggggcccagcaggtacaaaagc

SEQ ID NO: 62496 - DNA, 19 bp, Homo sapiens
cccgaaccctggaggcgga

SEQ ID NO: 62497 - DNA, 16 bp, Homo sapiens
gaacccaggaagcgga

SEQ ID NO: 62498 - DNA, 19 bp, Homo sapiens
ccggagcctgcaaggcgga

SEQ ID NO: 62499 - DNA, 24 bp, Homo sapiens
ccgggacgcctctgaggcggaagc

SEQ ID NO: 62500 - DNA, 20 bp, Homo sapiens
gggacccaccagggctccag

SEQ ID NO: 62501 - DNA, 17 bp, Homo sapiens
ggaacccactgggcaag

SEQ ID NO: 62502 - DNA, 23 bp, Homo sapiens
gaaacccactgtgaagtgcttcg

SEQ ID NO: 62503 - DNA, 19 bp, Homo sapiens
ccggaacccactgcgacag

SEQ ID NO: 62504 - DNA, 23 bp, Homo sapiens
cgggaccagagcttggcggaagc

SEQ ID NO: 62505 - DNA, 27 bp, Homo sapiens
ggcacccaccagtgtgggtgcttccgc

SEQ ID NO: 62506 - DNA, 23 bp, Homo sapiens
gggacccaccagactgtgtaggc

SEQ ID NO: 62507 - DNA, 22 bp, Homo sapiens
cggagccaaaaggggcgggagc

SEQ ID NO: 62508 - DNA, 18 bp, Homo sapiens
gaacccaggaggcggaag

SEQ ID NO: 62509 - DNA, 22 bp, Homo sapiens
ccggagccaccgaggcggaggc

SEQ ID NO: 62510 - DNA, 21 bp, Homo sapiens
ccaggagtcccgggcgggggc

SEQ ID NO: 62511 - DNA, 16 bp, Homo sapiens
ggacccaggaggcgga

SEQ ID NO: 62512 - DNA, 19 bp, Homo sapiens
cctgagcccaccaggtggc

SEQ ID NO: 62513 - DNA, 17 bp, Homo sapiens
gaacctcaggaggcgga

SEQ ID NO: 62514 - DNA, 19 bp, Homo sapiens
ccggaaccccccagcaggc

SEQ ID NO: 62515 - DNA, 24 bp, Homo sapiens
ggaacccaccacgggagcgcttcg

SEQ ID NO: 62516 - DNA, 19 bp, Homo sapiens
ggaacccatgaggtagagc

SEQ ID NO: 62517 - DNA, 17 bp, Homo sapiens
ggaacccactccggaag

SEQ ID NO: 62518 - DNA, 19 bp, Homo sapiens
ggaacccactaaaaactgg

SEQ ID NO: 62519 - DNA, 19 bp, Homo sapiens
gaaccagggaggcggaggc

SEQ ID NO: 62520 - DNA, 27 bp, Homo sapiens
ggaacccatgaagtgaggtgcttccgc

SEQ ID NO: 62521 - DNA, 25 bp, Homo sapiens
ccagaacctgtcagggctgcttgga

SEQ ID NO: 62522 - DNA, 22 bp, Homo sapiens
ggagtcaccagaaaaaaagaag

SEQ ID NO: 62523 - DNA, 28 bp, Homo sapiens
ggaacctattgcacaaaagcgcttccgc

SEQ ID NO: 62524 - DNA, 18 bp, Homo sapiens
cggactccaccagcaagc

SEQ ID NO: 62525 - DNA, 22 bp, Homo sapiens
ggaacccaccaggtcattaggc

SEQ ID NO: 62526 - DNA, 19 bp, Homo sapiens
cctgaatccgggaggcgga

SEQ ID NO: 62527 - DNA, 29 bp, Homo sapiens
ccggaacctagcagagcctgtgcttccgc

SEQ ID NO: 62528 - DNA, 19 bp, Homo sapiens
cctgagcccaggaggcgga

SEQ ID NO: 62529 - DNA, 17 bp, Homo sapiens
ggatccgccgcagaagc

SEQ ID NO: 62530 - DNA, 66 bp, Jembrana disease virus
agatctaggttatttgatgacacccgcaggaacacatacaacaggagaattaaatgaattagatct

SEQ ID NO: 62531 - DNA, 24 bp, Jembrana disease virus
taggttatttgatgacacccgcag

SEQ ID NO: 62532 - DNA, 18 bp, Homo sapiens
taggttatcatcactcgc

SEQ ID NO: 62533 - DNA, 21 bp, Homo sapiens
aagttctgatgacatttgcag

SEQ ID NO: 62534 - DNA, 22 bp, Homo sapiens
taggctatttggtggccctcag

SEQ ID NO: 62535 - DNA, 16 bp, Homo sapiens
agtcaaatgacatccg

SEQ ID NO: 62536 - DNA, 23 bp, Homo sapiens
ggttttcagactggcacccgcag

SEQ ID NO: 62537 - DNA, 16 bp, Homo sapiens
agttattcctgcccgc

SEQ ID NO: 62538 - DNA, 24 bp, Homo sapiens
taggtcactcttggtgacacctgc

SEQ ID NO: 62539 - DNA, 93 bp, Tobacco streak virus
cgttagcccaaagagtgaagtctattccctttattgagtctctgagttttcccagcgatattcaaaggatgcagcttcgtgctctaggtgacg

SEQ ID NO: 62540 - DNA, 24 bp, Tobacco streak virus
aaggatgcagcttcgtgctctagg

SEQ ID NO: 62541 - DNA, 20 bp, Homo sapiens
ggtgccggacgtgctctggg

SEQ ID NO: 62542 - DNA, 17 bp, Homo sapiens
aaggattggcttctctg

SEQ ID NO: 62543 - DNA, 20 bp, Homo sapiens
ggaggcagttgcaatctggg

SEQ ID NO: 62544 - DNA, 21 bp, Homo sapiens
agggtgcagcttgtgcagagg

SEQ ID NO: 62545 - DNA, 25 bp, Homo sapiens
agggctgcggcttcacagacttagg

SEQ ID NO: 62546 - DNA, 17 bp, Homo sapiens
aggatttcgtgctctag

SEQ ID NO: 62547 - DNA, 22 bp, Homo sapiens
ggatgcagcctcctgcactggg

SEQ ID NO: 62548 - DNA, 16 bp, Homo sapiens
agggtgcagccttgct

SEQ ID NO: 62549 - DNA, 22 bp, Homo sapiens
aggattcagacagagctctagg

SEQ ID NO: 62550 - DNA, 15 bp, Homo sapiens
ggatacagctttctg

SEQ ID NO: 62551 - DNA, 20 bp, Homo sapiens
aggatgcatctggttttagg

SEQ ID NO: 62552 - DNA, 23 bp, Homo sapiens
aaggatgcggttctaacattagg

SEQ ID NO: 62553 - DNA, 18 bp, Homo sapiens
ggaggcagcttcagtcct

SEQ ID NO: 62554 - DNA, 22 bp, Homo sapiens
ggatgcagctgtgatggagagg

SEQ ID NO: 62555 - DNA, 23 bp, Homo sapiens
aagggtgctggagcagctctagg

SEQ ID NO: 62556 - DNA, 15 bp, Homo sapiens
aggagctgtgctcta

SEQ ID NO: 62557 - DNA, 21 bp, Homo sapiens
agggctgcagccagttctagg

SEQ ID NO: 62558 - DNA, 23 bp, Homo sapiens
ggatgcagctctggggctttagg

SEQ ID NO: 62559 - DNA, 21 bp, Homo sapiens
ggagtgcagctttgatgtagg

SEQ ID NO: 62560 - DNA, 16 bp, Homo sapiens
aggatcagctccgtct

SEQ ID NO: 62561 - DNA, 24 bp, Homo sapiens
aagcgtgcagcttttccccctggg

SEQ ID NO: 62562 - DNA, 115 bp, Pea early browning virus
tgttgttattattatttgaagtttgatttatgaaaatcttctgctttctgaaaaggtcgttgaccaagagaaagtgggagggtgagtaagtactcttgaagtggtgatggttaca

SEQ ID NO: 62563 - DNA, 24 bp, Pea early browning virus
tgttattattatttgaagtttgat

SEQ ID NO: 62564 - DNA, 18 bp, Homo sapiens
tattattattatttgaaa

SEQ ID NO: 62565 - DNA, 70 bp, Pea early browning virus
ctatttgtttgtgtatgagctaggtattggttaattccatgcttaagtggttctaccataggaacgatag

SEQ ID NO: 62566 - DNA, 24 bp, Pea early browning virus
tgtatgagctaggtattggttaat

SEQ ID NO: 62567 - DNA, 18 bp, Homo sapiens
tgtatgagcttggtgggt

SEQ ID NO: 62568 - DNA, 18 bp, Homo sapiens
tgtagggctgggtctggt

SEQ ID NO: 62569 - DNA, 20 bp, Homo sapiens
tgtagagctaggagtttggt

SEQ ID NO: 62570 - DNA, 19 bp, Homo sapiens
tgtatagctgtggggttaa

SEQ ID NO: 62571 - DNA, 20 bp, Homo sapiens
tgtatgagcctcaatggtta

SEQ ID NO: 62572 - DNA, 21 bp, Homo sapiens
tgtttgggctaggtaagtagt

SEQ ID NO: 62573 - DNA, 70 bp, Zaire Ebola virus
gaggaagattaagaaaaactgcttattgggtctttccgtgttttagatgaagcagttgaaattcttcctc

SEQ ID NO: 62574 - DNA, 24 bp, Zaire Ebola virus
agaaaaactgcttattgggtcttt

SEQ ID NO: 62575 - DNA, 22 bp, Homo sapiens
agaaaatctgtttcagatcttt

SEQ ID NO: 62576 - DNA, 20 bp, Homo sapiens
gaaaaactgctttgtgcttt

SEQ ID NO: 62577 - DNA, 21 bp, Homo sapiens
gaaaacactgtctgggtcttt

SEQ ID NO: 62578 - DNA, 20 bp, Homo sapiens
agaggaactgcttaatgagt

SEQ ID NO: 62579 - DNA, 21 bp, Homo sapiens
gaagactgctgcgaagtcttt

SEQ ID NO: 62580 - DNA, 22 bp, Homo sapiens
agaaatggctgccaaggtcttt

SEQ ID NO: 62581 - DNA, 18 bp, Homo sapiens
agagaaactgctgttgga

SEQ ID NO: 62582 - DNA, 18 bp, Homo sapiens
aaaaactgcttataacgt

SEQ ID NO: 62583 - DNA, 20 bp, Homo sapiens
agacgccgccgggggtcttt

SEQ ID NO: 62584 - DNA, 19 bp, Homo sapiens
aaaaaaattgctgagtctt

SEQ ID NO: 62585 - DNA, 18 bp, Homo sapiens
agaagctgcttatgcctt

SEQ ID NO: 62586 - DNA, 19 bp, Homo sapiens
aaaaaactgtttgaggctt

SEQ ID NO: 62587 - DNA, 17 bp, Homo sapiens
gaaatgcttattggagc

SEQ ID NO: 62588 - DNA, 16 bp, Homo sapiens
aggaaaactgctgagt

SEQ ID NO: 62589 - DNA, 25 bp, Homo sapiens
agaaaaactcttattaaagagcttt

SEQ ID NO: 62590 - DNA, 18 bp, Homo sapiens
aggaaaactgctatttgg

SEQ ID NO: 62591 - DNA, 19 bp, Homo sapiens
agagtaactgctctgtctt

SEQ ID NO: 62592 - DNA, 21 bp, Homo sapiens
agaaaggcttcttgaacctct

SEQ ID NO: 62593 - DNA, 18 bp, Homo sapiens
aaagaaactgcttggctt

SEQ ID NO: 62594 - DNA, 17 bp, Homo sapiens
aactgcttagcatcctt

SEQ ID NO: 62595 - DNA, 21 bp, Homo sapiens
agaaaaactctttaaatccct

SEQ ID NO: 62596 - DNA, 20 bp, Homo sapiens
gaaaaggtgcttgaaccttt

SEQ ID NO: 62597 - DNA, 19 bp, Homo sapiens
gaacaattgcttattgagt

SEQ ID NO: 62598 - DNA, 18 bp, Homo sapiens
aaaaaaacttcagtgggt

SEQ ID NO: 62599 - DNA, 19 bp, Homo sapiens
agagaaactgctttttgaa

SEQ ID NO: 62600 - DNA, 22 bp, Homo sapiens
agagaaactgctagttgagact

SEQ ID NO: 62601 - DNA, 18 bp, Homo sapiens
gaaaactgcttgaccttt

SEQ ID NO: 62602 - DNA, 63 bp, Human papillomavirus type 83
tgaaatggactatgtaagctgggggcacatatatgtatatacggaggaaacaaggacatggca

SEQ ID NO: 62603 - DNA, 24 bp, Human papillomavirus type 83
gactatgtaagctgggggcacata

SEQ ID NO: 62604 - DNA, 21 bp, Homo sapiens
ctgtgtgaagaagggcacata

SEQ ID NO: 62605 - DNA, 22 bp, Homo sapiens
gactggtaagtactggcacata

SEQ ID NO: 62606 - DNA, 18 bp, Homo sapiens
tgcacacagctgggggca

SEQ ID NO: 62607 - DNA, 15 bp, Homo sapiens
ctatgtaactacaca

SEQ ID NO: 62608 - DNA, 15 bp, Homo sapiens
gactatgtgaggcaa

SEQ ID NO: 62609 - DNA, 60 bp, Human papillomavirus type 57
gctggggccatatatatgtgcaggacattaacgatgatacctggcataaggtgcccgggc

SEQ ID NO: 62610 - DNA, 23 bp, Human papillomavirus type 57
tacctggcataaggtgcccgggc

SEQ ID NO: 62611 - DNA, 19 bp, Homo sapiens
acttggcgtgagccagggc

SEQ ID NO: 62612 - DNA, 20 bp, Homo sapiens
tacctggcctaaggaagggc

SEQ ID NO: 62613 - DNA, 18 bp, Homo sapiens
cctggcggcggcccgggc

SEQ ID NO: 62614 - DNA, 21 bp, Homo sapiens
cctggcgggaggcgccccggg

SEQ ID NO: 62615 - DNA, 16 bp, Homo sapiens
cctggcactgcctggg

SEQ ID NO: 62616 - DNA, 20 bp, Homo sapiens
tacctagtggccgcccgggc

SEQ ID NO: 62617 - DNA, 18 bp, Homo sapiens
cctggtgtgcagccgggc

SEQ ID NO: 62618 - DNA, 19 bp, Homo sapiens
cccgacacggtgctcgggc

SEQ ID NO: 62619 - DNA, 16 bp, Homo sapiens
ctggcatagtcctggg

SEQ ID NO: 62620 - DNA, 17 bp, Homo sapiens
cctggcatggccctggg

SEQ ID NO: 62621 - DNA, 21 bp, Homo sapiens
tacctggctttatacctcggg

SEQ ID NO: 62622 - DNA, 20 bp, Homo sapiens
cctcgcagagctgcccgggc

SEQ ID NO: 62623 - DNA, 17 bp, Homo sapiens
ctggttcactgcccggg

SEQ ID NO: 62624 - DNA, 17 bp, Homo sapiens
ctggcggcagcccgggc

SEQ ID NO: 62625 - DNA, 23 bp, Homo sapiens
tacctggcgcgggacaggagggc

SEQ ID NO: 62626 - DNA, 18 bp, Homo sapiens
cctgctcggtgcccgggc

SEQ ID NO: 62627 - DNA, 17 bp, Homo sapiens
acctggcagggcctggg

SEQ ID NO: 62628 - DNA, 18 bp, Homo sapiens
ctggcacccctgcccggg

SEQ ID NO: 62629 - DNA, 18 bp, Homo sapiens
cctggcacagggataggc

SEQ ID NO: 62630 - DNA, 18 bp, Homo sapiens
cctggcatggtggtgggc

SEQ ID NO: 62631 - DNA, 18 bp, Homo sapiens
tacctggcatgtggaggg

SEQ ID NO: 62632 - DNA, 21 bp, Homo sapiens
ctggtatgaaaataccctggg

SEQ ID NO: 62633 - DNA, 19 bp, Homo sapiens
cctggcatggtccgccggg

SEQ ID NO: 62634 - DNA, 20 bp, Homo sapiens
cctggcactgaggacagggc

SEQ ID NO: 62635 - DNA, 18 bp, Homo sapiens
cacctggcatgggagggg

SEQ ID NO: 62636 - DNA, 20 bp, Homo sapiens
tggcataaggcacaatgggc

SEQ ID NO: 62637 - DNA, 17 bp, Homo sapiens
ctggcacccgcctgggc

SEQ ID NO: 62638 - DNA, 17 bp, Homo sapiens
tggatataggcccgggc

SEQ ID NO: 62639 - DNA, 18 bp, Homo sapiens
cctggcataggcataggg

SEQ ID NO: 62640 - DNA, 18 bp, Homo sapiens
cctggcacagggctgggc

SEQ ID NO: 62641 - DNA, 17 bp, Homo sapiens
tacctggctaggttggg

SEQ ID NO: 62642 - DNA, 61 bp, Common chimpanzee papillomavirus 1
gccacattggaccacaggtggtgccaccattacaggtatcacagactaagggacatgaggc

SEQ ID NO: 62643 - DNA, 24 bp, Common chimpanzee papillomavirus 1
tatcacagactaagggacatgagg

SEQ ID NO: 62644 - DNA, 17 bp, Homo sapiens
tcacagacggaggggag

SEQ ID NO: 62645 - DNA, 21 bp, Homo sapiens
tatcacagataagaccagagg

SEQ ID NO: 62646 - DNA, 19 bp, Homo sapiens
tatcacagataagaaggag

SEQ ID NO: 62647 - DNA, 19 bp, Homo sapiens
tcacagactaatactgagg

SEQ ID NO: 62648 - DNA, 18 bp, Homo sapiens
tatcacaggtcgggagag

SEQ ID NO: 62649 - DNA, 19 bp, Homo sapiens
tatccagactaagccaggg

SEQ ID NO: 62650 - DNA, 19 bp, Homo sapiens
cagaggcgaggacatgagg

SEQ ID NO: 62651 - DNA, 17 bp, Homo sapiens
cacagactgggagagag

SEQ ID NO: 62652 - DNA, 22 bp, Homo sapiens
tatcacaggctgagggctcaag

SEQ ID NO: 62653 - DNA, 21 bp, Homo sapiens
tcacatgttacagacatgagg

SEQ ID NO: 62654 - DNA, 21 bp, Homo sapiens
tatcacaggttgaacctgagg

SEQ ID NO: 62655 - DNA, 22 bp, Homo sapiens
tcacagtgacaagggacatggg

SEQ ID NO: 62656 - DNA, 16 bp, Homo sapiens
tcacagacaggcatgg

SEQ ID NO: 62657 - DNA, 18 bp, Homo sapiens
catcacaggttgggtgag

SEQ ID NO: 62658 - DNA, 77 bp, Common chimpanzee papillomavirus 1
ttatgtgtataacacagaaaaggaaatatggctaaaggtaaaaggcatggtagactataaagggttgtactatatga

SEQ ID NO: 62659 - DNA, 24 bp, Common chimpanzee papillomavirus 1
tataacacagaaaaggaaatatgg

SEQ ID NO: 62660 - DNA, 18 bp, Homo sapiens
tataacacatgggaagtg

SEQ ID NO: 62661 - DNA, 22 bp, Homo sapiens
cataacacaggaaaggcgttgg

SEQ ID NO: 62662 - DNA, 16 bp, Homo sapiens
taacactgaaaatatg

SEQ ID NO: 62663 - DNA, 18 bp, Homo sapiens
tataaccagataaatatg

SEQ ID NO: 62664 - DNA, 19 bp, Homo sapiens
tataatacagaaaatgaaa

SEQ ID NO: 62665 - DNA, 18 bp, Homo sapiens
tataacacgaaaaggaaa

SEQ ID NO: 62666 - DNA, 18 bp, Homo sapiens
acacagaatacaatatgg

SEQ ID NO: 62667 - DNA, 20 bp, Homo sapiens
taacacaggtgggggaaaca

SEQ ID NO: 62668 - DNA, 21 bp, Homo sapiens
cacagaaaagacatgttatgg

SEQ ID NO: 62669 - DNA, 18 bp, Homo sapiens
aacacagaaaagatctgg

SEQ ID NO: 62670 - DNA, 76 bp, Fowl adenovirus A
gaccgcctattaggtgtggcttcgggctccgcctagtgggaggagacaggaaaaccacgcctagtgacgctgggtc

SEQ ID NO: 62671 - DNA, 24 bp, Fowl adenovirus A
tattaggtgtggcttcgggctccg

SEQ ID NO: 62672 - DNA, 26 bp, Homo sapiens
ttgggtgtggcttttttgcggagccc

SEQ ID NO: 62673 - DNA, 24 bp, Homo sapiens
tattaggtttggtttccagcttcg

SEQ ID NO: 62674 - DNA, 22 bp, Homo sapiens
ttaggtgtggtttttgcggagc

SEQ ID NO: 62675 - DNA, 20 bp, Homo sapiens
tatcaggtgtggcaaattct

SEQ ID NO: 62676 - DNA, 17 bp, Homo sapiens
tattaggtggtggagct

SEQ ID NO: 62677 - DNA, 107 bp, Rauscher murine leukemia virus
aaacagctaacgttgggccaaacaggatatctgcggtgagcagtttcggccccggcccggggccaagaacagatggtccccagatatggcccaaccctcagcagttt

SEQ ID NO: 62678 - DNA, 24 bp, Rauscher murine leukemia virus
acgttgggccaaacaggatatctg

SEQ ID NO: 62679 - DNA, 20 bp, Homo sapiens
gctgggccaggtgtcctctg

SEQ ID NO: 62680 - DNA, 25 bp, Homo sapiens
acttgggccaaatgttgcagatatc

SEQ ID NO: 62681 - DNA, 21 bp, Homo sapiens
acgttagggtcagttaaggat

SEQ ID NO: 62682 - DNA, 22 bp, Homo sapiens
cgctgggctaggtaacggtctg

SEQ ID NO: 62683 - DNA, 20 bp, Homo sapiens
ttgggccagacgctggtctg

SEQ ID NO: 62684 - DNA, 18 bp, Homo sapiens
ttgggccaagtgggtcta

SEQ ID NO: 62685 - DNA, 22 bp, Homo sapiens
cgtgggccaagcgggtggtctg

SEQ ID NO: 62686 - DNA, 15 bp, Homo sapiens
gttgggcaggacacc

SEQ ID NO: 62687 - DNA, 68 bp, Lumpy skin disease virus
atgttgttttacgatataatacaactataaaatatggagatcttgtaacatatataacagtacaacat

SEQ ID NO: 62688 - DNA, 24 bp, Lumpy skin disease virus
tgtaacatatataacagtacaaca

SEQ ID NO: 62689 - DNA, 24 bp, Homo sapiens
taacatacttcatgcagtataaca

SEQ ID NO: 62690 - DNA, 21 bp, Homo sapiens
tgaacattaaaaacagtacaa

SEQ ID NO: 62691 - DNA, 21 bp, Homo sapiens
tgtgtcatatattgtacaaca

SEQ ID NO: 62692 - DNA, 22 bp, Homo sapiens
tgtaacattctctctcagtaca

SEQ ID NO: 62693 - DNA, 19 bp, Homo sapiens
taacatatactttacagta

SEQ ID NO: 62694 - DNA, 18 bp, Homo sapiens
tgtaacatgtacaaagta

SEQ ID NO: 62695 - DNA, 19 bp, Homo sapiens
tgtaacatagcaatacaac

SEQ ID NO: 62696 - DNA, 17 bp, Homo sapiens
gtaacatatatatagca

SEQ ID NO: 62697 - DNA, 19 bp, Homo sapiens
tgtaacacatatagcaata

SEQ ID NO: 62698 - DNA, 24 bp, Homo sapiens
tgtaacacatattcacacacaaca

SEQ ID NO: 62699 - DNA, 19 bp, Homo sapiens
tgtaacatctactacaata

SEQ ID NO: 62700 - DNA, 22 bp, Homo sapiens
tgtaacatacaacttctacagt

SEQ ID NO: 62701 - DNA, 21 bp, Homo sapiens
tgtcaacataacagtatgaca

SEQ ID NO: 62702 - DNA, 19 bp, Homo sapiens
tgtaacatttataaaagta

SEQ ID NO: 62703 - DNA, 21 bp, Homo sapiens
tataatatatatacagtacaa

SEQ ID NO: 62704 - DNA, 22 bp, Homo sapiens
tgtaacacgtagttttacaaca

SEQ ID NO: 62705 - DNA, 19 bp, Homo sapiens
tgtggcatatatacaccac

SEQ ID NO: 62706 - DNA, 19 bp, Homo sapiens
tgaacatatatttacagta

SEQ ID NO: 62707 - DNA, 20 bp, Homo sapiens
tgtaacacatacattacaat

SEQ ID NO: 62708 - DNA, 111 bp, Molluscum contagiosum virus
gtgcggagcacttctctgatgcgccggccgtgacggcaagtactttgacctggccgcaattccacgtgtagagttctcccgagggcaggatgtaatcagagctctccgcgc

SEQ ID NO: 62709 - DNA, 24 bp, Molluscum contagiosum virus
caggatgtaatcagagctctccgc

SEQ ID NO: 62710 - DNA, 19 bp, Homo sapiens
caagatgtggttcattccg

SEQ ID NO: 62711 - DNA, 18 bp, Homo sapiens
caggatgcaatcagagtc

SEQ ID NO: 62712 - DNA, 18 bp, Homo sapiens
caggtgtaatcagggagc

SEQ ID NO: 62713 - DNA, 20 bp, Homo sapiens
cgggatcaagagctctttgc

SEQ ID NO: 62714 - DNA, 22 bp, Homo sapiens
aagatgtaattatgttctctgc

SEQ ID NO: 62715 - DNA, 20 bp, Homo sapiens
caggatgtagtacagaatgc

SEQ ID NO: 62716 - DNA, 18 bp, Homo sapiens
caggatgcggtccctccg

SEQ ID NO: 62717 - DNA, 21 bp, Homo sapiens
caggatgtggtcgatagccgc

SEQ ID NO: 62718 - DNA, 17 bp, Homo sapiens
aggatgtaattccctcg

SEQ ID NO: 62719 - DNA, 20 bp, Homo sapiens
ggatgtaattacaaaattct

SEQ ID NO: 62720 - DNA, 20 bp, Homo sapiens
agatgtaatcgttccctccg

SEQ ID NO: 62721 - DNA, 21 bp, Homo sapiens
caggtgcttggcagagctctc

SEQ ID NO: 62722 - DNA, 21 bp, Homo sapiens
caggctggaggagctctctgc

SEQ ID NO: 62723 - DNA, 18 bp, Homo sapiens
caggatgtaaatagctct

SEQ ID NO: 62724 - DNA, 25 bp, Homo sapiens
ggatgtaaatctgttgtctctctgc

SEQ ID NO: 62725 - DNA, 25 bp, Homo sapiens
caggatgcaacacccagctctctgc

SEQ ID NO: 62726 - DNA, 19 bp, Homo sapiens
aggggcactccagagctct

SEQ ID NO: 62727 - DNA, 18 bp, Homo sapiens
ggagtaatcaatcactct

SEQ ID NO: 62728 - DNA, 18 bp, Homo sapiens
caggatgtagctggtcac

SEQ ID NO: 62729 - DNA, 18 bp, Homo sapiens
cagaatgtagtcggagct

SEQ ID NO: 62730 - DNA, 24 bp, Homo sapiens
caggcgtagtggggagctctccgc

SEQ ID NO: 62731 - DNA, 72 bp, Molluscum contagiosum virus
ggagcacttctccgatgggtcggtcgtgactccacgtgcggagcacttctccgatgggtcggtcgtgactcc

SEQ ID NO: 62732 - DNA, 23 bp, Molluscum contagiosum virus
tccgatgggtcggtcgtgactcc

SEQ ID NO: 62733 - DNA, 15 bp, Homo sapiens
gatgggtcatgactc

SEQ ID NO: 62734 - DNA, 15 bp, Homo sapiens
tccgacagggtcgtg

SEQ ID NO: 62735 - DNA, 21 bp, Homo sapiens
tgggtcggcagagatggttcc

SEQ ID NO: 62736 - DNA, 18 bp, Homo sapiens
tccaggtgggggtgattc

SEQ ID NO: 62737 - DNA, 20 bp, Homo sapiens
tcctatgggtcggtatatga

SEQ ID NO: 62738 - DNA, 22 bp, Homo sapiens
tccggcggccgcggtggtcgtg

SEQ ID NO: 62739 - DNA, 18 bp, Homo sapiens
tccaatgacttgtgactc

SEQ ID NO: 62740 - DNA, 79 bp, Fowl adenovirus A
gttcaggggttcgtcgaaccgtaccacagcctggtcgtttaatctcaaccaatattttctagggttcgacatcatgaac

SEQ ID NO: 62741 - DNA, 24 bp, Fowl adenovirus A
aaccgtaccacagcctggtcgttt

SEQ ID NO: 62742 - DNA, 20 bp, Homo sapiens
cgaactgagtttggtcgttt

SEQ ID NO: 62743 - DNA, 20 bp, Homo sapiens
gtaccacagtttaatagttt

SEQ ID NO: 62744 - DNA, 20 bp, Homo sapiens
gtgcccacagccaccccttt

SEQ ID NO: 62745 - DNA, 19 bp, Homo sapiens
ccgactgcagcttggacgt

SEQ ID NO: 62746 - DNA, 129 bp, African swine fever virus
gcctcgtttgcccattttctatgatttttttttacctcgggttctagatctgtcttctccatatactcattgtggtcatatttttttttggagggaggcggggtgggtggaggaatgggtggaggaagt

SEQ ID NO: 62747 - DNA, 24 bp, African swine fever virus
tctatgatttttttttacctcggg

SEQ ID NO: 62748 - DNA, 21 bp, Homo sapiens
tctatatttttaccttttggg

SEQ ID NO: 62749 - DNA, 24 bp, Homo sapiens
tctgtgattttttttttttctcgg

SEQ ID NO: 62750 - DNA, 18 bp, Homo sapiens
tctatgattttattctgg

SEQ ID NO: 62751 - DNA, 82 bp, African swine fever virus
ccatgacccttatgatttgccaaaaaagcggtttcatcaagattttctaaccctttcacggatgaagaaataaggtgttcgg

SEQ ID NO: 62752 - DNA, 24 bp, African swine fever virus
tgatttgccaaaaaagcggtttca

SEQ ID NO: 62753 - DNA, 20 bp, Homo sapiens
tgacttgccaggagagcccc

SEQ ID NO: 62754 - DNA, 23 bp, Homo sapiens
tgatctgctggggcaccagtttc

SEQ ID NO: 62755 - DNA, 20 bp, Homo sapiens
atttgccaatattggtttca

SEQ ID NO: 62756 - DNA, 22 bp, Homo sapiens
tggtttgccaaacaacgcttca

SEQ ID NO: 62757 - DNA, 16 bp, Homo sapiens
tgatttgcagaggcct

SEQ ID NO: 62758 - DNA, 21 bp, Homo sapiens
tgatttgcaggaaaactagtt

SEQ ID NO: 62759 - DNA, 17 bp, Homo sapiens
tgatttgccagggtgtc

SEQ ID NO: 62760 - DNA, 22 bp, Homo sapiens
tgatttaccaaagaaaatgttt

SEQ ID NO: 62761 - DNA, 21 bp, Homo sapiens
tgatttgcccaggaacaattt

SEQ ID NO: 62762 - DNA, 18 bp, Homo sapiens
gatttgccagaaaagtca

SEQ ID NO: 62763 - DNA, 21 bp, Homo sapiens
atttgccaagtcaatgtttca

SEQ ID NO: 62764 - DNA, 19 bp, Homo sapiens
tgattgccaaaaaagtgtt

SEQ ID NO: 62765 - DNA, 21 bp, Homo sapiens
tgatttgctggatgaagggct

SEQ ID NO: 62766 - DNA, 20 bp, Homo sapiens
tgatctgctgaaagaggtct

SEQ ID NO: 62767 - DNA, 20 bp, Homo sapiens
tgatttgccggaaagaggct

SEQ ID NO: 62768 - DNA, 19 bp, Homo sapiens
tgatttcccaaaaaaggcc

SEQ ID NO: 62769 - DNA, 21 bp, Homo sapiens
gattgcttaggggcggtttca

SEQ ID NO: 62770 - DNA, 21 bp, Homo sapiens
tgatttgctgaaagtcttttc

SEQ ID NO: 62771 - DNA, 20 bp, Homo sapiens
tgattgccaaaaacatcttc

SEQ ID NO: 62772 - DNA, 20 bp, Homo sapiens
tgatttgctgaggacagtct

SEQ ID NO: 62773 - DNA, 17 bp, Homo sapiens
tgatttgccagcaagtt

SEQ ID NO: 62774 - DNA, 60 bp, African swine fever virus
ggcggggtgggtggaggaatgggtggaggaagtacacccggcttttccgcttcaaccgtt

SEQ ID NO: 62775 - DNA, 19 bp, African swine fever virus
cttttccgcttcaaccgtt

SEQ ID NO: 62776 - DNA, 18 bp, Homo sapiens
cttttccgctccacacat

SEQ ID NO: 62777 - DNA, 18 bp, Homo sapiens
cttttccagtcatccatt

SEQ ID NO: 62778 - DNA, 18 bp, Homo sapiens
ttttccgcttctcctgct

SEQ ID NO: 62779 - DNA, 20 bp, Homo sapiens
cctttcctgttccaatcgtt

SEQ ID NO: 62780 - DNA, 17 bp, Homo sapiens
ctttcccacccactgtt

SEQ ID NO: 62781 - DNA, 16 bp, Homo sapiens
tcttccgcttcccgct

SEQ ID NO: 62782 - DNA, 21 bp, Homo sapiens
ctcttccgccacagcatcgtt

SEQ ID NO: 62783 - DNA, 16 bp, Homo sapiens
ctttcccgcttacgtt

SEQ ID NO: 62784 - DNA, 18 bp, Homo sapiens
ctttcccacccaactgtt

SEQ ID NO: 62785 - DNA, 16 bp, Homo sapiens
ctttcccgctctcgtt

SEQ ID NO: 62786 - DNA, 18 bp, Homo sapiens
ctttttggcccaaccgtt

SEQ ID NO: 62787 - DNA, 16 bp, Homo sapiens
cttctccgctttcgtt

SEQ ID NO: 62788 - DNA, 22 bp, Homo sapiens
cttttccagttttgcaaccgtt

SEQ ID NO: 62789 - DNA, 19 bp, Homo sapiens
ctttcccgcccctctcgtt

SEQ ID NO: 62790 - DNA, 21 bp, Homo sapiens
cttctccgcgaaataactgtt

SEQ ID NO: 62791 - DNA, 16 bp, Homo sapiens
ctcttccactactgtt

SEQ ID NO: 62792 - DNA, 114 bp, Human papillomavirus type 48
cctttcattgtaaatgtatggtttgataatgatgaaagaaattcttttccttatacctgttgggattttatatattatcaagatgaccaaaacaaatggcacaagactgaaggg

SEQ ID NO: 62793 - DNA, 18 bp, Human papillomavirus type 48
tggcacaagactgaaggg

SEQ ID NO: 62794 - DNA, 18 bp, Homo sapiens
tggcacaaaactatttgg

SEQ ID NO: 62795 - DNA, 18 bp, Homo sapiens
tggcaagaccaggaaggg

SEQ ID NO: 62796 - DNA, 15 bp, Homo sapiens
tggcaagaccaaggg

SEQ ID NO: 62797 - DNA, 19 bp, Homo sapiens
tggcacaagggctctgggg

SEQ ID NO: 62798 - DNA, 20 bp, Homo sapiens
agcacaagagggctggaggg

SEQ ID NO: 62799 - DNA, 16 bp, Homo sapiens
tggccaaaaagaaggg

SEQ ID NO: 62800 - DNA, 16 bp, Homo sapiens
tgtcaaagctgaaggg

SEQ ID NO: 62801 - DNA, 15 bp, Homo sapiens
tggcacaagatgggg

SEQ ID NO: 62802 - DNA, 17 bp, Homo sapiens
tgaagaagactgaaggg

SEQ ID NO: 62803 - DNA, 17 bp, Homo sapiens
tggcacaaaaatggggg

SEQ ID NO: 62804 - DNA, 19 bp, Homo sapiens
tggcacaatgaggctgggg

SEQ ID NO: 62805 - DNA, 16 bp, Homo sapiens
tggacaaactgaaagg

SEQ ID NO: 62806 - DNA, 17 bp, Homo sapiens
tggcagtagctgaaggg

SEQ ID NO: 62807 - DNA, 15 bp, Homo sapiens
tggcacaccgaaggg

SEQ ID NO: 62808 - DNA, 17 bp, Homo sapiens
tagctaaaactgaaggg

SEQ ID NO: 62809 - DNA, 17 bp, Homo sapiens
tagccaagactgaaggg

SEQ ID NO: 62810 - DNA, 16 bp, Homo sapiens
tgacacaaatccaggg

SEQ ID NO: 62811 - DNA, 20 bp, Homo sapiens
ggcacaagttgccgtgaggg

SEQ ID NO: 62812 - DNA, 16 bp, Homo sapiens
tggccaagactgaggg

SEQ ID NO: 62813 - DNA, 18 bp, Homo sapiens
tgggacataactgaaggg

SEQ ID NO: 62814 - DNA, 18 bp, Homo sapiens
tggtcaagaactgaaggg

SEQ ID NO: 62815 - DNA, 16 bp, Homo sapiens
tgtacaagactaaggg

SEQ ID NO: 62816 - DNA, 18 bp, Homo sapiens
ggcaccaagactgaaggg

SEQ ID NO: 62817 - DNA, 15 bp, Homo sapiens
tagcacaagccaggg

SEQ ID NO: 62818 - DNA, 17 bp, Homo sapiens
tgacacaagcaccaggg

SEQ ID NO: 62819 - DNA, 20 bp, Homo sapiens
gcacaagagaccctgaaggg

SEQ ID NO: 62820 - DNA, 18 bp, Homo sapiens
tggcacaagccttcaggg

SEQ ID NO: 62821 - DNA, 18 bp, Homo sapiens
tggcaaaggcctgaaggg

SEQ ID NO: 62822 - DNA, 22 bp, Homo sapiens
tggccacacacccactgaaggg

SEQ ID NO: 62823 - DNA, 16 bp, Homo sapiens
tagcatagctgaaggg

SEQ ID NO: 62824 - DNA, 23 bp, Homo sapiens
tggtcctgaagagactgaagggc

SEQ ID NO: 62825 - DNA, 18 bp, Homo sapiens
tggccaaaaggtgagggg

SEQ ID NO: 62826 - DNA, 16 bp, Homo sapiens
cggtacagctgaaggg

SEQ ID NO: 62827 - DNA, 17 bp, Homo sapiens
tggcacaagacaaaggg

SEQ ID NO: 62828 - DNA, 19 bp, Homo sapiens
tgacacaagcctgtgaggg

SEQ ID NO: 62829 - DNA, 17 bp, Homo sapiens
tggcttaagctgaaggg

SEQ ID NO: 62830 - DNA, 17 bp, Homo sapiens
tgacacaaaacccaggg

SEQ ID NO: 62831 - DNA, 19 bp, Homo sapiens
gcacaagagtgccgagggg

SEQ ID NO: 62832 - DNA, 20 bp, Homo sapiens
tggcagcaagcgacctgggg

SEQ ID NO: 62833 - DNA, 15 bp, Homo sapiens
tgaccaactgaaggg

SEQ ID NO: 62834 - DNA, 19 bp, Homo sapiens
tggcacaagatactctagg

SEQ ID NO: 62835 - DNA, 18 bp, Homo sapiens
tggccacaaactaaaggg

SEQ ID NO: 62836 - DNA, 16 bp, Homo sapiens
tggcaaaaaccgaggg

SEQ ID NO: 62837 - DNA, 16 bp, Homo sapiens
tgtcacagctgaaggg

SEQ ID NO: 62838 - DNA, 17 bp, Homo sapiens
tgacacaagctagtggg

SEQ ID NO: 62839 - DNA, 21 bp, Homo sapiens
tagcacaaacctcttgaaggg

SEQ ID NO: 62840 - DNA, 18 bp, Homo sapiens
tgggcaagactagaagag

SEQ ID NO: 62841 - DNA, 18 bp, Homo sapiens
ggcacaagaaggagaggg

SEQ ID NO: 62842 - DNA, 18 bp, Homo sapiens
tggcacaatgcaccgggg

SEQ ID NO: 62843 - DNA, 19 bp, Homo sapiens
tggcacaagtagttgaggg

SEQ ID NO: 62844 - DNA, 15 bp, Homo sapiens
tgacacaaacaaggg

SEQ ID NO: 62845 - DNA, 18 bp, Homo sapiens
ggaacgcagactgaaggg

SEQ ID NO: 62846 - DNA, 16 bp, Homo sapiens
tggccaaaagaaaggg

SEQ ID NO: 62847 - DNA, 15 bp, Homo sapiens
tggcacaaaagaggg

SEQ ID NO: 62848 - DNA, 15 bp, Homo sapiens
tagcacactgaaggg

SEQ ID NO: 62849 - DNA, 18 bp, Homo sapiens
tgtgcaaaactggaaggg

SEQ ID NO: 62850 - DNA, 20 bp, Homo sapiens
tggtagaccaaactgagggg

SEQ ID NO: 62851 - DNA, 16 bp, Homo sapiens
tggcacaaaaatgggg

SEQ ID NO: 62852 - DNA, 19 bp, Homo sapiens
tggcacaagccacaaaggg

SEQ ID NO: 62853 - DNA, 19 bp, Homo sapiens
tggcaaaactggccgaggg

SEQ ID NO: 62854 - DNA, 19 bp, Homo sapiens
ggcacaagctgtgggaggg

SEQ ID NO: 62855 - DNA, 19 bp, Homo sapiens
tggcacaaactccaaaagg

SEQ ID NO: 62856 - DNA, 18 bp, Homo sapiens
tggcacaaggaccccagg

SEQ ID NO: 62857 - DNA, 18 bp, Homo sapiens
ggctgcaaggctgaaggg

SEQ ID NO: 62858 - DNA, 19 bp, Homo sapiens
tggcacaaggctgagcagg

SEQ ID NO: 62859 - DNA, 20 bp, Homo sapiens
tggcacaacgtgaaaaaggg

SEQ ID NO: 62860 - DNA, 71 bp, Rabbit fibroma virus
gggatactgttcgcttttttctttcgtgtctgtttatcttatagatcgtgccgaggaagtagcagtatttc

SEQ ID NO: 62861 - DNA, 24 bp, Rabbit fibroma virus
tactgttcgcttttttctttcgtg

SEQ ID NO: 62862 - DNA, 20 bp, Homo sapiens
tgttggctttttcttttgtg

SEQ ID NO: 62863 - DNA, 19 bp, Homo sapiens
ctgtttgtttttttcctcc

SEQ ID NO: 62864 - DNA, 21 bp, Homo sapiens
tgttcactgcttttttttgtg

SEQ ID NO: 62865 - DNA, 18 bp, Homo sapiens
tgtttgctttcttttcca

SEQ ID NO: 62866 - DNA, 23 bp, Homo sapiens
ctgtttgctgatgaacttttgtg

SEQ ID NO: 62867 - DNA, 100 bp, Perina nuda picorna-like virus
ccttacacatgtgattacatgatagacttattagtagtagatacatctaaattctacaacgacctagtaagtattagttatgtgaaatagaatgtggagg

SEQ ID NO: 62868 - DNA, 24 bp, Perina nuda picorna-like virus
tacatgatagacttattagtagta

SEQ ID NO: 62869 - DNA, 19 bp, Homo sapiens
tgaatatttattagtagta

SEQ ID NO: 62870 - DNA, 20 bp, Homo sapiens
acatgataggttttaccggt

SEQ ID NO: 62871 - DNA, 18 bp, Homo sapiens
atgatagacttataagta

SEQ ID NO: 62872 - DNA, 20 bp, Homo sapiens
acagggtcacattagtagta

SEQ ID NO: 62873 - DNA, 17 bp, Homo sapiens
tgatagaaataagtagt

SEQ ID NO: 62874 - DNA, 71 bp, Camelpox virus
tttatgcttgcattattaatggtatgtaatatgattgattgtgtacacaataccaatttgtcaagtatgaa

SEQ ID NO: 62875 - DNA, 24 bp, Camelpox virus
tacacaataccaatttgtcaagta

SEQ ID NO: 62876 - DNA, 18 bp, Homo sapiens
tacacaacactggcaagt

SEQ ID NO: 62877 - DNA, 18 bp, Homo sapiens
acacaatactattcaagt

SEQ ID NO: 62878 - DNA, 19 bp, Homo sapiens
tacacatgtattgtcaagt

SEQ ID NO: 62879 - DNA, 22 bp, Homo sapiens
cacagtgtctctttgtcaagta

SEQ ID NO: 62880 - DNA, 16 bp, Homo sapiens
caacagcctgtcaagt

SEQ ID NO: 62881 - DNA, 23 bp, Homo sapiens
tacacaatgaccccagtcaggta

SEQ ID NO: 62882 - DNA, 21 bp, Homo sapiens
aataccaataaaacacaagta

SEQ ID NO: 62883 - DNA, 22 bp, Homo sapiens
acaatgccaactcaacacagta

SEQ ID NO: 62884 - DNA, 22 bp, Homo sapiens
tacacagtacaacttgtaagta

SEQ ID NO: 62885 - DNA, 22 bp, Homo sapiens
tacagaattacaaagtcaagta

SEQ ID NO: 62886 - DNA, 25 bp, Homo sapiens
tacacaatataattccatttcgagt

SEQ ID NO: 62887 - DNA, 20 bp, Homo sapiens
cacaatgtattggtcaagta

SEQ ID NO: 62888 - DNA, 76 bp, Murine hepatitis virus
tggccccgtaagaggcagtcatagctatggccgtgttggtcctaaggctacattggctgctgtctttattggtcca

SEQ ID NO: 62889 - DNA, 24 bp, Murine hepatitis virus
ctaaggctacattggctgctgtct

SEQ ID NO: 62890 - DNA, 20 bp, Homo sapiens
ggctgctttgtctgctgtct

SEQ ID NO: 62891 - DNA, 23 bp, Homo sapiens
taaaggctacatataaatgttgt

SEQ ID NO: 62892 - DNA, 23 bp, Homo sapiens
aggctgctgccaggctgctgtct

SEQ ID NO: 62893 - DNA, 17 bp, Homo sapiens
ggctgcctgtgctgtct

SEQ ID NO: 62894 - DNA, 20 bp, Homo sapiens
ggctgtgtctgatactgtct

SEQ ID NO: 62895 - DNA, 20 bp, Homo sapiens
agctacattggaaagcctct

SEQ ID NO: 62896 - DNA, 21 bp, Homo sapiens
taaggctatttttaaagctgt

SEQ ID NO: 62897 - DNA, 22 bp, Homo sapiens
aggctgcaagcccttgctgtct

SEQ ID NO: 62898 - DNA, 20 bp, Homo sapiens
aggctacagaaaggttgtct

SEQ ID NO: 62899 - DNA, 18 bp, Homo sapiens
ctgaggttacattgagcc

SEQ ID NO: 62900 - DNA, 17 bp, Homo sapiens
agggttggctgctgtct

SEQ ID NO: 62901 - DNA, 21 bp, Homo sapiens
tagagctacataatcttgtct

SEQ ID NO: 62902 - DNA, 15 bp, Homo sapiens
ggctacatggcatcc

SEQ ID NO: 62903 - DNA, 20 bp, Homo sapiens
taagatttttgttgctgtct

SEQ ID NO: 62904 - DNA, 16 bp, Homo sapiens
ctaagcctgctgctgt

SEQ ID NO: 62905 - DNA, 20 bp, Homo sapiens
ggggtgcaatggtgctgtct

SEQ ID NO: 62906 - DNA, 19 bp, Homo sapiens
ctacaggcaggctgctgtc

SEQ ID NO: 62907 - DNA, 21 bp, Homo sapiens
ctgaagctaatcctgctgtct

SEQ ID NO: 62908 - DNA, 20 bp, Homo sapiens
gggttgtttgactgctgtct

SEQ ID NO: 62909 - DNA, 21 bp, Homo sapiens
ctaaggctgttcattctgtct

SEQ ID NO: 62910 - DNA, 18 bp, Homo sapiens
taaggcatgactgctgtc

SEQ ID NO: 62911 - DNA, 22 bp, Homo sapiens
ctgaggctacaatggttcaacc

SEQ ID NO: 62912 - DNA, 20 bp, Homo sapiens
ctagcggctgctgctgctgt

SEQ ID NO: 62913 - DNA, 19 bp, Homo sapiens
ggctgccaatatgctgtct

SEQ ID NO: 62914 - DNA, 19 bp, Homo sapiens
caaggttgtaactgctgtc

SEQ ID NO: 62915 - DNA, 19 bp, Homo sapiens
gggggtttggctgctgtct

SEQ ID NO: 62916 - DNA, 18 bp, Homo sapiens
gctgcattgatgctgtct

SEQ ID NO: 62917 - DNA, 18 bp, Homo sapiens
gctgcattgacgctgtct

SEQ ID NO: 62918 - DNA, 19 bp, Homo sapiens
aggctacaatagcatgtct

SEQ ID NO: 62919 - DNA, 19 bp, Homo sapiens
ggctcattggttgctgtct

SEQ ID NO: 62920 - DNA, 18 bp, Homo sapiens
ggcttgaaactgctgtct

SEQ ID NO: 62921 - DNA, 22 bp, Homo sapiens
ctagggcagttgtgtgctgtct

SEQ ID NO: 62922 - DNA, 19 bp, Homo sapiens
ccaaggctgtagatgctgt

SEQ ID NO: 62923 - DNA, 20 bp, Homo sapiens
ggggtcaagaactgctgtct

SEQ ID NO: 62924 - DNA, 62 bp, Paramecium bursaria Chlorella virus 1
gggaaatttgttcaacgcatttttcaatttcacgcaattggaatcgtcacgcagatgctctc

SEQ ID NO: 62925 - DNA, 24 bp, Paramecium bursaria Chlorella virus 1
tggaatcgtcacgcagatgctctc

SEQ ID NO: 62926 - DNA, 21 bp, Homo sapiens
tggtgttcacatgcagatgct

SEQ ID NO: 62927 - DNA, 19 bp, Homo sapiens
ggccgccgcagatgttctc

SEQ ID NO: 62928 - DNA, 21 bp, Homo sapiens
tggaatcgtcatgtttgagct

SEQ ID NO: 62929 - DNA, 18 bp, Homo sapiens
tggaatcatcatgtcaga

SEQ ID NO: 62930 - DNA, 21 bp, Homo sapiens
tggagtcttggaagatgctct

SEQ ID NO: 62931 - DNA, 21 bp, Homo sapiens
ggaatcgttgtgcagcatctc

SEQ ID NO: 62932 - DNA, 21 bp, Homo sapiens
tggatcaggtttggatgctct

SEQ ID NO: 62933 - DNA, 18 bp, Homo sapiens
tgtgatcatccagatgct

SEQ ID NO: 62934 - DNA, 19 bp, Homo sapiens
tggaattgtacgtggccct

SEQ ID NO: 62935 - DNA, 21 bp, Homo sapiens
tgggatcgtcaccaagcgctc

SEQ ID NO: 62936 - DNA, 16 bp, Homo sapiens
tggatcacagatgctc

SEQ ID NO: 62937 - DNA, 16 bp, Homo sapiens
tggaatcgttgctgtc

SEQ ID NO: 62938 - DNA, 61 bp, Reston Ebola virus
gattcatctacaaaaactaatccattataacttattagtgctacttttctataagtgattc

SEQ ID NO: 62939 - DNA, 24 bp, Reston Ebola virus
ttcatctacaaaaactaatccatt

SEQ ID NO: 62940 - DNA, 19 bp, Homo sapiens
tacaaaaaaaaaatccatt

SEQ ID NO: 62941 - DNA, 18 bp, Homo sapiens
ttcatcacaaaaagtaac

SEQ ID NO: 62942 - DNA, 22 bp, Homo sapiens
tcatctacagaactaattcatt

SEQ ID NO: 62943 - DNA, 18 bp, Homo sapiens
ttctctacaaagacaatc

SEQ ID NO: 62944 - DNA, 24 bp, Homo sapiens
ttcatccatgaggccacttccatt

SEQ ID NO: 62945 - DNA, 21 bp, Homo sapiens
atctaaaaaaaaaaatccatt

SEQ ID NO: 62946 - DNA, 130 bp, Reston Ebola virus
ttgatttgaacatagtcataaggggataaataatactttatatttctgattgtggattgacccattctgcttaaaatgcttcgcccattgaaaatgtgatctaatagatagccctgactagacaaattaa

SEQ ID NO: 62947 - DNA, 24 bp, Reston Ebola virus
tctaatagatagccctgactagac

SEQ ID NO: 62948 - DNA, 23 bp, Homo sapiens
tctgacagacatttctgactaga

SEQ ID NO: 62949 - DNA, 19 bp, Homo sapiens
caatagatagataattaga

SEQ ID NO: 62950 - DNA, 21 bp, Homo sapiens
taataggaagaaatgactaga

SEQ ID NO: 62951 - DNA, 19 bp, Homo sapiens
tctgatagatagcattcct

SEQ ID NO: 62952 - DNA, 70 bp, Equine herpesvirus 2
tccagaaagctctccagaccattttactgtttatacacaaacagtatacaagtcattttatgaatctgga

SEQ ID NO: 62953 - DNA, 24 bp, Equine herpesvirus 2
acagtatacaagtcattttatgaa

SEQ ID NO: 62954 - DNA, 22 bp, Homo sapiens
acagaatacaagtgagctgtga

SEQ ID NO: 62955 - DNA, 18 bp, Homo sapiens
acagtaagcaagtcatct

SEQ ID NO: 62956 - DNA, 24 bp, Homo sapiens
acaatgtacattacattttatgaa

SEQ ID NO: 62957 - DNA, 20 bp, Homo sapiens
cagtatacattatttatgaa

SEQ ID NO: 62958 - DNA, 20 bp, Homo sapiens
acagtattataatcttatga

SEQ ID NO: 62959 - DNA, 18 bp, Homo sapiens
agtattcaagtttcatga

SEQ ID NO: 62960 - DNA, 20 bp, Homo sapiens
acagaacacttcattttgtg

SEQ ID NO: 62961 - DNA, 17 bp, Homo sapiens
agtctacaagtccatga

SEQ ID NO: 62962 - DNA, 18 bp, Homo sapiens
agtgtacaaatcagcatg

SEQ ID NO: 62963 - DNA, 21 bp, Homo sapiens
acagtttacaagtcacacctg

SEQ ID NO: 62964 - DNA, 19 bp, Homo sapiens
atatacaaccaattatgaa

SEQ ID NO: 62965 - DNA, 21 bp, Homo sapiens
cagtatgcatgtatttatgaa

SEQ ID NO: 62966 - DNA, 19 bp, Homo sapiens
acagtattgtaatcttatg

SEQ ID NO: 62967 - DNA, 21 bp, Homo sapiens
gtatgcaaagcattttatgaa

SEQ ID NO: 62968 - DNA, 19 bp, Homo sapiens
acagtatatagtctatatg

SEQ ID NO: 62969 - DNA, 19 bp, Homo sapiens
atatacaaatacttatgaa

SEQ ID NO: 62970 - DNA, 60 bp, Human herpesvirus 5
gcttttcgtctctccaaggaacactgggtccgctgaaagggaccgtgtaccgaccaaagc

SEQ ID NO: 62971 - DNA, 24 bp, Human herpesvirus 5
caaggaacactgggtccgctgaaa

SEQ ID NO: 62972 - DNA, 20 bp, Homo sapiens
ggaacaccgggaaagtgaaa

SEQ ID NO: 62973 - DNA, 16 bp, Homo sapiens
aaggagcactggactg

SEQ ID NO: 62974 - DNA, 19 bp, Homo sapiens
ggaggactgggccatggaa

SEQ ID NO: 62975 - DNA, 19 bp, Homo sapiens
tgaggaaactgtggctgaa

SEQ ID NO: 62976 - DNA, 19 bp, Homo sapiens
aggggacgctgagtccctg

SEQ ID NO: 62977 - DNA, 20 bp, Homo sapiens
cagggagcactgagccactg

SEQ ID NO: 62978 - DNA, 18 bp, Homo sapiens
aagggcactgggcggcga

SEQ ID NO: 62979 - DNA, 17 bp, Homo sapiens
tgaggaacacgtgctga

SEQ ID NO: 62980 - DNA, 21 bp, Homo sapiens
caagggctatttcccaagctg

SEQ ID NO: 62981 - DNA, 19 bp, Homo sapiens
ggacactgcagagactgaa

SEQ ID NO: 62982 - DNA, 21 bp, Homo sapiens
aagaacactgggtcctcggaa

SEQ ID NO: 62983 - DNA, 17 bp, Homo sapiens
tgagagcaccccgctga

SEQ ID NO: 62984 - DNA, 23 bp, Homo sapiens
tgaggggcactgggtccaccaaa

SEQ ID NO: 62985 - DNA, 24 bp, Homo sapiens
tgaggagacaggctttcgctgaaa

SEQ ID NO: 62986 - DNA, 23 bp, Homo sapiens
caaggaacctctggattgctgaa

SEQ ID NO: 62987 - DNA, 21 bp, Homo sapiens
tgaggaacggtgggcagctga

SEQ ID NO: 62988 - DNA, 16 bp, Homo sapiens
aggaacactgccttga

SEQ ID NO: 62989 - DNA, 19 bp, Homo sapiens
gagcagctgcatccgctga

SEQ ID NO: 62990 - DNA, 19 bp, Homo sapiens
aaggggacagacccgctga

SEQ ID NO: 62991 - DNA, 19 bp, Homo sapiens
ggcacactgagggagctga

SEQ ID NO: 62992 - DNA, 17 bp, Homo sapiens
ggaactgggtcccctga

SEQ ID NO: 62993 - DNA, 19 bp, Homo sapiens
ggaggaacactgggtgcca

SEQ ID NO: 62994 - DNA, 19 bp, Homo sapiens
ggagcactggatcctggga

SEQ ID NO: 62995 - DNA, 19 bp, Homo sapiens
caagggacactgagaactg

SEQ ID NO: 62996 - DNA, 23 bp, Homo sapiens
aagaacactgggtaacatgtgaa

SEQ ID NO: 62997 - DNA, 22 bp, Homo sapiens
tgagaaatgctgggtccacaga

SEQ ID NO: 62998 - DNA, 19 bp, Homo sapiens
aggaacactgacccctgaa

SEQ ID NO: 62999 - DNA, 20 bp, Homo sapiens
caaggaacatgcacactgaa

SEQ ID NO: 63000 - DNA, 20 bp, Homo sapiens
tgagggggctgggtcctgct

SEQ ID NO: 63001 - DNA, 21 bp, Homo sapiens
caagggcactggacagtgtga

SEQ ID NO: 63002 - DNA, 23 bp, Homo sapiens
cagagagcactggacaaactgaa

SEQ ID NO: 63003 - DNA, 20 bp, Homo sapiens
agtgaacactgaagatctga

SEQ ID NO: 63004 - DNA, 19 bp, Homo sapiens
aggaaacactgttctctga

SEQ ID NO: 63005 - DNA, 17 bp, Homo sapiens
tgaggaggtgtccgctg

SEQ ID NO: 63006 - DNA, 17 bp, Homo sapiens
ggcacactgggcatgaa

SEQ ID NO: 63007 - DNA, 20 bp, Homo sapiens
aggaagcgctgggtttacca

SEQ ID NO: 63008 - DNA, 20 bp, Homo sapiens
agggacactgagtgactctg

SEQ ID NO: 63009 - DNA, 18 bp, Homo sapiens
aaggaacacgtcctggga

SEQ ID NO: 63010 - DNA, 21 bp, Homo sapiens
caaggaacctgtaggacttga

SEQ ID NO: 63011 - DNA, 21 bp, Homo sapiens
caaggaacttgccatctgctg

SEQ ID NO: 63012 - DNA, 21 bp, Homo sapiens
aggaacacacaggccgttgaa

SEQ ID NO: 63013 - DNA, 18 bp, Homo sapiens
ggagacagagccgctgaa

SEQ ID NO: 63014 - DNA, 18 bp, Homo sapiens
ggatgctgggccgcatga

SEQ ID NO: 63015 - DNA, 23 bp, Homo sapiens
caaggaacacatgggcactgaaa

SEQ ID NO: 63016 - DNA, 19 bp, Homo sapiens
aaggggacactgggccacc

SEQ ID NO: 63017 - DNA, 21 bp, Homo sapiens
caaggacgctgcttcaggctg

SEQ ID NO: 63018 - DNA, 18 bp, Homo sapiens
agagaacaagccgctgaa

SEQ ID NO: 63019 - DNA, 24 bp, Homo sapiens
aggggacactgaggttttctgaaa

SEQ ID NO: 63020 - DNA, 20 bp, Homo sapiens
caaagaacactgggagtgaa

SEQ ID NO: 63021 - DNA, 18 bp, Homo sapiens
aaggatactgggtctctg

SEQ ID NO: 63022 - DNA, 61 bp, Fusarium poae virus 1
tatgctactattgatgtacaatttgacacacgcttcattatgaactacatcctgtaccatg

SEQ ID NO: 63023 - DNA, 24 bp, Fusarium poae virus 1
tactattgatgtacaatttgacac

SEQ ID NO: 63024 - DNA, 21 bp, Homo sapiens
ctaattacagtcaatttgaca

SEQ ID NO: 63025 - DNA, 17 bp, Homo sapiens
tattgatgtgcagtgac

SEQ ID NO: 63026 - DNA, 23 bp, Homo sapiens
tactttgctctctaatttgacac

SEQ ID NO: 63027 - DNA, 22 bp, Homo sapiens
cactgtaactataatttgacac

SEQ ID NO: 63028 - DNA, 21 bp, Homo sapiens
tactactggtgtgcagctgac

SEQ ID NO: 63029 - DNA, 21 bp, Homo sapiens
tactattgaagtagacattga

SEQ ID NO: 63030 - DNA, 18 bp, Homo sapiens
tactattgtgtatacttg

SEQ ID NO: 63031 - DNA, 22 bp, Homo sapiens
tactgatgatcattctttgaca

SEQ ID NO: 63032 - DNA, 21 bp, Homo sapiens
tactattgtgtacttggaaca

SEQ ID NO: 63033 - DNA, 19 bp, Homo sapiens
tacattgacatgtttgaca

SEQ ID NO: 63034 - DNA, 20 bp, Homo sapiens
tattgatgtagaacttgaca

SEQ ID NO: 63035 - DNA, 64 bp, Human herpesvirus 1
ggccgtctggttcgaggatatgacccccgccgagctggaggttgtcttcccgactacggacgcc

SEQ ID NO: 63036 - DNA, 24 bp, Human herpesvirus 1
gaggatatgacccccgccgagctg

SEQ ID NO: 63037 - DNA, 23 bp, Homo sapiens
gacgatagccccccgccgggctg

SEQ ID NO: 63038 - DNA, 23 bp, Homo sapiens
ggcgcccgcctcccgccgagctg

SEQ ID NO: 63039 - DNA, 23 bp, Homo sapiens
agaccaaggtccccgccgggctg

SEQ ID NO: 63040 - DNA, 21 bp, Homo sapiens
gaggatacgactcaaaagctg

SEQ ID NO: 63041 - DNA, 18 bp, Homo sapiens
gaggatgaggcccaagct

SEQ ID NO: 63042 - DNA, 23 bp, Homo sapiens
gaggatatggattttgggagctg

SEQ ID NO: 63043 - DNA, 19 bp, Homo sapiens
gagggtggggcccacggct

SEQ ID NO: 63044 - DNA, 22 bp, Homo sapiens
ggggaactgttctgccgagctg

SEQ ID NO: 63045 - DNA, 17 bp, Homo sapiens
ggggatgacccccaact

SEQ ID NO: 63046 - DNA, 21 bp, Homo sapiens
gaggtgtgggaacccgagctg

SEQ ID NO: 63047 - DNA, 22 bp, Homo sapiens
gaggctgtgatccccaccactg

SEQ ID NO: 63048 - DNA, 102 bp, Cowpea severe mosaic virus
tctaaacagttggcgttaacgcttatgcatacattcagattttatgtgctttattgcatgtacgaatgtacagcatttgctgttgtaacgggctagtttaga

SEQ ID NO: 63049 - DNA, 24 bp, Cowpea severe mosaic virus
tacagcatttgctgttgtaacggg

SEQ ID NO: 63050 - DNA, 21 bp, Homo sapiens
cagcatttgtgagggggcggg

SEQ ID NO: 63051 - DNA, 16 bp, Homo sapiens
cagcatttgccacagg

SEQ ID NO: 63052 - DNA, 18 bp, Homo sapiens
tacagtatttgctgctgt

SEQ ID NO: 63053 - DNA, 19 bp, Homo sapiens
gcatttgctgggatatggg

SEQ ID NO: 63054 - DNA, 16 bp, Homo sapiens
cagcatttctgtgcgg

SEQ ID NO: 63055 - DNA, 21 bp, Homo sapiens
gcacttgcttgttgtggtggg

SEQ ID NO: 63056 - DNA, 19 bp, Homo sapiens
agcatttgttgtacctggg

SEQ ID NO: 63057 - DNA, 21 bp, Homo sapiens
tacagcattgtacatgacggg

SEQ ID NO: 63058 - DNA, 23 bp, Homo sapiens
tacagcatttagttctcagtggg

SEQ ID NO: 63059 - DNA, 25 bp, Homo sapiens
taagtatttgctgttttttaatggg

SEQ ID NO: 63060 - DNA, 22 bp, Homo sapiens
acagcatttgtgcagtgatggg

SEQ ID NO: 63061 - DNA, 19 bp, Homo sapiens
cagcagatgttgtaatggg

SEQ ID NO: 63062 - DNA, 18 bp, Homo sapiens
agcatttgctatgatggg

SEQ ID NO: 63063 - DNA, 21 bp, Homo sapiens
tacagcatttaccaaggcggg

SEQ ID NO: 63064 - DNA, 77 bp, Camelpox virus
aatgacctatatgttaatactcgattgatattgatattgatattgatattgataattagtgtatattatatttcatt

SEQ ID NO: 63065 - DNA, 24 bp, Camelpox virus
taatactcgattgatattgatatt

SEQ ID NO: 63066 - DNA, 22 bp, Homo sapiens
aatactcttaattattgatatt

SEQ ID NO: 63067 - DNA, 95 bp, Camelpox virus
atgtctatccagtatatgcgagtaagtcttatcttgtcattggtttacattgatcagagtcagatacaatatctgtataagtacccttccgacat

SEQ ID NO: 63068 - DNA, 24 bp, Camelpox virus
tacaatatctgtataagtaccctt

SEQ ID NO: 63069 - DNA, 17 bp, Homo sapiens
tatctgtagctgccctt

SEQ ID NO: 63070 - DNA, 19 bp, Homo sapiens
tacggtatctgcataagta

SEQ ID NO: 63071 - DNA, 17 bp, Homo sapiens
tacaatactgtaccagt

SEQ ID NO: 63072 - DNA, 20 bp, Homo sapiens
aatatctgttacccaccctt

SEQ ID NO: 63073 - DNA, 18 bp, Homo sapiens
cacaataataagtactct

SEQ ID NO: 63074 - DNA, 19 bp, Homo sapiens
tacaatatctctatgaagt

SEQ ID NO: 63075 - DNA, 20 bp, Homo sapiens
caaaaaatgtgagtaccctt

SEQ ID NO: 63076 - DNA, 18 bp, Homo sapiens
caatggtataagtaccct

SEQ ID NO: 63077 - DNA, 69 bp, Human immunodeficiency virus 1
gtactgggtctctctggttagaccagatctgagcctgggagctctctggctaactagggaacccactgc

SEQ ID NO: 63078 - DNA, 24 bp, Human immunodeficiency virus 1
tctctggttagaccagatctgagc

SEQ ID NO: 63079 - DNA, 20 bp, Homo sapiens
cctctgtccctggatctgag

SEQ ID NO: 63080 - DNA, 18 bp, Homo sapiens
ctcttgatcagatctgag

SEQ ID NO: 63081 - DNA, 19 bp, Homo sapiens
tctggttagattctagagc

SEQ ID NO: 63082 - DNA, 20 bp, Homo sapiens
tctggttaacaactctgagc

SEQ ID NO: 63083 - DNA, 19 bp, Homo sapiens
tctctgattcaggtctgag

SEQ ID NO: 63084 - DNA, 23 bp, Homo sapiens
tctctggtcgggcgtgcctgggc

SEQ ID NO: 63085 - DNA, 22 bp, Homo sapiens
ctgcaagggaccagatctgggc

SEQ ID NO: 63086 - DNA, 20 bp, Homo sapiens
tctctggtggatcacttgag

SEQ ID NO: 63087 - DNA, 22 bp, Homo sapiens
tcttgtgcttttcagatctgag

SEQ ID NO: 63088 - DNA, 18 bp, Homo sapiens
ctttcagaaccagatttg

SEQ ID NO: 63089 - DNA, 22 bp, Homo sapiens
tctatctcaaaccaggtctgag

SEQ ID NO: 63090 - DNA, 22 bp, Homo sapiens
tcttgaagcatcagatctgagc

SEQ ID NO: 63091 - DNA, 20 bp, Homo sapiens
tctctggttgggatggggag

SEQ ID NO: 63092 - DNA, 26 bp, Homo sapiens
tctctgatgtttaaccagatctgagc

SEQ ID NO: 63093 - DNA, 22 bp, Homo sapiens
tccctggcacatggatctgagc

SEQ ID NO: 63094 - DNA, 18 bp, Homo sapiens
tctctggtgggatttgag

SEQ ID NO: 63095 - DNA, 19 bp, Homo sapiens
tcttggtcaagatctgagc

SEQ ID NO: 63096 - DNA, 61 bp, Human immunodeficiency virus 2
cacgcttgcttgcttaaagacctcttcaataaagctgccagttagaagcaagttaagtgtg

SEQ ID NO: 63097 - DNA, 24 bp, Human immunodeficiency virus 2
aagctgccagttagaagcaagtta

SEQ ID NO: 63098 - DNA, 20 bp, Homo sapiens
agtctgtcagccagcaagtt

SEQ ID NO: 63099 - DNA, 21 bp, Homo sapiens
aagtctggagagaagcaagtt

SEQ ID NO: 63100 - DNA, 23 bp, Homo sapiens
aactgggcatttagaagcaagtt

SEQ ID NO: 63101 - DNA, 23 bp, Homo sapiens
aagttgccagttctgcataagtt

SEQ ID NO: 63102 - DNA, 27 bp, Homo sapiens
aagcagccagaacttggaagtaagtta

SEQ ID NO: 63103 - DNA, 21 bp, Homo sapiens
aagctgtcccagagcaagtta

SEQ ID NO: 63104 - DNA, 23 bp, Homo sapiens
aagctgatggaaaggagcaagtt

SEQ ID NO: 63105 - DNA, 19 bp, Homo sapiens
aagcttccagttaacagtt

SEQ ID NO: 63106 - DNA, 21 bp, Homo sapiens
ctgttggttagaagcaggtta

SEQ ID NO: 63107 - DNA, 18 bp, Homo sapiens
agcttgccagttaggaag

SEQ ID NO: 63108 - DNA, 19 bp, Homo sapiens
agctccagttagaaaagtt

SEQ ID NO: 63109 - DNA, 20 bp, Homo sapiens
agctgccatcacagtgagtt

SEQ ID NO: 63110 - DNA, 19 bp, Homo sapiens
aagctgccagataggaagc

SEQ ID NO: 63111 - DNA, 23 bp, Homo sapiens
agctatcagttgcaaacaagtta

SEQ ID NO: 63112 - DNA, 20 bp, Homo sapiens
actgctgaatgagcaagtta

SEQ ID NO: 63113 - DNA, 19 bp, Homo sapiens
agctgctgttggaagcaaa

SEQ ID NO: 63114 - DNA, 20 bp, Homo sapiens
aagctgccgtgggcaagtta

SEQ ID NO: 63115 - DNA, 18 bp, Homo sapiens
aagctgacaaagcaagtt

SEQ ID NO: 63116 - DNA, 23 bp, Homo sapiens
aagctgtcattagaaatcgagtt

SEQ ID NO: 63117 - DNA, 21 bp, Homo sapiens
aagtgcaacagaagcaagtta

SEQ ID NO: 63118 - DNA, 18 bp, Homo sapiens
aacctgcagaagcaggtt

SEQ ID NO: 63119 - DNA, 18 bp, Homo sapiens
aaactgccatggcaggtt

SEQ ID NO: 63120 - DNA, 21 bp, Homo sapiens
gctgatatgtaaggcaagtta

SEQ ID NO: 63121 - DNA, 19 bp, Homo sapiens
agctgccacttgggagcaa

SEQ ID NO: 63122 - DNA, 18 bp, Homo sapiens
gcgtgccagcagcaagtt

SEQ ID NO: 63123 - DNA, 19 bp, Homo sapiens
gctgccagtattgcagtta

SEQ ID NO: 63124 - DNA, 24 bp, Homo sapiens
aagttgcccgaagatagcaggtta

SEQ ID NO: 63125 - DNA, 20 bp, Homo sapiens
aagctgccagttgcaaagtc

SEQ ID NO: 63126 - DNA, 21 bp, Homo sapiens
gcctactctagaggcaagtta

SEQ ID NO: 63127 - DNA, 18 bp, Homo sapiens
aagctgcccagtcaagtt

SEQ ID NO: 63128 - DNA, 63 bp, Human immunodeficiency virus 2
gctctgcggagaggctggcagatcgagccctgagaggttctctccagcactagcaggtagagc

SEQ ID NO: 63129 - DNA, 24 bp, Human immunodeficiency virus 2
agaggctggcagatcgagccctga

SEQ ID NO: 63130 - DNA, 21 bp, Homo sapiens
aaggctggcagatcagttctg

SEQ ID NO: 63131 - DNA, 18 bp, Homo sapiens
gaagctggcggcctcctg

SEQ ID NO: 63132 - DNA, 19 bp, Homo sapiens
gaggctggggaggcccctg

SEQ ID NO: 63133 - DNA, 18 bp, Homo sapiens
gaggtgggttcagccctg

SEQ ID NO: 63134 - DNA, 22 bp, Homo sapiens
aggggctggcagtccagcttga

SEQ ID NO: 63135 - DNA, 21 bp, Homo sapiens
agctggcagtccaacgtcctg

SEQ ID NO: 63136 - DNA, 20 bp, Homo sapiens
aggtgctggcagcagccctg

SEQ ID NO: 63137 - DNA, 22 bp, Homo sapiens
agaggctgcagatgacagctga

SEQ ID NO: 63138 - DNA, 15 bp, Homo sapiens
agaggctggagccct

SEQ ID NO: 63139 - DNA, 20 bp, Homo sapiens
agaggctggtgaaccgtctg

SEQ ID NO: 63140 - DNA, 17 bp, Homo sapiens
ggctgggcaggctcctg

SEQ ID NO: 63141 - DNA, 20 bp, Homo sapiens
agctggcaacccagttttga

SEQ ID NO: 63142 - DNA, 26 bp, Homo sapiens
gaggctgggtgccagccgagctctga

SEQ ID NO: 63143 - DNA, 15 bp, Homo sapiens
gctggcagatccctg

SEQ ID NO: 63144 - DNA, 19 bp, Homo sapiens
agaggctgccccagccctg

SEQ ID NO: 63145 - DNA, 21 bp, Homo sapiens
aggggctgggcctaggtcctg

SEQ ID NO: 63146 - DNA, 19 bp, Homo sapiens
aaggctggcaggttcactg

SEQ ID NO: 63147 - DNA, 16 bp, Homo sapiens
aggggctggcaggcct

SEQ ID NO: 63148 - DNA, 23 bp, Homo sapiens
gaggctgggaatccgagttctga

SEQ ID NO: 63149 - DNA, 16 bp, Homo sapiens
ggctggcagtgccctg

SEQ ID NO: 63150 - DNA, 19 bp, Homo sapiens
aaaggctggcccagccttg

SEQ ID NO: 63151 - DNA, 17 bp, Homo sapiens
gaggctggccaggcccc

SEQ ID NO: 63152 - DNA, 23 bp, Homo sapiens
gaggctgggcataggcagctctg

SEQ ID NO: 63153 - DNA, 21 bp, Homo sapiens
agaggctgctccacagccctg

SEQ ID NO: 63154 - DNA, 23 bp, Homo sapiens
gaggctggtctctgtggccctga

SEQ ID NO: 63155 - DNA, 16 bp, Homo sapiens
agggctggcagggcct

SEQ ID NO: 63156 - DNA, 21 bp, Homo sapiens
gaggccggcggcgcggtcctg

SEQ ID NO: 63157 - DNA, 21 bp, Homo sapiens
gaggctggcaggctccacctg

SEQ ID NO: 63158 - DNA, 17 bp, Homo sapiens
gaggctggtgaagcctg

SEQ ID NO: 63159 - DNA, 19 bp, Homo sapiens
aggggcggcagcagtcctg

SEQ ID NO: 63160 - DNA, 19 bp, Homo sapiens
gaggatcgctcgagtcctg

SEQ ID NO: 63161 - DNA, 21 bp, Homo sapiens
gaggctggagctcttgccctg

SEQ ID NO: 63162 - DNA, 18 bp, Homo sapiens
gctggtctctgagccctg

SEQ ID NO: 63163 - DNA, 18 bp, Homo sapiens
ggctggtgacaagctctg

SEQ ID NO: 63164 - DNA, 16 bp, Homo sapiens
agaggctggaggccct

SEQ ID NO: 63165 - DNA, 19 bp, Homo sapiens
aggggctggcagcctcctg

SEQ ID NO: 63166 - DNA, 23 bp, Homo sapiens
gaggctggccaggggcttcctga

SEQ ID NO: 63167 - DNA, 21 bp, Homo sapiens
gagactggaaaacgagccctg

SEQ ID NO: 63168 - DNA, 22 bp, Homo sapiens
agaggctgagtctgagccctga

SEQ ID NO: 63169 - DNA, 18 bp, Homo sapiens
aaggctggtggaggcctg

SEQ ID NO: 63170 - DNA, 22 bp, Homo sapiens
agagcgtagctgttgagccctg

SEQ ID NO: 63171 - DNA, 19 bp, Homo sapiens
ggtcctggattgagccctg

SEQ ID NO: 63172 - DNA, 20 bp, Homo sapiens
gaggctggcaggtggctctg

SEQ ID NO: 63173 - DNA, 20 bp, Homo sapiens
gaggctggtagatcatctga

SEQ ID NO: 63174 - DNA, 19 bp, Homo sapiens
agaggctgatggtctcctg

SEQ ID NO: 63175 - DNA, 18 bp, Homo sapiens
gaggctggctcagtcctg

SEQ ID NO: 63176 - DNA, 22 bp, Homo sapiens
agaggctggggatccaggctga

SEQ ID NO: 63177 - DNA, 18 bp, Homo sapiens
aggggcgggcagaccctg

SEQ ID NO: 63178 - DNA, 17 bp, Homo sapiens
gaggctggcagcccctg

SEQ ID NO: 63179 - DNA, 19 bp, Homo sapiens
gaggctgggggatcatctg

SEQ ID NO: 63180 - DNA, 21 bp, Homo sapiens
aaggctggggtttgagtcctg

SEQ ID NO: 63181 - DNA, 17 bp, Homo sapiens
gaggctgcgcaggccct

SEQ ID NO: 63182 - DNA, 22 bp, Homo sapiens
gaggctggcagacagtcccctg

SEQ ID NO: 63183 - DNA, 17 bp, Homo sapiens
gatgctggcagtctctg

SEQ ID NO: 63184 - DNA, 24 bp, Homo sapiens
agggggtggtgtcttgagccctga

SEQ ID NO: 63185 - DNA, 18 bp, Homo sapiens
gactgagctgagccctga

SEQ ID NO: 63186 - DNA, 24 bp, Homo sapiens
gagggttggcagataaatgctctg

SEQ ID NO: 63187 - DNA, 19 bp, Homo sapiens
gaggactgcttgagccctg

SEQ ID NO: 63188 - DNA, 20 bp, Homo sapiens
agaagctggcgccagctctg

SEQ ID NO: 63189 - DNA, 18 bp, Homo sapiens
gaggctggcagatgaccc

SEQ ID NO: 63190 - DNA, 17 bp, Homo sapiens
gaggctggcagagcccc

SEQ ID NO: 63191 - DNA, 20 bp, Homo sapiens
agaggctgttagaaaccttg

SEQ ID NO: 63192 - DNA, 20 bp, Homo sapiens
gaggctgggctcagccctga

SEQ ID NO: 63193 - DNA, 19 bp, Homo sapiens
agggcttggctgagccctg

SEQ ID NO: 63194 - DNA, 17 bp, Homo sapiens
ggctggcagccaccctg

SEQ ID NO: 63195 - DNA, 19 bp, Homo sapiens
agaggctggcagaggcctg

SEQ ID NO: 63196 - DNA, 22 bp, Homo sapiens
agaggctgtgaggggagccttg

SEQ ID NO: 63197 - DNA, 20 bp, Homo sapiens
gagactggtggaccacctga

SEQ ID NO: 63198 - DNA, 24 bp, Homo sapiens
aaaggctggttcagccgagctctg

SEQ ID NO: 63199 - DNA, 21 bp, Homo sapiens
agaggcaggcagatcacctga

SEQ ID NO: 63200 - DNA, 23 bp, Homo sapiens
gaggctggcaggacctgctctga

SEQ ID NO: 63201 - DNA, 17 bp, Homo sapiens
agctggcacaggccctg

SEQ ID NO: 63202 - DNA, 22 bp, Homo sapiens
agaggctgtgacaaagtcttga

SEQ ID NO: 63203 - DNA, 21 bp, Homo sapiens
agagactggagggggttctga

SEQ ID NO: 63204 - DNA, 23 bp, Homo sapiens
agacgctggtggcggaagccctg

SEQ ID NO: 63205 - DNA, 18 bp, Homo sapiens
agaggctggcaaggcctg

SEQ ID NO: 63206 - DNA, 18 bp, Homo sapiens
aggggctggcagagcact

SEQ ID NO: 63207 - DNA, 19 bp, Homo sapiens
aggggtcggtagagccctg

SEQ ID NO: 63208 - DNA, 18 bp, Homo sapiens
gaagctggcaggggcttg

SEQ ID NO: 63209 - DNA, 20 bp, Homo sapiens
gaggctggtggatcacctga

SEQ ID NO: 63210 - DNA, 19 bp, Homo sapiens
aaggctgcagtgagccctg

SEQ ID NO: 63211 - DNA, 22 bp, Homo sapiens
agaggccggcggcgcggtcctg

SEQ ID NO: 63212 - DNA, 24 bp, Homo sapiens
gagactggcagcaggggggccctg

SEQ ID NO: 63213 - DNA, 19 bp, Homo sapiens
gagggtggggagagccctg

SEQ ID NO: 63214 - DNA, 24 bp, Homo sapiens
aggggccggtaggttaggacacct

SEQ ID NO: 63215 - DNA, 19 bp, Homo sapiens
agaggctggcggcttcctg

SEQ ID NO: 63216 - DNA, 22 bp, Homo sapiens
aggctggcagcacctggctctg

SEQ ID NO: 63217 - DNA, 24 bp, Homo sapiens
agaggctggagtgagatgctttga

SEQ ID NO: 63218 - DNA, 22 bp, Homo sapiens
agagcgtggctgttgagccctg

SEQ ID NO: 63219 - DNA, 24 bp, Homo sapiens
agatgctggcaggtccagcgtctg

SEQ ID NO: 63220 - DNA, 19 bp, Homo sapiens
agggctggcagtctccctg

SEQ ID NO: 63221 - DNA, 16 bp, Homo sapiens
agacgctgggagccct

SEQ ID NO: 63222 - DNA, 18 bp, Homo sapiens
gaggctggcagggccctg

SEQ ID NO: 63223 - DNA, 20 bp, Homo sapiens
gaggcgggcagatcacctga

SEQ ID NO: 63224 - DNA, 21 bp, Homo sapiens
agaggctggtggtcagccctg

SEQ ID NO: 63225 - DNA, 21 bp, Homo sapiens
agaggcggtgggccgtccttg

SEQ ID NO: 63226 - DNA, 24 bp, Homo sapiens
gaggactggctcagggggctctga

SEQ ID NO: 63227 - DNA, 25 bp, Homo sapiens
ggctggcatgtcagcactgccctga

SEQ ID NO: 63228 - DNA, 18 bp, Homo sapiens
agctggcaggaggtcctg

SEQ ID NO: 63229 - DNA, 21 bp, Homo sapiens
gaggctgacggaagcgtctga

SEQ ID NO: 63230 - DNA, 19 bp, Homo sapiens
agagactggtgatgccctg

SEQ ID NO: 63231 - DNA, 19 bp, Homo sapiens
gaggctggcggctgtcctg

SEQ ID NO: 63232 - DNA, 19 bp, Homo sapiens
aggtgaaggttgagccctg

SEQ ID NO: 63233 - DNA, 19 bp, Homo sapiens
agaggctggcacatgtctg

SEQ ID NO: 63234 - DNA, 20 bp, Homo sapiens
gatgctgccaacgggtcctg

SEQ ID NO: 63235 - DNA, 23 bp, Homo sapiens
gaggctggaagtccttgctctga

SEQ ID NO: 63236 - DNA, 20 bp, Homo sapiens
gaggctggggaggagcctga

SEQ ID NO: 63237 - DNA, 17 bp, Homo sapiens
ggctgccaggagccctg

SEQ ID NO: 63238 - DNA, 21 bp, Homo sapiens
aggggctggcagggggccctg

SEQ ID NO: 63239 - DNA, 21 bp, Homo sapiens
aggggctggcaggcctgctct

SEQ ID NO: 63240 - DNA, 19 bp, Homo sapiens
agaggctgggcaggtcctg

SEQ ID NO: 63241 - DNA, 63 bp, Cowpox virus
ttagtgacagtccagacctaggagctattctaccatagcagaacttaggcatggacatactaa

SEQ ID NO: 63242 - DNA, 24 bp, Cowpox virus
tccagacctaggagctattctacc

SEQ ID NO: 63243 - DNA, 22 bp, Homo sapiens
cccagacctgggcagatctgcc

SEQ ID NO: 63244 - DNA, 19 bp, Homo sapiens
tccagctctagttttctac

SEQ ID NO: 63245 - DNA, 19 bp, Homo sapiens
aacctaggagttcaagacc

SEQ ID NO: 63246 - DNA, 22 bp, Homo sapiens
tccagatctagaagccaggacc

SEQ ID NO: 63247 - DNA, 19 bp, Homo sapiens
cagggcccacgctattcta

SEQ ID NO: 63248 - DNA, 19 bp, Homo sapiens
tccacataaagctattcta

SEQ ID NO: 63249 - DNA, 16 bp, Homo sapiens
ccagaggagctattct

SEQ ID NO: 63250 - DNA, 19 bp, Homo sapiens
ccaggtctgggaaaactct

SEQ ID NO: 63251 - DNA, 21 bp, Homo sapiens
tccagaccaggagtgtgttct

SEQ ID NO: 63252 - DNA, 21 bp, Homo sapiens
tccatgcctgggagccatgcc

SEQ ID NO: 63253 - DNA, 22 bp, Homo sapiens
cctaggcataagctattctgcc

SEQ ID NO: 63254 - DNA, 21 bp, Homo sapiens
tccaggcctcaagcattctac

SEQ ID NO: 63255 - DNA, 15 bp, Homo sapiens
aacctaaaaattcta

SEQ ID NO: 63256 - DNA, 21 bp, Homo sapiens
caaatgaaaagctattttacc

SEQ ID NO: 63257 - DNA, 19 bp, Homo sapiens
ccagacctggtaaattcta

SEQ ID NO: 63258 - DNA, 21 bp, Homo sapiens
cccagactgtcttctattcta

SEQ ID NO: 63259 - DNA, 18 bp, Homo sapiens
gatccaggagcccctgcc

SEQ ID NO: 63260 - DNA, 22 bp, Homo sapiens
tctataccccacctattctgcc

SEQ ID NO: 63261 - DNA, 22 bp, Homo sapiens
tccagacctcaggcgatctgcc

SEQ ID NO: 63262 - DNA, 17 bp, Homo sapiens
cagacctaggggattct

SEQ ID NO: 63263 - DNA, 18 bp, Homo sapiens
tccagatctggagccacc

SEQ ID NO: 63264 - DNA, 18 bp, Homo sapiens
cagaccaaggcattctac

SEQ ID NO: 63265 - DNA, 16 bp, Homo sapiens
cagaccaggaacctct

SEQ ID NO: 63266 - DNA, 21 bp, Homo sapiens
caaaccctctactattctacc

SEQ ID NO: 63267 - DNA, 23 bp, Homo sapiens
tccagacctgggggcaccctgcc

SEQ ID NO: 63268 - DNA, 21 bp, Homo sapiens
tccagacctggggtcatagcc

SEQ ID NO: 63269 - DNA, 22 bp, Homo sapiens
tcctgacctaggaccatctgcc

SEQ ID NO: 63270 - DNA, 18 bp, Homo sapiens
tcctgacctaattctatc

SEQ ID NO: 63271 - DNA, 118 bp, Amsacta moorei entomopoxvirus
atcatttatttattgtataatatttcatatattttattaaaatttacatattctaacaaatgtgcgataacaataaaaattagataaataggatataaaacaatttaaagctcaggat

SEQ ID NO: 63272 - DNA, 24 bp, Amsacta moorei entomopoxvirus
tattttattaaaatttacatattc

SEQ ID NO: 63273 - DNA, 18 bp, Homo sapiens
tactagaatttacatatt

SEQ ID NO: 63274 - DNA, 18 bp, Homo sapiens
tattttattaaaatatac

SEQ ID NO: 63275 - DNA, 19 bp, Homo sapiens
tttattaaaataacacatt

SEQ ID NO: 63276 - DNA, 24 bp, Homo sapiens
tattttactaacgtatacatattc

SEQ ID NO: 63277 - DNA, 19 bp, Homo sapiens
ttttattaaaattatacat

SEQ ID NO: 63278 - DNA, 63 bp, Amsacta moorei entomopoxvirus
aaaatggcatattttaatatatatgatttttatagtctttaattttatttatatagtcatttt

SEQ ID NO: 63279 - DNA, 24 bp, Amsacta moorei entomopoxvirus
aatggcatattttaatatatatga

SEQ ID NO: 63280 - DNA, 21 bp, Homo sapiens
atgacatgagatatatatatg

SEQ ID NO: 63281 - DNA, 19 bp, Homo sapiens
ggtatatttccacatatga

SEQ ID NO: 63282 - DNA, 23 bp, Homo sapiens
aatgacatgaacgtttatatatg

SEQ ID NO: 63283 - DNA, 27 bp, Homo sapiens
aatggcatattttgggtcaaagtatga

SEQ ID NO: 63284 - DNA, 20 bp, Homo sapiens
tgacatatgactatatatga

SEQ ID NO: 63285 - DNA, 16 bp, Homo sapiens
tggcatatttgatatg

SEQ ID NO: 63286 - DNA, 16 bp, Homo sapiens
cggcatattttacatg

SEQ ID NO: 63287 - DNA, 19 bp, Homo sapiens
atggcatataatatatatg

SEQ ID NO: 63288 - DNA, 20 bp, Homo sapiens
atggcatacgtatatatatg

SEQ ID NO: 63289 - DNA, 106 bp, Mouse mammary tumor virus
atgatataaaagagtgctaaatttttgagtaaacttgcaacagtcctaacattcacctctcgtgtgtttgtgtctgttcgccatcccgtctccgctcgtcacttat

SEQ ID NO: 63290 - DNA, 24 bp, Mouse mammary tumor virus
tgcaacagtcctaacattcacctc

SEQ ID NO: 63291 - DNA, 16 bp, Homo sapiens
gcaacaatgttcacct

SEQ ID NO: 63292 - DNA, 22 bp, Homo sapiens
gcaacccaacaacgttcacctc

SEQ ID NO: 63293 - DNA, 23 bp, Homo sapiens
tgctgacagttttctttcacctc

SEQ ID NO: 63294 - DNA, 22 bp, Homo sapiens
gcatagtatttaacattcatct

SEQ ID NO: 63295 - DNA, 24 bp, Homo sapiens
gcggcagttctggacgcccacctc

SEQ ID NO: 63296 - DNA, 25 bp, Homo sapiens
tgcaacagttttgttactgcatctc

SEQ ID NO: 63297 - DNA, 22 bp, Homo sapiens
tgcaaggtggtaacattcacct

SEQ ID NO: 63298 - DNA, 22 bp, Homo sapiens
tgcaacagtttaaacaccatca

SEQ ID NO: 63299 - DNA, 18 bp, Homo sapiens
tgtaacaatcctctcatt

SEQ ID NO: 63300 - DNA, 19 bp, Homo sapiens
caactcaaaacattcatct

SEQ ID NO: 63301 - DNA, 22 bp, Homo sapiens
tgcaacagtcctggaatcccct

SEQ ID NO: 63302 - DNA, 18 bp, Homo sapiens
gcacacaagtctaacatt

SEQ ID NO: 63303 - DNA, 18 bp, Homo sapiens
gtctccaacattcacctc

SEQ ID NO: 63304 - DNA, 20 bp, Homo sapiens
tgcaacaggcctgacgtttc

SEQ ID NO: 63305 - DNA, 18 bp, Homo sapiens
gcaacagtcttaggatcc

SEQ ID NO: 63306 - DNA, 26 bp, Homo sapiens
cagcagtcctactattgcattcatct

SEQ ID NO: 63307 - DNA, 21 bp, Homo sapiens
tgtcacagtcctggctcactc

SEQ ID NO: 63308 - DNA, 20 bp, Homo sapiens
tgcaacagtctaacataaca

SEQ ID NO: 63309 - DNA, 22 bp, Homo sapiens
tgcaacattctatagatacctc

SEQ ID NO: 63310 - DNA, 20 bp, Homo sapiens
tacaacagtagaatttacct

SEQ ID NO: 63311 - DNA, 23 bp, Homo sapiens
tgcagccagtcctcgcccacctc

SEQ ID NO: 63312 - DNA, 18 bp, Homo sapiens
tgcaacattcctgacatc

SEQ ID NO: 63313 - DNA, 60 bp, Fowlpox virus
tttttggaggttcgcttttctatatctcatgaagaaagtcgctgttcgtcctactaaaaa

SEQ ID NO: 63314 - DNA, 24 bp, Fowlpox virus
ttggaggttcgcttttctatatct

SEQ ID NO: 63315 - DNA, 25 bp, Homo sapiens
tggaggtttgtataccgctgtatct

SEQ ID NO: 63316 - DNA, 19 bp, Homo sapiens
ttggaggctttgttcatat

SEQ ID NO: 63317 - DNA, 25 bp, Homo sapiens
ttggggttaaagcatttctatgtct

SEQ ID NO: 63318 - DNA, 19 bp, Homo sapiens
ttggaggttttttttttac

SEQ ID NO: 63319 - DNA, 17 bp, Homo sapiens
ttggaggttctttttct

SEQ ID NO: 63320 - DNA, 20 bp, Homo sapiens
ggttttgcttttctatgtct

SEQ ID NO: 63321 - DNA, 22 bp, Homo sapiens
ttggcaagccttttctatgtct

SEQ ID NO: 63322 - DNA, 121 bp, Fowlpox virus
gagcatgagagcggctttagcgtaaagtttttctccgatagttttgataaaggtccttaagaatcttaacctatcccttactctgatgaaaaagattgcggtagacgccgttttagaaatc

SEQ ID NO: 63323 - DNA, 24 bp, Fowlpox virus
tgagagcggctttagcgtaaagtt

SEQ ID NO: 63324 - DNA, 19 bp, Homo sapiens
tgagtgggcctgtaaagtt

SEQ ID NO: 63325 - DNA, 17 bp, Homo sapiens
tgagagcagttttaggt

SEQ ID NO: 63326 - DNA, 130 bp, Human herpesvirus 5
cagcttcgaggtataacctacaacacggaggggaagggggggtacaaaacgtgaaattagactttttttttaatgatgttttgtccctctgtcttactttcccataggctgtaaggccctcgaggaagag

SEQ ID NO: 63327 - DNA, 24 bp, Human herpesvirus 5
atgatgttttgtccctctgtctta

SEQ ID NO: 63328 - DNA, 20 bp, Homo sapiens
tgattttccaccctttctgt

SEQ ID NO: 63329 - DNA, 19 bp, Homo sapiens
tgatgttccattttgtctt

SEQ ID NO: 63330 - DNA, 18 bp, Homo sapiens
atggtgttttatccctct

SEQ ID NO: 63331 - DNA, 16 bp, Homo sapiens
atgacgccccttctgt

SEQ ID NO: 63332 - DNA, 19 bp, Homo sapiens
atgagttttgtctttttcc

SEQ ID NO: 63333 - DNA, 22 bp, Homo sapiens
atgtgttttgttctttatctta

SEQ ID NO: 63334 - DNA, 20 bp, Homo sapiens
atggtgttttggccttcagt

SEQ ID NO: 63335 - DNA, 22 bp, Homo sapiens
atgaggttttgttaccatctta

SEQ ID NO: 63336 - DNA, 21 bp, Homo sapiens
atggtgttttgttcttcggtc

SEQ ID NO: 63337 - DNA, 19 bp, Homo sapiens
tgctgttttgtccctttct

SEQ ID NO: 63338 - DNA, 22 bp, Homo sapiens
atgatgttttgtttctttccca

SEQ ID NO: 63339 - DNA, 19 bp, Homo sapiens
atgatttcttctctgtctt

SEQ ID NO: 63340 - DNA, 15 bp, Homo sapiens
gttttgtcccatctt

SEQ ID NO: 63341 - DNA, 26 bp, Homo sapiens
atgctgttttgtgcccgtctgtctta

SEQ ID NO: 63342 - DNA, 17 bp, Homo sapiens
tgatgtttgtctttctg

SEQ ID NO: 63343 - DNA, 20 bp, Homo sapiens
atggtgttttgtccatccat

SEQ ID NO: 63344 - DNA, 21 bp, Homo sapiens
atgatgttttgatttttctca

SEQ ID NO: 63345 - DNA, 19 bp, Homo sapiens
atggtgttttgctttcctc

SEQ ID NO: 63346 - DNA, 17 bp, Homo sapiens
tgttgtccttctgtctt

SEQ ID NO: 63347 - DNA, 24 bp, Homo sapiens
atgagtggaaagttctctgtctta

SEQ ID NO: 63348 - DNA, 61 bp, Aura virus
aagactgagaaaactcgatgtacttccgaggatgtggtgcataatgtcacacatcagtctt

SEQ ID NO: 63349 - DNA, 24 bp, Aura virus
ggtgcataatgtcacacatcagtc

SEQ ID NO: 63350 - DNA, 23 bp, Homo sapiens
agtgcatacttcacacattggtc

SEQ ID NO: 63351 - DNA, 21 bp, Homo sapiens
ggtgcttaggagacatcagtc

SEQ ID NO: 63352 - DNA, 22 bp, Homo sapiens
ggtgcataatttcccatcagtc

SEQ ID NO: 63353 - DNA, 21 bp, Homo sapiens
gggcataaggaggcatcagtc

SEQ ID NO: 63354 - DNA, 20 bp, Homo sapiens
gatgcatagaagacatcagt

SEQ ID NO: 63355 - DNA, 18 bp, Homo sapiens
gtgggccacacattagtc

SEQ ID NO: 63356 - DNA, 19 bp, Homo sapiens
ggtgtctaatgacatcagt

SEQ ID NO: 63357 - DNA, 24 bp, Homo sapiens
ggttcataatgcatagttatcagt

SEQ ID NO: 63358 - DNA, 86 bp, Aura virus
gttgaaaataactttatagaattttaaaattttctttattaaaatcttttgtttttcttttattatttcaaaattttgtttttaat

SEQ ID NO: 63359 - DNA, 24 bp, Aura virus
tagaattttaaaattttctttatt

SEQ ID NO: 63360 - DNA, 19 bp, Homo sapiens
agaattttaagattttcct

SEQ ID NO: 63361 - DNA, 20 bp, Homo sapiens
attttaaaattttctttatt

SEQ ID NO: 63362 - DNA, 19 bp, Homo sapiens
tagagttttaaaatcccct

SEQ ID NO: 63363 - DNA, 23 bp, Homo sapiens
agacaagccaaattttctttatt

SEQ ID NO: 63364 - DNA, 19 bp, Homo sapiens
gaacacaattttctttatt

SEQ ID NO: 63365 - DNA, 22 bp, Homo sapiens
tagaatattaaattcctttatt

SEQ ID NO: 63366 - DNA, 20 bp, Homo sapiens
aaattttaaaattttcttta

SEQ ID NO: 63367 - DNA, 73 bp, Human immunodeficiency virus 1
ggtgtgaatatcaagcaggacataacaaggtaggatctctacaatacttggcactagcagcattaataacacc

SEQ ID NO: 63368 - DNA, 24 bp, Human immunodeficiency virus 1
aagcaggacataacaaggtaggat

SEQ ID NO: 63369 - DNA, 19 bp, Homo sapiens
gcaggacaatagcttggat

SEQ ID NO: 63370 - DNA, 20 bp, Homo sapiens
aagcaggacagacagttaag

SEQ ID NO: 63371 - DNA, 18 bp, Homo sapiens
aactaggacataatgggt

SEQ ID NO: 63372 - DNA, 20 bp, Homo sapiens
gcagggcacagtttggggat

SEQ ID NO: 63373 - DNA, 16 bp, Homo sapiens
gcaggacatgggcaga

SEQ ID NO: 63374 - DNA, 20 bp, Homo sapiens
aagcaaaagcaaggtaggat

SEQ ID NO: 63375 - DNA, 18 bp, Homo sapiens
gcgggacaggacagcagg

SEQ ID NO: 63376 - DNA, 17 bp, Homo sapiens
aagcaggacacggtaag

SEQ ID NO: 63377 - DNA, 16 bp, Homo sapiens
aagcaggacatgcagg

SEQ ID NO: 63378 - DNA, 17 bp, Homo sapiens
gcaggatatggcaagga

SEQ ID NO: 63379 - DNA, 22 bp, Homo sapiens
agggggacataacggaagtgat

SEQ ID NO: 63380 - DNA, 16 bp, Homo sapiens
aagcaggataaataag

SEQ ID NO: 63381 - DNA, 20 bp, Homo sapiens
aagacagggcacggggtagg

SEQ ID NO: 63382 - DNA, 25 bp, Homo sapiens
aaacaggacataacagcttctggat

SEQ ID NO: 63383 - DNA, 22 bp, Homo sapiens
gcaggacatgacgctgggggat

SEQ ID NO: 63384 - DNA, 21 bp, Homo sapiens
gcagcacgtagtaggcaggat

SEQ ID NO: 63385 - DNA, 21 bp, Homo sapiens
gcagagacataagcccacagg

SEQ ID NO: 63386 - DNA, 17 bp, Homo sapiens
agaggacgtgataggac

SEQ ID NO: 63387 - DNA, 18 bp, Homo sapiens
gcaggacatcacgaacgt

SEQ ID NO: 63388 - DNA, 19 bp, Homo sapiens
gcaggacataatgaagaag

SEQ ID NO: 63389 - DNA, 18 bp, Homo sapiens
aaacagggcataacaggt

SEQ ID NO: 63390 - DNA, 19 bp, Homo sapiens
gaaactgacaaggtaggat

SEQ ID NO: 63391 - DNA, 18 bp, Homo sapiens
aagcagggcaggcacaga

SEQ ID NO: 63392 - DNA, 18 bp, Homo sapiens
agcaggacggacagcgac

SEQ ID NO: 63393 - DNA, 17 bp, Homo sapiens
agcaggacataaagtag

SEQ ID NO: 63394 - DNA, 21 bp, Homo sapiens
agctaggacatagtaaagaga

SEQ ID NO: 63395 - DNA, 18 bp, Homo sapiens
agcaggacagaaatggga

SEQ ID NO: 63396 - DNA, 17 bp, Homo sapiens
aagcaggacatggaaga

SEQ ID NO: 63397 - DNA, 20 bp, Homo sapiens
aagtaggacatattaaaggt

SEQ ID NO: 63398 - DNA, 16 bp, Homo sapiens
aagcaggacaggtggg

SEQ ID NO: 63399 - DNA, 19 bp, Homo sapiens
aagcaggacaagcagccag

SEQ ID NO: 63400 - DNA, 21 bp, Homo sapiens
agtgggtcactggaaggtagg

SEQ ID NO: 63401 - DNA, 22 bp, Homo sapiens
aagcaggagtgacagaccaagg

SEQ ID NO: 63402 - DNA, 21 bp, Homo sapiens
gcaggacagaggcaaggtggg

SEQ ID NO: 63403 - DNA, 24 bp, Homo sapiens
aagcagggtggggtgagggagaat

SEQ ID NO: 63404 - DNA, 15 bp, Homo sapiens
gcaggacaaaatgga

SEQ ID NO: 63405 - DNA, 18 bp, Homo sapiens
aagcaggaggtaatggca

SEQ ID NO: 63406 - DNA, 18 bp, Homo sapiens
agcaggacatgacagagt

SEQ ID NO: 63407 - DNA, 24 bp, Homo sapiens
aagagcccacagacagggtaggat

SEQ ID NO: 63408 - DNA, 17 bp, Homo sapiens
gcagggcatgaggagga

SEQ ID NO: 63409 - DNA, 23 bp, Homo sapiens
aagcagggtgtcggcagcaagat

SEQ ID NO: 63410 - DNA, 15 bp, Homo sapiens
aacaggacatatagg

SEQ ID NO: 63411 - DNA, 19 bp, Homo sapiens
gcaggacataccactggat

SEQ ID NO: 63412 - DNA, 18 bp, Homo sapiens
aagtaggacagggtcagg

SEQ ID NO: 63413 - DNA, 16 bp, Homo sapiens
agcagggcaaggtaag

SEQ ID NO: 63414 - DNA, 19 bp, Homo sapiens
aagcaggacatagccagga

SEQ ID NO: 63415 - DNA, 19 bp, Homo sapiens
aagcagacatgacaataga

SEQ ID NO: 63416 - DNA, 15 bp, Homo sapiens
gcaggacatgcagaa

SEQ ID NO: 63417 - DNA, 21 bp, Homo sapiens
agtgggacaaaacatgagggg

SEQ ID NO: 63418 - DNA, 18 bp, Homo sapiens
aagtaggacatgcagaac

SEQ ID NO: 63419 - DNA, 22 bp, Homo sapiens
agcaggacttaggtccaaggat

SEQ ID NO: 63420 - DNA, 19 bp, Homo sapiens
aagcaggacatgacatggt

SEQ ID NO: 63421 - DNA, 16 bp, Homo sapiens
gcaggaataacgctgg

SEQ ID NO: 63422 - DNA, 22 bp, Homo sapiens
aagtaggaatgcccaaggtggg

SEQ ID NO: 63423 - DNA, 65 bp, Human coronavirus 229E
cacaatggtaagccagtggtagtaaaggtataagaaatttgctactatgttactgaacctaggtg

SEQ ID NO: 63424 - DNA, 23 bp, Human coronavirus 229E
tactatgttactgaacctaggtg

SEQ ID NO: 63425 - DNA, 19 bp, Homo sapiens
cactgtgttactgagtacc

SEQ ID NO: 63426 - DNA, 20 bp, Homo sapiens
tgtttaaaggaacctaggtg

SEQ ID NO: 63427 - DNA, 19 bp, Homo sapiens
ctaatgttattcccaggtg

SEQ ID NO: 63428 - DNA, 17 bp, Homo sapiens
tatgttactgactggtg

SEQ ID NO: 63429 - DNA, 20 bp, Homo sapiens
tgctaagccaaacctaggtg

SEQ ID NO: 63430 - DNA, 18 bp, Homo sapiens
tgccactgggcctgggtg

SEQ ID NO: 63431 - DNA, 20 bp, Homo sapiens
tactatgttcttaaaaggtg

SEQ ID NO: 63432 - DNA, 22 bp, Homo sapiens
tactaagactataatctaggtg

SEQ ID NO: 63433 - DNA, 21 bp, Homo sapiens
accacaggttgaacctaggtg

SEQ ID NO: 63434 - DNA, 17 bp, Homo sapiens
tacatgccagcctaggt

SEQ ID NO: 63435 - DNA, 21 bp, Homo sapiens
actatgttattggtgaaggtg

SEQ ID NO: 63436 - DNA, 22 bp, Homo sapiens
tactatgttcactacttgggtg

SEQ ID NO: 63437 - DNA, 77 bp, Dengue virus type 1
gatcctgctgtctctacagcatcattccaggcacagaacgccaaaaaatggaatggtgctgttgaatcaacaggttc

SEQ ID NO: 63438 - DNA, 77 bp, Dengue virus type 1; identical to SEQ ID NO: 63437

SEQ ID NO: 63439 - DNA, 18 bp, Homo sapiens
tggaatggtgttttgtca

SEQ ID NO: 63440 - DNA, 18 bp, Homo sapiens
tggaaactgttgagtcaa

SEQ ID NO: 63441 - DNA, 18 bp, Homo sapiens
tggaatggtggctggatg

SEQ ID NO: 63442 - DNA, 18 bp, Homo sapiens
tgggatgctgttgcttca

SEQ ID NO: 63443 - DNA, 15 bp, Homo sapiens
tggaaggtgttaaac

SEQ ID NO: 63444 - DNA, 22 bp, Homo sapiens
tggaatgggtttttggggtcga

SEQ ID NO: 63445 - DNA, 22 bp, Homo sapiens
tggaatgtgtttgtctttgaca

SEQ ID NO: 63446 - DNA, 22 bp, Homo sapiens
tgaaatagatgttgagttaaca

SEQ ID NO: 63447 - DNA, 21 bp, Homo sapiens
tgggatgctgttgagctaaca

SEQ ID NO: 63448 - DNA, 21 bp, Homo sapiens
gaagtttgtgttgaatcgaca

SEQ ID NO: 63449 - DNA, 16 bp, Homo sapiens
tggagggcttgaatca

SEQ ID NO: 63450 - DNA, 17 bp, Homo sapiens
tggggtgctgctgccca

SEQ ID NO: 63451 - DNA, 19 bp, Homo sapiens
tggaatggctgtttatcaa

SEQ ID NO: 63452 - DNA, 21 bp, Homo sapiens
tggaaggtgctgtttttccac

SEQ ID NO: 63453 - DNA, 71 bp, Human herpesvirus 2
gggagacggggttggtttggggttggtttggggttggttttcccgttagcacatgtctgcatttgtttttc

SEQ ID NO: 63454 - DNA, 24 bp, Human herpesvirus 2
tagcacatgtctgcatttgttttt

SEQ ID NO: 63455 - DNA, 19 bp, Homo sapiens
tagcaatgtcttctgtttt

SEQ ID NO: 63456 - DNA, 19 bp, Homo sapiens
tagctgtccaatttgtttt

SEQ ID NO: 63457 - DNA, 21 bp, Homo sapiens
tagttcatgtcacctgttttt

SEQ ID NO: 63458 - DNA, 16 bp, Homo sapiens
gcacatgctgtgttct

SEQ ID NO: 63459 - DNA, 19 bp, Homo sapiens
gccatgtctgcagctattt

SEQ ID NO: 63460 - DNA, 23 bp, Homo sapiens
gcatgtgtacttgctttgttttt

SEQ ID NO: 63461 - DNA, 22 bp, Homo sapiens
cagcatattaacatttgttttt

SEQ ID NO: 63462 - DNA, 22 bp, Homo sapiens
tagcagatggctatttgttttt

SEQ ID NO: 63463 - DNA, 18 bp, Homo sapiens
tagcgcatgcctgtattc

SEQ ID NO: 63464 - DNA, 20 bp, Homo sapiens
tagcataaacatttgttttt

SEQ ID NO: 63465 - DNA, 21 bp, Homo sapiens
gcacatgttgtaattgttttt

SEQ ID NO: 63466 - DNA, 22 bp, Homo sapiens
tagtatatgtctacatatgttt

SEQ ID NO: 63467 - DNA, 85 bp, Human adenovirus D
gcttaccagtagacaaagagcacagcagtacaagcgccaacagcagcgactgactacccactgacttagctccctatttaaaggc

SEQ ID NO: 63468 - DNA, 19 bp, Human adenovirus D
tagctccctatttaaaggc

SEQ ID NO: 63469 - DNA, 18 bp, Homo sapiens
tagctccactctcaaggg

SEQ ID NO: 63470 - DNA, 19 bp, Homo sapiens
gctcgcctctccaagaggc

SEQ ID NO: 63471 - DNA, 16 bp, Homo sapiens
cagctcccctagaggc

SEQ ID NO: 63472 - DNA, 19 bp, Homo sapiens
agctccctcctactggggc

SEQ ID NO: 63473 - DNA, 19 bp, Homo sapiens
cagcttccctaaaaagggc

SEQ ID NO: 63474 - DNA, 18 bp, Homo sapiens
tagctccctaaaaatggc

SEQ ID NO: 63475 - DNA, 16 bp, Homo sapiens
tagccaccctaaaggc

SEQ ID NO: 63476 - DNA, 19 bp, Homo sapiens
cagctctctggccaaaggc

SEQ ID NO: 63477 - DNA, 19 bp, Homo sapiens
tagcccccaactagaaggc

SEQ ID NO: 63478 - DNA, 17 bp, Homo sapiens
cagctccctaggaaggc

SEQ ID NO: 63479 - DNA, 20 bp, Homo sapiens
cagctccctccctcaggggc

SEQ ID NO: 63480 - DNA, 19 bp, Homo sapiens
actccctactgaggaaggc

SEQ ID NO: 63481 - DNA, 17 bp, Homo sapiens
cagctccccacgaaggc

SEQ ID NO: 63482 - DNA, 17 bp, Homo sapiens
cagctctatttaaaggc

SEQ ID NO: 63483 - DNA, 18 bp, Homo sapiens
agctcttctttttaaagg

SEQ ID NO: 63484 - DNA, 20 bp, Homo sapiens
tagctcccggctcaccaggc

SEQ ID NO: 63485 - DNA, 16 bp, Homo sapiens
agctcctactaaaggc

SEQ ID NO: 63486 - DNA, 18 bp, Homo sapiens
cagctcccggcccagggc

SEQ ID NO: 63487 - DNA, 19 bp, Homo sapiens
cagcttccactccaaaggc

SEQ ID NO: 63488 - DNA, 18 bp, Homo sapiens
cagctccctcataaaggc

SEQ ID NO: 63489 - DNA, 18 bp, Homo sapiens
aactctcctgtttaaagg

SEQ ID NO: 63490 - DNA, 15 bp, Homo sapiens
tagctcctttaaagg

SEQ ID NO: 63491 - DNA, 19 bp, Homo sapiens
actccccaggattaaaggc

SEQ ID NO: 63492 - DNA, 16 bp, Homo sapiens
tagcctcccctaaagg

SEQ ID NO: 63493 - DNA, 19 bp, Homo sapiens
tagctatgccactaaaggc

SEQ ID NO: 63494 - DNA, 19 bp, Homo sapiens
taactccctgttcccaagg

SEQ ID NO: 63495 - DNA, 18 bp, Homo sapiens
cagctcccaccccgaggc

SEQ ID NO: 63496 - DNA, 16 bp, Homo sapiens
cagctcccccaaaggc

SEQ ID NO: 63497 - DNA, 16 bp, Homo sapiens
tagtcctttcaaaggc

SEQ ID NO: 63498 - DNA, 16 bp, Homo sapiens
tagccccaccaaaggc

SEQ ID NO: 63499 - DNA, 17 bp, Homo sapiens
cagctcccacccagagg

SEQ ID NO: 63500 - DNA, 17 bp, Homo sapiens
cagctccctcccagagg

SEQ ID NO: 63501 - DNA, 20 bp, Homo sapiens
agctccctgctccgagaggc

SEQ ID NO: 63502 - DNA, 18 bp, Homo sapiens
gctttgctatttaaaggc

SEQ ID NO: 63503 - DNA, 17 bp, Homo sapiens
cagctccctgcctgggc

SEQ ID NO: 63504 - DNA, 18 bp, Homo sapiens
agctcacctttttaaagg

SEQ ID NO: 63505 - DNA, 18 bp, Homo sapiens
tacctccctactgcaagg

SEQ ID NO: 63506 - DNA, 17 bp, Homo sapiens
cagctctcttctaaagg

SEQ ID NO: 63507 - DNA, 17 bp, Homo sapiens
cagctactttttaaagg

SEQ ID NO: 63508 - DNA, 16 bp, Homo sapiens
cagctcccctcagggc

SEQ ID NO: 63509 - DNA, 16 bp, Homo sapiens
tagctcatttaaaaac

SEQ ID NO: 63510 - DNA, 20 bp, Homo sapiens
tagttccctaccatcaaggc

SEQ ID NO: 63511 - DNA, 21 bp, Homo sapiens
cagctccctgtctgccaaggc

SEQ ID NO: 63512 - DNA, 19 bp, Homo sapiens
agctcctgtcctcaaaggc

SEQ ID NO: 63513 - DNA, 15 bp, Homo sapiens
agctccctacttggc

SEQ ID NO: 63514 - DNA, 17 bp, Homo sapiens
tagcttctttccaaagg

SEQ ID NO: 63515 - DNA, 16 bp, Homo sapiens
cagctcccttttgggc

SEQ ID NO: 63516 - DNA, 18 bp, Homo sapiens
taaccaaaatttaaaggc

SEQ ID NO: 63517 - DNA, 17 bp, Homo sapiens
tagcccttctcaaaggc

SEQ ID NO: 63518 - DNA, 20 bp, Homo sapiens
tagcttcccttaaaaaaggc

SEQ ID NO: 63519 - DNA, 19 bp, Homo sapiens
agctccctactcacagggc

SEQ ID NO: 63520 - DNA, 18 bp, Homo sapiens
cagctcccacacccaggg

SEQ ID NO: 63521 - DNA, 18 bp, Homo sapiens
taactcccgtctaagggc

SEQ ID NO: 63522 - DNA, 18 bp, Homo sapiens
gctccctaaaccagaagg

SEQ ID NO: 63523 - DNA, 17 bp, Homo sapiens
tagtgccctccaaaggc

SEQ ID NO: 63524 - DNA, 18 bp, Homo sapiens
agttccctatctgaaggc

SEQ ID NO: 63525 - DNA, 130 bp, Hepatitis G virus
atgactcggcgccgactcggcgaccggccaaaaggtggtggatgggtgatgacagggttggtaggtcgtaaatcccggtcaccttggtagccactataggtgggtcttaagagaaggttaagattcctct

SEQ ID NO: 63526 - DNA, 24 bp, Hepatitis G virus
taggtgggtcttaagagaaggtta

SEQ ID NO: 63527 - DNA, 20 bp, Homo sapiens
agtgggtcttaagagccatt

SEQ ID NO: 63528 - DNA, 18 bp, Homo sapiens
agttggttagagaaggtt

SEQ ID NO: 63529 - DNA, 18 bp, Homo sapiens
tagatggaagagaaggtt

SEQ ID NO: 63530 - DNA, 25 bp, Homo sapiens
taggttgaagactaagagaaggtta

SEQ ID NO: 63531 - DNA, 18 bp, Homo sapiens
gggggtctggggagggtt

SEQ ID NO: 63532 - DNA, 20 bp, Homo sapiens
ggtggcaaggagagaaggtt

SEQ ID NO: 63533 - DNA, 131 bp, Human herpesvirus 5
tagagcaatttatagattctgaagtgcttttattgctgataactgttgtactgtatgttgatgtggctgtctcagtactagtggaatagttaacggtagtactacagggacattgacaggaacaggtttga

SEQ ID NO: 63534 - DNA, 24 bp, Human herpesvirus 5
tcagtactagtggaatagttaacg

SEQ ID NO: 63535 - DNA, 18 bp, Homo sapiens
tcagtactggatggcaat

SEQ ID NO: 63536 - DNA, 91 bp, Vaccinia virus
tatctaagataacacagcaatagatcggatgatttactaaagtcatcaatggtgtccgttagtatatcaaagatcttgttatcgattgata

SEQ ID NO: 63537 - DNA, 24 bp, Vaccinia virus
tatcaaagatcttgttatcgattg

SEQ ID NO: 63538 - DNA, 18 bp, Homo sapiens
tatcaaagacttttgtta

SEQ ID NO: 63539 - DNA, 78 bp, Montana myotis leukoencephalitis virus
gcggcgtggatatatactccagccagaaaagactcagattgtctcatgactttctgactggcgtacatagccatccgc

SEQ ID NO: 63540 - DNA, 24 bp, Montana myotis leukoencephalitis virus
tgactggcgtacatagccatccgc

SEQ ID NO: 63541 - DNA, 23 bp, Homo sapiens
tgactggctattcggctcatccg

SEQ ID NO: 63542 - DNA, 21 bp, Homo sapiens
gaccccagcatagccatccgc

SEQ ID NO: 63543 - DNA, 17 bp, Homo sapiens
tgactggctacagatcg

SEQ ID NO: 63544 - DNA, 21 bp, Homo sapiens
tgactggcgtaatggtcatcc

SEQ ID NO: 63545 - DNA, 63 bp, Simian hemorrhagic fever virus
tgcttggtatgcattgctacacttgcttatgctgcaactgctttcaatgaacattcccttgca

SEQ ID NO: 63546 - DNA, 24 bp, Simian hemorrhagic fever virus
atgcattgctacacttgcttatgc

SEQ ID NO: 63547 - DNA, 17 bp, Homo sapiens
atgcattgctgacatgc

SEQ ID NO: 63548 - DNA, 23 bp, Homo sapiens
cgctgagttacatttgcttatgc

SEQ ID NO: 63549 - DNA, 19 bp, Homo sapiens
gctacacacttgcttgtgc

SEQ ID NO: 63550 - DNA, 18 bp, Homo sapiens
tgcattgctttgctggtg

SEQ ID NO: 63551 - DNA, 20 bp, Homo sapiens
atgcattacatctgtttatg

SEQ ID NO: 63552 - DNA, 19 bp, Homo sapiens
atgcttgctacatacagtg

SEQ ID NO: 63553 - DNA, 22 bp, Homo sapiens
atgcatctgccactgcttatgc

SEQ ID NO: 63554 - DNA, 20 bp, Homo sapiens
tgtgttgctttagcttatgc

SEQ ID NO: 63555 - DNA, 20 bp, Homo sapiens
atgcattgctaacaaagtgc

SEQ ID NO: 63556 - DNA, 22 bp, Homo sapiens
atgcattactaataatcttatg

SEQ ID NO: 63557 - DNA, 23 bp, Homo sapiens
atgcattgcacgttcttccatgc

SEQ ID NO: 63558 - DNA, 19 bp, Homo sapiens
atgcattgttcacccgatg

SEQ ID NO: 63559 - DNA, 20 bp, Homo sapiens
tacattgctacctttttatg

SEQ ID NO: 63560 - DNA, 19 bp, Homo sapiens
tgctgctacacaattatgc

SEQ ID NO: 63561 - DNA, 18 bp, Homo sapiens
atgcattgtatgcttttg

SEQ ID NO: 63562 - DNA, 65 bp, Ictalurid herpesvirus 1
gcctgggctcgctcgcggtcagggatcgatgacgggttcactcgcagagcacagagagtccgggc

SEQ ID NO: 63563 - DNA, 24 bp, Ictalurid herpesvirus 1
ttcactcgcagagcacagagagtc

SEQ ID NO: 63564 - DNA, 20 bp, Homo sapiens
cttatcaaggcacagagagt

SEQ ID NO: 63565 - DNA, 18 bp, Homo sapiens
tccactcgcagagcacag

SEQ ID NO: 63566 - DNA, 19 bp, Homo sapiens
actcgcagggctaccaggt

SEQ ID NO: 63567 - DNA, 19 bp, Homo sapiens
ttcgtgcgcagaacagagt

SEQ ID NO: 63568 - DNA, 23 bp, Homo sapiens
ttcacttgcagaacaccatcgtc

SEQ ID NO: 63569 - DNA, 20 bp, Homo sapiens
actcacctttacagagagtc

SEQ ID NO: 63570 - DNA, 23 bp, Homo sapiens
ttcactcgctgtacacagggagt

SEQ ID NO: 63571 - DNA, 20 bp, Homo sapiens
cacttggggcacagagagtc

SEQ ID NO: 63572 - DNA, 15 bp, Homo sapiens
ttcctcgccagagag

SEQ ID NO: 63573 - DNA, 18 bp, Homo sapiens
ttcacccacacagggagt

SEQ ID NO: 63574 - DNA, 19 bp, Homo sapiens
tcattcgcagagcacaaga

SEQ ID NO: 63575 - DNA, 77 bp, Fowl adenovirus A
gacttgattaccgtcgacggcccgggctcttcgaggtccacgaagtccgccacgtcttcgtcgctgctgatcgtctc

SEQ ID NO: 63576 - DNA, 24 bp, Fowl adenovirus A
cgccacgtcttcgtcgctgctgat

SEQ ID NO: 63577 - DNA, 15 bp, Homo sapiens
cccgcgtcgctgctg

SEQ ID NO: 63578 - DNA, 19 bp, Homo sapiens
cgctccgcagtcgctgctg

SEQ ID NO: 63579 - DNA, 19 bp, Homo sapiens
gccatgtctccgttgttga

SEQ ID NO: 63580 - DNA, 16 bp, Homo sapiens
ccacagttgctgctga

SEQ ID NO: 63581 - DNA, 19 bp, Homo sapiens
cgccacgtttcccatgctg

SEQ ID NO: 63582 - DNA, 21 bp, Homo sapiens
ccacccagggttgctgctgat

SEQ ID NO: 63583 - DNA, 21 bp, Homo sapiens
gtcttcgttgccttccttgat

SEQ ID NO: 63584 - DNA, 94 bp, Paramecium bursaria Chlorella virus 1
taaaatttgtgtgtgcagcaattgacgaatttattccatgacgaaccaacataaataatttaaggaatgtaaaattgttatcacaatggcttta

SEQ ID NO: 63585 - DNA, 24 bp, Paramecium bursaria Chlorella virus 1
aggaatgtaaaattgttatcacaa

SEQ ID NO: 63586 - DNA, 21 bp, Homo sapiens
ggaggtgaggtcctcatcaca

SEQ ID NO: 63587 - DNA, 18 bp, Homo sapiens
aggaatgtaaggtgcaca

SEQ ID NO: 63588 - DNA, 24 bp, Homo sapiens
aggatgtgaaccagtatatcacaa

SEQ ID NO: 63589 - DNA, 17 bp, Homo sapiens
aggaatgagaattgcta

SEQ ID NO: 63590 - DNA, 19 bp, Homo sapiens
ggaatgtagaacaagttac

SEQ ID NO: 63591 - DNA, 20 bp, Homo sapiens
aggaagtgtggaatcatcac

SEQ ID NO: 63592 - DNA, 22 bp, Homo sapiens
ggcaatgtaaaaaatcttcaca

SEQ ID NO: 63593 - DNA, 25 bp, Homo sapiens
agaaatgtggaaaaaaaaatcacaa

SEQ ID NO: 63594 - DNA, 23 bp, Homo sapiens
aggaacgtgaaacagaaatcaca

SEQ ID NO: 63595 - DNA, 21 bp, Homo sapiens
aggaatgcaagaagtcttaca

SEQ ID NO: 63596 - DNA, 19 bp, Homo sapiens
aggaatggaaattgtttca

SEQ ID NO: 63597 - DNA, 19 bp, Homo sapiens
ggaatgtaaaaactggaat

SEQ ID NO: 63598 - DNA, 22 bp, Homo sapiens
aggaatgcaaaacatacaatca

SEQ ID NO: 63599 - DNA, 19 bp, Homo sapiens
agaaatgtaaagctcttac

SEQ ID NO: 63600 - DNA, 18 bp, Homo sapiens
agaatgtagccctgttac

SEQ ID NO: 63601 - DNA, 19 bp, Homo sapiens
agcaatgtaaactagttat

SEQ ID NO: 63602 - DNA, 18 bp, Homo sapiens
ggaattaaaattatcaca

SEQ ID NO: 63603 - DNA, 17 bp, Homo sapiens
ggaatgtaagttaatca

SEQ ID NO: 63604 - DNA, 21 bp, Homo sapiens
gaatgaatcattgttattgca

SEQ ID NO: 63605 - DNA, 18 bp, Homo sapiens
ggaatgtaaaatggtaca

SEQ ID NO: 63606 - DNA, 17 bp, Homo sapiens
ggaattatattatcaca

SEQ ID NO: 63607 - DNA, 18 bp, Homo sapiens
ggaatgtaaattggttca

SEQ ID NO: 63608 - DNA, 18 bp, Homo sapiens
agagtgtaaaatcattat

SEQ ID NO: 63609 - DNA, 18 bp, Homo sapiens
ggaatgtaaaatggcaca

SEQ ID NO: 63610 - DNA, 18 bp, Homo sapiens
aggaatgtgtggctcaca

SEQ ID NO: 63611 - DNA, 18 bp, Homo sapiens
aggaatgtgagtatcaca

SEQ ID NO: 63612 - DNA, 22 bp, Homo sapiens
aggcatgtggtgcctatcacaa

SEQ ID NO: 63613 - DNA, 23 bp, Homo sapiens
aggagtgtaaaatctgaccccaa

SEQ ID NO: 63614 - DNA, 65 bp, Bean pod mottle virus
aaagcaatcgttacttgattttaaagacttctcaatttctctctacatttcctgtatacggcttt

SEQ ID NO: 63615 - DNA, 24 bp, Bean pod mottle virus
aatcgttacttgattttaaagact

SEQ ID NO: 63616 - DNA, 20 bp, Homo sapiens
cgttactggttttaaaggct

SEQ ID NO: 63617 - DNA, 25 bp, Homo sapiens
aatcagttacttaaaaatgaagact

SEQ ID NO: 63618 - DNA, 81 bp, Bean pod mottle virus
ggtgaaatcttctgggctagtgctctcactctcctatctggcataggacttcgtgagtagactttcccatttcttttctct

SEQ ID NO: 63619 - DNA, 24 bp, Bean pod mottle virus
tagtgctctcactctcctatctgg

SEQ ID NO: 63620 - DNA, 22 bp, Homo sapiens
agtgctctctctctctgtctgg

SEQ ID NO: 63621 - DNA, 19 bp, Homo sapiens
tagtactcttacttatctg

SEQ ID NO: 63622 - DNA, 22 bp, Homo sapiens
tagaggcccttttcctatctgg

SEQ ID NO: 63623 - DNA, 19 bp, Homo sapiens
tggtcttctcgtccatctg

SEQ ID NO: 63624 - DNA, 19 bp, Homo sapiens
tagtgctccactctcccac

SEQ ID NO: 63625 - DNA, 118 bp, Human papillomavirus type 63
caacttgttctgagacgtctggatctgatcccgaccgctgtcgttactgccaaagacgaaagtggtaggcgcgaaccgtttgtggtttccctggggctagcagaaactctttaggttg

SEQ ID NO: 63626 - DNA, 24 bp, Human papillomavirus type 63
tccctggggctagcagaaactctt

SEQ ID NO: 63627 - DNA, 25 bp, Homo sapiens
cctctggggctggtttctgtctctt

SEQ ID NO: 63628 - DNA, 20 bp, Homo sapiens
tccctggggctgccgggacc

SEQ ID NO: 63629 - DNA, 17 bp, Homo sapiens
ccctggggctagcctct

SEQ ID NO: 63630 - DNA, 23 bp, Homo sapiens
ctggggaccagtcaggggctctt

SEQ ID NO: 63631 - DNA, 20 bp, Homo sapiens
cctgggggctggcagggact

SEQ ID NO: 63632 - DNA, 16 bp, Homo sapiens
cctggaaagaagctct

SEQ ID NO: 63633 - DNA, 17 bp, Homo sapiens
tccctgggttagcagaa

SEQ ID NO: 63634 - DNA, 21 bp, Homo sapiens
tctctggggctgccaaatctt

SEQ ID NO: 63635 - DNA, 18 bp, Homo sapiens
ccttggggccagagctct

SEQ ID NO: 63636 - DNA, 21 bp, Homo sapiens
tccctggggctgcttcctctc

SEQ ID NO: 63637 - DNA, 19 bp, Homo sapiens
tccctggagctaaagttct

SEQ ID NO: 63638 - DNA, 21 bp, Homo sapiens
cttggctgaacagaaactctt

SEQ ID NO: 63639 - DNA, 17 bp, Homo sapiens
tccctggggctagtgaa

SEQ ID NO: 63640 - DNA, 20 bp, Homo sapiens
tccctggggttggtcagaaa

SEQ ID NO: 63641 - DNA, 20 bp, Homo sapiens
cctgaggcaccaggactctt

SEQ ID NO: 63642 - DNA, 25 bp, Homo sapiens
tccctgggttagtttctgaattctt

SEQ ID NO: 63643 - DNA, 21 bp, Homo sapiens
tctctggggcttgcactgcct

SEQ ID NO: 63644 - DNA, 22 bp, Homo sapiens
tccctaggttcaagggattctt

SEQ ID NO: 63645 - DNA, 21 bp, Homo sapiens
tccctggggctggaatgtctt

SEQ ID NO: 63646 - DNA, 21 bp, Homo sapiens
tgggattatgtggaaactctt

SEQ ID NO: 63647 - DNA, 22 bp, Homo sapiens
tccctggggctgctggtttctt

SEQ ID NO: 63648 - DNA, 21 bp, Homo sapiens
cctctggaatcagaaactctt

SEQ ID NO: 63649 - DNA, 21 bp, Homo sapiens
tctgtggggccagggactctt

SEQ ID NO: 63650 - DNA, 64 bp, Canine adenovirus
gcagagacgaaagaggagtactcttgagtgcgcagcgagaagagttttctctcagcgaatctgc

SEQ ID NO: 63651 - DNA, 24 bp, Canine adenovirus
aggagtactcttgagtgcgcagcg

SEQ ID NO: 63652 - DNA, 19 bp, Homo sapiens
ggggtcccgggaagtgcgc

SEQ ID NO: 63653 - DNA, 20 bp, Homo sapiens
aggggcactcttgagtagcg

SEQ ID NO: 63654 - DNA, 20 bp, Homo sapiens
aggagtactccttgaggggc

SEQ ID NO: 63655 - DNA, 22 bp, Homo sapiens
ggggactttgagtgctgtgcag

SEQ ID NO: 63656 - DNA, 20 bp, Homo sapiens
aggagtactctttagttaac

SEQ ID NO: 63657 - DNA, 19 bp, Homo sapiens
ggaggcggccagtgcgcag

SEQ ID NO: 63658 - DNA, 24 bp, Homo sapiens
ggagtgttcgttgagggcacagcg

SEQ ID NO: 63659 - DNA, 77 bp, Camelpox virus
aaatctatcttatatacacataattattctatcaattttaccaattagttagtgtttaataaaaatatgggggattt

SEQ ID NO: 63660 - DNA, 24 bp, Camelpox virus
ttagtgtttaataaaaatatgggg

SEQ ID NO: 63661 - DNA, 19 bp, Homo sapiens
ttagtgtttaagaaaaaca

SEQ ID NO: 63662 - DNA, 23 bp, Homo sapiens
ttagtgttgtaataaaaaatatg

SEQ ID NO: 63663 - DNA, 23 bp, Homo sapiens
gtgtttaataaatatctcttggg

SEQ ID NO: 63664 - DNA, 19 bp, Homo sapiens
ttagagtttaatacttggg

SEQ ID NO: 63665 - DNA, 21 bp, Homo sapiens
ttagtgtttaataatgaatag

SEQ ID NO: 63666 - DNA, 17 bp, Homo sapiens
ttagtgtttaaaaaaat

SEQ ID NO: 63667 - DNA, 100 bp, Camelpox virus
tccaatagtacattttccagattagatattaatgtcgtatttgaacagagcctgtaacatctcaatgtctttattatctatagccaatgtaatatccgga

SEQ ID NO: 63668 - DNA, 24 bp, Camelpox virus
ttagatattaatgtcgtatttgaa

SEQ ID NO: 63669 - DNA, 24 bp, Homo sapiens
ttacatattaatgtactttttgaa

SEQ ID NO: 63670 - DNA, 24 bp, Homo sapiens
ttacatacgtcaatcgtatttgaa

SEQ ID NO: 63671 - DNA, 131 bp, Aleutian mink disease virus
ttatatatatactaacatctatactactaacctaactatggcctaatgtatgcagtgtcggcgtcgccgacaactacattatattattaggcatagttaggttagtagtatagatgttagtatatatataa

SEQ ID NO: 63672 - DNA, 24 bp, Aleutian mink disease virus
tatatactaacatctatactacta

SEQ ID NO: 63673 - DNA, 19 bp, Homo sapiens
tatacccattatactacta

SEQ ID NO: 63674 - DNA, 17 bp, Homo sapiens
catatactgtccatact

SEQ ID NO: 63675 - DNA, 18 bp, Homo sapiens
tatatcctagcatctata

SEQ ID NO: 63676 - DNA, 17 bp, Homo sapiens
tacactaacatttaact

SEQ ID NO: 63677 - DNA, 21 bp, Homo sapiens
tatatactaactttttaacta

SEQ ID NO: 63678 - DNA, 17 bp, Homo sapiens
tacatactgacatcact

SEQ ID NO: 63679 - DNA, 68 bp, Human papillomavirus type 38
ccctgaaaatcttatgtcatatactgtgtggacatatatatattacctgacagatgaggacatatggg

SEQ ID NO: 63680 - DNA, 24 bp, Human papillomavirus type 38
ttacctgacagatgaggacatatg

SEQ ID NO: 63681 - DNA, 17 bp, Homo sapiens
tgccagtggggacatat

SEQ ID NO: 63682 - DNA, 19 bp, Homo sapiens
tgacagatgaagaaatatg

SEQ ID NO: 63683 - DNA, 17 bp, Homo sapiens
tacctgataagacatat

SEQ ID NO: 63684 - DNA, 22 bp, Homo sapiens
ttacctgacatgatggcagcat

SEQ ID NO: 63685 - DNA, 18 bp, Homo sapiens
ttacctgatagacatata

SEQ ID NO: 63686 - DNA, 17 bp, Homo sapiens
ttacctggagatgaaaa

SEQ ID NO: 63687 - DNA, 19 bp, Homo sapiens
cctgacagatgatgatatg

SEQ ID NO: 63688 - DNA, 21 bp, Homo sapiens
ctgacagatgacaacagtatg

SEQ ID NO: 63689 - DNA, 65 bp, African swine fever virus
tatgatatttaaaatggttgttatataaatttaccgcttacaggtaatctttattcagtatcata

SEQ ID NO: 63690 - DNA, 21 bp, African swine fever virus
taatctttattcagtatcata

SEQ ID NO: 63691 - DNA, 18 bp, Homo sapiens
ctttattcagggatcata

SEQ ID NO: 63692 - DNA, 18 bp, Homo sapiens
tctttcattcagtatcat

SEQ ID NO: 63693 - DNA, 17 bp, Homo sapiens
caatctcaaagtatcat

SEQ ID NO: 63694 - DNA, 19 bp, Homo sapiens
taatctttattttcatcat

SEQ ID NO: 63695 - DNA, 18 bp, Homo sapiens
taatctttaattcagcat

SEQ ID NO: 63696 - DNA, 19 bp, Homo sapiens
taatcttcatcaaatcata

SEQ ID NO: 63697 - DNA, 17 bp, Homo sapiens
taatccttagtatcata

SEQ ID NO: 63698 - DNA, 17 bp, Homo sapiens
acctttattcccaccat

SEQ ID NO: 63699 - DNA, 19 bp, Homo sapiens
atcctgattcagtatcata

SEQ ID NO: 63700 - DNA, 19 bp, Homo sapiens
tctttactcttgcttcata

SEQ ID NO: 63701 - DNA, 18 bp, Homo sapiens
acattcatacagtatcat

SEQ ID NO: 63702 - DNA, 64 bp, Melanoplus sanguinipes entomopoxvirus
aatatcatctattgaatatctttttaaattgctaaaaaagattattttgttaattcattatatt

SEQ ID NO: 63703 - DNA, 24 bp, Melanoplus sanguinipes entomopoxvirus
aagattattttgttaattcattat

SEQ ID NO: 63704 - DNA, 25 bp, Homo sapiens
agattattttattctgaaacattat

SEQ ID NO: 63705 - DNA, 24 bp, Homo sapiens
aagattgtctcagcaattcattat

SEQ ID NO: 63706 - DNA, 20 bp, Homo sapiens
aagattaatttgtaatcatt

SEQ ID NO: 63707 - DNA, 20 bp, Homo sapiens
aagattattttattaattca

SEQ ID NO: 63708 - DNA, 18 bp, Homo sapiens
aagatatattttgttaac

SEQ ID NO: 63709 - DNA, 21 bp, Homo sapiens
agattatttctgcttcattat

SEQ ID NO: 63710 - DNA, 94 bp, Amsacta moorei entomopoxvirus
ttatattttttaaatatttatacatattatattttatttctatatcatataataaaattttgtgtatatcgttacaatatttattaaaatgtaa

SEQ ID NO: 63711 - DNA, 22 bp, Amsacta moorei entomopoxvirus
tacaatatttattaaaatgtaa

SEQ ID NO: 63712 - DNA, 21 bp, Homo sapiens
tacaatattttctaaatgtaa

SEQ ID NO: 63713 - DNA, 19 bp, Homo sapiens
aacaattactaaaatgtaa

SEQ ID NO: 63714 - DNA, 19 bp, Homo sapiens
catctctattaaaatgtaa

SEQ ID NO: 63715 - DNA, 21 bp, Homo sapiens
tacaagagtattaaaatgtaa

SEQ ID NO: 63716 - DNA, 18 bp, Homo sapiens
cacaatatctacaaatgt

SEQ ID NO: 63717 - DNA, 21 bp, Homo sapiens
acaatatatataaaaatgtaa

SEQ ID NO: 63718 - DNA, 20 bp, Homo sapiens
tacaatatatattaaaatat

SEQ ID NO: 63719 - DNA, 20 bp, Homo sapiens
caaaaactattaaaatgtaa

SEQ ID NO: 63720 - DNA, 19 bp, Homo sapiens
caacatttacatacatgta

SEQ ID NO: 63721 - DNA, 19 bp, Homo sapiens
caacaatactaaaatgtaa

SEQ ID NO: 63722 - DNA, 21 bp, Homo sapiens
tacaaaaaaatcaaaatgtaa

SEQ ID NO: 63723 - DNA, 60 bp, Amsacta moorei entomopoxvirus
ggtatttttatcatatttatttaatattttttcattaatattatcatatataatatgacc

SEQ ID NO: 63724 - DNA, 24 bp, Amsacta moorei entomopoxvirus
tcatatttatttaatattttttca

SEQ ID NO: 63725 - DNA, 19 bp, Homo sapiens
tcatatttatttcacattt

SEQ ID NO: 63726 - DNA, 21 bp, Homo sapiens
tcacatttatttacaactttt

SEQ ID NO: 63727 - DNA, 22 bp, Homo sapiens
tcattttatttatactttttca

SEQ ID NO: 63728 - DNA, 23 bp, Homo sapiens
tatttttgtttaatatttcttca

SEQ ID NO: 63729 - DNA, 22 bp, Homo sapiens
tcatatttattaaacacatttt

SEQ ID NO: 63730 - DNA, 77 bp, Fowlpox virus
cccccatcagaaggtttaggtccggtatttacgcctttatcatcggtagatggaggttgtacattcccttctggggg

SEQ ID NO: 63731 - DNA, 21 bp, Fowlpox virus
ttgtacattcccttctggggg

SEQ ID NO: 63732 - DNA, 16 bp, Homo sapiens
ttgtacatctctctgg

SEQ ID NO: 63733 - DNA, 20 bp, Homo sapiens
ttgtacatttactgaggagg

SEQ ID NO: 63734 - DNA, 18 bp, Homo sapiens
ttgtgcatgtctctgagg

SEQ ID NO: 63735 - DNA, 17 bp, Homo sapiens
ttgacattccccatggg

SEQ ID NO: 63736 - DNA, 18 bp, Homo sapiens
ttgtacatattccttctg

SEQ ID NO: 63737 - DNA, 17 bp, Homo sapiens
tgcatttccccaggggg

SEQ ID NO: 63738 - DNA, 20 bp, Homo sapiens
ttgtacatgcctttccttgg

SEQ ID NO: 63739 - DNA, 18 bp, Homo sapiens
ttgtgctttctctggagg

SEQ ID NO: 63740 - DNA, 17 bp, Homo sapiens
ctgtgcattccttctgg

SEQ ID NO: 63741 - DNA, 21 bp, Homo sapiens
ttgtccattctctggaatggg

SEQ ID NO: 63742 - DNA, 17 bp, Homo sapiens
ttgtacattttcctaag

SEQ ID NO: 63743 - DNA, 19 bp, Homo sapiens
gcacattcttttttggggg

SEQ ID NO: 63744 - DNA, 18 bp, Homo sapiens
cactctcctttctggggg

SEQ ID NO: 63745 - DNA, 21 bp, Homo sapiens
ttgcacattcttgggcagggg

SEQ ID NO: 63746 - DNA, 16 bp, Homo sapiens
tgtacatttttctggg

SEQ ID NO: 63747 - DNA, 17 bp, Homo sapiens
ctgtaaacttctggggg

SEQ ID NO: 63748 - DNA, 15 bp, Homo sapiens
ttgcacattcctggg

SEQ ID NO: 63749 - DNA, 19 bp, Homo sapiens
ctgcatttctccctagggg

SEQ ID NO: 63750 - DNA, 18 bp, Homo sapiens
tcgtacatttcctagagg

SEQ ID NO: 63751 - DNA, 18 bp, Homo sapiens
ttgtacatcttcttcaag

SEQ ID NO: 63752 - DNA, 15 bp, Homo sapiens
tgtaattcttccggg

SEQ ID NO: 63753 - DNA, 16 bp, Homo sapiens
ctgtacattctctagg

SEQ ID NO: 63754 - DNA, 20 bp, Homo sapiens
ttgtcgttttcatcctgggg

SEQ ID NO: 63755 - DNA, 21 bp, Homo sapiens
ttgtattatttccccaagggg

SEQ ID NO: 63756 - DNA, 19 bp, Homo sapiens
ttgtacattcacctttctg

SEQ ID NO: 63757 - DNA, 20 bp, Homo sapiens
ctgtacatttcctcccttgg

SEQ ID NO: 63758 - DNA, 16 bp, Homo sapiens
ttgtccattcctgggg

SEQ ID NO: 63759 - DNA, 22 bp, Homo sapiens
ttgtgcactccccgaaaggggg

SEQ ID NO: 63760 - DNA, 16 bp, Homo sapiens
ttgttcattcccttgg

SEQ ID NO: 63761 - DNA, 15 bp, Homo sapiens
ctgtacattctctgg

SEQ ID NO: 63762 - DNA, 19 bp, Homo sapiens
ttgtacattccatccccgg

SEQ ID NO: 63763 - DNA, 17 bp, Homo sapiens
tgcagcctttctggggg

SEQ ID NO: 63764 - DNA, 17 bp, Homo sapiens
ctgtgcattcccttggg

SEQ ID NO: 63765 - DNA, 21 bp, Homo sapiens
tgtgcattccctgaggcgggg

SEQ ID NO: 63766 - DNA, 18 bp, Homo sapiens
ttgtacattggttggggg

SEQ ID NO: 63767 - DNA, 16 bp, Homo sapiens
ttgttcatttccgggg

SEQ ID NO: 63768 - DNA, 21 bp, Homo sapiens
tgtagctttcttttctggggg

SEQ ID NO: 63769 - DNA, 18 bp, Homo sapiens
tacattctcttccagagg

SEQ ID NO: 63770 - DNA, 19 bp, Homo sapiens
ttgtacattttgttctagg

SEQ ID NO: 63771 - DNA, 19 bp, Homo sapiens
ctgccagcctttctggggg

SEQ ID NO: 63772 - DNA, 26 bp, Homo sapiens
ttgtacactcttttggcccccagaag

SEQ ID NO: 63773 - DNA, 18 bp, Homo sapiens
ttgtatatgttctggggg

SEQ ID NO: 63774 - DNA, 21 bp, Homo sapiens
ctgtatgatcctttctggggg

SEQ ID NO: 63775 - DNA, 17 bp, Homo sapiens
ttatacatttcttctgg

SEQ ID NO: 63776 - DNA, 23 bp, Homo sapiens
ttgtacatatgcatgcctggggg

SEQ ID NO: 63777 - DNA, 16 bp, Homo sapiens
tgtacattttctatgg

SEQ ID NO: 63778 - DNA, 18 bp, Homo sapiens
ttgtacattccaaaaggg

SEQ ID NO: 63779 - DNA, 19 bp, Homo sapiens
gcatattcccttttggggg

SEQ ID NO: 63780 - DNA, 17 bp, Homo sapiens
ctgtacatttcctgagg

SEQ ID NO: 63781 - DNA, 18 bp, Homo sapiens
ctgcaccctttctggggg

SEQ ID NO: 63782 - DNA, 18 bp, Homo sapiens
ttgtgtttcccctggggg

SEQ ID NO: 63783 - DNA, 19 bp, Homo sapiens
ttggacatttcctgaaggg

SEQ ID NO: 63784 - DNA, 20 bp, Homo sapiens
ttgttcgttcctccctgggg

SEQ ID NO: 63785 - DNA, 17 bp, Homo sapiens
ttgtgcatttcctaggg

SEQ ID NO: 63786 - DNA, 80 bp, Human adenovirus B
ctgctgccgaggaactgcttgatatggacggccgcacctcagaacagcgactcgcccaactacgcatacgccagcagcag

SEQ ID NO: 63787 - DNA, 24 bp, Human adenovirus B
tcgcccaactacgcatacgccagc

SEQ ID NO: 63788 - DNA, 22 bp, Homo sapiens
gccagacacgccatgcgccggc

SEQ ID NO: 63789 - DNA, 24 bp, Homo sapiens
tcccccaactgcacagacgccagc

SEQ ID NO: 63790 - DNA, 20 bp, Homo sapiens
tcgcccaactgcgacagagc

SEQ ID NO: 63791 - DNA, 23 bp, Homo sapiens
ccttggctaggcacgacgccagc

SEQ ID NO: 63792 - DNA, 22 bp, Homo sapiens
tcgccggctccggctacgccag

SEQ ID NO: 63793 - DNA, 24 bp, Homo sapiens
ccgcccagggatttatacgccagc

SEQ ID NO: 63794 - DNA, 83 bp, Human herpesvirus 7
aacgcttaatagaaattattgtacatttttctattagtatgagtgctatgaaaatttcctacaaaagttctgttttgagtgtt

SEQ ID NO: 63795 - DNA, 24 bp, Human herpesvirus 7
tattgtacatttttctattagtat

SEQ ID NO: 63796 - DNA, 21 bp, Homo sapiens
ttgtacatttttaaaaagtat

SEQ ID NO: 63797 - DNA, 20 bp, Homo sapiens
tattgtacattgtttcaact

SEQ ID NO: 63798 - DNA, 20 bp, Homo sapiens
tattgtacattcttcagtta

SEQ ID NO: 63799 - DNA, 23 bp, Homo sapiens
tattgtacatttatttttagtat

SEQ ID NO: 63800 - DNA, 97 bp, Human herpesvirus 7
cataaatattctaagccaaatatttttctcgtgattagtctgcgttacttctgtcaccacactcatatttttcatggtatttgttagaatatctgtg

SEQ ID NO: 63801 - DNA, 18 bp, Human herpesvirus 7
tttgttagaatatctgtg

SEQ ID NO: 63802 - DNA, 17 bp, Homo sapiens
tttgttagatacgtgtg

SEQ ID NO: 63803 - DNA, 17 bp, Homo sapiens
tttgtcagaaggctgtg

SEQ ID NO: 63804 - DNA, 16 bp, Homo sapiens
tttgctaggatctgtg

SEQ ID NO: 63805 - DNA, 19 bp, Homo sapiens
tttgctagagtcacacctg

SEQ ID NO: 63806 - DNA, 18 bp, Homo sapiens
tttataagaatatctgtg

SEQ ID NO: 63807 - DNA, 20 bp, Homo sapiens
ttgttagaataataattgtg

SEQ ID NO: 63808 - DNA, 17 bp, Homo sapiens
tttattagaatactatg

SEQ ID NO: 63809 - DNA, 17 bp, Homo sapiens
cttgttagaacattgtg

SEQ ID NO: 63810 - DNA, 19 bp, Homo sapiens
tttgttagaagcatcagtg

SEQ ID NO: 63811 - DNA, 18 bp, Homo sapiens
tctgtttaatcatctgtg

SEQ ID NO: 63812 - DNA, 17 bp, Homo sapiens
tttgttagaatactgtg

SEQ ID NO: 63813 - DNA, 18 bp, Homo sapiens
tttgtcccaatatctgtg

SEQ ID NO: 63814 - DNA, 20 bp, Homo sapiens
ttcgttaaccattatctgtg

SEQ ID NO: 63815 - DNA, 18 bp, Homo sapiens
ttgtctccaatatctgtg

SEQ ID NO: 63816 - DNA, 16 bp, Homo sapiens
tttgttattatctgtg

SEQ ID NO: 63817 - DNA, 16 bp, Homo sapiens
tttgtctacatctgtg

SEQ ID NO: 63818 - DNA, 17 bp, Homo sapiens
tctgttgatcatctgtg

SEQ ID NO: 63819 - DNA, 18 bp, Homo sapiens
tttcttagttcatctgtg

SEQ ID NO: 63820 - DNA, 16 bp, Homo sapiens
tttgtaaacatctgtg

SEQ ID NO: 63821 - DNA, 16 bp, Homo sapiens
tctgttagaaactgtg

SEQ ID NO: 63822 - DNA, 19 bp, Homo sapiens
tctgttaatttaatctgtg

SEQ ID NO: 63823 - DNA, 80 bp, Human herpesvirus 7
atggcggttgtactgtaatttctcaaatcaaagttttaaagtatgctttgtcacggagatactctacactacgaagttat

SEQ ID NO: 63824 - DNA, 24 bp, Human herpesvirus 7
tcacggagatactctacactacga

SEQ ID NO: 63825 - DNA, 18 bp, Homo sapiens
tcacagagatgttctgca

SEQ ID NO: 63826 - DNA, 23 bp, Homo sapiens
tcacggagtatgctggccccact

SEQ ID NO: 63827 - DNA, 18 bp, Homo sapiens
tcacagagatactcttca

SEQ ID NO: 63828 - DNA, 18 bp, Homo sapiens
tcaggagatactctccct

SEQ ID NO: 63829 - DNA, 83 bp, Chimpanzee cytomegalovirus
gtgacggcccctgcggtcgcctgacctccgttgcccgggacacccaccgcaccatgtacgtcttagaccacgggttcgtacgc

SEQ ID NO: 63830 - DNA, 24 bp, Chimpanzee cytomegalovirus
ccgcaccatgtacgtcttagacca

SEQ ID NO: 63831 - DNA, 16 bp, Homo sapiens
gcgcatgtacaagacc

SEQ ID NO: 63832 - DNA, 19 bp, Homo sapiens
caccaaaagtcttagacca

SEQ ID NO: 63833 - DNA, 17 bp, Homo sapiens
ccgcatcattcctagac

SEQ ID NO: 63834 - DNA, 19 bp, Homo sapiens
caccatgtgtgtcctgcca

SEQ ID NO: 63835 - DNA, 19 bp, Homo sapiens
gcaaacatgttttagacca

SEQ ID NO: 63836 - DNA, 20 bp, Homo sapiens
cctcactatgtacgtcaacc

SEQ ID NO: 63837 - DNA, 20 bp, Homo sapiens
gcaccatgagaggtagacca

SEQ ID NO: 63838 - DNA, 17 bp, Homo sapiens
caccatgtgggccagac

SEQ ID NO: 63839 - DNA, 17 bp, Homo sapiens
ccgcagtgtccttagac

SEQ ID NO: 63840 - DNA, 19 bp, Homo sapiens
gctgccgtgtcttagacca

SEQ ID NO: 63841 - DNA, 21 bp, Homo sapiens
caggccatacgtcttgggcca

SEQ ID NO: 63842 - DNA, 19 bp, Homo sapiens
gctgtgttagcttagacca

SEQ ID NO: 63843 - DNA, 70 bp, Equine herpesvirus 1
ggtattaccatagacgcggcgtatagtaccagcgtatctcacctggtagcggcgcgtagtggattttgcc

SEQ ID NO: 63844 - DNA, 24 bp, Equine herpesvirus 1
taccatagacgcggcgtatagtac

SEQ ID NO: 63845 - DNA, 22 bp, Homo sapiens
taccataagtgcggtcgactgc

SEQ ID NO: 63846 - DNA, 81 bp, Olive latent virus 2
caaagcattgaaggtggctcgcctagagcggattgtttcagtagtccataaatctgaatggggtgaagcagctatgctgtg

SEQ ID NO: 63847 - DNA, 24 bp, Olive latent virus 2
tgaatggggtgaagcagctatgct

SEQ ID NO: 63848 - DNA, 28 bp, Homo sapiens
tgaatggggtggggagatagcatagctg

SEQ ID NO: 63849 - DNA, 20 bp, Homo sapiens
tggatggggtagggcaggta

SEQ ID NO: 63850 - DNA, 23 bp, Homo sapiens
taaatggggtaaagggttatgct

SEQ ID NO: 63851 - DNA, 27 bp, Homo sapiens
tggatggggtggatattagcatagctg

SEQ ID NO: 63852 - DNA, 22 bp, Homo sapiens
tgaatgggtggggcagggagcc

SEQ ID NO: 63853 - DNA, 26 bp, Homo sapiens
tgaatggggaggactcctgctatgct

SEQ ID NO: 63854 - DNA, 16 bp, Homo sapiens
aaacagggtggctatg

SEQ ID NO: 63855 - DNA, 27 bp, Homo sapiens
gagtggggtgaaatgttagcatagctg

SEQ ID NO: 63856 - DNA, 22 bp, Homo sapiens
tgaatggggaggggtgcacact

SEQ ID NO: 63857 - DNA, 26 bp, Homo sapiens
tgaagatttattgaagcagttatgct

SEQ ID NO: 63858 - DNA, 23 bp, Homo sapiens
taaattctgaaggtagctatgct

SEQ ID NO: 63859 - DNA, 19 bp, Homo sapiens
tggatggggttgggcagcc

SEQ ID NO: 63860 - DNA, 24 bp, Homo sapiens
tgagtggggagaagcagcagcacc

SEQ ID NO: 63861 - DNA, 20 bp, Homo sapiens
gagatggaagcagctatgct

SEQ ID NO: 63862 - DNA, 18 bp, Homo sapiens
tgaatggggtaagcttgc

SEQ ID NO: 63863 - DNA, 18 bp, Homo sapiens
gaaggggagtggctgtgc

SEQ ID NO: 63864 - DNA, 19 bp, Homo sapiens
aaatgggagtggctatgct

SEQ ID NO: 63865 - DNA, 25 bp, Homo sapiens
tgaatgggagatgggtggctgtgct

SEQ ID NO: 63866 - DNA, 20 bp, Homo sapiens
gagtggggtgaggcccagct

SEQ ID NO: 63867 - DNA, 20 bp, Homo sapiens
gaatggggtgaagtgggacc

SEQ ID NO: 63868 - DNA, 20 bp, Homo sapiens
tgagatggggtggggcatct

SEQ ID NO: 63869 - DNA, 18 bp, Homo sapiens
agagtgatggcagctatg

SEQ ID NO: 63870 - DNA, 86 bp, Olive latent virus 2
gctcgtatgagccggtgattccgttatcattcttgctgcgtataacgtacgcttaattgtgtcaatggtgtactcggttcacgagt

SEQ ID NO: 63871 - DNA, 24 bp, Olive latent virus 2
tcaatggtgtactcggttcacgag

SEQ ID NO: 63872 - DNA, 18 bp, Homo sapiens
tcaatggtgttaacacgg

SEQ ID NO: 63873 - DNA, 17 bp, Homo sapiens
aatggtgtccaggtacg

SEQ ID NO: 63874 - DNA, 24 bp, Homo sapiens
tcaatggtgcatttcagagctgag

SEQ ID NO: 63875 - DNA, 75 bp, Myxoma virus
tgacgaattacgacattattttagaggacgtgtgtgcgtacatcaacgagtcgcgggtccttaagaggttcgtca

SEQ ID NO: 63876 - DNA, 24 bp, Myxoma virus
tagaggacgtgtgtgcgtacatca

SEQ ID NO: 63877 - DNA, 18 bp, Homo sapiens
tagagaacagggcgtgtg

SEQ ID NO: 63878 - DNA, 24 bp, Homo sapiens
gactgcatgtgtgtgtgtatgtca

SEQ ID NO: 63879 - DNA, 19 bp, Homo sapiens
tagggtgcgtgtgtgtgca

SEQ ID NO: 63880 - DNA, 17 bp, Homo sapiens
tagagatgtgtgtgcat

SEQ ID NO: 63881 - DNA, 18 bp, Homo sapiens
gaggacgtgtctccacat

SEQ ID NO: 63882 - DNA, 18 bp, Homo sapiens
tagagtgtgtgtgtgcgt

SEQ ID NO: 63883 - DNA, 23 bp, Homo sapiens
gggggtgaccaccgtgtacatca

SEQ ID NO: 63884 - DNA, 17 bp, Homo sapiens
gacaaccgcgtacatca

SEQ ID NO: 63885 - DNA, 23 bp, Homo sapiens
gggggtgaccagtgtgtacatca

SEQ ID NO: 63886 - DNA, 85 bp, Paramecium bursaria Chlorella virus 1
ctttccacgttgatcttttatgtttctcttctgcgagtttattcagttgattttgaagcgttgcaacatcttcggccgttgaaag

SEQ ID NO: 63887 - DNA, 24 bp, Paramecium bursaria Chlorella virus 1
ttgaagcgttgcaacatcttcggc

SEQ ID NO: 63888 - DNA, 21 bp, Homo sapiens
ttgaagcagccacgttttcgg

SEQ ID NO: 63889 - DNA, 21 bp, Homo sapiens
gaggcactgggtgtcttcggc

SEQ ID NO: 63890 - DNA, 22 bp, Homo sapiens
ttaaagtgtgtagtatcttcgg

SEQ ID NO: 63891 - DNA, 23 bp, Homo sapiens
tggcaactgtgtgacatctttgg

SEQ ID NO: 63892 - DNA, 20 bp, Homo sapiens
agctcttgagtatcttcggc

SEQ ID NO: 63893 - DNA, 21 bp, Homo sapiens
tgaggccacagtatcttcggc

SEQ ID NO: 63894 - DNA, 112 bp, Rabbit fibroma virus
ctatcgccacggaactcactaattatgacattattttagaggacgtctgttcgtatatcaacgagtctaaactccttaaacggtttgtcaagttatacaaaacgactaatag

SEQ ID NO: 63895 - DNA, 24 bp, Rabbit fibroma virus
agaggacgtctgttcgtatatcaa

SEQ ID NO: 63896 - DNA, 21 bp, Homo sapiens
agaggatgtctgctcatcaca

SEQ ID NO: 63897 - DNA, 20 bp, Homo sapiens
gaggatgatggatatatcaa

SEQ ID NO: 63898 - DNA, 19 bp, Homo sapiens
agggagtgtctgttcacca

SEQ ID NO: 63899 - DNA, 22 bp, Homo sapiens
gaagatgtctgttcttctagtc

SEQ ID NO: 63900 - DNA, 18 bp, Homo sapiens
gaggaggtctgttccaca

SEQ ID NO: 63901 - DNA, 60 bp, Vaccinia virus
taacaatatattattagtttatattactgaattaataatataaaattcccaatcttgtta

SEQ ID NO: 63902 - DNA, 24 bp, Vaccinia virus
ttaataatataaaattcccaatct

SEQ ID NO: 63903 - DNA, 24 bp, Homo sapiens
taataatataaaataaaaacatct

SEQ ID NO: 63904 - DNA, 66 bp, Tupaia herpesvirus
aaggttagtgagattcctattccaaaatcatgaaggagtttgtattcgttttttctcattttcctt

SEQ ID NO: 63905 - DNA, 24 bp, Tupaia herpesvirus
ttagtgagattcctattccaaaat

SEQ ID NO: 63906 - DNA, 21 bp, Homo sapiens
tcagtgaggttcctttaattc

SEQ ID NO: 63907 - DNA, 17 bp, Homo sapiens
ttagtgaggtcctgttc

SEQ ID NO: 63908 - DNA, 20 bp, Homo sapiens
gtgagattttataacaaaat

SEQ ID NO: 63909 - DNA, 18 bp, Homo sapiens
tagtgagattcttgttcc

SEQ ID NO: 63910 - DNA, 19 bp, Homo sapiens
ttagtgagatatttctcca

SEQ ID NO: 63911 - DNA, 24 bp, Homo sapiens
ctagccacatttctattccaaaat

SEQ ID NO: 63912 - DNA, 27 bp, Homo sapiens
ttagtgagattctcatgctattctaaa

SEQ ID NO: 63913 - DNA, 18 bp, Homo sapiens
gtggaaatattccaaaat

SEQ ID NO: 63914 - DNA, 79 bp, Tupaia herpesvirus
gctccaccccgccgacgagccggccgccgtccgggtgcgcggacgcggacggtgggggacgcgggggcggggcgcgagc

SEQ ID NO: 63915 - DNA, 24 bp, Tupaia herpesvirus
ggacggtgggggacgcgggggcgg

SEQ ID NO: 63916 - DNA, 24 bp, Homo sapiens
ggggtggggatgggatgggggtgg

SEQ ID NO: 63917 - DNA, 23 bp, Homo sapiens
ggaggtggatgcggcgggggcgg

SEQ ID NO: 63918 - DNA, 20 bp, Homo sapiens
ggtggggggaggcggggtgg

SEQ ID NO: 63919 - DNA, 21 bp, Homo sapiens
ggggtgggggtggaggggtgg

SEQ ID NO: 63920 - DNA, 17 bp, Homo sapiens
ggcggcggggcggggcg

SEQ ID NO: 63921 - DNA, 19 bp, Homo sapiens
ggggcggcgtgcgggggcg

SEQ ID NO: 63922 - DNA, 25 bp, Homo sapiens
ggacacggctggggtgtgggggtgg

SEQ ID NO: 63923 - DNA, 18 bp, Homo sapiens
ggcgttgaggcgggggcg

SEQ ID NO: 63924 - DNA, 17 bp, Homo sapiens
ggggtggggggtggggg

SEQ ID NO: 63925 - DNA, 23 bp, Homo sapiens
ggcgtgtcgcagcgcgggggtgg

SEQ ID NO: 63926 - DNA, 23 bp, Homo sapiens
ggacggtggaggaacaatggtgg

SEQ ID NO: 63927 - DNA, 17 bp, Homo sapiens
ggggtgggggtggggcg

SEQ ID NO: 63928 - DNA, 22 bp, Homo sapiens
ggcgtggggtgcgcgggggcgg

SEQ ID NO: 63929 - DNA, 17 bp, Homo sapiens
ggaggtggggaaggggg

SEQ ID NO: 63930 - DNA, 20 bp, Homo sapiens
ggcgtgtcccgcgggggcgg

SEQ ID NO: 63931 - DNA, 17 bp, Homo sapiens
ggtgggcggcgggggcg

SEQ ID NO: 63932 - DNA, 21 bp, Homo sapiens
ggcacggtggggggagggtgg

SEQ ID NO: 63933 - DNA, 20 bp, Homo sapiens
ggtggtggggctgggggtgg

SEQ ID NO: 63934 - DNA, 18 bp, Homo sapiens
ggcctgggtgcgggggcg

SEQ ID NO: 63935 - DNA, 21 bp, Homo sapiens
ggcgtggggcgcggggggcgg

SEQ ID NO: 63936 - DNA, 24 bp, Homo sapiens
ggagggtggccgtggcgggggtgg

SEQ ID NO: 63937 - DNA, 16 bp, Homo sapiens
ggtggtgcgggggcag

SEQ ID NO: 63938 - DNA, 19 bp, Homo sapiens
ggacggtggggatgaagcg

SEQ ID NO: 63939 - DNA, 18 bp, Homo sapiens
ggacgctggggaggggcg

SEQ ID NO: 63940 - DNA, 22 bp, Homo sapiens
ggagggtgggggcatggggtgg

SEQ ID NO: 63941 - DNA, 17 bp, Homo sapiens
ggggtggggtgaggggg

SEQ ID NO: 63942 - DNA, 17 bp, Homo sapiens
ggggtgggggacgctgg

SEQ ID NO: 63943 - DNA, 20 bp, Homo sapiens
ggcggtgggcgggcaggcgg

SEQ ID NO: 63944 - DNA, 26 bp, Homo sapiens
ggcggagggggcgcgggcgggggcgg

SEQ ID NO: 63945 - DNA, 16 bp, Homo sapiens
ggacggggggcggggc

SEQ ID NO: 63946 - DNA, 22 bp, Homo sapiens
ggggtggggggcggtgaggcgg

SEQ ID NO: 63947 - DNA, 21 bp, Homo sapiens
ggagggtggggtggggggcgg

SEQ ID NO: 63948 - DNA, 17 bp, Homo sapiens
ggccgagcgcgggggcg

SEQ ID NO: 63949 - DNA, 20 bp, Homo sapiens
gggtggtggggggcgggtgg

SEQ ID NO: 63950 - DNA, 20 bp, Homo sapiens
ggtggggagggcgggggcgg

SEQ ID NO: 63951 - DNA, 15 bp, Homo sapiens
ggcggcggggggggc

SEQ ID NO: 63952 - DNA, 15 bp, Homo sapiens
cggtgggggagggcg

SEQ ID NO: 63953 - DNA, 20 bp, Homo sapiens
ggtggggcggtggggggcgg

SEQ ID NO: 63954 - DNA, 19 bp, Homo sapiens
gggtgtgggggagggggcg

SEQ ID NO: 63955 - DNA, 21 bp, Homo sapiens
agatggtgggagtgggggtgg

SEQ ID NO: 63956 - DNA, 18 bp, Homo sapiens
gggtgtgggggacgcagg

SEQ ID NO: 63957 - DNA, 24 bp, Homo sapiens
ggatgctgggggacggtctcatgg

SEQ ID NO: 63958 - DNA, 23 bp, Homo sapiens
ggaaggtggggagagaggggtgg

SEQ ID NO: 63959 - DNA, 18 bp, Homo sapiens
ggacaggacgcgggggcg

SEQ ID NO: 63960 - DNA, 16 bp, Homo sapiens
ggggtgggggtggggg

SEQ ID NO: 63961 - DNA, 18 bp, Homo sapiens
ggacggaggggcggggcg

SEQ ID NO: 63962 - DNA, 21 bp, Homo sapiens
ggagggtgggggaaaaggcgg

SEQ ID NO: 63963 - DNA, 20 bp, Homo sapiens
ggcggggggagagggggcgg

SEQ ID NO: 63964 - DNA, 20 bp, Homo sapiens
ggcggcgggggaaggggcgg

SEQ ID NO: 63965 - DNA, 22 bp, Homo sapiens
ggtggggggggtgggggggcgg

SEQ ID NO: 63966 - DNA, 17 bp, Homo sapiens
ggggtgggggtgagggg

SEQ ID NO: 63967 - DNA, 22 bp, Homo sapiens
gggggtggggggtggggggtgg

SEQ ID NO: 63968 - DNA, 18 bp, Homo sapiens
ggtgggggcgagggggcg

SEQ ID NO: 63969 - DNA, 20 bp, Homo sapiens
ggaggtgggggttagggtgg

SEQ ID NO: 63970 - DNA, 21 bp, Homo sapiens
agaatgggggtgcgggggtgg

SEQ ID NO: 63971 - DNA, 18 bp, Homo sapiens
ggaggtggggggagggcg

SEQ ID NO: 63972 - DNA, 22 bp, Homo sapiens
gatggaggtttcttgggggtgg

SEQ ID NO: 63973 - DNA, 23 bp, Homo sapiens
ggtggtgggggcggtgggggtgg

SEQ ID NO: 63974 - DNA, 18 bp, Homo sapiens
ggggtggtggtgggggcg

SEQ ID NO: 63975 - DNA, 23 bp, Homo sapiens
ggactgtgcctctgtgggggcgg

SEQ ID NO: 63976 - DNA, 17 bp, Homo sapiens
ggcgctgggggcgggcg

SEQ ID NO: 63977 - DNA, 23 bp, Homo sapiens
ggcggggcccgacgcgggggcgg

SEQ ID NO: 63978 - DNA, 23 bp, Homo sapiens
ggagcggtgggaaaggggggtgg

SEQ ID NO: 63979 - DNA, 22 bp, Homo sapiens
ggacgggggcccatgggggtgg

SEQ ID NO: 63980 - DNA, 22 bp, Homo sapiens
ggtgggggtggggtgggggtgg

SEQ ID NO: 63981 - DNA, 23 bp, Homo sapiens
ggacctcgagggcgtgggggcgg

SEQ ID NO: 63982 - DNA, 23 bp, Homo sapiens
ggcggggctggccgcgggggcgg

SEQ ID NO: 63983 - DNA, 18 bp, Homo sapiens
ggtcgtggggggcagcgg

SEQ ID NO: 63984 - DNA, 25 bp, Homo sapiens
gggtgggggggacagttgggggtgg

SEQ ID NO: 63985 - DNA, 20 bp, Homo sapiens
ggggtgggggcggagggcgg

SEQ ID NO: 63986 - DNA, 18 bp, Homo sapiens
ggggtgggggacgggtgg

SEQ ID NO: 63987 - DNA, 22 bp, Homo sapiens
ggaggtggacaaccgggggcgg

SEQ ID NO: 63988 - DNA, 18 bp, Homo sapiens
ggatggtggggggaggag

SEQ ID NO: 63989 - DNA, 15 bp, Homo sapiens
ggacgtgagcggggg

SEQ ID NO: 63990 - DNA, 21 bp, Homo sapiens
ggtagtgggagcagggggtgg

SEQ ID NO: 63991 - DNA, 22 bp, Homo sapiens
ggatggtgaggggtgtgccagg

SEQ ID NO: 63992 - DNA, 15 bp, Homo sapiens
ggcgggggcgggggc

SEQ ID NO: 63993 - DNA, 21 bp, Homo sapiens
ggatggtgaggggggaggtgg

SEQ ID NO: 63994 - DNA, 17 bp, Homo sapiens
ggcgggggaagggggcg

SEQ ID NO: 63995 - DNA, 22 bp, Homo sapiens
gggtggtgggggtcaggggcgg

SEQ ID NO: 63996 - DNA, 19 bp, Homo sapiens
ggggtggggggcgtggggg

SEQ ID NO: 63997 - DNA, 22 bp, Homo sapiens
ggcggtggaggggctgtagtgg

SEQ ID NO: 63998 - DNA, 23 bp, Homo sapiens
gggagtggtgggtgtgggggtgg

SEQ ID NO: 63999 - DNA, 17 bp, Homo sapiens
ggcagtgagtgggggcg

SEQ ID NO: 64000 - DNA, 17 bp, Homo sapiens
ggcagtggggctggggg

SEQ ID NO: 64001 - DNA, 20 bp, Homo sapiens
gggggtgggggtgggggtgg

SEQ ID NO: 64002 - DNA, 17 bp, Homo sapiens
agtgggtgcgggggtgg

SEQ ID NO: 64003 - DNA, 22 bp, Homo sapiens
ggaggtggggggcgaggggcgg

SEQ ID NO: 64004 - DNA, 21 bp, Homo sapiens
ggaggtgggggtctggggtgg

SEQ ID NO: 64005 - DNA, 16 bp, Homo sapiens
ggtggagcgcgggggg

SEQ ID NO: 64006 - DNA, 17 bp, Homo sapiens
ggggtgggggtgggggg

SEQ ID NO: 64007 - DNA, 23 bp, Homo sapiens
ggcggggggcaggccgggggcgg

SEQ ID NO: 64008 - DNA, 24 bp, Homo sapiens
ggatggtgaggggcaccacggtgg

SEQ ID NO: 64009 - DNA, 21 bp, Homo sapiens
ggcggggctagccgggggcgg

SEQ ID NO: 64010 - DNA, 20 bp, Homo sapiens
cgctgcgggcgcgggggcgg

SEQ ID NO: 64011 - DNA, 23 bp, Homo sapiens
ggacggcgggggtcccggggtgg

SEQ ID NO: 64012 - DNA, 17 bp, Homo sapiens
ggtgtggggagggggcg

SEQ ID NO: 64013 - DNA, 22 bp, Homo sapiens
ggcaggtggagggtgggggtgg

SEQ ID NO: 64014 - DNA, 23 bp, Homo sapiens
ggcggtgggggcggtgggggtgg

SEQ ID NO: 64015 - DNA, 21 bp, Homo sapiens
ggcggcgggggcggcgggcgg

SEQ ID NO: 64016 - DNA, 25 bp, Homo sapiens
gggtggtggggggaggacagggtgg

SEQ ID NO: 64017 - DNA, 25 bp, Homo sapiens
gacggtgggggggccggaggggtgg

SEQ ID NO: 64018 - DNA, 17 bp, Homo sapiens
ggtgtggggtgggggcg

SEQ ID NO: 64019 - DNA, 24 bp, Homo sapiens
ggtggggggttagggtgggggtgg

SEQ ID NO: 64020 - DNA, 20 bp, Homo sapiens
ggggtggggggttagggtgg

SEQ ID NO: 64021 - DNA, 18 bp, Homo sapiens
ggatggtggggatggcgg

SEQ ID NO: 64022 - DNA, 23 bp, Homo sapiens
gggcggtggggccaatggggcgg

SEQ ID NO: 64023 - DNA, 18 bp, Homo sapiens
ggggtgggggcaggggcg

SEQ ID NO: 64024 - DNA, 23 bp, Homo sapiens
gacggtgggggaccgcatggtgg

SEQ ID NO: 64025 - DNA, 20 bp, Homo sapiens
ggcggtggggaccggggcgg

SEQ ID NO: 64026 - DNA, 20 bp, Homo sapiens
ggacgtgggtgcgggggcgg

SEQ ID NO: 64027 - DNA, 21 bp, Homo sapiens
ggtggtggggagatggggtgg

SEQ ID NO: 64028 - DNA, 21 bp, Homo sapiens
ggagtggaagtgtgggggtgg

SEQ ID NO: 64029 - DNA, 18 bp, Homo sapiens
ggggtgggcgcgggggcg

SEQ ID NO: 64030 - DNA, 18 bp, Homo sapiens
ggcgcgtgggggacgcgg

SEQ ID NO: 64031 - DNA, 21 bp, Homo sapiens
gacggtggctggcgggggtgg

SEQ ID NO: 64032 - DNA, 26 bp, Homo sapiens
ggcggtggggggaaaggcgggggcgg

SEQ ID NO: 64033 - DNA, 19 bp, Homo sapiens
gggtgatgggggatggtgg

SEQ ID NO: 64034 - DNA, 17 bp, Homo sapiens
ggcgggggctgggggcg

SEQ ID NO: 64035 - DNA, 22 bp, Homo sapiens
ggggtgggggcccgaggggcgg

SEQ ID NO: 64036 - DNA, 22 bp, Homo sapiens
ggcggtcggggtcagggggcgg

SEQ ID NO: 64037 - DNA, 18 bp, Homo sapiens
ggtggctgggcgggggcg

SEQ ID NO: 64038 - DNA, 22 bp, Homo sapiens
ggcggtccgcgtgcgggggcgg

SEQ ID NO: 64039 - DNA, 20 bp, Homo sapiens
gatgagtgccgcgggggtgg

SEQ ID NO: 64040 - DNA, 22 bp, Homo sapiens
ggggtgaggggtgtgggggtgg

SEQ ID NO: 64041 - DNA, 22 bp, Homo sapiens
agacggtgggggcggggggtgg

SEQ ID NO: 64042 - DNA, 19 bp, Homo sapiens
ggcaggtgggggatggtgg

SEQ ID NO: 64043 - DNA, 23 bp, Homo sapiens
ggatggtggggaggagggggcgg

SEQ ID NO: 64044 - DNA, 21 bp, Homo sapiens
gggggtggggggcgccggcgg

SEQ ID NO: 64045 - DNA, 21 bp, Homo sapiens
ggccgtgggggatgggggcgg

SEQ ID NO: 64046 - DNA, 20 bp, Homo sapiens
gggtggtgggggattccagg

SEQ ID NO: 64047 - DNA, 20 bp, Homo sapiens
gggtggtgggggctgccagg

SEQ ID NO: 64048 - DNA, 21 bp, Homo sapiens
ggcgtggggggtggggggcgg

SEQ ID NO: 64049 - DNA, 16 bp, Homo sapiens
ggcggtggtgggggcg

SEQ ID NO: 64050 - DNA, 19 bp, Homo sapiens
ggatggtgtggagggggcg

SEQ ID NO: 64051 - DNA, 20 bp, Homo sapiens
ggggtgggggatggtttcgg

SEQ ID NO: 64052 - DNA, 87 bp, Tupaia herpesvirus
atctatgaaaacagacgactataaagagataggctagcaattctaatcgggaatcatactaagtatagtagtatcacatcattggat

SEQ ID NO: 64053 - DNA, 24 bp, Tupaia herpesvirus
atcatactaagtatagtagtatca

SEQ ID NO: 64054 - DNA, 18 bp, Homo sapiens
ctattacaagtagtatca

SEQ ID NO: 64055 - DNA, 23 bp, Homo sapiens
tcatgctgggagttgtagtatca

SEQ ID NO: 64056 - DNA, 21 bp, Homo sapiens
taccaacttatagtagtatca

SEQ ID NO: 64057 - DNA, 18 bp, Homo sapiens
atcatactaagtatagta

SEQ ID NO: 64058 - DNA, 17 bp, Homo sapiens
tactgtctgtagtatca

SEQ ID NO: 64059 - DNA, 23 bp, Homo sapiens
atctattaagtatataaatatca

SEQ ID NO: 64060 - DNA, 18 bp, Homo sapiens
atcatacaagtataaagt

SEQ ID NO: 64061 - DNA, 21 bp, Homo sapiens
tcattatggttagtagtatca

SEQ ID NO: 64062 - DNA, 69 bp, Potato virus V
ttccctagtaaggtgcgagtgactagcaagatttactcttgttaggtgatcaaaaccggtcattgggag

SEQ ID NO: 64063 - DNA, 24 bp, Potato virus V
ttaggtgatcaaaaccggtcattg

SEQ ID NO: 64064 - DNA, 18 bp, Homo sapiens
ttaggtgattaagacact

SEQ ID NO: 64065 - DNA, 94 bp, Grapevine virus A
ctactggcaatactagatgacttgttgtctagacttgggagaggcagcgctttccttccaagtgatctgggggcagtcaaaggtgagctggtag

SEQ ID NO: 64066 - DNA, 24 bp, Grapevine virus A
tggcaatactagatgacttgttgt

SEQ ID NO: 64067 - DNA, 23 bp, Homo sapiens
tggcagacctccaagcttgttgt

SEQ ID NO: 64068 - DNA, 23 bp, Homo sapiens
tggtgatactagatattagatgt

SEQ ID NO: 64069 - DNA, 22 bp, Homo sapiens
ggcaaacacgatggcttgttgt

SEQ ID NO: 64070 - DNA, 19 bp, Homo sapiens
tggcagtgctggatgacct

SEQ ID NO: 64071 - DNA, 81 bp, Grapevine virus A
acgttccactcgtccagattaagtgtagacctttacgttaataacaagaaggttgtcacgcgatcagtgcaagcggaaggt

SEQ ID NO: 64072 - DNA, 24 bp, Grapevine virus A
taagtgtagacctttacgttaata

SEQ ID NO: 64073 - DNA, 18 bp, Homo sapiens
taagtgtagtttttacat

SEQ ID NO: 64074 - DNA, 23 bp, Homo sapiens
taagtatagactttgttttaata

SEQ ID NO: 64075 - DNA, 74 bp, Gallid herpesvirus 3
gtggtctattctttttcgtttgcctctgatcctgggcggtccgtactgcggggtgatagataaaagaagacaac

SEQ ID NO: 64076 - DNA, 24 bp, Gallid herpesvirus 3
ctgcggggtgatagataaaagaag

SEQ ID NO: 64077 - DNA, 25 bp, Homo sapiens
ctgcggggtgctgggtgtggagaag

SEQ ID NO: 64078 - DNA, 21 bp, Homo sapiens
ctgtggagtgatccagggaag

SEQ ID NO: 64079 - DNA, 16 bp, Homo sapiens
gcggggtggagaaaga

SEQ ID NO: 64080 - DNA, 19 bp, Homo sapiens
cggggtgacaaggaggaag

SEQ ID NO: 64081 - DNA, 18 bp, Homo sapiens
ctgcgggggataggaaag

SEQ ID NO: 64082 - DNA, 19 bp, Homo sapiens
tgcagggtgagaacaaaga

SEQ ID NO: 64083 - DNA, 18 bp, Homo sapiens
ctgggggtgcagagggaa

SEQ ID NO: 64084 - DNA, 18 bp, Homo sapiens
ctgcaggatgtgatgaag

SEQ ID NO: 64085 - DNA, 22 bp, Homo sapiens
ctgccagcttagataaaggaag

SEQ ID NO: 64086 - DNA, 18 bp, Homo sapiens
ctgcagagcagatggaag

SEQ ID NO: 64087 - DNA, 17 bp, Homo sapiens
gcggggcgcagtggaag

SEQ ID NO: 64088 - DNA, 25 bp, Homo sapiens
ctgtgggggacaggtatgggggaag

SEQ ID NO: 64089 - DNA, 23 bp, Homo sapiens
ccgtggggtgatatggcgggaag

SEQ ID NO: 64090 - DNA, 17 bp, Homo sapiens
tgcggggtggacggaga

SEQ ID NO: 64091 - DNA, 19 bp, Homo sapiens
ctgcaggggggtaggagaa

SEQ ID NO: 64092 - DNA, 21 bp, Homo sapiens
tgcggggtgtgagcgccgaag

SEQ ID NO: 64093 - DNA, 99 bp, Human herpesvirus 8
agaacaaaaagtgtgtgtctgacattcacatttatttttacaagacaattttgtgcagtagagttgtgccttccgacaccccgcgccgttcgctgttct

SEQ ID NO: 64094 - DNA, 24 bp, Human herpesvirus 8
tgtgcagtagagttgtgccttccg

SEQ ID NO: 64095 - DNA, 18 bp, Homo sapiens
tgtgagtggacgtgcctt

SEQ ID NO: 64096 - DNA, 18 bp, Homo sapiens
tgtgcagagagaaccttc

SEQ ID NO: 64097 - DNA, 18 bp, Homo sapiens
tgtgcagtggaggtgact

SEQ ID NO: 64098 - DNA, 16 bp, Homo sapiens
tgtggtgagtgccttc

SEQ ID NO: 64099 - DNA, 19 bp, Homo sapiens
tgtgcagtagagtgaccct

SEQ ID NO: 64100 - DNA, 21 bp, Homo sapiens
tgtgcagcagagacgtgcttc

SEQ ID NO: 64101 - DNA, 23 bp, Homo sapiens
tgtacagtaggagaaaggttttc

SEQ ID NO: 64102 - DNA, 20 bp, Homo sapiens
tgtgcagagcctctgtcttc

SEQ ID NO: 64103 - DNA, 23 bp, Homo sapiens
tgtgcagtgaggtttgagctccg

SEQ ID NO: 64104 - DNA, 62 bp, Camelpox virus
tctctatccaaggatgtaattaaatgtttgatcgataacaatgtttccatccatagcagaga

SEQ ID NO: 64105 - DNA, 24 bp, Camelpox virus
tccaaggatgtaattaaatgtttg

SEQ ID NO: 64106 - DNA, 21 bp, Homo sapiens
tccaaggatggagttaaaatg

SEQ ID NO: 64107 - DNA, 19 bp, Homo sapiens
tctgagaatgcaaatgttt

SEQ ID NO: 64108 - DNA, 69 bp, Yaba-like disease virus
accgattcttcctgtttgaacgtctatttttttgttaagaattatcatgttttttctcacagtatcggt

SEQ ID NO: 64109 - DNA, 24 bp, Yaba-like disease virus
atcatgttttttctcacagtatcg

SEQ ID NO: 64110 - DNA, 23 bp, Homo sapiens
atcatgctcttctcacagtatcg

SEQ ID NO: 64111 - DNA, 15 bp, Homo sapiens
catatttcacagtat

SEQ ID NO: 64112 - DNA, 82 bp, Human adenovirus A
gaagtgcggttccagaaggagtaataaaacctgtgcctcagcgggtgactgggaggcgtagatgtgctgtggaaagcatttt

SEQ ID NO: 64113 - DNA, 24 bp, Human adenovirus A
ggcgtagatgtgctgtggaaagca

SEQ ID NO: 64114 - DNA, 20 bp, Homo sapiens
gggtccgggctgtggagagc

SEQ ID NO: 64115 - DNA, 21 bp, Homo sapiens
ggctgggtgtggaggaaagca

SEQ ID NO: 64116 - DNA, 20 bp, Homo sapiens
gtggatgtgctgactgtgga

SEQ ID NO: 64117 - DNA, 22 bp, Homo sapiens
ggagtagatgtgtggccaagca

SEQ ID NO: 64118 - DNA, 19 bp, Homo sapiens
ggctgcggctgtggagggc

SEQ ID NO: 64119 - DNA, 20 bp, Homo sapiens
ggcagtggataaatggaaag

SEQ ID NO: 64120 - DNA, 21 bp, Homo sapiens
gccgtaggttggaggctgtgg

SEQ ID NO: 64121 - DNA, 18 bp, Homo sapiens
gatgtgctgtggggggca

SEQ ID NO: 64122 - DNA, 22 bp, Homo sapiens
gctgtattccctgtggagggca

SEQ ID NO: 64123 - DNA, 18 bp, Homo sapiens
ggtgaagatgtgcagagc

SEQ ID NO: 64124 - DNA, 18 bp, Homo sapiens
gacattttgtggaaagca

SEQ ID NO: 64125 - DNA, 18 bp, Homo sapiens
ggctagatgtgaatgagg

SEQ ID NO: 64126 - DNA, 23 bp, Homo sapiens
ggccttcaaagctgtggaaagca

SEQ ID NO: 64127 - DNA, 60 bp, Barmah Forest virus
gtatgtatgatagtatatttataagattagtttgttatgtaagtatgtagtagtaagtat

SEQ ID NO: 64128 - DNA, 24 bp, Barmah Forest virus
tgtatgatagtatatttataagat

SEQ ID NO: 64129 - DNA, 19 bp, Homo sapiens
tgattatatatttataaga

SEQ ID NO: 64130 - DNA, 15 bp, Homo sapiens
tgacagtttataaga

SEQ ID NO: 64131 - DNA, 116 bp, Lymphocystis disease virus 1
tgctaaaatacaatctaaacaataatgaattggtgttaaaaaatcagtatccagcttagcgtgtgttaagtaataaagtattttttgataacaaatttctattatattgttaagca

SEQ ID NO: 64132 - DNA, 24 bp, Lymphocystis disease virus 1
tgttaaaaaatcagtatccagctt

SEQ ID NO: 64133 - DNA, 23 bp, Homo sapiens
gttaggtttccagtatctagctt

SEQ ID NO: 64134 - DNA, 16 bp, Homo sapiens
tgctaaaaatatccag

SEQ ID NO: 64135 - DNA, 21 bp, Homo sapiens
tgttggtaaactctccagctt

SEQ ID NO: 64136 - DNA, 19 bp, Homo sapiens
tgctaaaggatccccagct

SEQ ID NO: 64137 - DNA, 22 bp, Homo sapiens
tattaaaaaatcaagtatttag

SEQ ID NO: 64138 - DNA, 23 bp, Homo sapiens
tgttaaaagttaagacacagctt

SEQ ID NO: 64139 - DNA, 20 bp, Homo sapiens
ttaaaaattctgtccagctt

SEQ ID NO: 64140 - DNA, 18 bp, Homo sapiens
gttaaaaaaaaaatccag

SEQ ID NO: 64141 - DNA, 24 bp, Homo sapiens
tgtcaaaaatcttatattcagctt

SEQ ID NO: 64142 - DNA, 19 bp, Homo sapiens
ttaaaaaatcactcagctt

SEQ ID NO: 64143 - DNA, 22 bp, Homo sapiens
gttaaaaaatctaaagcagctt

SEQ ID NO: 64144 - DNA, 17 bp, Homo sapiens
tgttaaaaaattgtatc

SEQ ID NO: 64145 - DNA, 67 bp, Gallid herpesvirus 3
gtaatggggaaccgaaaactgaaccaaatacagaaattagaagaggaacatcggcttttcccgttat

SEQ ID NO: 64146 - DNA, 24 bp, Gallid herpesvirus 3
tggggaaccgaaaactgaaccaaa

SEQ ID NO: 64147 - DNA, 22 bp, Homo sapiens
ggggcaccgggactgaaccaaa

SEQ ID NO: 64148 - DNA, 19 bp, Homo sapiens
gggaaccgaaagggactca

SEQ ID NO: 64149 - DNA, 17 bp, Homo sapiens
tggggattgaaaaacca

SEQ ID NO: 64150 - DNA, 22 bp, Homo sapiens
tggggaacttgaccggctgcca

SEQ ID NO: 64151 - DNA, 18 bp, Homo sapiens
tggggaactgaagacaga

SEQ ID NO: 64152 - DNA, 24 bp, Homo sapiens
tggagaactggagcacaggctgaa

SEQ ID NO: 64153 - DNA, 23 bp, Homo sapiens
tgggaaaccgaggacatcgcaaa

SEQ ID NO: 64154 - DNA, 21 bp, Homo sapiens
tggggaacttggaacgctgaa

SEQ ID NO: 64155 - DNA, 20 bp, Homo sapiens
tggggaaccagaaagacaga

SEQ ID NO: 64156 - DNA, 21 bp, Homo sapiens
tggggacctgaccagcaaccg

SEQ ID NO: 64157 - DNA, 18 bp, Homo sapiens
tggggaacttgctgacca

SEQ ID NO: 64158 - DNA, 19 bp, Homo sapiens
ggaactgagccacaaacca

SEQ ID NO: 64159 - DNA, 20 bp, Homo sapiens
tggggaacccaagtagccca

SEQ ID NO: 64160 - DNA, 20 bp, Homo sapiens
tggggaacagaaaggaatga

SEQ ID NO: 64161 - DNA, 18 bp, Homo sapiens
cggggattggaaactgaa

SEQ ID NO: 64162 - DNA, 18 bp, Homo sapiens
ggggaaaagactgagcca

SEQ ID NO: 64163 - DNA, 19 bp, Homo sapiens
tgaggaactggaagaacca

SEQ ID NO: 64164 - DNA, 20 bp, Homo sapiens
aggaaccacctggaaactga

SEQ ID NO: 64165 - DNA, 23 bp, Homo sapiens
ggggaaccggggctgtcagccaa

SEQ ID NO: 64166 - DNA, 23 bp, Homo sapiens
tggggaatgggaggaaaaccaaa

SEQ ID NO: 64167 - DNA, 16 bp, Homo sapiens
gggaacactgaaccaa

SEQ ID NO: 64168 - DNA, 27 bp, Homo sapiens
tgggaaaccggggcctctactgaacca

SEQ ID NO: 64169 - DNA, 22 bp, Homo sapiens
tgaggaactgaatgggggactg

SEQ ID NO: 64170 - DNA, 22 bp, Homo sapiens
tggggaactgggccagaccaaa

SEQ ID NO: 64171 - DNA, 16 bp, Homo sapiens
tggggaacagagacca

SEQ ID NO: 64172 - DNA, 21 bp, Homo sapiens
tggggaaatggaaaaagtgaa

SEQ ID NO: 64173 - DNA, 18 bp, Homo sapiens
tggggaacccaagcctga

SEQ ID NO: 64174 - DNA, 21 bp, Homo sapiens
tggggaacaaaggctgggcca

SEQ ID NO: 64175 - DNA, 20 bp, Homo sapiens
tgaggaactgaaagaagtga

SEQ ID NO: 64176 - DNA, 17 bp, Homo sapiens
tggggaaccgcgccgaa

SEQ ID NO: 64177 - DNA, 22 bp, Homo sapiens
gaggaactgggaggccttgaac

SEQ ID NO: 64178 - DNA, 19 bp, Homo sapiens
tggggtggagctgaaccaa

SEQ ID NO: 64179 - DNA, 17 bp, Homo sapiens
tgggaaacactgaatca

SEQ ID NO: 64180 - DNA, 19 bp, Homo sapiens
tggggaactcgaagccaaa

SEQ ID NO: 64181 - DNA, 24 bp, Homo sapiens
tggggaactggggggaaattctga

SEQ ID NO: 64182 - DNA, 16 bp, Homo sapiens
tggggaaactgaagcc

SEQ ID NO: 64183 - DNA, 23 bp, Homo sapiens
tggagaactgaaggaaatccaaa

SEQ ID NO: 64184 - DNA, 18 bp, Homo sapiens
tggagaactgaaagactg

SEQ ID NO: 64185 - DNA, 19 bp, Homo sapiens
tggggaaccagaagcacca

SEQ ID NO: 64186 - DNA, 18 bp, Homo sapiens
tggggaccgaaaactgcc

SEQ ID NO: 64187 - DNA, 21 bp, Homo sapiens
tggggaactgggggaaaagcg

SEQ ID NO: 64188 - DNA, 21 bp, Homo sapiens
tggggaacttgcactgagcca

SEQ ID NO: 64189 - DNA, 18 bp, Homo sapiens
tagggaagagaaactgaa

SEQ ID NO: 64190 - DNA, 18 bp, Homo sapiens
tggggaactgaagaagcc

SEQ ID NO: 64191 - DNA, 20 bp, Homo sapiens
tggggaacatggaacttgaa

SEQ ID NO: 64192 - DNA, 19 bp, Homo sapiens
tggggaaccgtggatacca

SEQ ID NO: 64193 - DNA, 20 bp, Homo sapiens
ggggaaccaggctgggccaa

SEQ ID NO: 64194 - DNA, 77 bp, Gallid herpesvirus 2
gatgggtgggaaatataataaagcaaccgaaatggtacataaaaactaaaaatacctacacggttacaccaccgatc

SEQ ID NO: 64195 - DNA, 21 bp, Gallid herpesvirus 2
tacacggttacaccaccgatc

SEQ ID NO: 64196 - DNA, 19 bp, Homo sapiens
acagacccagccaccgatc

SEQ ID NO: 64197 - DNA, 18 bp, Homo sapiens
cacacaacactaccgatc

SEQ ID NO: 64198 - DNA, 18 bp, Homo sapiens
cacagtcaagcactgatc

SEQ ID NO: 64199 - DNA, 19 bp, Homo sapiens
tacacaggtcacactgatc

SEQ ID NO: 64200 - DNA, 20 bp, Homo sapiens
tacatagttacacggcaatc

SEQ ID NO: 64201 - DNA, 82 bp, Human herpesvirus 5
cccccctccccctgtggtcccccgagacgagagccacccatcgtgtactctcgcaccacccacgaccacagagggagacggg

SEQ ID NO: 64202 - DNA, 24 bp, Human herpesvirus 5
ctcgcaccacccacgaccacagag

SEQ ID NO: 64203 - DNA, 17 bp, Homo sapiens
ccaggcagaccacagag

SEQ ID NO: 64204 - DNA, 21 bp, Homo sapiens
cgcaccacgcaccttgcagag

SEQ ID NO: 64205 - DNA, 21 bp, Homo sapiens
gccccacccacgactgcagag

SEQ ID NO: 64206 - DNA, 21 bp, Homo sapiens
tcacactgccagcccacagag

SEQ ID NO: 64207 - DNA, 22 bp, Homo sapiens
ctcacaccaccctgggacggag

SEQ ID NO: 64208 - DNA, 24 bp, Homo sapiens
ctcggttaccgtaccgccacagag

SEQ ID NO: 64209 - DNA, 22 bp, Homo sapiens
ctcggccaccgtcaccacagag

SEQ ID NO: 64210 - DNA, 21 bp, Homo sapiens
gcaccaccagctcctgcagag

SEQ ID NO: 64211 - DNA, 21 bp, Homo sapiens
tccatcaccagacccacagag

SEQ ID NO: 64212 - DNA, 22 bp, Homo sapiens
tctcaccgccccaaccacagag

SEQ ID NO: 64213 - DNA, 21 bp, Homo sapiens
ctctcaccacccacctcagag

SEQ ID NO: 64214 - DNA, 21 bp, Homo sapiens
cccgcaccactcgtgcatgag

SEQ ID NO: 64215 - DNA, 24 bp, Homo sapiens
cccacgacgcccacgaccacggag

SEQ ID NO: 64216 - DNA, 16 bp, Homo sapiens
ctcgctcacccgccac

SEQ ID NO: 64217 - DNA, 23 bp, Homo sapiens
ctccaccatcccatcccacagag

SEQ ID NO: 64218 - DNA, 23 bp, Homo sapiens
cacgtgaacccacggccacagag

SEQ ID NO: 64219 - DNA, 23 bp, Homo sapiens
gcaccacccacgtcccaccggag

SEQ ID NO: 64220 - DNA, 23 bp, Homo sapiens
gcaccacccacataagcacagag

SEQ ID NO: 64221 - DNA, 18 bp, Homo sapiens
gcaccacccgcgcctgag

SEQ ID NO: 64222 - DNA, 21 bp, Homo sapiens
gcaccacctaggccaactgag

SEQ ID NO: 64223 - DNA, 22 bp, Homo sapiens
cccgcaccatccaggggcagag

SEQ ID NO: 64224 - DNA, 19 bp, Homo sapiens
ctcgaccacccagggcaga

SEQ ID NO: 64225 - DNA, 79 bp, Dengue virus type 2
agatcctgctgtctcctcagcatcattccaggcacaggacgccagaaaatggaatggtgctgttgaatcaacaggttct

SEQ ID NO: 64226 - DNA, 76 bp, Zaire Ebola virus
agcgatttatctaaattaaattacattatgcttttataacttacctactagcctgcccaacatttacacgatcgtt

SEQ ID NO: 64227 - DNA, 24 bp, Zaire Ebola virus
tctaaattaaattacattatgctt

SEQ ID NO: 64228 - DNA, 16 bp, Homo sapiens
tccaaattaattatgc

SEQ ID NO: 64229 - DNA, 24 bp, Homo sapiens
tctaaattaaaatacatgaagctt

SEQ ID NO: 64230 - DNA, 23 bp, Homo sapiens
tctgaatcaaatatgccatgctt

SEQ ID NO: 64231 - DNA, 24 bp, Homo sapiens
caaattaaattctaatttatgctt

SEQ ID NO: 64232 - DNA, 18 bp, Homo sapiens
tctaaataaattacatgc

SEQ ID NO: 64233 - DNA, 131 bp, Zaire Ebola virus
aaatagctaacattaagtagtcaaggaacgaaaacaggaagaatttttgatgtctaaggtgtgaattattatcacaataaaagtgattcttatttttgaatttaaagctagcttattattactagccgttt

SEQ ID NO: 64234 - DNA, 24 bp, Zaire Ebola virus
tagctaacattaagtagtcaagga

SEQ ID NO: 64235 - DNA, 18 bp, Homo sapiens
tagtaacattgggtagcc

SEQ ID NO: 64236 - DNA, 22 bp, Homo sapiens
tagcagcaattccagtcaagga

SEQ ID NO: 64237 - DNA, 16 bp, Homo sapiens
cagctaacgttgcaag

SEQ ID NO: 64238 - DNA, 22 bp, Homo sapiens
tagctggcatgctcatcaagga

SEQ ID NO: 64239 - DNA, 22 bp, Homo sapiens
actaacattatgtaatcaagga

SEQ ID NO: 64240 - DNA, 16 bp, Homo sapiens
taacattaagcagagg

SEQ ID NO: 64241 - DNA, 21 bp, Homo sapiens
gctgacttaagcagtcaagga

SEQ ID NO: 64242 - DNA, 21 bp, Homo sapiens
tagctaacactgaggtctggg

SEQ ID NO: 64243 - DNA, 21 bp, Homo sapiens
gctggcattaagcccacaggg

SEQ ID NO: 64244 - DNA, 19 bp, Homo sapiens
gctgggacacagtcaagga

SEQ ID NO: 64245 - DNA, 17 bp, Homo sapiens
gctgacattaagctagg

SEQ ID NO: 64246 - DNA, 18 bp, Homo sapiens
agctgacggaggtcaagg

SEQ ID NO: 64247 - DNA, 105 bp, Cercopithecine herpesvirus 7
agttctacataccagtgatttccacgcctttttgtttatttacgccttccgcattctaaataagtggtgttttataaatcccctgcttcattggttttaatcact

SEQ ID NO: 64248 - DNA, 24 bp, Cercopithecine herpesvirus 7
acgcctttttgtttatttacgcct

SEQ ID NO: 64249 - DNA, 19 bp, Homo sapiens
cgtctttctgtttgaacac

SEQ ID NO: 64250 - DNA, 24 bp, Homo sapiens
acccctttccgtatttatttgcgc

SEQ ID NO: 64251 - DNA, 15 bp, Homo sapiens
cgctgttatttacgc

SEQ ID NO: 64252 - DNA, 18 bp, Homo sapiens
ctcctgattatttacgcc

SEQ ID NO: 64253 - DNA, 23 bp, Homo sapiens
acccttttttgttaactgtgcct

SEQ ID NO: 64254 - DNA, 22 bp, Homo sapiens
acctttttttgttttatagcct

SEQ ID NO: 64255 - DNA, 24 bp, Homo sapiens
gcctttttgtttgggaaactgcct

SEQ ID NO: 64256 - DNA, 18 bp, Homo sapiens
cctttttgtttggtgccc

SEQ ID NO: 64257 - DNA, 17 bp, Homo sapiens
gcctggctgtttatgcc

SEQ ID NO: 64258 - DNA, 18 bp, Homo sapiens
cgccttttttgtttgctc

SEQ ID NO: 64259 - DNA, 19 bp, Homo sapiens
gcctcttttatttgtgcct

SEQ ID NO: 64260 - DNA, 19 bp, Homo sapiens
gcctcatttgtttgtgcct

SEQ ID NO: 64261 - DNA, 16 bp, Homo sapiens
gccaatttatttacgc

SEQ ID NO: 64262 - DNA, 90 bp, Human adenovirus C
catgggcggcgatataaaatgcaaggtgctgctcaaaaaatcaggcaaagcctcgcgcaaaaaagcaagcacatcgtagtcatgctcatg

SEQ ID NO: 64263 - DNA, 19 bp, Human adenovirus C
catcgtagtcatgctcatg

SEQ ID NO: 64264 - DNA, 20 bp, Homo sapiens
accataattttgtgctcatg

SEQ ID NO: 64265 - DNA, 19 bp, Homo sapiens
cattttcaatctgctcatg

SEQ ID NO: 64266 - DNA, 18 bp, Homo sapiens
catcgcagcattatcatg

SEQ ID NO: 64267 - DNA, 20 bp, Homo sapiens
catcgtgggtaacgcgcatg

SEQ ID NO: 64268 - DNA, 20 bp, Homo sapiens
catcatagccaatgttcatg

SEQ ID NO: 64269 - DNA, 18 bp, Homo sapiens
cactgtgccagactcatg

SEQ ID NO: 64270 - DNA, 19 bp, Homo sapiens
catcagttctctgctcatg

SEQ ID NO: 64271 - DNA, 16 bp, Homo sapiens
atccagcatgctcatg

SEQ ID NO: 64272 - DNA, 19 bp, Homo sapiens
catcgtagaacaattcatg

SEQ ID NO: 64273 - DNA, 16 bp, Homo sapiens
catcgtagctgcgcac

SEQ ID NO: 64274 - DNA, 18 bp, Homo sapiens
catgcaatcatgttcatg

SEQ ID NO: 64275 - DNA, 19 bp, Homo sapiens
atcccatttcatgctcatg

SEQ ID NO: 64276 - DNA, 17 bp, Homo sapiens
caccgtggtcacccatg

SEQ ID NO: 64277 - DNA, 15 bp, Homo sapiens
catcacatgctcatg

SEQ ID NO: 64278 - DNA, 18 bp, Homo sapiens
tcattgcctctgctcatg

SEQ ID NO: 64279 - DNA, 19 bp, Homo sapiens
catggcattaatgctcatg

SEQ ID NO: 64280 - DNA, 16 bp, Homo sapiens
catcatagttgccacg

SEQ ID NO: 64281 - DNA, 20 bp, Homo sapiens
cacgcgtgtacatgcttatg

SEQ ID NO: 64282 - DNA, 17 bp, Homo sapiens
caccagtcatgcttatg

SEQ ID NO: 64283 - DNA, 15 bp, Homo sapiens
acccagatgctcatg

SEQ ID NO: 64284 - DNA, 19 bp, Homo sapiens
catctcctcaatgctcatg

SEQ ID NO: 64285 - DNA, 16 bp, Homo sapiens
catcgctctgctcatg

SEQ ID NO: 64286 - DNA, 18 bp, Homo sapiens
accaaagtcatgttcatg

SEQ ID NO: 64287 - DNA, 19 bp, Homo sapiens
catccaattaatgctcatg

SEQ ID NO: 64288 - DNA, 120 bp, Human herpesvirus 2
ggcccgggctgcgcacgccagccgggacgggtgagttcgctaggcaagcacggactggcggttacacgtgcatgcgtgccgagtgaactctcccgccccgacgcgctccggctccgggcc

SEQ ID NO: 64289 - DNA, 24 bp, Human herpesvirus 2
tgagttcgctaggcaagcacggac

SEQ ID NO: 64290 - DNA, 19 bp, Homo sapiens
tgagtcatgcaggcatgga

SEQ ID NO: 64291 - DNA, 18 bp, Homo sapiens
tgagttgttgcacacgga

SEQ ID NO: 64292 - DNA, 17 bp, Homo sapiens
tggttctccaagcacgg

SEQ ID NO: 64293 - DNA, 16 bp, Homo sapiens
gagtttggagcacgga

SEQ ID NO: 64294 - DNA, 23 bp, Homo sapiens
tgagttcagctagaattacatgg

SEQ ID NO: 64295 - DNA, 17 bp, Homo sapiens
tgagttcgtaggtaaac

SEQ ID NO: 64296 - DNA, 20 bp, Homo sapiens
tgagtgtgctccaagcacgg

SEQ ID NO: 64297 - DNA, 19 bp, Homo sapiens
cgggttcgctagtccacgg

SEQ ID NO: 64298 - DNA, 80 bp, Human herpesvirus 2
gggggagggacggggaagggggcgcgcggggctgccctgccgcccgcccgccgccgccgcccgccttcgcgccccccccc

SEQ ID NO: 64299 - DNA, 21 bp, Human herpesvirus 2
cccgccttcgcgccccccccc

SEQ ID NO: 64300 - DNA, 21 bp, Homo sapiens
cccccacactagccctccccc

SEQ ID NO: 64301 - DNA, 20 bp, Homo sapiens
ccgccttccgctgcctcccc

SEQ ID NO: 64302 - DNA, 21 bp, Homo sapiens
cacccccaggcgcccctcccc

SEQ ID NO: 64303 - DNA, 18 bp, Homo sapiens
cgcccacagcccctcccc

SEQ ID NO: 64304 - DNA, 19 bp, Homo sapiens
ccgcctcctgcctcctccc

SEQ ID NO: 64305 - DNA, 16 bp, Homo sapiens
cccgcctcgccctccc

SEQ ID NO: 64306 - DNA, 18 bp, Homo sapiens
cgtccctcgtgccccccc

SEQ ID NO: 64307 - DNA, 18 bp, Homo sapiens
cccacccctgccccttcc

SEQ ID NO: 64308 - DNA, 19 bp, Homo sapiens
ccgccccctgcccctcccc

SEQ ID NO: 64309 - DNA, 20 bp, Homo sapiens
ccgcctcctccgcctcctcc

SEQ ID NO: 64310 - DNA, 16 bp, Homo sapiens
ccgcgccacccccccc

SEQ ID NO: 64311 - DNA, 19 bp, Homo sapiens
ccgcctccgcggccgcccc

SEQ ID NO: 64312 - DNA, 21 bp, Homo sapiens
cccaccccccggtccccctcc

SEQ ID NO: 64313 - DNA, 17 bp, Homo sapiens
cccgccacgcccttccc

SEQ ID NO: 64314 - DNA, 21 bp, Homo sapiens
cctcgcggcgcgctccctccc

SEQ ID NO: 64315 - DNA, 21 bp, Homo sapiens
cccaccttgccagccttttcc

SEQ ID NO: 64316 - DNA, 17 bp, Homo sapiens
ccgccgcacccctcccc

SEQ ID NO: 64317 - DNA, 19 bp, Homo sapiens
ccctcccctgcctccctcc

SEQ ID NO: 64318 - DNA, 16 bp, Homo sapiens
cccgcctcggcctccc

SEQ ID NO: 64319 - DNA, 21 bp, Homo sapiens
ccgggctccgcgctccttccc

SEQ ID NO: 64320 - DNA, 20 bp, Homo sapiens
cccttgccacgcccccttcc

SEQ ID NO: 64321 - DNA, 22 bp, Homo sapiens
cccggggaccgcgccctcctcc

SEQ ID NO: 64322 - DNA, 19 bp, Homo sapiens
cccccttctgctgccctcc

SEQ ID NO: 64323 - DNA, 17 bp, Homo sapiens
ccgccctccgccctccc

SEQ ID NO: 64324 - DNA, 17 bp, Homo sapiens
cccggccccgccccccc

SEQ ID NO: 64325 - DNA, 19 bp, Homo sapiens
cctcctcacacctcctccc

SEQ ID NO: 64326 - DNA, 21 bp, Homo sapiens
cctcctcccgcctgtcctccc

SEQ ID NO: 64327 - DNA, 19 bp, Homo sapiens
cccacctcggccctcctcc

SEQ ID NO: 64328 - DNA, 20 bp, Homo sapiens
ccacgggcctgctcccctcc

SEQ ID NO: 64329 - DNA, 22 bp, Homo sapiens
ccgccttccccacgcccctccc

SEQ ID NO: 64330 - DNA, 20 bp, Homo sapiens
ccgcctcccgcgccctcccc

SEQ ID NO: 64331 - DNA, 21 bp, Homo sapiens
ccacgtcagcgaccctctccc

SEQ ID NO: 64332 - DNA, 16 bp, Homo sapiens
cccaccccaccctccc

SEQ ID NO: 64333 - DNA, 20 bp, Homo sapiens
cccatcccacgcctccctcc

SEQ ID NO: 64334 - DNA, 23 bp, Homo sapiens
cccgccctcagggtgctcccccc

SEQ ID NO: 64335 - DNA, 18 bp, Homo sapiens
cccacccctgccttcccc

SEQ ID NO: 64336 - DNA, 17 bp, Homo sapiens
ccggctgcaccccctcc

SEQ ID NO: 64337 - DNA, 21 bp, Homo sapiens
cccacccctgggccttcctcc

SEQ ID NO: 64338 - DNA, 21 bp, Homo sapiens
cccaccttcaggtaccctccc

SEQ ID NO: 64339 - DNA, 19 bp, Homo sapiens
cgcctgctcgctccctccc

SEQ ID NO: 64340 - DNA, 18 bp, Homo sapiens
cccgcctccgcctcctcc

SEQ ID NO: 64341 - DNA, 18 bp, Homo sapiens
cccatctccacccctccc

SEQ ID NO: 64342 - DNA, 20 bp, Homo sapiens
cccgcacccacggctccccc

SEQ ID NO: 64343 - DNA, 21 bp, Homo sapiens
cccttggtccagcccccctcc

SEQ ID NO: 64344 - DNA, 18 bp, Homo sapiens
cccgtcccccgccccccc

SEQ ID NO: 64345 - DNA, 17 bp, Homo sapiens
cccgcctcctgcctccc

SEQ ID NO: 64346 - DNA, 21 bp, Homo sapiens
ccccctttccagctcccttcc

SEQ ID NO: 64347 - DNA, 18 bp, Homo sapiens
cctgcccccaccccctcc

SEQ ID NO: 64348 - DNA, 22 bp, Homo sapiens
cctgccctcctccgccttcccc

SEQ ID NO: 64349 - DNA, 19 bp, Homo sapiens
ctgcgcgcccctgccctcc

SEQ ID NO: 64350 - DNA, 18 bp, Homo sapiens
ccgccctcagcctcctcc

SEQ ID NO: 64351 - DNA, 25 bp, Homo sapiens
cccgcctctctcaccgccttcctcc

SEQ ID NO: 64352 - DNA, 18 bp, Homo sapiens
ccctcctttcaccctccc

SEQ ID NO: 64353 - DNA, 26 bp, Homo sapiens
ccgcgccgcacccgcgtccctccccg

SEQ ID NO: 64354 - DNA, 22 bp, Homo sapiens
cccccctccctcgcccctttcc

SEQ ID NO: 64355 - DNA, 22 bp, Homo sapiens
cctcgcgccggcgctcccctcc

SEQ ID NO: 64356 - DNA, 19 bp, Homo sapiens
cccacctcctgcccctccc

SEQ ID NO: 64357 - DNA, 20 bp, Homo sapiens
ccgcactcagcgccttcccc

SEQ ID NO: 64358 - DNA, 27 bp, Homo sapiens
cccaccttctctggatgcctttccccg

SEQ ID NO: 64359 - DNA, 16 bp, Homo sapiens
cccgcctcagcctccc

SEQ ID NO: 64360 - DNA, 19 bp, Homo sapiens
ccgctcggcgccccctccc

SEQ ID NO: 64361 - DNA, 20 bp, Homo sapiens
ccgctcccgcgccctctccc

SEQ ID NO: 64362 - DNA, 21 bp, Homo sapiens
ccctcctgggcgccccctccc

SEQ ID NO: 64363 - DNA, 21 bp, Homo sapiens
cccacatgcttgcttcctccc

SEQ ID NO: 64364 - DNA, 20 bp, Homo sapiens
cccgcctctctcaaacctcc

SEQ ID NO: 64365 - DNA, 17 bp, Homo sapiens
cctgcctccggccctcc

SEQ ID NO: 64366 - DNA, 19 bp, Homo sapiens
cccacctcttactccctcc

SEQ ID NO: 64367 - DNA, 18 bp, Homo sapiens
ctccgcgccgccgcctcc

SEQ ID NO: 64368 - DNA, 20 bp, Homo sapiens
cccgcctccgcccagccccc

SEQ ID NO: 64369 - DNA, 17 bp, Homo sapiens
cccctcctgccctcccc

SEQ ID NO: 64370 - DNA, 17 bp, Homo sapiens
cccgcctcgcgctgccc

SEQ ID NO: 64371 - DNA, 21 bp, Homo sapiens
ccctgccctctgccccccccc

SEQ ID NO: 64372 - DNA, 21 bp, Homo sapiens
cgccggcccgcgcccccctcc

SEQ ID NO: 64373 - DNA, 17 bp, Homo sapiens
cccaccccacccccccc

SEQ ID NO: 64374 - DNA, 18 bp, Homo sapiens
cccgccctccgccctccc

SEQ ID NO: 64375 - DNA, 23 bp, Homo sapiens
ccgccctcccactgcctcctccc

SEQ ID NO: 64376 - DNA, 18 bp, Homo sapiens
cccactttcgctcctccc

SEQ ID NO: 64377 - DNA, 16 bp, Homo sapiens
cgccggaccccccccc

SEQ ID NO: 64378 - DNA, 22 bp, Homo sapiens
cctcccctctctgcccccctcc

SEQ ID NO: 64379 - DNA, 19 bp, Homo sapiens
gcctgcttgcccgcctccc

SEQ ID NO: 64380 - DNA, 24 bp, Homo sapiens
cccggcccgcgcccgtgccctccc

SEQ ID NO: 64381 - DNA, 17 bp, Homo sapiens
cccaccccgtccctccc

SEQ ID NO: 64382 - DNA, 17 bp, Homo sapiens
cccgcctcagcctcccc

SEQ ID NO: 64383 - DNA, 18 bp, Homo sapiens
cccgcctggcctccctcc

SEQ ID NO: 64384 - DNA, 18 bp, Homo sapiens
cccgcccagcctccctcc

SEQ ID NO: 64385 - DNA, 22 bp, Homo sapiens
cccgcctctcgccgatttcccc

SEQ ID NO: 64386 - DNA, 18 bp, Homo sapiens
ccgcgcccggccccctcc

SEQ ID NO: 64387 - DNA, 16 bp, Homo sapiens
ccgcgcgcccctcccc

SEQ ID NO: 64388 - DNA, 21 bp, Homo sapiens
cccccttcacggcttccctcc

SEQ ID NO: 64389 - DNA, 17 bp, Homo sapiens
cccgcctcggcctcccc

SEQ ID NO: 64390 - DNA, 18 bp, Homo sapiens
cccgctcgcgcccctccc

SEQ ID NO: 64391 - DNA, 19 bp, Homo sapiens
ccttcacaggcccccttcc

SEQ ID NO: 64392 - DNA, 18 bp, Homo sapiens
cccgcctccgcgcttccc

SEQ ID NO: 64393 - DNA, 17 bp, Homo sapiens
cccgccctcgccctccc

SEQ ID NO: 64394 - DNA, 21 bp, Homo sapiens
ccgcgctcctcccgctcctcc

SEQ ID NO: 64395 - DNA, 24 bp, Homo sapiens
cccgccctgggcgcgtcctctccc

SEQ ID NO: 64396 - DNA, 18 bp, Homo sapiens
ccacaccaggccccctcc

SEQ ID NO: 64397 - DNA, 19 bp, Homo sapiens
caccttcgcgcctcctccc

SEQ ID NO: 64398 - DNA, 19 bp, Homo sapiens
cccccgcgcccgccctccc

SEQ ID NO: 64399 - DNA, 20 bp, Homo sapiens
cctggcctgccgccctcccc

SEQ ID NO: 64400 - DNA, 18 bp, Homo sapiens
ccccctccgccctctccc

SEQ ID NO: 64401 - DNA, 19 bp, Homo sapiens
ccgccccctgcgtcccccc

SEQ ID NO: 64402 - DNA, 20 bp, Homo sapiens
cctctccggcgccctctccc

SEQ ID NO: 64403 - DNA, 18 bp, Homo sapiens
cgccgcgccgccgcctcc

SEQ ID NO: 64404 - DNA, 20 bp, Homo sapiens
ccgcacccgcgtcctcctcc

SEQ ID NO: 64405 - DNA, 19 bp, Homo sapiens
cccgccctccggcccctcc

SEQ ID NO: 64406 - DNA, 21 bp, Homo sapiens
cctgcacccgcaccctctccc

SEQ ID NO: 64407 - DNA, 19 bp, Homo sapiens
ccctcacatgcccccctcc

SEQ ID NO: 64408 - DNA, 18 bp, Homo sapiens
cccgcctcgccctcctcc

SEQ ID NO: 64409 - DNA, 17 bp, Homo sapiens
cctgcctcacacctccc

SEQ ID NO: 64410 - DNA, 17 bp, Homo sapiens
cccatcctgcccctccc

SEQ ID NO: 64411 - DNA, 18 bp, Homo sapiens
ccgcgcctccccgcctcc

SEQ ID NO: 64412 - DNA, 18 bp, Homo sapiens
cccatcacacccctctcc

SEQ ID NO: 64413 - DNA, 17 bp, Homo sapiens
cccgccccggcctcccc

SEQ ID NO: 64414 - DNA, 18 bp, Homo sapiens
cccgccttgccggtcccc

SEQ ID NO: 64415 - DNA, 21 bp, Homo sapiens
ccttccacgccgcctcctccc

SEQ ID NO: 64416 - DNA, 20 bp, Homo sapiens
cccccctcctccgccccccc

SEQ ID NO: 64417 - DNA, 20 bp, Homo sapiens
cctgatccacatcccccccc

SEQ ID NO: 64418 - DNA, 23 bp, Homo sapiens
ccttgtcctccccgcccctcccc

SEQ ID NO: 64419 - DNA, 19 bp, Homo sapiens
cttcacacggcctcctccc

SEQ ID NO: 64420 - DNA, 18 bp, Homo sapiens
cccacctccactcctccc

SEQ ID NO: 64421 - DNA, 23 bp, Homo sapiens
ccgcgcccgcagctgtcccctcc

SEQ ID NO: 64422 - DNA, 23 bp, Homo sapiens
cccgcggcgcggcgccccctccc

SEQ ID NO: 64423 - DNA, 25 bp, Homo sapiens
cccgcctcagggttcgcctccttcc

SEQ ID NO: 64424 - DNA, 23 bp, Homo sapiens
ccagccttcacgaaactctcccc

SEQ ID NO: 64425 - DNA, 16 bp, Homo sapiens
ccgcccgccccccccc

SEQ ID NO: 64426 - DNA, 19 bp, Homo sapiens
ccagcccccgctccctccc

SEQ ID NO: 64427 - DNA, 19 bp, Homo sapiens
ccccttccgcgcccctccc

SEQ ID NO: 64428 - DNA, 18 bp, Homo sapiens
ccccttccgcgcccctcc

SEQ ID NO: 64429 - DNA, 21 bp, Homo sapiens
cccagttttgcaccccccccc

SEQ ID NO: 64430 - DNA, 20 bp, Homo sapiens
cccgccgtccccaccctccc

SEQ ID NO: 64431 - DNA, 21 bp, Homo sapiens
cccaccctcccgcccttctcc

SEQ ID NO: 64432 - DNA, 24 bp, Homo sapiens
cccgccctcgcatcgactttcccc

SEQ ID NO: 64433 - DNA, 19 bp, Homo sapiens
cgcccgagcgctcccctcc

SEQ ID NO: 64434 - DNA, 20 bp, Homo sapiens
ccccctcggcgcccccctcc

SEQ ID NO: 64435 - DNA, 17 bp, Homo sapiens
ccgccccaccccccccc

SEQ ID NO: 64436 - DNA, 20 bp, Homo sapiens
ccctcccccagtcccccccc

SEQ ID NO: 64437 - DNA, 20 bp, Homo sapiens
cccccttcccaaccctcccc

SEQ ID NO: 64438 - DNA, 17 bp, Homo sapiens
cccgccctccatccccc

SEQ ID NO: 64439 - DNA, 20 bp, Homo sapiens
cccacctcggactcctcccc

SEQ ID NO: 64440 - DNA, 20 bp, Homo sapiens
cccaccccatgcccctttcc

SEQ ID NO: 64441 - DNA, 20 bp, Homo sapiens
ccgcgcccgcgcccttcccc

SEQ ID NO: 64442 - DNA, 20 bp, Homo sapiens
cgctctgcccgccccccccc

SEQ ID NO: 64443 - DNA, 19 bp, Homo sapiens
cccacgcacagccctcccc

SEQ ID NO: 64444 - DNA, 20 bp, Homo sapiens
cccgcgctctgcccctcccc

SEQ ID NO: 64445 - DNA, 18 bp, Homo sapiens
cctgcctccgctgcctcc

SEQ ID NO: 64446 - DNA, 20 bp, Homo sapiens
ccaactttgtgctccccccc

SEQ ID NO: 64447 - DNA, 18 bp, Homo sapiens
ccgccctcgccccctccc

SEQ ID NO: 64448 - DNA, 21 bp, Homo sapiens
ccgccatgacagccccccccc

SEQ ID NO: 64449 - DNA, 23 bp, Homo sapiens
ccctcctgagctctgccttcccc

SEQ ID NO: 64450 - DNA, 21 bp, Homo sapiens
ccaccctcaaagcccttcccc

SEQ ID NO: 64451 - DNA, 20 bp, Homo sapiens
ccgtctccttcgcctcctcc

SEQ ID NO: 64452 - DNA, 17 bp, Homo sapiens
cctgccttccccacccc

SEQ ID NO: 64453 - DNA, 19 bp, Homo sapiens
cccaccctcggcccctccc

SEQ ID NO: 64454 - DNA, 18 bp, Homo sapiens
ccctccctgctcccctcc

SEQ ID NO: 64455 - DNA, 20 bp, Homo sapiens
cctccacggcccgctcctcc

SEQ ID NO: 64456 - DNA, 18 bp, Homo sapiens
cccggctcaccctccccc

SEQ ID NO: 64457 - DNA, 20 bp, Homo sapiens
ccctcttcgcgccgtggccc

SEQ ID NO: 64458 - DNA, 19 bp, Homo sapiens
gccttcaccgtccccctcc

SEQ ID NO: 64459 - DNA, 18 bp, Homo sapiens
cccactttcaacttcccc

SEQ ID NO: 64460 - DNA, 20 bp, Homo sapiens
cccgcgccgcgcctccctcc

SEQ ID NO: 64461 - DNA, 19 bp, Homo sapiens
ccctcccccattccccccc

SEQ ID NO: 64462 - DNA, 19 bp, Homo sapiens
cccagccgcgccccccccc

SEQ ID NO: 64463 - DNA, 20 bp, Homo sapiens
cccacccgaggctccctccc

SEQ ID NO: 64464 - DNA, 21 bp, Homo sapiens
ccccctcccgcgcccctcccc

SEQ ID NO: 64465 - DNA, 20 bp, Homo sapiens
ccgccttctgcaccatctcc

SEQ ID NO: 64466 - DNA, 20 bp, Homo sapiens
cccgcgcggtgccctcctcc

SEQ ID NO: 64467 - DNA, 19 bp, Homo sapiens
ccacctcctgctcctcccc

SEQ ID NO: 64468 - DNA, 18 bp, Homo sapiens
cgccgtccccacccctcc

SEQ ID NO: 64469 - DNA, 17 bp, Homo sapiens
cctctcctacccccccc

SEQ ID NO: 64470 - DNA, 20 bp, Homo sapiens
cccggccccagcccttctcc

SEQ ID NO: 64471 - DNA, 20 bp, Homo sapiens
cccacccccaccgttcctcc

SEQ ID NO: 64472 - DNA, 18 bp, Homo sapiens
cccgccctcgcggcctcc

SEQ ID NO: 64473 - DNA, 18 bp, Homo sapiens
ccttccttccgcgccccc

SEQ ID NO: 64474 - DNA, 21 bp, Homo sapiens
ccacgcctcccgacttcctcc

SEQ ID NO: 64475 - DNA, 16 bp, Homo sapiens
cccccccggcctcccc

SEQ ID NO: 64476 - DNA, 16 bp, Homo sapiens
cccgcctcagcccccc

SEQ ID NO: 64477 - DNA, 19 bp, Homo sapiens
cccgcgtcggactccctcc

SEQ ID NO: 64478 - DNA, 18 bp, Homo sapiens
cccaccacaccccctccc

SEQ ID NO: 64479 - DNA, 18 bp, Homo sapiens
ccagcccccgcccctccc

SEQ ID NO: 64480 - DNA, 18 bp, Homo sapiens
cgctctccccgcctcccc

SEQ ID NO: 64481 - DNA, 22 bp, Homo sapiens
cccacctaccctgccccccccc

SEQ ID NO: 64482 - DNA, 19 bp, Homo sapiens
ccggcgctccgcttccccc

SEQ ID NO: 64483 - DNA, 24 bp, Homo sapiens
cccgccctggccgcgcctcctccc

SEQ ID NO: 64484 - DNA, 23 bp, Homo sapiens
ccgcctcgcgcagccgcccctcc

SEQ ID NO: 64485 - DNA, 20 bp, Homo sapiens
cccggcccccgccccctccc

SEQ ID NO: 64486 - DNA, 23 bp, Homo sapiens
cccgcctcgcgccacagcctccc

SEQ ID NO: 64487 - DNA, 21 bp, Homo sapiens
cctgccttcgcagctgctccc

SEQ ID NO: 64488 - DNA, 20 bp, Homo sapiens
ccgcccccacgtcccttccc

SEQ ID NO: 64489 - DNA, 19 bp, Homo sapiens
cccacgggcgccccttccc

SEQ ID NO: 64490 - DNA, 21 bp, Homo sapiens
ccctcgcagccgccccttccc

SEQ ID NO: 64491 - DNA, 19 bp, Homo sapiens
ccgctcttctgcagcctcc

SEQ ID NO: 64492 - DNA, 22 bp, Homo sapiens
ccagcctccgcagcctcctccc

SEQ ID NO: 64493 - DNA, 20 bp, Homo sapiens
cccaccccccgcctttcccc

SEQ ID NO: 64494 - DNA, 21 bp, Homo sapiens
gcctccgccgtgccccctccc

SEQ ID NO: 64495 - DNA, 20 bp, Homo sapiens
cccgccctgtcagccctccc

SEQ ID NO: 64496 - DNA, 20 bp, Homo sapiens
cccactccacacccttcccc

SEQ ID NO: 64497 - DNA, 18 bp, Homo sapiens
ccccctccacccccttcc

SEQ ID NO: 64498 - DNA, 19 bp, Homo sapiens
cccaccccgcccgcccccc

SEQ ID NO: 64499 - DNA, 18 bp, Homo sapiens
cccaccccaggccctccc

SEQ ID NO: 64500 - DNA, 18 bp, Homo sapiens
ccacgcctcaccccttcc

SEQ ID NO: 64501 - DNA, 19 bp, Homo sapiens
gctccccacgcctctcccc

SEQ ID NO: 64502 - DNA, 16 bp, Homo sapiens
ccgcctcgccctcccc

SEQ ID NO: 64503 - DNA, 21 bp, Homo sapiens
cctgggaccacgccccccccc

SEQ ID NO: 64504 - DNA, 22 bp, Homo sapiens
cccgcggccgccgttccccccc

SEQ ID NO: 64505 - DNA, 16 bp, Homo sapiens
cccgcctcgcctcccc

SEQ ID NO: 64506 - DNA, 19 bp, Homo sapiens
cccgcttctgccaagcccc

SEQ ID NO: 64507 - DNA, 21 bp, Homo sapiens
ccgccttctcgcccagctccc

SEQ ID NO: 64508 - DNA, 19 bp, Homo sapiens
cctgccttcgccctctccc

SEQ ID NO: 64509 - DNA, 19 bp, Homo sapiens
cccccccaagcccccctcc

SEQ ID NO: 64510 - DNA, 17 bp, Homo sapiens
gcccgctgccccccccc

SEQ ID NO: 64511 - DNA, 17 bp, Homo sapiens
cccaccttggcctcccc

SEQ ID NO: 64512 - DNA, 23 bp, Homo sapiens
ccctgtcacttccgtccctcccc

SEQ ID NO: 64513 - DNA, 21 bp, Homo sapiens
ccagcccccgcgcttctcccc

SEQ ID NO: 64514 - DNA, 23 bp, Homo sapiens
cccgccctgaccccgcctttccc

SEQ ID NO: 64515 - DNA, 20 bp, Homo sapiens
cccgtcccacgacctcctcc

SEQ ID NO: 64516 - DNA, 20 bp, Homo sapiens
ccctccccccgccccccccc

SEQ ID NO: 64517 - DNA, 19 bp, Homo sapiens
cctacccccacctcccccc

SEQ ID NO: 64518 - DNA, 22 bp, Homo sapiens
cccacctcctgagcgtctcccc

SEQ ID NO: 64519 - DNA, 17 bp, Homo sapiens
cccacctcggcctcccc

SEQ ID NO: 64520 - DNA, 21 bp, Homo sapiens
cccgcctgactgcctcctccc

SEQ ID NO: 64521 - DNA, 17 bp, Homo sapiens
cccgccctgcttccccc

SEQ ID NO: 64522 - DNA, 20 bp, Homo sapiens
cctcccttcctgccctcccc

SEQ ID NO: 64523 - DNA, 18 bp, Homo sapiens
cctccctcacaccttccc

SEQ ID NO: 64524 - DNA, 18 bp, Homo sapiens
ccgccttcagcatccccc

SEQ ID NO: 64525 - DNA, 19 bp, Homo sapiens
ccgcctcgcgcacctcccc

SEQ ID NO: 64526 - DNA, 19 bp, Homo sapiens
cgcctccgcagcagcctcc

SEQ ID NO: 64527 - DNA, 19 bp, Homo sapiens
cccctccgcatcctccccc

SEQ ID NO: 64528 - DNA, 19 bp, Homo sapiens
cccgctgcacgccccctcc

SEQ ID NO: 64529 - DNA, 20 bp, Homo sapiens
ccccttgccaggccctcccc

SEQ ID NO: 64530 - DNA, 20 bp, Homo sapiens
cccactcagcaccccctccc

SEQ ID NO: 64531 - DNA, 20 bp, Homo sapiens
cctgccctcactgctccccc

SEQ ID NO: 64532 - DNA, 17 bp, Homo sapiens
cccgcttccgccccccc

SEQ ID NO: 64533 - DNA, 17 bp, Homo sapiens
cccgccccagccctccc

SEQ ID NO: 64534 - DNA, 19 bp, Homo sapiens
cgcgcccgcgcctcctccc

SEQ ID NO: 64535 - DNA, 16 bp, Homo sapiens
cccgcctcgacctccc

SEQ ID NO: 64536 - DNA, 21 bp, Homo sapiens
cgctgctgggcaccccctccc

SEQ ID NO: 64537 - DNA, 20 bp, Homo sapiens
cccccctatcagcctcctcc

SEQ ID NO: 64538 - DNA, 19 bp, Homo sapiens
cctccctcccactcccccc

SEQ ID NO: 64539 - DNA, 20 bp, Homo sapiens
cccccctcccgccccctccc

SEQ ID NO: 64540 - DNA, 20 bp, Homo sapiens
cccctccgcgatctccctcc

SEQ ID NO: 64541 - DNA, 24 bp, Homo sapiens
cgccctttctgccctgcctcctcc

SEQ ID NO: 64542 - DNA, 18 bp, Homo sapiens
cccccttcccatcccccc

SEQ ID NO: 64543 - DNA, 16 bp, Homo sapiens
cccgcctcggccctcc

SEQ ID NO: 64544 - DNA, 21 bp, Homo sapiens
ccgcctcctccgcttcctccc

SEQ ID NO: 64545 - DNA, 18 bp, Homo sapiens
cccgccttccggcctccc

SEQ ID NO: 64546 - DNA, 20 bp, Homo sapiens
ccccctagcaaccccttccc

SEQ ID NO: 64547 - DNA, 20 bp, Homo sapiens
cccagccccagccccctccc

SEQ ID NO: 64548 - DNA, 20 bp, Homo sapiens
cccagcctacacctttcccc

SEQ ID NO: 64549 - DNA, 23 bp, Homo sapiens
cgacttcgcgcacccgccttccc

SEQ ID NO: 64550 - DNA, 19 bp, Homo sapiens
cctacatccacgcccctcc

SEQ ID NO: 64551 - DNA, 19 bp, Homo sapiens
cccgccttccagcacatcc

SEQ ID NO: 64552 - DNA, 19 bp, Homo sapiens
cctccctccgaccttcccc

SEQ ID NO: 64553 - DNA, 18 bp, Homo sapiens
cccccacaactcctcccc

SEQ ID NO: 64554 - DNA, 17 bp, Homo sapiens
ccacctcaccccctccc

SEQ ID NO: 64555 - DNA, 22 bp, Homo sapiens
ccgcctccggaagcccccttcc

SEQ ID NO: 64556 - DNA, 22 bp, Homo sapiens
ccgccctccgccgcctcccccc

SEQ ID NO: 64557 - DNA, 19 bp, Homo sapiens
ccccccgcgcgcgtccccc

SEQ ID NO: 64558 - DNA, 16 bp, Homo sapiens
gccccgaccccccccc

SEQ ID NO: 64559 - DNA, 19 bp, Homo sapiens
cccgcctacattccccccc

SEQ ID NO: 64560 - DNA, 23 bp, Homo sapiens
cccgccccgcttcgcccttcccc

SEQ ID NO: 64561 - DNA, 16 bp, Homo sapiens
ccacccacctcccccc

SEQ ID NO: 64562 - DNA, 20 bp, Homo sapiens
cccaccccaagctcccttcc

SEQ ID NO: 64563 - DNA, 18 bp, Homo sapiens
cctgcctcgcgcggcccc

SEQ ID NO: 64564 - DNA, 16 bp, Homo sapiens
cccgcctcaccctccc

SEQ ID NO: 64565 - DNA, 21 bp, Homo sapiens
cccgtccccgcaccttcttcc

SEQ ID NO: 64566 - DNA, 20 bp, Homo sapiens
cccacctcctaccctccccc

SEQ ID NO: 64567 - DNA, 18 bp, Homo sapiens
cccagctccgcccttccc

SEQ ID NO: 64568 - DNA, 21 bp, Homo sapiens
ccctccccggcgctcctcccc

SEQ ID NO: 64569 - DNA, 19 bp, Homo sapiens
cactgtccacacctcctcc

SEQ ID NO: 64570 - DNA, 21 bp, Homo sapiens
cccgcctctgcagtcccttcc

SEQ ID NO: 64571 - DNA, 22 bp, Homo sapiens
ccctgccgccaggcccctcccc

SEQ ID NO: 64572 - DNA, 20 bp, Homo sapiens
ccgcacgtccagtcccctcc

SEQ ID NO: 64573 - DNA, 20 bp, Homo sapiens
cccacctcctaccccttccc

SEQ ID NO: 64574 - DNA, 20 bp, Homo sapiens
cccgcctccctgacctcccc

SEQ ID NO: 64575 - DNA, 17 bp, Homo sapiens
cccgccctccacccccc

SEQ ID NO: 64576 - DNA, 20 bp, Homo sapiens
cgccctcagcagccccttcc

SEQ ID NO: 64577 - DNA, 18 bp, Homo sapiens
cccccacaacccccctcc

SEQ ID NO: 64578 - DNA, 18 bp, Homo sapiens
cccctcctaccccctccc

SEQ ID NO: 64579 - DNA, 20 bp, Homo sapiens
cccacacctacgccttcccc

SEQ ID NO: 64580 - DNA, 20 bp, Homo sapiens
ccgccttcgcgccccggccc

SEQ ID NO: 64581 - DNA, 21 bp, Homo sapiens
caccttcagttgccctcctcc

SEQ ID NO: 64582 - DNA, 19 bp, Homo sapiens
cctccggccgccccctccc

SEQ ID NO: 64583 - DNA, 18 bp, Homo sapiens
cacctttcagcccttccc

SEQ ID NO: 64584 - DNA, 19 bp, Homo sapiens
cccgccttggcctccctcc

SEQ ID NO: 64585 - DNA, 18 bp, Homo sapiens
ccccctcccgcgccttcc

SEQ ID NO: 64586 - DNA, 21 bp, Homo sapiens
cccgcgtcatgcagtcctccc

SEQ ID NO: 64587 - DNA, 19 bp, Homo sapiens
ccccctttcttagcccccc

SEQ ID NO: 64588 - DNA, 17 bp, Homo sapiens
cccgccaactccccccc

SEQ ID NO: 64589 - DNA, 17 bp, Homo sapiens
cccccttcgccctcccc

SEQ ID NO: 64590 - DNA, 19 bp, Homo sapiens
ccagcgttcgccccctccc

SEQ ID NO: 64591 - DNA, 21 bp, Homo sapiens
ccctcctaccggctctcctcc

SEQ ID NO: 64592 - DNA, 20 bp, Homo sapiens
gcctccgcgcgcctctcccc

SEQ ID NO: 64593 - DNA, 18 bp, Homo sapiens
ccgccctcagcgtcctcc

SEQ ID NO: 64594 - DNA, 18 bp, Homo sapiens
cctgtgctgccccccccc

SEQ ID NO: 64595 - DNA, 19 bp, Homo sapiens
cccacccccattccctccc

SEQ ID NO: 64596 - DNA, 20 bp, Homo sapiens
cctgcctccacaggctcccc

SEQ ID NO: 64597 - DNA, 20 bp, Homo sapiens
cccgcagcacgcccctctcc

SEQ ID NO: 64598 - DNA, 20 bp, Homo sapiens
gcctcgccgcgccccctccc

SEQ ID NO: 64599 - DNA, 21 bp, Homo sapiens
ccctctgggcagccctcctcc

SEQ ID NO: 64600 - DNA, 19 bp, Homo sapiens
ccctctaaccacccccccc

SEQ ID NO: 64601 - DNA, 17 bp, Homo sapiens
ccccctctgccctcccc

SEQ ID NO: 64602 - DNA, 19 bp, Homo sapiens
cccgcctgcgaatccctcc

SEQ ID NO: 64603 - DNA, 23 bp, Homo sapiens
ccctcctccacgtgcttccttcc

SEQ ID NO: 64604 - DNA, 17 bp, Homo sapiens
cccgcctcccgcctccc

SEQ ID NO: 64605 - DNA, 20 bp, Homo sapiens
cccgcactcccattctcccc

SEQ ID NO: 64606 - DNA, 19 bp, Homo sapiens
cccgctcccgccctcctcc

SEQ ID NO: 64607 - DNA, 17 bp, Homo sapiens
cctggccttaccccccc

SEQ ID NO: 64608 - DNA, 17 bp, Homo sapiens
cccccctcaacctcccc

SEQ ID NO: 64609 - DNA, 19 bp, Homo sapiens
cccgccttctccccgcccc

SEQ ID NO: 64610 - DNA, 18 bp, Homo sapiens
ccttcacgcgtccctccc

SEQ ID NO: 64611 - DNA, 20 bp, Homo sapiens
cctccgccatggcccccccc

SEQ ID NO: 64612 - DNA, 20 bp, Homo sapiens
cccgctttctctactccccc

SEQ ID NO: 64613 - DNA, 20 bp, Homo sapiens
cccacctcagaaccccttcc

SEQ ID NO: 64614 - DNA, 22 bp, Homo sapiens
cccactcaccctgccctcctcc

SEQ ID NO: 64615 - DNA, 18 bp, Homo sapiens
cccgccctcacatcctcc

SEQ ID NO: 64616 - DNA, 23 bp, Homo sapiens
cccgcgctctggcgcctcctccc

SEQ ID NO: 64617 - DNA, 19 bp, Homo sapiens
accatgcgcgcccctcccc

SEQ ID NO: 64618 - DNA, 20 bp, Homo sapiens
cgcctccgccaccacctccc

SEQ ID NO: 64619 - DNA, 19 bp, Homo sapiens
cccgcctccccgcctcccc

SEQ ID NO: 64620 - DNA, 21 bp, Homo sapiens
cccgccttcttgccccttccc

SEQ ID NO: 64621 - DNA, 23 bp, Homo sapiens
cccgcctcgcctttgccctctcc

SEQ ID NO: 64622 - DNA, 18 bp, Homo sapiens
cccaccctacccctttcc

SEQ ID NO: 64623 - DNA, 18 bp, Homo sapiens
ccgccgctgccccccccc

SEQ ID NO: 64624 - DNA, 17 bp, Homo sapiens
ccccctccagctcctcc

SEQ ID NO: 64625 - DNA, 22 bp, Homo sapiens
ccgccctcaggccgcccctccc

SEQ ID NO: 64626 - DNA, 20 bp, Homo sapiens
ccgccgctgccgcctcctcc

SEQ ID NO: 64627 - DNA, 24 bp, Homo sapiens
cccgcccagtgcctgctcccctcc

SEQ ID NO: 64628 - DNA, 18 bp, Homo sapiens
cccgccctcacgccttcc

SEQ ID NO: 64629 - DNA, 18 bp, Homo sapiens
ccttctccacaccctccc

SEQ ID NO: 64630 - DNA, 18 bp, Homo sapiens
ccagccttcgcgggcccc

SEQ ID NO: 64631 - DNA, 19 bp, Homo sapiens
cctgcctccacagcttccc

SEQ ID NO: 64632 - DNA, 17 bp, Homo sapiens
gccccccgccccccccc

SEQ ID NO: 64633 - DNA, 23 bp, Homo sapiens
ccgcctctgcctccgccccctcc

SEQ ID NO: 64634 - DNA, 17 bp, Homo sapiens
cccggtttccgcccccc

SEQ ID NO: 64635 - DNA, 21 bp, Homo sapiens
cgccgcgccgcgcccctcccc

SEQ ID NO: 64636 - DNA, 22 bp, Homo sapiens
cccaccttcagggagccctccc

SEQ ID NO: 64637 - DNA, 21 bp, Homo sapiens
ccctcacacaagcctcctccc

SEQ ID NO: 64638 - DNA, 19 bp, Homo sapiens
cccacacgcagccccctcc

SEQ ID NO: 64639 - DNA, 19 bp, Homo sapiens
ccacccggaaccccctccc

SEQ ID NO: 64640 - DNA, 19 bp, Homo sapiens
cctccccccacccccctcc

SEQ ID NO: 64641 - DNA, 22 bp, Homo sapiens
cctctctttctgcaactccccc

SEQ ID NO: 64642 - DNA, 22 bp, Homo sapiens
ccacgcctggctgctccttccc

SEQ ID NO: 64643 - DNA, 20 bp, Homo sapiens
ccccctctcacgcctccccc

SEQ ID NO: 64644 - DNA, 18 bp, Homo sapiens
cccgccacaccccctccc

SEQ ID NO: 64645 - DNA, 17 bp, Homo sapiens
ccctccccacgctcccc

SEQ ID NO: 64646 - DNA, 19 bp, Homo sapiens
cccgcccttcacagacccc

SEQ ID NO: 64647 - DNA, 21 bp, Homo sapiens
ccggcggccgcgcccctcccc

SEQ ID NO: 64648 - DNA, 20 bp, Homo sapiens
cctgccccacgttcctcccc

SEQ ID NO: 64649 - DNA, 20 bp, Homo sapiens
ccggctccgggccccctccc

SEQ ID NO: 64650 - DNA, 16 bp, Homo sapiens
cccatccaccctcccc

SEQ ID NO: 64651 - DNA, 19 bp, Homo sapiens
ccagccgccgctcctcccc

SEQ ID NO: 64652 - DNA, 19 bp, Homo sapiens
cccagctcgacctccttcc

SEQ ID NO: 64653 - DNA, 20 bp, Homo sapiens
cacccccactgtcccctccc

SEQ ID NO: 64654 - DNA, 19 bp, Homo sapiens
ccattcaacgcccccctcc

SEQ ID NO: 64655 - DNA, 18 bp, Homo sapiens
ccgccctccgccctctcc

SEQ ID NO: 64656 - DNA, 20 bp, Homo sapiens
cccgcctttccgacgccccc

SEQ ID NO: 64657 - DNA, 20 bp, Homo sapiens
ccacgcctcagcccccttcc

SEQ ID NO: 64658 - DNA, 23 bp, Homo sapiens
ccatctccacgatgtttccctcc

SEQ ID NO: 64659 - DNA, 21 bp, Homo sapiens
ccgccctccccgctcctcccc

SEQ ID NO: 64660 - DNA, 22 bp, Homo sapiens
cccccctcactcgtcccccccc

SEQ ID NO: 64661 - DNA, 22 bp, Homo sapiens
cccactccggacgcttcctccc

SEQ ID NO: 64662 - DNA, 21 bp, Homo sapiens
ccctcctaccagcccctcccc

SEQ ID NO: 64663 - DNA, 20 bp, Homo sapiens
cctacctttcggcctccccc

SEQ ID NO: 64664 - DNA, 21 bp, Homo sapiens
cccggtccggcgcccccctcc

SEQ ID NO: 64665 - DNA, 19 bp, Homo sapiens
cccgcctccaaagtccccc

SEQ ID NO: 64666 - DNA, 24 bp, Homo sapiens
ccgccttcccagcagctcccttcc

SEQ ID NO: 64667 - DNA, 21 bp, Homo sapiens
ccgcgcggcctgcgccctccc

SEQ ID NO: 64668 - DNA, 18 bp, Homo sapiens
cccatcccctgccccccc

SEQ ID NO: 64669 - DNA, 20 bp, Homo sapiens
cccgcgctccaccctctccc

SEQ ID NO: 64670 - DNA, 20 bp, Homo sapiens
cccgccctgcctgctcctcc

SEQ ID NO: 64671 - DNA, 19 bp, Homo sapiens
cccaccccagcctccttcc

SEQ ID NO: 64672 - DNA, 22 bp, Homo sapiens
ccctcccttcctgtcccctccc

SEQ ID NO: 64673 - DNA, 21 bp, Homo sapiens
cctgcctcctctgctcccccc

SEQ ID NO: 64674 - DNA, 23 bp, Homo sapiens
cctcctcctgggcgtcctcctcc

SEQ ID NO: 64675 - DNA, 20 bp, Homo sapiens
cctcgtctccacccccctcc

SEQ ID NO: 64676 - DNA, 18 bp, Homo sapiens
gccctagcgccccccccc

SEQ ID NO: 64677 - DNA, 21 bp, Homo sapiens
cccacactgatgccccccccc

SEQ ID NO: 64678 - DNA, 28 bp, Homo sapiens
cccgcctcctccatggtgccctcctccg

SEQ ID NO: 64679 - DNA, 20 bp, Homo sapiens
cccaccctgcgccctcctcc

SEQ ID NO: 64680 - DNA, 18 bp, Homo sapiens
cccccctccgcccttccc

SEQ ID NO: 64681 - DNA, 19 bp, Homo sapiens
cccgcccccgccctccccc

SEQ ID NO: 64682 - DNA, 19 bp, Homo sapiens
cccccttcgcccacccccc

SEQ ID NO: 64683 - DNA, 17 bp, Homo sapiens
ccctccccacaccctcc

SEQ ID NO: 64684 - DNA, 20 bp, Homo sapiens
ccttcctgccagcccctccc

SEQ ID NO: 64685 - DNA, 20 bp, Homo sapiens
ccttctccacacctctcccc

SEQ ID NO: 64686 - DNA, 21 bp, Homo sapiens
cccatgcccacgccctcctcc

SEQ ID NO: 64687 - DNA, 20 bp, Homo sapiens
ccatatccacgcctccttcc

SEQ ID NO: 64688 - DNA, 23 bp, Homo sapiens
ccgcgccgtcggctgtcccctcc

SEQ ID NO: 64689 - DNA, 22 bp, Homo sapiens
ccgcttccgcctggggtcctcc

SEQ ID NO: 64690 - DNA, 19 bp, Homo sapiens
cccgccccggcctcctccc

SEQ ID NO: 64691 - DNA, 18 bp, Homo sapiens
cccagctcctcgccctcc

SEQ ID NO: 64692 - DNA, 23 bp, Homo sapiens
ccagcgcccccgcgccctctccc

SEQ ID NO: 64693 - DNA, 19 bp, Homo sapiens
gcccagccgcgccccctcc

SEQ ID NO: 64694 - DNA, 21 bp, Homo sapiens
cccagaaacacgcccccctcc

SEQ ID NO: 64695 - DNA, 24 bp, Homo sapiens
cctccttttcatccacccttcccc

SEQ ID NO: 64696 - DNA, 18 bp, Homo sapiens
cctccagccccgccctcc

SEQ ID NO: 64697 - DNA, 19 bp, Homo sapiens
cccgccccccaacctcccc

SEQ ID NO: 64698 - DNA, 17 bp, Homo sapiens
cccacctcagcccttcc

SEQ ID NO: 64699 - DNA, 19 bp, Homo sapiens
ccctcctccgcgtccctcc

SEQ ID NO: 64700 - DNA, 16 bp, Homo sapiens
cccgcctcaacccccc

SEQ ID NO: 64701 - DNA, 22 bp, Homo sapiens
ccttcctccacagccctctccc

SEQ ID NO: 64702 - DNA, 17 bp, Homo sapiens
ccctgcctcaccccccc

SEQ ID NO: 64703 - DNA, 19 bp, Homo sapiens
ccacgctcgcacctccccc

SEQ ID NO: 64704 - DNA, 21 bp, Homo sapiens
cccgccttgctccgccccccc

SEQ ID NO: 64705 - DNA, 20 bp, Homo sapiens
cccgcctttgggcggcctcc

SEQ ID NO: 64706 - DNA, 19 bp, Homo sapiens
cccaccttcgccgcccccc

SEQ ID NO: 64707 - DNA, 16 bp, Homo sapiens
cccgctcgcgccctcc

SEQ ID NO: 64708 - DNA, 18 bp, Homo sapiens
cccgccccacgcccctcc

SEQ ID NO: 64709 - DNA, 19 bp, Homo sapiens
ccagcccccacctcccccc

SEQ ID NO: 64710 - DNA, 23 bp, Homo sapiens
cccgcctcggccaccgccccccc

SEQ ID NO: 64711 - DNA, 18 bp, Homo sapiens
cccgcctccccacttccc

SEQ ID NO: 64712 - DNA, 21 bp, Homo sapiens
ccctcccccgtcgcccctccc

SEQ ID NO: 64713 - DNA, 20 bp, Homo sapiens
ccccttggccacccccctcc

SEQ ID NO: 64714 - DNA, 20 bp, Homo sapiens
cccgccttcacgcgctctcc

SEQ ID NO: 64715 - DNA, 18 bp, Homo sapiens
cccgcctctggcagcccc

SEQ ID NO: 64716 - DNA, 22 bp, Homo sapiens
cccagctcatctgctcctcccc

SEQ ID NO: 64717 - DNA, 19 bp, Homo sapiens
ccagcccccacttcctccc

SEQ ID NO: 64718 - DNA, 19 bp, Homo sapiens
cccacccccacccttcccc

SEQ ID NO: 64719 - DNA, 21 bp, Homo sapiens
ccgccttctgccgcttcctcc

SEQ ID NO: 64720 - DNA, 18 bp, Homo sapiens
ccacccccgcctccctcc

SEQ ID NO: 64721 - DNA, 20 bp, Homo sapiens
cccgcctccagcccctctcc

SEQ ID NO: 64722 - DNA, 19 bp, Homo sapiens
cctgcccccaccctccccc

SEQ ID NO: 64723 - DNA, 17 bp, Homo sapiens
ccggcgcgcccctcccc

SEQ ID NO: 64724 - DNA, 21 bp, Homo sapiens
ccccctcgaaagccctttccc

SEQ ID NO: 64725 - DNA, 17 bp, Homo sapiens
ccgccctccgccttccc

SEQ ID NO: 64726 - DNA, 18 bp, Homo sapiens
ccctcccttgcccccccc

SEQ ID NO: 64727 - DNA, 20 bp, Homo sapiens
cctcttttgcaccccctccc

SEQ ID NO: 64728 - DNA, 20 bp, Homo sapiens
cctggccttccaccctcccc

SEQ ID NO: 64729 - DNA, 15 bp, Homo sapiens
cccgcctgccccccc

SEQ ID NO: 64730 - DNA, 21 bp, Homo sapiens
ccccctcacacacctctcccc

SEQ ID NO: 64731 - DNA, 18 bp, Homo sapiens
cccgcccccatccctccc

SEQ ID NO: 64732 - DNA, 22 bp, Homo sapiens
cccgcctcgcctgccctcttcc

SEQ ID NO: 64733 - DNA, 20 bp, Homo sapiens
ccgccctcctgccctccccc

SEQ ID NO: 64734 - DNA, 16 bp, Homo sapiens
ccccctcggcctcccc

SEQ ID NO: 64735 - DNA, 18 bp, Homo sapiens
cgctttagcagccccccc

SEQ ID NO: 64736 - DNA, 15 bp, Homo sapiens
cccccttaccccccc

SEQ ID NO: 64737 - DNA, 17 bp, Homo sapiens
cccgccttggcctcccc

SEQ ID NO: 64738 - DNA, 18 bp, Homo sapiens
ccacgccacagccccccc

SEQ ID NO: 64739 - DNA, 17 bp, Homo sapiens
cccgccttagcccctcc

SEQ ID NO: 64740 - DNA, 19 bp, Homo sapiens
cccagccccaccccctccc

SEQ ID NO: 64741 - DNA, 18 bp, Homo sapiens
cctgcctccccacccccc

SEQ ID NO: 64742 - DNA, 18 bp, Homo sapiens
ccctgcccgccccccccc

SEQ ID NO: 64743 - DNA, 18 bp, Homo sapiens
gccccccagccctccccc

SEQ ID NO: 64744 - DNA, 21 bp, Homo sapiens
cccccctttcggccgcccccc

SEQ ID NO: 64745 - DNA, 21 bp, Homo sapiens
ccctcccacacgcccctttcc

SEQ ID NO: 64746 - DNA, 25 bp, Homo sapiens
cccgcctttgcagtgcgccctctcc

SEQ ID NO: 64747 - DNA, 15 bp, Homo sapiens
cccgccttccccccc

SEQ ID NO: 64748 - DNA, 20 bp, Homo sapiens
cccgcctttcgcacgaaccc

SEQ ID NO: 64749 - DNA, 19 bp, Homo sapiens
cacgtctcgcaccccctcc

SEQ ID NO: 64750 - DNA, 19 bp, Homo sapiens
cccctccccgccccccccc

SEQ ID NO: 64751 - DNA, 21 bp, Homo sapiens
ccgcctccaccaccccccccc

SEQ ID NO: 64752 - DNA, 18 bp, Homo sapiens
cccgcctttcaggacccc

SEQ ID NO: 64753 - DNA, 22 bp, Homo sapiens
ccccctcgcgtcgccccttccc

SEQ ID NO: 64754 - DNA, 18 bp, Homo sapiens
cccccactggcctccccc

SEQ ID NO: 64755 - DNA, 21 bp, Homo sapiens
cacctccctgtgcccctcccc

SEQ ID NO: 64756 - DNA, 21 bp, Homo sapiens
cctgcctctcctgcccccccc

SEQ ID NO: 64757 - DNA, 16 bp, Homo sapiens
cccgcttcggcctccc

SEQ ID NO: 64758 - DNA, 18 bp, Homo sapiens
cccgcggcgccccctccc

SEQ ID NO: 64759 - DNA, 21 bp, Homo sapiens
cctcgccttcctcgccttccc

SEQ ID NO: 64760 - DNA, 17 bp, Homo sapiens
ccctaacctgccccccc

SEQ ID NO: 64761 - DNA, 17 bp, Homo sapiens
caccgcggtcccccccc

SEQ ID NO: 64762 - DNA, 18 bp, Homo sapiens
cccgccttctgcacgccc

SEQ ID NO: 64763 - DNA, 19 bp, Homo sapiens
ccccctccaactccccccc

SEQ ID NO: 64764 - DNA, 20 bp, Homo sapiens
ccgcactaacgccccctccc

SEQ ID NO: 64765 - DNA, 18 bp, Homo sapiens
gctcctcacgctccctcc

SEQ ID NO: 64766 - DNA, 17 bp, Homo sapiens
cctgcctcagcctcccc

SEQ ID NO: 64767 - DNA, 19 bp, Homo sapiens
cccagccggacaccccccc

SEQ ID NO: 64768 - DNA, 21 bp, Homo sapiens
cccagaccggcgtcctcctcc

SEQ ID NO: 64769 - DNA, 17 bp, Homo sapiens
ccccccttcagcctccc

SEQ ID NO: 64770 - DNA, 21 bp, Homo sapiens
ccgcccccacggccccctccc

SEQ ID NO: 64771 - DNA, 21 bp, Homo sapiens
cctgtctccacgcttccctcc

SEQ ID NO: 64772 - DNA, 18 bp, Homo sapiens
cccgccccatccctcccc

SEQ ID NO: 64773 - DNA, 18 bp, Homo sapiens
cgtccgcagcctccctcc

SEQ ID NO: 64774 - DNA, 20 bp, Homo sapiens
cccaccccacatctccttcc

SEQ ID NO: 64775 - DNA, 18 bp, Homo sapiens
cgcccccggccccctccc

SEQ ID NO: 64776 - DNA, 26 bp, Homo sapiens
cccatcttcgcacggtggcccctccc

SEQ ID NO: 64777 - DNA, 19 bp, Homo sapiens
ccagcctgggacccccccc

SEQ ID NO: 64778 - DNA, 20 bp, Homo sapiens
cctcctggcacaccccttcc

SEQ ID NO: 64779 - DNA, 20 bp, Homo sapiens
ccgcctcctgctgcccctcc

SEQ ID NO: 64780 - DNA, 20 bp, Homo sapiens
cccccccgacgccctccccc

SEQ ID NO: 64781 - DNA, 20 bp, Homo sapiens
cccgggccctgcccccctcc

SEQ ID NO: 64782 - DNA, 19 bp, Homo sapiens
cccacacctgctcccctcc

SEQ ID NO: 64783 - DNA, 19 bp, Homo sapiens
cccgccttccacgcccccc

SEQ ID NO: 64784 - DNA, 17 bp, Homo sapiens
ccgccttccgctcctcc

SEQ ID NO: 64785 - DNA, 19 bp, Homo sapiens
ccacctgcactgcccctcc

SEQ ID NO: 64786 - DNA, 16 bp, Homo sapiens
cccgcctcacccctcc

SEQ ID NO: 64787 - DNA, 16 bp, Homo sapiens
ccctccttgccccccc

SEQ ID NO: 64788 - DNA, 21 bp, Homo sapiens
cccgcctctcggtccttcccc

SEQ ID NO: 64789 - DNA, 20 bp, Homo sapiens
ccggcctcgcacgtcctccc

SEQ ID NO: 64790 - DNA, 17 bp, Homo sapiens
cccgcctcgcacccccc

SEQ ID NO: 64791 - DNA, 21 bp, Homo sapiens
cccaccttcacagcctcttcc

SEQ ID NO: 64792 - DNA, 17 bp, Homo sapiens
cccccttccgtcccccc

SEQ ID NO: 64793 - DNA, 19 bp, Homo sapiens
ccgcccccggccccctccc

SEQ ID NO: 64794 - DNA, 21 bp, Homo sapiens
cctgccttcccgcccgcctcc

SEQ ID NO: 64795 - DNA, 20 bp, Homo sapiens
cctccttggcatccccttcc

SEQ ID NO: 64796 - DNA, 18 bp, Homo sapiens
cccaccttcaccccttcc

SEQ ID NO: 64797 - DNA, 17 bp, Homo sapiens
cccgccctcgcccctcc

SEQ ID NO: 64798 - DNA, 19 bp, Homo sapiens
cccacccccaacctccccc

SEQ ID NO: 64799 - DNA, 19 bp, Homo sapiens
ccgtggcccgcgcctcccc

SEQ ID NO: 64800 - DNA, 20 bp, Homo sapiens
ccttccttcgcgaaccctcc

SEQ ID NO: 64801 - DNA, 20 bp, Homo sapiens
cgccttctgcgccccctccc

SEQ ID NO: 64802 - DNA, 19 bp, Homo sapiens
cgcccccgccgcccctccc

SEQ ID NO: 64803 - DNA, 20 bp, Homo sapiens
cctccacacctgtcccttcc

SEQ ID NO: 64804 - DNA, 19 bp, Homo sapiens
cccgcgccgcggctcctcc

SEQ ID NO: 64805 - DNA, 19 bp, Homo sapiens
cctccggccggcctcctcc

SEQ ID NO: 64806 - DNA, 20 bp, Homo sapiens
cgacctccaacgcctcctcc

SEQ ID NO: 64807 - DNA, 20 bp, Homo sapiens
cccatctctgagcgcccccc

SEQ ID NO: 64808 - DNA, 20 bp, Homo sapiens
ccccccttcgggaaccctcc

SEQ ID NO: 64809 - DNA, 26 bp, Homo sapiens
cctgccctcgctctgcagcctctccc

SEQ ID NO: 64810 - DNA, 23 bp, Homo sapiens
cccgcctcgctcatgcctcctcc

SEQ ID NO: 64811 - DNA, 23 bp, Homo sapiens
cccacctccctctgcttcccccc

SEQ ID NO: 64812 - DNA, 19 bp, Homo sapiens
cccgcctccacgctccccc

SEQ ID NO: 64813 - DNA, 19 bp, Homo sapiens
ccccccaccacccctcccc

SEQ ID NO: 64814 - DNA, 22 bp, Homo sapiens
ccctgcttgagcaccctccccc

SEQ ID NO: 64815 - DNA, 21 bp, Homo sapiens
cactctaacctgcccctcccc

SEQ ID NO: 64816 - DNA, 17 bp, Homo sapiens
cccgcctcgcgcccccc

SEQ ID NO: 64817 - DNA, 18 bp, Homo sapiens
cccgccccgttccctccc

SEQ ID NO: 64818 - DNA, 20 bp, Homo sapiens
ccctgccttcctgccccccc

SEQ ID NO: 64819 - DNA, 19 bp, Homo sapiens
cctgcctccacgctccccc

SEQ ID NO: 64820 - DNA, 23 bp, Homo sapiens
cccgctcctaggcgccctcctcc

SEQ ID NO: 64821 - DNA, 19 bp, Homo sapiens
ccgcgcccgcggctcctcc

SEQ ID NO: 64822 - DNA, 17 bp, Homo sapiens
cccgctcggcctcctcc

SEQ ID NO: 64823 - DNA, 18 bp, Homo sapiens
cgcctggacacccccccc

SEQ ID NO: 64824 - DNA, 18 bp, Homo sapiens
cccgtcttccgcagcccc

SEQ ID NO: 64825 - DNA, 20 bp, Homo sapiens
ccacacccctgcccttcccc

SEQ ID NO: 64826 - DNA, 21 bp, Homo sapiens
cccaccttcagaccctcctcc

SEQ ID NO: 64827 - DNA, 17 bp, Homo sapiens
cactcgcgccccttccc

SEQ ID NO: 64828 - DNA, 18 bp, Homo sapiens
cccgccctgggctccccc

SEQ ID NO: 64829 - DNA, 21 bp, Homo sapiens
cgccttcggccctcgccctcc

SEQ ID NO: 64830 - DNA, 19 bp, Homo sapiens
cctggcctggacccccccc

SEQ ID NO: 64831 - DNA, 22 bp, Homo sapiens
ccggccccacgcgtccccctcc

SEQ ID NO: 64832 - DNA, 20 bp, Homo sapiens
cccgccttcggacctcctcc

SEQ ID NO: 64833 - DNA, 22 bp, Homo sapiens
cccagcctccaagcctctctcc

SEQ ID NO: 64834 - DNA, 17 bp, Homo sapiens
gccccgcaccccccccc

SEQ ID NO: 64835 - DNA, 21 bp, Homo sapiens
ccgccttcgggggcctcctcc

SEQ ID NO: 64836 - DNA, 18 bp, Homo sapiens
cccaccctactcctcccc

SEQ ID NO: 64837 - DNA, 20 bp, Homo sapiens
ccagccccccgcccctcccc

SEQ ID NO: 64838 - DNA, 17 bp, Homo sapiens
cccgcccgcgccctccc

SEQ ID NO: 64839 - DNA, 18 bp, Homo sapiens
ccctgcccaacccccccc

SEQ ID NO: 64840 - DNA, 21 bp, Homo sapiens
cgctaccgcgcgcccctcccc

SEQ ID NO: 64841 - DNA, 22 bp, Homo sapiens
cccgcctcccccgccttcctcc

SEQ ID NO: 64842 - DNA, 19 bp, Homo sapiens
cccgcctcgagccaccccc

SEQ ID NO: 64843 - DNA, 18 bp, Homo sapiens
cccgccttcccgcgcccc

SEQ ID NO: 64844 - DNA, 21 bp, Homo sapiens
cccacccacgccgccccctcc

SEQ ID NO: 64845 - DNA, 20 bp, Homo sapiens
cgccaggtgcgcccccctcc

SEQ ID NO: 64846 - DNA, 18 bp, Homo sapiens
cctcactcgcgccttccc

SEQ ID NO: 64847 - DNA, 18 bp, Homo sapiens
cccgccccaccctccccc

SEQ ID NO: 64848 - DNA, 21 bp, Homo sapiens
ccgcgtcccccgcccctcccc

SEQ ID NO: 64849 - DNA, 21 bp, Homo sapiens
cccttctccgggcccctttcc

SEQ ID NO: 64850 - DNA, 20 bp, Homo sapiens
cgcgtttccacgcctccccc

SEQ ID NO: 64851 - DNA, 21 bp, Homo sapiens
cccacacagcagcctccctcc

SEQ ID NO: 64852 - DNA, 22 bp, Homo sapiens
ccccctcacatggcttcctccc

SEQ ID NO: 64853 - DNA, 18 bp, Homo sapiens
cccacccagctcccctcc

SEQ ID NO: 64854 - DNA, 19 bp, Homo sapiens
cccacgctcgcctccctcc

SEQ ID NO: 64855 - DNA, 19 bp, Homo sapiens
ccctcttgcacccccttcc

SEQ ID NO: 64856 - DNA, 18 bp, Homo sapiens
cccgtccccacccccccc

SEQ ID NO: 64857 - DNA, 22 bp, Homo sapiens
cccgcctcgggagcccctctcc

SEQ ID NO: 64858 - DNA, 18 bp, Homo sapiens
cccccccagccccttccc

SEQ ID NO: 64859 - DNA, 18 bp, Homo sapiens
ccgccctcgttccctccc

SEQ ID NO: 64860 - DNA, 18 bp, Homo sapiens
ccagcggccggccccccc

SEQ ID NO: 64861 - DNA, 16 bp, Homo sapiens
ccctaccctgcccccc

SEQ ID NO: 64862 - DNA, 22 bp, Homo sapiens
cccgcgctgcaggcccccctcc

SEQ ID NO: 64863 - DNA, 19 bp, Homo sapiens
cccctccacatccctcccc

SEQ ID NO: 64864 - DNA, 19 bp, Homo sapiens
ccctcccccatctcccccc

SEQ ID NO: 64865 - DNA, 20 bp, Homo sapiens
gccatcagttaccctccccc

SEQ ID NO: 64866 - DNA, 101 bp, Rat cytomegalovirus
acgcgatttatttatttcaacgcgttcacagtacgctttccacttagtatataattgtgacgcatccttttttaataagttgattcctataccattcgcgt

SEQ ID NO: 64867 - DNA, 24 bp, Rat cytomegalovirus
ttcaacgcgttcacagtacgcttt

SEQ ID NO: 64868 - DNA, 18 bp, Homo sapiens
ttcacgcgttcacaatcg

SEQ ID NO: 64869 - DNA, 84 bp, Rat cytomegalovirus
cacccgtagttaacgcatctacagatccattactgaagtacacattaacgttgcttatctgaagagtagaaataattacgggtg

SEQ ID NO: 64870 - DNA, 24 bp, Rat cytomegalovirus
tgaagagtagaaataattacgggt

SEQ ID NO: 64871 - DNA, 21 bp, Homo sapiens
tgaagagtaaagtgacatggt

SEQ ID NO: 64872 - DNA, 19 bp, Homo sapiens
taaagggtagaaatagtca

SEQ ID NO: 64873 - DNA, 19 bp, Homo sapiens
tgaagagtgtgaaatgagc

SEQ ID NO: 64874 - DNA, 19 bp, Homo sapiens
tgaaagtagaaatgacaag

SEQ ID NO: 64875 - DNA, 18 bp, Homo sapiens
tgaagagcagaaataatc

SEQ ID NO: 64876 - DNA, 17 bp, Homo sapiens
tggaggtagaaataatt

SEQ ID NO: 64877 - DNA, 23 bp, Homo sapiens
tggaggtagaaacatggatgggt

SEQ ID NO: 64878 - DNA, 22 bp, Homo sapiens
tgagagtagagtataaatgggt

SEQ ID NO: 64879 - DNA, 22 bp, Homo sapiens
tgaagagcgggaagagctgggt

SEQ ID NO: 64880 - DNA, 18 bp, Homo sapiens
tgaagagtatagataatc

SEQ ID NO: 64881 - DNA, 25 bp, Homo sapiens
tggagaatagagacccaaaatgggt

SEQ ID NO: 64882 - DNA, 24 bp, Homo sapiens
gaagagtagggctgctccttgggt

SEQ ID NO: 64883 - DNA, 22 bp, Homo sapiens
tgaagagcagagatagcaaggt

SEQ ID NO: 64884 - DNA, 97 bp, Paramecium bursaria Chlorella virus 1
gtgttccccagagcgtctgtgtattcagtttctttcttgatttccaacttaatcgcatcgagcatcgcggctgattgcccggtaatctggacaacac

SEQ ID NO: 64885 - DNA, 24 bp, Paramecium bursaria Chlorella virus 1
ccccagagcgtctgtgtattcagt

SEQ ID NO: 64886 - DNA, 16 bp, Homo sapiens
ccccagagtggcttca

SEQ ID NO: 64887 - DNA, 18 bp, Homo sapiens
aagtgcctgctatttagt

SEQ ID NO: 64888 - DNA, 19 bp, Homo sapiens
gagtgtttatatattcagt

SEQ ID NO: 64889 - DNA, 15 bp, Homo sapiens
cagagtggtattcag

SEQ ID NO: 64890 - DNA, 21 bp, Homo sapiens
ccccagagctctgacctcggt

SEQ ID NO: 64891 - DNA, 16 bp, Homo sapiens
agagtgcgtattcggt

SEQ ID NO: 64892 - DNA, 25 bp, Homo sapiens
ccctggagcatctgtgccgggcagt

SEQ ID NO: 64893 - DNA, 16 bp, Homo sapiens
cagagttgatattcag

SEQ ID NO: 64894 - DNA, 19 bp, Homo sapiens
ccccagaggtgtgattcag

SEQ ID NO: 64895 - DNA, 19 bp, Homo sapiens
ccccaggggagttattcag

SEQ ID NO: 64896 - DNA, 22 bp, Homo sapiens
cctaagtgtaaagtcattcagt

SEQ ID NO: 64897 - DNA, 21 bp, Homo sapiens
cccggagctctgcactctagt

SEQ ID NO: 64898 - DNA, 20 bp, Homo sapiens
gaggtaaacttgtattcagt

SEQ ID NO: 64899 - DNA, 18 bp, Homo sapiens
cctggagagtctgtgtat

SEQ ID NO: 64900 - DNA, 19 bp, Homo sapiens
ccctagaatgaatattcag

SEQ ID NO: 64901 - DNA, 20 bp, Homo sapiens
cccatggcactgtattcagt

SEQ ID NO: 64902 - DNA, 23 bp, Homo sapiens
ccacggcgtctgtcattgtcagt

SEQ ID NO: 64903 - DNA, 63 bp, Paramecium bursaria Chlorella virus 1
ttcgtaatacttgatatactcgtcagaaagcagtttcttcagagtcttcctgaaagttacgaa

SEQ ID NO: 64904 - DNA, 24 bp, Paramecium bursaria Chlorella virus 1
ttcagagtcttcctgaaagttacg

SEQ ID NO: 64905 - DNA, 20 bp, Homo sapiens
ttcagagtgttcctgaaagt

SEQ ID NO: 64906 - DNA, 18 bp, Homo sapiens
tccatgctcctgaaagtt

SEQ ID NO: 64907 - DNA, 21 bp, Homo sapiens
ctcagagttacccgggagtta

SEQ ID NO: 64908 - DNA, 19 bp, Homo sapiens
ttcagggttcttctgaaag

SEQ ID NO: 64909 - DNA, 20 bp, Homo sapiens
ttcagagtctcttatctctg

SEQ ID NO: 64910 - DNA, 21 bp, Homo sapiens
ttcagagtctgcctgaccatt

SEQ ID NO: 64911 - DNA, 72 bp, Paramecium bursaria Chlorella virus 1
gacgctaacctcctccttgtcagtgtacaactgcacacggctgtacatatcagaaggatttatatttggctc

SEQ ID NO: 64912 - DNA, 24 bp, Paramecium bursaria Chlorella virus 1
tgtacatatcagaaggatttatat

SEQ ID NO: 64913 - DNA, 18 bp, Homo sapiens
tgcatatatcagaaaaat

SEQ ID NO: 64914 - DNA, 17 bp, Homo sapiens
tgtatgtcagaaagact

SEQ ID NO: 64915 - DNA, 19 bp, Homo sapiens
tgtatatcagaggatctat

SEQ ID NO: 64916 - DNA, 18 bp, Homo sapiens
tgtgtatatcagacagga

SEQ ID NO: 64917 - DNA, 23 bp, Homo sapiens
tgtacatattcagaaaacaatat

SEQ ID NO: 64918 - DNA, 115 bp, Monkeypox virus
atctagttgtatgagtttatcgtttacataagcaattaacggctttaacagatgatctgagtaataatatacctctgttatacgtttaatgttcacggtcttagtatttttagat

SEQ ID NO: 64919 - DNA, 60 bp, Monkeypox virus
gtttaatgttcacggtcttagtatttttagatatcaattgtgatttacaccatattcgac

SEQ ID NO: 64920 - DNA, 89 bp, Monkeypox virus
aaaataaattagaagctgtgggtcattgttatgaatctctttcagaggaatacagacaattgacaaaattcacagactctcaagatttt

SEQ ID NO: 64921 - DNA, 24 bp, Monkeypox virus
tagaagctgtgggtcattgttatg

SEQ ID NO: 64922 - DNA, 18 bp, Homo sapiens
agctgtgggccatcagct

SEQ ID NO: 64923 - DNA, 19 bp, Homo sapiens
gaagctgtgtgttttctgt

SEQ ID NO: 64924 - DNA, 20 bp, Homo sapiens
agctgtggaaggatgttatg

SEQ ID NO: 64925 - DNA, 17 bp, Homo sapiens
tagaagctgtggtctgt

SEQ ID NO: 64926 - DNA, 19 bp, Homo sapiens
cagaggctgtgggtcagtg

SEQ ID NO: 64927 - DNA, 66 bp, Monkeypox virus
ccaccgcaatagatcctgttagatacatagatcctcgtcgtgatatcgcattttctaacgtgatgg

SEQ ID NO: 64928 - DNA, 23 bp, Monkeypox virus
tatcgcattttctaacgtgatgg

SEQ ID NO: 64929 - DNA, 16 bp, Homo sapiens
acagctaacgtgatgg

SEQ ID NO: 64930 - DNA, 20 bp, Homo sapiens
tccattttctaacagtctgg

SEQ ID NO: 64931 - DNA, 18 bp, Homo sapiens
tcacattttctagttaac

SEQ ID NO: 64932 - DNA, 21 bp, Homo sapiens
gcattttctagcttcatatgg

SEQ ID NO: 64933 - DNA, 21 bp, Homo sapiens
tatccattttcctatggatgg

SEQ ID NO: 64934 - DNA, 16 bp, Homo sapiens
tatcccattttctgat

SEQ ID NO: 64935 - DNA, 21 bp, Homo sapiens
tcgcatctttttaaatgttgg

SEQ ID NO: 64936 - DNA, 129 bp, Maize chlorotic dwarf waikavirus
acaggcctggcctggtaagttcccaagtggtaagagacccggcacgaagtgtagtaagacgccattggcgcagtaaatcgcgatgcgtagcttcgggcttttatcattgaagacgcccgccagtaactt

SEQ ID NO: 64937 - DNA, 24 bp, Maize chlorotic dwarf waikavirus
gcgcagtaaatcgcgatgcgtagc

SEQ ID NO: 64938 - DNA, 20 bp, Homo sapiens
cagtaaatcgtggccatagc

SEQ ID NO: 64939 - DNA, 21 bp, Homo sapiens
gcagtaaattctgaacaaggc

SEQ ID NO: 64940 - DNA, 89 bp, Cowpox virus
aaaataaattagaggctgtgggtcattgttatgaatctctttcagaggaatacagacaattgacaaaattcacagactctcaagatttt

SEQ ID NO: 64941 - DNA, 24 bp, Cowpox virus
ggtcattgttatgaatctctttca

SEQ ID NO: 64942 - DNA, 20 bp, Homo sapiens
ggtctttacaaaatctcttt

SEQ ID NO: 64943 - DNA, 21 bp, Homo sapiens
gttattgttacttgtctcttt

SEQ ID NO: 64944 - DNA, 18 bp, Homo sapiens
ggcattggagtctctttc

SEQ ID NO: 64945 - DNA, 19 bp, Homo sapiens
ttgtctagaatctctttca

SEQ ID NO: 64946 - DNA, 17 bp, Homo sapiens
gtcattgttctcgtttc

SEQ ID NO: 64947 - DNA, 100 bp, Equine herpesvirus 1
gccgtcttgcgaatcgtgacgctggagatgttgcaacacctgcattgagcaactgtgtatgtataactcatcccggatattgtttcaaccgtttgactgt

SEQ ID NO: 64948 - DNA, 24 bp, Equine herpesvirus 1
tgtgtatgtataactcatcccgga

SEQ ID NO: 64949 - DNA, 25 bp, Homo sapiens
tgtgtatgtgtgttttcagatcgga

SEQ ID NO: 64950 - DNA, 19 bp, Homo sapiens
tgttatgtataacacatgg

SEQ ID NO: 64951 - DNA, 18 bp, Homo sapiens
tgtgtcaactcatcttgg

SEQ ID NO: 64952 - DNA, 19 bp, Homo sapiens
tgtgtgtgtgtagatcatc

SEQ ID NO: 64953 - DNA, 20 bp, Homo sapiens
tgtgtatgtgtactcaaggg

SEQ ID NO: 64954 - DNA, 19 bp, Homo sapiens
tgtgtatgtatatattcat

SEQ ID NO: 64955 - DNA, 22 bp, Homo sapiens
tgcgtcaaacaactcattccgg

SEQ ID NO: 64956 - DNA, 20 bp, Homo sapiens
tgtgtatgtgtgagctcatc

SEQ ID NO: 64957 - DNA, 23 bp, Homo sapiens
tgtgtatgtatgtgtggctctgg

SEQ ID NO: 64958 - DNA, 19 bp, Homo sapiens
tgtgtatgtgtaacaccag

SEQ ID NO: 64959 - DNA, 18 bp, Homo sapiens
tatgtatgtataccttgg

SEQ ID NO: 64960 - DNA, 99 bp, Equine herpesvirus 1
gaggagagacgcgacttctggcatgcagcctgctccggacacggattcccaattaccaccccaagcacggctgctattctattttatgtgtctctgctt

SEQ ID NO: 64961 - DNA, 24 bp, Equine herpesvirus 1
tggcatgcagcctgctccggacac

SEQ ID NO: 64962 - DNA, 26 bp, Homo sapiens
tggctgcagcctacctgcctggacac

SEQ ID NO: 64963 - DNA, 18 bp, Homo sapiens
tgtgtgcagcctggccag

SEQ ID NO: 64964 - DNA, 19 bp, Homo sapiens
tggcatgcggtgctgggca

SEQ ID NO: 64965 - DNA, 17 bp, Homo sapiens
ggcatgcagtcctctgg

SEQ ID NO: 64966 - DNA, 21 bp, Homo sapiens
tgacatgcagccagtgggtgc

SEQ ID NO: 64967 - DNA, 17 bp, Homo sapiens
tgtgtgcagccccagac

SEQ ID NO: 64968 - DNA, 19 bp, Homo sapiens
tggcatgcgcctgtagtca

SEQ ID NO: 64969 - DNA, 20 bp, Homo sapiens
tggcgctgtggccaccccgg

SEQ ID NO: 64970 - DNA, 21 bp, Homo sapiens
tggcatgccaggaactgggca

SEQ ID NO: 64971 - DNA, 20 bp, Homo sapiens
gcatgcagcttgtggcagca

SEQ ID NO: 64972 - DNA, 22 bp, Homo sapiens
gctgtgcagcctgcttcctaac

SEQ ID NO: 64973 - DNA, 18 bp, Homo sapiens
tggcagcagctgcggaca

SEQ ID NO: 64974 - DNA, 19 bp, Homo sapiens
tggcatgcagactgagagg

SEQ ID NO: 64975 - DNA, 20 bp, Homo sapiens
tggtttgcagcctgctggga

SEQ ID NO: 64976 - DNA, 18 bp, Homo sapiens
tggctgcagcctgctcgg

SEQ ID NO: 64977 - DNA, 21 bp, Homo sapiens
tggcatggctgcagctccgga

SEQ ID NO: 64978 - DNA, 23 bp, Homo sapiens
gctgtgcagcctccacagggcac

SEQ ID NO: 64979 - DNA, 22 bp, Homo sapiens
tgggtgcagggaccccggacac

SEQ ID NO: 64980 - DNA, 25 bp, Homo sapiens
tggcaggcagcctgctgggaggcac

SEQ ID NO: 64981 - DNA, 90 bp, Equine herpesvirus 1
gctctctacctacaagaatcattagtgctgaaggttcctttcggggtttacagcgctagtattagagttttgtaagagtttattattagc

SEQ ID NO: 64982 - DNA, 24 bp, Equine herpesvirus 1
tttacagcgctagtattagagttt

SEQ ID NO: 64983 - DNA, 20 bp, Homo sapiens
tacaggtcttattagagttt

SEQ ID NO: 64984 - DNA, 89 bp, Camelpox virus
aaaataaattagaagctgttggtcattgttatgaatctctttcagaggaatacagacaattgacaaaattcacagactctcaagatttt

SEQ ID NO: 64985 - DNA, 24 bp, Camelpox virus
tagaagctgttggtcattgttatg

SEQ ID NO: 64986 - DNA, 22 bp, Homo sapiens
tagagactgttggcaagttatg

SEQ ID NO: 64987 - DNA, 22 bp, Homo sapiens
aggagttgttggtctcacagtg

SEQ ID NO: 64988 - DNA, 17 bp, Homo sapiens
aaagccattattgttat

SEQ ID NO: 64989 - DNA, 131 bp, Swinepox virus
tttatagttagaaatggataattgaaatattttctctaataccaataatcttaatataaaatcttttatcctcatctcatcgtggtgaataaatgagtctttcaatatatccgaaatatctaactcatgaa

SEQ ID NO: 64990 - DNA, 24 bp, Swinepox virus
taataccaataatcttaatataaa

SEQ ID NO: 64991 - DNA, 21 bp, Homo sapiens
caataccatgtctcttgatat

SEQ ID NO: 64992 - DNA, 21 bp, Homo sapiens
taataccaaatacaatataaa

SEQ ID NO: 64993 - DNA, 18 bp, Homo sapiens
taatacctataatcttaa

SEQ ID NO: 64994 - DNA, 20 bp, Homo sapiens
taataccaaatagttcttaa

SEQ ID NO: 64995 - DNA, 21 bp, Homo sapiens
taatactaataatctagtata

SEQ ID NO: 64996 - DNA, 18 bp, Homo sapiens
ataccaataaaatataaa

SEQ ID NO: 64997 - DNA, 104 bp, Myxoma virus
agtcgttgaaacaattgtttaacaaacaacccgtgtacgttgagagcgactctcccatttgcgtggataagggatatttggcagattttgttctcgcaacgact

SEQ ID NO: 64998 - DNA, 24 bp, Myxoma virus
tgcgtggataagggatatttggca

SEQ ID NO: 64999 - DNA, 20 bp, Homo sapiens
cgtggataagtgtcctttgg

SEQ ID NO: 65000 - DNA, 20 bp, Homo sapiens
gtggatagtcttatttggca

SEQ ID NO: 65001 - DNA, 63 bp, Myxoma virus
tggataaggaagttacgtacgtagatccgtataaggataaacgattcgcaaatatcctgtcta

SEQ ID NO: 65002 - DNA, 24 bp, Myxoma virus
aggaagttacgtacgtagatccgt

SEQ ID NO: 65003 - DNA, 19 bp, Homo sapiens
agggagtcacgtgcgagat

SEQ ID NO: 65004 - DNA, 17 bp, Homo sapiens
aggaagtcgtgtgctcc

SEQ ID NO: 65005 - DNA, 73 bp, Canine adenovirus
ttgctgttacaatagtgggcccactgtgactagaaagccttcgcacagccctgagattataagtagactgcaa

SEQ ID NO: 65006 - DNA, 24 bp, Canine adenovirus
tgttacaatagtgggcccactgtg

SEQ ID NO: 65007 - DNA, 18 bp, Homo sapiens
acagacacgcccactgtg

SEQ ID NO: 65008 - DNA, 21 bp, Homo sapiens
tgttttaatagtggaactgtg

SEQ ID NO: 65009 - DNA, 21 bp, Homo sapiens
tgctacaataaagctactgtg

SEQ ID NO: 65010 - DNA, 23 bp, Homo sapiens
tattacaattcatgttcactgtg

SEQ ID NO: 65011 - DNA, 19 bp, Homo sapiens
tgttggagaggcccactgt

SEQ ID NO: 65012 - DNA, 19 bp, Homo sapiens
tgttcaagggtccactgtg

SEQ ID NO: 65013 - DNA, 21 bp, Homo sapiens
tgttacacacggcccactgtg

SEQ ID NO: 65014 - DNA, 24 bp, Homo sapiens
tgttagagtctgccctccactgtg

SEQ ID NO: 65015 - DNA, 18 bp, Homo sapiens
tgtcacaatccccactgt

SEQ ID NO: 65016 - DNA, 24 bp, Homo sapiens
tgttctggtggcaaacccattgtg

SEQ ID NO: 65017 - DNA, 24 bp, Homo sapiens
tgttacatttatgagcccactgtg

SEQ ID NO: 65018 - DNA, 79 bp, Canine adenovirus
agtggtccttcaaagttatgttgcactcatagaagtacacacctccggcatccattctgaaaaataacaaaacaccact

SEQ ID NO: 65019 - DNA, 24 bp, Canine adenovirus
tatgttgcactcatagaagtacac

SEQ ID NO: 65020 - DNA, 17 bp, Homo sapiens
gttgcacttgaagtaca

SEQ ID NO: 65021 - DNA, 16 bp, Homo sapiens
tgttgcatcatgatgc

SEQ ID NO: 65022 - DNA, 17 bp, Homo sapiens
tgttgcacctgaataca

SEQ ID NO: 65023 - DNA, 22 bp, Homo sapiens
tatgttgcattaacatttgtac

SEQ ID NO: 65024 - DNA, 16 bp, Homo sapiens
tgttgcactagtatac

SEQ ID NO: 65025 - DNA, 20 bp, Homo sapiens
catgttgttaggcagaagta

SEQ ID NO: 65026 - DNA, 20 bp, Homo sapiens
gttgtgtcgatgaagtacac

SEQ ID NO: 65027 - DNA, 21 bp, Homo sapiens
tatgttgcacatagcctatac

SEQ ID NO: 65028 - DNA, 18 bp, Homo sapiens
tgttgtacaaaaagtaca

SEQ ID NO: 65029 - DNA, 22 bp, Homo sapiens
atgttttaaaatagaagtacac

SEQ ID NO: 65030 - DNA, 19 bp, Homo sapiens
tatgttgcgcttgagcagc

SEQ ID NO: 65031 - DNA, 15 bp, Homo sapiens
atgttgatagaagta

SEQ ID NO: 65032 - DNA, 21 bp, Homo sapiens
tatgttgcacttgaggggaag

SEQ ID NO: 65033 - DNA, 66 bp, Canine adenovirus
ataagtagactgcaacaacatcgaaaccccgcgacacaaatctgtctcgcggtcttgctctcttat

SEQ ID NO: 65034 - DNA, 22 bp, Canine adenovirus
tctcgcggtcttgctctcttat

SEQ ID NO: 65035 - DNA, 20 bp, Homo sapiens
tcttgctgtcttccccgctt

SEQ ID NO: 65036 - DNA, 18 bp, Homo sapiens
gcggtcttaatcctttat

SEQ ID NO: 65037 - DNA, 21 bp, Homo sapiens
tctgcggtctcaaaggcttat

SEQ ID NO: 65038 - DNA, 22 bp, Homo sapiens
tctctggtataaattctcttat

SEQ ID NO: 65039 - DNA, 22 bp, Homo sapiens
tctccggtatgaattctcttat

SEQ ID NO: 65040 - DNA, 17 bp, Homo sapiens
tctgcggtattctctta

SEQ ID NO: 65041 - DNA, 21 bp, Homo sapiens
tcggcagcctcttgttctctt

SEQ ID NO: 65042 - DNA, 20 bp, Homo sapiens
tccctgggtcttgctctctt

SEQ ID NO: 65043 - DNA, 20 bp, Homo sapiens
tcctgtgtaagctctcttat

SEQ ID NO: 65044 - DNA, 124 bp, Human papillomavirus type 65
taagaatgcatttgttctgccaatagaaacttaaactgagccaattattatataatctttggaaacgtgtatgtatttgctttttctgtgagaaacttgagtaaaataaactgccacattcttg

SEQ ID NO: 65045 - DNA, 24 bp, Human papillomavirus type 65
atgcatttgttctgccaatagaaa

SEQ ID NO: 65046 - DNA, 19 bp, Homo sapiens
atacaatctgccaatggaa

SEQ ID NO: 65047 - DNA, 18 bp, Homo sapiens
atgcatctgtagatagaa

SEQ ID NO: 65048 - DNA, 15 bp, Homo sapiens
atgcatttgtttaga

SEQ ID NO: 65049 - DNA, 20 bp, Homo sapiens
catttgtttaacaatagaaa

SEQ ID NO: 65050 - DNA, 24 bp, Homo sapiens
atgtatttattctgcattattaga

SEQ ID NO: 65051 - DNA, 18 bp, Homo sapiens
atgcagttgttctgccaa

SEQ ID NO: 65052 - DNA, 21 bp, Homo sapiens
gcatttgccttttaatagaaa

SEQ ID NO: 65053 - DNA, 18 bp, Homo sapiens
catttgttctgcactgaa

SEQ ID NO: 65054 - DNA, 20 bp, Homo sapiens
gcctccggttctgccgatag

SEQ ID NO: 65055 - DNA, 23 bp, Homo sapiens
atgcatttgcttttcttcagaaa

SEQ ID NO: 65056 - DNA, 20 bp, Homo sapiens
tgcatttagttctacagtag

SEQ ID NO: 65057 - DNA, 22 bp, Homo sapiens
atgcatttatttttgttagaaa

SEQ ID NO: 65058 - DNA, 22 bp, Homo sapiens
atgcatttgatctgtcactaaa

SEQ ID NO: 65059 - DNA, 26 bp, Homo sapiens
atacattttagtactgctgatagaaa

SEQ ID NO: 65060 - DNA, 21 bp, Homo sapiens
atgcatttgttactcaagaaa

SEQ ID NO: 65061 - DNA, 19 bp, Homo sapiens
tgcatttgtcagtgataga

SEQ ID NO: 65062 - DNA, 20 bp, Homo sapiens
tgctttgttctgatgagaaa

SEQ ID NO: 65063 - DNA, 20 bp, Homo sapiens
tttgttctgtggcatagaaa

SEQ ID NO: 65064 - DNA, 22 bp, Homo sapiens
catgaaaacctgctaatagaaa

SEQ ID NO: 65065 - DNA, 21 bp, Homo sapiens
gcggtcattctgccaatggga

SEQ ID NO: 65066 - DNA, 19 bp, Homo sapiens
atgcatttttctgctccag

SEQ ID NO: 65067 - DNA, 18 bp, Homo sapiens
tctgtgttgccaatagaa

SEQ ID NO: 65068 - DNA, 21 bp, Homo sapiens
gcatatttttgtcaatagaaa

SEQ ID NO: 65069 - DNA, 84 bp, Variola virus
tataatgtactagataatattataaagcctttatttaaccaacctatcttcaaaggaccgtctgatgttaaatggttcgatata

SEQ ID NO: 65070 - DNA, 24 bp, Variola virus
taatattataaagcctttatttaa

SEQ ID NO: 65071 - DNA, 21 bp, Homo sapiens
caatattataaagtctactta

SEQ ID NO: 65072 - DNA, 20 bp, Homo sapiens
cattctaaagcctttattta

SEQ ID NO: 65073 - DNA, 18 bp, Homo sapiens
taattttataaagccttc

SEQ ID NO: 65074 - DNA, 23 bp, Homo sapiens
taatagtaataacctttatttaa

SEQ ID NO: 65075 - DNA, 22 bp, Homo sapiens
taatattataaaatgccattta

SEQ ID NO: 65076 - DNA, 18 bp, Homo sapiens
taatatcatagagcccct

SEQ ID NO: 65077 - DNA, 91 bp, Human papillomavirus type 50
tgcattttatgcaaaaaaagaaaatatgagcaggcttggattacaacctcttcctcctgctaaggtttctgagcaaaaagcaaaagatgca

SEQ ID NO: 65078 - DNA, 24 bp, Human papillomavirus type 50
tgcaaaaaaagaaaatatgagcag

SEQ ID NO: 65079 - DNA, 19 bp, Homo sapiens
tgcaagtgaagaaaatgca

SEQ ID NO: 65080 - DNA, 18 bp, Homo sapiens
aaaaaagctgatgagcag

SEQ ID NO: 65081 - DNA, 19 bp, Homo sapiens
tgcaaaagaaaaagaaaat

SEQ ID NO: 65082 - DNA, 21 bp, Homo sapiens
tgcaaaaagagaataaggcag

SEQ ID NO: 65083 - DNA, 20 bp, Homo sapiens
tgcaagaaaagaaaactgaa

SEQ ID NO: 65084 - DNA, 18 bp, Homo sapiens
tgcaaaggaaaaaaatat

SEQ ID NO: 65085 - DNA, 25 bp, Homo sapiens
tgcaaaaaggagaaaagaaaagcag

SEQ ID NO: 65086 - DNA, 18 bp, Homo sapiens
tgcaaaaaaagaaaaagc

SEQ ID NO: 65087 - DNA, 19 bp, Homo sapiens
tgcaaaaaaaaaaaaaaac

SEQ ID NO: 65088 - DNA, 20 bp, Homo sapiens
caaaggaagaaaacaagcag

SEQ ID NO: 65089 - DNA, 21 bp, Homo sapiens
tacaaaaaaagagcatagcag

SEQ ID NO: 65090 - DNA, 18 bp, Homo sapiens
caaaaaaagaaaaaaaag

SEQ ID NO: 65091 - DNA, 17 bp, Homo sapiens
gcaaaaaaagaaaaaca

SEQ ID NO: 65092 - DNA, 23 bp, Homo sapiens
tgtaaaaaaaaaatgcatggcag

SEQ ID NO: 65093 - DNA, 16 bp, Homo sapiens
tgcaaaagaaaatggc

SEQ ID NO: 65094 - DNA, 23 bp, Homo sapiens
tacaaaaaaagaaagaaaagcag

SEQ ID NO: 65095 - DNA, 21 bp, Homo sapiens
tacaaaaaaagaaaatgtaaa

SEQ ID NO: 65096 - DNA, 22 bp, Homo sapiens
tgcagaatgaaggcacgagcag

SEQ ID NO: 65097 - DNA, 18 bp, Homo sapiens
agaaaataggatgagcag

SEQ ID NO: 65098 - DNA, 24 bp, Homo sapiens
tgcagtggagattcttatgagcag

SEQ ID NO: 65099 - DNA, 20 bp, Homo sapiens
tgcagaaaagaaaatacaaa

SEQ ID NO: 65100 - DNA, 25 bp, Homo sapiens
tgtaaaaaaagaaaaaaaaaggcag

SEQ ID NO: 65101 - DNA, 22 bp, Homo sapiens
gcggaaaggtacctatgagcag

SEQ ID NO: 65102 - DNA, 17 bp, Homo sapiens
gcaaaaaaaggagagca

SEQ ID NO: 65103 - DNA, 21 bp, Homo sapiens
aaaaaaagaaaaagaaagcag

SEQ ID NO: 65104 - DNA, 19 bp, Homo sapiens
tgcaaaaaggggaaaagca

SEQ ID NO: 65105 - DNA, 17 bp, Homo sapiens
aaaaagaaaatgaacaa

SEQ ID NO: 65106 - DNA, 20 bp, Homo sapiens
tgcagaaaaaaaaatataaa

SEQ ID NO: 65107 - DNA, 18 bp, Homo sapiens
tgctaaagaagaaaatat

SEQ ID NO: 65108 - DNA, 18 bp, Homo sapiens
tgcagaaaaagaaaaatg

SEQ ID NO: 65109 - DNA, 22 bp, Homo sapiens
tgcggagaaaaaaattaagcag

SEQ ID NO: 65110 - DNA, 18 bp, Homo sapiens
tgcaaaagaaaacaggca

SEQ ID NO: 65111 - DNA, 21 bp, Homo sapiens
gcaaagaaagaaaatacacaa

SEQ ID NO: 65112 - DNA, 22 bp, Homo sapiens
tgcaagagacaggaataagcag

SEQ ID NO: 65113 - DNA, 20 bp, Homo sapiens
tgcaaaaaaaaaaattaaac

SEQ ID NO: 65114 - DNA, 18 bp, Homo sapiens
tgcaaaaagaagctagca

SEQ ID NO: 65115 - DNA, 18 bp, Homo sapiens
tacaaaaagagaaaagca

SEQ ID NO: 65116 - DNA, 19 bp, Homo sapiens
tgcaaaaaaaggaagtatg

SEQ ID NO: 65117 - DNA, 23 bp, Homo sapiens
tgcaaaaaaaaaaactcatccag

SEQ ID NO: 65118 - DNA, 26 bp, Homo sapiens
tggaaaaaaagagggaacaccagcag

SEQ ID NO: 65119 - DNA, 23 bp, Homo sapiens
tgtaaaaaaaggagtcagagcag

SEQ ID NO: 65120 - DNA, 21 bp, Homo sapiens
tacagaagaagaaaatatcag

SEQ ID NO: 65121 - DNA, 19 bp, Homo sapiens
aagaaaggacaccgagcag

SEQ ID NO: 65122 - DNA, 21 bp, Homo sapiens
aaagaaagaaaataatggcag

SEQ ID NO: 65123 - DNA, 21 bp, Homo sapiens
gcaaaagaagaaaaataccag

SEQ ID NO: 65124 - DNA, 20 bp, Homo sapiens
tgcaaaaaagaaaaccaaag

SEQ ID NO: 65125 - DNA, 16 bp, Homo sapiens
aaaaaagaacatggca

SEQ ID NO: 65126 - DNA, 30 bp, Homo sapiens
gcaaaaaaaccagaaggaaatgtgagcagc

SEQ ID NO: 65127 - DNA, 20 bp, Homo sapiens
gcaaaaaaggaatgtagcag

SEQ ID NO: 65128 - DNA, 18 bp, Homo sapiens
gcaggaaaagaaaaagca

SEQ ID NO: 65129 - DNA, 22 bp, Homo sapiens
tgaaaagaagaaaatatgtcag

SEQ ID NO: 65130 - DNA, 17 bp, Homo sapiens
tgcaaaaaaaaaaatga

SEQ ID NO: 65131 - DNA, 82 bp, Human adenovirus D
gccctgagctcgcgcctcaatgtcagctgcaaaaagtcacttaagtcctgggccactacagctgacaattcagagccagggc

SEQ ID NO: 65132 - DNA, 24 bp, Human adenovirus D
cctcaatgtcagctgcaaaaagtc

SEQ ID NO: 65133 - DNA, 18 bp, Homo sapiens
aatgccagtgcaaaggtc

SEQ ID NO: 65134 - DNA, 17 bp, Homo sapiens
ctcaatgtctgaaaagt

SEQ ID NO: 65135 - DNA, 23 bp, Homo sapiens
tcaatgccaacttttaaaaggtc

SEQ ID NO: 65136 - DNA, 19 bp, Homo sapiens
tcaagccaatgcaaaaagt

SEQ ID NO: 65137 - DNA, 17 bp, Homo sapiens
tcaatgtcctgagaagt

SEQ ID NO: 65138 - DNA, 20 bp, Homo sapiens
tatcaactttgcaaagagtc

SEQ ID NO: 65139 - DNA, 22 bp, Homo sapiens
cctcagtgcacaactgaaggtc

SEQ ID NO: 65140 - DNA, 20 bp, Homo sapiens
ctcaatatccatgaaaagtc

SEQ ID NO: 65141 - DNA, 17 bp, Homo sapiens
tcaatgtcagctgaagt

SEQ ID NO: 65142 - DNA, 21 bp, Homo sapiens
tcaacgtcctgtgtggaaagt

SEQ ID NO: 65143 - DNA, 22 bp, Homo sapiens
tcactgtcttgggcaaaaagtc

SEQ ID NO: 65144 - DNA, 22 bp, Homo sapiens
cccggggcagctgcaggaggtc

SEQ ID NO: 65145 - DNA, 19 bp, Homo sapiens
aatatcaaagcaaaaagtc

SEQ ID NO: 65146 - DNA, 18 bp, Homo sapiens
ctcaatgttggcagtgca

SEQ ID NO: 65147 - DNA, 22 bp, Homo sapiens
ctcaagtcctcagcaaaaagtc

SEQ ID NO: 65148 - DNA, 17 bp, Homo sapiens
tgaaactgcaaaaggtc

SEQ ID NO: 65149 - DNA, 19 bp, Homo sapiens
tcagtctagtgcaaaaagt

SEQ ID NO: 65150 - DNA, 19 bp, Homo sapiens
atcagatctgcaaaaggtc

SEQ ID NO: 65151 - DNA, 24 bp, Homo sapiens
tcaatgtctcatttgtaaagagtc

SEQ ID NO: 65152 - DNA, 18 bp, Homo sapiens
ctcagagtcagcaaaaag

SEQ ID NO: 65153 - DNA, 122 bp, Macaca mulatta rhadinovirus
gttatcgcgccaccttgtggctacattatatagcacgatcactttccacgttatactttcacgtactatgactcatacgccttaacgtcacgtggcgtgcgattgtggccggggctgaaaat

SEQ ID NO: 65154 - DNA, 24 bp, Macaca mulatta rhadinovirus
tatcgcgccaccttgtggctacat

SEQ ID NO: 65155 - DNA, 18 bp, Homo sapiens
catcgcgttgccttgtga

SEQ ID NO: 65156 - DNA, 21 bp, Homo sapiens
gcagacaccttgtggttgcat

SEQ ID NO: 65157 - DNA, 96 bp, Molluscum contagiosum virus
cgcagttcggcgacacgcccgcgtcccgacagcagaggtaatcccgagcttctaaatcgcgcgcgggctcaagtcgccctttttgtctcgaactcg

SEQ ID NO: 65158 - DNA, 24 bp, Molluscum contagiosum virus
ctaaatcgcgcgcgggctcaagtc

SEQ ID NO: 65159 - DNA, 21 bp, Homo sapiens
ctaaatctctaggctcaagtc

SEQ ID NO: 65160 - DNA, 18 bp, Homo sapiens
gcgcgcgggagtcaagtc

SEQ ID NO: 65161 - DNA, 19 bp, Homo sapiens
gcccaaacagggctcaagt

SEQ ID NO: 65162 - DNA, 17 bp, Homo sapiens
tctgcgcgggctcaggt

SEQ ID NO: 65163 - DNA, 20 bp, Homo sapiens
taaatgtcattagctcaagt

SEQ ID NO: 65164 - DNA, 82 bp, Lumpy skin disease virus
catctatatcatttctatataaaaattttgcaattttaaaaaatgtaccattgtcaaatctagccatagaatcatatatatg

SEQ ID NO: 65165 - DNA, 24 bp, Lumpy skin disease virus
tctatatcatttctatataaaaat

SEQ ID NO: 65166 - DNA, 21 bp, Homo sapiens
tctatgccatttctgttaaaa

SEQ ID NO: 65167 - DNA, 18 bp, Homo sapiens
tataatatttctacataa

SEQ ID NO: 65168 - DNA, 20 bp, Homo sapiens
ctatgtcatttctctcaaaa

SEQ ID NO: 65169 - DNA, 20 bp, Homo sapiens
tataccatttcttgttaaaa

SEQ ID NO: 65170 - DNA, 22 bp, Homo sapiens
tcttgtcatttctataataaaa

SEQ ID NO: 65171 - DNA, 84 bp, Lumpy skin disease virus
aaggtttcatctaatcctttttccaataacaaaaatttttcgttataaattttttctatatctatagggcatataatattcctt

SEQ ID NO: 65172 - DNA, 24 bp, Lumpy skin disease virus
tttttctatatctatagggcatat

SEQ ID NO: 65173 - DNA, 20 bp, Homo sapiens
tttttttatatatatagagc

SEQ ID NO: 65174 - DNA, 24 bp, Homo sapiens
tttttctgaactcctagggcatat

SEQ ID NO: 65175 - DNA, 17 bp, Homo sapiens
tttttctatatccaagg

SEQ ID NO: 65176 - DNA, 19 bp, Homo sapiens
tatatctatactgctatat

SEQ ID NO: 65177 - DNA, 18 bp, Homo sapiens
tttttcatatttataggg

SEQ ID NO: 65178 - DNA, 71 bp, Bovine herpesvirus 4
gagagtgtgccttagcttgaaaggcactctaaagctaatgctctagagcttcaggtcagaggagtgctctc

SEQ ID NO: 65179 - DNA, 24 bp, Bovine herpesvirus 4
tctagagcttcaggtcagaggagt

SEQ ID NO: 65180 - DNA, 19 bp, Homo sapiens
tccagagatgttagaggag

SEQ ID NO: 65181 - DNA, 21 bp, Homo sapiens
tctggagttcgggccgggagt

SEQ ID NO: 65182 - DNA, 22 bp, Homo sapiens
tctcggccgcggtcagaggggt

SEQ ID NO: 65183 - DNA, 25 bp, Homo sapiens
tctggggctcaggtctgctgagagt

SEQ ID NO: 65184 - DNA, 22 bp, Homo sapiens
cagaggtaccggttagaggagt

SEQ ID NO: 65185 - DNA, 19 bp, Homo sapiens
tccagagcttcaggcaggg

SEQ ID NO: 65186 - DNA, 19 bp, Homo sapiens
tctagagcattaggcaggg

SEQ ID NO: 65187 - DNA, 23 bp, Homo sapiens
cctggagcttcagggcaaggagt

SEQ ID NO: 65188 - DNA, 19 bp, Homo sapiens
tagaagtacttagaggagt

SEQ ID NO: 65189 - DNA, 22 bp, Homo sapiens
tctaggggcttctccagaggag

SEQ ID NO: 65190 - DNA, 22 bp, Homo sapiens
tccagggctgcctcagaggggt

SEQ ID NO: 65191 - DNA, 63 bp, Bovine herpesvirus 4
tggtcctggctacacacccaaaggcacgtcagacagtgtctctaaatcagtgtaccaagacca

SEQ ID NO: 65192 - DNA, 24 bp, Bovine herpesvirus 4
cctggctacacacccaaaggcacg

SEQ ID NO: 65193 - DNA, 22 bp, Homo sapiens
ctggctacagtgtgggggcacg

SEQ ID NO: 65194 - DNA, 18 bp, Homo sapiens
ctggttacacacccacac

SEQ ID NO: 65195 - DNA, 23 bp, Homo sapiens
cctggctacatacactctacaca

SEQ ID NO: 65196 - DNA, 19 bp, Homo sapiens
ctggctaccatctagcaca

SEQ ID NO: 65197 - DNA, 17 bp, Homo sapiens
tggctacacacacccac

SEQ ID NO: 65198 - DNA, 19 bp, Homo sapiens
cctggccacgcatccagca

SEQ ID NO: 65199 - DNA, 17 bp, Homo sapiens
tggcaactccaaaggca

SEQ ID NO: 65200 - DNA, 22 bp, Homo sapiens
cctggccacaagaaaagaggca

SEQ ID NO: 65201 - DNA, 20 bp, Homo sapiens
cctggccacacacccttcgc

SEQ ID NO: 65202 - DNA, 17 bp, Homo sapiens
ctgctgcacacccacac

SEQ ID NO: 65203 - DNA, 19 bp, Homo sapiens
cctggccgtgcaaggcaca

SEQ ID NO: 65204 - DNA, 18 bp, Homo sapiens
cctgctgcacacccagca

SEQ ID NO: 65205 - DNA, 25 bp, Homo sapiens
tggctacagatgtaccagaggcacg

SEQ ID NO: 65206 - DNA, 16 bp, Homo sapiens
tggctacacccctggc

SEQ ID NO: 65207 - DNA, 20 bp, Homo sapiens
cctggccacatgcccacaca

SEQ ID NO: 65208 - DNA, 23 bp, Homo sapiens
ccaggagactgcctgaaggcacg

SEQ ID NO: 65209 - DNA, 18 bp, Homo sapiens
cctgctttaacccaaagg

SEQ ID NO: 65210 - DNA, 19 bp, Homo sapiens
ctgggtatacacccaaaag

SEQ ID NO: 65211 - DNA, 18 bp, Homo sapiens
ctggccacgcactccagc

SEQ ID NO: 65212 - DNA, 19 bp, Homo sapiens
ctgggtatatacccaaaag

SEQ ID NO: 65213 - DNA, 71 bp, Fowlpox virus
ctcttgaagacataaatactattaagaaatatatggactttattctaagcgttcttatacgttctaaagag

SEQ ID NO: 65214 - DNA, 24 bp, Fowlpox virus
taagcgttcttatacgttctaaag

SEQ ID NO: 65215 - DNA, 23 bp, Homo sapiens
taagctttcttagaactctaaag

SEQ ID NO: 65216 - DNA, 19 bp, Homo sapiens
taagctttctctttttcta

SEQ ID NO: 65217 - DNA, 23 bp, Homo sapiens
agcgttcttgtgcacctgtaaag

SEQ ID NO: 65218 - DNA, 20 bp, Homo sapiens
gctgttcttatgctctaaag

SEQ ID NO: 65219 - DNA, 17 bp, Homo sapiens
tgacgttcttatattcc

SEQ ID NO: 65220 - DNA, 22 bp, Homo sapiens
taagtgttcttatcgcaaaaag

SEQ ID NO: 65221 - DNA, 89 bp, European brown hare syndrome virus
ggtttgatttaagtaaatgaattgtttagtgatttaaatttgagtttaattagattagttgtttagtgatttatagtttaaagcaaatt

SEQ ID NO: 65222 - DNA, 24 bp, European brown hare syndrome virus
ttagttgtttagtgatttatagtt

SEQ ID NO: 65223 - DNA, 21 bp, Homo sapiens
ttaattgtttaaattatagtt

SEQ ID NO: 65224 - DNA, 18 bp, Homo sapiens
ttagttgtttatgaaata

SEQ ID NO: 65225 - DNA, 19 bp, Homo sapiens
ttagttatttagtagtagt

SEQ ID NO: 65226 - DNA, 20 bp, Homo sapiens
gttgtttagtagtagtagtt

SEQ ID NO: 65227 - DNA, 85 bp, Walleye dermal sarcoma virus
ccctcacagttgctgtggtgttgtgattcctcttctgcagaagatattaataaagtgtataacagacaaatgtgactggcctggg

SEQ ID NO: 65228 - DNA, 24 bp, Walleye dermal sarcoma virus
tgtggtgttgtgattcctcttctg

SEQ ID NO: 65229 - DNA, 18 bp, Homo sapiens
tgggtgttgttatcttct

SEQ ID NO: 65230 - DNA, 18 bp, Homo sapiens
tgtgtgtgttttcccctt

SEQ ID NO: 65231 - DNA, 109 bp, Walleye dermal sarcoma virus
cctacctacactaataaactggtgagtacctttatattttctcataactttgtctaaataaaacaataaaaagagataaataaggtacaagatccagcatgtaggtggg

SEQ ID NO: 65232 - DNA, 24 bp, Walleye dermal sarcoma virus
taaaaagagataaataaggtacaa

SEQ ID NO: 65233 - DNA, 18 bp, Homo sapiens
aaagatcaataaggtaca

SEQ ID NO: 65234 - DNA, 22 bp, Homo sapiens
taaaaagagagaaatattacaa

SEQ ID NO: 65235 - DNA, 18 bp, Homo sapiens
aaagaggtaataaaggta

SEQ ID NO: 65236 - DNA, 23 bp, Homo sapiens
taaaaagagaagaactcttacaa

SEQ ID NO: 65237 - DNA, 20 bp, Homo sapiens
aagactgtggtaaggtacaa

SEQ ID NO: 65238 - DNA, 17 bp, Homo sapiens
aaaaagagaaaggtgca

SEQ ID NO: 65239 - DNA, 17 bp, Homo sapiens
agggacaaataagtaca

SEQ ID NO: 65240 - DNA, 17 bp, Homo sapiens
agagaaaataaggtgca

SEQ ID NO: 65241 - DNA, 18 bp, Homo sapiens
taaaaagagctaaggaca

SEQ ID NO: 65242 - DNA, 22 bp, Homo sapiens
taaaaagagaaaatatactgta

SEQ ID NO: 65243 - DNA, 18 bp, Homo sapiens
taaaaagagataagagca

SEQ ID NO: 65244 - DNA, 18 bp, Homo sapiens
taaaaggagaaaggtaca

SEQ ID NO: 65245 - DNA, 20 bp, Homo sapiens
aagaatctttaataaggtac

SEQ ID NO: 65246 - DNA, 21 bp, Homo sapiens
aagtagtgtaagtaaggtaca

SEQ ID NO: 65247 - DNA, 15 bp, Homo sapiens
taaaaagagaaggta

SEQ ID NO: 65248 - DNA, 18 bp, Homo sapiens
agagagggcaaggtacaa

SEQ ID NO: 65249 - DNA, 20 bp, Homo sapiens
aaaagagataatgtggtaca

SEQ ID NO: 65250 - DNA, 18 bp, Homo sapiens
taaaaagaaataggcaca

SEQ ID NO: 65251 - DNA, 19 bp, Homo sapiens
tgaaagagatgaacaggca

SEQ ID NO: 65252 - DNA, 17 bp, Homo sapiens
taaaaaaagataaggca

SEQ ID NO: 65253 - DNA, 21 bp, Homo sapiens
taaaaagagatcattattaca

SEQ ID NO: 65254 - DNA, 19 bp, Homo sapiens
gatataagataaggtacaa

SEQ ID NO: 65255 - DNA, 19 bp, Homo sapiens
taaaaagagaaaacaggca

SEQ ID NO: 65256 - DNA, 19 bp, Homo sapiens
agagaagagataaaataca

SEQ ID NO: 65257 - DNA, 15 bp, Homo sapiens
taaaaagagatggca

SEQ ID NO: 65258 - DNA, 18 bp, Homo sapiens
gaaatgcttaaggtacaa

SEQ ID NO: 65259 - DNA, 20 bp, Homo sapiens
aaagaaataaatttcttaca

SEQ ID NO: 65260 - DNA, 16 bp, Homo sapiens
taaaaagagagagtac

SEQ ID NO: 65261 - DNA, 20 bp, Homo sapiens
taaaaaaagatgaataaggc

SEQ ID NO: 65262 - DNA, 18 bp, Homo sapiens
agagaataaataaaggca

SEQ ID NO: 65263 - DNA, 17 bp, Homo sapiens
tgaagagaaataaagca

SEQ ID NO: 65264 - DNA, 20 bp, Homo sapiens
aagaggggataaacaaagca

SEQ ID NO: 65265 - DNA, 18 bp, Homo sapiens
tgaaaaagataaatggta

SEQ ID NO: 65266 - DNA, 63 bp, Human papillomavirus type 24
tccagagaaccattttaaaaaaggacctataaatgtggaggttatatatgatggtgatccgga

SEQ ID NO: 65267 - DNA, 17 bp, Human papillomavirus type 24
tatgatggtgatccgga

SEQ ID NO: 65268 - DNA, 19 bp, Homo sapiens
tacgatggcacatcccgga

SEQ ID NO: 65269 - DNA, 18 bp, Homo sapiens
tgatggtaagctcctgga

SEQ ID NO: 65270 - DNA, 22 bp, Homo sapiens
atgatggtaaacagatctggat

SEQ ID NO: 65271 - DNA, 20 bp, Homo sapiens
tatgatggttcactcacgga

SEQ ID NO: 65272 - DNA, 18 bp, Homo sapiens
cataataagtgatctgga

SEQ ID NO: 65273 - DNA, 20 bp, Homo sapiens
catgatggttcctgtccgga

SEQ ID NO: 65274 - DNA, 20 bp, Homo sapiens
tatgataggtaatttctgga

SEQ ID NO: 65275 - DNA, 20 bp, Homo sapiens
tgatggtggcatcctttgga

SEQ ID NO: 65276 - DNA, 85 bp, Paramecium bursaria Chlorella virus 1
ggacaaaccgtgaaaatgcccaatgaacgcctcaaggaacaccaacgagaatcatccaagtgtcataggctaaaacacgctctcc

SEQ ID NO: 65277 - DNA, 24 bp, Paramecium bursaria Chlorella virus 1
tgtcataggctaaaacacgctctc

SEQ ID NO: 65278 - DNA, 21 bp, Homo sapiens
gccaggctggagcacgctctc

SEQ ID NO: 65279 - DNA, 23 bp, Homo sapiens
tgtcagtaataagaacacgctct

SEQ ID NO: 65280 - DNA, 19 bp, Homo sapiens
tatcataggttaaagtagc

SEQ ID NO: 65281 - DNA, 21 bp, Homo sapiens
tgtcacaggctatgtgttctc

SEQ ID NO: 65282 - DNA, 18 bp, Homo sapiens
tgtcacaggctgcccgct

SEQ ID NO: 65283 - DNA, 22 bp, Homo sapiens
tgtcaaggctaaaaaaaagtct

SEQ ID NO: 65284 - DNA, 24 bp, Homo sapiens
tatcataggctgctaagtgttctc

SEQ ID NO: 65285 - DNA, 21 bp, Homo sapiens
tgcataggctgccctgctctc

SEQ ID NO: 65286 - DNA, 22 bp, Homo sapiens
tcataggctggagatgcactct

SEQ ID NO: 65287 - DNA, 21 bp, Homo sapiens
tgtcatagctggaacgaaagc

SEQ ID NO: 65288 - DNA, 18 bp, Homo sapiens
aaactaaaatacgctctc

SEQ ID NO: 65289 - DNA, 24 bp, Homo sapiens
tgtcataggctagaaggatgctct

SEQ ID NO: 65290 - DNA, 19 bp, Homo sapiens
tgtcataggtgacactttc

SEQ ID NO: 65291 - DNA, 20 bp, Homo sapiens
tgtcataggctcaactatct

SEQ ID NO: 65292 - DNA, 18 bp, Homo sapiens
tgtcataggataatcgct

SEQ ID NO: 65293 - DNA, 22 bp, Homo sapiens
tgttgtaagctaagatcacatc

SEQ ID NO: 65294 - DNA, 101 bp, Paramecium bursaria Chlorella virus 1
ttcatgctgtagaaaaaattgccattgctctcgaagattcaacaggtccaaacggccttaacataaccatcgggggtgctggagtgaagaagccagatgaa

SEQ ID NO: 65295 - DNA, 24 bp, Paramecium bursaria Chlorella virus 1
tcgaagattcaacaggtccaaacg

SEQ ID NO: 65296 - DNA, 18 bp, Homo sapiens
agattcacagaattcaaa

SEQ ID NO: 65297 - DNA, 91 bp, Lumpy skin disease virus
agggtacttatcagattttgttacgacattgatgagattaaaaaaagaactttttttagaatcaccagagccgataacatatatagaccct

SEQ ID NO: 65298 - DNA, 24 bp, Lumpy skin disease virus
tagaatcaccagagccgataacat

SEQ ID NO: 65299 - DNA, 20 bp, Homo sapiens
gagtaccgagccgataacat

SEQ ID NO: 65300 - DNA, 18 bp, Homo sapiens
tagggtcccagagcccat

SEQ ID NO: 65301 - DNA, 20 bp, Homo sapiens
taaaatcattagaaaccaat

SEQ ID NO: 65302 - DNA, 19 bp, Homo sapiens
tagaacaccagagtctata

SEQ ID NO: 65303 - DNA, 19 bp, Homo sapiens
tagatcaccaaaaataaca

SEQ ID NO: 65304 - DNA, 19 bp, Homo sapiens
agaatagagccgataacat

SEQ ID NO: 65305 - DNA, 15 bp, Homo sapiens
gatcaccagaaaaca

SEQ ID NO: 65306 - DNA, 17 bp, Homo sapiens
tagaatcacatccaata

SEQ ID NO: 65307 - DNA, 21 bp, Homo sapiens
gaatcaccagggggtcccaca

SEQ ID NO: 65308 - DNA, 19 bp, Homo sapiens
agaatcactgcaataacat

SEQ ID NO: 65309 - DNA, 22 bp, Homo sapiens
gaatcacccgagtcgggaacat

SEQ ID NO: 65310 - DNA, 23 bp, Homo sapiens
cagaatcactggaagcaatgata

SEQ ID NO: 65311 - DNA, 17 bp, Homo sapiens
tagagccaccagacaat

SEQ ID NO: 65312 - DNA, 26 bp, Homo sapiens
cagggtcaccagagctttccccacat

SEQ ID NO: 65313 - DNA, 19 bp, Homo sapiens
cagaatcaggaaagctgat

SEQ ID NO: 65314 - DNA, 18 bp, Homo sapiens
tagaatcacaatgataac

SEQ ID NO: 65315 - DNA, 26 bp, Homo sapiens
agaatcaccgtgatgggctggtgaca

SEQ ID NO: 65316 - DNA, 129 bp, Molluscum contagiosum virus
ctggccgggctcgggctcgaggtgtgcctgtttgccacggccgcgcgcgactttgtcctgagccttttggcggcgcaaggacaccgcgggcgtgcccggcgttggctttctgtgcgcgacgcctgctag

SEQ ID NO: 65317 - DNA, 24 bp, Molluscum contagiosum virus
caaggacaccgcgggcgtgcccgg

SEQ ID NO: 65318 - DNA, 18 bp, Homo sapiens
tgagggctggtgtgcccg

SEQ ID NO: 65319 - DNA, 21 bp, Homo sapiens
aggggcgcgcggggctgccgg

SEQ ID NO: 65320 - DNA, 25 bp, Homo sapiens
cagggacacacgcgggcacgcttgg

SEQ ID NO: 65321 - DNA, 22 bp, Homo sapiens
aggcatgcaccaccgtgctcgg

SEQ ID NO: 65322 - DNA, 16 bp, Homo sapiens
ggacaccggggcccga

SEQ ID NO: 65323 - DNA, 16 bp, Homo sapiens
agggcaccgcgacccg

SEQ ID NO: 65324 - DNA, 23 bp, Homo sapiens
caaggacactgcagagtccctgg

SEQ ID NO: 65325 - DNA, 21 bp, Homo sapiens
tgaggacgcagcgcaccctgg

SEQ ID NO: 65326 - DNA, 16 bp, Homo sapiens
ggacaccgcgggcacg

SEQ ID NO: 65327 - DNA, 20 bp, Homo sapiens
ggcgctgcggtcgcgcccgg

SEQ ID NO: 65328 - DNA, 22 bp, Homo sapiens
aggggcgcggcgcgccgcccgg

SEQ ID NO: 65329 - DNA, 22 bp, Homo sapiens
aggcatgcgccactgtgcccgg

SEQ ID NO: 65330 - DNA, 19 bp, Homo sapiens
ggattacaggcgtgcccgg

SEQ ID NO: 65331 - DNA, 19 bp, Homo sapiens
ggagcgtggccgtgcccgg

SEQ ID NO: 65332 - DNA, 19 bp, Homo sapiens
agggcacgccgctgcccgg

SEQ ID NO: 65333 - DNA, 18 bp, Homo sapiens
cagggacccgaatgcccg

SEQ ID NO: 65334 - DNA, 22 bp, Homo sapiens
caaagacactgcgacgatttgg

SEQ ID NO: 65335 - DNA, 19 bp, Homo sapiens
ggacgcacgccgggtccgg

SEQ ID NO: 65336 - DNA, 20 bp, Homo sapiens
gggggccggcgtgtgcccgg

SEQ ID NO: 65337 - DNA, 19 bp, Homo sapiens
aggacagcgcccagcccgg

SEQ ID NO: 65338 - DNA, 20 bp, Homo sapiens
ggaagacagggtgtgcccgg

SEQ ID NO: 65339 - DNA, 18 bp, Homo sapiens
caaggtggagcgtgctcg

SEQ ID NO: 65340 - DNA, 19 bp, Homo sapiens
ggacaccgccgcggcttgg

SEQ ID NO: 65341 - DNA, 22 bp, Homo sapiens
ggacaaaaggtggtgtgcccgg

SEQ ID NO: 65342 - DNA, 20 bp, Homo sapiens
aggctgcccgacgtgcccgg

SEQ ID NO: 65343 - DNA, 19 bp, Homo sapiens
ggcgcaccgtgtgccctgg

SEQ ID NO: 65344 - DNA, 22 bp, Homo sapiens
tgaggacgtgcacagggcctgg

SEQ ID NO: 65345 - DNA, 21 bp, Homo sapiens
ggacgccgccccgcagcccgg

SEQ ID NO: 65346 - DNA, 19 bp, Homo sapiens
ggcacactgcccagcccgg

SEQ ID NO: 65347 - DNA, 19 bp, Homo sapiens
ggaggcaccgcggccccgg

SEQ ID NO: 65348 - DNA, 20 bp, Homo sapiens
aaggatgcccaggtgcctgg

SEQ ID NO: 65349 - DNA, 24 bp, Homo sapiens
aggggctgtcaggcgcgtgctcgg

SEQ ID NO: 65350 - DNA, 15 bp, Homo sapiens
ggacaccgccgtccg

SEQ ID NO: 65351 - DNA, 19 bp, Homo sapiens
ggattacaggcgtgcctgg

SEQ ID NO: 65352 - DNA, 21 bp, Homo sapiens
cagagacatacttgtgcctgg

SEQ ID NO: 65353 - DNA, 21 bp, Homo sapiens
caaagacacctttgtgcctgg

SEQ ID NO: 65354 - DNA, 22 bp, Homo sapiens
aggcgcatgccactgtgcctgg

SEQ ID NO: 65355 - DNA, 19 bp, Homo sapiens
agggcaccgcggaggccgg

SEQ ID NO: 65356 - DNA, 19 bp, Homo sapiens
aggatgcgcggggcctcgg

SEQ ID NO: 65357 - DNA, 20 bp, Homo sapiens
gagcaccgcggcgtgcctgg

SEQ ID NO: 65358 - DNA, 17 bp, Homo sapiens
aggggcccaggtgcccg

SEQ ID NO: 65359 - DNA, 19 bp, Homo sapiens
ggcactgctccgcgcccgg

SEQ ID NO: 65360 - DNA, 19 bp, Homo sapiens
ggacatgcacagggcctgg

SEQ ID NO: 65361 - DNA, 20 bp, Homo sapiens
caaggacactgctggcactg

SEQ ID NO: 65362 - DNA, 22 bp, Homo sapiens
aaggacactgtaggttacatcc

SEQ ID NO: 65363 - DNA, 19 bp, Homo sapiens
ggcgccgcggacacgctgg

SEQ ID NO: 65364 - DNA, 20 bp, Homo sapiens
aggggtacggttgtgcccgg

SEQ ID NO: 65365 - DNA, 23 bp, Homo sapiens
caaggacatctgcaaagccctgg

SEQ ID NO: 65366 - DNA, 21 bp, Homo sapiens
ggggaccgcggaaggctccgg

SEQ ID NO: 65367 - DNA, 22 bp, Homo sapiens
cagggaaaccgccaatgcccgg

SEQ ID NO: 65368 - DNA, 21 bp, Homo sapiens
aggagcaggtggcgtgcctgg

SEQ ID NO: 65369 - DNA, 22 bp, Homo sapiens
aggcatgtgccactgtgcctgg

SEQ ID NO: 65370 - DNA, 24 bp, Homo sapiens
agcgatgccgcgggcggcgtccgg

SEQ ID NO: 65371 - DNA, 23 bp, Homo sapiens
aggacacgcgcggaactctccgg

SEQ ID NO: 65372 - DNA, 19 bp, Homo sapiens
caagggcgcgcggcacccg

SEQ ID NO: 65373 - DNA, 17 bp, Homo sapiens
aggacaccgcgggccgc

SEQ ID NO: 65374 - DNA, 16 bp, Homo sapiens
caaagacaccgtgccc

SEQ ID NO: 65375 - DNA, 19 bp, Homo sapiens
aggacatgcgtagcctcgg

SEQ ID NO: 65376 - DNA, 102 bp, Molluscum contagiosum virus
gacctttcgtccggtgtcggacgcctcaagcatgccaggcgcaggcgccgccctgctagcgctccgcgtgcgagaagatccgacactactcggagagacgtt

SEQ ID NO: 65377 - DNA, 24 bp, Molluscum contagiosum virus
ctagcgctccgcgtgcgagaagat

SEQ ID NO: 65378 - DNA, 26 bp, Homo sapiens
ccagcgcttgacagttgcgggaggat

SEQ ID NO: 65379 - DNA, 23 bp, Homo sapiens
cagcgctctaggcaatggggaga

SEQ ID NO: 65380 - DNA, 16 bp, Homo sapiens
actcctgggagaagat

SEQ ID NO: 65381 - DNA, 23 bp, Homo sapiens
tagcccttaatctgtgagaagat

SEQ ID NO: 65382 - DNA, 24 bp, Homo sapiens
ctagtctttgctcaaaaagaagat

SEQ ID NO: 65383 - DNA, 18 bp, Homo sapiens
tcctgctagcgagaagat

SEQ ID NO: 65384 - DNA, 20 bp, Homo sapiens
gcgctctgcggagagaagat

SEQ ID NO: 65385 - DNA, 82 bp, Molluscum contagiosum virus
cgcgggcagggatccttcacgcgcgggcccgtggtagccgcgggcccttccttctgctcgggcccgacctttcctgcgcgcg

SEQ ID NO: 65386 - DNA, 24 bp, Molluscum contagiosum virus
cttctgctcgggcccgacctttcc

SEQ ID NO: 65387 - DNA, 22 bp, Homo sapiens
cctctgcctctctgatctttcc

SEQ ID NO: 65388 - DNA, 18 bp, Homo sapiens
cttctgctccggctcgcc

SEQ ID NO: 65389 - DNA, 21 bp, Homo sapiens
cttctgcttggctcacttttc

SEQ ID NO: 65390 - DNA, 20 bp, Homo sapiens
ctactgctcgggctcgggcc

SEQ ID NO: 65391 - DNA, 19 bp, Homo sapiens
cttctgccccaggcctttc

SEQ ID NO: 65392 - DNA, 21 bp, Homo sapiens
ctgctgcttttgggacttttc

SEQ ID NO: 65393 - DNA, 20 bp, Homo sapiens
ttctctcgggcctgtcattc

SEQ ID NO: 65394 - DNA, 22 bp, Homo sapiens
cttctgctgggaacgacctttc

SEQ ID NO: 65395 - DNA, 20 bp, Homo sapiens
ttctgctcaggctcatgtcc

SEQ ID NO: 65396 - DNA, 18 bp, Homo sapiens
cttccgctcgggtttgac

SEQ ID NO: 65397 - DNA, 23 bp, Homo sapiens
ttctctcctatgctgacctttcc

SEQ ID NO: 65398 - DNA, 23 bp, Homo sapiens
cttctgctgggtttagatttttc

SEQ ID NO: 65399 - DNA, 19 bp, Homo sapiens
tccacaggcccggcctttc

SEQ ID NO: 65400 - DNA, 21 bp, Homo sapiens
cttctgctcgtgccgaattcc

SEQ ID NO: 65401 - DNA, 22 bp, Homo sapiens
cttctgcctggctcaaggcttt

SEQ ID NO: 65402 - DNA, 22 bp, Homo sapiens
cttctgctcggatctccagtcc

SEQ ID NO: 65403 - DNA, 22 bp, Homo sapiens
cttctgctctgagcccctttcc

SEQ ID NO: 65404 - DNA, 18 bp, Homo sapiens
ttcgctcgggcccgctct

SEQ ID NO: 65405 - DNA, 21 bp, Homo sapiens
ttcttctcacaaagacctttc

SEQ ID NO: 65406 - DNA, 22 bp, Homo sapiens
cctctgcttccccatgaccttt

SEQ ID NO: 65407 - DNA, 17 bp, Homo sapiens
cttcgctcgggcctgac

SEQ ID NO: 65408 - DNA, 17 bp, Homo sapiens
ttctgcccaggtctttc

SEQ ID NO: 65409 - DNA, 23 bp, Homo sapiens
ttctgcacctccccggcctttcc

SEQ ID NO: 65410 - DNA, 18 bp, Homo sapiens
cttctgcttgggccctga

SEQ ID NO: 65411 - DNA, 19 bp, Homo sapiens
tctgccgatttgacctttc

SEQ ID NO: 65412 - DNA, 23 bp, Homo sapiens
cttctgctttgggctgaaccctt

SEQ ID NO: 65413 - DNA, 22 bp, Homo sapiens
cctctgcgccactcgacctttc

SEQ ID NO: 65414 - DNA, 25 bp, Homo sapiens
cttctgcctcggcatttgacctttc

SEQ ID NO: 65415 - DNA, 23 bp, Homo sapiens
cttctgccattaatgatttttcc

SEQ ID NO: 65416 - DNA, 63 bp, Molluscum contagiosum virus
gctcgcgcacacgccgtacacactgcagcagttactgttctgccctctacggaggtgcggggc

SEQ ID NO: 65417 - DNA, 24 bp, Molluscum contagiosum virus
tcgcgcacacgccgtacacactgc

SEQ ID NO: 65418 - DNA, 21 bp, Homo sapiens
tcgcgcacagcggtccactgc

SEQ ID NO: 65419 - DNA, 17 bp, Homo sapiens
acacagcctcacactgc

SEQ ID NO: 65420 - DNA, 20 bp, Homo sapiens
cgcacacatgcacacactgc

SEQ ID NO: 65421 - DNA, 20 bp, Homo sapiens
gcgtgcgcctcgcacactgc

SEQ ID NO: 65422 - DNA, 21 bp, Homo sapiens
gctcctcgctgtgcacactgc

SEQ ID NO: 65423 - DNA, 18 bp, Homo sapiens
gcagaagcgacacactgc

SEQ ID NO: 65424 - DNA, 19 bp, Homo sapiens
gcgcacacacacacgttgc

SEQ ID NO: 65425 - DNA, 19 bp, Homo sapiens
tcgcgcacgcgcagtgctg

SEQ ID NO: 65426 - DNA, 25 bp, Homo sapiens
tcacgcacgcgcgagtgcgcgctgc

SEQ ID NO: 65427 - DNA, 20 bp, Homo sapiens
cgtgcacaacagcacactgc

SEQ ID NO: 65428 - DNA, 20 bp, Homo sapiens
tcacgcacgcacacacactg

SEQ ID NO: 65429 - DNA, 19 bp, Homo sapiens
gcgcatatacacacactgc

SEQ ID NO: 65430 - DNA, 18 bp, Homo sapiens
gccaacactgcacactgc

SEQ ID NO: 65431 - DNA, 62 bp, Beet virus Q
ttgttattaatactagttgatttttctagcatctttgtcgtgttgatctagtatgtgtgcaa

SEQ ID NO: 65432 - DNA, 24 bp, Beet virus Q
taatactagttgatttttctagca

SEQ ID NO: 65433 - DNA, 19 bp, Homo sapiens
taatcttagttgatttttc

SEQ ID NO: 65434 - DNA, 22 bp, Homo sapiens
caatattaaatgttttctagca

SEQ ID NO: 65435 - DNA, 19 bp, Homo sapiens
taattctagttgatacggc

SEQ ID NO: 65436 - DNA, 18 bp, Homo sapiens
taacactgatttttctag

SEQ ID NO: 65437 - DNA, 19 bp, Homo sapiens
atactattcttttctagca

SEQ ID NO: 65438 - DNA, 18 bp, Homo sapiens
ctggtagatttttctagc

SEQ ID NO: 65439 - DNA, 22 bp, Homo sapiens
taatctagttgaatgcttagca

SEQ ID NO: 65440 - DNA, 64 bp, Beet virus Q
atttctggtctctagacgctggtagttcaataaataaaaaactatcatttgtcgttacagagat

SEQ ID NO: 65441 - DNA, 17 bp, Beet virus Q
tttgtcgttacagagat

SEQ ID NO: 65442 - DNA, 18 bp, Homo sapiens
tctgccatatatagagat

SEQ ID NO: 65443 - DNA, 18 bp, Homo sapiens
tttgtcgtccacggagat

SEQ ID NO: 65444 - DNA, 91 bp, Equine herpesvirus 4
agaggcgcgacttttggcatgcagcctgctccggacacggatttccaattaccaccccgagcactgcagctattctattttatgtgtcttt

SEQ ID NO: 65445 - DNA, 24 bp, Equine herpesvirus 4
ttaccaccccgagcactgcagcta

SEQ ID NO: 65446 - DNA, 23 bp, Homo sapiens
tcaccactgccactgctgcagct

SEQ ID NO: 65447 - DNA, 22 bp, Homo sapiens
tcaccacctcgcaaggcagcta

SEQ ID NO: 65448 - DNA, 20 bp, Homo sapiens
ttaccaccatcgagtgtctg

SEQ ID NO: 65449 - DNA, 18 bp, Homo sapiens
ccaccccgggcctaggct

SEQ ID NO: 65450 - DNA, 18 bp, Homo sapiens
cctgccggcactgcagct

SEQ ID NO: 65451 - DNA, 18 bp, Homo sapiens
cccgcaggcgctgcagct

SEQ ID NO: 65452 - DNA, 22 bp, Homo sapiens
cactgcagcagtactgcagcta

SEQ ID NO: 65453 - DNA, 20 bp, Homo sapiens
cccatcgaaccactgcagct

SEQ ID NO: 65454 - DNA, 17 bp, Homo sapiens
ccgccctcgctgcagct

SEQ ID NO: 65455 - DNA, 20 bp, Homo sapiens
ctactgtccaggctgcagct

SEQ ID NO: 65456 - DNA, 19 bp, Homo sapiens
ttactattagactgcagct

SEQ ID NO: 65457 - DNA, 21 bp, Homo sapiens
cctaccccgaggcccccagct

SEQ ID NO: 65458 - DNA, 19 bp, Homo sapiens
ccactcccctactgcagct

SEQ ID NO: 65459 - DNA, 19 bp, Homo sapiens
ttacagtccgcctgcagct

SEQ ID NO: 65460 - DNA, 17 bp, Homo sapiens
cacccacacctgcagct

SEQ ID NO: 65461 - DNA, 18 bp, Homo sapiens
ccgcagctcactgcagct

SEQ ID NO: 65462 - DNA, 22 bp, Homo sapiens
ttaccaccctctccctgtggct

SEQ ID NO: 65463 - DNA, 23 bp, Homo sapiens
ttactcctccaaagctgcagcta

SEQ ID NO: 65464 - DNA, 98 bp, Human papillomavirus type 63
gctatagaaatgactctttatcttagtggcctcagagactcacaatatggttctgaacagtggtctttacaagatactagcagagaaatctttttagc

SEQ ID NO: 65465 - DNA, 24 bp, Human papillomavirus type 63
ttctgaacagtggtctttacaaga

SEQ ID NO: 65466 - DNA, 23 bp, Homo sapiens
ttctaaacactgactttataaga

SEQ ID NO: 65467 - DNA, 18 bp, Homo sapiens
ttctgaacaatggtttct

SEQ ID NO: 65468 - DNA, 27 bp, Homo sapiens
ctctggacagtgacagggtcttgtaaa

SEQ ID NO: 65469 - DNA, 24 bp, Homo sapiens
ttctgagtagctgggattacagga

SEQ ID NO: 65470 - DNA, 21 bp, Homo sapiens
ctctggaggactctttacaag

SEQ ID NO: 65471 - DNA, 19 bp, Homo sapiens
ttctgaacaagtggtctct

SEQ ID NO: 65472 - DNA, 18 bp, Homo sapiens
ttctggacagtggtttta

SEQ ID NO: 65473 - DNA, 22 bp, Homo sapiens
ttctgaatagtcactttacaag

SEQ ID NO: 65474 - DNA, 19 bp, Homo sapiens
ttctgggtgtgattacaag

SEQ ID NO: 65475 - DNA, 19 bp, Homo sapiens
ttctagcagtggccttaag

SEQ ID NO: 65476 - DNA, 19 bp, Homo sapiens
ttctgtacaattttacaag

SEQ ID NO: 65477 - DNA, 18 bp, Homo sapiens
ttctggaggtggtcttta

SEQ ID NO: 65478 - DNA, 87 bp, Melanoplus sanguinipes entomopoxvirus
taataaacgatttaattaaattactatatatatatttacaactatcctttgaagtatataattcaatattttgtatattatttatta

SEQ ID NO: 65479 - DNA, 24 bp, Melanoplus sanguinipes entomopoxvirus
taaattactatatatatatttaca

SEQ ID NO: 65480 - DNA, 19 bp, Homo sapiens
taaattactaatatatata

SEQ ID NO: 65481 - DNA, 19 bp, Homo sapiens
taaattatatatatatatt

SEQ ID NO: 65482 - DNA, 24 bp, Homo sapiens
taaattactaggagtatatttaca

SEQ ID NO: 65483 - DNA, 18 bp, Homo sapiens
ttactatatatatataca

SEQ ID NO: 65484 - DNA, 20 bp, Homo sapiens
tcattatatatatatttaca

SEQ ID NO: 65485 - DNA, 18 bp, Homo sapiens
aattatctatatatatat

SEQ ID NO: 65486 - DNA, 21 bp, Homo sapiens
atcactgcatttatatttaca

SEQ ID NO: 65487 - DNA, 19 bp, Homo sapiens
taaataactatatatatat

SEQ ID NO: 65488 - DNA, 18 bp, Homo sapiens
tcactatatatatattta

SEQ ID NO: 65489 - DNA, 20 bp, Homo sapiens
taaattatatatatatattt

SEQ ID NO: 65490 - DNA, 22 bp, Homo sapiens
aatttgaatatatatatttaca

SEQ ID NO: 65491 - DNA, 24 bp, Homo sapiens
taaattactatgttgcaatttaca

SEQ ID NO: 65492 - DNA, 22 bp, Homo sapiens
taaatatatatatatatattta

SEQ ID NO: 65493 - DNA, 67 bp, Cowpox virus
gtggtatcaggagtacatcttgcacaactattgacggcaggcaccgtacattttaatcctggaccac

SEQ ID NO: 65494 - DNA, 24 bp, Cowpox virus
tcaggagtacatcttgcacaacta

SEQ ID NO: 65495 - DNA, 19 bp, Homo sapiens
tcaggagtagatgctgtca

SEQ ID NO: 65496 - DNA, 23 bp, Homo sapiens
tcaggagtaatgtctccaagact

SEQ ID NO: 65497 - DNA, 20 bp, Homo sapiens
gcattcatcttgcacggcta

SEQ ID NO: 65498 - DNA, 25 bp, Homo sapiens
aagagcactaggtcttgcacagcta

SEQ ID NO: 65499 - DNA, 20 bp, Homo sapiens
aaggcacatgtcttgcacaa

SEQ ID NO: 65500 - DNA, 22 bp, Homo sapiens
aggagtgcttggcacacaacta

SEQ ID NO: 65501 - DNA, 18 bp, Homo sapiens
tcagagtacatttttcac

SEQ ID NO: 65502 - DNA, 21 bp, Homo sapiens
ccattcatatcttgcacaact

SEQ ID NO: 65503 - DNA, 20 bp, Homo sapiens
tcaggagatgacacaataca

SEQ ID NO: 65504 - DNA, 20 bp, Homo sapiens
ccaggagtccctgcgcaact

SEQ ID NO: 65505 - DNA, 20 bp, Homo sapiens
gaggacatcttgcacgacta

SEQ ID NO: 65506 - DNA, 18 bp, Homo sapiens
tcggaagtacaaaacaca

SEQ ID NO: 65507 - DNA, 18 bp, Homo sapiens
tcagaagtacacacggca

SEQ ID NO: 65508 - DNA, 131 bp, African swine fever virus
tatggtgatatagtaatgagtgcctgcacaagtgcttgcacaggtgcttgcacaggtgcttgcacaagtgcttgcacaagtgcttgcacaagtgcctgcacaagtgcttgtacacattactgcatcgccaa

SEQ ID NO: 65509 - DNA, 24 bp, African swine fever virus
cttgcacaagtgcttgcacaagtg

SEQ ID NO: 65510 - DNA, 20 bp, Homo sapiens
gcatatctgctgcacaagtg

SEQ ID NO: 65511 - DNA, 18 bp, Homo sapiens
tgcacaagtgagacaagt

SEQ ID NO: 65512 - DNA, 19 bp, Homo sapiens
cttgcttaatggcacaagt

SEQ ID NO: 65513 - DNA, 20 bp, Homo sapiens
tgtacaagtgcacacaagtg

SEQ ID NO: 65514 - DNA, 22 bp, Homo sapiens
cttgcagaagggggcgcaggtg

SEQ ID NO: 65515 - DNA, 21 bp, Homo sapiens
cttgcacagatgttaccagtg

SEQ ID NO: 65516 - DNA, 20 bp, Homo sapiens
ttgagtgagtgcctggagtg

SEQ ID NO: 65517 - DNA, 21 bp, Homo sapiens
ttgcaaaggcggccacaagtg

SEQ ID NO: 65518 - DNA, 70 bp, Ectromelia virus
aagatagtattcatcttcatgctatttaatacatctaatatatgtattggtcattaaaaaatattatttt

SEQ ID NO: 65519 - DNA, 24 bp, Ectromelia virus
tagtattcatcttcatgctattta

SEQ ID NO: 65520 - DNA, 22 bp, Homo sapiens
tagtacttatctactactattt

SEQ ID NO: 65521 - DNA, 24 bp, Homo sapiens
tagcatttcattttatgctattta

SEQ ID NO: 65522 - DNA, 18 bp, Homo sapiens
tagcattcatttttggct

SEQ ID NO: 65523 - DNA, 23 bp, Homo sapiens
tagctattccccaatgctattta

SEQ ID NO: 65524 - DNA, 23 bp, Homo sapiens
tagtttcatctttatagtattta

SEQ ID NO: 65525 - DNA, 18 bp, Homo sapiens
gtattcacttcagtaact

SEQ ID NO: 65526 - DNA, 19 bp, Homo sapiens
tagtgttcatctcaaatct

SEQ ID NO: 65527 - DNA, 23 bp, Homo sapiens
tagtggtttccaaatgctattta

SEQ ID NO: 65528 - DNA, 20 bp, Homo sapiens
atattcattttcaccattta

SEQ ID NO: 65529 - DNA, 22 bp, Homo sapiens
tagtattctctgatggctgttt

SEQ ID NO: 65530 - DNA, 78 bp, Ectromelia virus
tgttgtggtatcaggagtacatcttgcacaactattgacggcaggcagcatacatttcaatcctggaccacattgaca

SEQ ID NO: 65531 - DNA, 24 bp, Ectromelia virus
aggcagcatacatttcaatcctgg

SEQ ID NO: 65532 - DNA, 23 bp, Homo sapiens
aggcagctgggaggcaatcctgg

SEQ ID NO: 65533 - DNA, 24 bp, Homo sapiens
aggtagatgaatcctcaatcctgg

SEQ ID NO: 65534 - DNA, 20 bp, Homo sapiens
ggtcagagttttaatcctgg

SEQ ID NO: 65535 - DNA, 21 bp, Homo sapiens
ggcagcattgttcccacctgg

SEQ ID NO: 65536 - DNA, 23 bp, Homo sapiens
ggtaatgtacatttctcacccag

SEQ ID NO: 65537 - DNA, 23 bp, Homo sapiens
aggcagcatgaaaacagtcctgg

SEQ ID NO: 65538 - DNA, 22 bp, Homo sapiens
aggcagcagatattttaacctg

SEQ ID NO: 65539 - DNA, 20 bp, Homo sapiens
gacagcatgagtgatcctgg

SEQ ID NO: 65540 - DNA, 23 bp, Homo sapiens
ggcagcatagggcacgatcttgg

SEQ ID NO: 65541 - DNA, 19 bp, Homo sapiens
aagcagcatgcatttcaat

SEQ ID NO: 65542 - DNA, 21 bp, Homo sapiens
aggcagcaacgtggtccctgg

SEQ ID NO: 65543 - DNA, 22 bp, Homo sapiens
ggaggcatacatcaccacttgg

SEQ ID NO: 65544 - DNA, 17 bp, Homo sapiens
ggcagcatatctgcctg

SEQ ID NO: 65545 - DNA, 24 bp, Homo sapiens
agacagcaaaaattttaattttgg

SEQ ID NO: 65546 - DNA, 22 bp, Homo sapiens
aggagtatgcatttcaatatgg

SEQ ID NO: 65547 - DNA, 18 bp, Homo sapiens
aggcagcatatgatcctg

SEQ ID NO: 65548 - DNA, 15 bp, Homo sapiens
aggcagcaacatcct

SEQ ID NO: 65549 - DNA, 70 bp, Human herpesvirus 6B
catttgtgctagatgagcggcaaagaactcatctttctgagatttttctgggattattctggtaaaaatg

SEQ ID NO: 65550 - DNA, 24 bp, Human herpesvirus 6B
tgctagatgagcggcaaagaactc

SEQ ID NO: 65551 - DNA, 25 bp, Homo sapiens
tgcgggatgagcaaaacaggaactc

SEQ ID NO: 65552 - DNA, 20 bp, Homo sapiens
tgtaggaatggcaaagaact

SEQ ID NO: 65553 - DNA, 16 bp, Homo sapiens
tgcagaagcagagaac

SEQ ID NO: 65554 - DNA, 18 bp, Homo sapiens
tagatgtaagaaagaact

SEQ ID NO: 65555 - DNA, 23 bp, Homo sapiens
tggtagatgaggccagggcagag

SEQ ID NO: 65556 - DNA, 24 bp, Homo sapiens
tgctaaatttcatgcaaaggactc

SEQ ID NO: 65557 - DNA, 18 bp, Homo sapiens
tgctagatgagggttaag

SEQ ID NO: 65558 - DNA, 18 bp, Homo sapiens
tagatgttcgaaagaact

SEQ ID NO: 65559 - DNA, 20 bp, Homo sapiens
tgctagatatttactgaaga

SEQ ID NO: 65560 - DNA, 17 bp, Homo sapiens
tgctggagagtggcaaa

SEQ ID NO: 65561 - DNA, 19 bp, Homo sapiens
agctgggcagcgaagaact

SEQ ID NO: 65562 - DNA, 22 bp, Homo sapiens
gccagtgagcggcgaaggactc

SEQ ID NO: 65563 - DNA, 63 bp, O'nyong-nyong virus
ttggtgcccccttagaggcacattatagaaccaggtataggtgcccccttagaggtacaccaa

SEQ ID NO: 65564 - DNA, 24 bp, O'nyong-nyong virus
taggtgcccccttagaggtacacc

SEQ ID NO: 65565 - DNA, 20 bp, Homo sapiens
taggtgccccctggaacggc

SEQ ID NO: 65566 - DNA, 20 bp, Homo sapiens
taggtatcttcttagaaagt

SEQ ID NO: 65567 - DNA, 19 bp, Homo sapiens
aggtgccttcttaggaggt

SEQ ID NO: 65568 - DNA, 21 bp, Homo sapiens
taggtgcctcctcagctacac

SEQ ID NO: 65569 - DNA, 18 bp, Homo sapiens
gatgcccccttgggggta

SEQ ID NO: 65570 - DNA, 20 bp, Homo sapiens
taagtgccttcttaatagca

SEQ ID NO: 65571 - DNA, 18 bp, Homo sapiens
ggtgcccctctagtgggc

SEQ ID NO: 65572 - DNA, 20 bp, Homo sapiens
ggtagttcccttaaagtaca

SEQ ID NO: 65573 - DNA, 17 bp, Homo sapiens
gatgctcccaggtacac

SEQ ID NO: 65574 - DNA, 22 bp, Homo sapiens
taggttgctctcttgaaacaca

SEQ ID NO: 65575 - DNA, 18 bp, Homo sapiens
taggtgccccctgtgggt

SEQ ID NO: 65576 - DNA, 20 bp, Homo sapiens
aggtgtcggggaggtacacc

SEQ ID NO: 65577 - DNA, 21 bp, Homo sapiens
taggtgctcctgtaaaggtac

SEQ ID NO: 65578 - DNA, 21 bp, Homo sapiens
ggtgcccccttaattttgtac

SEQ ID NO: 65579 - DNA, 20 bp, Homo sapiens
ggtgctctcacaggtacacc

SEQ ID NO: 65580 - DNA, 20 bp, Homo sapiens
taggggcccctaaagtgcac

SEQ ID NO: 65581 - DNA, 18 bp, Homo sapiens
caggtgccctctgtacac

SEQ ID NO: 65582 - DNA, 18 bp, Homo sapiens
taggtgccctttagaggc

SEQ ID NO: 65583 - DNA, 23 bp, Homo sapiens
ggtgctctcaggtatggtacacc

SEQ ID NO: 65584 - DNA, 21 bp, Homo sapiens
taagtgccttcttgtctgtac

SEQ ID NO: 65585 - DNA, 66 bp, Fowlpox virus
atctcaaggaacttaaatgaagagttgtagacaaacttagtaatcttatagaaagtttatgaagat

SEQ ID NO: 65586 - DNA, 18 bp, Fowlpox virus
tagaaagtttatgaagat

SEQ ID NO: 65587 - DNA, 18 bp, Homo sapiens
tagaaagtattacaaaga

SEQ ID NO: 65588 - DNA, 18 bp, Homo sapiens
caggaaggacacgaagat

SEQ ID NO: 65589 - DNA, 21 bp, Homo sapiens
tagaaagttgctcaggaagat

SEQ ID NO: 65590 - DNA, 19 bp, Homo sapiens
gaaagttttttatgaagat

SEQ ID NO: 65591 - DNA, 18 bp, Homo sapiens
tagaagtcctataaagat

SEQ ID NO: 65592 - DNA, 17 bp, Homo sapiens
cagaagtccatggagat

SEQ ID NO: 65593 - DNA, 18 bp, Homo sapiens
taaaaagccattgaagat

SEQ ID NO: 65594 - DNA, 21 bp, Homo sapiens
taaaaagtcttccatgaagat

SEQ ID NO: 65595 - DNA, 19 bp, Homo sapiens
cagaaagtcctacagagat

SEQ ID NO: 65596 - DNA, 18 bp, Homo sapiens
tagaaaaaccatgaagat

SEQ ID NO: 65597 - DNA, 17 bp, Homo sapiens
cagaaagcctctgagat

SEQ ID NO: 65598 - DNA, 17 bp, Homo sapiens
cagaaaatactgaagat

SEQ ID NO: 65599 - DNA, 17 bp, Homo sapiens
tagaactctatgaagat

SEQ ID NO: 65600 - DNA, 18 bp, Homo sapiens
tagaaagtgttgtgaaga

SEQ ID NO: 65601 - DNA, 16 bp, Homo sapiens
tagaaagtatgaaaat

SEQ ID NO: 65602 - DNA, 17 bp, Homo sapiens
cagaacatcatgaagat

SEQ ID NO: 65603 - DNA, 18 bp, Homo sapiens
agaaacttgcatgaagat

SEQ ID NO: 65604 - DNA, 15 bp, Homo sapiens
tagaaagttgaagac

SEQ ID NO: 65605 - DNA, 17 bp, Homo sapiens
cagaacaccatgaagat

SEQ ID NO: 65606 - DNA, 17 bp, Homo sapiens
tagaaagttctgtagat

SEQ ID NO: 65607 - DNA, 19 bp, Homo sapiens
tagaaagtgcaatgaagat

SEQ ID NO: 65608 - DNA, 17 bp, Homo sapiens
caggaagttatgaagat

SEQ ID NO: 65609 - DNA, 17 bp, Homo sapiens
tagaaaattcaccagat

SEQ ID NO: 65610 - DNA, 18 bp, Homo sapiens
agaaattactatgaagat

SEQ ID NO: 65611 - DNA, 18 bp, Homo sapiens
agaatagcttatgaggat

SEQ ID NO: 65612 - DNA, 18 bp, Homo sapiens
taaaaagtaaataaagat

SEQ ID NO: 65613 - DNA, 100 bp, Camelpox virus
tagtaaatgtgattgtatgttgttacatttccatgtcaatagagtttataaaaatttttatacattatcttccaacaagcaattgacgaacgtattacta

SEQ ID NO: 65614 - DNA, 24 bp, Camelpox virus
aatgtgattgtatgttgttacatt

SEQ ID NO: 65615 - DNA, 18 bp, Homo sapiens
aatgtgtttctatgttat

SEQ ID NO: 65616 - DNA, 22 bp, Homo sapiens
aatgtaattatgatgttacatt

SEQ ID NO: 65617 - DNA, 21 bp, Homo sapiens
atgtgattggaaatctacatt

SEQ ID NO: 65618 - DNA, 24 bp, Homo sapiens
aatgttatttatacctgttacatt

SEQ ID NO: 65619 - DNA, 20 bp, Homo sapiens
aatgtgattattaagttgtt

SEQ ID NO: 65620 - DNA, 18 bp, Homo sapiens
aatgtggtttatgttgct

SEQ ID NO: 65621 - DNA, 19 bp, Homo sapiens
aatgtgattgtctgtcatt

SEQ ID NO: 65622 - DNA, 21 bp, Homo sapiens
aatctgattgtattagattgc

SEQ ID NO: 65623 - DNA, 20 bp, Homo sapiens
aatgtcattgtatgattgtt

SEQ ID NO: 65624 - DNA, 17 bp, Homo sapiens
atgtgactgtagcagtc

SEQ ID NO: 65625 - DNA, 19 bp, Homo sapiens
aatgtgatttcatttacat

SEQ ID NO: 65626 - DNA, 88 bp, Camelpox virus
gactatacctagtgctattttgacatactcgtgttcttgtgtaattgcggtatctatattattaaagtacgtaaatctagctatagtt

SEQ ID NO: 65627 - DNA, 24 bp, Camelpox virus
tatacctagtgctattttgacata

SEQ ID NO: 65628 - DNA, 16 bp, Homo sapiens
ccagttgcttgacata

SEQ ID NO: 65629 - DNA, 19 bp, Homo sapiens
catatctggtgctatttca

SEQ ID NO: 65630 - DNA, 17 bp, Homo sapiens
tataccagtgctgtttg

SEQ ID NO: 65631 - DNA, 24 bp, Homo sapiens
ctagtgccagcctgttttgatata

SEQ ID NO: 65632 - DNA, 21 bp, Homo sapiens
tatatgtagtgttttgacata

SEQ ID NO: 65633 - DNA, 18 bp, Homo sapiens
tagccgttattttgacat

SEQ ID NO: 65634 - DNA, 130 bp, Yaba-like disease virus
ttccagcaatatcatttttgtacttaaagtattatcctgtaaatcgtcattgatggtattattgtaagataaattaatggtttttacaggtaaaagtggttcaagagattcaaaaaaactattattggga

SEQ ID NO: 65635 - DNA, 24 bp, Yaba-like disease virus
taaagtattatcctgtaaatcgtc

SEQ ID NO: 65636 - DNA, 19 bp, Homo sapiens
taaggtatcatcttgtaaa

SEQ ID NO: 65637 - DNA, 21 bp, Homo sapiens
agtttatcctaaggaaatcgt

SEQ ID NO: 65638 - DNA, 21 bp, Homo sapiens
taaagtatttcttgtcaaatc

SEQ ID NO: 65639 - DNA, 18 bp, Homo sapiens
taaagtatatatccatgt

SEQ ID NO: 65640 - DNA, 97 bp, Fowlpox virus
acattagtatgtttatttcataatgtcattattagtatttagtagttagcaagtgccatattacaactaataagatcaaaaataaaactgctgatgt

SEQ ID NO: 65641 - DNA, 24 bp, Fowlpox virus
tgtttatttcataatgtcattatt

SEQ ID NO: 65642 - DNA, 18 bp, Homo sapiens
tttcaatatgtcattatt

SEQ ID NO: 65643 - DNA, 19 bp, Homo sapiens
tgtttatttcatctccatt

SEQ ID NO: 65644 - DNA, 23 bp, Homo sapiens
tgtttgtttctaatcccattatt

SEQ ID NO: 65645 - DNA, 18 bp, Homo sapiens
gtttatttcatacaatgt

SEQ ID NO: 65646 - DNA, 20 bp, Homo sapiens
tgtttattttaaatgccatt

SEQ ID NO: 65647 - DNA, 18 bp, Homo sapiens
tttatttcataatacatt

SEQ ID NO: 65648 - DNA, 21 bp, Homo sapiens
gcccattataatgtcattatt

SEQ ID NO: 65649 - DNA, 96 bp, Garlic virus X
gctaccacacggaggccgataccgggacggcaacaaattcgtcagctacaacggtccgaacactggcgcctcctcacacagcatctggtggccagc

SEQ ID NO: 65650 - DNA, 24 bp, Garlic virus X
tccgaacactggcgcctcctcaca

SEQ ID NO: 65651 - DNA, 20 bp, Homo sapiens
tccgcacccggcctcctcac

SEQ ID NO: 65652 - DNA, 24 bp, Homo sapiens
tctgcacactcttccctcctcaca

SEQ ID NO: 65653 - DNA, 16 bp, Homo sapiens
gaacactgagcatcac

SEQ ID NO: 65654 - DNA, 24 bp, Homo sapiens
tcctgatgccaccctctcctcaca

SEQ ID NO: 65655 - DNA, 19 bp, Homo sapiens
cccggctcagcgcctcctc

SEQ ID NO: 65656 - DNA, 21 bp, Homo sapiens
tctgacatcaccacctcctca

SEQ ID NO: 65657 - DNA, 20 bp, Homo sapiens
tcagaaccttgcctcctcac

SEQ ID NO: 65658 - DNA, 19 bp, Homo sapiens
cgaaccttgcctcctcaca

SEQ ID NO: 65659 - DNA, 22 bp, Homo sapiens
gacactgacgctatttcttaca

SEQ ID NO: 65660 - DNA, 18 bp, Homo sapiens
tccaatgaccttcctcac

SEQ ID NO: 65661 - DNA, 19 bp, Homo sapiens
tccaggcagccttcctcac

SEQ ID NO: 65662 - DNA, 19 bp, Homo sapiens
cgaaggctgtttcctcaca

SEQ ID NO: 65663 - DNA, 16 bp, Homo sapiens
cccgggcgcctcctcc

SEQ ID NO: 65664 - DNA, 22 bp, Homo sapiens
cgggcatcaggtcctcctcaca

SEQ ID NO: 65665 - DNA, 20 bp, Homo sapiens
tccggggagagccctcctca

SEQ ID NO: 65666 - DNA, 23 bp, Homo sapiens
tccagcactggcgtgccatcgca

SEQ ID NO: 65667 - DNA, 23 bp, Homo sapiens
cctgaaaaccttgcctcctcaca

SEQ ID NO: 65668 - DNA, 21 bp, Homo sapiens
tccaagtcttgtctcctcaca

SEQ ID NO: 65669 - DNA, 18 bp, Homo sapiens
tccgggcactgccctcac

SEQ ID NO: 65670 - DNA, 21 bp, Homo sapiens
tcctgattaggcctcctcgca

SEQ ID NO: 65671 - DNA, 16 bp, Homo sapiens
tccggtggcgcctcct

SEQ ID NO: 65672 - DNA, 22 bp, Homo sapiens
tccaaacaacccctttctcaca

SEQ ID NO: 65673 - DNA, 23 bp, Homo sapiens
tcctggcactggcgtagaacaca

SEQ ID NO: 65674 - DNA, 19 bp, Homo sapiens
tccagaccagggcctcctc

SEQ ID NO: 65675 - DNA, 16 bp, Homo sapiens
gaaggctgcctcctca

SEQ ID NO: 65676 - DNA, 19 bp, Homo sapiens
ctgagcacccttcctcaca

SEQ ID NO: 65677 - DNA, 20 bp, Homo sapiens
tccggacaccggcgcctgct

SEQ ID NO: 65678 - DNA, 24 bp, Homo sapiens
cctgaacatgtttgtttcctcaca

SEQ ID NO: 65679 - DNA, 72 bp, Garlic virus A
tagccgtcctcgccgccgcatctgcatacgctgctctgagtctcattaaaggtgcgccgcaagggtgcgtta

SEQ ID NO: 65680 - DNA, 24 bp, Garlic virus A
aaggtgcgccgcaagggtgcgtta

SEQ ID NO: 65681 - DNA, 18 bp, Homo sapiens
gggcgccgcaggggccca

SEQ ID NO: 65682 - DNA, 24 bp, Homo sapiens
agggtcccaagcaggggtgtgtta

SEQ ID NO: 65683 - DNA, 19 bp, Homo sapiens
aggtgcgccgccgggacac

SEQ ID NO: 65684 - DNA, 19 bp, Homo sapiens
agggcgccgcaggctgatt

SEQ ID NO: 65685 - DNA, 19 bp, Homo sapiens
aaggtgcggccgcggggtg

SEQ ID NO: 65686 - DNA, 18 bp, Homo sapiens
aggtgcgcctggggtcca

SEQ ID NO: 65687 - DNA, 21 bp, Homo sapiens
aaagtgtgctgtgaggcatta

SEQ ID NO: 65688 - DNA, 21 bp, Homo sapiens
ggtgcaccgtgaggggcccta

SEQ ID NO: 65689 - DNA, 108 bp, Paramecium bursaria Chlorella virus 1
tgattaattttgataatctcattacgtttattatacgagtcgaggatatacctcgatacattttgttcgcgctcagtaaaatgtttgttgatgagagtatgttggtca

SEQ ID NO: 65690 - DNA, 24 bp, Paramecium bursaria Chlorella virus 1
ttcgcgctcagtaaaatgtttgtt

SEQ ID NO: 65691 - DNA, 18 bp, Homo sapiens
ttcgccctcattgtttgt

SEQ ID NO: 65692 - DNA, 20 bp, Homo sapiens
gctttgctcttatgtttgtt

SEQ ID NO: 65693 - DNA, 91 bp, Human herpesvirus 1
gatggccctccaggctgtcgacgccccctccctgtttgtcgcctggctggccgctcggtggctccggggggcttccggcctgggggccgtc

SEQ ID NO: 65694 - DNA, 24 bp, Human herpesvirus 1
tcgacgccccctccctgtttgtcg

SEQ ID NO: 65695 - DNA, 22 bp, Homo sapiens
cggcgccccctttcccggctcg

SEQ ID NO: 65696 - DNA, 20 bp, Homo sapiens
ccggcgccccctcctactcg

SEQ ID NO: 65697 - DNA, 18 bp, Homo sapiens
tcgccgcccccttcctgc

SEQ ID NO: 65698 - DNA, 20 bp, Homo sapiens
tcgatggctcttccctgttt

SEQ ID NO: 65699 - DNA, 17 bp, Homo sapiens
tcgcgcctcctccctgt

SEQ ID NO: 65700 - DNA, 18 bp, Homo sapiens
tcggcgtcccctgcccca

SEQ ID NO: 65701 - DNA, 19 bp, Homo sapiens
tcgacgccgtctccttctg

SEQ ID NO: 65702 - DNA, 19 bp, Homo sapiens
ccgcgccccctctctcccg

SEQ ID NO: 65703 - DNA, 21 bp, Homo sapiens
tcggtgctcctccctgagccg

SEQ ID NO: 65704 - DNA, 19 bp, Homo sapiens
tcggcgcccctcccttttg

SEQ ID NO: 65705 - DNA, 20 bp, Homo sapiens
tcggccttcctccctgttcg

SEQ ID NO: 65706 - DNA, 19 bp, Homo sapiens
tcgacgcccccaccttatc

SEQ ID NO: 65707 - DNA, 23 bp, Homo sapiens
tcgagttccctccttgcccaccg

SEQ ID NO: 65708 - DNA, 21 bp, Homo sapiens
tcggcgcatcctccctgggcg

SEQ ID NO: 65709 - DNA, 18 bp, Homo sapiens
gcctcctccctgagctat

SEQ ID NO: 65710 - DNA, 19 bp, Homo sapiens
tcgcgctccctccctccct

SEQ ID NO: 65711 - DNA, 21 bp, Homo sapiens
tcggccgcctcctcccgctcg

SEQ ID NO: 65712 - DNA, 19 bp, Homo sapiens
tcgatgccccttccccgcc

SEQ ID NO: 65713 - DNA, 18 bp, Homo sapiens
gatgctccttccctgtct

SEQ ID NO: 65714 - DNA, 96 bp, Human herpesvirus 5
ctcgggggatagtgaggaattctcaagggatacgggacccaatgactggataagagaagggtttttccccgtaagatgatcctcgtatcacatgag

SEQ ID NO: 65715 - DNA, 24 bp, Human herpesvirus 5
tacgggacccaatgactggataag

SEQ ID NO: 65716 - DNA, 18 bp, Homo sapiens
cgggacccggtgggcaag

SEQ ID NO: 65717 - DNA, 20 bp, Homo sapiens
tacgggacccaaggactgga

SEQ ID NO: 65718 - DNA, 17 bp, Homo sapiens
tacgggacctatgaagg

SEQ ID NO: 65719 - DNA, 21 bp, Homo sapiens
gggacccagactgtggataag

SEQ ID NO: 65720 - DNA, 19 bp, Homo sapiens
gggaccaaatggctcaaca

SEQ ID NO: 65721 - DNA, 21 bp, Homo sapiens
tacaggactcagtgaataaat

SEQ ID NO: 65722 - DNA, 66 bp, Taura syndrome virus
gtactatcagttaaccactcttgaatatgctcaatgaccctattcaacactggtgtctcttagtac

SEQ ID NO: 65723 - DNA, 24 bp, Taura syndrome virus
tcagttaaccactcttgaatatgc

SEQ ID NO: 65724 - DNA, 19 bp, Homo sapiens
tcagttaccaccccgtatg

SEQ ID NO: 65725 - DNA, 19 bp, Homo sapiens
ttaaccactccctgtatgc

SEQ ID NO: 65726 - DNA, 22 bp, Homo sapiens
tcagataactttgtgaatatgc

SEQ ID NO: 65727 - DNA, 18 bp, Homo sapiens
tcagttaatgaaaatatg

SEQ ID NO: 65728 - DNA, 21 bp, Homo sapiens
tcagtgagctgctgaatatgc

SEQ ID NO: 65729 - DNA, 19 bp, Homo sapiens
tcagcttgaccattcttga

SEQ ID NO: 65730 - DNA, 24 bp, Homo sapiens
ccagttgaccatgtgtgaatatgc

SEQ ID NO: 65731 - DNA, 24 bp, Homo sapiens
ccagttgatcatgtgtgaatatgc

SEQ ID NO: 65732 - DNA, 25 bp, Homo sapiens
tcagttaattgcattcttgatgtgc

SEQ ID NO: 65733 - DNA, 88 bp, Tupaia herpesvirus
cacggacggtgtcgctgttatattcgcgaacagtggtgatctgatacaaggcatagagtcactaccaataatagcgtatacagtcgtg

SEQ ID NO: 65734 - DNA, 24 bp, Tupaia herpesvirus
tcgctgttatattcgcgaacagtg

SEQ ID NO: 65735 - DNA, 17 bp, Homo sapiens
actgttacatgaacagt

SEQ ID NO: 65736 - DNA, 22 bp, Homo sapiens
tcgctgttatattgcactaatg

SEQ ID NO: 65737 - DNA, 131 bp, Human herpesvirus 5
gaaatcggataacggcacgcggaaaggtctcagcgagttggacacgttgtttagccgtctcgaagagtatctgcactcgagaaagtagcgttgcgatttgcagtccgctccggtgtcgttcacccagttac

SEQ ID NO: 65738 - DNA, 24 bp, Human herpesvirus 5
aaggtctcagcgagttggacacgt

SEQ ID NO: 65739 - DNA, 20 bp, Homo sapiens
aggtctcaggttgggcatgt

SEQ ID NO: 65740 - DNA, 24 bp, Homo sapiens
aggtcccagtggggactggtacgt

SEQ ID NO: 65741 - DNA, 18 bp, Homo sapiens
aaggttcagcgaggagac

SEQ ID NO: 65742 - DNA, 18 bp, Homo sapiens
aaggtctcagtcagttga

SEQ ID NO: 65743 - DNA, 20 bp, Homo sapiens
aaggtctcagtgacgtgctg

SEQ ID NO: 65744 - DNA, 24 bp, Homo sapiens
aaggtgtcagcgtcagagacacgt

SEQ ID NO: 65745 - DNA, 20 bp, Homo sapiens
gtctcagcttcaagacgcgt

SEQ ID NO: 65746 - DNA, 84 bp, Reston Ebola virus
tctttgcttgatttacaatatgatatttctcttaataatgattaatatattaagaaaaacttatgacgaagattaaaggagagg

SEQ ID NO: 65747 - DNA, 24 bp, Reston Ebola virus
tgcttgatttacaatatgatattt

SEQ ID NO: 65748 - DNA, 22 bp, Homo sapiens
tgcttgattttaataactactt

SEQ ID NO: 65749 - DNA, 22 bp, Homo sapiens
tgtcttgatttccttgatattt

SEQ ID NO: 65750 - DNA, 27 bp, Homo sapiens
tgcttgatttggccaaagatgatattt

SEQ ID NO: 65751 - DNA, 22 bp, Homo sapiens
tgtttgatgtacaatgtgacat

SEQ ID NO: 65752 - DNA, 20 bp, Homo sapiens
tgtttgctttacaacacaat

SEQ ID NO: 65753 - DNA, 83 bp, Avian leukosis virus
gcttaactaaggggactatggcatgtataggcgcaaagcggggcttcggttgtacgcggttaggagtcccctcaggatatagt

SEQ ID NO: 65754 - DNA, 24 bp, Avian leukosis virus
tggcatgtataggcgcaaagcggg

SEQ ID NO: 65755 - DNA, 18 bp, Homo sapiens
ggcaccggcgcaaagtgg

SEQ ID NO: 65756 - DNA, 25 bp, Homo sapiens
tggcctgcccggggcgcggggcggg

SEQ ID NO: 65757 - DNA, 18 bp, Homo sapiens
tggcatgtctggcagtgg

SEQ ID NO: 65758 - DNA, 23 bp, Homo sapiens
tgtgtgtgtaggcagggagtggg

SEQ ID NO: 65759 - DNA, 19 bp, Homo sapiens
tggcatgtgaggcccacgg

SEQ ID NO: 65760 - DNA, 22 bp, Homo sapiens
tggcatgtgggggctgggcggg

SEQ ID NO: 65761 - DNA, 16 bp, Homo sapiens
tggcatgtatggcatg

SEQ ID NO: 65762 - DNA, 79 bp, Vaccinia virus
gagattgtatcagtttcgtagtcttgagtattggtattactatatagtatatagatgtcgacgctagatatacagtctc

SEQ ID NO: 65763 - DNA, 24 bp, Vaccinia virus
gattgtatcagtttcgtagtcttg

SEQ ID NO: 65764 - DNA, 20 bp, Homo sapiens
ttatatcagtttggaccttg

SEQ ID NO: 65765 - DNA, 19 bp, Homo sapiens
gatttgcaattgtagtctt

SEQ ID NO: 65766 - DNA, 101 bp, Sulfolobus virus SIRV-1
ggaggtggagctggtagaaattctagatattttatgtatttagaaaaagaagatgacaagaaatatatagtagcagttgcctggcttcatgataatactcc

SEQ ID NO: 65767 - DNA, 24 bp, Sulfolobus virus SIRV-1
tgacaagaaatatatagtagcagt

SEQ ID NO: 65768 - DNA, 21 bp, Homo sapiens
gacaagaaatataaaatttag

SEQ ID NO: 65769 - DNA, 17 bp, Homo sapiens
gacaggaaatgcagcag

SEQ ID NO: 65770 - DNA, 20 bp, Homo sapiens
agaaggcacacagtggcagt

SEQ ID NO: 65771 - DNA, 18 bp, Homo sapiens
acaagaaatttatagcag

SEQ ID NO: 65772 - DNA, 20 bp, Homo sapiens
tgacaagaagtactgtgtag

SEQ ID NO: 65773 - DNA, 20 bp, Homo sapiens
tggcaagaaacatataaaag

SEQ ID NO: 65774 - DNA, 19 bp, Homo sapiens
tgacaagacatgtatccag

SEQ ID NO: 65775 - DNA, 24 bp, Homo sapiens
tgatggcgaggacacagtagcggt

SEQ ID NO: 65776 - DNA, 21 bp, Homo sapiens
tgacatggaacatgtagcagt

SEQ ID NO: 65777 - DNA, 20 bp, Homo sapiens
tggcaagatgtagtagcagt

SEQ ID NO: 65778 - DNA, 102 bp, Sulfolobus virus SIRV-1
tgagaaactgaagaaagatggttttgaagttctatggacacttggttttccagaccatagtaatgctttatataaaaaagccgggttcaaattagtaggtca

SEQ ID NO: 65779 - DNA, 24 bp, Sulfolobus virus SIRV-1
agaccatagtaatgctttatataa

SEQ ID NO: 65780 - DNA, 22 bp, Homo sapiens
cctatagtaatgaaaatatata

SEQ ID NO: 65781 - DNA, 17 bp, Homo sapiens
agatcaggtaatgcttt

SEQ ID NO: 65782 - DNA, 17 bp, Homo sapiens
aggccacagcactttat

SEQ ID NO: 65783 - DNA, 17 bp, Homo sapiens
caacagttgctttatat

SEQ ID NO: 65784 - DNA, 63 bp, Chimpanzee cytomegalovirus
acgtcgcttgtacacgtcgttcgtggcccaaagacacgggtggcgggtacggggacacggcgt

SEQ ID NO: 65785 - DNA, 19 bp, Chimpanzee cytomegalovirus
gggtacggggacacggcgt

SEQ ID NO: 65786 - DNA, 18 bp, Homo sapiens
ggtacggggatccagggt

SEQ ID NO: 65787 - DNA, 17 bp, Homo sapiens
gggtgaggggacagcat

SEQ ID NO: 65788 - DNA, 15 bp, Homo sapiens
gggcggggacagggt

SEQ ID NO: 65789 - DNA, 16 bp, Homo sapiens
gggcacggggaagggt

SEQ ID NO: 65790 - DNA, 19 bp, Homo sapiens
aggcaagaggacacggtgt

SEQ ID NO: 65791 - DNA, 17 bp, Homo sapiens
gagtaacggcacggcgt

SEQ ID NO: 65792 - DNA, 16 bp, Homo sapiens
gggtgggggacacaca

SEQ ID NO: 65793 - DNA, 17 bp, Homo sapiens
gggcacggggactgggt

SEQ ID NO: 65794 - DNA, 16 bp, Homo sapiens
gggcacggggatgggt

SEQ ID NO: 65795 - DNA, 18 bp, Homo sapiens
gggcacgggggcgcgggt

SEQ ID NO: 65796 - DNA, 16 bp, Homo sapiens
gggtacaaaatggcgt

SEQ ID NO: 65797 - DNA, 18 bp, Homo sapiens
aggcccacggcacggcgt

SEQ ID NO: 65798 - DNA, 18 bp, Homo sapiens
gggcacgggggtgcgggt

SEQ ID NO: 65799 - DNA, 16 bp, Homo sapiens
gggcggggacacgggt

SEQ ID NO: 65800 - DNA, 18 bp, Homo sapiens
gggtacggggccacgggt

SEQ ID NO: 65801 - DNA, 19 bp, Homo sapiens
gggttcctaagcacggcgt

SEQ ID NO: 65802 - DNA, 16 bp, Homo sapiens
gggacggggacaggca

SEQ ID NO: 65803 - DNA, 17 bp, Homo sapiens
gggacggggcccagcgt

SEQ ID NO: 65804 - DNA, 16 bp, Homo sapiens
gggtaaggacacaggt

SEQ ID NO: 65805 - DNA, 21 bp, Homo sapiens
gggtgcggggacagggaccgt

SEQ ID NO: 65806 - DNA, 18 bp, Homo sapiens
gggtaggaacaccggtgt

SEQ ID NO: 65807 - DNA, 17 bp, Homo sapiens
gggcacgggggcggcat

SEQ ID NO: 65808 - DNA, 18 bp, Homo sapiens
gggtacaggggacaccgt

SEQ ID NO: 65809 - DNA, 25 bp, Homo sapiens
gagtacagtggtggggtgcggtgta

SEQ ID NO: 65810 - DNA, 16 bp, Homo sapiens
gggccagccacggcgt

SEQ ID NO: 65811 - DNA, 16 bp, Homo sapiens
aggaggggcacggcgt

SEQ ID NO: 65812 - DNA, 16 bp, Homo sapiens
gggacggggacagggt

SEQ ID NO: 65813 - DNA, 18 bp, Homo sapiens
gagtacggggcggaccgt

SEQ ID NO: 65814 - DNA, 20 bp, Homo sapiens
ggctacggggacaccggtgt

SEQ ID NO: 65815 - DNA, 18 bp, Homo sapiens
gggtacggggtccgccgt

SEQ ID NO: 65816 - DNA, 19 bp, Homo sapiens
gggcacggggagcccgcgt

SEQ ID NO: 65817 - DNA, 22 bp, Homo sapiens
gagtgcggggacagccaggtgt

SEQ ID NO: 65818 - DNA, 18 bp, Homo sapiens
gggtacagggatacacgt

SEQ ID NO: 65819 - DNA, 79 bp, Variola virus
ggtacgacgagaatctttatacctttcctggaatatcattaactgttgccaatgatgttaggaaatattctgttgtgtc

SEQ ID NO: 65820 - DNA, 24 bp, Variola virus
acgagaatctttatacctttcctg

SEQ ID NO: 65821 - DNA, 20 bp, Homo sapiens
gaaaggacctgcctttcctg

SEQ ID NO: 65822 - DNA, 17 bp, Homo sapiens
gaatcttttgtttcctg

SEQ ID NO: 65823 - DNA, 20 bp, Homo sapiens
agaatctcaatactttcctg

SEQ ID NO: 65824 - DNA, 19 bp, Homo sapiens
acaggaatcttttcctttc

SEQ ID NO: 65825 - DNA, 21 bp, Homo sapiens
gagaatctagtgacatctttc

SEQ ID NO: 65826 - DNA, 16 bp, Homo sapiens
agaattcccctttcct

SEQ ID NO: 65827 - DNA, 21 bp, Homo sapiens
caggaaccactgtctttcctg

SEQ ID NO: 65828 - DNA, 15 bp, Homo sapiens
gaatctctctttcct

SEQ ID NO: 65829 - DNA, 17 bp, Homo sapiens
gagggctccactttcct

SEQ ID NO: 65830 - DNA, 20 bp, Homo sapiens
caaggaccctgtctttcctg

SEQ ID NO: 65831 - DNA, 19 bp, Homo sapiens
acaagaatttttttttcct

SEQ ID NO: 65832 - DNA, 84 bp, Variola virus
cattgtaaaagaaatatatgtggtgttacagttaggtgaacaagagatatattggagcattgctgcatatgtttgagtgcaatg

SEQ ID NO: 65833 - DNA, 24 bp, Variola virus
tatgtggtgttacagttaggtgaa

SEQ ID NO: 65834 - DNA, 16 bp, Homo sapiens
tgtagtgtgtgggtga

SEQ ID NO: 65835 - DNA, 20 bp, Homo sapiens
gtggtgttcacgtgggtgaa

SEQ ID NO: 65836 - DNA, 19 bp, Homo sapiens
gtggtgttagagataggtg

SEQ ID NO: 65837 - DNA, 21 bp, Homo sapiens
tgtggtgttgcatgcctgtaa

SEQ ID NO: 65838 - DNA, 15 bp, Homo sapiens
tgtggtgtagtggtg

SEQ ID NO: 65839 - DNA, 18 bp, Homo sapiens
tgtgtgtgtgttatggtg

SEQ ID NO: 65840 - DNA, 24 bp, Homo sapiens
tatgtggtttacagagcatctgaa

SEQ ID NO: 65841 - DNA, 18 bp, Homo sapiens
gtggtgttacaggttaga

SEQ ID NO: 65842 - DNA, 21 bp, Homo sapiens
tggtttcagtgcagttaggtg

SEQ ID NO: 65843 - DNA, 17 bp, Homo sapiens
tgtggtgtttgcaggga

SEQ ID NO: 65844 - DNA, 16 bp, Homo sapiens
tgtggtgttgttggtg

SEQ ID NO: 65845 - DNA, 20 bp, Homo sapiens
gtggtgttcacatgggtgaa

SEQ ID NO: 65846 - DNA, 20 bp, Homo sapiens
tgtggtgcttatagaataga

SEQ ID NO: 65847 - DNA, 19 bp, Homo sapiens
tgtagtgttgcacatatga

SEQ ID NO: 65848 - DNA, 22 bp, Homo sapiens
tgtgggtgtttctcgttaggtg

SEQ ID NO: 65849 - DNA, 75 bp, Sugarcane striate mosaic associated virus
caggaatagtataaggccaaggttagatttctcacctgcagaaataaattagcttttctttatatctaccccctg

SEQ ID NO: 65850 - DNA, 24 bp, Sugarcane striate mosaic associated virus
tagtataaggccaaggttagattt

SEQ ID NO: 65851 - DNA, 24 bp, Homo sapiens
atataaggctgaggtccttgattt

SEQ ID NO: 65852 - DNA, 20 bp, Homo sapiens
tagtataaagtcaggaacag

SEQ ID NO: 65853 - DNA, 17 bp, Homo sapiens
tagtaaaggccaaggtc

SEQ ID NO: 65854 - DNA, 19 bp, Homo sapiens
tagtaaaaggccaaatgtt

SEQ ID NO: 65855 - DNA, 19 bp, Homo sapiens
tagtgtaaggtcaaagtag

SEQ ID NO: 65856 - DNA, 92 bp, Sugarcane striate mosaic associated virus
gtcttagaactagtgctttgtcaatcatttaatggccaaggcaaggcattgtcttgggcactatttgattgacattgtggtctttctaagac

SEQ ID NO: 65857 - DNA, 24 bp, Sugarcane striate mosaic associated virus
tcaatcatttaatggccaaggcaa

SEQ ID NO: 65858 - DNA, 21 bp, Homo sapiens
tcaatctttaacagcaggcaa

SEQ ID NO: 65859 - DNA, 18 bp, Homo sapiens
tttaactacacaaggcaa

SEQ ID NO: 65860 - DNA, 22 bp, Homo sapiens
tccgtcacgaaggccaaggcaa

SEQ ID NO: 65861 - DNA, 19 bp, Homo sapiens
atcatttaattcttggcaa

SEQ ID NO: 65862 - DNA, 17 bp, Homo sapiens
ccattattcccaaggca

SEQ ID NO: 65863 - DNA, 18 bp, Homo sapiens
tcatgcttagccaaggca

SEQ ID NO: 65864 - DNA, 20 bp, Homo sapiens
tcaatatattaaccgaggca

SEQ ID NO: 65865 - DNA, 24 bp, Homo sapiens
tcaaatatttaataaatgaggcaa

SEQ ID NO: 65866 - DNA, 18 bp, Homo sapiens
tcaaccattttgtcaagg

SEQ ID NO: 65867 - DNA, 21 bp, Homo sapiens
tcaatcattagatggaagtgg

SEQ ID NO: 65868 - DNA, 19 bp, Homo sapiens
tcaatgactctggtcaagg

SEQ ID NO: 65869 - DNA, 20 bp, Homo sapiens
tcaatgggtgggccaaggca

SEQ ID NO: 65870 - DNA, 19 bp, Homo sapiens
tcaatcaatcactggggca

SEQ ID NO: 65871 - DNA, 22 bp, Homo sapiens
aatcatttactttagcaggcaa

SEQ ID NO: 65872 - DNA, 18 bp, Homo sapiens
ccaccttggccaaggcaa

SEQ ID NO: 65873 - DNA, 18 bp, Homo sapiens
tcaatcattcagaaggca

SEQ ID NO: 65874 - DNA, 18 bp, Homo sapiens
tcaatcatttaggtggca

SEQ ID NO: 65875 - DNA, 21 bp, Homo sapiens
caattgttaatcccaaggcaa

SEQ ID NO: 65876 - DNA, 21 bp, Homo sapiens
ccaatcaggccctggccaagg

SEQ ID NO: 65877 - DNA, 18 bp, Homo sapiens
tcagatcaccggccaagg

SEQ ID NO: 65878 - DNA, 83 bp, Swinepox virus
tatgattcgtttgatattacttatatagatccaagaagacatataacttggaataatattttatccatattgaatgaaaaata

SEQ ID NO: 65879 - DNA, 24 bp, Swinepox virus
tgattcgtttgatattacttatat

SEQ ID NO: 65880 - DNA, 17 bp, Homo sapiens
gtaaatattacttatat

SEQ ID NO: 65881 - DNA, 21 bp, Homo sapiens
tgattctgatattgcttatat

SEQ ID NO: 65882 - DNA, 76 bp, Fowlpox virus
ggtaatacttttctaaaaactaatctcaagtattgtttacaagcgactgaagtaatagttttagcaaaataatacc

SEQ ID NO: 65883 - DNA, 24 bp, Fowlpox virus
tctaaaaactaatctcaagtattg

SEQ ID NO: 65884 - DNA, 21 bp, Homo sapiens
taaaaactcatcttggtattg

SEQ ID NO: 65885 - DNA, 19 bp, Homo sapiens
tctgacgactaatctcagt

SEQ ID NO: 65886 - DNA, 17 bp, Homo sapiens
aaactaatctccaactg

SEQ ID NO: 65887 - DNA, 19 bp, Homo sapiens
tctaaaaactaactcaaat

SEQ ID NO: 65888 - DNA, 20 bp, Homo sapiens
tctagacactgatctcaagc

SEQ ID NO: 65889 - DNA, 21 bp, Homo sapiens
tctagagactcatctcaaagt

SEQ ID NO: 65890 - DNA, 112 bp, Duck adenovirus A
aaccttatgttacttttactttttacagatcacagcatgagtcgcctgaagtctttcatcggtggaatgcttttatttgtgctgtgccgtttcgtgtattgtaacccgggtt

SEQ ID NO: 65891 - DNA, 24 bp, Duck adenovirus A
tatgttacttttactttttacaga

SEQ ID NO: 65892 - DNA, 22 bp, Homo sapiens
tgttactttttattactacaga

SEQ ID NO: 65893 - DNA, 24 bp, Homo sapiens
tatgctgtttttacaaaaaacaga

SEQ ID NO: 65894 - DNA, 18 bp, Homo sapiens
tatgctgcttttactttc

SEQ ID NO: 65895 - DNA, 23 bp, Homo sapiens
tatgtaatttttttctttacaga

SEQ ID NO: 65896 - DNA, 18 bp, Homo sapiens
tgttatttccttttacag

SEQ ID NO: 65897 - DNA, 20 bp, Homo sapiens
gttattttcttttttacaga

SEQ ID NO: 65898 - DNA, 19 bp, Homo sapiens
tgttgctttcactctcaga

SEQ ID NO: 65899 - DNA, 22 bp, Homo sapiens
tgttacttttcctgaagtcaga

SEQ ID NO: 65900 - DNA, 18 bp, Homo sapiens
tgatgcttttacttttca

SEQ ID NO: 65901 - DNA, 17 bp, Homo sapiens
tatgttacttttccttt

SEQ ID NO: 65902 - DNA, 22 bp, Homo sapiens
tatgttactttatattttatag

SEQ ID NO: 65903 - DNA, 16 bp, Homo sapiens
gttacttttattacaa

SEQ ID NO: 65904 - DNA, 19 bp, Homo sapiens
atgcatttactttttacag

SEQ ID NO: 65905 - DNA, 90 bp, Fowlpox virus
cagtaaaggtattattttgctaaaactattacttcagtcgcttgtaaacaatacttgagattagtttttagaaaagtattaccattaatg

SEQ ID NO: 65906 - DNA, 24 bp, Fowlpox virus
tattttgctaaaactattacttca

SEQ ID NO: 65907 - DNA, 22 bp, Homo sapiens
ctttgctataattattatttca

SEQ ID NO: 65908 - DNA, 19 bp, Homo sapiens
tattttgccaaaattactt

SEQ ID NO: 65909 - DNA, 26 bp, Homo sapiens
tattttgctacagtggttgtgcttca

SEQ ID NO: 65910 - DNA, 26 bp, Homo sapiens
tattttgctgcaaagctgttgcttca

SEQ ID NO: 65911 - DNA, 22 bp, Homo sapiens
tattttttaaaaaatcacttca

SEQ ID NO: 65912 - DNA, 19 bp, Homo sapiens
tactttacgctattacttc

SEQ ID NO: 65913 - DNA, 21 bp, Homo sapiens
tattctgctgaagctttactt

SEQ ID NO: 65914 - DNA, 22 bp, Homo sapiens
tattttgccaaaattaggactc

SEQ ID NO: 65915 - DNA, 20 bp, Homo sapiens
cattttgctaaaattaatcc

SEQ ID NO: 65916 - DNA, 120 bp, Igbo Ora virus
accaggtattagtgcccccttagaggcacattatataaccaggtataggtgcccccttagaggcacactaacaataggtataagtgcccccttagtggcacactaaccaccacaattggt

SEQ ID NO: 65917 - DNA, 24 bp, Igbo Ora virus
taagtgcccccttagtggcacact

SEQ ID NO: 65918 - DNA, 18 bp, Homo sapiens
agtgtccccctcaaggca

SEQ ID NO: 65919 - DNA, 18 bp, Homo sapiens
taagttttccctaatgca

SEQ ID NO: 65920 - DNA, 18 bp, Homo sapiens
taagtccatgtggcacac

SEQ ID NO: 65921 - DNA, 18 bp, Homo sapiens
gtgttcccttagtaacac

SEQ ID NO: 65922 - DNA, 20 bp, Homo sapiens
gtgccccctctgttgtatgc

SEQ ID NO: 65923 - DNA, 17 bp, Homo sapiens
taagtgccctttcagga

SEQ ID NO: 65924 - DNA, 20 bp, Homo sapiens
taagttccccttagttccac

SEQ ID NO: 65925 - DNA, 18 bp, Homo sapiens
taagtgcctcttacccac

SEQ ID NO: 65926 - DNA, 18 bp, Homo sapiens
taagtgtcccatggcaca

SEQ ID NO: 65927 - DNA, 18 bp, Homo sapiens
gctctcaaaaggcacact

SEQ ID NO: 65928 - DNA, 19 bp, Homo sapiens
taagagcctagtggtgtac

SEQ ID NO: 65929 - DNA, 17 bp, Homo sapiens
gtgccctagtaggtaca

SEQ ID NO: 65930 - DNA, 24 bp, Homo sapiens
taagtttttctctcatggcacact

SEQ ID NO: 65931 - DNA, 23 bp, Homo sapiens
taaatgccttcttagaaatgcca

SEQ ID NO: 65932 - DNA, 20 bp, Homo sapiens
agtgctccttccagcacact

SEQ ID NO: 65933 - DNA, 19 bp, Homo sapiens
taagtgccctgctctgcac

SEQ ID NO: 65934 - DNA, 19 bp, Homo sapiens
taagtacctccttagttca

SEQ ID NO: 65935 - DNA, 18 bp, Homo sapiens
gtgccctctgagcacact

SEQ ID NO: 65936 - DNA, 22 bp, Homo sapiens
aaatgcaccttggtggcacact

SEQ ID NO: 65937 - DNA, 24 bp, Homo sapiens
taagtgcccccttcatgtagtcac

SEQ ID NO: 65938 - DNA, 128 bp, Beet soil-borne mosaic virus
cggtgccatttttccaaatgggggttgcattatggataggaattcgtttgcacagtttggtggttgtgatatcccaaaatatgtggctgattctatctctcgtgtggccatcaaggaattagacgccg

SEQ ID NO: 65939 - DNA, 24 bp, Beet soil-borne mosaic virus
tggctgattctatctctcgtgtgg

SEQ ID NO: 65940 - DNA, 23 bp, Homo sapiens
tggctgattttgtgctataatgg

SEQ ID NO: 65941 - DNA, 22 bp, Homo sapiens
tggctgattttgcttgtgaagg

SEQ ID NO: 65942 - DNA, 27 bp, Homo sapiens
tggctaattttttttttttttgtgtgg

SEQ ID NO: 65943 - DNA, 21 bp, Homo sapiens
tggtaagagtctttcgtgtgg

SEQ ID NO: 65944 - DNA, 76 bp, Equine infectious anemia virus
tctctactcagtccctgtctctagtttgtctgttcgagatcctacagttggcgcccgaacagggacctgagagggg

SEQ ID NO: 65945 - DNA, 24 bp, Equine infectious anemia virus
ttggcgcccgaacagggacctgag

SEQ ID NO: 65946 - DNA, 22 bp, Homo sapiens
agcgcccgagtaggggcctgag

SEQ ID NO: 65947 - DNA, 24 bp, Homo sapiens
ttggcgcccgcagccttgggcctg

SEQ ID NO: 65948 - DNA, 21 bp, Homo sapiens
ttggccctgcagggacctgag

SEQ ID NO: 65949 - DNA, 18 bp, Homo sapiens
tggctgcgcagggacctg

SEQ ID NO: 65950 - DNA, 24 bp, Homo sapiens
ttgtgtttgaaacaaggatctgag

SEQ ID NO: 65951 - DNA, 20 bp, Homo sapiens
ttggcgcccagggcgggctg

SEQ ID NO: 65952 - DNA, 17 bp, Homo sapiens
ctggcgcccggacggga

SEQ ID NO: 65953 - DNA, 19 bp, Homo sapiens
tggccgttacggggacctg

SEQ ID NO: 65954 - DNA, 22 bp, Homo sapiens
ctggtctgagtggggacctgag

SEQ ID NO: 65955 - DNA, 19 bp, Homo sapiens
ttggagccctggggacctg

SEQ ID NO: 65956 - DNA, 19 bp, Homo sapiens
ttgggacccaggggcctga

SEQ ID NO: 65957 - DNA, 19 bp, Homo sapiens
ttggcgcccagcaggctga

SEQ ID NO: 65958 - DNA, 19 bp, Homo sapiens
ttggtgctgaacaggacga

SEQ ID NO: 65959 - DNA, 19 bp, Homo sapiens
ctggcgtcagtggggcctg

SEQ ID NO: 65960 - DNA, 82 bp, Paramecium bursaria Chlorella virus 1
caccattgctatgaccgtgccccgggtaatcaatagtagctatattgataccattgcgtgcaaaaggtttcagcacatgctg

SEQ ID NO: 65961 - DNA, 24 bp, Paramecium bursaria Chlorella virus 1
ttgataccattgcgtgcaaaaggt

SEQ ID NO: 65962 - DNA, 18 bp, Homo sapiens
ctgataccatgtagaagg

SEQ ID NO: 65963 - DNA, 20 bp, Homo sapiens
ataccattgagtgagggggt

SEQ ID NO: 65964 - DNA, 18 bp, Homo sapiens
ttggaccactgcaaaagg

SEQ ID NO: 65965 - DNA, 19 bp, Homo sapiens
ttaatccgcgtgcggaagg

SEQ ID NO: 65966 - DNA, 24 bp, Homo sapiens
ttgttaccatcagccgcaaaaggt

SEQ ID NO: 65967 - DNA, 20 bp, Homo sapiens
ataccattgtgcaaaacagg

SEQ ID NO: 65968 - DNA, 18 bp, Homo sapiens
gataccattagttagagg

SEQ ID NO: 65969 - DNA, 25 bp, Homo sapiens
ttgatacctccctactgcaaggggt

SEQ ID NO: 65970 - DNA, 24 bp, Homo sapiens
ttaataccaatgaatgcagggggt

SEQ ID NO: 65971 - DNA, 20 bp, Homo sapiens
ttgacaccacgtggtagagg

SEQ ID NO: 65972 - DNA, 78 bp, Amsacta moorei entomopoxvirus
tgacagataataatatatttaccgtgattttaattaaacatcacatccaaagtaatattaaattcgaagatactgtta

SEQ ID NO: 65973 - DNA, 24 bp, Amsacta moorei entomopoxvirus
taatatatttaccgtgattttaat

SEQ ID NO: 65974 - DNA, 20 bp, Homo sapiens
taatattttactatgatttt

SEQ ID NO: 65975 - DNA, 82 bp, Amsacta moorei entomopoxvirus
aatatgtatattatatgctcaaactaaggtagatatggaatatttacattttaccgaagaagataatataaatatacaaatt

SEQ ID NO: 65976 - DNA, 24 bp, Amsacta moorei entomopoxvirus
tattatatgctcaaactaaggtag

SEQ ID NO: 65977 - DNA, 21 bp, Homo sapiens
tatagccctaaactaaggtag

SEQ ID NO: 65978 - DNA, 21 bp, Homo sapiens
tatatgctcaaatccctttgg

SEQ ID NO: 65979 - DNA, 20 bp, Homo sapiens
tgcaaaataaactaaggtag

SEQ ID NO: 65980 - DNA, 20 bp, Homo sapiens
tatgctatcacgtaaggtag

SEQ ID NO: 65981 - DNA, 64 bp, Human papillomavirus type 50
tgtgaattctatactgtgaatgctttagatctgagtcttgaacatttcacaaaatgaataaaca

SEQ ID NO: 65982 - DNA, 24 bp, Human papillomavirus type 50
cttgaacatttcacaaaatgaata

SEQ ID NO: 65983 - DNA, 18 bp, Homo sapiens
ttgaacatttcactaaat

SEQ ID NO: 65984 - DNA, 18 bp, Homo sapiens
ttgaacatttcctaaatg

SEQ ID NO: 65985 - DNA, 19 bp, Homo sapiens
cttgaacatttacaaaata

SEQ ID NO: 65986 - DNA, 22 bp, Homo sapiens
tgggcagcccacaaagtgaata

SEQ ID NO: 65987 - DNA, 22 bp, Homo sapiens
cttgaacatattcaactagaat

SEQ ID NO: 65988 - DNA, 19 bp, Homo sapiens
ttgacatttcacaaagaat

SEQ ID NO: 65989 - DNA, 21 bp, Homo sapiens
ttgaatttcacataatgaata

SEQ ID NO: 65990 - DNA, 17 bp, Homo sapiens
ttgaacatttaatgaat

SEQ ID NO: 65991 - DNA, 18 bp, Homo sapiens
cttgaacattctgcaaaa

SEQ ID NO: 65992 - DNA, 17 bp, Homo sapiens
acacacacaaaatgaat

SEQ ID NO: 65993 - DNA, 22 bp, Homo sapiens
tggacatttcattttatgaata

SEQ ID NO: 65994 - DNA, 23 bp, Homo sapiens
ttaaattttttacaaaatgaata

SEQ ID NO: 65995 - DNA, 18 bp, Homo sapiens
caccacacagaatgaata

SEQ ID NO: 65996 - DNA, 23 bp, Homo sapiens
cttgaacacttaccaagtgaata

SEQ ID NO: 65997 - DNA, 21 bp, Homo sapiens
tgaacattttcatcctgaata

SEQ ID NO: 65998 - DNA, 20 bp, Homo sapiens
cttgatatttcacaggaatg

SEQ ID NO: 65999 - DNA, 23 bp, Homo sapiens
cctgaactgacccaaaatgaata

SEQ ID NO: 66000 - DNA, 21 bp, Homo sapiens
tgaactgacccaaaatgaata

SEQ ID NO: 66001 - DNA, 19 bp, Homo sapiens
cttgaactattcactaatg

SEQ ID NO: 66002 - DNA, 69 bp, Human herpesvirus 5
cgcggtttcttacgcgggctgagctcgggagtagcggatgccccggggagaggagtgttagtaaccgcg

SEQ ID NO: 66003 - DNA, 24 bp, Human herpesvirus 5
ccccggggagaggagtgttagtaa

SEQ ID NO: 66004 - DNA, 20 bp, Homo sapiens
cctccgggagagggaccagt

SEQ ID NO: 66005 - DNA, 18 bp, Homo sapiens
cccccgggagagggggtg

SEQ ID NO: 66006 - DNA, 21 bp, Homo sapiens
cccatggggagggggtgcagt

SEQ ID NO: 66007 - DNA, 18 bp, Homo sapiens
ccccggagggaggaagtg

SEQ ID NO: 66008 - DNA, 19 bp, Homo sapiens
cctaggggagagggggcgt

SEQ ID NO: 66009 - DNA, 19 bp, Homo sapiens
ccccggggaaggggaagta

SEQ ID NO: 66010 - DNA, 19 bp, Homo sapiens
cccggggaggggggaagct

SEQ ID NO: 66011 - DNA, 18 bp, Homo sapiens
ccccgggggaggtgagtg

SEQ ID NO: 66012 - DNA, 18 bp, Homo sapiens
cccgggagagggtccagt

SEQ ID NO: 66013 - DNA, 19 bp, Homo sapiens
ccctgggagaggagaagct

SEQ ID NO: 66014 - DNA, 18 bp, Homo sapiens
cccagggagaggagaact

SEQ ID NO: 66015 - DNA, 19 bp, Homo sapiens
ccccaggggaggggaggct

SEQ ID NO: 66016 - DNA, 20 bp, Homo sapiens
cggggagaggggctatcagt

SEQ ID NO: 66017 - DNA, 19 bp, Homo sapiens
ccctggggagaggggccct

SEQ ID NO: 66018 - DNA, 24 bp, Homo sapiens
ccctggggagaagacaaacagtaa

SEQ ID NO: 66019 - DNA, 18 bp, Homo sapiens
cctggggagaggccagtg

SEQ ID NO: 66020 - DNA, 22 bp, Homo sapiens
ccccgggggcaggagacagagt

SEQ ID NO: 66021 - DNA, 18 bp, Homo sapiens
gggaagaggaacagagta

SEQ ID NO: 66022 - DNA, 20 bp, Homo sapiens
ccatggccaagagtgttagt

SEQ ID NO: 66023 - DNA, 21 bp, Homo sapiens
cccggggagaggggaggttaa

SEQ ID NO: 66024 - DNA, 18 bp, Homo sapiens
cccggggagagggtgcta

SEQ ID NO: 66025 - DNA, 18 bp, Homo sapiens
gggaagagggtgtgggta

SEQ ID NO: 66026 - DNA, 20 bp, Homo sapiens
cccggggaggggagggctag

SEQ ID NO: 66027 - DNA, 22 bp, Homo sapiens
ccccaggggagaggcctcagta

SEQ ID NO: 66028 - DNA, 22 bp, Homo sapiens
ccccggggggaggatgaagtgt

SEQ ID NO: 66029 - DNA, 21 bp, Homo sapiens
ccggggagaggcattcgtagt

SEQ ID NO: 66030 - DNA, 19 bp, Homo sapiens
ccctggggagaggcgtcag

SEQ ID NO: 66031 - DNA, 18 bp, Homo sapiens
ccccggggggagcccagt

SEQ ID NO: 66032 - DNA, 21 bp, Homo sapiens
cccttgggagagggccttgta

SEQ ID NO: 66033 - DNA, 19 bp, Homo sapiens
ggggagaggatgctactaa

SEQ ID NO: 66034 - DNA, 22 bp, Homo sapiens
ccttgggtgcagagtgttagta

SEQ ID NO: 66035 - DNA, 22 bp, Homo sapiens
cctggggagaggctctgatggt

SEQ ID NO: 66036 - DNA, 18 bp, Homo sapiens
ccctggggagagaggtgt

SEQ ID NO: 66037 - DNA, 18 bp, Homo sapiens
cctggggagagggaggtc

SEQ ID NO: 66038 - DNA, 19 bp, Homo sapiens
ccccgggggaaggagagcc

SEQ ID NO: 66039 - DNA, 18 bp, Homo sapiens
ccccgggggagggggtgc

SEQ ID NO: 66040 - DNA, 19 bp, Homo sapiens
ccccggggaggagggtcag

SEQ ID NO: 66041 - DNA, 18 bp, Homo sapiens
ccagggggaggagcagct

SEQ ID NO: 66042 - DNA, 18 bp, Homo sapiens
ccccgcggggaggaatgt

SEQ ID NO: 66043 - DNA, 18 bp, Homo sapiens
ccctgggaagaggaggcc

SEQ ID NO: 66044 - DNA, 18 bp, Homo sapiens
ccccgggggagggaggcc

SEQ ID NO: 66045 - DNA, 21 bp, Homo sapiens
ccccggggggcaggggctgct

SEQ ID NO: 66046 - DNA, 22 bp, Homo sapiens
cccttgggggaccaattagtaa

SEQ ID NO: 66047 - DNA, 19 bp, Homo sapiens
ccccggggagaggcgctag

SEQ ID NO: 66048 - DNA, 19 bp, Homo sapiens
ccccggggagagggagggc

SEQ ID NO: 66049 - DNA, 17 bp, Homo sapiens
cccgggagaggagccct

SEQ ID NO: 66050 - DNA, 20 bp, Homo sapiens
ccccgggagaggaaggaggt

SEQ ID NO: 66051 - DNA, 16 bp, Homo sapiens
cagggagagggccagt

SEQ ID NO: 66052 - DNA, 19 bp, Homo sapiens
ccttgggaagggcactagt

SEQ ID NO: 66053 - DNA, 26 bp, Homo sapiens
cctggggagaaggacatgcatggtaa

SEQ ID NO: 66054 - DNA, 21 bp, Homo sapiens
ggggagaggagggatgctggt

SEQ ID NO: 66055 - DNA, 21 bp, Homo sapiens
cccagggagggaaaatggtaa

SEQ ID NO: 66056 - DNA, 19 bp, Homo sapiens
ccccggggagaggaggtgt

SEQ ID NO: 66057 - DNA, 62 bp, Ovine adenovirus 7
ttcgtttttcagaaaactcaagtgttcagtcatatcaagttcacttgcctctgaaacacgaa

SEQ ID NO: 66058 - DNA, 24 bp, Ovine adenovirus 7
tttttcagaaaactcaagtgttca

SEQ ID NO: 66059 - DNA, 23 bp, Homo sapiens
ttcttcaggaaactataggttca

SEQ ID NO: 66060 - DNA, 19 bp, Homo sapiens
tttttcagaggccagcgtt

SEQ ID NO: 66061 - DNA, 27 bp, Homo sapiens
tttctcagagaagccgcagagtgttca

SEQ ID NO: 66062 - DNA, 16 bp, Homo sapiens
tttcggaaaagtgttc

SEQ ID NO: 66063 - DNA, 21 bp, Homo sapiens
tttttcagacaattcagcctt

SEQ ID NO: 66064 - DNA, 22 bp, Homo sapiens
ttttccaggaaactgcagtgtt

SEQ ID NO: 66065 - DNA, 24 bp, Homo sapiens
ttctttagatcccacgggtgttca

SEQ ID NO: 66066 - DNA, 23 bp, Homo sapiens
tttctcagaagactcaagatttc

SEQ ID NO: 66067 - DNA, 21 bp, Homo sapiens
ttttttaaaaaaaagtgttca

SEQ ID NO: 66068 - DNA, 19 bp, Homo sapiens
ttcttcagaaaactgcctt

SEQ ID NO: 66069 - DNA, 22 bp, Homo sapiens
tttttcagagtattcgtgttca

SEQ ID NO: 66070 - DNA, 18 bp, Homo sapiens
tttttcagaaacttgagc

SEQ ID NO: 66071 - DNA, 17 bp, Homo sapiens
tctttcattaagtgttc

SEQ ID NO: 66072 - DNA, 21 bp, Homo sapiens
tttttcagagcatggtcaagt

SEQ ID NO: 66073 - DNA, 16 bp, Homo sapiens
tttttcaaaagtgttc

SEQ ID NO: 66074 - DNA, 19 bp, Homo sapiens
ttttccagaaaattcagta

SEQ ID NO: 66075 - DNA, 22 bp, Homo sapiens
tttttcagaatgatggtgtgtt

SEQ ID NO: 66076 - DNA, 20 bp, Homo sapiens
ttttccagaaaattcagctc

SEQ ID NO: 66077 - DNA, 22 bp, Homo sapiens
tttttcaggaaacacaaacttt

SEQ ID NO: 66078 - DNA, 76 bp, Swinepox virus
tgtttatttagtatggtaactgtatatgacggaattaatgcttctatctcttcataaactatattatttataaata

SEQ ID NO: 66079 - DNA, 24 bp, Swinepox virus
tagtatggtaactgtatatgacgg

SEQ ID NO: 66080 - DNA, 18 bp, Homo sapiens
gtatggtaatgtgaaatg

SEQ ID NO: 66081 - DNA, 23 bp, Homo sapiens
gctgtggtaactgcagcagatgg

SEQ ID NO: 66082 - DNA, 104 bp, Swinepox virus
tatatctaatatacttggattatttctgtacaagaatttagctattcgtaaaatagttttattatcaaatctaggaatcaattcatatatatgcatacgatata

SEQ ID NO: 66083 - DNA, 24 bp, Swinepox virus
taatatacttggattatttctgta

SEQ ID NO: 66084 - DNA, 21 bp, Homo sapiens
acttggattgaagaactctgt

SEQ ID NO: 66085 - DNA, 23 bp, Homo sapiens
taatatatttgtatatctctgta

SEQ ID NO: 66086 - DNA, 18 bp, Homo sapiens
atatacaatatttctgta

SEQ ID NO: 66087 - DNA, 21 bp, Homo sapiens
atatacttagttcatttctgt

SEQ ID NO: 66088 - DNA, 23 bp, Homo sapiens
atattcttagctgtgtttctgta

SEQ ID NO: 66089 - DNA, 24 bp, Homo sapiens
taatatacgtgaaccatttttgta

SEQ ID NO: 66090 - DNA, 19 bp, Homo sapiens
taacatgtttcatttctgt

SEQ ID NO: 66091 - DNA, 20 bp, Homo sapiens
atagactgaaccatttctgt

SEQ ID NO: 66092 - DNA, 19 bp, Homo sapiens
taatatataccatttctgt

SEQ ID NO: 66093 - DNA, 76 bp, Paramecium bursaria Chlorella virus 1
actggccactcacccatgttgtattgcaaccaacgttgtttggctttctgcaccgcaatcccgtgaatggtccggt

SEQ ID NO: 66094 - DNA, 24 bp, Paramecium bursaria Chlorella virus 1
ctttctgcaccgcaatcccgtgaa

SEQ ID NO: 66095 - DNA, 20 bp, Homo sapiens
tttctgcactcggaatttga

SEQ ID NO: 66096 - DNA, 19 bp, Homo sapiens
cttctgcacattcttgtga

SEQ ID NO: 66097 - DNA, 17 bp, Homo sapiens
ctctctgcactcctgtg

SEQ ID NO: 66098 - DNA, 19 bp, Homo sapiens
tttctgcaccccagtttcc

SEQ ID NO: 66099 - DNA, 20 bp, Homo sapiens
ctttctgcaccccagtttcc

SEQ ID NO: 66100 - DNA, 20 bp, Homo sapiens
ttctgcactgtaactgtgaa

SEQ ID NO: 66101 - DNA, 18 bp, Homo sapiens
ctttctgcttgccctgtg

SEQ ID NO: 66102 - DNA, 18 bp, Homo sapiens
tttctgcattgcagatga

SEQ ID NO: 66103 - DNA, 19 bp, Homo sapiens
ttctgcactgcccaggtga

SEQ ID NO: 66104 - DNA, 18 bp, Homo sapiens
ctttctgcagctgcacgc

SEQ ID NO: 66105 - DNA, 21 bp, Homo sapiens
ttctgcactgtcagtcttgtg

SEQ ID NO: 66106 - DNA, 18 bp, Homo sapiens
ctttctgcaatatcgtga

SEQ ID NO: 66107 - DNA, 20 bp, Homo sapiens
tttctgcacgtgattccatg

SEQ ID NO: 66108 - DNA, 70 bp, Equine herpesvirus 2
gattctcatgtatgtgttttgtaacctgacattaaaaagtctgtttataaaatacctgcatgttgcaatc

SEQ ID NO: 66109 - DNA, 23 bp, Equine herpesvirus 2
taaaatacctgcatgttgcaatc

SEQ ID NO: 66110 - DNA, 17 bp, Homo sapiens
atacctaggattgcaat

SEQ ID NO: 66111 - DNA, 17 bp, Homo sapiens
taaaatacctggccaca

SEQ ID NO: 66112 - DNA, 18 bp, Homo sapiens
taaaacatccacattgca

SEQ ID NO: 66113 - DNA, 18 bp, Homo sapiens
taaaatacctatatagca

SEQ ID NO: 66114 - DNA, 19 bp, Homo sapiens
taaaatacctgcatttaac

SEQ ID NO: 66115 - DNA, 19 bp, Homo sapiens
caaaatacctgtgtgtgca

SEQ ID NO: 66116 - DNA, 18 bp, Homo sapiens
taaaatacctgcaatgtt

SEQ ID NO: 66117 - DNA, 23 bp, Homo sapiens
aaatacttgcacgccatgcaatc

SEQ ID NO: 66118 - DNA, 19 bp, Homo sapiens
taaaatacctatattagca

SEQ ID NO: 66119 - DNA, 20 bp, Homo sapiens
taaaatactgctaccctgca

SEQ ID NO: 66120 - DNA, 23 bp, Homo sapiens
taaaataccttgtcaaatcaatc

SEQ ID NO: 66121 - DNA, 17 bp, Homo sapiens
taaaatgccgcatgtgc

SEQ ID NO: 66122 - DNA, 18 bp, Homo sapiens
taaaatacttggcatgtt

SEQ ID NO: 66123 - DNA, 19 bp, Homo sapiens
taaaatacctgagtacaca

SEQ ID NO: 66124 - DNA, 18 bp, Homo sapiens
aatacctgcagtgaaatc

SEQ ID NO: 66125 - DNA, 18 bp, Homo sapiens
taaaatacctgttccgtc

SEQ ID NO: 66126 - DNA, 62 bp, Fowlpox virus
taatatatgtataatcttataggttaaaataacactaactatcagatttatcattaatatta

SEQ ID NO: 66127 - DNA, 22 bp, Fowlpox virus
atcagatttatcattaatatta

SEQ ID NO: 66128 - DNA, 19 bp, Homo sapiens
atcagaatcactaatatta

SEQ ID NO: 66129 - DNA, 25 bp, Homo sapiens
atcagatttatcttttgaaaatatt

SEQ ID NO: 66130 - DNA, 18 bp, Homo sapiens
agatttatcaacaatatt

SEQ ID NO: 66131 - DNA, 22 bp, Homo sapiens
atcagattcacctcgaatatta

SEQ ID NO: 66132 - DNA, 19 bp, Homo sapiens
atcagatttatcttgatac

SEQ ID NO: 66133 - DNA, 19 bp, Homo sapiens
cagatttacacaaatatta

SEQ ID NO: 66134 - DNA, 21 bp, Homo sapiens
agatttatcaataaaatatta

SEQ ID NO: 66135 - DNA, 19 bp, Homo sapiens
tcaaatttatcagaacatt

SEQ ID NO: 66136 - DNA, 87 bp, Arctic ground squirrel hepatitis B virus
aaataattatcctgatttctctatagaacacttttttgcagctgcaacttatttatggactttgtgggaatcaggaatcttgtattt

SEQ ID NO: 66137 - DNA, 24 bp, Arctic ground squirrel hepatitis B virus
tctatagaacacttttttgcagct

SEQ ID NO: 66138 - DNA, 17 bp, Homo sapiens
tctatagatacttttgc

SEQ ID NO: 66139 - DNA, 18 bp, Homo sapiens
agaatacttttctcagct

SEQ ID NO: 66140 - DNA, 21 bp, Homo sapiens
tatagaacattccccctggct

SEQ ID NO: 66141 - DNA, 22 bp, Homo sapiens
tctatagacactggaaatggct

SEQ ID NO: 66142 - DNA, 19 bp, Homo sapiens
agaactcgcttttgcagct

SEQ ID NO: 66143 - DNA, 19 bp, Homo sapiens
tctatagaatacatttttc

SEQ ID NO: 66144 - DNA, 18 bp, Homo sapiens
tctatagaacagttttac

SEQ ID NO: 66145 - DNA, 20 bp, Homo sapiens
tatagaacatctttttaaag

SEQ ID NO: 66146 - DNA, 16 bp, Homo sapiens
tatagaacactaacag

SEQ ID NO: 66147 - DNA, 23 bp, Homo sapiens
tctatagaaagtttcatctagct

SEQ ID NO: 66148 - DNA, 20 bp, Homo sapiens
ctgtagaacaccaagcagct

SEQ ID NO: 66149 - DNA, 18 bp, Homo sapiens
tctttagagcactgcagc

SEQ ID NO: 66150 - DNA, 19 bp, Homo sapiens
tctattgaatatttttgca

SEQ ID NO: 66151 - DNA, 22 bp, Homo sapiens
tctgctagctctttttgcagct

SEQ ID NO: 66152 - DNA, 19 bp, Homo sapiens
tctaaggagcactttctgc

SEQ ID NO: 66153 - DNA, 18 bp, Homo sapiens
tctatagtgcactgcagc

SEQ ID NO: 66154 - DNA, 17 bp, Homo sapiens
taaaatatttttgcagc

SEQ ID NO: 66155 - DNA, 17 bp, Homo sapiens
tctatggaaccttttct

SEQ ID NO: 66156 - DNA, 23 bp, Homo sapiens
cctatagaacataaactgcagct

SEQ ID NO: 66157 - DNA, 18 bp, Homo sapiens
tatagaatacttgcagct

SEQ ID NO: 66158 - DNA, 18 bp, Homo sapiens
tctataaacattttttac

SEQ ID NO: 66159 - DNA, 19 bp, Homo sapiens
tatggaacgcttttccaca

SEQ ID NO: 66160 - DNA, 98 bp, Gallid herpesvirus 2
gcattagataactgcagaaagacgctgcgtatagttatgtattcttagaatacgtctgtatatacgcacgaacatataagtctgtaagaatgtaatgc

SEQ ID NO: 66161 - DNA, 24 bp, Gallid herpesvirus 2
acgctgcgtatagttatgtattct

SEQ ID NO: 66162 - DNA, 17 bp, Homo sapiens
gctgcgtgtacatattc

SEQ ID NO: 66163 - DNA, 18 bp, Homo sapiens
tgcgttgtttatgtattc

SEQ ID NO: 66164 - DNA, 18 bp, Homo sapiens
tgcgtttccatgtattct

SEQ ID NO: 66165 - DNA, 17 bp, Homo sapiens
cactgaagttatgtatt

SEQ ID NO: 66166 - DNA, 23 bp, Homo sapiens
gctgtgttacagctatgtgttct

SEQ ID NO: 66167 - DNA, 19 bp, Homo sapiens
acgctgcgttatggttcgc

SEQ ID NO: 66168 - DNA, 22 bp, Homo sapiens
acgctgtgtatgtactgtttct

SEQ ID NO: 66169 - DNA, 128 bp, Gallid herpesvirus 2
cttacccttccccaactttctctgtcggtcgtggtatattgaggccggtgtatgtagagagtctacgatcttcgatctcccttcggatcacatggagcggagatgttgtagggttcgagaggggtgag

SEQ ID NO: 66170 - DNA, 24 bp, Gallid herpesvirus 2
tgaggccggtgtatgtagagagtc

SEQ ID NO: 66171 - DNA, 22 bp, Homo sapiens
tgaggcaggtgcattagagagt

SEQ ID NO: 66172 - DNA, 20 bp, Homo sapiens
gaggctgggcttggggagtc

SEQ ID NO: 66173 - DNA, 21 bp, Homo sapiens
aggcaaatgtatgtggagggt

SEQ ID NO: 66174 - DNA, 22 bp, Homo sapiens
tgagttatcattgtagagagtc

SEQ ID NO: 66175 - DNA, 22 bp, Homo sapiens
gaggttgaggcagtagagagtc

SEQ ID NO: 66176 - DNA, 24 bp, Homo sapiens
tggggccagtgaggtaggagagtc

SEQ ID NO: 66177 - DNA, 19 bp, Homo sapiens
tggggcggtggaggggagt

SEQ ID NO: 66178 - DNA, 21 bp, Homo sapiens
tggggctggtccaggagggtc

SEQ ID NO: 66179 - DNA, 18 bp, Homo sapiens
tgaggccgtgtgtgtcgt

SEQ ID NO: 66180 - DNA, 20 bp, Homo sapiens
tggggccgctgtgtgtggag

SEQ ID NO: 66181 - DNA, 64 bp, Human papillomavirus type 54
gcctggagtgtgcattgcaatacaaagcccgggaaatgggatacaaagtgttacagcaccaggc

SEQ ID NO: 66182 - DNA, 23 bp, Human papillomavirus type 54
tacaaagtgttacagcaccaggc

SEQ ID NO: 66183 - DNA, 21 bp, Homo sapiens
tacaaaatgtgcagtaccagg

SEQ ID NO: 66184 - DNA, 21 bp, Homo sapiens
tacaggtgcctgccaccaggc

SEQ ID NO: 66185 - DNA, 18 bp, Homo sapiens
aagagcaccagcaccagg

SEQ ID NO: 66186 - DNA, 20 bp, Homo sapiens
cacagcacagcagtgccagg

SEQ ID NO: 66187 - DNA, 21 bp, Homo sapiens
tacaggcgtgagccaccaggc

SEQ ID NO: 66188 - DNA, 21 bp, Homo sapiens
acaaagtgccacatgccaggc

SEQ ID NO: 66189 - DNA, 20 bp, Homo sapiens
tgaaaatatccagcaccagg

SEQ ID NO: 66190 - DNA, 18 bp, Homo sapiens
gtgcactcagcaccaggc

SEQ ID NO: 66191 - DNA, 21 bp, Homo sapiens
tacaggtgtgagccaccaggc

SEQ ID NO: 66192 - DNA, 20 bp, Homo sapiens
cacaattagcagcaccaggc

SEQ ID NO: 66193 - DNA, 20 bp, Homo sapiens
tacgaaatgttatacacagg

SEQ ID NO: 66194 - DNA, 19 bp, Homo sapiens
gcatcacacagcattaggc

SEQ ID NO: 66195 - DNA, 20 bp, Homo sapiens
tgaaatgacctagcaccagg

SEQ ID NO: 66196 - DNA, 19 bp, Homo sapiens
aaaacacccagcactgggc

SEQ ID NO: 66197 - DNA, 21 bp, Homo sapiens
tacagtgttacagtgtcaggc

SEQ ID NO: 66198 - DNA, 22 bp, Homo sapiens
cacagcagcagcagcaccaggc

SEQ ID NO: 66199 - DNA, 18 bp, Homo sapiens
tacaaggtgtgacagcac

SEQ ID NO: 66200 - DNA, 17 bp, Homo sapiens
acaaagtgcttactagg

SEQ ID NO: 66201 - DNA, 20 bp, Homo sapiens
cacaaagttgggcatcaggc

SEQ ID NO: 66202 - DNA, 23 bp, Homo sapiens
tacagggctggaccccaccaggc

SEQ ID NO: 66203 - DNA, 20 bp, Homo sapiens
caaggtgtcagtcaccaggc

SEQ ID NO: 66204 - DNA, 19 bp, Homo sapiens
aatggagcaacaccagtgc

SEQ ID NO: 66205 - DNA, 15 bp, Homo sapiens
caaagcagcaccagg

SEQ ID NO: 66206 - DNA, 20 bp, Homo sapiens
tacaaatgttaagcacaggc

SEQ ID NO: 66207 - DNA, 16 bp, Homo sapiens
aagtggttacacaggc

SEQ ID NO: 66208 - DNA, 21 bp, Homo sapiens
cagatttccacagcaccgggc

SEQ ID NO: 66209 - DNA, 21 bp, Homo sapiens
tacaggcgtgcgccaccaggc

SEQ ID NO: 66210 - DNA, 18 bp, Homo sapiens
caggatgtggcaccaggc

SEQ ID NO: 66211 - DNA, 20 bp, Homo sapiens
tacaaatggccccaccaggc

SEQ ID NO: 66212 - DNA, 21 bp, Homo sapiens
cacaggtgggctggcaccagg

SEQ ID NO: 66213 - DNA, 20 bp, Homo sapiens
acaacagtggcagcaccagg

SEQ ID NO: 66214 - DNA, 22 bp, Homo sapiens
cacagagtgggctgcaccaggc

SEQ ID NO: 66215 - DNA, 20 bp, Homo sapiens
taaaagtaaaggcaccaggc

SEQ ID NO: 66216 - DNA, 20 bp, Homo sapiens
atattctgacagcaccaggc

SEQ ID NO: 66217 - DNA, 23 bp, Homo sapiens
acggagtgttacaagcctcaggc

SEQ ID NO: 66218 - DNA, 20 bp, Homo sapiens
acaaagtgtttactttaggc

SEQ ID NO: 66219 - DNA, 17 bp, Homo sapiens
caaagtgtgaggccagg

SEQ ID NO: 66220 - DNA, 18 bp, Homo sapiens
aggttcccagcaccaggc

SEQ ID NO: 66221 - DNA, 23 bp, Homo sapiens
caaagtgtggcagtcactacagg

SEQ ID NO: 66222 - DNA, 19 bp, Homo sapiens
aaagtgttacgccggaggc

SEQ ID NO: 66223 - DNA, 21 bp, Homo sapiens
cacaacactacagcaccaggc

SEQ ID NO: 66224 - DNA, 21 bp, Homo sapiens
tacaaaatattggcactaggc

SEQ ID NO: 66225 - DNA, 20 bp, Homo sapiens
cacacacatacagcaccagg

SEQ ID NO: 66226 - DNA, 20 bp, Homo sapiens
tacaaagtgtgtgcagtgac

SEQ ID NO: 66227 - DNA, 23 bp, Homo sapiens
tacagtatgtttacagtatcagg

SEQ ID NO: 66228 - DNA, 18 bp, Homo sapiens
aaagtgttttccacaggc

SEQ ID NO: 66229 - DNA, 17 bp, Homo sapiens
caagacgcagcaccagg

SEQ ID NO: 66230 - DNA, 17 bp, Homo sapiens
tacaaagtattttcagg

SEQ ID NO: 66231 - DNA, 21 bp, Homo sapiens
tacaggtgcataccaccaggc

SEQ ID NO: 66232 - DNA, 21 bp, Homo sapiens
tgaagccaatacagcactggg

SEQ ID NO: 66233 - DNA, 18 bp, Homo sapiens
tacaaagcggacactggg

SEQ ID NO: 66234 - DNA, 17 bp, Homo sapiens
tacaaagtgttgggcac

SEQ ID NO: 66235 - DNA, 18 bp, Homo sapiens
agtgtggacggcaccagg

SEQ ID NO: 66236 - DNA, 17 bp, Homo sapiens
tacaaagtgtgcaccgg

SEQ ID NO: 66237 - DNA, 22 bp, Homo sapiens
tacaaagtggtcatcactaggc

SEQ ID NO: 66238 - DNA, 20 bp, Homo sapiens
caaagtgcttgagtgccagg

SEQ ID NO: 66239 - DNA, 19 bp, Homo sapiens
agcggagcacagcgccagg

SEQ ID NO: 66240 - DNA, 18 bp, Homo sapiens
acaaaaatggcaccaggc

SEQ ID NO: 66241 - DNA, 21 bp, Homo sapiens
cagggtgctctgggcaccagg

SEQ ID NO: 66242 - DNA, 16 bp, Homo sapiens
aaagtatagcaccagg

SEQ ID NO: 66243 - DNA, 127 bp, Indian citrus ringspot virus
ggtcgtctttgctccgcgtcaatttctgaacgcttggctctactccgcgagggaccgattaggtcattgaccgaaaatcccatcaacgctagagctgcgcacttcttggcgcacgagctcctcgacc

SEQ ID NO: 66244 - DNA, 24 bp, Indian citrus ringspot virus
gagctgcgcacttcttggcgcacg

SEQ ID NO: 66245 - DNA, 22 bp, Homo sapiens
gagctgccggcggaggcgcacg

SEQ ID NO: 66246 - DNA, 23 bp, Homo sapiens
gagctgtcaccacagggcgcacg

SEQ ID NO: 66247 - DNA, 20 bp, Homo sapiens
gagctgtggcttcttgggca

SEQ ID NO: 66248 - DNA, 24 bp, Homo sapiens
gagctgcagtggcggcggcgcgcg

SEQ ID NO: 66249 - DNA, 21 bp, Homo sapiens
gagctgcgcagcttggggcgc

SEQ ID NO: 66250 - DNA, 24 bp, Homo sapiens
gagctgcgcgatctgctgcgcgcg

SEQ ID NO: 66251 - DNA, 23 bp, Homo sapiens
gagctgcgcctttgggctggcgc

SEQ ID NO: 66252 - DNA, 15 bp, Homo sapiens
ggctgcgctggcgca

SEQ ID NO: 66253 - DNA, 26 bp, Homo sapiens
gagccgcgtgcgatgcctggtgcgcg

SEQ ID NO: 66254 - DNA, 21 bp, Homo sapiens
gctgcacagcacagttggcgc

SEQ ID NO: 66255 - DNA, 19 bp, Homo sapiens
gctgtgcacttctctgacg

SEQ ID NO: 66256 - DNA, 18 bp, Homo sapiens
gagctgtgcacttctgca

SEQ ID NO: 66257 - DNA, 68 bp, Indian citrus ringspot virus
gtagtcggtacttaggctcaagccgttccgccgtcaaaaggcgggctgccaggctcaattactgctac

SEQ ID NO: 66258 - DNA, 22 bp, Indian citrus ringspot virus
tgccaggctcaattactgctac

SEQ ID NO: 66259 - DNA, 17 bp, Homo sapiens
tgccaggcctaacactg

SEQ ID NO: 66260 - DNA, 25 bp, Homo sapiens
tgccaggcacgttactagctgctac

SEQ ID NO: 66261 - DNA, 19 bp, Homo sapiens
ccaggctcaacagccctgc

SEQ ID NO: 66262 - DNA, 17 bp, Homo sapiens
ccaacccaattgctgct

SEQ ID NO: 66263 - DNA, 19 bp, Homo sapiens
tgccaggccaggcagttac

SEQ ID NO: 66264 - DNA, 17 bp, Homo sapiens
tgcaggctcagcactac

SEQ ID NO: 66265 - DNA, 20 bp, Homo sapiens
tgccaggctcacagtaacta

SEQ ID NO: 66266 - DNA, 17 bp, Homo sapiens
tgcagttattactgcta

SEQ ID NO: 66267 - DNA, 20 bp, Homo sapiens
gccaggctattcacactgct

SEQ ID NO: 66268 - DNA, 19 bp, Homo sapiens
tgccagactcatgagctac

SEQ ID NO: 66269 - DNA, 19 bp, Homo sapiens
tgtgaggctcaatttttgc

SEQ ID NO: 66270 - DNA, 17 bp, Homo sapiens
tgccggccgtcactgct

SEQ ID NO: 66271 - DNA, 20 bp, Homo sapiens
tgccaggcctggtcacctct

SEQ ID NO: 66272 - DNA, 19 bp, Homo sapiens
tgcaggcttggaccgctac

SEQ ID NO: 66273 - DNA, 17 bp, Homo sapiens
tgccacaaattactgct

SEQ ID NO: 66274 - DNA, 17 bp, Homo sapiens
tgacaggctcaagctgc

SEQ ID NO: 66275 - DNA, 17 bp, Homo sapiens
tgccaggcttaatctgc

SEQ ID NO: 66276 - DNA, 20 bp, Homo sapiens
gctgggggccctactgctac

SEQ ID NO: 66277 - DNA, 18 bp, Homo sapiens
tgccaggctgcagttcac

SEQ ID NO: 66278 - DNA, 20 bp, Homo sapiens
gcaaactcagttgttgctac

SEQ ID NO: 66279 - DNA, 17 bp, Homo sapiens
gccaggctcaaggctgc

SEQ ID NO: 66280 - DNA, 17 bp, Homo sapiens
tgccaggcacaagctgc

SEQ ID NO: 66281 - DNA, 20 bp, Homo sapiens
tgccaggcctaaggccactg

SEQ ID NO: 66282 - DNA, 21 bp, Homo sapiens
tgcaggctcagcgcacactgc

SEQ ID NO: 66283 - DNA, 19 bp, Homo sapiens
tgccaagcttgatctctgc

SEQ ID NO: 66284 - DNA, 18 bp, Homo sapiens
tgccaggcccggctctgc

SEQ ID NO: 66285 - DNA, 17 bp, Homo sapiens
tgccaggctccgactgc

SEQ ID NO: 66286 - DNA, 20 bp, Homo sapiens
tgccaggcattcaccatgct

SEQ ID NO: 66287 - DNA, 17 bp, Homo sapiens
tgccaggctgtagcgcc

SEQ ID NO: 66288 - DNA, 19 bp, Homo sapiens
tgccaaggctcagctctgc

SEQ ID NO: 66289 - DNA, 19 bp, Homo sapiens
tgcaggctcaaggtcctgc

SEQ ID NO: 66290 - DNA, 20 bp, Homo sapiens
tgccagactctgcccctgct

SEQ ID NO: 66291 - DNA, 16 bp, Homo sapiens
tgtcaggcccactgct

SEQ ID NO: 66292 - DNA, 18 bp, Homo sapiens
cctattcattactgctac

SEQ ID NO: 66293 - DNA, 21 bp, Homo sapiens
tgtcagactcaaaagaactac

SEQ ID NO: 66294 - DNA, 17 bp, Homo sapiens
tgccagctcaatgcctg

SEQ ID NO: 66295 - DNA, 19 bp, Homo sapiens
tgcttggatctactgctac

SEQ ID NO: 66296 - DNA, 18 bp, Homo sapiens
tgccaccattattgctac

SEQ ID NO: 66297 - DNA, 17 bp, Homo sapiens
tgccaggcccagctctg

SEQ ID NO: 66298 - DNA, 18 bp, Homo sapiens
tgccaggctaattttctg

SEQ ID NO: 66299 - DNA, 22 bp, Homo sapiens
tgccaggctaaagctaaagcta

SEQ ID NO: 66300 - DNA, 23 bp, Homo sapiens
gctaggctcaaagacgcctgcta

SEQ ID NO: 66301 - DNA, 22 bp, Homo sapiens
gccaggctcccagctctgttac

SEQ ID NO: 66302 - DNA, 17 bp, Homo sapiens
tgccagctcaactctgc

SEQ ID NO: 66303 - DNA, 19 bp, Homo sapiens
tgtcaggctgacttagcta

SEQ ID NO: 66304 - DNA, 17 bp, Homo sapiens
gccaggctcagaactgc

SEQ ID NO: 66305 - DNA, 19 bp, Homo sapiens
caggctcagaacttctgct

SEQ ID NO: 66306 - DNA, 19 bp, Homo sapiens
tgccacccacattattgct

SEQ ID NO: 66307 - DNA, 22 bp, Homo sapiens
tgcttcagagagttactgctac

SEQ ID NO: 66308 - DNA, 19 bp, Homo sapiens
tgccggcttcctcactgct

SEQ ID NO: 66309 - DNA, 20 bp, Homo sapiens
tgcggggctcaactccctac

SEQ ID NO: 66310 - DNA, 16 bp, Homo sapiens
gccagctttgctgcta

SEQ ID NO: 66311 - DNA, 17 bp, Homo sapiens
tgctggactccaccgcc

SEQ ID NO: 66312 - DNA, 16 bp, Homo sapiens
tgctggctcaacactg

SEQ ID NO: 66313 - DNA, 22 bp, Homo sapiens
gctgggagctgattactgctac

SEQ ID NO: 66314 - DNA, 19 bp, Homo sapiens
tgccaggctcactgactgc

SEQ ID NO: 66315 - DNA, 20 bp, Homo sapiens
gctaggctcagtccttctgc

SEQ ID NO: 66316 - DNA, 23 bp, Homo sapiens
tgtcaggctcagctctaagtgct

SEQ ID NO: 66317 - DNA, 107 bp, Variola virus
gatttattgtgtatggaagaagtaaccatattacataatatatacaggctatttacaagatgcgccgtaccgttcgatgatatagtacgtactatgccaaatgaatc

SEQ ID NO: 66318 - DNA, 24 bp, Variola virus
tgtatggaagaagtaaccatatta

SEQ ID NO: 66319 - DNA, 19 bp, Homo sapiens
tgtatggatggaccatatt

SEQ ID NO: 66320 - DNA, 19 bp, Homo sapiens
tgtgggaagaggtaactca

SEQ ID NO: 66321 - DNA, 17 bp, Homo sapiens
tgtaggaagaagtggcc

SEQ ID NO: 66322 - DNA, 18 bp, Homo sapiens
tgtatggagaaggtaacc

SEQ ID NO: 66323 - DNA, 23 bp, Homo sapiens
tgtatggagaagtatatatatta

SEQ ID NO: 66324 - DNA, 21 bp, Homo sapiens
tggatgggagaagtaaaccac

SEQ ID NO: 66325 - DNA, 22 bp, Homo sapiens
tgtaggaaatttggccatatta

SEQ ID NO: 66326 - DNA, 26 bp, Homo sapiens
tgtgtggaaaaaggagaagccatatt

SEQ ID NO: 66327 - DNA, 62 bp, Paramecium bursaria Chlorella virus 1
cgtaggagatcttggcaatattctggcggataagaacggaaaagccaagtattcgttctatg

SEQ ID NO: 66328 - DNA, 24 bp, Paramecium bursaria Chlorella virus 1
taggagatcttggcaatattctgg

SEQ ID NO: 66329 - DNA, 20 bp, Homo sapiens
ggagatctggtggctcctgg

SEQ ID NO: 66330 - DNA, 20 bp, Homo sapiens
ggagtcttgggccactctgg

SEQ ID NO: 66331 - DNA, 22 bp, Homo sapiens
ggcagatcttggcttcttctgg

SEQ ID NO: 66332 - DNA, 21 bp, Homo sapiens
tagaagataggggtgttctgg

SEQ ID NO: 66333 - DNA, 19 bp, Homo sapiens
ggagatttgcttattctgg

SEQ ID NO: 66334 - DNA, 22 bp, Homo sapiens
agagacataagcaatattttgg

SEQ ID NO: 66335 - DNA, 24 bp, Homo sapiens
ggagacctaccacaaatgttttgg

SEQ ID NO: 66336 - DNA, 17 bp, Homo sapiens
ggcagatcttggatctg

SEQ ID NO: 66337 - DNA, 21 bp, Homo sapiens
gggcatcttggccctctctgg

SEQ ID NO: 66338 - DNA, 23 bp, Homo sapiens
taggggatcctggcggagtctgg

SEQ ID NO: 66339 - DNA, 19 bp, Homo sapiens
taggagatcttgatgaccg

SEQ ID NO: 66340 - DNA, 73 bp, Paramecium bursaria Chlorella virus 1
ctgatacggatgatcttggtttaggtggcaacgctgaaagtttgaaaaccgggaacgcaggaaaacgaatcgg

SEQ ID NO: 66341 - DNA, 24 bp, Paramecium bursaria Chlorella virus 1
tgaaaaccgggaacgcaggaaaac

SEQ ID NO: 66342 - DNA, 18 bp, Homo sapiens
tgagaaccaggaagcagg

SEQ ID NO: 66343 - DNA, 18 bp, Homo sapiens
tgaaaaccggcacgaaaa

SEQ ID NO: 66344 - DNA, 20 bp, Homo sapiens
tgaaattggcaccaggaaaa

SEQ ID NO: 66345 - DNA, 18 bp, Homo sapiens
gaaagcgggaacagcagg

SEQ ID NO: 66346 - DNA, 20 bp, Homo sapiens
tgaaaacccggaggggagga

SEQ ID NO: 66347 - DNA, 16 bp, Homo sapiens
gaaaactgggagcaga

SEQ ID NO: 66348 - DNA, 21 bp, Homo sapiens
tgaaggcaggccacacaggaa

SEQ ID NO: 66349 - DNA, 23 bp, Homo sapiens
gaaaacagcaaatgcaggaaaac

SEQ ID NO: 66350 - DNA, 23 bp, Homo sapiens
tgaaaactggggaggcaagaaaa

SEQ ID NO: 66351 - DNA, 20 bp, Homo sapiens
tggaaacttggaacacacaa

SEQ ID NO: 66352 - DNA, 19 bp, Homo sapiens
aaccgggagcggcttcaac

SEQ ID NO: 66353 - DNA, 18 bp, Homo sapiens
tgaaaaccagggaccaaa

SEQ ID NO: 66354 - DNA, 22 bp, Homo sapiens
tgaaaccgggaagcggccggga

SEQ ID NO: 66355 - DNA, 24 bp, Homo sapiens
taaaaatttgatttgcaggaaaac

SEQ ID NO: 66356 - DNA, 20 bp, Homo sapiens
tgaaaacctggagaacaaga

SEQ ID NO: 66357 - DNA, 24 bp, Homo sapiens
tgggaaccgagagtgcaaaaggaa

SEQ ID NO: 66358 - DNA, 23 bp, Homo sapiens
tgagaactggaatgcaggaaaac

SEQ ID NO: 66359 - DNA, 19 bp, Homo sapiens
tgaaaaccaggagtgcaaa

SEQ ID NO: 66360 - DNA, 22 bp, Homo sapiens
tggaaaccagggctgacaggaa

SEQ ID NO: 66361 - DNA, 21 bp, Homo sapiens
aaagcagaaaatgcaggaaaa

SEQ ID NO: 66362 - DNA, 20 bp, Homo sapiens
tgaaagtgggaacacttaaa

SEQ ID NO: 66363 - DNA, 23 bp, Homo sapiens
gaaaagatacaatgcaggaaaac

SEQ ID NO: 66364 - DNA, 16 bp, Homo sapiens
ccgggaaaaaaaaaac

SEQ ID NO: 66365 - DNA, 16 bp, Homo sapiens
aaaactgggaaggaaa

SEQ ID NO: 66366 - DNA, 21 bp, Homo sapiens
gaattgggggaaaaggaaaac

SEQ ID NO: 66367 - DNA, 17 bp, Homo sapiens
gaaaactgggggcaaaa

SEQ ID NO: 66368 - DNA, 18 bp, Homo sapiens
tggaaaccaggggacaga

SEQ ID NO: 66369 - DNA, 18 bp, Homo sapiens
tgaaagccaggcaggaaa

SEQ ID NO: 66370 - DNA, 17 bp, Homo sapiens
tggaaaccagggaagga

SEQ ID NO: 66371 - DNA, 18 bp, Homo sapiens
tgaaaaatgagcaggaaa

SEQ ID NO: 66372 - DNA, 16 bp, Homo sapiens
ccgaaaccaggaaaac

SEQ ID NO: 66373 - DNA, 21 bp, Homo sapiens
gaaagccaacagcagggaaac

SEQ ID NO: 66374 - DNA, 17 bp, Homo sapiens
aaaccgggagtcgggaa

SEQ ID NO: 66375 - DNA, 18 bp, Homo sapiens
tgaaggccgggatgcaga

SEQ ID NO: 66376 - DNA, 21 bp, Homo sapiens
tgaggaccaggaatggctcgg

SEQ ID NO: 66377 - DNA, 17 bp, Homo sapiens
tgaaaccgggaggcaga

SEQ ID NO: 66378 - DNA, 18 bp, Homo sapiens
aaccgggaacaacatagg

SEQ ID NO: 66379 - DNA, 19 bp, Homo sapiens
tgggaaccgagagccagga

SEQ ID NO: 66380 - DNA, 21 bp, Homo sapiens
aaagcggaaaatgcaggaaaa

SEQ ID NO: 66381 - DNA, 21 bp, Homo sapiens
tgaaatctgggaggtgcaaaa

SEQ ID NO: 66382 - DNA, 19 bp, Homo sapiens
gagccccaagcaggaaaac

SEQ ID NO: 66383 - DNA, 71 bp, Fowlpox virus
cgtagtggactttcgctttgaagagttaatgttaatatatttactccatagattcgatataatttattacg

SEQ ID NO: 66384 - DNA, 24 bp, Fowlpox virus
ttactccatagattcgatataatt

SEQ ID NO: 66385 - DNA, 19 bp, Homo sapiens
tccataaaatgatataatt

SEQ ID NO: 66386 - DNA, 17 bp, Homo sapiens
ttacttcatgattcaat

SEQ ID NO: 66387 - DNA, 86 bp, Fowlpox virus
cactaaaaagacatatagtagtaggttacctattatccttaaggctcatcatgtatgacctacgtttattataatctcgccgagtg

SEQ ID NO: 66388 - DNA, 24 bp, Fowlpox virus
tatgacctacgtttattataatct

SEQ ID NO: 66389 - DNA, 19 bp, Homo sapiens
acctatgtttactaacaat

SEQ ID NO: 66390 - DNA, 18 bp, Homo sapiens
tatgaccttgtttattat

SEQ ID NO: 66391 - DNA, 19 bp, Homo sapiens
atgaccttcccattataat

SEQ ID NO: 66392 - DNA, 16 bp, Homo sapiens
gacctgctttataatc

SEQ ID NO: 66393 - DNA, 21 bp, Homo sapiens
tatgacctgtgcttagccata

SEQ ID NO: 66394 - DNA, 20 bp, Homo sapiens
atgacaatttattataatct

SEQ ID NO: 66395 - DNA, 69 bp, Fowlpox virus
gaagctaaagaattaagaaaacagtatcgcgatacgcaagaactattaccattttaatcggagagcttt

SEQ ID NO: 66396 - DNA, 24 bp, Fowlpox virus
aagaattaagaaaacagtatcgcg

SEQ ID NO: 66397 - DNA, 20 bp, Homo sapiens
gaattaaggggccagtccac

SEQ ID NO: 66398 - DNA, 20 bp, Homo sapiens
aggcattaagaaaacaccat

SEQ ID NO: 66399 - DNA, 22 bp, Homo sapiens
aaaaattaagaaatccagatcg

SEQ ID NO: 66400 - DNA, 20 bp, Homo sapiens
aagagtaagaaaacagtccc

SEQ ID NO: 66401 - DNA, 18 bp, Homo sapiens
aagaatcaagaagatagt

SEQ ID NO: 66402 - DNA, 17 bp, Homo sapiens
aagaattaagacagcat

SEQ ID NO: 66403 - DNA, 18 bp, Homo sapiens
aaggatgaagaaaacagt

SEQ ID NO: 66404 - DNA, 19 bp, Homo sapiens
aagaattaagaacaacaat

SEQ ID NO: 66405 - DNA, 70 bp, Amsacta moorei entomopoxvirus
ttttttttaatatagaatataacattttaaataatatattattaatatttatatattttttcaaaaaaaa

SEQ ID NO: 66406 - DNA, 24 bp, Amsacta moorei entomopoxvirus
tagaatataacattttaaataata

SEQ ID NO: 66407 - DNA, 20 bp, Homo sapiens
tagaaataacattttaccca

SEQ ID NO: 66408 - DNA, 23 bp, Homo sapiens
tagaatataatcatttacaaata

SEQ ID NO: 66409 - DNA, 19 bp, Homo sapiens
aaatgtaacattctaaata

SEQ ID NO: 66410 - DNA, 23 bp, Homo sapiens
tagaaaataacattttaaaaaat

SEQ ID NO: 66411 - DNA, 61 bp, Myxoma virus
gggaatgtgtttaaccttatctatcttaataaaagaagtgctacctagtaaacatttttcc

SEQ ID NO: 66412 - DNA, 20 bp, Myxoma virus
tacctagtaaacatttttcc

SEQ ID NO: 66413 - DNA, 18 bp, Homo sapiens
taccttgtgaacatttct

SEQ ID NO: 66414 - DNA, 19 bp, Homo sapiens
ctgagacaaacatttttcc

SEQ ID NO: 66415 - DNA, 19 bp, Homo sapiens
tacctagcaagtacccttc

SEQ ID NO: 66416 - DNA, 18 bp, Homo sapiens
tacccagtaggcatgtcc

SEQ ID NO: 66417 - DNA, 16 bp, Homo sapiens
ccttagtcatttttcc

SEQ ID NO: 66418 - DNA, 18 bp, Homo sapiens
tacccagtaaggtcatct

SEQ ID NO: 66419 - DNA, 19 bp, Homo sapiens
acctagtaaaattattttc

SEQ ID NO: 66420 - DNA, 18 bp, Homo sapiens
ctagtaaaggccttttcc

SEQ ID NO: 66421 - DNA, 18 bp, Homo sapiens
tacctaggaacaccctcc

SEQ ID NO: 66422 - DNA, 17 bp, Homo sapiens
cctggtagcatccttcc

SEQ ID NO: 66423 - DNA, 19 bp, Homo sapiens
cccattccaacatttttcc

SEQ ID NO: 66424 - DNA, 20 bp, Homo sapiens
tacctagttacatacattcc

SEQ ID NO: 66425 - DNA, 24 bp, Homo sapiens
tacctagctgacacatctttttcc

SEQ ID NO: 66426 - DNA, 18 bp, Homo sapiens
tacctatgaaacatttct

SEQ ID NO: 66427 - DNA, 19 bp, Homo sapiens
tacccagtaatacgcttct

SEQ ID NO: 66428 - DNA, 18 bp, Homo sapiens
tagtaaacacatttttcc

SEQ ID NO: 66429 - DNA, 18 bp, Homo sapiens
tacctagcaaatctttcc

SEQ ID NO: 66430 - DNA, 16 bp, Homo sapiens
tacccagcattttttc

SEQ ID NO: 66431 - DNA, 18 bp, Homo sapiens
cctagtaaagtattttcc

SEQ ID NO: 66432 - DNA, 18 bp, Homo sapiens
cacctaaagcacattttt

SEQ ID NO: 66433 - DNA, 18 bp, Homo sapiens
acctcagcatacattttt

SEQ ID NO: 66434 - DNA, 20 bp, Homo sapiens
tacccagcacattcattttt

SEQ ID NO: 66435 - DNA, 15 bp, Homo sapiens
tacctagtcacttct

SEQ ID NO: 66436 - DNA, 16 bp, Homo sapiens
acctagtaaacaatcc

SEQ ID NO: 66437 - DNA, 18 bp, Homo sapiens
tacctaataggtttttcc

SEQ ID NO: 66438 - DNA, 16 bp, Homo sapiens
tacccacacatttttc

SEQ ID NO: 66439 - DNA, 19 bp, Homo sapiens
acctgtgtctcatttttcc

SEQ ID NO: 66440 - DNA, 19 bp, Homo sapiens
accacataaacatttttcc

SEQ ID NO: 66441 - DNA, 18 bp, Homo sapiens
caccgtaaaacatttttc

SEQ ID NO: 66442 - DNA, 16 bp, Homo sapiens
tacccaaaacattttt

SEQ ID NO: 66443 - DNA, 19 bp, Homo sapiens
taccttagctacatttttc

SEQ ID NO: 66444 - DNA, 20 bp, Homo sapiens
tacaatttaaacatttttcc

SEQ ID NO: 66445 - DNA, 18 bp, Homo sapiens
tacctagcaagttacatc

SEQ ID NO: 66446 - DNA, 22 bp, Homo sapiens
cacctagtaaggacatgtttcc

SEQ ID NO: 66447 - DNA, 18 bp, Homo sapiens
tacctagtaactctttcc

SEQ ID NO: 66448 - DNA, 18 bp, Homo sapiens
ctaaaacaacatttttcc

SEQ ID NO: 66449 - DNA, 17 bp, Homo sapiens
tacccagtgacccttcc

SEQ ID NO: 66450 - DNA, 21 bp, Homo sapiens
tacccagtaaacaataactcc

SEQ ID NO: 66451 - DNA, 17 bp, Homo sapiens
tacctagcaatatcctt

SEQ ID NO: 66452 - DNA, 18 bp, Homo sapiens
cctagggacaccttttcc

SEQ ID NO: 66453 - DNA, 18 bp, Homo sapiens
cacctggtatcacttttc

SEQ ID NO: 66454 - DNA, 18 bp, Homo sapiens
cacccaataacgtttttc

SEQ ID NO: 66455 - DNA, 18 bp, Homo sapiens
acctctaagcatttttcc

SEQ ID NO: 66456 - DNA, 61 bp, Bovine herpesvirus 1
cacccagacgctcggcacttagctctcgagtgattgcctggctgcttgccccgtttgcgtg

SEQ ID NO: 66457 - DNA, 24 bp, Bovine herpesvirus 1
acgctcggcacttagctctcgagt

SEQ ID NO: 66458 - DNA, 20 bp, Homo sapiens
cgctcagctagctctcgagt

SEQ ID NO: 66459 - DNA, 18 bp, Homo sapiens
cgctcggcacctggctct

SEQ ID NO: 66460 - DNA, 21 bp, Homo sapiens
gcatggtgcttagctctcagt

SEQ ID NO: 66461 - DNA, 20 bp, Homo sapiens
tcttcacatagttctcgagt

SEQ ID NO: 66462 - DNA, 60 bp, Bovine herpesvirus 1
gccccgtttgcgtggaatgaggccaaacaagcatttggcccctgtttgtctagacggggc

SEQ ID NO: 66463 - DNA, 23 bp, Bovine herpesvirus 1
gcccctgtttgtctagacggggc

SEQ ID NO: 66464 - DNA, 20 bp, Homo sapiens
ccctatttgtccctttgggc

SEQ ID NO: 66465 - DNA, 22 bp, Homo sapiens
gcccctctgcccaggatggggc

SEQ ID NO: 66466 - DNA, 18 bp, Homo sapiens
acccctggctggatgggg

SEQ ID NO: 66467 - DNA, 21 bp, Homo sapiens
gcccccgttaggagatggggc

SEQ ID NO: 66468 - DNA, 17 bp, Homo sapiens
cctgtttgtctgaaggc

SEQ ID NO: 66469 - DNA, 20 bp, Homo sapiens
gcctctgtttgtttcagagc

SEQ ID NO: 66470 - DNA, 21 bp, Homo sapiens
gcctctggttgtctaggtgag

SEQ ID NO: 66471 - DNA, 20 bp, Homo sapiens
gctcctgcttaaaatggggc

SEQ ID NO: 66472 - DNA, 20 bp, Homo sapiens
gcccccgtttgaacacgggg

SEQ ID NO: 66473 - DNA, 20 bp, Homo sapiens
tatttgtagtagagacgggg

SEQ ID NO: 66474 - DNA, 15 bp, Homo sapiens
ctgcttatgacgggg

SEQ ID NO: 66475 - DNA, 22 bp, Homo sapiens
gctcctctttgtgccttggggc

SEQ ID NO: 66476 - DNA, 16 bp, Homo sapiens
ccctctttgtccaggg

SEQ ID NO: 66477 - DNA, 20 bp, Homo sapiens
gcctctgcttgaagctgggg

SEQ ID NO: 66478 - DNA, 21 bp, Homo sapiens
gcccttgttttttaacaaagc

SEQ ID NO: 66479 - DNA, 18 bp, Homo sapiens
gcccctgtgtaggtgggg

SEQ ID NO: 66480 - DNA, 19 bp, Homo sapiens
gcctctgtccaggtggggc

SEQ ID NO: 66481 - DNA, 20 bp, Homo sapiens
gtttctcttagggacggggc

SEQ ID NO: 66482 - DNA, 22 bp, Homo sapiens
gcctctgtctgtttgaatgagg

SEQ ID NO: 66483 - DNA, 20 bp, Homo sapiens
cccgtttgaggaggcggggc

SEQ ID NO: 66484 - DNA, 22 bp, Homo sapiens
gcctgggcagtctgggcggggc

SEQ ID NO: 66485 - DNA, 17 bp, Homo sapiens
gcccctgtctgacgggg

SEQ ID NO: 66486 - DNA, 19 bp, Homo sapiens
gcccctgtctgtagagggg

SEQ ID NO: 66487 - DNA, 21 bp, Homo sapiens
gccctctgccttagatggggc

SEQ ID NO: 66488 - DNA, 18 bp, Homo sapiens
acccctgtttgttatggg

SEQ ID NO: 66489 - DNA, 24 bp, Homo sapiens
ccttgtttgtctcacgtctggggc

SEQ ID NO: 66490 - DNA, 19 bp, Homo sapiens
ccctgtttcctcatggggc

SEQ ID NO: 66491 - DNA, 17 bp, Homo sapiens
gctttgtagagacgggg

SEQ ID NO: 66492 - DNA, 23 bp, Homo sapiens
acttctgacctctctagatgggg

SEQ ID NO: 66493 - DNA, 19 bp, Homo sapiens
ctttttagtagagacgggg

SEQ ID NO: 66494 - DNA, 22 bp, Homo sapiens
gctctggtttgtctgtcctggc

SEQ ID NO: 66495 - DNA, 19 bp, Homo sapiens
gctccagtttgtctgcagg

SEQ ID NO: 66496 - DNA, 16 bp, Homo sapiens
ctgctctggacggggc

SEQ ID NO: 66497 - DNA, 21 bp, Homo sapiens
gcccctgtgtggtcctggggc

SEQ ID NO: 66498 - DNA, 18 bp, Homo sapiens
tgtttgtttgagacaggg

SEQ ID NO: 66499 - DNA, 18 bp, Homo sapiens
gcccctgcttgtctgagg

SEQ ID NO: 66500 - DNA, 17 bp, Homo sapiens
ctgttttttagacaggg

SEQ ID NO: 66501 - DNA, 17 bp, Homo sapiens
cctgtctgtctctcagg

SEQ ID NO: 66502 - DNA, 22 bp, Homo sapiens
gcctctgttccagcagtggggc

SEQ ID NO: 66503 - DNA, 19 bp, Homo sapiens
gcccttgcttgccctgggg

SEQ ID NO: 66504 - DNA, 19 bp, Homo sapiens
gccatctgtttaggtgggg

SEQ ID NO: 66505 - DNA, 15 bp, Homo sapiens
ccctgtttgtcaggg

SEQ ID NO: 66506 - DNA, 17 bp, Homo sapiens
cctgtctgggatggggc

SEQ ID NO: 66507 - DNA, 82 bp, Bovine herpesvirus 1
ggggctttgtgtttttcccacccctgcccttgcccctggccgcctggccggccggctaaagtataggccagaccaaaccccc

SEQ ID NO: 66508 - DNA, 24 bp, Bovine herpesvirus 1
gctttgtgtttttcccacccctgc

SEQ ID NO: 66509 - DNA, 23 bp, Homo sapiens
gcttcgtgggtattcgcttctgc

SEQ ID NO: 66510 - DNA, 21 bp, Homo sapiens
gctttgtgtttctttcagtgc

SEQ ID NO: 66511 - DNA, 24 bp, Homo sapiens
gccttgtgagagcccccacccctg

SEQ ID NO: 66512 - DNA, 18 bp, Homo sapiens
gctgtgtgctcatctctg

SEQ ID NO: 66513 - DNA, 19 bp, Homo sapiens
gcctttgcttctacccctg

SEQ ID NO: 66514 - DNA, 23 bp, Homo sapiens
tttgtgtttgttctcactcttgc

SEQ ID NO: 66515 - DNA, 19 bp, Homo sapiens
gctcttgtacccatccctg

SEQ ID NO: 66516 - DNA, 23 bp, Homo sapiens
gctttgcacactcccacccttgc

SEQ ID NO: 66517 - DNA, 23 bp, Homo sapiens
gccttgcacccatcctgcctctg

SEQ ID NO: 66518 - DNA, 21 bp, Homo sapiens
gctttatgttccatgtttctg

SEQ ID NO: 66519 - DNA, 17 bp, Homo sapiens
ctcttttttcccactct

SEQ ID NO: 66520 - DNA, 23 bp, Homo sapiens
gctcttgccgctcttgctcctgc

SEQ ID NO: 66521 - DNA, 18 bp, Homo sapiens
gcttccttttcatccctg

SEQ ID NO: 66522 - DNA, 18 bp, Homo sapiens
actttgtgtttacttctg

SEQ ID NO: 66523 - DNA, 25 bp, Homo sapiens
gcttagtgcctgctcccacttctgc

SEQ ID NO: 66524 - DNA, 18 bp, Homo sapiens
tgtttttctcatccctgc

SEQ ID NO: 66525 - DNA, 26 bp, Homo sapiens
gccttgtgttaccttgttatccttgc

SEQ ID NO: 66526 - DNA, 19 bp, Homo sapiens
gctccctttcccacccctg

SEQ ID NO: 66527 - DNA, 24 bp, Homo sapiens
tttgtgttttttttctttttctgc

SEQ ID NO: 66528 - DNA, 25 bp, Homo sapiens
gccttgtgttttaggccattcttgc

SEQ ID NO: 66529 - DNA, 19 bp, Homo sapiens
atatttttcttgcctctgc

SEQ ID NO: 66530 - DNA, 17 bp, Homo sapiens
tttgttttttccctctg

SEQ ID NO: 66531 - DNA, 21 bp, Homo sapiens
gccttccttttctatccctgc

SEQ ID NO: 66532 - DNA, 22 bp, Homo sapiens
gcttttcacccttcacccctgc

SEQ ID NO: 66533 - DNA, 23 bp, Homo sapiens
ccttttgtttttcctattcttgc

SEQ ID NO: 66534 - DNA, 21 bp, Homo sapiens
ttctgctccttccacttctgc

SEQ ID NO: 66535 - DNA, 22 bp, Homo sapiens
gccatggtttttcttgcttctg

SEQ ID NO: 66536 - DNA, 20 bp, Homo sapiens
ctttgcacttctgcccctgc

SEQ ID NO: 66537 - DNA, 24 bp, Homo sapiens
gctgtacaaagttcccacctctgc

SEQ ID NO: 66538 - DNA, 25 bp, Homo sapiens
ctttgtgtttcctgcacgcccttgc

SEQ ID NO: 66539 - DNA, 19 bp, Homo sapiens
gtgttgcttcccactcctg

SEQ ID NO: 66540 - DNA, 20 bp, Homo sapiens
tttgacaatctcacccctgc

SEQ ID NO: 66541 - DNA, 20 bp, Homo sapiens
gcttcttcttcccgtccttg

SEQ ID NO: 66542 - DNA, 22 bp, Homo sapiens
tttgtgctccacttatctctgc

SEQ ID NO: 66543 - DNA, 19 bp, Homo sapiens
actttgtgtcccatccctg

SEQ ID NO: 66544 - DNA, 19 bp, Homo sapiens
gctctcattcccattcctg

SEQ ID NO: 66545 - DNA, 18 bp, Homo sapiens
gctctcttcctgcctctg

SEQ ID NO: 66546 - DNA, 63 bp, Human papillomavirus type 55
gtaataaccttacaaaacatatacaacattggaaatgcataagatatgaatgtgtgttattac

SEQ ID NO: 66547 - DNA, 24 bp, Human papillomavirus type 55
taagatatgaatgtgtgttattac

SEQ ID NO: 66548 - DNA, 22 bp, Homo sapiens
taaaacctgatgtgtgttgtta

SEQ ID NO: 66549 - DNA, 18 bp, Homo sapiens
gatatgaataggagttac

SEQ ID NO: 66550 - DNA, 21 bp, Homo sapiens
aaatatgaatgtggctgatta

SEQ ID NO: 66551 - DNA, 20 bp, Homo sapiens
gatatggagttggttattac

SEQ ID NO: 66552 - DNA, 18 bp, Homo sapiens
taagacatgtctgttgtt

SEQ ID NO: 66553 - DNA, 21 bp, Homo sapiens
taagatataattatatgttat

SEQ ID NO: 66554 - DNA, 20 bp, Homo sapiens
taaaatatgggtatgcaatt

SEQ ID NO: 66555 - DNA, 23 bp, Homo sapiens
agatatggaatgtaccaggttac

SEQ ID NO: 66556 - DNA, 19 bp, Homo sapiens
taagcgtgtgtgtgttatt

SEQ ID NO: 66557 - DNA, 109 bp, Fowlpox virus
ggtgataagtcttatatagcaatatagaagtaaacataggcaaaacaagtattctaatagatattttgctaactatgtagtacaatataagtatattaattttgttacc

SEQ ID NO: 66558 - DNA, 24 bp, Fowlpox virus
tacaatataagtatattaattttg

SEQ ID NO: 66559 - DNA, 22 bp, Homo sapiens
tacaatataagttatatgcaat

SEQ ID NO: 66560 - DNA, 23 bp, Homo sapiens
cacaatataagtgtgagctcttg

SEQ ID NO: 66561 - DNA, 19 bp, Homo sapiens
tacagtgtaagtacattaa

SEQ ID NO: 66562 - DNA, 63 bp, Melanoplus sanguinipes entomopoxvirus
aatctgacttagttaaatatgtggatttagttaaaaattcatataattttaatatttcagatt

SEQ ID NO: 66563 - DNA, 24 bp, Melanoplus sanguinipes entomopoxvirus
ttcatataattttaatatttcaga

SEQ ID NO: 66564 - DNA, 23 bp, Homo sapiens
ttcatatggcagtcatatttcag

SEQ ID NO: 66565 - DNA, 21 bp, Homo sapiens
ttcatataattataattctca

SEQ ID NO: 66566 - DNA, 15 bp, Homo sapiens
tcatataatttttca

SEQ ID NO: 66567 - DNA, 19 bp, Homo sapiens
ttcatataattcttaatac

SEQ ID NO: 66568 - DNA, 21 bp, Homo sapiens
ttcataaaatcttatttcaga

SEQ ID NO: 66569 - DNA, 21 bp, Homo sapiens
ttcatataatgtatattcaga

SEQ ID NO: 66570 - DNA, 21 bp, Homo sapiens
ttcacataatttatcttcaga

SEQ ID NO: 66571 - DNA, 85 bp, Yaba-like disease virus
attatttgataagtttactaataaatggttaaaattagactcgttaatgtcttcttcactcatttaaaacttataaacaaatgat

SEQ ID NO: 66572 - DNA, 24 bp, Yaba-like disease virus
taagtttactaataaatggttaaa

SEQ ID NO: 66573 - DNA, 16 bp, Homo sapiens
taagtctacatggtta

SEQ ID NO: 66574 - DNA, 18 bp, Homo sapiens
taagtttactaacaagtg

SEQ ID NO: 66575 - DNA, 23 bp, Homo sapiens
taagtttactaacggaactctgg

SEQ ID NO: 66576 - DNA, 19 bp, Homo sapiens
taagtttactatactggtc

SEQ ID NO: 66577 - DNA, 19 bp, Homo sapiens
gttctgaataaatggttaa

SEQ ID NO: 66578 - DNA, 20 bp, Homo sapiens
caagtttactaatggaccgc

SEQ ID NO: 66579 - DNA, 18 bp, Homo sapiens
caagtttactaatactga

SEQ ID NO: 66580 - DNA, 21 bp, Homo sapiens
agtttctgctaaatggttaaa

SEQ ID NO: 66581 - DNA, 20 bp, Homo sapiens
tttaccatctaatggttaaa

SEQ ID NO: 66582 - DNA, 19 bp, Homo sapiens
taagtttactgaaacaaat

SEQ ID NO: 66583 - DNA, 22 bp, Homo sapiens
agtttactgatagacaactaaa

SEQ ID NO: 66584 - DNA, 100 bp, Paramecium bursaria Chlorella virus 1
tacgataaccgtaatgtccgctatgacggtaagtggtaacgtgtcgtttggcaacgtttcatttggcaatgtttcatatgggaatattacggcaaacgtg

SEQ ID NO: 66585 - DNA, 24 bp, Paramecium bursaria Chlorella virus 1
aaccgtaatgtccgctatgacggt

SEQ ID NO: 66586 - DNA, 20 bp, Homo sapiens
gctgaaatgtgcatgacggt

SEQ ID NO: 66587 - DNA, 21 bp, Homo sapiens
cgcagtgtccgctgccgcagt

SEQ ID NO: 66588 - DNA, 66 bp, Tupaia herpesvirus
gccgtacgtgggttcacagctttttttttaccgagatcagggacacgcaagcacggtcacgtcggc

SEQ ID NO: 66589 - DNA, 21 bp, Tupaia herpesvirus
cgcaagcacggtcacgtcggc

SEQ ID NO: 66590 - DNA, 19 bp, Homo sapiens
cgcggcactgctcgttggc

SEQ ID NO: 66591 - DNA, 17 bp, Homo sapiens
gcgagcacggctgtggc

SEQ ID NO: 66592 - DNA, 20 bp, Homo sapiens
gcaggcacggtcttccaggc

SEQ ID NO: 66593 - DNA, 17 bp, Homo sapiens
cgggcacggtccggggc

SEQ ID NO: 66594 - DNA, 19 bp, Homo sapiens
gcagccacggggacgcggc

SEQ ID NO: 66595 - DNA, 20 bp, Homo sapiens
cgcagcccggccacgtcggc

SEQ ID NO: 66596 - DNA, 19 bp, Homo sapiens
cgcaagcacagtgctgggc

SEQ ID NO: 66597 - DNA, 20 bp, Homo sapiens
caagtcacatgtcatgttgg

SEQ ID NO: 66598 - DNA, 17 bp, Homo sapiens
gcaagcacggaggtggc

SEQ ID NO: 66599 - DNA, 19 bp, Homo sapiens
gcacgcgcggtcacgtggc

SEQ ID NO: 66600 - DNA, 21 bp, Homo sapiens
cgtcaacgtcttcacgtcggc

SEQ ID NO: 66601 - DNA, 16 bp, Homo sapiens
cgcaagcaggcagcgg

SEQ ID NO: 66602 - DNA, 19 bp, Homo sapiens
cgcggccacggcgcgcggc

SEQ ID NO: 66603 - DNA, 20 bp, Homo sapiens
cacgagcacggtccccgagc

SEQ ID NO: 66604 - DNA, 20 bp, Homo sapiens
cacaaacaattcatgttggc

SEQ ID NO: 66605 - DNA, 18 bp, Homo sapiens
gcaagcaccggctgcggc

SEQ ID NO: 66606 - DNA, 19 bp, Homo sapiens
cgaagcacgggcgtgtggc

SEQ ID NO: 66607 - DNA, 18 bp, Homo sapiens
gccagcacggtccagggc

SEQ ID NO: 66608 - DNA, 19 bp, Homo sapiens
cgcaagcacgtaccagggc

SEQ ID NO: 66609 - DNA, 19 bp, Homo sapiens
gctacaacggtcacgtcgg

SEQ ID NO: 66610 - DNA, 19 bp, Homo sapiens
cgcagctgcagtctgtcgg

SEQ ID NO: 66611 - DNA, 19 bp, Homo sapiens
gcagcacagcagtgtcggc

SEQ ID NO: 66612 - DNA, 20 bp, Homo sapiens
gccaagcaaccacacgttgg

SEQ ID NO: 66613 - DNA, 15 bp, Homo sapiens
gcagcacgatgtcgg

SEQ ID NO: 66614 - DNA, 61 bp, Chinese wheat mosaic virus
tgtccttactgacatctgcgtttgtatctgtgtgtgcgtgctggattcggtaaccaggata

SEQ ID NO: 66615 - DNA, 20 bp, Chinese wheat mosaic virus
tggattcggtaaccaggata

SEQ ID NO: 66616 - DNA, 18 bp, Homo sapiens
tagaaaaagaccaggata

SEQ ID NO: 66617 - DNA, 18 bp, Homo sapiens
tggcattccaccaggata

SEQ ID NO: 66618 - DNA, 20 bp, Homo sapiens
tgaataaacaggccaggata

SEQ ID NO: 66619 - DNA, 17 bp, Homo sapiens
cggatttggcagaggat

SEQ ID NO: 66620 - DNA, 17 bp, Homo sapiens
tagatttaaaccaggat

SEQ ID NO: 66621 - DNA, 15 bp, Homo sapiens
tagactgaccaggat

SEQ ID NO: 66622 - DNA, 18 bp, Homo sapiens
tgggctggccaccaggat

SEQ ID NO: 66623 - DNA, 22 bp, Homo sapiens
tggatccagtgttgactaggat

SEQ ID NO: 66624 - DNA, 19 bp, Homo sapiens
tggggcagctgaccaggat

SEQ ID NO: 66625 - DNA, 20 bp, Homo sapiens
ggatagagaaaaccaggata

SEQ ID NO: 66626 - DNA, 15 bp, Homo sapiens
tggaagaaccaggat

SEQ ID NO: 66627 - DNA, 18 bp, Homo sapiens
tggactgagaaccaggat

SEQ ID NO: 66628 - DNA, 17 bp, Homo sapiens
ggattcgggcctggata

SEQ ID NO: 66629 - DNA, 18 bp, Homo sapiens
tggattcagttagagata

SEQ ID NO: 66630 - DNA, 19 bp, Homo sapiens
tagaaacttaaccaggata

SEQ ID NO: 66631 - DNA, 19 bp, Homo sapiens
tggacttttcaggaccagg

SEQ ID NO: 66632 - DNA, 16 bp, Homo sapiens
tagaggcaaccaggat

SEQ ID NO: 66633 - DNA, 17 bp, Homo sapiens
tggccagggccaggata

SEQ ID NO: 66634 - DNA, 18 bp, Homo sapiens
ggaggctaagccaggata

SEQ ID NO: 66635 - DNA, 19 bp, Homo sapiens
tggttttgataaccaggat

SEQ ID NO: 66636 - DNA, 18 bp, Homo sapiens
agattgagaaccaggata

SEQ ID NO: 66637 - DNA, 20 bp, Homo sapiens
tggttatccgcaccaggata

SEQ ID NO: 66638 - DNA, 15 bp, Homo sapiens
agactggccaggata

SEQ ID NO: 66639 - DNA, 20 bp, Homo sapiens
tgtgtccagtaatcaggata

SEQ ID NO: 66640 - DNA, 18 bp, Homo sapiens
tgaacccagagccgggat

SEQ ID NO: 66641 - DNA, 17 bp, Homo sapiens
gaggcagaaccaggata

SEQ ID NO: 66642 - DNA, 18 bp, Homo sapiens
tggggtacacccaggata

SEQ ID NO: 66643 - DNA, 20 bp, Homo sapiens
ggacccgcagtagccgggat

SEQ ID NO: 66644 - DNA, 18 bp, Homo sapiens
tgggtcagtcccaggata

SEQ ID NO: 66645 - DNA, 75 bp, Rat cytomegalovirus
acatatccgtcaccgggagggtcgttgttctcatatcgtggtcgagggtccttctgttagggggtgacggtgtgt

SEQ ID NO: 66646 - DNA, 24 bp, Rat cytomegalovirus
tccgtcaccgggagggtcgttgtt

SEQ ID NO: 66647 - DNA, 17 bp, Homo sapiens
gccactgggagagtgtt

SEQ ID NO: 66648 - DNA, 20 bp, Homo sapiens
tccgtcccgggaggaaagtt

SEQ ID NO: 66649 - DNA, 23 bp, Homo sapiens
tccatcgctgggattacattgtt

SEQ ID NO: 66650 - DNA, 22 bp, Homo sapiens
tccgttgttgagggggatcact

SEQ ID NO: 66651 - DNA, 22 bp, Homo sapiens
tccgttgctggtgaggcactgt

SEQ ID NO: 66652 - DNA, 23 bp, Homo sapiens
tccgtcatggggagggtcttgtt

SEQ ID NO: 66653 - DNA, 64 bp, Melanoplus sanguinipes entomopoxvirus
ttattttttaaatattaatttttcatagactatttactatatgaaattttataaataaaaataa

SEQ ID NO: 66654 - DNA, 23 bp, Melanoplus sanguinipes entomopoxvirus
tgaaattttataaataaaaataa

SEQ ID NO: 66655 - DNA, 24 bp, Homo sapiens
taaaatttaaataaataaaaataa

SEQ ID NO: 66656 - DNA, 22 bp, Homo sapiens
tgaaacttcgtaataaaaataa

SEQ ID NO: 66657 - DNA, 83 bp, Fowlpox virus
tatcttttaatatgaattacttcactttatctttcttacctgattattgtttaaagattaaaagtgaaatatattggaaggta

SEQ ID NO: 66658 - DNA, 24 bp, Fowlpox virus
tcttttaatatgaattacttcact

SEQ ID NO: 66659 - DNA, 20 bp, Homo sapiens
tcttttgatatgaaaaccac

SEQ ID NO: 66660 - DNA, 21 bp, Homo sapiens
tcttttaaatgatcacattca

SEQ ID NO: 66661 - DNA, 22 bp, Homo sapiens
ttttaatagaaaccacatcact

SEQ ID NO: 66662 - DNA, 18 bp, Homo sapiens
tcttttagtatgaactct

SEQ ID NO: 66663 - DNA, 21 bp, Homo sapiens
tcctttgggccttacttcact

SEQ ID NO: 66664 - DNA, 21 bp, Homo sapiens
tctcttaatatgcagcattca

SEQ ID NO: 66665 - DNA, 19 bp, Homo sapiens
tctccagtatgaattactt

SEQ ID NO: 66666 - DNA, 21 bp, Homo sapiens
tcttttaatacgggtattact

SEQ ID NO: 66667 - DNA, 19 bp, Homo sapiens
tcttttaatataacccact

SEQ ID NO: 66668 - DNA, 18 bp, Homo sapiens
ttttaacatgaaaccact

SEQ ID NO: 66669 - DNA, 21 bp, Homo sapiens
ttttaacagaaatatttcact

SEQ ID NO: 66670 - DNA, 22 bp, Homo sapiens
tcttttattgactaacttcact

SEQ ID NO: 66671 - DNA, 130 bp, Paramecium bursaria Chlorella virus 1
tcttccggaaagacttcagacagatcggaaataaaagaccgcataacagtgttgaaatcagtgaacttctgggacatattggtaataatgtggtatacgagtttcaaaatgttaagttaatacggtatga

SEQ ID NO: 66672 - DNA, 24 bp, Paramecium bursaria Chlorella virus 1
cggaaataaaagaccgcataacag

SEQ ID NO: 66673 - DNA, 17 bp, Homo sapiens
ggaaataaaaaataaca

SEQ ID NO: 66674 - DNA, 20 bp, Homo sapiens
ggaaataaaaatagcaccag

SEQ ID NO: 66675 - DNA, 17 bp, Homo sapiens
cggaaacaagaggcaca

SEQ ID NO: 66676 - DNA, 25 bp, Homo sapiens
cggagataaaagaacgctgctccag

SEQ ID NO: 66677 - DNA, 18 bp, Homo sapiens
ggaaacaaaggagaaaca

SEQ ID NO: 66678 - DNA, 17 bp, Homo sapiens
ggaaacaggacataaca

SEQ ID NO: 66679 - DNA, 17 bp, Homo sapiens
ggaaataaaaacacaca

SEQ ID NO: 66680 - DNA, 16 bp, Homo sapiens
cagaaataaaagtaac

SEQ ID NO: 66681 - DNA, 20 bp, Homo sapiens
ggaaataaaaactgaaccca

SEQ ID NO: 66682 - DNA, 22 bp, Homo sapiens
gagataaaaaattgcgtaacag

SEQ ID NO: 66683 - DNA, 22 bp, Homo sapiens
ggaaataagagcacacacacag

SEQ ID NO: 66684 - DNA, 23 bp, Homo sapiens
gaaataaaagattccaccaacag

SEQ ID NO: 66685 - DNA, 22 bp, Homo sapiens
gggaacaaaaggtaccatggca

SEQ ID NO: 66686 - DNA, 21 bp, Homo sapiens
ggaaataaaggagagaaacag

SEQ ID NO: 66687 - DNA, 24 bp, Homo sapiens
ggagaggggagaccgcacccacag

SEQ ID NO: 66688 - DNA, 21 bp, Homo sapiens
ggaaataaaagcctttgccag

SEQ ID NO: 66689 - DNA, 18 bp, Homo sapiens
ggagacaaagaccataac

SEQ ID NO: 66690 - DNA, 21 bp, Homo sapiens
ggaaatggctctgcataacag

SEQ ID NO: 66691 - DNA, 20 bp, Homo sapiens
ggaaataaaatgttgcttaa

SEQ ID NO: 66692 - DNA, 18 bp, Homo sapiens
ggaaataaaaggcataca

SEQ ID NO: 66693 - DNA, 22 bp, Homo sapiens
ggaagcaaaagactcgccacag

SEQ ID NO: 66694 - DNA, 20 bp, Homo sapiens
ggggataaaagaaccaacac

SEQ ID NO: 66695 - DNA, 20 bp, Homo sapiens
ggggataaaagaaccaacat

SEQ ID NO: 66696 - DNA, 19 bp, Homo sapiens
ggaaataaaagagtttgca

SEQ ID NO: 66697 - DNA, 84 bp, Amsacta moorei entomopoxvirus
gtttattattttcatttttaaaaatataatcgtaatcataaggttttggtatgttatcatttttataattttcaatatacaaac

SEQ ID NO: 66698 - DNA, 24 bp, Amsacta moorei entomopoxvirus
tatgttatcatttttataattttc

SEQ ID NO: 66699 - DNA, 18 bp, Homo sapiens
tattttatcatttttaca

SEQ ID NO: 66700 - DNA, 16 bp, Homo sapiens
tatgctatcattattt

SEQ ID NO: 66701 - DNA, 21 bp, Homo sapiens
tgctctaatttttataatttt

SEQ ID NO: 66702 - DNA, 20 bp, Homo sapiens
tgtcatcattttcccttttc

SEQ ID NO: 66703 - DNA, 68 bp, Amsacta moorei entomopoxvirus
tttattattatccataatatataatatataatatataatatataatatataatatatcttataatagg

SEQ ID NO: 66704 - DNA, 24 bp, Amsacta moorei entomopoxvirus
tataatatataatatatcttataa

SEQ ID NO: 66705 - DNA, 23 bp, Homo sapiens
tataataaataatatatattata

SEQ ID NO: 66706 - DNA, 17 bp, Homo sapiens
tataatatatatatatc

SEQ ID NO: 66707 - DNA, 22 bp, Homo sapiens
tataaatatagaataccttata

SEQ ID NO: 66708 - DNA, 21 bp, Homo sapiens
taaaatgaaatatatcttata

SEQ ID NO: 66709 - DNA, 20 bp, Homo sapiens
tataatatatatatatctca

SEQ ID NO: 66710 - DNA, 18 bp, Homo sapiens
tataatatataaatatcc

SEQ ID NO: 66711 - DNA, 22 bp, Homo sapiens
taatatataaaacaccttataa

SEQ ID NO: 66712 - DNA, 80 bp, Human papillomavirus type 60
ggtaagtacatgttcatacaaagttttgactcactctctttgttagaaaccatttccgttctgtggatatgcgccagacc

SEQ ID NO: 66713 - DNA, 24 bp, Human papillomavirus type 60
tacatgttcatacaaagttttgac

SEQ ID NO: 66714 - DNA, 19 bp, Homo sapiens
tacaggtttaaagttttga

SEQ ID NO: 66715 - DNA, 18 bp, Homo sapiens
acatgttcatgtatctga

SEQ ID NO: 66716 - DNA, 21 bp, Homo sapiens
atgtttatacaaaatactgac

SEQ ID NO: 66717 - DNA, 20 bp, Homo sapiens
acatcagctacaaagttttg

SEQ ID NO: 66718 - DNA, 20 bp, Homo sapiens
acattagcacaaagttttga

SEQ ID NO: 66719 - DNA, 19 bp, Homo sapiens
tacatgtttatacataagc

SEQ ID NO: 66720 - DNA, 21 bp, Homo sapiens
tgctgtacaaagggttttgac

SEQ ID NO: 66721 - DNA, 19 bp, Homo sapiens
tacatgctcgtatacatga

SEQ ID NO: 66722 - DNA, 18 bp, Homo sapiens
cgttcatcatattttgac

SEQ ID NO: 66723 - DNA, 18 bp, Homo sapiens
catgaaacaaagttttga

SEQ ID NO: 66724 - DNA, 22 bp, Homo sapiens
tacatgttcttgcaatcttgac

SEQ ID NO: 66725 - DNA, 80 bp, Human papillomavirus type 60
tcacttggcacactctcggatttaacaagcattgctggacacttaccaaccgtaactggttaaaaaagagcgccaaaggg

SEQ ID NO: 66726 - DNA, 24 bp, Human papillomavirus type 60
aactggttaaaaaagagcgccaaa

SEQ ID NO: 66727 - DNA, 20 bp, Homo sapiens
aactgattaaaagatttcca

SEQ ID NO: 66728 - DNA, 18 bp, Homo sapiens
aactgattgaaagtgagc

SEQ ID NO: 66729 - DNA, 18 bp, Homo sapiens
aactggttaagaggagca

SEQ ID NO: 66730 - DNA, 16 bp, Homo sapiens
actgcttaaaagagca

SEQ ID NO: 66731 - DNA, 16 bp, Homo sapiens
actggttagaacaaca

SEQ ID NO: 66732 - DNA, 21 bp, Homo sapiens
aactggctgaggacaaggcca

SEQ ID NO: 66733 - DNA, 21 bp, Homo sapiens
aactggcttaaaagctccaaa

SEQ ID NO: 66734 - DNA, 18 bp, Homo sapiens
actggttaagaaatccaa

SEQ ID NO: 66735 - DNA, 21 bp, Homo sapiens
aactggttagtgaaaaagtca

SEQ ID NO: 66736 - DNA, 26 bp, Homo sapiens
aactggtcagaaaagatactgtcaaa

SEQ ID NO: 66737 - DNA, 21 bp, Homo sapiens
gcagaaaagagagagcgccaa

SEQ ID NO: 66738 - DNA, 18 bp, Homo sapiens
ctggttaagagggggcca

SEQ ID NO: 66739 - DNA, 17 bp, Homo sapiens
ctggttaagaaaacacc

SEQ ID NO: 66740 - DNA, 22 bp, Homo sapiens
tggttaaaatcgcagtgccaaa

SEQ ID NO: 66741 - DNA, 17 bp, Homo sapiens
aactggttaaagtgcca

SEQ ID NO: 66742 - DNA, 20 bp, Homo sapiens
aactggcttgagagggcaca

SEQ ID NO: 66743 - DNA, 25 bp, Homo sapiens
aactggttataaaaagaacaccaaa

SEQ ID NO: 66744 - DNA, 24 bp, Homo sapiens
actggttagaggtgagctgccaaa

SEQ ID NO: 66745 - DNA, 15 bp, Homo sapiens
aactggctaagaggc

SEQ ID NO: 66746 - DNA, 16 bp, Homo sapiens
agtcaaaagagtgcca

SEQ ID NO: 66747 - DNA, 16 bp, Homo sapiens
aactggtttaagaaca

SEQ ID NO: 66748 - DNA, 19 bp, Homo sapiens
ctggttaaagagatctcca

SEQ ID NO: 66749 - DNA, 17 bp, Homo sapiens
actggttaaaaagggca

SEQ ID NO: 66750 - DNA, 15 bp, Homo sapiens
aactggtaaaaaacg

SEQ ID NO: 66751 - DNA, 17 bp, Homo sapiens
tggttaaaaaaatccaa

SEQ ID NO: 66752 - DNA, 21 bp, Homo sapiens
ctggttaaaaaatctacacca

SEQ ID NO: 66753 - DNA, 21 bp, Homo sapiens
actagttaggaaaaagccaaa

SEQ ID NO: 66754 - DNA, 18 bp, Homo sapiens
tggttaaaggccaccaaa

SEQ ID NO: 66755 - DNA, 19 bp, Homo sapiens
aactggtctaaaagaacac

SEQ ID NO: 66756 - DNA, 17 bp, Homo sapiens
aactggtttaagagaca

SEQ ID NO: 66757 - DNA, 16 bp, Homo sapiens
ctggttaaaagctcaa

SEQ ID NO: 66758 - DNA, 18 bp, Homo sapiens
actggttaataaaagagc

SEQ ID NO: 66759 - DNA, 17 bp, Homo sapiens
tggttaaaaacaccaaa

SEQ ID NO: 66760 - DNA, 17 bp, Homo sapiens
aactggctaaagagccc

SEQ ID NO: 66761 - DNA, 19 bp, Homo sapiens
aacttggttaaaaacccaa

SEQ ID NO: 66762 - DNA, 19 bp, Homo sapiens
taattaaaagagcgccaaa

SEQ ID NO: 66763 - DNA, 16 bp, Homo sapiens
ctggttcaagaaccca

SEQ ID NO: 66764 - DNA, 16 bp, Homo sapiens
aactgattaaaaagca

SEQ ID NO: 66765 - DNA, 18 bp, Homo sapiens
actggttaaaaaaaatcg

SEQ ID NO: 66766 - DNA, 18 bp, Homo sapiens
tggttaaaaaatgccaaa

SEQ ID NO: 66767 - DNA, 17 bp, Homo sapiens
aactgaaaagagcgtca

SEQ ID NO: 66768 - DNA, 23 bp, Homo sapiens
aactggttcaggagctcttgcca

SEQ ID NO: 66769 - DNA, 16 bp, Homo sapiens
actggttagaaaaaca

SEQ ID NO: 66770 - DNA, 18 bp, Homo sapiens
aactgattggaagaggcc

SEQ ID NO: 66771 - DNA, 21 bp, Homo sapiens
tggctaaaaaaaaaaatcaaa

SEQ ID NO: 66772 - DNA, 20 bp, Homo sapiens
aactgtttaaaaagaagcac

SEQ ID NO: 66773 - DNA, 21 bp, Homo sapiens
aactggtcaggggcacttcaa

SEQ ID NO: 66774 - DNA, 20 bp, Homo sapiens
actggttaatgggagatcca

SEQ ID NO: 66775 - DNA, 17 bp, Homo sapiens
ctggttaaaaagaatac

SEQ ID NO: 66776 - DNA, 19 bp, Homo sapiens
aactggtttaaaaaaatca

SEQ ID NO: 66777 - DNA, 77 bp, Variola virus
atttttatcataacactactttggttagatgttttagaaaaaaaatatcgccgtaccgttcttgtttttataaaaat

SEQ ID NO: 66778 - DNA, 24 bp, Variola virus
aacactactttggttagatgtttt

SEQ ID NO: 66779 - DNA, 18 bp, Homo sapiens
aacactagtttaatgttt

SEQ ID NO: 66780 - DNA, 16 bp, Homo sapiens
ctactttgtgatgttt

SEQ ID NO: 66781 - DNA, 22 bp, Homo sapiens
aacacagcaagatagatgtttt

SEQ ID NO: 66782 - DNA, 18 bp, Homo sapiens
aaccctgctttggttgga

SEQ ID NO: 66783 - DNA, 18 bp, Homo sapiens
acattactttgagttaga

SEQ ID NO: 66784 - DNA, 19 bp, Homo sapiens
aacacctatttagatgttt

SEQ ID NO: 66785 - DNA, 20 bp, Homo sapiens
ccactttggttctttgtttt

SEQ ID NO: 66786 - DNA, 24 bp, Homo sapiens
aacatctgtttaaccagatgtttt

SEQ ID NO: 66787 - DNA, 22 bp, Homo sapiens
cactacttgggttattctattt

SEQ ID NO: 66788 - DNA, 18 bp, Homo sapiens
cactctttggttgacatt

SEQ ID NO: 66789 - DNA, 18 bp, Homo sapiens
cataactttggttgagat

SEQ ID NO: 66790 - DNA, 22 bp, Homo sapiens
aacatactttggttaatacatt

SEQ ID NO: 66791 - DNA, 21 bp, Homo sapiens
acattacttttggaatgtttt

SEQ ID NO: 66792 - DNA, 20 bp, Homo sapiens
tactcagaactagatgtttt

SEQ ID NO: 66793 - DNA, 18 bp, Homo sapiens
actctatcttagatgttt

SEQ ID NO: 66794 - DNA, 85 bp, Cowpox virus
tgattttctttctaatactatatatttctctcgaagaagttcttgcacatcatctgggaataaaatactactgttgagtaaatca

SEQ ID NO: 66795 - DNA, 85 bp, Cowpox virus; identical to SEQ ID NO: 66794

SEQ ID NO: 66796 - DNA, 19 bp, Homo sapiens
tgggaatagatgcacttga

SEQ ID NO: 66797 - DNA, 24 bp, Homo sapiens
tgggaataataatattacctcatg

SEQ ID NO: 66798 - DNA, 22 bp, Homo sapiens
tgggaataagactattatcaag

SEQ ID NO: 66799 - DNA, 18 bp, Homo sapiens
tgggaataaaaatgctga

SEQ ID NO: 66800 - DNA, 18 bp, Homo sapiens
tgggaataatggtgctga

SEQ ID NO: 66801 - DNA, 22 bp, Homo sapiens
tgggaagaaaatactgtttctg

SEQ ID NO: 66802 - DNA, 18 bp, Homo sapiens
tgggtataaaatacttga

SEQ ID NO: 66803 - DNA, 21 bp, Homo sapiens
tgggaatacaaaattgttgag

SEQ ID NO: 66804 - DNA, 20 bp, Homo sapiens
tgggaataaggtacattttg

SEQ ID NO: 66805 - DNA, 19 bp, Homo sapiens
tgggaataaaataatgccg

SEQ ID NO: 66806 - DNA, 22 bp, Homo sapiens
tgggaatcaaatactaaccaag

SEQ ID NO: 66807 - DNA, 19 bp, Homo sapiens
ggaataaaatcctttgttg

SEQ ID NO: 66808 - DNA, 18 bp, Homo sapiens
tgggaataaattattact

SEQ ID NO: 66809 - DNA, 22 bp, Homo sapiens
tgggagtggaattactgttgag

SEQ ID NO: 66810 - DNA, 25 bp, Homo sapiens
tgggaataaggcttggtgtgttgag

SEQ ID NO: 66811 - DNA, 16 bp, Homo sapiens
tggaaataaaatgttg

SEQ ID NO: 66812 - DNA, 21 bp, Homo sapiens
cgggaataagcagctgttgag

SEQ ID NO: 66813 - DNA, 98 bp, Camelpox virus
acatctggcctgttcataaataaaaacttggcgattctatatatactcttattatcaaatctagccattgtcttatagatgtgagctactgtaggtgt

SEQ ID NO: 66814 - DNA, 24 bp, Camelpox virus
tcaaatctagccattgtcttatag

SEQ ID NO: 66815 - DNA, 18 bp, Homo sapiens
tcaaatgtttgtcttata

SEQ ID NO: 66816 - DNA, 19 bp, Homo sapiens
cagtcctgttgtcttatag

SEQ ID NO: 66817 - DNA, 19 bp, Homo sapiens
aaatatagttgtcttatag

SEQ ID NO: 66818 - DNA, 23 bp, Homo sapiens
tcaatttagcagccatcttatag

SEQ ID NO: 66819 - DNA, 22 bp, Homo sapiens
tcaaatctatccaagcatatag

SEQ ID NO: 66820 - DNA, 87 bp, Camelpox virus
ttgattttctttctaatactatatatttctctcgaagaagtttttgcacatcatctgggaataaaatactactgttgagtaaatcag

SEQ ID NO: 66821 - DNA, 81 bp, Cowpox virus
agaaattggtctgtgttacatatctcttctatattattgttgatgtattggcttagaaaactattacttagaccattttct

SEQ ID NO: 66822 - DNA, 24 bp, Cowpox virus
tgtattggcttagaaaactattac

SEQ ID NO: 66823 - DNA, 19 bp, Homo sapiens
tgattggcttggaagaaaa

SEQ ID NO: 66824 - DNA, 21 bp, Homo sapiens
tgttttggcttaaacgttatt

SEQ ID NO: 66825 - DNA, 19 bp, Homo sapiens
tgtcttggcttaggactat

SEQ ID NO: 66826 - DNA, 19 bp, Homo sapiens
tgtattggattagaactac

SEQ ID NO: 66827 - DNA, 21 bp, Homo sapiens
tatattgacttggagactatt

SEQ ID NO: 66828 - DNA, 21 bp, Homo sapiens
tgtaatggatctaaaactatt

SEQ ID NO: 66829 - DNA, 102 bp, Rat cytomegalovirus
cctcgtggcgcgcgtccgcgccggggtcgcgaggtcccggaccgaggtctcccgcccgcgaccccggcgcggcgccgcggaaaaacagacgacgacacgagg

SEQ ID NO: 66830 - DNA, 24 bp, Rat cytomegalovirus
ctcccgcccgcgaccccggcgcgg

SEQ ID NO: 66831 - DNA, 19 bp, Homo sapiens
ctcccgcccgccgcctcgg

SEQ ID NO: 66832 - DNA, 17 bp, Homo sapiens
ctccgcccgcggtccgg

SEQ ID NO: 66833 - DNA, 26 bp, Homo sapiens
ctcccgcccgcgctgcagccgcgcgg

SEQ ID NO: 66834 - DNA, 19 bp, Homo sapiens
cccgcccggcacggcgcgg

SEQ ID NO: 66835 - DNA, 18 bp, Homo sapiens
ctcccgccgcggctccgg

SEQ ID NO: 66836 - DNA, 18 bp, Homo sapiens
ctcctgctccgaccccga

SEQ ID NO: 66837 - DNA, 20 bp, Homo sapiens
ctcccgtcctggcccccacg

SEQ ID NO: 66838 - DNA, 17 bp, Homo sapiens
tcccgggctccggcgcg

SEQ ID NO: 66839 - DNA, 20 bp, Homo sapiens
cttcctccaggccggcgcgg

SEQ ID NO: 66840 - DNA, 18 bp, Homo sapiens
ctcccgcccgcggctccg

SEQ ID NO: 66841 - DNA, 24 bp, Homo sapiens
ccccgacgcccggccccggtgcgg

SEQ ID NO: 66842 - DNA, 19 bp, Homo sapiens
cctgcccgcgaccacgcgg

SEQ ID NO: 66843 - DNA, 28 bp, Homo sapiens
ctcccgcccgccggctcctcgctcgcgg

SEQ ID NO: 66844 - DNA, 19 bp, Homo sapiens
ctcctgccccgcggctccg

SEQ ID NO: 66845 - DNA, 19 bp, Homo sapiens
ctcccgccgcggctgccgg

SEQ ID NO: 66846 - DNA, 19 bp, Homo sapiens
ctcccgcccgcgacctccg

SEQ ID NO: 66847 - DNA, 17 bp, Homo sapiens
tcctgccctgaccccag

SEQ ID NO: 66848 - DNA, 20 bp, Homo sapiens
ctcccgcccgctgcccgccg

SEQ ID NO: 66849 - DNA, 22 bp, Homo sapiens
tcccttccgcgaccccacgcgg

SEQ ID NO: 66850 - DNA, 20 bp, Homo sapiens
ctcccgccttggcctcccaa

SEQ ID NO: 66851 - DNA, 20 bp, Homo sapiens
cccgcccggtcccggcgcgg

SEQ ID NO: 66852 - DNA, 22 bp, Homo sapiens
ctccggctgggccccggcgcgg

SEQ ID NO: 66853 - DNA, 19 bp, Homo sapiens
ctcccacctgcgacccaag

SEQ ID NO: 66854 - DNA, 21 bp, Homo sapiens
cccacatgggccccggcgcgg

SEQ ID NO: 66855 - DNA, 24 bp, Homo sapiens
ctcccggccgcggctcgactccgg

SEQ ID NO: 66856 - DNA, 18 bp, Homo sapiens
ctcccgctcggactgcgg

SEQ ID NO: 66857 - DNA, 19 bp, Homo sapiens
cccgcccgcggcctcgcgg

SEQ ID NO: 66858 - DNA, 20 bp, Homo sapiens
ctcccgccctggcctcccaa

SEQ ID NO: 66859 - DNA, 20 bp, Homo sapiens
ctcccgcctcggcctcccaa

SEQ ID NO: 66860 - DNA, 21 bp, Homo sapiens
ctcccgcctgcaacttcccgg

SEQ ID NO: 66861 - DNA, 23 bp, Homo sapiens
ctcatgcccgcgtcacggcgcgg

SEQ ID NO: 66862 - DNA, 24 bp, Homo sapiens
ctcccctccgcgatctccctccgg

SEQ ID NO: 66863 - DNA, 23 bp, Homo sapiens
ctcccgccctggccctgccgcgc

SEQ ID NO: 66864 - DNA, 19 bp, Homo sapiens
ctcctgctctgacggcgcg

SEQ ID NO: 66865 - DNA, 17 bp, Homo sapiens
tcccgcccatggtcgcg

SEQ ID NO: 66866 - DNA, 21 bp, Homo sapiens
tcccgggctgcttcggcgcgg

SEQ ID NO: 66867 - DNA, 18 bp, Homo sapiens
ctcccgcccccggtcccg

SEQ ID NO: 66868 - DNA, 21 bp, Homo sapiens
tcccacccgatcctggtgtgg

SEQ ID NO: 66869 - DNA, 17 bp, Homo sapiens
ctctcgcccgcgtcggc

SEQ ID NO: 66870 - DNA, 19 bp, Homo sapiens
ctcctccccgcggccccgg

SEQ ID NO: 66871 - DNA, 19 bp, Homo sapiens
cccgcccgccggggcgcgg

SEQ ID NO: 66872 - DNA, 20 bp, Homo sapiens
ctcccgcctgggcctcccag

SEQ ID NO: 66873 - DNA, 20 bp, Homo sapiens
ctcccgcccggtggccccgg

SEQ ID NO: 66874 - DNA, 26 bp, Homo sapiens
tcccgccctggcctgaggccgcgccg

SEQ ID NO: 66875 - DNA, 25 bp, Homo sapiens
ctcccgcccgaggcgggctgcgcgg

SEQ ID NO: 66876 - DNA, 19 bp, Homo sapiens
ctcccgccctcggccctcg

SEQ ID NO: 66877 - DNA, 19 bp, Homo sapiens
cccgcccgcggccgaccgg

SEQ ID NO: 66878 - DNA, 20 bp, Homo sapiens
cccgccagcacccggtgtgg

SEQ ID NO: 66879 - DNA, 18 bp, Homo sapiens
ctcccgcctgcggctgcg

SEQ ID NO: 66880 - DNA, 20 bp, Homo sapiens
tctcggcggccccggcgtgg

SEQ ID NO: 66881 - DNA, 19 bp, Homo sapiens
ctcccgcctccggccggcg

SEQ ID NO: 66882 - DNA, 15 bp, Homo sapiens
ctcccgccgcggcgc

SEQ ID NO: 66883 - DNA, 21 bp, Homo sapiens
cctcgcttcctgccggcgcgg

SEQ ID NO: 66884 - DNA, 18 bp, Homo sapiens
ctcccgcccggacttcgg

SEQ ID NO: 66885 - DNA, 16 bp, Homo sapiens
gccggccccggcgcgg

SEQ ID NO: 66886 - DNA, 21 bp, Homo sapiens
ctcccgccttggcctccccaa

SEQ ID NO: 66887 - DNA, 18 bp, Homo sapiens
ctctcgcccgccgcccgg

SEQ ID NO: 66888 - DNA, 17 bp, Homo sapiens
gcttcggaccggcgcgg

SEQ ID NO: 66889 - DNA, 24 bp, Homo sapiens
ctcccgcccacggttctgccgcgc

SEQ ID NO: 66890 - DNA, 19 bp, Homo sapiens
ctcccacctgtgatcccag

SEQ ID NO: 66891 - DNA, 23 bp, Homo sapiens
ctcccacccgcggtggtctgcgg

SEQ ID NO: 66892 - DNA, 20 bp, Homo sapiens
ctcccgccctggccttccgg

SEQ ID NO: 66893 - DNA, 18 bp, Homo sapiens
cccctgcggccggcgcgg

SEQ ID NO: 66894 - DNA, 20 bp, Homo sapiens
cctcgcccgcggctccctcg

SEQ ID NO: 66895 - DNA, 18 bp, Homo sapiens
tcctgcctgcaaccccag

SEQ ID NO: 66896 - DNA, 20 bp, Homo sapiens
ctcccgccgcggcctgccgg

SEQ ID NO: 66897 - DNA, 18 bp, Homo sapiens
ctcccacccgcgacccgg

SEQ ID NO: 66898 - DNA, 19 bp, Homo sapiens
ccgcagcccctcggcgcgg

SEQ ID NO: 66899 - DNA, 19 bp, Homo sapiens
ctcccgcctgtaatcccag

SEQ ID NO: 66900 - DNA, 76 bp, Bovine adenovirus B
aagaccactgcaacagcttctgcgtacgcttgtatttacagtacataaaaaagcacttttgccacagagcggtctt

SEQ ID NO: 66901 - DNA, 24 bp, Bovine adenovirus B
aaaaagcacttttgccacagagcg

SEQ ID NO: 66902 - DNA, 16 bp, Homo sapiens
acactcccgcagagcg

SEQ ID NO: 66903 - DNA, 21 bp, Homo sapiens
aaaagatatttttgccaacag

SEQ ID NO: 66904 - DNA, 24 bp, Homo sapiens
aaaaagcactttgttgacaaggag

SEQ ID NO: 66905 - DNA, 19 bp, Homo sapiens
aaagagcacttctgccaca

SEQ ID NO: 66906 - DNA, 17 bp, Homo sapiens
aagcgagccacagagcg

SEQ ID NO: 66907 - DNA, 16 bp, Homo sapiens
gcactcttgagtagcg

SEQ ID NO: 66908 - DNA, 24 bp, Homo sapiens
ggagactactcgcgtcacagagcg

SEQ ID NO: 66909 - DNA, 20 bp, Homo sapiens
agcacgggagccacggagcg

SEQ ID NO: 66910 - DNA, 19 bp, Homo sapiens
aggaccgacccacagagcg

SEQ ID NO: 66911 - DNA, 18 bp, Homo sapiens
aagcaccttcaacagcag

SEQ ID NO: 66912 - DNA, 16 bp, Homo sapiens
aagcacttttatagag

SEQ ID NO: 66913 - DNA, 20 bp, Homo sapiens
aaaaagcacttctgccaaag

SEQ ID NO: 66914 - DNA, 21 bp, Homo sapiens
agcaggcgccagcacagagcg

SEQ ID NO: 66915 - DNA, 19 bp, Homo sapiens
aaaaggcacttttccatag

SEQ ID NO: 66916 - DNA, 22 bp, Homo sapiens
aaaaatcacttccaggacagag

SEQ ID NO: 66917 - DNA, 15 bp, Homo sapiens
aaaaacactttggag

SEQ ID NO: 66918 - DNA, 18 bp, Homo sapiens
actgtttgacacagagcg

SEQ ID NO: 66919 - DNA, 19 bp, Homo sapiens
aacactgaggcacagagcg

SEQ ID NO: 66920 - DNA, 18 bp, Homo sapiens
aaaaacacagggccacag

SEQ ID NO: 66921 - DNA, 18 bp, Homo sapiens
gcacctcttcacagggcg

SEQ ID NO: 66922 - DNA, 121 bp, Peanut clump virus
ccttagggtgttgaaaggtgtccaacgaccgtgtaggaaaagaagagttcgttcgcgactgggctttgtccctgcctcttcttctgttaccatttcgtggattacctctatcgccttaagg

SEQ ID NO: 66923 - DNA, 24 bp, Peanut clump virus
tgtaggaaaagaagagttcgttcg

SEQ ID NO: 66924 - DNA, 17 bp, Homo sapiens
tgtaggaaaagagggtt

SEQ ID NO: 66925 - DNA, 18 bp, Homo sapiens
tgtaaggagagaagagct

SEQ ID NO: 66926 - DNA, 24 bp, Homo sapiens
tgagggagaagaaaaacatgttcg

SEQ ID NO: 66927 - DNA, 21 bp, Homo sapiens
tgtagaaaagaggggttccct

SEQ ID NO: 66928 - DNA, 20 bp, Homo sapiens
gtggggaaagaaggccttcg

SEQ ID NO: 66929 - DNA, 18 bp, Homo sapiens
tgtggaaaagaatttgtt

SEQ ID NO: 66930 - DNA, 21 bp, Homo sapiens
tgaggggaggaagagccagtt

SEQ ID NO: 66931 - DNA, 17 bp, Homo sapiens
taggaaaagggagggtt

SEQ ID NO: 66932 - DNA, 22 bp, Homo sapiens
tgcaggaagagaggagtctcat

SEQ ID NO: 66933 - DNA, 18 bp, Homo sapiens
tgtgggaaaagaaggact

SEQ ID NO: 66934 - DNA, 21 bp, Homo sapiens
tgtaggaatggaacaagttcg

SEQ ID NO: 66935 - DNA, 130 bp, Peanut clump virus
gcggtgtctgtgtttaccactcgtgacgacgttcagaacttctgtacggttctcttcgtgagactgagcacggctctgcccgtcagtcgttttgacattttcgtctgtagtggagcgcgaataccagggc

SEQ ID NO: 66936 - DNA, 24 bp, Peanut clump virus
tctgtgtttaccactcgtgacgac

SEQ ID NO: 66937 - DNA, 20 bp, Homo sapiens
tctgtgttactggacatgac

SEQ ID NO: 66938 - DNA, 24 bp, Homo sapiens
tctgtgttcactgaagccagtgac

SEQ ID NO: 66939 - DNA, 22 bp, Homo sapiens
tctgtgtttgcagctctcctga

SEQ ID NO: 66940 - DNA, 18 bp, Homo sapiens
tctgcgttccccttgtga

SEQ ID NO: 66941 - DNA, 19 bp, Homo sapiens
tctgtgtttatgtcactcg

SEQ ID NO: 66942 - DNA, 16 bp, Homo sapiens
cgtgtttactacctga

SEQ ID NO: 66943 - DNA, 19 bp, Homo sapiens
tctgtgtttccctgcccga

SEQ ID NO: 66944 - DNA, 18 bp, Homo sapiens
ctgggctcactcgtggcg

SEQ ID NO: 66945 - DNA, 18 bp, Homo sapiens
tctgtgttcaccattctg

SEQ ID NO: 66946 - DNA, 22 bp, Homo sapiens
tctgtgtttaacaccctaacga

SEQ ID NO: 66947 - DNA, 21 bp, Homo sapiens
cctgtgtttgctggcacagcg

SEQ ID NO: 66948 - DNA, 15 bp, Homo sapiens
tgtgtttaaccgtga

SEQ ID NO: 66949 - DNA, 22 bp, Homo sapiens
tctgtgttggccggaaagcgac

SEQ ID NO: 66950 - DNA, 25 bp, Homo sapiens
tctgtgttttatcatagcatgatga

SEQ ID NO: 66951 - DNA, 15 bp, Homo sapiens
tctgtgtttctcaga

SEQ ID NO: 66952 - DNA, 17 bp, Homo sapiens
tctgtgtttattctgac

SEQ ID NO: 66953 - DNA, 18 bp, Homo sapiens
cgtgtacccttgtgatga

SEQ ID NO: 66954 - DNA, 18 bp, Homo sapiens
tctgtgtttcccagtgcg

SEQ ID NO: 66955 - DNA, 16 bp, Homo sapiens
tgtgtttttcatgaca

SEQ ID NO: 66956 - DNA, 85 bp, Human coronavirus 229E
tatacactaatgagcctctttgttgtgtattttgctttatttaaagcaagatcacaccgtggcagagctgctcttatagtgttta

SEQ ID NO: 66957 - DNA, 24 bp, Human coronavirus 229E
tggcagagctgctcttatagtgtt

SEQ ID NO: 66958 - DNA, 24 bp, Homo sapiens
tagaggagctgtttttatagtgtt

SEQ ID NO: 66959 - DNA, 18 bp, Homo sapiens
tggggagctgctctatgt

SEQ ID NO: 66960 - DNA, 19 bp, Homo sapiens
tggtcgaagcttatagtgt

SEQ ID NO: 66961 - DNA, 18 bp, Homo sapiens
tggtcagtcttatagtgt

SEQ ID NO: 66962 - DNA, 18 bp, Homo sapiens
tggcagagcttcttctgt

SEQ ID NO: 66963 - DNA, 21 bp, Homo sapiens
tggcagagctctctgtgtgtt

SEQ ID NO: 66964 - DNA, 25 bp, Homo sapiens
tggcagagctgcgcgtgcccgtgtt

SEQ ID NO: 66965 - DNA, 22 bp, Homo sapiens
tggcagaagttgttctaatgct

SEQ ID NO: 66966 - DNA, 89 bp, Human coronavirus 229E
cgcttagcaatgcgaaagttagtgctgaagtttcacgacaggttatccaagacgtgaaagatggcactgttaccttcaacttgctagcg

SEQ ID NO: 66967 - DNA, 24 bp, Human coronavirus 229E
ttagtgctgaagtttcacgacagg

SEQ ID NO: 66968 - DNA, 18 bp, Homo sapiens
ttagtgttgcagtttcac

SEQ ID NO: 66969 - DNA, 22 bp, Homo sapiens
gtgctaaagtttcagactaagg

SEQ ID NO: 66970 - DNA, 25 bp, Homo sapiens
ttagtttgaagtttcatgttacagg

SEQ ID NO: 66971 - DNA, 19 bp, Homo sapiens
tcagtgctggcagcggcag

SEQ ID NO: 66972 - DNA, 19 bp, Homo sapiens
ttagtgctagtggcggcag

SEQ ID NO: 66973 - DNA, 90 bp, Human coronavirus 229E
gtgccattgctgtattggtctcaagcatatatttacgcaactttgattgctgtaattttgcttggaagatttttccatacagcttggcac

SEQ ID NO: 66974 - DNA, 24 bp, Human coronavirus 229E
tgctgtattggtctcaagcatata

SEQ ID NO: 66975 - DNA, 24 bp, Homo sapiens
tgttgtattggtttttgctgcata

SEQ ID NO: 66976 - DNA, 20 bp, Homo sapiens
tgctgtaactgatcaagcat

SEQ ID NO: 66977 - DNA, 21 bp, Homo sapiens
tgctgtgctggtccccagcat

SEQ ID NO: 66978 - DNA, 20 bp, Homo sapiens
tgctgctgctgctcaagcat

SEQ ID NO: 66979 - DNA, 17 bp, Homo sapiens
tgctgtattgtttcaaa

SEQ ID NO: 66980 - DNA, 76 bp, Human papillomavirus type 53
atacaatactacacacgccatatatgctgctaggcctgtaaacttgcaaccattgtgttgtgtgttagttttgtgt

SEQ ID NO: 66981 - DNA, 24 bp, Human papillomavirus type 53
accattgtgttgtgtgttagtttt

SEQ ID NO: 66982 - DNA, 27 bp, Homo sapiens
acagttgtgcaaatctgtgttggtttt

SEQ ID NO: 66983 - DNA, 21 bp, Homo sapiens
catttgttgaattttagtttt

SEQ ID NO: 66984 - DNA, 24 bp, Homo sapiens
actattggttatatatttggtttt

SEQ ID NO: 66985 - DNA, 20 bp, Homo sapiens
ttatgttttgtgttggtttt

SEQ ID NO: 66986 - DNA, 19 bp, Homo sapiens
attgtgtttctctagtttt

SEQ ID NO: 66987 - DNA, 24 bp, Homo sapiens
accgtcgtgagacaggttagtttt

SEQ ID NO: 66988 - DNA, 19 bp, Homo sapiens
attgtggtactttagtttt

SEQ ID NO: 66989 - DNA, 21 bp, Homo sapiens
cattgcacaagtgttggtttt

SEQ ID NO: 66990 - DNA, 22 bp, Homo sapiens
accattctgtgcttttagtttt

SEQ ID NO: 66991 - DNA, 20 bp, Homo sapiens
ttgtgtcagttgttggtttt

SEQ ID NO: 66992 - DNA, 20 bp, Homo sapiens
ccttttgttgtgttagtttt

SEQ ID NO: 66993 - DNA, 19 bp, Homo sapiens
tgtgttacacaatagtttt

SEQ ID NO: 66994 - DNA, 21 bp, Homo sapiens
cattgtggttgtgttctgttt

SEQ ID NO: 66995 - DNA, 19 bp, Homo sapiens
ttgagttggtgttggtttt

SEQ ID NO: 66996 - DNA, 22 bp, Homo sapiens
acctttgttatttgttagtttt

SEQ ID NO: 66997 - DNA, 22 bp, Homo sapiens
ctgcactctgtgtgttggtttt

SEQ ID NO: 66998 - DNA, 24 bp, Homo sapiens
ccatatgtgaatgaggttggtttt

SEQ ID NO: 66999 - DNA, 19 bp, Homo sapiens
actgtgttgtggacatttt

SEQ ID NO: 67000 - DNA, 18 bp, Homo sapiens
attggttgtgtgtgtttt

SEQ ID NO: 67001 - DNA, 18 bp, Homo sapiens
gtactgtgtgttggtttt

SEQ ID NO: 67002 - DNA, 21 bp, Homo sapiens
tgttgctcatttgttagtttt

SEQ ID NO: 67003 - DNA, 18 bp, Homo sapiens
tgtgttgtgcagaatttt

SEQ ID NO: 67004 - DNA, 71 bp, Human herpesvirus 6B
gacatttaccagagatacgtgatactcggtctactgtgtattgtgtaccttgtaatctctaggtaaacttc

SEQ ID NO: 67005 - DNA, 24 bp, Human herpesvirus 6B
tattgtgtaccttgtaatctctag

SEQ ID NO: 67006 - DNA, 21 bp, Homo sapiens
ttatatgcttgtaatttctag

SEQ ID NO: 67007 - DNA, 22 bp, Homo sapiens
tattgtgtatcttattttcact

SEQ ID NO: 67008 - DNA, 22 bp, Homo sapiens
tattatgtgcctacaactctag

SEQ ID NO: 67009 - DNA, 76 bp, Human herpesvirus 6B
tactgatctctttgtttttttttttctgtgtattgtgatagggaaggtttgtaaggacaaaggacaaagttcagta

SEQ ID NO: 67010 - DNA, 24 bp, Human herpesvirus 6B
gggaaggtttgtaaggacaaagga

SEQ ID NO: 67011 - DNA, 23 bp, Homo sapiens
ggtaagggaggcaaggacggagg

SEQ ID NO: 67012 - DNA, 21 bp, Homo sapiens
gggaaagctgagggcaaagga

SEQ ID NO: 67013 - DNA, 20 bp, Homo sapiens
gggaagatggcagggcgagg

SEQ ID NO: 67014 - DNA, 21 bp, Homo sapiens
gggaaggttggtgcacacagg

SEQ ID NO: 67015 - DNA, 24 bp, Homo sapiens
gggaaggtggcaaggggggcgagg

SEQ ID NO: 67016 - DNA, 25 bp, Homo sapiens
ggtgagggtgagtgggggacagagg

SEQ ID NO: 67017 - DNA, 21 bp, Homo sapiens
gggaggttggcagacaaagga

SEQ ID NO: 67018 - DNA, 22 bp, Homo sapiens
gggggacagcagggacaaagga

SEQ ID NO: 67019 - DNA, 18 bp, Homo sapiens
gggtagagaggacaaagg

SEQ ID NO: 67020 - DNA, 24 bp, Homo sapiens
gggaagtttgtcacctagatgagg

SEQ ID NO: 67021 - DNA, 18 bp, Homo sapiens
ggaaggttcaggcagagg

SEQ ID NO: 67022 - DNA, 22 bp, Homo sapiens
ggggtgtccgtaaaggggcagg

SEQ ID NO: 67023 - DNA, 19 bp, Homo sapiens
ggacagtaaggacagagga

SEQ ID NO: 67024 - DNA, 21 bp, Homo sapiens
gggggtgaggaaggacaaggg

SEQ ID NO: 67025 - DNA, 25 bp, Homo sapiens
gggagagggggcaggagggtgaagg

SEQ ID NO: 67026 - DNA, 19 bp, Homo sapiens
gggaaggtccgatagagga

SEQ ID NO: 67027 - DNA, 22 bp, Homo sapiens
ggggtgtcagagggacaaagga

SEQ ID NO: 67028 - DNA, 21 bp, Homo sapiens
gggaaagttggaggtggggga

SEQ ID NO: 67029 - DNA, 20 bp, Homo sapiens
gggaaagtccagggcagagg

SEQ ID NO: 67030 - DNA, 25 bp, Homo sapiens
gggaggtttgtgatggaggcagagg

SEQ ID NO: 67031 - DNA, 23 bp, Homo sapiens
ggggaggccaggggggcaaggga

SEQ ID NO: 67032 - DNA, 21 bp, Homo sapiens
gggaaggtggtaggtaaagga

SEQ ID NO: 67033 - DNA, 21 bp, Homo sapiens
gggaaagctccaagggcgagg

SEQ ID NO: 67034 - DNA, 18 bp, Homo sapiens
aggaggaagggcaaagga

SEQ ID NO: 67035 - DNA, 19 bp, Homo sapiens
gggaaggtctgtgggtggg

SEQ ID NO: 67036 - DNA, 22 bp, Homo sapiens
gggaaggttttgaggaactgga

SEQ ID NO: 67037 - DNA, 18 bp, Homo sapiens
gggaaggcttcatggagg

SEQ ID NO: 67038 - DNA, 20 bp, Homo sapiens
gagggcccccaggatggagg

SEQ ID NO: 67039 - DNA, 22 bp, Homo sapiens
aggaaggcgaggaggacgaagg

SEQ ID NO: 67040 - DNA, 22 bp, Homo sapiens
gggggctttggcaggcagggga

SEQ ID NO: 67041 - DNA, 21 bp, Homo sapiens
gggaaggtggttgatgaagga

SEQ ID NO: 67042 - DNA, 19 bp, Homo sapiens
gggaaggtttggccaaagg

SEQ ID NO: 67043 - DNA, 24 bp, Homo sapiens
gggaaggtttttaagggccgggga

SEQ ID NO: 67044 - DNA, 22 bp, Homo sapiens
gagaaggcaatgggggtaaagg

SEQ ID NO: 67045 - DNA, 22 bp, Homo sapiens
aggaaggttgcgggggtggggg

SEQ ID NO: 67046 - DNA, 20 bp, Homo sapiens
gggaggtttgtgggtgctgg

SEQ ID NO: 67047 - DNA, 17 bp, Homo sapiens
ggaaggaaggacaaggg

SEQ ID NO: 67048 - DNA, 20 bp, Homo sapiens
gagaagacaaggatgaagga

SEQ ID NO: 67049 - DNA, 25 bp, Homo sapiens
gggaggtttgtagggtccactagga

SEQ ID NO: 67050 - DNA, 22 bp, Homo sapiens
gggaaggcgtgggggcagggga

SEQ ID NO: 67051 - DNA, 21 bp, Homo sapiens
gggaaggttctagacgaagga

SEQ ID NO: 67052 - DNA, 21 bp, Homo sapiens
gggctgaagtggggacaaggg

SEQ ID NO: 67053 - DNA, 19 bp, Homo sapiens
gggaaggctgggacagggg

SEQ ID NO: 67054 - DNA, 21 bp, Homo sapiens
gggaaggttttggatgaagga

SEQ ID NO: 67055 - DNA, 22 bp, Homo sapiens
gagaaggtgagaatagggtagg

SEQ ID NO: 67056 - DNA, 22 bp, Homo sapiens
gggaaggttggtgaggcaagga

SEQ ID NO: 67057 - DNA, 22 bp, Homo sapiens
gggaaggtttgaaatcagcagg

SEQ ID NO: 67058 - DNA, 19 bp, Homo sapiens
gggtggaaaaggacaaggg

SEQ ID NO: 67059 - DNA, 22 bp, Homo sapiens
gggggggctgagggggcagagg

SEQ ID NO: 67060 - DNA, 19 bp, Homo sapiens
aggaaggttttgcagagga

SEQ ID NO: 67061 - DNA, 22 bp, Homo sapiens
gggaaggtatgttatggaagga

SEQ ID NO: 67062 - DNA, 22 bp, Homo sapiens
gggaaggagggcggggcagagg

SEQ ID NO: 67063 - DNA, 18 bp, Homo sapiens
gaaggtttcaaagtgagg

SEQ ID NO: 67064 - DNA, 21 bp, Homo sapiens
gggggtcagtcgggggcaagg

SEQ ID NO: 67065 - DNA, 22 bp, Homo sapiens
gggaaggctcaccaggcagagg

SEQ ID NO: 67066 - DNA, 19 bp, Homo sapiens
gggaaagtttagagtgagg

SEQ ID NO: 67067 - DNA, 124 bp, Human herpesvirus 2
gattgccatcgcggacgcacgcggggacccgccagagaccctgccccccggcgcgggcggcgccgcgcccgcgtgccgcagaccacctcgcggcggctcccccgcggcctttcccgtggccctc

SEQ ID NO: 67068 - DNA, 24 bp, Human herpesvirus 2
tgccgcagaccacctcgcggcggc

SEQ ID NO: 67069 - DNA, 21 bp, Homo sapiens
tgcgcagaccgactcggcggc

SEQ ID NO: 67070 - DNA, 21 bp, Homo sapiens
gccgcaggctgccacacgtgg

SEQ ID NO: 67071 - DNA, 22 bp, Homo sapiens
tgctgcaaccacctgcccgggc

SEQ ID NO: 67072 - DNA, 21 bp, Homo sapiens
tgcttcagaccacctcccagc

SEQ ID NO: 67073 - DNA, 19 bp, Homo sapiens
tgcgcagggtccgcggcgg

SEQ ID NO: 67074 - DNA, 16 bp, Homo sapiens
tgccacaggccaggcg

SEQ ID NO: 67075 - DNA, 20 bp, Homo sapiens
gccgcggcggtcgcggcggc

SEQ ID NO: 67076 - DNA, 21 bp, Homo sapiens
tgccccggacccggcggcggc

SEQ ID NO: 67077 - DNA, 24 bp, Homo sapiens
tgctgggaccgcggccgcggcggc

SEQ ID NO: 67078 - DNA, 18 bp, Homo sapiens
gctgcagggccgcggcgg

SEQ ID NO: 67079 - DNA, 21 bp, Homo sapiens
tgtccggaggctcgcggcggc

SEQ ID NO: 67080 - DNA, 18 bp, Homo sapiens
gcagaccacctgacaggc

SEQ ID NO: 67081 - DNA, 22 bp, Homo sapiens
tgtcgggggccagccacggcgg

SEQ ID NO: 67082 - DNA, 21 bp, Homo sapiens
gctgcggatcccggcggcggc

SEQ ID NO: 67083 - DNA, 18 bp, Homo sapiens
tgctgcagccggcggcgg

SEQ ID NO: 67084 - DNA, 22 bp, Homo sapiens
tgccgcagccacctccaacggc

SEQ ID NO: 67085 - DNA, 17 bp, Homo sapiens
tgccgcgaccgcccggc

SEQ ID NO: 67086 - DNA, 17 bp, Homo sapiens
gccgcagaccttggcgg

SEQ ID NO: 67087 - DNA, 18 bp, Homo sapiens
tgccgtgagctgcagcgg

SEQ ID NO: 67088 - DNA, 22 bp, Homo sapiens
tgctgctgggccacctgcaggc

SEQ ID NO: 67089 - DNA, 22 bp, Homo sapiens
tgccgcaggccagcatggtggc

SEQ ID NO: 67090 - DNA, 21 bp, Homo sapiens
tgtcacagaccatcttattgc

SEQ ID NO: 67091 - DNA, 26 bp, Homo sapiens
tgccgcagggtggccagggcggtggc

SEQ ID NO: 67092 - DNA, 20 bp, Homo sapiens
tgccgggactgctccgcggc

SEQ ID NO: 67093 - DNA, 16 bp, Homo sapiens
tgccgaagtcgcggcg

SEQ ID NO: 67094 - DNA, 22 bp, Homo sapiens
cgcttccccgcctcgcggcggc

SEQ ID NO: 67095 - DNA, 19 bp, Homo sapiens
tactgcggactcgcggcgg

SEQ ID NO: 67096 - DNA, 24 bp, Homo sapiens
gccgcagggacagctcgcggcggc

SEQ ID NO: 67097 - DNA, 17 bp, Homo sapiens
ccggcacttcgcggcgg

SEQ ID NO: 67098 - DNA, 18 bp, Homo sapiens
tgccgcagtccgcggcgg

SEQ ID NO: 67099 - DNA, 20 bp, Homo sapiens
tgccgcagatgccgcaatgg

SEQ ID NO: 67100 - DNA, 19 bp, Homo sapiens
tgcccagaccaccttgggc

SEQ ID NO: 67101 - DNA, 23 bp, Homo sapiens
tgccagcagaggggcgcggcggc

SEQ ID NO: 67102 - DNA, 66 bp, Equine herpesvirus 1
ggttttcttcgaggccgtcgcgaggccgaaaaatttttttcacgggcccgcgcccgagagagagcc

SEQ ID NO: 67103 - DNA, 24 bp, Equine herpesvirus 1
ttcacgggcccgcgcccgagagag

SEQ ID NO: 67104 - DNA, 18 bp, Homo sapiens
tccgcgggcccgcgggag

SEQ ID NO: 67105 - DNA, 20 bp, Homo sapiens
ttcacggacaactgggagag

SEQ ID NO: 67106 - DNA, 22 bp, Homo sapiens
gggcccgcgatgagctcgggag

SEQ ID NO: 67107 - DNA, 25 bp, Homo sapiens
ttcatgggcccacgtggccccagag

SEQ ID NO: 67108 - DNA, 19 bp, Homo sapiens
ctcacggatgcccgggaga

SEQ ID NO: 67109 - DNA, 92 bp, Variola virus
gatcatatagttatgtatattagtgacgaatcaagagatgaaaataatcctgaatatattgattttcgtaacagatacggagactatagatc

SEQ ID NO: 67110 - DNA, 24 bp, Variola virus
ttagtgacgaatcaagagatgaaa

SEQ ID NO: 67111 - DNA, 21 bp, Homo sapiens
ctagtgattgaagagatgaaa

SEQ ID NO: 67112 - DNA, 17 bp, Homo sapiens
ttagtttaagagatgaa

SEQ ID NO: 67113 - DNA, 16 bp, Homo sapiens
atgaccaagagatgaa

SEQ ID NO: 67114 - DNA, 17 bp, Homo sapiens
gtggaaggaagagatga

SEQ ID NO: 67115 - DNA, 19 bp, Homo sapiens
ttactgacgaatcatgaaa

SEQ ID NO: 67116 - DNA, 19 bp, Homo sapiens
ttagtgacaagttaagacg

SEQ ID NO: 67117 - DNA, 21 bp, Homo sapiens
ttagagatggcagagatgaaa

SEQ ID NO: 67118 - DNA, 19 bp, Homo sapiens
ttaggataaaggagatgaa

SEQ ID NO: 67119 - DNA, 22 bp, Homo sapiens
tgactacaattaagagatgaaa

SEQ ID NO: 67120 - DNA, 22 bp, Homo sapiens
ttaatgatggagaaagatgaaa

SEQ ID NO: 67121 - DNA, 22 bp, Homo sapiens
ttagtggttcaggagagatgaa

SEQ ID NO: 67122 - DNA, 60 bp, Paramecium bursaria Chlorella virus 1
gaaatcaagggatgcgttgaatcttctcataaaaagactcaacgtcatttcgattatttc

SEQ ID NO: 67123 - DNA, 22 bp, Paramecium bursaria Chlorella virus 1
tcaacgtcatttcgattatttc

SEQ ID NO: 67124 - DNA, 18 bp, Homo sapiens
tcaacgtcattgtccatt

SEQ ID NO: 67125 - DNA, 17 bp, Homo sapiens
tccacgtcactttattt

SEQ ID NO: 67126 - DNA, 23 bp, Homo sapiens
tcaacgacattcatatatatttc

SEQ ID NO: 67127 - DNA, 18 bp, Homo sapiens
gtcatttctagattattt

SEQ ID NO: 67128 - DNA, 20 bp, Homo sapiens
tcaacctttcccattatttc

SEQ ID NO: 67129 - DNA, 21 bp, Homo sapiens
tcagtgtcatctctggctttc

SEQ ID NO: 67130 - DNA, 18 bp, Homo sapiens
tcaacatttcaattattt

SEQ ID NO: 67131 - DNA, 20 bp, Homo sapiens
aacatcatttcattatattt

SEQ ID NO: 67132 - DNA, 21 bp, Homo sapiens
tcaacatcattctccttattt

SEQ ID NO: 67133 - DNA, 110 bp, Tupaia herpesvirus
tgggtctcgcgatagctttgtgttcgtcgatcgtcgacgccgctcccaacgcgatctcggttaacggtggtttgtacgatagaaaagcctgttgtcagagagcggaccca

SEQ ID NO: 67134 - DNA, 24 bp, Tupaia herpesvirus
ttaacggtggtttgtacgatagaa

SEQ ID NO: 67135 - DNA, 23 bp, Homo sapiens
ttaacggtggttggggcctagaa

SEQ ID NO: 67136 - DNA, 18 bp, Homo sapiens
ggggtttgtgtcacagaa

SEQ ID NO: 67137 - DNA, 21 bp, Homo sapiens
ttaatagtggtcctgatggaa

SEQ ID NO: 67138 - DNA, 24 bp, Homo sapiens
aacggtggcatccggtatgatgga

SEQ ID NO: 67139 - DNA, 22 bp, Homo sapiens
ttaatggtggtttatagcatag

SEQ ID NO: 67140 - DNA, 77 bp, Dengue virus type 4
gatcctgctgtctctgcaacatcaatccaggcacagagcgccgcaagatggattggtgttgttgatccaacaggttc

SEQ ID NO: 67141 - DNA, 24 bp, Dengue virus type 4
tctctgcaacatcaatccaggcac

SEQ ID NO: 67142 - DNA, 21 bp, Homo sapiens
tctctgcagtgccagggccac

SEQ ID NO: 67143 - DNA, 24 bp, Homo sapiens
tccctgcagcgcctccccgggcac

SEQ ID NO: 67144 - DNA, 21 bp, Homo sapiens
tctctgcagctcaaaacctgc

SEQ ID NO: 67145 - DNA, 24 bp, Homo sapiens
tctgcaacgcccatgtccaggcac

SEQ ID NO: 67146 - DNA, 20 bp, Homo sapiens
tctctgtgtactcccaggca

SEQ ID NO: 67147 - DNA, 20 bp, Homo sapiens
tcttgcagtacaaatccagg

SEQ ID NO: 67148 - DNA, 19 bp, Homo sapiens
tctgcaacattcctccagg

SEQ ID NO: 67149 - DNA, 20 bp, Homo sapiens
ctctgcaatccagctaggca

SEQ ID NO: 67150 - DNA, 17 bp, Homo sapiens
tctgcaacacacagtac

SEQ ID NO: 67151 - DNA, 15 bp, Homo sapiens
tctctcaacccaggc

SEQ ID NO: 67152 - DNA, 16 bp, Homo sapiens
tctctccaatgcaggc

SEQ ID NO: 67153 - DNA, 17 bp, Homo sapiens
tctctgcaataccaagc

SEQ ID NO: 67154 - DNA, 21 bp, Homo sapiens
tctttgcaacatatgaggcac

SEQ ID NO: 67155 - DNA, 23 bp, Homo sapiens
tctctggcagctcctcccaggca

SEQ ID NO: 67156 - DNA, 23 bp, Homo sapiens
tctctgcaaatgtcacaatagca

SEQ ID NO: 67157 - DNA, 16 bp, Homo sapiens
tctacaacatcaagca

SEQ ID NO: 67158 - DNA, 18 bp, Homo sapiens
tctcagcaataccaggca

SEQ ID NO: 67159 - DNA, 24 bp, Homo sapiens
ctttgtgacatgagtgccaggcac

SEQ ID NO: 67160 - DNA, 21 bp, Homo sapiens
tctctgtggacacccaggcac

SEQ ID NO: 67161 - DNA, 18 bp, Homo sapiens
tcttgcagtttccaggca

SEQ ID NO: 67162 - DNA, 16 bp, Homo sapiens
tctctcaattccaggc

SEQ ID NO: 67163 - DNA, 20 bp, Homo sapiens
tccctgcagccctccaggca

SEQ ID NO: 67164 - DNA, 24 bp, Homo sapiens
tctctgtagttccaggccaggcac

SEQ ID NO: 67165 - DNA, 20 bp, Homo sapiens
tctctgcagcctcactagca

SEQ ID NO: 67166 - DNA, 19 bp, Homo sapiens
tctctgcaatgctcagcca

SEQ ID NO: 67167 - DNA, 20 bp, Homo sapiens
ctctgcgacctgccaggcac

SEQ ID NO: 67168 - DNA, 23 bp, Homo sapiens
tctctccagcttagtccaggcac

SEQ ID NO: 67169 - DNA, 20 bp, Homo sapiens
tcctgcccacccaatccagg

SEQ ID NO: 67170 - DNA, 18 bp, Homo sapiens
tctctgcacccccaggca

SEQ ID NO: 67171 - DNA, 21 bp, Homo sapiens
tctctgagcagggcccaggca

SEQ ID NO: 67172 - DNA, 18 bp, Homo sapiens
tctctgcagccacccagg

SEQ ID NO: 67173 - DNA, 19 bp, Homo sapiens
tctctgcactgtcatcagg

SEQ ID NO: 67174 - DNA, 22 bp, Homo sapiens
tctttcagggtaaatccaggca

SEQ ID NO: 67175 - DNA, 21 bp, Homo sapiens
tctgtgacccatcccaggcac

SEQ ID NO: 67176 - DNA, 20 bp, Homo sapiens
tctgcagcttttccaggcac

SEQ ID NO: 67177 - DNA, 20 bp, Homo sapiens
tctgtgcagtgtccaggcac

SEQ ID NO: 67178 - DNA, 21 bp, Homo sapiens
tctctgcagtgctccaggcac

SEQ ID NO: 67179 - DNA, 19 bp, Homo sapiens
tctctgcaaaattaaaaca

SEQ ID NO: 67180 - DNA, 22 bp, Homo sapiens
tctctgcaggcatccaaggggc

SEQ ID NO: 67181 - DNA, 21 bp, Homo sapiens
cctttgcaacctttccaggca

SEQ ID NO: 67182 - DNA, 19 bp, Homo sapiens
tctgcacagggtccaggca

SEQ ID NO: 67183 - DNA, 16 bp, Homo sapiens
tctgcaacatctggca

SEQ ID NO: 67184 - DNA, 89 bp, Apple latent spherical virus
tagagcttgtgagttgttattacgttttgttgtttgaatctctgttttgttactctgatttccttcacgtttgcaccttacactctcta

SEQ ID NO: 67185 - DNA, 24 bp, Apple latent spherical virus
tattacgttttgttgtttgaatct

SEQ ID NO: 67186 - DNA, 24 bp, Homo sapiens
tattgcattttgttgacttaatct

SEQ ID NO: 67187 - DNA, 22 bp, Homo sapiens
tattactttttggagtgaatct

SEQ ID NO: 67188 - DNA, 86 bp, Garlic latent virus
agtgtgtgataatgccggggcttcacgctacgctcgcgctcgtagagctaagagcataggtcggtgccctcgttgcttcaggtgct

SEQ ID NO: 67189 - DNA, 24 bp, Garlic latent virus
taagagcataggtcggtgccctcg

SEQ ID NO: 67190 - DNA, 15 bp, Homo sapiens
gagcgaagcgccctc

SEQ ID NO: 67191 - DNA, 21 bp, Homo sapiens
agagtgtcgcctccgccctcg

SEQ ID NO: 67192 - DNA, 16 bp, Homo sapiens
taagagcatgggccct

SEQ ID NO: 67193 - DNA, 18 bp, Homo sapiens
taagagcatggtggcctc

SEQ ID NO: 67194 - DNA, 17 bp, Homo sapiens
gcatgcacgtgccctcg

SEQ ID NO: 67195 - DNA, 20 bp, Homo sapiens
gagccttcacagtgccctcg

SEQ ID NO: 67196 - DNA, 19 bp, Homo sapiens
gagcggggcggtgccctcg

SEQ ID NO: 67197 - DNA, 19 bp, Homo sapiens
gaggcggcgggtgccctcg

SEQ ID NO: 67198 - DNA, 18 bp, Homo sapiens
gagaggtgggccaccctc

SEQ ID NO: 67199 - DNA, 68 bp, Gallid herpesvirus 2
gcactttttttttccgattttgactcctcgtacatatatcgataatgtagctattggaggatggaggc

SEQ ID NO: 67200 - DNA, 24 bp, Gallid herpesvirus 2
taatgtagctattggaggatggag

SEQ ID NO: 67201 - DNA, 17 bp, Homo sapiens
tgcagattggagggtgg

SEQ ID NO: 67202 - DNA, 17 bp, Homo sapiens
gtttctctggaggatgg

SEQ ID NO: 67203 - DNA, 19 bp, Homo sapiens
tgtgctttgggggatggag

SEQ ID NO: 67204 - DNA, 21 bp, Homo sapiens
tgtattccagacaggatggag

SEQ ID NO: 67205 - DNA, 21 bp, Homo sapiens
caatgtagcttttgggggtgg

SEQ ID NO: 67206 - DNA, 97 bp, Grapevine trichovirus B
gctcaacagtataggattttaagtctcctttgtagaatcaataaagttagtgtgtcattcgtagtgagttgtctggttaggagggagtgtgtcgggc

SEQ ID NO: 67207 - DNA, 24 bp, Grapevine trichovirus B
tgagttgtctggttaggagggagt

SEQ ID NO: 67208 - DNA, 22 bp, Homo sapiens
aattctctggttgggagggagt

SEQ ID NO: 67209 - DNA, 17 bp, Homo sapiens
tgagctgtctggttggg

SEQ ID NO: 67210 - DNA, 16 bp, Homo sapiens
tgggtgtctggaggga

SEQ ID NO: 67211 - DNA, 25 bp, Homo sapiens
tgatttgtctagcttaggagggggt

SEQ ID NO: 67212 - DNA, 21 bp, Homo sapiens
tgagttgttgggttaaagagt

SEQ ID NO: 67213 - DNA, 21 bp, Homo sapiens
tgagttgctggtccttggagt

SEQ ID NO: 67214 - DNA, 71 bp, Grapevine trichovirus B
tgtctaaatcttgaagaggtaatcgagcggttggttaaccgatccttaccgcctgtcttctcgataaggca

SEQ ID NO: 67215 - DNA, 24 bp, Grapevine trichovirus B
agaggtaatcgagcggttggttaa

SEQ ID NO: 67216 - DNA, 19 bp, Homo sapiens
agacggtagttgagcgtgg

SEQ ID NO: 67217 - DNA, 18 bp, Homo sapiens
aggggtggcggcggttgg

SEQ ID NO: 67218 - DNA, 21 bp, Homo sapiens
agaggtggtcagcggctgcta

SEQ ID NO: 67219 - DNA, 20 bp, Homo sapiens
agagggaagtttggttggtt

SEQ ID NO: 67220 - DNA, 18 bp, Homo sapiens
gaggaagagggttggtta

SEQ ID NO: 67221 - DNA, 21 bp, Homo sapiens
aggggctaattgagttgttgg

SEQ ID NO: 67222 - DNA, 18 bp, Homo sapiens
aggggtgatcgaacgtgg

SEQ ID NO: 67223 - DNA, 17 bp, Homo sapiens
agaggcaattgggtgat

SEQ ID NO: 67224 - DNA, 15 bp, Homo sapiens
agaggtggttggtca

SEQ ID NO: 67225 - DNA, 62 bp, Pestivirus Giraffe-1
ccccgatgcgaaggccgaaaagggctaaccatgcccttagtaggactagcaaaaaatcgggg

SEQ ID NO: 67226 - DNA, 22 bp, Pestivirus Giraffe-1
taggactagcaaaaaatcgggg

SEQ ID NO: 67227 - DNA, 22 bp, Homo sapiens
taggactacaaggcaaaagggg

SEQ ID NO: 67228 - DNA, 20 bp, Homo sapiens
ctagctctggaaaatcgggg

SEQ ID NO: 67229 - DNA, 19 bp, Homo sapiens
taggacagtaggaatcagg

SEQ ID NO: 67230 - DNA, 22 bp, Homo sapiens
aggactagtaaaggtgactggg

SEQ ID NO: 67231 - DNA, 19 bp, Homo sapiens
taggactataaaactacgg

SEQ ID NO: 67232 - DNA, 20 bp, Homo sapiens
taggacagccagaatcgggg

SEQ ID NO: 67233 - DNA, 20 bp, Homo sapiens
taggactatggaaaaattgg

SEQ ID NO: 67234 - DNA, 19 bp, Homo sapiens
taggactacaagggagggg

SEQ ID NO: 67235 - DNA, 20 bp, Homo sapiens
gggctagcaaagaaaaccag

SEQ ID NO: 67236 - DNA, 15 bp, Homo sapiens
taggaccagcagggg

SEQ ID NO: 67237 - DNA, 23 bp, Homo sapiens
taggagttagcaaaaaaaaaagg

SEQ ID NO: 67238 - DNA, 21 bp, Homo sapiens
taggactagcgcagtgcaggg

SEQ ID NO: 67239 - DNA, 19 bp, Homo sapiens
ggcacaacaggaatcgggg

SEQ ID NO: 67240 - DNA, 20 bp, Homo sapiens
cagcacttaaagaatcgggg

SEQ ID NO: 67241 - DNA, 21 bp, Homo sapiens
gaactagcagaaatcacgggg

SEQ ID NO: 67242 - DNA, 20 bp, Homo sapiens
caggcgagagaaaatcgggg

SEQ ID NO: 67243 - DNA, 19 bp, Homo sapiens
caggataagggaatcgggg

SEQ ID NO: 67244 - DNA, 20 bp, Homo sapiens
agggcaggaaagaatcgggg

SEQ ID NO: 67245 - DNA, 18 bp, Homo sapiens
taggactacaggaatggg

SEQ ID NO: 67246 - DNA, 19 bp, Homo sapiens
cagggagcaggaatcgggg

SEQ ID NO: 67247 - DNA, 18 bp, Homo sapiens
gggtacaaaaaattgggg

SEQ ID NO: 67248 - DNA, 19 bp, Homo sapiens
tagggctaacaaaatatgg

SEQ ID NO: 67249 - DNA, 20 bp, Homo sapiens
agggctggcaaaatccaggg

SEQ ID NO: 67250 - DNA, 18 bp, Homo sapiens
ggacaggcaaaaccaggg

SEQ ID NO: 67251 - DNA, 18 bp, Homo sapiens
ggactagcaaagaaacag

SEQ ID NO: 67252 - DNA, 22 bp, Homo sapiens
taggactagcgacaaagttagg

SEQ ID NO: 67253 - DNA, 60 bp, Rat cytomegalovirus
ggagcgggggggatctcgacgcgcgcgacggacagatcgagacggaccaggcccggcttc

SEQ ID NO: 67254 - DNA, 24 bp, Rat cytomegalovirus
acggacagatcgagacggaccagg

SEQ ID NO: 67255 - DNA, 20 bp, Homo sapiens
gggcagatcaagaggtcagg

SEQ ID NO: 67256 - DNA, 23 bp, Homo sapiens
cgggcagatcacctgaggtcagg

SEQ ID NO: 67257 - DNA, 18 bp, Homo sapiens
acggacggatggagagag

SEQ ID NO: 67258 - DNA, 22 bp, Homo sapiens
caggtaggtcggaagaatcagg

SEQ ID NO: 67259 - DNA, 21 bp, Homo sapiens
acggacgggacgggagcccgg

SEQ ID NO: 67260 - DNA, 23 bp, Homo sapiens
actgacatgccgggtggaccagg

SEQ ID NO: 67261 - DNA, 22 bp, Homo sapiens
acaggtggatcacgaggtcagg

SEQ ID NO: 67262 - DNA, 21 bp, Homo sapiens
cagaccgacgggcggaccggg

SEQ ID NO: 67263 - DNA, 21 bp, Homo sapiens
ggacagatggacaactccggg

SEQ ID NO: 67264 - DNA, 24 bp, Homo sapiens
ggacagacgggcctggaggccagg

SEQ ID NO: 67265 - DNA, 18 bp, Homo sapiens
gggtaggagaggaccagg

SEQ ID NO: 67266 - DNA, 19 bp, Homo sapiens
acaggccaaggtggaccag

SEQ ID NO: 67267 - DNA, 24 bp, Homo sapiens
acgggtggatcacttgaggtcagg

SEQ ID NO: 67268 - DNA, 22 bp, Homo sapiens
cagacagacaatttggactggg

SEQ ID NO: 67269 - DNA, 17 bp, Homo sapiens
ggacagatcgagggcag

SEQ ID NO: 67270 - DNA, 23 bp, Homo sapiens
cgggcggatcacttgagaccagg

SEQ ID NO: 67271 - DNA, 18 bp, Homo sapiens
acagacagacatgggccg

SEQ ID NO: 67272 - DNA, 21 bp, Homo sapiens
ggaggagtgaggtggaccagg

SEQ ID NO: 67273 - DNA, 17 bp, Homo sapiens
acggacagacagactgg

SEQ ID NO: 67274 - DNA, 22 bp, Homo sapiens
acgggcagatcatgaggtcagg

SEQ ID NO: 67275 - DNA, 25 bp, Homo sapiens
acagacagattgggatcactgcagg

SEQ ID NO: 67276 - DNA, 19 bp, Homo sapiens
ggacagatcacacctcagg

SEQ ID NO: 67277 - DNA, 24 bp, Homo sapiens
acgggtggatctcttgaggccagg

SEQ ID NO: 67278 - DNA, 21 bp, Homo sapiens
ggcagatcacttgaggtcagg

SEQ ID NO: 67279 - DNA, 19 bp, Homo sapiens
acggacagacactgaccag

SEQ ID NO: 67280 - DNA, 20 bp, Homo sapiens
ggacaggtcgagggaccagg

SEQ ID NO: 67281 - DNA, 17 bp, Homo sapiens
acggcagatcgaggtga

SEQ ID NO: 67282 - DNA, 19 bp, Homo sapiens
ggcggatcaagaggtcagg

SEQ ID NO: 67283 - DNA, 20 bp, Homo sapiens
cggacatggcccggaccagg

SEQ ID NO: 67284 - DNA, 20 bp, Homo sapiens
gggcagatcaagaggttagg

SEQ ID NO: 67285 - DNA, 18 bp, Homo sapiens
acggacagatggcctcag

SEQ ID NO: 67286 - DNA, 24 bp, Homo sapiens
acaggcagatcacctgaggtcagg

SEQ ID NO: 67287 - DNA, 18 bp, Homo sapiens
cagacagatcaaggctgg

SEQ ID NO: 67288 - DNA, 21 bp, Homo sapiens
cgggcagatcacaaggtcagg

SEQ ID NO: 67289 - DNA, 19 bp, Homo sapiens
ggacagatttagggttagg

SEQ ID NO: 67290 - DNA, 22 bp, Homo sapiens
ggacagatcacgtgaggccagg

SEQ ID NO: 67291 - DNA, 24 bp, Homo sapiens
acgggcagatcacctgaggtcagg

SEQ ID NO: 67292 - DNA, 21 bp, Homo sapiens
agacgaggtgggtggaccagg

SEQ ID NO: 67293 - DNA, 21 bp, Homo sapiens
agacagatcacttgaggtcgg

SEQ ID NO: 67294 - DNA, 23 bp, Homo sapiens
cgggtggatcacttgcggtcagg

SEQ ID NO: 67295 - DNA, 22 bp, Homo sapiens
cagacagatccttgaggtcagg

SEQ ID NO: 67296 - DNA, 24 bp, Homo sapiens
acgagatagccgacgtggaccagg

SEQ ID NO: 67297 - DNA, 20 bp, Homo sapiens
ggaaccagggacggatcagg

SEQ ID NO: 67298 - DNA, 21 bp, Homo sapiens
ggaggatcgcttgaaaccagg

SEQ ID NO: 67299 - DNA, 17 bp, Homo sapiens
cggcagcgatggaccag

SEQ ID NO: 67300 - DNA, 21 bp, Homo sapiens
ggaaagccgagacgggccggg

SEQ ID NO: 67301 - DNA, 22 bp, Homo sapiens
acggacagatgggggattcagg

SEQ ID NO: 67302 - DNA, 22 bp, Homo sapiens
cgaacagatcacctgaggtcgg

SEQ ID NO: 67303 - DNA, 22 bp, Homo sapiens
gggcagatcaactaaggtcagg

SEQ ID NO: 67304 - DNA, 64 bp, Beet soil-borne virus
attttttgttgcatagataaaacatacggacaggtatcggtgtttttgaagtgtaacttaaaat

SEQ ID NO: 67305 - DNA, 19 bp, Beet soil-borne virus
ttgaagtgtaacttaaaat

SEQ ID NO: 67306 - DNA, 19 bp, Homo sapiens
ctgagtgtatacttaaaat

SEQ ID NO: 67307 - DNA, 17 bp, Homo sapiens
ttgaagtttacttaaaa

SEQ ID NO: 67308 - DNA, 20 bp, Homo sapiens
tcgaagtgtctatttaaaat

SEQ ID NO: 67309 - DNA, 18 bp, Homo sapiens
tgaagtgcattgtaaaat

SEQ ID NO: 67310 - DNA, 18 bp, Homo sapiens
ttgatggtaacttaaaat

SEQ ID NO: 67311 - DNA, 18 bp, Homo sapiens
ttgaagtgtaatgcccca

SEQ ID NO: 67312 - DNA, 16 bp, Homo sapiens
tgaagtggctcaaaat

SEQ ID NO: 67313 - DNA, 20 bp, Homo sapiens
tgaagtgtaaacttgaaaat

SEQ ID NO: 67314 - DNA, 16 bp, Homo sapiens
tcgaagtgtaataaaa

SEQ ID NO: 67315 - DNA, 18 bp, Homo sapiens
ttgaagtgttactaaaat

SEQ ID NO: 67316 - DNA, 17 bp, Homo sapiens
ctgaagtgtacgtaaaa

SEQ ID NO: 67317 - DNA, 18 bp, Homo sapiens
ttaaagataacttaaaat

SEQ ID NO: 67318 - DNA, 19 bp, Homo sapiens
ttgattatatgtaacttaa

SEQ ID NO: 67319 - DNA, 129 bp, Rabbit oral papillomavirus
cagcaattttacagttttgtcttgtctggagaccgctgccggtcgcgctaatccctcaggtaagcttaaaggattagctgctcgaccgaaagcggtcccaggtggtaggaattactcaggcgattgttg

SEQ ID NO: 67320 - DNA, 18 bp, Rabbit oral papillomavirus
ttactcaggcgattgttg

SEQ ID NO: 67321 - DNA, 17 bp, Homo sapiens
ttacccaaggcttgttg

SEQ ID NO: 67322 - DNA, 16 bp, Homo sapiens
tcactcagcagtgttg

SEQ ID NO: 67323 - DNA, 19 bp, Homo sapiens
ttacccacttgcattgttg

SEQ ID NO: 67324 - DNA, 17 bp, Homo sapiens
ttactcaggtatccttg

SEQ ID NO: 67325 - DNA, 18 bp, Homo sapiens
tcactctgatgattgttg

SEQ ID NO: 67326 - DNA, 16 bp, Homo sapiens
ttaccagggactgttg

SEQ ID NO: 67327 - DNA, 20 bp, Homo sapiens
ttactcagccacccctgttg

SEQ ID NO: 67328 - DNA, 18 bp, Homo sapiens
tcactcagggcaaggttg

SEQ ID NO: 67329 - DNA, 18 bp, Homo sapiens
ttattcagttaactgttg

SEQ ID NO: 67330 - DNA, 15 bp, Homo sapiens
ctactcaggtcgctg

SEQ ID NO: 67331 - DNA, 16 bp, Homo sapiens
ttacccaagtttgttg

SEQ ID NO: 67332 - DNA, 17 bp, Homo sapiens
ctactcaggaattgttg

SEQ ID NO: 67333 - DNA, 18 bp, Homo sapiens
tcactcagtgacaggttg

SEQ ID NO: 67334 - DNA, 18 bp, Homo sapiens
tcactcaggtgcccgttg

SEQ ID NO: 67335 - DNA, 22 bp, Homo sapiens
ttactcagtgtatatactgttg

SEQ ID NO: 67336 - DNA, 15 bp, Homo sapiens
ttacccagggagttg

SEQ ID NO: 67337 - DNA, 16 bp, Homo sapiens
tcaccaacgattgttg

SEQ ID NO: 67338 - DNA, 17 bp, Homo sapiens
ttacccaggctcccctg

SEQ ID NO: 67339 - DNA, 16 bp, Homo sapiens
tcactcagccaagttg

SEQ ID NO: 67340 - DNA, 18 bp, Homo sapiens
ttacccaggccgagattg

SEQ ID NO: 67341 - DNA, 18 bp, Homo sapiens
ttactctagcaattgttg

SEQ ID NO: 67342 - DNA, 126 bp, Saimiriine herpesvirus 2
tcttcttgcaaaagtgttataacagaaaaaattataatgttgtattagtggacctcaaactcaacatgtttaagaaacattagattatattaaatacataaataacttaaagtttttaaaagaaga

SEQ ID NO: 67343 - DNA, 24 bp, Saimiriine herpesvirus 2
aagaaacattagattatattaaat

SEQ ID NO: 67344 - DNA, 18 bp, Homo sapiens
aagaaacatggattacat

SEQ ID NO: 67345 - DNA, 18 bp, Homo sapiens
aagaaacattgatttcac

SEQ ID NO: 67346 - DNA, 19 bp, Homo sapiens
aagaaacattaataccaaa

SEQ ID NO: 67347 - DNA, 24 bp, Homo sapiens
gaagacattagattatatacaaat

SEQ ID NO: 67348 - DNA, 20 bp, Homo sapiens
aagaaatattagattccatt

SEQ ID NO: 67349 - DNA, 17 bp, Homo sapiens
aagaaacattagatata

SEQ ID NO: 67350 - DNA, 17 bp, Homo sapiens
aaaacattagacattaa

SEQ ID NO: 67351 - DNA, 21 bp, Homo sapiens
aaaaaacattaaaaatattaa

SEQ ID NO: 67352 - DNA, 19 bp, Homo sapiens
gaaacattaaacattaaat

SEQ ID NO: 67353 - DNA, 67 bp, Fowlpox virus
atcataaaatctttaattattatttatattttattagcgatataaatctatcaaagaaccttatgat

SEQ ID NO: 67354 - DNA, 19 bp, Fowlpox virus
tatcaaagaaccttatgat

SEQ ID NO: 67355 - DNA, 18 bp, Homo sapiens
tatcaaagacccaaagat

SEQ ID NO: 67356 - DNA, 18 bp, Homo sapiens
taccaaagaacgccagat

SEQ ID NO: 67357 - DNA, 17 bp, Homo sapiens
tatcagaaaccttatga

SEQ ID NO: 67358 - DNA, 19 bp, Homo sapiens
tatcaaatcagcttatgat

SEQ ID NO: 67359 - DNA, 19 bp, Homo sapiens
tatcaaaaaactttacaat

SEQ ID NO: 67360 - DNA, 19 bp, Homo sapiens
tcaaagaatctcctttgat

SEQ ID NO: 67361 - DNA, 18 bp, Homo sapiens
taccaaagaacacttttg

SEQ ID NO: 67362 - DNA, 16 bp, Homo sapiens
catcaaagactatgat

SEQ ID NO: 67363 - DNA, 17 bp, Homo sapiens
caccaactccttatgat

SEQ ID NO: 67364 - DNA, 20 bp, Homo sapiens
tatcaaaggctacccatgat

SEQ ID NO: 67365 - DNA, 17 bp, Homo sapiens
catcagagaaccccaga

SEQ ID NO: 67366 - DNA, 19 bp, Homo sapiens
tatcaaagcaacccacaga

SEQ ID NO: 67367 - DNA, 20 bp, Homo sapiens
atcaaagaaccttcagtgat

SEQ ID NO: 67368 - DNA, 20 bp, Homo sapiens
tatcaaaagccccacctgat

SEQ ID NO: 67369 - DNA, 16 bp, Homo sapiens
caccataccttatgat

SEQ ID NO: 67370 - DNA, 94 bp, Chimpanzee cytomegalovirus
ccgccgaaagcggtagaaagagccagaagcggccctcgcagacggtacgcatccccctgtttttggccccgctcccccgcttttgacatcacgg

SEQ ID NO: 67371 - DNA, 24 bp, Chimpanzee cytomegalovirus
agccagaagcggccctcgcagacg

SEQ ID NO: 67372 - DNA, 18 bp, Homo sapiens
gctgcgagcggcccccgc

SEQ ID NO: 67373 - DNA, 22 bp, Homo sapiens
agccagaggctggcctcacaaa

SEQ ID NO: 67374 - DNA, 21 bp, Homo sapiens
agccagaacggcttcatgcag

SEQ ID NO: 67375 - DNA, 18 bp, Homo sapiens
gccaggggcggcccacag

SEQ ID NO: 67376 - DNA, 21 bp, Homo sapiens
ccggaagcggcgacggggacg

SEQ ID NO: 67377 - DNA, 17 bp, Homo sapiens
gccagaggtgcccccac

SEQ ID NO: 67378 - DNA, 16 bp, Homo sapiens
ccagaagccccgcaga

SEQ ID NO: 67379 - DNA, 16 bp, Homo sapiens
gccggagcggccccgc

SEQ ID NO: 67380 - DNA, 21 bp, Homo sapiens
gcccggaagcgcccgcagacg

SEQ ID NO: 67381 - DNA, 18 bp, Homo sapiens
agtcagaagcagtccacg

SEQ ID NO: 67382 - DNA, 20 bp, Homo sapiens
gccagaaggggctgccgggc

SEQ ID NO: 67383 - DNA, 21 bp, Homo sapiens
agtcagaagcgcccctcacag

SEQ ID NO: 67384 - DNA, 19 bp, Homo sapiens
gccagaagccgaggacaga

SEQ ID NO: 67385 - DNA, 25 bp, Homo sapiens
agcgagaagcggggcgcagcagacg

SEQ ID NO: 67386 - DNA, 22 bp, Homo sapiens
agctaggggcgacccggaccgc

SEQ ID NO: 67387 - DNA, 18 bp, Homo sapiens
gccagaggggccctcaca

SEQ ID NO: 67388 - DNA, 18 bp, Homo sapiens
agcaggggcggccctaac

SEQ ID NO: 67389 - DNA, 25 bp, Homo sapiens
gccgcaggcggcccctctgcaggcg

SEQ ID NO: 67390 - DNA, 17 bp, Homo sapiens
gccagcggcctcgcagc

SEQ ID NO: 67391 - DNA, 18 bp, Homo sapiens
aggcagggcagcccttgc

SEQ ID NO: 67392 - DNA, 24 bp, Homo sapiens
gcccgcacccggctctcgcagacg

SEQ ID NO: 67393 - DNA, 20 bp, Homo sapiens
gccagaaatggctctcatag

SEQ ID NO: 67394 - DNA, 21 bp, Homo sapiens
gcggggggcggccccgcgacg

SEQ ID NO: 67395 - DNA, 18 bp, Homo sapiens
gacgctggccctcgcgga

SEQ ID NO: 67396 - DNA, 22 bp, Homo sapiens
gcccgaagcggctcccgcgacg

SEQ ID NO: 67397 - DNA, 18 bp, Homo sapiens
aaccagaagtatcgtaga

SEQ ID NO: 67398 - DNA, 21 bp, Homo sapiens
agcttggagcggcccccgcaa

SEQ ID NO: 67399 - DNA, 20 bp, Homo sapiens
accagaagtggctttctcag

SEQ ID NO: 67400 - DNA, 61 bp, Chimpanzee cytomegalovirus
gtggcgtaggagtggcgaaccggcgtcattataatcaaacgccggagtcgccgcccgccac

SEQ ID NO: 67401 - DNA, 24 bp, Chimpanzee cytomegalovirus
ggagtggcgaaccggcgtcattat

SEQ ID NO: 67402 - DNA, 18 bp, Homo sapiens
gggtgggaggtatcatta

SEQ ID NO: 67403 - DNA, 23 bp, Homo sapiens
ggaggggcggctgttgtcattat

SEQ ID NO: 67404 - DNA, 19 bp, Homo sapiens
ggagtggcatcttgtcatt

SEQ ID NO: 67405 - DNA, 19 bp, Homo sapiens
ggagtggcgagtggcccac

SEQ ID NO: 67406 - DNA, 75 bp, Avian sarcoma virus
attccctgacgactacgaacacctaaatgaagcggaaggcttcatttggtgaccccgacgtgatagttagggaat

SEQ ID NO: 67407 - DNA, 24 bp, Avian sarcoma virus
tccctgacgactacgaacacctaa

SEQ ID NO: 67408 - DNA, 22 bp, Homo sapiens
tccctgactgctgcccactcct

SEQ ID NO: 67409 - DNA, 21 bp, Homo sapiens
tccccgacgtcgggcatctaa

SEQ ID NO: 67410 - DNA, 19 bp, Homo sapiens
cccggggagctgaacacct

SEQ ID NO: 67411 - DNA, 21 bp, Homo sapiens
cctttgacccaaagaacacct

SEQ ID NO: 67412 - DNA, 22 bp, Homo sapiens
tctctgacaactgacttcctaa

SEQ ID NO: 67413 - DNA, 21 bp, Homo sapiens
ccctgatggcgaaaacaccta

SEQ ID NO: 67414 - DNA, 20 bp, Homo sapiens
cctgacaaaactggacatct

SEQ ID NO: 67415 - DNA, 16 bp, Homo sapiens
tccctgacactagcct

SEQ ID NO: 67416 - DNA, 78 bp, Avian sarcoma virus
ggcgaaaagctgagtggcgtcggagggagctctactgcagggagccaacataccctaccgagcactcagagagtcgtt

SEQ ID NO: 67417 - DNA, 24 bp, Avian sarcoma virus
taccctaccgagcactcagagagt

SEQ ID NO: 67418 - DNA, 20 bp, Homo sapiens
ccagttactcttcagagagt

SEQ ID NO: 67419 - DNA, 27 bp, Homo sapiens
taccccactgggcatggtactctctga

SEQ ID NO: 67420 - DNA, 23 bp, Homo sapiens
tacatttcacatattcagagagt

SEQ ID NO: 67421 - DNA, 19 bp, Homo sapiens
ctcctggcactcagagggt

SEQ ID NO: 67422 - DNA, 21 bp, Homo sapiens
ccagccgagcaccatctgagt

SEQ ID NO: 67423 - DNA, 19 bp, Homo sapiens
cccatagcactcagagagt

SEQ ID NO: 67424 - DNA, 22 bp, Homo sapiens
actctgtcaaacctcagagagt

SEQ ID NO: 67425 - DNA, 17 bp, Homo sapiens
ccctgctcttcagagag

SEQ ID NO: 67426 - DNA, 29 bp, Homo sapiens
taccctactgagacaaggtactctctgag

SEQ ID NO: 67427 - DNA, 24 bp, Homo sapiens
taccttgccggatgctcagaaagt

SEQ ID NO: 67428 - DNA, 21 bp, Homo sapiens
accctgccgggtaactcagag

SEQ ID NO: 67429 - DNA, 111 bp, Rous sarcoma virus
gttgatggccggaccgtcgattccctaacgattgcgaacacctgaatgaagcagaaggcttcatttggtgaccccgacgtgatagttagggaatagtggtcggccacagac

SEQ ID NO: 67430 - DNA, 24 bp, Rous sarcoma virus
tccctaacgattgcgaacacctga

SEQ ID NO: 67431 - DNA, 22 bp, Homo sapiens
tccctaacattgtgctgtccct

SEQ ID NO: 67432 - DNA, 19 bp, Homo sapiens
ctagcagcaaaacacctga

SEQ ID NO: 67433 - DNA, 17 bp, Homo sapiens
cctaagactgacacctg

SEQ ID NO: 67434 - DNA, 21 bp, Homo sapiens
tccccaacggtggaccacctg

SEQ ID NO: 67435 - DNA, 21 bp, Homo sapiens
cccctaaccgccgggcatctg

SEQ ID NO: 67436 - DNA, 22 bp, Homo sapiens
tcccggggagctgaacacctga

SEQ ID NO: 67437 - DNA, 23 bp, Homo sapiens
cctttgacccaaagaacacctga

SEQ ID NO: 67438 - DNA, 18 bp, Homo sapiens
tccccaaccgggcgcctg

SEQ ID NO: 67439 - DNA, 122 bp, Tupaia paramyxovirus
tacagttcaaggataattacatctgggtagtcttaaaccacctcatatgaaagtcccagtcaaagcttaccttcattacagtttcacttgctctttcactatcccagtaccctaaacctgta

SEQ ID NO: 67440 - DNA, 24 bp, Tupaia paramyxovirus
ttcacttgctctttcactatccca

SEQ ID NO: 67441 - DNA, 20 bp, Homo sapiens
ttctcttgctccacgtctat

SEQ ID NO: 67442 - DNA, 21 bp, Homo sapiens
tccacttgcttataattatcc

SEQ ID NO: 67443 - DNA, 19 bp, Homo sapiens
ttcacttgcctggatctca

SEQ ID NO: 67444 - DNA, 22 bp, Homo sapiens
ttcacttgtcttccaaatccca

SEQ ID NO: 67445 - DNA, 19 bp, Homo sapiens
ttcagttgctctttccatc

SEQ ID NO: 67446 - DNA, 18 bp, Homo sapiens
ttcacttgttttttccta

SEQ ID NO: 67447 - DNA, 16 bp, Homo sapiens
ttcacttgtttcctat

SEQ ID NO: 67448 - DNA, 21 bp, Homo sapiens
ttcacttttggaactatccca

SEQ ID NO: 67449 - DNA, 19 bp, Homo sapiens
ttcacttgctgtagttcca

SEQ ID NO: 67450 - DNA, 18 bp, Homo sapiens
ccggcttttcactatccc

SEQ ID NO: 67451 - DNA, 19 bp, Homo sapiens
ttcacttgttcttttctat

SEQ ID NO: 67452 - DNA, 22 bp, Homo sapiens
ttcacttgtcttctctgtctca

SEQ ID NO: 67453 - DNA, 18 bp, Homo sapiens
acctgctctttctgcact

SEQ ID NO: 67454 - DNA, 19 bp, Homo sapiens
ttccttgctctttatttcc

SEQ ID NO: 67455 - DNA, 20 bp, Homo sapiens
cttaggaattcactatctca

SEQ ID NO: 67456 - DNA, 19 bp, Homo sapiens
ttcacctgctattattcca

SEQ ID NO: 67457 - DNA, 20 bp, Homo sapiens
ttgttctttcactctttcca

SEQ ID NO: 67458 - DNA, 17 bp, Homo sapiens
cttgctttcactgttcc

SEQ ID NO: 67459 - DNA, 19 bp, Homo sapiens
ttctcttgctctttcaact

SEQ ID NO: 67460 - DNA, 19 bp, Homo sapiens
ttgctctctcaatgtctca

SEQ ID NO: 67461 - DNA, 21 bp, Homo sapiens
tccccaagttctttcactgtc

SEQ ID NO: 67462 - DNA, 19 bp, Homo sapiens
ttcacctgctctttctcca

SEQ ID NO: 67463 - DNA, 19 bp, Homo sapiens
cttctcttttactatccca

SEQ ID NO: 67464 - DNA, 17 bp, Homo sapiens
ttcacttgtctttaact

SEQ ID NO: 67465 - DNA, 20 bp, Homo sapiens
ctcacttgttctttccatac

SEQ ID NO: 67466 - DNA, 90 bp, Fujinami sarcoma virus
gaccgttgagtccctaacgattgcgaacacctgaatgaagcggaaggcttcatttggtgaccccgacgtgatcgttagggaatagtggtc

SEQ ID NO: 67467 - DNA, 24 bp, Fujinami sarcoma virus
gcgaacacctgaatgaagcggaag

SEQ ID NO: 67468 - DNA, 19 bp, Homo sapiens
gcgaacactggggacccag

SEQ ID NO: 67469 - DNA, 19 bp, Homo sapiens
gaacacctgaatgagatgg

SEQ ID NO: 67470 - DNA, 20 bp, Homo sapiens
gaatcaactgaatggagtgg

SEQ ID NO: 67471 - DNA, 21 bp, Homo sapiens
gcgaaaaaaatgaggtggaag

SEQ ID NO: 67472 - DNA, 18 bp, Homo sapiens
gcgaatgcctgaatgcag

SEQ ID NO: 67473 - DNA, 23 bp, Homo sapiens
gctgacacctgaatgttgagaag

SEQ ID NO: 67474 - DNA, 19 bp, Homo sapiens
gcgaacacactgagtaggg

SEQ ID NO: 67475 - DNA, 20 bp, Homo sapiens
gcaatatctgaataaaagga

SEQ ID NO: 67476 - DNA, 21 bp, Homo sapiens
gctagcatctgggtgaaacag

SEQ ID NO: 67477 - DNA, 18 bp, Homo sapiens
acggacatagaagcggaa

SEQ ID NO: 67478 - DNA, 17 bp, Homo sapiens
gaaacagagtgaagcgg

SEQ ID NO: 67479 - DNA, 18 bp, Homo sapiens
gcaacacctggtctggga

SEQ ID NO: 67480 - DNA, 22 bp, Homo sapiens
gcagcacctgaatatttagaag

SEQ ID NO: 67481 - DNA, 19 bp, Homo sapiens
gcggacacctgaggcagga

SEQ ID NO: 67482 - DNA, 18 bp, Homo sapiens
gcaaacacctgggtgaaa

SEQ ID NO: 67483 - DNA, 18 bp, Homo sapiens
gcgacgcggacgaagcgg

SEQ ID NO: 67484 - DNA, 21 bp, Homo sapiens
gagtgtctgaatgagagtgga

SEQ ID NO: 67485 - DNA, 17 bp, Homo sapiens
gaacacctggatgagca

SEQ ID NO: 67486 - DNA, 61 bp, Alcelaphine herpesvirus 1
accacaaaatgtcacaataattattttttttaaaaaattagtagtttgtccctttgatggt

SEQ ID NO: 67487 - DNA, 24 bp, Alcelaphine herpesvirus 1
ttagtagtttgtccctttgatggt

SEQ ID NO: 67488 - DNA, 27 bp, Homo sapiens
ttagtagttttctcttgtaccatcaag

SEQ ID NO: 67489 - DNA, 22 bp, Homo sapiens
agtggtttgtcccgcagctggt

SEQ ID NO: 67490 - DNA, 21 bp, Homo sapiens
atagtttgttttttttgtggt

SEQ ID NO: 67491 - DNA, 26 bp, Homo sapiens
ttagtagtttgctttgtaccatcaag

SEQ ID NO: 67492 - DNA, 18 bp, Homo sapiens
ttagtagtttgttgcttt

SEQ ID NO: 67493 - DNA, 18 bp, Homo sapiens
tagtttgtctctaatagt

SEQ ID NO: 67494 - DNA, 18 bp, Homo sapiens
gttggtttgtctttaatg

SEQ ID NO: 67495 - DNA, 19 bp, Homo sapiens
gcagtttttttttggtggt

SEQ ID NO: 67496 - DNA, 86 bp, Alcelaphine herpesvirus 1
ggaactttaaatgtgacgcatcttttcaggtagtgttggagacatagatcagatttgagaggaaccacagaacatcaaaggtattc

SEQ ID NO: 67497 - DNA, 24 bp, Alcelaphine herpesvirus 1
tgagaggaaccacagaacatcaaa

SEQ ID NO: 67498 - DNA, 16 bp, Homo sapiens
gagaggaaccgcatca

SEQ ID NO: 67499 - DNA, 22 bp, Homo sapiens
tgaaggaaaggaggacatcaaa

SEQ ID NO: 67500 - DNA, 18 bp, Homo sapiens
gagccaacaggacatcaa

SEQ ID NO: 67501 - DNA, 26 bp, Homo sapiens
tgagaggagttcaaatatacatcaaa

SEQ ID NO: 67502 - DNA, 17 bp, Homo sapiens
tgagaggaagaagacat

SEQ ID NO: 67503 - DNA, 22 bp, Homo sapiens
tgagaggagcctgtgtgtcaaa

SEQ ID NO: 67504 - DNA, 18 bp, Homo sapiens
tgaggggaaccactggaa

SEQ ID NO: 67505 - DNA, 19 bp, Homo sapiens
tgagaggaggtacagtaca

SEQ ID NO: 67506 - DNA, 16 bp, Homo sapiens
tgagagaaaagcatca

SEQ ID NO: 67507 - DNA, 19 bp, Homo sapiens
gagaggaaccgcaggttca

SEQ ID NO: 67508 - DNA, 21 bp, Homo sapiens
tgggaggggctagacatcaaa

SEQ ID NO: 67509 - DNA, 20 bp, Homo sapiens
tgagaggaaccctagctctc

SEQ ID NO: 67510 - DNA, 19 bp, Homo sapiens
tgggaggagccgcagagca

SEQ ID NO: 67511 - DNA, 23 bp, Homo sapiens
tgagaggaactgaagccagtcaa

SEQ ID NO: 67512 - DNA, 22 bp, Homo sapiens
tgccaaacaccacagggcatca

SEQ ID NO: 67513 - DNA, 18 bp, Homo sapiens
gagaggaatcatgaagca

SEQ ID NO: 67514 - DNA, 20 bp, Homo sapiens
tgagaagaagtggcatcaga

SEQ ID NO: 67515 - DNA, 19 bp, Homo sapiens
tgagaggaaactccatcaa

SEQ ID NO: 67516 - DNA, 18 bp, Homo sapiens
tgagagaactgcagaaca

SEQ ID NO: 67517 - DNA, 19 bp, Homo sapiens
gaggggccacacactcaaa

SEQ ID NO: 67518 - DNA, 18 bp, Homo sapiens
gagagcttagaacatcaa

SEQ ID NO: 67519 - DNA, 18 bp, Homo sapiens
tggaggagccacaaaaca

SEQ ID NO: 67520 - DNA, 19 bp, Homo sapiens
tgaaggaaaccaacatcaa

SEQ ID NO: 67521 - DNA, 20 bp, Homo sapiens
tgaaaggataggaggacatc

SEQ ID NO: 67522 - DNA, 20 bp, Homo sapiens
tgatgaggggccacagaaca

SEQ ID NO: 67523 - DNA, 20 bp, Homo sapiens
tgagagggacacgaacatca

SEQ ID NO: 67524 - DNA, 19 bp, Homo sapiens
tgagaggactcatacatca

SEQ ID NO: 67525 - DNA, 24 bp, Homo sapiens
tgagaggatatcttccaagcatca

SEQ ID NO: 67526 - DNA, 17 bp, Homo sapiens
gagaaacaggacatcaa

SEQ ID NO: 67527 - DNA, 16 bp, Homo sapiens
gagggaagaacatcaa

SEQ ID NO: 67528 - DNA, 18 bp, Homo sapiens
tgagagagtccatatcaa

SEQ ID NO: 67529 - DNA, 20 bp, Homo sapiens
tgggaggaaccaattatcaa

SEQ ID NO: 67530 - DNA, 19 bp, Homo sapiens
tgagaggaacccacacaga

SEQ ID NO: 67531 - DNA, 60 bp, Fujinami sarcoma virus
ctgagtgacgtcggagggagctccacggccgggggccaagataacctaccgagaactcag

SEQ ID NO: 67532 - DNA, 24 bp, Fujinami sarcoma virus
cgtcggagggagctccacggccgg

SEQ ID NO: 67533 - DNA, 23 bp, Homo sapiens
cgctggaggggggcggtggctgg

SEQ ID NO: 67534 - DNA, 22 bp, Homo sapiens
gtcgcaagagctccgcggccgg

SEQ ID NO: 67535 - DNA, 20 bp, Homo sapiens
cgtcgggggaggtttcccga

SEQ ID NO: 67536 - DNA, 21 bp, Homo sapiens
gttggagggggcaggggccgg

SEQ ID NO: 67537 - DNA, 17 bp, Homo sapiens
cgttggggagagcagcg

SEQ ID NO: 67538 - DNA, 22 bp, Homo sapiens
atcggagggggctggctgctgg

SEQ ID NO: 67539 - DNA, 21 bp, Homo sapiens
cgtcggaggagccggggccgg

SEQ ID NO: 67540 - DNA, 20 bp, Homo sapiens
gtgggggagcccgcggctgg

SEQ ID NO: 67541 - DNA, 21 bp, Homo sapiens
cgttgaagagctcgtggctgg

SEQ ID NO: 67542 - DNA, 19 bp, Homo sapiens
cgcggaggtgctacggccg

SEQ ID NO: 67543 - DNA, 21 bp, Homo sapiens
gtcggaggcgacggcggccgg

SEQ ID NO: 67544 - DNA, 20 bp, Homo sapiens
gtcggaggggagccagctgg

SEQ ID NO: 67545 - DNA, 19 bp, Homo sapiens
cgtctgggattcacggccg

SEQ ID NO: 67546 - DNA, 21 bp, Homo sapiens
gcggagggagggaaaggccgg

SEQ ID NO: 67547 - DNA, 24 bp, Homo sapiens
cgtcagaatctcatttgtggctgg

SEQ ID NO: 67548 - DNA, 22 bp, Homo sapiens
cggcggaggagaacgcggctgg

SEQ ID NO: 67549 - DNA, 21 bp, Homo sapiens
gtaggagggagttctctgtgg

SEQ ID NO: 67550 - DNA, 15 bp, Homo sapiens
cgcggaggcacggcc

SEQ ID NO: 67551 - DNA, 17 bp, Homo sapiens
tcggagggtcgcggccg

SEQ ID NO: 67552 - DNA, 19 bp, Homo sapiens
cgttgggggagctcagcgg

SEQ ID NO: 67553 - DNA, 17 bp, Homo sapiens
gtcgggggagctcatgg

SEQ ID NO: 67554 - DNA, 22 bp, Homo sapiens
catcccacggctccacggctgg

SEQ ID NO: 67555 - DNA, 21 bp, Homo sapiens
gttgggggaggcgggggccgg

SEQ ID NO: 67556 - DNA, 22 bp, Homo sapiens
tcggccgcggcttcacggccgg

SEQ ID NO: 67557 - DNA, 20 bp, Homo sapiens
tcggaggggctcgcggccgg

SEQ ID NO: 67558 - DNA, 90 bp, Y73 sarcoma virus
gaccgtcgattccctgacgactacgagcacctgaatgaagcagaaggcttcatttggtgaccccgacgtgatcgttagggaatagtggtc

SEQ ID NO: 67559 - DNA, 24 bp, Y73 sarcoma virus
tccctgacgactacgagcacctga

SEQ ID NO: 67560 - DNA, 17 bp, Homo sapiens
cctgcgcccggcacctg

SEQ ID NO: 67561 - DNA, 22 bp, Homo sapiens
tcccgtggtgagaagcacctga

SEQ ID NO: 67562 - DNA, 19 bp, Homo sapiens
tccctgtcgactgtccctg

SEQ ID NO: 67563 - DNA, 24 bp, Homo sapiens
tccctgactgctgcccactcctga

SEQ ID NO: 67564 - DNA, 20 bp, Homo sapiens
tgacgactttaaccacctga

SEQ ID NO: 67565 - DNA, 21 bp, Homo sapiens
tccctgaggccccgcacctga

SEQ ID NO: 67566 - DNA, 24 bp, Homo sapiens
tccctgacagttggctcccacctg

SEQ ID NO: 67567 - DNA, 22 bp, Homo sapiens
tccctgttttctggagcacctg

SEQ ID NO: 67568 - DNA, 25 bp, Homo sapiens
tccctgacagccaggtgagcatttg

SEQ ID NO: 67569 - DNA, 22 bp, Homo sapiens
tccctgatgactttagcacctg

SEQ ID NO: 67570 - DNA, 19 bp, Homo sapiens
cccggtccatgagcacctg

SEQ ID NO: 67571 - DNA, 18 bp, Homo sapiens
tccttgacaactcacttg

SEQ ID NO: 67572 - DNA, 107 bp, Paramecium bursaria Chlorella virus 1
gcaattagatttgtaatgtttgataccgccaacgtctctgaagaaacaaaaatctcggctgatatagaagttgcgtcgaatcttgtcacgtttagatctgaatttgc

SEQ ID NO: 67573 - DNA, 24 bp, Paramecium bursaria Chlorella virus 1
tcgaatcttgtcacgtttagatct

SEQ ID NO: 67574 - DNA, 19 bp, Homo sapiens
gaatcttgtgtaatagtct

SEQ ID NO: 67575 - DNA, 19 bp, Homo sapiens
tcgattctcggtttagatc

SEQ ID NO: 67576 - DNA, 22 bp, Homo sapiens
tctattattgtcatgtttagat

SEQ ID NO: 67577 - DNA, 97 bp, Paramecium bursaria Chlorella virus 1
gtggcttgaacatctacttgagaagatactacgttcgaagcgaccagcgaggttacgttcaaagtgtctacgttagacgatgttaagatcaagttac

SEQ ID NO: 67578 - DNA, 24 bp, Paramecium bursaria Chlorella virus 1
ttcaaagtgtctacgttagacgat

SEQ ID NO: 67579 - DNA, 19 bp, Homo sapiens
ttcgaagtgtctatttaaa

SEQ ID NO: 67580 - DNA, 18 bp, Homo sapiens
ttcaaagtgttctgttag

SEQ ID NO: 67581 - DNA, 19 bp, Homo sapiens
aagtgtctattgcgcttga

SEQ ID NO: 67582 - DNA, 122 bp, Paramecium bursaria Chlorella virus 1
gatgttaagatcaagttaccaatattaaaaacatttgttataacattcccgaagaacgttgtgttcgtggttactgttcctacattggcatttgatatcgtagcaacattggttgtaacatc

SEQ ID NO: 67583 - DNA, 24 bp, Paramecium bursaria Chlorella virus 1
tatcgtagcaacattggttgtaac

SEQ ID NO: 67584 - DNA, 20 bp, Homo sapiens
gtagcagtattcactataac

SEQ ID NO: 67585 - DNA, 20 bp, Homo sapiens
gtagcaacatgacaggtagt

SEQ ID NO: 67586 - DNA, 17 bp, Homo sapiens
tctagcaacattcctta

SEQ ID NO: 67587 - DNA, 18 bp, Homo sapiens
tatcatagcaactgtgta

SEQ ID NO: 67588 - DNA, 20 bp, Homo sapiens
catcgtggcgacgtggtggc

SEQ ID NO: 67589 - DNA, 80 bp, Fowlpox virus
tgaaacaattacgtataaagaactatgcaatatattaggtgataagacctatataactatatttgtgagtaattgcttta

SEQ ID NO: 67590 - DNA, 24 bp, Fowlpox virus
taaagaactatgcaatatattagg

SEQ ID NO: 67591 - DNA, 18 bp, Homo sapiens
taaagagcaatgcaatat

SEQ ID NO: 67592 - DNA, 21 bp, Homo sapiens
taaagaactaatgctatttgg

SEQ ID NO: 67593 - DNA, 22 bp, Homo sapiens
taaaggctgtgcagacaccagg

SEQ ID NO: 67594 - DNA, 20 bp, Homo sapiens
gaactatgtggcacattggg

SEQ ID NO: 67595 - DNA, 88 bp, Human herpesvirus 7
taaaaacgatatactgactcggatttgatagtttatgcaaattagcgtccacctcactcgtaatagtatttatttttcatggttttta

SEQ ID NO: 67596 - DNA, 24 bp, Human herpesvirus 7
cactcgtaatagtatttatttttc

SEQ ID NO: 67597 - DNA, 24 bp, Homo sapiens
ctcattctgtagtgtttatttttc

SEQ ID NO: 67598 - DNA, 22 bp, Homo sapiens
cacttgcccaatatttattttt

SEQ ID NO: 67599 - DNA, 23 bp, Homo sapiens
cacttgtaataatccccattttc

SEQ ID NO: 67600 - DNA, 20 bp, Homo sapiens
actcttaagcattatttttc

SEQ ID NO: 67601 - DNA, 21 bp, Homo sapiens
cactctgcaaatttatttttc

SEQ ID NO: 67602 - DNA, 96 bp, Ovine adenovirus A
acctgagtgttcaaaaaaatcaataaaccatccctcaataaacttgtgctgacatcaatagtaggagtggttttctgtataagtactagctcaggt

SEQ ID NO: 67603 - DNA, 24 bp, Ovine adenovirus A
tcaatagtaggagtggttttctgt

SEQ ID NO: 67604 - DNA, 19 bp, Homo sapiens
tcagtggtaggagtgtctt

SEQ ID NO: 67605 - DNA, 22 bp, Homo sapiens
tcacatagtacttgttttctgt

SEQ ID NO: 67606 - DNA, 22 bp, Homo sapiens
cagtattgggcaagttttctgt

SEQ ID NO: 67607 - DNA, 17 bp, Homo sapiens
cagtgggatgttttctg

SEQ ID NO: 67608 - DNA, 19 bp, Homo sapiens
tcaatagtgtgggtctttg

SEQ ID NO: 67609 - DNA, 19 bp, Homo sapiens
gtagaaggggttcttctgt

SEQ ID NO: 67610 - DNA, 18 bp, Homo sapiens
taatatggatgttttctg

SEQ ID NO: 67611 - DNA, 20 bp, Homo sapiens
caatagaagtttttttctgt

SEQ ID NO: 67612 - DNA, 21 bp, Homo sapiens
cagtggtggtggtggccctgt

SEQ ID NO: 67613 - DNA, 18 bp, Homo sapiens
tcaatgctgagttttctg

SEQ ID NO: 67614 - DNA, 17 bp, Homo sapiens
taatggtatggtttctg

SEQ ID NO: 67615 - DNA, 127 bp, Lumpy skin disease virus
aacttattattgttagatgatgaaataactgatagacctacttttggatatatgtgcatcgacattgtatcagtaactataaattctatacccgttattttgttataattattaacgaacattagtt

SEQ ID NO: 67616 - DNA, 24 bp, Lumpy skin disease virus
tgaaataactgatagacctacttt

SEQ ID NO: 67617 - DNA, 23 bp, Homo sapiens
tgaaatagctgcagacctacttt

SEQ ID NO: 67618 - DNA, 19 bp, Homo sapiens
gaggtaactgacaatactt

SEQ ID NO: 67619 - DNA, 22 bp, Homo sapiens
tgaaaggctgaccgcctacttt

SEQ ID NO: 67620 - DNA, 95 bp, Tupaia herpesvirus
gcccgacgtcagtcagtcacctgaggcggtgagccacacagcccggggtgaggagcggaggtgagcgagggacggcgtaggtggcgacggtgggc

SEQ ID NO: 67621 - DNA, 24 bp, Tupaia herpesvirus
aggcggtgagccacacagcccggg

SEQ ID NO: 67622 - DNA, 18 bp, Homo sapiens
agggtgtacgcagcccgg

SEQ ID NO: 67623 - DNA, 19 bp, Homo sapiens
ggcggtgagcagtgccagg

SEQ ID NO: 67624 - DNA, 18 bp, Homo sapiens
agacggtggggcacgcgg

SEQ ID NO: 67625 - DNA, 21 bp, Homo sapiens
acgttcgccacacagtccggg

SEQ ID NO: 67626 - DNA, 18 bp, Homo sapiens
aggaggtggccagcccgg

SEQ ID NO: 67627 - DNA, 22 bp, Homo sapiens
aggtgtgagccaccatgccggg

SEQ ID NO: 67628 - DNA, 22 bp, Homo sapiens
aggcggggcgggccggcccggg

SEQ ID NO: 67629 - DNA, 21 bp, Homo sapiens
ggcggtgagcctgcacccggg

SEQ ID NO: 67630 - DNA, 23 bp, Homo sapiens
aggtgtgagccaccgtgcccggg

SEQ ID NO: 67631 - DNA, 22 bp, Homo sapiens
aggcgtgagccaccacaccggg

SEQ ID NO: 67632 - DNA, 21 bp, Homo sapiens
aggcggtgacaagagcccggg

SEQ ID NO: 67633 - DNA, 21 bp, Homo sapiens
aggcggtgcgccgtggccggg

SEQ ID NO: 67634 - DNA, 24 bp, Homo sapiens
aggcgatgaagttggtggcctggg

SEQ ID NO: 67635 - DNA, 24 bp, Homo sapiens
agctgggccaccacacagcccggg

SEQ ID NO: 67636 - DNA, 22 bp, Homo sapiens
agctgtttccacacagcctggg

SEQ ID NO: 67637 - DNA, 21 bp, Homo sapiens
aggtgtgagccatgcaatggg

SEQ ID NO: 67638 - DNA, 18 bp, Homo sapiens
ggcggtgagtcagccaag

SEQ ID NO: 67639 - DNA, 23 bp, Homo sapiens
aggcagtattggcacagcttggg

SEQ ID NO: 67640 - DNA, 22 bp, Homo sapiens
ggcgggacagcagcagcccggg

SEQ ID NO: 67641 - DNA, 18 bp, Homo sapiens
agacgccgcgcagcccgg

SEQ ID NO: 67642 - DNA, 22 bp, Homo sapiens
aggtgtgagccactgagcccgg

SEQ ID NO: 67643 - DNA, 15 bp, Homo sapiens
ggcccacacagcccg

SEQ ID NO: 67644 - DNA, 24 bp, Homo sapiens
aggcagtgggctgcagcaggtggg

SEQ ID NO: 67645 - DNA, 22 bp, Homo sapiens
aggcgtgagccactgtgctggg

SEQ ID NO: 67646 - DNA, 22 bp, Homo sapiens
aggtgtgagccaccgctccggg

SEQ ID NO: 67647 - DNA, 22 bp, Homo sapiens
gacggccccgacgtagcccggg

SEQ ID NO: 67648 - DNA, 16 bp, Homo sapiens
ggctggtgagagcccg

SEQ ID NO: 67649 - DNA, 22 bp, Homo sapiens
ggagggggctgcacagcccggg

SEQ ID NO: 67650 - DNA, 19 bp, Homo sapiens
gggggagggcgcagcccgg

SEQ ID NO: 67651 - DNA, 22 bp, Homo sapiens
aggcggtgggtggcatgcacag

SEQ ID NO: 67652 - DNA, 21 bp, Homo sapiens
agccggtgtgtgcagcccggg

SEQ ID NO: 67653 - DNA, 19 bp, Homo sapiens
aggcggtgggcgaagctgg

SEQ ID NO: 67654 - DNA, 22 bp, Homo sapiens
ggccagctttgcacagcccggg

SEQ ID NO: 67655 - DNA, 21 bp, Homo sapiens
aggcgtgagccacacgcctgg

SEQ ID NO: 67656 - DNA, 21 bp, Homo sapiens
ggggtgggcaggaagcccggg

SEQ ID NO: 67657 - DNA, 26 bp, Homo sapiens
aggtgtgagccacaggtgctcctggg

SEQ ID NO: 67658 - DNA, 22 bp, Homo sapiens
aggggtgagcgcggtgcccggg

SEQ ID NO: 67659 - DNA, 19 bp, Homo sapiens
agctggtgagccacctcgg

SEQ ID NO: 67660 - DNA, 23 bp, Homo sapiens
ggcggtgagccgggcacgtcggg

SEQ ID NO: 67661 - DNA, 17 bp, Homo sapiens
aggcggtgagtcagctg

SEQ ID NO: 67662 - DNA, 21 bp, Homo sapiens
ggcggtgatccaggctttggg

SEQ ID NO: 67663 - DNA, 24 bp, Homo sapiens
ggcggtgagctgcggcgagccggg

SEQ ID NO: 67664 - DNA, 21 bp, Homo sapiens
aggtgggggcctgagtccggg

SEQ ID NO: 67665 - DNA, 19 bp, Homo sapiens
aggcggtgagccgaccagg

SEQ ID NO: 67666 - DNA, 18 bp, Homo sapiens
aggcggtgagcttgctgg

SEQ ID NO: 67667 - DNA, 18 bp, Homo sapiens
ggcggtgagctcacccgg

SEQ ID NO: 67668 - DNA, 23 bp, Homo sapiens
aggtggggacaacccagcctggg

SEQ ID NO: 67669 - DNA, 20 bp, Homo sapiens
aggccgtgagccacaaaggg

SEQ ID NO: 67670 - DNA, 22 bp, Homo sapiens
aggcgtgagccaccgcactggg

SEQ ID NO: 67671 - DNA, 21 bp, Homo sapiens
aggcgtgagccacgcgccagg

SEQ ID NO: 67672 - DNA, 22 bp, Homo sapiens
aggcggtgggcagagcctcggg

SEQ ID NO: 67673 - DNA, 16 bp, Homo sapiens
aggcggcggcggcccg

SEQ ID NO: 67674 - DNA, 17 bp, Homo sapiens
ggcggtgaagccacagg

SEQ ID NO: 67675 - DNA, 23 bp, Homo sapiens
aggcggtggagggggagcctggg

SEQ ID NO: 67676 - DNA, 23 bp, Homo sapiens
aggcgtgagccaccgcgcccggg

SEQ ID NO: 67677 - DNA, 18 bp, Homo sapiens
aggcgatgagttgcacag

SEQ ID NO: 67678 - DNA, 21 bp, Homo sapiens
aggcggtgagcggctggtggg

SEQ ID NO: 67679 - DNA, 21 bp, Homo sapiens
ggtggggccccacagtccggg

SEQ ID NO: 67680 - DNA, 20 bp, Homo sapiens
gacggtgagcggcgtctggg

SEQ ID NO: 67681 - DNA, 19 bp, Homo sapiens
aggcagtggcccagcctgg

SEQ ID NO: 67682 - DNA, 17 bp, Homo sapiens
aggtggtgagcccacag

SEQ ID NO: 67683 - DNA, 19 bp, Homo sapiens
aggcggtggccgagtccgg

SEQ ID NO: 67684 - DNA, 22 bp, Homo sapiens
aggtgtgagccaccacgctggg

SEQ ID NO: 67685 - DNA, 15 bp, Homo sapiens
gcggacacagcccgg

SEQ ID NO: 67686 - DNA, 25 bp, Homo sapiens
ggcggtgagtcctgccacgtgcggg

SEQ ID NO: 67687 - DNA, 23 bp, Homo sapiens
ggggtggggccgcgcagcccggg

SEQ ID NO: 67688 - DNA, 22 bp, Homo sapiens
aggtgtgagccaacacgctggg

SEQ ID NO: 67689 - DNA, 27 bp, Homo sapiens
aggcggtgggcagtggcggtccctggg

SEQ ID NO: 67690 - DNA, 22 bp, Homo sapiens
aggtgtgagccaccgcccccgg

SEQ ID NO: 67691 - DNA, 20 bp, Homo sapiens
acggggccacacagcctggg

SEQ ID NO: 67692 - DNA, 23 bp, Homo sapiens
ggctacacactgtgcagcccggg

SEQ ID NO: 67693 - DNA, 22 bp, Homo sapiens
aggtgtgagccaccatgctggg

SEQ ID NO: 67694 - DNA, 22 bp, Homo sapiens
aggcgtgagccaccgtgccggg

SEQ ID NO: 67695 - DNA, 21 bp, Homo sapiens
gacggtgagtcagatctcggg

SEQ ID NO: 67696 - DNA, 20 bp, Homo sapiens
ggtgaaccacacagcctggg

SEQ ID NO: 67697 - DNA, 19 bp, Homo sapiens
aggcgatggcttggcccgg

SEQ ID NO: 67698 - DNA, 18 bp, Homo sapiens
aggcagggtacagcccgg

SEQ ID NO: 67699 - DNA, 22 bp, Homo sapiens
aggcgtgagccacagtatcggg

SEQ ID NO: 67700 - DNA, 20 bp, Homo sapiens
ggcggggcgctcagcccggg

SEQ ID NO: 67701 - DNA, 15 bp, Homo sapiens
aggcgtgagccaccg

SEQ ID NO: 67702 - DNA, 21 bp, Homo sapiens
aggcggtgggcagtggcaggg

SEQ ID NO: 67703 - DNA, 18 bp, Homo sapiens
ggcgtggacgcagcccgg

SEQ ID NO: 67704 - DNA, 23 bp, Homo sapiens
aggtgtgagccacagcgcccggg

SEQ ID NO: 67705 - DNA, 25 bp, Homo sapiens
aggcggggagccgcccgcgctcggg

SEQ ID NO: 67706 - DNA, 21 bp, Homo sapiens
aggcgtgagccacgcgcccgg

SEQ ID NO: 67707 - DNA, 76 bp, Tupaia herpesvirus
ggagagggacagagaggacacaacggagtcgaggttgccaaggaaccgggcgttttattgtcttttttgcgtctcc

SEQ ID NO: 67708 - DNA, 24 bp, Tupaia herpesvirus
gaggacacaacggagtcgaggttg

SEQ ID NO: 67709 - DNA, 23 bp, Homo sapiens
gaggatggggtggggcgaggttg

SEQ ID NO: 67710 - DNA, 21 bp, Homo sapiens
gaggctgagaagtcgaggttg

SEQ ID NO: 67711 - DNA, 23 bp, Homo sapiens
aggacacaatggggcgcgggttg

SEQ ID NO: 67712 - DNA, 21 bp, Homo sapiens
gaggacacagaggggaaattg

SEQ ID NO: 67713 - DNA, 16 bp, Homo sapiens
gaggacacaggagggt

SEQ ID NO: 67714 - DNA, 23 bp, Homo sapiens
gaggttgcagtgagccgaggttg

SEQ ID NO: 67715 - DNA, 19 bp, Homo sapiens
ggacatagtgacaaagttg

SEQ ID NO: 67716 - DNA, 17 bp, Homo sapiens
gggacacagcggagtca

SEQ ID NO: 67717 - DNA, 20 bp, Homo sapiens
ggacagtggagtcaaacctg

SEQ ID NO: 67718 - DNA, 23 bp, Homo sapiens
gaggatgcagtgagccgaggttg

SEQ ID NO: 67719 - DNA, 23 bp, Homo sapiens
ggacacagtggagatcaaggttg

SEQ ID NO: 67720 - DNA, 127 bp, Sheeppox virus
aacttattattgttagatgacgaaataactgatagacctactttcggatatatgtgaatcgacattgtatcagtaactataaattctatacccgttattttgttataattattaacgaacattagtt

SEQ ID NO: 67721 - DNA, 24 bp, Sheeppox virus
tgacgaaataactgatagacctac

SEQ ID NO: 67722 - DNA, 19 bp, Homo sapiens
tgacaaaataataaacact

SEQ ID NO: 67723 - DNA, 18 bp, Homo sapiens
aaaattgcatagacctac

SEQ ID NO: 67724 - DNA, 71 bp, Equine herpesvirus 1
gggtttaagcaatcagaggcgtgtctcattttggtacgccacacgccgtacgtctgaaagatatcaagccc

SEQ ID NO: 67725 - DNA, 19 bp, Equine herpesvirus 1
tctgaaagatatcaagccc

SEQ ID NO: 67726 - DNA, 16 bp, Homo sapiens
tccgaagtccaagccc

SEQ ID NO: 67727 - DNA, 15 bp, Homo sapiens
cctgaacaccaagcc

SEQ ID NO: 67728 - DNA, 21 bp, Homo sapiens
tctgaaaattattttcaggcc

SEQ ID NO: 67729 - DNA, 17 bp, Homo sapiens
tctgaaaaccaccagcc

SEQ ID NO: 67730 - DNA, 17 bp, Homo sapiens
cctgggagaccaagccc

SEQ ID NO: 67731 - DNA, 20 bp, Homo sapiens
taaaagatcttcccaagccc

SEQ ID NO: 67732 - DNA, 17 bp, Homo sapiens
cctgaaaacacaaagcc

SEQ ID NO: 67733 - DNA, 17 bp, Homo sapiens
tctaaaaagagaagccc

SEQ ID NO: 67734 - DNA, 17 bp, Homo sapiens
cctgagataccaggccc

SEQ ID NO: 67735 - DNA, 17 bp, Homo sapiens
tctagagacaccaggcc

SEQ ID NO: 67736 - DNA, 16 bp, Homo sapiens
tctgaaaagaaagccc

SEQ ID NO: 67737 - DNA, 19 bp, Homo sapiens
ctgggagacaccagagccc

SEQ ID NO: 67738 - DNA, 16 bp, Homo sapiens
tctgaaaaaccagccc

SEQ ID NO: 67739 - DNA, 20 bp, Homo sapiens
cctgaaagggcgacaagccc

SEQ ID NO: 67740 - DNA, 18 bp, Homo sapiens
tctaaaacaaccaagccc

SEQ ID NO: 67741 - DNA, 16 bp, Homo sapiens
cctgaaaagaaagccc

SEQ ID NO: 67742 - DNA, 18 bp, Homo sapiens
tctgaaaagcaggagccc

SEQ ID NO: 67743 - DNA, 16 bp, Homo sapiens
cctgagaaccaagccc

SEQ ID NO: 67744 - DNA, 18 bp, Homo sapiens
tccgaaagacactgcaag

SEQ ID NO: 67745 - DNA, 18 bp, Homo sapiens
tctgaaaagatactcaag

SEQ ID NO: 67746 - DNA, 19 bp, Homo sapiens
tctgtaagacaccagggcc

SEQ ID NO: 67747 - DNA, 16 bp, Homo sapiens
cctgaaaaacaggccc

SEQ ID NO: 67748 - DNA, 16 bp, Homo sapiens
ctggaagaccaagccc

SEQ ID NO: 67749 - DNA, 16 bp, Homo sapiens
tctgaaagcatatgcc

SEQ ID NO: 67750 - DNA, 19 bp, Homo sapiens
cctgagaagccccaagccc

SEQ ID NO: 67751 - DNA, 17 bp, Homo sapiens
tctggcaagccaagccc

SEQ ID NO: 67752 - DNA, 18 bp, Homo sapiens
tctgaaaacacggggccc

SEQ ID NO: 67753 - DNA, 15 bp, Homo sapiens
tctgaaaaatacacc

SEQ ID NO: 67754 - DNA, 19 bp, Homo sapiens
cctgaaagacctctcaagc

SEQ ID NO: 67755 - DNA, 18 bp, Homo sapiens
tctgaaaagatacacaaa

SEQ ID NO: 67756 - DNA, 18 bp, Homo sapiens
tctgacaaagccaagccc

SEQ ID NO: 67757 - DNA, 16 bp, Homo sapiens
cctggacatcaagtcc

SEQ ID NO: 67758 - DNA, 15 bp, Homo sapiens
tctgaaagtatagcc

SEQ ID NO: 67759 - DNA, 16 bp, Homo sapiens
tctgagagccaagccc

SEQ ID NO: 67760 - DNA, 18 bp, Homo sapiens
tctaaacaaatcaagccc

SEQ ID NO: 67761 - DNA, 18 bp, Homo sapiens
tgaaagatacctgaagcc

SEQ ID NO: 67762 - DNA, 18 bp, Homo sapiens
tctgggagcaccaagccc

SEQ ID NO: 67763 - DNA, 17 bp, Homo sapiens
tcagaaagataccaccc

SEQ ID NO: 67764 - DNA, 18 bp, Homo sapiens
ctggagaccgtcaagccc

SEQ ID NO: 67765 - DNA, 17 bp, Homo sapiens
cctgaaaatatgagccc

SEQ ID NO: 67766 - DNA, 19 bp, Homo sapiens
cctgagatgagtcaagccc

SEQ ID NO: 67767 - DNA, 19 bp, Homo sapiens
tctgatgcacttcaagccc

SEQ ID NO: 67768 - DNA, 18 bp, Homo sapiens
tcttgaaatgtcaagccc

SEQ ID NO: 67769 - DNA, 18 bp, Homo sapiens
tctgaaagatggcaatcc

SEQ ID NO: 67770 - DNA, 17 bp, Homo sapiens
tctgaaaagcagagccc

SEQ ID NO: 67771 - DNA, 20 bp, Homo sapiens
tctgaaagcaccaagggtcc

SEQ ID NO: 67772 - DNA, 18 bp, Homo sapiens
tctgaaaaactcatgtcc

SEQ ID NO: 67773 - DNA, 17 bp, Homo sapiens
tctgaaaaatacagccc

SEQ ID NO: 67774 - DNA, 19 bp, Homo sapiens
tctcaaacacaccaagccc

SEQ ID NO: 67775 - DNA, 19 bp, Homo sapiens
tctgaaagtagcattggcc

SEQ ID NO: 67776 - DNA, 17 bp, Homo sapiens
tctgaaaatatcttgcc

SEQ ID NO: 67777 - DNA, 17 bp, Homo sapiens
tctggaacatcaaggcc

SEQ ID NO: 67778 - DNA, 20 bp, Homo sapiens
tctgaaagacagtgaagccc

SEQ ID NO: 67779 - DNA, 17 bp, Homo sapiens
ctggacatttcaagccc

SEQ ID NO: 67780 - DNA, 17 bp, Homo sapiens
tccggagagccaagccc

SEQ ID NO: 67781 - DNA, 18 bp, Homo sapiens
tctgtgagaaccaagccc

SEQ ID NO: 67782 - DNA, 22 bp, Homo sapiens
tctgaaaaaccctcttcaggcc

SEQ ID NO: 67783 - DNA, 19 bp, Homo sapiens
cctgggattagtcaagccc

SEQ ID NO: 67784 - DNA, 17 bp, Homo sapiens
tctaaataaccaagccc

SEQ ID NO: 67785 - DNA, 20 bp, Homo sapiens
cctgaaagtactgtaggccc

SEQ ID NO: 67786 - DNA, 18 bp, Homo sapiens
ctgagacagcatcaagcc

SEQ ID NO: 67787 - DNA, 20 bp, Homo sapiens
tctgaaagttgcaccagccc

SEQ ID NO: 67788 - DNA, 17 bp, Homo sapiens
tctaaagaaatcaagcc

SEQ ID NO: 67789 - DNA, 15 bp, Homo sapiens
tctggacccaagccc

SEQ ID NO: 67790 - DNA, 22 bp, Homo sapiens
tctgaaagaaaggcagtagccc

SEQ ID NO: 67791 - DNA, 92 bp, Canine adenovirus
cacattagcataagatgtacttgtaacaaaccgcgtcctcacctaagcctaattgaggcggcctgttctatgtataaccttgactagatgtg

SEQ ID NO: 67792 - DNA, 24 bp, Canine adenovirus
tgtaacaaaccgcgtcctcaccta

SEQ ID NO: 67793 - DNA, 18 bp, Homo sapiens
tgtaacaaactgcaatct

SEQ ID NO: 67794 - DNA, 23 bp, Homo sapiens
tgtaacaaaattgcagaaaccta

SEQ ID NO: 67795 - DNA, 18 bp, Homo sapiens
tgtgacaaaccgtgctca

SEQ ID NO: 67796 - DNA, 17 bp, Homo sapiens
tgtaacaagctggtcct

SEQ ID NO: 67797 - DNA, 16 bp, Homo sapiens
tgtagcagcgctcacc

SEQ ID NO: 67798 - DNA, 21 bp, Homo sapiens
tgtaacaaacctgcacatcct

SEQ ID NO: 67799 - DNA, 20 bp, Homo sapiens
tgtaacaaacctgcacattc

SEQ ID NO: 67800 - DNA, 20 bp, Homo sapiens
tgagacaaaccagctgctca

SEQ ID NO: 67801 - DNA, 22 bp, Homo sapiens
tggcacagcccaggctcaccta

SEQ ID NO: 67802 - DNA, 20 bp, Homo sapiens
tgaactgccctactcaccta

SEQ ID NO: 67803 - DNA, 21 bp, Homo sapiens
tgtaacaaacctgcaggtcct

SEQ ID NO: 67804 - DNA, 20 bp, Homo sapiens
tgtaaaagtctcctcaccta

SEQ ID NO: 67805 - DNA, 22 bp, Homo sapiens
tgtaacaaatcactccagccta

SEQ ID NO: 67806 - DNA, 70 bp, Fowlpox virus
ggatagctctgcgcagctataccccacttaataaattataccgcgcagagtataaaagattatattatcc

SEQ ID NO: 67807 - DNA, 24 bp, Fowlpox virus
taccgcgcagagtataaaagatta

SEQ ID NO: 67808 - DNA, 23 bp, Homo sapiens
gctgttatcaatataaaagatta

SEQ ID NO: 67809 - DNA, 18 bp, Homo sapiens
gcaaggtataaaagatta

SEQ ID NO: 67810 - DNA, 18 bp, Homo sapiens
cgcagagttaaaggatta

SEQ ID NO: 67811 - DNA, 19 bp, Homo sapiens
cccaaggtgtaaaagatta

SEQ ID NO: 67812 - DNA, 18 bp, Homo sapiens
gagcatttaaaaagatta

SEQ ID NO: 67813 - DNA, 64 bp, Melanoplus sanguinipes entomopoxvirus
tattttgaaagatatgagtaaaatatttaatgaaataagtaacttatttaataatttcaaaata

SEQ ID NO: 67814 - DNA, 24 bp, Melanoplus sanguinipes entomopoxvirus
tgaaagatatgagtaaaatattta

SEQ ID NO: 67815 - DNA, 23 bp, Homo sapiens
tgacaagataatgagaaatattt

SEQ ID NO: 67816 - DNA, 20 bp, Homo sapiens
aaaatttaagtaaaatattt

SEQ ID NO: 67817 - DNA, 21 bp, Homo sapiens
aaagatactcctaaaatattt

SEQ ID NO: 67818 - DNA, 22 bp, Homo sapiens
aaagatgaaagcaaaatgttta

SEQ ID NO: 67819 - DNA, 20 bp, Homo sapiens
gaaaggatgtaaaatattta

SEQ ID NO: 67820 - DNA, 19 bp, Homo sapiens
gaaagaagtaaaatattta

SEQ ID NO: 67821 - DNA, 25 bp, Homo sapiens
gaaagatatgagtaaagttcattta

SEQ ID NO: 67822 - DNA, 21 bp, Homo sapiens
tgaagatatgaaacctattta

SEQ ID NO: 67823 - DNA, 22 bp, Homo sapiens
tgaaagatatttaaaatattta

SEQ ID NO: 67824 - DNA, 20 bp, Homo sapiens
gaaaggtgagggaaatattt

SEQ ID NO: 67825 - DNA, 20 bp, Homo sapiens
aagattaagtagaatattta

SEQ ID NO: 67826 - DNA, 115 bp, Equine herpesvirus 1
gtggtgggagtgggcgtggtatgcgggggttctttgtttaaattgggcccaggcggatcagtgccagttttgtttgcattgggggcctgtgcggcatgcgacactcctcaattgc

SEQ ID NO: 67827 - DNA, 24 bp, Equine herpesvirus 1
tttaaattgggcccaggcggatca

SEQ ID NO: 67828 - DNA, 22 bp, Homo sapiens
tcggcgttgcccaggcgggtca

SEQ ID NO: 67829 - DNA, 20 bp, Homo sapiens
ttaaagttgggccctagtca

SEQ ID NO: 67830 - DNA, 19 bp, Homo sapiens
tttaaattggggccaggca

SEQ ID NO: 67831 - DNA, 18 bp, Homo sapiens
ttcaaattgggcctgtgg

SEQ ID NO: 67832 - DNA, 21 bp, Homo sapiens
tttaagttaggcccatggtca

SEQ ID NO: 67833 - DNA, 83 bp, Chimpanzee cytomegalovirus
acgtcgagcccgcgttggggcatatcacgctactgtacagctctgcactaagcactttatactctcaccggcacgttcgacgt

SEQ ID NO: 67834 - DNA, 18 bp, Chimpanzee cytomegalovirus
caccggcacgttcgacgt

SEQ ID NO: 67835 - DNA, 15 bp, Homo sapiens
caccagcactcgcgt

SEQ ID NO: 67836 - DNA, 17 bp, Homo sapiens
cactcgcacgctcacgt

SEQ ID NO: 67837 - DNA, 17 bp, Homo sapiens
cacatggaccccgacgt

SEQ ID NO: 67838 - DNA, 16 bp, Homo sapiens
caccagcactccacgt

SEQ ID NO: 67839 - DNA, 17 bp, Homo sapiens
caccgacagcgccacgt

SEQ ID NO: 67840 - DNA, 17 bp, Homo sapiens
caccgacagtgcagcgt

SEQ ID NO: 67841 - DNA, 18 bp, Homo sapiens
caccagcactgctgatgt

SEQ ID NO: 67842 - DNA, 19 bp, Homo sapiens
acgggcacatcgtcgatgt

SEQ ID NO: 67843 - DNA, 18 bp, Homo sapiens
caccagcacgccggacgt

SEQ ID NO: 67844 - DNA, 18 bp, Homo sapiens
caccagcagctcggacgt

SEQ ID NO: 67845 - DNA, 17 bp, Homo sapiens
caccagcatgcccgcgt

SEQ ID NO: 67846 - DNA, 23 bp, Homo sapiens
ccggcacatcagagttcgatgta

SEQ ID NO: 67847 - DNA, 18 bp, Homo sapiens
cactggcacgctgcgcgt

SEQ ID NO: 67848 - DNA, 20 bp, Homo sapiens
cactcgcacacacacggcgt

SEQ ID NO: 67849 - DNA, 17 bp, Homo sapiens
cactggcatgtcaacat

SEQ ID NO: 67850 - DNA, 20 bp, Homo sapiens
caccagcacctcaccgatgt

SEQ ID NO: 67851 - DNA, 17 bp, Homo sapiens
caccggcttcccaacgt

SEQ ID NO: 67852 - DNA, 16 bp, Homo sapiens
caccagcagccaatgt

SEQ ID NO: 67853 - DNA, 15 bp, Homo sapiens
caccgacagccacgt

SEQ ID NO: 67854 - DNA, 18 bp, Homo sapiens
cacccgcagggctgacgt

SEQ ID NO: 67855 - DNA, 17 bp, Homo sapiens
cactggcacgcccacgt

SEQ ID NO: 67856 - DNA, 17 bp, Homo sapiens
caccagcatgtgcacgt

SEQ ID NO: 67857 - DNA, 16 bp, Homo sapiens
cacaggcacgtaacat

SEQ ID NO: 67858 - DNA, 63 bp, Lumpy skin disease virus
atttgttattaaatgaataaaattagattcatctatatcttcttcactcatttaaaaacttat

SEQ ID NO: 67859 - DNA, 24 bp, Lumpy skin disease virus
taaatgaataaaattagattcatc

SEQ ID NO: 67860 - DNA, 25 bp, Homo sapiens
taaatgagtaaaaataaataacatc

SEQ ID NO: 67861 - DNA, 19 bp, Homo sapiens
aatgaatattaaattcatc

SEQ ID NO: 67862 - DNA, 19 bp, Homo sapiens
aaatgaataaataattcat

SEQ ID NO: 67863 - DNA, 17 bp, Homo sapiens
tgaataattagattcat

SEQ ID NO: 67864 - DNA, 19 bp, Homo sapiens
aatgaataaaacaaatcat

SEQ ID NO: 67865 - DNA, 18 bp, Homo sapiens
atgagtaaaattagattc

SEQ ID NO: 67866 - DNA, 69 bp, Monkeypox virus
tagtcacgactgaaataaccgcgtgattattttttggtataattctacacggcatggtttctgtgacta

SEQ ID NO: 67867 - DNA, 20 bp, Monkeypox virus
cggcatggtttctgtgacta

SEQ ID NO: 67868 - DNA, 18 bp, Homo sapiens
ggcacagcttctgtggct

SEQ ID NO: 67869 - DNA, 17 bp, Homo sapiens
cggcgccttctgtggct

SEQ ID NO: 67870 - DNA, 19 bp, Homo sapiens
cggcttgctttctgtggct

SEQ ID NO: 67871 - DNA, 16 bp, Homo sapiens
ggaatttctgtgacta

SEQ ID NO: 67872 - DNA, 18 bp, Homo sapiens
ggcatagtttagttccta

SEQ ID NO: 67873 - DNA, 16 bp, Homo sapiens
ggcttggtctagacta

SEQ ID NO: 67874 - DNA, 18 bp, Homo sapiens
cggcagggagtgtgacta

SEQ ID NO: 67875 - DNA, 19 bp, Homo sapiens
cagcatggtgacttgacta

SEQ ID NO: 67876 - DNA, 16 bp, Homo sapiens
gacatctcctgtggct

SEQ ID NO: 67877 - DNA, 18 bp, Homo sapiens
aacgtggtttctgtggct

SEQ ID NO: 67878 - DNA, 19 bp, Homo sapiens
cagcatggtttcctagact

SEQ ID NO: 67879 - DNA, 17 bp, Homo sapiens
cagcatgtctgtggcta

SEQ ID NO: 67880 - DNA, 17 bp, Homo sapiens
cagcagttctgtgacta

SEQ ID NO: 67881 - DNA, 18 bp, Homo sapiens
gacatgatgattgtgact

SEQ ID NO: 67882 - DNA, 19 bp, Homo sapiens
ggcaggacagtctgtgact

SEQ ID NO: 67883 - DNA, 19 bp, Homo sapiens
gacccccagttctgtgact

SEQ ID NO: 67884 - DNA, 18 bp, Homo sapiens
cgacatggtttcgcaact

SEQ ID NO: 67885 - DNA, 16 bp, Homo sapiens
gggtggtctctgacta

SEQ ID NO: 67886 - DNA, 17 bp, Homo sapiens
ggctcatctctgtgact

SEQ ID NO: 67887 - DNA, 20 bp, Homo sapiens
cggcgcgtgccgcgtgacta

SEQ ID NO: 67888 - DNA, 16 bp, Homo sapiens
gacatcttctgtggct

SEQ ID NO: 67889 - DNA, 20 bp, Homo sapiens
ggcatgattttgcagcggct

SEQ ID NO: 67890 - DNA, 19 bp, Homo sapiens
ggcatggtctcagctcact

SEQ ID NO: 67891 - DNA, 19 bp, Homo sapiens
ggcatggtctcggctcact

SEQ ID NO: 67892 - DNA, 20 bp, Homo sapiens
ggcatggtggcaagtgacta

SEQ ID NO: 67893 - DNA, 19 bp, Homo sapiens
ggtattatctttgtgacta

SEQ ID NO: 67894 - DNA, 20 bp, Homo sapiens
ggctcctgtgtctgtgacta

SEQ ID NO: 67895 - DNA, 18 bp, Homo sapiens
ggaagcccagctgtgact

SEQ ID NO: 67896 - DNA, 19 bp, Homo sapiens
atggtaaatcttgtgacta

SEQ ID NO: 67897 - DNA, 19 bp, Homo sapiens
ggcatgattttggctcact

SEQ ID NO: 67898 - DNA, 17 bp, Homo sapiens
cagccactctgtgacta

SEQ ID NO: 67899 - DNA, 18 bp, Homo sapiens
cagcacttccctgtgact

SEQ ID NO: 67900 - DNA, 15 bp, Homo sapiens
gacatggtttgtgct

SEQ ID NO: 67901 - DNA, 17 bp, Homo sapiens
ggctggtctccatgact

SEQ ID NO: 67902 - DNA, 17 bp, Homo sapiens
ggagatgttctgtgact

SEQ ID NO: 67903 - DNA, 18 bp, Homo sapiens
cggctttactttctgtga

SEQ ID NO: 67904 - DNA, 19 bp, Homo sapiens
ggaatggtttcacaagcta

SEQ ID NO: 67905 - DNA, 15 bp, Homo sapiens
cgacgccctgtgact

SEQ ID NO: 67906 - DNA, 19 bp, Homo sapiens
cagcatgacggtcctgtga

SEQ ID NO: 67907 - DNA, 18 bp, Homo sapiens
gcaaatccgtctgtgact

SEQ ID NO: 67908 - DNA, 16 bp, Homo sapiens
ggcagctgctgtgact

SEQ ID NO: 67909 - DNA, 16 bp, Homo sapiens
gacatttctgtggcta

SEQ ID NO: 67910 - DNA, 18 bp, Homo sapiens
cagcatggccaggtggct

SEQ ID NO: 67911 - DNA, 18 bp, Homo sapiens
ggatggtttcggtctact

SEQ ID NO: 67912 - DNA, 16 bp, Homo sapiens
ggaaccttctgtgact

SEQ ID NO: 67913 - DNA, 16 bp, Homo sapiens
gcagctcctgtgacta

SEQ ID NO: 67914 - DNA, 16 bp, Homo sapiens
gacattgtttgtgact

SEQ ID NO: 67915 - DNA, 19 bp, Homo sapiens
cggcgatggttttccgact

SEQ ID NO: 67916 - DNA, 17 bp, Homo sapiens
ggggattactgtgacta

SEQ ID NO: 67917 - DNA, 15 bp, Homo sapiens
gcgatcctgtgacta

SEQ ID NO: 67918 - DNA, 16 bp, Homo sapiens
gacagttttgtgacta

SEQ ID NO: 67919 - DNA, 16 bp, Homo sapiens
ggcatgatttcaaact

SEQ ID NO: 67920 - DNA, 16 bp, Homo sapiens
ggcgtgatctgtgact

SEQ ID NO: 67921 - DNA, 16 bp, Homo sapiens
ggcggctgctgtgact

SEQ ID NO: 67922 - DNA, 19 bp, Homo sapiens
cagcatggtttttgtgact

SEQ ID NO: 67923 - DNA, 19 bp, Homo sapiens
cgtaagccctttgtgacta

SEQ ID NO: 67924 - DNA, 17 bp, Homo sapiens
ggcacctgcctgtgact

SEQ ID NO: 67925 - DNA, 18 bp, Homo sapiens
ggtgtggccatgtgacta

SEQ ID NO: 67926 - DNA, 18 bp, Homo sapiens
gacatcggatctgtgact

SEQ ID NO: 67927 - DNA, 18 bp, Homo sapiens
ggtaaaattttgtgacta

SEQ ID NO: 67928 - DNA, 17 bp, Homo sapiens
ggacacttcctgtggct

SEQ ID NO: 67929 - DNA, 17 bp, Homo sapiens
gcattgggttgtgacta

SEQ ID NO: 67930 - DNA, 19 bp, Homo sapiens
ggcgagtccttctgtgact

SEQ ID NO: 67931 - DNA, 16 bp, Homo sapiens
cggcatgatcatgact

SEQ ID NO: 67932 - DNA, 19 bp, Homo sapiens
cagttctgatttgtgacta

SEQ ID NO: 67933 - DNA, 18 bp, Homo sapiens
ggcatggctcacgtggct

SEQ ID NO: 67934 - DNA, 18 bp, Homo sapiens
ggtatattttctgtggct

SEQ ID NO: 67935 - DNA, 17 bp, Homo sapiens
ggcaggcctctgtggct

SEQ ID NO: 67936 - DNA, 17 bp, Homo sapiens
ggcacctctctgtgact

SEQ ID NO: 67937 - DNA, 19 bp, Homo sapiens
ggtatggtctcggctcact

SEQ ID NO: 67938 - DNA, 18 bp, Homo sapiens
agaatgatttctgtgact

SEQ ID NO: 67939 - DNA, 106 bp, Rat cytomegalovirus
gagagagaaagagacagagagacgcgagacgaaagagaccacgggacgccacacgaccacgtttttatctttttttattctgcgttttttatccgctttctttttt

SEQ ID NO: 67940 - DNA, 24 bp, Rat cytomegalovirus
accacgtttttatctttttttatt

SEQ ID NO: 67941 - DNA, 20 bp, Homo sapiens
cgaatttgtctttttttatt

SEQ ID NO: 67942 - DNA, 20 bp, Homo sapiens
ccacagtttttattttcctt

SEQ ID NO: 67943 - DNA, 17 bp, Homo sapiens
gcatcatctttttttat

SEQ ID NO: 67944 - DNA, 18 bp, Homo sapiens
ccacgtttctgttttctt

SEQ ID NO: 67945 - DNA, 18 bp, Homo sapiens
gtttttatcttcagatat

SEQ ID NO: 67946 - DNA, 25 bp, Homo sapiens
ccacctttctactattttttttatt

SEQ ID NO: 67947 - DNA, 18 bp, Homo sapiens
atttccatctttttttat

SEQ ID NO: 67948 - DNA, 23 bp, Homo sapiens
accagtcaagcactttttttatt

SEQ ID NO: 67949 - DNA, 19 bp, Homo sapiens
gtctttaatctttttttat

SEQ ID NO: 67950 - DNA, 60 bp, Cowpox virus
aaataaaattctgattggtcaatgtgaatgtattcacttaacagttccacaaatttattt

SEQ ID NO: 67951 - DNA, 60 bp, Cowpox virus; identical to SEQ ID NO: 67950

SEQ ID NO: 67952 - DNA, 22 bp, Homo sapiens
tgatggttctttgaatgtattc

SEQ ID NO: 67953 - DNA, 21 bp, Homo sapiens
tgattggttggtgtcaaatgt

SEQ ID NO: 67954 - DNA, 19 bp, Homo sapiens
tgattggtcaactggctgt

SEQ ID NO: 67955 - DNA, 19 bp, Homo sapiens
tggttggcaatgtctctgt

SEQ ID NO: 67956 - DNA, 19 bp, Homo sapiens
tgttggtcaattatgtatt

SEQ ID NO: 67957 - DNA, 70 bp, Equine herpesvirus 4
ctaccaatcttcaaatatcgcccatttaacagtacaaaactagggggtatggcggttttgaagctcgtag

SEQ ID NO: 67958 - DNA, 24 bp, Equine herpesvirus 4
tatcgcccatttaacagtacaaaa

SEQ ID NO: 67959 - DNA, 21 bp, Homo sapiens
tatcacccatttgaatgacag

SEQ ID NO: 67960 - DNA, 22 bp, Homo sapiens
tatcgccgccgtgagtacaaaa

SEQ ID NO: 67961 - DNA, 20 bp, Homo sapiens
tatctccattttacagacaa

SEQ ID NO: 67962 - DNA, 22 bp, Homo sapiens
tatctctcatcacaagtacaaa

SEQ ID NO: 67963 - DNA, 16 bp, Homo sapiens
tcacgccaacagtaca

SEQ ID NO: 67964 - DNA, 19 bp, Homo sapiens
tatggcccccacagtacaa

SEQ ID NO: 67965 - DNA, 60 bp, Variola virus
aaataaaattctgattggtcaatgtgaatgtattcacttaacaattccacaaatttattt

SEQ ID NO: 67966 - DNA, 76 bp, Camelpox virus
gattattttttggtataattctacacggcatagtttctgtaactatgaattctacccccgttacatttgtataatc

SEQ ID NO: 67967 - DNA, 24 bp, Camelpox virus
tatgaattctacccccgttacatt

SEQ ID NO: 67968 - DNA, 18 bp, Homo sapiens
tatgaatcttaccctcgc

SEQ ID NO: 67969 - DNA, 17 bp, Homo sapiens
tgaattctaccacatta

SEQ ID NO: 67970 - DNA, 18 bp, Homo sapiens
tatgaattcacctgtgtt

SEQ ID NO: 67971 - DNA, 23 bp, Homo sapiens
atgaattctatctcttcccagtt

SEQ ID NO: 67972 - DNA, 25 bp, Homo sapiens
tatgaattcttccctgtaaagcatt

SEQ ID NO: 67973 - DNA, 18 bp, Homo sapiens
tatgaattctccgacgtt

SEQ ID NO: 67974 - DNA, 24 bp, Homo sapiens
tatgaattctaattaagagacatt

SEQ ID NO: 67975 - DNA, 21 bp, Homo sapiens
tatgaattctattatcccatc

SEQ ID NO: 67976 - DNA, 19 bp, Homo sapiens
tgaaaccctctgttacatt

SEQ ID NO: 67977 - DNA, 20 bp, Homo sapiens
gaaaaaccctttgttacatt

SEQ ID NO: 67978 - DNA, 25 bp, Homo sapiens
taaattctactccaggacatacatt

SEQ ID NO: 67979 - DNA, 91 bp, Gallid herpesvirus 3
ggcgcgccaataggtagggatggatctacgtatgtcaatggaggccgtataaagcttcaataatacgttccctaaaatgctgtgctccgcc

SEQ ID NO: 67980 - DNA, 24 bp, Gallid herpesvirus 3
tacgttccctaaaatgctgtgctc

SEQ ID NO: 67981 - DNA, 19 bp, Homo sapiens
cgttccctaaatcccactc

SEQ ID NO: 67982 - DNA, 20 bp, Homo sapiens
acgcttgaaatgctgtgttc

SEQ ID NO: 67983 - DNA, 18 bp, Homo sapiens
tacgttccctgaaattcc

SEQ ID NO: 67984 - DNA, 21 bp, Homo sapiens
gcttgacaaaatgctgtgttc

SEQ ID NO: 67985 - DNA, 19 bp, Homo sapiens
gttgccctggctggtgctc

SEQ ID NO: 67986 - DNA, 16 bp, Homo sapiens
tacatgaaatgctgtg

SEQ ID NO: 67987 - DNA, 19 bp, Homo sapiens
tacattccctgagatgagt

SEQ ID NO: 67988 - DNA, 19 bp, Homo sapiens
ttctttaaaatgcaaactc

SEQ ID NO: 67989 - DNA, 18 bp, Homo sapiens
tacattctttaaaatact

SEQ ID NO: 67990 - DNA, 18 bp, Homo sapiens
gtgatccctaaaggctgt

SEQ ID NO: 67991 - DNA, 21 bp, Homo sapiens
gttccctggggtgccatgctc

SEQ ID NO: 67992 - DNA, 20 bp, Homo sapiens
gttcctgttatcctgtgctc

SEQ ID NO: 67993 - DNA, 67 bp, Rat cytomegalovirus
catgggatccggttcgtaatcgcgctatcgtcttcgtaaaggttgtcgttacgaacatatcccgatg

SEQ ID NO: 67994 - DNA, 24 bp, Rat cytomegalovirus
aaggttgtcgttacgaacatatcc

SEQ ID NO: 67995 - DNA, 19 bp, Homo sapiens
aaggttgtcattaaatatc

SEQ ID NO: 67996 - DNA, 17 bp, Homo sapiens
aaggttgtgaacatatc

SEQ ID NO: 67997 - DNA, 21 bp, Homo sapiens
agcttgtcgttgttggcatat

SEQ ID NO: 67998 - DNA, 18 bp, Homo sapiens
ggctgtcgtcttcatatc

SEQ ID NO: 67999 - DNA, 22 bp, Homo sapiens
aaagttgtccttgaacatgtcc

SEQ ID NO: 68000 - DNA, 64 bp, Simian immunodeficiency virus
gggaatacagacatcattggcaggtgcaatggcagttttggacctacagccagttcattatccc

SEQ ID NO: 68001 - DNA, 24 bp, Simian immunodeficiency virus
gacctacagccagttcattatccc

SEQ ID NO: 68002 - DNA, 17 bp, Homo sapiens
ccacagccagcccatcc

SEQ ID NO: 68003 - DNA, 19 bp, Homo sapiens
tacagtgagcctcattatc

SEQ ID NO: 68004 - DNA, 23 bp, Homo sapiens
gacctacaggtcagtgcactctc

SEQ ID NO: 68005 - DNA, 16 bp, Homo sapiens
gacctacagcgagatc

SEQ ID NO: 68006 - DNA, 20 bp, Homo sapiens
cacagccagttcagactccc

SEQ ID NO: 68007 - DNA, 18 bp, Homo sapiens
cactagcagttcattgtc

SEQ ID NO: 68008 - DNA, 17 bp, Homo sapiens
ctacagcatcattatcc

SEQ ID NO: 68009 - DNA, 19 bp, Homo sapiens
gctttcagttcattattcc

SEQ ID NO: 68010 - DNA, 24 bp, Homo sapiens
acctctgcaacggttcattatccc

SEQ ID NO: 68011 - DNA, 20 bp, Homo sapiens
aacctacagctggggcatcc

SEQ ID NO: 68012 - DNA, 17 bp, Homo sapiens
gacctgagccaattatc

SEQ ID NO: 68013 - DNA, 15 bp, Homo sapiens
ctacaacttcattat

SEQ ID NO: 68014 - DNA, 63 bp, Sorghum chlorotic spot virus
ggcgctacagatgtaattgacgaaagatctgtatttgtctatgatgggatgtggtgggttgcc

SEQ ID NO: 68015 - DNA, 24 bp, Sorghum chlorotic spot virus
tatgatgggatgtggtgggttgcc

SEQ ID NO: 68016 - DNA, 18 bp, Homo sapiens
tatgaagggatgtggtgg

SEQ ID NO: 68017 - DNA, 19 bp, Homo sapiens
tggtgggatgtgctgtgcc

SEQ ID NO: 68018 - DNA, 19 bp, Homo sapiens
tgggtagatggtgggttgc

SEQ ID NO: 68019 - DNA, 20 bp, Homo sapiens
tgaggggatgtggcaaaggt

SEQ ID NO: 68020 - DNA, 19 bp, Homo sapiens
gatggtggggtggggttgc

SEQ ID NO: 68021 - DNA, 19 bp, Homo sapiens
tggtgggatgggatgggcc

SEQ ID NO: 68022 - DNA, 20 bp, Homo sapiens
tgatgggatgggatcttgcc

SEQ ID NO: 68023 - DNA, 20 bp, Homo sapiens
tgatggggtggcactgtgcc

SEQ ID NO: 68024 - DNA, 20 bp, Homo sapiens
catgatgggatgtgtcctac

SEQ ID NO: 68025 - DNA, 16 bp, Homo sapiens
tgatgggaggggttgc

SEQ ID NO: 68026 - DNA, 61 bp, Human papillomavirus type 4
tttgataatgatagacagaatgcaatgctgtacacaaattgggactttttatattatcaag

SEQ ID NO: 68027 - DNA, 24 bp, Human papillomavirus type 4
tgatagacagaatgcaatgctgta

SEQ ID NO: 68028 - DNA, 20 bp, Homo sapiens
tgaaggcagaatacccctgt

SEQ ID NO: 68029 - DNA, 22 bp, Homo sapiens
tgtaggcagaatgctagatgta

SEQ ID NO: 68030 - DNA, 21 bp, Homo sapiens
tgattgacaaaacaatgctgt

SEQ ID NO: 68031 - DNA, 18 bp, Homo sapiens
tgaggacagaatgcaata

SEQ ID NO: 68032 - DNA, 21 bp, Homo sapiens
tgaaggacagagtatgctgta

SEQ ID NO: 68033 - DNA, 70 bp, Canine adenovirus
acagaaaatccgcaggagattccagcattgttccaagctgtctaacaaaatcttcctcataatgaactgt

SEQ ID NO: 68034 - DNA, 24 bp, Canine adenovirus
caggagattccagcattgttccaa

SEQ ID NO: 68035 - DNA, 16 bp, Homo sapiens
ggagattcagtgtccc

SEQ ID NO: 68036 - DNA, 18 bp, Homo sapiens
caggagattcagcaacgc

SEQ ID NO: 68037 - DNA, 16 bp, Homo sapiens
caggagactccattcc

SEQ ID NO: 68038 - DNA, 18 bp, Homo sapiens
tgagaggtttcagcattg

SEQ ID NO: 68039 - DNA, 19 bp, Homo sapiens
caggagactcgcgtgttcc

SEQ ID NO: 68040 - DNA, 23 bp, Homo sapiens
caggagatctagttattatccaa

SEQ ID NO: 68041 - DNA, 20 bp, Homo sapiens
caggggttccagcaagttcc

SEQ ID NO: 68042 - DNA, 17 bp, Homo sapiens
ggagatccagcaggctc

SEQ ID NO: 68043 - DNA, 20 bp, Homo sapiens
agagattccagttgaaccaa

SEQ ID NO: 68044 - DNA, 21 bp, Homo sapiens
tgagagattccagccagctcc

SEQ ID NO: 68045 - DNA, 16 bp, Homo sapiens
ggagattcagactttc

SEQ ID NO: 68046 - DNA, 19 bp, Homo sapiens
aggaggctccagcactgtc

SEQ ID NO: 68047 - DNA, 21 bp, Homo sapiens
caggagatgttacttttccaa

SEQ ID NO: 68048 - DNA, 21 bp, Homo sapiens
caggagcttccagcaggaacc

SEQ ID NO: 68049 - DNA, 18 bp, Homo sapiens
caggagatctggcctcca

SEQ ID NO: 68050 - DNA, 19 bp, Homo sapiens
aggggattccagcaccacc

SEQ ID NO: 68051 - DNA, 16 bp, Homo sapiens
cagaagattttgttcc

SEQ ID NO: 68052 - DNA, 18 bp, Homo sapiens
caggagactccagtctta

SEQ ID NO: 68053 - DNA, 20 bp, Homo sapiens
ggatcctggcattgttccaa

SEQ ID NO: 68054 - DNA, 21 bp, Homo sapiens
caggagattttattggcccca

SEQ ID NO: 68055 - DNA, 18 bp, Homo sapiens
cagcaggttccagcacca

SEQ ID NO: 68056 - DNA, 19 bp, Homo sapiens
caggagatctccagtcctg

SEQ ID NO: 68057 - DNA, 18 bp, Homo sapiens
caggggacttccattcca

SEQ ID NO: 68058 - DNA, 20 bp, Homo sapiens
ggagattccggagaggcgtc

SEQ ID NO: 68059 - DNA, 21 bp, Homo sapiens
ggagactccgggaacctccaa

SEQ ID NO: 68060 - DNA, 20 bp, Homo sapiens
ttcctttagcattgttccaa

SEQ ID NO: 68061 - DNA, 22 bp, Homo sapiens
caggagattctgccattttaca

SEQ ID NO: 68062 - DNA, 18 bp, Homo sapiens
aggagggacattgttcca

SEQ ID NO: 68063 - DNA, 15 bp, Homo sapiens
caggagattttgctc

SEQ ID NO: 68064 - DNA, 20 bp, Homo sapiens
ggagattctacgactgccca

SEQ ID NO: 68065 - DNA, 15 bp, Homo sapiens
cagggattctgttcc

SEQ ID NO: 68066 - DNA, 23 bp, Homo sapiens
caggagattctaatgtttgccaa

SEQ ID NO: 68067 - DNA, 20 bp, Homo sapiens
agagattctagtgagcatca

SEQ ID NO: 68068 - DNA, 21 bp, Homo sapiens
gaagattctggtgttgccgcc

SEQ ID NO: 68069 - DNA, 18 bp, Homo sapiens
ggagatccaggcatggtt

SEQ ID NO: 68070 - DNA, 18 bp, Homo sapiens
gggaattccagaattcca

SEQ ID NO: 68071 - DNA, 18 bp, Homo sapiens
caggagactttagcaccg

SEQ ID NO: 68072 - DNA, 21 bp, Homo sapiens
ggagagtttcaccctgttcca

SEQ ID NO: 68073 - DNA, 19 bp, Homo sapiens
caggagactttggggtcca

SEQ ID NO: 68074 - DNA, 18 bp, Homo sapiens
aggagattcagtgtttca

SEQ ID NO: 68075 - DNA, 19 bp, Homo sapiens
caagagattttataacatt

SEQ ID NO: 68076 - DNA, 15 bp, Homo sapiens
aggagattttgttcc

SEQ ID NO: 68077 - DNA, 18 bp, Homo sapiens
caggagattttcgcacca

SEQ ID NO: 68078 - DNA, 21 bp, Homo sapiens
caggaggtccagcacaccccc

SEQ ID NO: 68079 - DNA, 18 bp, Homo sapiens
aggaaatacattgtttca

SEQ ID NO: 68080 - DNA, 17 bp, Homo sapiens
ggaggtttcaagtccca

SEQ ID NO: 68081 - DNA, 19 bp, Homo sapiens
cagggaattttagcattat

SEQ ID NO: 68082 - DNA, 17 bp, Homo sapiens
caagcccagcattgttc

SEQ ID NO: 68083 - DNA, 20 bp, Homo sapiens
caggagattccgggagctcc

SEQ ID NO: 68084 - DNA, 21 bp, Homo sapiens
caggagattgtggtgcatgct

SEQ ID NO: 68085 - DNA, 16 bp, Homo sapiens
ggagattctgcctcca

SEQ ID NO: 68086 - DNA, 18 bp, Homo sapiens
caggagatccaggttcca

SEQ ID NO: 68087 - DNA, 19 bp, Homo sapiens
caggagtattcatgttcca

SEQ ID NO: 68088 - DNA, 18 bp, Homo sapiens
caggagatccagctgctc

SEQ ID NO: 68089 - DNA, 21 bp, Homo sapiens
caggagattttaagtgctgct

SEQ ID NO: 68090 - DNA, 17 bp, Homo sapiens
cagggattccaggtgtc

SEQ ID NO: 68091 - DNA, 18 bp, Homo sapiens
cagaagatttcaattcca

SEQ ID NO: 68092 - DNA, 19 bp, Homo sapiens
agagggttccagcatcatc

SEQ ID NO: 68093 - DNA, 18 bp, Homo sapiens
caggagatttgcaggcac

SEQ ID NO: 68094 - DNA, 22 bp, Homo sapiens
cagaagattctgaaggcttcca

SEQ ID NO: 68095 - DNA, 24 bp, Homo sapiens
cagggggctctggcactgccacca

SEQ ID NO: 68096 - DNA, 18 bp, Homo sapiens
caggagatttcgttgacc

SEQ ID NO: 68097 - DNA, 19 bp, Homo sapiens
caggagattctagcctacc

SEQ ID NO: 68098 - DNA, 16 bp, Homo sapiens
ggagattccaggcccc

SEQ ID NO: 68099 - DNA, 108 bp, Canine adenovirus
agaaattgcttgcgccaaagaacgtttgaaatatgttactgcatcaacgtgctcagaaagaagttgagagtgacaaaccactttaaaggttaagccaggcttgttttt

SEQ ID NO: 68100 - DNA, 24 bp, Canine adenovirus
ttactgcatcaacgtgctcagaaa

SEQ ID NO: 68101 - DNA, 19 bp, Homo sapiens
tcactgcatcaatccagaa

SEQ ID NO: 68102 - DNA, 17 bp, Homo sapiens
tacatccgtctcagaaa

SEQ ID NO: 68103 - DNA, 22 bp, Homo sapiens
ctactgcattgtaaactttcag

SEQ ID NO: 68104 - DNA, 21 bp, Homo sapiens
ttaatgcagctgtgctcagaa

SEQ ID NO: 68105 - DNA, 19 bp, Homo sapiens
tactgcagatgctcagaaa

SEQ ID NO: 68106 - DNA, 16 bp, Homo sapiens
ttactacattatcaga

SEQ ID NO: 68107 - DNA, 22 bp, Homo sapiens
ttactgcagttagtttgtcaga

SEQ ID NO: 68108 - DNA, 18 bp, Homo sapiens
tactgcatcggtcccaga

SEQ ID NO: 68109 - DNA, 19 bp, Homo sapiens
ttactgcattttttcagaa

SEQ ID NO: 68110 - DNA, 18 bp, Homo sapiens
tgcttcaggatgctcaga

SEQ ID NO: 68111 - DNA, 16 bp, Homo sapiens
ttactgcactggcaga

SEQ ID NO: 68112 - DNA, 23 bp, Homo sapiens
ttactgcatttattctccagaaa

SEQ ID NO: 68113 - DNA, 22 bp, Homo sapiens
ttactgcaataaaacggttcag

SEQ ID NO: 68114 - DNA, 17 bp, Homo sapiens
ctgcatcaactttcaga

SEQ ID NO: 68115 - DNA, 17 bp, Homo sapiens
tcactgagcgtgctcag

SEQ ID NO: 68116 - DNA, 21 bp, Homo sapiens
ccttcccaaacgtgcttagaa

SEQ ID NO: 68117 - DNA, 19 bp, Homo sapiens
ctgcatcagttggtctaga

SEQ ID NO: 68118 - DNA, 17 bp, Homo sapiens
ctgcccaagtgctcaga

SEQ ID NO: 68119 - DNA, 15 bp, Homo sapiens
ctgcatcagcccaaa

SEQ ID NO: 68120 - DNA, 18 bp, Homo sapiens
ttactgcatttgtggaga

SEQ ID NO: 68121 - DNA, 89 bp, Sheeppox virus
gagtggcagtaaaatcattacaatctgatttagttgataaatttgttattaaatgaataaaattagattcatctatatcttcttcactc

SEQ ID NO: 68122 - DNA, 24 bp, Sheeppox virus
ttaaatgaataaaattagattcat

SEQ ID NO: 68123 - DNA, 19 bp, Homo sapiens
ttaaatgaataaaatgaaa

SEQ ID NO: 68124 - DNA, 21 bp, Homo sapiens
ttaaatcaatatcagattcat

SEQ ID NO: 68125 - DNA, 17 bp, Homo sapiens
ctaaatgattagattca

SEQ ID NO: 68126 - DNA, 18 bp, Homo sapiens
aatgaatattaaattcat

SEQ ID NO: 68127 - DNA, 18 bp, Homo sapiens
ttaagtgaataaaactag

SEQ ID NO: 68128 - DNA, 19 bp, Homo sapiens
ttaagtgaataaaattaaa

SEQ ID NO: 68129 - DNA, 16 bp, Homo sapiens
tgaataattagattca

SEQ ID NO: 68130 - DNA, 96 bp, Tupaia herpesvirus
gacgattcacctacctggcgttgcagcgttattacggatacggatcggataccgaatggctagctgccacctccgccctcgtcggtcgagtcagtc

SEQ ID NO: 68131 - DNA, 24 bp, Tupaia herpesvirus
ttgcagcgttattacggatacgga

SEQ ID NO: 68132 - DNA, 22 bp, Homo sapiens
tgcagcgcagagcgggtgcgga

SEQ ID NO: 68133 - DNA, 101 bp, Macaca mulatta rhadinovirus
cccttcccgagcgagtgcggtttctcacatgccgtgagcaaacgaaaacgctacacataataagacacgtgtgagaggaaaactttattgcagggacaggg

SEQ ID NO: 68134 - DNA, 24 bp, Macaca mulatta rhadinovirus
tgagaggaaaactttattgcaggg

SEQ ID NO: 68135 - DNA, 18 bp, Homo sapiens
gaggggaaggctgcaggg

SEQ ID NO: 68136 - DNA, 22 bp, Homo sapiens
tgagaagggatacattgcaggg

SEQ ID NO: 68137 - DNA, 21 bp, Homo sapiens
gagtggagcgcctctgcaggg

SEQ ID NO: 68138 - DNA, 23 bp, Homo sapiens
tgagaaggagatggtttgcaggg

SEQ ID NO: 68139 - DNA, 21 bp, Homo sapiens
gagaggaaaggcagtgcaggg

SEQ ID NO: 68140 - DNA, 17 bp, Homo sapiens
aagaggggcattgcagg

SEQ ID NO: 68141 - DNA, 22 bp, Homo sapiens
tggaaggagggctccaccaggg

SEQ ID NO: 68142 - DNA, 19 bp, Homo sapiens
tgagtggaaggctcacagg

SEQ ID NO: 68143 - DNA, 18 bp, Homo sapiens
tgagaggagacttcccgg

SEQ ID NO: 68144 - DNA, 19 bp, Homo sapiens
tgagagaaagccccgcagg

SEQ ID NO: 68145 - DNA, 23 bp, Homo sapiens
tgagaggagggtttagacacggg

SEQ ID NO: 68146 - DNA, 23 bp, Homo sapiens
gagaggaaatggcacttgcaggg

SEQ ID NO: 68147 - DNA, 23 bp, Homo sapiens
tgagagaagaacattatgcaggg

SEQ ID NO: 68148 - DNA, 23 bp, Homo sapiens
tgagcttctattttgttgcaggg

SEQ ID NO: 68149 - DNA, 21 bp, Homo sapiens
tgaaaggaaggtaaggcaggg

SEQ ID NO: 68150 - DNA, 23 bp, Homo sapiens
tggcaggaaaaggccctgcaggg

SEQ ID NO: 68151 - DNA, 20 bp, Homo sapiens
tgagaggagagactgcaggg

SEQ ID NO: 68152 - DNA, 20 bp, Homo sapiens
gagaggaggagcctgcaggg

SEQ ID NO: 68153 - DNA, 19 bp, Homo sapiens
tgagggcaagacaggcagg

SEQ ID NO: 68154 - DNA, 24 bp, Homo sapiens
gagaggagacctaggggtgtgggg

SEQ ID NO: 68155 - DNA, 22 bp, Homo sapiens
gaggggaggggccgctgcaggg

SEQ ID NO: 68156 - DNA, 21 bp, Homo sapiens
tgaaaggagcacattgtgggg

SEQ ID NO: 68157 - DNA, 20 bp, Homo sapiens
tgacagactttattgtgggg

SEQ ID NO: 68158 - DNA, 18 bp, Homo sapiens
gagggggaactccacggg

SEQ ID NO: 68159 - DNA, 22 bp, Homo sapiens
tggaaggaaaactgagatgggg

SEQ ID NO: 68160 - DNA, 22 bp, Homo sapiens
tgagaggaggacctgggctggg

SEQ ID NO: 68161 - DNA, 22 bp, Homo sapiens
gagaggggagaactctgcaggg

SEQ ID NO: 68162 - DNA, 21 bp, Homo sapiens
gagagcatctttattgtgggg

SEQ ID NO: 68163 - DNA, 21 bp, Homo sapiens
tgaaggagagttttattgcag

SEQ ID NO: 68164 - DNA, 18 bp, Homo sapiens
tgagagagaacctgcagg

SEQ ID NO: 68165 - DNA, 24 bp, Homo sapiens
tggaggaaggcttgcaccacaggg

SEQ ID NO: 68166 - DNA, 21 bp, Homo sapiens
tgagcaggaaaagttgtgggg

SEQ ID NO: 68167 - DNA, 19 bp, Homo sapiens
tgagaggaagctgtccagg

SEQ ID NO: 68168 - DNA, 20 bp, Homo sapiens
tgagtgggggacttgcaagg

SEQ ID NO: 68169 - DNA, 24 bp, Homo sapiens
taagaggaagacaaaaatgcaggg

SEQ ID NO: 68170 - DNA, 130 bp, Cowpox virus
acgaaaaatgatgaaggcaatcattcctcataagatgataaaaagtaaggtgtgtgtgtgtgtgtgtgtgtgataaaaagtgtagtgagtgagagtattagtgagtgagtgagtgtgtgagtgagtgagt

SEQ ID NO: 68171 - DNA, 24 bp, Cowpox virus
taaaaagtgtagtgagtgagagta

SEQ ID NO: 68172 - DNA, 24 bp, Homo sapiens
taaaaagtgggatgtttgggagta

SEQ ID NO: 68173 - DNA, 17 bp, Homo sapiens
agtgtggtgaattaagt

SEQ ID NO: 68174 - DNA, 21 bp, Homo sapiens
taaaaagtgtaggaccaaggt

SEQ ID NO: 68175 - DNA, 20 bp, Homo sapiens
gtgagtttaaagtgagagta

SEQ ID NO: 68176 - DNA, 17 bp, Homo sapiens
aagtgtgtcaagagagt

SEQ ID NO: 68177 - DNA, 18 bp, Homo sapiens
aaaagtttaagtgagggt

SEQ ID NO: 68178 - DNA, 19 bp, Homo sapiens
aagagtagttggtgggagt

SEQ ID NO: 68179 - DNA, 18 bp, Homo sapiens
aaagtgtactgtgggagt

SEQ ID NO: 68180 - DNA, 18 bp, Homo sapiens
aagtggcaggtgagagta

SEQ ID NO: 68181 - DNA, 18 bp, Homo sapiens
taaaaagctgtggagagt

SEQ ID NO: 68182 - DNA, 18 bp, Homo sapiens
aaaaggctgagtgagggt

SEQ ID NO: 68183 - DNA, 17 bp, Homo sapiens
tgaagagtgtggagagc

SEQ ID NO: 68184 - DNA, 19 bp, Homo sapiens
tgaatgagtgtgcgagggt

SEQ ID NO: 68185 - DNA, 22 bp, Homo sapiens
taaaaagtgtacgttgtgggtg

SEQ ID NO: 68186 - DNA, 21 bp, Homo sapiens
taaaaagtgtgctgactcgtg

SEQ ID NO: 68187 - DNA, 20 bp, Homo sapiens
aaaagtgttagtgccaggtg

SEQ ID NO: 68188 - DNA, 21 bp, Homo sapiens
aaaaaggtgtggggtgagagt

SEQ ID NO: 68189 - DNA, 20 bp, Homo sapiens
gtgacagtgtgggtgagagt

SEQ ID NO: 68190 - DNA, 18 bp, Homo sapiens
aagtgtagctgaaaaagt

SEQ ID NO: 68191 - DNA, 21 bp, Homo sapiens
taaaaagtggtagtgcaggtg

SEQ ID NO: 68192 - DNA, 23 bp, Homo sapiens
tgaaagctgatgacagtgggagt

SEQ ID NO: 68193 - DNA, 20 bp, Homo sapiens
gcaagagtgagtgtgggagt

SEQ ID NO: 68194 - DNA, 20 bp, Homo sapiens
aaacataagtgagtgagagt

SEQ ID NO: 68195 - DNA, 16 bp, Homo sapiens
aaatgtaatagagagt

SEQ ID NO: 68196 - DNA, 20 bp, Homo sapiens
agtgtagtattagggagagt

SEQ ID NO: 68197 - DNA, 18 bp, Homo sapiens
taaaaagtgtgtaagagt

SEQ ID NO: 68198 - DNA, 23 bp, Homo sapiens
taaaaagtgtatgcctctgagtg

SEQ ID NO: 68199 - DNA, 16 bp, Homo sapiens
aaagtgtcatgagagt

SEQ ID NO: 68200 - DNA, 17 bp, Homo sapiens
aggtaaaagtgggagta

SEQ ID NO: 68201 - DNA, 22 bp, Homo sapiens
taatgaatgagtgggtgagagt

SEQ ID NO: 68202 - DNA, 19 bp, Homo sapiens
aaagtgtagtccaagggta

SEQ ID NO: 68203 - DNA, 78 bp, Cowpox virus
gtcgttctcgttcagaatctttcgcagcataagtagtatgtcgatatacttatcgttgaagactcttccagagacgat

SEQ ID NO: 68204 - DNA, 24 bp, Cowpox virus
tcgcagcataagtagtatgtcgat

SEQ ID NO: 68205 - DNA, 21 bp, Homo sapiens
gcagcatattaaggtgttgat

SEQ ID NO: 68206 - DNA, 19 bp, Homo sapiens
tcgcagtacaggtaggctg

SEQ ID NO: 68207 - DNA, 83 bp, Human herpesvirus 4
cctacgcgaggctgaacctcctgaatcactgcatctttcttgaggcgtttaaagaagagaatagtggccagggcctcggtggg

SEQ ID NO: 68208 - DNA, 24 bp, Human herpesvirus 4
aagaagagaatagtggccagggcc

SEQ ID NO: 68209 - DNA, 19 bp, Homo sapiens
aagaggaccatccagggcc

SEQ ID NO: 68210 - DNA, 20 bp, Homo sapiens
gaaggggaattagccagggc

SEQ ID NO: 68211 - DNA, 19 bp, Homo sapiens
gagaggagctcccagggcc

SEQ ID NO: 68212 - DNA, 23 bp, Homo sapiens
aaggggacagcagagccagggcc

SEQ ID NO: 68213 - DNA, 21 bp, Homo sapiens
aaggaaagaacatttggggcc

SEQ ID NO: 68214 - DNA, 19 bp, Homo sapiens
gaagagaatgttgggggcc

SEQ ID NO: 68215 - DNA, 18 bp, Homo sapiens
agaagagagagtggtaag

SEQ ID NO: 68216 - DNA, 16 bp, Homo sapiens
gaagagaaacaagggc

SEQ ID NO: 68217 - DNA, 20 bp, Homo sapiens
aggagagagtggaaagggcc

SEQ ID NO: 68218 - DNA, 21 bp, Homo sapiens
agggacagggggctccagggc

SEQ ID NO: 68219 - DNA, 21 bp, Homo sapiens
gagagacgcgaggccagggcc

SEQ ID NO: 68220 - DNA, 22 bp, Homo sapiens
aagaagagaatgagttcaggcc

SEQ ID NO: 68221 - DNA, 19 bp, Homo sapiens
aagaacagggaacctaggg

SEQ ID NO: 68222 - DNA, 18 bp, Homo sapiens
aagaggaggtaacggggg

SEQ ID NO: 68223 - DNA, 23 bp, Homo sapiens
gaagagaatgtgagttggccctg

SEQ ID NO: 68224 - DNA, 17 bp, Homo sapiens
agaagagaagggagggc

SEQ ID NO: 68225 - DNA, 21 bp, Homo sapiens
gaagaaatagtgcttggggcc

SEQ ID NO: 68226 - DNA, 21 bp, Homo sapiens
gagcaggcagagggccagggc

SEQ ID NO: 68227 - DNA, 21 bp, Homo sapiens
aagaagagggaaggaagggcc

SEQ ID NO: 68228 - DNA, 17 bp, Homo sapiens
gaggcagcggccggggc

SEQ ID NO: 68229 - DNA, 22 bp, Homo sapiens
aagaggaagtgaggatggggcc

SEQ ID NO: 68230 - DNA, 26 bp, Homo sapiens
aagaagagaacagcatcagtggggcc

SEQ ID NO: 68231 - DNA, 21 bp, Homo sapiens
gaagctttagtggccagggcc

SEQ ID NO: 68232 - DNA, 23 bp, Homo sapiens
aagaagggaaggaggccagggcc

SEQ ID NO: 68233 - DNA, 15 bp, Homo sapiens
aggaaaggaccaggg

SEQ ID NO: 68234 - DNA, 17 bp, Homo sapiens
agaagagaatggtgggg

SEQ ID NO: 68235 - DNA, 18 bp, Homo sapiens
aggagagaacaagaaggg

SEQ ID NO: 68236 - DNA, 22 bp, Homo sapiens
gagaaggcagtatcccagggcc

SEQ ID NO: 68237 - DNA, 21 bp, Homo sapiens
aaggagaggggtgctggggcc

SEQ ID NO: 68238 - DNA, 19 bp, Homo sapiens
agaagagagggtccagcgg

SEQ ID NO: 68239 - DNA, 19 bp, Homo sapiens
aagggcaggaggccagggc

SEQ ID NO: 68240 - DNA, 21 bp, Homo sapiens
gagagaccaccggccagggcc

SEQ ID NO: 68241 - DNA, 19 bp, Homo sapiens
gaagaggggtgagccaggg

SEQ ID NO: 68242 - DNA, 21 bp, Homo sapiens
aagaggagggtgctcgaggcc

SEQ ID NO: 68243 - DNA, 19 bp, Homo sapiens
agagaggaatagtggtggc

SEQ ID NO: 68244 - DNA, 18 bp, Homo sapiens
agaagagaaggtggtggc

SEQ ID NO: 68245 - DNA, 21 bp, Homo sapiens
gaggggaggggccccagggcc

SEQ ID NO: 68246 - DNA, 17 bp, Homo sapiens
agaagagagtgtccagg

SEQ ID NO: 68247 - DNA, 21 bp, Homo sapiens
gaggggggcggccaaggggcc

SEQ ID NO: 68248 - DNA, 20 bp, Homo sapiens
agaagagaatggtgggtacc

SEQ ID NO: 68249 - DNA, 20 bp, Homo sapiens
agcggagccatggccagggc

SEQ ID NO: 68250 - DNA, 24 bp, Homo sapiens
aagaggagaaacaagcccggggcc

SEQ ID NO: 68251 - DNA, 20 bp, Homo sapiens
gagaggcaggggctggggcc

SEQ ID NO: 68252 - DNA, 19 bp, Homo sapiens
gaagggcagagccagggcc

SEQ ID NO: 68253 - DNA, 16 bp, Homo sapiens
aaaaagagaataaggg

SEQ ID NO: 68254 - DNA, 19 bp, Homo sapiens
aagaagataaaagccaggg

SEQ ID NO: 68255 - DNA, 17 bp, Homo sapiens
gaaggacaagccagggc

SEQ ID NO: 68256 - DNA, 26 bp, Homo sapiens
gaagagaaaagtgagtcggccctggc

SEQ ID NO: 68257 - DNA, 16 bp, Homo sapiens
aagaagagaagcaggg

SEQ ID NO: 68258 - DNA, 17 bp, Homo sapiens
gaaaagaacctcagggc

SEQ ID NO: 68259 - DNA, 21 bp, Homo sapiens
agaagaggggtacccagggcc

SEQ ID NO: 68260 - DNA, 19 bp, Homo sapiens
gagaagaatggggagggcc

SEQ ID NO: 68261 - DNA, 15 bp, Homo sapiens
aggaaagagccaggg

SEQ ID NO: 68262 - DNA, 24 bp, Homo sapiens
aagaagagatgcttgcgccagggc

SEQ ID NO: 68263 - DNA, 17 bp, Homo sapiens
agaggagaagccagggc

SEQ ID NO: 68264 - DNA, 18 bp, Homo sapiens
aaggagaggaggccagag

SEQ ID NO: 68265 - DNA, 21 bp, Homo sapiens
gaaggggaaagggccagggcc

SEQ ID NO: 68266 - DNA, 21 bp, Homo sapiens
agaggaagggctggccagggc

SEQ ID NO: 68267 - DNA, 20 bp, Homo sapiens
aagaagaggaaattgaaggg

SEQ ID NO: 68268 - DNA, 19 bp, Homo sapiens
gaggagctgggccagggcc

SEQ ID NO: 68269 - DNA, 17 bp, Homo sapiens
gaagaaaatttgcaggg

SEQ ID NO: 68270 - DNA, 19 bp, Homo sapiens
aacaagagaataaagaggg

SEQ ID NO: 68271 - DNA, 20 bp, Homo sapiens
gaagagactagtggcctggg

SEQ ID NO: 68272 - DNA, 21 bp, Homo sapiens
agagaagccaagggccagggc

SEQ ID NO: 68273 - DNA, 22 bp, Homo sapiens
aagaagatgcgtcagctggggc

SEQ ID NO: 68274 - DNA, 18 bp, Homo sapiens
gaagaaaaaacctagggc

SEQ ID NO: 68275 - DNA, 19 bp, Homo sapiens
aagaaaagggggctggggc

SEQ ID NO: 68276 - DNA, 21 bp, Homo sapiens
aagaagagaaatggaagggcc

SEQ ID NO: 68277 - DNA, 18 bp, Homo sapiens
aagaagagaactggtggc

SEQ ID NO: 68278 - DNA, 22 bp, Homo sapiens
gagcagggttgtggccagggcc

SEQ ID NO: 68279 - DNA, 16 bp, Homo sapiens
aagaaaagagccaggg

SEQ ID NO: 68280 - DNA, 25 bp, Homo sapiens
aagaagagggtgtagacggagggcc

SEQ ID NO: 68281 - DNA, 20 bp, Homo sapiens
gagaggaggaacccagggcc

SEQ ID NO: 68282 - DNA, 21 bp, Homo sapiens
gatgagggcttctccagggcc

SEQ ID NO: 68283 - DNA, 19 bp, Homo sapiens
gaagaggggtaccagggcc

SEQ ID NO: 68284 - DNA, 18 bp, Homo sapiens
gaaaagggagtccagggc

SEQ ID NO: 68285 - DNA, 23 bp, Homo sapiens
agaagaggacaggaccaggggcc

SEQ ID NO: 68286 - DNA, 19 bp, Homo sapiens
aagaagagtaatgtcaggg

SEQ ID NO: 68287 - DNA, 19 bp, Homo sapiens
agacagagggggaccaggg

SEQ ID NO: 68288 - DNA, 18 bp, Homo sapiens
aggaagtggaatcagggc

SEQ ID NO: 68289 - DNA, 18 bp, Homo sapiens
gaagggtggaccagggcc

SEQ ID NO: 68290 - DNA, 19 bp, Homo sapiens
agaagaggatgttcaaggc

SEQ ID NO: 68291 - DNA, 19 bp, Homo sapiens
gaaggggagggccagggcc

SEQ ID NO: 68292 - DNA, 20 bp, Homo sapiens
aggggaaatgtcagccaggg

SEQ ID NO: 68293 - DNA, 18 bp, Homo sapiens
aagaagaggagctggggc

SEQ ID NO: 68294 - DNA, 16 bp, Homo sapiens
aggaacaggaccaggg

SEQ ID NO: 68295 - DNA, 21 bp, Homo sapiens
gatgaggccactggccagggc

SEQ ID NO: 68296 - DNA, 21 bp, Homo sapiens
aagggaaggtggggccagggc

SEQ ID NO: 68297 - DNA, 20 bp, Homo sapiens
aaaagagagtaactctaggg

SEQ ID NO: 68298 - DNA, 19 bp, Homo sapiens
aagaggagaatagtggggc

SEQ ID NO: 68299 - DNA, 18 bp, Homo sapiens
gaaggatggggccagggc

SEQ ID NO: 68300 - DNA, 23 bp, Homo sapiens
aagcaggggggccacccagggcc

SEQ ID NO: 68301 - DNA, 22 bp, Homo sapiens
aggcagagggtgagccagggcc

SEQ ID NO: 68302 - DNA, 21 bp, Homo sapiens
gagaagggggttggccagggc

SEQ ID NO: 68303 - DNA, 19 bp, Homo sapiens
agaagagagagtggcgaag

SEQ ID NO: 68304 - DNA, 25 bp, Homo sapiens
aagaagagcaagcctgcgccggggc

SEQ ID NO: 68305 - DNA, 19 bp, Homo sapiens
gaagcgaagggccagggcc

SEQ ID NO: 68306 - DNA, 18 bp, Homo sapiens
aagaggaagagccaaggc

SEQ ID NO: 68307 - DNA, 18 bp, Homo sapiens
aagaaagagccccagggc

SEQ ID NO: 68308 - DNA, 21 bp, Homo sapiens
gagggcagggaagccagggcc

SEQ ID NO: 68309 - DNA, 21 bp, Homo sapiens
gagaacagaggcgtcggggcc

SEQ ID NO: 68310 - DNA, 29 bp, Homo sapiens
aagaggaaaatagtgctgctggccctggc

SEQ ID NO: 68311 - DNA, 22 bp, Homo sapiens
aagatagaactggtggttgggg

SEQ ID NO: 68312 - DNA, 23 bp, Homo sapiens
aagaaagaaagcaagccagggcc

SEQ ID NO: 68313 - DNA, 22 bp, Homo sapiens
aagaaaacgtctggccagggcc

SEQ ID NO: 68314 - DNA, 22 bp, Homo sapiens
gaaggaggcaaacgccagggcc

SEQ ID NO: 68315 - DNA, 18 bp, Homo sapiens
aagaagaggaagcctggg

SEQ ID NO: 68316 - DNA, 20 bp, Homo sapiens
aagaaaagagaacctggggc

SEQ ID NO: 68317 - DNA, 21 bp, Homo sapiens
aagaagaaaatatttagggcc

SEQ ID NO: 68318 - DNA, 16 bp, Homo sapiens
agaagagaaccagggc

SEQ ID NO: 68319 - DNA, 22 bp, Homo sapiens
aagaagagatcgagagctgggg

SEQ ID NO: 68320 - DNA, 22 bp, Homo sapiens
aaggagtggaatttagccaggg

SEQ ID NO: 68321 - DNA, 21 bp, Homo sapiens
agaagggatgaagccagggcc

SEQ ID NO: 68322 - DNA, 16 bp, Homo sapiens
gaagtgaagtcagggc

SEQ ID NO: 68323 - DNA, 19 bp, Homo sapiens
gaaaagggggtgacctggg

SEQ ID NO: 68324 - DNA, 21 bp, Homo sapiens
gagggagtgaggaccagggcc

SEQ ID NO: 68325 - DNA, 17 bp, Homo sapiens
gaagagctggccagggc

SEQ ID NO: 68326 - DNA, 18 bp, Homo sapiens
gaggggcagagccagggc

SEQ ID NO: 68327 - DNA, 20 bp, Homo sapiens
agaagagactgggctgggcc

SEQ ID NO: 68328 - DNA, 20 bp, Homo sapiens
gaaaagaagaaattcagggc

SEQ ID NO: 68329 - DNA, 25 bp, Homo sapiens
aagaagagaatgctggtcggccctg

SEQ ID NO: 68330 - DNA, 20 bp, Homo sapiens
gaagagaattgttaccaggg

SEQ ID NO: 68331 - DNA, 15 bp, Homo sapiens
gaagaaataacaggg

SEQ ID NO: 68332 - DNA, 21 bp, Homo sapiens
gaagatgacgttggccagggc

SEQ ID NO: 68333 - DNA, 18 bp, Homo sapiens
gagaacaggtgctagggc

SEQ ID NO: 68334 - DNA, 17 bp, Homo sapiens
agaagagagtggcgacc

SEQ ID NO: 68335 - DNA, 25 bp, Homo sapiens
aggggaggggcagccaggccggggc

SEQ ID NO: 68336 - DNA, 20 bp, Homo sapiens
gaagagagaccaggagggcc

SEQ ID NO: 68337 - DNA, 23 bp, Homo sapiens
gaggaggtggcagcaccagggcc

SEQ ID NO: 68338 - DNA, 15 bp, Homo sapiens
gagaagggccagggc

SEQ ID NO: 68339 - DNA, 17 bp, Homo sapiens
aaaagagaatattgggg

SEQ ID NO: 68340 - DNA, 19 bp, Homo sapiens
agaagaaaagcctcagggc

SEQ ID NO: 68341 - DNA, 16 bp, Homo sapiens
aagaagagaaggaggg

SEQ ID NO: 68342 - DNA, 19 bp, Homo sapiens
agagaggggtgaccagggc

SEQ ID NO: 68343 - DNA, 20 bp, Homo sapiens
gagggaggtaggccagggcc

SEQ ID NO: 68344 - DNA, 21 bp, Homo sapiens
gagaaaaatgagtggccaggg

SEQ ID NO: 68345 - DNA, 20 bp, Homo sapiens
agaagagaagggggacaggg

SEQ ID NO: 68346 - DNA, 22 bp, Homo sapiens
agatggagagggggccagggcc

SEQ ID NO: 68347 - DNA, 17 bp, Homo sapiens
gaagagaatggatggac

SEQ ID NO: 68348 - DNA, 19 bp, Homo sapiens
aaaagagaacgtgctgggg

SEQ ID NO: 68349 - DNA, 15 bp, Homo sapiens
aaagagaagtcaggg

SEQ ID NO: 68350 - DNA, 18 bp, Homo sapiens
aagagcaggaaccagggc

SEQ ID NO: 68351 - DNA, 28 bp, Homo sapiens
agaagaaaatggtgtagctggccctggc

SEQ ID NO: 68352 - DNA, 17 bp, Homo sapiens
aagaagaggagggaggg

SEQ ID NO: 68353 - DNA, 20 bp, Homo sapiens
agaagggaatatacccaggg

SEQ ID NO: 68354 - DNA, 21 bp, Homo sapiens
aagaagaggaaggctggggcc

SEQ ID NO: 68355 - DNA, 21 bp, Homo sapiens
aaggcagggaggactagggcc

SEQ ID NO: 68356 - DNA, 19 bp, Homo sapiens
ggaaagggaaagccagggc

SEQ ID NO: 68357 - DNA, 20 bp, Homo sapiens
agaagagaatgttgaacaag

SEQ ID NO: 68358 - DNA, 19 bp, Homo sapiens
gaagaggtggaggggggcc

SEQ ID NO: 68359 - DNA, 17 bp, Homo sapiens
gaaggcaatgggagggc

SEQ ID NO: 68360 - DNA, 23 bp, Homo sapiens
aggagagagtagaggccagagcc

SEQ ID NO: 68361 - DNA, 17 bp, Homo sapiens
gaaaggagaaccagggc

SEQ ID NO: 68362 - DNA, 18 bp, Homo sapiens
gaagggaaggccagggcc

SEQ ID NO: 68363 - DNA, 20 bp, Homo sapiens
gagaacaggagagccccggg

SEQ ID NO: 68364 - DNA, 18 bp, Homo sapiens
aaaaagaggacccagggc

SEQ ID NO: 68365 - DNA, 23 bp, Homo sapiens
gaggacagagcctacccagggcc

SEQ ID NO: 68366 - DNA, 20 bp, Homo sapiens
gaaggagaatggtgattgcc

SEQ ID NO: 68367 - DNA, 66 bp, Bovine parvovirus
cttggtatagaaacatgatgtatcactttgccttggggggtgattgtgaaaaatgtaattactggg

SEQ ID NO: 68368 - DNA, 22 bp, Bovine parvovirus
tgtgaaaaatgtaattactggg

SEQ ID NO: 68369 - DNA, 22 bp, Homo sapiens
tgtgagaaagctctttactggg

SEQ ID NO: 68370 - DNA, 23 bp, Homo sapiens
tatgaaaaatgaggtatactggg

SEQ ID NO: 68371 - DNA, 21 bp, Homo sapiens
gtgaaggatgtaattttaagg

SEQ ID NO: 68372 - DNA, 22 bp, Homo sapiens
tgttaaaatgcagattgctggg

SEQ ID NO: 68373 - DNA, 21 bp, Homo sapiens
tgtgaaaaatgattatttggg

SEQ ID NO: 68374 - DNA, 20 bp, Homo sapiens
tgtgaaaaattagcacatgg

SEQ ID NO: 68375 - DNA, 20 bp, Homo sapiens
tgagaaatgtcatgactggg

SEQ ID NO: 68376 - DNA, 19 bp, Homo sapiens
tggaagaattctcactggg

SEQ ID NO: 68377 - DNA, 17 bp, Homo sapiens
tgtaaaaattatactgg

SEQ ID NO: 68378 - DNA, 19 bp, Homo sapiens
tatgagaaatgtaatatgg

SEQ ID NO: 68379 - DNA, 19 bp, Homo sapiens
tgtgaagatggccactggg

SEQ ID NO: 68380 - DNA, 20 bp, Homo sapiens
tgggaaatggtgccactggg

SEQ ID NO: 68381 - DNA, 22 bp, Homo sapiens
tatgagaaaaaaaattactggg

SEQ ID NO: 68382 - DNA, 20 bp, Homo sapiens
tggagagatgtgtcactggg

SEQ ID NO: 68383 - DNA, 21 bp, Homo sapiens
cgtgaggatggagttactggg

SEQ ID NO: 68384 - DNA, 21 bp, Homo sapiens
tgtgaatgatgtaaaacatgg

SEQ ID NO: 68385 - DNA, 23 bp, Homo sapiens
tgtgaatggatgtgccttctggg

SEQ ID NO: 68386 - DNA, 17 bp, Homo sapiens
tgtgaaaaatgtattgg

SEQ ID NO: 68387 - DNA, 20 bp, Homo sapiens
tgtgaaaaatggggtcatgg

SEQ ID NO: 68388 - DNA, 17 bp, Homo sapiens
tggaaaaatgtaactgg

SEQ ID NO: 68389 - DNA, 22 bp, Homo sapiens
tgtgaaaagttatgctactggg

SEQ ID NO: 68390 - DNA, 21 bp, Homo sapiens
tgtgaaaatgtcttgcctggg

SEQ ID NO: 68391 - DNA, 20 bp, Homo sapiens
tgtaaaaatgcctgcctggg

SEQ ID NO: 68392 - DNA, 20 bp, Homo sapiens
tgggaaatgtagtcaccagg

SEQ ID NO: 68393 - DNA, 21 bp, Homo sapiens
tggaaaaatggcccagctggg

SEQ ID NO: 68394 - DNA, 20 bp, Homo sapiens
tgtggaggggtaatcactgg

SEQ ID NO: 68395 - DNA, 20 bp, Homo sapiens
tgtaaaaaatgtagtatctg

SEQ ID NO: 68396 - DNA, 19 bp, Homo sapiens
gtgaaaaatgtggtcatgg

SEQ ID NO: 68397 - DNA, 19 bp, Homo sapiens
tgtgggagtgaccactggg

SEQ ID NO: 68398 - DNA, 19 bp, Homo sapiens
tgtgaaaaactctattggg

SEQ ID NO: 68399 - DNA, 19 bp, Homo sapiens
tgtcaaccaaattactggg

SEQ ID NO: 68400 - DNA, 20 bp, Homo sapiens
tgtaagatggaattactggg

SEQ ID NO: 68401 - DNA, 20 bp, Homo sapiens
tgtgaaaaaagatgactggg

SEQ ID NO: 68402 - DNA, 83 bp, Turkey adenovirus 3
ctgtacctgctcctacagtttctgctgtaccagtacctgctgctcctgtagctgtagctgctaagagacgtagagtaggttag

SEQ ID NO: 68403 - DNA, 24 bp, Turkey adenovirus 3
cctacagtttctgctgtaccagta

SEQ ID NO: 68404 - DNA, 19 bp, Homo sapiens
cctacaagtttttctggtg

SEQ ID NO: 68405 - DNA, 19 bp, Homo sapiens
tacagttttattgccagta

SEQ ID NO: 68406 - DNA, 22 bp, Homo sapiens
cagttaccctgctgtattagta

SEQ ID NO: 68407 - DNA, 19 bp, Homo sapiens
cctcagtttcttcatcagt

SEQ ID NO: 68408 - DNA, 23 bp, Homo sapiens
ccacagttttggaaaatgccagt

SEQ ID NO: 68409 - DNA, 21 bp, Homo sapiens
cctagagtttctaattcagta

SEQ ID NO: 68410 - DNA, 18 bp, Homo sapiens
cctgcagctttctgctgt

SEQ ID NO: 68411 - DNA, 17 bp, Homo sapiens
tacagtttctctccggt

SEQ ID NO: 68412 - DNA, 15 bp, Homo sapiens
tacagtttctgacca

SEQ ID NO: 68413 - DNA, 17 bp, Homo sapiens
tacagtttctctccagt

SEQ ID NO: 68414 - DNA, 17 bp, Homo sapiens
tacagtttttgcactag

SEQ ID NO: 68415 - DNA, 23 bp, Homo sapiens
cagtttctggacacaaactagta

SEQ ID NO: 68416 - DNA, 22 bp, Homo sapiens
tacatttctacgtttgtcagta

SEQ ID NO: 68417 - DNA, 15 bp, Homo sapiens
cctcagtttcaccag

SEQ ID NO: 68418 - DNA, 19 bp, Homo sapiens
ctacatttctgcagcgagt

SEQ ID NO: 68419 - DNA, 19 bp, Homo sapiens
cctcagtttccctgtcagt

SEQ ID NO: 68420 - DNA, 18 bp, Homo sapiens
ctcagtttctgcccaagt

SEQ ID NO: 68421 - DNA, 24 bp, Homo sapiens
cccttcatttctgctgtatcagta

SEQ ID NO: 68422 - DNA, 17 bp, Homo sapiens
cctacatttctgctgca

SEQ ID NO: 68423 - DNA, 18 bp, Homo sapiens
ctacagtcttttgacagt

SEQ ID NO: 68424 - DNA, 21 bp, Homo sapiens
ctacagtttctatatggagta

SEQ ID NO: 68425 - DNA, 17 bp, Homo sapiens
cctgtagtttctgtgta

SEQ ID NO: 68426 - DNA, 17 bp, Homo sapiens
cctgcagttgctgtccc

SEQ ID NO: 68427 - DNA, 17 bp, Homo sapiens
cagtgcgctgtaccggt

SEQ ID NO: 68428 - DNA, 19 bp, Homo sapiens
tacatttccactgctagta

SEQ ID NO: 68429 - DNA, 21 bp, Homo sapiens
ccttcagtttccaggccagta

SEQ ID NO: 68430 - DNA, 22 bp, Homo sapiens
ctacagttctgtaatctcagta

SEQ ID NO: 68431 - DNA, 19 bp, Homo sapiens
agtccgtgtctgtaccagt

SEQ ID NO: 68432 - DNA, 22 bp, Homo sapiens
ctacagtttctttaaaaacagt

SEQ ID NO: 68433 - DNA, 18 bp, Homo sapiens
cctacaatttctcagcta

SEQ ID NO: 68434 - DNA, 15 bp, Homo sapiens
acagcttgtaccagt

SEQ ID NO: 68435 - DNA, 21 bp, Homo sapiens
cacaggacatgctgtactggt

SEQ ID NO: 68436 - DNA, 17 bp, Homo sapiens
ctcagtttctcatcagt

SEQ ID NO: 68437 - DNA, 23 bp, Homo sapiens
ccagcagtttctgaatccacagt

SEQ ID NO: 68438 - DNA, 19 bp, Homo sapiens
agtttctgtctataaagta

SEQ ID NO: 68439 - DNA, 23 bp, Homo sapiens
cctgtagtttctagatcctcagt

SEQ ID NO: 68440 - DNA, 19 bp, Homo sapiens
ctacagtttctgtgatgta

SEQ ID NO: 68441 - DNA, 16 bp, Homo sapiens
cagtttctagcccagt

SEQ ID NO: 68442 - DNA, 21 bp, Homo sapiens
ctacagtttttgtatatagta

SEQ ID NO: 68443 - DNA, 21 bp, Homo sapiens
cctgtggttcctgccacctgt

SEQ ID NO: 68444 - DNA, 19 bp, Homo sapiens
tacagtttcaataccagta

SEQ ID NO: 68445 - DNA, 70 bp, Porcine adenovirus A
tgtgttctcctcccgccgcttgtgcagcaccacctcccgctgctcgagctgaggatccgtgatggacaca

SEQ ID NO: 68446 - DNA, 24 bp, Porcine adenovirus A
ctcgagctgaggatccgtgatgga

SEQ ID NO: 68447 - DNA, 16 bp, Homo sapiens
ctcaagctgaggggtg

SEQ ID NO: 68448 - DNA, 18 bp, Homo sapiens
cgagctgaggggagatgg

SEQ ID NO: 68449 - DNA, 23 bp, Homo sapiens
ctcgatctgaactgggtgatgga

SEQ ID NO: 68450 - DNA, 20 bp, Homo sapiens
tcgagctgcggatctgccgg

SEQ ID NO: 68451 - DNA, 16 bp, Homo sapiens
gctgaggagccaatgg

SEQ ID NO: 68452 - DNA, 19 bp, Homo sapiens
agttggagactgtgatgga

SEQ ID NO: 68453 - DNA, 20 bp, Homo sapiens
tcagttgcagccgtgatgga

SEQ ID NO: 68454 - DNA, 22 bp, Homo sapiens
ctccagctgagggcagtatgga

SEQ ID NO: 68455 - DNA, 17 bp, Homo sapiens
ctcgggcggggatccgc

SEQ ID NO: 68456 - DNA, 24 bp, Homo sapiens
ctccagctgaggattctgctttgg

SEQ ID NO: 68457 - DNA, 21 bp, Homo sapiens
ctcgagctgggcgcatgtgga

SEQ ID NO: 68458 - DNA, 21 bp, Homo sapiens
ctcgagctgtgggtcccagga

SEQ ID NO: 68459 - DNA, 18 bp, Homo sapiens
tcgagctgagggcggcgg

SEQ ID NO: 68460 - DNA, 20 bp, Homo sapiens
ctcagctgaggatcttccgg

SEQ ID NO: 68461 - DNA, 18 bp, Homo sapiens
gagctgagggttgctgga

SEQ ID NO: 68462 - DNA, 19 bp, Homo sapiens
gagctggtccagtgatgga

SEQ ID NO: 68463 - DNA, 19 bp, Homo sapiens
gaattggggagtgtatgga

SEQ ID NO: 68464 - DNA, 16 bp, Homo sapiens
tcgagctggtggtaga

SEQ ID NO: 68465 - DNA, 17 bp, Homo sapiens
tcaggctggggtgatgg

SEQ ID NO: 68466 - DNA, 82 bp, Porcine adenovirus A
tccaacaactgtttatgtaaaggaaaataaagactcagagaaaatccaagttcatatgatttttcttttattgattggggga

SEQ ID NO: 68467 - DNA, 24 bp, Porcine adenovirus A
taaaggaaaataaagactcagaga

SEQ ID NO: 68468 - DNA, 24 bp, Homo sapiens
taaaggatgagataaacttggaga

SEQ ID NO: 68469 - DNA, 21 bp, Homo sapiens
aaggaaactgaggctcagaga

SEQ ID NO: 68470 - DNA, 24 bp, Homo sapiens
taaagaaaaatgaagataaaagag

SEQ ID NO: 68471 - DNA, 21 bp, Homo sapiens
tgaggtaaacagcagactcag

SEQ ID NO: 68472 - DNA, 22 bp, Homo sapiens
gaaaataataggggctcaggga

SEQ ID NO: 68473 - DNA, 21 bp, Homo sapiens
tgaggaaaaataaaggccaga

SEQ ID NO: 68474 - DNA, 18 bp, Homo sapiens
taaaggaagagaccagag

SEQ ID NO: 68475 - DNA, 20 bp, Homo sapiens
taaaggaagagtggacagag

SEQ ID NO: 68476 - DNA, 20 bp, Homo sapiens
aagaaaatgaagaaaccaga

SEQ ID NO: 68477 - DNA, 22 bp, Homo sapiens
tgaggaaatcaaggctcagaga

SEQ ID NO: 68478 - DNA, 21 bp, Homo sapiens
tgaggaaaaatagatcagaga

SEQ ID NO: 68479 - DNA, 21 bp, Homo sapiens
taaagggaggtaaagaacaga

SEQ ID NO: 68480 - DNA, 21 bp, Homo sapiens
taaaggaagaaagagaaagag

SEQ ID NO: 68481 - DNA, 19 bp, Homo sapiens
tgaggcaaagactttagag

SEQ ID NO: 68482 - DNA, 19 bp, Homo sapiens
aaggaaaatggagaagaga

SEQ ID NO: 68483 - DNA, 18 bp, Homo sapiens
ggaagcaaggctcagaga

SEQ ID NO: 68484 - DNA, 17 bp, Homo sapiens
aggaaaatgaggcagag

SEQ ID NO: 68485 - DNA, 19 bp, Homo sapiens
ggataacagggctcagaga

SEQ ID NO: 68486 - DNA, 19 bp, Homo sapiens
tgaagaaaataatacagag

SEQ ID NO: 68487 - DNA, 19 bp, Homo sapiens
agggaaataaaggcacaga

SEQ ID NO: 68488 - DNA, 17 bp, Homo sapiens
aaagaaaagaactcagg

SEQ ID NO: 68489 - DNA, 24 bp, Homo sapiens
aagagaaaatgaagacccatgaga

SEQ ID NO: 68490 - DNA, 21 bp, Homo sapiens
aaagccctcaaagacttagag

SEQ ID NO: 68491 - DNA, 18 bp, Homo sapiens
aagaaacataactcagag

SEQ ID NO: 68492 - DNA, 24 bp, Homo sapiens
taaaggaaagaaagtgctttagag

SEQ ID NO: 68493 - DNA, 17 bp, Homo sapiens
ggaaaataaatcaaaga

SEQ ID NO: 68494 - DNA, 17 bp, Homo sapiens
ggagaaaaacttcagag

SEQ ID NO: 68495 - DNA, 19 bp, Homo sapiens
aggaaaatagagctctgag

SEQ ID NO: 68496 - DNA, 18 bp, Homo sapiens
aggaaacaggctcagaga

SEQ ID NO: 68497 - DNA, 18 bp, Homo sapiens
taaagaaaaaattcagag

SEQ ID NO: 68498 - DNA, 21 bp, Homo sapiens
aaggaaaggaatacccagaga

SEQ ID NO: 68499 - DNA, 22 bp, Homo sapiens
taaaggaaagatgaaacaagag

SEQ ID NO: 68500 - DNA, 20 bp, Homo sapiens
aaggaaaatagcactggaga

SEQ ID NO: 68501 - DNA, 20 bp, Homo sapiens
aggaaagtgagactcagaga

SEQ ID NO: 68502 - DNA, 24 bp, Homo sapiens
taaaagaaaataaaatgaaagaga

SEQ ID NO: 68503 - DNA, 22 bp, Homo sapiens
taaagggaataaaaacatgaga

SEQ ID NO: 68504 - DNA, 23 bp, Homo sapiens
taaaggaaatgaaaagatggaga

SEQ ID NO: 68505 - DNA, 20 bp, Homo sapiens
aaggaaactaggctcagaga

SEQ ID NO: 68506 - DNA, 22 bp, Homo sapiens
taaaggggaataataacagaga

SEQ ID NO: 68507 - DNA, 23 bp, Homo sapiens
aaggaaggagacaggctcagaga

SEQ ID NO: 68508 - DNA, 19 bp, Homo sapiens
aagagacaaagactcggag

SEQ ID NO: 68509 - DNA, 21 bp, Homo sapiens
aaagaaaataaggaaatcaga

SEQ ID NO: 68510 - DNA, 18 bp, Homo sapiens
aggaaaccagctcagaga

SEQ ID NO: 68511 - DNA, 22 bp, Homo sapiens
taaaggaaaaaaaaagatgaga

SEQ ID NO: 68512 - DNA, 22 bp, Homo sapiens
tgaggaaagtgacgcccagaga

SEQ ID NO: 68513 - DNA, 22 bp, Homo sapiens
aggaaaatgaagacaccaggga

SEQ ID NO: 68514 - DNA, 26 bp, Homo sapiens
tgaggaaaatacttttggttcagaga

SEQ ID NO: 68515 - DNA, 18 bp, Homo sapiens
ggaaaataaaggcagtga

SEQ ID NO: 68516 - DNA, 17 bp, Homo sapiens
aagaaaaataactagag

SEQ ID NO: 68517 - DNA, 18 bp, Homo sapiens
taaagggaaaacccagag

SEQ ID NO: 68518 - DNA, 25 bp, Homo sapiens
taaaggagcaatgaaaatatagaga

SEQ ID NO: 68519 - DNA, 23 bp, Homo sapiens
taaaagaaaatgaggactttaga

SEQ ID NO: 68520 - DNA, 19 bp, Homo sapiens
ggaaactgagactcagaga

SEQ ID NO: 68521 - DNA, 27 bp, Homo sapiens
taagggaaaacaatggtgtcttagaga

SEQ ID NO: 68522 - DNA, 21 bp, Homo sapiens
caaaggaaaatgaagataaga

SEQ ID NO: 68523 - DNA, 21 bp, Homo sapiens
aaagaaaaactacacttagag

SEQ ID NO: 68524 - DNA, 19 bp, Homo sapiens
aaggaggcaggctcagaga

SEQ ID NO: 68525 - DNA, 18 bp, Homo sapiens
agagacagaggctcagag

SEQ ID NO: 68526 - DNA, 26 bp, Homo sapiens
aaagaaaataaacacagccttagaga

SEQ ID NO: 68527 - DNA, 22 bp, Homo sapiens
tgaagaaaccaaggctcagaga

SEQ ID NO: 68528 - DNA, 17 bp, Homo sapiens
aagaaaaataaagctag

SEQ ID NO: 68529 - DNA, 21 bp, Homo sapiens
agggggacaaagactcaggga

SEQ ID NO: 68530 - DNA, 21 bp, Homo sapiens
agggagacaaagacttggaga

SEQ ID NO: 68531 - DNA, 20 bp, Homo sapiens
agaaaatggagtctcagaga

SEQ ID NO: 68532 - DNA, 17 bp, Homo sapiens
aggtaaaggctcagaga

SEQ ID NO: 68533 - DNA, 20 bp, Homo sapiens
aggaaactgaggctcagaga

SEQ ID NO: 68534 - DNA, 18 bp, Homo sapiens
aaagaaagtaaaacagag

SEQ ID NO: 68535 - DNA, 25 bp, Homo sapiens
taaaggagattaaagaccaatcaga

SEQ ID NO: 68536 - DNA, 20 bp, Homo sapiens
aaggaactgaggctcagaga

SEQ ID NO: 68537 - DNA, 22 bp, Homo sapiens
aagagaaaataaaaagtggaga

SEQ ID NO: 68538 - DNA, 25 bp, Homo sapiens
aaggaaaagtggaggagactcggag

SEQ ID NO: 68539 - DNA, 21 bp, Homo sapiens
aaggagagaaagactagcaga

SEQ ID NO: 68540 - DNA, 21 bp, Homo sapiens
tgaagaaaatgattaccagag

SEQ ID NO: 68541 - DNA, 20 bp, Homo sapiens
taaaggaaaatgagtccaga

SEQ ID NO: 68542 - DNA, 20 bp, Homo sapiens
aaaggaaaataaaaatggag

SEQ ID NO: 68543 - DNA, 19 bp, Homo sapiens
aggaaaacaaggaaagaga

SEQ ID NO: 68544 - DNA, 22 bp, Homo sapiens
tgaggaaaccaaggctcagaga

SEQ ID NO: 68545 - DNA, 21 bp, Homo sapiens
aaggcagggcaaactcagaga

SEQ ID NO: 68546 - DNA, 21 bp, Homo sapiens
taaagcaaacggactcagaga

SEQ ID NO: 68547 - DNA, 23 bp, Homo sapiens
aaggaaaagaggggctgcagaga

SEQ ID NO: 68548 - DNA, 76 bp, Peanut chlorotic streak virus
ggataaaacgaatctttagtatgagctattatagaagtagaataatagaaacaatacaacgagaaatagattgtct

SEQ ID NO: 68549 - DNA, 24 bp, Peanut chlorotic streak virus
atagaaacaatacaacgagaaata

SEQ ID NO: 68550 - DNA, 18 bp, Homo sapiens
acagagcagcaacgagaa

SEQ ID NO: 68551 - DNA, 19 bp, Homo sapiens
aaaacaatacataaaaaat

SEQ ID NO: 68552 - DNA, 19 bp, Homo sapiens
atagaaacaaaacagtaag

SEQ ID NO: 68553 - DNA, 24 bp, Homo sapiens
taagaaacaatacagaattaaata

SEQ ID NO: 68554 - DNA, 16 bp, Homo sapiens
tagaaacaataagaga

SEQ ID NO: 68555 - DNA, 19 bp, Homo sapiens
gaaagcacaatgagaaata

SEQ ID NO: 68556 - DNA, 24 bp, Homo sapiens
tagaaacaatgcaattcacaaaaa

SEQ ID NO: 68557 - DNA, 21 bp, Homo sapiens
tagaaaagatgcaacaagaaa

SEQ ID NO: 68558 - DNA, 22 bp, Homo sapiens
acagaaacagcatcgaggaata

SEQ ID NO: 68559 - DNA, 20 bp, Homo sapiens
atagaaacatacgacgaaaa

SEQ ID NO: 68560 - DNA, 24 bp, Homo sapiens
acagaaacaatatgaaactgaaat

SEQ ID NO: 68561 - DNA, 21 bp, Homo sapiens
agaaacagcctatgagaaata

SEQ ID NO: 68562 - DNA, 21 bp, Homo sapiens
agaaacagtacgtaacaaaaa

SEQ ID NO: 68563 - DNA, 20 bp, Homo sapiens
gaaacaatacaaattaaata

SEQ ID NO: 68564 - DNA, 21 bp, Homo sapiens
tagacagtacaacgaggaaat

SEQ ID NO: 68565 - DNA, 24 bp, Homo sapiens
gaagaagtaaaacaatgagaaata

SEQ ID NO: 68566 - DNA, 23 bp, Homo sapiens
acagaaagctacaaacgagaaat

SEQ ID NO: 68567 - DNA, 20 bp, Homo sapiens
atatgaacaatacttcaaga

SEQ ID NO: 68568 - DNA, 27 bp, Homo sapiens
atagaaacatccacagaatgaggaata

SEQ ID NO: 68569 - DNA, 20 bp, Homo sapiens
agaaacagtacacagggaga

SEQ ID NO: 68570 - DNA, 22 bp, Homo sapiens
taaaaacaatggattaagaaat

SEQ ID NO: 68571 - DNA, 21 bp, Homo sapiens
ataaaaacaatatcagaaata

SEQ ID NO: 68572 - DNA, 18 bp, Homo sapiens
aaaacaataagagaaata

SEQ ID NO: 68573 - DNA, 22 bp, Homo sapiens
atagaaaggcaaacgagaaata

SEQ ID NO: 68574 - DNA, 20 bp, Homo sapiens
acagaaacactatgagaaat

SEQ ID NO: 68575 - DNA, 22 bp, Homo sapiens
agagacagtacagtaagaaata

SEQ ID NO: 68576 - DNA, 20 bp, Homo sapiens
atagaaacaagacaccaaga

SEQ ID NO: 68577 - DNA, 18 bp, Homo sapiens
gaaagaacatcgagaaat

SEQ ID NO: 68578 - DNA, 17 bp, Homo sapiens
gaaacaataacagagaa

SEQ ID NO: 68579 - DNA, 18 bp, Homo sapiens
cagaaagaacgagaaata

SEQ ID NO: 68580 - DNA, 19 bp, Homo sapiens
aaacatacagtgagaaata

SEQ ID NO: 68581 - DNA, 22 bp, Homo sapiens
acagaaacaatattcagaaata

SEQ ID NO: 68582 - DNA, 79 bp, Human herpesvirus 1
tatgttctttttttattgggaggcgcgggtaggcgggtagctttacaatgcaaaagccttcgacgtggaggaaggcgtg

SEQ ID NO: 68583 - DNA, 24 bp, Human herpesvirus 1
tacaatgcaaaagccttcgacgtg

SEQ ID NO: 68584 - DNA, 23 bp, Homo sapiens
taaatgcaaaacagcccgatgtg

SEQ ID NO: 68585 - DNA, 18 bp, Homo sapiens
acaatgcaaaggcgatgt

SEQ ID NO: 68586 - DNA, 18 bp, Homo sapiens
tacaatgcaaagtgcctt

SEQ ID NO: 68587 - DNA, 18 bp, Homo sapiens
tacaagcaaaagcttttc

SEQ ID NO: 68588 - DNA, 25 bp, Homo sapiens
tacaatgctgaaaagcagtggtgtg

SEQ ID NO: 68589 - DNA, 21 bp, Homo sapiens
tacgaagcaaaagcttctgtg

SEQ ID NO: 68590 - DNA, 101 bp, Human herpesvirus 1
ggtccgttttgtcacgggaaaggaaagaggaaacaggccgcggacacccgggggagtttgtgttcccttttctttcttcccacacacacaaaaggcgtacc

SEQ ID NO: 68591 - DNA, 24 bp, Human herpesvirus 1
agaggaaacaggccgcggacaccc

SEQ ID NO: 68592 - DNA, 18 bp, Homo sapiens
agaggggcgcggacatcc

SEQ ID NO: 68593 - DNA, 18 bp, Homo sapiens
agaggaaatggaccgcag

SEQ ID NO: 68594 - DNA, 19 bp, Homo sapiens
aaggaaactgatgggcacc

SEQ ID NO: 68595 - DNA, 23 bp, Homo sapiens
agagggatgggccccgaacaccc

SEQ ID NO: 68596 - DNA, 16 bp, Homo sapiens
agagggggcagacacc

SEQ ID NO: 68597 - DNA, 19 bp, Homo sapiens
gaggtgggaaacagacacc

SEQ ID NO: 68598 - DNA, 21 bp, Homo sapiens
ggagcaggctctgcgcggaca

SEQ ID NO: 68599 - DNA, 18 bp, Homo sapiens
gaggagacggccacagcc

SEQ ID NO: 68600 - DNA, 19 bp, Homo sapiens
gagggcacaggccacagac

SEQ ID NO: 68601 - DNA, 21 bp, Homo sapiens
gagggagaaggccacgtcacc

SEQ ID NO: 68602 - DNA, 19 bp, Homo sapiens
agaggaaacaggacgtcac

SEQ ID NO: 68603 - DNA, 18 bp, Homo sapiens
gagggggccacagggcac

SEQ ID NO: 68604 - DNA, 18 bp, Homo sapiens
agaggaaaggatgacacc

SEQ ID NO: 68605 - DNA, 24 bp, Homo sapiens
agggaaacaggctcagcggtgccc

SEQ ID NO: 68606 - DNA, 19 bp, Homo sapiens
gaggaggcggtccagaccc

SEQ ID NO: 68607 - DNA, 19 bp, Homo sapiens
gaggaaacaggcaggaccc

SEQ ID NO: 68608 - DNA, 21 bp, Homo sapiens
gaggaaacgagtcagcaaccc

SEQ ID NO: 68609 - DNA, 22 bp, Homo sapiens
ggagacaggccagggaggcacc

SEQ ID NO: 68610 - DNA, 18 bp, Homo sapiens
agaggaaagggcagctac

SEQ ID NO: 68611 - DNA, 19 bp, Homo sapiens
agatgaaatacaggacacc

SEQ ID NO: 68612 - DNA, 26 bp, Homo sapiens
agaggaaatgggcccagggacatgcc

SEQ ID NO: 68613 - DNA, 22 bp, Homo sapiens
agagaaacaggcacaaacaccc

SEQ ID NO: 68614 - DNA, 20 bp, Homo sapiens
gaggaaggcaggcagcgccc

SEQ ID NO: 68615 - DNA, 18 bp, Homo sapiens
agaaacgggccgcaacac

SEQ ID NO: 68616 - DNA, 16 bp, Homo sapiens
gagggggcagacaccc

SEQ ID NO: 68617 - DNA, 23 bp, Homo sapiens
gaggggccaggccactcgggtgc

SEQ ID NO: 68618 - DNA, 17 bp, Homo sapiens
ggaaacagccaagccac

SEQ ID NO: 68619 - DNA, 18 bp, Homo sapiens
gggaacaggcctgaaccc

SEQ ID NO: 68620 - DNA, 17 bp, Homo sapiens
aggggaaacagggctgg

SEQ ID NO: 68621 - DNA, 22 bp, Homo sapiens
gaggaagggggatgagacaccc

SEQ ID NO: 68622 - DNA, 22 bp, Homo sapiens
gaggaaacaggcggagcgatcc

SEQ ID NO: 68623 - DNA, 21 bp, Homo sapiens
agaggaaacatggtcacaccc

SEQ ID NO: 68624 - DNA, 19 bp, Homo sapiens
agaggtggccttggacacc

SEQ ID NO: 68625 - DNA, 23 bp, Homo sapiens
gaggaagggcgtaagggacaccc

SEQ ID NO: 68626 - DNA, 18 bp, Homo sapiens
aggggaaacagagggcag

SEQ ID NO: 68627 - DNA, 19 bp, Homo sapiens
agggagcaggcatggcacc

SEQ ID NO: 68628 - DNA, 22 bp, Homo sapiens
agaggagtaggtaggcacaccc

SEQ ID NO: 68629 - DNA, 19 bp, Homo sapiens
agagggtgacagcagacac

SEQ ID NO: 68630 - DNA, 20 bp, Homo sapiens
agaggagacaccctgggcac

SEQ ID NO: 68631 - DNA, 21 bp, Homo sapiens
aggggaaacagtccagagtcc

SEQ ID NO: 68632 - DNA, 18 bp, Homo sapiens
aggagaaacaggaacacc

SEQ ID NO: 68633 - DNA, 20 bp, Homo sapiens
agagaaaacgggtaaaacag

SEQ ID NO: 68634 - DNA, 19 bp, Homo sapiens
agaggaaaaggctccagcc

SEQ ID NO: 68635 - DNA, 26 bp, Homo sapiens
agagggaacagggtgcttgggtgtcc

SEQ ID NO: 68636 - DNA, 18 bp, Homo sapiens
agaggcagcagggacacc

SEQ ID NO: 68637 - DNA, 15 bp, Homo sapiens
agaggaaaaggcaac

SEQ ID NO: 68638 - DNA, 18 bp, Homo sapiens
aaaggaaacaggtgaacg

SEQ ID NO: 68639 - DNA, 20 bp, Homo sapiens
ggaattaagaacggacaccc

SEQ ID NO: 68640 - DNA, 18 bp, Homo sapiens
gggaacagccccagatcc

SEQ ID NO: 68641 - DNA, 20 bp, Homo sapiens
agaggaaacagtctgtgcaa

SEQ ID NO: 68642 - DNA, 20 bp, Homo sapiens
agggaaacaggcacatgccc

SEQ ID NO: 68643 - DNA, 17 bp, Homo sapiens
ggaagtagcagacaccc

SEQ ID NO: 68644 - DNA, 16 bp, Homo sapiens
gaggaagctggacacc

SEQ ID NO: 68645 - DNA, 19 bp, Homo sapiens
gaggaaacagtgccctaga

SEQ ID NO: 68646 - DNA, 17 bp, Homo sapiens
agggaaacaggagcacc

SEQ ID NO: 68647 - DNA, 15 bp, Homo sapiens
agggaaacaggacag

SEQ ID NO: 68648 - DNA, 23 bp, Homo sapiens
ggaaacaggacagtcatataccc

SEQ ID NO: 68649 - DNA, 18 bp, Homo sapiens
aaggggaacaggccacaa

SEQ ID NO: 68650 - DNA, 21 bp, Homo sapiens
aggggaggcagacacgtgccc

SEQ ID NO: 68651 - DNA, 23 bp, Homo sapiens
gagggaggagaaaaaagacaccc

SEQ ID NO: 68652 - DNA, 16 bp, Homo sapiens
agaggaaaaggggtac

SEQ ID NO: 68653 - DNA, 18 bp, Homo sapiens
gaggaggtggccgcggcc

SEQ ID NO: 68654 - DNA, 20 bp, Homo sapiens
agagggcaggtgacccaccc

SEQ ID NO: 68655 - DNA, 23 bp, Homo sapiens
aggggaagcaggaagggacaccc

SEQ ID NO: 68656 - DNA, 20 bp, Homo sapiens
agaggaaatggggaaaacac

SEQ ID NO: 68657 - DNA, 22 bp, Homo sapiens
aggaaacaatggtttgggcacc

SEQ ID NO: 68658 - DNA, 20 bp, Homo sapiens
gaggaaacgggcagctggca

SEQ ID NO: 68659 - DNA, 21 bp, Homo sapiens
agaggaattgtttacggacac

SEQ ID NO: 68660 - DNA, 19 bp, Homo sapiens
ggaaacaggcaaagcatac

SEQ ID NO: 68661 - DNA, 22 bp, Homo sapiens
gagggggcagcacagacacacc

SEQ ID NO: 68662 - DNA, 19 bp, Homo sapiens
ggaaataggccacacagac

SEQ ID NO: 68663 - DNA, 24 bp, Homo sapiens
agaggaaacgagactcgggtaccc

SEQ ID NO: 68664 - DNA, 23 bp, Homo sapiens
agggggaacagaccccagtgccc

SEQ ID NO: 68665 - DNA, 15 bp, Homo sapiens
agggaaacagagaca

SEQ ID NO: 68666 - DNA, 17 bp, Homo sapiens
agaggaaacaggctgga

SEQ ID NO: 68667 - DNA, 20 bp, Homo sapiens
gaggaaacagcaggaggcac

SEQ ID NO: 68668 - DNA, 23 bp, Homo sapiens
agaggaaacaggctcagttatcc

SEQ ID NO: 68669 - DNA, 17 bp, Homo sapiens
aggggaaggctggacac

SEQ ID NO: 68670 - DNA, 23 bp, Homo sapiens
agaggcggcacacacggacgtcc

SEQ ID NO: 68671 - DNA, 25 bp, Homo sapiens
aggggaaacaggccggagagggccc

SEQ ID NO: 68672 - DNA, 20 bp, Homo sapiens
gaggttgggggcagacaccc

SEQ ID NO: 68673 - DNA, 16 bp, Homo sapiens
gaggaaacagcaacac

SEQ ID NO: 68674 - DNA, 20 bp, Homo sapiens
gagagataggataaacaccc

SEQ ID NO: 68675 - DNA, 18 bp, Homo sapiens
agggaggacggggacacc

SEQ ID NO: 68676 - DNA, 18 bp, Homo sapiens
aagggggacaggccaacc

SEQ ID NO: 68677 - DNA, 18 bp, Homo sapiens
gggcacaggtggacaccc

SEQ ID NO: 68678 - DNA, 20 bp, Homo sapiens
aggggaggcagccacagtcc

SEQ ID NO: 68679 - DNA, 19 bp, Homo sapiens
agatgaaacaggtgaacac

SEQ ID NO: 68680 - DNA, 19 bp, Homo sapiens
gaggagacaggccgtccac

SEQ ID NO: 68681 - DNA, 21 bp, Homo sapiens
aaggggaacaggcctgggtcc

SEQ ID NO: 68682 - DNA, 26 bp, Homo sapiens
agaggaaatggtgccagggaatgccc

SEQ ID NO: 68683 - DNA, 23 bp, Homo sapiens
aggggaaacaggcactcctaccc

SEQ ID NO: 68684 - DNA, 17 bp, Homo sapiens
gaggagaagaggacacc

SEQ ID NO: 68685 - DNA, 22 bp, Homo sapiens
gaggaaacccccttgggtgccc

SEQ ID NO: 68686 - DNA, 22 bp, Homo sapiens
agaggaaaaggctggggttgcc

SEQ ID NO: 68687 - DNA, 20 bp, Homo sapiens
gagggtgtgggcaaacaccc

SEQ ID NO: 68688 - DNA, 18 bp, Homo sapiens
agagtaaacaggctgaac

SEQ ID NO: 68689 - DNA, 19 bp, Homo sapiens
aggggaaacaggcagggca

SEQ ID NO: 68690 - DNA, 21 bp, Homo sapiens
agagaggcggttaagacatcc

SEQ ID NO: 68691 - DNA, 19 bp, Homo sapiens
agagggaacaggccccgcc

SEQ ID NO: 68692 - DNA, 23 bp, Homo sapiens
ggaaacagagcttatgactgccc

SEQ ID NO: 68693 - DNA, 17 bp, Homo sapiens
ggagagccgcggacgcc

SEQ ID NO: 68694 - DNA, 17 bp, Homo sapiens
agaggaaagagcagaca

SEQ ID NO: 68695 - DNA, 22 bp, Homo sapiens
agaggcggcggccgcggtgccc

SEQ ID NO: 68696 - DNA, 19 bp, Homo sapiens
agaggaaataggcccggca

SEQ ID NO: 68697 - DNA, 19 bp, Homo sapiens
aaggggatagagcagacac

SEQ ID NO: 68698 - DNA, 23 bp, Homo sapiens
gaggaaggggccgcagagcagcc

SEQ ID NO: 68699 - DNA, 18 bp, Homo sapiens
aaggaaacacaggatacc

SEQ ID NO: 68700 - DNA, 21 bp, Homo sapiens
agaggacacaggccggagccc

SEQ ID NO: 68701 - DNA, 22 bp, Homo sapiens
agaggaagcagtcgggacaccc

SEQ ID NO: 68702 - DNA, 21 bp, Homo sapiens
gaggggagggcacaaacatcc

SEQ ID NO: 68703 - DNA, 22 bp, Homo sapiens
agaggaaataaggcctaggtcc

SEQ ID NO: 68704 - DNA, 20 bp, Homo sapiens
gagggaagaggcagacaccc

SEQ ID NO: 68705 - DNA, 21 bp, Homo sapiens
gaggaggcgagccgcagcgcc

SEQ ID NO: 68706 - DNA, 116 bp, Tupaia paramyxovirus
tttcttattatatatcaattaatgactatcttaactttatagagctttcatactatcgcaattatatatcatgaatcatttataaaggatgtgcatgaataaaccaattaaagaaa

SEQ ID NO: 68707 - DNA, 24 bp, Tupaia paramyxovirus
aaggatgtgcatgaataaaccaat

SEQ ID NO: 68708 - DNA, 15 bp, Homo sapiens
aaggatggcaaacca

SEQ ID NO: 68709 - DNA, 23 bp, Homo sapiens
aggatgtgctgtggtttaaacca

SEQ ID NO: 68710 - DNA, 20 bp, Homo sapiens
aaggaggcaatcgaataaac

SEQ ID NO: 68711 - DNA, 16 bp, Homo sapiens
ggatgtgcacagacca

SEQ ID NO: 68712 - DNA, 19 bp, Homo sapiens
aagagatgcataagtaaac

SEQ ID NO: 68713 - DNA, 20 bp, Homo sapiens
aagagtataggaataaacca

SEQ ID NO: 68714 - DNA, 17 bp, Homo sapiens
ggatagaaataaaccaa

SEQ ID NO: 68715 - DNA, 19 bp, Homo sapiens
aagggtgtgcataatccca

SEQ ID NO: 68716 - DNA, 18 bp, Homo sapiens
ggataaacgcatgaataa

SEQ ID NO: 68717 - DNA, 19 bp, Homo sapiens
aggagtacagaataaacca

SEQ ID NO: 68718 - DNA, 22 bp, Homo sapiens
aaggatacgagagtaaaccaat

SEQ ID NO: 68719 - DNA, 64 bp, Paramecium bursaria Chlorella virus 1
ctccatattttaccattgacaaactcacatctactgtaaggtcaaaagatggtaaaatcacgag

SEQ ID NO: 68720 - DNA, 24 bp, Paramecium bursaria Chlorella virus 1
tattttaccattgacaaactcaca

SEQ ID NO: 68721 - DNA, 24 bp, Homo sapiens
cattttattacaaagaaactcaca

SEQ ID NO: 68722 - DNA, 22 bp, Homo sapiens
cattttactaaatcaactcaca

SEQ ID NO: 68723 - DNA, 25 bp, Homo sapiens
cattttaccatgtacataattcaca

SEQ ID NO: 68724 - DNA, 17 bp, Homo sapiens
attttaaacaaactcac

SEQ ID NO: 68725 - DNA, 20 bp, Homo sapiens
tttcactgggacaaactcac

SEQ ID NO: 68726 - DNA, 20 bp, Homo sapiens
tattttaccatggacaccca

SEQ ID NO: 68727 - DNA, 18 bp, Homo sapiens
ttttaccaaatgcaactc

SEQ ID NO: 68728 - DNA, 72 bp, Paramecium bursaria Chlorella virus 1
gtggtttctactcaaaagctcgaacaacgcctcgggaaagacccacgtatttacgctttgagaaaataccac

SEQ ID NO: 68729 - DNA, 24 bp, Paramecium bursaria Chlorella virus 1
actcaaaagctcgaacaacgcctc

SEQ ID NO: 68730 - DNA, 23 bp, Homo sapiens
tcaaaagcttgagaagtcgcctc

SEQ ID NO: 68731 - DNA, 17 bp, Homo sapiens
ccaagggctcgaaccct

SEQ ID NO: 68732 - DNA, 20 bp, Homo sapiens
cttaaaagctccaaatcctc

SEQ ID NO: 68733 - DNA, 23 bp, Homo sapiens
actcagaaaaccggcaacgcctc

SEQ ID NO: 68734 - DNA, 20 bp, Homo sapiens
ctcaaaagacaaggatgcct

SEQ ID NO: 68735 - DNA, 22 bp, Homo sapiens
ctcagcgagctctcttcgcctc

SEQ ID NO: 68736 - DNA, 21 bp, Homo sapiens
tcaaaagctcctcactgcctc

SEQ ID NO: 68737 - DNA, 21 bp, Homo sapiens
cccgaaagctctgcgcgcctc

SEQ ID NO: 68738 - DNA, 22 bp, Homo sapiens
ctcaagagtctccctccgcttc

SEQ ID NO: 68739 - DNA, 20 bp, Homo sapiens
tcaacaggtaacaacgcttc

SEQ ID NO: 68740 - DNA, 19 bp, Homo sapiens
acttagaagctcaacaagc

SEQ ID NO: 68741 - DNA, 18 bp, Homo sapiens
actcaggggctgaaacct

SEQ ID NO: 68742 - DNA, 18 bp, Homo sapiens
acccaaaagtaaatgcct

SEQ ID NO: 68743 - DNA, 22 bp, Homo sapiens
ctttaaagctcaaggatgcctc

SEQ ID NO: 68744 - DNA, 15 bp, Homo sapiens
tcaaaacaaacaacg

SEQ ID NO: 68745 - DNA, 20 bp, Homo sapiens
ctcgaaacctcgagctcctc

SEQ ID NO: 68746 - DNA, 18 bp, Homo sapiens
tcaaaagctgagcagggc

SEQ ID NO: 68747 - DNA, 18 bp, Homo sapiens
actcaaaactccatgcct

SEQ ID NO: 68748 - DNA, 74 bp, Myxoma virus
cgatagagggatttagagacctttcttccacgttagaacgacgacgtaaggacgaaagggaggtttctttttcg

SEQ ID NO: 68749 - DNA, 24 bp, Myxoma virus
agagggatttagagacctttcttc

SEQ ID NO: 68750 - DNA, 21 bp, Homo sapiens
agggatttggatggattcttc

SEQ ID NO: 68751 - DNA, 19 bp, Homo sapiens
aaagggattttcttttctt

SEQ ID NO: 68752 - DNA, 18 bp, Homo sapiens
agagggacttgatttctt

SEQ ID NO: 68753 - DNA, 21 bp, Homo sapiens
agagggcatttattgcccttt

SEQ ID NO: 68754 - DNA, 18 bp, Homo sapiens
agagggatttgggaaccc

SEQ ID NO: 68755 - DNA, 23 bp, Homo sapiens
agacggtagttgggcctttcttc

SEQ ID NO: 68756 - DNA, 21 bp, Homo sapiens
aagggattaaatcctttcttc

SEQ ID NO: 68757 - DNA, 20 bp, Homo sapiens
gagggatttagaatttcttc

SEQ ID NO: 68758 - DNA, 22 bp, Homo sapiens
gagggaattaacagcctttctt

SEQ ID NO: 68759 - DNA, 18 bp, Homo sapiens
agagggattacttttctt

SEQ ID NO: 68760 - DNA, 17 bp, Homo sapiens
agagggatttagggcct

SEQ ID NO: 68761 - DNA, 22 bp, Homo sapiens
gagaggaaacagatctttcttc

SEQ ID NO: 68762 - DNA, 20 bp, Homo sapiens
aaagggatttaggacttttc

SEQ ID NO: 68763 - DNA, 21 bp, Homo sapiens
gggatccagggatctttcttc

SEQ ID NO: 68764 - DNA, 22 bp, Homo sapiens
gagggcttaattccctttcttc

SEQ ID NO: 68765 - DNA, 21 bp, Homo sapiens
agagggattcgatattttttc

SEQ ID NO: 68766 - DNA, 19 bp, Homo sapiens
agggatttttagttttctt

SEQ ID NO: 68767 - DNA, 16 bp, Homo sapiens
gagggattccaccttt

SEQ ID NO: 68768 - DNA, 20 bp, Homo sapiens
gaggcattcccttctttctt

SEQ ID NO: 68769 - DNA, 20 bp, Homo sapiens
gagggatctggaatattttc

SEQ ID NO: 68770 - DNA, 16 bp, Homo sapiens
aaaggggttcctttct

SEQ ID NO: 68771 - DNA, 18 bp, Homo sapiens
agggggatgtcctttctt

SEQ ID NO: 68772 - DNA, 18 bp, Homo sapiens
gggatgtcacctttcttc

SEQ ID NO: 68773 - DNA, 19 bp, Homo sapiens
agagggacttagggacccc

SEQ ID NO: 68774 - DNA, 23 bp, Homo sapiens
agggagacctacaggcttttctt

SEQ ID NO: 68775 - DNA, 21 bp, Homo sapiens
gaggagattctctctttcttc

SEQ ID NO: 68776 - DNA, 66 bp, Paramecium bursaria Chlorella virus 1
gtattatacatatatctgttgatatgattgtcactttaccatatcaacaatatatagttttaatat

SEQ ID NO: 68777 - DNA, 24 bp, Paramecium bursaria Chlorella virus 1
tacatatatctgttgatatgattg

SEQ ID NO: 68778 - DNA, 21 bp, Homo sapiens
tacatctgtagaatatgattg

SEQ ID NO: 68779 - DNA, 22 bp, Homo sapiens
atataaattgaaaatatgattg

SEQ ID NO: 68780 - DNA, 76 bp, Feline calicivirus
tgagcaaagggtacaaggcccaatccaatccgttcgccttgcgcgcgcggctggatttagggttgacccttactca

SEQ ID NO: 68781 - DNA, 24 bp, Feline calicivirus
caaggcccaatccaatccgttcgc

SEQ ID NO: 68782 - DNA, 19 bp, Homo sapiens
cagggcccaattcaatcca

SEQ ID NO: 68783 - DNA, 19 bp, Homo sapiens
tgaggcccaatccattcca

SEQ ID NO: 68784 - DNA, 23 bp, Homo sapiens
ggccctaatccaatatgacccgc

SEQ ID NO: 68785 - DNA, 20 bp, Homo sapiens
aagcccaatttcgggttcgc

SEQ ID NO: 68786 - DNA, 20 bp, Homo sapiens
cagggcccgaactagtccgt

SEQ ID NO: 68787 - DNA, 24 bp, Homo sapiens
caaggcccaacctgaggggcttgc

SEQ ID NO: 68788 - DNA, 23 bp, Homo sapiens
cagggcccaatgtcaggagctgc

SEQ ID NO: 68789 - DNA, 23 bp, Homo sapiens
cagggcccaggccgatccattcg

SEQ ID NO: 68790 - DNA, 17 bp, Homo sapiens
caaggcccacatctgtc

SEQ ID NO: 68791 - DNA, 18 bp, Homo sapiens
tgagcctgatcccgttcg

SEQ ID NO: 68792 - DNA, 19 bp, Homo sapiens
caaggcccaaccaacacgc

SEQ ID NO: 68793 - DNA, 18 bp, Homo sapiens
caaggccgggcccgttcg

SEQ ID NO: 68794 - DNA, 61 bp, Rat cytomegalovirus
ggttgttgttagtaatagtatacaagataatggtattttgttctttacttgttagtcaatt

SEQ ID NO: 68795 - DNA, 24 bp, Rat cytomegalovirus
ttagtaatagtatacaagataatg

SEQ ID NO: 68796 - DNA, 20 bp, Homo sapiens
ttagaatagtatataaaata

SEQ ID NO: 68797 - DNA, 67 bp, Trichomonas vaginalis virus 3
gcgccgcgagggtaggtggtcgatagcccgtttgacggagtagcgatattcctgattctggtgtagc

SEQ ID NO: 68798 - DNA, 19 bp, Trichomonas vaginalis virus 3
ttcctgattctggtgtagc

SEQ ID NO: 68799 - DNA, 18 bp, Homo sapiens
tctctatcctggtgtggc

SEQ ID NO: 68800 - DNA, 19 bp, Homo sapiens
tccttgattctaggatagc

SEQ ID NO: 68801 - DNA, 20 bp, Homo sapiens
tccctgatacctagtgtggc

SEQ ID NO: 68802 - DNA, 19 bp, Homo sapiens
ttcctgatgctgacaaagc

SEQ ID NO: 68803 - DNA, 17 bp, Homo sapiens
ttcagattctgatacag

SEQ ID NO: 68804 - DNA, 18 bp, Homo sapiens
tctctgacaccttgtagc

SEQ ID NO: 68805 - DNA, 17 bp, Homo sapiens
ttcctgatctagacagc

SEQ ID NO: 68806 - DNA, 17 bp, Homo sapiens
ctcctgatgagctgtag

SEQ ID NO: 68807 - DNA, 18 bp, Homo sapiens
ttcctgacttcctggggt

SEQ ID NO: 68808 - DNA, 25 bp, Homo sapiens
ttcctgatgtctcaacgatgtggcg

SEQ ID NO: 68809 - DNA, 19 bp, Homo sapiens
ttcttggttctggtgttgc

SEQ ID NO: 68810 - DNA, 18 bp, Homo sapiens
ctcctggccctggtgtag

SEQ ID NO: 68811 - DNA, 19 bp, Homo sapiens
ttcctgatatcagatgtag

SEQ ID NO: 68812 - DNA, 17 bp, Homo sapiens
ttcctgattagatttag

SEQ ID NO: 68813 - DNA, 19 bp, Homo sapiens
ttcctgattaccccttagc

SEQ ID NO: 68814 - DNA, 19 bp, Homo sapiens
ttcctgacttctcctgggc

SEQ ID NO: 68815 - DNA, 17 bp, Homo sapiens
ttcctgatgccaccagc

SEQ ID NO: 68816 - DNA, 17 bp, Homo sapiens
ttcctgattcatccagc

SEQ ID NO: 68817 - DNA, 17 bp, Homo sapiens
ctcctgcctggtgtggc

SEQ ID NO: 68818 - DNA, 18 bp, Homo sapiens
ttcctgatttcactgtag

SEQ ID NO: 68819 - DNA, 18 bp, Homo sapiens
ttcctgactcccttgagc

SEQ ID NO: 68820 - DNA, 18 bp, Homo sapiens
tccctgatttcctgcagc

SEQ ID NO: 68821 - DNA, 19 bp, Homo sapiens
ttccagagtctggtgtggc

SEQ ID NO: 68822 - DNA, 19 bp, Homo sapiens
ttcctgacttctaaattag

SEQ ID NO: 68823 - DNA, 18 bp, Homo sapiens
tctctgttctggtgtggc

SEQ ID NO: 68824 - DNA, 20 bp, Homo sapiens
ttcctgacttaaatgatggc

SEQ ID NO: 68825 - DNA, 16 bp, Homo sapiens
ttcctgatttcatagc

SEQ ID NO: 68826 - DNA, 18 bp, Homo sapiens
ttcctgataccacgtcag

SEQ ID NO: 68827 - DNA, 17 bp, Homo sapiens
ttcctaacctatgtggc

SEQ ID NO: 68828 - DNA, 18 bp, Homo sapiens
ttccgattccatcccagc

SEQ ID NO: 68829 - DNA, 19 bp, Homo sapiens
ttcctgacttttggtatag

SEQ ID NO: 68830 - DNA, 19 bp, Homo sapiens
ttcctaattctatcaatgt

SEQ ID NO: 68831 - DNA, 17 bp, Homo sapiens
ttccttatttgatgtaa

SEQ ID NO: 68832 - DNA, 18 bp, Homo sapiens
ttcccgattctactgagc

SEQ ID NO: 68833 - DNA, 18 bp, Homo sapiens
ttcctgatttcatggagt

SEQ ID NO: 68834 - DNA, 17 bp, Homo sapiens
ttcccgattctcccagc

SEQ ID NO: 68835 - DNA, 18 bp, Homo sapiens
ttcctaaagaagtgtagc

SEQ ID NO: 68836 - DNA, 20 bp, Homo sapiens
ttcctgatgtcaccctgggt

SEQ ID NO: 68837 - DNA, 16 bp, Homo sapiens
ctcctcactggtgtag

SEQ ID NO: 68838 - DNA, 16 bp, Homo sapiens
ttcctattcagtgtag

SEQ ID NO: 68839 - DNA, 20 bp, Homo sapiens
ctcctgattctgagaagagc

SEQ ID NO: 68840 - DNA, 20 bp, Homo sapiens
tcctgatttttgataatggc

SEQ ID NO: 68841 - DNA, 16 bp, Homo sapiens
ttcctgatatgccagc

SEQ ID NO: 68842 - DNA, 19 bp, Homo sapiens
ttctagattctggtccagc

SEQ ID NO: 68843 - DNA, 20 bp, Homo sapiens
ttcctgacttcctcattggc

SEQ ID NO: 68844 - DNA, 19 bp, Homo sapiens
ttcctgactactcattagc

SEQ ID NO: 68845 - DNA, 19 bp, Homo sapiens
ttcctgatttccatgtggc

SEQ ID NO: 68846 - DNA, 19 bp, Homo sapiens
ttcctgatttaaatctagc

SEQ ID NO: 68847 - DNA, 18 bp, Homo sapiens
ttcctgatgctttacagc

SEQ ID NO: 68848 - DNA, 19 bp, Homo sapiens
ttcccgatggggttgtggc

SEQ ID NO: 68849 - DNA, 16 bp, Homo sapiens
ttcctcccggtgtagc

SEQ ID NO: 68850 - DNA, 18 bp, Homo sapiens
tctcgatgatggtgtagc

SEQ ID NO: 68851 - DNA, 21 bp, Homo sapiens
ttcctgatgtctgccattagc

SEQ ID NO: 68852 - DNA, 18 bp, Homo sapiens
ctcctctcctggtgtggc

SEQ ID NO: 68853 - DNA, 74 bp, Cowpox virus
ttagtgttggaattattagtattcttcttgtcatcttgttcagaaatatacaacaatgctatacctaatactaa

SEQ ID NO: 68854 - DNA, 24 bp, Cowpox virus
tacaacaatgctatacctaatact

SEQ ID NO: 68855 - DNA, 19 bp, Homo sapiens
tacaacaaatggctaatac

SEQ ID NO: 68856 - DNA, 24 bp, Homo sapiens
tacaagagttggagacctaatact

SEQ ID NO: 68857 - DNA, 20 bp, Homo sapiens
acaataatgctacagatact

SEQ ID NO: 68858 - DNA, 21 bp, Homo sapiens
caacaataacattctaatact

SEQ ID NO: 68859 - DNA, 17 bp, Homo sapiens
cacaacttgccatacct

SEQ ID NO: 68860 - DNA, 18 bp, Homo sapiens
acaacaatccattctaat

SEQ ID NO: 68861 - DNA, 21 bp, Homo sapiens
tacattaatgctatacacaat

SEQ ID NO: 68862 - DNA, 23 bp, Homo sapiens
tacaacaatgtttgacccatact

SEQ ID NO: 68863 - DNA, 65 bp, Eimeria brunetti RNA virus 1
tagggttctgctattcagacgtacgcacattaagtgtagtaggccgtcatgtggtggtaagccta

SEQ ID NO: 68864 - DNA, 24 bp, Eimeria brunetti RNA virus 1
tagtaggccgtcatgtggtggtaa

SEQ ID NO: 68865 - DNA, 17 bp, Homo sapiens
tagctgggtgtggtggt

SEQ ID NO: 68866 - DNA, 24 bp, Homo sapiens
tagtagtcatttggtgtggtggta

SEQ ID NO: 68867 - DNA, 21 bp, Homo sapiens
tagtaggctgcttgtgattgg

SEQ ID NO: 68868 - DNA, 19 bp, Homo sapiens
tagctgggcgtggtggtgg

SEQ ID NO: 68869 - DNA, 17 bp, Homo sapiens
tagcaggctgtggtggt

SEQ ID NO: 68870 - DNA, 19 bp, Homo sapiens
tagaggctgtcatgcatgg

SEQ ID NO: 68871 - DNA, 19 bp, Homo sapiens
tagggggcggtggtggtgg

SEQ ID NO: 68872 - DNA, 20 bp, Homo sapiens
tagtgtgccgtcatcggtgg

SEQ ID NO: 68873 - DNA, 23 bp, Homo sapiens
tagtaggccttatcacactgtaa

SEQ ID NO: 68874 - DNA, 18 bp, Homo sapiens
agtaggtggtggtggtgg

SEQ ID NO: 68875 - DNA, 19 bp, Homo sapiens
gtaggccgcgtagcggtgg

SEQ ID NO: 68876 - DNA, 17 bp, Homo sapiens
cagtgggtggtggtggt

SEQ ID NO: 68877 - DNA, 18 bp, Homo sapiens
tagtggtggtggtggtgg

SEQ ID NO: 68878 - DNA, 16 bp, Homo sapiens
gtgggccgtgtggtgg

SEQ ID NO: 68879 - DNA, 19 bp, Homo sapiens
taggaggcggtggtggtgg

SEQ ID NO: 68880 - DNA, 22 bp, Homo sapiens
tagtggtgtcttttgtggtggt

SEQ ID NO: 68881 - DNA, 20 bp, Homo sapiens
ggtagctacgatggtggtaa

SEQ ID NO: 68882 - DNA, 17 bp, Homo sapiens
tagctggatgtggtggt

SEQ ID NO: 68883 - DNA, 19 bp, Homo sapiens
gctggcatggtgtggtggt

SEQ ID NO: 68884 - DNA, 20 bp, Homo sapiens
taggaggcctgggtggtggt

SEQ ID NO: 68885 - DNA, 19 bp, Homo sapiens
ggtggtgatggtggtggta

SEQ ID NO: 68886 - DNA, 18 bp, Homo sapiens
tagtgggtcttgaggtgg

SEQ ID NO: 68887 - DNA, 20 bp, Homo sapiens
tagtaggtctcatttggtag

SEQ ID NO: 68888 - DNA, 19 bp, Homo sapiens
gtaggtctgccagtggtag

SEQ ID NO: 68889 - DNA, 20 bp, Homo sapiens
cagtgggcggccgtggtggt

SEQ ID NO: 68890 - DNA, 20 bp, Homo sapiens
ggaggttggacatggtggta

SEQ ID NO: 68891 - DNA, 18 bp, Homo sapiens
tagctggatgtggtggta

SEQ ID NO: 68892 - DNA, 19 bp, Homo sapiens
taataggtcttgtggtggt

SEQ ID NO: 68893 - DNA, 70 bp, Human papillomavirus type 48
gtagaatgtttacattattaatactgtgaatcaaacaaactgtgatcaataaacactgtgaatattttac

SEQ ID NO: 68894 - DNA, 24 bp, Human papillomavirus type 48
tgtgatcaataaacactgtgaata

SEQ ID NO: 68895 - DNA, 20 bp, Homo sapiens
tgtgatcaataacgacagta

SEQ ID NO: 68896 - DNA, 19 bp, Homo sapiens
tgtgataatagacactata

SEQ ID NO: 68897 - DNA, 22 bp, Homo sapiens
tgtgatcaattagttgtaaata

SEQ ID NO: 68898 - DNA, 19 bp, Homo sapiens
tgtgacaataaacatgaat

SEQ ID NO: 68899 - DNA, 18 bp, Homo sapiens
tgtgaataataaacactg

SEQ ID NO: 68900 - DNA, 17 bp, Homo sapiens
tggatcaataaatacta

SEQ ID NO: 68901 - DNA, 26 bp, Homo sapiens
tgtggtcaataaacatgggcctggtg

SEQ ID NO: 68902 - DNA, 20 bp, Homo sapiens
tgtgatcagtgacacctgtg

SEQ ID NO: 68903 - DNA, 21 bp, Homo sapiens
gtggacacaacattgtgaata

SEQ ID NO: 68904 - DNA, 20 bp, Homo sapiens
tgtgattagtactgtgaata

SEQ ID NO: 68905 - DNA, 21 bp, Homo sapiens
tgtgatcaataaataactgtg

SEQ ID NO: 68906 - DNA, 20 bp, Homo sapiens
tgtgatcagaaaacatactg

SEQ ID NO: 68907 - DNA, 19 bp, Homo sapiens
tgtggtcaacaaacacagc

SEQ ID NO: 68908 - DNA, 23 bp, Homo sapiens
tgtggcaatttactttgtgaata

SEQ ID NO: 68909 - DNA, 16 bp, Homo sapiens
tgtgatcaatagtaaa

SEQ ID NO: 68910 - DNA, 19 bp, Homo sapiens
tgtgatcactaagcatgga

SEQ ID NO: 68911 - DNA, 18 bp, Homo sapiens
gtgatgaatgctgtgaat

SEQ ID NO: 68912 - DNA, 69 bp, Bovine papillomavirus type 2
aggtaaagtgctatcgctttcgtgtgaaaaagaaccatagacaccgctacgagaactgcaccaccacct

SEQ ID NO: 68913 - DNA, 24 bp, Bovine papillomavirus type 2
taaagtgctatcgctttcgtgtga

SEQ ID NO: 68914 - DNA, 20 bp, Homo sapiens
agtgctatttctccatcatg

SEQ ID NO: 68915 - DNA, 23 bp, Homo sapiens
aagtgctacttcacctctgtgtg

SEQ ID NO: 68916 - DNA, 25 bp, Homo sapiens
taaagtgcatcccattttcgtgtga

SEQ ID NO: 68917 - DNA, 22 bp, Homo sapiens
taaagtgctgtttgctcagtga

SEQ ID NO: 68918 - DNA, 18 bp, Homo sapiens
taaaatgctgtttgtgtg

SEQ ID NO: 68919 - DNA, 113 bp, Camelpox virus
tgtgagaagtttgcctcgttaaggtcttccatttaaatattatataaacatttgtgtttatatcttattcgtcttttatggaatagtttttaactagtaaagctgtaattaca

SEQ ID NO: 68920 - DNA, 113 bp, Camelpox virus; identical to SEQ ID NO: 68919

SEQ ID NO: 68921 - DNA, 16 bp, Homo sapiens
tggaacaaaaactagt

SEQ ID NO: 68922 - DNA, 24 bp, Homo sapiens
tgagatggttttcccacagtaaag

SEQ ID NO: 68923 - DNA, 19 bp, Homo sapiens
tggaatagttttaatacag

SEQ ID NO: 68924 - DNA, 18 bp, Homo sapiens
tgaaatagttttcttagt

SEQ ID NO: 68925 - DNA, 19 bp, Homo sapiens
tgggatagttcttatttag

SEQ ID NO: 68926 - DNA, 22 bp, Homo sapiens
tgggatagcttttggagcccag

SEQ ID NO: 68927 - DNA, 19 bp, Homo sapiens
tgggatgatttttaaccag

SEQ ID NO: 68928 - DNA, 76 bp, Chimpanzee cytomegalovirus
catggcctgtgtaactagccttctagtgaaagttaccgaaaacgcatttcactagaacgctggttcagaggctatg

SEQ ID NO: 68929 - DNA, 24 bp, Chimpanzee cytomegalovirus
catttcactagaacgctggttcag

SEQ ID NO: 68930 - DNA, 22 bp, Homo sapiens
catttccctgaatgtggttcag

SEQ ID NO: 68931 - DNA, 23 bp, Homo sapiens
catttcactaaacacagcttcag

SEQ ID NO: 68932 - DNA, 22 bp, Homo sapiens
ttttgctagctccctggttcag

SEQ ID NO: 68933 - DNA, 20 bp, Homo sapiens
cattttacagagcgctgatt

SEQ ID NO: 68934 - DNA, 16 bp, Homo sapiens
catttcaccagagctc

SEQ ID NO: 68935 - DNA, 21 bp, Homo sapiens
catttcactgaatgtgaacag

SEQ ID NO: 68936 - DNA, 17 bp, Homo sapiens
atttcctggctggttca

SEQ ID NO: 68937 - DNA, 17 bp, Homo sapiens
catttcactagaagcgg

SEQ ID NO: 68938 - DNA, 17 bp, Homo sapiens
catttcactagaattca

SEQ ID NO: 68939 - DNA, 22 bp, Homo sapiens
cattttattagaacacattcaa

SEQ ID NO: 68940 - DNA, 24 bp, Homo sapiens
catttcacaggacgctgtcaacag

SEQ ID NO: 68941 - DNA, 19 bp, Homo sapiens
catttcacgagaacatcag

SEQ ID NO: 68942 - DNA, 20 bp, Homo sapiens
tttcactataattagttcag

SEQ ID NO: 68943 - DNA, 18 bp, Homo sapiens
catttcacagagcatcgg

SEQ ID NO: 68944 - DNA, 17 bp, Homo sapiens
ttcactagaacaggatt

SEQ ID NO: 68945 - DNA, 17 bp, Homo sapiens
catttcactagatgtgg

SEQ ID NO: 68946 - DNA, 20 bp, Homo sapiens
ttttactttttctggttcag

SEQ ID NO: 68947 - DNA, 19 bp, Homo sapiens
catttcagtttctggttca

SEQ ID NO: 68948 - DNA, 19 bp, Homo sapiens
atttcactaaatgggtatc

SEQ ID NO: 68949 - DNA, 25 bp, Homo sapiens
catttcacagaatgttctgtttcag

SEQ ID NO: 68950 - DNA, 19 bp, Homo sapiens
catctcactgggactggtt

SEQ ID NO: 68951 - DNA, 18 bp, Homo sapiens
cattccactagaagttca

SEQ ID NO: 68952 - DNA, 18 bp, Homo sapiens
tttcaccagaacattcgg

SEQ ID NO: 68953 - DNA, 115 bp, Ectromelia virus
atgtgagaagtttgcctcgttaaggtcttccatttaaatattatataaacatttgtgtttgcatcttattcgtcttttgtggaatagtttttaactagtaaagctgtaattacat

SEQ ID NO: 68954 - DNA, 24 bp, Ectromelia virus
taaggtcttccatttaaatattat

SEQ ID NO: 68955 - DNA, 23 bp, Homo sapiens
aggtttttccatttaaaagttat

SEQ ID NO: 68956 - DNA, 18 bp, Homo sapiens
aggctttccatttgaaac

SEQ ID NO: 68957 - DNA, 18 bp, Homo sapiens
aagtcttccatttgaaac

SEQ ID NO: 68958 - DNA, 64 bp, Gallid herpesvirus 2
atatgttaattggaatatacactgctatagtttacgggcattcgaaaataatcctaacacatat

SEQ ID NO: 68959 - DNA, 24 bp, Gallid herpesvirus 2
cattcgaaaataatcctaacacat

SEQ ID NO: 68960 - DNA, 17 bp, Homo sapiens
ttcgaaaacataacaca

SEQ ID NO: 68961 - DNA, 18 bp, Homo sapiens
aaacgcctcctaacacat

SEQ ID NO: 68962 - DNA, 20 bp, Homo sapiens
cattcaaaatagttcctaca

SEQ ID NO: 68963 - DNA, 16 bp, Homo sapiens
tcgaaaatacaacaca

SEQ ID NO: 68964 - DNA, 22 bp, Homo sapiens
cattcaaaagtaaaacacacat

SEQ ID NO: 68965 - DNA, 25 bp, Homo sapiens
cactcgaaggtcatctctagcacat

SEQ ID NO: 68966 - DNA, 20 bp, Homo sapiens
accagagggtaatcctaaca

SEQ ID NO: 68967 - DNA, 21 bp, Homo sapiens
gaaaataaatacctaatacat

SEQ ID NO: 68968 - DNA, 62 bp, Human herpesvirus 7
gtaagctaccgtacatctctttcacaaacccagggctcacatagagacaagcacaagctcgc

SEQ ID NO: 68969 - DNA, 24 bp, Human herpesvirus 7
ctcacatagagacaagcacaagct

SEQ ID NO: 68970 - DNA, 18 bp, Homo sapiens
cataaagacagctgtgct

SEQ ID NO: 68971 - DNA, 23 bp, Homo sapiens
cacacaggttgtaagcatgagct

SEQ ID NO: 68972 - DNA, 28 bp, Homo sapiens
tcacgtagagacagggattagcttgtgc

SEQ ID NO: 68973 - DNA, 21 bp, Homo sapiens
ctcacacaggggccaagagct

SEQ ID NO: 68974 - DNA, 21 bp, Homo sapiens
cacagcccatgggcacaagct

SEQ ID NO: 68975 - DNA, 24 bp, Homo sapiens
tcacataggggcagacacaaggct

SEQ ID NO: 68976 - DNA, 21 bp, Homo sapiens
ctccatagagaacaacataag

SEQ ID NO: 68977 - DNA, 27 bp, Homo sapiens
tcatgtagagacaggtctagcttgtgc

SEQ ID NO: 68978 - DNA, 24 bp, Homo sapiens
ctgacacaaaggcaggcacaggct

SEQ ID NO: 68979 - DNA, 23 bp, Homo sapiens
ctcgtctagagacaagcacggcc

SEQ ID NO: 68980 - DNA, 18 bp, Homo sapiens
cacacacacacaagcaca

SEQ ID NO: 68981 - DNA, 21 bp, Homo sapiens
ctcgctagagacagccaggct

SEQ ID NO: 68982 - DNA, 18 bp, Homo sapiens
catagagacaagaaagct

SEQ ID NO: 68983 - DNA, 18 bp, Homo sapiens
ctacatagagacttaagc

SEQ ID NO: 68984 - DNA, 17 bp, Homo sapiens
ctcacataagacaggca

SEQ ID NO: 68985 - DNA, 20 bp, Homo sapiens
acatagaaataaaaacagct

SEQ ID NO: 68986 - DNA, 21 bp, Homo sapiens
ctacataaaaaagcatgagct

SEQ ID NO: 68987 - DNA, 22 bp, Homo sapiens
tcacatagaaatgactcaggct

SEQ ID NO: 68988 - DNA, 20 bp, Homo sapiens
cacagaatcaggcacaagct

SEQ ID NO: 68989 - DNA, 21 bp, Homo sapiens
tcattagagacatcaagagct

SEQ ID NO: 68990 - DNA, 22 bp, Homo sapiens
ctaacatttggacaagcatgag

SEQ ID NO: 68991 - DNA, 18 bp, Homo sapiens
ctcactagatacacaagc

SEQ ID NO: 68992 - DNA, 21 bp, Homo sapiens
ctccacccacaggcacaagct

SEQ ID NO: 68993 - DNA, 18 bp, Homo sapiens
ctcatatagctcacaagc

SEQ ID NO: 68994 - DNA, 28 bp, Homo sapiens
ctcacagagagaataagttagcttgtgc

SEQ ID NO: 68995 - DNA, 16 bp, Homo sapiens
tagagacaaggaaact

SEQ ID NO: 68996 - DNA, 20 bp, Homo sapiens
catagagattatgacaagct

SEQ ID NO: 68997 - DNA, 27 bp, Homo sapiens
ccacatagagattgagttagcttgtgc

SEQ ID NO: 68998 - DNA, 18 bp, Homo sapiens
cagagagacaagtacaag

SEQ ID NO: 68999 - DNA, 25 bp, Homo sapiens
ctcacatagggagcagttagcttgg

SEQ ID NO: 69000 - DNA, 25 bp, Homo sapiens
ctcacatagaggtagtgaagcttgg

SEQ ID NO: 69001 - DNA, 102 bp, Human herpesvirus 7
gcgcggcactcaatcgttactggtggctgcttctgggacgacacaagctcagtttggtatgcaactacgtcacagctcatcgccaacagttactgccgctgc

SEQ ID NO: 69002 - DNA, 24 bp, Human herpesvirus 7
ttactggtggctgcttctgggacg

SEQ ID NO: 69003 - DNA, 15 bp, Homo sapiens
ctggtggctcctgag

SEQ ID NO: 69004 - DNA, 20 bp, Homo sapiens
ctgccactgctgcttctggg

SEQ ID NO: 69005 - DNA, 19 bp, Homo sapiens
ctggggcgcttctggggcg

SEQ ID NO: 69006 - DNA, 20 bp, Homo sapiens
tgggggctgcttctgggacg

SEQ ID NO: 69007 - DNA, 16 bp, Homo sapiens
ctggggggctctggga

SEQ ID NO: 69008 - DNA, 17 bp, Homo sapiens
tggctgtgcttctgggc

SEQ ID NO: 69009 - DNA, 113 bp, Variola virus
tgtgagaagtttgcctcgttaaggtcttccatttaaatattatataaacatttgtgtttgtatcttattcgtcttttatggaatagtttttaactagtaaagctgtaattaca

SEQ ID NO: 69010 - DNA, 66 bp, Variola virus
agtgtctaggatgcgtaattttttatatggtatagatcctgtaagcgttgtctgtattctggagct

SEQ ID NO: 69011 - DNA, 24 bp, Variola virus
taggatgcgtaattttttatatgg

SEQ ID NO: 69012 - DNA, 16 bp, Homo sapiens
ggatggtttttatatg

SEQ ID NO: 69013 - DNA, 104 bp, Variola virus
agttggatgaatagtatgtcttaataattgttattatttcactaattaatatttagtaattagtgcactctataaaaacgagaatgacataactaatcataact

SEQ ID NO: 69014 - DNA, 24 bp, Variola virus
ttagtgcactctataaaaacgaga

SEQ ID NO: 69015 - DNA, 23 bp, Homo sapiens
ttagtgcattccaacaggtgaga

SEQ ID NO: 69016 - DNA, 19 bp, Homo sapiens
gcattttataaaaacgaga

SEQ ID NO: 69017 - DNA, 19 bp, Homo sapiens
ttagtagtactcaaacgag

SEQ ID NO: 69018 - DNA, 21 bp, Homo sapiens
tcagtgcatctcaaagatgag

SEQ ID NO: 69019 - DNA, 21 bp, Homo sapiens
agtagctctataaaaatgaga

SEQ ID NO: 69020 - DNA, 17 bp, Homo sapiens
ttagtgcactttaaaaa

SEQ ID NO: 69021 - DNA, 20 bp, Homo sapiens
atgcacccaggaaaatgaga

SEQ ID NO: 69022 - DNA, 18 bp, Homo sapiens
gtgcactccatagtccaa

SEQ ID NO: 69023 - DNA, 22 bp, Homo sapiens
ttagtggtccacaaagagtgag

SEQ ID NO: 69024 - DNA, 69 bp, Human herpesvirus 3
gtacggcccatgggagggaacatttccacgtgttccaatacagggggtgttccttaatagggactgtgc

SEQ ID NO: 69025 - DNA, 24 bp, Human herpesvirus 3
agggggtgttccttaatagggact

SEQ ID NO: 69026 - DNA, 21 bp, Homo sapiens
gggggtgtgggggtaggggct

SEQ ID NO: 69027 - DNA, 24 bp, Homo sapiens
agggggtgtgggtgggtaggggct

SEQ ID NO: 69028 - DNA, 23 bp, Homo sapiens
aggggatgggggagatagggact

SEQ ID NO: 69029 - DNA, 25 bp, Homo sapiens
agggggtgttccttggcccagggct

SEQ ID NO: 69030 - DNA, 19 bp, Homo sapiens
gggacagttggtagggact

SEQ ID NO: 69031 - DNA, 17 bp, Homo sapiens
gggggtgtgctggggac

SEQ ID NO: 69032 - DNA, 16 bp, Homo sapiens
agggggtgctcctgga

SEQ ID NO: 69033 - DNA, 22 bp, Homo sapiens
aggtggtgccccagtagggact

SEQ ID NO: 69034 - DNA, 23 bp, Homo sapiens
agggggtgatgggaatgggggct

SEQ ID NO: 69035 - DNA, 20 bp, Homo sapiens
gggcagggtccttaatgggg

SEQ ID NO: 69036 - DNA, 67 bp, Bovine adenovirus D
aatgaagtttaaagaatattaaatttgacgtacaggctttaattttattcttattttaaaccttatt

SEQ ID NO: 69037 - DNA, 24 bp, Bovine adenovirus D
ctttaattttattcttattttaaa

SEQ ID NO: 69038 - DNA, 23 bp, Homo sapiens
ctttaactttatttttacaataa

SEQ ID NO: 69039 - DNA, 24 bp, Homo sapiens
cttcaattttatttctattttaaa

SEQ ID NO: 69040 - DNA, 20 bp, Homo sapiens
tttaatttcattcttccttc

SEQ ID NO: 69041 - DNA, 85 bp, Casphalia extranea densovirus
gtcacaatggcctacgtgacttggtatacgtgacctaaaacaacaaagtggcgtacgtgagataatgtaatgaggtggtggtgat

SEQ ID NO: 69042 - DNA, 24 bp, Casphalia extranea densovirus
tacgtgagataatgtaatgaggtg

SEQ ID NO: 69043 - DNA, 16 bp, Homo sapiens
gtgagataatgtaggt

SEQ ID NO: 69044 - DNA, 16 bp, Homo sapiens
gtgagataatacaggt

SEQ ID NO: 69045 - DNA, 26 bp, Homo sapiens
tacgtgaggttgtggtacgtgaggtg

SEQ ID NO: 69046 - DNA, 19 bp, Homo sapiens
cgtggggtgaaatgaggtg

SEQ ID NO: 69047 - DNA, 86 bp, Human adenovirus D
cagacccaccccagtcagacccagtggcgagaggcgagcagctgttgaaaaaattgaggacttgttacatgacatgggtggggatg

SEQ ID NO: 69048 - DNA, 17 bp, Human adenovirus D
tgacatgggtggggatg

SEQ ID NO: 69049 - DNA, 20 bp, Homo sapiens
tgagatgggggccctggatg

SEQ ID NO: 69050 - DNA, 19 bp, Homo sapiens
tgacatggcagtctggatg

SEQ ID NO: 69051 - DNA, 18 bp, Homo sapiens
taacatgggtttaaaatg

SEQ ID NO: 69052 - DNA, 18 bp, Homo sapiens
tgacatggccatgggatg

SEQ ID NO: 69053 - DNA, 19 bp, Homo sapiens
gacatgacgctgggggatg

SEQ ID NO: 69054 - DNA, 18 bp, Homo sapiens
tgctatgggcaggggatg

SEQ ID NO: 69055 - DNA, 18 bp, Homo sapiens
tgaggcaagtgggggatg

SEQ ID NO: 69056 - DNA, 18 bp, Homo sapiens
tgaatggggcaggggatg

SEQ ID NO: 69057 - DNA, 18 bp, Homo sapiens
tgaatgggcacgaagatg

SEQ ID NO: 69058 - DNA, 18 bp, Homo sapiens
tgacaggtattagggatg

SEQ ID NO: 69059 - DNA, 19 bp, Homo sapiens
tgatcatggtaagaagatg

SEQ ID NO: 69060 - DNA, 22 bp, Homo sapiens
gatgtggggcagctggggatgc

SEQ ID NO: 69061 - DNA, 18 bp, Homo sapiens
tgagatgagatggggatg

SEQ ID NO: 69062 - DNA, 18 bp, Homo sapiens
taaaatgaagtggggatg

SEQ ID NO: 69063 - DNA, 18 bp, Homo sapiens
tgaatggtgtttaggatg

SEQ ID NO: 69064 - DNA, 19 bp, Homo sapiens
tgaaaatggagtggggatg

SEQ ID NO: 69065 - DNA, 19 bp, Homo sapiens
tgagatggggtggggatgc

SEQ ID NO: 69066 - DNA, 18 bp, Homo sapiens
tgagatgggtgatggatg

SEQ ID NO: 69067 - DNA, 18 bp, Homo sapiens
tgaatggatagagggatg

SEQ ID NO: 69068 - DNA, 19 bp, Homo sapiens
tggcatgggcatcgagatg

SEQ ID NO: 69069 - DNA, 18 bp, Homo sapiens
gacatgaagaaggggatg

SEQ ID NO: 69070 - DNA, 19 bp, Homo sapiens
tgggatggagctggggatg

SEQ ID NO: 69071 - DNA, 19 bp, Homo sapiens
tgacagggaggcctggatg

SEQ ID NO: 69072 - DNA, 79 bp, Human adenovirus C
tggccctcacctgccgcctccgtttcccggtgccgggattccgaggaagaatgcaccgtaggaggggcatggccggcca

SEQ ID NO: 69073 - DNA, 24 bp, Human adenovirus C
agaatgcaccgtaggaggggcatg

SEQ ID NO: 69074 - DNA, 20 bp, Homo sapiens
agaatgcattgtagaagtag

SEQ ID NO: 69075 - DNA, 18 bp, Homo sapiens
gcatcacaggggggcatg

SEQ ID NO: 69076 - DNA, 16 bp, Homo sapiens
agaagcaccgtggggc

SEQ ID NO: 69077 - DNA, 20 bp, Homo sapiens
gaatgctgccgaagggcatg

SEQ ID NO: 69078 - DNA, 21 bp, Homo sapiens
gagtactggtccaggggcatg

SEQ ID NO: 69079 - DNA, 21 bp, Homo sapiens
agaacgttgaggaggggtatg

SEQ ID NO: 69080 - DNA, 18 bp, Homo sapiens
agaatccatctggggcat

SEQ ID NO: 69081 - DNA, 22 bp, Homo sapiens
agaatgcactgggagatgcatg

SEQ ID NO: 69082 - DNA, 23 bp, Homo sapiens
agaatggcaagccaaggggcatg

SEQ ID NO: 69083 - DNA, 17 bp, Homo sapiens
gaatggcgggggggcat

SEQ ID NO: 69084 - DNA, 19 bp, Homo sapiens
agggcgcaccgtgggggac

SEQ ID NO: 69085 - DNA, 17 bp, Homo sapiens
agtgtgcccaggggcat

SEQ ID NO: 69086 - DNA, 21 bp, Homo sapiens
agaggcgctgtggacggcatg

SEQ ID NO: 69087 - DNA, 17 bp, Homo sapiens
agaatgtattggaggag

SEQ ID NO: 69088 - DNA, 18 bp, Homo sapiens
agaagggccaaggagggg

SEQ ID NO: 69089 - DNA, 18 bp, Homo sapiens
agggtgcaccgtgagggg

SEQ ID NO: 69090 - DNA, 63 bp, Human adenovirus C
agttgcatgtggaaaaatcaaaataaaaagtctggagtctcacgctcgcttggtcctgtaact

SEQ ID NO: 69091 - DNA, 18 bp, Human adenovirus C
tcgcttggtcctgtaact

SEQ ID NO: 69092 - DNA, 17 bp, Homo sapiens
tcacttggcttgtgact

SEQ ID NO: 69093 - DNA, 17 bp, Homo sapiens
ccactctgcctgtaact

SEQ ID NO: 69094 - DNA, 21 bp, Homo sapiens
tcacttgagtatactgtaact

SEQ ID NO: 69095 - DNA, 16 bp, Homo sapiens
tcgttggcccctaact

SEQ ID NO: 69096 - DNA, 17 bp, Homo sapiens
tcacttaagatgtaact

SEQ ID NO: 69097 - DNA, 16 bp, Homo sapiens
tcactaagctgtaact

SEQ ID NO: 69098 - DNA, 15 bp, Homo sapiens
tcacctgctgtaact

SEQ ID NO: 69099 - DNA, 17 bp, Homo sapiens
tcacttggtttacaact

SEQ ID NO: 69100 - DNA, 16 bp, Homo sapiens
tcgcttagcagcaact

SEQ ID NO: 69101 - DNA, 16 bp, Homo sapiens
tccttggcccctaact

SEQ ID NO: 69102 - DNA, 18 bp, Homo sapiens
tcttttagtcctgtaact

SEQ ID NO: 69103 - DNA, 16 bp, Homo sapiens
tcattaacctgtaact

SEQ ID NO: 69104 - DNA, 16 bp, Homo sapiens
tcatttggtcctgact

SEQ ID NO: 69105 - DNA, 20 bp, Homo sapiens
tcgcttggtgccgtggcact

SEQ ID NO: 69106 - DNA, 16 bp, Homo sapiens
tctcttggccctgact

SEQ ID NO: 69107 - DNA, 17 bp, Homo sapiens
ccagaagccctgtaact

SEQ ID NO: 69108 - DNA, 16 bp, Homo sapiens
tcgtgttcctgtaact

SEQ ID NO: 69109 - DNA, 18 bp, Homo sapiens
tcggggtctcctgtaact

SEQ ID NO: 69110 - DNA, 17 bp, Homo sapiens
tccctctctctgtaact

SEQ ID NO: 69111 - DNA, 17 bp, Homo sapiens
tcacttgacacctaact

SEQ ID NO: 69112 - DNA, 15 bp, Homo sapiens
ccgcctcctgtaact

SEQ ID NO: 69113 - DNA, 16 bp, Homo sapiens
tcacttgaccataact

SEQ ID NO: 69114 - DNA, 17 bp, Homo sapiens
tcgcttagtactaaact

SEQ ID NO: 69115 - DNA, 61 bp, Cymbidium ringspot virus
ggaaaggatctcgtgcgctataagtctaacgaaagttgagcttgcaacatgggtctatgcc

SEQ ID NO: 69116 - DNA, 24 bp, Cymbidium ringspot virus
aaggatctcgtgcgctataagtct

SEQ ID NO: 69117 - DNA, 21 bp, Homo sapiens
aaagatcttgcccatgagtct

SEQ ID NO: 69118 - DNA, 22 bp, Homo sapiens
gggtctctgccttcctgggtct

SEQ ID NO: 69119 - DNA, 61 bp, Oat mosaic virus
atcaatgctggtgccacggtttcacccccttcttaagggaggctgctgcacccacgttggt

SEQ ID NO: 69120 - DNA, 24 bp, Oat mosaic virus
ctggtgccacggtttcaccccctt

SEQ ID NO: 69121 - DNA, 21 bp, Homo sapiens
ctggtgccttggccgttcctt

SEQ ID NO: 69122 - DNA, 23 bp, Homo sapiens
ctggtgccaggcgctgcctcctt

SEQ ID NO: 69123 - DNA, 18 bp, Homo sapiens
tggtgccagctgcctcct

SEQ ID NO: 69124 - DNA, 21 bp, Homo sapiens
ctggttccccttcaccctctt

SEQ ID NO: 69125 - DNA, 23 bp, Homo sapiens
ctggtgcttcctggtaccccctt

SEQ ID NO: 69126 - DNA, 20 bp, Homo sapiens
ggtgctggtcccacctcctt

SEQ ID NO: 69127 - DNA, 19 bp, Homo sapiens
ctgctgcgtttcacctcct

SEQ ID NO: 69128 - DNA, 18 bp, Homo sapiens
tgatgccatggctttcct

SEQ ID NO: 69129 - DNA, 22 bp, Homo sapiens
ctggtgcctggttcagagcctt

SEQ ID NO: 69130 - DNA, 62 bp, Satellite virus of maize white line mosaic virus
ccctctacgaaatgttcagtcggaagctgagaacctcccggtgcatactgacattgtgaggg

SEQ ID NO: 69131 - DNA, 23 bp, Satellite virus of maize white line mosaic virus
ggtgcatactgacattgtgaggg

SEQ ID NO: 69132 - DNA, 18 bp, Homo sapiens
gggcatgtgtgtgtgagg

SEQ ID NO: 69133 - DNA, 15 bp, Homo sapiens
ggtgactgttgtgag

SEQ ID NO: 69134 - DNA, 19 bp, Homo sapiens
gtgcatggctttgtgaggg

SEQ ID NO: 69135 - DNA, 15 bp, Homo sapiens
ggtacacattgtggg

SEQ ID NO: 69136 - DNA, 24 bp, Homo sapiens
agtgtatgctgacatctaggaggg

SEQ ID NO: 69137 - DNA, 23 bp, Homo sapiens
ggtgcatatctggctgggcaggg

SEQ ID NO: 69138 - DNA, 21 bp, Homo sapiens
ggtgcggcccacatgtgaggg

SEQ ID NO: 69139 - DNA, 21 bp, Homo sapiens
ggtgcatactgggttccaggg

SEQ ID NO: 69140 - DNA, 17 bp, Homo sapiens
gtgcatgttgcatgagg

SEQ ID NO: 69141 - DNA, 18 bp, Homo sapiens
ggtggtactgacatcagg

SEQ ID NO: 69142 - DNA, 16 bp, Homo sapiens
gtgctggctgtgaggg

SEQ ID NO: 69143 - DNA, 20 bp, Homo sapiens
ggtcaattacattgtgaggg

SEQ ID NO: 69144 - DNA, 19 bp, Homo sapiens
ggtgctatgagatgtgggg

SEQ ID NO: 69145 - DNA, 21 bp, Homo sapiens
agtgtgtaacctttgtgaggg

SEQ ID NO: 69146 - DNA, 20 bp, Homo sapiens
ggtacatgctggtatatagg

SEQ ID NO: 69147 - DNA, 20 bp, Homo sapiens
ggtgtctgcctgtgtgaggg

SEQ ID NO: 69148 - DNA, 21 bp, Homo sapiens
ggtgtgtgacaactgtgaggg

SEQ ID NO: 69149 - DNA, 19 bp, Homo sapiens
ggtcatgctgatgtaagag

SEQ ID NO: 69150 - DNA, 21 bp, Homo sapiens
ggtggtagctttttgtgaggg

SEQ ID NO: 69151 - DNA, 61 bp, Satellite virus of maize white line mosaic virus
ggtaggaagttggccaaaggtttccggatataagccacccggttactgtctaactatcccc

SEQ ID NO: 69152 - DNA, 20 bp, Satellite virus of maize white line mosaic virus
gttactgtctaactatcccc

SEQ ID NO: 69153 - DNA, 19 bp, Homo sapiens
attactgtcacaactgtcc

SEQ ID NO: 69154 - DNA, 17 bp, Homo sapiens
attactcctctatcccc

SEQ ID NO: 69155 - DNA, 17 bp, Homo sapiens
gtcactgctctgtcccc

SEQ ID NO: 69156 - DNA, 20 bp, Homo sapiens
gttactgtgctgtcagcccc

SEQ ID NO: 69157 - DNA, 18 bp, Homo sapiens
ctgacccagactatcccc

SEQ ID NO: 69158 - DNA, 19 bp, Homo sapiens
gctactgtttaaatattcc

SEQ ID NO: 69159 - DNA, 21 bp, Homo sapiens
gttactgttaacaagagtccc

SEQ ID NO: 69160 - DNA, 18 bp, Homo sapiens
ttacaaatttaactatcc

SEQ ID NO: 69161 - DNA, 21 bp, Homo sapiens
attactgtcccccaagtcccc

SEQ ID NO: 69162 - DNA, 20 bp, Homo sapiens
gttactgttcaccagattcc

SEQ ID NO: 69163 - DNA, 19 bp, Homo sapiens
gtcactgtgctcaatcccc

SEQ ID NO: 69164 - DNA, 18 bp, Homo sapiens
gtcactgtttaactgccc

SEQ ID NO: 69165 - DNA, 17 bp, Homo sapiens
gttactgctgaactccc

SEQ ID NO: 69166 - DNA, 20 bp, Homo sapiens
gtcactgtctgagatcatcc

SEQ ID NO: 69167 - DNA, 16 bp, Homo sapiens
ttactgtctccacccc

SEQ ID NO: 69168 - DNA, 18 bp, Homo sapiens
ttactgtcccctatttcc

SEQ ID NO: 69169 - DNA, 18 bp, Homo sapiens
gttcttggtaactatccc

SEQ ID NO: 69170 - DNA, 19 bp, Homo sapiens
tactgtcttaaatatctcc

SEQ ID NO: 69171 - DNA, 21 bp, Homo sapiens
gttatctgaatcactattccc

SEQ ID NO: 69172 - DNA, 18 bp, Homo sapiens
gttccctcaaaactatcc

SEQ ID NO: 69173 - DNA, 15 bp, Homo sapiens
gttactgctaatccc

SEQ ID NO: 69174 - DNA, 17 bp, Homo sapiens
gttacgtctaactttcc

SEQ ID NO: 69175 - DNA, 17 bp, Homo sapiens
attactgtctctactcc

SEQ ID NO: 69176 - DNA, 18 bp, Homo sapiens
gttgatgctactatcccc

SEQ ID NO: 69177 - DNA, 19 bp, Homo sapiens
attgctgttctccatcccc

SEQ ID NO: 69178 - DNA, 17 bp, Homo sapiens
ttacttcccctatcccc

SEQ ID NO: 69179 - DNA, 17 bp, Homo sapiens
gtcactgctgtatcccc

SEQ ID NO: 69180 - DNA, 19 bp, Homo sapiens
gttactatcaactggatcc

SEQ ID NO: 69181 - DNA, 18 bp, Homo sapiens
gctactgttactgttccc

SEQ ID NO: 69182 - DNA, 20 bp, Homo sapiens
gttctgtggggtctatcccc

SEQ ID NO: 69183 - DNA, 18 bp, Homo sapiens
gctactgtcatcacatcc

SEQ ID NO: 69184 - DNA, 22 bp, Homo sapiens
gtttctgtctgcttctgtcccc

SEQ ID NO: 69185 - DNA, 18 bp, Homo sapiens
tacaatctaactgtcccc

SEQ ID NO: 69186 - DNA, 17 bp, Homo sapiens
gttgatgtctaacaccc

SEQ ID NO: 69187 - DNA, 18 bp, Homo sapiens
gttactgtctccaatccc

SEQ ID NO: 69188 - DNA, 19 bp, Homo sapiens
gttaccatgcctagctatc

SEQ ID NO: 69189 - DNA, 21 bp, Homo sapiens
attactataaccactatcccc

SEQ ID NO: 69190 - DNA, 19 bp, Homo sapiens
gtcaccacccagctatccc

SEQ ID NO: 69191 - DNA, 18 bp, Homo sapiens
gctactgtctcgatcccc

SEQ ID NO: 69192 - DNA, 79 bp, Saimiriine herpesvirus 2
aagtttaagtaagatacttattttctagtagctagtacgttgcttgctcatttttctaatagtgtttattctaaaactt

SEQ ID NO: 69193 - DNA, 24 bp, Saimiriine herpesvirus 2
taagatacttattttctagtagct

SEQ ID NO: 69194 - DNA, 22 bp, Homo sapiens
agatatttattgcatagtagct

SEQ ID NO: 69195 - DNA, 19 bp, Homo sapiens
taagaatatctctagtagc

SEQ ID NO: 69196 - DNA, 22 bp, Homo sapiens
aaatatttattttctgcagact

SEQ ID NO: 69197 - DNA, 22 bp, Homo sapiens
gaattaaacctttctagtagct

SEQ ID NO: 69198 - DNA, 22 bp, Homo sapiens
taaaatactttttgtctagtag

SEQ ID NO: 69199 - DNA, 18 bp, Homo sapiens
gatgcttaaatagtagct

SEQ ID NO: 69200 - DNA, 19 bp, Homo sapiens
agatacttttttcaaagct

SEQ ID NO: 69201 - DNA, 22 bp, Homo sapiens
agggacttggttattagtagct

SEQ ID NO: 69202 - DNA, 18 bp, Homo sapiens
aaatatttattttctagc

SEQ ID NO: 69203 - DNA, 15 bp, Homo sapiens
atacttatttttagc

SEQ ID NO: 69204 - DNA, 19 bp, Homo sapiens
taagaacttgttttccagc

SEQ ID NO: 69205 - DNA, 63 bp, Saimiriine herpesvirus 2
aacaaataaacttataaacatattttaagctttactggtattgttgtttataacctttttgtt

SEQ ID NO: 69206 - DNA, 24 bp, Saimiriine herpesvirus 2
tataaacatattttaagctttact

SEQ ID NO: 69207 - DNA, 18 bp, Homo sapiens
taaacatatttttaagct

SEQ ID NO: 69208 - DNA, 18 bp, Homo sapiens
tataaacatatttctagc

SEQ ID NO: 69209 - DNA, 20 bp, Homo sapiens
taaacatatttagctttgct

SEQ ID NO: 69210 - DNA, 19 bp, Homo sapiens
acacagactaggctttact

SEQ ID NO: 69211 - DNA, 25 bp, Homo sapiens
tataagtaattttaagccttttact

SEQ ID NO: 69212 - DNA, 24 bp, Homo sapiens
ataaacatatcactctaggcttta

SEQ ID NO: 69213 - DNA, 75 bp, Saimiriine herpesvirus 2
acagtttaaaatgttaaacttttgttatttttaatatgatatatgttaacagctatagttgcattttatatttgt

SEQ ID NO: 69214 - DNA, 24 bp, Saimiriine herpesvirus 2
tttaaaatgttaaacttttgttat

SEQ ID NO: 69215 - DNA, 18 bp, Homo sapiens
tttaaaatgttaacactc

SEQ ID NO: 69216 - DNA, 19 bp, Homo sapiens
tttaaaattttaaacttct

SEQ ID NO: 69217 - DNA, 20 bp, Homo sapiens
tttaaaatgctagttttgtt

SEQ ID NO: 69218 - DNA, 89 bp, Molluscum contagiosum virus
ggccgtctcctctcgcgatctgcgtgaccctcttcgacttacggacgccctcctcgacctgcacgaccctcttcgacttacggacgccc

SEQ ID NO: 69219 - DNA, 24 bp, Molluscum contagiosum virus
gacctgcacgaccctcttcgactt

SEQ ID NO: 69220 - DNA, 17 bp, Homo sapiens
gacctgcacggtctctt

SEQ ID NO: 69221 - DNA, 18 bp, Homo sapiens
aacctgcatgactctctt

SEQ ID NO: 69222 - DNA, 21 bp, Homo sapiens
gacctgcacgttctgggcctt

SEQ ID NO: 69223 - DNA, 25 bp, Homo sapiens
gacctgcacatttttctgagcactt

SEQ ID NO: 69224 - DNA, 21 bp, Homo sapiens
gaacagggctctcttcgactt

SEQ ID NO: 69225 - DNA, 20 bp, Homo sapiens
ctgcacgaccctggcaactt

SEQ ID NO: 69226 - DNA, 94 bp, Molluscum contagiosum virus
gcacgaccctcttcgacttacggacgccctcctcgacctgcacgaccctcttctcgagtgcacgtaaagacggcgattcgtgctcgtgttgtgc

SEQ ID NO: 69227 - DNA, 24 bp, Molluscum contagiosum virus
acttacggacgccctcctcgacct

SEQ ID NO: 69228 - DNA, 18 bp, Homo sapiens
cttagggcgccctccgca

SEQ ID NO: 69229 - DNA, 19 bp, Homo sapiens
cttccagtcccctcctcga

SEQ ID NO: 69230 - DNA, 17 bp, Homo sapiens
ctacggacgccctagac

SEQ ID NO: 69231 - DNA, 82 bp, Camelpox virus
tattaacaagaatcatcccagcaaatatattagagaagcgctcgttttattaataccagtagtaatagtgattccattgata

SEQ ID NO: 69232 - DNA, 24 bp, Camelpox virus
agcaaatatattagagaagcgctc

SEQ ID NO: 69233 - DNA, 17 bp, Homo sapiens
caaatatacagagtgct

SEQ ID NO: 69234 - DNA, 18 bp, Homo sapiens
gcagatgtattagagagc

SEQ ID NO: 69235 - DNA, 19 bp, Homo sapiens
agcaaaattctgaagcgct

SEQ ID NO: 69236 - DNA, 20 bp, Homo sapiens
gctataggtggagaagcgct

SEQ ID NO: 69237 - DNA, 17 bp, Homo sapiens
atacattagaagtgctc

SEQ ID NO: 69238 - DNA, 22 bp, Homo sapiens
agcaaatattttagaatgcctc

SEQ ID NO: 69239 - DNA, 20 bp, Homo sapiens
gcatgattagagaagtgctc

SEQ ID NO: 69240 - DNA, 20 bp, Homo sapiens
aaatatattagtggagtgct

SEQ ID NO: 69241 - DNA, 20 bp, Homo sapiens
agcaataaaaaagaagtgct

SEQ ID NO: 69242 - DNA, 18 bp, Homo sapiens
gcagatttattagagaaa

SEQ ID NO: 69243 - DNA, 23 bp, Homo sapiens
agcaaatatataatatcagtgct

SEQ ID NO: 69244 - DNA, 60 bp, Human erythrovirus V9
ctagatatgaacaacatgtaattagaatgctaagattatgtaatatgtacacaagtttgg

SEQ ID NO: 69245 - DNA, 24 bp, Human erythrovirus V9
tgaacaacatgtaattagaatgct

SEQ ID NO: 69246 - DNA, 22 bp, Homo sapiens
tgaaagacatgtaataaatgct

SEQ ID NO: 69247 - DNA, 24 bp, Homo sapiens
tgaccagtatgtaacaagaatgct

SEQ ID NO: 69248 - DNA, 22 bp, Homo sapiens
tgactaacatgtaaaacaaatg

SEQ ID NO: 69249 - DNA, 18 bp, Homo sapiens
caacatgtgagaactgct

SEQ ID NO: 69250 - DNA, 16 bp, Homo sapiens
tgaaccacatagaatg

SEQ ID NO: 69251 - DNA, 16 bp, Homo sapiens
tgacaacatcagaatg

SEQ ID NO: 69252 - DNA, 19 bp, Homo sapiens
tgagcagcatgcaatatgc

SEQ ID NO: 69253 - DNA, 22 bp, Homo sapiens
tgggcaacttgacaagaatgct

SEQ ID NO: 69254 - DNA, 23 bp, Homo sapiens
tggacagtggcacaaagaatgct

SEQ ID NO: 69255 - DNA, 18 bp, Homo sapiens
acatgtgattaaaatgct

SEQ ID NO: 69256 - DNA, 131 bp, Bombyx mori densovirus 1
accaccaccacaaccccccggaacacaggcccaaaattttcgctacgaagtgaccacacgaagtgacgcgcttcgcgcgtcgtggtcagcgaaaattttgggcctgtgttccggggggttgtggtggtggt

SEQ ID NO: 69257 - DNA, 23 bp, Bombyx mori densovirus 1
ttccggggggttgtggtggtggt

SEQ ID NO: 69258 - DNA, 22 bp, Homo sapiens
ttctaggggcataagtggtggt

SEQ ID NO: 69259 - DNA, 22 bp, Homo sapiens
ttctggagggttgtgacatggt

SEQ ID NO: 69260 - DNA, 22 bp, Homo sapiens
tctggggtgctgtggtggtggt

SEQ ID NO: 69261 - DNA, 17 bp, Homo sapiens
ctctggggtggtggtgg

SEQ ID NO: 69262 - DNA, 21 bp, Homo sapiens
cggggggcggggggtggtggt

SEQ ID NO: 69263 - DNA, 19 bp, Homo sapiens
ttcaggggggagtggtggt

SEQ ID NO: 69264 - DNA, 20 bp, Homo sapiens
ttccggagggaggtggtggt

SEQ ID NO: 69265 - DNA, 18 bp, Homo sapiens
gggtagggtggtggtggt

SEQ ID NO: 69266 - DNA, 18 bp, Homo sapiens
ttctgtggggttggtggt

SEQ ID NO: 69267 - DNA, 20 bp, Homo sapiens
ccgggactggtggtggtggt

SEQ ID NO: 69268 - DNA, 19 bp, Homo sapiens
ggggggtcagggtggtggt

SEQ ID NO: 69269 - DNA, 22 bp, Homo sapiens
tctcgtgtgttgtggtggtggt

SEQ ID NO: 69270 - DNA, 22 bp, Homo sapiens
ttctggggggttttgccagagt

SEQ ID NO: 69271 - DNA, 70 bp, Cowpox virus
ggattttagaatttccaaattcaccagcgatttatcggttttggtgaaatccaaggatttattaatgtcc

SEQ ID NO: 69272 - DNA, 24 bp, Cowpox virus
tccaaattcaccagcgatttatcg

SEQ ID NO: 69273 - DNA, 20 bp, Homo sapiens
tccaaatcaccacaaattat

SEQ ID NO: 69274 - DNA, 21 bp, Homo sapiens
tccaaattctccaagaaatat

SEQ ID NO: 69275 - DNA, 25 bp, Homo sapiens
tctgaattcaccagggttcgataat

SEQ ID NO: 69276 - DNA, 19 bp, Homo sapiens
caaatttaccatgcagctc

SEQ ID NO: 69277 - DNA, 70 bp, Camelpox virus
ggattttagaatttccaaattcaccagcgatttatctgttttggtgaaatccaaggatttattaatgtcc

SEQ ID NO: 69278 - DNA, 24 bp, Camelpox virus
ttggtgaaatccaaggatttatta

SEQ ID NO: 69279 - DNA, 25 bp, Homo sapiens
ttggtgaaagctgcaaaactttatt

SEQ ID NO: 69280 - DNA, 19 bp, Homo sapiens
tggtgaaatttaagaattt

SEQ ID NO: 69281 - DNA, 20 bp, Homo sapiens
ttggtgaagtggcatttatt

SEQ ID NO: 69282 - DNA, 24 bp, Homo sapiens
ttagtgggatccatttcactatta

SEQ ID NO: 69283 - DNA, 18 bp, Homo sapiens
ttggtgaaatcaacaagg

SEQ ID NO: 69284 - DNA, 22 bp, Homo sapiens
ttgatggaaaataggatttatt

SEQ ID NO: 69285 - DNA, 18 bp, Homo sapiens
ttggtgaaatctagattc

SEQ ID NO: 69286 - DNA, 21 bp, Homo sapiens
tggtgaaggagtggatttatt

SEQ ID NO: 69287 - DNA, 21 bp, Homo sapiens
ttggtggaggccaaggactca

SEQ ID NO: 69288 - DNA, 17 bp, Homo sapiens
gtgaaatagaatttatt

SEQ ID NO: 69289 - DNA, 21 bp, Homo sapiens
ttggtaaaattaaatttatta

SEQ ID NO: 69290 - DNA, 24 bp, Homo sapiens
ttagcacctatcagggatttatta

SEQ ID NO: 69291 - DNA, 67 bp, Cowpox virus
gatgcgctgcaaagtttcctattagggttccgcgctttacgtcacccaacatacttgaagcaccatc

SEQ ID NO: 69292 - DNA, 24 bp, Cowpox virus
tcacccaacatacttgaagcacca

SEQ ID NO: 69293 - DNA, 21 bp, Homo sapiens
tcacccaaaatataaacagca

SEQ ID NO: 69294 - DNA, 19 bp, Homo sapiens
cactcaacatatttttcac

SEQ ID NO: 69295 - DNA, 18 bp, Homo sapiens
cacccaatatgtttgaag

SEQ ID NO: 69296 - DNA, 25 bp, Homo sapiens
cacttgaacagaatttgaagcacca

SEQ ID NO: 69297 - DNA, 22 bp, Homo sapiens
tcaccttgtgctaccaaagcac

SEQ ID NO: 69298 - DNA, 19 bp, Homo sapiens
cacccaacatgctccccac

SEQ ID NO: 69299 - DNA, 17 bp, Homo sapiens
cactcaacatattgaaa

SEQ ID NO: 69300 - DNA, 23 bp, Homo sapiens
cacttagcatacttggcctacca

SEQ ID NO: 69301 - DNA, 16 bp, Homo sapiens
tcacccaatgtagcac

SEQ ID NO: 69302 - DNA, 19 bp, Homo sapiens
catccaacatattttaaac

SEQ ID NO: 69303 - DNA, 23 bp, Homo sapiens
acccaataaaacacttggcacca

SEQ ID NO: 69304 - DNA, 23 bp, Homo sapiens
tcacttaacataccttacaggac

SEQ ID NO: 69305 - DNA, 17 bp, Homo sapiens
tctccctttgaagcacc

SEQ ID NO: 69306 - DNA, 19 bp, Homo sapiens
tccccaacacagtgagtgc

SEQ ID NO: 69307 - DNA, 21 bp, Homo sapiens
ccaccttctccttgaagcgcc

SEQ ID NO: 69308 - DNA, 17 bp, Homo sapiens
tcactcacataaagcac

SEQ ID NO: 69309 - DNA, 20 bp, Homo sapiens
tcagccaacataaagagtgc

SEQ ID NO: 69310 - DNA, 25 bp, Homo sapiens
tcactaaacatactgcttaatacca

SEQ ID NO: 69311 - DNA, 17 bp, Homo sapiens
tcacccaacaactgccc

SEQ ID NO: 69312 - DNA, 18 bp, Homo sapiens
tcacccaaatacttcgca

SEQ ID NO: 69313 - DNA, 21 bp, Homo sapiens
tcacccaaggagaaagcatca

SEQ ID NO: 69314 - DNA, 20 bp, Homo sapiens
cacccaatataataaagtac

SEQ ID NO: 69315 - DNA, 24 bp, Homo sapiens
tcacccaaaatggagatggcatca

SEQ ID NO: 69316 - DNA, 20 bp, Homo sapiens
cccaacatgtactcacatca

SEQ ID NO: 69317 - DNA, 22 bp, Homo sapiens
cactcaacatacatttgcatca

SEQ ID NO: 69318 - DNA, 22 bp, Homo sapiens
tccccagcaaagagaagcacca

SEQ ID NO: 69319 - DNA, 19 bp, Homo sapiens
tcccccaactttgaagcac

SEQ ID NO: 69320 - DNA, 22 bp, Homo sapiens
cccaacatgtatagaagtgcca

SEQ ID NO: 69321 - DNA, 20 bp, Homo sapiens
tcacctgaatacttagaagc

SEQ ID NO: 69322 - DNA, 21 bp, Homo sapiens
accttctctcttgaagcacca

SEQ ID NO: 69323 - DNA, 21 bp, Homo sapiens
acctaaacatatttgcaacac

SEQ ID NO: 69324 - DNA, 62 bp, Human herpesvirus 7
acaggaaacattagagtgattaaaaccataagcctggtgttatcggattaaaaacctcttgt

SEQ ID NO: 69325 - DNA, 24 bp, Human herpesvirus 7
tgttatcggattaaaaacctcttg

SEQ ID NO: 69326 - DNA, 22 bp, Homo sapiens
tgtatcagtgaaagacctcttg

SEQ ID NO: 69327 - DNA, 19 bp, Homo sapiens
tgtatcggatcagcttctt

SEQ ID NO: 69328 - DNA, 17 bp, Homo sapiens
tcaccagaaacctcttg

SEQ ID NO: 69329 - DNA, 71 bp, African swine fever virus
tagttactttattacgatgaatctttattaacgattcttttattaatgaattatcataagataaataatta

SEQ ID NO: 69330 - DNA, 24 bp, African swine fever virus
tactttattacgatgaatctttat

SEQ ID NO: 69331 - DNA, 22 bp, Homo sapiens
tactttattgcaatgtctttat

SEQ ID NO: 69332 - DNA, 17 bp, Homo sapiens
ttattacgatgttcttt

SEQ ID NO: 69333 - DNA, 22 bp, Homo sapiens
tttattacccagaaatctttat

SEQ ID NO: 69334 - DNA, 82 bp, Bovine papillomavirus type 2
agggccacgtcgagtgtactctgtgactgtctgctgcggacactgcggaaaggaccttacatttgctgtcaagactggctct

SEQ ID NO: 69335 - DNA, 24 bp, Bovine papillomavirus type 2
tctgtgactgtctgctgcggacac

SEQ ID NO: 69336 - DNA, 20 bp, Homo sapiens
tctgtgactgtcttctaaac

SEQ ID NO: 69337 - DNA, 19 bp, Homo sapiens
tgccttttgctgcgggcac

SEQ ID NO: 69338 - DNA, 21 bp, Homo sapiens
tctgtgactggctgcttctac

SEQ ID NO: 69339 - DNA, 19 bp, Homo sapiens
ctgtggctgtctgcagaac

SEQ ID NO: 69340 - DNA, 19 bp, Homo sapiens
tgtgactgtgactgtgtgg

SEQ ID NO: 69341 - DNA, 18 bp, Homo sapiens
cctgtgacctttgtggac

SEQ ID NO: 69342 - DNA, 24 bp, Homo sapiens
tctgtgactgcttgcgacaagcac

SEQ ID NO: 69343 - DNA, 19 bp, Homo sapiens
tgtgatttcttctgcggac

SEQ ID NO: 69344 - DNA, 18 bp, Homo sapiens
ctgtgacttttgtggaca

SEQ ID NO: 69345 - DNA, 21 bp, Homo sapiens
tctgagaatggctgcggacac

SEQ ID NO: 69346 - DNA, 19 bp, Homo sapiens
tcggtggctgtctgctcag

SEQ ID NO: 69347 - DNA, 21 bp, Homo sapiens
tctgtgactgtttgggaagga

SEQ ID NO: 69348 - DNA, 17 bp, Homo sapiens
tctgtgactgctgatgc

SEQ ID NO: 69349 - DNA, 22 bp, Homo sapiens
tctgtggctgcttttgcggcac

SEQ ID NO: 69350 - DNA, 20 bp, Homo sapiens
tgtggctgctctgcagacac

SEQ ID NO: 69351 - DNA, 20 bp, Homo sapiens
tgtgactgtttgtttcagac

SEQ ID NO: 69352 - DNA, 22 bp, Homo sapiens
tctgtgactgcccccagggcac

SEQ ID NO: 69353 - DNA, 21 bp, Homo sapiens
tctgtgacatgttgacgggca

SEQ ID NO: 69354 - DNA, 18 bp, Homo sapiens
tgtgtgttgtctgctaca

SEQ ID NO: 69355 - DNA, 20 bp, Homo sapiens
tctgtgactatttaaggaca

SEQ ID NO: 69356 - DNA, 19 bp, Homo sapiens
tggttgcctgctgtgggca

SEQ ID NO: 69357 - DNA, 18 bp, Homo sapiens
tctgtgactgtctctggc

SEQ ID NO: 69358 - DNA, 18 bp, Homo sapiens
ctgtgattgtctgctgac

SEQ ID NO: 69359 - DNA, 19 bp, Homo sapiens
cgtgactgtctgcttgaga

SEQ ID NO: 69360 - DNA, 21 bp, Homo sapiens
tctgtgactgctggtctgtgc

SEQ ID NO: 69361 - DNA, 131 bp, Bombyx mori densovirus 5
accaccaccacaaccccccggaacacaggcccaaaattttcgctgaccacgacgcgcgaaacgcgtcacttcgtgtggtcacttcgtagcgaaaattttgggcctgtgttccggggggttgtggtggtggt

SEQ ID NO: 69362 - DNA, 24 bp, Bombyx mori densovirus 5
tcgctgaccacgacgcgcgaaacg

SEQ ID NO: 69363 - DNA, 19 bp, Homo sapiens
ccgttgaccacggctggga

SEQ ID NO: 69364 - DNA, 19 bp, Homo sapiens
ccgttgaccacgacgggcg

SEQ ID NO: 69365 - DNA, 18 bp, Homo sapiens
tcgctgacgcacggggcg

SEQ ID NO: 69366 - DNA, 66 bp, Human immunodeficiency virus 1
cttgtagagctattcgccacatacctagaagaataagacagggcttggaaaggattttgctataag

SEQ ID NO: 69367 - DNA, 23 bp, Human immunodeficiency virus 1
cttggaaaggattttgctataag

SEQ ID NO: 69368 - DNA, 18 bp, Homo sapiens
cctggaaaggccactttg

SEQ ID NO: 69369 - DNA, 17 bp, Homo sapiens
ttggaaagattgcctaa

SEQ ID NO: 69370 - DNA, 18 bp, Homo sapiens
ttggaaagcatttcttct

SEQ ID NO: 69371 - DNA, 17 bp, Homo sapiens
cttgaaaagggtttacc

SEQ ID NO: 69372 - DNA, 21 bp, Homo sapiens
tgggaagtcagttgctataag

SEQ ID NO: 69373 - DNA, 18 bp, Homo sapiens
cttggaaaggagttcccc

SEQ ID NO: 69374 - DNA, 23 bp, Homo sapiens
ttggagagacaccctgctgtaag

SEQ ID NO: 69375 - DNA, 21 bp, Homo sapiens
cctggagggagatgctataag

SEQ ID NO: 69376 - DNA, 18 bp, Homo sapiens
ttgggaacagttgctata

SEQ ID NO: 69377 - DNA, 23 bp, Homo sapiens
ttgaaaaaactgcttgctataag

SEQ ID NO: 69378 - DNA, 20 bp, Homo sapiens
gagagtccccttgctataag

SEQ ID NO: 69379 - DNA, 17 bp, Homo sapiens
ctcggaaagggctgtaa

SEQ ID NO: 69380 - DNA, 17 bp, Homo sapiens
ctggaaagggaactata

SEQ ID NO: 69381 - DNA, 16 bp, Homo sapiens
cctggaggcctgctat

SEQ ID NO: 69382 - DNA, 21 bp, Homo sapiens
ctggaaaaatgctgctgtaag

SEQ ID NO: 69383 - DNA, 18 bp, Homo sapiens
cttggaaaggtttttcca

SEQ ID NO: 69384 - DNA, 20 bp, Homo sapiens
ttggaagtgattttgcaaca

SEQ ID NO: 69385 - DNA, 16 bp, Homo sapiens
cttggaggttgctata

SEQ ID NO: 69386 - DNA, 20 bp, Homo sapiens
ttggaatctcgggttttgct

SEQ ID NO: 69387 - DNA, 17 bp, Homo sapiens
cctgggggatgctataa

SEQ ID NO: 69388 - DNA, 92 bp, Rhesus monkey papillomavirus
cctcgaggacattgtcctagatttgcaaccatttccacaaccgcaaccggtcgaccttatgtgttatgagcaattatctgacagctcagagg

SEQ ID NO: 69389 - DNA, 24 bp, Rhesus monkey papillomavirus
aaccatttccacaaccgcaaccgg

SEQ ID NO: 69390 - DNA, 19 bp, Homo sapiens
ccatttccacagcgtccag

SEQ ID NO: 69391 - DNA, 20 bp, Homo sapiens
aaccattttttataaccgca

SEQ ID NO: 69392 - DNA, 18 bp, Homo sapiens
aaccagttttaacaaccg

SEQ ID NO: 69393 - DNA, 26 bp, Homo sapiens
ccatttccacatattggccggttgcg

SEQ ID NO: 69394 - DNA, 18 bp, Homo sapiens
catttccacagctgccag

SEQ ID NO: 69395 - DNA, 21 bp, Homo sapiens
ccattctcatacagcaaccgg

SEQ ID NO: 69396 - DNA, 27 bp, Homo sapiens
accacttccacaggttggccggttgcg

SEQ ID NO: 69397 - DNA, 22 bp, Homo sapiens
aaccattcttcaacccaactgg

SEQ ID NO: 69398 - DNA, 26 bp, Homo sapiens
ccacttccacagctgtgccggttgcg

SEQ ID NO: 69399 - DNA, 28 bp, Homo sapiens
aaccatttctccagtgtggccggttgcg

SEQ ID NO: 69400 - DNA, 23 bp, Homo sapiens
accatttccctgctggcagccgg

SEQ ID NO: 69401 - DNA, 24 bp, Homo sapiens
catttccacaattattacaattgg

SEQ ID NO: 69402 - DNA, 26 bp, Homo sapiens
ccacttccacgatgcggccggttgcg

SEQ ID NO: 69403 - DNA, 23 bp, Homo sapiens
ccatctcctgcgtgcgcagccgg

SEQ ID NO: 69404 - DNA, 19 bp, Homo sapiens
aactgtttccacagccagc

SEQ ID NO: 69405 - DNA, 23 bp, Homo sapiens
ccacttccaggtcttgcgaccgg

SEQ ID NO: 69406 - DNA, 21 bp, Homo sapiens
accatttccacatgcccttgg

SEQ ID NO: 69407 - DNA, 131 bp, Bombyx mori densovirus 1
accaccaccacaaccccccggaacacaggcccaaaattttcgctgaccacgacgcgcgaagcgcgtcacttcgtgtggtcacttcgtagcgaaaattttgggcctgtgttccggggggttgtggtggtggt

SEQ ID NO: 69408 - DNA, 24 bp, Bombyx mori densovirus 1
tcgctgaccacgacgcgcgaagcg

SEQ ID NO: 69409 - DNA, 28 bp, Homo sapiens
tccctgaccaccccggggtgcgcttcgc

SEQ ID NO: 69410 - DNA, 29 bp, Homo sapiens
tcgctgaccatataaggtgcgcttcgcgc

SEQ ID NO: 69411 - DNA, 21 bp, Homo sapiens
tccctgaccacatgagtgaag

SEQ ID NO: 69412 - DNA, 115 bp, Equine herpesvirus 4
ccccagcctctgcgcgtttgttcgatggcccgggtagcttgtttcccaccccctatcggaggtggggaggtggggaggtggggaggtggggaggtggggaggtggggaggtgggg

SEQ ID NO: 69413 - DNA, 24 bp, Equine herpesvirus 4
gatggcccgggtagcttgtttccc

SEQ ID NO: 69414 - DNA, 16 bp, Homo sapiens
gatggcccggggtttc

SEQ ID NO: 69415 - DNA, 20 bp, Homo sapiens
gatgcttggaggctgtttcc

SEQ ID NO: 69416 - DNA, 16 bp, Homo sapiens
gcccgggtagtggtcc

SEQ ID NO: 69417 - DNA, 17 bp, Homo sapiens
tggcctggaatgtttcc

SEQ ID NO: 69418 - DNA, 17 bp, Homo sapiens
ggcccgggtggccgctt

SEQ ID NO: 69419 - DNA, 17 bp, Homo sapiens
tggtccgggcaaggttt

SEQ ID NO: 69420 - DNA, 21 bp, Homo sapiens
gaggccccttcccttgtttcc

SEQ ID NO: 69421 - DNA, 20 bp, Homo sapiens
gaggctggcagggcttgttt

SEQ ID NO: 69422 - DNA, 22 bp, Homo sapiens
gatgcttaactgcttgttttcc

SEQ ID NO: 69423 - DNA, 18 bp, Homo sapiens
tggctgcactcttgtttc

SEQ ID NO: 69424 - DNA, 19 bp, Homo sapiens
tggctcggggatgtttccc

SEQ ID NO: 69425 - DNA, 17 bp, Homo sapiens
tggcccgggtgtgatcc

SEQ ID NO: 69426 - DNA, 21 bp, Homo sapiens
gatggtctgggggcctggccc

SEQ ID NO: 69427 - DNA, 20 bp, Homo sapiens
tgacctgaagtttgtttccc

SEQ ID NO: 69428 - DNA, 20 bp, Homo sapiens
gcagatgtagcttgttttcc

SEQ ID NO: 69429 - DNA, 19 bp, Homo sapiens
gatgcccgggcacgtttcc

SEQ ID NO: 69430 - DNA, 17 bp, Homo sapiens
gatgttccacttgtttc

SEQ ID NO: 69431 - DNA, 21 bp, Homo sapiens
gatgcctgggtgacttgtttc

SEQ ID NO: 69432 - DNA, 19 bp, Homo sapiens
tggcttcaggtttgtttcc

SEQ ID NO: 69433 - DNA, 19 bp, Homo sapiens
gacggtccgcttgttttcc

SEQ ID NO: 69434 - DNA, 19 bp, Homo sapiens
gatggagatggcttgtttc

SEQ ID NO: 69435 - DNA, 21 bp, Homo sapiens
ggcctgaacatgtttgtttcc

SEQ ID NO: 69436 - DNA, 21 bp, Homo sapiens
gatagcctgggcctatgtttc

SEQ ID NO: 69437 - DNA, 19 bp, Homo sapiens
tggcccaggtggtggttcc

SEQ ID NO: 69438 - DNA, 73 bp, Horseradish curly top virus
ccttatccttagggtttagttttgaagcagagcgagcgcagcgagcgtaaacaacccgaataaacggactagg

SEQ ID NO: 69439 - DNA, 24 bp, Horseradish curly top virus
atccttagggtttagttttgaagc

SEQ ID NO: 69440 - DNA, 18 bp, Homo sapiens
atccttctagttttgaag

SEQ ID NO: 69441 - DNA, 21 bp, Homo sapiens
ctctggggtagctcttggagc

SEQ ID NO: 69442 - DNA, 20 bp, Homo sapiens
cttatagttcagttttggag

SEQ ID NO: 69443 - DNA, 18 bp, Homo sapiens
atcctagggtttgacagc

SEQ ID NO: 69444 - DNA, 21 bp, Homo sapiens
tccttaaggttgaagatgaag

SEQ ID NO: 69445 - DNA, 18 bp, Homo sapiens
tccttaggtttagtgttg

SEQ ID NO: 69446 - DNA, 16 bp, Homo sapiens
ctttgggtttgctgag

SEQ ID NO: 69447 - DNA, 20 bp, Homo sapiens
ccttagggacgttttggggc

SEQ ID NO: 69448 - DNA, 16 bp, Homo sapiens
cttaaaagttttgaag

SEQ ID NO: 69449 - DNA, 21 bp, Homo sapiens
cttaagggtttgacctgaagc

SEQ ID NO: 69450 - DNA, 22 bp, Homo sapiens
tcctagggtttatctagtttga

SEQ ID NO: 69451 - DNA, 19 bp, Homo sapiens
ccttggggtgctttggggc

SEQ ID NO: 69452 - DNA, 20 bp, Homo sapiens
tctttagggttcagttgaag

SEQ ID NO: 69453 - DNA, 21 bp, Homo sapiens
atccttaaggtttggtaacaa

SEQ ID NO: 69454 - DNA, 18 bp, Homo sapiens
ctcagggtttagctcaga

SEQ ID NO: 69455 - DNA, 131 bp, Human herpesvirus 2
tgtttctctttctttccccccctctctccgcaataaacgccttcccggaactgtgtttccccccctacaacagtgttgtccgttggttgggtggttggggtgcgggggtgggcgggggaagcaagaaaacg

SEQ ID NO: 69456 - DNA, 24 bp, Human herpesvirus 2
tccgttggttgggtggttggggtg

SEQ ID NO: 69457 - DNA, 17 bp, Homo sapiens
ttggtgggggttggggt

SEQ ID NO: 69458 - DNA, 21 bp, Homo sapiens
ttggttgagtgaattggggtg

SEQ ID NO: 69459 - DNA, 20 bp, Homo sapiens
gttggttggcgaagggggtg

SEQ ID NO: 69460 - DNA, 112 bp, Equine herpesvirus 2
gctctaatctctatcctccttccccttttttcactcctcccaccggcaacttcccctactgctgttttcccgagagagatggtgtgtgggtgagtgatggcagagagccagc

SEQ ID NO: 69461 - DNA, 24 bp, Equine herpesvirus 2
tggtgtgtgggtgagtgatggcag

SEQ ID NO: 69462 - DNA, 15 bp, Homo sapiens
tggtgtgtgggtggc

SEQ ID NO: 69463 - DNA, 19 bp, Homo sapiens
tggtatgtgggtgggctgg

SEQ ID NO: 69464 - DNA, 20 bp, Homo sapiens
ggtgtggtgggtgatggtgg

SEQ ID NO: 69465 - DNA, 18 bp, Homo sapiens
gtgtgtggaagggtggca

SEQ ID NO: 69466 - DNA, 17 bp, Homo sapiens
gtgtgtgggtgggtgtg

SEQ ID NO: 69467 - DNA, 16 bp, Homo sapiens
tggtggcagtggtggc

SEQ ID NO: 69468 - DNA, 19 bp, Homo sapiens
tggtgtgagggtgaacgca

SEQ ID NO: 69469 - DNA, 22 bp, Homo sapiens
tggtgtgtgtgtgtccaggtgg

SEQ ID NO: 69470 - DNA, 17 bp, Homo sapiens
gtgtgtgggtgtgaagg

SEQ ID NO: 69471 - DNA, 27 bp, Homo sapiens
tgatgtgtttgggctgggtgatggcag

SEQ ID NO: 69472 - DNA, 20 bp, Homo sapiens
tgggtgtgggtggctggtgg

SEQ ID NO: 69473 - DNA, 19 bp, Homo sapiens
tgggtggctggtggtggca

SEQ ID NO: 69474 - DNA, 24 bp, Homo sapiens
tggttttctctggggtggtggtgg

SEQ ID NO: 69475 - DNA, 19 bp, Homo sapiens
tggtggtgagtggtggtgg

SEQ ID NO: 69476 - DNA, 18 bp, Homo sapiens
tggtggtggtggtggtgg

SEQ ID NO: 69477 - DNA, 19 bp, Homo sapiens
tggtgagtggtggtggtgg

SEQ ID NO: 69478 - DNA, 20 bp, Homo sapiens
tggtgagtgggtggcagtag

SEQ ID NO: 69479 - DNA, 18 bp, Homo sapiens
gtgagtgggtggtggtgg

SEQ ID NO: 69480 - DNA, 18 bp, Homo sapiens
tggtggtggtggtggcgg

SEQ ID NO: 69481 - DNA, 19 bp, Homo sapiens
tgggtggtggtggtggtgg

SEQ ID NO: 69482 - DNA, 18 bp, Homo sapiens
ggcagtgggtggtggtgg

SEQ ID NO: 69483 - DNA, 19 bp, Homo sapiens
tggtgtgtggtgggtttgg

SEQ ID NO: 69484 - DNA, 17 bp, Homo sapiens
tgtgtgagtggtggtgg

SEQ ID NO: 69485 - DNA, 18 bp, Homo sapiens
tgatgtgggtagtggtgg

SEQ ID NO: 69486 - DNA, 21 bp, Homo sapiens
tggtggcagtggtgatggcag

SEQ ID NO: 69487 - DNA, 19 bp, Homo sapiens
tggtgtgtgggtgggtgtg

SEQ ID NO: 69488 - DNA, 21 bp, Homo sapiens
tgggtgtgggctctgtggcag

SEQ ID NO: 69489 - DNA, 21 bp, Homo sapiens
tggtagtggtggtggtggtgg

SEQ ID NO: 69490 - DNA, 19 bp, Homo sapiens
tggtgtgtgggagagacgg

SEQ ID NO: 69491 - DNA, 21 bp, Homo sapiens
tgggtgtgggttatatggtgg

SEQ ID NO: 69492 - DNA, 19 bp, Homo sapiens
ggtgtgtggtggctgatgg

SEQ ID NO: 69493 - DNA, 27 bp, Homo sapiens
tggtgtgcggtgacattgggtgatggc

SEQ ID NO: 69494 - DNA, 18 bp, Homo sapiens
tggtggtgggagcgatgg

SEQ ID NO: 69495 - DNA, 19 bp, Homo sapiens
tggtgggtgggtgagctgg

SEQ ID NO: 69496 - DNA, 21 bp, Homo sapiens
tggggagtgagtgagtgatgg

SEQ ID NO: 69497 - DNA, 18 bp, Homo sapiens
ggtgctgggtgatggcag

SEQ ID NO: 69498 - DNA, 20 bp, Homo sapiens
gtgtgtggcactggtggtgg

SEQ ID NO: 69499 - DNA, 15 bp, Homo sapiens
tggtggtgggatggc

SEQ ID NO: 69500 - DNA, 18 bp, Homo sapiens
gtgtgcagggtggtggca

SEQ ID NO: 69501 - DNA, 18 bp, Homo sapiens
tggtgtgagaagtgatgg

SEQ ID NO: 69502 - DNA, 22 bp, Homo sapiens
tggttgcagtgggtgatggcag

SEQ ID NO: 69503 - DNA, 19 bp, Homo sapiens
gcgtggctggtggtggcag

SEQ ID NO: 69504 - DNA, 19 bp, Homo sapiens
tggtgttgggtggggagtg

SEQ ID NO: 69505 - DNA, 23 bp, Homo sapiens
ggtgcctgagtgagtggtggcag

SEQ ID NO: 69506 - DNA, 18 bp, Homo sapiens
tgggtgtgggtgggtggg

SEQ ID NO: 69507 - DNA, 75 bp, Bovine herpesvirus 1
ggcccttccctgttgatttatggcatcgcacacaacggtgtttgcggaacacattttatttaaaacgacagcgcc

SEQ ID NO: 69508 - DNA, 24 bp, Bovine herpesvirus 1
tttgcggaacacattttatttaaa

SEQ ID NO: 69509 - DNA, 16 bp, Homo sapiens
tttgcagagcatttta

SEQ ID NO: 69510 - DNA, 19 bp, Homo sapiens
tttgcagggcatttcattt

SEQ ID NO: 69511 - DNA, 17 bp, Homo sapiens
agaaacattttatttaa

SEQ ID NO: 69512 - DNA, 18 bp, Homo sapiens
tttgcagaacatattata

SEQ ID NO: 69513 - DNA, 63 bp, Equine herpesvirus 1
gacatgtgagcaataaggaacgtgggctgctagatacaacgcccccttcgttcctcacatgtc

SEQ ID NO: 69514 - DNA, 24 bp, Equine herpesvirus 1
taaggaacgtgggctgctagatac

SEQ ID NO: 69515 - DNA, 19 bp, Homo sapiens
gggacgtgagctgggtgat

SEQ ID NO: 69516 - DNA, 19 bp, Homo sapiens
taaggactgtgggctggta

SEQ ID NO: 69517 - DNA, 16 bp, Homo sapiens
agaaacgtggtccaga

SEQ ID NO: 69518 - DNA, 20 bp, Homo sapiens
ggaactaacgctgctagata

SEQ ID NO: 69519 - DNA, 19 bp, Homo sapiens
taaagagaaattgctagat

SEQ ID NO: 69520 - DNA, 23 bp, Homo sapiens
ggagcctgggctacaacagatac

SEQ ID NO: 69521 - DNA, 21 bp, Homo sapiens
taaggaacgtggctttcagat

SEQ ID NO: 69522 - DNA, 18 bp, Homo sapiens
ggatctgggctgcaatac

SEQ ID NO: 69523 - DNA, 19 bp, Homo sapiens
aagaggtctctgctagata

SEQ ID NO: 69524 - DNA, 19 bp, Homo sapiens
ggaacacattgctaggtac

SEQ ID NO: 69525 - DNA, 20 bp, Homo sapiens
caagggacgtccctgggtac

SEQ ID NO: 69526 - DNA, 21 bp, Homo sapiens
aggctgccgggctgctagata

SEQ ID NO: 69527 - DNA, 22 bp, Homo sapiens
taagggattggggccctgatac

SEQ ID NO: 69528 - DNA, 16 bp, Homo sapiens
agggcgtgagctggat

SEQ ID NO: 69529 - DNA, 22 bp, Homo sapiens
taaagaactatctgttaggtac

SEQ ID NO: 69530 - DNA, 15 bp, Homo sapiens
aggcatgagctggat

SEQ ID NO: 69531 - DNA, 74 bp, Hepatitis C virus
gtacaccggaattgccaggacgaccgggtcctttcttggataaacccgctcaatgcctggagatttgggcgtgc

SEQ ID NO: 69532 - DNA, 24 bp, Hepatitis C virus
caccggaattgccaggacgaccgg

SEQ ID NO: 69533 - DNA, 22 bp, Homo sapiens
ggaattgctggactgtgactgg

SEQ ID NO: 69534 - DNA, 22 bp, Homo sapiens
gggattgccaggggctgaccgg

SEQ ID NO: 69535 - DNA, 23 bp, Homo sapiens
ggggctgccaggggcacggccgg

SEQ ID NO: 69536 - DNA, 18 bp, Homo sapiens
cgggcccaggacgatcgg

SEQ ID NO: 69537 - DNA, 22 bp, Homo sapiens
ccgcagttgccagagcattcgg

SEQ ID NO: 69538 - DNA, 18 bp, Homo sapiens
cactggggctgccaggac

SEQ ID NO: 69539 - DNA, 21 bp, Homo sapiens
gaattgccaggaacttcctgg

SEQ ID NO: 69540 - DNA, 89 bp, Amsacta moorei entomopoxvirus
gatacaattttagatgctattaatgataatttagattttaaagaattaataaaagacgaaattagtaattaagtttttaaagttgaatc

SEQ ID NO: 69541 - DNA, 24 bp, Amsacta moorei entomopoxvirus
tagatgctattaatgataatttag

SEQ ID NO: 69542 - DNA, 22 bp, Homo sapiens
tagatgccattacattatttag

SEQ ID NO: 69543 - DNA, 18 bp, Homo sapiens
tagaagctattaagagat

SEQ ID NO: 69544 - DNA, 24 bp, Homo sapiens
aatgctatctttatgataatttag

SEQ ID NO: 69545 - DNA, 65 bp, Amsacta moorei entomopoxvirus
tactaataaagtatgttcaatgttaataaaagtattaactctgacaaatgtattttaatatagta

SEQ ID NO: 69546 - DNA, 24 bp, Amsacta moorei entomopoxvirus
taaagtatgttcaatgttaataaa

SEQ ID NO: 69547 - DNA, 21 bp, Homo sapiens
taaagtatgttggcaggttaa

SEQ ID NO: 69548 - DNA, 18 bp, Homo sapiens
tacctttcaatgttaata

SEQ ID NO: 69549 - DNA, 18 bp, Homo sapiens
tgaatatgttcagatgtc

SEQ ID NO: 69550 - DNA, 24 bp, Homo sapiens
aatatgccaatcaatgttaataaa

SEQ ID NO: 69551 - DNA, 16 bp, Homo sapiens
agatgtcaatgttaat

SEQ ID NO: 69552 - DNA, 21 bp, Homo sapiens
aaagtatgagtagttaataaa

SEQ ID NO: 69553 - DNA, 21 bp, Homo sapiens
aaagcttatcagtgttaataa

SEQ ID NO: 69554 - DNA, 113 bp, Duck adenovirus A
actgtatttgatttttttaggaaattttgcgttgcaatcatatcaactgcacactgaaattaaagatcagattgcagatgtgttggagctgattaggaaggaatcaaaaaagt

SEQ ID NO: 69555 - DNA, 24 bp, Duck adenovirus A
agattgcagatgtgttggagctga

SEQ ID NO: 69556 - DNA, 19 bp, Homo sapiens
aatgtgtatttggagctga

SEQ ID NO: 69557 - DNA, 19 bp, Homo sapiens
aggctgcagatgacagctg

SEQ ID NO: 69558 - DNA, 22 bp, Homo sapiens
agggtgcagatgggaaagctga

SEQ ID NO: 69559 - DNA, 17 bp, Homo sapiens
agttgtggatgtgctga

SEQ ID NO: 69560 - DNA, 23 bp, Homo sapiens
agatggcagaaagctggagctga

SEQ ID NO: 69561 - DNA, 20 bp, Homo sapiens
gactgcaggtgcgctggctg

SEQ ID NO: 69562 - DNA, 16 bp, Homo sapiens
agattgggatggggct

SEQ ID NO: 69563 - DNA, 17 bp, Homo sapiens
gattacaggtgtgagcc

SEQ ID NO: 69564 - DNA, 21 bp, Homo sapiens
aggttgcaaatgtggctgctg

SEQ ID NO: 69565 - DNA, 22 bp, Homo sapiens
gattacaggtgtgagccactga

SEQ ID NO: 69566 - DNA, 20 bp, Homo sapiens
agattcaggagcaggagttg

SEQ ID NO: 69567 - DNA, 20 bp, Homo sapiens
ctgcagatccaggggagttg

SEQ ID NO: 69568 - DNA, 20 bp, Homo sapiens
attgtaagagttggagctga

SEQ ID NO: 69569 - DNA, 20 bp, Homo sapiens
agatgcagacgcggggttgg

SEQ ID NO: 69570 - DNA, 21 bp, Homo sapiens
aggatgcaaagttggagctga

SEQ ID NO: 69571 - DNA, 18 bp, Homo sapiens
gattacagatggagttgg

SEQ ID NO: 69572 - DNA, 18 bp, Homo sapiens
gactgcaggtgttgctgg

SEQ ID NO: 69573 - DNA, 20 bp, Homo sapiens
tgcagatgtttggaagctga

SEQ ID NO: 69574 - DNA, 20 bp, Homo sapiens
aggttccagatgtgtgttga

SEQ ID NO: 69575 - DNA, 18 bp, Homo sapiens
agattcgctttggagctg

SEQ ID NO: 69576 - DNA, 22 bp, Homo sapiens
aggttacagggggaggagctga

SEQ ID NO: 69577 - DNA, 16 bp, Homo sapiens
tgcagagctggggctg

SEQ ID NO: 69578 - DNA, 18 bp, Homo sapiens
tgcaggtatgcagagctg

SEQ ID NO: 69579 - DNA, 19 bp, Homo sapiens
gattgcaggtgtgtagctg

SEQ ID NO: 69580 - DNA, 21 bp, Homo sapiens
ttgtggaattactggagctga

SEQ ID NO: 69581 - DNA, 17 bp, Homo sapiens
agattgcagggagccga

SEQ ID NO: 69582 - DNA, 17 bp, Homo sapiens
agattgtgatgtgctga

SEQ ID NO: 69583 - DNA, 22 bp, Homo sapiens
gagtgtggatgaagccaggctg

SEQ ID NO: 69584 - DNA, 21 bp, Homo sapiens
gattacaggtgtgagccactg

SEQ ID NO: 69585 - DNA, 22 bp, Homo sapiens
gattgcagaggctgagggctga

SEQ ID NO: 69586 - DNA, 21 bp, Homo sapiens
gattgtacggagtggggctga

SEQ ID NO: 69587 - DNA, 21 bp, Homo sapiens
agaatgtagatattggagttg

SEQ ID NO: 69588 - DNA, 67 bp, Meleagrid herpesvirus 1
tgtctacaacaattagttaaattgctatgttctactgcgagtaacatttgataagttgtaagagacg

SEQ ID NO: 69589 - DNA, 24 bp, Meleagrid herpesvirus 1
aacaattagttaaattgctatgtt

SEQ ID NO: 69590 - DNA, 18 bp, Homo sapiens
aacgattattaaattgcc

SEQ ID NO: 69591 - DNA, 20 bp, Homo sapiens
atcagttaaacctctgtgtt

SEQ ID NO: 69592 - DNA, 18 bp, Homo sapiens
tagttcccctgctatgtt

SEQ ID NO: 69593 - DNA, 18 bp, Homo sapiens
aacaattacttaccatgt

SEQ ID NO: 69594 - DNA, 18 bp, Homo sapiens
tagctaaattgctatgtt

SEQ ID NO: 69595 - DNA, 19 bp, Homo sapiens
aacaaatagttaaatatgt

SEQ ID NO: 69596 - DNA, 127 bp, Reston Ebola virus
acaaggcaagccacaaccttagatggaacctcagccagactattgaactattgacgctgttgatgataatatataattaatggtcttatttgaatatgacaacatcttgcttcttgttctgccttgt

SEQ ID NO: 69597 - DNA, 24 bp, Reston Ebola virus
tgatgataatatataattaatggt

SEQ ID NO: 69598 - DNA, 22 bp, Homo sapiens
taatgataaactagttaatggt

SEQ ID NO: 69599 - DNA, 15 bp, Homo sapiens
tgatgataataatgg

SEQ ID NO: 69600 - DNA, 66 bp, Reston Ebola virus
agtgatgaagattaagaaaaaccagtcggtattttccagacttggcatttcttatcttcatcttct

SEQ ID NO: 69601 - DNA, 21 bp, Reston Ebola virus
catttcttatcttcatcttct

SEQ ID NO: 69602 - DNA, 19 bp, Homo sapiens
cattcccctctcatcttct

SEQ ID NO: 69603 - DNA, 20 bp, Homo sapiens
cacttccattttcatcttct

SEQ ID NO: 69604 - DNA, 19 bp, Homo sapiens
atttcttatcctatattct

SEQ ID NO: 69605 - DNA, 20 bp, Homo sapiens
tttcttttcatctctcttct

SEQ ID NO: 69606 - DNA, 20 bp, Homo sapiens
catttcttgatctttcactc

SEQ ID NO: 69607 - DNA, 20 bp, Homo sapiens
cacttcttttcttgtcttct

SEQ ID NO: 69608 - DNA, 18 bp, Homo sapiens
ttcttaactgcatcttct

SEQ ID NO: 69609 - DNA, 17 bp, Homo sapiens
catttcttctctcctct

SEQ ID NO: 69610 - DNA, 18 bp, Homo sapiens
tttccttcttcatcttct

SEQ ID NO: 69611 - DNA, 19 bp, Homo sapiens
catttctttctccgcttct

SEQ ID NO: 69612 - DNA, 20 bp, Homo sapiens
cacttttactatcatcttct

SEQ ID NO: 69613 - DNA, 18 bp, Homo sapiens
tttcatcattttcatctt

SEQ ID NO: 69614 - DNA, 18 bp, Homo sapiens
ttatccaggtcatcttct

SEQ ID NO: 69615 - DNA, 15 bp, Homo sapiens
cattttcttcatctt

SEQ ID NO: 69616 - DNA, 16 bp, Homo sapiens
catttctcatctcttc

SEQ ID NO: 69617 - DNA, 15 bp, Homo sapiens
attcctctcatcttc

SEQ ID NO: 69618 - DNA, 15 bp, Homo sapiens
atttcttacatcttc

SEQ ID NO: 69619 - DNA, 21 bp, Homo sapiens
catttctcacaagaatcttct

SEQ ID NO: 69620 - DNA, 19 bp, Homo sapiens
atttaaaccttcatcttct

SEQ ID NO: 69621 - DNA, 18 bp, Homo sapiens
cttcttcatcttcatctt

SEQ ID NO: 69622 - DNA, 18 bp, Homo sapiens
ctaccttctttatcttct

SEQ ID NO: 69623 - DNA, 20 bp, Homo sapiens
caattctgcagtcatcttct

SEQ ID NO: 69624 - DNA, 17 bp, Homo sapiens
tttctggctcatcttct

SEQ ID NO: 69625 - DNA, 18 bp, Homo sapiens
tttgctcattcatcttct

SEQ ID NO: 69626 - DNA, 19 bp, Homo sapiens
cttctcagcatcatcttct

SEQ ID NO: 69627 - DNA, 21 bp, Homo sapiens
catctcttccagccatcttct

SEQ ID NO: 69628 - DNA, 18 bp, Homo sapiens
ctatcctctttatcttct

SEQ ID NO: 69629 - DNA, 20 bp, Homo sapiens
cattttgttcttcatcttct

SEQ ID NO: 69630 - DNA, 19 bp, Homo sapiens
atttcctatttcacgttct

SEQ ID NO: 69631 - DNA, 19 bp, Homo sapiens
catctcttcttcatcttct

SEQ ID NO: 69632 - DNA, 16 bp, Homo sapiens
ttcttcttcatcttct

SEQ ID NO: 69633 - DNA, 21 bp, Homo sapiens
catatcttgatgtcatcttct

SEQ ID NO: 69634 - DNA, 18 bp, Homo sapiens
cattccctctcatcttct

SEQ ID NO: 69635 - DNA, 19 bp, Homo sapiens
catctcttagccttcttct

SEQ ID NO: 69636 - DNA, 20 bp, Homo sapiens
catttcttgtttctcatcct

SEQ ID NO: 69637 - DNA, 22 bp, Homo sapiens
catttcttatgtatccatttct

SEQ ID NO: 69638 - DNA, 20 bp, Homo sapiens
tttcttacgctaagtcttct

SEQ ID NO: 69639 - DNA, 21 bp, Homo sapiens
caattctctgcctcatcttct

SEQ ID NO: 69640 - DNA, 18 bp, Homo sapiens
catttcctatttccctct

SEQ ID NO: 69641 - DNA, 21 bp, Homo sapiens
tttcttatactctccactctt

SEQ ID NO: 69642 - DNA, 19 bp, Homo sapiens
cactccttcttcattttct

SEQ ID NO: 69643 - DNA, 18 bp, Homo sapiens
atttctgtgtcatcttct

SEQ ID NO: 69644 - DNA, 22 bp, Homo sapiens
atttcttatcacatcatcatct

SEQ ID NO: 69645 - DNA, 20 bp, Homo sapiens
cactcacttcttcatcttct

SEQ ID NO: 69646 - DNA, 17 bp, Homo sapiens
ttcttatcattccttct

SEQ ID NO: 69647 - DNA, 18 bp, Homo sapiens
tttcctattaccacttct

SEQ ID NO: 69648 - DNA, 18 bp, Homo sapiens
tttcttatcttcgcttct

SEQ ID NO: 69649 - DNA, 18 bp, Homo sapiens
tcttcctcttcatcttct

SEQ ID NO: 69650 - DNA, 22 bp, Homo sapiens
catttccttagagcctcatctt

SEQ ID NO: 69651 - DNA, 19 bp, Homo sapiens
ttcttatctttgcccttct

SEQ ID NO: 69652 - DNA, 16 bp, Homo sapiens
ttcttatctaccttct

SEQ ID NO: 69653 - DNA, 20 bp, Homo sapiens
catttcttcacagatcttct

SEQ ID NO: 69654 - DNA, 20 bp, Homo sapiens
cattccttgatccatcttct

SEQ ID NO: 69655 - DNA, 20 bp, Homo sapiens
cttcttcttcttcatcttct

SEQ ID NO: 69656 - DNA, 17 bp, Homo sapiens
ttcttatctgtccttct

SEQ ID NO: 69657 - DNA, 17 bp, Homo sapiens
attcctcagcatcttct

SEQ ID NO: 69658 - DNA, 15 bp, Homo sapiens
catcttcttcatctt

SEQ ID NO: 69659 - DNA, 22 bp, Homo sapiens
cattgttttatcttcaccccct

SEQ ID NO: 69660 - DNA, 16 bp, Homo sapiens
ttctcccccatcttct

SEQ ID NO: 69661 - DNA, 20 bp, Homo sapiens
cattaagcatttcatcttct

SEQ ID NO: 69662 - DNA, 18 bp, Homo sapiens
tcttcatcttcatcttct

SEQ ID NO: 69663 - DNA, 18 bp, Homo sapiens
tttcttatcaaatcttct

SEQ ID NO: 69664 - DNA, 19 bp, Homo sapiens
catgtcttcatcatcttct

SEQ ID NO: 69665 - DNA, 17 bp, Homo sapiens
ttcctatggcatcttct

SEQ ID NO: 69666 - DNA, 19 bp, Homo sapiens
ttcttatcatcatccttct

SEQ ID NO: 69667 - DNA, 20 bp, Homo sapiens
atctcaaactttcatcttct

SEQ ID NO: 69668 - DNA, 18 bp, Homo sapiens
atttcttatctgacatct

SEQ ID NO: 69669 - DNA, 20 bp, Homo sapiens
catttctttcttcttcttct

SEQ ID NO: 69670 - DNA, 18 bp, Homo sapiens
ctctgatcttcatcttct

SEQ ID NO: 69671 - DNA, 19 bp, Homo sapiens
catttcttgccccatttct

SEQ ID NO: 69672 - DNA, 18 bp, Homo sapiens
cttcttatctttccacct

SEQ ID NO: 69673 - DNA, 17 bp, Homo sapiens
tttctcccccatcttct

SEQ ID NO: 69674 - DNA, 20 bp, Homo sapiens
catctccctactcatcttct

SEQ ID NO: 69675 - DNA, 20 bp, Homo sapiens
atttctgatgcccatcttct

SEQ ID NO: 69676 - DNA, 20 bp, Homo sapiens
catcttcatcatcatcttct

SEQ ID NO: 69677 - DNA, 17 bp, Homo sapiens
cacttctctgtcatctt

SEQ ID NO: 69678 - DNA, 87 bp, Tupaia herpesvirus
acgtgatacagccgttagagcaacctgtacttgacttgtcacagcgtgacaatttatcaataaacgttgaccctcgaaacggtacgt

SEQ ID NO: 69679 - DNA, 24 bp, Tupaia herpesvirus
gagcaacctgtacttgacttgtca

SEQ ID NO: 69680 - DNA, 19 bp, Homo sapiens
gagccaacctgtgtttgtc

SEQ ID NO: 69681 - DNA, 25 bp, Homo sapiens
gagtaacctgtgcctttatgacaat

SEQ ID NO: 69682 - DNA, 17 bp, Homo sapiens
gagcatctgtacttgac

SEQ ID NO: 69683 - DNA, 19 bp, Homo sapiens
gagggtctgtactcatgtc

SEQ ID NO: 69684 - DNA, 21 bp, Homo sapiens
gagccacctggccacttgtca

SEQ ID NO: 69685 - DNA, 19 bp, Homo sapiens
gcaacttgtgcttcagtca

SEQ ID NO: 69686 - DNA, 19 bp, Homo sapiens
gagattatacttggcttgt

SEQ ID NO: 69687 - DNA, 18 bp, Homo sapiens
gcaatttgtacttgccta

SEQ ID NO: 69688 - DNA, 21 bp, Homo sapiens
gccaagtatgacttgacttgt

SEQ ID NO: 69689 - DNA, 21 bp, Homo sapiens
gagcaatttgttttcaactta

SEQ ID NO: 69690 - DNA, 22 bp, Homo sapiens
gagcagaagtacttgacttgtc

SEQ ID NO: 69691 - DNA, 18 bp, Homo sapiens
agcagtctgtcacttgtc

SEQ ID NO: 69692 - DNA, 69 bp, Polyomavirus muris
gtgtccgggcaatcagccattgcggtatccgggcaatctgcccggtcttggcaaggcgcccgggagcac

SEQ ID NO: 69693 - DNA, 24 bp, Polyomavirus muris
agccattgcggtatccgggcaatc

SEQ ID NO: 69694 - DNA, 22 bp, Homo sapiens
agccattagtcagatgtctggg

SEQ ID NO: 69695 - DNA, 18 bp, Homo sapiens
gctgtagccctgggcaat

SEQ ID NO: 69696 - DNA, 20 bp, Homo sapiens
gccactggtcacgctgggca

SEQ ID NO: 69697 - DNA, 17 bp, Homo sapiens
gccatggcggtatctgc

SEQ ID NO: 69698 - DNA, 21 bp, Homo sapiens
agccattgtgtctggcctggg

SEQ ID NO: 69699 - DNA, 22 bp, Homo sapiens
agctactgctgtgtgggcaatc

SEQ ID NO: 69700 - DNA, 22 bp, Homo sapiens
agccttgaactcttgggtaatc

SEQ ID NO: 69701 - DNA, 23 bp, Homo sapiens
agctgtgtggcttcagggcaatc

SEQ ID NO: 69702 - DNA, 22 bp, Homo sapiens
agctgttgtgtatacaagcaat

SEQ ID NO: 69703 - DNA, 19 bp, Homo sapiens
gccatcacatccgggtaat

SEQ ID NO: 69704 - DNA, 20 bp, Homo sapiens
attattgtatctgggtgatc

SEQ ID NO: 69705 - DNA, 131 bp, Macaca mulatta rhadinovirus
gggcccatggtggcgcgcggcccccaccgtccccatttcccacggtttgctcatgggcaccgacggtgcccgtggtgatatgtttcagtgaccctcggatgacccgggcgacgttttgcgcaccatggtcc

SEQ ID NO: 69706 - DNA, 24 bp, Macaca mulatta rhadinovirus
tgatatgtttcagtgaccctcgga

SEQ ID NO: 69707 - DNA, 20 bp, Homo sapiens
tgatatgttcggttcctggg

SEQ ID NO: 69708 - DNA, 20 bp, Homo sapiens
tgttaatagtgaccctcgga

SEQ ID NO: 69709 - DNA, 21 bp, Homo sapiens
tggtatgtttcatggactgga

SEQ ID NO: 69710 - DNA, 89 bp, Vaccinia virus
taataaatttcttttcacgatgcatcttattgaatgacgttttctcataagtggacatatagatgcagaagtaatgaagaaaagtatta

SEQ ID NO: 69711 - DNA, 24 bp, Vaccinia virus
ataagtggacatatagatgcagaa

SEQ ID NO: 69712 - DNA, 19 bp, Homo sapiens
ataaatggacatatgggca

SEQ ID NO: 69713 - DNA, 18 bp, Homo sapiens
acaagtggcagggtgcag

SEQ ID NO: 69714 - DNA, 15 bp, Homo sapiens
gtggacagatgcaga

SEQ ID NO: 69715 - DNA, 20 bp, Homo sapiens
taagtggacataacattaga

SEQ ID NO: 69716 - DNA, 23 bp, Homo sapiens
ataagtggtgtatattttgacag

SEQ ID NO: 69717 - DNA, 18 bp, Homo sapiens
caagtcagtagatgcaga

SEQ ID NO: 69718 - DNA, 19 bp, Homo sapiens
gtgttcaaatggatgcaga

SEQ ID NO: 69719 - DNA, 18 bp, Homo sapiens
aagtggacatagtacaga

SEQ ID NO: 69720 - DNA, 15 bp, Homo sapiens
agtggcagatgcaga

SEQ ID NO: 69721 - DNA, 25 bp, Homo sapiens
ataagtgacaacatctgatgtagaa

SEQ ID NO: 69722 - DNA, 17 bp, Homo sapiens
gtggacatgatccatga

SEQ ID NO: 69723 - DNA, 25 bp, Homo sapiens
taaatgttgagttgtagatgcagaa

SEQ ID NO: 69724 - DNA, 18 bp, Homo sapiens
gtggacatatggactcga

SEQ ID NO: 69725 - DNA, 16 bp, Homo sapiens
gtggcatggatgcaga

SEQ ID NO: 69726 - DNA, 17 bp, Homo sapiens
agtgggtagagagcaga

SEQ ID NO: 69727 - DNA, 20 bp, Homo sapiens
ataaatgggcatagcttaga

SEQ ID NO: 69728 - DNA, 21 bp, Homo sapiens
agggtgtatatggatgcagaa

SEQ ID NO: 69729 - DNA, 18 bp, Homo sapiens
gtgggtacataaatggag

SEQ ID NO: 69730 - DNA, 25 bp, Homo sapiens
taaatggatataggtaaagatgcag

SEQ ID NO: 69731 - DNA, 16 bp, Homo sapiens
taagtggacacatgca

SEQ ID NO: 69732 - DNA, 17 bp, Homo sapiens
taaggggagagatgcag

SEQ ID NO: 69733 - DNA, 20 bp, Homo sapiens
taagtggatagacatatgga

SEQ ID NO: 69734 - DNA, 17 bp, Homo sapiens
agtggcagaagatgcag

SEQ ID NO: 69735 - DNA, 18 bp, Homo sapiens
agttggactaaaatgcag

SEQ ID NO: 69736 - DNA, 17 bp, Homo sapiens
agtggaatggatgcaga

SEQ ID NO: 69737 - DNA, 21 bp, Homo sapiens
ataagtggtgtccctgcagaa

SEQ ID NO: 69738 - DNA, 18 bp, Homo sapiens
ggagtacatggatgcaga

SEQ ID NO: 69739 - DNA, 17 bp, Homo sapiens
atggacatattctgaga

SEQ ID NO: 69740 - DNA, 22 bp, Homo sapiens
ataggtggacatgggtcaacag

SEQ ID NO: 69741 - DNA, 22 bp, Homo sapiens
taagtagacatgtgtaacagaa

SEQ ID NO: 69742 - DNA, 106 bp, Rana tigrina ranavirus
actatcgtaatatatattatcactgaaagacttttaggccaagaaggagatgtaacatcttaagtcttttgttagtctctttcagaagactttatattaagatagt

SEQ ID NO: 69743 - DNA, 24 bp, Rana tigrina ranavirus
tcactgaaagacttttaggccaag

SEQ ID NO: 69744 - DNA, 17 bp, Homo sapiens
actgaggtttaggccaa

SEQ ID NO: 69745 - DNA, 25 bp, Homo sapiens
tcagtgaaagacctcttgggctaag

SEQ ID NO: 69746 - DNA, 23 bp, Homo sapiens
tctctggaaggttccaggccaag

SEQ ID NO: 69747 - DNA, 21 bp, Homo sapiens
tcctgggaaacgtaggccaag

SEQ ID NO: 69748 - DNA, 19 bp, Homo sapiens
actgaaaggctttaaacca

SEQ ID NO: 69749 - DNA, 20 bp, Homo sapiens
actggaagagttaggccaag

SEQ ID NO: 69750 - DNA, 20 bp, Homo sapiens
tcactgaaaaactaagttgg

SEQ ID NO: 69751 - DNA, 18 bp, Homo sapiens
tcgctgagaaactttcag

SEQ ID NO: 69752 - DNA, 23 bp, Homo sapiens
tcactgaaaggtggacatttagg

SEQ ID NO: 69753 - DNA, 18 bp, Homo sapiens
actgaaagattttttaag

SEQ ID NO: 69754 - DNA, 16 bp, Homo sapiens
ctgaaaggcttccacc

SEQ ID NO: 69755 - DNA, 18 bp, Homo sapiens
tcactgaaagtctaacca

SEQ ID NO: 69756 - DNA, 19 bp, Homo sapiens
tcactgaagggacaggcca

SEQ ID NO: 69757 - DNA, 22 bp, Homo sapiens
tcactgaaggatgacttctagg

SEQ ID NO: 69758 - DNA, 19 bp, Homo sapiens
tcatgaaaggggaggccaa

SEQ ID NO: 69759 - DNA, 20 bp, Homo sapiens
tgggagtcccttaggtcaag

SEQ ID NO: 69760 - DNA, 18 bp, Homo sapiens
tcactgaaaggtttttgg

SEQ ID NO: 69761 - DNA, 19 bp, Homo sapiens
tcagctgaaaggttttaag

SEQ ID NO: 69762 - DNA, 20 bp, Homo sapiens
tcactgaaagtttaattaag

SEQ ID NO: 69763 - DNA, 18 bp, Homo sapiens
tcatgagaggctcttagg

SEQ ID NO: 69764 - DNA, 21 bp, Homo sapiens
tcactgaagtaaggaccaggc

SEQ ID NO: 69765 - DNA, 18 bp, Homo sapiens
tcacagaaagacttcagg

SEQ ID NO: 69766 - DNA, 18 bp, Homo sapiens
gaaagacttagctacaag

SEQ ID NO: 69767 - DNA, 22 bp, Homo sapiens
ctgagggagagtggaggccaag

SEQ ID NO: 69768 - DNA, 18 bp, Homo sapiens
tcattgtaagacttttgg

SEQ ID NO: 69769 - DNA, 23 bp, Homo sapiens
tcactgaaagctcatcagtcaag

SEQ ID NO: 69770 - DNA, 18 bp, Homo sapiens
tcactaaaaggttttagg

SEQ ID NO: 69771 - DNA, 18 bp, Homo sapiens
cactgaaagactttatgg

SEQ ID NO: 69772 - DNA, 19 bp, Homo sapiens
ctgggagactcaggccaag

SEQ ID NO: 69773 - DNA, 19 bp, Homo sapiens
tcactgagggtcttccagg

SEQ ID NO: 69774 - DNA, 18 bp, Homo sapiens
tcctgaaagacggtcagg

SEQ ID NO: 69775 - DNA, 17 bp, Homo sapiens
tcactgaaagatctagg

SEQ ID NO: 69776 - DNA, 20 bp, Homo sapiens
tcactgaagaatttagcaca

SEQ ID NO: 69777 - DNA, 20 bp, Homo sapiens
tcactgaagtatttcctagg

SEQ ID NO: 69778 - DNA, 18 bp, Homo sapiens
tcactgaaggcttttcca

SEQ ID NO: 69779 - DNA, 18 bp, Homo sapiens
tcactgaagggctttcaa

SEQ ID NO: 69780 - DNA, 16 bp, Homo sapiens
tcacttgattaggcca

SEQ ID NO: 69781 - DNA, 18 bp, Homo sapiens
tcactgaaggatattagg

SEQ ID NO: 69782 - DNA, 130 bp, Camelpox virus
gagaatactaaaattcctaacgatgatatgttttcagctagttcttcataacgtccagaatgttcaccagctccatgacttatgaatactaatgccttaggatatgtaataggtttctaatatttacaat

SEQ ID NO: 69783 - DNA, 24 bp, Camelpox virus
agctagttcttcataacgtccaga

SEQ ID NO: 69784 - DNA, 18 bp, Homo sapiens
agctagctcttcctccag

SEQ ID NO: 69785 - DNA, 19 bp, Homo sapiens
agctagttctatatagcag

SEQ ID NO: 69786 - DNA, 19 bp, Homo sapiens
agctagttttctataaagt

SEQ ID NO: 69787 - DNA, 23 bp, Homo sapiens
agttagttccttttcattccaga

SEQ ID NO: 69788 - DNA, 16 bp, Homo sapiens
ctagttcttcctccag

SEQ ID NO: 69789 - DNA, 22 bp, Homo sapiens
gctggttcttcaggaggccaga

SEQ ID NO: 69790 - DNA, 21 bp, Homo sapiens
gctaattcttcattgtgccag

SEQ ID NO: 69791 - DNA, 20 bp, Homo sapiens
cagttcttcatgctgctcag

SEQ ID NO: 69792 - DNA, 21 bp, Homo sapiens
agtcagttcttttattccaga

SEQ ID NO: 69793 - DNA, 23 bp, Homo sapiens
agcaagttcttcattatatctag

SEQ ID NO: 69794 - DNA, 23 bp, Homo sapiens
agccagttctgagtttgttcaga

SEQ ID NO: 69795 - DNA, 25 bp, Homo sapiens
agctgtttcttcatgggcaaaacag

SEQ ID NO: 69796 - DNA, 131 bp, Human herpesvirus 2
cgggccaaaggatggggtggggtgagggtaaaagcacaaagggagtaccagaccgaaaacaaggacggatcggcccgctccgtttttcggtggggtgctgatacggtgccagccctggccccgaacccccg

SEQ ID NO: 69797 - DNA, 24 bp, Human herpesvirus 2
tgatacggtgccagccctggcccc

SEQ ID NO: 69798 - DNA, 20 bp, Homo sapiens
ggtgacccagtcctggcccc

SEQ ID NO: 69799 - DNA, 20 bp, Homo sapiens
tgaaacgtgcgtcctggccc

SEQ ID NO: 69800 - DNA, 18 bp, Homo sapiens
agcgccggtcctggcccc

SEQ ID NO: 69801 - DNA, 19 bp, Homo sapiens
ggcggggcgccctggcccc

SEQ ID NO: 69802 - DNA, 22 bp, Homo sapiens
tgacagcagcagtcctggcccc

SEQ ID NO: 69803 - DNA, 19 bp, Homo sapiens
gatggcattgccctggccc

SEQ ID NO: 69804 - DNA, 19 bp, Homo sapiens
gggcctgaggtcctggccc

SEQ ID NO: 69805 - DNA, 19 bp, Homo sapiens
ggcatccgggccctggccc

SEQ ID NO: 69806 - DNA, 20 bp, Homo sapiens
taatgcggtgccagggtccc

SEQ ID NO: 69807 - DNA, 22 bp, Homo sapiens
ggggcataagagtcctggcccc

SEQ ID NO: 69808 - DNA, 21 bp, Homo sapiens
cggtggggcagccctggttcc

SEQ ID NO: 69809 - DNA, 16 bp, Homo sapiens
cacaggctctggcccc

SEQ ID NO: 69810 - DNA, 19 bp, Homo sapiens
tgatctgcctgccctggcc

SEQ ID NO: 69811 - DNA, 19 bp, Homo sapiens
tgacaagtggccctggccc

SEQ ID NO: 69812 - DNA, 18 bp, Homo sapiens
ggcctcagctctggcccc

SEQ ID NO: 69813 - DNA, 19 bp, Homo sapiens
gtgccgcagccctggctcc

SEQ ID NO: 69814 - DNA, 22 bp, Homo sapiens
gatcagggccagccctggtccc

SEQ ID NO: 69815 - DNA, 19 bp, Homo sapiens
gattcatgagccctggccc

SEQ ID NO: 69816 - DNA, 19 bp, Homo sapiens
actttgctggccctggccc

SEQ ID NO: 69817 - DNA, 18 bp, Homo sapiens
tgactggcagccctggcc

SEQ ID NO: 69818 - DNA, 19 bp, Homo sapiens
cggctcagccggccctggc

SEQ ID NO: 69819 - DNA, 19 bp, Homo sapiens
tgatctgccagccttggcc

SEQ ID NO: 69820 - DNA, 18 bp, Homo sapiens
tgagtgtggccctggccc

SEQ ID NO: 69821 - DNA, 20 bp, Homo sapiens
tgactgtcctgagccctggc

SEQ ID NO: 69822 - DNA, 18 bp, Homo sapiens
gggaccggccctggcccc

SEQ ID NO: 69823 - DNA, 19 bp, Homo sapiens
cggttgtagccctggctcc

SEQ ID NO: 69824 - DNA, 19 bp, Homo sapiens
cgctgccagccctggttcc

SEQ ID NO: 69825 - DNA, 19 bp, Homo sapiens
tgatccaccagccttggcc

SEQ ID NO: 69826 - DNA, 19 bp, Homo sapiens
ggtgctcagctctggcccc

SEQ ID NO: 69827 - DNA, 23 bp, Homo sapiens
tggcacggtgctaggaacatggc

SEQ ID NO: 69828 - DNA, 20 bp, Homo sapiens
ggtgggttcagcctggcccc

SEQ ID NO: 69829 - DNA, 20 bp, Homo sapiens
taaaacggttggccctggcc

SEQ ID NO: 69830 - DNA, 66 bp, Chimpanzee cytomegalovirus
gtcctccacctccgccaccgcgatttatcatcatcgtcgcgggccgccgagccgttcctcagggac

SEQ ID NO: 69831 - DNA, 23 bp, Chimpanzee cytomegalovirus
ccgccgagccgttcctcagggac

SEQ ID NO: 69832 - DNA, 20 bp, Homo sapiens
ccgccgagtccgtttccctc

SEQ ID NO: 69833 - DNA, 17 bp, Homo sapiens
gcccagttcctcaggga

SEQ ID NO: 69834 - DNA, 20 bp, Homo sapiens
cccctgagtcccccagggac

SEQ ID NO: 69835 - DNA, 22 bp, Homo sapiens
ccaccgaggccaatttggggac

SEQ ID NO: 69836 - DNA, 17 bp, Homo sapiens
gacccatcctcagggac

SEQ ID NO: 69837 - DNA, 26 bp, Homo sapiens
cgccgagccccgctgcccttggggac

SEQ ID NO: 69838 - DNA, 19 bp, Homo sapiens
ccgccgagtcttccgaggg

SEQ ID NO: 69839 - DNA, 18 bp, Homo sapiens
cccccatcttcctcaggg

SEQ ID NO: 69840 - DNA, 22 bp, Homo sapiens
ccgccgagcgtgccgaggcggg

SEQ ID NO: 69841 - DNA, 16 bp, Homo sapiens
gccaagcccaccaggg

SEQ ID NO: 69842 - DNA, 18 bp, Homo sapiens
gctggccctttcagggac

SEQ ID NO: 69843 - DNA, 20 bp, Homo sapiens
gctgaactgtttctcaggga

SEQ ID NO: 69844 - DNA, 16 bp, Homo sapiens
ccccgagctccaggga

SEQ ID NO: 69845 - DNA, 18 bp, Homo sapiens
cgctgtgcctcctcaggg

SEQ ID NO: 69846 - DNA, 22 bp, Homo sapiens
cctccgagccgcggaggcaggg

SEQ ID NO: 69847 - DNA, 16 bp, Homo sapiens
cgccgggccgctccgg

SEQ ID NO: 69848 - DNA, 17 bp, Homo sapiens
ccagcctttctcaggga

SEQ ID NO: 69849 - DNA, 21 bp, Homo sapiens
ccgccgaggtgtgatggggac

SEQ ID NO: 69850 - DNA, 18 bp, Homo sapiens
gccgactcagccagggac

SEQ ID NO: 69851 - DNA, 20 bp, Homo sapiens
ccgccggctcgttcctcagg

SEQ ID NO: 69852 - DNA, 22 bp, Homo sapiens
ccagccgggccaaggcggggac

SEQ ID NO: 69853 - DNA, 19 bp, Homo sapiens
cctcctcgcttcctcaggg

SEQ ID NO: 69854 - DNA, 19 bp, Homo sapiens
cgccacgaccctcagggac

SEQ ID NO: 69855 - DNA, 19 bp, Homo sapiens
gatgggtccacccagggac

SEQ ID NO: 69856 - DNA, 16 bp, Homo sapiens
gccggcctcccaggga

SEQ ID NO: 69857 - DNA, 21 bp, Homo sapiens
ccagccggccgctcctcgggg

SEQ ID NO: 69858 - DNA, 20 bp, Homo sapiens
ccgccgagcagcggggaggg

SEQ ID NO: 69859 - DNA, 19 bp, Homo sapiens
gccgggctgctcccagaga

SEQ ID NO: 69860 - DNA, 15 bp, Homo sapiens
cgaagttctcaggga

SEQ ID NO: 69861 - DNA, 17 bp, Homo sapiens
ccgccaagccgcgggga

SEQ ID NO: 69862 - DNA, 20 bp, Homo sapiens
gcctgagggccttcagggac

SEQ ID NO: 69863 - DNA, 20 bp, Homo sapiens
gctgtacccacctcagggac

SEQ ID NO: 69864 - DNA, 18 bp, Homo sapiens
gcccagtgccctcaggga

SEQ ID NO: 69865 - DNA, 21 bp, Homo sapiens
ccgccgcgccccgccagggac

SEQ ID NO: 69866 - DNA, 19 bp, Homo sapiens
cctgggcttcaccagggac

SEQ ID NO: 69867 - DNA, 18 bp, Homo sapiens
ccgcccgggactcaggga

SEQ ID NO: 69868 - DNA, 19 bp, Homo sapiens
ccactgagcccagccaggg

SEQ ID NO: 69869 - DNA, 20 bp, Homo sapiens
gccagtggcagttcagggac

SEQ ID NO: 69870 - DNA, 20 bp, Homo sapiens
ccgcctgagccgccggggac

SEQ ID NO: 69871 - DNA, 16 bp, Homo sapiens
gcccgcccctcaggga

SEQ ID NO: 69872 - DNA, 20 bp, Homo sapiens
ccactctccttcctcaggga

SEQ ID NO: 69873 - DNA, 17 bp, Homo sapiens
gcggactcttcagggac

SEQ ID NO: 69874 - DNA, 16 bp, Homo sapiens
gctgagccattcagga

SEQ ID NO: 69875 - DNA, 18 bp, Homo sapiens
ccgccgaactcccggggg

SEQ ID NO: 69876 - DNA, 17 bp, Homo sapiens
cgaaggccctcagggac

SEQ ID NO: 69877 - DNA, 17 bp, Homo sapiens
ccagttttcctcaggga

SEQ ID NO: 69878 - DNA, 18 bp, Homo sapiens
cgtcgtgccgttccaagg

SEQ ID NO: 69879 - DNA, 16 bp, Homo sapiens
gctgagccgctcaggg

SEQ ID NO: 69880 - DNA, 21 bp, Homo sapiens
cgccgctgacctcctcaggga

SEQ ID NO: 69881 - DNA, 19 bp, Homo sapiens
gcctagccaccccagggac

SEQ ID NO: 69882 - DNA, 19 bp, Homo sapiens
cgccggccggctcagggac

SEQ ID NO: 69883 - DNA, 18 bp, Homo sapiens
gccgactgttgccaggac

SEQ ID NO: 69884 - DNA, 20 bp, Homo sapiens
cccccgagtcgccccggggg

SEQ ID NO: 69885 - DNA, 19 bp, Homo sapiens
gctaggcattctcagggac

SEQ ID NO: 69886 - DNA, 19 bp, Homo sapiens
gccgagtcacgccagggac

SEQ ID NO: 69887 - DNA, 22 bp, Homo sapiens
ccgccgagtcttctcccgggac

SEQ ID NO: 69888 - DNA, 19 bp, Homo sapiens
gccaagccgtttctcaagg

SEQ ID NO: 69889 - DNA, 20 bp, Homo sapiens
gctgacccgcatccagggac

SEQ ID NO: 69890 - DNA, 18 bp, Homo sapiens
ccgctgagccgctgaggg

SEQ ID NO: 69891 - DNA, 19 bp, Homo sapiens
cctgagccgttctcttcag

SEQ ID NO: 69892 - DNA, 21 bp, Homo sapiens
gccgggccggcgttcagggac

SEQ ID NO: 69893 - DNA, 20 bp, Homo sapiens
ccaccggctggtctcaggga

SEQ ID NO: 69894 - DNA, 19 bp, Homo sapiens
ccgcagtctctcctcaggg

SEQ ID NO: 69895 - DNA, 23 bp, Homo sapiens
ccaccgggctgtggcggaaggga

SEQ ID NO: 69896 - DNA, 19 bp, Homo sapiens
cgccgggccgttcccggac

SEQ ID NO: 69897 - DNA, 22 bp, Homo sapiens
ccgccgaggtcgctggaatggg

SEQ ID NO: 69898 - DNA, 19 bp, Homo sapiens
ccgagccgcggctggggac

SEQ ID NO: 69899 - DNA, 22 bp, Homo sapiens
ccatcgagcccaagtcagggac

SEQ ID NO: 69900 - DNA, 18 bp, Homo sapiens
gccgggtgttcctcaggg

SEQ ID NO: 69901 - DNA, 20 bp, Homo sapiens
ccggccgggggctcagggac

SEQ ID NO: 69902 - DNA, 69 bp, Chimpanzee cytomegalovirus
gccatcaccgtcgccgatcgaccaggaccgccgcgcggtcttcacgtacgttctggcccgctgctgcgc

SEQ ID NO: 69903 - DNA, 24 bp, Chimpanzee cytomegalovirus
ttcacgtacgttctggcccgctgc

SEQ ID NO: 69904 - DNA, 22 bp, Homo sapiens
ttcacatacgtttttacgttgc

SEQ ID NO: 69905 - DNA, 19 bp, Homo sapiens
ttcacgtctgtgacactgc

SEQ ID NO: 69906 - DNA, 22 bp, Homo sapiens
cgctatgttccaaacccgctgc

SEQ ID NO: 69907 - DNA, 24 bp, Homo sapiens
ttcacgtaggaacatgcctgctgc

SEQ ID NO: 69908 - DNA, 100 bp, Cercopithecine herpesvirus 7
aacggctcttgcgtataatgcatgtttccggttatttactcgatccgtcttacgtagtacatggtaaacacccatacatgtaagtataaaagggactgtt

SEQ ID NO: 69909 - DNA, 24 bp, Cercopithecine herpesvirus 7
taatgcatgtttccggttatttac

SEQ ID NO: 69910 - DNA, 15 bp, Homo sapiens
gcatgttgctattta

SEQ ID NO: 69911 - DNA, 18 bp, Homo sapiens
taatgcatgttctgtagt

SEQ ID NO: 69912 - DNA, 19 bp, Homo sapiens
atacatttttggttattta

SEQ ID NO: 69913 - DNA, 21 bp, Homo sapiens
taatgatgtggccagttattt

SEQ ID NO: 69914 - DNA, 18 bp, Homo sapiens
atgcatgtttcgtaagtt

SEQ ID NO: 69915 - DNA, 20 bp, Homo sapiens
caatgcttcctggttattta

SEQ ID NO: 69916 - DNA, 16 bp, Homo sapiens
taatacatggttattt

SEQ ID NO: 69917 - DNA, 17 bp, Homo sapiens
atgcatgtttttattat

SEQ ID NO: 69918 - DNA, 18 bp, Homo sapiens
aatgcatgtcattattta

SEQ ID NO: 69919 - DNA, 18 bp, Homo sapiens
gcatgtgggagttattta

SEQ ID NO: 69920 - DNA, 22 bp, Homo sapiens
atgctctgttttggttatttac

SEQ ID NO: 69921 - DNA, 99 bp, Porcine teschovirus
tccccctctggacttgtaactggtaagtgataatccttggaagctaggtactcgttacgcaagttttggattatcttgtgcccaacattagttctcgga

SEQ ID NO: 69922 - DNA, 24 bp, Porcine teschovirus
tggtaagtgataatccttggaagc

SEQ ID NO: 69923 - DNA, 22 bp, Homo sapiens
tggtccttgagtctttggaagc

SEQ ID NO: 69924 - DNA, 22 bp, Homo sapiens
tggtaagtgaagaaagagaggc

SEQ ID NO: 69925 - DNA, 18 bp, Homo sapiens
tggcaggtggtctggaag

SEQ ID NO: 69926 - DNA, 21 bp, Homo sapiens
tggtgatgataatctgatcgc

SEQ ID NO: 69927 - DNA, 20 bp, Homo sapiens
tgggtggtgaggatccttgg

SEQ ID NO: 69928 - DNA, 17 bp, Homo sapiens
tggtgggtgatatctgg

SEQ ID NO: 69929 - DNA, 22 bp, Homo sapiens
tggtaagtgagatggcggaagc

SEQ ID NO: 69930 - DNA, 20 bp, Homo sapiens
tggtgggtgctcttggaagc

SEQ ID NO: 69931 - DNA, 18 bp, Homo sapiens
tggtagatctccttggag

SEQ ID NO: 69932 - DNA, 22 bp, Homo sapiens
tggtggtgggctctttggaagc

SEQ ID NO: 69933 - DNA, 24 bp, Homo sapiens
tggcaaaattcagtccttggaggc

SEQ ID NO: 69934 - DNA, 22 bp, Homo sapiens
gctaataatgatctttggaagc

SEQ ID NO: 69935 - DNA, 19 bp, Homo sapiens
gtggtccatccttggaagc

SEQ ID NO: 69936 - DNA, 23 bp, Homo sapiens
tggcaagtgattagctttgggag

SEQ ID NO: 69937 - DNA, 20 bp, Homo sapiens
tggtaagtgactggcctggg

SEQ ID NO: 69938 - DNA, 20 bp, Homo sapiens
tggaggccttagtccttgga

SEQ ID NO: 69939 - DNA, 20 bp, Homo sapiens
gtaagtgatgatccacatgg

SEQ ID NO: 69940 - DNA, 130 bp, Porcine epidemic diarrhea virus
gtcacgaggggaacgcagtaccttttcatctaaacctttgcacgagtaattaaagatccgcttgacgagcctatatggaagagcgtgccaggtatttgacttaaggactgttagtaactgaagacctgac

SEQ ID NO: 69941 - DNA, 24 bp, Porcine epidemic diarrhea virus
tctaaacctttgcacgagtaatta

SEQ ID NO: 69942 - DNA, 18 bp, Homo sapiens
tctcaaacctgagtaatt

SEQ ID NO: 69943 - DNA, 19 bp, Homo sapiens
taaacctttgttactgaat

SEQ ID NO: 69944 - DNA, 21 bp, Homo sapiens
tctacattttgcacagtgatt

SEQ ID NO: 69945 - DNA, 18 bp, Homo sapiens
tccaaacctttgcatgta

SEQ ID NO: 69946 - DNA, 17 bp, Homo sapiens
aacccttacaagtaatt

SEQ ID NO: 69947 - DNA, 20 bp, Homo sapiens
tcaaaacctttttaggagta

SEQ ID NO: 69948 - DNA, 21 bp, Homo sapiens
tctaaatccttcaagtaatta

SEQ ID NO: 69949 - DNA, 112 bp, Paramecium bursaria Chlorella virus 1
gaacaatcgcctttgtgtaaatgttgcggagaatgtcattaggcaaattagcaaacataaaaccggttgacatatccgttgtttcaccatgttgacacaaagttttttgttc

SEQ ID NO: 69950 - DNA, 24 bp, Paramecium bursaria Chlorella virus 1
ttgacatatccgttgtttcaccat

SEQ ID NO: 69951 - DNA, 21 bp, Homo sapiens
ttgacatatcccttgttacac

SEQ ID NO: 69952 - DNA, 21 bp, Homo sapiens
ttcactgtctctgttgtttca

SEQ ID NO: 69953 - DNA, 24 bp, Homo sapiens
ttgacttatttgttgtttctccat

SEQ ID NO: 69954 - DNA, 19 bp, Homo sapiens
ttgacatatttgttgcttc

SEQ ID NO: 69955 - DNA, 19 bp, Homo sapiens
ttgcataaacttgtttcac

SEQ ID NO: 69956 - DNA, 19 bp, Homo sapiens
ttgcatgttcatctcacca

SEQ ID NO: 69957 - DNA, 16 bp, Homo sapiens
ttgacatatctgtctc

SEQ ID NO: 69958 - DNA, 20 bp, Homo sapiens
ttgacaaatctatcatttca

SEQ ID NO: 69959 - DNA, 17 bp, Homo sapiens
ttgcatgtcatttcacc

SEQ ID NO: 69960 - DNA, 18 bp, Homo sapiens
ttgacatatactgttgcc

SEQ ID NO: 69961 - DNA, 24 bp, Homo sapiens
ttggcattatctgttgtcactcat

SEQ ID NO: 69962 - DNA, 17 bp, Homo sapiens
ctgacatattttctcac

SEQ ID NO: 69963 - DNA, 64 bp, Camelpox virus
gtgattttggcaatagtccgtgtaatccataatccagtaacacgagctggtgcttgctagacac

SEQ ID NO: 69964 - DNA, 23 bp, Camelpox virus
acgagctggtgcttgctagacac

SEQ ID NO: 69965 - DNA, 16 bp, Homo sapiens
gagctgggctctgaca

SEQ ID NO: 69966 - DNA, 18 bp, Homo sapiens
agctggtaatgtaggcac

SEQ ID NO: 69967 - DNA, 18 bp, Homo sapiens
cgagctggtgctgaatag

SEQ ID NO: 69968 - DNA, 18 bp, Homo sapiens
cgagctggttgttaaaca

SEQ ID NO: 69969 - DNA, 20 bp, Homo sapiens
cggctggtgcaagcaggcac

SEQ ID NO: 69970 - DNA, 19 bp, Homo sapiens
cgagctgggcgagctggac

SEQ ID NO: 69971 - DNA, 25 bp, Homo sapiens
acaagctggtgggattcctagacac

SEQ ID NO: 69972 - DNA, 19 bp, Homo sapiens
cgggcgggcaggctagaca

SEQ ID NO: 69973 - DNA, 18 bp, Homo sapiens
agcccttgttgttagaca

SEQ ID NO: 69974 - DNA, 16 bp, Homo sapiens
cgagctggtcctgcag

SEQ ID NO: 69975 - DNA, 16 bp, Homo sapiens
gagctggtggtgtaga

SEQ ID NO: 69976 - DNA, 17 bp, Homo sapiens
gaagaatgtttgctaga

SEQ ID NO: 69977 - DNA, 23 bp, Homo sapiens
accagctggtgcctgtggctgga

SEQ ID NO: 69978 - DNA, 18 bp, Homo sapiens
cgagctgggtgtgtgaga

SEQ ID NO: 69979 - DNA, 18 bp, Homo sapiens
tagttcccatgctagaca

SEQ ID NO: 69980 - DNA, 21 bp, Homo sapiens
acgggtaggtgcccaagacac

SEQ ID NO: 69981 - DNA, 18 bp, Homo sapiens
gcaagggctttgctagac

SEQ ID NO: 69982 - DNA, 23 bp, Homo sapiens
actggctggtgctaccaagacac

SEQ ID NO: 69983 - DNA, 16 bp, Homo sapiens
gctggtgctcaaaaca

SEQ ID NO: 69984 - DNA, 17 bp, Homo sapiens
cgggctgtgctgcagca

SEQ ID NO: 69985 - DNA, 25 bp, Homo sapiens
acgagctgtgcacacggctgggcac

SEQ ID NO: 69986 - DNA, 20 bp, Homo sapiens
gagctggggctcccagacac

SEQ ID NO: 69987 - DNA, 21 bp, Homo sapiens
caggctggtgcttgtctctag

SEQ ID NO: 69988 - DNA, 16 bp, Homo sapiens
gagcggtgcccaggca

SEQ ID NO: 69989 - DNA, 15 bp, Homo sapiens
gagctggactagaca

SEQ ID NO: 69990 - DNA, 16 bp, Homo sapiens
acggctggtgctgcag

SEQ ID NO: 69991 - DNA, 18 bp, Homo sapiens
caagttggtgcttgttag

SEQ ID NO: 69992 - DNA, 21 bp, Homo sapiens
cgggctgggaactctagacac

SEQ ID NO: 69993 - DNA, 23 bp, Homo sapiens
cgtgctggtgcgagcggagacac

SEQ ID NO: 69994 - DNA, 18 bp, Homo sapiens
cgagctggtcattagaca

SEQ ID NO: 69995 - DNA, 15 bp, Homo sapiens
agctggtgacagaca

SEQ ID NO: 69996 - DNA, 17 bp, Homo sapiens
gagctggttcttggaac

SEQ ID NO: 69997 - DNA, 18 bp, Homo sapiens
cgaactggccagcctaga

SEQ ID NO: 69998 - DNA, 17 bp, Homo sapiens
cgagctggtgcggcgac

SEQ ID NO: 69999 - DNA, 16 bp, Homo sapiens
gaactggtgctccaga

SEQ ID NO: 70000 - DNA, 19 bp, Homo sapiens
cgggcaggtgggcagacac

SEQ ID NO: 70001 - DNA, 21 bp, Homo sapiens
gagctggttgttccacagcac

SEQ ID NO: 70002 - DNA, 77 bp, Camelpox virus
atatgtgttattttaggatcatatttacatatttacggtatatcaaagatgttagatatagttaataggacacatat

SEQ ID NO: 70003 - DNA, 24 bp, Camelpox virus
taggatcatatttacatatttacg

SEQ ID NO: 70004 - DNA, 22 bp, Homo sapiens
taggatgtgtttatatttacac

SEQ ID NO: 70005 - DNA, 61 bp, Fowlpox virus
tctttaagaaccaagtgtgaggtagatagagcggttaaatatttcatatcggttataaaga

SEQ ID NO: 70006 - DNA, 24 bp, Fowlpox virus
aaatatttcatatcggttataaag

SEQ ID NO: 70007 - DNA, 18 bp, Homo sapiens
atatttcatttggttata

SEQ ID NO: 70008 - DNA, 21 bp, Homo sapiens
atatttcattttattataaag

SEQ ID NO: 70009 - DNA, 23 bp, Homo sapiens
aatatttcattatcaatataaag

SEQ ID NO: 70010 - DNA, 21 bp, Homo sapiens
aaatatttcatgttttggcta

SEQ ID NO: 70011 - DNA, 65 bp, Human papillomavirus type 47
tggtagtcttgatagcctttaacaagcattaacgctgctttgctactaactgctattaacaacca

SEQ ID NO: 70012 - DNA, 22 bp, Human papillomavirus type 47
tactaactgctattaacaacca

SEQ ID NO: 70013 - DNA, 17 bp, Homo sapiens
taccagctgctaccacc

SEQ ID NO: 70014 - DNA, 21 bp, Homo sapiens
tactaactgcatcactaacca

SEQ ID NO: 70015 - DNA, 19 bp, Homo sapiens
tactactgctgctgctaac

SEQ ID NO: 70016 - DNA, 21 bp, Homo sapiens
tactaactgttaaaacaatca

SEQ ID NO: 70017 - DNA, 21 bp, Homo sapiens
ccagcacgctattaataacca

SEQ ID NO: 70018 - DNA, 17 bp, Homo sapiens
tactactgccactggcc

SEQ ID NO: 70019 - DNA, 20 bp, Homo sapiens
tactacttgctatgcagcca

SEQ ID NO: 70020 - DNA, 21 bp, Homo sapiens
taccaactgctgaaacaacca

SEQ ID NO: 70021 - DNA, 19 bp, Homo sapiens
taccaatactattaataac

SEQ ID NO: 70022 - DNA, 20 bp, Homo sapiens
tactaactgcttctctacca

SEQ ID NO: 70023 - DNA, 20 bp, Homo sapiens
actaatttgcataacaacca

SEQ ID NO: 70024 - DNA, 17 bp, Homo sapiens
ctaactgcaaacaacca

SEQ ID NO: 70025 - DNA, 19 bp, Homo sapiens
ctggctgccactccaacca

SEQ ID NO: 70026 - DNA, 20 bp, Homo sapiens
taacagcttattaacaacca

SEQ ID NO: 70027 - DNA, 17 bp, Homo sapiens
aactactatagcaacca

SEQ ID NO: 70028 - DNA, 19 bp, Homo sapiens
cactaattgcttcaaacca

SEQ ID NO: 70029 - DNA, 20 bp, Homo sapiens
tactaactgctctccaacca

SEQ ID NO: 70030 - DNA, 19 bp, Homo sapiens
tactgctgctactggaacc

SEQ ID NO: 70031 - DNA, 17 bp, Homo sapiens
cactaactgttaaaaca

SEQ ID NO: 70032 - DNA, 20 bp, Homo sapiens
tactgctgctactggaacca

SEQ ID NO: 70033 - DNA, 80 bp, Human papillomavirus type 47
ttcctgggtagctggagatagcattgagcgtctaggcaggtccagaatgctcattagcttttcctgcctcactcagagaa

SEQ ID NO: 70034 - DNA, 24 bp, Human papillomavirus type 47
tagcattgagcgtctaggcaggtc

SEQ ID NO: 70035 - DNA, 18 bp, Homo sapiens
gcattgagtgaaacaggt

SEQ ID NO: 70036 - DNA, 21 bp, Homo sapiens
gcattgagcagggcccaggtc

SEQ ID NO: 70037 - DNA, 19 bp, Homo sapiens
gcctagagtttaggcaggt

SEQ ID NO: 70038 - DNA, 22 bp, Homo sapiens
gcattgagcaggcctggcgggt

SEQ ID NO: 70039 - DNA, 21 bp, Homo sapiens
tagcattggagggggcaggtc

SEQ ID NO: 70040 - DNA, 16 bp, Homo sapiens
cagcattgagggcggg

SEQ ID NO: 70041 - DNA, 19 bp, Homo sapiens
cattggtcaggggcaggtc

SEQ ID NO: 70042 - DNA, 22 bp, Homo sapiens
tagcatgacatccaggtgggtc

SEQ ID NO: 70043 - DNA, 17 bp, Homo sapiens
gcattgagtgtctgcaa

SEQ ID NO: 70044 - DNA, 17 bp, Homo sapiens
gcattgagtgtctgcag

SEQ ID NO: 70045 - DNA, 18 bp, Homo sapiens
tagcattgacggtcaggt

SEQ ID NO: 70046 - DNA, 21 bp, Homo sapiens
attaaacagtctgggtgggtc

SEQ ID NO: 70047 - DNA, 80 bp, Human herpesvirus 7
aatggaatctaataatttacataccgtttttgaagtgagctttctaattatttcgtgattatagaaattatcattctgtt

SEQ ID NO: 70048 - DNA, 24 bp, Human herpesvirus 7
taatttacataccgtttttgaagt

SEQ ID NO: 70049 - DNA, 16 bp, Homo sapiens
ttacatatctttgaag

SEQ ID NO: 70050 - DNA, 20 bp, Homo sapiens
tttacattattttttgaagt

SEQ ID NO: 70051 - DNA, 62 bp, Human herpesvirus 7
gtagaagttgtatttttagaagtcgaatctgagtcaagatctatagaaaatataaactttat

SEQ ID NO: 70052 - DNA, 24 bp, Human herpesvirus 7
agttgtatttttagaagtcgaatc

SEQ ID NO: 70053 - DNA, 19 bp, Homo sapiens
agttgtatttttataactc

SEQ ID NO: 70054 - DNA, 20 bp, Homo sapiens
gttgtatttttggcaaagtc

SEQ ID NO: 70055 - DNA, 22 bp, Homo sapiens
agttgtatatttagaaccccaa

SEQ ID NO: 70056 - DNA, 22 bp, Homo sapiens
agttgatttttcatatcgaatc

SEQ ID NO: 70057 - DNA, 18 bp, Homo sapiens
agttgcatttttaggcca

SEQ ID NO: 70058 - DNA, 21 bp, Homo sapiens
agctgttcaggaagaagtcga

SEQ ID NO: 70059 - DNA, 18 bp, Homo sapiens
ttgtatttttagaagaga

SEQ ID NO: 70060 - DNA, 18 bp, Homo sapiens
gctggttttggaagtcga

SEQ ID NO: 70061 - DNA, 83 bp, Gallid herpesvirus 2
aggagagcgagcagagaggggccggtgcgggagtttggaactccgcggtcattcatctcccgccacgccccatgcacgtgccc

SEQ ID NO: 70062 - DNA, 21 bp, Gallid herpesvirus 2
ccacgccccatgcacgtgccc

SEQ ID NO: 70063 - DNA, 19 bp, Homo sapiens
cacgccccatggcctgtgc

SEQ ID NO: 70064 - DNA, 20 bp, Homo sapiens
ccacgcccaatcacaactgc

SEQ ID NO: 70065 - DNA, 19 bp, Homo sapiens
cacgccacgcgccgtgccc

SEQ ID NO: 70066 - DNA, 16 bp, Homo sapiens
cacccccatgcaaacc

SEQ ID NO: 70067 - DNA, 19 bp, Homo sapiens
ccactctcccccagtgtcc

SEQ ID NO: 70068 - DNA, 18 bp, Homo sapiens
ccagccccatatgagccc

SEQ ID NO: 70069 - DNA, 20 bp, Homo sapiens
ccgcgccccacgctgcggcc

SEQ ID NO: 70070 - DNA, 19 bp, Homo sapiens
ccacgcctatgacagtgcc

SEQ ID NO: 70071 - DNA, 16 bp, Homo sapiens
ggacgccatgcacgtg

SEQ ID NO: 70072 - DNA, 18 bp, Homo sapiens
ccaggccccatgccggcc

SEQ ID NO: 70073 - DNA, 19 bp, Homo sapiens
caaacacatgcgcgtgtcc

SEQ ID NO: 70074 - DNA, 20 bp, Homo sapiens
ccaggccccatgctggagcc

SEQ ID NO: 70075 - DNA, 19 bp, Homo sapiens
cacgccccactggcctgtg

SEQ ID NO: 70076 - DNA, 18 bp, Homo sapiens
ccgcgccccacgctgccc

SEQ ID NO: 70077 - DNA, 18 bp, Homo sapiens
cacgtgccaacaggtgcc

SEQ ID NO: 70078 - DNA, 18 bp, Homo sapiens
ccactcaaccacgtgccc

SEQ ID NO: 70079 - DNA, 20 bp, Homo sapiens
ccaggctgagacacgtgccc

SEQ ID NO: 70080 - DNA, 18 bp, Homo sapiens
ccaggccccatgaggtcc

SEQ ID NO: 70081 - DNA, 19 bp, Homo sapiens
cctgccccatgccaggccc

SEQ ID NO: 70082 - DNA, 17 bp, Homo sapiens
cacgccctactttgccc

SEQ ID NO: 70083 - DNA, 18 bp, Homo sapiens
ccgcgccccactccgccc

SEQ ID NO: 70084 - DNA, 18 bp, Homo sapiens
ccatcccccatgcagacc

SEQ ID NO: 70085 - DNA, 19 bp, Homo sapiens
ccacggcccacacgtgccc

SEQ ID NO: 70086 - DNA, 15 bp, Homo sapiens
ccacacccatgtgcc

SEQ ID NO: 70087 - DNA, 17 bp, Homo sapiens
cacgcgccatggtaccc

SEQ ID NO: 70088 - DNA, 16 bp, Homo sapiens
cacgcctgccgtgccc

SEQ ID NO: 70089 - DNA, 16 bp, Homo sapiens
ccaggccccatgctgc

SEQ ID NO: 70090 - DNA, 22 bp, Homo sapiens
ccagccccatgggccgcgtgcc

SEQ ID NO: 70091 - DNA, 21 bp, Homo sapiens
caccccactccccacgtgtcc

SEQ ID NO: 70092 - DNA, 17 bp, Homo sapiens
cccgccccatgggatgc

SEQ ID NO: 70093 - DNA, 17 bp, Homo sapiens
ccgcaccccacgtgccc

SEQ ID NO: 70094 - DNA, 19 bp, Homo sapiens
cgcgccctggaacgtgccc

SEQ ID NO: 70095 - DNA, 16 bp, Homo sapiens
ccatgccacacacgtg

SEQ ID NO: 70096 - DNA, 20 bp, Homo sapiens
cccgccctgtgtgcacaccc

SEQ ID NO: 70097 - DNA, 18 bp, Homo sapiens
ccacgcccttgcagggcc

SEQ ID NO: 70098 - DNA, 16 bp, Homo sapiens
cctgccccacagtgcc

SEQ ID NO: 70099 - DNA, 19 bp, Homo sapiens
cgcttcccatgacacgccc

SEQ ID NO: 70100 - DNA, 18 bp, Homo sapiens
ccactcctgccagctgcc

SEQ ID NO: 70101 - DNA, 17 bp, Homo sapiens
cccgccccatagagtcc

SEQ ID NO: 70102 - DNA, 18 bp, Homo sapiens
cgcgtccagcacatgccc

SEQ ID NO: 70103 - DNA, 17 bp, Homo sapiens
cacgccccggcacaccc

SEQ ID NO: 70104 - DNA, 19 bp, Homo sapiens
ccacaccctgtgtcagccc

SEQ ID NO: 70105 - DNA, 18 bp, Homo sapiens
ccacgcccacatgtgatg

SEQ ID NO: 70106 - DNA, 15 bp, Homo sapiens
acgccccatggcgcc

SEQ ID NO: 70107 - DNA, 19 bp, Homo sapiens
ccgcgccccacggccaccc

SEQ ID NO: 70108 - DNA, 20 bp, Homo sapiens
cgtctccacgcactgtgtcc

SEQ ID NO: 70109 - DNA, 19 bp, Homo sapiens
ccacaccccacacctgccc

SEQ ID NO: 70110 - DNA, 20 bp, Homo sapiens
ccacgccccctggccagccc

SEQ ID NO: 70111 - DNA, 20 bp, Homo sapiens
ccacactccgtacgccgtcc

SEQ ID NO: 70112 - DNA, 17 bp, Homo sapiens
cacaccccaccttgccc

SEQ ID NO: 70113 - DNA, 19 bp, Homo sapiens
gccccacacattcgtgccc

SEQ ID NO: 70114 - DNA, 23 bp, Homo sapiens
ccacatcctggccgggcgtgtcc

SEQ ID NO: 70115 - DNA, 22 bp, Homo sapiens
ccagccccatggcaatggtgcc

SEQ ID NO: 70116 - DNA, 20 bp, Homo sapiens
ccacgcgcccgcaactgccc

SEQ ID NO: 70117 - DNA, 21 bp, Homo sapiens
ccagggggcatgcacgtgccc

SEQ ID NO: 70118 - DNA, 19 bp, Homo sapiens
cacgtgtgcacatgtgccc

SEQ ID NO: 70119 - DNA, 19 bp, Homo sapiens
ccacgccccatggcaggcc

SEQ ID NO: 70120 - DNA, 18 bp, Homo sapiens
ccacaccccacggtgtcc

SEQ ID NO: 70121 - DNA, 16 bp, Homo sapiens
ccacgcccatggtgcc

SEQ ID NO: 70122 - DNA, 17 bp, Homo sapiens
ccacgctcccgctgtcc

SEQ ID NO: 70123 - DNA, 18 bp, Homo sapiens
ccacgcgcgccacgtgcc

SEQ ID NO: 70124 - DNA, 19 bp, Homo sapiens
ccatcagtcccacgtgccc

SEQ ID NO: 70125 - DNA, 16 bp, Homo sapiens
ccacgcccccacgtgc

SEQ ID NO: 70126 - DNA, 16 bp, Homo sapiens
cccgccccatgcagcc

SEQ ID NO: 70127 - DNA, 18 bp, Homo sapiens
ccacaccccagcctgccc

SEQ ID NO: 70128 - DNA, 19 bp, Homo sapiens
cacccccacagacgtgccc

SEQ ID NO: 70129 - DNA, 20 bp, Homo sapiens
cgtctcccatgcaggtgccc

SEQ ID NO: 70130 - DNA, 19 bp, Homo sapiens
ccaccccccatcacaggcc

SEQ ID NO: 70131 - DNA, 16 bp, Homo sapiens
ccacaccctgcaggtg

SEQ ID NO: 70132 - DNA, 15 bp, Homo sapiens
cacgccccgcatgcc

SEQ ID NO: 70133 - DNA, 20 bp, Homo sapiens
cctgccccacgaatgtgtcc

SEQ ID NO: 70134 - DNA, 16 bp, Homo sapiens
cagccccatgcggtcc

SEQ ID NO: 70135 - DNA, 20 bp, Homo sapiens
ccggctcagctgacgtgccc

SEQ ID NO: 70136 - DNA, 15 bp, Homo sapiens
cccgccccaccgtgc

SEQ ID NO: 70137 - DNA, 17 bp, Homo sapiens
cacgccccaccatgccc

SEQ ID NO: 70138 - DNA, 16 bp, Homo sapiens
ccagccccatggtacc

SEQ ID NO: 70139 - DNA, 21 bp, Homo sapiens
cacgctcatccacacgtgccc

SEQ ID NO: 70140 - DNA, 18 bp, Homo sapiens
ccacaccccatcaggccc

SEQ ID NO: 70141 - DNA, 16 bp, Homo sapiens
ccacatcctgcacgtg

SEQ ID NO: 70142 - DNA, 21 bp, Homo sapiens
ccacgccctcaggctgtgccc

SEQ ID NO: 70143 - DNA, 18 bp, Homo sapiens
ccacgccccgctgcagcc

SEQ ID NO: 70144 - DNA, 19 bp, Homo sapiens
ccacgccccggccctgccc

SEQ ID NO: 70145 - DNA, 19 bp, Homo sapiens
ccaggccccatgaacaccc

SEQ ID NO: 70146 - DNA, 18 bp, Homo sapiens
cccgccccacccgtgccc

SEQ ID NO: 70147 - DNA, 19 bp, Homo sapiens
ccacaccctggggctgccc

SEQ ID NO: 70148 - DNA, 17 bp, Homo sapiens
cccgccccactgctgcc

SEQ ID NO: 70149 - DNA, 18 bp, Homo sapiens
cccgccccatctttgccc

SEQ ID NO: 70150 - DNA, 18 bp, Homo sapiens
ccagccccatgtgtaccc

SEQ ID NO: 70151 - DNA, 19 bp, Homo sapiens
tgaccggaatgcacgtgcc

SEQ ID NO: 70152 - DNA, 20 bp, Homo sapiens
ccacgccctctggcaggtcc

SEQ ID NO: 70153 - DNA, 20 bp, Homo sapiens
cgtgtcccgcgcacgcgccc

SEQ ID NO: 70154 - DNA, 19 bp, Homo sapiens
acgccccagtgggtatgcc

SEQ ID NO: 70155 - DNA, 21 bp, Homo sapiens
ccagccccatggctgcagccc

SEQ ID NO: 70156 - DNA, 17 bp, Homo sapiens
ccacgcccacccgctgc

SEQ ID NO: 70157 - DNA, 19 bp, Homo sapiens
ccacaccccatgctggtcc

SEQ ID NO: 70158 - DNA, 18 bp, Homo sapiens
ccatgcctttgcacatgc

SEQ ID NO: 70159 - DNA, 19 bp, Homo sapiens
ccacgcccctgctgcggcc

SEQ ID NO: 70160 - DNA, 18 bp, Homo sapiens
cacgccctgcaggctgcc

SEQ ID NO: 70161 - DNA, 20 bp, Homo sapiens
caccctccatgcacctgccc

SEQ ID NO: 70162 - DNA, 18 bp, Homo sapiens
ccaggccccatggcatcc

SEQ ID NO: 70163 - DNA, 19 bp, Homo sapiens
ccacgcccctgagcagccc

SEQ ID NO: 70164 - DNA, 21 bp, Homo sapiens
ccacacagccagcatgtgtcc

SEQ ID NO: 70165 - DNA, 17 bp, Homo sapiens
ccactgctccatggtcc

SEQ ID NO: 70166 - DNA, 18 bp, Homo sapiens
ccacgccccaggtgcgcc

SEQ ID NO: 70167 - DNA, 18 bp, Homo sapiens
ccacaccccaccctgccc

SEQ ID NO: 70168 - DNA, 18 bp, Homo sapiens
cacgccccggcacttgcc

SEQ ID NO: 70169 - DNA, 16 bp, Homo sapiens
ccagccccacgatgcc

SEQ ID NO: 70170 - DNA, 19 bp, Homo sapiens
ccacgccctacggatgccc

SEQ ID NO: 70171 - DNA, 18 bp, Homo sapiens
ccagcctcacaggtgccc

SEQ ID NO: 70172 - DNA, 24 bp, Homo sapiens
ccattccccatgcaggggatgccc

SEQ ID NO: 70173 - DNA, 19 bp, Homo sapiens
cagctccacacgcgtgccc

SEQ ID NO: 70174 - DNA, 24 bp, Homo sapiens
ccacgccctgagtctggcgtgccc

SEQ ID NO: 70175 - DNA, 18 bp, Homo sapiens
gccacagttgcacgtgcc

SEQ ID NO: 70176 - DNA, 17 bp, Homo sapiens
cacgtgccatgccgtcc

SEQ ID NO: 70177 - DNA, 18 bp, Homo sapiens
ccacgcccccacctgtcc

SEQ ID NO: 70178 - DNA, 20 bp, Homo sapiens
ccagcgccccggacgtgccc

SEQ ID NO: 70179 - DNA, 16 bp, Homo sapiens
ccacgccctggatgcc

SEQ ID NO: 70180 - DNA, 20 bp, Homo sapiens
ccggccgccaccacgtgccc

SEQ ID NO: 70181 - DNA, 17 bp, Homo sapiens
cacccctgcaagtgccc

SEQ ID NO: 70182 - DNA, 16 bp, Homo sapiens
ccacaccccatagtcc

SEQ ID NO: 70183 - DNA, 18 bp, Homo sapiens
cgccccacgcccgtgtcc

SEQ ID NO: 70184 - DNA, 18 bp, Homo sapiens
ccacaccccaaggtgtcc

SEQ ID NO: 70185 - DNA, 20 bp, Homo sapiens
ccagtccccacgccgtgccc

SEQ ID NO: 70186 - DNA, 21 bp, Homo sapiens
ccacgccctggggcggtggcc

SEQ ID NO: 70187 - DNA, 20 bp, Homo sapiens
cgcatgttcctaacgtgccc

SEQ ID NO: 70188 - DNA, 19 bp, Homo sapiens
ccctgccctgaacatgccc

SEQ ID NO: 70189 - DNA, 62 bp, African swine fever virus
accattaaaaatatttttatctgttagatttaatttaataaatggctcatggaatgtgtggt

SEQ ID NO: 70190 - DNA, 24 bp, African swine fever virus
ttaataaatggctcatggaatgtg

SEQ ID NO: 70191 - DNA, 21 bp, Homo sapiens
ttaataaatggctgaaaagtg

SEQ ID NO: 70192 - DNA, 21 bp, Homo sapiens
aataagtggcaatggggtgtg

SEQ ID NO: 70193 - DNA, 23 bp, Homo sapiens
ttaataactggcccgctggtgtg

SEQ ID NO: 70194 - DNA, 18 bp, Homo sapiens
ttagtaaatggctgatgg

SEQ ID NO: 70195 - DNA, 24 bp, Homo sapiens
ataaatggcttcagatggagtgtg

SEQ ID NO: 70196 - DNA, 22 bp, Homo sapiens
ttaataaatgggcttctctgtg

SEQ ID NO: 70197 - DNA, 110 bp, Paramecium bursaria Chlorella virus 1
cagtgagatatggtctaattggagactatacgctccagttccgccgaacttataatcttggaaatttttagctggctgcatatatctactgaataatcatattattattg

SEQ ID NO: 70198 - DNA, 24 bp, Paramecium bursaria Chlorella virus 1
tagctggctgcatatatctactga

SEQ ID NO: 70199 - DNA, 22 bp, Homo sapiens
taactggtttcctatctactga

SEQ ID NO: 70200 - DNA, 24 bp, Homo sapiens
tggctgcatatgctttcctattga

SEQ ID NO: 70201 - DNA, 19 bp, Homo sapiens
gctagaatatatctactga

SEQ ID NO: 70202 - DNA, 18 bp, Homo sapiens
tagctgctgcagctgctg

SEQ ID NO: 70203 - DNA, 18 bp, Homo sapiens
agtgacatatatctactg

SEQ ID NO: 70204 - DNA, 19 bp, Homo sapiens
tagtgcactatgtctactg

SEQ ID NO: 70205 - DNA, 20 bp, Homo sapiens
gctggctgtgttgcctactg

SEQ ID NO: 70206 - DNA, 16 bp, Homo sapiens
gctggctgatttactg

SEQ ID NO: 70207 - DNA, 20 bp, Homo sapiens
actggctgcaaaacttgctg

SEQ ID NO: 70208 - DNA, 19 bp, Homo sapiens
actggctgctaggctgctg

SEQ ID NO: 70209 - DNA, 21 bp, Homo sapiens
tagctgctgcatgtggtgctg

SEQ ID NO: 70210 - DNA, 23 bp, Homo sapiens
tggctgcattcaaaatttactga

SEQ ID NO: 70211 - DNA, 22 bp, Homo sapiens
gctgggcttccattgtctactg

SEQ ID NO: 70212 - DNA, 24 bp, Homo sapiens
gctggctgtacatggggcagctga

SEQ ID NO: 70213 - DNA, 130 bp, Tupaia herpesvirus
gtgtgtgtgtgtgcgtccgttcgttcgttcgtcggggtgagggaggaagaaaaacgcgggttcgtcacacaaggtccccggggtttttttaccgctttattgaaaaaccgaaatgtcgtacacacatgtc

SEQ ID NO: 70214 - DNA, 24 bp, Tupaia herpesvirus
tccccggggtttttttaccgcttt

SEQ ID NO: 70215 - DNA, 23 bp, Homo sapiens
ggggctttttaatattttgcttt

SEQ ID NO: 70216 - DNA, 18 bp, Homo sapiens
tcctggggtccactgctt

SEQ ID NO: 70217 - DNA, 18 bp, Homo sapiens
gggtttttttgaagcttt

SEQ ID NO: 70218 - DNA, 17 bp, Homo sapiens
tccctggggtattgctt

SEQ ID NO: 70219 - DNA, 21 bp, Homo sapiens
ggggtttttctaatatacttt

SEQ ID NO: 70220 - DNA, 18 bp, Homo sapiens
tccccagggtttgtgctt

SEQ ID NO: 70221 - DNA, 22 bp, Homo sapiens
ccttggtcttttttgttgcttt

SEQ ID NO: 70222 - DNA, 19 bp, Homo sapiens
ccagggtttttaaagcttt

SEQ ID NO: 70223 - DNA, 18 bp, Homo sapiens
gggttttcttctcgcttt

SEQ ID NO: 70224 - DNA, 17 bp, Homo sapiens
tcctggggttttttgct

SEQ ID NO: 70225 - DNA, 24 bp, Homo sapiens
tcacccatttttttttattgcttt

SEQ ID NO: 70226 - DNA, 77 bp, Tupaia herpesvirus
gccttcacgagcacgggcgagcgagcatatggtgtctatacgagcgtgtgtgggcgtgtcggtgtgtccgtgtgggt

SEQ ID NO: 70227 - DNA, 24 bp, Tupaia herpesvirus
cacgagcacgggcgagcgagcata

SEQ ID NO: 70228 - DNA, 17 bp, Homo sapiens
cacgagctgggcaggcg

SEQ ID NO: 70229 - DNA, 28 bp, Homo sapiens
cacgagacgggtgggatgagtgggcata

SEQ ID NO: 70230 - DNA, 21 bp, Homo sapiens
cgcgccggcgagcgagcgagc

SEQ ID NO: 70231 - DNA, 21 bp, Homo sapiens
cacagcacgctttgcgggcat

SEQ ID NO: 70232 - DNA, 16 bp, Homo sapiens
cacgacacgggcagcg

SEQ ID NO: 70233 - DNA, 18 bp, Homo sapiens
cacgggagaagcgagcat

SEQ ID NO: 70234 - DNA, 17 bp, Homo sapiens
cacgggcagggtgagca

SEQ ID NO: 70235 - DNA, 21 bp, Homo sapiens
gagcacgggatcagtgggcat

SEQ ID NO: 70236 - DNA, 17 bp, Homo sapiens
gcaggtggagcgagcat

SEQ ID NO: 70237 - DNA, 21 bp, Homo sapiens
cacgaggaggtagtgggcata

SEQ ID NO: 70238 - DNA, 70 bp, Tupaia herpesvirus
ccgacgggctgaacgtccgggcctctcggtgacatcggtgaagaaacgggcgggcgggcgggctgaccgg

SEQ ID NO: 70239 - DNA, 24 bp, Tupaia herpesvirus
tgaagaaacgggcgggcgggcggg

SEQ ID NO: 70240 - DNA, 18 bp, Homo sapiens
tgaggcaggcgggggcgg

SEQ ID NO: 70241 - DNA, 17 bp, Homo sapiens
cgggcgggcgggcgggc

SEQ ID NO: 70242 - DNA, 18 bp, Homo sapiens
gagcgggcgggcgggcgg

SEQ ID NO: 70243 - DNA, 20 bp, Homo sapiens
gaggccagcgggcgggcggg

SEQ ID NO: 70244 - DNA, 24 bp, Homo sapiens
gaggaggcaggcattgggggtggg

SEQ ID NO: 70245 - DNA, 24 bp, Homo sapiens
tgagggcgcgggcggcggtgcggg

SEQ ID NO: 70246 - DNA, 19 bp, Homo sapiens
tgaggagggccgcgggcgg

SEQ ID NO: 70247 - DNA, 18 bp, Homo sapiens
tgaaggggcgggcggccg

SEQ ID NO: 70248 - DNA, 18 bp, Homo sapiens
gaaggggcgggcgggcgg

SEQ ID NO: 70249 - DNA, 22 bp, Homo sapiens
gaaggagcgggcggcggccggg

SEQ ID NO: 70250 - DNA, 23 bp, Homo sapiens
tgaggagcgggcggcgcgctggg

SEQ ID NO: 70251 - DNA, 19 bp, Homo sapiens
gaggaaacgggaaggcggg

SEQ ID NO: 70252 - DNA, 18 bp, Homo sapiens
agagggggcgggcggcgg

SEQ ID NO: 70253 - DNA, 19 bp, Homo sapiens
gagcgggcgggcgggcggg

SEQ ID NO: 70254 - DNA, 19 bp, Homo sapiens
gaggaggcgtgcgggtggg

SEQ ID NO: 70255 - DNA, 20 bp, Homo sapiens
gagacgagcgtgtgggtggg

SEQ ID NO: 70256 - DNA, 18 bp, Homo sapiens
agaaagcaggcgggcggg

SEQ ID NO: 70257 - DNA, 18 bp, Homo sapiens
gaaaggcgggcgggccag

SEQ ID NO: 70258 - DNA, 17 bp, Homo sapiens
gaggaggcagagggcgg

SEQ ID NO: 70259 - DNA, 18 bp, Homo sapiens
gagcaggcaggcgggcgg

SEQ ID NO: 70260 - DNA, 19 bp, Homo sapiens
agaggaagcgggcgggagg

SEQ ID NO: 70261 - DNA, 20 bp, Homo sapiens
tgaggaaacgggggtctggg

SEQ ID NO: 70262 - DNA, 19 bp, Homo sapiens
tgaggaagcaggcgggcaa

SEQ ID NO: 70263 - DNA, 23 bp, Homo sapiens
tgaggaaacgggcagggaccgag

SEQ ID NO: 70264 - DNA, 19 bp, Homo sapiens
tgaggaaacaggcggcggg

SEQ ID NO: 70265 - DNA, 18 bp, Homo sapiens
cggtgctgggcgggcggg

SEQ ID NO: 70266 - DNA, 18 bp, Homo sapiens
gaagagcgggcgaaccgg

SEQ ID NO: 70267 - DNA, 17 bp, Homo sapiens
agaggagacgggcgggg

SEQ ID NO: 70268 - DNA, 18 bp, Homo sapiens
gaagaacgggcctgcggg

SEQ ID NO: 70269 - DNA, 24 bp, Homo sapiens
tgaaggggtcggacgccgggcggg

SEQ ID NO: 70270 - DNA, 21 bp, Homo sapiens
agaagggggcaggcgggtggg

SEQ ID NO: 70271 - DNA, 23 bp, Homo sapiens
gaggagacagaaaggcgggcggg

SEQ ID NO: 70272 - DNA, 22 bp, Homo sapiens
gaagcggaggcaggcgggtggg

SEQ ID NO: 70273 - DNA, 21 bp, Homo sapiens
tgcggaaacgaggtgggtggg

SEQ ID NO: 70274 - DNA, 26 bp, Homo sapiens
tgaggaaattagagcgggcgggcggg

SEQ ID NO: 70275 - DNA, 21 bp, Homo sapiens
gaagaggcggggcgaggcggg

SEQ ID NO: 70276 - DNA, 22 bp, Homo sapiens
gaggagggacacggcgggcggg

SEQ ID NO: 70277 - DNA, 69 bp, Fowl adenovirus A
tacctgtaccgataaggcacaccctgagcaaacaaaccataaaggtatacttccttattcagacaggta

SEQ ID NO: 70278 - DNA, 22 bp, Fowl adenovirus A
tacttccttattcagacaggta

SEQ ID NO: 70279 - DNA, 20 bp, Homo sapiens
acttcctctatcaggtgggt

SEQ ID NO: 70280 - DNA, 21 bp, Homo sapiens
cacttccttatttctttagta

SEQ ID NO: 70281 - DNA, 18 bp, Homo sapiens
tacctccttgtccagggt

SEQ ID NO: 70282 - DNA, 21 bp, Homo sapiens
cacttccttgaagcttgggta

SEQ ID NO: 70283 - DNA, 19 bp, Homo sapiens
cttccttatttttcatgta

SEQ ID NO: 70284 - DNA, 19 bp, Homo sapiens
ttccttattccagaccagg

SEQ ID NO: 70285 - DNA, 19 bp, Homo sapiens
ttccttatttctgaaggta

SEQ ID NO: 70286 - DNA, 18 bp, Homo sapiens
ttccctccaagacaggta

SEQ ID NO: 70287 - DNA, 16 bp, Homo sapiens
tacttccttattaaca

SEQ ID NO: 70288 - DNA, 20 bp, Homo sapiens
ctttcttagttagacaagta

SEQ ID NO: 70289 - DNA, 21 bp, Homo sapiens
tacttcctctagttcacaggt

SEQ ID NO: 70290 - DNA, 19 bp, Homo sapiens
cttaacagttcagacaggt

SEQ ID NO: 70291 - DNA, 18 bp, Homo sapiens
cttccctaaaggacaggt

SEQ ID NO: 70292 - DNA, 21 bp, Homo sapiens
tacttccctaagtattaggta

SEQ ID NO: 70293 - DNA, 20 bp, Homo sapiens
ttccttgttccagacaggta

SEQ ID NO: 70294 - DNA, 22 bp, Homo sapiens
tacttcctcacccagggcaggt

SEQ ID NO: 70295 - DNA, 16 bp, Homo sapiens
cacttcccaggcaggt

SEQ ID NO: 70296 - DNA, 16 bp, Homo sapiens
ttccattagacaggta

SEQ ID NO: 70297 - DNA, 17 bp, Homo sapiens
tactttctcattcacag

SEQ ID NO: 70298 - DNA, 16 bp, Homo sapiens
cactcttcagacaggt

SEQ ID NO: 70299 - DNA, 19 bp, Homo sapiens
cttctcctaacaggcaggt

SEQ ID NO: 70300 - DNA, 19 bp, Homo sapiens
tacttcctttatcgagggt

SEQ ID NO: 70301 - DNA, 18 bp, Homo sapiens
ttccctatattacaggta

SEQ ID NO: 70302 - DNA, 20 bp, Homo sapiens
cacttccttgggcaatgggt

SEQ ID NO: 70303 - DNA, 20 bp, Homo sapiens
ttccttgctccagacaggta

SEQ ID NO: 70304 - DNA, 21 bp, Homo sapiens
acttttttattcaaaggggta

SEQ ID NO: 70305 - DNA, 17 bp, Homo sapiens
tacttcctgttcaaaca

SEQ ID NO: 70306 - DNA, 18 bp, Homo sapiens
cttccttatctagaaggt

SEQ ID NO: 70307 - DNA, 18 bp, Homo sapiens
tacttccttattctacaa

SEQ ID NO: 70308 - DNA, 20 bp, Homo sapiens
tacttcctgattctcatgta

SEQ ID NO: 70309 - DNA, 18 bp, Homo sapiens
ctttctatgcagacaggt

SEQ ID NO: 70310 - DNA, 20 bp, Homo sapiens
cacttccttgtgggacgggt

SEQ ID NO: 70311 - DNA, 18 bp, Homo sapiens
ttccttattagcaaaggt

SEQ ID NO: 70312 - DNA, 19 bp, Homo sapiens
ttccttgctccagacaggt

SEQ ID NO: 70313 - DNA, 17 bp, Homo sapiens
ttccctagtgacaggta

SEQ ID NO: 70314 - DNA, 16 bp, Homo sapiens
ttcccgcagacaggta

SEQ ID NO: 70315 - DNA, 19 bp, Homo sapiens
tacttgctctggacaggta

SEQ ID NO: 70316 - DNA, 17 bp, Homo sapiens
cacttcctgagacaggt

SEQ ID NO: 70317 - DNA, 17 bp, Homo sapiens
tacttctttattcaagg

SEQ ID NO: 70318 - DNA, 20 bp, Homo sapiens
tacatactttttagacaggt

SEQ ID NO: 70319 - DNA, 22 bp, Homo sapiens
tacttcatttattcaacaagta

SEQ ID NO: 70320 - DNA, 15 bp, Homo sapiens
cttccccagacaggt

SEQ ID NO: 70321 - DNA, 19 bp, Homo sapiens
ttccttattcgaaggaggt

SEQ ID NO: 70322 - DNA, 71 bp, Gallid herpesvirus 2
gagtaggcggtacgcccacccgtataagaatcgtaatttcttgtggcctcgagtggcggtgcgacttgctc

SEQ ID NO: 70323 - DNA, 24 bp, Gallid herpesvirus 2
cttgtggcctcgagtggcggtgcg

SEQ ID NO: 70324 - DNA, 22 bp, Homo sapiens
cttgaggtctgtctgcggtgcg

SEQ ID NO: 70325 - DNA, 25 bp, Homo sapiens
cttgtggcctgtggggcagcatgcg

SEQ ID NO: 70326 - DNA, 17 bp, Homo sapiens
ctcgtggccttgggtgc

SEQ ID NO: 70327 - DNA, 18 bp, Homo sapiens
cttgtggcctctggaatg

SEQ ID NO: 70328 - DNA, 18 bp, Homo sapiens
cttgtggcctctagaatg

SEQ ID NO: 70329 - DNA, 77 bp, Gallid herpesvirus 2
gatcggtggtgtaaccgtgtaggtatttttagtttttatgtaccatttcggttgctttattatatttcccacccatc

SEQ ID NO: 70330 - DNA, 24 bp, Gallid herpesvirus 2
tcggtggtgtaaccgtgtaggtat

SEQ ID NO: 70331 - DNA, 18 bp, Homo sapiens
gtggtgtaactgcaatgt

SEQ ID NO: 70332 - DNA, 19 bp, Homo sapiens
tcgcgtggtgtaggcgggt

SEQ ID NO: 70333 - DNA, 20 bp, Homo sapiens
ggtggtgtgatcgtacaggt

SEQ ID NO: 70334 - DNA, 19 bp, Homo sapiens
tcagtggtgttggtgggta

SEQ ID NO: 70335 - DNA, 109 bp, Bovine respiratory syncytial virus
tgatgttattgtactaagtcatcaaaatgttcttgactacttacagtttcaatatccatgtaatatgtattctcaaaatcatatgcttgatgatatctattggacatca

SEQ ID NO: 70336 - DNA, 24 bp, Bovine respiratory syncytial virus
taagtcatcaaaatgttcttgact

SEQ ID NO: 70337 - DNA, 20 bp, Homo sapiens
aatcatcaaaatcaatgact

SEQ ID NO: 70338 - DNA, 23 bp, Homo sapiens
taagttgtccggaagtcctgact

SEQ ID NO: 70339 - DNA, 18 bp, Homo sapiens
agtcatcaaattacttga

SEQ ID NO: 70340 - DNA, 21 bp, Homo sapiens
taaattttcatgttcttgact

SEQ ID NO: 70341 - DNA, 23 bp, Homo sapiens
taagttgctcagagatcttgact

SEQ ID NO: 70342 - DNA, 21 bp, Homo sapiens
agtcctcaagcatccttggct

SEQ ID NO: 70343 - DNA, 20 bp, Homo sapiens
tcatcaaagtgacagcgact

SEQ ID NO: 70344 - DNA, 61 bp, Bovine respiratory syncytial virus
tatgttttagtgctatagtatataagtcactcaactattaatcaacagccacttcttcata

SEQ ID NO: 70345 - DNA, 24 bp, Bovine respiratory syncytial virus
tattaatcaacagccacttcttca

SEQ ID NO: 70346 - DNA, 19 bp, Homo sapiens
tattaatcaattgctcctc

SEQ ID NO: 70347 - DNA, 18 bp, Homo sapiens
aatctgcagccacttctt

SEQ ID NO: 70348 - DNA, 21 bp, Homo sapiens
cattaatcaatagctgcactt

SEQ ID NO: 70349 - DNA, 22 bp, Homo sapiens
tatcaatcagaaactttcttca

SEQ ID NO: 70350 - DNA, 21 bp, Homo sapiens
cattaatcagtagctgcactt

SEQ ID NO: 70351 - DNA, 19 bp, Homo sapiens
cattaatcaaagtcttctt

SEQ ID NO: 70352 - DNA, 20 bp, Homo sapiens
tattaatcaacagtgtccca

SEQ ID NO: 70353 - DNA, 130 bp, Molluscum contagiosum virus
cacgcgtgtggttgcttgcatgttctctttgttcctgcggaacgcgcatggttgtgcttgttctctttaacgcgtgcggtgacttgccgtgttctaaggagcgagaagacattgccttttgcacagtgtg

SEQ ID NO: 70354 - DNA, 24 bp, Molluscum contagiosum virus
gcgcatggttgtgcttgttctctt

SEQ ID NO: 70355 - DNA, 23 bp, Homo sapiens
gcgcagaagctgcttgttttctt

SEQ ID NO: 70356 - DNA, 17 bp, Homo sapiens
gcgttggttgtgttgtc

SEQ ID NO: 70357 - DNA, 22 bp, Homo sapiens
gcttggaacattttgttctctt

SEQ ID NO: 70358 - DNA, 17 bp, Homo sapiens
gttcaagtttgcttgtt

SEQ ID NO: 70359 - DNA, 20 bp, Homo sapiens
gcttatggttgtgttggcct

SEQ ID NO: 70360 - DNA, 20 bp, Homo sapiens
gcctgtggttgtagctttct

SEQ ID NO: 70361 - DNA, 16 bp, Homo sapiens
atggttattgttttct

SEQ ID NO: 70362 - DNA, 18 bp, Homo sapiens
gctgtggttgtgcatgtt

SEQ ID NO: 70363 - DNA, 20 bp, Homo sapiens
ggcagtatgcttgttctctt

SEQ ID NO: 70364 - DNA, 18 bp, Homo sapiens
gcgtgtggctgtgtttgt

SEQ ID NO: 70365 - DNA, 19 bp, Homo sapiens
gctgggatgcttgttttct

SEQ ID NO: 70366 - DNA, 74 bp, Ectromelia virus
ttagtgttggtattattagtattcttcttgtcatcttgttcagaaatatacagcaatgctatacctaatactaa

SEQ ID NO: 70367 - DNA, 24 bp, Ectromelia virus
tacagcaatgctatacctaatact

SEQ ID NO: 70368 - DNA, 19 bp, Homo sapiens
cagcaatgtctgcaatact

SEQ ID NO: 70369 - DNA, 18 bp, Homo sapiens
agtgatgctacacatact

SEQ ID NO: 70370 - DNA, 19 bp, Homo sapiens
tacagcaatgtcatacacc

SEQ ID NO: 70371 - DNA, 20 bp, Homo sapiens
cagcaatgacgtttaatact

SEQ ID NO: 70372 - DNA, 22 bp, Homo sapiens
taagcataccatatttaatact

SEQ ID NO: 70373 - DNA, 24 bp, Homo sapiens
tacagcaaagttatacaacacact

SEQ ID NO: 70374 - DNA, 18 bp, Homo sapiens
tacagcaatgtttatcct

SEQ ID NO: 70375 - DNA, 20 bp, Homo sapiens
agcaatgctgaactgatact

SEQ ID NO: 70376 - DNA, 83 bp, Ectromelia virus
ttttttacccataaataataaatacaataattaatttctcgtaaaagtagaaaatatattctaatttattgtatggtaaggaa

SEQ ID NO: 70377 - DNA, 24 bp, Ectromelia virus
tacaataattaatttctcgtaaaa

SEQ ID NO: 70378 - DNA, 23 bp, Homo sapiens
tacaataataattgccagtaaaa

SEQ ID NO: 70379 - DNA, 21 bp, Homo sapiens
tacaaggtttattttctcgta

SEQ ID NO: 70380 - DNA, 19 bp, Homo sapiens
aatagttaatttccgtaaa

SEQ ID NO: 70381 - DNA, 20 bp, Homo sapiens
tacaataaattaatttccat

SEQ ID NO: 70382 - DNA, 131 bp, Potato virus Y
ctgtactacttttatcataattaataatcgtttgaatattactggcagataggggtggtatagcgattccgtcgttgttagtgaccttagctgtcggttctgtattattaagtcttagataaaaagtgccg

SEQ ID NO: 70383 - DNA, 24 bp, Potato virus Y
ttactggcagataggggtggtata

SEQ ID NO: 70384 - DNA, 18 bp, Homo sapiens
tggcagataggattagta

SEQ ID NO: 70385 - DNA, 16 bp, Homo sapiens
ttactgcagattggta

SEQ ID NO: 70386 - DNA, 18 bp, Homo sapiens
ttactggggataggaatg

SEQ ID NO: 70387 - DNA, 18 bp, Homo sapiens
ctggtggaaggggtgagt

SEQ ID NO: 70388 - DNA, 17 bp, Homo sapiens
tactggcagatactgta

SEQ ID NO: 70389 - DNA, 19 bp, Homo sapiens
ttactgcagataggatgtg

SEQ ID NO: 70390 - DNA, 20 bp, Homo sapiens
ttattggcagataagttatg

SEQ ID NO: 70391 - DNA, 18 bp, Homo sapiens
tactggagggggtggtat

SEQ ID NO: 70392 - DNA, 17 bp, Homo sapiens
actggcaggcgggtggt

SEQ ID NO: 70393 - DNA, 69 bp, Potato virus Y
gtgactgatctatcgattaggtgatgctgtgattctgtcatagcagtgactatgtctggatttagttac

SEQ ID NO: 70394 - DNA, 17 bp, Potato virus Y
tgtctggatttagttac

SEQ ID NO: 70395 - DNA, 18 bp, Homo sapiens
tgtctagatttaagttac

SEQ ID NO: 70396 - DNA, 18 bp, Homo sapiens
tgcctggagctctgagtt

SEQ ID NO: 70397 - DNA, 18 bp, Homo sapiens
tgtctggaccaggagtta

SEQ ID NO: 70398 - DNA, 18 bp, Homo sapiens
tgcctggataagagttac

SEQ ID NO: 70399 - DNA, 18 bp, Homo sapiens
gtctgaacactttagtta

SEQ ID NO: 70400 - DNA, 18 bp, Homo sapiens
tatctggataggcagtta

SEQ ID NO: 70401 - DNA, 18 bp, Homo sapiens
tgtttggataatagttac

SEQ ID NO: 70402 - DNA, 67 bp, Infectious spleen and kidney necrosis virus
ccagtgacgctgccaccgggatctacaacaacttactacaatctgtgtgtctggacagcaacattgg

SEQ ID NO: 70403 - DNA, 24 bp, Infectious spleen and kidney necrosis virus
acgctgccaccgggatctacaaca

SEQ ID NO: 70404 - DNA, 22 bp, Homo sapiens
acgctgccagccggggagaaca

SEQ ID NO: 70405 - DNA, 20 bp, Homo sapiens
acgccgccgccgggcccaac

SEQ ID NO: 70406 - DNA, 17 bp, Homo sapiens
tgactgtggtctacaac

SEQ ID NO: 70407 - DNA, 19 bp, Homo sapiens
gcttcatttagctacaaca

SEQ ID NO: 70408 - DNA, 18 bp, Homo sapiens
cgctgccatcgcgggtcc

SEQ ID NO: 70409 - DNA, 17 bp, Homo sapiens
gctccttccatctacaa

SEQ ID NO: 70410 - DNA, 22 bp, Homo sapiens
cgctggcaccgggagcccggac

SEQ ID NO: 70411 - DNA, 21 bp, Homo sapiens
acgccgccgccggtccctgac

SEQ ID NO: 70412 - DNA, 26 bp, Homo sapiens
acgctgccaccgcttcgcctgcaaca

SEQ ID NO: 70413 - DNA, 20 bp, Homo sapiens
actctgccacccaggctgca

SEQ ID NO: 70414 - DNA, 19 bp, Homo sapiens
gctgacacgtgctacaaca

SEQ ID NO: 70415 - DNA, 18 bp, Homo sapiens
tgccaccaaagtttacaa

SEQ ID NO: 70416 - DNA, 20 bp, Homo sapiens
acgctgttgctgagacctac

SEQ ID NO: 70417 - DNA, 20 bp, Homo sapiens
gctgccacgtgcccagcaac

SEQ ID NO: 70418 - DNA, 20 bp, Homo sapiens
cgcggccaccgggacccaca

SEQ ID NO: 70419 - DNA, 19 bp, Homo sapiens
gctaccactgggatttcta

SEQ ID NO: 70420 - DNA, 103 bp, Infectious spleen and kidney necrosis virus
gtttccctgattcgtgtatgtctacagtattttccgtgcggtggagatattcaaattttttataatacatggaaagatcgcttgtgacgacgacaatggagat

SEQ ID NO: 70421 - DNA, 24 bp, Infectious spleen and kidney necrosis virus
tctacagtattttccgtgcggtgg

SEQ ID NO: 70422 - DNA, 19 bp, Homo sapiens
tctacagcatttgatggtg

SEQ ID NO: 70423 - DNA, 18 bp, Homo sapiens
tccatagtatttttggtg

SEQ ID NO: 70424 - DNA, 23 bp, Homo sapiens
cagtattttttgttattttgtgg

SEQ ID NO: 70425 - DNA, 21 bp, Homo sapiens
cacagtattttctaatactgg

SEQ ID NO: 70426 - DNA, 18 bp, Homo sapiens
tctacatattttccttgg

SEQ ID NO: 70427 - DNA, 24 bp, Homo sapiens
tctacagtattgtctaataattgg

SEQ ID NO: 70428 - DNA, 67 bp, Chimpanzee cytomegalovirus
gactcaagcatatatacacggctcggggagcaaggtgtgactgtggtcgtgtgtggtgtctctggtc

SEQ ID NO: 70429 - DNA, 24 bp, Chimpanzee cytomegalovirus
aagcatatatacacggctcgggga

SEQ ID NO: 70430 - DNA, 31 bp, Homo sapiens
aagaatatatacatggagcgtgtttggggat

SEQ ID NO: 70431 - DNA, 21 bp, Homo sapiens
agcatacatatcccttgggga

SEQ ID NO: 70432 - DNA, 15 bp, Homo sapiens
atatatacagagggg

SEQ ID NO: 70433 - DNA, 19 bp, Homo sapiens
gcatatatgtaccaaggga

SEQ ID NO: 70434 - DNA, 21 bp, Homo sapiens
gcactgggggcggctcgggga

SEQ ID NO: 70435 - DNA, 17 bp, Homo sapiens
aagcatatatgcctggg

SEQ ID NO: 70436 - DNA, 23 bp, Homo sapiens
aagcatatatgctgtgggtcagg

SEQ ID NO: 70437 - DNA, 18 bp, Homo sapiens
aagctatatacataaggg

SEQ ID NO: 70438 - DNA, 20 bp, Homo sapiens
atatgtatcactccttgggg

SEQ ID NO: 70439 - DNA, 19 bp, Homo sapiens
gcatatatccatggctggg

SEQ ID NO: 70440 - DNA, 20 bp, Homo sapiens
aagcatatgtacattgcagg

SEQ ID NO: 70441 - DNA, 91 bp, Chimpanzee cytomegalovirus
acagaagaagttctatatctaggcacactctaaaaaaaaaaaagcacacgcttgctggcatgtccctcgtaataaagaacaaaactactgt

SEQ ID NO: 70442 - DNA, 24 bp, Chimpanzee cytomegalovirus
tctaaaaaaaaaaaagcacacgct

SEQ ID NO: 70443 - DNA, 19 bp, Homo sapiens
tctaagaaaaaaaaaagca

SEQ ID NO: 70444 - DNA, 20 bp, Homo sapiens
tcttaaaaaaaaaaagcaca

SEQ ID NO: 70445 - DNA, 22 bp, Homo sapiens
tccaaaaaaaaaaaaaaatgct

SEQ ID NO: 70446 - DNA, 21 bp, Homo sapiens
aaaaaaaaaaaagtgtacact

SEQ ID NO: 70447 - DNA, 18 bp, Homo sapiens
aaaaaaaaaaaagctgct

SEQ ID NO: 70448 - DNA, 23 bp, Homo sapiens
tctaaaaaaaaaaaaaaaaagct

SEQ ID NO: 70449 - DNA, 21 bp, Homo sapiens
tctaaaacaaaaaaagcaaca

SEQ ID NO: 70450 - DNA, 26 bp, Homo sapiens
cctaaaaaaaggaaaaaaaacacgct

SEQ ID NO: 70451 - DNA, 18 bp, Homo sapiens
taaaaaaaaaaaggccac

SEQ ID NO: 70452 - DNA, 23 bp, Homo sapiens
taaaaaaacaaaagcaacatgct

SEQ ID NO: 70453 - DNA, 22 bp, Homo sapiens
tcaaaaaaaaaaaaagcgagct

SEQ ID NO: 70454 - DNA, 20 bp, Homo sapiens
tctaaaaagaataaaagcac

SEQ ID NO: 70455 - DNA, 19 bp, Homo sapiens
tctaaaaaaaaaaatagca

SEQ ID NO: 70456 - DNA, 23 bp, Homo sapiens
taaaaaaaaaaaagcatatgcta

SEQ ID NO: 70457 - DNA, 20 bp, Homo sapiens
aaaaaaaaaaaagccagact

SEQ ID NO: 70458 - DNA, 19 bp, Homo sapiens
taaaaaaaaaaaaacaaac

SEQ ID NO: 70459 - DNA, 21 bp, Homo sapiens
tctcaaaaaaaaaaaagtaca

SEQ ID NO: 70460 - DNA, 19 bp, Homo sapiens
aaaaaaaaaaaagccaact

SEQ ID NO: 70461 - DNA, 20 bp, Homo sapiens
tctcaaaaaaaaaaagtcca

SEQ ID NO: 70462 - DNA, 18 bp, Homo sapiens
tctaaaaaaaaaaaagac

SEQ ID NO: 70463 - DNA, 29 bp, Homo sapiens
tctaaaaaaaaaaaaagtggagcgtgtgc

SEQ ID NO: 70464 - DNA, 21 bp, Homo sapiens
tctaaaaaaagagaagcaaca

SEQ ID NO: 70465 - DNA, 24 bp, Homo sapiens
tcaaaaaaaaaaaaagcacctgct

SEQ ID NO: 70466 - DNA, 23 bp, Homo sapiens
tctaaaggcaaaaaagcaacact

SEQ ID NO: 70467 - DNA, 20 bp, Homo sapiens
aaaaaaaaacaaaaaacgct

SEQ ID NO: 70468 - DNA, 18 bp, Homo sapiens
tctaaaaaaaaaaaatca

SEQ ID NO: 70469 - DNA, 19 bp, Homo sapiens
taaaaaaaaaaaaacagct

SEQ ID NO: 70470 - DNA, 17 bp, Homo sapiens
tctaaaaaaaaaaagca

SEQ ID NO: 70471 - DNA, 24 bp, Homo sapiens
tcaaaaaaaaaaaaagtgcaaact

SEQ ID NO: 70472 - DNA, 18 bp, Homo sapiens
tccaaaaaaaaaaaagac

SEQ ID NO: 70473 - DNA, 24 bp, Homo sapiens
tctaaaaaaaaaaaaaagcaggct

SEQ ID NO: 70474 - DNA, 23 bp, Homo sapiens
tctaaaaagaggaaagcaaggct

SEQ ID NO: 70475 - DNA, 22 bp, Homo sapiens
tccaaaaaaaaaaaaaaaagct

SEQ ID NO: 70476 - DNA, 18 bp, Homo sapiens
tctaaaaaaaaaaaagca

SEQ ID NO: 70477 - DNA, 19 bp, Homo sapiens
aaaaaaaaaaaagcccaca

SEQ ID NO: 70478 - DNA, 21 bp, Homo sapiens
tctcaaaaaaaaaaagcaaca

SEQ ID NO: 70479 - DNA, 21 bp, Homo sapiens
tccaaaaagaaaggagcccac

SEQ ID NO: 70480 - DNA, 24 bp, Homo sapiens
tctaaaaaacaggagcactttgct

SEQ ID NO: 70481 - DNA, 21 bp, Homo sapiens
tccaggagtcaagcacacgct

SEQ ID NO: 70482 - DNA, 22 bp, Homo sapiens
tcttaaaaaaaaaaagtcagcc

SEQ ID NO: 70483 - DNA, 18 bp, Homo sapiens
tctaagaaaaaaaaaaca

SEQ ID NO: 70484 - DNA, 22 bp, Homo sapiens
tccaaaaaaaaaaaaaagagct

SEQ ID NO: 70485 - DNA, 19 bp, Homo sapiens
ctaaaaaagaaaaagccac

SEQ ID NO: 70486 - DNA, 20 bp, Homo sapiens
tccaaaaaaaaaaaaaaagc

SEQ ID NO: 70487 - DNA, 18 bp, Homo sapiens
tctaaaaaaaaaaaacac

SEQ ID NO: 70488 - DNA, 19 bp, Homo sapiens
tctaaaaaaaaaatggcca

SEQ ID NO: 70489 - DNA, 116 bp, Human herpesvirus 1
tggggatgcgtgagtggccctctgtgggcggtgggggagagtcttataggaagtgcatataaccacaacccatgggtctaaccaatccccaggggccaagaaacagacacgcccca

SEQ ID NO: 70490 - DNA, 24 bp, Human herpesvirus 1
tctaaccaatccccaggggccaag

SEQ ID NO: 70491 - DNA, 18 bp, Homo sapiens
tctgacccatcctcaggg

SEQ ID NO: 70492 - DNA, 24 bp, Homo sapiens
taaccaatcattccattagtcaag

SEQ ID NO: 70493 - DNA, 23 bp, Homo sapiens
tctggccaaactcctgggccaag

SEQ ID NO: 70494 - DNA, 23 bp, Homo sapiens
tctgctccacgccgggggccaag

SEQ ID NO: 70495 - DNA, 23 bp, Homo sapiens
tctaaccaagtttcctaaatagg

SEQ ID NO: 70496 - DNA, 19 bp, Homo sapiens
tctaaccagctcccatggg

SEQ ID NO: 70497 - DNA, 22 bp, Homo sapiens
tcctgtgtctctccaggggcca

SEQ ID NO: 70498 - DNA, 20 bp, Homo sapiens
tcagccaatccctcagtgag

SEQ ID NO: 70499 - DNA, 19 bp, Homo sapiens
tcaaaccgatccccaggag

SEQ ID NO: 70500 - DNA, 20 bp, Homo sapiens
taaccaatccttgacacaag

SEQ ID NO: 70501 - DNA, 20 bp, Homo sapiens
tctaaccatctccctctgcc

SEQ ID NO: 70502 - DNA, 21 bp, Homo sapiens
tctaaccatttcctactgaag

SEQ ID NO: 70503 - DNA, 20 bp, Homo sapiens
tctaaccagccccagcccca

SEQ ID NO: 70504 - DNA, 15 bp, Homo sapiens
ctaaccaacaggggc

SEQ ID NO: 70505 - DNA, 17 bp, Homo sapiens
tccggccaatccccggc

SEQ ID NO: 70506 - DNA, 20 bp, Homo sapiens
tctgtcaatccccacttgag

SEQ ID NO: 70507 - DNA, 19 bp, Homo sapiens
tccaaccagtcctcaaaag

SEQ ID NO: 70508 - DNA, 24 bp, Homo sapiens
tctaaccagttccctattaatggg

SEQ ID NO: 70509 - DNA, 19 bp, Homo sapiens
tctaaccagtcccaatgag

SEQ ID NO: 70510 - DNA, 19 bp, Homo sapiens
tctaaccaatgttccagag

SEQ ID NO: 70511 - DNA, 27 bp, Homo sapiens
tctaaccaagttctcatgtcagccaag

SEQ ID NO: 70512 - DNA, 23 bp, Homo sapiens
aaccagaggcccctccaggggcc

SEQ ID NO: 70513 - DNA, 23 bp, Homo sapiens
cctagccaattcaataagccaag

SEQ ID NO: 70514 - DNA, 23 bp, Homo sapiens
cctagccaatccctaaatccaag

SEQ ID NO: 70515 - DNA, 23 bp, Homo sapiens
tctcaccagtttgggaggccaag

SEQ ID NO: 70516 - DNA, 22 bp, Homo sapiens
tctcactggtcataaggccaag

SEQ ID NO: 70517 - DNA, 18 bp, Homo sapiens
ctaaccaatcatggccaa

SEQ ID NO: 70518 - DNA, 19 bp, Homo sapiens
cctaaccaatcttcagaag

SEQ ID NO: 70519 - DNA, 19 bp, Homo sapiens
tctaaccaatcccagtgag

SEQ ID NO: 70520 - DNA, 70 bp, Human herpesvirus 6B
tacattaaggcagtgttgattttttttcattgtacccacttacgaataacgaatcaaaagccatgaagta

SEQ ID NO: 70521 - DNA, 24 bp, Human herpesvirus 6B
aggcagtgttgattttttttcatt

SEQ ID NO: 70522 - DNA, 22 bp, Homo sapiens
aggcaggtttttctttttcatt

SEQ ID NO: 70523 - DNA, 21 bp, Homo sapiens
aggttgtgttttcttttcatt

SEQ ID NO: 70524 - DNA, 18 bp, Homo sapiens
tgttgattttttttcatt

SEQ ID NO: 70525 - DNA, 18 bp, Homo sapiens
aggcagtattatattttt

SEQ ID NO: 70526 - DNA, 23 bp, Homo sapiens
aggcggtgtaggcagccttcatt

SEQ ID NO: 70527 - DNA, 22 bp, Homo sapiens
aggcattgaagtttttttcatt

SEQ ID NO: 70528 - DNA, 20 bp, Homo sapiens
aggcactgtagccttttttt

SEQ ID NO: 70529 - DNA, 23 bp, Homo sapiens
aagcagtgttggtttttaacatt

SEQ ID NO: 70530 - DNA, 19 bp, Homo sapiens
gcaaagattttttttcatt

SEQ ID NO: 70531 - DNA, 19 bp, Homo sapiens
gtgtgtgttttttttcatt

SEQ ID NO: 70532 - DNA, 16 bp, Homo sapiens
agcagtgtttttttca

SEQ ID NO: 70533 - DNA, 18 bp, Homo sapiens
aggcactgaatttttttt

SEQ ID NO: 70534 - DNA, 23 bp, Homo sapiens
aggcaagtgtcatctttttcatt

SEQ ID NO: 70535 - DNA, 23 bp, Homo sapiens
aggcagtgatggtgaagttcatt

SEQ ID NO: 70536 - DNA, 81 bp, Human herpesvirus 6B
ttatcagcgtcttataatgtgatgtctttttttttattttcttgtcggtattttaaaagtagtctgttaagatgtttttaa

SEQ ID NO: 70537 - DNA, 24 bp, Human herpesvirus 6B
ttttaaaagtagtctgttaagatg

SEQ ID NO: 70538 - DNA, 25 bp, Homo sapiens
ttttaaaagtagttagcatttaatg

SEQ ID NO: 70539 - DNA, 19 bp, Homo sapiens
ttttggaagtagtctgtta

SEQ ID NO: 70540 - DNA, 15 bp, Homo sapiens
aaaatagcctgagat

SEQ ID NO: 70541 - DNA, 24 bp, Homo sapiens
ttttaaaaatagacctctaagatg

SEQ ID NO: 70542 - DNA, 19 bp, Homo sapiens
ttaaaagtggtcacagatg

SEQ ID NO: 70543 - DNA, 72 bp, Molluscum contagiosum virus
cgcccgcgcccgactcgcagctcacgagatggctgctctcggcagcgtcgcggagcgcgcacggcagcggcg

SEQ ID NO: 70544 - DNA, 23 bp, Molluscum contagiosum virus
gcggagcgcgcacggcagcggcg

SEQ ID NO: 70545 - DNA, 23 bp, Homo sapiens
gcgcagcggggctggcggcggcg

SEQ ID NO: 70546 - DNA, 16 bp, Homo sapiens
cgggctcgggcagcgg

SEQ ID NO: 70547 - DNA, 21 bp, Homo sapiens
gcggggcccgtctcagcggcg

SEQ ID NO: 70548 - DNA, 23 bp, Homo sapiens
gcggagcgtgcgccggacgggcg

SEQ ID NO: 70549 - DNA, 21 bp, Homo sapiens
gcggtggcagcggcggcggcg

SEQ ID NO: 70550 - DNA, 19 bp, Homo sapiens
cgggtcaacggcggcggcg

SEQ ID NO: 70551 - DNA, 20 bp, Homo sapiens
gcggggcgcgggcagcggcg

SEQ ID NO: 70552 - DNA, 18 bp, Homo sapiens
gcggcgctcggcagcggc

SEQ ID NO: 70553 - DNA, 19 bp, Homo sapiens
gcggagcgcggagccctgg

SEQ ID NO: 70554 - DNA, 24 bp, Homo sapiens
gcggcagcggcagcggcagcggcg

SEQ ID NO: 70555 - DNA, 26 bp, Homo sapiens
gcggagcggagggcgcggtggcggcg

SEQ ID NO: 70556 - DNA, 20 bp, Homo sapiens
gcgggcgcgcacagccggcg

SEQ ID NO: 70557 - DNA, 19 bp, Homo sapiens
ggagccacagtggcagcgg

SEQ ID NO: 70558 - DNA, 18 bp, Homo sapiens
ggagcgcgaccgcggcgg

SEQ ID NO: 70559 - DNA, 19 bp, Homo sapiens
gcggagcgggggcgcgcgg

SEQ ID NO: 70560 - DNA, 20 bp, Homo sapiens
gggcggcagcggcggcggcg

SEQ ID NO: 70561 - DNA, 23 bp, Homo sapiens
gcgggccggcggcggcagcggcg

SEQ ID NO: 70562 - DNA, 19 bp, Homo sapiens
cggggcagaggcagcggcg

SEQ ID NO: 70563 - DNA, 17 bp, Homo sapiens
gcggcgcgcgggcggcg

SEQ ID NO: 70564 - DNA, 22 bp, Homo sapiens
ggggcggcgggcggcagcggcg

SEQ ID NO: 70565 - DNA, 16 bp, Homo sapiens
gcggagcgcagcgcgg

SEQ ID NO: 70566 - DNA, 23 bp, Homo sapiens
gcgaggcgcgtgggcgcgcggcg

SEQ ID NO: 70567 - DNA, 22 bp, Homo sapiens
gctgaccgcggtggcagcggcg

SEQ ID NO: 70568 - DNA, 21 bp, Homo sapiens
gcggcggcggcggcagcggcg

SEQ ID NO: 70569 - DNA, 21 bp, Homo sapiens
gcggccgaggcggtggcggcg

SEQ ID NO: 70570 - DNA, 17 bp, Homo sapiens
gcagaggcggcagcggc

SEQ ID NO: 70571 - DNA, 21 bp, Homo sapiens
gcggcggcggcagcagcggcg

SEQ ID NO: 70572 - DNA, 18 bp, Homo sapiens
gcgggagcaggcagcggc

SEQ ID NO: 70573 - DNA, 21 bp, Homo sapiens
gcggcgcgcgggcgagcggcg

SEQ ID NO: 70574 - DNA, 20 bp, Homo sapiens
gcggggtgcggtggcagcgg

SEQ ID NO: 70575 - DNA, 20 bp, Homo sapiens
gcggaggcgctgcggcggcg

SEQ ID NO: 70576 - DNA, 27 bp, Homo sapiens
gcggcagcggcagaggcggcggcggcg

SEQ ID NO: 70577 - DNA, 21 bp, Homo sapiens
cggggcgcgcaggcagcggcg

SEQ ID NO: 70578 - DNA, 20 bp, Homo sapiens
gcggagcgcggggggcggcg

SEQ ID NO: 70579 - DNA, 18 bp, Homo sapiens
gcgggccaggcagcggcg

SEQ ID NO: 70580 - DNA, 23 bp, Homo sapiens
gcggagcgggctcgcgcgcggcg

SEQ ID NO: 70581 - DNA, 21 bp, Homo sapiens
cgggcagcaacggcggcggcg

SEQ ID NO: 70582 - DNA, 27 bp, Homo sapiens
gcggagcgcggcgcggaggaggcggcg

SEQ ID NO: 70583 - DNA, 17 bp, Homo sapiens
gggcggtggcagcggcg

SEQ ID NO: 70584 - DNA, 21 bp, Homo sapiens
gcggcagcagcggcggcggcg

SEQ ID NO: 70585 - DNA, 22 bp, Homo sapiens
acggggccgggtggcagtggcg

SEQ ID NO: 70586 - DNA, 24 bp, Homo sapiens
gcgggcagcggagcggcggcggcg

SEQ ID NO: 70587 - DNA, 22 bp, Homo sapiens
ggggcgcgcacgccgctcggcg

SEQ ID NO: 70588 - DNA, 17 bp, Homo sapiens
gcggaggtggcagcggc

SEQ ID NO: 70589 - DNA, 20 bp, Homo sapiens
gggatgcggcggcagcggcg

SEQ ID NO: 70590 - DNA, 19 bp, Homo sapiens
acggagcgcgcgcgaagcg

SEQ ID NO: 70591 - DNA, 21 bp, Homo sapiens
gcggcagctttggcagcggcg

SEQ ID NO: 70592 - DNA, 20 bp, Homo sapiens
gcaaacgcgcggcggcggcg

SEQ ID NO: 70593 - DNA, 21 bp, Homo sapiens
gcagcagctgcggcggcggcg

SEQ ID NO: 70594 - DNA, 23 bp, Homo sapiens
gcggggcgcgacaacaagcggcg

SEQ ID NO: 70595 - DNA, 18 bp, Homo sapiens
ggagcgcggcgccgggcg

SEQ ID NO: 70596 - DNA, 21 bp, Homo sapiens
gcggcaacagcggcggcggcg

SEQ ID NO: 70597 - DNA, 23 bp, Homo sapiens
gcggcggcgacacggcagcggcg

SEQ ID NO: 70598 - DNA, 19 bp, Homo sapiens
cggagacatggcagcggcg

SEQ ID NO: 70599 - DNA, 17 bp, Homo sapiens
gcgggggcgcacgggca

SEQ ID NO: 70600 - DNA, 21 bp, Homo sapiens
ggaggagcagcggcggcggcg

SEQ ID NO: 70601 - DNA, 26 bp, Homo sapiens
gcggggcgctccgggcggcggcggcg

SEQ ID NO: 70602 - DNA, 21 bp, Homo sapiens
gcggggcggcgcggagaggcg

SEQ ID NO: 70603 - DNA, 17 bp, Homo sapiens
gcggagcgcggggcggc

SEQ ID NO: 70604 - DNA, 21 bp, Homo sapiens
gcggcagcagaggcggcggcg

SEQ ID NO: 70605 - DNA, 17 bp, Homo sapiens
gcgagcgcgcggtcggc

SEQ ID NO: 70606 - DNA, 15 bp, Homo sapiens
gcggagcgcggcgcg

SEQ ID NO: 70607 - DNA, 22 bp, Homo sapiens
gcggggtctgccggcggcggcg

SEQ ID NO: 70608 - DNA, 22 bp, Homo sapiens
gcggacggtggcggcagcggcg

SEQ ID NO: 70609 - DNA, 18 bp, Homo sapiens
gcgagcgcaacggcggcg

SEQ ID NO: 70610 - DNA, 21 bp, Homo sapiens
gtggctgcagcggcggcggcg

SEQ ID NO: 70611 - DNA, 20 bp, Homo sapiens
gcggagcgcgaagagcggcg

SEQ ID NO: 70612 - DNA, 21 bp, Homo sapiens
gcggagcgggcggcggcggcg

SEQ ID NO: 70613 - DNA, 19 bp, Homo sapiens
gcgggcggcggcggcggcg

SEQ ID NO: 70614 - DNA, 21 bp, Homo sapiens
gcggggcgcgcacgggggcgg

SEQ ID NO: 70615 - DNA, 20 bp, Homo sapiens
ggggccggacagcggcggcg

SEQ ID NO: 70616 - DNA, 25 bp, Homo sapiens
gcgaagcgcgcagtggacggcggcg

SEQ ID NO: 70617 - DNA, 15 bp, Homo sapiens
gggagcggcagcggc

SEQ ID NO: 70618 - DNA, 22 bp, Homo sapiens
gcggagcgcgggtcaatcggcg

SEQ ID NO: 70619 - DNA, 19 bp, Homo sapiens
cgggcgcggggcagcggcg

SEQ ID NO: 70620 - DNA, 17 bp, Homo sapiens
gcggacgcgcgcggagc

SEQ ID NO: 70621 - DNA, 22 bp, Homo sapiens
gcgtgcgcagcgaaggcagtgg

SEQ ID NO: 70622 - DNA, 21 bp, Homo sapiens
gccgagcgcgcggcggtggcg

SEQ ID NO: 70623 - DNA, 15 bp, Homo sapiens
ggagcgcgccgcggc

SEQ ID NO: 70624 - DNA, 19 bp, Homo sapiens
gcggcggcgacggcagcgg

SEQ ID NO: 70625 - DNA, 17 bp, Homo sapiens
gcggggcgcgctcgggc

SEQ ID NO: 70626 - DNA, 22 bp, Homo sapiens
gcgcgcggcggcggcagcggcg

SEQ ID NO: 70627 - DNA, 22 bp, Homo sapiens
cggggcgcacggggcggcggcg

SEQ ID NO: 70628 - DNA, 19 bp, Homo sapiens
gcggggccgcacggctccg

SEQ ID NO: 70629 - DNA, 16 bp, Homo sapiens
cggaggcggcagcggc

SEQ ID NO: 70630 - DNA, 22 bp, Homo sapiens
cggggtctcagcggcggcggcg

SEQ ID NO: 70631 - DNA, 18 bp, Homo sapiens
ggtcgcgcggcagcggcg

SEQ ID NO: 70632 - DNA, 20 bp, Homo sapiens
gcgcggcagcggcggcggcg

SEQ ID NO: 70633 - DNA, 22 bp, Homo sapiens
gcgggacgcgcgggccacggcg

SEQ ID NO: 70634 - DNA, 23 bp, Homo sapiens
gcagccagcgtacggcagcggcg

SEQ ID NO: 70635 - DNA, 22 bp, Homo sapiens
gagctgcagcgcggcagcggcg

SEQ ID NO: 70636 - DNA, 17 bp, Homo sapiens
gcggggccgggagcggc

SEQ ID NO: 70637 - DNA, 22 bp, Homo sapiens
gtggcgcgcgcgggcacgggcg

SEQ ID NO: 70638 - DNA, 22 bp, Homo sapiens
gcggagcgggcgcgggtctgcg

SEQ ID NO: 70639 - DNA, 21 bp, Homo sapiens
gccgaggcagcggcggcggcg

SEQ ID NO: 70640 - DNA, 19 bp, Homo sapiens
gcggggcgcggcagcggcg

SEQ ID NO: 70641 - DNA, 16 bp, Homo sapiens
ggagcgcgcggcccgg

SEQ ID NO: 70642 - DNA, 18 bp, Homo sapiens
gcggagcgggcgcggagc

SEQ ID NO: 70643 - DNA, 21 bp, Homo sapiens
gcggggcccgcggcggtggcg

SEQ ID NO: 70644 - DNA, 20 bp, Homo sapiens
gcggcggctcggtggcggcg

SEQ ID NO: 70645 - DNA, 19 bp, Homo sapiens
gcggcaactgcggcagcgg

SEQ ID NO: 70646 - DNA, 26 bp, Homo sapiens
gcggagcgagcgcggggactgagcgg

SEQ ID NO: 70647 - DNA, 17 bp, Homo sapiens
gcagggcgcgcagcggc

SEQ ID NO: 70648 - DNA, 20 bp, Homo sapiens
ggaggacggcggcagcggcg

SEQ ID NO: 70649 - DNA, 24 bp, Homo sapiens
gcgagcgcgcgcgtgtgcgccgcg

SEQ ID NO: 70650 - DNA, 19 bp, Homo sapiens
ggaggccacagcagcggcg

SEQ ID NO: 70651 - DNA, 20 bp, Homo sapiens
gcggggcgcacgggctgcgg

SEQ ID NO: 70652 - DNA, 20 bp, Homo sapiens
cggaggcggcggcagcggcg

SEQ ID NO: 70653 - DNA, 21 bp, Homo sapiens
gcggtggcggcggcagcggcg

SEQ ID NO: 70654 - DNA, 18 bp, Homo sapiens
gcaggcggtggcagcggc

SEQ ID NO: 70655 - DNA, 23 bp, Homo sapiens
gcggaggagcagcggcggcggcg

SEQ ID NO: 70656 - DNA, 18 bp, Homo sapiens
gcgggggacagcagcggc

SEQ ID NO: 70657 - DNA, 21 bp, Homo sapiens
gcggcgacagcggcggcggcg

SEQ ID NO: 70658 - DNA, 21 bp, Homo sapiens
ggccgcggcgcggtggcggcg

SEQ ID NO: 70659 - DNA, 23 bp, Homo sapiens
gcggagcgcagccccgagcggcg

SEQ ID NO: 70660 - DNA, 18 bp, Homo sapiens
gcgagcgcgcgcgcctcg

SEQ ID NO: 70661 - DNA, 15 bp, Homo sapiens
gcgggcgggcagcgg

SEQ ID NO: 70662 - DNA, 18 bp, Homo sapiens
ggaggcccggcagcggcg

SEQ ID NO: 70663 - DNA, 20 bp, Homo sapiens
gcaggagaccacggtggtgg

SEQ ID NO: 70664 - DNA, 20 bp, Homo sapiens
gcggagccggggcagcggcg

SEQ ID NO: 70665 - DNA, 21 bp, Homo sapiens
gtggcggcggcggcagcggcg

SEQ ID NO: 70666 - DNA, 21 bp, Homo sapiens
gctgaggcagcggcggcggcg

SEQ ID NO: 70667 - DNA, 17 bp, Homo sapiens
gcggagcggcggtggcg

SEQ ID NO: 70668 - DNA, 23 bp, Homo sapiens
ggagcggcccagcggcagcggcg

SEQ ID NO: 70669 - DNA, 15 bp, Homo sapiens
gcggagcgggcgcgg

SEQ ID NO: 70670 - DNA, 18 bp, Homo sapiens
gcggaggcggcggcggcg

SEQ ID NO: 70671 - DNA, 19 bp, Homo sapiens
gcggagcgcggcgtgcgcg

SEQ ID NO: 70672 - DNA, 22 bp, Homo sapiens
gcggggtggcgcccgggtggcg

SEQ ID NO: 70673 - DNA, 23 bp, Homo sapiens
gcgagagcacggcggcagcggcg

SEQ ID NO: 70674 - DNA, 21 bp, Homo sapiens
gcggtggcgtcggcagcggcg

SEQ ID NO: 70675 - DNA, 20 bp, Homo sapiens
gcgaagcaacggtggtggcg

SEQ ID NO: 70676 - DNA, 22 bp, Homo sapiens
gcgggcggaggcggcagcggcg

SEQ ID NO: 70677 - DNA, 21 bp, Homo sapiens
gcggcggcagcggtggcggcg

SEQ ID NO: 70678 - DNA, 21 bp, Homo sapiens
ggagcgcgccggccagtggcg

SEQ ID NO: 70679 - DNA, 19 bp, Homo sapiens
gcgagcgcgcgcacgggcg

SEQ ID NO: 70680 - DNA, 17 bp, Homo sapiens
gtggcgcgggcagcggc

SEQ ID NO: 70681 - DNA, 19 bp, Homo sapiens
gcgcagcgccaggcagtgg

SEQ ID NO: 70682 - DNA, 17 bp, Homo sapiens
gcggagcgcagcgcggc

SEQ ID NO: 70683 - DNA, 21 bp, Homo sapiens
gagcagcgagcggcggcggcg

SEQ ID NO: 70684 - DNA, 16 bp, Homo sapiens
ggaggcggcagcggcg

SEQ ID NO: 70685 - DNA, 24 bp, Homo sapiens
gcggcagcgtgaagcccggcggcg

SEQ ID NO: 70686 - DNA, 21 bp, Homo sapiens
gcggtggcggtagcagcggcg

SEQ ID NO: 70687 - DNA, 19 bp, Homo sapiens
gcggtagcagcggcggcgg

SEQ ID NO: 70688 - DNA, 17 bp, Homo sapiens
gcggaggcagcggcggc

SEQ ID NO: 70689 - DNA, 21 bp, Homo sapiens
gcggcgacgccggcagcggcg

SEQ ID NO: 70690 - DNA, 21 bp, Homo sapiens
gcggggggctcagcagcggcg

SEQ ID NO: 70691 - DNA, 21 bp, Homo sapiens
cggagcccaacggcagcggcg

SEQ ID NO: 70692 - DNA, 25 bp, Homo sapiens
gcggtgcgcagcagcggcggcggcg

SEQ ID NO: 70693 - DNA, 21 bp, Homo sapiens
gcggagcgcgcgcaggtctcg

SEQ ID NO: 70694 - DNA, 20 bp, Homo sapiens
gcggagcgtgggcctcggcg

SEQ ID NO: 70695 - DNA, 22 bp, Homo sapiens
gcgggccgggcgcgcagcggcg

SEQ ID NO: 70696 - DNA, 19 bp, Homo sapiens
gcggggcggcgcggcggcg

SEQ ID NO: 70697 - DNA, 17 bp, Homo sapiens
gcggagagcgcagcggc

SEQ ID NO: 70698 - DNA, 20 bp, Homo sapiens
ggggggcgcgcgcagcggcg

SEQ ID NO: 70699 - DNA, 24 bp, Homo sapiens
cggagcgcgagcgcggcggcggcg

SEQ ID NO: 70700 - DNA, 18 bp, Homo sapiens
gcggtgcagggcagcggc

SEQ ID NO: 70701 - DNA, 21 bp, Homo sapiens
gcagggcggcagtggcagcgg

SEQ ID NO: 70702 - DNA, 21 bp, Homo sapiens
gggacgctggcggcggcggcg

SEQ ID NO: 70703 - DNA, 71 bp, Molluscum contagiosum virus
gctcgcggtgcagctgccgcagagccgcgaaagcgtcgtgctccacgcgcagcttctctgcgatcgcgggc

SEQ ID NO: 70704 - DNA, 24 bp, Molluscum contagiosum virus
gtgcagctgccgcagagccgcgaa

SEQ ID NO: 70705 - DNA, 19 bp, Homo sapiens
gtgcagctgcagaacgtga

SEQ ID NO: 70706 - DNA, 25 bp, Homo sapiens
gcgcggctgccgcagtccagccgga

SEQ ID NO: 70707 - DNA, 22 bp, Homo sapiens
gtgcagctttgctcgctgtgag

SEQ ID NO: 70708 - DNA, 19 bp, Homo sapiens
gcgcagctgttgcaccgga

SEQ ID NO: 70709 - DNA, 21 bp, Homo sapiens
gcagctgccgcggcgcccgaa

SEQ ID NO: 70710 - DNA, 18 bp, Homo sapiens
gtgtgctgccgctggcga

SEQ ID NO: 70711 - DNA, 23 bp, Homo sapiens
gtgcagctgtctctgagcgtgaa

SEQ ID NO: 70712 - DNA, 19 bp, Homo sapiens
gtgcagctgctctggcgcg

SEQ ID NO: 70713 - DNA, 18 bp, Homo sapiens
gcagctgcgcgggccgcg

SEQ ID NO: 70714 - DNA, 19 bp, Homo sapiens
gtgcagctaccgcaggtgc

SEQ ID NO: 70715 - DNA, 19 bp, Homo sapiens
gcagctgctgcaggacgcg

SEQ ID NO: 70716 - DNA, 15 bp, Homo sapiens
gccccggagccgcga

SEQ ID NO: 70717 - DNA, 17 bp, Homo sapiens
gtgcagctgcagcggcc

SEQ ID NO: 70718 - DNA, 21 bp, Homo sapiens
gtgagccactcagagccgcga

SEQ ID NO: 70719 - DNA, 19 bp, Homo sapiens
gtgcagctggtgcgaggcg

SEQ ID NO: 70720 - DNA, 18 bp, Homo sapiens
tgcagccgctcagggccg

SEQ ID NO: 70721 - DNA, 18 bp, Homo sapiens
gcagcgcggagagccgcg

SEQ ID NO: 70722 - DNA, 18 bp, Homo sapiens
gcagctgccaaggctgcg

SEQ ID NO: 70723 - DNA, 23 bp, Homo sapiens
gtgcggcttccacagagctgcga

SEQ ID NO: 70724 - DNA, 20 bp, Homo sapiens
agctgccgtgcagggtcgcg

SEQ ID NO: 70725 - DNA, 18 bp, Homo sapiens
atgcagctgcacacgccg

SEQ ID NO: 70726 - DNA, 19 bp, Homo sapiens
tgcagctgctgcaggctca

SEQ ID NO: 70727 - DNA, 23 bp, Homo sapiens
gtgcagcttccacagagctgcga

SEQ ID NO: 70728 - DNA, 19 bp, Homo sapiens
gtgcagctgtctcccgcga

SEQ ID NO: 70729 - DNA, 22 bp, Homo sapiens
gtgcagctctggagctgttgcg

SEQ ID NO: 70730 - DNA, 17 bp, Homo sapiens
gtgcagctgcgccggcg

SEQ ID NO: 70731 - DNA, 22 bp, Homo sapiens
gtgcagctcgctgtggccagaa

SEQ ID NO: 70732 - DNA, 19 bp, Homo sapiens
gtgtgctggaggagccgcg

SEQ ID NO: 70733 - DNA, 93 bp, Tupaia herpesvirus
gtcgtggtcgtcgtcgtggccgtggccgtgtagcggggcgcctgctggggttgaggctgctgctgcggctgcggccgcggcgacgactgcggc

SEQ ID NO: 70734 - DNA, 24 bp, Tupaia herpesvirus
ggttgaggctgctgctgcggctgc

SEQ ID NO: 70735 - DNA, 20 bp, Homo sapiens
ggtggggctgctgccactgc

SEQ ID NO: 70736 - DNA, 22 bp, Homo sapiens
ggtgaggctgctgccaggctgc

SEQ ID NO: 70737 - DNA, 16 bp, Homo sapiens
ggttgaggctgctggg

SEQ ID NO: 70738 - DNA, 21 bp, Homo sapiens
ggttgaggctgcagtgaactg

SEQ ID NO: 70739 - DNA, 21 bp, Homo sapiens
ggtcgaggctgcactgggctg

SEQ ID NO: 70740 - DNA, 18 bp, Homo sapiens
ggctgctgctgtggctgc

SEQ ID NO: 70741 - DNA, 21 bp, Homo sapiens
ggctggggctgctgcttagct

SEQ ID NO: 70742 - DNA, 20 bp, Homo sapiens
ggctgaggttgctgatctgc

SEQ ID NO: 70743 - DNA, 23 bp, Homo sapiens
ggctgaggtttgaaaagtggctg

SEQ ID NO: 70744 - DNA, 23 bp, Homo sapiens
ggcggctgctgctgttgtggctg

SEQ ID NO: 70745 - DNA, 23 bp, Homo sapiens
ggttgatgctgctgttgaaaggc

SEQ ID NO: 70746 - DNA, 21 bp, Homo sapiens
ggttgaggctgcagtgagccg

SEQ ID NO: 70747 - DNA, 26 bp, Homo sapiens
ggctggggttgctgccgtgaggctgc

SEQ ID NO: 70748 - DNA, 22 bp, Homo sapiens
ggttgaggcttctgttcccagg

SEQ ID NO: 70749 - DNA, 22 bp, Homo sapiens
ggctggggctgctggggcttgc

SEQ ID NO: 70750 - DNA, 18 bp, Homo sapiens
ggttgaggatggtggctg

SEQ ID NO: 70751 - DNA, 18 bp, Homo sapiens
ggcggctgctgcggctgc

SEQ ID NO: 70752 - DNA, 22 bp, Homo sapiens
ggttgaggctgctgatgaatgc

SEQ ID NO: 70753 - DNA, 23 bp, Homo sapiens
ggttgaggctgccggtgctctgc

SEQ ID NO: 70754 - DNA, 19 bp, Homo sapiens
ggctgaggctgcgggctgc

SEQ ID NO: 70755 - DNA, 23 bp, Homo sapiens
ggtggggctgctgttgctgctgc

SEQ ID NO: 70756 - DNA, 23 bp, Homo sapiens
ggtggagttcttgctgtggttgc

SEQ ID NO: 70757 - DNA, 21 bp, Homo sapiens
ggttgaggctgcagtgagcca

SEQ ID NO: 70758 - DNA, 23 bp, Homo sapiens
ggttgaggctgcagttagccctg

SEQ ID NO: 70759 - DNA, 22 bp, Homo sapiens
ggttggagctgctgctttgagc

SEQ ID NO: 70760 - DNA, 18 bp, Homo sapiens
ggtgggggctgctgctgc

SEQ ID NO: 70761 - DNA, 21 bp, Homo sapiens
ggcggctgctgctgcggctgc

SEQ ID NO: 70762 - DNA, 23 bp, Homo sapiens
ggttgatgctgctgccgggctgc

SEQ ID NO: 70763 - DNA, 23 bp, Homo sapiens
gagccatctgctgctgtggctgc

SEQ ID NO: 70764 - DNA, 22 bp, Homo sapiens
ggttgaggctgcagtcagctgc

SEQ ID NO: 70765 - DNA, 18 bp, Homo sapiens
ggctggggctgctgctgc

SEQ ID NO: 70766 - DNA, 19 bp, Homo sapiens
ggttgaggctgcagttgga

SEQ ID NO: 70767 - DNA, 21 bp, Homo sapiens
ggttgaggctgcagtcagctg

SEQ ID NO: 70768 - DNA, 18 bp, Homo sapiens
ggttgaggctcctcctgc

SEQ ID NO: 70769 - DNA, 93 bp, Vaccinia virus
taccaatattggaattataatataggtgtatttgcgcactcgcgacggttgatgcatcggtaaatatagctgtatctaatgttctagtcggta

SEQ ID NO: 70770 - DNA, 93 bp, Vaccinia virus; identical to SEQ ID NO: 70769

SEQ ID NO: 70771 - DNA, 17 bp, Homo sapiens
tgcattgctcagctgta

SEQ ID NO: 70772 - DNA, 21 bp, Homo sapiens
tgcatcggtgtgtttgcgtat

SEQ ID NO: 70773 - DNA, 18 bp, Homo sapiens
gcatcggtaaatgttcta

SEQ ID NO: 70774 - DNA, 93 bp, Porcine adenovirus C
ctttttcaagatcctggtttgattgataaatgatatgcaaaatctctgatgatctctgcaatgcaaatgtctcacagtctaccggagaaaaag

SEQ ID NO: 70775 - DNA, 24 bp, Porcine adenovirus C
tgattgataaatgatatgcaaaat

SEQ ID NO: 70776 - DNA, 18 bp, Homo sapiens
tgcttgataaatggtagc

SEQ ID NO: 70777 - DNA, 22 bp, Homo sapiens
tgattgataaagattttacaaa

SEQ ID NO: 70778 - DNA, 17 bp, Homo sapiens
tgcaaatgatatgcaaa

SEQ ID NO: 70779 - DNA, 20 bp, Homo sapiens
tgattggtactatgcaaaat

SEQ ID NO: 70780 - DNA, 16 bp, Homo sapiens
tgattgattgattgca

SEQ ID NO: 70781 - DNA, 25 bp, Homo sapiens
tgattgataagctgacaaaaaaaat

SEQ ID NO: 70782 - DNA, 20 bp, Homo sapiens
tgattaataaatgataaaac

SEQ ID NO: 70783 - DNA, 18 bp, Homo sapiens
tggttgacaaatcacatg

SEQ ID NO: 70784 - DNA, 23 bp, Homo sapiens
tgattggtaaatgatgcacaaaa

SEQ ID NO: 70785 - DNA, 18 bp, Homo sapiens
attgataatatgatgcaa

SEQ ID NO: 70786 - DNA, 24 bp, Homo sapiens
tgattgattgatatataccaaaat

SEQ ID NO: 70787 - DNA, 17 bp, Homo sapiens
tgattgatgaatgatgc

SEQ ID NO: 70788 - DNA, 22 bp, Homo sapiens
tgatagatacaatatgcaaaat

SEQ ID NO: 70789 - DNA, 106 bp, Human herpesvirus 2
ggggtagtgtcggagaggcccgccgcgcatttaaggagtcgccgccccgactctgtgtcttcgggtgacttggtgcgccgccgtcagctagtctccgatctgcccc

SEQ ID NO: 70790 - DNA, 24 bp, Human herpesvirus 2
tgacttggtgcgccgccgtcagct

SEQ ID NO: 70791 - DNA, 18 bp, Homo sapiens
tgacttggtgcttgccac

SEQ ID NO: 70792 - DNA, 22 bp, Homo sapiens
tggcctggtgcgcgctccagct

SEQ ID NO: 70793 - DNA, 19 bp, Homo sapiens
tgacttggtggtacacagc

SEQ ID NO: 70794 - DNA, 17 bp, Homo sapiens
tgacttggtgggctgtc

SEQ ID NO: 70795 - DNA, 21 bp, Homo sapiens
tgatttggtgcagcggggtag

SEQ ID NO: 70796 - DNA, 93 bp, Camelpox virus
tgccaatattggaattataatataggtgtatttgcgcactcgcgacggttgatgcatctgtaaatatagctgtatctaatgttctagtcggta

SEQ ID NO: 70797 - DNA, 24 bp, Camelpox virus
atgcatctgtaaatatagctgtat

SEQ ID NO: 70798 - DNA, 24 bp, Homo sapiens
atgcatctgtggatattacactat

SEQ ID NO: 70799 - DNA, 16 bp, Homo sapiens
tgcatctgtcaggtgt

SEQ ID NO: 70800 - DNA, 24 bp, Homo sapiens
atgcatctgtaaataatggtctgt

SEQ ID NO: 70801 - DNA, 23 bp, Homo sapiens
atgcgtttctctgtgagctgtat

SEQ ID NO: 70802 - DNA, 20 bp, Homo sapiens
gcatctgtggatttaggtat

SEQ ID NO: 70803 - DNA, 21 bp, Homo sapiens
tgcatttttaaatagctctat

SEQ ID NO: 70804 - DNA, 20 bp, Homo sapiens
tgtgtctgtaaatacagcgc

SEQ ID NO: 70805 - DNA, 21 bp, Homo sapiens
atgcgtctgtaagatagctgc

SEQ ID NO: 70806 - DNA, 22 bp, Homo sapiens
atgcatctatgaagtactgtat

SEQ ID NO: 70807 - DNA, 22 bp, Homo sapiens
atgcatctgtggaatgtagagt

SEQ ID NO: 70808 - DNA, 18 bp, Homo sapiens
catctgtaaaaagtgtat

SEQ ID NO: 70809 - DNA, 24 bp, Homo sapiens
tgcatttataaataatttttgtat

SEQ ID NO: 70810 - DNA, 22 bp, Homo sapiens
atgtactgtaaataaacagtat

SEQ ID NO: 70811 - DNA, 17 bp, Homo sapiens
acgcatctgttagctgt

SEQ ID NO: 70812 - DNA, 24 bp, Homo sapiens
atgcatctgtggcagagactgtat

SEQ ID NO: 70813 - DNA, 77 bp, Cowpox virus
tggaattataatataggtgtatttgagcactagaaacggtcgatgcatcggtaaatatagctgtatttaatgttcta

SEQ ID NO: 70814 - DNA, 24 bp, Cowpox virus
taatataggtgtatttgagcacta

SEQ ID NO: 70815 - DNA, 15 bp, Homo sapiens
taggttttgagcact

SEQ ID NO: 70816 - DNA, 18 bp, Homo sapiens
taataagggtgtatttaa

SEQ ID NO: 70817 - DNA, 24 bp, Homo sapiens
taatgtagatgtatcttcacacta

SEQ ID NO: 70818 - DNA, 77 bp, Variola virus
tggaattataatataggtatatttgcgcacttgcgacagttgatgcatcggtaaatatagctgtatctaatgttcta

SEQ ID NO: 70819 - DNA, 129 bp, Bovine papillomavirus
ctttgctctaatttcaggaactgctaaccaggtaaagtgctatcgctttcgggtgaaaaagaaccatagacatcgctacgagaactgcaccaccacctggttcacagttgctgacaacggtgctgaaag

SEQ ID NO: 70820 - DNA, 24 bp, Bovine papillomavirus
ttcacagttgctgacaacggtgct

SEQ ID NO: 70821 - DNA, 19 bp, Homo sapiens
ttcacagttgttaataagt

SEQ ID NO: 70822 - DNA, 21 bp, Homo sapiens
ttcacagttgctaaccttgct

SEQ ID NO: 70823 - DNA, 24 bp, Homo sapiens
ttcctaggcactgataacggtgct

SEQ ID NO: 70824 - DNA, 21 bp, Homo sapiens
ctcatggttgctgaaattgct

SEQ ID NO: 70825 - DNA, 22 bp, Homo sapiens
cacagttgctgaggctggtgct

SEQ ID NO: 70826 - DNA, 20 bp, Homo sapiens
ttccagttgctcaagcggtg

SEQ ID NO: 70827 - DNA, 18 bp, Homo sapiens
ttcacagctcaggtggtg

SEQ ID NO: 70828 - DNA, 18 bp, Homo sapiens
ttcgagttgctgatatgc

SEQ ID NO: 70829 - DNA, 16 bp, Homo sapiens
ttcacagttttgagtg

SEQ ID NO: 70830 - DNA, 68 bp, Bovine herpesvirus 4
tttttattcttgttatttagctgagtcatcggtaccgaatatacagttaagagtatctagagggagaa

SEQ ID NO: 70831 - DNA, 24 bp, Bovine herpesvirus 4
tatacagttaagagtatctagagg

SEQ ID NO: 70832 - DNA, 16 bp, Homo sapiens
gctatgtatctagagg

SEQ ID NO: 70833 - DNA, 24 bp, Homo sapiens
tatacagtatagataacctagagg

SEQ ID NO: 70834 - DNA, 23 bp, Homo sapiens
tatacagttgaaggcaaaggagg

SEQ ID NO: 70835 - DNA, 22 bp, Homo sapiens
tatgcacttaagagtcccaagg

SEQ ID NO: 70836 - DNA, 16 bp, Homo sapiens
agttgagatccagagg

SEQ ID NO: 70837 - DNA, 23 bp, Homo sapiens
tacacagttggaaagtttggagg

SEQ ID NO: 70838 - DNA, 18 bp, Homo sapiens
gttaagagtttttagagg

SEQ ID NO: 70839 - DNA, 22 bp, Homo sapiens
tatacttaagagtatttacagg

SEQ ID NO: 70840 - DNA, 19 bp, Homo sapiens
tacagttaagaaaaagagg

SEQ ID NO: 70841 - DNA, 21 bp, Homo sapiens
cagttaagagtagattgcagg

SEQ ID NO: 70842 - DNA, 17 bp, Homo sapiens
tacagttaagggttaag

SEQ ID NO: 70843 - DNA, 70 bp, Rana tigrina ranavirus
cctctggtacagttctgacaaagaggactcttgcagagaggactctgagggctgcgtgttctactagagg

SEQ ID NO: 70844 - DNA, 24 bp, Rana tigrina ranavirus
tgagggctgcgtgttctactagag

SEQ ID NO: 70845 - DNA, 23 bp, Homo sapiens
tgggggctgcgtgtcctaaggag

SEQ ID NO: 70846 - DNA, 22 bp, Homo sapiens
tgagggctgggtcccactctag

SEQ ID NO: 70847 - DNA, 16 bp, Homo sapiens
gggcccttctactaga

SEQ ID NO: 70848 - DNA, 21 bp, Homo sapiens
tgagggcttcgtgctttagag

SEQ ID NO: 70849 - DNA, 23 bp, Homo sapiens
gagggctggagagtctgctggag

SEQ ID NO: 70850 - DNA, 21 bp, Homo sapiens
tgagggctgctgtcccaggag

SEQ ID NO: 70851 - DNA, 21 bp, Homo sapiens
tgaggttgcagactactagag

SEQ ID NO: 70852 - DNA, 22 bp, Homo sapiens
ggcggctgcgtccagcctggag

SEQ ID NO: 70853 - DNA, 127 bp, Rana tigrina ranavirus
tcccaagctttcgttaccctctaggggtaacaaatgcaatgactgtaaatgtttagacttggagtgtttaaaacactgacatttaggtcaacgatgttctcagaaagtagagggtggccaaaccgga

SEQ ID NO: 70854 - DNA, 24 bp, Rana tigrina ranavirus
tgtaaatgtttagacttggagtgt

SEQ ID NO: 70855 - DNA, 20 bp, Homo sapiens
taaatgtttttgtggagtgt

SEQ ID NO: 70856 - DNA, 17 bp, Homo sapiens
tgtaaatatttagattg

SEQ ID NO: 70857 - DNA, 24 bp, Homo sapiens
tgttatctgaaaggtttggagtgt

SEQ ID NO: 70858 - DNA, 18 bp, Homo sapiens
tgtttagatttggagtgt

SEQ ID NO: 70859 - DNA, 16 bp, Homo sapiens
tgttgacttggagtgt

SEQ ID NO: 70860 - DNA, 20 bp, Homo sapiens
tgtaaatgttgagatttgga

SEQ ID NO: 70861 - DNA, 131 bp, African swine fever virus
tgtagataccatataatgaatgttttattaggatagtagttaatagtttagttaagacagtagttctttctgttaagatagtagttctgttaagatagtagtttagttatgatagtggtttagttaagaca

SEQ ID NO: 70862 - DNA, 24 bp, African swine fever virus
tgttaagatagtagttctgttaag

SEQ ID NO: 70863 - DNA, 20 bp, Homo sapiens
tgttacgctatgttctgtta

SEQ ID NO: 70864 - DNA, 18 bp, Homo sapiens
tgctagcccagttctgtt

SEQ ID NO: 70865 - DNA, 21 bp, Homo sapiens
tgtgaggatggtagttctctt

SEQ ID NO: 70866 - DNA, 18 bp, Homo sapiens
tgttaagagggtaggtct

SEQ ID NO: 70867 - DNA, 18 bp, Homo sapiens
tgctgagatagtagttcc

SEQ ID NO: 70868 - DNA, 131 bp, Alcelaphine herpesvirus 1
atctgctctgttttgtacaaaaagtggaagtgtgtgtttatatgattcacaaaactgtagtttaacagtaaaagttaattgtggtttgtggtatgacacacagttctggaaactgaccaaacagtgttctt

SEQ ID NO: 70869 - DNA, 24 bp, Alcelaphine herpesvirus 1
tatgacacacagttctggaaactg

SEQ ID NO: 70870 - DNA, 20 bp, Homo sapiens
tgacacaccagtgggagctg

SEQ ID NO: 70871 - DNA, 28 bp, Homo sapiens
tatgacacatgatgatacatggaggctg

SEQ ID NO: 70872 - DNA, 23 bp, Homo sapiens
catgacatgcacacaggaaactg

SEQ ID NO: 70873 - DNA, 17 bp, Homo sapiens
tatgatcaattctggaa

SEQ ID NO: 70874 - DNA, 21 bp, Homo sapiens
tgacacacagatgacccactg

SEQ ID NO: 70875 - DNA, 20 bp, Homo sapiens
atgacaaactctggaaactg

SEQ ID NO: 70876 - DNA, 19 bp, Homo sapiens
catgacacacagtggccgg

SEQ ID NO: 70877 - DNA, 18 bp, Homo sapiens
catgacattctggaggct

SEQ ID NO: 70878 - DNA, 21 bp, Homo sapiens
tgcccacagttctggagactg

SEQ ID NO: 70879 - DNA, 20 bp, Homo sapiens
tgtcatacttcaggaaactg

SEQ ID NO: 70880 - DNA, 19 bp, Homo sapiens
cgactgtttttggaaactg

SEQ ID NO: 70881 - DNA, 20 bp, Homo sapiens
tgattacagctctggaactg

SEQ ID NO: 70882 - DNA, 26 bp, Homo sapiens
tatgacacactgtttgcattcgactg

SEQ ID NO: 70883 - DNA, 16 bp, Homo sapiens
tggcacacaagaaact

SEQ ID NO: 70884 - DNA, 17 bp, Homo sapiens
tatgacacacactgaaa

SEQ ID NO: 70885 - DNA, 19 bp, Homo sapiens
tgaacacagcccggaactg

SEQ ID NO: 70886 - DNA, 21 bp, Homo sapiens
tgcaggcagttctggggactg

SEQ ID NO: 70887 - DNA, 18 bp, Homo sapiens
gatgcacagtttctggaa

SEQ ID NO: 70888 - DNA, 18 bp, Homo sapiens
tataacacacagtaactg

SEQ ID NO: 70889 - DNA, 16 bp, Homo sapiens
cataactattctggaa

SEQ ID NO: 70890 - DNA, 24 bp, Homo sapiens
aacatctcacagttctggaggctg

SEQ ID NO: 70891 - DNA, 17 bp, Homo sapiens
tatgacacatagccgga

SEQ ID NO: 70892 - DNA, 17 bp, Homo sapiens
gacacacagttgcaact

SEQ ID NO: 70893 - DNA, 23 bp, Homo sapiens
tatgggaacagttctggaggctg

SEQ ID NO: 70894 - DNA, 108 bp, Human papillomavirus type 36
catttagtacaacttggtcatgggtggcaggagatggcactgagcgtctaggcaggcccagaatgctcattagcttttcgtcctacaatcagagaagggattttgatg

SEQ ID NO: 70895 - DNA, 24 bp, Human papillomavirus type 36
ttcgtcctacaatcagagaaggga

SEQ ID NO: 70896 - DNA, 20 bp, Homo sapiens
cgtcctagaaaagaggaggg

SEQ ID NO: 70897 - DNA, 23 bp, Homo sapiens
ttcgtgcctcatgggagaaggga

SEQ ID NO: 70898 - DNA, 25 bp, Homo sapiens
ttcgtcctgcaggtcagtctcaggg

SEQ ID NO: 70899 - DNA, 22 bp, Homo sapiens
ttcataagcaatcagagagggg

SEQ ID NO: 70900 - DNA, 19 bp, Homo sapiens
gtcttagaatgaaaaggga

SEQ ID NO: 70901 - DNA, 21 bp, Homo sapiens
ttcatcctgcccaaggaggga

SEQ ID NO: 70902 - DNA, 24 bp, Homo sapiens
ttcatcctgtggcagcaagaaggg

SEQ ID NO: 70903 - DNA, 21 bp, Homo sapiens
ttcgtcctcgcctaggaggga

SEQ ID NO: 70904 - DNA, 60 bp, Fowlpox virus
gccattgtacttgatatatttcgctgatatcatttctcggaatcggcatcaagagcaggc

SEQ ID NO: 70905 - DNA, 24 bp, Fowlpox virus
tacttgatatatttcgctgatatc

SEQ ID NO: 70906 - DNA, 18 bp, Homo sapiens
ctggacattgctgatatc

SEQ ID NO: 70907 - DNA, 25 bp, Homo sapiens
acttgatatatttctcaagaatatc

SEQ ID NO: 70908 - DNA, 20 bp, Homo sapiens
tacttgacatcccacagctg

SEQ ID NO: 70909 - DNA, 21 bp, Homo sapiens
tacttgcatctctgctgatat

SEQ ID NO: 70910 - DNA, 20 bp, Homo sapiens
tacttgatatgattcataat

SEQ ID NO: 70911 - DNA, 97 bp, Human adenovirus A
tagttcttttctttatgttaatcccagtttgggctagttcttgtcaactacataaaccatggaattttttagattgttatactaaagaaacaaacta

SEQ ID NO: 70912 - DNA, 24 bp, Human adenovirus A
tagattgttatactaaagaaacaa

SEQ ID NO: 70913 - DNA, 19 bp, Homo sapiens
tagattgttaaaaactaaa

SEQ ID NO: 70914 - DNA, 19 bp, Homo sapiens
tacattgttaccagaaaca

SEQ ID NO: 70915 - DNA, 18 bp, Homo sapiens
gatgtgactagagaaaca

SEQ ID NO: 70916 - DNA, 19 bp, Homo sapiens
tagattgttatggaaagaa

SEQ ID NO: 70917 - DNA, 18 bp, Homo sapiens
attgattatactaaggaa

SEQ ID NO: 70918 - DNA, 17 bp, Homo sapiens
tagattttatactaaaa

SEQ ID NO: 70919 - DNA, 21 bp, Homo sapiens
gaaaaccatactaaagagaca

SEQ ID NO: 70920 - DNA, 20 bp, Homo sapiens
gattgttaacggaggaaaca

SEQ ID NO: 70921 - DNA, 18 bp, Homo sapiens
agatttgactaaagaaac

SEQ ID NO: 70922 - DNA, 21 bp, Homo sapiens
tagattattcagaagaaacaa

SEQ ID NO: 70923 - DNA, 20 bp, Homo sapiens
agattgtttttaagaaacaa

SEQ ID NO: 70924 - DNA, 21 bp, Homo sapiens
agaccgttgctagagaaacaa

SEQ ID NO: 70925 - DNA, 17 bp, Homo sapiens
agattgttacattagaa

SEQ ID NO: 70926 - DNA, 19 bp, Homo sapiens
tgcattcactaaagaaaca

SEQ ID NO: 70927 - DNA, 21 bp, Homo sapiens
cagatgtaaatactaaagaaa

SEQ ID NO: 70928 - DNA, 18 bp, Homo sapiens
tagattgttatagttaag

SEQ ID NO: 70929 - DNA, 67 bp, Human papillomavirus type 20
tggctggagatggcacggagcgtctaggcaggtccagaatgctcattagctttatatccttcagtca

SEQ ID NO: 70930 - DNA, 24 bp, Human papillomavirus type 20
gatggcacggagcgtctaggcagg

SEQ ID NO: 70931 - DNA, 21 bp, Homo sapiens
tgacacgggggtgggggcagg

SEQ ID NO: 70932 - DNA, 19 bp, Homo sapiens
tggcacgaggtcctgcagg

SEQ ID NO: 70933 - DNA, 19 bp, Homo sapiens
gatggtagaggttaggcag

SEQ ID NO: 70934 - DNA, 16 bp, Homo sapiens
ggcgcgggcccaggcg

SEQ ID NO: 70935 - DNA, 20 bp, Homo sapiens
tggcacggggtggagggagg

SEQ ID NO: 70936 - DNA, 20 bp, Homo sapiens
gaggtggatgtctaggcagg

SEQ ID NO: 70937 - DNA, 17 bp, Homo sapiens
gaggcacggagcacagg

SEQ ID NO: 70938 - DNA, 20 bp, Homo sapiens
tgggcggacgcacaggcagg

SEQ ID NO: 70939 - DNA, 21 bp, Homo sapiens
gatgtacggttcctaggcagg

SEQ ID NO: 70940 - DNA, 17 bp, Homo sapiens
tggcagcggacaggcag

SEQ ID NO: 70941 - DNA, 20 bp, Homo sapiens
tggggcggagcgtctgctgg

SEQ ID NO: 70942 - DNA, 20 bp, Homo sapiens
cggcacggggcgcgggtggg

SEQ ID NO: 70943 - DNA, 20 bp, Homo sapiens
tggtgagggtatcaggcagg

SEQ ID NO: 70944 - DNA, 21 bp, Homo sapiens
gatggtgctcctctaggcagg

SEQ ID NO: 70945 - DNA, 22 bp, Homo sapiens
gatggcacggctggtgggcagg

SEQ ID NO: 70946 - DNA, 21 bp, Homo sapiens
gatggcactggggtgggcagg

SEQ ID NO: 70947 - DNA, 20 bp, Homo sapiens
gggacaagcgtctgggcggg

SEQ ID NO: 70948 - DNA, 19 bp, Homo sapiens
gatggcagggggcaagcag

SEQ ID NO: 70949 - DNA, 21 bp, Homo sapiens
tggggcgggctcctaggcagg

SEQ ID NO: 70950 - DNA, 61 bp, Pea early browning virus
gtaattgagtttccaaacttacatttgatacagtacgaaaatggtgtggaaaagaagttgc

SEQ ID NO: 70951 - DNA, 17 bp, Pea early browning virus
tgtggaaaagaagttgc

SEQ ID NO: 70952 - DNA, 19 bp, Homo sapiens
gtggaaagtggaaaagttg

SEQ ID NO: 70953 - DNA, 18 bp, Homo sapiens
tgtaaaaaaagaagttgc

SEQ ID NO: 70954 - DNA, 19 bp, Homo sapiens
tgtaggaaagaaatgttgc

SEQ ID NO: 70955 - DNA, 19 bp, Homo sapiens
tgtagaaattctaaagttg

SEQ ID NO: 70956 - DNA, 19 bp, Homo sapiens
tgggaaaaaacgcagttgc

SEQ ID NO: 70957 - DNA, 18 bp, Homo sapiens
tgtagaaaaaagaggttg

SEQ ID NO: 70958 - DNA, 19 bp, Homo sapiens
tgtggaaataaaatgttgc

SEQ ID NO: 70959 - DNA, 19 bp, Homo sapiens
tatggaaataagcagttgc

SEQ ID NO: 70960 - DNA, 95 bp, Oat golden stripe virus
caacaaacgttgtggaaattcaaaattgttgtcctaggcctgccacggcaataaatcctaggcgtctcagttttggtttttcgctacgttagttg

SEQ ID NO: 70961 - DNA, 24 bp, Oat golden stripe virus
tgtggaaattcaaaattgttgtcc

SEQ ID NO: 70962 - DNA, 17 bp, Homo sapiens
tgtggaaatcatttgtt

SEQ ID NO: 70963 - DNA, 23 bp, Homo sapiens
tgtggtagttcaaaacagtggtc

SEQ ID NO: 70964 - DNA, 22 bp, Homo sapiens
tgtagcgctgggattgttgtcc

SEQ ID NO: 70965 - DNA, 20 bp, Homo sapiens
tgtagaaattcagaatggct

SEQ ID NO: 70966 - DNA, 18 bp, Homo sapiens
atggaaatttaaattgtt

SEQ ID NO: 70967 - DNA, 22 bp, Homo sapiens
tgtagaaattcaggacgcggtc

SEQ ID NO: 70968 - DNA, 19 bp, Homo sapiens
tgtggaaggttaaattgtt

SEQ ID NO: 70969 - DNA, 21 bp, Homo sapiens
tgtggaaatataaagcctatc

SEQ ID NO: 70970 - DNA, 21 bp, Homo sapiens
tgtggaaattgaaaccctgtc

SEQ ID NO: 70971 - DNA, 21 bp, Homo sapiens
tgtggaaattaaataactgtt

SEQ ID NO: 70972 - DNA, 24 bp, Homo sapiens
tgtggagtataatccttgttgtcc

SEQ ID NO: 70973 - DNA, 17 bp, Homo sapiens
tgggaaattcatttgtt

SEQ ID NO: 70974 - DNA, 19 bp, Homo sapiens
tgggaagttctgtgttgtc

SEQ ID NO: 70975 - DNA, 16 bp, Homo sapiens
tgcggaagttcattgt

SEQ ID NO: 70976 - DNA, 21 bp, Homo sapiens
tggggaagtttcttgttgtcc

SEQ ID NO: 70977 - DNA, 104 bp, Cowpox virus
ctatctaccagattattatgtgttataaggtactttttctcataataaactagagtatgagtatgatagtgttttttcaaaacatataaatctaaaattgatgg

SEQ ID NO: 70978 - DNA, 24 bp, Cowpox virus
taaggtactttttctcataataaa

SEQ ID NO: 70979 - DNA, 20 bp, Homo sapiens
taaggtacatttttcttcta

SEQ ID NO: 70980 - DNA, 21 bp, Homo sapiens
taaggtattttctataataaa

SEQ ID NO: 70981 - DNA, 20 bp, Homo sapiens
taagatacttttttgcataa

SEQ ID NO: 70982 - DNA, 15 bp, Homo sapiens
ggcctttctcataat

SEQ ID NO: 70983 - DNA, 18 bp, Homo sapiens
ggtacttttttctcttaa

SEQ ID NO: 70984 - DNA, 23 bp, Homo sapiens
caaggtacttgaccatgtgataa

SEQ ID NO: 70985 - DNA, 60 bp, Cowpox virus
aatctgataactttaaacatggatttttgatgacatagtggtttaaagtttaaacagatt

SEQ ID NO: 70986 - DNA, 24 bp, Cowpox virus
taactttaaacatggatttttgat

SEQ ID NO: 70987 - DNA, 18 bp, Homo sapiens
tttaaacatggaaatgat

SEQ ID NO: 70988 - DNA, 19 bp, Homo sapiens
tttaaacataaaacttgat

SEQ ID NO: 70989 - DNA, 22 bp, Homo sapiens
taactattagacatgatttttg

SEQ ID NO: 70990 - DNA, 119 bp, Equine herpesvirus 2
tctccagacccgggtttcaccttgccctcgctctctccgtctatctgtacttaagaaagtgatccttttgtgtgtgggccgagagaaggggaaagtgtgtggttggggggtgacagaga

SEQ ID NO: 70991 - DNA, 24 bp, Equine herpesvirus 2
gaaagtgtgtggttggggggtgac

SEQ ID NO: 70992 - DNA, 21 bp, Homo sapiens
gcgggtgggcaatggggggtg

SEQ ID NO: 70993 - DNA, 20 bp, Homo sapiens
gagagtggtgtgtgggtggc

SEQ ID NO: 70994 - DNA, 18 bp, Homo sapiens
gaaaatttttggggggtg

SEQ ID NO: 70995 - DNA, 22 bp, Homo sapiens
gaaggtgggtgggctgggtggt

SEQ ID NO: 70996 - DNA, 22 bp, Homo sapiens
gaaagtggtggaggcgggggtg

SEQ ID NO: 70997 - DNA, 20 bp, Homo sapiens
gaaagtgttgcttgggtggt

SEQ ID NO: 70998 - DNA, 20 bp, Homo sapiens
ggaatgtgtgaaagggtggt

SEQ ID NO: 70999 - DNA, 21 bp, Homo sapiens
gagagtgagtagtagggggtg

SEQ ID NO: 71000 - DNA, 19 bp, Homo sapiens
gtgtgtggacatcggtggt

SEQ ID NO: 71001 - DNA, 19 bp, Homo sapiens
gcggtgggatggggggtga

SEQ ID NO: 71002 - DNA, 21 bp, Homo sapiens
agtgtgatggttgatcctggt

SEQ ID NO: 71003 - DNA, 20 bp, Homo sapiens
ggagggtgtggtgaagggtg

SEQ ID NO: 71004 - DNA, 16 bp, Homo sapiens
aaagtgctggggggtg

SEQ ID NO: 71005 - DNA, 18 bp, Homo sapiens
gtggtgggcaggggtgac

SEQ ID NO: 71006 - DNA, 17 bp, Homo sapiens
gaaggtgtgtgttggag

SEQ ID NO: 71007 - DNA, 18 bp, Homo sapiens
gaaggtgtgtggtggggg

SEQ ID NO: 71008 - DNA, 17 bp, Homo sapiens
ggagggtgcagggggtg

SEQ ID NO: 71009 - DNA, 24 bp, Homo sapiens
gagagtggtgggagcctgggtggc

SEQ ID NO: 71010 - DNA, 19 bp, Homo sapiens
agtgtgaggcttgggggtg

SEQ ID NO: 71011 - DNA, 20 bp, Homo sapiens
gagagtctgtggtttatggc

SEQ ID NO: 71012 - DNA, 18 bp, Homo sapiens
gaagtgtggaggggggtg

SEQ ID NO: 71013 - DNA, 20 bp, Homo sapiens
agggtgtgggtgggtgggtg

SEQ ID NO: 71014 - DNA, 19 bp, Homo sapiens
agtgtgtgttgatctcgtg

SEQ ID NO: 71015 - DNA, 19 bp, Homo sapiens
gagagtgtgggccaggtga

SEQ ID NO: 71016 - DNA, 17 bp, Homo sapiens
agtgtatggataggtga

SEQ ID NO: 71017 - DNA, 21 bp, Homo sapiens
agggtgtgagcactgggtggc

SEQ ID NO: 71018 - DNA, 18 bp, Homo sapiens
gtgggtgccttgggggtg

SEQ ID NO: 71019 - DNA, 21 bp, Homo sapiens
gaaagttggggtgggggtgac

SEQ ID NO: 71020 - DNA, 21 bp, Homo sapiens
gaaaatcgacttggggggtga

SEQ ID NO: 71021 - DNA, 18 bp, Homo sapiens
gtgtgtggttggggggtg

SEQ ID NO: 71022 - DNA, 15 bp, Homo sapiens
atgtgtgggggggtg

SEQ ID NO: 71023 - DNA, 129 bp, Chimpanzee cytomegalovirus
tgcctgtgtcgtgttcgttgttaattcgccaccattcactgagtttccaaaagattgtttttccttgaaattgttccggtcggtcttttgggttagtaatgttggggcgccaatcatatggcacttgta

SEQ ID NO: 71024 - DNA, 24 bp, Chimpanzee cytomegalovirus
tcactgagtttccaaaagattgtt

SEQ ID NO: 71025 - DNA, 22 bp, Homo sapiens
tcatcgagtttctgacattgtt

SEQ ID NO: 71026 - DNA, 16 bp, Homo sapiens
tcctgagtttctaaga

SEQ ID NO: 71027 - DNA, 22 bp, Homo sapiens
tcctgagtttctagctcttgtt

SEQ ID NO: 71028 - DNA, 21 bp, Homo sapiens
tccttgagtttccaaaatcct

SEQ ID NO: 71029 - DNA, 19 bp, Homo sapiens
taaattccaagagattgtt

SEQ ID NO: 71030 - DNA, 17 bp, Homo sapiens
cactgagttttcagacc

SEQ ID NO: 71031 - DNA, 21 bp, Homo sapiens
tcactaagtttctgggggact

SEQ ID NO: 71032 - DNA, 22 bp, Homo sapiens
tcctgagtttccattcactgtt

SEQ ID NO: 71033 - DNA, 18 bp, Homo sapiens
tggtctctggaagattgt

SEQ ID NO: 71034 - DNA, 17 bp, Homo sapiens
tcactgcgtttctaaga

SEQ ID NO: 71035 - DNA, 22 bp, Homo sapiens
tcactaagtttctgaaaatgtt

SEQ ID NO: 71036 - DNA, 16 bp, Homo sapiens
actgagaaaagattgt

SEQ ID NO: 71037 - DNA, 21 bp, Homo sapiens
actggagttcagaagattgtt

SEQ ID NO: 71038 - DNA, 18 bp, Homo sapiens
tcactgagttctcattgt

SEQ ID NO: 71039 - DNA, 21 bp, Homo sapiens
tcactgagttgctggaaagat

SEQ ID NO: 71040 - DNA, 22 bp, Homo sapiens
cactgagtccaaagaggttgtt

SEQ ID NO: 71041 - DNA, 19 bp, Homo sapiens
gcctcttcaagagattgtt

SEQ ID NO: 71042 - DNA, 20 bp, Homo sapiens
cacatcttcaaaagattgtt

SEQ ID NO: 71043 - DNA, 24 bp, Homo sapiens
cactgggaagacaagaagattgtt

SEQ ID NO: 71044 - DNA, 20 bp, Homo sapiens
tcattgattttccaaaacat

SEQ ID NO: 71045 - DNA, 66 bp, Human papillomavirus type 32
ggttgacctgtattgttatgaacaatttgacacctcagatgaagatgatgaagacgatgaccaacc

SEQ ID NO: 71046 - DNA, 24 bp, Human papillomavirus type 32
tgaagatgatgaagacgatgacca

SEQ ID NO: 71047 - DNA, 20 bp, Homo sapiens
tgaagatggtggggaaggat

SEQ ID NO: 71048 - DNA, 22 bp, Homo sapiens
tgaggatgatgatgtaggacca

SEQ ID NO: 71049 - DNA, 21 bp, Homo sapiens
gatgatgaaggaacaaggcca

SEQ ID NO: 71050 - DNA, 19 bp, Homo sapiens
tgaggatgaagaagaggat

SEQ ID NO: 71051 - DNA, 18 bp, Homo sapiens
taaagatgatggagaaga

SEQ ID NO: 71052 - DNA, 25 bp, Homo sapiens
tgaagaggatgaggaggagaggcca

SEQ ID NO: 71053 - DNA, 23 bp, Homo sapiens
tggagggtggtgaagaacaacca

SEQ ID NO: 71054 - DNA, 25 bp, Homo sapiens
tgagggtgctgaagacagaggtgac

SEQ ID NO: 71055 - DNA, 17 bp, Homo sapiens
tgaggatgataaggcga

SEQ ID NO: 71056 - DNA, 21 bp, Homo sapiens
tggggatgataaagacagcca

SEQ ID NO: 71057 - DNA, 18 bp, Homo sapiens
tgaagatgatgatgatga

SEQ ID NO: 71058 - DNA, 20 bp, Homo sapiens
gaagatgatggaatacagac

SEQ ID NO: 71059 - DNA, 20 bp, Homo sapiens
tgaggatgatgaagcaaatg

SEQ ID NO: 71060 - DNA, 24 bp, Homo sapiens
tgaagatgtggagaagttcggctg

SEQ ID NO: 71061 - DNA, 25 bp, Homo sapiens
tgaaatgatgaaggcaatctggcca

SEQ ID NO: 71062 - DNA, 15 bp, Homo sapiens
taaagatgatggatg

SEQ ID NO: 71063 - DNA, 22 bp, Homo sapiens
tgagatggtgacctgatgacca

SEQ ID NO: 71064 - DNA, 26 bp, Homo sapiens
tgaagatgagtgacagtgtgtggcca

SEQ ID NO: 71065 - DNA, 21 bp, Homo sapiens
taaagatgatggcagtggctg

SEQ ID NO: 71066 - DNA, 23 bp, Homo sapiens
tgagggtggggaagacaattcca

SEQ ID NO: 71067 - DNA, 24 bp, Homo sapiens
tgaggatgatgaagggtatggcca

SEQ ID NO: 71068 - DNA, 19 bp, Homo sapiens
tgaagagatgaagacactg

SEQ ID NO: 71069 - DNA, 20 bp, Homo sapiens
tgaagatgggaggagacaac

SEQ ID NO: 71070 - DNA, 18 bp, Homo sapiens
tgaagatgtgaagggaat

SEQ ID NO: 71071 - DNA, 17 bp, Homo sapiens
tgaaatgatgtgatgac

SEQ ID NO: 71072 - DNA, 19 bp, Homo sapiens
tggggatgatgagaggacc

SEQ ID NO: 71073 - DNA, 19 bp, Homo sapiens
gaagatgatggagccatcg

SEQ ID NO: 71074 - DNA, 23 bp, Homo sapiens
tggagatgatgacaggatgccca

SEQ ID NO: 71075 - DNA, 23 bp, Homo sapiens
aagatgatgagggtagcgtgcca

SEQ ID NO: 71076 - DNA, 19 bp, Homo sapiens
tggggatgatgaggagatg

SEQ ID NO: 71077 - DNA, 19 bp, Homo sapiens
tgaagatacacaagcggtg

SEQ ID NO: 71078 - DNA, 24 bp, Homo sapiens
tggggatgatgagaggaccccgac

SEQ ID NO: 71079 - DNA, 20 bp, Homo sapiens
tgcaggtgatgaagaggatg

SEQ ID NO: 71080 - DNA, 25 bp, Homo sapiens
tgaagatgatggatttgagtgatca

SEQ ID NO: 71081 - DNA, 20 bp, Homo sapiens
tgaggatgatgatgatgatg

SEQ ID NO: 71082 - DNA, 16 bp, Homo sapiens
agatgatgaggcaacc

SEQ ID NO: 71083 - DNA, 19 bp, Homo sapiens
tgaagatgggaggacactg

SEQ ID NO: 71084 - DNA, 20 bp, Homo sapiens
gatgatgatggagataaaca

SEQ ID NO: 71085 - DNA, 23 bp, Homo sapiens
gaccacggtgaagacggtgacca

SEQ ID NO: 71086 - DNA, 19 bp, Homo sapiens
gagaggtggacgacgacca

SEQ ID NO: 71087 - DNA, 75 bp, Human papillomavirus type 38
tggtcatggataggagatgcatcaaatgatcgcatagggcgctcacgaatgcttctagctttttattcagaatca

SEQ ID NO: 71088 - DNA, 24 bp, Human papillomavirus type 38
taggagatgcatcaaatgatcgca

SEQ ID NO: 71089 - DNA, 19 bp, Homo sapiens
agagatgcatcagtgagca

SEQ ID NO: 71090 - DNA, 19 bp, Homo sapiens
taggagatgcactgaaagc

SEQ ID NO: 71091 - DNA, 21 bp, Homo sapiens
taggagatgtgttgttctgca

SEQ ID NO: 71092 - DNA, 21 bp, Homo sapiens
ggagatgcatctgtgcctgca

SEQ ID NO: 71093 - DNA, 18 bp, Homo sapiens
caggagatgcatcagctg

SEQ ID NO: 71094 - DNA, 23 bp, Homo sapiens
taggagatggtcaagggagggca

SEQ ID NO: 71095 - DNA, 117 bp, Fowlpox virus
gtaaatttaataacttttgtatctatggtgaatgtatgaatattattaatttagataaaaaattttgtatttgtaataaaggttacaccggtaataggtgcgacatagtaagtatac

SEQ ID NO: 71096 - DNA, 24 bp, Fowlpox virus
acttttgtatctatggtgaatgta

SEQ ID NO: 71097 - DNA, 16 bp, Homo sapiens
acgtttgtagtgaatg

SEQ ID NO: 71098 - DNA, 18 bp, Homo sapiens
cttttgtatcgtccatgt

SEQ ID NO: 71099 - DNA, 18 bp, Homo sapiens
gtatttagtggtgaatgt

SEQ ID NO: 71100 - DNA, 21 bp, Homo sapiens
ttttttccccaggtgaatgta

SEQ ID NO: 71101 - DNA, 20 bp, Homo sapiens
cttttgtaactatggaacat

SEQ ID NO: 71102 - DNA, 21 bp, Homo sapiens
tcttgtattcaacctgaatgt

SEQ ID NO: 71103 - DNA, 17 bp, Homo sapiens
acttttgttctgtggtg

SEQ ID NO: 71104 - DNA, 19 bp, Homo sapiens
ttcgcactgtggtgaatgt

SEQ ID NO: 71105 - DNA, 19 bp, Homo sapiens
actttttgttgatgaatgt

SEQ ID NO: 71106 - DNA, 23 bp, Homo sapiens
ttttgtactttgatgaagaatgt

SEQ ID NO: 71107 - DNA, 71 bp, Cercopithecine herpesvirus 7
gtacgtatactattgatttacttgtatttgttttcatatagagcttttatagtaattaatattacatttac

SEQ ID NO: 71108 - DNA, 24 bp, Cercopithecine herpesvirus 7
tatactattgatttacttgtattt

SEQ ID NO: 71109 - DNA, 26 bp, Homo sapiens
tatacctatatattttacttgtattt

SEQ ID NO: 71110 - DNA, 21 bp, Homo sapiens
tactattcaagacttgtattt

SEQ ID NO: 71111 - DNA, 18 bp, Homo sapiens
tatactattgaatttgta

SEQ ID NO: 71112 - DNA, 19 bp, Homo sapiens
ctctcctttacttgtattt

SEQ ID NO: 71113 - DNA, 18 bp, Homo sapiens
catactatgacttgtatt

SEQ ID NO: 71114 - DNA, 18 bp, Homo sapiens
attgatttatttgtattt

SEQ ID NO: 71115 - DNA, 115 bp, Cercopithecine herpesvirus 7
gtgttacttgtgattttcatacaacatactgttattataatgtgaatttatagttgaacctcattggctgtgttttcaaaaagtctaatattagttcataaagttactttaatat

SEQ ID NO: 71116 - DNA, 24 bp, Cercopithecine herpesvirus 7
cttgtgattttcatacaacatact

SEQ ID NO: 71117 - DNA, 20 bp, Homo sapiens
tgtgcagtgtacaacatact

SEQ ID NO: 71118 - DNA, 19 bp, Homo sapiens
ttgtgatatatgacatact

SEQ ID NO: 71119 - DNA, 17 bp, Homo sapiens
ttgtgatgtacaacata

SEQ ID NO: 71120 - DNA, 18 bp, Homo sapiens
ttgtgatttttgcacgac

SEQ ID NO: 71121 - DNA, 20 bp, Homo sapiens
ctggtgtatttatacaacat

SEQ ID NO: 71122 - DNA, 74 bp, Human herpesvirus 6
ttgcatacgttcatcattggatcccatgttgtttccagagggttttgctggctccattgtatattaagatgcaa

SEQ ID NO: 71123 - DNA, 24 bp, Human herpesvirus 6
ttttgctggctccattgtatatta

SEQ ID NO: 71124 - DNA, 18 bp, Homo sapiens
ttttgctgatttccctgt

SEQ ID NO: 71125 - DNA, 22 bp, Homo sapiens
ttttctggctgagcatatatta

SEQ ID NO: 71126 - DNA, 25 bp, Homo sapiens
ttttgctgtcttcataaataaatta

SEQ ID NO: 71127 - DNA, 21 bp, Homo sapiens
ttttgctggcctgttcccatt

SEQ ID NO: 71128 - DNA, 18 bp, Homo sapiens
ttgctggctccattgcat

SEQ ID NO: 71129 - DNA, 18 bp, Homo sapiens
ttttgctgattcctttgt

SEQ ID NO: 71130 - DNA, 83 bp, Melanoplus sanguinipes entomopoxvirus
acatctcaataaaaaaatgtaatataatatttatatcattttgtgacattattgaattatcatttatattttttttagcatgt

SEQ ID NO: 71131 - DNA, 24 bp, Melanoplus sanguinipes entomopoxvirus
aatgtaatataatatttatatcat

SEQ ID NO: 71132 - DNA, 24 bp, Homo sapiens
aatgtaggctgaaatttatatcat

SEQ ID NO: 71133 - DNA, 25 bp, Homo sapiens
aatgtaataaaacataagatatcat

SEQ ID NO: 71134 - DNA, 17 bp, Homo sapiens
gcaaaatatttatatca

SEQ ID NO: 71135 - DNA, 21 bp, Homo sapiens
tgtaatataaatatttacacc

SEQ ID NO: 71136 - DNA, 19 bp, Homo sapiens
aatgcaatgtaatattcac

SEQ ID NO: 71137 - DNA, 88 bp, Melanoplus sanguinipes entomopoxvirus
atgttttttttaatttttctatttcatacatataaattgatcgatctttattgactttattaatgaataaataaattaattcaaatat

SEQ ID NO: 71138 - DNA, 24 bp, Melanoplus sanguinipes entomopoxvirus
ttaatgaataaataaattaattca

SEQ ID NO: 71139 - DNA, 19 bp, Homo sapiens
tcaatgaataaatgaacta

SEQ ID NO: 71140 - DNA, 22 bp, Homo sapiens
ttaatgaatgaataaacctatt

SEQ ID NO: 71141 - DNA, 19 bp, Homo sapiens
gaatagataaattaattca

SEQ ID NO: 71142 - DNA, 116 bp, Rat cytomegalovirus
ccgtcccccgccccgccgccctccccgtcgccgcctccccgccctctctacctgtccgcgggtaccgaggaggccggggacgcccccggggaagaccgagccgacggaggagacgg

SEQ ID NO: 71143 - DNA, 24 bp, Rat cytomegalovirus
taccgaggaggccggggacgcccc

SEQ ID NO: 71144 - DNA, 21 bp, Homo sapiens
cgtcccggccggggacgcccc

SEQ ID NO: 71145 - DNA, 18 bp, Homo sapiens
ccgaggaggctccgctcc

SEQ ID NO: 71146 - DNA, 24 bp, Homo sapiens
ccgaggggcagccaggggcgctcc

SEQ ID NO: 71147 - DNA, 21 bp, Homo sapiens
cgaggaggtctaggaggcgcc

SEQ ID NO: 71148 - DNA, 16 bp, Homo sapiens
ggagcaaggacgcccc

SEQ ID NO: 71149 - DNA, 17 bp, Homo sapiens
ccgaggagcgggcgccc

SEQ ID NO: 71150 - DNA, 20 bp, Homo sapiens
ccgaggaggccggggcagcc

SEQ ID NO: 71151 - DNA, 20 bp, Homo sapiens
caccgaggaggccccgctcc

SEQ ID NO: 71152 - DNA, 24 bp, Homo sapiens
ccgggggggccaggccgacgttcc

SEQ ID NO: 71153 - DNA, 18 bp, Homo sapiens
gaggagccaaggtgtccc

SEQ ID NO: 71154 - DNA, 21 bp, Homo sapiens
ccgggccgggccgggggcgcc

SEQ ID NO: 71155 - DNA, 22 bp, Homo sapiens
gaggagttcctggacgtgctcc

SEQ ID NO: 71156 - DNA, 19 bp, Homo sapiens
ccggggaagccactgcccc

SEQ ID NO: 71157 - DNA, 22 bp, Homo sapiens
cgaggacgggctgggggtgtcc

SEQ ID NO: 71158 - DNA, 20 bp, Homo sapiens
gaggaggctgactcaacccc

SEQ ID NO: 71159 - DNA, 18 bp, Homo sapiens
gaggagaatggacgcccc

SEQ ID NO: 71160 - DNA, 17 bp, Homo sapiens
ccgggaaggccaggccc

SEQ ID NO: 71161 - DNA, 18 bp, Homo sapiens
agacatcggggacgctcc

SEQ ID NO: 71162 - DNA, 22 bp, Homo sapiens
tactgaggagccaggagtgtcc

SEQ ID NO: 71163 - DNA, 21 bp, Homo sapiens
cggggaggctggggacgcccc

SEQ ID NO: 71164 - DNA, 18 bp, Homo sapiens
cgaggaggccgtatcgcc

SEQ ID NO: 71165 - DNA, 25 bp, Homo sapiens
tactggggaggccgcctcggggcgc

SEQ ID NO: 71166 - DNA, 18 bp, Homo sapiens
cgaggaggccggaatcac

SEQ ID NO: 71167 - DNA, 20 bp, Homo sapiens
ccgggaagccaaggtgcccc

SEQ ID NO: 71168 - DNA, 18 bp, Homo sapiens
gaggggccggggcgcccc

SEQ ID NO: 71169 - DNA, 20 bp, Homo sapiens
ccaaggaacacggggtgccc

SEQ ID NO: 71170 - DNA, 19 bp, Homo sapiens
aggaggccacaggagcgcc

SEQ ID NO: 71171 - DNA, 21 bp, Homo sapiens
cctggggagctcagacgcccc

SEQ ID NO: 71172 - DNA, 24 bp, Homo sapiens
taccaagggggttgagtctgtgcc

SEQ ID NO: 71173 - DNA, 18 bp, Homo sapiens
cggggaggccgggcagcc

SEQ ID NO: 71174 - DNA, 21 bp, Homo sapiens
caccgaggctccgggggtgcc

SEQ ID NO: 71175 - DNA, 19 bp, Homo sapiens
gaggaggctggagaggtcc

SEQ ID NO: 71176 - DNA, 18 bp, Homo sapiens
gaggactgaggacgcccc

SEQ ID NO: 71177 - DNA, 17 bp, Homo sapiens
ccaggaggccggggaca

SEQ ID NO: 71178 - DNA, 18 bp, Homo sapiens
ccgaggaggccgggggac

SEQ ID NO: 71179 - DNA, 17 bp, Homo sapiens
ccggggagggggcgccc

SEQ ID NO: 71180 - DNA, 21 bp, Homo sapiens
ccgggggcggtggggtgtccc

SEQ ID NO: 71181 - DNA, 19 bp, Homo sapiens
cgaggaggttgaaggtccc

SEQ ID NO: 71182 - DNA, 20 bp, Homo sapiens
ccgaggggtccggacgcccc

SEQ ID NO: 71183 - DNA, 19 bp, Homo sapiens
cccggccacccggggacgc

SEQ ID NO: 71184 - DNA, 22 bp, Homo sapiens
ccgaggagcctgtgccagtccc

SEQ ID NO: 71185 - DNA, 17 bp, Homo sapiens
gaggagcttgacacccc

SEQ ID NO: 71186 - DNA, 21 bp, Homo sapiens
ccgaggaggccgggtggcccc

SEQ ID NO: 71187 - DNA, 19 bp, Homo sapiens
ccgaggaggccgggtggcc

SEQ ID NO: 71188 - DNA, 91 bp, Molluscum contagiosum virus
gccacagggtgtcgctcacgtagtcgccgcgcgccagcagcagcgttccgcggcgcgcgcgtggcgcctcgtcggcgcgcgcctgcacggc

SEQ ID NO: 71189 - DNA, 24 bp, Molluscum contagiosum virus
tcacgtagtcgccgcgcgccagca

SEQ ID NO: 71190 - DNA, 18 bp, Homo sapiens
tcacgtagccgctgggcg

SEQ ID NO: 71191 - DNA, 21 bp, Homo sapiens
cgcggcggggccgcgcgtcag

SEQ ID NO: 71192 - DNA, 20 bp, Homo sapiens
caagtcgtgcgcgcgccggc

SEQ ID NO: 71193 - DNA, 19 bp, Homo sapiens
catgcaaccgcgtgtcagc

SEQ ID NO: 71194 - DNA, 19 bp, Homo sapiens
cgcgcgcccgcgcgctggc

SEQ ID NO: 71195 - DNA, 19 bp, Homo sapiens
gtgctgcagtgcgccagca

SEQ ID NO: 71196 - DNA, 18 bp, Homo sapiens
gtagtcgctgctcaagca

SEQ ID NO: 71197 - DNA, 16 bp, Homo sapiens
tctcgtagtcggccag

SEQ ID NO: 71198 - DNA, 71 bp, Caprine arthritis-encephalitis virus
gatacatggcaatggacaagcatcagagtacctgcggaaatactgcaaagatggcttgctatgcttaggtc

SEQ ID NO: 71199 - DNA, 24 bp, Caprine arthritis-encephalitis virus
catggcaatggacaagcatcagag

SEQ ID NO: 71200 - DNA, 20 bp, Homo sapiens
tggcaatgggtggggcccag

SEQ ID NO: 71201 - DNA, 19 bp, Homo sapiens
tggagggaaggcatcagag

SEQ ID NO: 71202 - DNA, 19 bp, Homo sapiens
ggcagaagtagcatcagag

SEQ ID NO: 71203 - DNA, 24 bp, Homo sapiens
tgggtgagtggccaagcatcagag

SEQ ID NO: 71204 - DNA, 24 bp, Homo sapiens
catggcagctggctttcatcagag

SEQ ID NO: 71205 - DNA, 16 bp, Homo sapiens
tggcaaaggcatcaga

SEQ ID NO: 71206 - DNA, 21 bp, Homo sapiens
tgggaaagcagggcatcagag

SEQ ID NO: 71207 - DNA, 21 bp, Homo sapiens
tgggaggggtgagcatcagag

SEQ ID NO: 71208 - DNA, 25 bp, Homo sapiens
catggcaagtgctgctacatcagag

SEQ ID NO: 71209 - DNA, 19 bp, Homo sapiens
atggcaatggaaaggtttc

SEQ ID NO: 71210 - DNA, 17 bp, Homo sapiens
catggcagcagcatcag

SEQ ID NO: 71211 - DNA, 19 bp, Homo sapiens
tggcaatggacagcaggag

SEQ ID NO: 71212 - DNA, 17 bp, Homo sapiens
atggcaacggtgtcaga

SEQ ID NO: 71213 - DNA, 18 bp, Homo sapiens
catggcaatgggacccag

SEQ ID NO: 71214 - DNA, 19 bp, Homo sapiens
ggcatcagaagcattagag

SEQ ID NO: 71215 - DNA, 19 bp, Homo sapiens
tggtgggcaggcatcagag

SEQ ID NO: 71216 - DNA, 67 bp, Equine arteritis virus
caggagcgcgccaccctttcgtcgaacgtacaacggttcttcatgattgggcatggttcactcactg

SEQ ID NO: 71217 - DNA, 24 bp, Equine arteritis virus
ttcatgattgggcatggttcactc

SEQ ID NO: 71218 - DNA, 20 bp, Homo sapiens
ttctggtggaatggttcact

SEQ ID NO: 71219 - DNA, 24 bp, Homo sapiens
ttcacgaagcttgatggttcattc

SEQ ID NO: 71220 - DNA, 21 bp, Homo sapiens
ttcataattgaaagttcactc

SEQ ID NO: 71221 - DNA, 23 bp, Homo sapiens
ttcatggttgggcacggtggctc

SEQ ID NO: 71222 - DNA, 16 bp, Homo sapiens
ttcatgattgggggtt

SEQ ID NO: 71223 - DNA, 19 bp, Homo sapiens
atgatttgggtatatgatc

SEQ ID NO: 71224 - DNA, 18 bp, Homo sapiens
tgatagggcatgaagacc

SEQ ID NO: 71225 - DNA, 19 bp, Homo sapiens
ttcatggcttgacagttca

SEQ ID NO: 71226 - DNA, 24 bp, Homo sapiens
ctcatgatttatcctggtttactc

SEQ ID NO: 71227 - DNA, 19 bp, Homo sapiens
ttcatagtaatggttcact

SEQ ID NO: 71228 - DNA, 22 bp, Homo sapiens
ctcagcatggtgtggttcattc

SEQ ID NO: 71229 - DNA, 18 bp, Homo sapiens
ttcatgatttggctctct

SEQ ID NO: 71230 - DNA, 76 bp, Bovine immunodeficiency virus
gaggcactggctcggttgggtagccagcctttcgggtaataaaggcttgttggcattcggcatctacccgtgcctc

SEQ ID NO: 71231 - DNA, 23 bp, Bovine immunodeficiency virus
cattcggcatctacccgtgcctc

SEQ ID NO: 71232 - DNA, 20 bp, Homo sapiens
cactcagtttacctgtgcct

SEQ ID NO: 71233 - DNA, 20 bp, Homo sapiens
catccggcctccagcttgtg

SEQ ID NO: 71234 - DNA, 25 bp, Homo sapiens
cactcggcaaacaagcctgtgcctc

SEQ ID NO: 71235 - DNA, 16 bp, Homo sapiens
ggcatccactacactc

SEQ ID NO: 71236 - DNA, 17 bp, Homo sapiens
cattggtccccgtgcct

SEQ ID NO: 71237 - DNA, 69 bp, Vaccinia virus
atgaagttaatgatacacactacactgtcgaatttgatagggacaaagtagttgacacgtttatttcat

SEQ ID NO: 71238 - DNA, 73 bp, Transmissible gastroenteritis virus
tcgaactaaacgaaatatttgtctttctatgaaatcatagaggacaagcgttgattatttccattcagtttgg

SEQ ID NO: 71239 - DNA, 24 bp, Transmissible gastroenteritis virus
ggacaagcgttgattatttccatt

SEQ ID NO: 71240 - DNA, 19 bp, Homo sapiens
ggacaagccttgctttatt

SEQ ID NO: 71241 - DNA, 24 bp, Homo sapiens
ggagagttggaatttatttccatt

SEQ ID NO: 71242 - DNA, 19 bp, Homo sapiens
ggccaatgtagattatttc

SEQ ID NO: 71243 - DNA, 21 bp, Homo sapiens
ggcaggtaggacatttccatt

SEQ ID NO: 71244 - DNA, 24 bp, Homo sapiens
ggacggagtgtgctgctttccatt

SEQ ID NO: 71245 - DNA, 16 bp, Homo sapiens
ggtaagcactatttcc

SEQ ID NO: 71246 - DNA, 20 bp, Homo sapiens
ggacgggcgctgattggccc

SEQ ID NO: 71247 - DNA, 19 bp, Homo sapiens
ggacaagctttgctttatt

SEQ ID NO: 71248 - DNA, 22 bp, Homo sapiens
ggcaagtgtggaattttccatt

SEQ ID NO: 71249 - DNA, 68 bp, Hepatitis GB virus C
gggttaacgcctgatggtgctaatgcactgccgcttcggcggcgggtcgctaccttatagcgtaatcc

SEQ ID NO: 71250 - DNA, 18 bp, Hepatitis GB virus C
taccttatagcgtaatcc

SEQ ID NO: 71251 - DNA, 18 bp, Homo sapiens
taccctatactccaatcc

SEQ ID NO: 71252 - DNA, 18 bp, Homo sapiens
taccttatttaataatcc

SEQ ID NO: 71253 - DNA, 19 bp, Homo sapiens
taccttacaggtgtgatcc

SEQ ID NO: 71254 - DNA, 19 bp, Homo sapiens
ccttataaagcactaatcc

SEQ ID NO: 71255 - DNA, 15 bp, Homo sapiens
tacctcatgtaatcc

SEQ ID NO: 71256 - DNA, 18 bp, Homo sapiens
taccctatttgctaatcc

SEQ ID NO: 71257 - DNA, 18 bp, Homo sapiens
caccttataaccatatcc

SEQ ID NO: 71258 - DNA, 18 bp, Homo sapiens
cacctggaagcgtaatcc

SEQ ID NO: 71259 - DNA, 17 bp, Homo sapiens
taccttaccacaaatcc

SEQ ID NO: 71260 - DNA, 18 bp, Homo sapiens
caccttatagtgctatcc

SEQ ID NO: 71261 - DNA, 19 bp, Homo sapiens
caccttatgctgcatgtcc

SEQ ID NO: 71262 - DNA, 18 bp, Homo sapiens
tactttacagcaacatcc

SEQ ID NO: 71263 - DNA, 72 bp, Paramecium bursaria Chlorella virus 1
gccgaatattttgtttcgaacggagcagaaacgcctacaccaagagaccactcctgttccccgttcgtcggc

SEQ ID NO: 71264 - DNA, 24 bp, Paramecium bursaria Chlorella virus 1
tattttgtttcgaacggagcagaa

SEQ ID NO: 71265 - DNA, 19 bp, Homo sapiens
ttttgtttttgagacggag

SEQ ID NO: 71266 - DNA, 16 bp, Homo sapiens
tttgtttcggagacag

SEQ ID NO: 71267 - DNA, 17 bp, Homo sapiens
ttttgcttcacagcaga

SEQ ID NO: 71268 - DNA, 20 bp, Homo sapiens
tattttgttttgatacagaa

SEQ ID NO: 71269 - DNA, 18 bp, Homo sapiens
ttttgttttgaaagcaga

SEQ ID NO: 71270 - DNA, 21 bp, Homo sapiens
tattttgtttctgtggcagaa

SEQ ID NO: 71271 - DNA, 18 bp, Homo sapiens
ttttgttttgagacggag

SEQ ID NO: 71272 - DNA, 20 bp, Homo sapiens
ttttgttttgagacagacag

SEQ ID NO: 71273 - DNA, 19 bp, Homo sapiens
tattgtgtttcgaatgcaa

SEQ ID NO: 71274 - DNA, 19 bp, Homo sapiens
ttttgtttctcccaggcag

SEQ ID NO: 71275 - DNA, 18 bp, Homo sapiens
ttttgttttggagacaga

SEQ ID NO: 71276 - DNA, 18 bp, Homo sapiens
ttttgttttgaactgcaa

SEQ ID NO: 71277 - DNA, 21 bp, Homo sapiens
tattttgttctgatacttcag

SEQ ID NO: 71278 - DNA, 19 bp, Homo sapiens
ttttgtttatggaactaga

SEQ ID NO: 71279 - DNA, 23 bp, Homo sapiens
tactttgtctagaatggagtaga

SEQ ID NO: 71280 - DNA, 17 bp, Homo sapiens
attttgttttggaacag

SEQ ID NO: 71281 - DNA, 19 bp, Homo sapiens
tatcttgttatgggagcag

SEQ ID NO: 71282 - DNA, 18 bp, Homo sapiens
ttttgttttgagacagag

SEQ ID NO: 71283 - DNA, 19 bp, Homo sapiens
tattttgttacaggagcag

SEQ ID NO: 71284 - DNA, 17 bp, Homo sapiens
tattctgtttctggcag

SEQ ID NO: 71285 - DNA, 17 bp, Homo sapiens
ttttgttttgaggcaga

SEQ ID NO: 71286 - DNA, 63 bp, Paramecium bursaria Chlorella virus 1
atagaggggtgttttttaaagttactgtatgcgtcacatgtactatacgcgaataccctctat

SEQ ID NO: 71287 - DNA, 23 bp, Paramecium bursaria Chlorella virus 1
tactatacgcgaataccctctat

SEQ ID NO: 71288 - DNA, 17 bp, Homo sapiens
tactatacagaagctct

SEQ ID NO: 71289 - DNA, 16 bp, Homo sapiens
tactacacagccctct

SEQ ID NO: 71290 - DNA, 20 bp, Homo sapiens
tactatacagcttggaccct

SEQ ID NO: 71291 - DNA, 23 bp, Homo sapiens
tacagtgccactgtaccctctat

SEQ ID NO: 71292 - DNA, 69 bp, Human herpesvirus 2
ttgggaggcaaaaagaaagaaaacacccagacgtaggcccgaggaccggccggcgtcctctgtccccga

SEQ ID NO: 71293 - DNA, 24 bp, Human herpesvirus 2
aggcaaaaagaaagaaaacaccca

SEQ ID NO: 71294 - DNA, 21 bp, Homo sapiens
agcaaaaagaaagaatgaaca

SEQ ID NO: 71295 - DNA, 23 bp, Homo sapiens
agatgaaaagaaaaagacaccca

SEQ ID NO: 71296 - DNA, 22 bp, Homo sapiens
aggcaaaaaggggtagaataca

SEQ ID NO: 71297 - DNA, 19 bp, Homo sapiens
aggcaaaaggaaagtgaca

SEQ ID NO: 71298 - DNA, 17 bp, Homo sapiens
aggaagaagaaagaaaa

SEQ ID NO: 71299 - DNA, 20 bp, Homo sapiens
aggcaaaaagataaacaacc

SEQ ID NO: 71300 - DNA, 18 bp, Homo sapiens
agcaaaaagaggtcaccc

SEQ ID NO: 71301 - DNA, 23 bp, Homo sapiens
aggcaaaaggataaatccaccca

SEQ ID NO: 71302 - DNA, 19 bp, Homo sapiens
aggcaaattccaaaacacc

SEQ ID NO: 71303 - DNA, 21 bp, Homo sapiens
aggcaggtgccaaaacaccca

SEQ ID NO: 71304 - DNA, 18 bp, Homo sapiens
aggaaaaaagaaagaaaa

SEQ ID NO: 71305 - DNA, 22 bp, Homo sapiens
agctaagtcacggaaacaccca

SEQ ID NO: 71306 - DNA, 16 bp, Homo sapiens
aggaaagaaagaaaca

SEQ ID NO: 71307 - DNA, 19 bp, Homo sapiens
agggagaaagaactcaccc

SEQ ID NO: 71308 - DNA, 19 bp, Homo sapiens
ggcaaagtagaaaacaacc

SEQ ID NO: 71309 - DNA, 22 bp, Homo sapiens
aggcaaaaggaaacagaagaca

SEQ ID NO: 71310 - DNA, 17 bp, Homo sapiens
ggccaaaagaaagtccc

SEQ ID NO: 71311 - DNA, 21 bp, Homo sapiens
aggatggaagcggaacaccca

SEQ ID NO: 71312 - DNA, 18 bp, Homo sapiens
ggcaaaagaaagtgtcac

SEQ ID NO: 71313 - DNA, 17 bp, Homo sapiens
ggcaggaaagaacaccc

SEQ ID NO: 71314 - DNA, 18 bp, Homo sapiens
aggaaaaagaaagaaaac

SEQ ID NO: 71315 - DNA, 20 bp, Homo sapiens
ggagtcaaagaaagaaagca

SEQ ID NO: 71316 - DNA, 18 bp, Homo sapiens
agggggaaagaaagaaaa

SEQ ID NO: 71317 - DNA, 16 bp, Homo sapiens
ggcaaaaagcaagcac

SEQ ID NO: 71318 - DNA, 19 bp, Homo sapiens
aggcaaaagagaaagtaaa

SEQ ID NO: 71319 - DNA, 19 bp, Homo sapiens
ggcaggaagaaagagaccc

SEQ ID NO: 71320 - DNA, 21 bp, Homo sapiens
ggcaaaaagagagtcttccca

SEQ ID NO: 71321 - DNA, 19 bp, Homo sapiens
aggcagaaagaaaacaacc

SEQ ID NO: 71322 - DNA, 22 bp, Homo sapiens
aggggagaagaaagaaattcca

SEQ ID NO: 71323 - DNA, 21 bp, Homo sapiens
aggcaaaaaaaaggggacgcc

SEQ ID NO: 71324 - DNA, 20 bp, Homo sapiens
ggcaaaaaggaaactgtacc

SEQ ID NO: 71325 - DNA, 20 bp, Homo sapiens
ggcgcggaaagaaagaaacc

SEQ ID NO: 71326 - DNA, 19 bp, Homo sapiens
ggaaaaaaaaaagtgccca

SEQ ID NO: 71327 - DNA, 18 bp, Homo sapiens
ggcaaaagaaagaaagcc

SEQ ID NO: 71328 - DNA, 19 bp, Homo sapiens
aggcaaaagcgaagaagac

SEQ ID NO: 71329 - DNA, 20 bp, Homo sapiens
aagcaaaaggagagagaaaa

SEQ ID NO: 71330 - DNA, 21 bp, Homo sapiens
ggcaaaaataaaggtacgcac

SEQ ID NO: 71331 - DNA, 24 bp, Homo sapiens
agggaaggagagacagaacaccca

SEQ ID NO: 71332 - DNA, 19 bp, Homo sapiens
aggagaaacaggaacaccc

SEQ ID NO: 71333 - DNA, 18 bp, Homo sapiens
aggcaaaaaggaaggccc

SEQ ID NO: 71334 - DNA, 25 bp, Homo sapiens
ggcagagagaaagaaaatgattcca

SEQ ID NO: 71335 - DNA, 18 bp, Homo sapiens
aggaaaaagtgaacaccc

SEQ ID NO: 71336 - DNA, 22 bp, Homo sapiens
aagcaaaaaggttaagcaccca

SEQ ID NO: 71337 - DNA, 22 bp, Homo sapiens
aagcaaaaaacaaaagaaaaca

SEQ ID NO: 71338 - DNA, 20 bp, Homo sapiens
aggaaaaagaaagggaaaca

SEQ ID NO: 71339 - DNA, 20 bp, Homo sapiens
aggcaaaaagcagaaccaac

SEQ ID NO: 71340 - DNA, 17 bp, Homo sapiens
gacaaagagagaaaaca

SEQ ID NO: 71341 - DNA, 23 bp, Homo sapiens
aggcaagaaagagggagtaaccc

SEQ ID NO: 71342 - DNA, 21 bp, Homo sapiens
aggaaaaaaacccaaaacacc

SEQ ID NO: 71343 - DNA, 23 bp, Homo sapiens
agcaaaaaggctatgggcaccca

SEQ ID NO: 71344 - DNA, 20 bp, Homo sapiens
aggctggaaagaaaggaaca

SEQ ID NO: 71345 - DNA, 20 bp, Homo sapiens
aggatggagggaaacaccca

SEQ ID NO: 71346 - DNA, 17 bp, Homo sapiens
ggcaaaaaagatgaccc

SEQ ID NO: 71347 - DNA, 20 bp, Homo sapiens
aggctgaaagaaagaaaaca

SEQ ID NO: 71348 - DNA, 15 bp, Homo sapiens
aggagaaagaaaacc

SEQ ID NO: 71349 - DNA, 23 bp, Homo sapiens
aagcaaaaagtcctgaagcaccc

SEQ ID NO: 71350 - DNA, 22 bp, Homo sapiens
gggaagaaagaaaaccagccca

SEQ ID NO: 71351 - DNA, 18 bp, Homo sapiens
aggctgaaaagaacaccc

SEQ ID NO: 71352 - DNA, 19 bp, Homo sapiens
ggcaaaaaaaaagatcccc

SEQ ID NO: 71353 - DNA, 22 bp, Homo sapiens
aggtgaagaaagagcaaaccca

SEQ ID NO: 71354 - DNA, 18 bp, Homo sapiens
aggcagaaaaaaactcac

SEQ ID NO: 71355 - DNA, 15 bp, Homo sapiens
ggcagaaagaacacc

SEQ ID NO: 71356 - DNA, 23 bp, Homo sapiens
aggcaaaaaaggattcacaccca

SEQ ID NO: 71357 - DNA, 18 bp, Homo sapiens
gggaaaactaaaaacacc

SEQ ID NO: 71358 - DNA, 20 bp, Homo sapiens
aggcaaaagggagatgtacc

SEQ ID NO: 71359 - DNA, 23 bp, Homo sapiens
aggcacaaagaaagacgtctcca

SEQ ID NO: 71360 - DNA, 23 bp, Homo sapiens
gcaaaaaaacctgaaaacactca

SEQ ID NO: 71361 - DNA, 15 bp, Homo sapiens
ggcaaaaagaaagcc

SEQ ID NO: 71362 - DNA, 17 bp, Homo sapiens
ggcaaagaaaggaaaca

SEQ ID NO: 71363 - DNA, 20 bp, Homo sapiens
aggcatgaagaaaaaatacc

SEQ ID NO: 71364 - DNA, 18 bp, Homo sapiens
agcagaaagaaaaagccc

SEQ ID NO: 71365 - DNA, 19 bp, Homo sapiens
aagcttgagggaaacaccc

SEQ ID NO: 71366 - DNA, 24 bp, Homo sapiens
aagcaaaaaggaggaaacaaccca

SEQ ID NO: 71367 - DNA, 19 bp, Homo sapiens
aggcaaaaaaaactgaccc

SEQ ID NO: 71368 - DNA, 21 bp, Homo sapiens
aggcaaaaagaaaagaaaccc

SEQ ID NO: 71369 - DNA, 21 bp, Homo sapiens
ggcaaaaaagggaaacactca

SEQ ID NO: 71370 - DNA, 22 bp, Homo sapiens
ggaaaaaagacaccaataccca

SEQ ID NO: 71371 - DNA, 16 bp, Homo sapiens
aggaaaaaagaaaacc

SEQ ID NO: 71372 - DNA, 21 bp, Homo sapiens
aggcaaaagaaaaggcaaaac

SEQ ID NO: 71373 - DNA, 21 bp, Homo sapiens
ggcaaggactgagaacaccca

SEQ ID NO: 71374 - DNA, 19 bp, Homo sapiens
aggcaggaaaaaaaaaccc

SEQ ID NO: 71375 - DNA, 21 bp, Homo sapiens
ggctctcagggaaaacaccca

SEQ ID NO: 71376 - DNA, 17 bp, Homo sapiens
ggcagaaagagaaaaca

SEQ ID NO: 71377 - DNA, 19 bp, Homo sapiens
aggaaaaaaaagaggcacc

SEQ ID NO: 71378 - DNA, 18 bp, Homo sapiens
ggcaagaaagaagttccc

SEQ ID NO: 71379 - DNA, 23 bp, Homo sapiens
agacaaaaaggtaacttaaacac

SEQ ID NO: 71380 - DNA, 19 bp, Homo sapiens
agtaaaaagaaagggcacc

SEQ ID NO: 71381 - DNA, 20 bp, Homo sapiens
aggcaaaaataagtaaaaca

SEQ ID NO: 71382 - DNA, 24 bp, Homo sapiens
ggcaggaagaaaagaaagtaccca

SEQ ID NO: 71383 - DNA, 25 bp, Homo sapiens
aagcaaaaaggatagaaaatgccca

SEQ ID NO: 71384 - DNA, 18 bp, Homo sapiens
aggcaaagaaaacagtcc

SEQ ID NO: 71385 - DNA, 20 bp, Homo sapiens
aggcaagatgaaaacactca

SEQ ID NO: 71386 - DNA, 22 bp, Homo sapiens
agcttaaaaagaaagaaagcac

SEQ ID NO: 71387 - DNA, 22 bp, Homo sapiens
agctgcctgaagaaaacactca

SEQ ID NO: 71388 - DNA, 19 bp, Homo sapiens
aggtaaagaaaatacaccc

SEQ ID NO: 71389 - DNA, 18 bp, Homo sapiens
aggcaaaaaagaaagaaa

SEQ ID NO: 71390 - DNA, 19 bp, Homo sapiens
aggctagaaagaaggcccc

SEQ ID NO: 71391 - DNA, 17 bp, Homo sapiens
aggcagaaagaaggccc

SEQ ID NO: 71392 - DNA, 19 bp, Homo sapiens
ggcagggaacaaacaccca

SEQ ID NO: 71393 - DNA, 19 bp, Homo sapiens
aggaaaaaaaaaaggcacc

SEQ ID NO: 71394 - DNA, 17 bp, Homo sapiens
gcaaaaaggaaagtcac

SEQ ID NO: 71395 - DNA, 20 bp, Homo sapiens
aggaaagggaaggaaaacac

SEQ ID NO: 71396 - DNA, 24 bp, Homo sapiens
aagcaaaaagagaggagatatcca

SEQ ID NO: 71397 - DNA, 16 bp, Homo sapiens
agggagaaagaaaaca

SEQ ID NO: 71398 - DNA, 19 bp, Homo sapiens
gacagaaagaaaaccaacc

SEQ ID NO: 71399 - DNA, 21 bp, Homo sapiens
aggcaaaagggaaagggacac

SEQ ID NO: 71400 - DNA, 22 bp, Homo sapiens
aggcaaaagggagaatgagcac

SEQ ID NO: 71401 - DNA, 21 bp, Homo sapiens
aggcaaaaggaaagctctcca

SEQ ID NO: 71402 - DNA, 22 bp, Homo sapiens
aggaagaagaaagaggagccca

SEQ ID NO: 71403 - DNA, 21 bp, Homo sapiens
aggcaaaagtgaagacctccc

SEQ ID NO: 71404 - DNA, 21 bp, Homo sapiens
aggcaaaagaggagagtccca

SEQ ID NO: 71405 - DNA, 19 bp, Homo sapiens
aggctgaaaagaaaacacc

SEQ ID NO: 71406 - DNA, 19 bp, Homo sapiens
aaaagagagaaaacatcca

SEQ ID NO: 71407 - DNA, 21 bp, Homo sapiens
acaggaaagaaagagggtacc

SEQ ID NO: 71408 - DNA, 16 bp, Homo sapiens
aggcaagaaaaaaaca

SEQ ID NO: 71409 - DNA, 23 bp, Homo sapiens
agcaaaaagaaggtaggaaaaca

SEQ ID NO: 71410 - DNA, 18 bp, Homo sapiens
aggtaacaagaaagaaaa

SEQ ID NO: 71411 - DNA, 18 bp, Homo sapiens
agacaaaaagaaagaaaa

SEQ ID NO: 71412 - DNA, 16 bp, Homo sapiens
aggcaaagaaagcaac

SEQ ID NO: 71413 - DNA, 21 bp, Homo sapiens
ggcagaaggaaacttcaccca

SEQ ID NO: 71414 - DNA, 20 bp, Homo sapiens
agcttccaggagaacaccca

SEQ ID NO: 71415 - DNA, 20 bp, Homo sapiens
gacttaagagagaaaacacc

SEQ ID NO: 71416 - DNA, 17 bp, Homo sapiens
aggataagaaagacacc

SEQ ID NO: 71417 - DNA, 23 bp, Homo sapiens
gacaagaagaaagaaaaggtcca

SEQ ID NO: 71418 - DNA, 16 bp, Homo sapiens
aggcagaaagaaacac

SEQ ID NO: 71419 - DNA, 23 bp, Homo sapiens
aggaagaggaaagaaatttccca

SEQ ID NO: 71420 - DNA, 23 bp, Homo sapiens
aggcaaagggaggaaaacactca

SEQ ID NO: 71421 - DNA, 23 bp, Homo sapiens
gacaaaggctgtgaaaacactca

SEQ ID NO: 71422 - DNA, 17 bp, Homo sapiens
ggcaaagaaaagaaaca

SEQ ID NO: 71423 - DNA, 18 bp, Homo sapiens
ggcaaaaaagaaggagaa

SEQ ID NO: 71424 - DNA, 20 bp, Homo sapiens
agccaaaaagaagataaaca

SEQ ID NO: 71425 - DNA, 64 bp, Human papillomavirus type 22
taggtgtagaatggtcatatggccagtttgatgatttataaactgcttttttactaacacacta

SEQ ID NO: 71426 - DNA, 24 bp, Human papillomavirus type 22
tgtagaatggtcatatggccagtt

SEQ ID NO: 71427 - DNA, 24 bp, Homo sapiens
tgtagagttgtcatacagagagtt

SEQ ID NO: 71428 - DNA, 21 bp, Homo sapiens
tagggtggtccacagccagtt

SEQ ID NO: 71429 - DNA, 21 bp, Homo sapiens
tgtagaatgtcaatcctagtt

SEQ ID NO: 71430 - DNA, 22 bp, Homo sapiens
tgtagaatgtcatctaaaagtt

SEQ ID NO: 71431 - DNA, 24 bp, Homo sapiens
tgtgggactgtttaatggccagtt

SEQ ID NO: 71432 - DNA, 122 bp, Human herpesvirus 5
tgttgtacatgtgcagaaaaatgtgtaaatacgtgttatttatcccatgcgtcttgtacatagatatatgtttttatatacgctatttatactttatatatccttttgcataaccatagaca

SEQ ID NO: 71433 - DNA, 24 bp, Human herpesvirus 5
catgtgcagaaaaatgtgtaaata

SEQ ID NO: 71434 - DNA, 22 bp, Homo sapiens
atgtgcacaaaaccaaaaaata

SEQ ID NO: 71435 - DNA, 17 bp, Homo sapiens
tgtgagaatgtgtaaat

SEQ ID NO: 71436 - DNA, 22 bp, Homo sapiens
catgtgcacaaggaatcaaata

SEQ ID NO: 71437 - DNA, 18 bp, Homo sapiens
atgtgcagattcatgtgt

SEQ ID NO: 71438 - DNA, 17 bp, Homo sapiens
catgtgcagggaatgtg

SEQ ID NO: 71439 - DNA, 16 bp, Homo sapiens
gtgtaaatgtgtaaat

SEQ ID NO: 71440 - DNA, 23 bp, Homo sapiens
tgtgcgtgtgtggatgtgtaaat

SEQ ID NO: 71441 - DNA, 19 bp, Homo sapiens
atgtgcaggaaagcatctg

SEQ ID NO: 71442 - DNA, 22 bp, Homo sapiens
catgtgcagtggcccataaata

SEQ ID NO: 71443 - DNA, 18 bp, Homo sapiens
atgtacagaagcctaaat

SEQ ID NO: 71444 - DNA, 18 bp, Homo sapiens
atgtgcagaaaggtgggt

SEQ ID NO: 71445 - DNA, 17 bp, Homo sapiens
tatcagatgtgtaaata

SEQ ID NO: 71446 - DNA, 20 bp, Homo sapiens
catgtacagaaaaataccca

SEQ ID NO: 71447 - DNA, 16 bp, Homo sapiens
tgcagaaaggtgaaat

SEQ ID NO: 71448 - DNA, 21 bp, Homo sapiens
catgtgcagaggtaatgaaat

SEQ ID NO: 71449 - DNA, 20 bp, Homo sapiens
catgtgcaaaaagatgagca

SEQ ID NO: 71450 - DNA, 20 bp, Homo sapiens
tgcagaaagatatacgaata

SEQ ID NO: 71451 - DNA, 20 bp, Homo sapiens
gtgcagaaaaataccaagta

SEQ ID NO: 71452 - DNA, 20 bp, Homo sapiens
atgtggaatatatgtaaata

SEQ ID NO: 71453 - DNA, 21 bp, Homo sapiens
tgtgcagagagatgtgaaaat

SEQ ID NO: 71454 - DNA, 25 bp, Homo sapiens
catgtgcagggataagagccaaata

SEQ ID NO: 71455 - DNA, 19 bp, Homo sapiens
catgtgcacaaaaagagta

SEQ ID NO: 71456 - DNA, 21 bp, Homo sapiens
catgtgcatgagaaaagagta

SEQ ID NO: 71457 - DNA, 23 bp, Homo sapiens
taatacattaaaaatgtgtaaat

SEQ ID NO: 71458 - DNA, 21 bp, Homo sapiens
catgtgcacagaaaataggtg

SEQ ID NO: 71459 - DNA, 17 bp, Homo sapiens
catgtgcaaaaggtggc

SEQ ID NO: 71460 - DNA, 17 bp, Homo sapiens
atgtacaaaaaatgtgt

SEQ ID NO: 71461 - DNA, 23 bp, Homo sapiens
atgtgtgtatgtatgtgtaaata

SEQ ID NO: 71462 - DNA, 18 bp, Homo sapiens
catgtgcagaaaaagtgc

SEQ ID NO: 71463 - DNA, 17 bp, Homo sapiens
atgtgcacaaaggtgta

SEQ ID NO: 71464 - DNA, 18 bp, Homo sapiens
atgtgcagaaagtgtaaa

SEQ ID NO: 71465 - DNA, 18 bp, Homo sapiens
tgtgcagaaaaaaaaata

SEQ ID NO: 71466 - DNA, 18 bp, Homo sapiens
atgtgctgtgtgtaaata

SEQ ID NO: 71467 - DNA, 18 bp, Homo sapiens
atgtcagaagaatacgta

SEQ ID NO: 71468 - DNA, 19 bp, Homo sapiens
acgtgcagggaaaacagta

SEQ ID NO: 71469 - DNA, 15 bp, Homo sapiens
catgtacagatgtaa

SEQ ID NO: 71470 - DNA, 23 bp, Homo sapiens
catgtgcaagtgtgagtgtgtaa

SEQ ID NO: 71471 - DNA, 16 bp, Homo sapiens
atgtgggaaaaatggc

SEQ ID NO: 71472 - DNA, 18 bp, Homo sapiens
atatgctagtgtgtaaat

SEQ ID NO: 71473 - DNA, 20 bp, Homo sapiens
atgtacagaaggggatgggt

SEQ ID NO: 71474 - DNA, 21 bp, Homo sapiens
tgtgtcagaaaaactgaggtg

SEQ ID NO: 71475 - DNA, 20 bp, Homo sapiens
tgtacagatttttgtaaata

SEQ ID NO: 71476 - DNA, 17 bp, Homo sapiens
gtgcagaagatctataa

SEQ ID NO: 71477 - DNA, 18 bp, Homo sapiens
atgggcagaaaatggata

SEQ ID NO: 71478 - DNA, 17 bp, Homo sapiens
gtggaagaaatgtgtaa

SEQ ID NO: 71479 - DNA, 18 bp, Homo sapiens
caggtgcagaaaggtgta

SEQ ID NO: 71480 - DNA, 21 bp, Homo sapiens
cataaagttaaaaatgtgtaa

SEQ ID NO: 71481 - DNA, 23 bp, Homo sapiens
catgtgtgtgtgtttgtgtaaat

SEQ ID NO: 71482 - DNA, 20 bp, Homo sapiens
atgtacagaagaacagagta

SEQ ID NO: 71483 - DNA, 21 bp, Homo sapiens
gtgcagaaagaacgagaaata

SEQ ID NO: 71484 - DNA, 21 bp, Homo sapiens
tgttcttataatgtgtaaata

SEQ ID NO: 71485 - DNA, 20 bp, Homo sapiens
gtgcagaaaaatactaagta

SEQ ID NO: 71486 - DNA, 20 bp, Homo sapiens
catgtgcacagaaatggagc

SEQ ID NO: 71487 - DNA, 17 bp, Homo sapiens
catgtgcgggaaatgta

SEQ ID NO: 71488 - DNA, 18 bp, Homo sapiens
catgtgcagaatgtccaa

SEQ ID NO: 71489 - DNA, 82 bp, Camelpox virus
tcttgtttgttccctggagtatgagactagggggtgttaatcttgggaattatttttctaaccttgttggtagcattcaaga

SEQ ID NO: 71490 - DNA, 24 bp, Camelpox virus
tccctggagtatgagactaggggg

SEQ ID NO: 71491 - DNA, 19 bp, Homo sapiens
tctctggagatgagggtgg

SEQ ID NO: 71492 - DNA, 21 bp, Homo sapiens
ctggacttaatctctaggggg

SEQ ID NO: 71493 - DNA, 22 bp, Homo sapiens
tccctggagtctgaggtattgg

SEQ ID NO: 71494 - DNA, 17 bp, Homo sapiens
ccctggagcattggggg

SEQ ID NO: 71495 - DNA, 21 bp, Homo sapiens
tccctggagttgggaagtggg

SEQ ID NO: 71496 - DNA, 22 bp, Homo sapiens
cccggagtgtggtgctgggggg

SEQ ID NO: 71497 - DNA, 19 bp, Homo sapiens
cctggagtggagacttaag

SEQ ID NO: 71498 - DNA, 23 bp, Homo sapiens
tccgtggagtatgggcctcaggg

SEQ ID NO: 71499 - DNA, 20 bp, Homo sapiens
cctggagtgtgattttgggg

SEQ ID NO: 71500 - DNA, 21 bp, Homo sapiens
cccggagccggggctgggggg

SEQ ID NO: 71501 - DNA, 22 bp, Homo sapiens
tccctggagatgggaagtgggg

SEQ ID NO: 71502 - DNA, 18 bp, Homo sapiens
tccctggagttgagcggg

SEQ ID NO: 71503 - DNA, 18 bp, Homo sapiens
tccttggggatgagacag

SEQ ID NO: 71504 - DNA, 18 bp, Homo sapiens
ctgagcaccgctaggggg

SEQ ID NO: 71505 - DNA, 20 bp, Homo sapiens
tccctggggcatgagatggg

SEQ ID NO: 71506 - DNA, 22 bp, Homo sapiens
tccctggagtgtgagggaaagg

SEQ ID NO: 71507 - DNA, 81 bp, Human papillomavirus type 24
gggggtgctaacacattaaaatgttttcgcaacagggcaaagcttagatatagaggacattataaagcatttagcacatct

SEQ ID NO: 71508 - DNA, 21 bp, Human papillomavirus type 24
tataaagcatttagcacatct

SEQ ID NO: 71509 - DNA, 20 bp, Homo sapiens
tataaaacattccttcatct

SEQ ID NO: 71510 - DNA, 18 bp, Homo sapiens
taaagcatttaaacttct

SEQ ID NO: 71511 - DNA, 18 bp, Homo sapiens
taaagagacttagcacat

SEQ ID NO: 71512 - DNA, 21 bp, Homo sapiens
tataaagcatttcattattct

SEQ ID NO: 71513 - DNA, 21 bp, Homo sapiens
tacaaggcacttaatgcacat

SEQ ID NO: 71514 - DNA, 16 bp, Homo sapiens
taaaagcatttcacat

SEQ ID NO: 71515 - DNA, 18 bp, Homo sapiens
tataaagcacttagtaca

SEQ ID NO: 71516 - DNA, 17 bp, Homo sapiens
taaggcactacacatct

SEQ ID NO: 71517 - DNA, 18 bp, Homo sapiens
taaagcattagctcatct

SEQ ID NO: 71518 - DNA, 21 bp, Homo sapiens
tacagggcacctaaagcacat

SEQ ID NO: 71519 - DNA, 23 bp, Homo sapiens
tataaagcactcttcaaacatct

SEQ ID NO: 71520 - DNA, 20 bp, Homo sapiens
tataaaacatttatgaacat

SEQ ID NO: 71521 - DNA, 19 bp, Homo sapiens
tagagcactcacaccatct

SEQ ID NO: 71522 - DNA, 18 bp, Homo sapiens
tacaaagttgacacatct

SEQ ID NO: 71523 - DNA, 17 bp, Homo sapiens
ataaagcattttcatct

SEQ ID NO: 71524 - DNA, 19 bp, Homo sapiens
ataaagtgttctaacacat

SEQ ID NO: 71525 - DNA, 21 bp, Homo sapiens
cataaagcatctagagtatct

SEQ ID NO: 71526 - DNA, 18 bp, Homo sapiens
taaaagcaaataacacat

SEQ ID NO: 71527 - DNA, 19 bp, Homo sapiens
aaagtcatttagcacatct

SEQ ID NO: 71528 - DNA, 18 bp, Homo sapiens
tacaaagcattacaatct

SEQ ID NO: 71529 - DNA, 18 bp, Homo sapiens
tataaagtatttagcaca

SEQ ID NO: 71530 - DNA, 19 bp, Homo sapiens
taaagcattttttccacat

SEQ ID NO: 71531 - DNA, 18 bp, Homo sapiens
cataaattaagcacatct

SEQ ID NO: 71532 - DNA, 16 bp, Homo sapiens
tataaagctagctcat

SEQ ID NO: 71533 - DNA, 19 bp, Homo sapiens
tgaaagcatttcttcatct

SEQ ID NO: 71534 - DNA, 18 bp, Homo sapiens
tataaagcatttacaaca

SEQ ID NO: 71535 - DNA, 20 bp, Homo sapiens
tataaaacaaaggcacgtct

SEQ ID NO: 71536 - DNA, 20 bp, Homo sapiens
tataaaacacttctgcacat

SEQ ID NO: 71537 - DNA, 19 bp, Homo sapiens
tacaaaaataacagcacat

SEQ ID NO: 71538 - DNA, 15 bp, Homo sapiens
tataaagcattcatc

SEQ ID NO: 71539 - DNA, 89 bp, Human papillomavirus type 37
aagagagttgtttttaaaaactatgaaattaccaccaggagttgattggtcactgggtcatttagatgaattgtgaaaacagctttttt

SEQ ID NO: 71540 - DNA, 24 bp, Human papillomavirus type 37
cactgggtcatttagatgaattgt

SEQ ID NO: 71541 - DNA, 21 bp, Homo sapiens
ctgggttaaagaatgaattgt

SEQ ID NO: 71542 - DNA, 16 bp, Homo sapiens
cacgggtcatagaatt

SEQ ID NO: 71543 - DNA, 21 bp, Homo sapiens
ctgggtcattatataaattgt

SEQ ID NO: 71544 - DNA, 22 bp, Homo sapiens
cactaggttatttcaccattgt

SEQ ID NO: 71545 - DNA, 24 bp, Homo sapiens
actgagtcatttaatcttcattgt

SEQ ID NO: 71546 - DNA, 23 bp, Homo sapiens
cactgggttatttgaatgattgt

SEQ ID NO: 71547 - DNA, 18 bp, Homo sapiens
cactgagtcatttacttg

SEQ ID NO: 71548 - DNA, 22 bp, Homo sapiens
cattgggtgatctttgaattgt

SEQ ID NO: 71549 - DNA, 100 bp, Ictalurid herpesvirus 1
ttcgtggactcgaccgtacacctcgagacggtggacgcactcatgcgttacgagggcgtacaaccacccccgttcgacccggtgaacgattcttcccgaa

SEQ ID NO: 71550 - DNA, 24 bp, Ictalurid herpesvirus 1
tcgaccgtacacctcgagacggtg

SEQ ID NO: 71551 - DNA, 20 bp, Homo sapiens
cctcctccctcgagacggtg

SEQ ID NO: 71552 - DNA, 63 bp, Paramecium bursaria Chlorella virus 1
taaacatccctatagtgaaactgattagtacaagagtaaacaggagccctggggtctggttta

SEQ ID NO: 71553 - DNA, 24 bp, Paramecium bursaria Chlorella virus 1
tccctatagtgaaactgattagta

SEQ ID NO: 71554 - DNA, 20 bp, Homo sapiens
tccctatagtgagacgaacc

SEQ ID NO: 71555 - DNA, 17 bp, Homo sapiens
tccaggagctgattagt

SEQ ID NO: 71556 - DNA, 18 bp, Homo sapiens
tccctgtaatgaaactga

SEQ ID NO: 71557 - DNA, 18 bp, Homo sapiens
cctttattactgattagt

SEQ ID NO: 71558 - DNA, 19 bp, Homo sapiens
cctgtagtaaaacttctta

SEQ ID NO: 71559 - DNA, 18 bp, Homo sapiens
tctctatagtaaagtctg

SEQ ID NO: 71560 - DNA, 24 bp, Homo sapiens
tcccaaataactggctgattagta

SEQ ID NO: 71561 - DNA, 21 bp, Homo sapiens
ctagtggtgaaaccaagagta

SEQ ID NO: 71562 - DNA, 18 bp, Homo sapiens
tccctacagtgggacagt

SEQ ID NO: 71563 - DNA, 19 bp, Homo sapiens
tcttcatagtgagattaat

SEQ ID NO: 71564 - DNA, 18 bp, Homo sapiens
tctctatagtagaaacta

SEQ ID NO: 71565 - DNA, 22 bp, Homo sapiens
cccttgtggtctgtgattagta

SEQ ID NO: 71566 - DNA, 105 bp, Gallid herpesvirus 2
tttacagttccattctctcgaacgcaattatgaaataaacacaaaaataaacactattcttaaagcggttctttatttctttaataatcgagcatgaaaggtgaa

SEQ ID NO: 71567 - DNA, 24 bp, Gallid herpesvirus 2
aagcggttctttatttctttaata

SEQ ID NO: 71568 - DNA, 23 bp, Homo sapiens
agttcttttttatttctttaata

SEQ ID NO: 71569 - DNA, 19 bp, Homo sapiens
agtggttcttatttcctta

SEQ ID NO: 71570 - DNA, 19 bp, Homo sapiens
acggcattatttctttaat

SEQ ID NO: 71571 - DNA, 21 bp, Homo sapiens
agcggttcttcaagatttaat

SEQ ID NO: 71572 - DNA, 23 bp, Homo sapiens
aagctttcaattatttctttaat

SEQ ID NO: 71573 - DNA, 21 bp, Homo sapiens
aagtggtctttattcaataat

SEQ ID NO: 71574 - DNA, 16 bp, Homo sapiens
agtggttcttctcttt

SEQ ID NO: 71575 - DNA, 18 bp, Homo sapiens
ggtccactttctttaata

SEQ ID NO: 71576 - DNA, 64 bp, Gallid herpesvirus 2
agtaccgcggcttctataatcagagatgctcgtatctatcttcgtttagaacgacgcgattact

SEQ ID NO: 71577 - DNA, 24 bp, Gallid herpesvirus 2
ccgcggcttctataatcagagatg

SEQ ID NO: 71578 - DNA, 25 bp, Homo sapiens
cctggtataaccataatcggagatg

SEQ ID NO: 71579 - DNA, 17 bp, Homo sapiens
ggctttctgcagagatg

SEQ ID NO: 71580 - DNA, 18 bp, Homo sapiens
ggcttcttagcagagatg

SEQ ID NO: 71581 - DNA, 20 bp, Homo sapiens
cctcggcttctgcctcggag

SEQ ID NO: 71582 - DNA, 22 bp, Homo sapiens
cctggcttctatttactggatg

SEQ ID NO: 71583 - DNA, 18 bp, Homo sapiens
cctggcttctataacaag

SEQ ID NO: 71584 - DNA, 15 bp, Homo sapiens
ggcttcaccagagat

SEQ ID NO: 71585 - DNA, 19 bp, Homo sapiens
ccgcggcctcaccagggat

SEQ ID NO: 71586 - DNA, 130 bp, African swine fever virus
ctgtattaagttagtttctgaataagtaattaatagatagattttagtttatgtaaaaatgttaacatttgttaataagttttagataattactattttagagttactattttagattttaccattttag

SEQ ID NO: 71587 - DNA, 24 bp, African swine fever virus
taagtaattaatagatagatttta

SEQ ID NO: 71588 - DNA, 19 bp, Homo sapiens
taagtaattaatgaatgat

SEQ ID NO: 71589 - DNA, 18 bp, Homo sapiens
gtaattaacagagatccc

SEQ ID NO: 71590 - DNA, 130 bp, Tupaia paramyxovirus
aatgtaagtgtccttttataagattgctcagagtgactgacaaaaatcttttctataacttatagaatatatcaaactgttaaaaatgtctccctattgtaactcttgaattacttatggctattatatt

SEQ ID NO: 71591 - DNA, 24 bp, Tupaia paramyxovirus
tagaatatatcaaactgttaaaaa

SEQ ID NO: 71592 - DNA, 24 bp, Homo sapiens
taagctatagcaaactgttaaaaa

SEQ ID NO: 71593 - DNA, 18 bp, Homo sapiens
taggatataacaaactat

SEQ ID NO: 71594 - DNA, 18 bp, Homo sapiens
tagaatattcaaacagtc

SEQ ID NO: 71595 - DNA, 19 bp, Homo sapiens
tagaatacattgaactgtc

SEQ ID NO: 71596 - DNA, 18 bp, Homo sapiens
taaaatatatcaaattgt

SEQ ID NO: 71597 - DNA, 24 bp, Homo sapiens
taaaatatgtcaaacatggttaaa

SEQ ID NO: 71598 - DNA, 19 bp, Homo sapiens
gaatatatcacaagtaaaa

SEQ ID NO: 71599 - DNA, 20 bp, Homo sapiens
aaatatatcttctctgttaa

SEQ ID NO: 71600 - DNA, 24 bp, Homo sapiens
tagaaagtatcaaaatgtacaaaa

SEQ ID NO: 71601 - DNA, 22 bp, Homo sapiens
agactatacaagctgttaaaaa

SEQ ID NO: 71602 - DNA, 23 bp, Homo sapiens
agaattcccaaagctgttaaaaa

SEQ ID NO: 71603 - DNA, 24 bp, Homo sapiens
taaaatgtatcaaacatctaaaaa

SEQ ID NO: 71604 - DNA, 19 bp, Homo sapiens
gaacgcattcaaactgtta

SEQ ID NO: 71605 - DNA, 15 bp, Homo sapiens
gaatatatcatgtta

SEQ ID NO: 71606 - DNA, 79 bp, Cycas necrotic stunt virus
gacttatccatctgaatgatgcgcgtttattgcacacgcggcgaagctcaagtgcatgtgcattttcttttggtttgtt

SEQ ID NO: 71607 - DNA, 24 bp, Cycas necrotic stunt virus
tgaatgatgcgcgtttattgcaca

SEQ ID NO: 71608 - DNA, 17 bp, Homo sapiens
taaatgatgccattgca

SEQ ID NO: 71609 - DNA, 17 bp, Homo sapiens
tgagtgtgtgcgtctat

SEQ ID NO: 71610 - DNA, 16 bp, Homo sapiens
tgaagatgtcattgca

SEQ ID NO: 71611 - DNA, 21 bp, Homo sapiens
tgaatggtaccttttattgca

SEQ ID NO: 71612 - DNA, 21 bp, Homo sapiens
tgcatgatgcgcggggggcgc

SEQ ID NO: 71613 - DNA, 18 bp, Homo sapiens
tgaatgactgatattgca

SEQ ID NO: 71614 - DNA, 22 bp, Homo sapiens
tgaattattgatttattgcaca

SEQ ID NO: 71615 - DNA, 20 bp, Homo sapiens
taaatgatgccataattgca

SEQ ID NO: 71616 - DNA, 17 bp, Homo sapiens
tggatgtgtgcgcctat

SEQ ID NO: 71617 - DNA, 20 bp, Homo sapiens
tgaatgatgtcggctcggca

SEQ ID NO: 71618 - DNA, 20 bp, Homo sapiens
tgaatgatgttgttagtaca

SEQ ID NO: 71619 - DNA, 75 bp, Hop latent virus
tactcaagtccaggcaagttgaattcccttgagggacactcccgtggtttgcggtttcagccctgggcagtggta

SEQ ID NO: 71620 - DNA, 24 bp, Hop latent virus
tccaggcaagttgaattcccttga

SEQ ID NO: 71621 - DNA, 21 bp, Homo sapiens
tccaggagaactttcccttga

SEQ ID NO: 71622 - DNA, 18 bp, Homo sapiens
tccagacaggttgccttg

SEQ ID NO: 71623 - DNA, 19 bp, Homo sapiens
tccatgcagttttcccttg

SEQ ID NO: 71624 - DNA, 19 bp, Homo sapiens
cacgctcaagttcccttga

SEQ ID NO: 71625 - DNA, 18 bp, Homo sapiens
aggcaagtttataacctt

SEQ ID NO: 71626 - DNA, 23 bp, Homo sapiens
tctaggcaagctttattctttga

SEQ ID NO: 71627 - DNA, 15 bp, Homo sapiens
agcaagttccccttg

SEQ ID NO: 71628 - DNA, 19 bp, Homo sapiens
tccagattaaattcccttg

SEQ ID NO: 71629 - DNA, 19 bp, Homo sapiens
cagaatctgaattcccttg

SEQ ID NO: 71630 - DNA, 18 bp, Homo sapiens
agatcaaaattcccttga

SEQ ID NO: 71631 - DNA, 22 bp, Homo sapiens
cctgggcaatctcttcccttga

SEQ ID NO: 71632 - DNA, 20 bp, Homo sapiens
caggtaggttaactcccttg

SEQ ID NO: 71633 - DNA, 17 bp, Homo sapiens
ggcagtctttcccttga

SEQ ID NO: 71634 - DNA, 19 bp, Homo sapiens
agcagttacattcccttga

SEQ ID NO: 71635 - DNA, 20 bp, Homo sapiens
cccaggcaagtgggctcttg

SEQ ID NO: 71636 - DNA, 23 bp, Homo sapiens
tcgaggacttcggggttcccttg

SEQ ID NO: 71637 - DNA, 19 bp, Homo sapiens
tccagcagctcttcccttg

SEQ ID NO: 71638 - DNA, 18 bp, Homo sapiens
gaccatggattcccttga

SEQ ID NO: 71639 - DNA, 21 bp, Homo sapiens
ggggtagtgacctttcccttg

SEQ ID NO: 71640 - DNA, 67 bp, Human papillomavirus type 6
tgaatctaattgtttaaagtgttttagatataggctaaatgacaaacacagacatttatttgattta

SEQ ID NO: 71641 - DNA, 24 bp, Human papillomavirus type 6
tgacaaacacagacatttatttga

SEQ ID NO: 71642 - DNA, 20 bp, Homo sapiens
acaaacacagatactgttga

SEQ ID NO: 71643 - DNA, 19 bp, Homo sapiens
tgacagacacagggctctg

SEQ ID NO: 71644 - DNA, 21 bp, Homo sapiens
tgatggacacagaccaacact

SEQ ID NO: 71645 - DNA, 18 bp, Homo sapiens
tgacaaccgcagacatct

SEQ ID NO: 71646 - DNA, 18 bp, Homo sapiens
tgacaaacaccagacatt

SEQ ID NO: 71647 - DNA, 21 bp, Homo sapiens
tggcaaaacagacataccttg

SEQ ID NO: 71648 - DNA, 22 bp, Homo sapiens
gacaagtgttcagatttatttg

SEQ ID NO: 71649 - DNA, 17 bp, Homo sapiens
aacaaggcatttatttg

SEQ ID NO: 71650 - DNA, 18 bp, Homo sapiens
tgacagatacaaacattt

SEQ ID NO: 71651 - DNA, 22 bp, Homo sapiens
tgcagacacagacatcatgtga

SEQ ID NO: 71652 - DNA, 19 bp, Homo sapiens
tgataaacacagcatacat

SEQ ID NO: 71653 - DNA, 21 bp, Homo sapiens
gacagatacacaactatttga

SEQ ID NO: 71654 - DNA, 22 bp, Homo sapiens
tgaaaacactgaagtttatttg

SEQ ID NO: 71655 - DNA, 20 bp, Homo sapiens
caaacatgacatcctatttg

SEQ ID NO: 71656 - DNA, 21 bp, Homo sapiens
cagacacagacatttcactga

SEQ ID NO: 71657 - DNA, 23 bp, Homo sapiens
tgacagacccaggcaccatttga

SEQ ID NO: 71658 - DNA, 19 bp, Homo sapiens
aacaaagacatcttccttg

SEQ ID NO: 71659 - DNA, 23 bp, Homo sapiens
tgacaaacacaaacatctactga

SEQ ID NO: 71660 - DNA, 71 bp, Rabbit oral papillomavirus
ccttggctgctacacagcacaatgctaaacaggctattgaaattgtattgtttttggagagtttacagagg

SEQ ID NO: 71661 - DNA, 24 bp, Rabbit oral papillomavirus
cagcacaatgctaaacaggctatt

SEQ ID NO: 71662 - DNA, 18 bp, Homo sapiens
cagcctcccaaacaggct

SEQ ID NO: 71663 - DNA, 18 bp, Homo sapiens
gcacagtgtcaggccacc

SEQ ID NO: 71664 - DNA, 19 bp, Homo sapiens
cagcacaatctgaaaacaa

SEQ ID NO: 71665 - DNA, 15 bp, Homo sapiens
caacacaatgctgcc

SEQ ID NO: 71666 - DNA, 19 bp, Homo sapiens
agcataggctaaacaacca

SEQ ID NO: 71667 - DNA, 18 bp, Homo sapiens
agacaatgctaagtacag

SEQ ID NO: 71668 - DNA, 19 bp, Homo sapiens
cagctacctggtaggctat

SEQ ID NO: 71669 - DNA, 17 bp, Homo sapiens
aatgctaagagcctact

SEQ ID NO: 71670 - DNA, 19 bp, Homo sapiens
agcacaatactggatggct

SEQ ID NO: 71671 - DNA, 18 bp, Homo sapiens
gcacaatgactggacaaa

SEQ ID NO: 71672 - DNA, 23 bp, Homo sapiens
cagcatacagtccacaggctatt

SEQ ID NO: 71673 - DNA, 20 bp, Homo sapiens
cagcacaatactgaacatct

SEQ ID NO: 71674 - DNA, 16 bp, Homo sapiens
cagcacaaagctaggc

SEQ ID NO: 71675 - DNA, 19 bp, Homo sapiens
cagtacaatgctgaaaagc

SEQ ID NO: 71676 - DNA, 18 bp, Homo sapiens
cagtcaccagcaggctat

SEQ ID NO: 71677 - DNA, 16 bp, Homo sapiens
cagcacaatgccaggc

SEQ ID NO: 71678 - DNA, 23 bp, Homo sapiens
cagcagaatgctaagtagttatt

SEQ ID NO: 71679 - DNA, 118 bp, Paramecium bursaria Chlorella virus 1
agtattttcaaaaaaaaaaaaaaaaataaacagggcaccctgccctacaaaactgctatgccgtatttattagggcaccctgcgcaccctgccctgtttattttttttctaaaatatt

SEQ ID NO: 71680 - DNA, 24 bp, Paramecium bursaria Chlorella virus 1
gggcaccctgcgcaccctgccctg

SEQ ID NO: 71681 - DNA, 22 bp, Homo sapiens
gggccttttactgcctgccctg

SEQ ID NO: 71682 - DNA, 21 bp, Homo sapiens
gggccgggcagccctgccctg

SEQ ID NO: 71683 - DNA, 22 bp, Homo sapiens
gggctacgcacaccctgctctg

SEQ ID NO: 71684 - DNA, 23 bp, Homo sapiens
gggcaccccctggccctgccctg

SEQ ID NO: 71685 - DNA, 24 bp, Homo sapiens
ggtatcctgctgccccctgccctg

SEQ ID NO: 71686 - DNA, 18 bp, Homo sapiens
ggacgcccgccctgccct

SEQ ID NO: 71687 - DNA, 18 bp, Homo sapiens
gggcaccctttgcacccc

SEQ ID NO: 71688 - DNA, 20 bp, Homo sapiens
gagcaccctgtgcaggtctg

SEQ ID NO: 71689 - DNA, 22 bp, Homo sapiens
gggacctgcagcccctgccctg

SEQ ID NO: 71690 - DNA, 16 bp, Homo sapiens
aggcacctgccttgcc

SEQ ID NO: 71691 - DNA, 18 bp, Homo sapiens
gggctccctacacctgcc

SEQ ID NO: 71692 - DNA, 18 bp, Homo sapiens
gggcccttgctctgccct

SEQ ID NO: 71693 - DNA, 22 bp, Homo sapiens
gggctgcccagtttctgccctg

SEQ ID NO: 71694 - DNA, 24 bp, Homo sapiens
gggctgctccaacctcctgccctg

SEQ ID NO: 71695 - DNA, 21 bp, Homo sapiens
gggcacgtggatcctgccctg

SEQ ID NO: 71696 - DNA, 17 bp, Homo sapiens
gggacctactctgccct

SEQ ID NO: 71697 - DNA, 22 bp, Homo sapiens
gggagtaggtcaccctgccctg

SEQ ID NO: 71698 - DNA, 24 bp, Homo sapiens
gggcaccctctcagacctgccctg

SEQ ID NO: 71699 - DNA, 21 bp, Homo sapiens
gggtgtctgaggcctgccctg

SEQ ID NO: 71700 - DNA, 21 bp, Homo sapiens
gggccttgggaccctgccctg

SEQ ID NO: 71701 - DNA, 25 bp, Homo sapiens
gggcaccctgggcaccacgtttctg

SEQ ID NO: 71702 - DNA, 18 bp, Homo sapiens
ggccaccctttctgccct

SEQ ID NO: 71703 - DNA, 22 bp, Homo sapiens
gcaccctcgtcctcctgccctg

SEQ ID NO: 71704 - DNA, 19 bp, Homo sapiens
gggcaccctgtccactgcc

SEQ ID NO: 71705 - DNA, 19 bp, Homo sapiens
gggcaccctgttccctcct

SEQ ID NO: 71706 - DNA, 23 bp, Homo sapiens
aggtgctgcgcggctctgccctg

SEQ ID NO: 71707 - DNA, 18 bp, Homo sapiens
ggcaccctgcgctgccct

SEQ ID NO: 71708 - DNA, 21 bp, Homo sapiens
gggcctctgacccctgccctg

SEQ ID NO: 71709 - DNA, 24 bp, Homo sapiens
gggcttcataccagccctgccctg

SEQ ID NO: 71710 - DNA, 21 bp, Homo sapiens
gggcctcctgcccttgccctg

SEQ ID NO: 71711 - DNA, 17 bp, Homo sapiens
gggcggcgtcctgccct

SEQ ID NO: 71712 - DNA, 18 bp, Homo sapiens
gggcctgctccctgccct

SEQ ID NO: 71713 - DNA, 20 bp, Homo sapiens
aggcaccttgtgcagacctg

SEQ ID NO: 71714 - DNA, 21 bp, Homo sapiens
gtccacccccaccctgtcctg

SEQ ID NO: 71715 - DNA, 17 bp, Homo sapiens
gggcacccagcgtgccc

SEQ ID NO: 71716 - DNA, 22 bp, Homo sapiens
ggccaccctggcctctgctctg

SEQ ID NO: 71717 - DNA, 26 bp, Homo sapiens
gggctacccacccccaccctgccctg

SEQ ID NO: 71718 - DNA, 23 bp, Homo sapiens
gggctgtccctgtccctgccctg

SEQ ID NO: 71719 - DNA, 19 bp, Homo sapiens
gacaggctgccctgccctg

SEQ ID NO: 71720 - DNA, 26 bp, Homo sapiens
gggcacccagtcaccattctgtcctg

SEQ ID NO: 71721 - DNA, 16 bp, Homo sapiens
gggcagccctctgccc

SEQ ID NO: 71722 - DNA, 15 bp, Homo sapiens
gggcaccctgctgcc

SEQ ID NO: 71723 - DNA, 20 bp, Homo sapiens
gcccggaccaccctgctctg

SEQ ID NO: 71724 - DNA, 22 bp, Homo sapiens
ggctgcctaggctcctgctctg

SEQ ID NO: 71725 - DNA, 17 bp, Homo sapiens
gggccctgccttgccct

SEQ ID NO: 71726 - DNA, 18 bp, Homo sapiens
gggtccctgtgctgccct

SEQ ID NO: 71727 - DNA, 23 bp, Homo sapiens
gggcagctgagacccctgccctg

SEQ ID NO: 71728 - DNA, 19 bp, Homo sapiens
gggcaccctgggcaccacg

SEQ ID NO: 71729 - DNA, 21 bp, Homo sapiens
gggctctgtgcgtcctgccct

SEQ ID NO: 71730 - DNA, 17 bp, Homo sapiens
gggcaccctgcccgtgc

SEQ ID NO: 71731 - DNA, 23 bp, Homo sapiens
gggccacccgcatctctgccctg

SEQ ID NO: 71732 - DNA, 21 bp, Homo sapiens
gggctctgctattctgccctg

SEQ ID NO: 71733 - DNA, 23 bp, Homo sapiens
ggcattgctcatactctgccctg

SEQ ID NO: 71734 - DNA, 18 bp, Homo sapiens
aggcctgcattctgccct

SEQ ID NO: 71735 - DNA, 20 bp, Homo sapiens
ggtgcctctgccctgccctg

SEQ ID NO: 71736 - DNA, 24 bp, Homo sapiens
gggcctcttctggcctctgccctg

SEQ ID NO: 71737 - DNA, 23 bp, Homo sapiens
aggctgagttgtgctctgccctg

SEQ ID NO: 71738 - DNA, 19 bp, Homo sapiens
gcgtccctgccctgccctg

SEQ ID NO: 71739 - DNA, 24 bp, Homo sapiens
gggcccctggcctgccctgccctg

SEQ ID NO: 71740 - DNA, 21 bp, Homo sapiens
ggccagcgcgtgcaccctgcc

SEQ ID NO: 71741 - DNA, 19 bp, Homo sapiens
gggcattgccttctgccct

SEQ ID NO: 71742 - DNA, 24 bp, Homo sapiens
gggcacccagtgccggggcctctg

SEQ ID NO: 71743 - DNA, 24 bp, Homo sapiens
gggtgctttccgcaccctgctctg

SEQ ID NO: 71744 - DNA, 18 bp, Homo sapiens
ggacaccctctttgccct

SEQ ID NO: 71745 - DNA, 20 bp, Homo sapiens
gggcaccctgcccatctctg

SEQ ID NO: 71746 - DNA, 25 bp, Homo sapiens
gggctgccccaggaaccctgctctg

SEQ ID NO: 71747 - DNA, 18 bp, Homo sapiens
ggacgtcctgcgcatcct

SEQ ID NO: 71748 - DNA, 18 bp, Homo sapiens
gggcaattcctctgccct

SEQ ID NO: 71749 - DNA, 20 bp, Homo sapiens
gggctgccctgtgcattctg

SEQ ID NO: 71750 - DNA, 78 bp, Cherry virus A
gtacttggtcactagagaagtagtgtatgtcttctccaaccttaagagaggttagtttctcttccctggtttaagtac

SEQ ID NO: 71751 - DNA, 24 bp, Cherry virus A
gaggttagtttctcttccctggtt

SEQ ID NO: 71752 - DNA, 19 bp, Homo sapiens
ggtttggtttctcttggtc

SEQ ID NO: 71753 - DNA, 22 bp, Homo sapiens
atcctttttcttttccctggtt

SEQ ID NO: 71754 - DNA, 16 bp, Homo sapiens
gaggtcacttccctgg

SEQ ID NO: 71755 - DNA, 21 bp, Homo sapiens
ggttagtttctcttccttggc

SEQ ID NO: 71756 - DNA, 18 bp, Homo sapiens
ggcgttcttttctctggt

SEQ ID NO: 71757 - DNA, 19 bp, Homo sapiens
gaggatggctttccctggt

SEQ ID NO: 71758 - DNA, 19 bp, Homo sapiens
ggttgttttctcttcagct

SEQ ID NO: 71759 - DNA, 19 bp, Homo sapiens
ggtttgtttgctcttggtt

SEQ ID NO: 71760 - DNA, 79 bp, Human herpesvirus 7
attaagtagagaatagtgtaagcctgtagttactgacaagacttcagacagccctttactcataattttttctcttaat

SEQ ID NO: 71761 - DNA, 24 bp, Human herpesvirus 7
taagtagagaatagtgtaagcctg

SEQ ID NO: 71762 - DNA, 19 bp, Homo sapiens
taagtacggaggcaagcct

SEQ ID NO: 71763 - DNA, 21 bp, Homo sapiens
agtggggaggagctgagcctg

SEQ ID NO: 71764 - DNA, 20 bp, Homo sapiens
aatagagagatgagagtctg

SEQ ID NO: 71765 - DNA, 22 bp, Homo sapiens
aagtggagaacagcagagcctg

SEQ ID NO: 71766 - DNA, 18 bp, Homo sapiens
atagagaaggtgagcctg

SEQ ID NO: 71767 - DNA, 20 bp, Homo sapiens
agtagagagaggagggcctg

SEQ ID NO: 71768 - DNA, 22 bp, Homo sapiens
taagagagaactgacaggcctg

SEQ ID NO: 71769 - DNA, 19 bp, Homo sapiens
aagtagagaatagggatgt

SEQ ID NO: 71770 - DNA, 90 bp, Human herpesvirus 7
gtttctaataatataacccttagaagaattaaaagtaaggtgtgagaaatttacttaaaaagctcttcaaagtcgtcatattgtagaaat

SEQ ID NO: 71771 - DNA, 24 bp, Human herpesvirus 7
aaaaagctcttcaaagtcgtcata

SEQ ID NO: 71772 - DNA, 18 bp, Homo sapiens
aagctcttcaaaggtcgt

SEQ ID NO: 71773 - DNA, 24 bp, Homo sapiens
aaaaaattcttcaaacctttcata

SEQ ID NO: 71774 - DNA, 22 bp, Homo sapiens
aaaaagctcttcaaaaggatca

SEQ ID NO: 71775 - DNA, 19 bp, Homo sapiens
aaaaagcttttcaaaagtc

SEQ ID NO: 71776 - DNA, 18 bp, Homo sapiens
ggaaagctctttcagagc

SEQ ID NO: 71777 - DNA, 15 bp, Homo sapiens
agctcttcagtgcat

SEQ ID NO: 71778 - DNA, 21 bp, Homo sapiens
aaaaagcttctccaatgtcat

SEQ ID NO: 71779 - DNA, 18 bp, Homo sapiens
gcccttcaaatgaccata

SEQ ID NO: 71780 - DNA, 20 bp, Homo sapiens
gctcttcaatagcccacata

SEQ ID NO: 71781 - DNA, 19 bp, Homo sapiens
aaaaggctcctcaaggtca

SEQ ID NO: 71782 - DNA, 18 bp, Homo sapiens
aaaaagctctataatatc

SEQ ID NO: 71783 - DNA, 18 bp, Homo sapiens
aaaaagctcttttgaatc

SEQ ID NO: 71784 - DNA, 18 bp, Homo sapiens
aaaaagccttcagagagc

SEQ ID NO: 71785 - DNA, 19 bp, Homo sapiens
agctcttcaagcagcacat

SEQ ID NO: 71786 - DNA, 21 bp, Homo sapiens
aaaagctctttaaagtcctca

SEQ ID NO: 71787 - DNA, 17 bp, Homo sapiens
aagtcttctaccgtcat

SEQ ID NO: 71788 - DNA, 22 bp, Homo sapiens
ggaaagctcttcagcacacata

SEQ ID NO: 71789 - DNA, 18 bp, Homo sapiens
gctcttcattccaatcat

SEQ ID NO: 71790 - DNA, 20 bp, Homo sapiens
aagcactcgatgtcgtcata

SEQ ID NO: 71791 - DNA, 17 bp, Homo sapiens
aaaaactcttcaagcat

SEQ ID NO: 71792 - DNA, 18 bp, Homo sapiens
aaaaagcttatcaacagc

SEQ ID NO: 71793 - DNA, 22 bp, Homo sapiens
aaaaagctcttgatgtttcata

SEQ ID NO: 71794 - DNA, 18 bp, Homo sapiens
aaaagtttcttcaaagtc

SEQ ID NO: 71795 - DNA, 20 bp, Homo sapiens
ggaaagctctcggggtctca

SEQ ID NO: 71796 - DNA, 22 bp, Homo sapiens
agctcttcaaactgggtgtcgt

SEQ ID NO: 71797 - DNA, 18 bp, Homo sapiens
aaagctctccaaagaggt

SEQ ID NO: 71798 - DNA, 18 bp, Homo sapiens
agctcttcatccatcata

SEQ ID NO: 71799 - DNA, 16 bp, Homo sapiens
aaaagctcttggtcat

SEQ ID NO: 71800 - DNA, 19 bp, Homo sapiens
aaaaagcccttcacgttgt

SEQ ID NO: 71801 - DNA, 18 bp, Homo sapiens
aaaaagttcttcaggatc

SEQ ID NO: 71802 - DNA, 23 bp, Homo sapiens
aaaaagccctttggccctgcata

SEQ ID NO: 71803 - DNA, 17 bp, Homo sapiens
agttcttcaaagtctca

SEQ ID NO: 71804 - DNA, 17 bp, Homo sapiens
aagctctcaacacacat

SEQ ID NO: 71805 - DNA, 20 bp, Homo sapiens
agcccttcaggcactgtcat

SEQ ID NO: 71806 - DNA, 24 bp, Homo sapiens
aaaaaacttttcagaagatccata

SEQ ID NO: 71807 - DNA, 65 bp, Giardia lamblia virus
agcagctggcttcacgcaatttttaggtcaaggaaatttctcctttgcgtagtagcatagctgtt

SEQ ID NO: 71808 - DNA, 20 bp, Giardia lamblia virus
tgcgtagtagcatagctgtt

SEQ ID NO: 71809 - DNA, 18 bp, Homo sapiens
gcagtgcatatagctgtt

SEQ ID NO: 71810 - DNA, 19 bp, Homo sapiens
tgcacagtgcatggctgtt

SEQ ID NO: 71811 - DNA, 27 bp, Homo sapiens
tgcgtagtggtgaagtctgggctgtta

SEQ ID NO: 71812 - DNA, 18 bp, Homo sapiens
tggtagtagcaaggtgtt

SEQ ID NO: 71813 - DNA, 20 bp, Homo sapiens
tgcgtagtaatggaacagtt

SEQ ID NO: 71814 - DNA, 20 bp, Homo sapiens
tgtcacagagcgtagctgtt

SEQ ID NO: 71815 - DNA, 17 bp, Homo sapiens
tgcgtagtaggtagctg

SEQ ID NO: 71816 - DNA, 20 bp, Homo sapiens
tgtgtagtagcacaaaagtt

SEQ ID NO: 71817 - DNA, 17 bp, Homo sapiens
tggtagtattagctgtt

SEQ ID NO: 71818 - DNA, 19 bp, Homo sapiens
tgctttgtaaatagctgtt

SEQ ID NO: 71819 - DNA, 17 bp, Homo sapiens
tgtgtagtagccacctg

SEQ ID NO: 71820 - DNA, 18 bp, Homo sapiens
tggtaggaaccagctgtt

SEQ ID NO: 71821 - DNA, 20 bp, Homo sapiens
tgccgtcttaaatagctgtt

SEQ ID NO: 71822 - DNA, 19 bp, Homo sapiens
tgtgcagagaatagctgtt

SEQ ID NO: 71823 - DNA, 16 bp, Homo sapiens
gcgtagaatagctgtt

SEQ ID NO: 71824 - DNA, 17 bp, Homo sapiens
tgcatgtgttagctgtt

SEQ ID NO: 71825 - DNA, 23 bp, Homo sapiens
tgcttcacaatagcatggctgtt

SEQ ID NO: 71826 - DNA, 18 bp, Homo sapiens
gtgagcaacatggctgtt

SEQ ID NO: 71827 - DNA, 90 bp, Human herpesvirus 2
acgagcggggcctgtttatgggccgggcgtcccgatgagtactgttgtttccgccgcccgaacccccccgcccatcaaccgcctgttcgt

SEQ ID NO: 71828 - DNA, 24 bp, Human herpesvirus 2
tatgggccgggcgtcccgatgagt

SEQ ID NO: 71829 - DNA, 20 bp, Homo sapiens
ggctgggcccagaaatgggt

SEQ ID NO: 71830 - DNA, 93 bp, African swine fever virus
ggattgattgttcataaatatttttatactctgaccaagaaattatttttttattaagccggttatttacgttgttatggaacgcgaaggtcc

SEQ ID NO: 71831 - DNA, 24 bp, African swine fever virus
aagccggttatttacgttgttatg

SEQ ID NO: 71832 - DNA, 20 bp, Homo sapiens
agccagttagacttgttatg

SEQ ID NO: 71833 - DNA, 21 bp, Homo sapiens
gcttgttatgaagttgttatg

SEQ ID NO: 71834 - DNA, 62 bp, Equine herpesvirus 1
actgtttttaccagcgcttcaaactgtagttttgacaaataggttgtttgggggagagcggt

SEQ ID NO: 71835 - DNA, 23 bp, Equine herpesvirus 1
taggttgtttgggggagagcggt

SEQ ID NO: 71836 - DNA, 20 bp, Homo sapiens
ggtttttgggggaggagggt

SEQ ID NO: 71837 - DNA, 20 bp, Homo sapiens
agggttggcaggagagtggt

SEQ ID NO: 71838 - DNA, 20 bp, Homo sapiens
gggtgctgggggagagtggt

SEQ ID NO: 71839 - DNA, 16 bp, Homo sapiens
ggttggtggggggcgg

SEQ ID NO: 71840 - DNA, 20 bp, Homo sapiens
taggttttttgggaattggt

SEQ ID NO: 71841 - DNA, 17 bp, Homo sapiens
ggttgtttgcagagcgg

SEQ ID NO: 71842 - DNA, 16 bp, Homo sapiens
ggctggaggagagtgg

SEQ ID NO: 71843 - DNA, 21 bp, Homo sapiens
ggtggtttgggaagggagggt

SEQ ID NO: 71844 - DNA, 17 bp, Homo sapiens
taggtttttgagggtgg

SEQ ID NO: 71845 - DNA, 19 bp, Homo sapiens
ggtttgtttgggaactggt

SEQ ID NO: 71846 - DNA, 18 bp, Homo sapiens
gattggttggggagtggt

SEQ ID NO: 71847 - DNA, 18 bp, Homo sapiens
ggttgtttggggggtggt

SEQ ID NO: 71848 - DNA, 17 bp, Homo sapiens
ggttgttgggggagagc

SEQ ID NO: 71849 - DNA, 79 bp, Variola virus
tatcttggctgctggatctaaatattttagaacactgtttacaacacctatgataataagagatctagtaactagagta

SEQ ID NO: 71850 - DNA, 24 bp, Variola virus
tgctggatctaaatattttagaac

SEQ ID NO: 71851 - DNA, 20 bp, Homo sapiens
tgctgaatatctgttttaga

SEQ ID NO: 71852 - DNA, 22 bp, Homo sapiens
tgctggacctaggaactagaac

SEQ ID NO: 71853 - DNA, 19 bp, Homo sapiens
ctggatttaaatttcagaa

SEQ ID NO: 71854 - DNA, 19 bp, Homo sapiens
actggatctagactctaga

SEQ ID NO: 71855 - DNA, 18 bp, Homo sapiens
tgctgaatctgggtagaa

SEQ ID NO: 71856 - DNA, 21 bp, Homo sapiens
tgtcagaaaaatattttagaa

SEQ ID NO: 71857 - DNA, 19 bp, Homo sapiens
tgctggattcaagctccag

SEQ ID NO: 71858 - DNA, 17 bp, Homo sapiens
gctggggatattttaga

SEQ ID NO: 71859 - DNA, 23 bp, Homo sapiens
tgctggatttggattcctggaac

SEQ ID NO: 71860 - DNA, 15 bp, Homo sapiens
tggatccaattttag

SEQ ID NO: 71861 - DNA, 21 bp, Homo sapiens
tgctggtctaaggcctctgga

SEQ ID NO: 71862 - DNA, 21 bp, Homo sapiens
tgctggatctaaattttaaga

SEQ ID NO: 71863 - DNA, 18 bp, Homo sapiens
tgttggattaaatacttt

SEQ ID NO: 71864 - DNA, 21 bp, Homo sapiens
tgctgggtctgaatttttcag

SEQ ID NO: 71865 - DNA, 19 bp, Homo sapiens
tgctggtttaattttagaa

SEQ ID NO: 71866 - DNA, 65 bp, Equine herpesvirus 2
gtggctctttgcgtaaaatcttctcacatgattgtagcagaagtgaaaatttgggaagaggccac

SEQ ID NO: 71867 - DNA, 24 bp, Equine herpesvirus 2
tagcagaagtgaaaatttgggaag

SEQ ID NO: 71868 - DNA, 19 bp, Homo sapiens
gcggaagggaaatttaaga

SEQ ID NO: 71869 - DNA, 22 bp, Homo sapiens
tagcagaaggaaatcagaggga

SEQ ID NO: 71870 - DNA, 17 bp, Homo sapiens
gcaaaagtgaaaacagg

SEQ ID NO: 71871 - DNA, 18 bp, Homo sapiens
gcagaatgaaaattcaag

SEQ ID NO: 71872 - DNA, 22 bp, Homo sapiens
tagaggagtgaaaatctctagg

SEQ ID NO: 71873 - DNA, 20 bp, Homo sapiens
acaggagtggggacctggga

SEQ ID NO: 71874 - DNA, 18 bp, Homo sapiens
gcagaagtggagctggaa

SEQ ID NO: 71875 - DNA, 19 bp, Homo sapiens
gcagaagtgaaagctggaa

SEQ ID NO: 71876 - DNA, 17 bp, Homo sapiens
agagacttgatttggga

SEQ ID NO: 71877 - DNA, 22 bp, Homo sapiens
gcagaaagcagagtttgggaag

SEQ ID NO: 71878 - DNA, 18 bp, Homo sapiens
gcagaatgaaaaatcaag

SEQ ID NO: 71879 - DNA, 19 bp, Homo sapiens
acagaaatggagtttggga

SEQ ID NO: 71880 - DNA, 17 bp, Homo sapiens
gcagaagtgggctggga

SEQ ID NO: 71881 - DNA, 16 bp, Homo sapiens
tagcgaagtgaaagga

SEQ ID NO: 71882 - DNA, 25 bp, Homo sapiens
tagcagaagtgagaatctgtaaaag

SEQ ID NO: 71883 - DNA, 20 bp, Homo sapiens
caggggtgaagcccaggaag

SEQ ID NO: 71884 - DNA, 19 bp, Homo sapiens
cagcaggagtggctgggaa

SEQ ID NO: 71885 - DNA, 20 bp, Homo sapiens
gcagagatgaaaacagcaag

SEQ ID NO: 71886 - DNA, 19 bp, Homo sapiens
tagcaggaatgaaaaagaa

SEQ ID NO: 71887 - DNA, 19 bp, Homo sapiens
gcagaagctgagtgggaag

SEQ ID NO: 71888 - DNA, 17 bp, Homo sapiens
agcagaagtgaggaaag

SEQ ID NO: 71889 - DNA, 17 bp, Homo sapiens
gcagaggtgactgggaa

SEQ ID NO: 71890 - DNA, 22 bp, Homo sapiens
gcagaaaagctggtttgggaag

SEQ ID NO: 71891 - DNA, 18 bp, Homo sapiens
gcagaagtaaggattgaa

SEQ ID NO: 71892 - DNA, 17 bp, Homo sapiens
tagagaagtgagatgga

SEQ ID NO: 71893 - DNA, 17 bp, Homo sapiens
agaagtgaggcttggaa

SEQ ID NO: 71894 - DNA, 22 bp, Homo sapiens
cagtagaggtggccccgggaag

SEQ ID NO: 71895 - DNA, 20 bp, Homo sapiens
tagaagaggtgaaggctgag

SEQ ID NO: 71896 - DNA, 17 bp, Homo sapiens
cagaagtggaactgagg

SEQ ID NO: 71897 - DNA, 18 bp, Homo sapiens
agaagtgaggaatatggg

SEQ ID NO: 71898 - DNA, 19 bp, Homo sapiens
gaaggaggggtttgggaag

SEQ ID NO: 71899 - DNA, 22 bp, Homo sapiens
tagcagaagtgaatgccaagga

SEQ ID NO: 71900 - DNA, 19 bp, Homo sapiens
gcggtgatgatttgggaag

SEQ ID NO: 71901 - DNA, 22 bp, Homo sapiens
acaggacttggggtttgggaag

SEQ ID NO: 71902 - DNA, 19 bp, Homo sapiens
tagcagaagtgacgctggg

SEQ ID NO: 71903 - DNA, 18 bp, Homo sapiens
agcagaagtgggagagaa

SEQ ID NO: 71904 - DNA, 24 bp, Homo sapiens
tagcagaagtgaatgaccaatggg

SEQ ID NO: 71905 - DNA, 20 bp, Homo sapiens
cagcaggtgaagatttggga

SEQ ID NO: 71906 - DNA, 15 bp, Homo sapiens
gcagaagtgagagaa

SEQ ID NO: 71907 - DNA, 19 bp, Homo sapiens
gcggaaggtgaagacagga

SEQ ID NO: 71908 - DNA, 19 bp, Homo sapiens
acagaagtgaaagcctgag

SEQ ID NO: 71909 - DNA, 19 bp, Homo sapiens
tagcagaagtagaagtgag

SEQ ID NO: 71910 - DNA, 18 bp, Homo sapiens
gcaacatgagaatttggg

SEQ ID NO: 71911 - DNA, 20 bp, Homo sapiens
gcagaagtgagaaggacggg

SEQ ID NO: 71912 - DNA, 23 bp, Homo sapiens
tagcagaaggaaagaacccagaa

SEQ ID NO: 71913 - DNA, 18 bp, Homo sapiens
gcagagtgaaaatgcgag

SEQ ID NO: 71914 - DNA, 17 bp, Homo sapiens
agcagaagtgaagagaa

SEQ ID NO: 71915 - DNA, 20 bp, Homo sapiens
gaagtgaaaatgaaatgaag

SEQ ID NO: 71916 - DNA, 18 bp, Homo sapiens
tagcagagagtttgggaa

SEQ ID NO: 71917 - DNA, 20 bp, Homo sapiens
gcagaagtgagaagaacgag

SEQ ID NO: 71918 - DNA, 19 bp, Homo sapiens
tagcagaaggagaaagggg

SEQ ID NO: 71919 - DNA, 16 bp, Homo sapiens
gcagaagcgaagggaa

SEQ ID NO: 71920 - DNA, 19 bp, Homo sapiens
gcagatgtaatttgggaag

SEQ ID NO: 71921 - DNA, 17 bp, Homo sapiens
aagtgagatttgggaag

SEQ ID NO: 71922 - DNA, 19 bp, Homo sapiens
gcagaagtgaaagatcgga

SEQ ID NO: 71923 - DNA, 19 bp, Homo sapiens
tagcggaggcgcctgggaa

SEQ ID NO: 71924 - DNA, 19 bp, Homo sapiens
tagcagaattggaaaggga

SEQ ID NO: 71925 - DNA, 21 bp, Homo sapiens
gcagaagtggaaatacactgg

SEQ ID NO: 71926 - DNA, 16 bp, Homo sapiens
gcagaagcctttggga

SEQ ID NO: 71927 - DNA, 17 bp, Homo sapiens
acggaagtgaagccgga

SEQ ID NO: 71928 - DNA, 21 bp, Homo sapiens
gcagaagtgagagaaattggg

SEQ ID NO: 71929 - DNA, 17 bp, Homo sapiens
gcgaaagtgaaaacagg

SEQ ID NO: 71930 - DNA, 98 bp, Foxtail mosaic virus
gctccaccaatactcgccgcagtactctttttcctcacacagccatatctagctaccagacgatccaggtgcgttcggtgcttcgttgtccacggggc

SEQ ID NO: 71931 - DNA, 24 bp, Foxtail mosaic virus
cagtactctttttcctcacacagc

SEQ ID NO: 71932 - DNA, 21 bp, Homo sapiens
tactcttttttaacaaacagc

SEQ ID NO: 71933 - DNA, 21 bp, Homo sapiens
tgatactcccttttcatgcag

SEQ ID NO: 71934 - DNA, 18 bp, Homo sapiens
atgctctttttcgtacag

SEQ ID NO: 71935 - DNA, 19 bp, Homo sapiens
cagtaatctttttccaaac

SEQ ID NO: 71936 - DNA, 19 bp, Homo sapiens
cagtgctctttccactgca

SEQ ID NO: 71937 - DNA, 21 bp, Homo sapiens
agtgcttgttttagcacacag

SEQ ID NO: 71938 - DNA, 20 bp, Homo sapiens
cagtatttttccaaatacag

SEQ ID NO: 71939 - DNA, 22 bp, Homo sapiens
cagatttttttccttacatagc

SEQ ID NO: 71940 - DNA, 23 bp, Homo sapiens
cagtgctccttttcaaagttagc

SEQ ID NO: 71941 - DNA, 18 bp, Homo sapiens
cagtacctttttcctcca

SEQ ID NO: 71942 - DNA, 23 bp, Homo sapiens
cagtctcttcccttctcacacag

SEQ ID NO: 71943 - DNA, 19 bp, Homo sapiens
cagtactctttctcctcac

SEQ ID NO: 71944 - DNA, 20 bp, Homo sapiens
taccaacttcctcatgtagc

SEQ ID NO: 71945 - DNA, 21 bp, Homo sapiens
gctcctctctcctcatatagc

SEQ ID NO: 71946 - DNA, 18 bp, Homo sapiens
agtacttttttcacacag

SEQ ID NO: 71947 - DNA, 16 bp, Homo sapiens
tcttttcccgcacagc

SEQ ID NO: 71948 - DNA, 20 bp, Homo sapiens
gtatttatttttcacacagc

SEQ ID NO: 71949 - DNA, 21 bp, Homo sapiens
cagcacaaagtcctcatacag

SEQ ID NO: 71950 - DNA, 18 bp, Homo sapiens
gtctcttttttccaccag

SEQ ID NO: 71951 - DNA, 23 bp, Homo sapiens
atgctcttaacacatcacacagc

SEQ ID NO: 71952 - DNA, 22 bp, Homo sapiens
cagggccgttttctcacacagc

SEQ ID NO: 71953 - DNA, 18 bp, Homo sapiens
cagggttcttttccacag

SEQ ID NO: 71954 - DNA, 19 bp, Homo sapiens
cagtgctctttctatgcag

SEQ ID NO: 71955 - DNA, 19 bp, Homo sapiens
atacttttttcctatacag

SEQ ID NO: 71956 - DNA, 27 bp, Homo sapiens
cactatttttcctctaccttacacagc

SEQ ID NO: 71957 - DNA, 15 bp, Homo sapiens
agtactcttctcaca

SEQ ID NO: 71958 - DNA, 19 bp, Homo sapiens
cagtagtttttttccccca

SEQ ID NO: 71959 - DNA, 18 bp, Homo sapiens
cagtgtcctttttcctca

SEQ ID NO: 71960 - DNA, 22 bp, Homo sapiens
gtgccttcttcactcacatggc

SEQ ID NO: 71961 - DNA, 18 bp, Homo sapiens
cagtctctttttcctcac

SEQ ID NO: 71962 - DNA, 23 bp, Homo sapiens
gtattagtccattttcacacagc

SEQ ID NO: 71963 - DNA, 21 bp, Homo sapiens
cagtacccttggcctgcacag

SEQ ID NO: 71964 - DNA, 17 bp, Homo sapiens
agtactctcttatacag

SEQ ID NO: 71965 - DNA, 18 bp, Homo sapiens
agttctctttctatacag

SEQ ID NO: 71966 - DNA, 63 bp, Foxtail mosaic virus
tgccacacgtcggtgataacatccactcactaccccacggaggaagttacattgacggtacca

SEQ ID NO: 71967 - DNA, 24 bp, Foxtail mosaic virus
ccacacgtcggtgataacatccac

SEQ ID NO: 71968 - DNA, 20 bp, Homo sapiens
cacaccaacaggatagtatc

SEQ ID NO: 71969 - DNA, 19 bp, Homo sapiens
cagcatggagtaacatcca

SEQ ID NO: 71970 - DNA, 23 bp, Homo sapiens
catgtcttggtgacaaaagcatc

SEQ ID NO: 71971 - DNA, 21 bp, Homo sapiens
cccagaaatgatgacatccac

SEQ ID NO: 71972 - DNA, 16 bp, Homo sapiens
cacacgataacattca

SEQ ID NO: 71973 - DNA, 19 bp, Homo sapiens
ccacatgtctgcatatcca

SEQ ID NO: 71974 - DNA, 22 bp, Homo sapiens
ccactgtctggatgacatccac

SEQ ID NO: 71975 - DNA, 19 bp, Homo sapiens
ccatgtgtagtgataacat

SEQ ID NO: 71976 - DNA, 24 bp, Homo sapiens
ccactcagatatgataacatctac

SEQ ID NO: 71977 - DNA, 22 bp, Homo sapiens
ccacagggcagtgatagcgtcc

SEQ ID NO: 71978 - DNA, 16 bp, Homo sapiens
acatgggtgacatcca

SEQ ID NO: 71979 - DNA, 19 bp, Homo sapiens
ccacactcagagtgacatc

SEQ ID NO: 71980 - DNA, 19 bp, Homo sapiens
acaaaagtgataatgtcca

SEQ ID NO: 71981 - DNA, 21 bp, Homo sapiens
ccacacatcggctctgtccac

SEQ ID NO: 71982 - DNA, 16 bp, Homo sapiens
ccacacattaacatcc

SEQ ID NO: 71983 - DNA, 17 bp, Homo sapiens
ccacacgcaaagcatcc

SEQ ID NO: 71984 - DNA, 65 bp, Macaca mulatta rhadinovirus
ctttatgtccgctcgccctcccagagcgaaagtgagaatggttcctggggcgttttggcgttgag

SEQ ID NO: 71985 - DNA, 24 bp, Macaca mulatta rhadinovirus
agaatggttcctggggcgttttgg

SEQ ID NO: 71986 - DNA, 21 bp, Homo sapiens
gaatggtcctggggaaggtgg

SEQ ID NO: 71987 - DNA, 18 bp, Homo sapiens
atggttccaggggctcgg

SEQ ID NO: 71988 - DNA, 18 bp, Homo sapiens
aggatggttactgggggt

SEQ ID NO: 71989 - DNA, 18 bp, Homo sapiens
agaatgttcctggggtca

SEQ ID NO: 71990 - DNA, 22 bp, Homo sapiens
agaatggtttctggagtccctg

SEQ ID NO: 71991 - DNA, 18 bp, Homo sapiens
aggatgtttcctggggac

SEQ ID NO: 71992 - DNA, 19 bp, Homo sapiens
ggttcctgggagtacatgg

SEQ ID NO: 71993 - DNA, 18 bp, Homo sapiens
aggatggctcctgggtgt

SEQ ID NO: 71994 - DNA, 20 bp, Homo sapiens
agaatggtttttggaggaca

SEQ ID NO: 71995 - DNA, 19 bp, Homo sapiens
aaaatggtttttggttttg

SEQ ID NO: 71996 - DNA, 62 bp, Macaca mulatta rhadinovirus
gtggtttcttgtgcgacgcttcctgtgtaactgcatacaccggggtgtcgccaggaaaccgc

SEQ ID NO: 71997 - DNA, 24 bp, Macaca mulatta rhadinovirus
caccggggtgtcgccaggaaaccg

SEQ ID NO: 71998 - DNA, 22 bp, Homo sapiens
cactcggggcactggggagccg

SEQ ID NO: 71999 - DNA, 17 bp, Homo sapiens
ccggggacgcaggaaac

SEQ ID NO: 72000 - DNA, 20 bp, Homo sapiens
ccggggcggctgggaggccg

SEQ ID NO: 72001 - DNA, 19 bp, Homo sapiens
cctgggtccccaggaaacc

SEQ ID NO: 72002 - DNA, 18 bp, Homo sapiens
ccgaccgccagggagccg

SEQ ID NO: 72003 - DNA, 20 bp, Homo sapiens
ccggggtgaagaggaggccg

SEQ ID NO: 72004 - DNA, 20 bp, Homo sapiens
ccggagtgagccgggggccg

SEQ ID NO: 72005 - DNA, 19 bp, Homo sapiens
caccggggtatggggagcc

SEQ ID NO: 72006 - DNA, 18 bp, Homo sapiens
ggcgttgccaggaagccg

SEQ ID NO: 72007 - DNA, 19 bp, Homo sapiens
caccagggcatcgccagga

SEQ ID NO: 72008 - DNA, 19 bp, Homo sapiens
ccgggggtccctagagccg

SEQ ID NO: 72009 - DNA, 20 bp, Homo sapiens
cctgggtgacaccaggagac

SEQ ID NO: 72010 - DNA, 18 bp, Homo sapiens
caccggagtctcaggagg

SEQ ID NO: 72011 - DNA, 19 bp, Homo sapiens
ggtaagggccgggaaaccg

SEQ ID NO: 72012 - DNA, 15 bp, Homo sapiens
caccgggggcgcagg

SEQ ID NO: 72013 - DNA, 20 bp, Homo sapiens
caccggggtgtcctcgaagg

SEQ ID NO: 72014 - DNA, 22 bp, Homo sapiens
cactgggcgtggctcaggaaac

SEQ ID NO: 72015 - DNA, 19 bp, Homo sapiens
cggggcgtgcgggaggccg

SEQ ID NO: 72016 - DNA, 18 bp, Homo sapiens
cgcggccgccaggaggcc

SEQ ID NO: 72017 - DNA, 23 bp, Homo sapiens
cctaccttgttgccaggaagccg

SEQ ID NO: 72018 - DNA, 18 bp, Homo sapiens
cactggggtgtcgtgagg

SEQ ID NO: 72019 - DNA, 23 bp, Homo sapiens
ggggcgtccccgccggggggccg

SEQ ID NO: 72020 - DNA, 23 bp, Homo sapiens
cactggggtgccgtcccctcccg

SEQ ID NO: 72021 - DNA, 20 bp, Homo sapiens
cacctgggtgcagacgggga

SEQ ID NO: 72022 - DNA, 18 bp, Homo sapiens
ccggggtgtctcccgagg

SEQ ID NO: 72023 - DNA, 24 bp, Homo sapiens
cactgagggtgtcacccgggaccg

SEQ ID NO: 72024 - DNA, 16 bp, Homo sapiens
cggggtgtagccagcc

SEQ ID NO: 72025 - DNA, 17 bp, Homo sapiens
ccggggtgcggggaacc

SEQ ID NO: 72026 - DNA, 24 bp, Homo sapiens
cggggctgtagcggtaggaggccg

SEQ ID NO: 72027 - DNA, 18 bp, Homo sapiens
cgccgggccaggggaccg

SEQ ID NO: 72028 - DNA, 15 bp, Homo sapiens
caccagggtgtcagg

SEQ ID NO: 72029 - DNA, 18 bp, Homo sapiens
ggctcatcgccaggaaac

SEQ ID NO: 72030 - DNA, 21 bp, Homo sapiens
ccagggtgccagacaggaaac

SEQ ID NO: 72031 - DNA, 24 bp, Homo sapiens
accggggtgtcctgggcaggggac

SEQ ID NO: 72032 - DNA, 17 bp, Homo sapiens
accgagctcaggagacc

SEQ ID NO: 72033 - DNA, 20 bp, Homo sapiens
accagggagctgggaggccg

SEQ ID NO: 72034 - DNA, 21 bp, Homo sapiens
accggggtatcaaataaaccg

SEQ ID NO: 72035 - DNA, 60 bp, Porcine epidemic diarrhea virus
gaaattttgtccttccttccggccgcatgttcatgctgctggaagctggcgtggaatttc

SEQ ID NO: 72036 - DNA, 24 bp, Porcine epidemic diarrhea virus
ctgctggaagctggcgtggaattt

SEQ ID NO: 72037 - DNA, 18 bp, Homo sapiens
tgggagctgacagaattt

SEQ ID NO: 72038 - DNA, 16 bp, Homo sapiens
ctgctggagacggaat

SEQ ID NO: 72039 - DNA, 20 bp, Homo sapiens
ctgctggaggctggaggcgg

SEQ ID NO: 72040 - DNA, 21 bp, Homo sapiens
ctgctggaggttatgatcggg

SEQ ID NO: 72041 - DNA, 20 bp, Homo sapiens
gctggaaactggtggaattt

SEQ ID NO: 72042 - DNA, 15 bp, Homo sapiens
ctgctgaagctgtgg

SEQ ID NO: 72043 - DNA, 22 bp, Homo sapiens
tgtaggaggcactttggaattt

SEQ ID NO: 72044 - DNA, 25 bp, Homo sapiens
ctgctggaatctagatttgggattt

SEQ ID NO: 72045 - DNA, 18 bp, Homo sapiens
ctggtgggatgtggaatt

SEQ ID NO: 72046 - DNA, 18 bp, Homo sapiens
ctgctgggagctggctgg

SEQ ID NO: 72047 - DNA, 17 bp, Homo sapiens
ctgctggagctggcgtg

SEQ ID NO: 72048 - DNA, 20 bp, Homo sapiens
ctgtgcctggcgtggaattt

SEQ ID NO: 72049 - DNA, 21 bp, Homo sapiens
ctggaggcagctgtggaattt

SEQ ID NO: 72050 - DNA, 16 bp, Homo sapiens
ctgctagaactgcgtg

SEQ ID NO: 72051 - DNA, 19 bp, Homo sapiens
ctgctggagtgatgggatt

SEQ ID NO: 72052 - DNA, 91 bp, Variola virus
atgatgctggttattacacatgtgttttaatatatatatatatatatatatatatatatgggagtaaagcatataacgtaaccagaattgt

SEQ ID NO: 72053 - DNA, 24 bp, Variola virus
tatatgggagtaaagcatataacg

SEQ ID NO: 72054 - DNA, 19 bp, Homo sapiens
tgatgggagttactataac

SEQ ID NO: 72055 - DNA, 17 bp, Homo sapiens
tatatgggcaaacacat

SEQ ID NO: 72056 - DNA, 78 bp, Triatoma virus
atataaatatacattcatttattgtaaataattatatatatataattttgtttgtttgtaaataatgtgcttttatat

SEQ ID NO: 72057 - DNA, 24 bp, Triatoma virus
tatacattcatttattgtaaataa

SEQ ID NO: 72058 - DNA, 21 bp, Homo sapiens
tgacattcatttattactgta

SEQ ID NO: 72059 - DNA, 18 bp, Homo sapiens
tatacattcattcattgc

SEQ ID NO: 72060 - DNA, 20 bp, Homo sapiens
atacattcatctgtaaataa

SEQ ID NO: 72061 - DNA, 19 bp, Homo sapiens
tacattcatttaaatgtaa

SEQ ID NO: 72062 - DNA, 19 bp, Homo sapiens
attcatttactataaataa

SEQ ID NO: 72063 - DNA, 21 bp, Homo sapiens
tatacatacataccataaata

SEQ ID NO: 72064 - DNA, 18 bp, Homo sapiens
tatacattcattaggcaa

SEQ ID NO: 72065 - DNA, 19 bp, Homo sapiens
tatacatttatttatccta

SEQ ID NO: 72066 - DNA, 24 bp, Homo sapiens
tatacattcattaattctatataa

SEQ ID NO: 72067 - DNA, 20 bp, Homo sapiens
tatacattcattgtcttcta

SEQ ID NO: 72068 - DNA, 22 bp, Homo sapiens
tatacattctttacagattgta

SEQ ID NO: 72069 - DNA, 73 bp, Tupaia herpesvirus
gagatgcagtccttgcatcggcgcgcccgagccgccccccgctcgggccgcgccgcgcaaatgacgcgcgctt

SEQ ID NO: 72070 - DNA, 24 bp, Tupaia herpesvirus
agtccttgcatcggcgcgcccgag

SEQ ID NO: 72071 - DNA, 17 bp, Homo sapiens
gcccttgcagacctgcc

SEQ ID NO: 72072 - DNA, 22 bp, Homo sapiens
gtccttgcagttggtgcctacg

SEQ ID NO: 72073 - DNA, 18 bp, Homo sapiens
gtccttgctgctgctcga

SEQ ID NO: 72074 - DNA, 17 bp, Homo sapiens
gtccctcagcgcgcccg

SEQ ID NO: 72075 - DNA, 16 bp, Homo sapiens
gtcctggacgcgcccg

SEQ ID NO: 72076 - DNA, 21 bp, Homo sapiens
gtccttgcacctcagcccgag

SEQ ID NO: 72077 - DNA, 19 bp, Homo sapiens
agccttgcacggtgcctga

SEQ ID NO: 72078 - DNA, 19 bp, Homo sapiens
agctttgcgccgcgcctga

SEQ ID NO: 72079 - DNA, 25 bp, Homo sapiens
agcccttgtatccattatgctcgag

SEQ ID NO: 72080 - DNA, 20 bp, Homo sapiens
ctgccctcggcgcgcctgag

SEQ ID NO: 72081 - DNA, 24 bp, Homo sapiens
gtccctgctccgtgtgcgcccgag

SEQ ID NO: 72082 - DNA, 16 bp, Homo sapiens
agtcctttcatccccg

SEQ ID NO: 72083 - DNA, 17 bp, Homo sapiens
agtccttgtggccctcg

SEQ ID NO: 72084 - DNA, 66 bp, Newcastle disease virus
cgggtagaagagggatattcagagatcagggcaagtctcccgagtctctgctctctcctctacctg

SEQ ID NO: 72085 - DNA, 24 bp, Newcastle disease virus
agagggatattcagagatcagggc

SEQ ID NO: 72086 - DNA, 26 bp, Homo sapiens
gggggtgttcagagagagattggggc

SEQ ID NO: 72087 - DNA, 19 bp, Homo sapiens
agatgggtgttcacagggg

SEQ ID NO: 72088 - DNA, 20 bp, Homo sapiens
gggatggtcggggatcaggg

SEQ ID NO: 72089 - DNA, 23 bp, Homo sapiens
agagggatgctcaggttactggc

SEQ ID NO: 72090 - DNA, 16 bp, Homo sapiens
agagggatgctcaggg

SEQ ID NO: 72091 - DNA, 18 bp, Homo sapiens
gaggtgttcggatcaggg

SEQ ID NO: 72092 - DNA, 22 bp, Homo sapiens
aagggataagcagggttggggc

SEQ ID NO: 72093 - DNA, 20 bp, Homo sapiens
gagggacatttggaaggggc

SEQ ID NO: 72094 - DNA, 20 bp, Homo sapiens
ggctgcccggagatcagggc

SEQ ID NO: 72095 - DNA, 21 bp, Homo sapiens
aggggatattcacatataggg

SEQ ID NO: 72096 - DNA, 24 bp, Homo sapiens
gagggacattgttccagattgggg

SEQ ID NO: 72097 - DNA, 18 bp, Homo sapiens
agaggagtcggatcaggg

SEQ ID NO: 72098 - DNA, 19 bp, Homo sapiens
agagggagtggaatcaggg

SEQ ID NO: 72099 - DNA, 17 bp, Homo sapiens
agaggggattcagagat

SEQ ID NO: 72100 - DNA, 20 bp, Homo sapiens
gaggggacctcgatcagggc

SEQ ID NO: 72101 - DNA, 19 bp, Homo sapiens
agagggatgtgtcaaaggg

SEQ ID NO: 72102 - DNA, 21 bp, Homo sapiens
gatggatattcaatgcagggc

SEQ ID NO: 72103 - DNA, 15 bp, Homo sapiens
agagggatttcgagg

SEQ ID NO: 72104 - DNA, 18 bp, Homo sapiens
agaagctagagatcaggg

SEQ ID NO: 72105 - DNA, 67 bp, Human adenovirus A
gtaaaaagcgttcaatagttgccacgctttgaccggtcaggcgtgcgcagtcttgaatgctctggac

SEQ ID NO: 72106 - DNA, 24 bp, Human adenovirus A
aagcgttcaatagttgccacgctt

SEQ ID NO: 72107 - DNA, 17 bp, Homo sapiens
gcgtccaagattgtgct

SEQ ID NO: 72108 - DNA, 21 bp, Homo sapiens
aagccttcaatgctaccacac

SEQ ID NO: 72109 - DNA, 23 bp, Homo sapiens
aagcattcaagaacaccacgctt

SEQ ID NO: 72110 - DNA, 19 bp, Homo sapiens
gcgttcaatgaatagtcgc

SEQ ID NO: 72111 - DNA, 64 bp, Human papillomavirus type 13
ttgcaattgttataacagcatatattgtatgtaaatatttgttgtgtgtgtgtatatattgtaa

SEQ ID NO: 72112 - DNA, 24 bp, Human papillomavirus type 13
tttgttgtgtgtgtgtatatattg

SEQ ID NO: 72113 - DNA, 19 bp, Homo sapiens
tttgtgtgtgtgtgtgtat

SEQ ID NO: 72114 - DNA, 21 bp, Homo sapiens
tttgttctgtgtgtgttattg

SEQ ID NO: 72115 - DNA, 23 bp, Homo sapiens
tttatgtgtgtgtgtatatattg

SEQ ID NO: 72116 - DNA, 17 bp, Homo sapiens
tttgtgtgtgtgtgtat

SEQ ID NO: 72117 - DNA, 18 bp, Homo sapiens
tctgcagtgtgtgtgtat

SEQ ID NO: 72118 - DNA, 18 bp, Homo sapiens
tttgtgtgtgtgtgtata

SEQ ID NO: 72119 - DNA, 18 bp, Homo sapiens
tttgtgtgtgtgtgtgta

SEQ ID NO: 72120 - DNA, 89 bp, Human papillomavirus type 21
acgcgcgccagagttggatcacatctcgttgttctaacacgctaaggactcaaggaaatgtaagtctgccaatcgattttggctcgtgt

SEQ ID NO: 72121 - DNA, 24 bp, Human papillomavirus type 21
tcaaggaaatgtaagtctgccaat

SEQ ID NO: 72122 - DNA, 20 bp, Homo sapiens
aaggaaaatgctctgccaat

SEQ ID NO: 72123 - DNA, 16 bp, Homo sapiens
aagaaaatactgccaa

SEQ ID NO: 72124 - DNA, 21 bp, Homo sapiens
tcatgggaagtgactgccaat

SEQ ID NO: 72125 - DNA, 16 bp, Homo sapiens
agggtaagtctgccaa

SEQ ID NO: 72126 - DNA, 19 bp, Homo sapiens
tcaggttctaagtctgtca

SEQ ID NO: 72127 - DNA, 22 bp, Homo sapiens
tcaaggaagctgtaagttccac

SEQ ID NO: 72128 - DNA, 22 bp, Homo sapiens
aggaaatgtgggtttgcgcaat

SEQ ID NO: 72129 - DNA, 19 bp, Homo sapiens
cagggaagtgtaagtcaac

SEQ ID NO: 72130 - DNA, 16 bp, Homo sapiens
tcaaggaaagtatcct

SEQ ID NO: 72131 - DNA, 17 bp, Homo sapiens
aggaagctgtctgccaa

SEQ ID NO: 72132 - DNA, 21 bp, Homo sapiens
cagggaaatgtacagaggcca

SEQ ID NO: 72133 - DNA, 21 bp, Homo sapiens
tcatggaaatgtgatgtgagc

SEQ ID NO: 72134 - DNA, 23 bp, Homo sapiens
cagggaagtcgccatctgccaat

SEQ ID NO: 72135 - DNA, 25 bp, Homo sapiens
tcaaggaagggtgggatttatctgc

SEQ ID NO: 72136 - DNA, 21 bp, Homo sapiens
aagggaatgtcaactgccaat

SEQ ID NO: 72137 - DNA, 18 bp, Homo sapiens
tcaggaaatgacagtctg

SEQ ID NO: 72138 - DNA, 18 bp, Homo sapiens
tcaaggaagtgtttaagt

SEQ ID NO: 72139 - DNA, 21 bp, Homo sapiens
tccaggaagtggcctgccaat

SEQ ID NO: 72140 - DNA, 18 bp, Homo sapiens
aagaaaatgtagccatgc

SEQ ID NO: 72141 - DNA, 19 bp, Homo sapiens
tctgggaagtgactgccaa

SEQ ID NO: 72142 - DNA, 61 bp, Human papillomavirus type 21
gcaaaataccaaccgcgcccgacacataaaggtgagttgtgagccaaatgaggtgagttgt

SEQ ID NO: 72143 - DNA, 22 bp, Human papillomavirus type 21
tgagccaaatgaggtgagttgt

SEQ ID NO: 72144 - DNA, 16 bp, Homo sapiens
tgagccaagtaagctg

SEQ ID NO: 72145 - DNA, 17 bp, Homo sapiens
tgagccaaggggagctg

SEQ ID NO: 72146 - DNA, 20 bp, Homo sapiens
tgattgaatggataaattgt

SEQ ID NO: 72147 - DNA, 21 bp, Homo sapiens
tgggccaaatggagatattgt

SEQ ID NO: 72148 - DNA, 21 bp, Homo sapiens
tgagccggggtgaggtgggtt

SEQ ID NO: 72149 - DNA, 16 bp, Homo sapiens
tgagccagatgagtta

SEQ ID NO: 72150 - DNA, 21 bp, Homo sapiens
gagttgaacaatgtgagttgt

SEQ ID NO: 72151 - DNA, 21 bp, Homo sapiens
tgagtcacatgagacacctgt

SEQ ID NO: 72152 - DNA, 20 bp, Homo sapiens
tgagccaagtgtagcattgt

SEQ ID NO: 72153 - DNA, 18 bp, Homo sapiens
tgagccaaggaggtcaat

SEQ ID NO: 72154 - DNA, 17 bp, Homo sapiens
tggaccaaatggggtcg

SEQ ID NO: 72155 - DNA, 16 bp, Homo sapiens
tgagctagatgagtca

SEQ ID NO: 72156 - DNA, 17 bp, Homo sapiens
tgagcagggctgagttg

SEQ ID NO: 72157 - DNA, 17 bp, Homo sapiens
tgagtccacatgagttg

SEQ ID NO: 72158 - DNA, 21 bp, Homo sapiens
tgagccaagagaatctgttgt

SEQ ID NO: 72159 - DNA, 19 bp, Homo sapiens
tgagctgaatgtgaactgt

SEQ ID NO: 72160 - DNA, 19 bp, Homo sapiens
tgagtgaagtgagggttgt

SEQ ID NO: 72161 - DNA, 19 bp, Homo sapiens
taagccaggttcaagttgt

SEQ ID NO: 72162 - DNA, 19 bp, Homo sapiens
gagccaagttccgagttgt

SEQ ID NO: 72163 - DNA, 17 bp, Homo sapiens
tgagtaaagtgaggctg

SEQ ID NO: 72164 - DNA, 17 bp, Homo sapiens
tgacctggaatgagttg

SEQ ID NO: 72165 - DNA, 16 bp, Homo sapiens
tgagttgagagagttg

SEQ ID NO: 72166 - DNA, 21 bp, Homo sapiens
tgatcaaatgaatttagttgt

SEQ ID NO: 72167 - DNA, 20 bp, Homo sapiens
agccaaatgagaaccattgt

SEQ ID NO: 72168 - DNA, 15 bp, Homo sapiens
agccagaatgagttg

SEQ ID NO: 72169 - DNA, 22 bp, Homo sapiens
tgagccaggtgggggcctgagt

SEQ ID NO: 72170 - DNA, 19 bp, Homo sapiens
tgaatgctaggtgagttgt

SEQ ID NO: 72171 - DNA, 20 bp, Homo sapiens
tgagtcacatggggaaatgt

SEQ ID NO: 72172 - DNA, 20 bp, Homo sapiens
tgagccacagtggggtggct

SEQ ID NO: 72173 - DNA, 20 bp, Homo sapiens
tgagccaaataaatttttgt

SEQ ID NO: 72174 - DNA, 21 bp, Homo sapiens
tgggccgacggactgagttgt

SEQ ID NO: 72175 - DNA, 24 bp, Homo sapiens
tgaatcaagtgaggccagggttgt

SEQ ID NO: 72176 - DNA, 21 bp, Homo sapiens
tgagtcaatgggtgatattgt

SEQ ID NO: 72177 - DNA, 19 bp, Homo sapiens
tgagctgatgaggtcagct

SEQ ID NO: 72178 - DNA, 19 bp, Homo sapiens
tgagccagaggggatctgt

SEQ ID NO: 72179 - DNA, 16 bp, Homo sapiens
tgagccaggtgggctg

SEQ ID NO: 72180 - DNA, 22 bp, Homo sapiens
tgagccggtcctgcggagttgt

SEQ ID NO: 72181 - DNA, 18 bp, Homo sapiens
tgggctcaatgaggcagt

SEQ ID NO: 72182 - DNA, 15 bp, Homo sapiens
tggctgaatgagctg

SEQ ID NO: 72183 - DNA, 16 bp, Homo sapiens
tgagcgagttgagttg

SEQ ID NO: 72184 - DNA, 15 bp, Homo sapiens
tgagctgggtgagct

SEQ ID NO: 72185 - DNA, 16 bp, Homo sapiens
tgagctgggtgaagtg

SEQ ID NO: 72186 - DNA, 20 bp, Homo sapiens
tgagccgggcgagggagagt

SEQ ID NO: 72187 - DNA, 19 bp, Homo sapiens
agctgaggtcacgagttgt

SEQ ID NO: 72188 - DNA, 77 bp, Human papillomavirus type 20
ctgaggttcaaccagttgacctgttttgtgaagaggagttaccgaacgagcagcaggagagagaggaggagcctcag

SEQ ID NO: 72189 - DNA, 24 bp, Human papillomavirus type 20
aaccagttgacctgttttgtgaag

SEQ ID NO: 72190 - DNA, 16 bp, Homo sapiens
cagttgacatcctgga

SEQ ID NO: 72191 - DNA, 19 bp, Homo sapiens
aaccagctgaccagtgtga

SEQ ID NO: 72192 - DNA, 21 bp, Homo sapiens
cacttagagtgttttgtgaag

SEQ ID NO: 72193 - DNA, 21 bp, Homo sapiens
agctggtttactgctgtgaag

SEQ ID NO: 72194 - DNA, 18 bp, Homo sapiens
aaccagtgcttttgtgaa

SEQ ID NO: 72195 - DNA, 21 bp, Homo sapiens
accaggtggcctgtcccctga

SEQ ID NO: 72196 - DNA, 20 bp, Homo sapiens
ccagctgatttctgaacgtg

SEQ ID NO: 72197 - DNA, 23 bp, Homo sapiens
ccagttgaatcctcaacgtgaag

SEQ ID NO: 72198 - DNA, 19 bp, Homo sapiens
aaccatttgatctgtttta

SEQ ID NO: 72199 - DNA, 16 bp, Homo sapiens
ccagctgagttgtgaa

SEQ ID NO: 72200 - DNA, 18 bp, Homo sapiens
ccagttgattttttctaa

SEQ ID NO: 72201 - DNA, 20 bp, Homo sapiens
ccacttgaaccattgtgaag

SEQ ID NO: 72202 - DNA, 16 bp, Homo sapiens
aaccagttgttctgga

SEQ ID NO: 72203 - DNA, 75 bp, Tupaia herpesvirus
gggctctggccaacggtggacctcgtctttttccgttcccccacgttcccgacaccaccaccgtccccaccgtcc

SEQ ID NO: 72204 - DNA, 24 bp, Tupaia herpesvirus
aacggtggacctcgtctttttccg

SEQ ID NO: 72205 - DNA, 16 bp, Homo sapiens
ggtggaaatctttttc

SEQ ID NO: 72206 - DNA, 18 bp, Homo sapiens
acggtggagttcactttc

SEQ ID NO: 72207 - DNA, 19 bp, Homo sapiens
tggaccttttgtctttttc

SEQ ID NO: 72208 - DNA, 18 bp, Homo sapiens
aacagtggatgttttttt

SEQ ID NO: 72209 - DNA, 18 bp, Homo sapiens
cggtggccctccctttct

SEQ ID NO: 72210 - DNA, 17 bp, Homo sapiens
cggtggtcgccttttcc

SEQ ID NO: 72211 - DNA, 18 bp, Homo sapiens
ggtagccttgtctttttc

SEQ ID NO: 72212 - DNA, 18 bp, Homo sapiens
aacagtgggttttttcca

SEQ ID NO: 72213 - DNA, 20 bp, Homo sapiens
acggtgaatttccgtttccg

SEQ ID NO: 72214 - DNA, 20 bp, Homo sapiens
acgctggagggtatcttttt

SEQ ID NO: 72215 - DNA, 16 bp, Homo sapiens
gatggaaatctttttc

SEQ ID NO: 72216 - DNA, 19 bp, Homo sapiens
ggtaggccttgtcatcttc

SEQ ID NO: 72217 - DNA, 82 bp, Tupaia herpesvirus
cgctcgacggcgcggcggtgaccccgtccgcgggtcgcgcgcgggagtcaaatagtcgagcctccgtcgcgccgcaccggcg

SEQ ID NO: 72218 - DNA, 24 bp, Tupaia herpesvirus
tcaaatagtcgagcctccgtcgcg

SEQ ID NO: 72219 - DNA, 19 bp, Homo sapiens
tcagatagtcgatgtcagt

SEQ ID NO: 72220 - DNA, 18 bp, Homo sapiens
tagtcgagccaaggcgcg

SEQ ID NO: 72221 - DNA, 18 bp, Homo sapiens
tcaaacagttgaatgtcg

SEQ ID NO: 72222 - DNA, 70 bp, Tupaia herpesvirus
cgcaccggcgagtcgggacgcgcccgtccggcctctcgtccgggaggaggcggccgactccgtcgaggcg

SEQ ID NO: 72223 - DNA, 23 bp, Tupaia herpesvirus
aggcggccgactccgtcgaggcg

SEQ ID NO: 72224 - DNA, 21 bp, Homo sapiens
ggcagccggctttgtacaagg

SEQ ID NO: 72225 - DNA, 22 bp, Homo sapiens
aggcggccgatgttccccggcg

SEQ ID NO: 72226 - DNA, 22 bp, Homo sapiens
aggcggcctggagtctggggcg

SEQ ID NO: 72227 - DNA, 20 bp, Homo sapiens
aggggctgactccattagcg

SEQ ID NO: 72228 - DNA, 23 bp, Homo sapiens
agcggccggtgcggcgtggggcg

SEQ ID NO: 72229 - DNA, 22 bp, Homo sapiens
aggtgtgctgagctccgaggcg

SEQ ID NO: 72230 - DNA, 16 bp, Homo sapiens
ggcagccgagcgaggc

SEQ ID NO: 72231 - DNA, 16 bp, Homo sapiens
ggcggccggcggaggc

SEQ ID NO: 72232 - DNA, 19 bp, Homo sapiens
ggcggccggtttcctcggg

SEQ ID NO: 72233 - DNA, 21 bp, Homo sapiens
ggcgggccgggctccgaggcg

SEQ ID NO: 72234 - DNA, 18 bp, Homo sapiens
ggcggccgaggcggggcg

SEQ ID NO: 72235 - DNA, 16 bp, Homo sapiens
ggcgccgactcggggc

SEQ ID NO: 72236 - DNA, 18 bp, Homo sapiens
aggcggccaggctctgtc

SEQ ID NO: 72237 - DNA, 19 bp, Homo sapiens
aggcagccctgggtcgggg

SEQ ID NO: 72238 - DNA, 18 bp, Homo sapiens
ggcggccgttctctcggg

SEQ ID NO: 72239 - DNA, 20 bp, Homo sapiens
ggtcggccgagcccggggcg

SEQ ID NO: 72240 - DNA, 21 bp, Homo sapiens
ggcagccgaggggccttgagg

SEQ ID NO: 72241 - DNA, 19 bp, Homo sapiens
ggccgccgagcccggggcg

SEQ ID NO: 72242 - DNA, 24 bp, Homo sapiens
ggcggccagtgtgagctcgaggcg

SEQ ID NO: 72243 - DNA, 20 bp, Homo sapiens
ggcggccgggctgcggggcg

SEQ ID NO: 72244 - DNA, 20 bp, Homo sapiens
ggcggccgacggcgggggcg

SEQ ID NO: 72245 - DNA, 21 bp, Homo sapiens
agcggccggctcccgacggcg

SEQ ID NO: 72246 - DNA, 20 bp, Homo sapiens
ggcgggcggggcacggggcg

SEQ ID NO: 72247 - DNA, 18 bp, Homo sapiens
agcggccgggcccggggc

SEQ ID NO: 72248 - DNA, 18 bp, Homo sapiens
aagcggccggctccgggc

SEQ ID NO: 72249 - DNA, 20 bp, Homo sapiens
aagcggccggacggccgggg

SEQ ID NO: 72250 - DNA, 22 bp, Homo sapiens
aggcggccacttccagccagcg

SEQ ID NO: 72251 - DNA, 17 bp, Homo sapiens
aggcgccggctccgccg

SEQ ID NO: 72252 - DNA, 17 bp, Homo sapiens
ggcggccggctccgagc

SEQ ID NO: 72253 - DNA, 17 bp, Homo sapiens
aggcggcccgccgaggc

SEQ ID NO: 72254 - DNA, 16 bp, Homo sapiens
ggcggtcgaccgaggc

SEQ ID NO: 72255 - DNA, 22 bp, Homo sapiens
aggcggccggcctcggggagcg

SEQ ID NO: 72256 - DNA, 19 bp, Homo sapiens
aggcggcccgctccgcacg

SEQ ID NO: 72257 - DNA, 17 bp, Homo sapiens
ggcggccgggcagaggc

SEQ ID NO: 72258 - DNA, 22 bp, Homo sapiens
ggcggccgaccggcctgaggcg

SEQ ID NO: 72259 - DNA, 21 bp, Homo sapiens
agccggccaaccgttggggcg

SEQ ID NO: 72260 - DNA, 23 bp, Homo sapiens
ggtggccgactcgtagcgcctca

SEQ ID NO: 72261 - DNA, 16 bp, Homo sapiens
ggcggccgaccggggc

SEQ ID NO: 72262 - DNA, 18 bp, Homo sapiens
aggcggccgaccttcggc

SEQ ID NO: 72263 - DNA, 121 bp, Melanoplus sanguinipes entomopoxvirus
ttcaatatgttagtgtaaaataaatgtatatgtatataatatataaatatgactgaaattattattcaatatgttagtgtaaaataaatgtatatgtatataatatataaatatgactgaa

SEQ ID NO: 72264 - DNA, 24 bp, Melanoplus sanguinipes entomopoxvirus
ttagtgtaaaataaatgtatatgt

SEQ ID NO: 72265 - DNA, 18 bp, Homo sapiens
ttagtgtgtttgtatatg

SEQ ID NO: 72266 - DNA, 19 bp, Homo sapiens
gtgtatgttatgtatatgt

SEQ ID NO: 72267 - DNA, 21 bp, Homo sapiens
gtgtaaaatgagataatatgt

SEQ ID NO: 72268 - DNA, 19 bp, Homo sapiens
ttagtgtaagaataaatgt

SEQ ID NO: 72269 - DNA, 24 bp, Homo sapiens
ttagtgtaaagtgtagcatgatgt

SEQ ID NO: 72270 - DNA, 22 bp, Homo sapiens
atgatcaaataaatgtgtatgt

SEQ ID NO: 72271 - DNA, 26 bp, Homo sapiens
ttagtgtaatgtgggcatatatatat

SEQ ID NO: 72272 - DNA, 24 bp, Homo sapiens
ttactgtagaatatatatatatgt

SEQ ID NO: 72273 - DNA, 22 bp, Homo sapiens
ttaatgtatgttatgtatatgt

SEQ ID NO: 72274 - DNA, 83 bp, Human herpesvirus 1
tggggcacttgcagatttgtaaggccacgcacggcggggagacaggccgacgcgggggctgctctaaaaatttaagggcccta

SEQ ID NO: 72275 - DNA, 24 bp, Human herpesvirus 1
acgcgggggctgctctaaaaattt

SEQ ID NO: 72276 - DNA, 22 bp, Homo sapiens
actcaagttgctttaaaaattt

SEQ ID NO: 72277 - DNA, 19 bp, Homo sapiens
gcaggctctttaaaaattt

SEQ ID NO: 72278 - DNA, 24 bp, Homo sapiens
gccttaaagttgctctaaagattt

SEQ ID NO: 72279 - DNA, 19 bp, Homo sapiens
aagaactgctttaggaatt

SEQ ID NO: 72280 - DNA, 22 bp, Homo sapiens
acccaagttgctttaaaaattt

SEQ ID NO: 72281 - DNA, 75 bp, Human herpesvirus 1
gctgctctaaaaatttaagggccctacggtccacagacccgccttcccgggggggcccttggagcgaccggcagc

SEQ ID NO: 72282 - DNA, 24 bp, Human herpesvirus 1
ttaagggccctacggtccacagac

SEQ ID NO: 72283 - DNA, 21 bp, Homo sapiens
agggcccacggtgctgcagac

SEQ ID NO: 72284 - DNA, 19 bp, Homo sapiens
ttaaaggccaatccacaga

SEQ ID NO: 72285 - DNA, 26 bp, Homo sapiens
ttaagggctcgtggagttgtcacaga

SEQ ID NO: 72286 - DNA, 17 bp, Homo sapiens
aagggctcagtccacag

SEQ ID NO: 72287 - DNA, 19 bp, Homo sapiens
aagggtctccaccacagac

SEQ ID NO: 72288 - DNA, 16 bp, Homo sapiens
gggcctcggtccacag

SEQ ID NO: 72289 - DNA, 19 bp, Homo sapiens
agggccccatctcatggac

SEQ ID NO: 72290 - DNA, 17 bp, Homo sapiens
ttaaagacggtccacag

SEQ ID NO: 72291 - DNA, 18 bp, Homo sapiens
ggggacttcggtccacag

SEQ ID NO: 72292 - DNA, 22 bp, Homo sapiens
ttaaaggctttaaatccatgga

SEQ ID NO: 72293 - DNA, 18 bp, Homo sapiens
ttaaaggcttccttccac

SEQ ID NO: 72294 - DNA, 65 bp, African swine fever virus
ggaagcggaaccgatcgaccgccacctgctcccagggacccttgcgctcgatgtcgtcggcttcc

SEQ ID NO: 72295 - DNA, 24 bp, African swine fever virus
aagcggaaccgatcgaccgccacc

SEQ ID NO: 72296 - DNA, 19 bp, Homo sapiens
gcgagacgcggccgccacc

SEQ ID NO: 72297 - DNA, 21 bp, Homo sapiens
gcgaagcctccaaccgctgcc

SEQ ID NO: 72298 - DNA, 20 bp, Homo sapiens
aagcagaaccgcgctgtcac

SEQ ID NO: 72299 - DNA, 19 bp, Homo sapiens
agccgggacaaccgccgcc

SEQ ID NO: 72300 - DNA, 20 bp, Homo sapiens
ggagctccagcgccgccacc

SEQ ID NO: 72301 - DNA, 18 bp, Homo sapiens
aagcgcattgaccgccac

SEQ ID NO: 72302 - DNA, 20 bp, Homo sapiens
gcggggcgagcgaccgccac

SEQ ID NO: 72303 - DNA, 18 bp, Homo sapiens
aaggggagcctccgccac

SEQ ID NO: 72304 - DNA, 23 bp, Homo sapiens
aagcggaaactccctctgccgcc

SEQ ID NO: 72305 - DNA, 18 bp, Homo sapiens
aagcgaaactgaacatgc

SEQ ID NO: 72306 - DNA, 21 bp, Homo sapiens
gcgagggccaccaccgccacc

SEQ ID NO: 72307 - DNA, 21 bp, Homo sapiens
aagcgagtgggagccgccacc

SEQ ID NO: 72308 - DNA, 21 bp, Homo sapiens
agtgggaccgccactgccgcc

SEQ ID NO: 72309 - DNA, 19 bp, Homo sapiens
aacggaactgatcgcgcac

SEQ ID NO: 72310 - DNA, 22 bp, Homo sapiens
aagtagaaccaatgctgccacc

SEQ ID NO: 72311 - DNA, 22 bp, Homo sapiens
gcggagccgtcctcccgccacc

SEQ ID NO: 72312 - DNA, 19 bp, Homo sapiens
ggagaccgcggccgccacc

SEQ ID NO: 72313 - DNA, 20 bp, Homo sapiens
gcggcaggagggaccgccac

SEQ ID NO: 72314 - DNA, 17 bp, Homo sapiens
agcggggccgccgccac

SEQ ID NO: 72315 - DNA, 22 bp, Homo sapiens
agtggctgcctcggccgccacc

SEQ ID NO: 72316 - DNA, 20 bp, Homo sapiens
aagaggaaccgaggcactgc

SEQ ID NO: 72317 - DNA, 21 bp, Homo sapiens
gctgggcacgatgccgccacc

SEQ ID NO: 72318 - DNA, 18 bp, Homo sapiens
agcagaaccagacatcgc

SEQ ID NO: 72319 - DNA, 131 bp, Casphalia extranea densovirus
accaccacaacccccccagaacccaagcccaatcctattgcgatacgtagtgaccacacgaagtgacgcgcttcgcgcgtcgtggtcatcgcaataggattgggcttgggttctgggggggttgtggtggt

SEQ ID NO: 72320 - DNA, 24 bp, Casphalia extranea densovirus
catcgcaataggattgggcttggg

SEQ ID NO: 72321 - DNA, 17 bp, Homo sapiens
gcagcaggaggcttggg

SEQ ID NO: 72322 - DNA, 16 bp, Homo sapiens
tcacgatgaggcttgg

SEQ ID NO: 72323 - DNA, 17 bp, Homo sapiens
catcgtggtggggtggg

SEQ ID NO: 72324 - DNA, 72 bp, Northern cereal mosaic virus
agttcaagtggtatatgttgagaaaggtgatagccttatcaaacaaacaggatcatatgcctcttcattact

SEQ ID NO: 72325 - DNA, 24 bp, Northern cereal mosaic virus
ttcaagtggtatatgttgagaaag

SEQ ID NO: 72326 - DNA, 15 bp, Homo sapiens
ctcaagtggttgaga

SEQ ID NO: 72327 - DNA, 20 bp, Homo sapiens
ttcaagtgatataagagaga

SEQ ID NO: 72328 - DNA, 17 bp, Homo sapiens
ttcagcagtgttgagaa

SEQ ID NO: 72329 - DNA, 18 bp, Homo sapiens
atgagccggttgagaaag

SEQ ID NO: 72330 - DNA, 18 bp, Homo sapiens
ttcaagtgtatgtgtgag

SEQ ID NO: 72331 - DNA, 19 bp, Homo sapiens
ttcaggtgtgtataagaaa

SEQ ID NO: 72332 - DNA, 18 bp, Homo sapiens
ttcaggtggtacagggag

SEQ ID NO: 72333 - DNA, 20 bp, Homo sapiens
aagtgatatatcagatcaaa

SEQ ID NO: 72334 - DNA, 17 bp, Homo sapiens
ttcatagttatgttgag

SEQ ID NO: 72335 - DNA, 21 bp, Homo sapiens
ctcaagtgttctgttggggaa

SEQ ID NO: 72336 - DNA, 17 bp, Homo sapiens
ttcaagtggtagtgttg

SEQ ID NO: 72337 - DNA, 20 bp, Homo sapiens
ttcaagtggtgcatgagtag

SEQ ID NO: 72338 - DNA, 21 bp, Homo sapiens
ttcaagtgtattgcagggaga

SEQ ID NO: 72339 - DNA, 72 bp, Vaccinia virus
gtcgtgcgattcagaacacacttttctcaaccttctggtagagaggctgctgaaaataatgacgcgtacgat

SEQ ID NO: 72340 - DNA, 24 bp, Vaccinia virus
gaacacacttttctcaaccttctg

SEQ ID NO: 72341 - DNA, 17 bp, Homo sapiens
gacacacttttccttct

SEQ ID NO: 72342 - DNA, 20 bp, Homo sapiens
gaacacctttttctttttct

SEQ ID NO: 72343 - DNA, 18 bp, Homo sapiens
gaatgcacttttccagcc

SEQ ID NO: 72344 - DNA, 21 bp, Homo sapiens
aaacacacacacaatcttctg

SEQ ID NO: 72345 - DNA, 16 bp, Homo sapiens
acacttcgaccttctg

SEQ ID NO: 72346 - DNA, 18 bp, Homo sapiens
gaatacacttttccaaac

SEQ ID NO: 72347 - DNA, 21 bp, Homo sapiens
cacacttttatctttcttctg

SEQ ID NO: 72348 - DNA, 18 bp, Homo sapiens
accacttttcttagcaac

SEQ ID NO: 72349 - DNA, 21 bp, Homo sapiens
gaacttgtttttctcatccct

SEQ ID NO: 72350 - DNA, 24 bp, Homo sapiens
gaaacactgctggacaaccttctg

SEQ ID NO: 72351 - DNA, 18 bp, Homo sapiens
gacacactttttagttct

SEQ ID NO: 72352 - DNA, 17 bp, Homo sapiens
acttttctcaagctctg

SEQ ID NO: 72353 - DNA, 21 bp, Homo sapiens
cacatgctctctgaccttctg

SEQ ID NO: 72354 - DNA, 22 bp, Homo sapiens
gaacgcactttcctcaccactg

SEQ ID NO: 72355 - DNA, 22 bp, Homo sapiens
gaacacacttctcctggttctg

SEQ ID NO: 72356 - DNA, 21 bp, Homo sapiens
ggacacctttgccgtcttctg

SEQ ID NO: 72357 - DNA, 21 bp, Homo sapiens
gaatgcacttcccgtcttctg

SEQ ID NO: 72358 - DNA, 19 bp, Homo sapiens
catttttccaacctttctg

SEQ ID NO: 72359 - DNA, 18 bp, Homo sapiens
gagcacacttctctctct

SEQ ID NO: 72360 - DNA, 20 bp, Homo sapiens
aaacatatttttctcaatcc

SEQ ID NO: 72361 - DNA, 62 bp, Paramecium bursaria Chlorella virus 1
gtcgtgaacgttgctgcttataccgtgggtaatctcactacatcatccaatgtatcgacgac

SEQ ID NO: 72362 - DNA, 24 bp, Paramecium bursaria Chlorella virus 1
gaacgttgctgcttataccgtggg

SEQ ID NO: 72363 - DNA, 22 bp, Homo sapiens
gagcgctgctgctcctcgtggg

SEQ ID NO: 72364 - DNA, 16 bp, Homo sapiens
acgtcgctggccgtgg

SEQ ID NO: 72365 - DNA, 23 bp, Homo sapiens
cgttgctgtgtgcctgccgtggg

SEQ ID NO: 72366 - DNA, 23 bp, Homo sapiens
gagcgctgctgctcagctgtggg

SEQ ID NO: 72367 - DNA, 79 bp, Molluscum contagiosum virus
ggagcacgtgaacagacccagtggcgtttgccgtgacaagacactgtccttcctccggcgaaaagccgctcgcgtcttc

SEQ ID NO: 72368 - DNA, 24 bp, Molluscum contagiosum virus
agtggcgtttgccgtgacaagaca

SEQ ID NO: 72369 - DNA, 17 bp, Homo sapiens
agtggttttactgcaag

SEQ ID NO: 72370 - DNA, 22 bp, Homo sapiens
gtagcgtttgacgcctgggaca

SEQ ID NO: 72371 - DNA, 130 bp, Molluscum contagiosum virus
cggcgttctcgatgccctatctttcctcgtgcgcgctcggaaatggcgggcagttgcgtgcttccaacctccggcggcgaagcccgcttgcctcctcggagcacgtgaacagacccagtggcgtttgccg

SEQ ID NO: 72372 - DNA, 24 bp, Molluscum contagiosum virus
gagcacgtgaacagacccagtggc

SEQ ID NO: 72373 - DNA, 19 bp, Homo sapiens
gaggactgaggtccagtgg

SEQ ID NO: 72374 - DNA, 21 bp, Homo sapiens
acagactagcaggcccagtgg

SEQ ID NO: 72375 - DNA, 20 bp, Homo sapiens
ggcacgtgagagccagtggc

SEQ ID NO: 72376 - DNA, 20 bp, Homo sapiens
acgccaagaggcccagtggc

SEQ ID NO: 72377 - DNA, 18 bp, Homo sapiens
gaacacgtggatgagtgg

SEQ ID NO: 72378 - DNA, 18 bp, Homo sapiens
gagcatgtgaacaagacc

SEQ ID NO: 72379 - DNA, 19 bp, Homo sapiens
cgtggtcagccccagtggc

SEQ ID NO: 72380 - DNA, 21 bp, Homo sapiens
gaggcgcgcaggcccagtggc

SEQ ID NO: 72381 - DNA, 15 bp, Homo sapiens
gcacgtgacaggtgg

SEQ ID NO: 72382 - DNA, 23 bp, Homo sapiens
aagcacgtgtttgagcccagtgg

SEQ ID NO: 72383 - DNA, 21 bp, Homo sapiens
gcgaattccaggcccagtggc

SEQ ID NO: 72384 - DNA, 19 bp, Homo sapiens
agcactcagatccagtggc

SEQ ID NO: 72385 - DNA, 19 bp, Homo sapiens
gaggtaaggggcccagtgg

SEQ ID NO: 72386 - DNA, 20 bp, Homo sapiens
gagacgtgaacagatcactg

SEQ ID NO: 72387 - DNA, 19 bp, Homo sapiens
gagcgtggggtcccagtgg

SEQ ID NO: 72388 - DNA, 20 bp, Homo sapiens
agcatgtgaacaggctgggc

SEQ ID NO: 72389 - DNA, 22 bp, Homo sapiens
gagtatggaagtccccagtggc

SEQ ID NO: 72390 - DNA, 20 bp, Homo sapiens
gagcgtgtgaacagcaacgg

SEQ ID NO: 72391 - DNA, 18 bp, Homo sapiens
acgtgaacagcgggtggc

SEQ ID NO: 72392 - DNA, 17 bp, Homo sapiens
acatgtgaacaggcagt

SEQ ID NO: 72393 - DNA, 22 bp, Homo sapiens
ggcatgtgttttgacccagtgg

SEQ ID NO: 72394 - DNA, 21 bp, Homo sapiens
gagtgcgtgaacaggactcgc

SEQ ID NO: 72395 - DNA, 21 bp, Homo sapiens
agcacgtgcgcgtccagtggc

SEQ ID NO: 72396 - DNA, 22 bp, Homo sapiens
gaggcgtggccgccccagtggc

SEQ ID NO: 72397 - DNA, 18 bp, Homo sapiens
gccgggaggcccagtggc

SEQ ID NO: 72398 - DNA, 22 bp, Homo sapiens
gagcacatatgcatttagtggc

SEQ ID NO: 72399 - DNA, 62 bp, Human papillomavirus type 21
gcgtacaaagttgttacaccttgcggctgctgcaaggtcaagcttcgcatctttgtaaacgc

SEQ ID NO: 72400 - DNA, 24 bp, Human papillomavirus type 21
tacaaagttgttacaccttgcggc

SEQ ID NO: 72401 - DNA, 21 bp, Homo sapiens
tacaaagttgtttttcttggc

SEQ ID NO: 72402 - DNA, 19 bp, Homo sapiens
aaaaattacatcttgtggc

SEQ ID NO: 72403 - DNA, 25 bp, Homo sapiens
tacaaagttgttttgtttgccgcag

SEQ ID NO: 72404 - DNA, 21 bp, Homo sapiens
tacaaagttgttcttcctggc

SEQ ID NO: 72405 - DNA, 19 bp, Homo sapiens
aagttgcagacccttgcgg

SEQ ID NO: 72406 - DNA, 24 bp, Homo sapiens
taaaagttgttatgtcagcatggc

SEQ ID NO: 72407 - DNA, 21 bp, Homo sapiens
aaagttgtgcgtctctgcggc

SEQ ID NO: 72408 - DNA, 27 bp, Homo sapiens
caaagttgtgacatcagtgccgcaagg

SEQ ID NO: 72409 - DNA, 18 bp, Homo sapiens
tacaaagtttttatgcag

SEQ ID NO: 72410 - DNA, 21 bp, Homo sapiens
aaagttgtcacatcttgtggc

SEQ ID NO: 72411 - DNA, 20 bp, Homo sapiens
caaagttgttatgtataggc

SEQ ID NO: 72412 - DNA, 19 bp, Homo sapiens
aaagttgttccattgtggc

SEQ ID NO: 72413 - DNA, 65 bp, Cowpox virus
gatatttactttttatatgcttgcattacagaatgatattcacaggtattattaaaatgagtatc

SEQ ID NO: 72414 - DNA, 24 bp, Cowpox virus
cacaggtattattaaaatgagtat

SEQ ID NO: 72415 - DNA, 24 bp, Homo sapiens
acaggcacatattaaaatgagtat

SEQ ID NO: 72416 - DNA, 19 bp, Homo sapiens
cacaggtcttattgaagag

SEQ ID NO: 72417 - DNA, 24 bp, Homo sapiens
cacaggggcttccaaaatgggtat

SEQ ID NO: 72418 - DNA, 17 bp, Homo sapiens
caggcactaagatgagt

SEQ ID NO: 72419 - DNA, 22 bp, Homo sapiens
agatattattaaaattaggtat

SEQ ID NO: 72420 - DNA, 22 bp, Homo sapiens
acaggtataaatacatgggtat

SEQ ID NO: 72421 - DNA, 24 bp, Homo sapiens
cagggtgtttcaaccaatgagtat

SEQ ID NO: 72422 - DNA, 19 bp, Homo sapiens
cacaggtactgttaaaatg

SEQ ID NO: 72423 - DNA, 21 bp, Homo sapiens
taaagtagcgttaaaatgagt

SEQ ID NO: 72424 - DNA, 15 bp, Homo sapiens
agtattattagagca

SEQ ID NO: 72425 - DNA, 20 bp, Homo sapiens
aggtgattctcaatgagtat

SEQ ID NO: 72426 - DNA, 20 bp, Homo sapiens
acagatacctaaatgggtat

SEQ ID NO: 72427 - DNA, 66 bp, Cowpox virus
tataatcaatgatacgtgtattagaatactttccgaataagtcttctaaatattgtattaattatg

SEQ ID NO: 72428 - DNA, 24 bp, Cowpox virus
tcaatgatacgtgtattagaatac

SEQ ID NO: 72429 - DNA, 28 bp, Homo sapiens
aatgatactgtgtgtctcaaagaatacg

SEQ ID NO: 72430 - DNA, 23 bp, Homo sapiens
tcaagatgcttttattagaatac

SEQ ID NO: 72431 - DNA, 19 bp, Homo sapiens
tcactgatacgtcgtccag

SEQ ID NO: 72432 - DNA, 23 bp, Homo sapiens
tcaatgatatatgcaactaatac

SEQ ID NO: 72433 - DNA, 21 bp, Homo sapiens
aatgattgttttattagaata

SEQ ID NO: 72434 - DNA, 20 bp, Homo sapiens
tcaatgatagtgtaaaaaat

SEQ ID NO: 72435 - DNA, 17 bp, Homo sapiens
tcaataatacagataga

SEQ ID NO: 72436 - DNA, 25 bp, Homo sapiens
tcaatgatgttttatactagaatac

SEQ ID NO: 72437 - DNA, 18 bp, Homo sapiens
tcaagatccatatattag

SEQ ID NO: 72438 - DNA, 21 bp, Homo sapiens
tcagtaatttgcattagaata

SEQ ID NO: 72439 - DNA, 18 bp, Homo sapiens
tcagtatacgtgtgtcag

SEQ ID NO: 72440 - DNA, 21 bp, Homo sapiens
tcaaatcttgtattagaatac

SEQ ID NO: 72441 - DNA, 122 bp, Melanoplus sanguinipes entomopoxvirus
atttaagtattaattgtcctaatcgtgaatgcatatctcttaaaaaaatatataaatcatatatattattttcataatcattttcaggtataattttatgtaatttttcaattaaactaaat

SEQ ID NO: 72442 - DNA, 24 bp, Melanoplus sanguinipes entomopoxvirus
ttaattgtcctaatcgtgaatgca

SEQ ID NO: 72443 - DNA, 19 bp, Homo sapiens
ttaattgtcctatctgagc

SEQ ID NO: 72444 - DNA, 20 bp, Homo sapiens
attgcacagtatcgtgaatg

SEQ ID NO: 72445 - DNA, 23 bp, Homo sapiens
attgtcctaatgggaggggtgca

SEQ ID NO: 72446 - DNA, 18 bp, Homo sapiens
ttaattgtccttgtttgc

SEQ ID NO: 72447 - DNA, 25 bp, Homo sapiens
ttaattgctcctaatccctgatgca

SEQ ID NO: 72448 - DNA, 16 bp, Homo sapiens
ttaattatcctaattg

SEQ ID NO: 72449 - DNA, 16 bp, Homo sapiens
taattgtccgtgagtg

SEQ ID NO: 72450 - DNA, 62 bp, Red clover mottle virus
gaagaatagcgtgtggagcgatccttggtgttaattcaccttgaggagcacgttatatcttt

SEQ ID NO: 72451 - DNA, 24 bp, Red clover mottle virus
tagcgtgtggagcgatccttggtg

SEQ ID NO: 72452 - DNA, 24 bp, Homo sapiens
tagtgtgtggagggtggggtggtg

SEQ ID NO: 72453 - DNA, 19 bp, Homo sapiens
gtgtggagcacagctggtg

SEQ ID NO: 72454 - DNA, 19 bp, Homo sapiens
gtgtggagtgattccagtg

SEQ ID NO: 72455 - DNA, 111 bp, Paramecium bursaria Chlorella virus 1
cgtgctgctgcaaaagcgaagggtagagacgctcttgtgaaggcgttagatagggcaattattgaaaaacgcaaaagacttggggggtcggctcaacgttcgcaaagcgcg

SEQ ID NO: 72456 - DNA, 24 bp, Paramecium bursaria Chlorella virus 1
aaacgcaaaagacttggggggtcg

SEQ ID NO: 72457 - DNA, 20 bp, Homo sapiens
ggacacagccagtggggggt

SEQ ID NO: 72458 - DNA, 20 bp, Homo sapiens
gcagtggaagcagggggtcg

SEQ ID NO: 72459 - DNA, 20 bp, Homo sapiens
gcaaagggttgaattggtcg

SEQ ID NO: 72460 - DNA, 20 bp, Homo sapiens
gcggaaggctcgcgaggtcg

SEQ ID NO: 72461 - DNA, 20 bp, Homo sapiens
gcaaaaggcttggaagctcg

SEQ ID NO: 72462 - DNA, 18 bp, Homo sapiens
ggacacaaaggacttggg

SEQ ID NO: 72463 - DNA, 19 bp, Homo sapiens
aacgcgagccggggggtcg

SEQ ID NO: 72464 - DNA, 19 bp, Homo sapiens
ggacgcgcaggaaggggtc

SEQ ID NO: 72465 - DNA, 19 bp, Homo sapiens
acgggagagagaagggtcg

SEQ ID NO: 72466 - DNA, 19 bp, Homo sapiens
gcaaatgacttgggcatgt

SEQ ID NO: 72467 - DNA, 20 bp, Homo sapiens
cgcgaagacggcgggggtcg

SEQ ID NO: 72468 - DNA, 19 bp, Homo sapiens
aaacacaggaggaggggtc

SEQ ID NO: 72469 - DNA, 18 bp, Homo sapiens
aacccaggagacggaggt

SEQ ID NO: 72470 - DNA, 22 bp, Homo sapiens
gcggggaagatcgttagggtcg

SEQ ID NO: 72471 - DNA, 19 bp, Homo sapiens
aaacccaggagacagaggt

SEQ ID NO: 72472 - DNA, 18 bp, Homo sapiens
gcagaaggacgagggtcg

SEQ ID NO: 72473 - DNA, 22 bp, Homo sapiens
ggacacagaggaaccggggtcg

SEQ ID NO: 72474 - DNA, 20 bp, Homo sapiens
aaacgcaggagacatggatc

SEQ ID NO: 72475 - DNA, 21 bp, Homo sapiens
actaaagggttcctgaagggt

SEQ ID NO: 72476 - DNA, 18 bp, Homo sapiens
aacccaggagacagaggt

SEQ ID NO: 72477 - DNA, 22 bp, Homo sapiens
acgctggagcaggagggggtcg

SEQ ID NO: 72478 - DNA, 20 bp, Homo sapiens
gcgagaggcctcgggggtcg

SEQ ID NO: 72479 - DNA, 23 bp, Homo sapiens
gctagaagggagtgcgggggtcg

SEQ ID NO: 72480 - DNA, 21 bp, Homo sapiens
acgcagaggacgcttcggggt

SEQ ID NO: 72481 - DNA, 18 bp, Homo sapiens
caagagactgcagcaggt

SEQ ID NO: 72482 - DNA, 21 bp, Homo sapiens
gccgaagggggcgaggggtcg

SEQ ID NO: 72483 - DNA, 16 bp, Homo sapiens
accaagagactgagtc

SEQ ID NO: 72484 - DNA, 18 bp, Homo sapiens
gcaaaaggcttgaaagat

SEQ ID NO: 72485 - DNA, 22 bp, Homo sapiens
gcgaagagataaacaggggtcg

SEQ ID NO: 72486 - DNA, 16 bp, Homo sapiens
gcaaaagacagaaggt

SEQ ID NO: 72487 - DNA, 19 bp, Homo sapiens
ggacacaggagatttggaa

SEQ ID NO: 72488 - DNA, 19 bp, Homo sapiens
cgcaaaggactggtggtcg

SEQ ID NO: 72489 - DNA, 21 bp, Homo sapiens
aaacccagaggcaaaaggggt

SEQ ID NO: 72490 - DNA, 68 bp, Bovine coronavirus
tcagaatggatgtcttgctgctataatagatagagaaggttatagcagactatagattaattagttga

SEQ ID NO: 72491 - DNA, 24 bp, Bovine coronavirus
tagcagactatagattaattagtt

SEQ ID NO: 72492 - DNA, 23 bp, Homo sapiens
tagcagactagggttgccagatt

SEQ ID NO: 72493 - DNA, 20 bp, Homo sapiens
acagactgttgtaattagtt

SEQ ID NO: 72494 - DNA, 130 bp, Aedes albopictus densovirus
catgatatagaaaagaaatattatttcgtgatacggatactccaagatacagttactattagtaacgatctgtcagatctgtatcttggagtatccgtatcacgaaataatatttcttttctatatcatg

SEQ ID NO: 72495 - DNA, 24 bp, Aedes albopictus densovirus
actccaagatacagttactattag

SEQ ID NO: 72496 - DNA, 21 bp, Homo sapiens
cccgggatacagcaggattag

SEQ ID NO: 72497 - DNA, 21 bp, Homo sapiens
acttcaggctacagttactat

SEQ ID NO: 72498 - DNA, 19 bp, Homo sapiens
tccaagatggtactgttag

SEQ ID NO: 72499 - DNA, 17 bp, Homo sapiens
ctccaagaggtttatta

SEQ ID NO: 72500 - DNA, 79 bp, Human herpesvirus 1
aaacgcgggcgtattggtcccaatggggtctcggtggggtatcgacagagtgccagccctgggaccgaaccccgcgttt

SEQ ID NO: 72501 - DNA, 24 bp, Human herpesvirus 1
gcgtattggtcccaatggggtctc

SEQ ID NO: 72502 - DNA, 22 bp, Homo sapiens
ctgagacctttgatggggtctc

SEQ ID NO: 72503 - DNA, 19 bp, Homo sapiens
gcgtgttgagctggggtct

SEQ ID NO: 72504 - DNA, 19 bp, Homo sapiens
ttggtcccagaggggtctc

SEQ ID NO: 72505 - DNA, 21 bp, Homo sapiens
gtgtggtgggtttggggtctc

SEQ ID NO: 72506 - DNA, 19 bp, Homo sapiens
gtgctggtctcaggagctc

SEQ ID NO: 72507 - DNA, 16 bp, Homo sapiens
gtttggtttggggtct

SEQ ID NO: 72508 - DNA, 19 bp, Homo sapiens
ctggtgctgatggggtctc

SEQ ID NO: 72509 - DNA, 18 bp, Homo sapiens
gtattggtcatggcatct

SEQ ID NO: 72510 - DNA, 64 bp, Helminthosporium victoriae virus 190S
aagggtggtgttggttggcgagggggggcttcggccttccgttgacccaactgatatcacactt

SEQ ID NO: 72511 - DNA, 24 bp, Helminthosporium victoriae virus 190S
cttccgttgacccaactgatatca

SEQ ID NO: 72512 - DNA, 23 bp, Homo sapiens
cttccgttgcttggacctcttca

SEQ ID NO: 72513 - DNA, 19 bp, Homo sapiens
ctcccgttgatctgacttc

SEQ ID NO: 72514 - DNA, 18 bp, Homo sapiens
ttctgctgttctgatatc

SEQ ID NO: 72515 - DNA, 22 bp, Homo sapiens
ttccgttgcattggatgtatca

SEQ ID NO: 72516 - DNA, 25 bp, Homo sapiens
ctgccgttgacttaaaactggatca

SEQ ID NO: 72517 - DNA, 18 bp, Homo sapiens
cttccattgatttgacat

SEQ ID NO: 72518 - DNA, 19 bp, Homo sapiens
catctgtccaactgatgtc

SEQ ID NO: 72519 - DNA, 15 bp, Homo sapiens
ctcccgttgactgat

SEQ ID NO: 72520 - DNA, 20 bp, Homo sapiens
ttcccccccaactgatgtca

SEQ ID NO: 72521 - DNA, 21 bp, Homo sapiens
cttccgtctgtcactgatgtc

SEQ ID NO: 72522 - DNA, 131 bp, Amsacta moorei entomopoxvirus
atataataatatttattgatgattgatattattagaatatattataataaatggataaaattatatggataataattttatttattataataatatttatgatattattaaaaattatagatgtgttatgt

SEQ ID NO: 72523 - DNA, 24 bp, Amsacta moorei entomopoxvirus
tatattataataaatggataaaat

SEQ ID NO: 72524 - DNA, 19 bp, Homo sapiens
atattataataaatgagat

SEQ ID NO: 72525 - DNA, 20 bp, Homo sapiens
tatattacaataaatatgat

SEQ ID NO: 72526 - DNA, 18 bp, Homo sapiens
tcagaataaatggataaa

SEQ ID NO: 72527 - DNA, 23 bp, Homo sapiens
tatattttaataaatacgacaaa

SEQ ID NO: 72528 - DNA, 63 bp, Ovine lentivirus
acgggaaagcacaatcattgttatcagaaagcagagtcaggatgacacagcaaatgtaaccgt

SEQ ID NO: 72529 - DNA, 21 bp, Ovine lentivirus
tgacacagcaaatgtaaccgt

SEQ ID NO: 72530 - DNA, 18 bp, Homo sapiens
tgacacaggcagcatcgt

SEQ ID NO: 72531 - DNA, 16 bp, Homo sapiens
tggcacagcaatgacc

SEQ ID NO: 72532 - DNA, 19 bp, Homo sapiens
tgacacaacaagaccccgt

SEQ ID NO: 72533 - DNA, 20 bp, Homo sapiens
tgacaagcaaatatagccat

SEQ ID NO: 72534 - DNA, 19 bp, Homo sapiens
taacacagcaaacaactgt

SEQ ID NO: 72535 - DNA, 18 bp, Homo sapiens
acacagcaggtgaacagt

SEQ ID NO: 72536 - DNA, 18 bp, Homo sapiens
gacacagcaaggccccgt

SEQ ID NO: 72537 - DNA, 18 bp, Homo sapiens
gacacagcaagtaagcgt

SEQ ID NO: 72538 - DNA, 17 bp, Homo sapiens
tgacacagcaaactgac

SEQ ID NO: 72539 - DNA, 21 bp, Homo sapiens
tgacacagaagtgtgtttcgt

SEQ ID NO: 72540 - DNA, 19 bp, Homo sapiens
taacacagtgaaacaccgt

SEQ ID NO: 72541 - DNA, 19 bp, Homo sapiens
tgacacagcaagactccgt

SEQ ID NO: 72542 - DNA, 20 bp, Homo sapiens
gacacagcaaactccatcgt

SEQ ID NO: 72543 - DNA, 18 bp, Homo sapiens
taacacagcaaaccccgt

SEQ ID NO: 72544 - DNA, 19 bp, Homo sapiens
gacacagcaggtgtggcgt

SEQ ID NO: 72545 - DNA, 78 bp, Ovine lentivirus
aagcagagtcaggatgacacagcaaatgtaaccgcaagttccgcttgtaaacgctaaatcatgtatcagctgatgctt

SEQ ID NO: 72546 - DNA, 24 bp, Ovine lentivirus
taaacgctaaatcatgtatcagct

SEQ ID NO: 72547 - DNA, 18 bp, Homo sapiens
taaacgctaaaacggagc

SEQ ID NO: 72548 - DNA, 24 bp, Homo sapiens
taaatgctgaacatcagcacagct

SEQ ID NO: 72549 - DNA, 21 bp, Homo sapiens
gctaaatctgtcttgtcagct

SEQ ID NO: 72550 - DNA, 23 bp, Homo sapiens
taaacgctaatattacaagtcag

SEQ ID NO: 72551 - DNA, 21 bp, Homo sapiens
gctatacaccatgtattggct

SEQ ID NO: 72552 - DNA, 21 bp, Homo sapiens
gcctaaaattgtgtatcagct

SEQ ID NO: 72553 - DNA, 85 bp, Peanut mottle virus
gtgtgttggcgggattttggcacctctctttcaaagtgtgggcgtcccacggaattggagttgtcatcacacaccaaagatacac

SEQ ID NO: 72554 - DNA, 24 bp, Peanut mottle virus
tttggcacctctctttcaaagtgt

SEQ ID NO: 72555 - DNA, 17 bp, Homo sapiens
tttggtacctcaaagtg

SEQ ID NO: 72556 - DNA, 22 bp, Homo sapiens
tttagcacttttcccccagtgt

SEQ ID NO: 72557 - DNA, 24 bp, Homo sapiens
tttggctacaaattttcaaagtgt

SEQ ID NO: 72558 - DNA, 25 bp, Homo sapiens
tttggcgtctctccttggttcatgt

SEQ ID NO: 72559 - DNA, 25 bp, Homo sapiens
tttggcttctctcaatacaaagtgt

SEQ ID NO: 72560 - DNA, 73 bp, Peanut mottle virus
gaagttctacacacaggcacggatctatagtgtgagtggctcacgtgacgagtgttggtgtgtatatcgcttc

SEQ ID NO: 72561 - DNA, 18 bp, Peanut mottle virus
tggtgtgtatatcgcttc

SEQ ID NO: 72562 - DNA, 18 bp, Homo sapiens
tggtatgtagccatcctt

SEQ ID NO: 72563 - DNA, 18 bp, Homo sapiens
tggagatacgatcgcttc

SEQ ID NO: 72564 - DNA, 25 bp, Homo sapiens
tggtgtgtctgggtgtattgcttcg

SEQ ID NO: 72565 - DNA, 16 bp, Homo sapiens
tggtgggcaccgcttc

SEQ ID NO: 72566 - DNA, 17 bp, Homo sapiens
tgctgattcatcgcttc

SEQ ID NO: 72567 - DNA, 17 bp, Homo sapiens
tggtcagccatcgcttc

SEQ ID NO: 72568 - DNA, 20 bp, Homo sapiens
tggtgtatataggggagctt

SEQ ID NO: 72569 - DNA, 16 bp, Homo sapiens
tggtgtgtgtcacttc

SEQ ID NO: 72570 - DNA, 16 bp, Homo sapiens
tggtgtgtcatccttc

SEQ ID NO: 72571 - DNA, 17 bp, Homo sapiens
tggctcgcaatcgcttc

SEQ ID NO: 72572 - DNA, 16 bp, Homo sapiens
tggatgtgaccgcttc

SEQ ID NO: 72573 - DNA, 20 bp, Homo sapiens
tggtgtgtataggggagctt

SEQ ID NO: 72574 - DNA, 17 bp, Homo sapiens
tggtgtgtgtaacgttc

SEQ ID NO: 72575 - DNA, 17 bp, Homo sapiens
tggtgtgacggcacttc

SEQ ID NO: 72576 - DNA, 16 bp, Homo sapiens
tggtctataccgcttc

SEQ ID NO: 72577 - DNA, 17 bp, Homo sapiens
tggtgtgtaacgacttc

SEQ ID NO: 72578 - DNA, 64 bp, Rice yellow stunt virus
cacacaagaggagaggcacccagccatgagacgggacgtggacgtgagggtgggcctttgtgtg

SEQ ID NO: 72579 - DNA, 24 bp, Rice yellow stunt virus
agaggcacccagccatgagacggg

SEQ ID NO: 72580 - DNA, 24 bp, Homo sapiens
agaggagcccagggcagagacggg

SEQ ID NO: 72581 - DNA, 21 bp, Homo sapiens
aggggcacgcagccacgtggg

SEQ ID NO: 72582 - DNA, 25 bp, Homo sapiens
agaggcaccatggaggcaagatggg

SEQ ID NO: 72583 - DNA, 20 bp, Homo sapiens
ggccacccagaggagacggg

SEQ ID NO: 72584 - DNA, 24 bp, Homo sapiens
ggcccctcccagccatggggtggg

SEQ ID NO: 72585 - DNA, 20 bp, Homo sapiens
ggttcccagccaaagctggg

SEQ ID NO: 72586 - DNA, 22 bp, Homo sapiens
agaggcagctcagcaatgtggg

SEQ ID NO: 72587 - DNA, 23 bp, Homo sapiens
agaggcaccccggccaggacggg

SEQ ID NO: 72588 - DNA, 22 bp, Homo sapiens
agggtacccagccgcaggtggg

SEQ ID NO: 72589 - DNA, 23 bp, Homo sapiens
gaggcaccgtggccgctttcagg

SEQ ID NO: 72590 - DNA, 19 bp, Homo sapiens
aggggcggccgggagacgg

SEQ ID NO: 72591 - DNA, 18 bp, Homo sapiens
ggctcctggccatgaggg

SEQ ID NO: 72592 - DNA, 19 bp, Homo sapiens
agaggacccagccagctgg

SEQ ID NO: 72593 - DNA, 21 bp, Homo sapiens
aaggcacctgtgggagacggg

SEQ ID NO: 72594 - DNA, 20 bp, Homo sapiens
gaggcaccggagtggatggg

SEQ ID NO: 72595 - DNA, 26 bp, Homo sapiens
aggggacccagccagccatggacggg

SEQ ID NO: 72596 - DNA, 24 bp, Homo sapiens
agaggggcccagccagccaacggg

SEQ ID NO: 72597 - DNA, 21 bp, Homo sapiens
agagacacctgcacagatggg

SEQ ID NO: 72598 - DNA, 20 bp, Homo sapiens
ggcacccagacagggatggg

SEQ ID NO: 72599 - DNA, 16 bp, Homo sapiens
agaggctcccagccag

SEQ ID NO: 72600 - DNA, 22 bp, Homo sapiens
agagtgcccagccactgctggg

SEQ ID NO: 72601 - DNA, 19 bp, Homo sapiens
aggggtacttgccatgaaa

SEQ ID NO: 72602 - DNA, 18 bp, Homo sapiens
agaggaccttggagacgg

SEQ ID NO: 72603 - DNA, 15 bp, Homo sapiens
ggcacccacatgcgg

SEQ ID NO: 72604 - DNA, 24 bp, Homo sapiens
agaggcaccacagttatccctggg

SEQ ID NO: 72605 - DNA, 22 bp, Homo sapiens
agaggcaccaggccctagcggg

SEQ ID NO: 72606 - DNA, 17 bp, Homo sapiens
gaggcacccgcccacag

SEQ ID NO: 72607 - DNA, 24 bp, Homo sapiens
agcaggcagcgaccatgagatggg

SEQ ID NO: 72608 - DNA, 23 bp, Homo sapiens
aggggctttcaaaacaaggcggg

SEQ ID NO: 72609 - DNA, 18 bp, Homo sapiens
gaggcaccacagccgagg

SEQ ID NO: 72610 - DNA, 23 bp, Homo sapiens
agaggcacgccggctcctctggg

SEQ ID NO: 72611 - DNA, 22 bp, Homo sapiens
agaggggctcagtcaaaaaggg

SEQ ID NO: 72612 - DNA, 21 bp, Homo sapiens
aggggccccagccatgcccag

SEQ ID NO: 72613 - DNA, 23 bp, Homo sapiens
agaggcacctgggtgcagacggg

SEQ ID NO: 72614 - DNA, 19 bp, Homo sapiens
agggtcacccagctgtgac

SEQ ID NO: 72615 - DNA, 21 bp, Homo sapiens
agagccacccagccggctggg

SEQ ID NO: 72616 - DNA, 18 bp, Homo sapiens
agaggcaccagtccccgg

SEQ ID NO: 72617 - DNA, 17 bp, Homo sapiens
gaggcacttgccataag

SEQ ID NO: 72618 - DNA, 23 bp, Homo sapiens
agaggcaccttggctaaaatggg

SEQ ID NO: 72619 - DNA, 21 bp, Homo sapiens
agaggcactttgagtggtggg

SEQ ID NO: 72620 - DNA, 23 bp, Homo sapiens
agaggcactgggctgtaatgtgg

SEQ ID NO: 72621 - DNA, 22 bp, Homo sapiens
agagcacccaggtcatggtggg

SEQ ID NO: 72622 - DNA, 25 bp, Homo sapiens
aggggcacccagtccccgctgcggg

SEQ ID NO: 72623 - DNA, 21 bp, Homo sapiens
ggtactcagccatgccccagg

SEQ ID NO: 72624 - DNA, 18 bp, Homo sapiens
agaggctccagccactgg

SEQ ID NO: 72625 - DNA, 21 bp, Homo sapiens
ggcaccataaacccaggtggg

SEQ ID NO: 72626 - DNA, 22 bp, Homo sapiens
agaggcacctgggcgaggcggg

SEQ ID NO: 72627 - DNA, 22 bp, Homo sapiens
agcacccagctatggtcatggg

SEQ ID NO: 72628 - DNA, 21 bp, Homo sapiens
agagggacccagtgagacggg

SEQ ID NO: 72629 - DNA, 21 bp, Homo sapiens
gaagcgtctggccatgagtgg

SEQ ID NO: 72630 - DNA, 18 bp, Homo sapiens
aggggcacccaggctggg

SEQ ID NO: 72631 - DNA, 22 bp, Homo sapiens
gaggcaccccccgcgaggcggg

SEQ ID NO: 72632 - DNA, 17 bp, Homo sapiens
ggcacccatgctgaggg

SEQ ID NO: 72633 - DNA, 21 bp, Homo sapiens
agaggcactgcagcccctggg

SEQ ID NO: 72634 - DNA, 19 bp, Homo sapiens
gaggcacccaccatgaaac

SEQ ID NO: 72635 - DNA, 17 bp, Homo sapiens
ggtccccaggagacggg

SEQ ID NO: 72636 - DNA, 94 bp, Rice yellow stunt virus
cggcgggtgtggtgtgtcttatctatgatatagtgacgatgtatgttgcagtctgtatctatattatgtaaaaaccactatcaatcaatagccg

SEQ ID NO: 72637 - DNA, 24 bp, Rice yellow stunt virus
tctatgatatagtgacgatgtatg

SEQ ID NO: 72638 - DNA, 17 bp, Homo sapiens
tatgatataggataatg

SEQ ID NO: 72639 - DNA, 21 bp, Homo sapiens
tatgatatatatatatgtatg

SEQ ID NO: 72640 - DNA, 18 bp, Homo sapiens
tgtataatgtgatgtatg

SEQ ID NO: 72641 - DNA, 21 bp, Homo sapiens
cctatggtatttggatgtatg

SEQ ID NO: 72642 - DNA, 23 bp, Homo sapiens
tctatgatgtattgtgaggtatg

SEQ ID NO: 72643 - DNA, 23 bp, Homo sapiens
tctatggtgaggtgtgacatatg

SEQ ID NO: 72644 - DNA, 18 bp, Homo sapiens
tgattcttgcgatgtatg

SEQ ID NO: 72645 - DNA, 60 bp, Chimpanzee cytomegalovirus
cggtgggaaaaaaggcattattatctctgtggtacgtctcagtctgtgccgtccccgccg

SEQ ID NO: 72646 - DNA, 22 bp, Chimpanzee cytomegalovirus
tcagtctgtgccgtccccgccg

SEQ ID NO: 72647 - DNA, 16 bp, Homo sapiens
ccagtctgcccctcgc

SEQ ID NO: 72648 - DNA, 18 bp, Homo sapiens
tcagccccgttcccgccg

SEQ ID NO: 72649 - DNA, 21 bp, Homo sapiens
tcatgtctggtgttcctgccg

SEQ ID NO: 72650 - DNA, 19 bp, Homo sapiens
tcaggctgccgccccgccg

SEQ ID NO: 72651 - DNA, 17 bp, Homo sapiens
tcagcctggcttcctgc

SEQ ID NO: 72652 - DNA, 20 bp, Homo sapiens
tcagaccaaggtccccgccg

SEQ ID NO: 72653 - DNA, 19 bp, Homo sapiens
tcggcttggctccccgccg

SEQ ID NO: 72654 - DNA, 23 bp, Homo sapiens
ccagtctgcccgctcgtccctgc

SEQ ID NO: 72655 - DNA, 18 bp, Homo sapiens
gctggctgtcgtccccgc

SEQ ID NO: 72656 - DNA, 20 bp, Homo sapiens
ccagaagcacccgtccccgc

SEQ ID NO: 72657 - DNA, 24 bp, Homo sapiens
tcagtccagaactcgtcttcgtcg

SEQ ID NO: 72658 - DNA, 20 bp, Homo sapiens
ccggtctggaggccccgccg

SEQ ID NO: 72659 - DNA, 19 bp, Homo sapiens
tcggcctccctgtccccgc

SEQ ID NO: 72660 - DNA, 20 bp, Homo sapiens
tcaatctgtgttgtgagccg

SEQ ID NO: 72661 - DNA, 20 bp, Homo sapiens
caatgctgtcgtccccgccg

SEQ ID NO: 72662 - DNA, 17 bp, Homo sapiens
gccggccgtctccgccg

SEQ ID NO: 72663 - DNA, 15 bp, Homo sapiens
cagtctgctccccgc

SEQ ID NO: 72664 - DNA, 23 bp, Homo sapiens
tcagtctgtctatggtctcctgc

SEQ ID NO: 72665 - DNA, 19 bp, Homo sapiens
cagtctgtgcatcagtcgc

SEQ ID NO: 72666 - DNA, 21 bp, Homo sapiens
tctgtgagcgtgtccccgccg

SEQ ID NO: 72667 - DNA, 20 bp, Homo sapiens
cagcaggaggccgtccccgc

SEQ ID NO: 72668 - DNA, 17 bp, Homo sapiens
cagtctgtgtcccctgc

SEQ ID NO: 72669 - DNA, 19 bp, Homo sapiens
ccagccccaccgttcccgc

SEQ ID NO: 72670 - DNA, 20 bp, Homo sapiens
tcaaccctggctgtccccgc

SEQ ID NO: 72671 - DNA, 20 bp, Homo sapiens
caggaggtggctgtccccgc

SEQ ID NO: 72672 - DNA, 20 bp, Homo sapiens
tcaagtctgtgctgtcttcg

SEQ ID NO: 72673 - DNA, 18 bp, Homo sapiens
gtccccgcgtccccgccg

SEQ ID NO: 72674 - DNA, 20 bp, Homo sapiens
ccagtctgcggcccccgccg

SEQ ID NO: 72675 - DNA, 18 bp, Homo sapiens
tcgcggccgtccccgccg

SEQ ID NO: 72676 - DNA, 18 bp, Homo sapiens
cggtcccggtccccgccg

SEQ ID NO: 72677 - DNA, 18 bp, Homo sapiens
ccagtctgcagcctctgc

SEQ ID NO: 72678 - DNA, 19 bp, Homo sapiens
gccgccgccgtccccgccg

SEQ ID NO: 72679 - DNA, 21 bp, Homo sapiens
tcagcccaatcgttcccgccg

SEQ ID NO: 72680 - DNA, 20 bp, Homo sapiens
tcagctgtgccgtccccagc

SEQ ID NO: 72681 - DNA, 19 bp, Homo sapiens
tcaggctgtgccggggccg

SEQ ID NO: 72682 - DNA, 22 bp, Homo sapiens
tcagtctgtggccgaaggcccg

SEQ ID NO: 72683 - DNA, 21 bp, Homo sapiens
tcagtctgtacaaaggtgccg

SEQ ID NO: 72684 - DNA, 18 bp, Homo sapiens
gcggcgctgtccccgccg

SEQ ID NO: 72685 - DNA, 81 bp, Equine herpesvirus 1
tgaacgcggacacctttgaggaatttagcatggaagagtttgatattcccccacccccacctctcccgaaacccgtcttca

SEQ ID NO: 72686 - DNA, 24 bp, Equine herpesvirus 1
acgcggacacctttgaggaattta

SEQ ID NO: 72687 - DNA, 16 bp, Homo sapiens
ggacattcgggaattt

SEQ ID NO: 72688 - DNA, 84 bp, Equine herpesvirus 1
acgacgagacccctattaaataaaatgactgtaaacgcatataaacgtatcaggtgttttattttttctatagtagtgcgtggt

SEQ ID NO: 72689 - DNA, 24 bp, Equine herpesvirus 1
tatcaggtgttttattttttctat

SEQ ID NO: 72690 - DNA, 17 bp, Homo sapiens
tatcaggtttttaccct

SEQ ID NO: 72691 - DNA, 18 bp, Homo sapiens
tatcggtgttttatttcc

SEQ ID NO: 72692 - DNA, 24 bp, Homo sapiens
tatcaagtgttttatttagaccat

SEQ ID NO: 72693 - DNA, 18 bp, Homo sapiens
agtttttattttttctat

SEQ ID NO: 72694 - DNA, 18 bp, Homo sapiens
gcgtgttattttttctat

SEQ ID NO: 72695 - DNA, 17 bp, Homo sapiens
tatcaggttcatttttt

SEQ ID NO: 72696 - DNA, 19 bp, Homo sapiens
tatcaggttttttaaattt

SEQ ID NO: 72697 - DNA, 72 bp, Cowpox virus
tctagacgatatagtggaacaaaatatagcggatgaaaaatttgtagattttgttatacacggtctactaga

SEQ ID NO: 72698 - DNA, 24 bp, Cowpox virus
agtggaacaaaatatagcggatga

SEQ ID NO: 72699 - DNA, 18 bp, Homo sapiens
agggaacaaaatacgatg

SEQ ID NO: 72700 - DNA, 22 bp, Homo sapiens
agaggaacaaagataaggatga

SEQ ID NO: 72701 - DNA, 20 bp, Homo sapiens
agtgggacaaacataggatg

SEQ ID NO: 72702 - DNA, 21 bp, Homo sapiens
gtggagtgaaacacaagggtg

SEQ ID NO: 72703 - DNA, 19 bp, Homo sapiens
agtggaacaggtattgatg

SEQ ID NO: 72704 - DNA, 22 bp, Homo sapiens
gtggaacaaaatggaatggatg

SEQ ID NO: 72705 - DNA, 16 bp, Homo sapiens
agtggaacagaatgga

SEQ ID NO: 72706 - DNA, 18 bp, Homo sapiens
agtgaacaaaatatgtgg

SEQ ID NO: 72707 - DNA, 23 bp, Homo sapiens
agttgaacaaaaggcaggggtga

SEQ ID NO: 72708 - DNA, 20 bp, Homo sapiens
agtgggcaaaatacacatgg

SEQ ID NO: 72709 - DNA, 20 bp, Homo sapiens
gtggaacaaagaggctatga

SEQ ID NO: 72710 - DNA, 20 bp, Homo sapiens
gtggaacagaatgggtacag

SEQ ID NO: 72711 - DNA, 22 bp, Homo sapiens
gtggggtgaatacaacgggtga

SEQ ID NO: 72712 - DNA, 22 bp, Homo sapiens
atggagcaggaggggcggatga

SEQ ID NO: 72713 - DNA, 19 bp, Homo sapiens
gtggggcaaggagcagatg

SEQ ID NO: 72714 - DNA, 23 bp, Homo sapiens
agtagaacaagatatttgaaatg

SEQ ID NO: 72715 - DNA, 16 bp, Homo sapiens
atggaacagaatgaat

SEQ ID NO: 72716 - DNA, 22 bp, Homo sapiens
agtgaaacagaatcatgggtga

SEQ ID NO: 72717 - DNA, 22 bp, Homo sapiens
atggaacaaagtaatcaaatga

SEQ ID NO: 72718 - DNA, 24 bp, Homo sapiens
agtggaatgcaagtttgagggatg

SEQ ID NO: 72719 - DNA, 20 bp, Homo sapiens
gtggggcaaactacaaatga

SEQ ID NO: 72720 - DNA, 23 bp, Homo sapiens
agtggaaaaagagaaacgggtga

SEQ ID NO: 72721 - DNA, 23 bp, Homo sapiens
agtgggacaaaacatgaggggtg

SEQ ID NO: 72722 - DNA, 21 bp, Homo sapiens
agtggaacgtaataaaagtga

SEQ ID NO: 72723 - DNA, 20 bp, Homo sapiens
gtgaatgatatagcgggtga

SEQ ID NO: 72724 - DNA, 21 bp, Homo sapiens
agtagagtaggaagcggatga

SEQ ID NO: 72725 - DNA, 87 bp, Human papillomavirus type 47
ggtcaccgtgcgagatattgttctggagttaagtgaggttcaacctgaagtattaccagttgacctgttttgcgacgaggaattacc

SEQ ID NO: 72726 - DNA, 24 bp, Human papillomavirus type 47
aagtattaccagttgacctgtttt

SEQ ID NO: 72727 - DNA, 22 bp, Homo sapiens
aagtattttcagttgacaaagc

SEQ ID NO: 72728 - DNA, 19 bp, Homo sapiens
tattgccagttgacatatt

SEQ ID NO: 72729 - DNA, 63 bp, Human papillomavirus type 12
cctgtgaggtcaaccttcgtatttttgtcaacgcaactgatactggcattaggaccctacagg

SEQ ID NO: 72730 - DNA, 24 bp, Human papillomavirus type 12
tgatactggcattaggaccctaca

SEQ ID NO: 72731 - DNA, 19 bp, Homo sapiens
tgacactggctggccttac

SEQ ID NO: 72732 - DNA, 23 bp, Homo sapiens
tgtactggcaagaaagggctcta

SEQ ID NO: 72733 - DNA, 15 bp, Homo sapiens
tgatactgcactcct

SEQ ID NO: 72734 - DNA, 23 bp, Homo sapiens
tgatactgtaaaacagttttaca

SEQ ID NO: 72735 - DNA, 17 bp, Homo sapiens
tggcactggcattgcct

SEQ ID NO: 72736 - DNA, 19 bp, Homo sapiens
tgatgtggcaccaccccct

SEQ ID NO: 72737 - DNA, 19 bp, Homo sapiens
tgaacttccaggaccttac

SEQ ID NO: 72738 - DNA, 17 bp, Homo sapiens
tggcattcagggccctc

SEQ ID NO: 72739 - DNA, 16 bp, Homo sapiens
gatactgaggactctc

SEQ ID NO: 72740 - DNA, 63 bp, Human papillomavirus type 13
gtccggctggtggtggagtgtacaggacctgacattcacgacctacacgacctactgctgggc

SEQ ID NO: 72741 - DNA, 24 bp, Human papillomavirus type 13
tggtggtggagtgtacaggacctg

SEQ ID NO: 72742 - DNA, 23 bp, Homo sapiens
ggtggtggcctgggtaggatctg

SEQ ID NO: 72743 - DNA, 19 bp, Homo sapiens
tggtggctggggtgggcct

SEQ ID NO: 72744 - DNA, 21 bp, Homo sapiens
tggggtgggccctgggacctg

SEQ ID NO: 72745 - DNA, 19 bp, Homo sapiens
tgatggtggggtgaatagg

SEQ ID NO: 72746 - DNA, 20 bp, Homo sapiens
ggaggagtgtacagggtctg

SEQ ID NO: 72747 - DNA, 22 bp, Homo sapiens
tggtgtgtctgcacagggcctg

SEQ ID NO: 72748 - DNA, 24 bp, Homo sapiens
tggtgggggagggtctagggcctg

SEQ ID NO: 72749 - DNA, 24 bp, Homo sapiens
tggggcggccgtgtgtggggtctg

SEQ ID NO: 72750 - DNA, 21 bp, Homo sapiens
tggggtggagcccggggtctg

SEQ ID NO: 72751 - DNA, 24 bp, Homo sapiens
ggtggtggggtgtctgtggacctg

SEQ ID NO: 72752 - DNA, 23 bp, Homo sapiens
tggtggcgggggaccagggcctg

SEQ ID NO: 72753 - DNA, 21 bp, Homo sapiens
tggttgaaagtgcagggtctg

SEQ ID NO: 72754 - DNA, 19 bp, Homo sapiens
tggggtggttccaggacct

SEQ ID NO: 72755 - DNA, 18 bp, Homo sapiens
tggtggtggggttgtcct

SEQ ID NO: 72756 - DNA, 21 bp, Homo sapiens
tggtggttgggtggaggcctg

SEQ ID NO: 72757 - DNA, 16 bp, Homo sapiens
tggtggtgacagggcc

SEQ ID NO: 72758 - DNA, 20 bp, Homo sapiens
ggggaggtgtgtaggacctg

SEQ ID NO: 72759 - DNA, 21 bp, Homo sapiens
tggtggtggggtgcctgcctg

SEQ ID NO: 72760 - DNA, 22 bp, Homo sapiens
tggggtggagtggatggatctg

SEQ ID NO: 72761 - DNA, 21 bp, Homo sapiens
ggtggtaacatgtggggtctg

SEQ ID NO: 72762 - DNA, 82 bp, Fowl adenovirus D
cctttccgcgaatcttgcgagatgcctgctggtttctatggtgaaggggccgctagggctattgagtagggtttggtagagg

SEQ ID NO: 72763 - DNA, 24 bp, Fowl adenovirus D
ctagggctattgagtagggtttgg

SEQ ID NO: 72764 - DNA, 17 bp, Homo sapiens
gggctgcagggggtttg

SEQ ID NO: 72765 - DNA, 19 bp, Homo sapiens
tgaggggaagtggggtttg

SEQ ID NO: 72766 - DNA, 22 bp, Homo sapiens
cagggttgttgggtagagaagg

SEQ ID NO: 72767 - DNA, 17 bp, Homo sapiens
gggctgctaagggtttg

SEQ ID NO: 72768 - DNA, 23 bp, Homo sapiens
ctggggctattggctatccccgg

SEQ ID NO: 72769 - DNA, 19 bp, Homo sapiens
caggggttgtgagggtttg

SEQ ID NO: 72770 - DNA, 19 bp, Homo sapiens
gggctattgtgggacttgg

SEQ ID NO: 72771 - DNA, 19 bp, Homo sapiens
ctggggcttttgggctttg

SEQ ID NO: 72772 - DNA, 19 bp, Homo sapiens
ctggggctcttggaatttg

SEQ ID NO: 72773 - DNA, 23 bp, Homo sapiens
cagggctgttgggacaaatttgg

SEQ ID NO: 72774 - DNA, 21 bp, Homo sapiens
tagggctggggtggggtttgg

SEQ ID NO: 72775 - DNA, 19 bp, Homo sapiens
ctggggctgtagggtgggg

SEQ ID NO: 72776 - DNA, 19 bp, Homo sapiens
gggtctgggaagggtttgg

SEQ ID NO: 72777 - DNA, 104 bp, Fowl adenovirus D
ctccgtatcgagcgaattgctccggatccctgagacgccattctccttcggtgaaaatgagcctcttttggagctggtaggcgagttcgcccggattttcgggg

SEQ ID NO: 72778 - DNA, 24 bp, Fowl adenovirus D
ttggagctggtaggcgagttcgcc

SEQ ID NO: 72779 - DNA, 19 bp, Homo sapiens
ttggagctggttgggcagc

SEQ ID NO: 72780 - DNA, 24 bp, Homo sapiens
ttggggctggcaggtgagcggggc

SEQ ID NO: 72781 - DNA, 19 bp, Homo sapiens
ttggagctggaggaagtgc

SEQ ID NO: 72782 - DNA, 18 bp, Homo sapiens
ttggagctggagggagtt

SEQ ID NO: 72783 - DNA, 28 bp, Homo sapiens
ttggagctggaggatgctggcgaactcg

SEQ ID NO: 72784 - DNA, 24 bp, Homo sapiens
ttggggctggagggcgagtcgcgc

SEQ ID NO: 72785 - DNA, 68 bp, Human papillomavirus type 22
gcgactttcaaacatctctacttggacctgtaaaacttttgtgtcccacctgtcgagaagagattcgc

SEQ ID NO: 72786 - DNA, 24 bp, Human papillomavirus type 22
tacttggacctgtaaaacttttgt

SEQ ID NO: 72787 - DNA, 18 bp, Homo sapiens
ggaaccatagacttttgt

SEQ ID NO: 72788 - DNA, 21 bp, Homo sapiens
cttaaactgtaaaatttttgt

SEQ ID NO: 72789 - DNA, 19 bp, Homo sapiens
cttggctctgctattttgt

SEQ ID NO: 72790 - DNA, 21 bp, Homo sapiens
tacttggacacctatttttgt

SEQ ID NO: 72791 - DNA, 26 bp, Homo sapiens
tacttggaagagctcaaaacttttgt

SEQ ID NO: 72792 - DNA, 18 bp, Homo sapiens
tacttggactgtgaaact

SEQ ID NO: 72793 - DNA, 21 bp, Homo sapiens
tacctggacctccatttttgt

SEQ ID NO: 72794 - DNA, 19 bp, Homo sapiens
ttggcagtaaaacttttgt

SEQ ID NO: 72795 - DNA, 108 bp, Human herpesvirus 2
ggtatcccggataatctgacgttccggatatagggggcggggggtagtggggggtgtgtcgacaaactgccgcttcttaaaacaccggggcccgtcgctcggggtgct

SEQ ID NO: 72796 - DNA, 24 bp, Human herpesvirus 2
tagggggcggggggtagtgggggg

SEQ ID NO: 72797 - DNA, 19 bp, Homo sapiens
gggggcggggcgtgggggg

SEQ ID NO: 72798 - DNA, 20 bp, Homo sapiens
ggagggcggggggctcgggg

SEQ ID NO: 72799 - DNA, 17 bp, Homo sapiens
gggggcgggggcggggg

SEQ ID NO: 72800 - DNA, 17 bp, Homo sapiens
ggggacgggggcggggg

SEQ ID NO: 72801 - DNA, 17 bp, Homo sapiens
ggggggtgggaggtggg

SEQ ID NO: 72802 - DNA, 19 bp, Homo sapiens
taggggttggggggtaggg

SEQ ID NO: 72803 - DNA, 16 bp, Homo sapiens
gggggtggggggtggg

SEQ ID NO: 72804 - DNA, 25 bp, Homo sapiens
cagggggcggggcaggagtgggggg

SEQ ID NO: 72805 - DNA, 19 bp, Homo sapiens
cagggggtggggggtgggg

SEQ ID NO: 72806 - DNA, 24 bp, Homo sapiens
ggggtggggaggtggtggggggcc

SEQ ID NO: 72807 - DNA, 18 bp, Homo sapiens
ggggggtgggggtggggg

SEQ ID NO: 72808 - DNA, 25 bp, Homo sapiens
tagggggtgggagggatggcggggg

SEQ ID NO: 72809 - DNA, 19 bp, Homo sapiens
cagggggcgggggcggggg

SEQ ID NO: 72810 - DNA, 17 bp, Homo sapiens
gggggtgggggtggggg

SEQ ID NO: 72811 - DNA, 22 bp, Homo sapiens
gggggtggggggtaggtggggg

SEQ ID NO: 72812 - DNA, 16 bp, Homo sapiens
gggggcggggcggggg

SEQ ID NO: 72813 - DNA, 17 bp, Homo sapiens
ggggggggggttggggg

SEQ ID NO: 72814 - DNA, 17 bp, Homo sapiens
gggggcgggggtggggg

SEQ ID NO: 72815 - DNA, 21 bp, Homo sapiens
gggggccggaagggtgggggg

SEQ ID NO: 72816 - DNA, 15 bp, Homo sapiens
ggggggggggtgggg

SEQ ID NO: 72817 - DNA, 18 bp, Homo sapiens
agggggcagtggtggggg

SEQ ID NO: 72818 - DNA, 18 bp, Homo sapiens
gggggtggggggtaaagg

SEQ ID NO: 72819 - DNA, 20 bp, Homo sapiens
gggggcggggggccgcgggg

SEQ ID NO: 72820 - DNA, 20 bp, Homo sapiens
ggggggtggtggccaggggg

SEQ ID NO: 72821 - DNA, 20 bp, Homo sapiens
ggggcggtggggggcggggg

SEQ ID NO: 72822 - DNA, 20 bp, Homo sapiens
gggggctggggacagggggg

SEQ ID NO: 72823 - DNA, 18 bp, Homo sapiens
tagggggtgggagggggg

SEQ ID NO: 72824 - DNA, 18 bp, Homo sapiens
gggggctggggagggggg

SEQ ID NO: 72825 - DNA, 18 bp, Homo sapiens
tagggggctgggggtggg

SEQ ID NO: 72826 - DNA, 17 bp, Homo sapiens
ggtgggcgggggggggg

SEQ ID NO: 72827 - DNA, 20 bp, Homo sapiens
agggggtggggaaagggggg

SEQ ID NO: 72828 - DNA, 18 bp, Homo sapiens
ggggggtggggggtgggg

SEQ ID NO: 72829 - DNA, 21 bp, Homo sapiens
gggggcgggggctgtaaaagg

SEQ ID NO: 72830 - DNA, 20 bp, Homo sapiens
gggggctggttggtgggggg

SEQ ID NO: 72831 - DNA, 18 bp, Homo sapiens
ggggtgggggaagggggg

SEQ ID NO: 72832 - DNA, 23 bp, Homo sapiens
ggtgggtggggaggggtgggggg

SEQ ID NO: 72833 - DNA, 18 bp, Homo sapiens
ggtggggtggggtggggg

SEQ ID NO: 72834 - DNA, 17 bp, Homo sapiens
ggggggtggggaggggg

SEQ ID NO: 72835 - DNA, 17 bp, Homo sapiens
gggggctggggggtggg

SEQ ID NO: 72836 - DNA, 18 bp, Homo sapiens
gggggcggggggtggtgg

SEQ ID NO: 72837 - DNA, 20 bp, Homo sapiens
gggggctggggcgaaggggg

SEQ ID NO: 72838 - DNA, 24 bp, Homo sapiens
taggaggtggtggttggtgggggg

SEQ ID NO: 72839 - DNA, 17 bp, Homo sapiens
ggggtgggggttggggg

SEQ ID NO: 72840 - DNA, 18 bp, Homo sapiens
ggggggtgggaggtgggg

SEQ ID NO: 72841 - DNA, 17 bp, Homo sapiens
gggaggtggggaggggg

SEQ ID NO: 72842 - DNA, 19 bp, Homo sapiens
gggggtggggggtgggggg

SEQ ID NO: 72843 - DNA, 19 bp, Homo sapiens
ggggggtggggggtggggg

SEQ ID NO: 72844 - DNA, 18 bp, Homo sapiens
ggggtgcgggggtggggg

SEQ ID NO: 72845 - DNA, 17 bp, Homo sapiens
gggggccgggggagggg

SEQ ID NO: 72846 - DNA, 23 bp, Homo sapiens
gggggtggggggctggctgcggg

SEQ ID NO: 72847 - DNA, 17 bp, Homo sapiens
gggggtggggggagggg

SEQ ID NO: 72848 - DNA, 16 bp, Homo sapiens
ggggtgggggaagggg

SEQ ID NO: 72849 - DNA, 21 bp, Homo sapiens
tagggggtgggggtagaccag

SEQ ID NO: 72850 - DNA, 20 bp, Homo sapiens
ggggggtgggggtggcttag

SEQ ID NO: 72851 - DNA, 18 bp, Homo sapiens
agggggcggggagggggg

SEQ ID NO: 72852 - DNA, 16 bp, Homo sapiens
gggggtgggggggggg

SEQ ID NO: 72853 - DNA, 22 bp, Homo sapiens
gggggtggggaggtgaagaggg

SEQ ID NO: 72854 - DNA, 18 bp, Homo sapiens
agggggtggggagggggg

SEQ ID NO: 72855 - DNA, 19 bp, Homo sapiens
gggggcggggggcaggggg

SEQ ID NO: 72856 - DNA, 20 bp, Homo sapiens
ggggtgtggggggcctgggg

SEQ ID NO: 72857 - DNA, 20 bp, Homo sapiens
gggcggtgggagatgggggg

SEQ ID NO: 72858 - DNA, 17 bp, Homo sapiens
gggggcgggaggcgggg

SEQ ID NO: 72859 - DNA, 16 bp, Homo sapiens
gggggtgggggtgggg

SEQ ID NO: 72860 - DNA, 17 bp, Homo sapiens
gggggtgggggaagggg

SEQ ID NO: 72861 - DNA, 25 bp, Homo sapiens
tagaggggtggggggtagtagaggg

SEQ ID NO: 72862 - DNA, 19 bp, Homo sapiens
taaggggtgggggtggggg

SEQ ID NO: 72863 - DNA, 18 bp, Homo sapiens
ggggcggggggagggggg

SEQ ID NO: 72864 - DNA, 19 bp, Homo sapiens
cagggggcgggggaggggg

SEQ ID NO: 72865 - DNA, 18 bp, Homo sapiens
gggggtgggggggtgggg

SEQ ID NO: 72866 - DNA, 21 bp, Homo sapiens
agaaactggggtggtgggggg

SEQ ID NO: 72867 - DNA, 18 bp, Homo sapiens
gggggcgggggaaggggg

SEQ ID NO: 72868 - DNA, 21 bp, Homo sapiens
gggggtggggggcgtgggggg

SEQ ID NO: 72869 - DNA, 17 bp, Homo sapiens
gggggcggggggtgggg

SEQ ID NO: 72870 - DNA, 18 bp, Homo sapiens
gggggcgggggcccgggg

SEQ ID NO: 72871 - DNA, 21 bp, Homo sapiens
acggggtgtgctggtgggggg

SEQ ID NO: 72872 - DNA, 19 bp, Homo sapiens
aggggggtgggggtggggg

SEQ ID NO: 72873 - DNA, 17 bp, Homo sapiens
gagggcgggggcggggg

SEQ ID NO: 72874 - DNA, 17 bp, Homo sapiens
ggggggtgggggctggg

SEQ ID NO: 72875 - DNA, 21 bp, Homo sapiens
agggggtgggggggtgggggg

SEQ ID NO: 72876 - DNA, 17 bp, Homo sapiens
aggggtggggggtgtgg

SEQ ID NO: 72877 - DNA, 20 bp, Homo sapiens
ggggggagggtgatgggggg

SEQ ID NO: 72878 - DNA, 19 bp, Homo sapiens
tagggggcgggaggtagtg

SEQ ID NO: 72879 - DNA, 18 bp, Homo sapiens
ggagggtgggggtggggg

SEQ ID NO: 72880 - DNA, 16 bp, Homo sapiens
gggggcgggaggtggg

SEQ ID NO: 72881 - DNA, 19 bp, Homo sapiens
gggggctgggggagggggg

SEQ ID NO: 72882 - DNA, 16 bp, Homo sapiens
gggggcgggggtgggg

SEQ ID NO: 72883 - DNA, 21 bp, Homo sapiens
agggggcggggggccctgggg

SEQ ID NO: 72884 - DNA, 20 bp, Homo sapiens
ggggggtggggggtgaaagg

SEQ ID NO: 72885 - DNA, 18 bp, Homo sapiens
gggggtggggggttaggg

SEQ ID NO: 72886 - DNA, 18 bp, Homo sapiens
ggggtggtggggtggggg

SEQ ID NO: 72887 - DNA, 25 bp, Homo sapiens
gggggtggagggtggtggtgggggg

SEQ ID NO: 72888 - DNA, 19 bp, Homo sapiens
gggggtggggggagtgggg

SEQ ID NO: 72889 - DNA, 23 bp, Homo sapiens
gggggtggggggtggaaataagg

SEQ ID NO: 72890 - DNA, 18 bp, Homo sapiens
ggtgggcggggaaggggg

SEQ ID NO: 72891 - DNA, 21 bp, Homo sapiens
tagggggtgcggcctgggggg

SEQ ID NO: 72892 - DNA, 20 bp, Homo sapiens
ggggcggctgtagtgggggg

SEQ ID NO: 72893 - DNA, 18 bp, Homo sapiens
gggggctgggggcagggg

SEQ ID NO: 72894 - DNA, 18 bp, Homo sapiens
aggggggtggggggtggg

SEQ ID NO: 72895 - DNA, 16 bp, Homo sapiens
gggggcgggggggggg

SEQ ID NO: 72896 - DNA, 16 bp, Homo sapiens
gggggctggggggggg

SEQ ID NO: 72897 - DNA, 22 bp, Homo sapiens
gggggcggggggtggttcatag

SEQ ID NO: 72898 - DNA, 18 bp, Homo sapiens
ggggggtgggggcgtggg

SEQ ID NO: 72899 - DNA, 20 bp, Homo sapiens
ggggggtgggaggtgggggg

SEQ ID NO: 72900 - DNA, 18 bp, Homo sapiens
gggaggtggggggttggg

SEQ ID NO: 72901 - DNA, 19 bp, Homo sapiens
ggggggtggggggcggggg

SEQ ID NO: 72902 - DNA, 18 bp, Homo sapiens
gggggcagggggcagggg

SEQ ID NO: 72903 - DNA, 71 bp, Human herpesvirus 2
cccgtggtccgatcttcactcactcgcctgtctgcggacctatgcacggcgggacggcgcgcggacccggg

SEQ ID NO: 72904 - DNA, 24 bp, Human herpesvirus 2
tcactcgcctgtctgcggacctat

SEQ ID NO: 72905 - DNA, 19 bp, Homo sapiens
tcactcgccgtctgtccag

SEQ ID NO: 72906 - DNA, 20 bp, Homo sapiens
actcacctgtttgaaaaccc

SEQ ID NO: 72907 - DNA, 19 bp, Homo sapiens
tcacccgcctgtctatcct

SEQ ID NO: 72908 - DNA, 27 bp, Homo sapiens
tcattcgtctgcctgctgagctcctat

SEQ ID NO: 72909 - DNA, 18 bp, Homo sapiens
gctgtctgcaattactat

SEQ ID NO: 72910 - DNA, 17 bp, Homo sapiens
cgccgtctgcgggccta

SEQ ID NO: 72911 - DNA, 131 bp, Human herpesvirus 3
acattatacagtcgtagtaccgtttatataatgttaggtaggaggagcctataaaaatattttgattggcgttaaaaggttcttcaacttaccgtgacgtcctttttattaacatgcgtttttattgatgt

SEQ ID NO: 72912 - DNA, 24 bp, Human herpesvirus 3
aaggttcttcaacttaccgtgacg

SEQ ID NO: 72913 - DNA, 17 bp, Homo sapiens
aagttcttcggttccat

SEQ ID NO: 72914 - DNA, 22 bp, Homo sapiens
aaggttctttacactcggggtg

SEQ ID NO: 72915 - DNA, 22 bp, Homo sapiens
ggttctctatctctccgtgacg

SEQ ID NO: 72916 - DNA, 21 bp, Homo sapiens
aggttcttgaactttcattga

SEQ ID NO: 72917 - DNA, 21 bp, Homo sapiens
ggtccttcagtttaaatggtg

SEQ ID NO: 72918 - DNA, 19 bp, Homo sapiens
aaggttcttccactttgtg

SEQ ID NO: 72919 - DNA, 21 bp, Homo sapiens
ggttcatcagtttaccacacg

SEQ ID NO: 72920 - DNA, 84 bp, Paramecium bursaria Chlorella virus 1
gacgcgaataaatatttgacgtgctccgacgtaaattttattattctggagaagtaatgcatatgtaaaatacctattcccgtt

SEQ ID NO: 72921 - DNA, 19 bp, Paramecium bursaria Chlorella virus 1
taaaatacctattcccgtt

SEQ ID NO: 72922 - DNA, 19 bp, Homo sapiens
aaaataccttacatccgtt

SEQ ID NO: 72923 - DNA, 15 bp, Homo sapiens
aaaatacttcccgct

SEQ ID NO: 72924 - DNA, 17 bp, Homo sapiens
taaaatacctggccatt

SEQ ID NO: 72925 - DNA, 19 bp, Homo sapiens
caaaatgccgagccccgtt

SEQ ID NO: 72926 - DNA, 20 bp, Homo sapiens
aaaataccagtctccctgtt

SEQ ID NO: 72927 - DNA, 131 bp, Swinepox virus
acttttttttaccgtttataaattattattttataaaataaagatgttaatttacttaccttaggtatagataaatataatcatctattatttttattaaaaataataatttataaacggtaaaaaaaagt

SEQ ID NO: 72928 - DNA, 24 bp, Swinepox virus
taaattattattttataaaataaa

SEQ ID NO: 72929 - DNA, 23 bp, Homo sapiens
taaatcattatttatcataaaat

SEQ ID NO: 72930 - DNA, 19 bp, Homo sapiens
tattaccttataaaataaa

SEQ ID NO: 72931 - DNA, 75 bp, Human papillomavirus type 36
ttggtacagatttataaacttttacacagtattcaaggaatgtttgtttactctgactaagtataactctaccaa

SEQ ID NO: 72932 - DNA, 24 bp, Human papillomavirus type 36
tactctgactaagtataactctac

SEQ ID NO: 72933 - DNA, 16 bp, Homo sapiens
ctctgacttaattcta

SEQ ID NO: 72934 - DNA, 17 bp, Homo sapiens
tacgttgactaaactct

SEQ ID NO: 72935 - DNA, 17 bp, Homo sapiens
ctttgacttcaactcta

SEQ ID NO: 72936 - DNA, 16 bp, Homo sapiens
ctctgactgcagctct

SEQ ID NO: 72937 - DNA, 22 bp, Homo sapiens
tctgactaggagtgctaactct

SEQ ID NO: 72938 - DNA, 18 bp, Homo sapiens
tactctgataatacagct

SEQ ID NO: 72939 - DNA, 18 bp, Homo sapiens
tgaccaaggtgtaactct

SEQ ID NO: 72940 - DNA, 16 bp, Homo sapiens
tactctgattaactct

SEQ ID NO: 72941 - DNA, 62 bp, Human papillomavirus type 36
cgatactgctgccaatatagactctgtttagtgccagaacatatcatcttggaagcagatcg

SEQ ID NO: 72942 - DNA, 21 bp, Human papillomavirus type 36
tatcatcttggaagcagatcg

SEQ ID NO: 72943 - DNA, 21 bp, Homo sapiens
ccatcttggggtagtccagat

SEQ ID NO: 72944 - DNA, 18 bp, Homo sapiens
tatctcttggaaaactcg

SEQ ID NO: 72945 - DNA, 15 bp, Homo sapiens
tcatcttgaaagatc

SEQ ID NO: 72946 - DNA, 21 bp, Homo sapiens
catcgaaccgggggcaggtcg

SEQ ID NO: 72947 - DNA, 21 bp, Homo sapiens
tcatcttagggcatcaggtcg

SEQ ID NO: 72948 - DNA, 21 bp, Homo sapiens
atccgttctgggagcagatcg

SEQ ID NO: 72949 - DNA, 75 bp, Human herpesvirus 6B
tggtaaaaaaacaggattaaaaaaacaaacaacgacaaatcttatcatcggctgaaatttttattctgtatacta

SEQ ID NO: 72950 - DNA, 24 bp, Human herpesvirus 6B
aacaggattaaaaaaacaaacaac

SEQ ID NO: 72951 - DNA, 18 bp, Homo sapiens
aagactgaaaacaaacaa

SEQ ID NO: 72952 - DNA, 19 bp, Homo sapiens
aacaagcaaaaacaaacaa

SEQ ID NO: 72953 - DNA, 18 bp, Homo sapiens
ggcaaaaaaacaaacaac

SEQ ID NO: 72954 - DNA, 21 bp, Homo sapiens
aaaaagaaaaaaacaaacaac

SEQ ID NO: 72955 - DNA, 20 bp, Homo sapiens
acaagaaaagaacaaacaac

SEQ ID NO: 72956 - DNA, 22 bp, Homo sapiens
agaaaataagaaaacaaacaac

SEQ ID NO: 72957 - DNA, 23 bp, Homo sapiens
caggaataaaaaaaataaacaac

SEQ ID NO: 72958 - DNA, 19 bp, Homo sapiens
acaggattaaaaactaaac

SEQ ID NO: 72959 - DNA, 21 bp, Homo sapiens
caacacaaagaaacaaacaac

SEQ ID NO: 72960 - DNA, 21 bp, Homo sapiens
agatgataaaaaacaaacaac

SEQ ID NO: 72961 - DNA, 18 bp, Homo sapiens
acaggattaaaagcccaa

SEQ ID NO: 72962 - DNA, 21 bp, Homo sapiens
aacagtaatcaaacaaacaac

SEQ ID NO: 72963 - DNA, 18 bp, Homo sapiens
acaagactaaacaaacaa

SEQ ID NO: 72964 - DNA, 19 bp, Homo sapiens
ggatctaaaaacaaacaac

SEQ ID NO: 72965 - DNA, 22 bp, Homo sapiens
aacaggccaaaaaaaataaaca

SEQ ID NO: 72966 - DNA, 23 bp, Homo sapiens
aacaggaatttgggaacaaacaa

SEQ ID NO: 72967 - DNA, 18 bp, Homo sapiens
aggatttaagaaacaaac

SEQ ID NO: 72968 - DNA, 20 bp, Homo sapiens
aacaggatttgaaagaacaa

SEQ ID NO: 72969 - DNA, 19 bp, Homo sapiens
acaggattaaaaaaaaaaa

SEQ ID NO: 72970 - DNA, 18 bp, Homo sapiens
aacagccaaaaacaaaca

SEQ ID NO: 72971 - DNA, 23 bp, Homo sapiens
aacaggattgataaaacccaaac

SEQ ID NO: 72972 - DNA, 19 bp, Homo sapiens
aggagtaaaaacaaacaac

SEQ ID NO: 72973 - DNA, 18 bp, Homo sapiens
agaagcaaaacaaacaac

SEQ ID NO: 72974 - DNA, 20 bp, Homo sapiens
aacaatgaaaaacaaacaac

SEQ ID NO: 72975 - DNA, 17 bp, Homo sapiens
acaggattaaaggacaa

SEQ ID NO: 72976 - DNA, 19 bp, Homo sapiens
caggactggcaaacaaaca

SEQ ID NO: 72977 - DNA, 21 bp, Homo sapiens
acaggttagggaacaaacaac

SEQ ID NO: 72978 - DNA, 21 bp, Homo sapiens
caaaataaaaaaacaaacaac

SEQ ID NO: 72979 - DNA, 21 bp, Homo sapiens
aaaatccagaaaacaaacaac

SEQ ID NO: 72980 - DNA, 22 bp, Homo sapiens
aggatgaggaggaacaaacaac

SEQ ID NO: 72981 - DNA, 20 bp, Homo sapiens
caggattagaaaaaaaaaac

SEQ ID NO: 72982 - DNA, 23 bp, Homo sapiens
acagcacatagggaaacaaacaa

SEQ ID NO: 72983 - DNA, 23 bp, Homo sapiens
acagggaagtccaaacaaacaac

SEQ ID NO: 72984 - DNA, 18 bp, Homo sapiens
aggattttaaacaaacaa

SEQ ID NO: 72985 - DNA, 24 bp, Homo sapiens
aacaaaaggaaaaaaacaaacaac

SEQ ID NO: 72986 - DNA, 21 bp, Homo sapiens
aaaatccaaaaaacaaacaac

SEQ ID NO: 72987 - DNA, 18 bp, Homo sapiens
caggaccaaataaataac

SEQ ID NO: 72988 - DNA, 21 bp, Homo sapiens
aacaggatttaggaaacagac

SEQ ID NO: 72989 - DNA, 19 bp, Homo sapiens
aggttaaaaaaacagacaa

SEQ ID NO: 72990 - DNA, 22 bp, Homo sapiens
aacaagattagaaaagccaaca

SEQ ID NO: 72991 - DNA, 20 bp, Homo sapiens
aacagggggacaaacaaaca

SEQ ID NO: 72992 - DNA, 22 bp, Homo sapiens
aacaagatacaaaacaaacaac

SEQ ID NO: 72993 - DNA, 19 bp, Homo sapiens
aacaggatcagagcaaaca

SEQ ID NO: 72994 - DNA, 18 bp, Homo sapiens
acaggaatagaaaaacaa

SEQ ID NO: 72995 - DNA, 19 bp, Homo sapiens
aacaggactggaaaaccaa

SEQ ID NO: 72996 - DNA, 22 bp, Homo sapiens
cagggttaaaacaaaaaacaac

SEQ ID NO: 72997 - DNA, 22 bp, Homo sapiens
aacaggatttgggaaagcaaac

SEQ ID NO: 72998 - DNA, 25 bp, Homo sapiens
aacaggattgggtggcttaaacaac

SEQ ID NO: 72999 - DNA, 22 bp, Homo sapiens
caggaaaaacaaggaacaaaca

SEQ ID NO: 73000 - DNA, 21 bp, Homo sapiens
caggagcagggaaacaaacaa

SEQ ID NO: 73001 - DNA, 24 bp, Homo sapiens
aactgaacaaagggaacaaacaac

SEQ ID NO: 73002 - DNA, 19 bp, Homo sapiens
ggcaataaaaaaacaagca

SEQ ID NO: 73003 - DNA, 24 bp, Homo sapiens
acaggaataataaaaacaaacaac

SEQ ID NO: 73004 - DNA, 20 bp, Homo sapiens
acaagaaaaaaacaaacaac

SEQ ID NO: 73005 - DNA, 25 bp, Homo sapiens
aactcaacaaaaaaagacaaacaac

SEQ ID NO: 73006 - DNA, 76 bp, Fowlpox virus
atattatctttatctaaccgaacagatgttgctttcttagttaacataaatagaaaaaaaacgataactataatat

SEQ ID NO: 73007 - DNA, 24 bp, Fowlpox virus
ttaacataaatagaaaaaaaacga

SEQ ID NO: 73008 - DNA, 23 bp, Homo sapiens
tcaacataaatacaaaagagcga

SEQ ID NO: 73009 - DNA, 73 bp, Cricket paralysis virus
ctttatccccataggattcttttaaatttaaaattttaaataattaacgtcagagtcccatcggggctaacag

SEQ ID NO: 73010 - DNA, 24 bp, Cricket paralysis virus
tcagagtcccatcggggctaacag

SEQ ID NO: 73011 - DNA, 18 bp, Homo sapiens
ccagggccggggctggca

SEQ ID NO: 73012 - DNA, 22 bp, Homo sapiens
tcacagtcccatcgtcggagct

SEQ ID NO: 73013 - DNA, 20 bp, Homo sapiens
agaggaggcggggctagcag

SEQ ID NO: 73014 - DNA, 17 bp, Homo sapiens
tcagagtcccgcagagc

SEQ ID NO: 73015 - DNA, 21 bp, Homo sapiens
tcaaagtcttgttatcagagc

SEQ ID NO: 73016 - DNA, 17 bp, Homo sapiens
agagtccctcgaataca

SEQ ID NO: 73017 - DNA, 20 bp, Homo sapiens
tcagagctcttacctggtgg

SEQ ID NO: 73018 - DNA, 22 bp, Homo sapiens
aggggtctcccagggctaacag

SEQ ID NO: 73019 - DNA, 22 bp, Homo sapiens
gagtgcggcgcggggctagcag

SEQ ID NO: 73020 - DNA, 17 bp, Homo sapiens
tcagagtctgatcgcca

SEQ ID NO: 73021 - DNA, 21 bp, Homo sapiens
tcagagtcttgctacaaacag

SEQ ID NO: 73022 - DNA, 16 bp, Homo sapiens
tcagagtcatcactaa

SEQ ID NO: 73023 - DNA, 24 bp, Homo sapiens
tcagagtccacacacaattgacag

SEQ ID NO: 73024 - DNA, 17 bp, Homo sapiens
tcacagtcccacactaa

SEQ ID NO: 73025 - DNA, 21 bp, Homo sapiens
tcagagtcccatgctcctggc

SEQ ID NO: 73026 - DNA, 21 bp, Homo sapiens
tcagggcctgggcgctggcag

SEQ ID NO: 73027 - DNA, 20 bp, Homo sapiens
tcagagcttcattgcaggac

SEQ ID NO: 73028 - DNA, 21 bp, Homo sapiens
tcggagtcccacacacaacag

SEQ ID NO: 73029 - DNA, 19 bp, Homo sapiens
gagtcccactggctgtcag

SEQ ID NO: 73030 - DNA, 18 bp, Homo sapiens
tcagggccgaggctgaca

SEQ ID NO: 73031 - DNA, 19 bp, Homo sapiens
tcagagtccagtctggtgg

SEQ ID NO: 73032 - DNA, 20 bp, Homo sapiens
agagtctccaaggctgacag

SEQ ID NO: 73033 - DNA, 19 bp, Homo sapiens
tcagagtctcttgacaaca

SEQ ID NO: 73034 - DNA, 21 bp, Homo sapiens
tcggagtccatctttggacag

SEQ ID NO: 73035 - DNA, 21 bp, Homo sapiens
tcagagtcttaatggacacag

SEQ ID NO: 73036 - DNA, 18 bp, Homo sapiens
tcagagtccatcaatcca

SEQ ID NO: 73037 - DNA, 73 bp, Molluscum contagiosum virus
cgcacacgggcaggcagaaggcgcagtcgatctcgcactggggtcgcaagcagccctttcccagcccgcggcg

SEQ ID NO: 73038 - DNA, 24 bp, Molluscum contagiosum virus
tcgcaagcagccctttcccagccc

SEQ ID NO: 73039 - DNA, 21 bp, Homo sapiens
gctctgagcccttttccagcc

SEQ ID NO: 73040 - DNA, 20 bp, Homo sapiens
tccaagttctttcccagccc

SEQ ID NO: 73041 - DNA, 19 bp, Homo sapiens
gccccctctttcccagccc

SEQ ID NO: 73042 - DNA, 18 bp, Homo sapiens
tcgcaaacagcctggccc

SEQ ID NO: 73043 - DNA, 21 bp, Homo sapiens
tcgtggtgcagagctcccagc

SEQ ID NO: 73044 - DNA, 23 bp, Homo sapiens
gcagccagccctttccccagccc

SEQ ID NO: 73045 - DNA, 18 bp, Homo sapiens
gcaggagtttcccagccc

SEQ ID NO: 73046 - DNA, 21 bp, Homo sapiens
tcgcaagccagtcctggggcc

SEQ ID NO: 73047 - DNA, 19 bp, Homo sapiens
gcagtcccccacccagccc

SEQ ID NO: 73048 - DNA, 21 bp, Homo sapiens
tcccaggcacccttctggccc

SEQ ID NO: 73049 - DNA, 17 bp, Homo sapiens
tccaagtagcccttccc

SEQ ID NO: 73050 - DNA, 17 bp, Homo sapiens
gcaaacagctctttcgc

SEQ ID NO: 73051 - DNA, 22 bp, Homo sapiens
gcaaacagtcctcagttacagc

SEQ ID NO: 73052 - DNA, 16 bp, Homo sapiens
agcagccctccagtcc

SEQ ID NO: 73053 - DNA, 18 bp, Homo sapiens
tctgagcagcccccggcc

SEQ ID NO: 73054 - DNA, 23 bp, Homo sapiens
tcgaagcagcctctccccccagc

SEQ ID NO: 73055 - DNA, 23 bp, Homo sapiens
tctcaagcagccctttcctagcc

SEQ ID NO: 73056 - DNA, 17 bp, Homo sapiens
gcaagcagccagccagc

SEQ ID NO: 73057 - DNA, 22 bp, Homo sapiens
acaagcagctcaaatctagccc

SEQ ID NO: 73058 - DNA, 17 bp, Homo sapiens
tcacaagcggctccagc

SEQ ID NO: 73059 - DNA, 18 bp, Homo sapiens
aagcagctttcctcccag

SEQ ID NO: 73060 - DNA, 21 bp, Homo sapiens
aagcagtggctgccccagccc

SEQ ID NO: 73061 - DNA, 19 bp, Homo sapiens
tccaagcagccagccggcc

SEQ ID NO: 73062 - DNA, 22 bp, Homo sapiens
tcggaggcagccctcttcctcc

SEQ ID NO: 73063 - DNA, 19 bp, Homo sapiens
tcgcaaacagctttccgcc

SEQ ID NO: 73064 - DNA, 20 bp, Homo sapiens
ccgctccccctttcctggcc

SEQ ID NO: 73065 - DNA, 22 bp, Homo sapiens
acactcagccctttcccagccc

SEQ ID NO: 73066 - DNA, 18 bp, Homo sapiens
ccgcaagcacctcctggc

SEQ ID NO: 73067 - DNA, 16 bp, Homo sapiens
gcagccctcgcagccc

SEQ ID NO: 73068 - DNA, 22 bp, Homo sapiens
tctaagcagcccttggggacag

SEQ ID NO: 73069 - DNA, 16 bp, Homo sapiens
tccaagcagcaccagc

SEQ ID NO: 73070 - DNA, 19 bp, Homo sapiens
tcgcaggcagaccctgttc

SEQ ID NO: 73071 - DNA, 20 bp, Homo sapiens
cgcaggcggggctcccagcc

SEQ ID NO: 73072 - DNA, 19 bp, Homo sapiens
gcaaacagctctctagccc

SEQ ID NO: 73073 - DNA, 17 bp, Homo sapiens
tccaagcagccccgcag

SEQ ID NO: 73074 - DNA, 20 bp, Homo sapiens
gccctgcggccttttcccag

SEQ ID NO: 73075 - DNA, 17 bp, Homo sapiens
ccacacttttcccagcc

SEQ ID NO: 73076 - DNA, 21 bp, Homo sapiens
tctcaagcagctctttaagcc

SEQ ID NO: 73077 - DNA, 21 bp, Homo sapiens
tcccaggcggctcccaggtcc

SEQ ID NO: 73078 - DNA, 20 bp, Homo sapiens
gcaagcagtgagcccccggc

SEQ ID NO: 73079 - DNA, 18 bp, Homo sapiens
cgcgggcagcccttgtcc

SEQ ID NO: 73080 - DNA, 24 bp, Homo sapiens
gcaagcagctctagtactcggtcc

SEQ ID NO: 73081 - DNA, 22 bp, Homo sapiens
tctaggcagtgctgcccagccc

SEQ ID NO: 73082 - DNA, 24 bp, Homo sapiens
tcacaagcagcggctatttcagcc

SEQ ID NO: 73083 - DNA, 19 bp, Homo sapiens
tccaagcagctccagagcc

SEQ ID NO: 73084 - DNA, 21 bp, Homo sapiens
tcttgggcagcaccccagccc

SEQ ID NO: 73085 - DNA, 24 bp, Homo sapiens
tccaggcactgaacttcccagccc

SEQ ID NO: 73086 - DNA, 18 bp, Homo sapiens
gcaaacatgtcccagtcc

SEQ ID NO: 73087 - DNA, 21 bp, Homo sapiens
tcacacagcctttcccagccc

SEQ ID NO: 73088 - DNA, 20 bp, Homo sapiens
gcaagcagccctctgcaccc

SEQ ID NO: 73089 - DNA, 19 bp, Homo sapiens
gccactcttttcccagccc

SEQ ID NO: 73090 - DNA, 21 bp, Homo sapiens
tcagtgagcagcatttcccag

SEQ ID NO: 73091 - DNA, 21 bp, Homo sapiens
tcacagcagctttcccagtcc

SEQ ID NO: 73092 - DNA, 22 bp, Homo sapiens
gccctgggccctttcctagccc

SEQ ID NO: 73093 - DNA, 16 bp, Homo sapiens
gcaggcagccccagcc

SEQ ID NO: 73094 - DNA, 20 bp, Homo sapiens
ccgggcagcgcgcccagccc

SEQ ID NO: 73095 - DNA, 19 bp, Homo sapiens
tccaagccccttttcagcc

SEQ ID NO: 73096 - DNA, 18 bp, Homo sapiens
tcccaggcagccccagcc

SEQ ID NO: 73097 - DNA, 18 bp, Homo sapiens
tcgcaggcagccccttcc

SEQ ID NO: 73098 - DNA, 21 bp, Homo sapiens
tctcaagcagctttccacacc

SEQ ID NO: 73099 - DNA, 19 bp, Homo sapiens
tccaggcagccctcccagc

SEQ ID NO: 73100 - DNA, 22 bp, Homo sapiens
ccgcgggcagccccggtggccc

SEQ ID NO: 73101 - DNA, 20 bp, Homo sapiens
tcgcaagcaggccttccagc

SEQ ID NO: 73102 - DNA, 16 bp, Homo sapiens
gcagccccaccagccc

SEQ ID NO: 73103 - DNA, 19 bp, Homo sapiens
gcaggactcttcccagtcc

SEQ ID NO: 73104 - DNA, 24 bp, Homo sapiens
gcccatgtggccctttcctggccc

SEQ ID NO: 73105 - DNA, 21 bp, Homo sapiens
tcccaggggaccttttcccag

SEQ ID NO: 73106 - DNA, 21 bp, Homo sapiens
gcggcagcaagagcccagccc

SEQ ID NO: 73107 - DNA, 23 bp, Homo sapiens
tcgcggtcagccttccccggccc

SEQ ID NO: 73108 - DNA, 21 bp, Homo sapiens
tcgggagcagccctggtgccc

SEQ ID NO: 73109 - DNA, 18 bp, Homo sapiens
ccgaagcacttttcccag

SEQ ID NO: 73110 - DNA, 20 bp, Homo sapiens
tcacaagcagcaccgccagc

SEQ ID NO: 73111 - DNA, 19 bp, Homo sapiens
tctgagcagtgcccccagc

SEQ ID NO: 73112 - DNA, 17 bp, Homo sapiens
ccgggcagccctcgccc

SEQ ID NO: 73113 - DNA, 18 bp, Homo sapiens
tcgcaagcgccccgggcc

SEQ ID NO: 73114 - DNA, 20 bp, Homo sapiens
tccaggcagccctctagagc

SEQ ID NO: 73115 - DNA, 74 bp, Molluscum contagiosum virus
gcagatgttatcgcagttgcgcacctgccattgcacgacaggtctccagtacaacagccgtagattcatactgc

SEQ ID NO: 73116 - DNA, 24 bp, Molluscum contagiosum virus
tacaacagccgtagattcatactg

SEQ ID NO: 73117 - DNA, 18 bp, Homo sapiens
actacttatagattcata

SEQ ID NO: 73118 - DNA, 24 bp, Homo sapiens
tacaaccgctgtccagtcatgctg

SEQ ID NO: 73119 - DNA, 20 bp, Homo sapiens
caacagcctagacagtactg

SEQ ID NO: 73120 - DNA, 18 bp, Homo sapiens
acagcagggattcatact

SEQ ID NO: 73121 - DNA, 19 bp, Homo sapiens
tacaacagctgtaggtttc

SEQ ID NO: 73122 - DNA, 24 bp, Homo sapiens
tacaacagtagttaagatgtactg

SEQ ID NO: 73123 - DNA, 23 bp, Homo sapiens
tacatcaagcagggttcatactg

SEQ ID NO: 73124 - DNA, 17 bp, Homo sapiens
caaccagagttcatact

SEQ ID NO: 73125 - DNA, 23 bp, Homo sapiens
cagcagcctcaaggttcatactg

SEQ ID NO: 73126 - DNA, 20 bp, Homo sapiens
acggcagccgtagatgcccg

SEQ ID NO: 73127 - DNA, 16 bp, Homo sapiens
tacacagtattcatac

SEQ ID NO: 73128 - DNA, 19 bp, Homo sapiens
acagctgccccccatactg

SEQ ID NO: 73129 - DNA, 17 bp, Homo sapiens
cagcagtagttcatact

SEQ ID NO: 73130 - DNA, 18 bp, Homo sapiens
cagccccacctcatactg

SEQ ID NO: 73131 - DNA, 77 bp, Murine adenovirus A
ttgtttggctttgttccaactgtttttggcccgagttgggtttcgttttcccgggtttcacgtggtgcgtcaggtga

SEQ ID NO: 73132 - DNA, 19 bp, Murine adenovirus A
cacgtggtgcgtcaggtga

SEQ ID NO: 73133 - DNA, 18 bp, Homo sapiens
cactggtgcagttggtga

SEQ ID NO: 73134 - DNA, 18 bp, Homo sapiens
cgtagatgaagtcaggtg

SEQ ID NO: 73135 - DNA, 17 bp, Homo sapiens
cacgtggttcaacgtga

SEQ ID NO: 73136 - DNA, 15 bp, Homo sapiens
cagcggtgtcaggtg

SEQ ID NO: 73137 - DNA, 18 bp, Homo sapiens
acgtgatgcattgggtga

SEQ ID NO: 73138 - DNA, 17 bp, Homo sapiens
cacctgtcatcaggtga

SEQ ID NO: 73139 - DNA, 18 bp, Homo sapiens
cacgtggctagcaggtga

SEQ ID NO: 73140 - DNA, 16 bp, Homo sapiens
acttggtagccggtga

SEQ ID NO: 73141 - DNA, 19 bp, Homo sapiens
cacagtggaccacaggtga

SEQ ID NO: 73142 - DNA, 15 bp, Homo sapiens
acatcactcaggtga

SEQ ID NO: 73143 - DNA, 19 bp, Homo sapiens
cacgctggacgcccgggtg

SEQ ID NO: 73144 - DNA, 17 bp, Homo sapiens
cacatggtacatggtga

SEQ ID NO: 73145 - DNA, 17 bp, Homo sapiens
cacatggtgctgtcgtg

SEQ ID NO: 73146 - DNA, 17 bp, Homo sapiens
cacgtgggcgggactga

SEQ ID NO: 73147 - DNA, 17 bp, Homo sapiens
cacatggtgctcagtga

SEQ ID NO: 73148 - DNA, 18 bp, Homo sapiens
cacttgatgttcaggtga

SEQ ID NO: 73149 - DNA, 19 bp, Homo sapiens
cacgtcggtgtcagggtga

SEQ ID NO: 73150 - DNA, 16 bp, Homo sapiens
cacatggccagggtga

SEQ ID NO: 73151 - DNA, 17 bp, Homo sapiens
caatgttggtcaggtga

SEQ ID NO: 73152 - DNA, 18 bp, Homo sapiens
cgctatatgatcaggtga

SEQ ID NO: 73153 - DNA, 17 bp, Homo sapiens
acattaggttcaggtga

SEQ ID NO: 73154 - DNA, 18 bp, Homo sapiens
cacgtggctgcccgatga

SEQ ID NO: 73155 - DNA, 17 bp, Homo sapiens
cacctgtggccaggtga

SEQ ID NO: 73156 - DNA, 19 bp, Homo sapiens
cactgtggtgccctggtga

SEQ ID NO: 73157 - DNA, 18 bp, Homo sapiens
catggtgcatggtaggtg

SEQ ID NO: 73158 - DNA, 18 bp, Homo sapiens
cacagtgcaaccaggtga

SEQ ID NO: 73159 - DNA, 17 bp, Homo sapiens
cactgatcgtttaggtg

SEQ ID NO: 73160 - DNA, 18 bp, Homo sapiens
acatcatctgtcaggtga

SEQ ID NO: 73161 - DNA, 18 bp, Homo sapiens
cacatgtgccccaggtga

SEQ ID NO: 73162 - DNA, 15 bp, Homo sapiens
acgtggacaaggtga

SEQ ID NO: 73163 - DNA, 18 bp, Homo sapiens
gtggtgcagacccaggtg

SEQ ID NO: 73164 - DNA, 16 bp, Homo sapiens
acctggtgcaaaatga

SEQ ID NO: 73165 - DNA, 18 bp, Homo sapiens
acgtggtgtgagtcaatg

SEQ ID NO: 73166 - DNA, 18 bp, Homo sapiens
cactgaaaaatcaggtga

SEQ ID NO: 73167 - DNA, 17 bp, Homo sapiens
acattctgatcaggtga

SEQ ID NO: 73168 - DNA, 18 bp, Homo sapiens
cacgtgtgtgaatctagg

SEQ ID NO: 73169 - DNA, 18 bp, Homo sapiens
cacaatcacgtcaggtga

SEQ ID NO: 73170 - DNA, 18 bp, Homo sapiens
cacatggtaaatcaggtg

SEQ ID NO: 73171 - DNA, 18 bp, Homo sapiens
cgtggtgcgccccagtga

SEQ ID NO: 73172 - DNA, 22 bp, Homo sapiens
cacagtataaatcgttaggtga

SEQ ID NO: 73173 - DNA, 16 bp, Homo sapiens
cactgtggtggcgtga

SEQ ID NO: 73174 - DNA, 16 bp, Homo sapiens
cacggaagccaggtga

SEQ ID NO: 73175 - DNA, 17 bp, Homo sapiens
cacgtaaacatcaggtg

SEQ ID NO: 73176 - DNA, 18 bp, Homo sapiens
cgctgggctggtcaggtg

SEQ ID NO: 73177 - DNA, 18 bp, Homo sapiens
gcctgtgcagtcaggtga

SEQ ID NO: 73178 - DNA, 15 bp, Homo sapiens
cacgtggtggccgtg

SEQ ID NO: 73179 - DNA, 19 bp, Homo sapiens
atgggcaaatgtcaggtga

SEQ ID NO: 73180 - DNA, 18 bp, Homo sapiens
cacatggtggtacaggtg

SEQ ID NO: 73181 - DNA, 17 bp, Homo sapiens
cacgtcgcggaaggtga

SEQ ID NO: 73182 - DNA, 15 bp, Homo sapiens
cacgcggtgcaggtg

SEQ ID NO: 73183 - DNA, 17 bp, Homo sapiens
cacgtcgagcgaggtga

SEQ ID NO: 73184 - DNA, 16 bp, Homo sapiens
cactggcatcagggtg

SEQ ID NO: 73185 - DNA, 15 bp, Homo sapiens
cacatagatcaggtg

SEQ ID NO: 73186 - DNA, 16 bp, Homo sapiens
cacgtcgcaaaggtga

SEQ ID NO: 73187 - DNA, 17 bp, Homo sapiens
cacctgtgcagcaggtg

SEQ ID NO: 73188 - DNA, 18 bp, Homo sapiens
cacgttgagtcggggtga

SEQ ID NO: 73189 - DNA, 18 bp, Homo sapiens
catggtgggtgaaggtga

SEQ ID NO: 73190 - DNA, 18 bp, Homo sapiens
cattgtgcccccaggtga

SEQ ID NO: 73191 - DNA, 18 bp, Homo sapiens
cacctatgtttcaggtga

SEQ ID NO: 73192 - DNA, 17 bp, Homo sapiens
cacgcgccacccaggtg

SEQ ID NO: 73193 - DNA, 18 bp, Homo sapiens
cacgtgccgcgcaggtga

SEQ ID NO: 73194 - DNA, 17 bp, Homo sapiens
cactaagtatcaggtga

SEQ ID NO: 73195 - DNA, 19 bp, Homo sapiens
cacgatgggtatcagggtg

SEQ ID NO: 73196 - DNA, 16 bp, Homo sapiens
cacgtggctccggtga

SEQ ID NO: 73197 - DNA, 17 bp, Homo sapiens
cacgtgctggatagtga

SEQ ID NO: 73198 - DNA, 17 bp, Homo sapiens
cactggaggtcaggtga

SEQ ID NO: 73199 - DNA, 18 bp, Homo sapiens
gtggcagcttgtcaggtg

SEQ ID NO: 73200 - DNA, 18 bp, Homo sapiens
catggtggggccaggtga

SEQ ID NO: 73201 - DNA, 18 bp, Homo sapiens
caataggctgtcaggtga

SEQ ID NO: 73202 - DNA, 19 bp, Homo sapiens
cacatgatccgctcaggtg

SEQ ID NO: 73203 - DNA, 16 bp, Homo sapiens
cacgggccgcaaggtg

SEQ ID NO: 73204 - DNA, 17 bp, Homo sapiens
cacgctggtgtcagatg

SEQ ID NO: 73205 - DNA, 16 bp, Homo sapiens
cactgtggcccaggtg

SEQ ID NO: 73206 - DNA, 17 bp, Homo sapiens
cacctggcctcaggtga

SEQ ID NO: 73207 - DNA, 17 bp, Homo sapiens
cacgtggtcaggagtga

SEQ ID NO: 73208 - DNA, 21 bp, Homo sapiens
cacatggtacaccatgggtga

SEQ ID NO: 73209 - DNA, 63 bp, Lymphocystis disease virus 1
gtaaattatgatatggcacatgcgttagatgctgccagaaacacacggctatatacattttat

SEQ ID NO: 73210 - DNA, 24 bp, Lymphocystis disease virus 1
tatggcacatgcgttagatgctgc

SEQ ID NO: 73211 - DNA, 22 bp, Homo sapiens
tggcgcagaaccgagatgctgc

SEQ ID NO: 73212 - DNA, 17 bp, Homo sapiens
ggcacatgtccgtgctg

SEQ ID NO: 73213 - DNA, 19 bp, Homo sapiens
tggcacatgtttaattctg

SEQ ID NO: 73214 - DNA, 21 bp, Homo sapiens
tggggtgtggtccaatgctgc

SEQ ID NO: 73215 - DNA, 22 bp, Homo sapiens
tatggcactgcacgtctgctgc

SEQ ID NO: 73216 - DNA, 15 bp, Homo sapiens
tatggcactgctgct

SEQ ID NO: 73217 - DNA, 18 bp, Homo sapiens
tatggcactgtgttcatg

SEQ ID NO: 73218 - DNA, 22 bp, Homo sapiens
tggcagcataagctgatgctgc

SEQ ID NO: 73219 - DNA, 21 bp, Homo sapiens
tgtgcagtgacaagatgctgc

SEQ ID NO: 73220 - DNA, 21 bp, Homo sapiens
gctagatgcgttgggtgctgc

SEQ ID NO: 73221 - DNA, 20 bp, Homo sapiens
ggcactcccctagatgctgc

SEQ ID NO: 73222 - DNA, 20 bp, Homo sapiens
tggcatacgttctctgttgc

SEQ ID NO: 73223 - DNA, 18 bp, Homo sapiens
tatgatatgaagatgctg

SEQ ID NO: 73224 - DNA, 22 bp, Homo sapiens
tggatgtgctttaagatgctgc

SEQ ID NO: 73225 - DNA, 19 bp, Homo sapiens
tggagcaggtagatgctgc

SEQ ID NO: 73226 - DNA, 23 bp, Homo sapiens
tggtatgtgaatcaagatgctgc

SEQ ID NO: 73227 - DNA, 111 bp, Paramecium bursaria Chlorella virus 1
cggtgaagactgagacggtgaagactgagacggtgaagactgagatggtgaagccccagccttctgcaaccgccgtactaatgaagcagcccgtcgcaacggctcttcccg

SEQ ID NO: 73228 - DNA, 24 bp, Paramecium bursaria Chlorella virus 1
gtgaagactgagacggtgaagact

SEQ ID NO: 73229 - DNA, 18 bp, Homo sapiens
agactgaacactgggaga

SEQ ID NO: 73230 - DNA, 17 bp, Homo sapiens
ggaagctgagagaagac

SEQ ID NO: 73231 - DNA, 18 bp, Homo sapiens
gtgaagagctgggatggt

SEQ ID NO: 73232 - DNA, 20 bp, Homo sapiens
gtgaggactaagaaattaag

SEQ ID NO: 73233 - DNA, 23 bp, Homo sapiens
gtgagggcgagacggcggcgact

SEQ ID NO: 73234 - DNA, 16 bp, Homo sapiens
gtgaagacggtggaag

SEQ ID NO: 73235 - DNA, 18 bp, Homo sapiens
gtgaagactaggatagac

SEQ ID NO: 73236 - DNA, 20 bp, Homo sapiens
gtgaagacctgaggtctggc

SEQ ID NO: 73237 - DNA, 22 bp, Homo sapiens
gtgaagactgggagggaaccct

SEQ ID NO: 73238 - DNA, 21 bp, Homo sapiens
atggagactgagggtcaggct

SEQ ID NO: 73239 - DNA, 21 bp, Homo sapiens
gaatcagaaagatggtgaaga

SEQ ID NO: 73240 - DNA, 19 bp, Homo sapiens
atgaagactgagtgaagac

SEQ ID NO: 73241 - DNA, 17 bp, Homo sapiens
gtggagactgaaggtaa

SEQ ID NO: 73242 - DNA, 19 bp, Homo sapiens
gtgaagatttggaaagtaa

SEQ ID NO: 73243 - DNA, 20 bp, Homo sapiens
gtgaatggacacaatggtga

SEQ ID NO: 73244 - DNA, 17 bp, Homo sapiens
gtgaaggtgagtgaagc

SEQ ID NO: 73245 - DNA, 23 bp, Homo sapiens
gtgaagaatgagatggcccaact

SEQ ID NO: 73246 - DNA, 16 bp, Homo sapiens
gtgaagagtgaggtga

SEQ ID NO: 73247 - DNA, 19 bp, Homo sapiens
agactgaggtgggaggact

SEQ ID NO: 73248 - DNA, 18 bp, Homo sapiens
agactgaggctcgagact

SEQ ID NO: 73249 - DNA, 20 bp, Homo sapiens
tggaggctgagatgaagact

SEQ ID NO: 73250 - DNA, 22 bp, Homo sapiens
gtgaagactgaataaatagggc

SEQ ID NO: 73251 - DNA, 16 bp, Homo sapiens
gtgaagatggagatga

SEQ ID NO: 73252 - DNA, 21 bp, Homo sapiens
gtgaagattgtagtgaagact

SEQ ID NO: 73253 - DNA, 17 bp, Homo sapiens
atgaagactggggtgaa

SEQ ID NO: 73254 - DNA, 19 bp, Homo sapiens
gtgaagactgaatgtcaac

SEQ ID NO: 73255 - DNA, 16 bp, Homo sapiens
gtgaaggctgagggtg

SEQ ID NO: 73256 - DNA, 18 bp, Homo sapiens
gtggaactgagagtgaga

SEQ ID NO: 73257 - DNA, 17 bp, Homo sapiens
gaagaccaggtggagac

SEQ ID NO: 73258 - DNA, 24 bp, Homo sapiens
tgaagactgagatggtgatcaact

SEQ ID NO: 73259 - DNA, 17 bp, Homo sapiens
gtgaaaactgggtgaga

SEQ ID NO: 73260 - DNA, 18 bp, Homo sapiens
gtgaagactgggacgaca

SEQ ID NO: 73261 - DNA, 17 bp, Homo sapiens
aggctgagacaggagga

SEQ ID NO: 73262 - DNA, 24 bp, Homo sapiens
gtgaagatggaaaacttgaagact

SEQ ID NO: 73263 - DNA, 65 bp, Paramecium bursaria Chlorella virus 1
caccaaagtcaaccgcgggttttaaaaaatacattaagactgagacggtgaagactgagacggtg

SEQ ID NO: 73264 - DNA, 24 bp, Paramecium bursaria Chlorella virus 1
tgagacggtgaagactgagacggt

SEQ ID NO: 73265 - DNA, 19 bp, Homo sapiens
tgggaggtgaagactgcag

SEQ ID NO: 73266 - DNA, 19 bp, Homo sapiens
cgggacggtgagggctggg

SEQ ID NO: 73267 - DNA, 23 bp, Homo sapiens
tgagacggtgcagggagtacggt

SEQ ID NO: 73268 - DNA, 19 bp, Homo sapiens
tgggatggggaagactgaa

SEQ ID NO: 73269 - DNA, 19 bp, Homo sapiens
tggatggtgagacagacgg

SEQ ID NO: 73270 - DNA, 19 bp, Homo sapiens
tggacggtgagggtgaagg

SEQ ID NO: 73271 - DNA, 70 bp, Vaccinia virus
tatcaaatactgtacggaatggattcattctcttctctttttatgaaactctgttgtatatctactgata

SEQ ID NO: 73272 - DNA, 24 bp, Vaccinia virus
aactctgttgtatatctactgata

SEQ ID NO: 73273 - DNA, 21 bp, Homo sapiens
tctttgtatgcatctctgata

SEQ ID NO: 73274 - DNA, 22 bp, Homo sapiens
ctctgctgggcagttgctgata

SEQ ID NO: 73275 - DNA, 16 bp, Homo sapiens
tctgtttcttactgat

SEQ ID NO: 73276 - DNA, 19 bp, Homo sapiens
ctcagttttcctactgata

SEQ ID NO: 73277 - DNA, 17 bp, Homo sapiens
tctgttgtatttacaga

SEQ ID NO: 73278 - DNA, 16 bp, Homo sapiens
tattgtatctactgat

SEQ ID NO: 73279 - DNA, 20 bp, Homo sapiens
aacccttattatctactgat

SEQ ID NO: 73280 - DNA, 18 bp, Homo sapiens
tctgtggtagtactgata

SEQ ID NO: 73281 - DNA, 19 bp, Homo sapiens
tctgtttggaccactgata

SEQ ID NO: 73282 - DNA, 21 bp, Homo sapiens
tcttggacgtgtctactgata

SEQ ID NO: 73283 - DNA, 76 bp, Transmissible gastroenteritis virus
tttagagaagtttaaagatccgctacgacgagccaacaatggaagagctaacgtctggatctagtgattgtttaaa

SEQ ID NO: 73284 - DNA, 24 bp, Transmissible gastroenteritis virus
aaagatccgctacgacgagccaac

SEQ ID NO: 73285 - DNA, 18 bp, Homo sapiens
aaagaccccacatgggcc

SEQ ID NO: 73286 - DNA, 20 bp, Homo sapiens
aaagatcccctatggtccaa

SEQ ID NO: 73287 - DNA, 18 bp, Homo sapiens
gatccgctacagaccggc

SEQ ID NO: 73288 - DNA, 17 bp, Homo sapiens
aaagatccgctcccagc

SEQ ID NO: 73289 - DNA, 18 bp, Homo sapiens
ggagaccgctacggaagc

SEQ ID NO: 73290 - DNA, 18 bp, Homo sapiens
ggagacccgctgcgggcc

SEQ ID NO: 73291 - DNA, 22 bp, Homo sapiens
aaagatccctaaaggtttgagc

SEQ ID NO: 73292 - DNA, 20 bp, Homo sapiens
cgaggtcccggcgagccaac

SEQ ID NO: 73293 - DNA, 22 bp, Homo sapiens
aaaggccttgctgtgagccaac

SEQ ID NO: 73294 - DNA, 21 bp, Homo sapiens
aaaggtctgcaacgaacaaac

SEQ ID NO: 73295 - DNA, 15 bp, Homo sapiens
gatccgccagagcca

SEQ ID NO: 73296 - DNA, 24 bp, Homo sapiens
aaagatccagctacagttgccaac

SEQ ID NO: 73297 - DNA, 18 bp, Homo sapiens
ggagatccgcactccagc

SEQ ID NO: 73298 - DNA, 19 bp, Homo sapiens
aaagatccaaatacgtgag

SEQ ID NO: 73299 - DNA, 20 bp, Homo sapiens
aaagatccgcctacctcggc

SEQ ID NO: 73300 - DNA, 21 bp, Homo sapiens
aaagatcccctatggtccgaa

SEQ ID NO: 73301 - DNA, 19 bp, Homo sapiens
gatccgccccgccgagtca

SEQ ID NO: 73302 - DNA, 96 bp, Camelpox virus
ctagaggataatttatctcgtgatatagtgataatataataatagagtgcggttttacctattttatcatctatattaataatataatcctaatag

SEQ ID NO: 73303 - DNA, 24 bp, Camelpox virus
taatttatctcgtgatatagtgat

SEQ ID NO: 73304 - DNA, 19 bp, Homo sapiens
tttatctctgatcaaggat

SEQ ID NO: 73305 - DNA, 18 bp, Homo sapiens
tttatctctggcagtgat

SEQ ID NO: 73306 - DNA, 83 bp, Vaccinia virus
taggagtatctattttaacaaagcatcgatttgctaatatacaattatcattttgattaattgttattttattcatattctta

SEQ ID NO: 73307 - DNA, 24 bp, Vaccinia virus
tattttaacaaagcatcgatttgc

SEQ ID NO: 73308 - DNA, 21 bp, Homo sapiens
tattttcaaaacattgatttg

SEQ ID NO: 73309 - DNA, 21 bp, Homo sapiens
ttttaaaaaagcacctgattt

SEQ ID NO: 73310 - DNA, 20 bp, Homo sapiens
tattgtaacaaagcaacttg

SEQ ID NO: 73311 - DNA, 18 bp, Homo sapiens
ctttaacaaagcaggatt

SEQ ID NO: 73312 - DNA, 20 bp, Homo sapiens
ttttaacagagcatcacatg

SEQ ID NO: 73313 - DNA, 20 bp, Homo sapiens
tttaacaaagcacatcttgc

SEQ ID NO: 73314 - DNA, 21 bp, Homo sapiens
tattctaacaaatgagatttg

SEQ ID NO: 73315 - DNA, 130 bp, Cercopithecine herpesvirus 7
gtaaaatatttccggtaggcgtgtatgtagtgttctgttattttaatttgatatattagtacagctatataacagttgtgtatgttacacgccatataacaacactacatatatctctaagttgataaac

SEQ ID NO: 73316 - DNA, 17 bp, Cercopithecine herpesvirus 7
tctctaagttgataaac

SEQ ID NO: 73317 - DNA, 18 bp, Homo sapiens
tctctaaatccagataaa

SEQ ID NO: 73318 - DNA, 18 bp, Homo sapiens
tccctaaattacataaac

SEQ ID NO: 73319 - DNA, 18 bp, Homo sapiens
tctctaaatcttttaaac

SEQ ID NO: 73320 - DNA, 18 bp, Homo sapiens
tcactaagttgtccaaac

SEQ ID NO: 73321 - DNA, 106 bp, Alcelaphine herpesvirus 1
tgcacagtgctgatcaattgactggtattaactgttgacagttttaactgttcatacaaattgtgactatatatacaagttagtttccccaaaaaatcactctgca

SEQ ID NO: 73322 - DNA, 24 bp, Alcelaphine herpesvirus 1
tgttgacagttttaactgttcata

SEQ ID NO: 73323 - DNA, 22 bp, Homo sapiens
gttgatagaataactgttcata

SEQ ID NO: 73324 - DNA, 16 bp, Homo sapiens
gctgaagactgttcat

SEQ ID NO: 73325 - DNA, 18 bp, Homo sapiens
tgttacagttgtgttcat

SEQ ID NO: 73326 - DNA, 22 bp, Homo sapiens
ttgcataatttaactgttcata

SEQ ID NO: 73327 - DNA, 19 bp, Homo sapiens
tgtagacagttttaattgt

SEQ ID NO: 73328 - DNA, 19 bp, Homo sapiens
tgttgatagttttaattca

SEQ ID NO: 73329 - DNA, 22 bp, Homo sapiens
ttggcagacacagctgttcata

SEQ ID NO: 73330 - DNA, 19 bp, Homo sapiens
tgttaacagttttgatgtt

SEQ ID NO: 73331 - DNA, 18 bp, Homo sapiens
tgttgatagctttaaagc

SEQ ID NO: 73332 - DNA, 19 bp, Homo sapiens
tgttgacattttccatcat

SEQ ID NO: 73333 - DNA, 22 bp, Homo sapiens
tattgatgcaaatgctgttcat

SEQ ID NO: 73334 - DNA, 19 bp, Homo sapiens
tgtttacagttttattgtt

SEQ ID NO: 73335 - DNA, 18 bp, Homo sapiens
ttgacagtttttaattgt

SEQ ID NO: 73336 - DNA, 24 bp, Homo sapiens
tgtttatttaaataactgttcata

SEQ ID NO: 73337 - DNA, 84 bp, Alcelaphine herpesvirus 1
acagtccttgttatcaacattgtcttacaagtggatgatgtatctaaaaactcacctattaaagacattggaaacagatactgt

SEQ ID NO: 73338 - DNA, 24 bp, Alcelaphine herpesvirus 1
tccttgttatcaacattgtcttac

SEQ ID NO: 73339 - DNA, 24 bp, Homo sapiens
tccttgtttattaacagaatttac

SEQ ID NO: 73340 - DNA, 19 bp, Homo sapiens
cttgttatgtaacagcccc

SEQ ID NO: 73341 - DNA, 16 bp, Homo sapiens
ttgtaaacattgtctt

SEQ ID NO: 73342 - DNA, 19 bp, Homo sapiens
gttattaaccgtatcttac

SEQ ID NO: 73343 - DNA, 19 bp, Homo sapiens
tccttgttgtgactgtcct

SEQ ID NO: 73344 - DNA, 24 bp, Homo sapiens
tccctgttcagtcctgttgtctta

SEQ ID NO: 73345 - DNA, 19 bp, Homo sapiens
ttgtttcagaattgtctta

SEQ ID NO: 73346 - DNA, 19 bp, Homo sapiens
tccttgttattcatattgt

SEQ ID NO: 73347 - DNA, 20 bp, Homo sapiens
ttgttatcagcatctcccac

SEQ ID NO: 73348 - DNA, 19 bp, Homo sapiens
tcactgtcaacattgtctt

SEQ ID NO: 73349 - DNA, 20 bp, Homo sapiens
cttgttatccaacatgtctt

SEQ ID NO: 73350 - DNA, 18 bp, Homo sapiens
tccttgttataacatctc

SEQ ID NO: 73351 - DNA, 18 bp, Homo sapiens
tctttgttatcatcatta

SEQ ID NO: 73352 - DNA, 22 bp, Homo sapiens
tccttgtcatcaattcgaactt

SEQ ID NO: 73353 - DNA, 18 bp, Homo sapiens
tccttattatcacagtgt

SEQ ID NO: 73354 - DNA, 21 bp, Homo sapiens
tccttgtcattaacaccttac

SEQ ID NO: 73355 - DNA, 23 bp, Homo sapiens
tccttattattatacagtcttac

SEQ ID NO: 73356 - DNA, 17 bp, Homo sapiens
gttatcaaaatgcttac

SEQ ID NO: 73357 - DNA, 19 bp, Homo sapiens
tccttgttatagaacttgt

SEQ ID NO: 73358 - DNA, 107 bp, Human herpesvirus 2
ggggaggggggtggcggctggggaaagggaaggaacgcccgaaaccagagaaaaggaccaaaagggaaacgcgtccaaccgataaatcaagcgccgaccagaacccc

SEQ ID NO: 73359 - DNA, 24 bp, Human herpesvirus 2
tccaaccgataaatcaagcgccga

SEQ ID NO: 73360 - DNA, 17 bp, Homo sapiens
tccagccaataaataac

SEQ ID NO: 73361 - DNA, 23 bp, Homo sapiens
tccaaccagatgtcctaaagtgc

SEQ ID NO: 73362 - DNA, 66 bp, Human papillomavirus type 90
accagcacagcaagcatatagggtggtaacaagttgttgtaggtgttgctgtacagtaaggctggt

SEQ ID NO: 73363 - DNA, 24 bp, Human papillomavirus type 90
ttgtaggtgttgctgtacagtaag

SEQ ID NO: 73364 - DNA, 22 bp, Homo sapiens
ttgagggtgtggaactgtggta

SEQ ID NO: 73365 - DNA, 21 bp, Homo sapiens
ttgtaggctgtttgaagcagt

SEQ ID NO: 73366 - DNA, 77 bp, Human papillomavirus type 6
ggacggacaagattcacaacctttaaaacaacattaccaaatagtgacctgttgctgtggatgtgacagcaacgttc

SEQ ID NO: 73367 - DNA, 24 bp, Human papillomavirus type 6
ttgctgtggatgtgacagcaacgt

SEQ ID NO: 73368 - DNA, 20 bp, Homo sapiens
cttggttgtgacagcagcgt

SEQ ID NO: 73369 - DNA, 20 bp, Homo sapiens
ttgctgtgtgtcttcaggca

SEQ ID NO: 73370 - DNA, 24 bp, Homo sapiens
ttgctgtgcaaccttgggcaacgt

SEQ ID NO: 73371 - DNA, 16 bp, Homo sapiens
ttgctgtgaatgtcag

SEQ ID NO: 73372 - DNA, 15 bp, Homo sapiens
tgctgtggatgtggc

SEQ ID NO: 73373 - DNA, 101 bp, Cowpox virus
taggtataatataattaattatatggtttattatcacaattcaaccatggtgattgtgaattagtactacccaataatcaaatgtgcttgtattgtatcta

SEQ ID NO: 73374 - DNA, 24 bp, Cowpox virus
ttagtactacccaataatcaaatg

SEQ ID NO: 73375 - DNA, 19 bp, Homo sapiens
ttaatgctacccaatgtca

SEQ ID NO: 73376 - DNA, 24 bp, Homo sapiens
atacgaaagcccaataatcagatg

SEQ ID NO: 73377 - DNA, 22 bp, Homo sapiens
ttaatactattcagatcaaatg

SEQ ID NO: 73378 - DNA, 18 bp, Homo sapiens
ttagtattaaccaataat

SEQ ID NO: 73379 - DNA, 64 bp, Tupaia herpesvirus
tcagcttcagatgagctctattgaagagtcaagaggctctggagagacgctcaaactgccttga

SEQ ID NO: 73380 - DNA, 24 bp, Tupaia herpesvirus
tggagagacgctcaaactgccttg

SEQ ID NO: 73381 - DNA, 20 bp, Homo sapiens
tggggagcagaactgccttg

SEQ ID NO: 73382 - DNA, 22 bp, Homo sapiens
tggggagcaggaggctgccttg

SEQ ID NO: 73383 - DNA, 18 bp, Homo sapiens
tgggaaggctgctgcctt

SEQ ID NO: 73384 - DNA, 21 bp, Homo sapiens
tggggagatgaggctgccttg

SEQ ID NO: 73385 - DNA, 19 bp, Homo sapiens
tggagagaagctgagcctt

SEQ ID NO: 73386 - DNA, 21 bp, Homo sapiens
tggatgggctaagctgccttg

SEQ ID NO: 73387 - DNA, 22 bp, Homo sapiens
gagggcatttcagactgccttg

SEQ ID NO: 73388 - DNA, 21 bp, Homo sapiens
gaactctcttggactgccttg

SEQ ID NO: 73389 - DNA, 19 bp, Homo sapiens
tgcagacccaagctgcctt

SEQ ID NO: 73390 - DNA, 20 bp, Homo sapiens
tggagagagttcctgacctt

SEQ ID NO: 73391 - DNA, 19 bp, Homo sapiens
ggagagatgttcaagctcc

SEQ ID NO: 73392 - DNA, 16 bp, Homo sapiens
ggagagagactgcctt

SEQ ID NO: 73393 - DNA, 62 bp, Sulfolobus virus SIRV-1
aagctaattttacgtgagttaaaagtttaaaaagatttcttggaaattcacgttattagttt

SEQ ID NO: 73394 - DNA, 24 bp, Sulfolobus virus SIRV-1
ttttacgtgagttaaaagtttaaa

SEQ ID NO: 73395 - DNA, 17 bp, Homo sapiens
gcgcataaaagtttaaa

SEQ ID NO: 73396 - DNA, 18 bp, Homo sapiens
ttttactgagcagtttaa

SEQ ID NO: 73397 - DNA, 23 bp, Homo sapiens
tttcacccaagtgaaagtttaaa

SEQ ID NO: 73398 - DNA, 95 bp, Sulfolobus virus SIRV-2
tacgactaacatttttatagttatcattacaattttttagcagttaaatgcaaaaaaataacagatgtataattgaaagaacttttagttttgta

SEQ ID NO: 73399 - DNA, 24 bp, Sulfolobus virus SIRV-2
actaacatttttatagttatcatt

SEQ ID NO: 73400 - DNA, 18 bp, Homo sapiens
actaacatttttaatgtc

SEQ ID NO: 73401 - DNA, 21 bp, Homo sapiens
acatttttacataaaatcatt

SEQ ID NO: 73402 - DNA, 17 bp, Homo sapiens
taacacttttatatatc

SEQ ID NO: 73403 - DNA, 20 bp, Homo sapiens
actggcattttcatagttat

SEQ ID NO: 73404 - DNA, 23 bp, Homo sapiens
ctgacatttttataatagccatt

SEQ ID NO: 73405 - DNA, 25 bp, Homo sapiens
ctaacatttttatactatcatcatt

SEQ ID NO: 73406 - DNA, 19 bp, Homo sapiens
acaaataatagttatcatt

SEQ ID NO: 73407 - DNA, 20 bp, Homo sapiens
ccaacatttttattctcatt

SEQ ID NO: 73408 - DNA, 23 bp, Homo sapiens
ctaatatttttataaatcccatt

SEQ ID NO: 73409 - DNA, 17 bp, Homo sapiens
actacatttttatagct

SEQ ID NO: 73410 - DNA, 22 bp, Homo sapiens
actaacatataaaattatcatt

SEQ ID NO: 73411 - DNA, 17 bp, Homo sapiens
ctaacattttttatcat

SEQ ID NO: 73412 - DNA, 19 bp, Homo sapiens
actaacattttttatagtt

SEQ ID NO: 73413 - DNA, 19 bp, Homo sapiens
taacatttttatatatcat

SEQ ID NO: 73414 - DNA, 20 bp, Homo sapiens
ccaacatttttatttattat

SEQ ID NO: 73415 - DNA, 83 bp, Bovine respiratory syncytial virus
cataatcatcatattttctcaacctgattaacccttcaattcatcttgtagattatacctcagttagataaataaaaattatg

SEQ ID NO: 73416 - DNA, 24 bp, Bovine respiratory syncytial virus
tacctcagttagataaataaaaat

SEQ ID NO: 73417 - DNA, 21 bp, Homo sapiens
cctcagacagtagataaaaat

SEQ ID NO: 73418 - DNA, 16 bp, Homo sapiens
tcagttagaacaaaaa

SEQ ID NO: 73419 - DNA, 18 bp, Homo sapiens
ctcagcaaaaataaaaat

SEQ ID NO: 73420 - DNA, 20 bp, Homo sapiens
ccttagtcagagataaaaat

SEQ ID NO: 73421 - DNA, 21 bp, Homo sapiens
tcagttaaatacagtaaaaat

SEQ ID NO: 73422 - DNA, 19 bp, Homo sapiens
ctcaaaaataaataaaaat

SEQ ID NO: 73423 - DNA, 15 bp, Homo sapiens
taccccagcacaaat

SEQ ID NO: 73424 - DNA, 20 bp, Homo sapiens
tacctcagctatgctcaaat

SEQ ID NO: 73425 - DNA, 98 bp, Meleagrid herpesvirus 1
gcaccgtggaggtcgttctatcgcatgcgattgtgcgaatgtgccaactgcgaatgccgttattacaataaaaatgtgacttgaaaaatccgcgaagc

SEQ ID NO: 73426 - DNA, 24 bp, Meleagrid herpesvirus 1
tatcgcatgcgattgtgcgaatgt

SEQ ID NO: 73427 - DNA, 18 bp, Homo sapiens
tatcacatgtgataaatg

SEQ ID NO: 73428 - DNA, 85 bp, Meleagrid herpesvirus 1
ttgtgggatgttcgtcgtatcggcaacattggcatccgctgcggattatgtggactttgcacgtaccaaccagaacgttgcacga

SEQ ID NO: 73429 - DNA, 24 bp, Meleagrid herpesvirus 1
ctttgcacgtaccaaccagaacgt

SEQ ID NO: 73430 - DNA, 15 bp, Homo sapiens
ctttacacgtcagaa

SEQ ID NO: 73431 - DNA, 16 bp, Homo sapiens
tctgcacaaccagaag

SEQ ID NO: 73432 - DNA, 71 bp, Avian paramyxovirus 6
gataaaaatatgtcgagggatgacattgatgagaccccttattctctctcaaactaagacagtaatccatc

SEQ ID NO: 73433 - DNA, 24 bp, Avian paramyxovirus 6
tatgtcgagggatgacattgatga

SEQ ID NO: 73434 - DNA, 23 bp, Homo sapiens
tatgttggcatgtacattgatga

SEQ ID NO: 73435 - DNA, 20 bp, Homo sapiens
tgttgaaggatgtgctggtg

SEQ ID NO: 73436 - DNA, 20 bp, Homo sapiens
tgtcacaggtggcattgatg

SEQ ID NO: 73437 - DNA, 67 bp, Avian paramyxovirus 6
ggggggaaggaggttgactgcaacctcaattgatcagaggttgcagcactaactctttacaaccccc

SEQ ID NO: 73438 - DNA, 24 bp, Avian paramyxovirus 6
tgcagcactaactctttacaaccc

SEQ ID NO: 73439 - DNA, 18 bp, Homo sapiens
cagcacaaactttacaac

SEQ ID NO: 73440 - DNA, 18 bp, Homo sapiens
gcagcactgacccccaac

SEQ ID NO: 73441 - DNA, 23 bp, Homo sapiens
tgcagcactgacacaaagcaccc

SEQ ID NO: 73442 - DNA, 19 bp, Homo sapiens
tgcagcactcgtttcccac

SEQ ID NO: 73443 - DNA, 26 bp, Homo sapiens
tgcagcacctggctctcatcacagcc

SEQ ID NO: 73444 - DNA, 23 bp, Homo sapiens
tgcagagatgttctttacaatcc

SEQ ID NO: 73445 - DNA, 18 bp, Homo sapiens
tgtaacattaactctcta

SEQ ID NO: 73446 - DNA, 23 bp, Homo sapiens
tgtggcgccagctccccacgtcc

SEQ ID NO: 73447 - DNA, 18 bp, Homo sapiens
tacagcacatttacagcc

SEQ ID NO: 73448 - DNA, 17 bp, Homo sapiens
gcagtcactctttacaa

SEQ ID NO: 73449 - DNA, 17 bp, Homo sapiens
gcactatttttacaacc

SEQ ID NO: 73450 - DNA, 18 bp, Homo sapiens
gcactgacttttacaacc

SEQ ID NO: 73451 - DNA, 17 bp, Homo sapiens
agccttctttacaatcc

SEQ ID NO: 73452 - DNA, 16 bp, Homo sapiens
cagcagcttctttaca

SEQ ID NO: 73453 - DNA, 19 bp, Homo sapiens
tgcaccactagtccacaac

SEQ ID NO: 73454 - DNA, 17 bp, Homo sapiens
gcgctaactccccatcc

SEQ ID NO: 73455 - DNA, 17 bp, Homo sapiens
tacagcactgaacacaa

SEQ ID NO: 73456 - DNA, 18 bp, Homo sapiens
tgcacactggctctacaa

SEQ ID NO: 73457 - DNA, 17 bp, Homo sapiens
cagcatactttacaacc

SEQ ID NO: 73458 - DNA, 20 bp, Homo sapiens
tgcagtatcaactcttgtac

SEQ ID NO: 73459 - DNA, 18 bp, Homo sapiens
tacagtactctttataac

SEQ ID NO: 73460 - DNA, 21 bp, Homo sapiens
tgcagcactgagtcgccagcc

SEQ ID NO: 73461 - DNA, 22 bp, Homo sapiens
gcagcactaatctctgcaatcc

SEQ ID NO: 73462 - DNA, 19 bp, Homo sapiens
tgagcactaatttcttgac

SEQ ID NO: 73463 - DNA, 17 bp, Homo sapiens
cagcactaagtcataca

SEQ ID NO: 73464 - DNA, 21 bp, Homo sapiens
gcactaatcttttttacaacc

SEQ ID NO: 73465 - DNA, 61 bp, Peanut clump virus
cattccctagctattataaggttaattgcaaaaacccttatatctggctaagatgggagtg

SEQ ID NO: 73466 - DNA, 21 bp, Peanut clump virus
tatctggctaagatgggagtg

SEQ ID NO: 73467 - DNA, 17 bp, Homo sapiens
tcagggaagtgggagtg

SEQ ID NO: 73468 - DNA, 21 bp, Homo sapiens
tctggctaaggccggggagtg

SEQ ID NO: 73469 - DNA, 17 bp, Homo sapiens
tcctgcaggtgggagtg

SEQ ID NO: 73470 - DNA, 18 bp, Homo sapiens
tcgggggagatgggagtg

SEQ ID NO: 73471 - DNA, 19 bp, Homo sapiens
tacctgcggcgtgggagtg

SEQ ID NO: 73472 - DNA, 19 bp, Homo sapiens
tatctgactgaggacaatg

SEQ ID NO: 73473 - DNA, 18 bp, Homo sapiens
tctggcagagtgggagtg

SEQ ID NO: 73474 - DNA, 19 bp, Homo sapiens
catctgtaaaatgggagtg

SEQ ID NO: 73475 - DNA, 17 bp, Homo sapiens
catctgacatgggagtg

SEQ ID NO: 73476 - DNA, 21 bp, Homo sapiens
tctggctaggttgctagggtg

SEQ ID NO: 73477 - DNA, 16 bp, Homo sapiens
tcttggcccgggagtg

SEQ ID NO: 73478 - DNA, 17 bp, Homo sapiens
tctggcctttgggagtg

SEQ ID NO: 73479 - DNA, 18 bp, Homo sapiens
tctggttaagaacaggtg

SEQ ID NO: 73480 - DNA, 17 bp, Homo sapiens
tcctgcagatgggagtg

SEQ ID NO: 73481 - DNA, 18 bp, Homo sapiens
atctggctgctgagggtg

SEQ ID NO: 73482 - DNA, 19 bp, Homo sapiens
tctttgtaaaatgggggtg

SEQ ID NO: 73483 - DNA, 19 bp, Homo sapiens
tggccctcaggtgggagtg

SEQ ID NO: 73484 - DNA, 20 bp, Homo sapiens
tcttgtccagtatgggagtg

SEQ ID NO: 73485 - DNA, 21 bp, Homo sapiens
tatctgtgggctttgggagtg

SEQ ID NO: 73486 - DNA, 18 bp, Homo sapiens
tatttggccaagatatag

SEQ ID NO: 73487 - DNA, 15 bp, Homo sapiens
tatctgactaggagt

SEQ ID NO: 73488 - DNA, 18 bp, Homo sapiens
tatcctaggatgggagtg

SEQ ID NO: 73489 - DNA, 16 bp, Homo sapiens
catctggctgggcgcg

SEQ ID NO: 73490 - DNA, 19 bp, Homo sapiens
tctgggggaggtgggagtg

SEQ ID NO: 73491 - DNA, 18 bp, Homo sapiens
tctgcagggatgggagtg

SEQ ID NO: 73492 - DNA, 16 bp, Homo sapiens
catctggagtgggagt

SEQ ID NO: 73493 - DNA, 18 bp, Homo sapiens
catctggctggggaactg

SEQ ID NO: 73494 - DNA, 18 bp, Homo sapiens
ctggctaattttggggtg

SEQ ID NO: 73495 - DNA, 17 bp, Homo sapiens
tctggctggacgcagtg

SEQ ID NO: 73496 - DNA, 17 bp, Homo sapiens
atctggcttgaggagtg

SEQ ID NO: 73497 - DNA, 18 bp, Homo sapiens
tctggctaatggggagtg

SEQ ID NO: 73498 - DNA, 16 bp, Homo sapiens
ctggtagatgggagtg

SEQ ID NO: 73499 - DNA, 17 bp, Homo sapiens
atctggctgaggaaatg

SEQ ID NO: 73500 - DNA, 24 bp, Homo sapiens
tatgctgagagtgggatgggagtg

SEQ ID NO: 73501 - DNA, 19 bp, Homo sapiens
tatctggctggccagagtg

SEQ ID NO: 73502 - DNA, 16 bp, Homo sapiens
tctggtctcgggagtg

SEQ ID NO: 73503 - DNA, 16 bp, Homo sapiens
tctggccatgggagtg

SEQ ID NO: 73504 - DNA, 16 bp, Homo sapiens
tatttggccgggagca

SEQ ID NO: 73505 - DNA, 18 bp, Homo sapiens
tatctggctggcgatggg

SEQ ID NO: 73506 - DNA, 63 bp, Paramecium bursaria Chlorella virus 1
ggatgtaacggtggaggtccggcaggaagtgggcaagaattgaccgatttatctattgcatcc

SEQ ID NO: 73507 - DNA, 24 bp, Paramecium bursaria Chlorella virus 1
gggcaagaattgaccgatttatct

SEQ ID NO: 73508 - DNA, 21 bp, Homo sapiens
gggtaagaactggacgtattt

SEQ ID NO: 73509 - DNA, 16 bp, Homo sapiens
gggccagccgatttat

SEQ ID NO: 73510 - DNA, 23 bp, Homo sapiens
gggagagaaaaatggatttatct

SEQ ID NO: 73511 - DNA, 63 bp, Brome mosaic virus
ttgtggtctaactcaagactagctgaatcggtgctataaccgatagtcgtggttgacacgcag

SEQ ID NO: 73512 - DNA, 18 bp, Brome mosaic virus
gtcgtggttgacacgcag

SEQ ID NO: 73513 - DNA, 18 bp, Homo sapiens
gtcttaggtaacacgcag

SEQ ID NO: 73514 - DNA, 16 bp, Homo sapiens
gtccgcggacacgcag

SEQ ID NO: 73515 - DNA, 17 bp, Homo sapiens
gtcatggctcactgcag

SEQ ID NO: 73516 - DNA, 17 bp, Homo sapiens
gtcatggttaagggcag

SEQ ID NO: 73517 - DNA, 18 bp, Homo sapiens
gccttcagtgacacgcag

SEQ ID NO: 73518 - DNA, 16 bp, Homo sapiens
gtcgtggtcacagcag

SEQ ID NO: 73519 - DNA, 18 bp, Homo sapiens
gtcatggcgacactgcag

SEQ ID NO: 73520 - DNA, 17 bp, Homo sapiens
atcaaggtgacatgcag

SEQ ID NO: 73521 - DNA, 17 bp, Homo sapiens
atcgtggttccactcag

SEQ ID NO: 73522 - DNA, 17 bp, Homo sapiens
gtctgtgggacacgcag

SEQ ID NO: 73523 - DNA, 16 bp, Homo sapiens
gtcctgggacacgcag

SEQ ID NO: 73524 - DNA, 16 bp, Homo sapiens
gtcatagtccacgcag

SEQ ID NO: 73525 - DNA, 16 bp, Homo sapiens
gtcgaggtgacagcag

SEQ ID NO: 73526 - DNA, 17 bp, Homo sapiens
gtcatggtttcatgcag

SEQ ID NO: 73527 - DNA, 17 bp, Homo sapiens
gccacagtgacacgcag

SEQ ID NO: 73528 - DNA, 16 bp, Homo sapiens
gccagatgacatgcag

SEQ ID NO: 73529 - DNA, 18 bp, Homo sapiens
gtcataacttgcatgcag

SEQ ID NO: 73530 - DNA, 18 bp, Homo sapiens
gtcgtggtcccacagcag

SEQ ID NO: 73531 - DNA, 21 bp, Homo sapiens
gtcgcggtcgggagtgcgcag

SEQ ID NO: 73532 - DNA, 15 bp, Homo sapiens
gtcagagacacgcag

SEQ ID NO: 73533 - DNA, 15 bp, Homo sapiens
gcctgagacacgcag

SEQ ID NO: 73534 - DNA, 21 bp, Homo sapiens
gtcggggctcgggacgcgcag

SEQ ID NO: 73535 - DNA, 18 bp, Homo sapiens
gtttcagctgacatgcag

SEQ ID NO: 73536 - DNA, 19 bp, Homo sapiens
gccgtggcgggaggcacgc

SEQ ID NO: 73537 - DNA, 16 bp, Homo sapiens
gccgtggcggacgcag

SEQ ID NO: 73538 - DNA, 18 bp, Homo sapiens
gtcgtggctgactcccag

SEQ ID NO: 73539 - DNA, 15 bp, Homo sapiens
gtcgtgatgacgcag

SEQ ID NO: 73540 - DNA, 15 bp, Homo sapiens
gtcgtagccacgcag

SEQ ID NO: 73541 - DNA, 82 bp, Human papillomavirus type 55
gttttagagctggatcctcctgaccctgtaggcctacattgcaatgagcaattagacagctcagaggatgaggtggatgaac

SEQ ID NO: 73542 - DNA, 24 bp, Human papillomavirus type 55
ttagacagctcagaggatgaggtg

SEQ ID NO: 73543 - DNA, 24 bp, Homo sapiens
tcaggcagctcaggcgacagggtg

SEQ ID NO: 73544 - DNA, 19 bp, Homo sapiens
ttagatgttcagaggcagt

SEQ ID NO: 73545 - DNA, 19 bp, Homo sapiens
ttagacagctgtgggggcg

SEQ ID NO: 73546 - DNA, 19 bp, Homo sapiens
agacaaagagggtggggtg

SEQ ID NO: 73547 - DNA, 17 bp, Homo sapiens
gatagcttgaggaggtg

SEQ ID NO: 73548 - DNA, 19 bp, Homo sapiens
ttagacagccaggatgcgg

SEQ ID NO: 73549 - DNA, 19 bp, Homo sapiens
ttagaagctcagaggcatg

SEQ ID NO: 73550 - DNA, 66 bp, Human papillomavirus type 63
gtgcctaaatctgtttctgttattttaggggcatttgacggttcctaagggtgggtgttggggtat

SEQ ID NO: 73551 - DNA, 22 bp, Human papillomavirus type 63
ctaagggtgggtgttggggtat

SEQ ID NO: 73552 - DNA, 23 bp, Homo sapiens
ctgagggtgggggccacttgggt

SEQ ID NO: 73553 - DNA, 19 bp, Homo sapiens
ctgaggctgggtgtggtgt

SEQ ID NO: 73554 - DNA, 21 bp, Homo sapiens
taagagtggggtggcaggtat

SEQ ID NO: 73555 - DNA, 19 bp, Homo sapiens
gggtggggggattgggtgt

SEQ ID NO: 73556 - DNA, 19 bp, Homo sapiens
ctaggagtgggcaaggtat

SEQ ID NO: 73557 - DNA, 19 bp, Homo sapiens
ctgagggcggggccggtgt

SEQ ID NO: 73558 - DNA, 16 bp, Homo sapiens
gggtgggtgcaggtat

SEQ ID NO: 73559 - DNA, 21 bp, Homo sapiens
ctaagggtgagtctcaggtgt

SEQ ID NO: 73560 - DNA, 18 bp, Homo sapiens
ctgagggtggggtagtgt

SEQ ID NO: 73561 - DNA, 15 bp, Homo sapiens
ccaagggtgggaggt

SEQ ID NO: 73562 - DNA, 17 bp, Homo sapiens
gggcgtgggtgaggtat

SEQ ID NO: 73563 - DNA, 19 bp, Homo sapiens
gagtgtgtttatggggtat

SEQ ID NO: 73564 - DNA, 19 bp, Homo sapiens
agggcgtgtgtgttggggt

SEQ ID NO: 73565 - DNA, 21 bp, Homo sapiens
ctgaggatggctcctgggtgt

SEQ ID NO: 73566 - DNA, 18 bp, Homo sapiens
ctaagggtggggagaggc

SEQ ID NO: 73567 - DNA, 19 bp, Homo sapiens
taaggttgggtgtctcaat

SEQ ID NO: 73568 - DNA, 15 bp, Homo sapiens
gggtgggtggggtat

SEQ ID NO: 73569 - DNA, 18 bp, Homo sapiens
agggtgaaatgatggggt

SEQ ID NO: 73570 - DNA, 19 bp, Homo sapiens
ctgagggttggtgggtggt

SEQ ID NO: 73571 - DNA, 17 bp, Homo sapiens
ctgagggtgggtgtgag

SEQ ID NO: 73572 - DNA, 18 bp, Homo sapiens
agggcaagcttggggtat

SEQ ID NO: 73573 - DNA, 68 bp, Human papillomavirus type 63
gtctgaaggggggccctaatcaacttaagtgcttaaggtataggattaaagcttcaaattcatctgac

SEQ ID NO: 73574 - DNA, 22 bp, Human papillomavirus type 63
taaagcttcaaattcatctgac

SEQ ID NO: 73575 - DNA, 20 bp, Homo sapiens
taaagctttgattcatagac

SEQ ID NO: 73576 - DNA, 22 bp, Homo sapiens
taaagctccaagtatatttgac

SEQ ID NO: 73577 - DNA, 18 bp, Homo sapiens
aaacttcaagtcacagac

SEQ ID NO: 73578 - DNA, 16 bp, Homo sapiens
taaagctccccatctg

SEQ ID NO: 73579 - DNA, 18 bp, Homo sapiens
aagctttcacctcatctg

SEQ ID NO: 73580 - DNA, 17 bp, Homo sapiens
taaagtcagttcatctg

SEQ ID NO: 73581 - DNA, 17 bp, Homo sapiens
taaagctgatcatctga

SEQ ID NO: 73582 - DNA, 21 bp, Homo sapiens
aaagcttcataatcatatctg

SEQ ID NO: 73583 - DNA, 15 bp, Homo sapiens
aagcttcaaacctga

SEQ ID NO: 73584 - DNA, 18 bp, Homo sapiens
agaatcacttcatctgac

SEQ ID NO: 73585 - DNA, 22 bp, Homo sapiens
aagcttcagtttcaggtctgac

SEQ ID NO: 73586 - DNA, 19 bp, Homo sapiens
aaacttggaaattcatctg

SEQ ID NO: 73587 - DNA, 22 bp, Homo sapiens
taaagcttgtaagtccatcgtg

SEQ ID NO: 73588 - DNA, 16 bp, Homo sapiens
aaacttcaaccttctg

SEQ ID NO: 73589 - DNA, 18 bp, Homo sapiens
taaaactgttttcatctg

SEQ ID NO: 73590 - DNA, 17 bp, Homo sapiens
aagcttcaagtcagtga

SEQ ID NO: 73591 - DNA, 16 bp, Homo sapiens
aagcctcaaactcctg

SEQ ID NO: 73592 - DNA, 17 bp, Homo sapiens
tgagcttcaactcctga

SEQ ID NO: 73593 - DNA, 19 bp, Homo sapiens
aagtcttcaaattcctctg

SEQ ID NO: 73594 - DNA, 19 bp, Homo sapiens
aagcctcaggccccctctg

SEQ ID NO: 73595 - DNA, 25 bp, Homo sapiens
taaagcttacaaagatataatctga

SEQ ID NO: 73596 - DNA, 82 bp, Human papillomavirus type 44
gtgcagtgcacaggaacagacatccatcacctacatacgcttctgctgggttcactggatatattgtgtcctgtgtgtgcgc

SEQ ID NO: 73597 - DNA, 24 bp, Human papillomavirus type 44
ttcactggatatattgtgtcctgt

SEQ ID NO: 73598 - DNA, 23 bp, Homo sapiens
ttcgctggtgccggctgtcctgt

SEQ ID NO: 73599 - DNA, 18 bp, Homo sapiens
tccactggatgtgccact

SEQ ID NO: 73600 - DNA, 22 bp, Homo sapiens
ttcactgatatttaagtcctgt

SEQ ID NO: 73601 - DNA, 17 bp, Homo sapiens
tggatatacagttctgt

SEQ ID NO: 73602 - DNA, 16 bp, Homo sapiens
ctcactggatgtgcct

SEQ ID NO: 73603 - DNA, 21 bp, Homo sapiens
ttcactggaatctcattttgt

SEQ ID NO: 73604 - DNA, 19 bp, Homo sapiens
ttcactggaattattttgt

SEQ ID NO: 73605 - DNA, 23 bp, Homo sapiens
ttcactgaatataatggtcttgt

SEQ ID NO: 73606 - DNA, 89 bp, Human papillomavirus type 60
aggaggaggagcactatccctatacaatagacacctgttgcaaaccttgtggagcaggtgttagatttactattattgctactccttct

SEQ ID NO: 73607 - DNA, 24 bp, Human papillomavirus type 60
gagcaggtgttagatttactatta

SEQ ID NO: 73608 - DNA, 18 bp, Homo sapiens
gcagggggatttactatt

SEQ ID NO: 73609 - DNA, 21 bp, Homo sapiens
aggtataaaggtttactatta

SEQ ID NO: 73610 - DNA, 19 bp, Homo sapiens
acagacaggatttactatt

SEQ ID NO: 73611 - DNA, 22 bp, Homo sapiens
accggcatcagatttattatta

SEQ ID NO: 73612 - DNA, 65 bp, Pestivirus type 3
tttatttgatgggatgtagatggcaactaactacctcataggaccacactacactcatttttaaa

SEQ ID NO: 73613 - DNA, 24 bp, Pestivirus type 3
ggaccacactacactcatttttaa

SEQ ID NO: 73614 - DNA, 22 bp, Homo sapiens
ggatcgctctacactcgccccc

SEQ ID NO: 73615 - DNA, 22 bp, Homo sapiens
ggaacaagacattcatttttaa

SEQ ID NO: 73616 - DNA, 21 bp, Homo sapiens
ggaccacactgccttccccct

SEQ ID NO: 73617 - DNA, 24 bp, Homo sapiens
agattacacttttgtcatttttaa

SEQ ID NO: 73618 - DNA, 18 bp, Homo sapiens
ggccacactgaatttcta

SEQ ID NO: 73619 - DNA, 19 bp, Homo sapiens
gaactacaggtcattttta

SEQ ID NO: 73620 - DNA, 20 bp, Homo sapiens
ggccacgctgcaccattttt

SEQ ID NO: 73621 - DNA, 17 bp, Homo sapiens
ggccacgcttcatcctt

SEQ ID NO: 73622 - DNA, 18 bp, Homo sapiens
ggactgctctcattttta

SEQ ID NO: 73623 - DNA, 22 bp, Homo sapiens
aaacaatgctacactcattttt

SEQ ID NO: 73624 - DNA, 17 bp, Homo sapiens
ggaccacattagccatt

SEQ ID NO: 73625 - DNA, 18 bp, Homo sapiens
gaccactttctcattttt

SEQ ID NO: 73626 - DNA, 24 bp, Homo sapiens
gaaccccacgacatttatttttaa

SEQ ID NO: 73627 - DNA, 60 bp, Paramecium bursaria Chlorella virus 1
tgtacgtaatggacatcataggtacgatagcagtatctttcttggtttcttatttgtata

SEQ ID NO: 73628 - DNA, 23 bp, Paramecium bursaria Chlorella virus 1
tttcttggtttcttatttgtata

SEQ ID NO: 73629 - DNA, 17 bp, Homo sapiens
tttcttggttttgttgc

SEQ ID NO: 73630 - DNA, 17 bp, Homo sapiens
tttcttggttcttttgt

SEQ ID NO: 73631 - DNA, 19 bp, Homo sapiens
tttcttggtttctgattca

SEQ ID NO: 73632 - DNA, 19 bp, Homo sapiens
tttctggtttctgttgtat

SEQ ID NO: 73633 - DNA, 19 bp, Homo sapiens
ttcttgagggtatttgtat

SEQ ID NO: 73634 - DNA, 17 bp, Homo sapiens
tttcttggttctttgta

SEQ ID NO: 73635 - DNA, 20 bp, Homo sapiens
tttcttggtatcttaagggt

SEQ ID NO: 73636 - DNA, 16 bp, Homo sapiens
tcttggtttctcctgt

SEQ ID NO: 73637 - DNA, 18 bp, Homo sapiens
tcttggtttcttcttgta

SEQ ID NO: 73638 - DNA, 21 bp, Homo sapiens
tttcttgtttttctcaggtat

SEQ ID NO: 73639 - DNA, 16 bp, Homo sapiens
tttcttggctttttgt

SEQ ID NO: 73640 - DNA, 22 bp, Homo sapiens
ttttatggtttctctccagtat

SEQ ID NO: 73641 - DNA, 19 bp, Homo sapiens
tttctggtggtttatttgt

SEQ ID NO: 73642 - DNA, 20 bp, Homo sapiens
tttcttagtttcttttctat

SEQ ID NO: 73643 - DNA, 17 bp, Homo sapiens
tttcttggctttttgta

SEQ ID NO: 73644 - DNA, 18 bp, Homo sapiens
tttcttggtttatatatg

SEQ ID NO: 73645 - DNA, 21 bp, Homo sapiens
tttcttggttttttctttctg

SEQ ID NO: 73646 - DNA, 23 bp, Homo sapiens
tttcttggtatttctcatgtata

SEQ ID NO: 73647 - DNA, 17 bp, Homo sapiens
tttctggttttacttgt

SEQ ID NO: 73648 - DNA, 81 bp, Human papillomavirus type 65
cattagcagtaactgaatataatgcaaaacaagcaatacaaatacatttgactttgcagtcattattaaagtctccttatg

SEQ ID NO: 73649 - DNA, 24 bp, Human papillomavirus type 65
tataatgcaaaacaagcaatacaa

SEQ ID NO: 73650 - DNA, 19 bp, Homo sapiens
tataatacaaaaaaataca

SEQ ID NO: 73651 - DNA, 18 bp, Homo sapiens
ataatgcagaacctacaa

SEQ ID NO: 73652 - DNA, 18 bp, Homo sapiens
taatgcaaacaaaataca

SEQ ID NO: 73653 - DNA, 20 bp, Homo sapiens
tataatacaaaacaaattac

SEQ ID NO: 73654 - DNA, 23 bp, Homo sapiens
acgcaggtaaagcaggcaataca

SEQ ID NO: 73655 - DNA, 20 bp, Homo sapiens
tagtgcaaaacaaaaatcac

SEQ ID NO: 73656 - DNA, 21 bp, Homo sapiens
tataagcaaaacaaaatacaa

SEQ ID NO: 73657 - DNA, 24 bp, Homo sapiens
tgaatgcaaaataagccatctaca

SEQ ID NO: 73658 - DNA, 22 bp, Homo sapiens
cataataaaataagcaatacaa

SEQ ID NO: 73659 - DNA, 23 bp, Homo sapiens
tataatcaaaatacgcaatacaa

SEQ ID NO: 73660 - DNA, 20 bp, Homo sapiens
taatgcaaaacaactgacaa

SEQ ID NO: 73661 - DNA, 23 bp, Homo sapiens
taatgcaaaatgttgcaatacaa

SEQ ID NO: 73662 - DNA, 19 bp, Homo sapiens
taatacagtcacaatacaa

SEQ ID NO: 73663 - DNA, 20 bp, Homo sapiens
gcaccaaacaggcaatacaa

SEQ ID NO: 73664 - DNA, 21 bp, Homo sapiens
tataatgaataagcaatacaa

SEQ ID NO: 73665 - DNA, 19 bp, Homo sapiens
tgcaaaacataaaatacaa

SEQ ID NO: 73666 - DNA, 23 bp, Homo sapiens
atacaaatgagtgggcaatacaa

SEQ ID NO: 73667 - DNA, 26 bp, Homo sapiens
tataatgcagaaaaacttcaatacaa

SEQ ID NO: 73668 - DNA, 17 bp, Homo sapiens
tacaatgcaaaacaaca

SEQ ID NO: 73669 - DNA, 22 bp, Homo sapiens
taatacaaaacaaagaccaaca

SEQ ID NO: 73670 - DNA, 19 bp, Homo sapiens
tataagcaaatgcaataca

SEQ ID NO: 73671 - DNA, 19 bp, Homo sapiens
tataagcaagacaaagcaa

SEQ ID NO: 73672 - DNA, 20 bp, Homo sapiens
tataatacaaaacagctata

SEQ ID NO: 73673 - DNA, 81 bp, Human papillomavirus type 25
cgatacataaaaggtgagttatgtgccaaatcagatacagtctgtgccaaactcaggcagctgctcgccagatgcgtatcg

SEQ ID NO: 73674 - DNA, 24 bp, Human papillomavirus type 25
tcaggcagctgctcgccagatgcg

SEQ ID NO: 73675 - DNA, 26 bp, Homo sapiens
tcaggcagcagtttgctgcgcatctg

SEQ ID NO: 73676 - DNA, 17 bp, Homo sapiens
tcaggcaagtctggatg

SEQ ID NO: 73677 - DNA, 17 bp, Homo sapiens
tcaggggctgctcgcca

SEQ ID NO: 73678 - DNA, 19 bp, Homo sapiens
tcaggcagctgttctaacc

SEQ ID NO: 73679 - DNA, 20 bp, Homo sapiens
tcagccggctgctcgggcag

SEQ ID NO: 73680 - DNA, 15 bp, Homo sapiens
tcaggtggccagatg

SEQ ID NO: 73681 - DNA, 20 bp, Homo sapiens
ccaggtaggagccaggtgcg

SEQ ID NO: 73682 - DNA, 18 bp, Homo sapiens
tcaggctgtggccagatg

SEQ ID NO: 73683 - DNA, 22 bp, Homo sapiens
tcaggcaagttggaaccagatg

SEQ ID NO: 73684 - DNA, 19 bp, Homo sapiens
tcagcagctgggcaggatg

SEQ ID NO: 73685 - DNA, 15 bp, Homo sapiens
caggcaggccagatg

SEQ ID NO: 73686 - DNA, 26 bp, Homo sapiens
tcagacagctgtgatgtgcgcatctg

SEQ ID NO: 73687 - DNA, 25 bp, Homo sapiens
tcaggcagctgcttttgcgcatctg

SEQ ID NO: 73688 - DNA, 20 bp, Homo sapiens
caggtggcctcagccagatg

SEQ ID NO: 73689 - DNA, 18 bp, Homo sapiens
agacagctgctgccgatg

SEQ ID NO: 73690 - DNA, 22 bp, Homo sapiens
tcgggcagctggctctcatgtg

SEQ ID NO: 73691 - DNA, 15 bp, Homo sapiens
agacagccctagatg

SEQ ID NO: 73692 - DNA, 18 bp, Homo sapiens
caggcagcaactcagatg

SEQ ID NO: 73693 - DNA, 93 bp, Fowlpox virus
attactgttaccgctgtaataacaaaagtatctataattcccatttattgataattaacttttgacaatatttataatagtttaactagtaat

SEQ ID NO: 73694 - DNA, 24 bp, Fowlpox virus
taacaaaagtatctataattccca

SEQ ID NO: 73695 - DNA, 17 bp, Homo sapiens
aacaaaatataattccc

SEQ ID NO: 73696 - DNA, 19 bp, Homo sapiens
acaaaagtatttcataact

SEQ ID NO: 73697 - DNA, 22 bp, Homo sapiens
aaaagtatctccacctttccca

SEQ ID NO: 73698 - DNA, 21 bp, Homo sapiens
aaagtatctcaacaattctca

SEQ ID NO: 73699 - DNA, 17 bp, Homo sapiens
caaaagtatctacactc

SEQ ID NO: 73700 - DNA, 16 bp, Homo sapiens
caaaagcaccattccc

SEQ ID NO: 73701 - DNA, 19 bp, Homo sapiens
taacaaaagtatatataat

SEQ ID NO: 73702 - DNA, 20 bp, Homo sapiens
acaaaagctgtccattattc

SEQ ID NO: 73703 - DNA, 18 bp, Homo sapiens
taaccaaagtatcttccc

SEQ ID NO: 73704 - DNA, 16 bp, Homo sapiens
acaaaagcatctgtcc

SEQ ID NO: 73705 - DNA, 19 bp, Homo sapiens
acaggtattctataattcc

SEQ ID NO: 73706 - DNA, 18 bp, Homo sapiens
aaggaatatataattccc

SEQ ID NO: 73707 - DNA, 19 bp, Homo sapiens
aaatattacataattccca

SEQ ID NO: 73708 - DNA, 18 bp, Homo sapiens
caaaagtatatacattcc

SEQ ID NO: 73709 - DNA, 20 bp, Homo sapiens
taaccgaagagttaattccc

SEQ ID NO: 73710 - DNA, 19 bp, Homo sapiens
acaaaagcaatatgattcc

SEQ ID NO: 73711 - DNA, 22 bp, Homo sapiens
taacaagaatcaggaattccca

SEQ ID NO: 73712 - DNA, 20 bp, Homo sapiens
acaactggctataattccca

SEQ ID NO: 73713 - DNA, 118 bp, Canine parvovirus
attctttagaaccaactgaccaagttcacgtacgtatgacgtgatgacccgctgcgcgcgctgcctacggcagtcacacgtcatacgtacgctccttggtcagttggttctaaagaat

SEQ ID NO: 73714 - DNA, 24 bp, Canine parvovirus
ctacggcagtcacacgtcatacgt

SEQ ID NO: 73715 - DNA, 24 bp, Homo sapiens
ctgcggcagccacgtcctcggcgt

SEQ ID NO: 73716 - DNA, 26 bp, Homo sapiens
ctacagcagttacattgtacgtatgc

SEQ ID NO: 73717 - DNA, 22 bp, Homo sapiens
tgacggcagttgtgccaatcgt

SEQ ID NO: 73718 - DNA, 126 bp, Camelpox virus
gtagatgctatcattactctaaaatatataatgaataatccagatttaaaactacgtatgtggaagtactcggttccagaatagcggatatagatattaaacaagtgatacatgagaatatactac

SEQ ID NO: 73719 - DNA, 24 bp, Camelpox virus
tatcattactctaaaatatataat

SEQ ID NO: 73720 - DNA, 22 bp, Homo sapiens
catcattactaatttatataat

SEQ ID NO: 73721 - DNA, 99 bp, Paramecium bursaria Chlorella virus 1
aaaggagaaatatcagattatgacgggtactattggataccgacgaacaagtaatttgttgatacgatattacaccatcattattttatgtacttcttt

SEQ ID NO: 73722 - DNA, 24 bp, Paramecium bursaria Chlorella virus 1
tattacaccatcattattttatgt

SEQ ID NO: 73723 - DNA, 18 bp, Homo sapiens
catcatcagattttatgt

SEQ ID NO: 73724 - DNA, 19 bp, Homo sapiens
tattacatctcattatcct

SEQ ID NO: 73725 - DNA, 18 bp, Homo sapiens
ccatcattaacattatgt

SEQ ID NO: 73726 - DNA, 21 bp, Homo sapiens
tacactgtctcaattttatgt

SEQ ID NO: 73727 - DNA, 20 bp, Homo sapiens
ttaccccatcctttttatgt

SEQ ID NO: 73728 - DNA, 18 bp, Homo sapiens
ttacagccatcattatcc

SEQ ID NO: 73729 - DNA, 19 bp, Homo sapiens
tacaccaaacattttatgt

SEQ ID NO: 73730 - DNA, 26 bp, Homo sapiens
tattatcaccatcatttactatatgt

SEQ ID NO: 73731 - DNA, 80 bp, Monkeypox virus
atatgactagaccgatgaccatttaaaaaatactctctagctttaacttaaactgtatcgatcattcttttagcacatgt

SEQ ID NO: 73732 - DNA, 23 bp, Monkeypox virus
tcgatcattcttttagcacatgt

SEQ ID NO: 73733 - DNA, 20 bp, Homo sapiens
tcgattcttaaagcatatgt

SEQ ID NO: 73734 - DNA, 22 bp, Homo sapiens
tcaatcatgttttggcatgtgt

SEQ ID NO: 73735 - DNA, 21 bp, Homo sapiens
gattattccctgagcacatgt

SEQ ID NO: 73736 - DNA, 20 bp, Homo sapiens
gacatttcatctgcacatgt

SEQ ID NO: 73737 - DNA, 18 bp, Homo sapiens
gaacattcttccacatgt

SEQ ID NO: 73738 - DNA, 21 bp, Homo sapiens
tcagtcattctttatccatgt

SEQ ID NO: 73739 - DNA, 21 bp, Homo sapiens
gattactttcagcctgcatgt

SEQ ID NO: 73740 - DNA, 67 bp, Monkeypox virus
gattttcaattatgtatcattatagcaacagtaattcttgctcctccttgattttagcatcctcttc

SEQ ID NO: 73741 - DNA, 24 bp, Monkeypox virus
tcctccttgattttagcatcctct

SEQ ID NO: 73742 - DNA, 16 bp, Homo sapiens
cttcttgattcttcct

SEQ ID NO: 73743 - DNA, 16 bp, Homo sapiens
tcctcttgatttccct

SEQ ID NO: 73744 - DNA, 17 bp, Homo sapiens
tccttgattttcttcct

SEQ ID NO: 73745 - DNA, 19 bp, Homo sapiens
tccttctgaaatcatcctc

SEQ ID NO: 73746 - DNA, 21 bp, Homo sapiens
tcctccatgtctgtatcttct

SEQ ID NO: 73747 - DNA, 21 bp, Homo sapiens
cctccttgaggaacgtcctct

SEQ ID NO: 73748 - DNA, 18 bp, Homo sapiens
ttgattttcagcatttct

SEQ ID NO: 73749 - DNA, 19 bp, Homo sapiens
ttgattcctagtgtcctct

SEQ ID NO: 73750 - DNA, 17 bp, Homo sapiens
tcctccttggctcccct

SEQ ID NO: 73751 - DNA, 17 bp, Homo sapiens
tcgcctgatagcatcct

SEQ ID NO: 73752 - DNA, 25 bp, Homo sapiens
tcctccttggtttatgggcatttct

SEQ ID NO: 73753 - DNA, 18 bp, Homo sapiens
tccttggcttcgtcctct

SEQ ID NO: 73754 - DNA, 19 bp, Homo sapiens
cctcagtttagcattttct

SEQ ID NO: 73755 - DNA, 18 bp, Homo sapiens
cttctttatttcagcctc

SEQ ID NO: 73756 - DNA, 25 bp, Homo sapiens
cctccttgaggctgtagtgtcttct

SEQ ID NO: 73757 - DNA, 17 bp, Homo sapiens
cttcttgatttcttcct

SEQ ID NO: 73758 - DNA, 22 bp, Homo sapiens
tcctttggaaactacatcctct

SEQ ID NO: 73759 - DNA, 17 bp, Homo sapiens
tcctcctgatttatcct

SEQ ID NO: 73760 - DNA, 22 bp, Homo sapiens
tcctcctttatttcaagcctct

SEQ ID NO: 73761 - DNA, 19 bp, Homo sapiens
tcctccttgttttttgctc

SEQ ID NO: 73762 - DNA, 17 bp, Homo sapiens
ccttcttcagcatcttc

SEQ ID NO: 73763 - DNA, 21 bp, Homo sapiens
cttgatcctctggcatcctct

SEQ ID NO: 73764 - DNA, 23 bp, Homo sapiens
ccctccttgagaactcattttct

SEQ ID NO: 73765 - DNA, 21 bp, Homo sapiens
tcctttgttcaggtgtcctct

SEQ ID NO: 73766 - DNA, 18 bp, Homo sapiens
tcttccctggcattctct

SEQ ID NO: 73767 - DNA, 15 bp, Homo sapiens
ctccttgacttccct

SEQ ID NO: 73768 - DNA, 19 bp, Homo sapiens
cttgtccatagcattctct

SEQ ID NO: 73769 - DNA, 24 bp, Homo sapiens
ctcctttaacctttagtattttct

SEQ ID NO: 73770 - DNA, 16 bp, Homo sapiens
tcctccttattctcct

SEQ ID NO: 73771 - DNA, 18 bp, Homo sapiens
cttgatttttttccctct

SEQ ID NO: 73772 - DNA, 19 bp, Homo sapiens
tcctccgtgggactccatc

SEQ ID NO: 73773 - DNA, 20 bp, Homo sapiens
ctttttttacaccatcctct

SEQ ID NO: 73774 - DNA, 18 bp, Homo sapiens
tcttccctgacacattct

SEQ ID NO: 73775 - DNA, 20 bp, Homo sapiens
tccttctctgattttagatc

SEQ ID NO: 73776 - DNA, 18 bp, Homo sapiens
tccgccttgattttggca

SEQ ID NO: 73777 - DNA, 18 bp, Homo sapiens
tcccccttggatccgtct

SEQ ID NO: 73778 - DNA, 18 bp, Homo sapiens
tcctgcagttttagcatc

SEQ ID NO: 73779 - DNA, 18 bp, Homo sapiens
cttgattttccaatctct

SEQ ID NO: 73780 - DNA, 18 bp, Homo sapiens
tcctccttcattcttcct

SEQ ID NO: 73781 - DNA, 18 bp, Homo sapiens
ctctcttgatttggcctc

SEQ ID NO: 73782 - DNA, 24 bp, Homo sapiens
tccttctgattttatttgtcttct

SEQ ID NO: 73783 - DNA, 19 bp, Homo sapiens
ctccttgaagtcatcttct

SEQ ID NO: 73784 - DNA, 18 bp, Homo sapiens
tcctccttgtttctcctc

SEQ ID NO: 73785 - DNA, 19 bp, Homo sapiens
tcctccttattcctttcct

SEQ ID NO: 73786 - DNA, 18 bp, Homo sapiens
ctcctgactccatgcatc

SEQ ID NO: 73787 - DNA, 16 bp, Homo sapiens
ctctttaatttccctc

SEQ ID NO: 73788 - DNA, 20 bp, Homo sapiens
cctttgccttggcatcctct

SEQ ID NO: 73789 - DNA, 83 bp, Feline immunodeficiency virus
tatttgtaaatggatatcctataaaatttttattagacacaggagcagatataacaattttaaataggagagattttcaagta

SEQ ID NO: 73790 - DNA, 24 bp, Feline immunodeficiency virus
tatcctataaaatttttattagac

SEQ ID NO: 73791 - DNA, 21 bp, Homo sapiens
tatccataattactattagac

SEQ ID NO: 73792 - DNA, 19 bp, Homo sapiens
tatcctaaaaaattttcat

SEQ ID NO: 73793 - DNA, 18 bp, Homo sapiens
tcctataaacatttttat

SEQ ID NO: 73794 - DNA, 16 bp, Homo sapiens
tcctatcttttattag

SEQ ID NO: 73795 - DNA, 20 bp, Homo sapiens
tccagatttttttattagac

SEQ ID NO: 73796 - DNA, 20 bp, Homo sapiens
tcctaaggatcctattagac

SEQ ID NO: 73797 - DNA, 22 bp, Homo sapiens
tatcctataaacacatgattag

SEQ ID NO: 73798 - DNA, 26 bp, Homo sapiens
tatcctataaagtttgaactttagac

SEQ ID NO: 73799 - DNA, 75 bp, Feline immunodeficiency virus
gaacaaattatattaatgtacatttagagattagagatgaaaattataagacacaatgtatatttggtaatgttt

SEQ ID NO: 73800 - DNA, 24 bp, Feline immunodeficiency virus
taatgtacatttagagattagaga

SEQ ID NO: 73801 - DNA, 20 bp, Homo sapiens
aatgtgcatttgaccaaaga

SEQ ID NO: 73802 - DNA, 17 bp, Homo sapiens
atgaacattgattagag

SEQ ID NO: 73803 - DNA, 19 bp, Homo sapiens
caatgtgcatttaaaggag

SEQ ID NO: 73804 - DNA, 16 bp, Homo sapiens
tgtacacagattagag

SEQ ID NO: 73805 - DNA, 17 bp, Homo sapiens
tacatttagaaactgag

SEQ ID NO: 73806 - DNA, 19 bp, Homo sapiens
tgtacattagatcttgaga

SEQ ID NO: 73807 - DNA, 18 bp, Homo sapiens
taatgtacactttacaga

SEQ ID NO: 73808 - DNA, 18 bp, Homo sapiens
tgtacaactgattagaga

SEQ ID NO: 73809 - DNA, 23 bp, Homo sapiens
tgtacatttcaggttaatagaga

SEQ ID NO: 73810 - DNA, 17 bp, Homo sapiens
tgtacatttacacagag

SEQ ID NO: 73811 - DNA, 20 bp, Homo sapiens
tgtatattggaaattagaga

SEQ ID NO: 73812 - DNA, 17 bp, Homo sapiens
atgtacatttaagaaga

SEQ ID NO: 73813 - DNA, 16 bp, Homo sapiens
tgtacattttttagag

SEQ ID NO: 73814 - DNA, 19 bp, Homo sapiens
tatacatttagatacagag

SEQ ID NO: 73815 - DNA, 112 bp, Human herpesvirus 1
tgggtgtttttggggtgtggcggacgcggggcggtcattggacggggtgcagttaaatacatgcccgggacccatgaagcatgcgcgacttccgggcctcagaacccacccg

SEQ ID NO: 73816 - DNA, 24 bp, Human herpesvirus 1
ggtcattggacggggtgcagttaa

SEQ ID NO: 73817 - DNA, 20 bp, Homo sapiens
agttgttggacaagctggtt

SEQ ID NO: 73818 - DNA, 19 bp, Homo sapiens
ggtgattggtggtgcagtt

SEQ ID NO: 73819 - DNA, 17 bp, Homo sapiens
ggtcattgggagggggc

SEQ ID NO: 73820 - DNA, 19 bp, Homo sapiens
ggggaggcggggtgtagtt

SEQ ID NO: 73821 - DNA, 19 bp, Homo sapiens
ggccattgggaaggcggtt

SEQ ID NO: 73822 - DNA, 20 bp, Homo sapiens
ggtgtggctggggtgcagtt

SEQ ID NO: 73823 - DNA, 127 bp, Human papillomavirus type 15
gacctgcattgctacgaagagttaagtgaagaagagacagaggaggagccacgatttattccttacaagattgtagttccgtgttgcttttgtgattccaagcttcgacttatagtggttgcaactc

SEQ ID NO: 73824 - DNA, 24 bp, Human papillomavirus type 15
gtagttccgtgttgcttttgtgat

SEQ ID NO: 73825 - DNA, 17 bp, Homo sapiens
tagttttccttttgtga

SEQ ID NO: 73826 - DNA, 18 bp, Homo sapiens
gtaattttccttttgtga

SEQ ID NO: 73827 - DNA, 18 bp, Homo sapiens
gtagctgctgcttttgtg

SEQ ID NO: 73828 - DNA, 64 bp, Human papillomavirus type 9
gcaagacttcgtttatacgtgcttgctacaaatttaggaattcgagcgcaacaggaacttttgc

SEQ ID NO: 73829 - DNA, 24 bp, Human papillomavirus type 9
acttcgtttatacgtgcttgctac

SEQ ID NO: 73830 - DNA, 19 bp, Homo sapiens
ttcatttatgagctgctac

SEQ ID NO: 73831 - DNA, 20 bp, Homo sapiens
ttcatttattttatttgcta

SEQ ID NO: 73832 - DNA, 18 bp, Homo sapiens
acttcgttatggtgctac

SEQ ID NO: 73833 - DNA, 17 bp, Homo sapiens
ttcagtttatgcgcctg

SEQ ID NO: 73834 - DNA, 25 bp, Homo sapiens
acttcgttttcatattgtttgttgc

SEQ ID NO: 73835 - DNA, 21 bp, Homo sapiens
acttaggtttgtgtttgctac

SEQ ID NO: 73836 - DNA, 18 bp, Homo sapiens
ttccttttgatgcttgct

SEQ ID NO: 73837 - DNA, 22 bp, Homo sapiens
actttgttctatacactttgct

SEQ ID NO: 73838 - DNA, 18 bp, Homo sapiens
ttcattcccatgcttgct

SEQ ID NO: 73839 - DNA, 74 bp, Equine herpesvirus 2
ctcattgtggttttcgcgcctcagagttgttaaccacattcggcaaaaggggaagtatgaaacccacaagggag

SEQ ID NO: 73840 - DNA, 24 bp, Equine herpesvirus 2
cattgtggttttcgcgcctcagag

SEQ ID NO: 73841 - DNA, 20 bp, Homo sapiens
ttgtggtttttttcttggag

SEQ ID NO: 73842 - DNA, 22 bp, Homo sapiens
cactgtatcctgtgccttggag

SEQ ID NO: 73843 - DNA, 18 bp, Homo sapiens
taatcctttgcgcctcag

SEQ ID NO: 73844 - DNA, 65 bp, Equine herpesvirus 2
acactacatttctcagaaccaaaaatttctaaataaagattttttctatgaaattcataaagtgt

SEQ ID NO: 73845 - DNA, 24 bp, Equine herpesvirus 2
actacatttctcagaaccaaaaat

SEQ ID NO: 73846 - DNA, 19 bp, Homo sapiens
actatgattctcagaatcc

SEQ ID NO: 73847 - DNA, 21 bp, Homo sapiens
cacatttctcaatctaaaaaa

SEQ ID NO: 73848 - DNA, 20 bp, Homo sapiens
ctgcatttctcagtggcaaa

SEQ ID NO: 73849 - DNA, 25 bp, Homo sapiens
ctgcatttctccattggccccaaaa

SEQ ID NO: 73850 - DNA, 19 bp, Homo sapiens
tacatttataaccaaaaat

SEQ ID NO: 73851 - DNA, 27 bp, Homo sapiens
actacacttcttgaaattcctaaaaat

SEQ ID NO: 73852 - DNA, 18 bp, Homo sapiens
acttgctcctcagaacca

SEQ ID NO: 73853 - DNA, 16 bp, Homo sapiens
acaacaagaaccaaaa

SEQ ID NO: 73854 - DNA, 20 bp, Homo sapiens
actatagttctcagaaacaa

SEQ ID NO: 73855 - DNA, 19 bp, Homo sapiens
cttcatgggcagaaccaaa

SEQ ID NO: 73856 - DNA, 19 bp, Homo sapiens
tacaaactcagaactgaaa

SEQ ID NO: 73857 - DNA, 18 bp, Homo sapiens
cttctcggagccaaaaat

SEQ ID NO: 73858 - DNA, 26 bp, Homo sapiens
ctacatttactcagctggataaaaat

SEQ ID NO: 73859 - DNA, 23 bp, Homo sapiens
accatattttctagaccaaaaat

SEQ ID NO: 73860 - DNA, 16 bp, Homo sapiens
acatttggaaccaaaa

SEQ ID NO: 73861 - DNA, 17 bp, Homo sapiens
actactttttcagaacc

SEQ ID NO: 73862 - DNA, 17 bp, Homo sapiens
cacatttctcaggccaa

SEQ ID NO: 73863 - DNA, 19 bp, Homo sapiens
tttctgaatagaaccaaaa

SEQ ID NO: 73864 - DNA, 18 bp, Homo sapiens
cacatttctcagaacaca

SEQ ID NO: 73865 - DNA, 18 bp, Homo sapiens
cttcccaggaccagaaat

SEQ ID NO: 73866 - DNA, 22 bp, Homo sapiens
actacattccacctccaaaaat

SEQ ID NO: 73867 - DNA, 16 bp, Homo sapiens
actaccagagccaaaa

SEQ ID NO: 73868 - DNA, 16 bp, Homo sapiens
cacatttccccaaaaa

SEQ ID NO: 73869 - DNA, 19 bp, Homo sapiens
actacatttcccagggtcc

SEQ ID NO: 73870 - DNA, 16 bp, Homo sapiens
catctggaaccaaaaa

SEQ ID NO: 73871 - DNA, 18 bp, Homo sapiens
acttcatttctccaaaaa

SEQ ID NO: 73872 - DNA, 19 bp, Homo sapiens
tacatttcacatcccaaaa

SEQ ID NO: 73873 - DNA, 24 bp, Homo sapiens
actgggtttctcccctccaaaaat

SEQ ID NO: 73874 - DNA, 24 bp, Homo sapiens
acagcatttggaaaaaccaaaaat

SEQ ID NO: 73875 - DNA, 87 bp, Camelpox virus
tttttattcttcattcgttacgacttttaacacacccgaatgtatcgacaaagggcaatattttgcgtcatttatggagttagaaaa

SEQ ID NO: 73876 - DNA, 24 bp, Camelpox virus
aaagggcaatattttgcgtcattt

SEQ ID NO: 73877 - DNA, 18 bp, Homo sapiens
aaagggcagatagttttg

SEQ ID NO: 73878 - DNA, 21 bp, Homo sapiens
agggcaatggttaaatcattt

SEQ ID NO: 73879 - DNA, 19 bp, Homo sapiens
ggagtgcaatggcgtcatt

SEQ ID NO: 73880 - DNA, 23 bp, Homo sapiens
gggcaatattttaaaattcattt

SEQ ID NO: 73881 - DNA, 22 bp, Homo sapiens
aagggtgatactttgtacattt

SEQ ID NO: 73882 - DNA, 19 bp, Homo sapiens
aagggcaatgcttttgcat

SEQ ID NO: 73883 - DNA, 16 bp, Homo sapiens
aaaaggcaacatgcat

SEQ ID NO: 73884 - DNA, 22 bp, Homo sapiens
ggagggcaattttttggccatt

SEQ ID NO: 73885 - DNA, 21 bp, Homo sapiens
aaaggcaacaaagtgtcattt

SEQ ID NO: 73886 - DNA, 78 bp, Paramecium bursaria Chlorella virus 1
gagataagtttcataagtttattttattatcatttcaaatattttgatttctttttctaaatttgtgaaatttttttc

SEQ ID NO: 73887 - DNA, 24 bp, Paramecium bursaria Chlorella virus 1
taagtttcataagtttattttatt

SEQ ID NO: 73888 - DNA, 17 bp, Homo sapiens
taagtttcatagttcac

SEQ ID NO: 73889 - DNA, 26 bp, Homo sapiens
caagtttaagacaggtttattttatt

SEQ ID NO: 73890 - DNA, 18 bp, Homo sapiens
taagtcagtttattttat

SEQ ID NO: 73891 - DNA, 18 bp, Homo sapiens
gtttcattctattttatt

SEQ ID NO: 73892 - DNA, 25 bp, Homo sapiens
caagtttccctctatttattttatt

SEQ ID NO: 73893 - DNA, 93 bp, Camelpox virus
tctactggtgaaatgatgtgtcccaatattaatgcatttattgctagtaacgtaaacgcagatattatatggagcggacatcgacgccttaga

SEQ ID NO: 73894 - DNA, 24 bp, Camelpox virus
tattatatggagcggacatcgacg

SEQ ID NO: 73895 - DNA, 21 bp, Homo sapiens
tattacatggagtggggctcg

SEQ ID NO: 73896 - DNA, 19 bp, Homo sapiens
atataaaggtggatgtcga

SEQ ID NO: 73897 - DNA, 131 bp, Camelpox virus
attattactatagaagatgttagaaaaaatgatgctggttattacacatgtgtttatatatatatatatatataagtaaagcatataacgactaaccagaattgtaaaattataggtactgatagaataat

SEQ ID NO: 73898 - DNA, 24 bp, Camelpox virus
taagtaaagcatataacgactaac

SEQ ID NO: 73899 - DNA, 21 bp, Homo sapiens
taagtaaagatatgagtgact

SEQ ID NO: 73900 - DNA, 17 bp, Homo sapiens
aataaagcatataaaac

SEQ ID NO: 73901 - DNA, 20 bp, Homo sapiens
agtaaagccatatacattac

SEQ ID NO: 73902 - DNA, 100 bp, Cercopithecine herpesvirus 7
acaaagcatttccacaactgctgggtttacatgggaaacaaagcatttccacaactgctgggtttacatgggaaacaaagcatttccacaactgctgggt

SEQ ID NO: 73903 - DNA, 24 bp, Cercopithecine herpesvirus 7
tacatgggaaacaaagcatttcca

SEQ ID NO: 73904 - DNA, 21 bp, Homo sapiens
tacatggggacaaaatttcca

SEQ ID NO: 73905 - DNA, 22 bp, Homo sapiens
tacatgggagaagcagactcca

SEQ ID NO: 73906 - DNA, 18 bp, Homo sapiens
tgggaaacagaaggcact

SEQ ID NO: 73907 - DNA, 18 bp, Homo sapiens
acatgggaaacagacact

SEQ ID NO: 73908 - DNA, 23 bp, Homo sapiens
tacatggtgggataacatctcca

SEQ ID NO: 73909 - DNA, 16 bp, Homo sapiens
catgggaaggatttcc

SEQ ID NO: 73910 - DNA, 18 bp, Homo sapiens
tgatgggaaacaaaggca

SEQ ID NO: 73911 - DNA, 20 bp, Homo sapiens
catgagaaataaaccttcca

SEQ ID NO: 73912 - DNA, 22 bp, Homo sapiens
tacatgggggcacaaaattcca

SEQ ID NO: 73913 - DNA, 22 bp, Homo sapiens
catgggaaacatttagcttttc

SEQ ID NO: 73914 - DNA, 18 bp, Homo sapiens
tacatgagagccatttcc

SEQ ID NO: 73915 - DNA, 19 bp, Homo sapiens
tgggaaacaaagagatttc

SEQ ID NO: 73916 - DNA, 19 bp, Homo sapiens
tacatgggaaagaaaaaac

SEQ ID NO: 73917 - DNA, 20 bp, Homo sapiens
tacatgggagaccgctttcc

SEQ ID NO: 73918 - DNA, 19 bp, Homo sapiens
tacatgggtggcaagatct

SEQ ID NO: 73919 - DNA, 23 bp, Homo sapiens
cataggaaacttctgcatttcca

SEQ ID NO: 73920 - DNA, 19 bp, Homo sapiens
cacatgggaaataaggatt

SEQ ID NO: 73921 - DNA, 18 bp, Homo sapiens
tgggaaacaatacacccc

SEQ ID NO: 73922 - DNA, 21 bp, Homo sapiens
taatgggaaataaacaaattc

SEQ ID NO: 73923 - DNA, 20 bp, Homo sapiens
tacagatgggcaaagcattt

SEQ ID NO: 73924 - DNA, 24 bp, Homo sapiens
tacatgaggaacgagaagtccttc

SEQ ID NO: 73925 - DNA, 19 bp, Homo sapiens
tacatgggaagcaaaatcc

SEQ ID NO: 73926 - DNA, 23 bp, Homo sapiens
tacatgttcttaaagcatttcca

SEQ ID NO: 73927 - DNA, 21 bp, Homo sapiens
tacataggaaacaaaaaacct

SEQ ID NO: 73928 - DNA, 20 bp, Homo sapiens
atgggaaacaaaaatatcca

SEQ ID NO: 73929 - DNA, 20 bp, Homo sapiens
tacatgggaagaagagcatc

SEQ ID NO: 73930 - DNA, 21 bp, Homo sapiens
tacattggaaacaatcacttc

SEQ ID NO: 73931 - DNA, 15 bp, Homo sapiens
tacatggaagcatct

SEQ ID NO: 73932 - DNA, 19 bp, Homo sapiens
catgggaagcagcacacca

SEQ ID NO: 73933 - DNA, 21 bp, Homo sapiens
atgggaagcattctctttcca

SEQ ID NO: 73934 - DNA, 20 bp, Homo sapiens
tgagctcaagagcatttcca

SEQ ID NO: 73935 - DNA, 24 bp, Homo sapiens
caatgaaaaaataaagcattttca

SEQ ID NO: 73936 - DNA, 19 bp, Homo sapiens
caccagatgaagcatttcc

SEQ ID NO: 73937 - DNA, 19 bp, Homo sapiens
tacatgggtaaaagtttcc

SEQ ID NO: 73938 - DNA, 20 bp, Homo sapiens
atgggaagatcacatttcca

SEQ ID NO: 73939 - DNA, 20 bp, Homo sapiens
tgaggactgaagcatttcca

SEQ ID NO: 73940 - DNA, 19 bp, Homo sapiens
tacatgggaaatggaaaca

SEQ ID NO: 73941 - DNA, 21 bp, Homo sapiens
acatgggaaacagagggagca

SEQ ID NO: 73942 - DNA, 21 bp, Homo sapiens
tacatgggtacattatttcca

SEQ ID NO: 73943 - DNA, 23 bp, Homo sapiens
cacatgggaggcagagccgtttc

SEQ ID NO: 73944 - DNA, 19 bp, Homo sapiens
tacagggaaacaacaattt

SEQ ID NO: 73945 - DNA, 18 bp, Homo sapiens
atggaaaacatttacttc

SEQ ID NO: 73946 - DNA, 19 bp, Homo sapiens
gggaaacaaattattttca

SEQ ID NO: 73947 - DNA, 19 bp, Homo sapiens
cataggaaacaataatctc

SEQ ID NO: 73948 - DNA, 17 bp, Homo sapiens
tacatgggcaaacttcc

SEQ ID NO: 73949 - DNA, 21 bp, Homo sapiens
tacatggggaagtaaacacct

SEQ ID NO: 73950 - DNA, 19 bp, Homo sapiens
taatgggaaacaaaatatc

SEQ ID NO: 73951 - DNA, 19 bp, Homo sapiens
tgggaaacaatgccctcca

SEQ ID NO: 73952 - DNA, 19 bp, Homo sapiens
tacatggagaaatggagca

SEQ ID NO: 73953 - DNA, 19 bp, Homo sapiens
catgggagataaagatttc

SEQ ID NO: 73954 - DNA, 19 bp, Homo sapiens
catgggaaataattatttc

SEQ ID NO: 73955 - DNA, 20 bp, Homo sapiens
tacatggggaaaaaaacatt

SEQ ID NO: 73956 - DNA, 75 bp, Human papillomavirus type 89
actggcagaacgagcacagcaggcctttagggtggtaactacgtgtggtgtgtgctatcgtgcagttaggttagt

SEQ ID NO: 73957 - DNA, 24 bp, Human papillomavirus type 89
tggcagaacgagcacagcaggcct

SEQ ID NO: 73958 - DNA, 22 bp, Homo sapiens
gcatcgagggtacagcaggcct

SEQ ID NO: 73959 - DNA, 22 bp, Homo sapiens
tggagagcgtgagggcaggcct

SEQ ID NO: 73960 - DNA, 23 bp, Homo sapiens
tggcagaagggagttccaggtct

SEQ ID NO: 73961 - DNA, 21 bp, Homo sapiens
tggaggaaggacacagcaggc

SEQ ID NO: 73962 - DNA, 19 bp, Homo sapiens
tggggacgggtagcaggcc

SEQ ID NO: 73963 - DNA, 22 bp, Homo sapiens
ggcagaacgggcgccagcacct

SEQ ID NO: 73964 - DNA, 21 bp, Homo sapiens
tgtcagaaccacagcaggcct

SEQ ID NO: 73965 - DNA, 18 bp, Homo sapiens
ggcagggcgagcacaggc

SEQ ID NO: 73966 - DNA, 19 bp, Homo sapiens
tggcaggggagcacagggg

SEQ ID NO: 73967 - DNA, 19 bp, Homo sapiens
tgccagagtgacacaggcc

SEQ ID NO: 73968 - DNA, 21 bp, Homo sapiens
gctgatgtaagcacagcaggc

SEQ ID NO: 73969 - DNA, 22 bp, Homo sapiens
ggcaggatgagactgcaggcct

SEQ ID NO: 73970 - DNA, 20 bp, Homo sapiens
tggcaggacgggcagcaggc

SEQ ID NO: 73971 - DNA, 18 bp, Homo sapiens
tgggacgagcacaggggc

SEQ ID NO: 73972 - DNA, 23 bp, Homo sapiens
ggcaggtggctcacagcaggcct

SEQ ID NO: 73973 - DNA, 21 bp, Homo sapiens
tggcagaatgagctgcagagg

SEQ ID NO: 73974 - DNA, 17 bp, Homo sapiens
tgacagaacatggcagg

SEQ ID NO: 73975 - DNA, 21 bp, Homo sapiens
tgggacgaaagcacagcaggc

SEQ ID NO: 73976 - DNA, 20 bp, Homo sapiens
tggtgagtgagtacagcaag

SEQ ID NO: 73977 - DNA, 23 bp, Homo sapiens
tggggaatgaggtggacaggcct

SEQ ID NO: 73978 - DNA, 21 bp, Homo sapiens
gcagatgcaggcagcaggcct

SEQ ID NO: 73979 - DNA, 16 bp, Homo sapiens
tggcaggcaggcaggc

SEQ ID NO: 73980 - DNA, 17 bp, Homo sapiens
tagcagaatgagcgcct

SEQ ID NO: 73981 - DNA, 19 bp, Homo sapiens
tggcagggatgggcaagcc

SEQ ID NO: 73982 - DNA, 20 bp, Homo sapiens
gcagggagctggcagcaggc

SEQ ID NO: 73983 - DNA, 19 bp, Homo sapiens
gcagagtaaaagcaggcct

SEQ ID NO: 73984 - DNA, 20 bp, Homo sapiens
ggcaactgcacagcaggcct

SEQ ID NO: 73985 - DNA, 23 bp, Homo sapiens
gctggaacgagcatgcagtgcct

SEQ ID NO: 73986 - DNA, 23 bp, Homo sapiens
tggcagaatggataccagttcct

SEQ ID NO: 73987 - DNA, 23 bp, Homo sapiens
tgccagggccactcagcaggcct

SEQ ID NO: 73988 - DNA, 19 bp, Homo sapiens
tggcagagcaggcacagca

SEQ ID NO: 73989 - DNA, 17 bp, Homo sapiens
acaggagcacagcaggc

SEQ ID NO: 73990 - DNA, 24 bp, Homo sapiens
tggcagaaggggcaagcagggcct

SEQ ID NO: 73991 - DNA, 19 bp, Homo sapiens
tggcagggggctgcaggcc

SEQ ID NO: 73992 - DNA, 22 bp, Homo sapiens
tggggtgcgcacagcagcaggc

SEQ ID NO: 73993 - DNA, 20 bp, Homo sapiens
gcagaacgagcgagctgcct

SEQ ID NO: 73994 - DNA, 23 bp, Homo sapiens
tggagaatcagctcagcaggcct

SEQ ID NO: 73995 - DNA, 25 bp, Homo sapiens
tgacagaaaacagcacagtgggtct

SEQ ID NO: 73996 - DNA, 18 bp, Homo sapiens
tggcagaatgaggcatgg

SEQ ID NO: 73997 - DNA, 22 bp, Homo sapiens
tggccacaagcatggcaggcct

SEQ ID NO: 73998 - DNA, 95 bp, Human papillomavirus type 84
ccaacctgcaaaaccagcacagctggcctatagggtggtaacagagtgtgggttgtgtagccgtccagttaggctggcggtgctttgtggagtgg

SEQ ID NO: 73999 - DNA, 24 bp, Human papillomavirus type 84
accagcacagctggcctatagggt

SEQ ID NO: 74000 - DNA, 20 bp, Homo sapiens
ccatacagctgggcatgggt

SEQ ID NO: 74001 - DNA, 26 bp, Homo sapiens
accagtgcagctggtcacaccctatg

SEQ ID NO: 74002 - DNA, 19 bp, Homo sapiens
caggcatggctggccccgg

SEQ ID NO: 74003 - DNA, 17 bp, Homo sapiens
gcacactggcctgaggt

SEQ ID NO: 74004 - DNA, 23 bp, Homo sapiens
ccagtgcagctggtgcacagggt

SEQ ID NO: 74005 - DNA, 20 bp, Homo sapiens
ccagtctggctggccccaag

SEQ ID NO: 74006 - DNA, 18 bp, Homo sapiens
ccagcatggctcggcggg

SEQ ID NO: 74007 - DNA, 17 bp, Homo sapiens
actagcatactggccta

SEQ ID NO: 74008 - DNA, 23 bp, Homo sapiens
accagcacgcctgggcccggggt

SEQ ID NO: 74009 - DNA, 20 bp, Homo sapiens
accaggacagctggtcaccc

SEQ ID NO: 74010 - DNA, 24 bp, Homo sapiens
cagcacagtctggggtaccctatg

SEQ ID NO: 74011 - DNA, 23 bp, Homo sapiens
ccagctggctgggggcacggggt

SEQ ID NO: 74012 - DNA, 16 bp, Homo sapiens
cagcacagtagaaggg

SEQ ID NO: 74013 - DNA, 25 bp, Homo sapiens
accagccgtggctggccttgaaggt

SEQ ID NO: 74014 - DNA, 22 bp, Homo sapiens
caatacagctggctccatctgt

SEQ ID NO: 74015 - DNA, 25 bp, Homo sapiens
ccagcagagcgtggggtaccctatg

SEQ ID NO: 74016 - DNA, 24 bp, Homo sapiens
accagccaccagtccctgtggggt

SEQ ID NO: 74017 - DNA, 19 bp, Homo sapiens
acacagctggcaaatgggt

SEQ ID NO: 74018 - DNA, 22 bp, Homo sapiens
caggtacagctggctccagggt

SEQ ID NO: 74019 - DNA, 21 bp, Homo sapiens
cagcacagcaggagggagggt

SEQ ID NO: 74020 - DNA, 19 bp, Homo sapiens
agacgcaggcatatagggt

SEQ ID NO: 74021 - DNA, 19 bp, Homo sapiens
gctagcctgcctttatggg

SEQ ID NO: 74022 - DNA, 16 bp, Homo sapiens
cagcacagctgcaggg

SEQ ID NO: 74023 - DNA, 24 bp, Homo sapiens
ccagcacagctgctttaccctatg

SEQ ID NO: 74024 - DNA, 23 bp, Homo sapiens
ccggcccagctggggacaagggt

SEQ ID NO: 74025 - DNA, 20 bp, Homo sapiens
acacaactaccctatggggt

SEQ ID NO: 74026 - DNA, 17 bp, Homo sapiens
agcatagctggcctggc

SEQ ID NO: 74027 - DNA, 21 bp, Homo sapiens
ccggcgcagccggcattgggt

SEQ ID NO: 74028 - DNA, 15 bp, Homo sapiens
cagcacagcgcaggg

SEQ ID NO: 74029 - DNA, 17 bp, Homo sapiens
ccagacagctgggtggg

SEQ ID NO: 74030 - DNA, 62 bp, Human herpesvirus 5
ggcggtggcgatcaaaaggcgcgtatgagaaaccgtttatagagtgtaatagaatcaccgtc

SEQ ID NO: 74031 - DNA, 23 bp, Human herpesvirus 5
tagagtgtaatagaatcaccgtc

SEQ ID NO: 74032 - DNA, 18 bp, Homo sapiens
gagtgtaatggcacgatc

SEQ ID NO: 74033 - DNA, 21 bp, Homo sapiens
gagtgtaagcagcacgttgtc

SEQ ID NO: 74034 - DNA, 20 bp, Homo sapiens
taggggcaagaatcaccgtc

SEQ ID NO: 74035 - DNA, 16 bp, Homo sapiens
tgttagaatcactgtc

SEQ ID NO: 74036 - DNA, 20 bp, Homo sapiens
tagaggtaatagaggccgtc

SEQ ID NO: 74037 - DNA, 20 bp, Homo sapiens
cagagccaagagtcaccgtc

SEQ ID NO: 74038 - DNA, 18 bp, Homo sapiens
gagtgcaatggcactgtc

SEQ ID NO: 74039 - DNA, 20 bp, Homo sapiens
tagagtgcaatggtgccgtc

SEQ ID NO: 74040 - DNA, 22 bp, Homo sapiens
tagagtgtaagtatagcttgtc

SEQ ID NO: 74041 - DNA, 16 bp, Homo sapiens
gtgtgatgatcaccgt

SEQ ID NO: 74042 - DNA, 18 bp, Homo sapiens
cagagctggaatcactgt

SEQ ID NO: 74043 - DNA, 18 bp, Homo sapiens
gagtgcaatggagccatc

SEQ ID NO: 74044 - DNA, 18 bp, Homo sapiens
gagtgcaatggagcaatc

SEQ ID NO: 74045 - DNA, 69 bp, Broad bean mottle virus
accgtttgtactggcgttctttacgacattcgtgtccgaccggcgtttaggaggctcgcgttacaaggt

SEQ ID NO: 74046 - DNA, 22 bp, Broad bean mottle virus
taggaggctcgcgttacaaggt

SEQ ID NO: 74047 - DNA, 17 bp, Homo sapiens
taggaggctcagaaagg

SEQ ID NO: 74048 - DNA, 20 bp, Homo sapiens
caggaggttctgcacagggt

SEQ ID NO: 74049 - DNA, 21 bp, Homo sapiens
gaggctcgctccagtcaaggt

SEQ ID NO: 74050 - DNA, 20 bp, Homo sapiens
taggggtttttctacaaggt

SEQ ID NO: 74051 - DNA, 21 bp, Homo sapiens
taggaagctccggtgtgaggt

SEQ ID NO: 74052 - DNA, 22 bp, Homo sapiens
taggaggctgggggcatggggt

SEQ ID NO: 74053 - DNA, 17 bp, Homo sapiens
caggaggctttgcaagg

SEQ ID NO: 74054 - DNA, 18 bp, Homo sapiens
gggggctaccaacaaggt

SEQ ID NO: 74055 - DNA, 21 bp, Homo sapiens
ggaggctctgacttacggggt

SEQ ID NO: 74056 - DNA, 22 bp, Homo sapiens
ggaggccgcaggagaacagggt

SEQ ID NO: 74057 - DNA, 20 bp, Homo sapiens
aggaggcttagggtcagggt

SEQ ID NO: 74058 - DNA, 19 bp, Homo sapiens
taggaggccgatctgcagg

SEQ ID NO: 74059 - DNA, 19 bp, Homo sapiens
caggaggctgaggtaaggt

SEQ ID NO: 74060 - DNA, 22 bp, Homo sapiens
caggaggctgaacagacaaggt

SEQ ID NO: 74061 - DNA, 21 bp, Homo sapiens
caggaagccgtgttatggggt

SEQ ID NO: 74062 - DNA, 20 bp, Homo sapiens
aggaggctcgttccaaaggt

SEQ ID NO: 74063 - DNA, 19 bp, Homo sapiens
caggaggctcatttgaggt

SEQ ID NO: 74064 - DNA, 20 bp, Homo sapiens
taagaggctcgtgaagaagg

SEQ ID NO: 74065 - DNA, 19 bp, Homo sapiens
ggaggctcaggccggaggt

SEQ ID NO: 74066 - DNA, 20 bp, Homo sapiens
taggaggcctggtacggggt

SEQ ID NO: 74067 - DNA, 19 bp, Homo sapiens
caggaggttagtacaaggt

SEQ ID NO: 74068 - DNA, 21 bp, Homo sapiens
ggattgcaagcgttacaaggt

SEQ ID NO: 74069 - DNA, 61 bp, Bovine adenovirus B
ggtcgtcggaagttactgatggaacaacaagcgccgcccaacttcaaatttccagccgacc

SEQ ID NO: 74070 - DNA, 24 bp, Bovine adenovirus B
tcggaagttactgatggaacaaca

SEQ ID NO: 74071 - DNA, 20 bp, Homo sapiens
tctgaaatctgatggaacaa

SEQ ID NO: 74072 - DNA, 18 bp, Homo sapiens
tcgggggtttagaacaac

SEQ ID NO: 74073 - DNA, 18 bp, Homo sapiens
ggagactgtgatggaaca

SEQ ID NO: 74074 - DNA, 20 bp, Homo sapiens
gaagttactagaaaacgaca

SEQ ID NO: 74075 - DNA, 18 bp, Homo sapiens
ggaagctaatatggagca

SEQ ID NO: 74076 - DNA, 17 bp, Homo sapiens
ggaagatgttggaacaa

SEQ ID NO: 74077 - DNA, 18 bp, Homo sapiens
tctgaggttgctgatgga

SEQ ID NO: 74078 - DNA, 18 bp, Homo sapiens
tcggaaattattcacaac

SEQ ID NO: 74079 - DNA, 82 bp, Pepper mottle virus
tgatgtggtctctgggatgaaatattattatatgtagtatgcaatatatagtatggcttttctcgttccagtctttatatta

SEQ ID NO: 74080 - DNA, 24 bp, Pepper mottle virus
tagtatggcttttctcgttccagt

SEQ ID NO: 74081 - DNA, 23 bp, Homo sapiens
tagtatggcatatgagttctagt

SEQ ID NO: 74082 - DNA, 16 bp, Homo sapiens
tggtttacattccagt

SEQ ID NO: 74083 - DNA, 17 bp, Homo sapiens
gtatggttttgttccag

SEQ ID NO: 74084 - DNA, 21 bp, Homo sapiens
taggatagctcttgtttcagt

SEQ ID NO: 74085 - DNA, 17 bp, Homo sapiens
gtatggcttttctccag

SEQ ID NO: 74086 - DNA, 22 bp, Homo sapiens
gtgtggcttttcctcccacagt

SEQ ID NO: 74087 - DNA, 17 bp, Homo sapiens
gtatggcttctttccag

SEQ ID NO: 74088 - DNA, 65 bp, Pepper mottle virus
tctctcagaaaacgagagtgacttctagacacactctaggaggtgatcgtagttggcatgagaga

SEQ ID NO: 74089 - DNA, 24 bp, Pepper mottle virus
taggaggtgatcgtagttggcatg

SEQ ID NO: 74090 - DNA, 19 bp, Homo sapiens
ggagatgattaagagttgg

SEQ ID NO: 74091 - DNA, 19 bp, Homo sapiens
ggaggtgagggttggcatg

SEQ ID NO: 74092 - DNA, 92 bp, Fowlpox virus
ctgttctacggaattaacaactcgtgaatataaagatacaacattcagtataagaaaataagaagcacagttatatcattgcgtagcaacag

SEQ ID NO: 74093 - DNA, 24 bp, Fowlpox virus
taagaaaataagaagcacagttat

SEQ ID NO: 74094 - DNA, 20 bp, Homo sapiens
taagaaaataagaaagtgca

SEQ ID NO: 74095 - DNA, 18 bp, Homo sapiens
aagaaaataagccagtta

SEQ ID NO: 74096 - DNA, 20 bp, Homo sapiens
gaaaaaatgaaaacacagtt

SEQ ID NO: 74097 - DNA, 21 bp, Homo sapiens
aaaaaacaagggcatagttat

SEQ ID NO: 74098 - DNA, 16 bp, Homo sapiens
gaaaaaagaagcaagt

SEQ ID NO: 74099 - DNA, 23 bp, Homo sapiens
taagaaggaagaaggtaagttat

SEQ ID NO: 74100 - DNA, 19 bp, Homo sapiens
aagaaaagaaggcacagtt

SEQ ID NO: 74101 - DNA, 26 bp, Homo sapiens
taagaaacataattgtgcatagttat

SEQ ID NO: 74102 - DNA, 20 bp, Homo sapiens
taagacaataagaggcaagt

SEQ ID NO: 74103 - DNA, 17 bp, Homo sapiens
gaaaccaagcacagtta

SEQ ID NO: 74104 - DNA, 20 bp, Homo sapiens
gaaaatattaatacagttat

SEQ ID NO: 74105 - DNA, 17 bp, Homo sapiens
taagaaaatggaagcac

SEQ ID NO: 74106 - DNA, 22 bp, Homo sapiens
taaaaaaataatgtttacagtt

SEQ ID NO: 74107 - DNA, 131 bp, Rat cytomegalovirus
atatgggtggggcgggcgtgggagggacctagtctgtggggtcatgtatgggagggggctgacctacgagggtcagggtgagaggaagttgatatgcagatgtggtctgacacgtaggtagagtcctatat

SEQ ID NO: 74108 - DNA, 24 bp, Rat cytomegalovirus
tatgcagatgtggtctgacacgta

SEQ ID NO: 74109 - DNA, 19 bp, Homo sapiens
tatgtgtagcctgacacgt

SEQ ID NO: 74110 - DNA, 21 bp, Homo sapiens
gcaactatggtctgatgtgta

SEQ ID NO: 74111 - DNA, 19 bp, Homo sapiens
gcagggcgatctggcatgt

SEQ ID NO: 74112 - DNA, 22 bp, Homo sapiens
gcaggtgtggtctgggctgcgt

SEQ ID NO: 74113 - DNA, 19 bp, Homo sapiens
gatgtggcctttggcacgt

SEQ ID NO: 74114 - DNA, 23 bp, Homo sapiens
atgcggtccaggtctggcacgta

SEQ ID NO: 74115 - DNA, 86 bp, Lymphocystis disease virus 1
tgttaatcatcaatccgttacggaaacaaattatcatttttataaaaatggtttgtggtttctgtttagggttacctttattaaca

SEQ ID NO: 74116 - DNA, 24 bp, Lymphocystis disease virus 1
tacggaaacaaattatcattttta

SEQ ID NO: 74117 - DNA, 19 bp, Homo sapiens
ggaaataaacatcattttt

SEQ ID NO: 74118 - DNA, 19 bp, Homo sapiens
ggaaacaaattgaaacttt

SEQ ID NO: 74119 - DNA, 21 bp, Homo sapiens
gaaacaaacttttcattttta

SEQ ID NO: 74120 - DNA, 16 bp, Homo sapiens
ggaaacaaatattttt

SEQ ID NO: 74121 - DNA, 19 bp, Homo sapiens
agagacaaatttcattttt

SEQ ID NO: 74122 - DNA, 23 bp, Homo sapiens
tacagaaactactattgttttta

SEQ ID NO: 74123 - DNA, 22 bp, Homo sapiens
tacaagtaaattatcattttta

SEQ ID NO: 74124 - DNA, 122 bp, Mouse parvovirus 1
atcatttttagaactgaccaaccatgttcacgtaagtgacgtgatgacgcgcgcttcgcgcgctgcctgcggcagtcacacgtcacttacgtctcacatggttggtcagttctaaaaatgat

SEQ ID NO: 74125 - DNA, 24 bp, Mouse parvovirus 1
tcacatggttggtcagttctaaaa

SEQ ID NO: 74126 - DNA, 18 bp, Homo sapiens
tcgctggttgacaaatct

SEQ ID NO: 74127 - DNA, 19 bp, Homo sapiens
tcccataattggttctaaa

SEQ ID NO: 74128 - DNA, 19 bp, Homo sapiens
tcaatgcttcagttctaaa

SEQ ID NO: 74129 - DNA, 15 bp, Homo sapiens
ccacatgccagttct

SEQ ID NO: 74130 - DNA, 16 bp, Homo sapiens
tcacatggtttgttct

SEQ ID NO: 74131 - DNA, 18 bp, Homo sapiens
tcatatggttggtgacag

SEQ ID NO: 74132 - DNA, 19 bp, Homo sapiens
tggatggtacacagttcta

SEQ ID NO: 74133 - DNA, 22 bp, Homo sapiens
caggctactgtcagttttaaaa

SEQ ID NO: 74134 - DNA, 18 bp, Homo sapiens
atggctgaagttctaaaa

SEQ ID NO: 74135 - DNA, 19 bp, Homo sapiens
ccatatggttggaggccta

SEQ ID NO: 74136 - DNA, 15 bp, Homo sapiens
tccatggtgttctaa

SEQ ID NO: 74137 - DNA, 21 bp, Homo sapiens
accagtctggtcagttctaaa

SEQ ID NO: 74138 - DNA, 22 bp, Homo sapiens
cagtggttgctacattctaaaa

SEQ ID NO: 74139 - DNA, 17 bp, Homo sapiens
tcacacggttggcaatt

SEQ ID NO: 74140 - DNA, 21 bp, Homo sapiens
tcacactgtaaacagttctaa

SEQ ID NO: 74141 - DNA, 18 bp, Homo sapiens
cacgggtatagttctaaa

SEQ ID NO: 74142 - DNA, 18 bp, Homo sapiens
acagtggacgccagttct

SEQ ID NO: 74143 - DNA, 20 bp, Homo sapiens
tcacaggctcgggttctaaa

SEQ ID NO: 74144 - DNA, 17 bp, Homo sapiens
tcacagtcagttttaaa

SEQ ID NO: 74145 - DNA, 19 bp, Homo sapiens
tccatggttggtcagactc

SEQ ID NO: 74146 - DNA, 19 bp, Homo sapiens
tcacatggcttggaatcct

SEQ ID NO: 74147 - DNA, 18 bp, Homo sapiens
cgtctgggaagttctaaa

SEQ ID NO: 74148 - DNA, 17 bp, Homo sapiens
cacttcggttggttcta

SEQ ID NO: 74149 - DNA, 15 bp, Homo sapiens
tcacagcagttctaa

SEQ ID NO: 74150 - DNA, 15 bp, Homo sapiens
ccacaggtcagttct

SEQ ID NO: 74151 - DNA, 24 bp, Homo sapiens
acatagttgttgagtgttctaaaa

SEQ ID NO: 74152 - DNA, 18 bp, Homo sapiens
tggatgttagttctaaaa

SEQ ID NO: 74153 - DNA, 105 bp, Human herpesvirus 6B
tagctgctaaatgtgatacggaagttgaaaaaaaactgccgcttaaatcaaaaaaatgatagacgacgcagatttacgacacgctcgtattttattttgtggcta

SEQ ID NO: 74154 - DNA, 24 bp, Human herpesvirus 6B
tacgacacgctcgtattttatttt

SEQ ID NO: 74155 - DNA, 23 bp, Homo sapiens
caacacgtttcctcatttatttt

SEQ ID NO: 74156 - DNA, 23 bp, Homo sapiens
cacgacacgttttacagtatttt

SEQ ID NO: 74157 - DNA, 19 bp, Homo sapiens
acgctggctattttatttt

SEQ ID NO: 74158 - DNA, 22 bp, Homo sapiens
cacactttttgtattttatttt

SEQ ID NO: 74159 - DNA, 21 bp, Homo sapiens
tactgcatgctcggtcatttt

SEQ ID NO: 74160 - DNA, 67 bp, Human herpesvirus 8
ctcagacaaggtattttttagcatcctatcgcacagacacgagctaggagtggactttctccgtgag

SEQ ID NO: 74161 - DNA, 24 bp, Human herpesvirus 8
tattttttagcatcctatcgcaca

SEQ ID NO: 74162 - DNA, 21 bp, Homo sapiens
tatttttcagtatcccctgca

SEQ ID NO: 74163 - DNA, 21 bp, Homo sapiens
ttttttagcatccagaataca

SEQ ID NO: 74164 - DNA, 16 bp, Homo sapiens
ttttttggcaccgcac

SEQ ID NO: 74165 - DNA, 21 bp, Homo sapiens
ttttttagcattttgtacaca

SEQ ID NO: 74166 - DNA, 20 bp, Homo sapiens
tatttattagcatcaacgac

SEQ ID NO: 74167 - DNA, 22 bp, Homo sapiens
ttttttttttttttatcgcaca

SEQ ID NO: 74168 - DNA, 19 bp, Homo sapiens
tattttttagtattcccac

SEQ ID NO: 74169 - DNA, 16 bp, Homo sapiens
ttctttagcattcaca

SEQ ID NO: 74170 - DNA, 92 bp, Murid herpesvirus 4
gcaccctgaagatggtttgaatgctctgcagtatgtcaagaatttggaacttgctcttcggcgtctgcagtcagacagtctcaaacatgggc

SEQ ID NO: 74171 - DNA, 24 bp, Murid herpesvirus 4
tctgcagtcagacagtctcaaaca

SEQ ID NO: 74172 - DNA, 20 bp, Homo sapiens
tgctcagcactgctcaaaca

SEQ ID NO: 74173 - DNA, 19 bp, Homo sapiens
tctgcagtcagcactgagc

SEQ ID NO: 74174 - DNA, 19 bp, Homo sapiens
tctgcagttggatcagtct

SEQ ID NO: 74175 - DNA, 22 bp, Homo sapiens
tctacagtagttggtttcaaac

SEQ ID NO: 74176 - DNA, 15 bp, Homo sapiens
tctgcagcaggcctc

SEQ ID NO: 74177 - DNA, 19 bp, Homo sapiens
tctgcattttagtctcaaa

SEQ ID NO: 74178 - DNA, 21 bp, Homo sapiens
tcagcagtcaatacatttcaa

SEQ ID NO: 74179 - DNA, 16 bp, Homo sapiens
acaggacagtctcaaa

SEQ ID NO: 74180 - DNA, 19 bp, Homo sapiens
tctgaggtccttctcaaac

SEQ ID NO: 74181 - DNA, 17 bp, Homo sapiens
tgagtcagacctgaaac

SEQ ID NO: 74182 - DNA, 19 bp, Homo sapiens
tgcagtcagagcacagaca

SEQ ID NO: 74183 - DNA, 15 bp, Homo sapiens
tctacagtgtctcaa

SEQ ID NO: 74184 - DNA, 22 bp, Homo sapiens
tctgcagtgtacactttctcaa

SEQ ID NO: 74185 - DNA, 16 bp, Homo sapiens
tctggacagtctcaaa

SEQ ID NO: 74186 - DNA, 18 bp, Homo sapiens
tctgcagcagatagtact

SEQ ID NO: 74187 - DNA, 19 bp, Homo sapiens
tctgcaatcagatgacaat

SEQ ID NO: 74188 - DNA, 26 bp, Homo sapiens
tctgcagtcagagggagaagaaaaca

SEQ ID NO: 74189 - DNA, 19 bp, Homo sapiens
tctcaaactccagtctcaa

SEQ ID NO: 74190 - DNA, 18 bp, Homo sapiens
tctcatcatcagtctcaa

SEQ ID NO: 74191 - DNA, 22 bp, Homo sapiens
tctgcagtgtgggcagcaccaa

SEQ ID NO: 74192 - DNA, 18 bp, Homo sapiens
tctgcattggacagtccc

SEQ ID NO: 74193 - DNA, 21 bp, Homo sapiens
ctgcagtcatcggctcggaca

SEQ ID NO: 74194 - DNA, 18 bp, Homo sapiens
tctgcagtagacacccca

SEQ ID NO: 74195 - DNA, 19 bp, Homo sapiens
gccataacagtcttgaaca

SEQ ID NO: 74196 - DNA, 21 bp, Homo sapiens
cctgcagcccagtctcaaaca

SEQ ID NO: 74197 - DNA, 20 bp, Homo sapiens
tctgcagtcagcagaagaca

SEQ ID NO: 74198 - DNA, 17 bp, Homo sapiens
tctgcagtggacagtct

SEQ ID NO: 74199 - DNA, 17 bp, Homo sapiens
tctgcagtcggaagtct

SEQ ID NO: 74200 - DNA, 19 bp, Homo sapiens
tctggagtcagacagaact

SEQ ID NO: 74201 - DNA, 23 bp, Homo sapiens
tctgcagtttgagatagattcaa

SEQ ID NO: 74202 - DNA, 22 bp, Homo sapiens
tctgcagctcagaaggtaaaca

SEQ ID NO: 74203 - DNA, 16 bp, Homo sapiens
cagtcccaatctcaaa

SEQ ID NO: 74204 - DNA, 18 bp, Homo sapiens
tctacagtcaatttcaaa

SEQ ID NO: 74205 - DNA, 88 bp, Murid herpesvirus 4
gaagcaggtctacttgagccagttgattggagtctctgctgaaacaaaagaggaatttcagcaactggtagatctatttatatgcttc

SEQ ID NO: 74206 - DNA, 24 bp, Murid herpesvirus 4
aggaatttcagcaactggtagatc

SEQ ID NO: 74207 - DNA, 21 bp, Homo sapiens
gaattttggcaaaccgagatc

SEQ ID NO: 74208 - DNA, 19 bp, Homo sapiens
aggaatttctgcaacaagt

SEQ ID NO: 74209 - DNA, 21 bp, Homo sapiens
agcaatttcagcgaaggggat

SEQ ID NO: 74210 - DNA, 19 bp, Homo sapiens
aggagtctcagcaggctgg

SEQ ID NO: 74211 - DNA, 22 bp, Homo sapiens
aggaatttctgtgactacaact

SEQ ID NO: 74212 - DNA, 19 bp, Homo sapiens
aggaatttagtgcaactgg

SEQ ID NO: 74213 - DNA, 16 bp, Homo sapiens
agaatcaattggtaga

SEQ ID NO: 74214 - DNA, 17 bp, Homo sapiens
aggagcttcagcaaggt

SEQ ID NO: 74215 - DNA, 24 bp, Homo sapiens
aggattttcagcagtaatgcggat

SEQ ID NO: 74216 - DNA, 22 bp, Homo sapiens
agggatttcagcatcaccaggt

SEQ ID NO: 74217 - DNA, 19 bp, Homo sapiens
aggagtttcaacaatgggt

SEQ ID NO: 74218 - DNA, 19 bp, Homo sapiens
aggatttcacagggtagat

SEQ ID NO: 74219 - DNA, 20 bp, Homo sapiens
agagtttcagcagctaccaa

SEQ ID NO: 74220 - DNA, 18 bp, Homo sapiens
ggaatcttagcgacgagt

SEQ ID NO: 74221 - DNA, 19 bp, Homo sapiens
aggaacttcagtgactagt

SEQ ID NO: 74222 - DNA, 19 bp, Homo sapiens
ggaatgttcagcagatggt

SEQ ID NO: 74223 - DNA, 20 bp, Homo sapiens
agggtttcagtaactgacaa

SEQ ID NO: 74224 - DNA, 21 bp, Homo sapiens
aggaatttcaccaagcttggt

SEQ ID NO: 74225 - DNA, 22 bp, Homo sapiens
aggaattttagaaccacaaggt

SEQ ID NO: 74226 - DNA, 18 bp, Homo sapiens
agggatttcagcgtcagt

SEQ ID NO: 74227 - DNA, 18 bp, Homo sapiens
aggaatttcacatcaggt

SEQ ID NO: 74228 - DNA, 24 bp, Homo sapiens
aggaattttaggtaatcacctggt

SEQ ID NO: 74229 - DNA, 20 bp, Homo sapiens
agagatttcagcaatccaat

SEQ ID NO: 74230 - DNA, 18 bp, Homo sapiens
aggaattcagcaagtgat

SEQ ID NO: 74231 - DNA, 19 bp, Homo sapiens
aggaatttggcagctgtag

SEQ ID NO: 74232 - DNA, 24 bp, Homo sapiens
aggaattttggagattggtatatc

SEQ ID NO: 74233 - DNA, 17 bp, Homo sapiens
aggaattttacaacagc

SEQ ID NO: 74234 - DNA, 19 bp, Homo sapiens
aggaattttgacaggagat

SEQ ID NO: 74235 - DNA, 22 bp, Homo sapiens
aggaatttcaacatctctaggt

SEQ ID NO: 74236 - DNA, 17 bp, Homo sapiens
aggaattttacagctgg

SEQ ID NO: 74237 - DNA, 18 bp, Homo sapiens
ggattttcagcagctggc

SEQ ID NO: 74238 - DNA, 118 bp, Parvovirus H1
catttttagaactgaccaaccatgttcacgcaagtgacgtgatgacgcgcgctgcgcgcgctgccttcggcagtcacacgtcactagcgtttcacatggttggtcagttctaaaaatg

SEQ ID NO: 74239 - DNA, 24 bp, Parvovirus H1
gaactgaccaaccatgttcacgca

SEQ ID NO: 74240 - DNA, 20 bp, Homo sapiens
gagctgtcaaccatgagcca

SEQ ID NO: 74241 - DNA, 19 bp, Homo sapiens
actgaccagcattcacgca

SEQ ID NO: 74242 - DNA, 18 bp, Homo sapiens
gaactgacctacccatgt

SEQ ID NO: 74243 - DNA, 19 bp, Homo sapiens
gaactaaccaagtttgtgc

SEQ ID NO: 74244 - DNA, 21 bp, Homo sapiens
gaactgactggctgatcagca

SEQ ID NO: 74245 - DNA, 23 bp, Homo sapiens
aactgatcaaccataagcatgca

SEQ ID NO: 74246 - DNA, 18 bp, Homo sapiens
gagctgaccaagcacacg

SEQ ID NO: 74247 - DNA, 20 bp, Homo sapiens
gactgaccaatcacaacacg

SEQ ID NO: 74248 - DNA, 17 bp, Homo sapiens
gagctggccaccatgcc

SEQ ID NO: 74249 - DNA, 19 bp, Homo sapiens
gaactgacaattgacacac

SEQ ID NO: 74250 - DNA, 20 bp, Homo sapiens
gaactgacggccatccccgc

SEQ ID NO: 74251 - DNA, 18 bp, Homo sapiens
gaactaactaacatatgc

SEQ ID NO: 74252 - DNA, 21 bp, Homo sapiens
gaactgacaactgacgagtgc

SEQ ID NO: 74253 - DNA, 18 bp, Homo sapiens
ctgaccacaccatcagca

SEQ ID NO: 74254 - DNA, 20 bp, Homo sapiens
gaactgccatcatgttcacg

SEQ ID NO: 74255 - DNA, 23 bp, Homo sapiens
gaactgactgcttgcttggcacg

SEQ ID NO: 74256 - DNA, 66 bp, Parvovirus H1
tggtcggttactcactctgctttcatttctgagtttgtgagacacaggagcgagactaaccaacta

SEQ ID NO: 74257 - DNA, 22 bp, Parvovirus H1
caggagcgagactaaccaacta

SEQ ID NO: 74258 - DNA, 21 bp, Homo sapiens
ggagcgaggtctaggcagcta

SEQ ID NO: 74259 - DNA, 22 bp, Homo sapiens
caggagcatcagtaactgacta

SEQ ID NO: 74260 - DNA, 21 bp, Homo sapiens
ggagcgaggcctccagaacta

SEQ ID NO: 74261 - DNA, 22 bp, Homo sapiens
agagcaagacgctggccaacta

SEQ ID NO: 74262 - DNA, 19 bp, Homo sapiens
cagtagcagataaccaact

SEQ ID NO: 74263 - DNA, 15 bp, Homo sapiens
gggcaagcccaacta

SEQ ID NO: 74264 - DNA, 19 bp, Homo sapiens
caggagcgaaacaccagct

SEQ ID NO: 74265 - DNA, 23 bp, Homo sapiens
caggagcgacagagaccccagct

SEQ ID NO: 74266 - DNA, 17 bp, Homo sapiens
ggtacaaaaaccaacta

SEQ ID NO: 74267 - DNA, 22 bp, Homo sapiens
caggaggcctgcctgaccaact

SEQ ID NO: 74268 - DNA, 21 bp, Homo sapiens
aagaacaaggttaactaacta

SEQ ID NO: 74269 - DNA, 18 bp, Homo sapiens
cagaagcgcaggctagcc

SEQ ID NO: 74270 - DNA, 20 bp, Homo sapiens
aagagtggagctaaccagct

SEQ ID NO: 74271 - DNA, 21 bp, Homo sapiens
ggaattaagactgaccaacta

SEQ ID NO: 74272 - DNA, 20 bp, Homo sapiens
caggagcatatgaaattaac

SEQ ID NO: 74273 - DNA, 18 bp, Homo sapiens
caggacgagacttcaact

SEQ ID NO: 74274 - DNA, 21 bp, Homo sapiens
caggcctaagactaaccagct

SEQ ID NO: 74275 - DNA, 22 bp, Homo sapiens
aggaattatggctagccaacta

SEQ ID NO: 74276 - DNA, 20 bp, Homo sapiens
cagggtccccaaaccaacta

SEQ ID NO: 74277 - DNA, 17 bp, Homo sapiens
caggagcagataaaact

SEQ ID NO: 74278 - DNA, 22 bp, Homo sapiens
caagtacagagactgattaact

SEQ ID NO: 74279 - DNA, 22 bp, Homo sapiens
aggagcgagaaaaccctaacta

SEQ ID NO: 74280 - DNA, 17 bp, Homo sapiens
agagcgagactccatct

SEQ ID NO: 74281 - DNA, 23 bp, Homo sapiens
caggagcagagcgtaaaccagct

SEQ ID NO: 74282 - DNA, 20 bp, Homo sapiens
caggagcgggctatatacta

SEQ ID NO: 74283 - DNA, 23 bp, Homo sapiens
caggggcgagactatttcagact

SEQ ID NO: 74284 - DNA, 18 bp, Homo sapiens
agagcgagactccgtcta

SEQ ID NO: 74285 - DNA, 20 bp, Homo sapiens
ggagcgggtcccaaccaact

SEQ ID NO: 74286 - DNA, 100 bp, Paramecium bursaria Chlorella virus 1
cctaatttcgtcgtccactgaccacttggttttaaatccggtcttactttttgtaacattgcttttccccagtcgtcttctccttttttaagaaatttgg

SEQ ID NO: 74287 - DNA, 24 bp, Paramecium bursaria Chlorella virus 1
tccccagtcgtcttctcctttttt

SEQ ID NO: 74288 - DNA, 18 bp, Homo sapiens
gtccctctctcctttttt

SEQ ID NO: 74289 - DNA, 23 bp, Homo sapiens
tctccttcttcttcttctttttt

SEQ ID NO: 74290 - DNA, 17 bp, Homo sapiens
gtgtcctctcctcttct

SEQ ID NO: 74291 - DNA, 22 bp, Homo sapiens
tccctcttttttttcctttttt

SEQ ID NO: 74292 - DNA, 17 bp, Homo sapiens
gtgtcctctcttttttt

SEQ ID NO: 74293 - DNA, 24 bp, Homo sapiens
ccagtcttcctcttttcctttttt

SEQ ID NO: 74294 - DNA, 20 bp, Homo sapiens
tccctcggccgccctttttt

SEQ ID NO: 74295 - DNA, 20 bp, Homo sapiens
tccccagttgtctttccttt

SEQ ID NO: 74296 - DNA, 19 bp, Homo sapiens
tcctctttctctctttttt

SEQ ID NO: 74297 - DNA, 18 bp, Homo sapiens
gtcatcttcttctctttt

SEQ ID NO: 74298 - DNA, 24 bp, Homo sapiens
tctcctgtattactctcctttttt

SEQ ID NO: 74299 - DNA, 20 bp, Homo sapiens
tccccgccctctcttttttt

SEQ ID NO: 74300 - DNA, 22 bp, Homo sapiens
tccccagcgtcttcttgttttt

SEQ ID NO: 74301 - DNA, 18 bp, Homo sapiens
ccagtattctccttctct

SEQ ID NO: 74302 - DNA, 16 bp, Homo sapiens
ccccgactcccttttt

SEQ ID NO: 74303 - DNA, 17 bp, Homo sapiens
tcccccccccctttttt

SEQ ID NO: 74304 - DNA, 18 bp, Homo sapiens
gttgtttttctccttttt

SEQ ID NO: 74305 - DNA, 25 bp, Homo sapiens
tcctttctaattcttctcttttttt

SEQ ID NO: 74306 - DNA, 18 bp, Homo sapiens
tccctgctcccctttttt

SEQ ID NO: 74307 - DNA, 23 bp, Homo sapiens
tccccaagtcgtttttctttttt

SEQ ID NO: 74308 - DNA, 22 bp, Homo sapiens
cccagagggcttctcctttttt

SEQ ID NO: 74309 - DNA, 23 bp, Homo sapiens
cccccaacctctttttttttttt

SEQ ID NO: 74310 - DNA, 19 bp, Homo sapiens
tccacagagttcctttttc

SEQ ID NO: 74311 - DNA, 18 bp, Homo sapiens
tcgttttttctccttttt

SEQ ID NO: 74312 - DNA, 24 bp, Homo sapiens
cccctaccctctttctcctttttt

SEQ ID NO: 74313 - DNA, 19 bp, Homo sapiens
tcctggtgttttctcccct

SEQ ID NO: 74314 - DNA, 15 bp, Homo sapiens
ccaatcatccttttt

SEQ ID NO: 74315 - DNA, 19 bp, Homo sapiens
ccagtctgaatcctttttt

SEQ ID NO: 74316 - DNA, 22 bp, Homo sapiens
gtctttccttttctcctttttt

SEQ ID NO: 74317 - DNA, 23 bp, Homo sapiens
ccaggggatccttcttttttttt

SEQ ID NO: 74318 - DNA, 21 bp, Homo sapiens
ccttcctgcttttcctttttt

SEQ ID NO: 74319 - DNA, 19 bp, Homo sapiens
tcctggtgtcttcttcctt

SEQ ID NO: 74320 - DNA, 23 bp, Homo sapiens
ccccctcaacttttttctttttt

SEQ ID NO: 74321 - DNA, 17 bp, Homo sapiens
ccagcttttcctttttt

SEQ ID NO: 74322 - DNA, 19 bp, Homo sapiens
tccccagccgtttttagcc

SEQ ID NO: 74323 - DNA, 21 bp, Homo sapiens
tccctgttccccccctttttt

SEQ ID NO: 74324 - DNA, 22 bp, Homo sapiens
gtcttccttcttttcctttttt

SEQ ID NO: 74325 - DNA, 15 bp, Homo sapiens
cccagctcctttttt

SEQ ID NO: 74326 - DNA, 20 bp, Homo sapiens
tcctaagtctttcctttttt

SEQ ID NO: 74327 - DNA, 21 bp, Homo sapiens
cctacttccttcttctttttt

SEQ ID NO: 74328 - DNA, 17 bp, Homo sapiens
gtctctccacctttttt

SEQ ID NO: 74329 - DNA, 19 bp, Homo sapiens
ccagtctcttctcctcttt

SEQ ID NO: 74330 - DNA, 60 bp, Paramecium bursaria Chlorella virus 1
tttggtagcttctacttttggcttgaaagacttacctttccaaaacattgtgcctccaaa

SEQ ID NO: 74331 - DNA, 24 bp, Paramecium bursaria Chlorella virus 1
tagcttctacttttggcttgaaag

SEQ ID NO: 74332 - DNA, 18 bp, Homo sapiens
gcttcggctttggcttga

SEQ ID NO: 74333 - DNA, 20 bp, Homo sapiens
tagcttctattttttttaaa

SEQ ID NO: 74334 - DNA, 21 bp, Homo sapiens
cagtttctattcctgacttga

SEQ ID NO: 74335 - DNA, 18 bp, Homo sapiens
tacttttgtaccttgaaa

SEQ ID NO: 74336 - DNA, 20 bp, Homo sapiens
gcttctacttgtttccagaa

SEQ ID NO: 74337 - DNA, 22 bp, Homo sapiens
tagctgtaatttggcttgaaag

SEQ ID NO: 74338 - DNA, 23 bp, Homo sapiens
acttctatttttattaaagaaag

SEQ ID NO: 74339 - DNA, 19 bp, Homo sapiens
gcttctcttttgtcccaga

SEQ ID NO: 74340 - DNA, 19 bp, Homo sapiens
agcttttgcttttggcttg

SEQ ID NO: 74341 - DNA, 21 bp, Homo sapiens
gcttctacttttgctactgaa

SEQ ID NO: 74342 - DNA, 19 bp, Homo sapiens
gcttttacttttgaacctg

SEQ ID NO: 74343 - DNA, 21 bp, Homo sapiens
acttctgcttttccttggaag

SEQ ID NO: 74344 - DNA, 17 bp, Homo sapiens
cttctcctttggcttga

SEQ ID NO: 74345 - DNA, 20 bp, Homo sapiens
tagtttttacttttggtgaa

SEQ ID NO: 74346 - DNA, 18 bp, Homo sapiens
taacttttgggcttgaaa

SEQ ID NO: 74347 - DNA, 20 bp, Homo sapiens
cttctactttctcacagaga

SEQ ID NO: 74348 - DNA, 18 bp, Homo sapiens
tagttcctactttggatg

SEQ ID NO: 74349 - DNA, 69 bp, Rous sarcoma virus
cgaggggactataacatgtataggcgaaaagcggggtctcggttgtaacgcgcttaggaagtcccctcg

SEQ ID NO: 74350 - DNA, 24 bp, Rous sarcoma virus
aacatgtataggcgaaaagcgggg

SEQ ID NO: 74351 - DNA, 18 bp, Homo sapiens
gtagagactgaagcgggg

SEQ ID NO: 74352 - DNA, 25 bp, Homo sapiens
aacatgtttgggggacggagcgggg

SEQ ID NO: 74353 - DNA, 22 bp, Homo sapiens
gcagtgggagtggaaagcgggg

SEQ ID NO: 74354 - DNA, 18 bp, Homo sapiens
aacacgtaagggagtggg

SEQ ID NO: 74355 - DNA, 17 bp, Homo sapiens
catgcacagggagtggg

SEQ ID NO: 74356 - DNA, 22 bp, Homo sapiens
aacagtgtaactcaaagcgggg

SEQ ID NO: 74357 - DNA, 20 bp, Homo sapiens
atgtataggtgaggtcgtgg

SEQ ID NO: 74358 - DNA, 22 bp, Homo sapiens
atgtgtagagttgtaagcgggg

SEQ ID NO: 74359 - DNA, 17 bp, Homo sapiens
tgtacggagaagcgggg

SEQ ID NO: 74360 - DNA, 77 bp, Tupaia herpesvirus
gggtgtgtgtgtgggggtggtgggcggccgcgggcgcggagggtccggcccgtccccgactcctctgtactagactc

SEQ ID NO: 74361 - DNA, 24 bp, Tupaia herpesvirus
tccccgactcctctgtactagact

SEQ ID NO: 74362 - DNA, 25 bp, Homo sapiens
tccccgcactcttctgcgcccgact

SEQ ID NO: 74363 - DNA, 21 bp, Homo sapiens
tccccgactcctcctgttacc

SEQ ID NO: 74364 - DNA, 16 bp, Homo sapiens
cccccgctcctttgac

SEQ ID NO: 74365 - DNA, 25 bp, Homo sapiens
tccctggccccagctaaactaggct

SEQ ID NO: 74366 - DNA, 21 bp, Homo sapiens
ccccgactcctcaggaggact

SEQ ID NO: 74367 - DNA, 15 bp, Homo sapiens
gactcctctctgacc

SEQ ID NO: 74368 - DNA, 19 bp, Homo sapiens
cccactcccctgctggact

SEQ ID NO: 74369 - DNA, 19 bp, Homo sapiens
tcccagactcctctgagct

SEQ ID NO: 74370 - DNA, 17 bp, Homo sapiens
cccccatttctactagc

SEQ ID NO: 74371 - DNA, 22 bp, Homo sapiens
cccatttttcagtgactagact

SEQ ID NO: 74372 - DNA, 22 bp, Homo sapiens
ccctgttctacctaactagact

SEQ ID NO: 74373 - DNA, 18 bp, Homo sapiens
tctccgactccttcacac

SEQ ID NO: 74374 - DNA, 15 bp, Homo sapiens
caactccttgtaaga

SEQ ID NO: 74375 - DNA, 24 bp, Homo sapiens
tccccgatcctctgtatgcaggct

SEQ ID NO: 74376 - DNA, 18 bp, Homo sapiens
tccccgactccttgcact

SEQ ID NO: 74377 - DNA, 21 bp, Homo sapiens
cctccgactccccactggact

SEQ ID NO: 74378 - DNA, 21 bp, Homo sapiens
cccctggcttcccactggact

SEQ ID NO: 74379 - DNA, 18 bp, Homo sapiens
tccccgactccctgttcc

SEQ ID NO: 74380 - DNA, 21 bp, Homo sapiens
tctccggccccccgctagact

SEQ ID NO: 74381 - DNA, 23 bp, Homo sapiens
ccccgactaatctgtgctggact

SEQ ID NO: 74382 - DNA, 18 bp, Homo sapiens
tccccgactctctgggct

SEQ ID NO: 74383 - DNA, 20 bp, Homo sapiens
ccccggctcctctgtccgga

SEQ ID NO: 74384 - DNA, 17 bp, Homo sapiens
gactcctccactggact

SEQ ID NO: 74385 - DNA, 61 bp, Tupaia herpesvirus
cgtccggatcgggcgaacggtctcggcctctcgggcgagagagcgagcgagcgagcgggcg

SEQ ID NO: 74386 - DNA, 24 bp, Tupaia herpesvirus
cgagagagcgagcgagcgagcggg

SEQ ID NO: 74387 - DNA, 19 bp, Homo sapiens
gagagcgatggcagctggg

SEQ ID NO: 74388 - DNA, 16 bp, Homo sapiens
gagcagcgagcgccgg

SEQ ID NO: 74389 - DNA, 24 bp, Homo sapiens
cgacgggggcgacgggcgagcggg

SEQ ID NO: 74390 - DNA, 20 bp, Homo sapiens
aagagcgagtggagaccggg

SEQ ID NO: 74391 - DNA, 19 bp, Homo sapiens
gagcgagcgagtgagcgag

SEQ ID NO: 74392 - DNA, 21 bp, Homo sapiens
gagcgggcgggtgcgcccggg

SEQ ID NO: 74393 - DNA, 22 bp, Homo sapiens
gagagagcgagcgagctcctgg

SEQ ID NO: 74394 - DNA, 23 bp, Homo sapiens
cgagaggcgcgagcggccgcggg

SEQ ID NO: 74395 - DNA, 24 bp, Homo sapiens
gagggagtgagcgtgccaccaagg

SEQ ID NO: 74396 - DNA, 23 bp, Homo sapiens
cgacggggcgagcggcggccggg

SEQ ID NO: 74397 - DNA, 19 bp, Homo sapiens
gagagtgcgcccgagcggg

SEQ ID NO: 74398 - DNA, 24 bp, Homo sapiens
cgagcgagcgagcgggcgggcggg

SEQ ID NO: 74399 - DNA, 19 bp, Homo sapiens
gagcgagcgagcgggcggg

SEQ ID NO: 74400 - DNA, 18 bp, Homo sapiens
gagcgggcgggcgggcag

SEQ ID NO: 74401 - DNA, 19 bp, Homo sapiens
agagggcgagcgagttcgg

SEQ ID NO: 74402 - DNA, 19 bp, Homo sapiens
cgagtggccgggcgagcgg

SEQ ID NO: 74403 - DNA, 20 bp, Homo sapiens
gaggcggcgagcgggcgcgg

SEQ ID NO: 74404 - DNA, 20 bp, Homo sapiens
gagacgaggcggcgagcggg

SEQ ID NO: 74405 - DNA, 26 bp, Homo sapiens
cgcgggagcgagcgggagcgggcggg

SEQ ID NO: 74406 - DNA, 18 bp, Homo sapiens
cgagagagcgagcgaacg

SEQ ID NO: 74407 - DNA, 16 bp, Homo sapiens
cgggaggcgagcgagg

SEQ ID NO: 74408 - DNA, 23 bp, Homo sapiens
gaggaaggcggcgagcgggcggg

SEQ ID NO: 74409 - DNA, 23 bp, Homo sapiens
cgaggaagcgaagctcgagcggg

SEQ ID NO: 74410 - DNA, 18 bp, Homo sapiens
gagcgagcgagcgtgcgg

SEQ ID NO: 74411 - DNA, 24 bp, Homo sapiens
cgagcgggcgggcgggcgagcggg

SEQ ID NO: 74412 - DNA, 21 bp, Homo sapiens
aggagcgggcgagcgggcggg

SEQ ID NO: 74413 - DNA, 20 bp, Homo sapiens
gcggccggcgagcgagcggg

SEQ ID NO: 74414 - DNA, 17 bp, Homo sapiens
gaggcgagcgagcgcgg

SEQ ID NO: 74415 - DNA, 21 bp, Homo sapiens
gagggccgggcagcgagcggg

SEQ ID NO: 74416 - DNA, 22 bp, Homo sapiens
gagagagcaagtgtgctttggg

SEQ ID NO: 74417 - DNA, 20 bp, Homo sapiens
cggaagggcgagcgggcacg

SEQ ID NO: 74418 - DNA, 21 bp, Homo sapiens
cgggagaggggtgcgagcggg

SEQ ID NO: 74419 - DNA, 27 bp, Homo sapiens
cggggaaaccgagcgagcgagcgggcc

SEQ ID NO: 74420 - DNA, 25 bp, Homo sapiens
cggggaaaccgagcgagcgagcggg

SEQ ID NO: 74421 - DNA, 24 bp, Homo sapiens
cgagggagtgagtgaatgagtggg

SEQ ID NO: 74422 - DNA, 23 bp, Homo sapiens
ccaggggagcgcgagcgggcggg

SEQ ID NO: 74423 - DNA, 22 bp, Homo sapiens
cgggagcgcgagcgagtcccag

SEQ ID NO: 74424 - DNA, 20 bp, Homo sapiens
gagagagccaagtgagtggg

SEQ ID NO: 74425 - DNA, 22 bp, Homo sapiens
gagcagagcggggacgggcggg

SEQ ID NO: 74426 - DNA, 22 bp, Homo sapiens
gagcggagcggagcggagcggg

SEQ ID NO: 74427 - DNA, 19 bp, Homo sapiens
aggggcccgagcgggcggg

SEQ ID NO: 74428 - DNA, 24 bp, Homo sapiens
gagcgagcgagtgggcagcgcggg

SEQ ID NO: 74429 - DNA, 23 bp, Homo sapiens
gagtgcgcgagcgagcgagtggg

SEQ ID NO: 74430 - DNA, 20 bp, Homo sapiens
aggagggcgtggcgagcggg

SEQ ID NO: 74431 - DNA, 20 bp, Homo sapiens
gagagggcgagccgagcggg

SEQ ID NO: 74432 - DNA, 18 bp, Homo sapiens
cgagagagcgagggctgg

SEQ ID NO: 74433 - DNA, 18 bp, Homo sapiens
gagcgagcgggcgggcag

SEQ ID NO: 74434 - DNA, 21 bp, Homo sapiens
cgagagagagagcgagcacgg

SEQ ID NO: 74435 - DNA, 24 bp, Homo sapiens
agggcgggtgggcgggcgagcggg

SEQ ID NO: 74436 - DNA, 18 bp, Homo sapiens
ccagagagcgagcgggcg

SEQ ID NO: 74437 - DNA, 20 bp, Homo sapiens
cgagggaccgagcgagacgg

SEQ ID NO: 74438 - DNA, 20 bp, Homo sapiens
gaagagcaccagcgagcggg

SEQ ID NO: 74439 - DNA, 21 bp, Homo sapiens
cgagagagccaggcgggcggg

SEQ ID NO: 74440 - DNA, 130 bp, Red clover mottle virus
ggtatagttgcatatttattttatgttcattttctttcttgcttgagtgtgttatttcaatagctcctgtttagcaggtcgaaccttcagcaagttcacaaaaagattttccttttgtgtgtttcttttc

SEQ ID NO: 74441 - DNA, 24 bp, Red clover mottle virus
tgcatatttattttatgttcattt

SEQ ID NO: 74442 - DNA, 21 bp, Homo sapiens
tgctattcaaggtgttcattt

SEQ ID NO: 74443 - DNA, 19 bp, Homo sapiens
tgcatattatttcaccatt

SEQ ID NO: 74444 - DNA, 19 bp, Homo sapiens
tgcatactttgttttgttc

SEQ ID NO: 74445 - DNA, 24 bp, Homo sapiens
tgcatactttattggatgtcattt

SEQ ID NO: 74446 - DNA, 20 bp, Homo sapiens
tatttattttatgtttattt

SEQ ID NO: 74447 - DNA, 19 bp, Homo sapiens
tgcatatttgtctgatgtt

SEQ ID NO: 74448 - DNA, 16 bp, Homo sapiens
tgcattttatattcat

SEQ ID NO: 74449 - DNA, 22 bp, Homo sapiens
tgcacatttattttaatcattt

SEQ ID NO: 74450 - DNA, 19 bp, Homo sapiens
tgcatgtttactttatgtt

SEQ ID NO: 74451 - DNA, 19 bp, Homo sapiens
tgcatacttattttgtgtt

SEQ ID NO: 74452 - DNA, 87 bp, Lymphocystis disease virus 1
gtttaacggcgtttggaccattaccatattatgtttatgctttagcagaaaaaggacaacataatttagctatagatgctgttttgc

SEQ ID NO: 74453 - DNA, 24 bp, Lymphocystis disease virus 1
ggacaacataatttagctatagat

SEQ ID NO: 74454 - DNA, 18 bp, Homo sapiens
ggatacataatttaacca

SEQ ID NO: 74455 - DNA, 19 bp, Homo sapiens
ggagacataattttataga

SEQ ID NO: 74456 - DNA, 22 bp, Homo sapiens
gacaacacatttagttatagat

SEQ ID NO: 74457 - DNA, 96 bp, Ovine pulmonary adenocarcinoma virus
ggggaccgtccgttctctccctgtgcaggtgcgactcttgtttgtgctggtcgcggcaggtggcgcccaacgtggggctcgagctcgacagttttc

SEQ ID NO: 74458 - DNA, 24 bp, Ovine pulmonary adenocarcinoma virus
tccctgtgcaggtgcgactcttgt

SEQ ID NO: 74459 - DNA, 25 bp, Homo sapiens
tccctgtgtagggctcattatttgt

SEQ ID NO: 74460 - DNA, 20 bp, Homo sapiens
ccttatgtatcaactcttgt

SEQ ID NO: 74461 - DNA, 18 bp, Homo sapiens
tccctgtggggcctcttg

SEQ ID NO: 74462 - DNA, 17 bp, Homo sapiens
tgcaggtgcgcgcttgt

SEQ ID NO: 74463 - DNA, 19 bp, Homo sapiens
tgtgaaggtacatttttgt

SEQ ID NO: 74464 - DNA, 19 bp, Homo sapiens
tctttgtgcaggtggccga

SEQ ID NO: 74465 - DNA, 20 bp, Homo sapiens
tgtgcaggtcaccaacttgt

SEQ ID NO: 74466 - DNA, 20 bp, Homo sapiens
ctgggcagaaccattcttgt

SEQ ID NO: 74467 - DNA, 18 bp, Homo sapiens
tgtgcaggttgagattgt

SEQ ID NO: 74468 - DNA, 18 bp, Homo sapiens
tctttgtgcaagtccttg

SEQ ID NO: 74469 - DNA, 21 bp, Homo sapiens
tccctggacaccggcttttgt

SEQ ID NO: 74470 - DNA, 19 bp, Homo sapiens
tccccgtgcgggtgcggcc

SEQ ID NO: 74471 - DNA, 21 bp, Homo sapiens
cccctgtgtggatcctcttgt

SEQ ID NO: 74472 - DNA, 75 bp, Cowpox virus
gcttgttcaaattttataaagaatcatattcattaggcatataataaaaaatataatttataatacacttacagc

SEQ ID NO: 74473 - DNA, 24 bp, Cowpox virus
tttataaagaatcatattcattag

SEQ ID NO: 74474 - DNA, 17 bp, Homo sapiens
tttataaagaattattc

SEQ ID NO: 74475 - DNA, 19 bp, Homo sapiens
tttataaaaagtcatattc

SEQ ID NO: 74476 - DNA, 21 bp, Homo sapiens
tttataatagaacctcattag

SEQ ID NO: 74477 - DNA, 23 bp, Homo sapiens
taaagctaaatcatgttcattag

SEQ ID NO: 74478 - DNA, 60 bp, Cowpox virus
tagttcttaacatctattaatcatttattcgcttattgctttaattgtttttgtaaacta

SEQ ID NO: 74479 - DNA, 24 bp, Cowpox virus
ttgctttaattgtttttgtaaact

SEQ ID NO: 74480 - DNA, 18 bp, Homo sapiens
ttgcttttattgttttta

SEQ ID NO: 74481 - DNA, 19 bp, Homo sapiens
ttgctttaagtgtttggca

SEQ ID NO: 74482 - DNA, 24 bp, Homo sapiens
ttgcttcaattcgagaagtaaact

SEQ ID NO: 74483 - DNA, 18 bp, Homo sapiens
ttgctttatgttgttctc

SEQ ID NO: 74484 - DNA, 22 bp, Homo sapiens
ttgcttttattaaaaatgtaaa

SEQ ID NO: 74485 - DNA, 20 bp, Homo sapiens
ttgttttaattatttttata

SEQ ID NO: 74486 - DNA, 19 bp, Homo sapiens
ctgctttaattgttttaac

SEQ ID NO: 74487 - DNA, 21 bp, Homo sapiens
ttactttaattgttgaaataa

SEQ ID NO: 74488 - DNA, 18 bp, Homo sapiens
ttgctttgtttgttttgc

SEQ ID NO: 74489 - DNA, 18 bp, Homo sapiens
ttcctttaattgtcactg

SEQ ID NO: 74490 - DNA, 70 bp, Human papillomavirus type 86
cgtccacttaagctggtggtgcgttgtggagctgaagacctaaggcagctacagcagcttatggtggacg

SEQ ID NO: 74491 - DNA, 24 bp, Human papillomavirus type 86
aggcagctacagcagcttatggtg

SEQ ID NO: 74492 - DNA, 22 bp, Homo sapiens
ggtagcaacagcagcagacatg

SEQ ID NO: 74493 - DNA, 20 bp, Homo sapiens
aggcagctggggcagcagct

SEQ ID NO: 74494 - DNA, 21 bp, Homo sapiens
aggcagctgtagggcttctag

SEQ ID NO: 74495 - DNA, 19 bp, Homo sapiens
aggcagctggagcagcagt

SEQ ID NO: 74496 - DNA, 20 bp, Homo sapiens
ggtggccacggcagctcctg

SEQ ID NO: 74497 - DNA, 20 bp, Homo sapiens
agacggctatagcagcatac

SEQ ID NO: 74498 - DNA, 23 bp, Homo sapiens
ggtaattatcagcaattatggtg

SEQ ID NO: 74499 - DNA, 18 bp, Homo sapiens
aggcagctgcaggggcct

SEQ ID NO: 74500 - DNA, 22 bp, Homo sapiens
aggcagctcggcagttacagtg

SEQ ID NO: 74501 - DNA, 19 bp, Homo sapiens
ggcgcagcagctacaggtg

SEQ ID NO: 74502 - DNA, 24 bp, Homo sapiens
aggcagctgcgcgggccgcgggtg

SEQ ID NO: 74503 - DNA, 28 bp, Homo sapiens
aggcagctagtcccgagagcttgtggtg

SEQ ID NO: 74504 - DNA, 17 bp, Homo sapiens
aggtactacagtagctt

SEQ ID NO: 74505 - DNA, 18 bp, Homo sapiens
agggagctgcagcagctt

SEQ ID NO: 74506 - DNA, 18 bp, Homo sapiens
aggtaactgcattatggt

SEQ ID NO: 74507 - DNA, 18 bp, Homo sapiens
aggcagctgggctgtggt

SEQ ID NO: 74508 - DNA, 22 bp, Homo sapiens
aggcagctgcgggacctgggtg

SEQ ID NO: 74509 - DNA, 23 bp, Homo sapiens
agcggctatggcagacagcggtg

SEQ ID NO: 74510 - DNA, 20 bp, Homo sapiens
aggcggccacagcagtggcg

SEQ ID NO: 74511 - DNA, 18 bp, Homo sapiens
aggcagcagcagcagctc

SEQ ID NO: 74512 - DNA, 21 bp, Homo sapiens
aggcagctgggtggccaagtg

SEQ ID NO: 74513 - DNA, 15 bp, Homo sapiens
ggcagcacagcaagg

SEQ ID NO: 74514 - DNA, 21 bp, Homo sapiens
aggcagcttggcaggagggtg

SEQ ID NO: 74515 - DNA, 24 bp, Homo sapiens
aggcagctgtgttggccattggtg

SEQ ID NO: 74516 - DNA, 25 bp, Homo sapiens
aggcagctgcagacagtgagttgtg

SEQ ID NO: 74517 - DNA, 17 bp, Homo sapiens
aggagctgcagcagctc

SEQ ID NO: 74518 - DNA, 18 bp, Homo sapiens
aggcagctgcagcactag

SEQ ID NO: 74519 - DNA, 22 bp, Homo sapiens
aggcagctgaggcgggacagtg

SEQ ID NO: 74520 - DNA, 21 bp, Homo sapiens
aggcagctgcaatggcctctg

SEQ ID NO: 74521 - DNA, 21 bp, Homo sapiens
aggcaactgcagaagatggtg

SEQ ID NO: 74522 - DNA, 16 bp, Homo sapiens
aggcagctgcggcggt

SEQ ID NO: 74523 - DNA, 22 bp, Homo sapiens
ggtggccatagcacaaggggtg

SEQ ID NO: 74524 - DNA, 21 bp, Homo sapiens
ggctgccagcccaccatggtg

SEQ ID NO: 74525 - DNA, 17 bp, Homo sapiens
ggcagctgagcagctca

SEQ ID NO: 74526 - DNA, 103 bp, Leek white stripe virus
gctattttctcttttgttttataatcatgtctgagcctatgtatcgttctgatgattcttcgtcatctaaaactaggtccaagaggtcggaggggaccacagc

SEQ ID NO: 74527 - DNA, 24 bp, Leek white stripe virus
tcttttgttttataatcatgtctg

SEQ ID NO: 74528 - DNA, 16 bp, Homo sapiens
tcctgtataatcatgt

SEQ ID NO: 74529 - DNA, 18 bp, Homo sapiens
ttttgtttttagccatgt

SEQ ID NO: 74530 - DNA, 24 bp, Homo sapiens
tctttggttttataatcaaaactg

SEQ ID NO: 74531 - DNA, 18 bp, Homo sapiens
cttttgtttgttatgtct

SEQ ID NO: 74532 - DNA, 60 bp, Raspberry bushy dwarf virus
gcagcattttcttttgaccggcttagtaataagtctttgcctgtctcttttcaatgctgt

SEQ ID NO: 74533 - DNA, 23 bp, Raspberry bushy dwarf virus
tgcctgtctcttttcaatgctgt

SEQ ID NO: 74534 - DNA, 17 bp, Homo sapiens
tgctgttttgaatgctg

SEQ ID NO: 74535 - DNA, 20 bp, Homo sapiens
tgtctgtccctgactgctgt

SEQ ID NO: 74536 - DNA, 15 bp, Homo sapiens
cctgtctcttttgct

SEQ ID NO: 74537 - DNA, 19 bp, Homo sapiens
ctgttttccaacgtgctgt

SEQ ID NO: 74538 - DNA, 24 bp, Homo sapiens
tgccttctctttttaacccgctgt

SEQ ID NO: 74539 - DNA, 19 bp, Homo sapiens
tgcttgtcccttttttatg

SEQ ID NO: 74540 - DNA, 19 bp, Homo sapiens
tacctgtttcttttcaccg

SEQ ID NO: 74541 - DNA, 22 bp, Homo sapiens
tatctgtttcaatgggtgctgt

SEQ ID NO: 74542 - DNA, 21 bp, Homo sapiens
tggctgtcacaataatgctgt

SEQ ID NO: 74543 - DNA, 19 bp, Homo sapiens
gcctgtctcgcggtgctgt

SEQ ID NO: 74544 - DNA, 21 bp, Homo sapiens
tgtctgacttcagaatgctgt

SEQ ID NO: 74545 - DNA, 19 bp, Homo sapiens
ctgtctctttgcctgctgt

SEQ ID NO: 74546 - DNA, 20 bp, Homo sapiens
tgcctgtctctcttttaatg

SEQ ID NO: 74547 - DNA, 18 bp, Homo sapiens
tgctgtttcataatgctg

SEQ ID NO: 74548 - DNA, 17 bp, Homo sapiens
tgtctttgtcagtgctg

SEQ ID NO: 74549 - DNA, 19 bp, Homo sapiens
tctcttccaaatatgctgt

SEQ ID NO: 74550 - DNA, 21 bp, Homo sapiens
tgtcttttttccaatatctgt

SEQ ID NO: 74551 - DNA, 21 bp, Homo sapiens
tgcttgcctctttagatctgt

SEQ ID NO: 74552 - DNA, 21 bp, Homo sapiens
tgcctgtttctttttttctgt

SEQ ID NO: 74553 - DNA, 18 bp, Homo sapiens
tgcctgtttgttttcaat

SEQ ID NO: 74554 - DNA, 18 bp, Homo sapiens
tgcctgcctctttttgcc

SEQ ID NO: 74555 - DNA, 18 bp, Homo sapiens
tgctttctctttccactg

SEQ ID NO: 74556 - DNA, 17 bp, Homo sapiens
tgtctgtctcttttgct

SEQ ID NO: 74557 - DNA, 21 bp, Homo sapiens
tgcttgtgctttcaatgttgt

SEQ ID NO: 74558 - DNA, 21 bp, Homo sapiens
tgcctctctctttgggtctgt

SEQ ID NO: 74559 - DNA, 19 bp, Homo sapiens
cctgtcctcttggtgctgt

SEQ ID NO: 74560 - DNA, 22 bp, Homo sapiens
tgcctgcccggatcagtgctgt

SEQ ID NO: 74561 - DNA, 20 bp, Homo sapiens
cctgtctcttccctcgctgt

SEQ ID NO: 74562 - DNA, 19 bp, Homo sapiens
tgtctcttttagctactgt

SEQ ID NO: 74563 - DNA, 20 bp, Homo sapiens
gcctgaccatttggtgctgt

SEQ ID NO: 74564 - DNA, 19 bp, Homo sapiens
tgcctgtctttttctagct

SEQ ID NO: 74565 - DNA, 17 bp, Homo sapiens
tgtcttttccaatgctg

SEQ ID NO: 74566 - DNA, 18 bp, Homo sapiens
tgcctctcagcagtgctg

SEQ ID NO: 74567 - DNA, 18 bp, Homo sapiens
tgccgcaattcaatgctg

SEQ ID NO: 74568 - DNA, 21 bp, Homo sapiens
tgtcctgtctacaaatgctgt

SEQ ID NO: 74569 - DNA, 60 bp, Potato aucuba mosaic virus
gtcctccgattcgccactatatttgccattagagcaaatcaccagccacaagtcggggac

SEQ ID NO: 74570 - DNA, 22 bp, Potato aucuba mosaic virus
tcaccagccacaagtcggggac

SEQ ID NO: 74571 - DNA, 17 bp, Homo sapiens
ccaccagccgcaggcga

SEQ ID NO: 74572 - DNA, 21 bp, Homo sapiens
tcacagccacaggagcagggg

SEQ ID NO: 74573 - DNA, 15 bp, Homo sapiens
tcccagccaaggggg

SEQ ID NO: 74574 - DNA, 19 bp, Homo sapiens
ccatccctaagtcggggac

SEQ ID NO: 74575 - DNA, 17 bp, Homo sapiens
tcaccagcaacagaagg

SEQ ID NO: 74576 - DNA, 20 bp, Homo sapiens
ccagccacaaaccttgggga

SEQ ID NO: 74577 - DNA, 20 bp, Homo sapiens
ccaccagccacaggcacggg

SEQ ID NO: 74578 - DNA, 18 bp, Homo sapiens
tcaccagccttaccaggg

SEQ ID NO: 74579 - DNA, 21 bp, Homo sapiens
ccaccggcctttcccggggac

SEQ ID NO: 74580 - DNA, 22 bp, Homo sapiens
caccagctacctggtcggggac

SEQ ID NO: 74581 - DNA, 17 bp, Homo sapiens
tcaacagccacagtagg

SEQ ID NO: 74582 - DNA, 16 bp, Homo sapiens
tcaccagcaatgacga

SEQ ID NO: 74583 - DNA, 17 bp, Homo sapiens
tcaccagcacaggaggg

SEQ ID NO: 74584 - DNA, 19 bp, Homo sapiens
ccagccacagacacgtggg

SEQ ID NO: 74585 - DNA, 17 bp, Homo sapiens
tcccagccacagatgga

SEQ ID NO: 74586 - DNA, 22 bp, Homo sapiens
tcatcgccacaaggaggcgggg

SEQ ID NO: 74587 - DNA, 22 bp, Homo sapiens
tcaccagtcagcagccaaagac

SEQ ID NO: 74588 - DNA, 16 bp, Homo sapiens
ccaccagctacagagg

SEQ ID NO: 74589 - DNA, 19 bp, Homo sapiens
tcaccagccaccgaatcgg

SEQ ID NO: 74590 - DNA, 17 bp, Homo sapiens
tcaccagctaggcaagg

SEQ ID NO: 74591 - DNA, 21 bp, Homo sapiens
ccaccagctactctagagggg

SEQ ID NO: 74592 - DNA, 18 bp, Homo sapiens
tcaccagcacatagtggg

SEQ ID NO: 74593 - DNA, 18 bp, Homo sapiens
tcacggccagagccgggg

SEQ ID NO: 74594 - DNA, 21 bp, Homo sapiens
tcgccgcccacaaatcccggg

SEQ ID NO: 74595 - DNA, 19 bp, Homo sapiens
tcacttgccattcagggac

SEQ ID NO: 74596 - DNA, 18 bp, Homo sapiens
tcaccagcagcagcgagg

SEQ ID NO: 74597 - DNA, 18 bp, Homo sapiens
tcctcagccacaagagag

SEQ ID NO: 74598 - DNA, 17 bp, Homo sapiens
tctccagccacaggcaa

SEQ ID NO: 74599 - DNA, 21 bp, Homo sapiens
ccgccggcctgctccggggac

SEQ ID NO: 74600 - DNA, 20 bp, Homo sapiens
ccaccagccgcatggcaggg

SEQ ID NO: 74601 - DNA, 18 bp, Homo sapiens
tcaccagcccaaacaggg

SEQ ID NO: 74602 - DNA, 21 bp, Homo sapiens
ccagccacggggggagcgggg

SEQ ID NO: 74603 - DNA, 19 bp, Homo sapiens
tgaccacaaggttggggac

SEQ ID NO: 74604 - DNA, 18 bp, Homo sapiens
caccggccccgcggggac

SEQ ID NO: 74605 - DNA, 16 bp, Homo sapiens
ccaccagccgttgggg

SEQ ID NO: 74606 - DNA, 17 bp, Homo sapiens
tcaccagcagcaacaga

SEQ ID NO: 74607 - DNA, 17 bp, Homo sapiens
accagccatagggagac

SEQ ID NO: 74608 - DNA, 18 bp, Homo sapiens
cagccacagtagtgggac

SEQ ID NO: 74609 - DNA, 18 bp, Homo sapiens
tcccagccacatgctggg

SEQ ID NO: 74610 - DNA, 19 bp, Homo sapiens
tcactgcccacaagcccaa

SEQ ID NO: 74611 - DNA, 22 bp, Homo sapiens
tcactggccaaagaagtcgggg

SEQ ID NO: 74612 - DNA, 16 bp, Homo sapiens
tcaccagcccacgaga

SEQ ID NO: 74613 - DNA, 16 bp, Homo sapiens
tcaccagccacagaga

SEQ ID NO: 74614 - DNA, 20 bp, Homo sapiens
tcaccagtcaaggcctcggg

SEQ ID NO: 74615 - DNA, 17 bp, Homo sapiens
cagccacactcagggac

SEQ ID NO: 74616 - DNA, 19 bp, Homo sapiens
tcaccagcttccaagggac

SEQ ID NO: 74617 - DNA, 19 bp, Homo sapiens
tccccagccacccccaggg

SEQ ID NO: 74618 - DNA, 21 bp, Homo sapiens
tcaccagcatgccgttgggac

SEQ ID NO: 74619 - DNA, 23 bp, Homo sapiens
tcattgcagtcagaggttgggga

SEQ ID NO: 74620 - DNA, 20 bp, Homo sapiens
ccagccacagaggagaggac

SEQ ID NO: 74621 - DNA, 16 bp, Homo sapiens
tcaccaaccgtaaggg

SEQ ID NO: 74622 - DNA, 17 bp, Homo sapiens
tcccagccacctcgggg

SEQ ID NO: 74623 - DNA, 18 bp, Homo sapiens
tcacagccacaggcggag

SEQ ID NO: 74624 - DNA, 17 bp, Homo sapiens
actagcacaagccaggg

SEQ ID NO: 74625 - DNA, 17 bp, Homo sapiens
tcaccagctaaatagga

SEQ ID NO: 74626 - DNA, 16 bp, Homo sapiens
tccccagccccgggga

SEQ ID NO: 74627 - DNA, 21 bp, Homo sapiens
tcaccagctgcactgctgggg

SEQ ID NO: 74628 - DNA, 20 bp, Homo sapiens
tcaccgcccacttcccgggg

SEQ ID NO: 74629 - DNA, 16 bp, Homo sapiens
tcaccagccatcacgg

SEQ ID NO: 74630 - DNA, 21 bp, Homo sapiens
tcatcagccacaccgtcgggg

SEQ ID NO: 74631 - DNA, 16 bp, Homo sapiens
tcaccaaccgcaggag

SEQ ID NO: 74632 - DNA, 18 bp, Homo sapiens
tcatcgccacagtcaagg

SEQ ID NO: 74633 - DNA, 22 bp, Homo sapiens
tcatggccacagtctgtgggac

SEQ ID NO: 74634 - DNA, 16 bp, Homo sapiens
tcgccagccaagccgg

SEQ ID NO: 74635 - DNA, 17 bp, Homo sapiens
ccaccagccacccaggg

SEQ ID NO: 74636 - DNA, 17 bp, Homo sapiens
ccagccactggcaagac

SEQ ID NO: 74637 - DNA, 19 bp, Homo sapiens
tcatcagccccaagccgga

SEQ ID NO: 74638 - DNA, 16 bp, Homo sapiens
tcaccagctcacagga

SEQ ID NO: 74639 - DNA, 21 bp, Homo sapiens
tcaccagtcaagaggctgggg

SEQ ID NO: 74640 - DNA, 19 bp, Homo sapiens
tcaccagctcagcacaggg

SEQ ID NO: 74641 - DNA, 16 bp, Homo sapiens
tcaccagccacaggaa

SEQ ID NO: 74642 - DNA, 20 bp, Homo sapiens
ccaccagctgagtcggggac

SEQ ID NO: 74643 - DNA, 18 bp, Homo sapiens
tcagcagccacaagaagg

SEQ ID NO: 74644 - DNA, 21 bp, Homo sapiens
tcaccagccaggctgagggac

SEQ ID NO: 74645 - DNA, 23 bp, Homo sapiens
tcgcaagccgcaaaccaggggac

SEQ ID NO: 74646 - DNA, 21 bp, Homo sapiens
tcaccagcaaaaactggggac

SEQ ID NO: 74647 - DNA, 18 bp, Homo sapiens
caccagccgcaggcccgg

SEQ ID NO: 74648 - DNA, 22 bp, Homo sapiens
actggccacaaaatagggggac

SEQ ID NO: 74649 - DNA, 22 bp, Homo sapiens
ccgccagccacagcacaaggac

SEQ ID NO: 74650 - DNA, 17 bp, Homo sapiens
tccctggccacgcagga

SEQ ID NO: 74651 - DNA, 17 bp, Homo sapiens
tcccagccacaagctga

SEQ ID NO: 74652 - DNA, 20 bp, Homo sapiens
tcaccagccagaagtaaaaa

SEQ ID NO: 74653 - DNA, 21 bp, Homo sapiens
tcatcagccacatagaaggac

SEQ ID NO: 74654 - DNA, 19 bp, Homo sapiens
tcatcagcttaatcaggga

SEQ ID NO: 74655 - DNA, 16 bp, Homo sapiens
tcccagccacggcggg

SEQ ID NO: 74656 - DNA, 17 bp, Homo sapiens
tcactggccacaaaaga

SEQ ID NO: 74657 - DNA, 20 bp, Homo sapiens
tcgccggccggctcagggac

SEQ ID NO: 74658 - DNA, 16 bp, Homo sapiens
tcccagccacccaggg

SEQ ID NO: 74659 - DNA, 21 bp, Homo sapiens
tcaccagctccatgcagggac

SEQ ID NO: 74660 - DNA, 16 bp, Homo sapiens
ccaccagctgccgggg

SEQ ID NO: 74661 - DNA, 19 bp, Homo sapiens
tcaccagctcagtcctgac

SEQ ID NO: 74662 - DNA, 16 bp, Homo sapiens
tcatagcagtcgggga

SEQ ID NO: 74663 - DNA, 18 bp, Homo sapiens
tcccagccacagtagggg

SEQ ID NO: 74664 - DNA, 17 bp, Homo sapiens
tcgccaaccacggggga

SEQ ID NO: 74665 - DNA, 20 bp, Homo sapiens
tcaccagcggcgcccgggac

SEQ ID NO: 74666 - DNA, 18 bp, Homo sapiens
accagccacagagaagac

SEQ ID NO: 74667 - DNA, 19 bp, Homo sapiens
tcaccacccacagtaggac

SEQ ID NO: 74668 - DNA, 17 bp, Homo sapiens
accagccacaaaagagg

SEQ ID NO: 74669 - DNA, 19 bp, Homo sapiens
ccattggccagagccgggg

SEQ ID NO: 74670 - DNA, 19 bp, Homo sapiens
tcaccaggcacaaatctgg

SEQ ID NO: 74671 - DNA, 19 bp, Homo sapiens
tcaccagccaccactcagg

SEQ ID NO: 74672 - DNA, 19 bp, Homo sapiens
tcaccagccgccagccggg

SEQ ID NO: 74673 - DNA, 20 bp, Homo sapiens
tcagtggctccatcggggac

SEQ ID NO: 74674 - DNA, 20 bp, Homo sapiens
tcaccaggttgcaatcaagg

SEQ ID NO: 74675 - DNA, 23 bp, Homo sapiens
caccggctacaagccgcccgggg

SEQ ID NO: 74676 - DNA, 19 bp, Homo sapiens
tcaccagcagcaggttggg

SEQ ID NO: 74677 - DNA, 19 bp, Homo sapiens
ccaccagccacgcacgagg

SEQ ID NO: 74678 - DNA, 18 bp, Homo sapiens
tcacctggctgtcaggga

SEQ ID NO: 74679 - DNA, 20 bp, Homo sapiens
tcaccagcggcatcaaaggg

SEQ ID NO: 74680 - DNA, 19 bp, Homo sapiens
tcaccagcccagccttgac

SEQ ID NO: 74681 - DNA, 17 bp, Homo sapiens
tcattagccatcaggga

SEQ ID NO: 74682 - DNA, 20 bp, Homo sapiens
tcaccagctaccaagttgga

SEQ ID NO: 74683 - DNA, 18 bp, Homo sapiens
ccattagccacaaattgg

SEQ ID NO: 74684 - DNA, 20 bp, Homo sapiens
tcacagccacaaggaaaagg

SEQ ID NO: 74685 - DNA, 28 bp, Homo sapiens
tcaccagccgccggcccagctggggacg

SEQ ID NO: 74686 - DNA, 16 bp, Homo sapiens
tcatcagccacacggg

SEQ ID NO: 74687 - DNA, 19 bp, Homo sapiens
tcaccagcagcaggccaaa

SEQ ID NO: 74688 - DNA, 20 bp, Homo sapiens
tcagcagctgcaccagggac

SEQ ID NO: 74689 - DNA, 19 bp, Homo sapiens
ccagccacgtccatagggg

SEQ ID NO: 74690 - DNA, 17 bp, Homo sapiens
tcaccagcagtgggcga

SEQ ID NO: 74691 - DNA, 21 bp, Homo sapiens
tcaccagctgtaatgagcgga

SEQ ID NO: 74692 - DNA, 16 bp, Homo sapiens
ccaccagccgtgcgga

SEQ ID NO: 74693 - DNA, 21 bp, Homo sapiens
tcaccagccacagacactggg

SEQ ID NO: 74694 - DNA, 21 bp, Homo sapiens
tcatcagccagggcagtgggg

SEQ ID NO: 74695 - DNA, 20 bp, Homo sapiens
tcatagccacaagcacagac

SEQ ID NO: 74696 - DNA, 20 bp, Homo sapiens
caccagccagccctggggac

SEQ ID NO: 74697 - DNA, 22 bp, Homo sapiens
tcacctggctctcgtcggggac

SEQ ID NO: 74698 - DNA, 20 bp, Homo sapiens
ccagccacagccatctggac

SEQ ID NO: 74699 - DNA, 19 bp, Homo sapiens
tcccagccacctcggggac

SEQ ID NO: 74700 - DNA, 16 bp, Homo sapiens
tcaccagctacaaagg

SEQ ID NO: 74701 - DNA, 79 bp, Potato aucuba mosaic virus
gccactcattgccattcggtggacattacaaagacggaaccaaagaagtcttatattacccacagaattccaaagtagc

SEQ ID NO: 74702 - DNA, 24 bp, Potato aucuba mosaic virus
ttatattacccacagaattccaaa

SEQ ID NO: 74703 - DNA, 20 bp, Homo sapiens
tatattaccttatttccaaa

SEQ ID NO: 74704 - DNA, 16 bp, Homo sapiens
attacccagattccaa

SEQ ID NO: 74705 - DNA, 22 bp, Homo sapiens
ttataacagcacagaattccaa

SEQ ID NO: 74706 - DNA, 23 bp, Homo sapiens
ttatttacccattgaattccaaa

SEQ ID NO: 74707 - DNA, 19 bp, Homo sapiens
ttatattacctgtgaactc

SEQ ID NO: 74708 - DNA, 21 bp, Homo sapiens
cattacaatcacagaattcca

SEQ ID NO: 74709 - DNA, 22 bp, Homo sapiens
ttattttaccctttattccaaa

SEQ ID NO: 74710 - DNA, 19 bp, Homo sapiens
ttatattatgccacaaaac

SEQ ID NO: 74711 - DNA, 19 bp, Homo sapiens
ttatattacaaaattccaa

SEQ ID NO: 74712 - DNA, 18 bp, Homo sapiens
tatattacttacaaaact

SEQ ID NO: 74713 - DNA, 20 bp, Homo sapiens
tcatattatccctacaattc

SEQ ID NO: 74714 - DNA, 18 bp, Homo sapiens
tattatcccacagagttc

SEQ ID NO: 74715 - DNA, 20 bp, Homo sapiens
ttatatcatccacaatttcc

SEQ ID NO: 74716 - DNA, 115 bp, Lumpy skin disease virus
tttgttcttttaatataaacacaaaataacattaattctaccaacgatggatttattaataatatcgttttgctatcatcattgttaattttgttaaaatttttaaatgtacaag

SEQ ID NO: 74717 - DNA, 24 bp, Lumpy skin disease virus
aataacattaattctaccaacgat

SEQ ID NO: 74718 - DNA, 18 bp, Homo sapiens
aataacataggccaacga

SEQ ID NO: 74719 - DNA, 62 bp, Human parainfluenza virus 2
actattgaatgaagactccagattcaataataattgaaaggctctctatcttatgcaatagt

SEQ ID NO: 74720 - DNA, 24 bp, Human parainfluenza virus 2
atgaagactccagattcaataata

SEQ ID NO: 74721 - DNA, 21 bp, Homo sapiens
gaagattcaaattcagtaata

SEQ ID NO: 74722 - DNA, 24 bp, Homo sapiens
atgaagctctgaatctcaataata

SEQ ID NO: 74723 - DNA, 21 bp, Homo sapiens
tgaagacttcccctcctaata

SEQ ID NO: 74724 - DNA, 18 bp, Homo sapiens
ataaggactccaggtttc

SEQ ID NO: 74725 - DNA, 18 bp, Homo sapiens
atgaagacttaggacaat

SEQ ID NO: 74726 - DNA, 22 bp, Homo sapiens
tgaagtaactggattcaataat

SEQ ID NO: 74727 - DNA, 18 bp, Homo sapiens
gaagactctagattcaat

SEQ ID NO: 74728 - DNA, 22 bp, Homo sapiens
tgaagatctaattacaataata

SEQ ID NO: 74729 - DNA, 19 bp, Homo sapiens
atgaaaaccattcaataat

SEQ ID NO: 74730 - DNA, 18 bp, Homo sapiens
atggggactacagattca

SEQ ID NO: 74731 - DNA, 18 bp, Homo sapiens
tgaagactctgaggttca

SEQ ID NO: 74732 - DNA, 20 bp, Homo sapiens
atgaagacttttagagacaa

SEQ ID NO: 74733 - DNA, 77 bp, Human parainfluenza virus 2
aggttcaattttctcatcatttactgttgtaattcaatcttactaaagttattccgatatttaagaaaaaataacct

SEQ ID NO: 74734 - DNA, 24 bp, Human parainfluenza virus 2
taaagttattccgatatttaagaa

SEQ ID NO: 74735 - DNA, 18 bp, Homo sapiens
atcactgatatttaagaa

SEQ ID NO: 74736 - DNA, 16 bp, Homo sapiens
gttattccggcataga

SEQ ID NO: 74737 - DNA, 22 bp, Homo sapiens
tgaattattccttgactaagaa

SEQ ID NO: 74738 - DNA, 21 bp, Homo sapiens
taaagttatgacatttgagaa

SEQ ID NO: 74739 - DNA, 18 bp, Homo sapiens
agttattccacttaagaa

SEQ ID NO: 74740 - DNA, 114 bp, Human papillomavirus type 6
tgtaacaagtgtaacaaacacaactgtaatgatgattatgtaactatgcattatgatactgctggtgattatatatatatgaattagagtaaaactttttttatatttgtaaca

SEQ ID NO: 74741 - DNA, 24 bp, Human papillomavirus type 6
taacaagtgtaacaaacacaactg

SEQ ID NO: 74742 - DNA, 22 bp, Homo sapiens
acaaggcaccaaggcacaactg

SEQ ID NO: 74743 - DNA, 16 bp, Homo sapiens
agcatgaacacaactg

SEQ ID NO: 74744 - DNA, 26 bp, Homo sapiens
taacaaatgtgacagggaccgggctg

SEQ ID NO: 74745 - DNA, 26 bp, Homo sapiens
caacaagccagcaacaaacacaactg

SEQ ID NO: 74746 - DNA, 19 bp, Homo sapiens
agtgtcaggaacacaactg

SEQ ID NO: 74747 - DNA, 22 bp, Homo sapiens
taacaagtgaggggtgcaactg

SEQ ID NO: 74748 - DNA, 20 bp, Homo sapiens
aatgacattaaacacaactg

SEQ ID NO: 74749 - DNA, 27 bp, Homo sapiens
taacaagtgtagtaaaaacgaaaactg

SEQ ID NO: 74750 - DNA, 18 bp, Homo sapiens
aagtgtaataaatacaac

SEQ ID NO: 74751 - DNA, 18 bp, Homo sapiens
aatgagcaagcacaactg

SEQ ID NO: 74752 - DNA, 19 bp, Homo sapiens
taaaaagtgcaacacagct

SEQ ID NO: 74753 - DNA, 20 bp, Homo sapiens
taacaagtgtaataatacaa

SEQ ID NO: 74754 - DNA, 22 bp, Homo sapiens
taacaagtgaaacaggcaactg

SEQ ID NO: 74755 - DNA, 22 bp, Homo sapiens
catttataaacaaacacagctg

SEQ ID NO: 74756 - DNA, 19 bp, Homo sapiens
acaagtgttatgaacacaa

SEQ ID NO: 74757 - DNA, 19 bp, Homo sapiens
agtgccaataacacaactg

SEQ ID NO: 74758 - DNA, 20 bp, Homo sapiens
acaggcccaaaacacaactg

SEQ ID NO: 74759 - DNA, 23 bp, Homo sapiens
taaggagtgtaacaactcagctg

SEQ ID NO: 74760 - DNA, 21 bp, Homo sapiens
gtgaagccaaaaacacaactg

SEQ ID NO: 74761 - DNA, 19 bp, Homo sapiens
agtgccaacaacacaactg

SEQ ID NO: 74762 - DNA, 22 bp, Homo sapiens
aatgcttcgataaacacaactg

SEQ ID NO: 74763 - DNA, 20 bp, Homo sapiens
caggtgtaacaaaagcagct

SEQ ID NO: 74764 - DNA, 87 bp, Human papillomavirus type 6
ggtttgtggttgttatgtgcctttattgtaggggtgttggggttattattaatgcactatagagctgtacaaggcgataaacacacc

SEQ ID NO: 74765 - DNA, 24 bp, Human papillomavirus type 6
tggttgttatgtgcctttattgta

SEQ ID NO: 74766 - DNA, 18 bp, Homo sapiens
tggctgtacctttgttgt

SEQ ID NO: 74767 - DNA, 23 bp, Homo sapiens
tggttgttatttgtctaagaagt

SEQ ID NO: 74768 - DNA, 61 bp, Cocksfoot streak virus
ctcactctgatatgtgcaccgtgtgtgattttatcacgaaggctggacatatgtttgtgag

SEQ ID NO: 74769 - DNA, 24 bp, Cocksfoot streak virus
tgatatgtgcaccgtgtgtgattt

SEQ ID NO: 74770 - DNA, 21 bp, Homo sapiens
tggtatgtgtacacgtgcatg

SEQ ID NO: 74771 - DNA, 16 bp, Homo sapiens
tgatatgtgtgtgtgt

SEQ ID NO: 74772 - DNA, 22 bp, Homo sapiens
tgatagtggagtcgtgtgattt

SEQ ID NO: 74773 - DNA, 17 bp, Homo sapiens
tgatatgtgtgtgtgtg

SEQ ID NO: 74774 - DNA, 18 bp, Homo sapiens
tgtgtgtgtgtgtgattt

SEQ ID NO: 74775 - DNA, 19 bp, Homo sapiens
tgacatgtgtactgtttgt

SEQ ID NO: 74776 - DNA, 24 bp, Homo sapiens
tgtatgtgtgcatatgtgtgattt

SEQ ID NO: 74777 - DNA, 24 bp, Homo sapiens
tgatatgtttatcataattgattt

SEQ ID NO: 74778 - DNA, 19 bp, Homo sapiens
tgatatgtgcattgagatt

SEQ ID NO: 74779 - DNA, 60 bp, Canine oral papillomavirus
gagcgaccgttattggtttggagtgacgcccggacattcctgacaagaccggattcgttc

SEQ ID NO: 74780 - DNA, 20 bp, Canine oral papillomavirus
tgacaagaccggattcgttc

SEQ ID NO: 74781 - DNA, 18 bp, Homo sapiens
tgcaggatgaactcgttc

SEQ ID NO: 74782 - DNA, 20 bp, Homo sapiens
tgacaagaatgggcccattc

SEQ ID NO: 74783 - DNA, 21 bp, Homo sapiens
tgacagacccagcacttgttc

SEQ ID NO: 74784 - DNA, 22 bp, Homo sapiens
tgacaagacatgaaagattgtt

SEQ ID NO: 74785 - DNA, 18 bp, Homo sapiens
tgacaagaactggacatc

SEQ ID NO: 74786 - DNA, 19 bp, Homo sapiens
tgacaaaattggagacatt

SEQ ID NO: 74787 - DNA, 19 bp, Homo sapiens
tgacaagaactaatagttc

SEQ ID NO: 74788 - DNA, 18 bp, Homo sapiens
tgagagaccagaggcgtt

SEQ ID NO: 74789 - DNA, 18 bp, Homo sapiens
tgacaagccggacccgtc

SEQ ID NO: 74790 - DNA, 16 bp, Homo sapiens
gacaagaccggcgctc

SEQ ID NO: 74791 - DNA, 18 bp, Homo sapiens
tgacaaaatcagaggttc

SEQ ID NO: 74792 - DNA, 17 bp, Homo sapiens
tgatagaccaaatgttc

SEQ ID NO: 74793 - DNA, 21 bp, Homo sapiens
taatgagaccaaatactgttc

SEQ ID NO: 74794 - DNA, 18 bp, Homo sapiens
gacaagactccaaagttc

SEQ ID NO: 74795 - DNA, 20 bp, Homo sapiens
tggtcagactcagaacgttc

SEQ ID NO: 74796 - DNA, 20 bp, Homo sapiens
tgatgaaaccatatccgttc

SEQ ID NO: 74797 - DNA, 19 bp, Homo sapiens
gacaagatcgggtgcgttc

SEQ ID NO: 74798 - DNA, 19 bp, Homo sapiens
tgataagaccagtgaattc

SEQ ID NO: 74799 - DNA, 78 bp, Swinepox virus
atatgtacacatattttaattatatctgttttacttggatttaataacaatactgaattaaaacatgattgtatatat

SEQ ID NO: 74800 - DNA, 24 bp, Swinepox virus
tattttaattatatctgttttact

SEQ ID NO: 74801 - DNA, 20 bp, Homo sapiens
ttttagatatatctgtatta

SEQ ID NO: 74802 - DNA, 18 bp, Homo sapiens
tattttaaatatatctat

SEQ ID NO: 74803 - DNA, 19 bp, Homo sapiens
taatccaatatctgtttta

SEQ ID NO: 74804 - DNA, 19 bp, Homo sapiens
tttaattagctctgtttta

SEQ ID NO: 74805 - DNA, 73 bp, Human herpesvirus 8
ttccgtaatatctgttttatatagtgagggttcacgcatgcgcgagtcccgactaatgaggacaattactgaa

SEQ ID NO: 74806 - DNA, 24 bp, Human herpesvirus 8
tctgttttatatagtgagggttca

SEQ ID NO: 74807 - DNA, 21 bp, Homo sapiens
tctgttttgagttccggttca

SEQ ID NO: 74808 - DNA, 22 bp, Homo sapiens
tctgttttaaatggtgaatcca

SEQ ID NO: 74809 - DNA, 20 bp, Homo sapiens
tgtcttatatgctttaggtt

SEQ ID NO: 74810 - DNA, 16 bp, Homo sapiens
tcagttttatatggtt

SEQ ID NO: 74811 - DNA, 21 bp, Homo sapiens
cctgcacgtggtgagggttca

SEQ ID NO: 74812 - DNA, 16 bp, Homo sapiens
tctgttctgtggggtt

SEQ ID NO: 74813 - DNA, 20 bp, Homo sapiens
tctgattcacagtgagggtt

SEQ ID NO: 74814 - DNA, 19 bp, Homo sapiens
tctgttttatgtgatcatc

SEQ ID NO: 74815 - DNA, 23 bp, Homo sapiens
tctgttttataaagaagcaagtt

SEQ ID NO: 74816 - DNA, 20 bp, Homo sapiens
tgtcttatatgttttaggtt

SEQ ID NO: 74817 - DNA, 81 bp, Human herpesvirus 8
gtctatttcccacgacatacttccgcggaaaaatacccacgctccttaatttccgtgggaagacgatgggggaaatgtggc

SEQ ID NO: 74818 - DNA, 24 bp, Human herpesvirus 8
tccgtgggaagacgatgggggaaa

SEQ ID NO: 74819 - DNA, 19 bp, Homo sapiens
tcctgggaggaatgaggga

SEQ ID NO: 74820 - DNA, 21 bp, Homo sapiens
tccgtgggaagcaccaggaaa

SEQ ID NO: 74821 - DNA, 20 bp, Homo sapiens
tgggaaggcgaatgggggaa

SEQ ID NO: 74822 - DNA, 21 bp, Homo sapiens
tccatgggaaggtgaagggag

SEQ ID NO: 74823 - DNA, 17 bp, Homo sapiens
tcctgggaggatggaga

SEQ ID NO: 74824 - DNA, 21 bp, Homo sapiens
tctttgggaagggaaagggga

SEQ ID NO: 74825 - DNA, 15 bp, Homo sapiens
gtgggaagagggaga

SEQ ID NO: 74826 - DNA, 17 bp, Homo sapiens
gtgggaaaaatgaggga

SEQ ID NO: 74827 - DNA, 18 bp, Homo sapiens
gtgggagaggatggggga

SEQ ID NO: 74828 - DNA, 17 bp, Homo sapiens
tccgagggaagagggag

SEQ ID NO: 74829 - DNA, 22 bp, Homo sapiens
tctctggggggacaaagggaga

SEQ ID NO: 74830 - DNA, 20 bp, Homo sapiens
tcggtggggagtcaggggaa

SEQ ID NO: 74831 - DNA, 18 bp, Homo sapiens
tcggtggggggatgggaa

SEQ ID NO: 74832 - DNA, 17 bp, Homo sapiens
cgtgggagatgaaggaa

SEQ ID NO: 74833 - DNA, 18 bp, Homo sapiens
gttggaaggagagggaaa

SEQ ID NO: 74834 - DNA, 23 bp, Homo sapiens
tccctggggtctggtgggggaaa

SEQ ID NO: 74835 - DNA, 22 bp, Homo sapiens
tcctgggaggcggaggggggaa

SEQ ID NO: 74836 - DNA, 21 bp, Homo sapiens
tctttgggagtgttgggggaa

SEQ ID NO: 74837 - DNA, 18 bp, Homo sapiens
tccgtgggaagctgaggg

SEQ ID NO: 74838 - DNA, 22 bp, Homo sapiens
tccgcgggggggcaagggggga

SEQ ID NO: 74839 - DNA, 16 bp, Homo sapiens
gtgggaagaaggggga

SEQ ID NO: 74840 - DNA, 18 bp, Homo sapiens
tcctggaggatgggggaa

SEQ ID NO: 74841 - DNA, 19 bp, Homo sapiens
gtgggggagcagggggaaa

SEQ ID NO: 74842 - DNA, 19 bp, Homo sapiens
cgtggggagaaaagggggg

SEQ ID NO: 74843 - DNA, 17 bp, Homo sapiens
gtgggagcctgggggaa

SEQ ID NO: 74844 - DNA, 17 bp, Homo sapiens
cgtggcaggtgggggaa

SEQ ID NO: 74845 - DNA, 19 bp, Homo sapiens
tccatggggggatgatggg

SEQ ID NO: 74846 - DNA, 22 bp, Homo sapiens
cccgtgggagggctgcagggaa

SEQ ID NO: 74847 - DNA, 21 bp, Homo sapiens
ccgtgggagggctgcagggaa

SEQ ID NO: 74848 - DNA, 23 bp, Homo sapiens
tccgtgggggagtgagacaggga

SEQ ID NO: 74849 - DNA, 22 bp, Homo sapiens
cctgtgggaggccttgggggaa

SEQ ID NO: 74850 - DNA, 23 bp, Homo sapiens
tcagtgggaagatactctgggga

SEQ ID NO: 74851 - DNA, 16 bp, Homo sapiens
cctgtggggaggggga

SEQ ID NO: 74852 - DNA, 23 bp, Homo sapiens
tccatgggagggactgcagggag

SEQ ID NO: 74853 - DNA, 18 bp, Homo sapiens
tccggggaaaggggggga

SEQ ID NO: 74854 - DNA, 20 bp, Homo sapiens
tcctgggaaaacagggggaa

SEQ ID NO: 74855 - DNA, 19 bp, Homo sapiens
gtgggagggagttggggga

SEQ ID NO: 74856 - DNA, 23 bp, Homo sapiens
tccctgggtcaaggtgggggaaa

SEQ ID NO: 74857 - DNA, 15 bp, Homo sapiens
cgtgggaagatgagg

SEQ ID NO: 74858 - DNA, 19 bp, Homo sapiens
gtggagggaggtggggaaa

SEQ ID NO: 74859 - DNA, 21 bp, Homo sapiens
cgtgggaacacggttatcagg

SEQ ID NO: 74860 - DNA, 22 bp, Homo sapiens
cctgtgggaaataatgggggaa

SEQ ID NO: 74861 - DNA, 18 bp, Homo sapiens
gtgggaggaatagggaaa

SEQ ID NO: 74862 - DNA, 19 bp, Homo sapiens
catggggagggatgggaaa

SEQ ID NO: 74863 - DNA, 20 bp, Homo sapiens
tccgtgagggaggcggcagg

SEQ ID NO: 74864 - DNA, 22 bp, Homo sapiens
cccgtgggaaggtgaccctggg

SEQ ID NO: 74865 - DNA, 16 bp, Homo sapiens
cctgggtgatggggga

SEQ ID NO: 74866 - DNA, 17 bp, Homo sapiens
gtggggagaaggggaaa

SEQ ID NO: 74867 - DNA, 18 bp, Homo sapiens
tccctggggaatggggga

SEQ ID NO: 74868 - DNA, 20 bp, Homo sapiens
tcctgggagggaaagggaga

SEQ ID NO: 74869 - DNA, 17 bp, Homo sapiens
gtgggaaggtaggggaa

SEQ ID NO: 74870 - DNA, 16 bp, Homo sapiens
tcctggggatggggga

SEQ ID NO: 74871 - DNA, 17 bp, Homo sapiens
tcctggggagatggagg

SEQ ID NO: 74872 - DNA, 21 bp, Homo sapiens
gtgatccaaatggtgggggaa

SEQ ID NO: 74873 - DNA, 23 bp, Homo sapiens
tccgtggggagaaagccggggaa

SEQ ID NO: 74874 - DNA, 19 bp, Homo sapiens
tgggaagggatgaagggaa

SEQ ID NO: 74875 - DNA, 19 bp, Homo sapiens
cccgtgggaagaaagggag

SEQ ID NO: 74876 - DNA, 15 bp, Homo sapiens
gtgggagtgggggaa

SEQ ID NO: 74877 - DNA, 23 bp, Homo sapiens
tccgtgggaggctccctcggaag

SEQ ID NO: 74878 - DNA, 19 bp, Homo sapiens
tccgtgggagtgcgggcga

SEQ ID NO: 74879 - DNA, 21 bp, Homo sapiens
tcagtgggaggacagaggagg

SEQ ID NO: 74880 - DNA, 19 bp, Homo sapiens
tcagtggggagtgggggaa

SEQ ID NO: 74881 - DNA, 19 bp, Homo sapiens
tggggacatcttgggggaa

SEQ ID NO: 74882 - DNA, 18 bp, Homo sapiens
gtgaactgatgggggaaa

SEQ ID NO: 74883 - DNA, 20 bp, Homo sapiens
tctgtggggggacaagggag

SEQ ID NO: 74884 - DNA, 18 bp, Homo sapiens
tcagtggggaggtggtga

SEQ ID NO: 74885 - DNA, 19 bp, Homo sapiens
tccatgggagaagggggaa

SEQ ID NO: 74886 - DNA, 15 bp, Homo sapiens
gtggggatgggggaa

SEQ ID NO: 74887 - DNA, 22 bp, Homo sapiens
tccgtggggagatgaaggggga

SEQ ID NO: 74888 - DNA, 20 bp, Homo sapiens
cgtgggaaggcatctggagg

SEQ ID NO: 74889 - DNA, 21 bp, Homo sapiens
cctgtgggaaggctatggaaa

SEQ ID NO: 74890 - DNA, 21 bp, Homo sapiens
tcctgggaagacgccatgaaa

SEQ ID NO: 74891 - DNA, 17 bp, Homo sapiens
cataaaagtgatggggg

SEQ ID NO: 74892 - DNA, 16 bp, Homo sapiens
tcagtgggaaggggga

SEQ ID NO: 74893 - DNA, 21 bp, Homo sapiens
tccatgggaggaccacgggag

SEQ ID NO: 74894 - DNA, 16 bp, Homo sapiens
tccgggggagagggga

SEQ ID NO: 74895 - DNA, 22 bp, Homo sapiens
tccgtgaggaaggtgacagaag

SEQ ID NO: 74896 - DNA, 23 bp, Homo sapiens
tctatggggaggacaaagggaga

SEQ ID NO: 74897 - DNA, 19 bp, Homo sapiens
tcctgggaggagtgggaaa

SEQ ID NO: 74898 - DNA, 20 bp, Homo sapiens
tcctgggaagacactgggga

SEQ ID NO: 74899 - DNA, 22 bp, Homo sapiens
tccgtggggagctggccaggag

SEQ ID NO: 74900 - DNA, 63 bp, Tupaia herpesvirus
aaaaccgggtccgcgagcgggcccgtccggtcgagacggtggcgtgcgtgtgtgtctgttttt

SEQ ID NO: 74901 - DNA, 24 bp, Tupaia herpesvirus
tggcgtgcgtgtgtgtctgttttt

SEQ ID NO: 74902 - DNA, 19 bp, Homo sapiens
tggtgtgtgtgtgtggtgt

SEQ ID NO: 74903 - DNA, 22 bp, Homo sapiens
gtgtgtgtgtttttttgttttt

SEQ ID NO: 74904 - DNA, 18 bp, Homo sapiens
gtgtgtgtgtgtgtgttt

SEQ ID NO: 74905 - DNA, 19 bp, Homo sapiens
gtgtgtgtgtgtttgtttt

SEQ ID NO: 74906 - DNA, 16 bp, Homo sapiens
gtgtgtgtgtgtgttc

SEQ ID NO: 74907 - DNA, 19 bp, Homo sapiens
tgagtgtgtgtgtgtgtgt

SEQ ID NO: 74908 - DNA, 19 bp, Homo sapiens
gcgtgtgtgtgtgttccat

SEQ ID NO: 74909 - DNA, 19 bp, Homo sapiens
gtgtgtgtgtgtgtgtccc

SEQ ID NO: 74910 - DNA, 21 bp, Homo sapiens
tgagtgtgtgtgtgtgttttc

SEQ ID NO: 74911 - DNA, 19 bp, Homo sapiens
gtggtgtgtgttttgtttt

SEQ ID NO: 74912 - DNA, 19 bp, Homo sapiens
gtgtgtgtgtgtgtgtttt

SEQ ID NO: 74913 - DNA, 20 bp, Homo sapiens
gcgtgtgtgtgtgtgtgttt

SEQ ID NO: 74914 - DNA, 20 bp, Homo sapiens
gtgtgtgtgtgtgtgctttt

SEQ ID NO: 74915 - DNA, 20 bp, Homo sapiens
gtgtgtgtgtgtgtattttt

SEQ ID NO: 74916 - DNA, 21 bp, Homo sapiens
gtgtgtgtgtgttttgttttt

SEQ ID NO: 74917 - DNA, 18 bp, Homo sapiens
tggtgtgtgtgtgtgtct

SEQ ID NO: 74918 - DNA, 20 bp, Homo sapiens
gtgtgtgtgtgtgtgttttt

SEQ ID NO: 74919 - DNA, 20 bp, Homo sapiens
cgtgtgtgtgtgtgtagctt

SEQ ID NO: 74920 - DNA, 20 bp, Homo sapiens
ggtgtgtgtgtgtgtgtgtt

SEQ ID NO: 74921 - DNA, 20 bp, Homo sapiens
agtgtgtgtgtgtgtgtgtt

SEQ ID NO: 74922 - DNA, 17 bp, Homo sapiens
gtgtgtgtgtgtgttcc

SEQ ID NO: 74923 - DNA, 19 bp, Homo sapiens
gtgtgtgtgtttagttttt

SEQ ID NO: 74924 - DNA, 20 bp, Homo sapiens
taggtgtgtgtgtgtgtgtt

SEQ ID NO: 74925 - DNA, 19 bp, Homo sapiens
gcgtgtgtgtgtgtgtgtt

SEQ ID NO: 74926 - DNA, 17 bp, Homo sapiens
gtgtgtgtgtgtgtttt

SEQ ID NO: 74927 - DNA, 21 bp, Homo sapiens
gtgtgtgttggccttgttttt

SEQ ID NO: 74928 - DNA, 20 bp, Homo sapiens
agtgtgcgtgtgtgtgtgtt

SEQ ID NO: 74929 - DNA, 20 bp, Homo sapiens
gtgtttatgtgtctgttttt

SEQ ID NO: 74930 - DNA, 18 bp, Homo sapiens
gtgtgtgtgtgcacattt

SEQ ID NO: 74931 - DNA, 21 bp, Homo sapiens
gtgtgtgtgtgtgtgttttta

SEQ ID NO: 74932 - DNA, 18 bp, Homo sapiens
gtgtgtgtgtgtgtattt

SEQ ID NO: 74933 - DNA, 84 bp, Soybean mosaic virus
gggagaaccattgtgttgccggagccctttgaagagtgatttcatcacgtctagtggccgaggtgcggcaatgtttgttgtcct

SEQ ID NO: 74934 - DNA, 24 bp, Soybean mosaic virus
tgccggagccctttgaagagtgat

SEQ ID NO: 74935 - DNA, 19 bp, Homo sapiens
tgcggatgctgaagagtga

SEQ ID NO: 74936 - DNA, 19 bp, Homo sapiens
tgctggagctttttaaaaa

SEQ ID NO: 74937 - DNA, 19 bp, Homo sapiens
tgtcagggtcctttgaaga

SEQ ID NO: 74938 - DNA, 20 bp, Homo sapiens
tgctgggggtctttgaaggc

SEQ ID NO: 74939 - DNA, 19 bp, Homo sapiens
tgctggtgtccaagagtga

SEQ ID NO: 74940 - DNA, 17 bp, Homo sapiens
gccggagtgtgagagtg

SEQ ID NO: 74941 - DNA, 19 bp, Homo sapiens
tgctgggcctctttggcag

SEQ ID NO: 74942 - DNA, 70 bp, Tobacco rattle virus
tctgtttctgtgtatagactgtttgagattggcgcttggccgactcattgtcttaccataggggaacgga

SEQ ID NO: 74943 - DNA, 24 bp, Tobacco rattle virus
tgtatagactgtttgagattggcg

SEQ ID NO: 74944 - DNA, 21 bp, Homo sapiens
tgcatgcctttgggattggcg

SEQ ID NO: 74945 - DNA, 18 bp, Homo sapiens
tgtaagggccagattggc

SEQ ID NO: 74946 - DNA, 16 bp, Homo sapiens
taggctgtttgaagca

SEQ ID NO: 74947 - DNA, 86 bp, Tobacco rattle virus
tttatttgtattttattaaaattctcaatgatctgaaaaggcctcgaggctaagagattattggggggtgagtaagtacttttaaa

SEQ ID NO: 74948 - DNA, 24 bp, Tobacco rattle virus
tcaatgatctgaaaaggcctcgag

SEQ ID NO: 74949 - DNA, 17 bp, Homo sapiens
tcaatgtctgaaaaggc

SEQ ID NO: 74950 - DNA, 21 bp, Homo sapiens
tcaatgatcttgaaatacagg

SEQ ID NO: 74951 - DNA, 18 bp, Homo sapiens
gatctgaagagaatcgag

SEQ ID NO: 74952 - DNA, 19 bp, Homo sapiens
ccaacaggaaaaggcttcg

SEQ ID NO: 74953 - DNA, 22 bp, Homo sapiens
tcaatgatttgaaatctctgag

SEQ ID NO: 74954 - DNA, 22 bp, Homo sapiens
tgaggtcagaagaggcctcgag

SEQ ID NO: 74955 - DNA, 25 bp, Homo sapiens
tcaatgatcagaagtccaccttgag

SEQ ID NO: 74956 - DNA, 21 bp, Homo sapiens
tcaatgactgggaggaaaagg

SEQ ID NO: 74957 - DNA, 20 bp, Homo sapiens
aatgatctaaaggtaacacg

SEQ ID NO: 74958 - DNA, 22 bp, Homo sapiens
tgaagtcagaagaggcctcgag

SEQ ID NO: 74959 - DNA, 23 bp, Homo sapiens
tcagtagtctgaaaaagaacgag

SEQ ID NO: 74960 - DNA, 121 bp, Melanoplus sanguinipes entomopoxvirus
aattttatttataggttctaattctaaaaatattataaatgtatcgatcattataaatattgttataataattgctattaatttactaaaaatgagagttaaccctataatatcaaaaatt

SEQ ID NO: 74961 - DNA, 24 bp, Melanoplus sanguinipes entomopoxvirus
taggttctaattctaaaaatatta

SEQ ID NO: 74962 - DNA, 23 bp, Homo sapiens
taagttctagtaccataaatatt

SEQ ID NO: 74963 - DNA, 82 bp, Avian paramyxovirus 6
gatcacaacaattagtacagatggcctcccaatatcacatcgtgattctattgtcaaatcatagcattcttttctcctgatc

SEQ ID NO: 74964 - DNA, 21 bp, Avian paramyxovirus 6
tagcattcttttctcctgatc

SEQ ID NO: 74965 - DNA, 17 bp, Homo sapiens
tagctttgtctcctgat

SEQ ID NO: 74966 - DNA, 16 bp, Homo sapiens
gcattcttctctgatc

SEQ ID NO: 74967 - DNA, 18 bp, Homo sapiens
cagcatctttctcctgat

SEQ ID NO: 74968 - DNA, 18 bp, Homo sapiens
taactgccttttctcctg

SEQ ID NO: 74969 - DNA, 23 bp, Homo sapiens
tagtatttttttccccaactgat

SEQ ID NO: 74970 - DNA, 18 bp, Homo sapiens
tagagcttttctcttgat

SEQ ID NO: 74971 - DNA, 18 bp, Homo sapiens
cagctcctttcttctgat

SEQ ID NO: 74972 - DNA, 18 bp, Homo sapiens
agtcacatttttctcctg

SEQ ID NO: 74973 - DNA, 16 bp, Homo sapiens
tagatcccttttcctg

SEQ ID NO: 74974 - DNA, 19 bp, Homo sapiens
tagtgttctttctccaaat

SEQ ID NO: 74975 - DNA, 22 bp, Homo sapiens
taacattcttttttaactgatc

SEQ ID NO: 74976 - DNA, 19 bp, Homo sapiens
cagcatacttctcctgatc

SEQ ID NO: 74977 - DNA, 21 bp, Homo sapiens
gcattcttttgagtttctgat

SEQ ID NO: 74978 - DNA, 17 bp, Homo sapiens
gcagacctctcctgatc

SEQ ID NO: 74979 - DNA, 18 bp, Homo sapiens
acattcttttctagccct

SEQ ID NO: 74980 - DNA, 19 bp, Homo sapiens
gcagaacccttctcctgat

SEQ ID NO: 74981 - DNA, 17 bp, Homo sapiens
acattcccctcctgatc

SEQ ID NO: 74982 - DNA, 22 bp, Homo sapiens
tagcattcatgttcaacctgat

SEQ ID NO: 74983 - DNA, 16 bp, Homo sapiens
cagcattctttctgat

SEQ ID NO: 74984 - DNA, 18 bp, Homo sapiens
gcattctttttccccatc

SEQ ID NO: 74985 - DNA, 21 bp, Homo sapiens
tagcactcaaacttcctgatc

SEQ ID NO: 74986 - DNA, 18 bp, Homo sapiens
attcctccttctcttgat

SEQ ID NO: 74987 - DNA, 22 bp, Homo sapiens
tagctttcttttctgggggatc

SEQ ID NO: 74988 - DNA, 19 bp, Homo sapiens
taacattttattcctgatc

SEQ ID NO: 74989 - DNA, 15 bp, Homo sapiens
gcttcttctcctgat

SEQ ID NO: 74990 - DNA, 16 bp, Homo sapiens
taacagtcttttcctg

SEQ ID NO: 74991 - DNA, 20 bp, Homo sapiens
tagcattccactcattcctg

SEQ ID NO: 74992 - DNA, 17 bp, Homo sapiens
taacctcgtttctcctg

SEQ ID NO: 74993 - DNA, 17 bp, Homo sapiens
cattccccaccctgatc

SEQ ID NO: 74994 - DNA, 17 bp, Homo sapiens
gctattctgccctgatc

SEQ ID NO: 74995 - DNA, 16 bp, Homo sapiens
gcattctctgcttgat

SEQ ID NO: 74996 - DNA, 19 bp, Homo sapiens
gcctcaattttctcctgat

SEQ ID NO: 74997 - DNA, 19 bp, Homo sapiens
cagcattcttttcaggcct

SEQ ID NO: 74998 - DNA, 20 bp, Homo sapiens
tagtattttttccccatgat

SEQ ID NO: 74999 - DNA, 19 bp, Homo sapiens
tagcctcagacttctgatc

SEQ ID NO: 75000 - DNA, 20 bp, Homo sapiens
tagcaatcctcttcctgatc

SEQ ID NO: 75001 - DNA, 21 bp, Homo sapiens
acattcatggtttctcttgat

SEQ ID NO: 75002 - DNA, 73 bp, Avian paramyxovirus 6
gggggaactggtggtgtccggactgggcaatccagggtcacccggtccgaatcaaacacccgccagttcctcc

SEQ ID NO: 75003 - DNA, 24 bp, Avian paramyxovirus 6
cacccggtccgaatcaaacacccg

SEQ ID NO: 75004 - DNA, 17 bp, Homo sapiens
cacccagctcagacacc

SEQ ID NO: 75005 - DNA, 20 bp, Homo sapiens
cccggcccggctcccacccg

SEQ ID NO: 75006 - DNA, 25 bp, Homo sapiens
cacccggtccgggaagcgacgcccg

SEQ ID NO: 75007 - DNA, 24 bp, Homo sapiens
cacccggcgccgcgcaggtgcccg

SEQ ID NO: 75008 - DNA, 19 bp, Homo sapiens
cccggtccagcataacccg

SEQ ID NO: 75009 - DNA, 20 bp, Homo sapiens
cgttctgaaccaaatgtccg

SEQ ID NO: 75010 - DNA, 24 bp, Homo sapiens
cacccgggcccccaaaaacacccg

SEQ ID NO: 75011 - DNA, 18 bp, Homo sapiens
cacccggtcgaatggccc

SEQ ID NO: 75012 - DNA, 18 bp, Homo sapiens
cccggtccgggaacgccc

SEQ ID NO: 75013 - DNA, 19 bp, Homo sapiens
cccagtccgaattgactcc

SEQ ID NO: 75014 - DNA, 78 bp, Chimpanzee cytomegalovirus
ccccaaagaataaaacaccgtcaacgggtcttttgtacaaaaaaatcagagagcctgttgtctcttttttattcgggg

SEQ ID NO: 75015 - DNA, 24 bp, Chimpanzee cytomegalovirus
taaaacaccgtcaacgggtctttt

SEQ ID NO: 75016 - DNA, 19 bp, Homo sapiens
taaaatgcctcaacagagt

SEQ ID NO: 75017 - DNA, 18 bp, Homo sapiens
acacagtgtgggtctttt

SEQ ID NO: 75018 - DNA, 20 bp, Homo sapiens
taaaacactggtcaaaatgt

SEQ ID NO: 75019 - DNA, 26 bp, Homo sapiens
taaaacactgtttttatttgtctttt

SEQ ID NO: 75020 - DNA, 23 bp, Homo sapiens
caaaatacagtggtgggtctttt

SEQ ID NO: 75021 - DNA, 21 bp, Homo sapiens
taaaacaccgttagcatccgg

SEQ ID NO: 75022 - DNA, 20 bp, Homo sapiens
taaaacaccatcagacaggt

SEQ ID NO: 75023 - DNA, 17 bp, Homo sapiens
aaacactgtcagtcttt

SEQ ID NO: 75024 - DNA, 92 bp, Cowpea severe mosaic virus
tcctctcttacttttctttatttctctttaaaactctcttctttctgattatcagattccaacaatctcaggcttaacagagatactgggga

SEQ ID NO: 75025 - DNA, 24 bp, Cowpea severe mosaic virus
tcttacttttctttatttctcttt

SEQ ID NO: 75026 - DNA, 16 bp, Homo sapiens
ttttcttcttctcttt

SEQ ID NO: 75027 - DNA, 21 bp, Homo sapiens
tctcatttcccatttctcttt

SEQ ID NO: 75028 - DNA, 18 bp, Homo sapiens
ttttctctctctctcttt

SEQ ID NO: 75029 - DNA, 21 bp, Homo sapiens
tcttactttccttgccccttt

SEQ ID NO: 75030 - DNA, 18 bp, Homo sapiens
tctcagacatttctcttt

SEQ ID NO: 75031 - DNA, 22 bp, Homo sapiens
tctttttttttcttttctcttt

SEQ ID NO: 75032 - DNA, 21 bp, Homo sapiens
tctatttttctttttctcttt

SEQ ID NO: 75033 - DNA, 24 bp, Homo sapiens
tcttacttttctttctttttcttt

SEQ ID NO: 75034 - DNA, 16 bp, Homo sapiens
ttacttttcttccctt

SEQ ID NO: 75035 - DNA, 20 bp, Homo sapiens
tcttctttttctcctcttct

SEQ ID NO: 75036 - DNA, 18 bp, Homo sapiens
ttttgtttatttctcttt

SEQ ID NO: 75037 - DNA, 21 bp, Homo sapiens
tcttttttcccttttctcttt

SEQ ID NO: 75038 - DNA, 22 bp, Homo sapiens
tcttgctttctcttttctcttt

SEQ ID NO: 75039 - DNA, 16 bp, Homo sapiens
ttttctctctctcttt

SEQ ID NO: 75040 - DNA, 21 bp, Homo sapiens
tcttccttttctgtcttttct

SEQ ID NO: 75041 - DNA, 16 bp, Homo sapiens
tctcactttttttctc

SEQ ID NO: 75042 - DNA, 15 bp, Homo sapiens
cttttcttttctctt

SEQ ID NO: 75043 - DNA, 17 bp, Homo sapiens
ttttctttttcctcttc

SEQ ID NO: 75044 - DNA, 26 bp, Homo sapiens
tcttttcttttcttaatttttcttta

SEQ ID NO: 75045 - DNA, 26 bp, Homo sapiens
tcttgtttttttcttcaagcctcttt

SEQ ID NO: 75046 - DNA, 17 bp, Homo sapiens
cttcttttacttctctt

SEQ ID NO: 75047 - DNA, 20 bp, Homo sapiens
tcttgattttctttctcttc

SEQ ID NO: 75048 - DNA, 19 bp, Homo sapiens
tctctacttttctttttct

SEQ ID NO: 75049 - DNA, 16 bp, Homo sapiens
ttacttttcttcttct

SEQ ID NO: 75050 - DNA, 18 bp, Homo sapiens
ttttcttttctctctctt

SEQ ID NO: 75051 - DNA, 16 bp, Homo sapiens
ttacttttcttttcct

SEQ ID NO: 75052 - DNA, 18 bp, Homo sapiens
tcacttttttccatttct

SEQ ID NO: 75053 - DNA, 19 bp, Homo sapiens
tcttactgtttctacttct

SEQ ID NO: 75054 - DNA, 21 bp, Homo sapiens
tctaattttctgtttctcttt

SEQ ID NO: 75055 - DNA, 21 bp, Homo sapiens
tcctgtttttctcccctcttt

SEQ ID NO: 75056 - DNA, 18 bp, Homo sapiens
ctttttttcttttctctt

SEQ ID NO: 75057 - DNA, 22 bp, Homo sapiens
tctttcttttctttctctcttt

SEQ ID NO: 75058 - DNA, 18 bp, Homo sapiens
tcttccttttctatttct

SEQ ID NO: 75059 - DNA, 20 bp, Homo sapiens
tcttacttttcttctatctc

SEQ ID NO: 75060 - DNA, 17 bp, Homo sapiens
ctttcttctttctcttt

SEQ ID NO: 75061 - DNA, 20 bp, Homo sapiens
tctttccctactttatttct

SEQ ID NO: 75062 - DNA, 18 bp, Homo sapiens
tctttcttttctttttct

SEQ ID NO: 75063 - DNA, 22 bp, Homo sapiens
tcttgtctttctcgctctcttt

SEQ ID NO: 75064 - DNA, 18 bp, Homo sapiens
ttttcttttctttctctt

SEQ ID NO: 75065 - DNA, 18 bp, Homo sapiens
cttttcttttttctcttt

SEQ ID NO: 75066 - DNA, 23 bp, Homo sapiens
tcttacttcttgaccatctcttt

SEQ ID NO: 75067 - DNA, 19 bp, Homo sapiens
ttttcttttttttctcctt

SEQ ID NO: 75068 - DNA, 26 bp, Homo sapiens
ttacttttttctattatactctcttt

SEQ ID NO: 75069 - DNA, 23 bp, Homo sapiens
tctttcttttctttttcttcttt

SEQ ID NO: 75070 - DNA, 18 bp, Homo sapiens
tcttctttttcttcatcc

SEQ ID NO: 75071 - DNA, 22 bp, Homo sapiens
tcttgcttttcactgtctcttt

SEQ ID NO: 75072 - DNA, 21 bp, Homo sapiens
ttactgttcctgcttctcttt

SEQ ID NO: 75073 - DNA, 21 bp, Homo sapiens
tcttttcttttctttgtttct

SEQ ID NO: 75074 - DNA, 62 bp, Infectious spleen and kidney necrosis virus
cgtgccaaagccccgccgcaacgtctcgagctgcgccatcgagggatggggactgcggcgcg

SEQ ID NO: 75075 - DNA, 21 bp, Infectious spleen and kidney necrosis virus
agggatggggactgcggcgcg

SEQ ID NO: 75076 - DNA, 18 bp, Homo sapiens
aggggctggggacttgcg

SEQ ID NO: 75077 - DNA, 19 bp, Homo sapiens
aggaggaggttgcggcgcg

SEQ ID NO: 75078 - DNA, 21 bp, Homo sapiens
agggtgggtggctgcggcgcg

SEQ ID NO: 75079 - DNA, 18 bp, Homo sapiens
ggggtgggggtgcaggcg

SEQ ID NO: 75080 - DNA, 20 bp, Homo sapiens
aggggtgagagggcggcgcg

SEQ ID NO: 75081 - DNA, 16 bp, Homo sapiens
ggaatggggagacccg

SEQ ID NO: 75082 - DNA, 18 bp, Homo sapiens
gggatggggtctggaccg

SEQ ID NO: 75083 - DNA, 18 bp, Homo sapiens
agggacggctgcccggcg

SEQ ID NO: 75084 - DNA, 18 bp, Homo sapiens
gggggcggcggcggcgcg

SEQ ID NO: 75085 - DNA, 16 bp, Homo sapiens
agggatgagggcagac

SEQ ID NO: 75086 - DNA, 21 bp, Homo sapiens
agagacaaaagggctgtggcg

SEQ ID NO: 75087 - DNA, 17 bp, Homo sapiens
agggcgtggggtgcgcg

SEQ ID NO: 75088 - DNA, 17 bp, Homo sapiens
agggatggggctgggcg

SEQ ID NO: 75089 - DNA, 19 bp, Homo sapiens
gggtgaagagtgcggcgcg

SEQ ID NO: 75090 - DNA, 17 bp, Homo sapiens
gggatggggactaagcg

SEQ ID NO: 75091 - DNA, 22 bp, Homo sapiens
agagatgggggaaggcggcgcg

SEQ ID NO: 75092 - DNA, 19 bp, Homo sapiens
gggtcgggaacgcagcgcg

SEQ ID NO: 75093 - DNA, 19 bp, Homo sapiens
agggatgggggccggggcg

SEQ ID NO: 75094 - DNA, 19 bp, Homo sapiens
aggggaggcgggcggcgcg

SEQ ID NO: 75095 - DNA, 19 bp, Homo sapiens
agggctggggacgccggcg

SEQ ID NO: 75096 - DNA, 16 bp, Homo sapiens
gggatgcagcggcgcg

SEQ ID NO: 75097 - DNA, 19 bp, Homo sapiens
ggagggtggcggcggcgcg

SEQ ID NO: 75098 - DNA, 15 bp, Homo sapiens
gggagggggcagcgc

SEQ ID NO: 75099 - DNA, 19 bp, Homo sapiens
gagatgggcgacaggcgcg

SEQ ID NO: 75100 - DNA, 16 bp, Homo sapiens
gggaggggaccgtgcg

SEQ ID NO: 75101 - DNA, 20 bp, Homo sapiens
gggctgggggctgtttcacg

SEQ ID NO: 75102 - DNA, 19 bp, Homo sapiens
agggataggggctgcaccg

SEQ ID NO: 75103 - DNA, 18 bp, Homo sapiens
agggatggaggctgtcaa

SEQ ID NO: 75104 - DNA, 20 bp, Homo sapiens
aaggatggggaggctgtgcg

SEQ ID NO: 75105 - DNA, 16 bp, Homo sapiens
agggttggggatgaac

SEQ ID NO: 75106 - DNA, 18 bp, Homo sapiens
gggagggggagccccgcg

SEQ ID NO: 75107 - DNA, 16 bp, Homo sapiens
aggggtgggggcagca

SEQ ID NO: 75108 - DNA, 18 bp, Homo sapiens
agggatggggacttacaa

SEQ ID NO: 75109 - DNA, 17 bp, Homo sapiens
ggggcgggcgcggcgcg

SEQ ID NO: 75110 - DNA, 17 bp, Homo sapiens
gggctgagcgcggcgcg

SEQ ID NO: 75111 - DNA, 20 bp, Homo sapiens
ggggtggcgggcggcaggcg

SEQ ID NO: 75112 - DNA, 18 bp, Homo sapiens
agggagggggctgcgggc

SEQ ID NO: 75113 - DNA, 17 bp, Homo sapiens
aggatgggggctcaccg

SEQ ID NO: 75114 - DNA, 18 bp, Homo sapiens
ggaatgggggctgtggca

SEQ ID NO: 75115 - DNA, 17 bp, Homo sapiens
ggggtgggggcgaggcg

SEQ ID NO: 75116 - DNA, 16 bp, Homo sapiens
agggatgggaggcaca

SEQ ID NO: 75117 - DNA, 19 bp, Homo sapiens
ggcgatgggggctgcagcg

SEQ ID NO: 75118 - DNA, 16 bp, Homo sapiens
aggggcgggggcaggc

SEQ ID NO: 75119 - DNA, 18 bp, Homo sapiens
agggattggggctctcac

SEQ ID NO: 75120 - DNA, 15 bp, Homo sapiens
gggatgaaggcggcg

SEQ ID NO: 75121 - DNA, 19 bp, Homo sapiens
agggtgggcgcccggtgcg

SEQ ID NO: 75122 - DNA, 19 bp, Homo sapiens
agggacgggggtcgccgcg

SEQ ID NO: 75123 - DNA, 19 bp, Homo sapiens
aggatgggggcaggacgcg

SEQ ID NO: 75124 - DNA, 16 bp, Homo sapiens
agggtgggggctggcg

SEQ ID NO: 75125 - DNA, 18 bp, Homo sapiens
agggagggcggcggcgcg

SEQ ID NO: 75126 - DNA, 21 bp, Homo sapiens
gggacgcccggctgcggcgcg

SEQ ID NO: 75127 - DNA, 18 bp, Homo sapiens
gggatggagtgcggcgcg

SEQ ID NO: 75128 - DNA, 19 bp, Homo sapiens
aagctacggctgtggcgcg

SEQ ID NO: 75129 - DNA, 20 bp, Homo sapiens
aggggtgtgggagcaaggcg

SEQ ID NO: 75130 - DNA, 21 bp, Homo sapiens
agggttggggacttaaagccg

SEQ ID NO: 75131 - DNA, 17 bp, Homo sapiens
gggctgcgggcggcgcg

SEQ ID NO: 75132 - DNA, 20 bp, Homo sapiens
gggagggcccgggcggcgcg

SEQ ID NO: 75133 - DNA, 18 bp, Homo sapiens
agggatggaggcgctgcg

SEQ ID NO: 75134 - DNA, 18 bp, Homo sapiens
gggatggggagcgacgcg

SEQ ID NO: 75135 - DNA, 15 bp, Homo sapiens
gggatgggggcaggc

SEQ ID NO: 75136 - DNA, 22 bp, Homo sapiens
ggggtgggaactgacccctgcg

SEQ ID NO: 75137 - DNA, 19 bp, Homo sapiens
agggctggggactgaccac

SEQ ID NO: 75138 - DNA, 19 bp, Homo sapiens
gggaggggaccagccggcg

SEQ ID NO: 75139 - DNA, 21 bp, Homo sapiens
ggcgtgtggggctgcggcgcg

SEQ ID NO: 75140 - DNA, 17 bp, Homo sapiens
gatggggaggacaggcg

SEQ ID NO: 75141 - DNA, 17 bp, Homo sapiens
agggaggggctggggcg

SEQ ID NO: 75142 - DNA, 17 bp, Homo sapiens
gggctggggacggcgcg

SEQ ID NO: 75143 - DNA, 16 bp, Homo sapiens
gggggcgacgcggcgc

SEQ ID NO: 75144 - DNA, 17 bp, Homo sapiens
aggaagactgcggcgcg

SEQ ID NO: 75145 - DNA, 18 bp, Homo sapiens
gggctggggacttagccg

SEQ ID NO: 75146 - DNA, 18 bp, Homo sapiens
gggatgggggtgggggcg

SEQ ID NO: 75147 - DNA, 17 bp, Homo sapiens
agggcgtgggggcggcg

SEQ ID NO: 75148 - DNA, 20 bp, Homo sapiens
gggcacagagttgcggcgcg

SEQ ID NO: 75149 - DNA, 17 bp, Homo sapiens
ggggtgggggcaatgcg

SEQ ID NO: 75150 - DNA, 15 bp, Homo sapiens
gggacggggagacgc

SEQ ID NO: 75151 - DNA, 20 bp, Homo sapiens
gggatggggtgggatgtgcg

SEQ ID NO: 75152 - DNA, 18 bp, Homo sapiens
gggagggggcgtggcgcg

SEQ ID NO: 75153 - DNA, 16 bp, Homo sapiens
aaggtaagctgcggcg

SEQ ID NO: 75154 - DNA, 20 bp, Homo sapiens
agggatgggcggctgggccg

SEQ ID NO: 75155 - DNA, 16 bp, Homo sapiens
agggtggggaccggcg

SEQ ID NO: 75156 - DNA, 22 bp, Homo sapiens
agcgatggggagctgcttggcg

SEQ ID NO: 75157 - DNA, 16 bp, Homo sapiens
aggaatgggggcagcg

SEQ ID NO: 75158 - DNA, 18 bp, Homo sapiens
agggactggggggctgcg

SEQ ID NO: 75159 - DNA, 17 bp, Homo sapiens
gggatgggcacacggcg

SEQ ID NO: 75160 - DNA, 17 bp, Homo sapiens
gggagggggctgcggca

SEQ ID NO: 75161 - DNA, 19 bp, Homo sapiens
ggatgcggactgcggcgcg

SEQ ID NO: 75162 - DNA, 19 bp, Homo sapiens
agggatgggggatgtacag

SEQ ID NO: 75163 - DNA, 18 bp, Homo sapiens
gggatgaggaccccggcg

SEQ ID NO: 75164 - DNA, 19 bp, Homo sapiens
aggaggtgagggtggcgcg

SEQ ID NO: 75165 - DNA, 18 bp, Homo sapiens
gggatggaggctgccccg

SEQ ID NO: 75166 - DNA, 19 bp, Homo sapiens
gggtgggggctcacacgcg

SEQ ID NO: 75167 - DNA, 21 bp, Homo sapiens
gggcatggggagaaaggggcg

SEQ ID NO: 75168 - DNA, 19 bp, Homo sapiens
gggatgggactgctctgcg

SEQ ID NO: 75169 - DNA, 19 bp, Homo sapiens
ggggcggggaggcagcgcg

SEQ ID NO: 75170 - DNA, 18 bp, Homo sapiens
ggaatggggacagccgcg

SEQ ID NO: 75171 - DNA, 15 bp, Homo sapiens
agggatgaggcggca

SEQ ID NO: 75172 - DNA, 16 bp, Homo sapiens
agggacgggtacggcg

SEQ ID NO: 75173 - DNA, 18 bp, Homo sapiens
aggagatgcggcggcgcg

SEQ ID NO: 75174 - DNA, 17 bp, Homo sapiens
ggtgtggagacggcgcg

SEQ ID NO: 75175 - DNA, 18 bp, Homo sapiens
agggctgggggctgctcg

SEQ ID NO: 75176 - DNA, 19 bp, Homo sapiens
gggacgggggcggccggcg

SEQ ID NO: 75177 - DNA, 21 bp, Homo sapiens
ggggtgggggctggaggtgcg

SEQ ID NO: 75178 - DNA, 18 bp, Homo sapiens
agggatggtggttctgcg

SEQ ID NO: 75179 - DNA, 15 bp, Homo sapiens
gggatggggcggcac

SEQ ID NO: 75180 - DNA, 19 bp, Homo sapiens
agggatgggggctccccac

SEQ ID NO: 75181 - DNA, 19 bp, Homo sapiens
aggatggggtacagtggcg

SEQ ID NO: 75182 - DNA, 17 bp, Homo sapiens
gggatgagggcggagcg

SEQ ID NO: 75183 - DNA, 22 bp, Homo sapiens
agggatggtggttggcagggcg

SEQ ID NO: 75184 - DNA, 17 bp, Homo sapiens
agggcggctgcggcgcg

SEQ ID NO: 75185 - DNA, 22 bp, Homo sapiens
aggatggggatgcagcggcgcg

SEQ ID NO: 75186 - DNA, 18 bp, Homo sapiens
ggagagggctgcggtgcg

SEQ ID NO: 75187 - DNA, 18 bp, Homo sapiens
agggatggcgggctggag

SEQ ID NO: 75188 - DNA, 21 bp, Homo sapiens
aggcatgggagtggcggcgcg

SEQ ID NO: 75189 - DNA, 18 bp, Homo sapiens
ggtgatggggattgtcag

SEQ ID NO: 75190 - DNA, 20 bp, Homo sapiens
agggatggggcctggatgcg

SEQ ID NO: 75191 - DNA, 18 bp, Homo sapiens
gggagggactgcggtgcg

SEQ ID NO: 75192 - DNA, 19 bp, Homo sapiens
gggcgggaattgcggcgcg

SEQ ID NO: 75193 - DNA, 18 bp, Homo sapiens
aaggatggggacatcgcg

SEQ ID NO: 75194 - DNA, 18 bp, Homo sapiens
gggatggagtggggtgcg

SEQ ID NO: 75195 - DNA, 19 bp, Homo sapiens
agggacggggttgagcgcg

SEQ ID NO: 75196 - DNA, 17 bp, Homo sapiens
gggatggggagtggacg

SEQ ID NO: 75197 - DNA, 19 bp, Homo sapiens
ggggcgggggctgggggcg

SEQ ID NO: 75198 - DNA, 20 bp, Homo sapiens
ggaatgggggccggggcgcg

SEQ ID NO: 75199 - DNA, 21 bp, Homo sapiens
gggatggaggccgagggcgcg

SEQ ID NO: 75200 - DNA, 19 bp, Homo sapiens
ggatgacacaggcggcgcg

SEQ ID NO: 75201 - DNA, 21 bp, Homo sapiens
agggactggaaacgtggtgcg

SEQ ID NO: 75202 - DNA, 20 bp, Homo sapiens
ggatggcaacacgtggcgcg

SEQ ID NO: 75203 - DNA, 16 bp, Homo sapiens
agggaggggaccagcg

SEQ ID NO: 75204 - DNA, 15 bp, Homo sapiens
gggatgggggcggcg

SEQ ID NO: 75205 - DNA, 17 bp, Homo sapiens
gggtatggggagcatcg

SEQ ID NO: 75206 - DNA, 21 bp, Homo sapiens
gggatggggagggagggcgcg

SEQ ID NO: 75207 - DNA, 16 bp, Homo sapiens
aggatggggggcggcg

SEQ ID NO: 75208 - DNA, 15 bp, Homo sapiens
agggagggggcagcg

SEQ ID NO: 75209 - DNA, 19 bp, Homo sapiens
aggggtggggggcccagcg

SEQ ID NO: 75210 - DNA, 63 bp, Human papillomavirus type 48
gttgttttgagcaactgttactgaaagagctttgtttattttgtcctgcgtgctccagacaac

SEQ ID NO: 75211 - DNA, 24 bp, Human papillomavirus type 48
tttgtcctgcgtgctccagacaac

SEQ ID NO: 75212 - DNA, 23 bp, Homo sapiens
cttgtcctgcgtggaggaaggca

SEQ ID NO: 75213 - DNA, 18 bp, Homo sapiens
tttgtcctgtgtgcacaa

SEQ ID NO: 75214 - DNA, 20 bp, Homo sapiens
tttgtcccaatttcagacaa

SEQ ID NO: 75215 - DNA, 23 bp, Homo sapiens
tttgtcccgtggatacccaggca

SEQ ID NO: 75216 - DNA, 16 bp, Homo sapiens
tttgcccctccaggca

SEQ ID NO: 75217 - DNA, 22 bp, Homo sapiens
tttgtccctccctttccagaca

SEQ ID NO: 75218 - DNA, 21 bp, Homo sapiens
tttgttctgcatgctgctaac

SEQ ID NO: 75219 - DNA, 16 bp, Homo sapiens
tttgtccttcccaaca

SEQ ID NO: 75220 - DNA, 20 bp, Homo sapiens
tttattttgcgtgcctgcag

SEQ ID NO: 75221 - DNA, 20 bp, Homo sapiens
tgtttctgacttcagacaac

SEQ ID NO: 75222 - DNA, 19 bp, Homo sapiens
tttgtcctctgtgctttcc

SEQ ID NO: 75223 - DNA, 17 bp, Homo sapiens
tttgtcctggtgtccag

SEQ ID NO: 75224 - DNA, 22 bp, Homo sapiens
tttgctcttgccaaccagacaa

SEQ ID NO: 75225 - DNA, 17 bp, Homo sapiens
tttgtgcctgccccaga

SEQ ID NO: 75226 - DNA, 20 bp, Homo sapiens
tctgtcctgcgtgctcccac

SEQ ID NO: 75227 - DNA, 20 bp, Homo sapiens
tctttcctctttccagacaa

SEQ ID NO: 75228 - DNA, 21 bp, Homo sapiens
tttgtcctgtgtgcctttgac

SEQ ID NO: 75229 - DNA, 22 bp, Homo sapiens
tttgtcctcgtgcttcaggcca

SEQ ID NO: 75230 - DNA, 23 bp, Homo sapiens
cttgtcctgccagtatctagaca

SEQ ID NO: 75231 - DNA, 16 bp, Homo sapiens
ttgtcccctccagaca

SEQ ID NO: 75232 - DNA, 25 bp, Homo sapiens
tttgtcctgtcgtgctcttttggac

SEQ ID NO: 75233 - DNA, 70 bp, Murine hepatitis virus
tgtaatactttggtgctgtccccttctatttatttgtatgataggagtaagcagctttataagtattata

SEQ ID NO: 75234 - DNA, 24 bp, Murine hepatitis virus
actttggtgctgtccccttctatt

SEQ ID NO: 75235 - DNA, 19 bp, Homo sapiens
actttgtgctgtcttccat

SEQ ID NO: 75236 - DNA, 16 bp, Homo sapiens
ctttggttactccctt

SEQ ID NO: 75237 - DNA, 17 bp, Homo sapiens
tttggtacaacttctat

SEQ ID NO: 75238 - DNA, 18 bp, Homo sapiens
actttgctacccccttct

SEQ ID NO: 75239 - DNA, 17 bp, Homo sapiens
actttgtgctgtcttct

SEQ ID NO: 75240 - DNA, 17 bp, Homo sapiens
accttggcaccgtttct

SEQ ID NO: 75241 - DNA, 19 bp, Homo sapiens
ctttggtgtctaattttct

SEQ ID NO: 75242 - DNA, 21 bp, Homo sapiens
ttcggtgctgatacttctatt

SEQ ID NO: 75243 - DNA, 16 bp, Homo sapiens
cttggtgctgttctct

SEQ ID NO: 75244 - DNA, 24 bp, Homo sapiens
acctttttctggtttccttctatt

SEQ ID NO: 75245 - DNA, 18 bp, Homo sapiens
ctttggtgcctgtccacc

SEQ ID NO: 75246 - DNA, 18 bp, Homo sapiens
tttggtactgtcagttct

SEQ ID NO: 75247 - DNA, 16 bp, Homo sapiens
cttggtgctgtccttc

SEQ ID NO: 75248 - DNA, 75 bp, Yaba-like disease virus
taacataatgtaaacaattatataaatttaaagtttttaaaacttttgtgcaataattgtttaaaatatatgtta

SEQ ID NO: 75249 - DNA, 24 bp, Yaba-like disease virus
tgtaaacaattatataaatttaaa

SEQ ID NO: 75250 - DNA, 22 bp, Homo sapiens
tgtaacaatacacaaatttaaa

SEQ ID NO: 75251 - DNA, 17 bp, Homo sapiens
tgtaaacaattaataaa

SEQ ID NO: 75252 - DNA, 24 bp, Homo sapiens
tgtaaacaatacataaaatttaaa

SEQ ID NO: 75253 - DNA, 20 bp, Homo sapiens
tgtaaacaataatatacaaa

SEQ ID NO: 75254 - DNA, 17 bp, Homo sapiens
tgtaaacattatataaa

SEQ ID NO: 75255 - DNA, 18 bp, Homo sapiens
tgcaaacgattatataaa

SEQ ID NO: 75256 - DNA, 18 bp, Homo sapiens
tgtaaacaatatatacaa

SEQ ID NO: 75257 - DNA, 20 bp, Homo sapiens
taaacaattatatacactaa

SEQ ID NO: 75258 - DNA, 124 bp, Human papillomavirus type 60
ttgttagttgtttttaatgataccacacaacgagatgtttttatgaaattagtaactttgccaagaggttgtacatatacatttggaacattaaactctttgtaatatttgtaaaacaaaacaa

SEQ ID NO: 75259 - DNA, 24 bp, Human papillomavirus type 60
tgtacatatacatttggaacatta

SEQ ID NO: 75260 - DNA, 23 bp, Homo sapiens
tgtaatatatgtttgaaacatta

SEQ ID NO: 75261 - DNA, 20 bp, Homo sapiens
tacatatacaagaaggcatt

SEQ ID NO: 75262 - DNA, 18 bp, Homo sapiens
tgtccatatacacacatt

SEQ ID NO: 75263 - DNA, 18 bp, Homo sapiens
tgtgcatacacacaagaa

SEQ ID NO: 75264 - DNA, 19 bp, Homo sapiens
tgtacatacatggcatatt

SEQ ID NO: 75265 - DNA, 18 bp, Homo sapiens
tgtacatatactttctga

SEQ ID NO: 75266 - DNA, 26 bp, Homo sapiens
tgtaatatacatttaatagcacatta

SEQ ID NO: 75267 - DNA, 18 bp, Homo sapiens
tgcacatatacacatttg

SEQ ID NO: 75268 - DNA, 21 bp, Homo sapiens
gtgcatatacattttttcatt

SEQ ID NO: 75269 - DNA, 19 bp, Homo sapiens
tgtacatattcagaaaaca

SEQ ID NO: 75270 - DNA, 23 bp, Homo sapiens
tgtatctatagaatggaacatta

SEQ ID NO: 75271 - DNA, 18 bp, Homo sapiens
tgtcacatagatttggaa

SEQ ID NO: 75272 - DNA, 23 bp, Homo sapiens
catatacattaggttgaacatta

SEQ ID NO: 75273 - DNA, 98 bp, Human papillomavirus type 60
gtctagcaaactcccttaaatgttggagatatcgattgaaaaagtatacacgttattttaaatgtatgagtacagtatttagatgggtagacatagac

SEQ ID NO: 75274 - DNA, 24 bp, Human papillomavirus type 60
tacagtatttagatgggtagacat

SEQ ID NO: 75275 - DNA, 23 bp, Homo sapiens
agtatttatatacttatagacat

SEQ ID NO: 75276 - DNA, 19 bp, Homo sapiens
cagtatttggaacaaggta

SEQ ID NO: 75277 - DNA, 16 bp, Homo sapiens
tgagtatttgggtaaa

SEQ ID NO: 75278 - DNA, 19 bp, Homo sapiens
tacagtatttgaatgagac

SEQ ID NO: 75279 - DNA, 19 bp, Homo sapiens
tacagtgtttcaggggtga

SEQ ID NO: 75280 - DNA, 23 bp, Homo sapiens
gcaactgggagatgggtagacat

SEQ ID NO: 75281 - DNA, 21 bp, Homo sapiens
cagatttagaaaagcagacat

SEQ ID NO: 75282 - DNA, 17 bp, Homo sapiens
acagtattttgtaggta

SEQ ID NO: 75283 - DNA, 19 bp, Homo sapiens
tacagtctttcagtaggca

SEQ ID NO: 75284 - DNA, 17 bp, Homo sapiens
cagtatttaatggcaaa

SEQ ID NO: 75285 - DNA, 17 bp, Homo sapiens
cagtatttagtggcaaa

SEQ ID NO: 75286 - DNA, 64 bp, Human herpesvirus 1
gagcctccgttgggttttctttgtgcctgtactcaaaaggtcataccccgtaaacggcgggctc

SEQ ID NO: 75287 - DNA, 21 bp, Human herpesvirus 1
taccccgtaaacggcgggctc

SEQ ID NO: 75288 - DNA, 16 bp, Homo sapiens
cccgtccggcgggctc

SEQ ID NO: 75289 - DNA, 20 bp, Homo sapiens
cccctgcagacggcgggctc

SEQ ID NO: 75290 - DNA, 16 bp, Homo sapiens
cctccgcggcgggctc

SEQ ID NO: 75291 - DNA, 17 bp, Homo sapiens
cctccgcaggcgggctc

SEQ ID NO: 75292 - DNA, 20 bp, Homo sapiens
cactccacggcggcgggctc

SEQ ID NO: 75293 - DNA, 20 bp, Homo sapiens
tactccgtgacagcaagttc

SEQ ID NO: 75294 - DNA, 20 bp, Homo sapiens
cccataaatatatcaggctc

SEQ ID NO: 75295 - DNA, 18 bp, Homo sapiens
taccccgcaagtggactc

SEQ ID NO: 75296 - DNA, 19 bp, Homo sapiens
ccagcagggcggcgggctc

SEQ ID NO: 75297 - DNA, 21 bp, Homo sapiens
caccccgtgggcatcagggct

SEQ ID NO: 75298 - DNA, 18 bp, Homo sapiens
taccagcgcggcgggctc

SEQ ID NO: 75299 - DNA, 20 bp, Homo sapiens
cctccgccccgggcgggctc

SEQ ID NO: 75300 - DNA, 20 bp, Homo sapiens
taccctttagacacaagctc

SEQ ID NO: 75301 - DNA, 22 bp, Homo sapiens
caccccgtgggtgaactggctc

SEQ ID NO: 75302 - DNA, 21 bp, Homo sapiens
accccgcactctggcgggctc

SEQ ID NO: 75303 - DNA, 19 bp, Homo sapiens
cccaacaggcggcgggctc

SEQ ID NO: 75304 - DNA, 15 bp, Homo sapiens
taccccgtaggcact

SEQ ID NO: 75305 - DNA, 20 bp, Homo sapiens
tacccagtaaacaataactc

SEQ ID NO: 75306 - DNA, 17 bp, Homo sapiens
tacgcccgtggcaggct

SEQ ID NO: 75307 - DNA, 18 bp, Homo sapiens
caccccagcggcgggctc

SEQ ID NO: 75308 - DNA, 18 bp, Homo sapiens
taccccgctaggcacgcc

SEQ ID NO: 75309 - DNA, 63 bp, Cowpea mottle virus
acttctggccctccatggggtgcgcgtccgcaactttgcgcagtaccacggacatccagaagt

SEQ ID NO: 75310 - DNA, 23 bp, Cowpea mottle virus
cagtaccacggacatccagaagt

SEQ ID NO: 75311 - DNA, 17 bp, Homo sapiens
cagtaccaggacatcca

SEQ ID NO: 75312 - DNA, 22 bp, Homo sapiens
cagtggatgggcatccagaagt

SEQ ID NO: 75313 - DNA, 20 bp, Homo sapiens
cagttctgcaggccagaagt

SEQ ID NO: 75314 - DNA, 20 bp, Homo sapiens
agaccacttaccccagaagt

SEQ ID NO: 75315 - DNA, 16 bp, Homo sapiens
agtatcacaccagaag

SEQ ID NO: 75316 - DNA, 21 bp, Homo sapiens
agtagtcacagtgccagaagt

SEQ ID NO: 75317 - DNA, 19 bp, Homo sapiens
aggtccaacatccaggagt

SEQ ID NO: 75318 - DNA, 17 bp, Homo sapiens
cagtccatttccagaag

SEQ ID NO: 75319 - DNA, 23 bp, Homo sapiens
cagggtcatggacacccggaagt

SEQ ID NO: 75320 - DNA, 21 bp, Homo sapiens
cagtaccctgaacccagaagt

SEQ ID NO: 75321 - DNA, 18 bp, Homo sapiens
gtgccagggtccagaagt

SEQ ID NO: 75322 - DNA, 19 bp, Homo sapiens
agtatagttatccagaagt

SEQ ID NO: 75323 - DNA, 17 bp, Homo sapiens
gctccaaatccagaagt

SEQ ID NO: 75324 - DNA, 18 bp, Homo sapiens
cagtttgacctccagaag

SEQ ID NO: 75325 - DNA, 19 bp, Homo sapiens
cagtaccatgggtcagccc

SEQ ID NO: 75326 - DNA, 61 bp, Monkeypox virus
tcataaaaaagctattatcaaatactgtactgaatggattcattcttttctctttttatga

SEQ ID NO: 75327 - DNA, 22 bp, Monkeypox virus
tcattcttttctctttttatga

SEQ ID NO: 75328 - DNA, 18 bp, Homo sapiens
tcatccttttctttttta

SEQ ID NO: 75329 - DNA, 18 bp, Homo sapiens
tcgttcatttctctttcc

SEQ ID NO: 75330 - DNA, 24 bp, Homo sapiens
tcattccttgacatttttttatga

SEQ ID NO: 75331 - DNA, 21 bp, Homo sapiens
atttttttctctctcagctga

SEQ ID NO: 75332 - DNA, 21 bp, Homo sapiens
tcatttttttctctataactg

SEQ ID NO: 75333 - DNA, 19 bp, Homo sapiens
tcagttcttcctttttatg

SEQ ID NO: 75334 - DNA, 17 bp, Homo sapiens
tcattctttcttttttg

SEQ ID NO: 75335 - DNA, 21 bp, Homo sapiens
tcattttcttctctgcccatg

SEQ ID NO: 75336 - DNA, 23 bp, Homo sapiens
tcatttttcttctcagaattatg

SEQ ID NO: 75337 - DNA, 21 bp, Homo sapiens
tcattctattctctttctctg

SEQ ID NO: 75338 - DNA, 21 bp, Homo sapiens
atccttttcttcactctatga

SEQ ID NO: 75339 - DNA, 20 bp, Homo sapiens
ttcttttctttttttaatga

SEQ ID NO: 75340 - DNA, 24 bp, Homo sapiens
tcattttttactcccttcttatga

SEQ ID NO: 75341 - DNA, 18 bp, Homo sapiens
ttcttttctcttttctga

SEQ ID NO: 75342 - DNA, 19 bp, Homo sapiens
cacagcttctctttttgtg

SEQ ID NO: 75343 - DNA, 21 bp, Homo sapiens
tcagtcttgttcctttttatg

SEQ ID NO: 75344 - DNA, 16 bp, Homo sapiens
tcatttttctcttttt

SEQ ID NO: 75345 - DNA, 19 bp, Homo sapiens
cattcttttgtcatttatg

SEQ ID NO: 75346 - DNA, 18 bp, Homo sapiens
tcttcttttctcttttca

SEQ ID NO: 75347 - DNA, 18 bp, Homo sapiens
attccaactctttttatg

SEQ ID NO: 75348 - DNA, 16 bp, Homo sapiens
tcctttccttttatga

SEQ ID NO: 75349 - DNA, 17 bp, Homo sapiens
tcattcttcttttaatg

SEQ ID NO: 75350 - DNA, 24 bp, Homo sapiens
tcattcttttcattaccatttatg

SEQ ID NO: 75351 - DNA, 18 bp, Homo sapiens
tcattccttttcttttta

SEQ ID NO: 75352 - DNA, 19 bp, Homo sapiens
tcattccttttctttcatg

SEQ ID NO: 75353 - DNA, 20 bp, Homo sapiens
tcttttctttttttttatga

SEQ ID NO: 75354 - DNA, 17 bp, Homo sapiens
tcattcttcttcttgtg

SEQ ID NO: 75355 - DNA, 17 bp, Homo sapiens
ttcttttctattttatg

SEQ ID NO: 75356 - DNA, 20 bp, Homo sapiens
tcattctttttcttttctga

SEQ ID NO: 75357 - DNA, 25 bp, Homo sapiens
tcattcctttttttaccacttatga

SEQ ID NO: 75358 - DNA, 23 bp, Homo sapiens
cattctttttcttcattttatga

SEQ ID NO: 75359 - DNA, 21 bp, Homo sapiens
ttcttttcttctcaaatatga

SEQ ID NO: 75360 - DNA, 17 bp, Homo sapiens
tcattccttttcttctt

SEQ ID NO: 75361 - DNA, 18 bp, Homo sapiens
tcttcttttctccagctg

SEQ ID NO: 75362 - DNA, 18 bp, Homo sapiens
tcattcttttttcttttt

SEQ ID NO: 75363 - DNA, 19 bp, Homo sapiens
ttctttccaaattttatga

SEQ ID NO: 75364 - DNA, 20 bp, Homo sapiens
ttcttttctctttaagctga

SEQ ID NO: 75365 - DNA, 17 bp, Homo sapiens
ttctcttccccccatga

SEQ ID NO: 75366 - DNA, 19 bp, Homo sapiens
attcttttctctaaaatga

SEQ ID NO: 75367 - DNA, 17 bp, Homo sapiens
tcattttttctctcttc

SEQ ID NO: 75368 - DNA, 19 bp, Homo sapiens
ctctccctctctttttgtg

SEQ ID NO: 75369 - DNA, 21 bp, Homo sapiens
tccgttttcacctttttatga

SEQ ID NO: 75370 - DNA, 21 bp, Homo sapiens
tcgatcttttctcagaacatg

SEQ ID NO: 75371 - DNA, 62 bp, Sonchus yellow net virus
atgttgtagtgtgatggttgtggtgtgatataagaaaaaccaacttaaaataataataatat

SEQ ID NO: 75372 - DNA, 18 bp, Sonchus yellow net virus
ttaaaataataataatat

SEQ ID NO: 75373 - DNA, 18 bp, Homo sapiens
ttaaaataataataacat

SEQ ID NO: 75374 - DNA, 129 bp, White clover mosaic virus
atacttgcattaggattagtacttctcgcctttgttctcatttctgaccattccccaaaagttggtgatcatttacacaatctcccattcggaggtgaatacaaagacggcactaaatctatcaagtat

SEQ ID NO: 75375 - DNA, 24 bp, White clover mosaic virus
gcctttgttctcatttctgaccat

SEQ ID NO: 75376 - DNA, 19 bp, Homo sapiens
ctttgctcttgttcttctg

SEQ ID NO: 75377 - DNA, 21 bp, Homo sapiens
gcctttgttttgtttttctaa

SEQ ID NO: 75378 - DNA, 22 bp, Homo sapiens
ctttgtccctgtttctggtcat

SEQ ID NO: 75379 - DNA, 17 bp, Homo sapiens
ccttgtcctttttctga

SEQ ID NO: 75380 - DNA, 18 bp, Homo sapiens
gcttttgtcctcacactg

SEQ ID NO: 75381 - DNA, 18 bp, Homo sapiens
gcctttgctgtttgacca

SEQ ID NO: 75382 - DNA, 19 bp, Homo sapiens
gcctttgttctgatctcca

SEQ ID NO: 75383 - DNA, 21 bp, Homo sapiens
gcctttgttcatacagaccat

SEQ ID NO: 75384 - DNA, 20 bp, Homo sapiens
gcttttgttctcatctttcc

SEQ ID NO: 75385 - DNA, 18 bp, Homo sapiens
gcctttgttcttgcttct

SEQ ID NO: 75386 - DNA, 17 bp, Homo sapiens
ctttgtttcaccgacca

SEQ ID NO: 75387 - DNA, 23 bp, Homo sapiens
gcctttgtttccataggtcccat

SEQ ID NO: 75388 - DNA, 15 bp, Homo sapiens
gcctttgttttccta

SEQ ID NO: 75389 - DNA, 25 bp, Homo sapiens
gcctttgttcttagtgagctcccat

SEQ ID NO: 75390 - DNA, 16 bp, Homo sapiens
cctttgtcatttctga

SEQ ID NO: 75391 - DNA, 20 bp, Homo sapiens
ctttgttccatcatgaccat

SEQ ID NO: 75392 - DNA, 17 bp, Homo sapiens
gcctgagctatttctga

SEQ ID NO: 75393 - DNA, 16 bp, Homo sapiens
gcctttgttcttggcc

SEQ ID NO: 75394 - DNA, 19 bp, Homo sapiens
gcctttgctctcctgatca

SEQ ID NO: 75395 - DNA, 18 bp, Homo sapiens
gcctttgctctcattctg

SEQ ID NO: 75396 - DNA, 20 bp, Homo sapiens
gcctttgttttccttttgcc

SEQ ID NO: 75397 - DNA, 19 bp, Homo sapiens
cttttggttttctgaccat

SEQ ID NO: 75398 - DNA, 15 bp, Homo sapiens
cttttcccttctgac

SEQ ID NO: 75399 - DNA, 16 bp, Homo sapiens
gcctttgtcctcgtct

SEQ ID NO: 75400 - DNA, 21 bp, Homo sapiens
acctttgttcttgcagcactg

SEQ ID NO: 75401 - DNA, 20 bp, Homo sapiens
gcctttgttcccgaatcctg

SEQ ID NO: 75402 - DNA, 21 bp, Homo sapiens
gcttttgctctctctgaccat

SEQ ID NO: 75403 - DNA, 130 bp, Variola virus
acgatgaatgagtaataagaaatatgaaatctatcttatatacacataattattctatcaattttaccaattagttagtgtttaataaaaatatgggaatctaattaatttttccttacacaatcgacgt

SEQ ID NO: 75404 - DNA, 24 bp, Variola virus
ttagtgtttaataaaaatatggga

SEQ ID NO: 75405 - DNA, 21 bp, Homo sapiens
ttagtgtttaatagataatga

SEQ ID NO: 75406 - DNA, 24 bp, Homo sapiens
ttagtgttgtaataaaaaatatga

SEQ ID NO: 75407 - DNA, 21 bp, Homo sapiens
ttagtgttaataagctatgga

SEQ ID NO: 75408 - DNA, 70 bp, Human papillomavirus type 53
agtgtgccgggaagctgtaaaacgaaggctaattgatacagaagtgccggacagcgggtatggcaatact

SEQ ID NO: 75409 - DNA, 24 bp, Human papillomavirus type 53
aagctgtaaaacgaaggctaattg

SEQ ID NO: 75410 - DNA, 18 bp, Homo sapiens
aagctgtaaagtgagaga

SEQ ID NO: 75411 - DNA, 18 bp, Homo sapiens
agctgtaaaatgagatct

SEQ ID NO: 75412 - DNA, 24 bp, Homo sapiens
aagctgtagaaggaaaaagaattg

SEQ ID NO: 75413 - DNA, 19 bp, Homo sapiens
gctgtaaaatgaatggacc

SEQ ID NO: 75414 - DNA, 18 bp, Homo sapiens
agctgtaaagggaaggcc

SEQ ID NO: 75415 - DNA, 23 bp, Homo sapiens
aactgtgaaaaggtggctaattg

SEQ ID NO: 75416 - DNA, 18 bp, Homo sapiens
aagctgtgggacgaaagc

SEQ ID NO: 75417 - DNA, 17 bp, Homo sapiens
aagctgtagaagaaggc

SEQ ID NO: 75418 - DNA, 19 bp, Homo sapiens
aagctgtaaagctaagggc

SEQ ID NO: 75419 - DNA, 16 bp, Homo sapiens
aactgtgaagactaat

SEQ ID NO: 75420 - DNA, 74 bp, Equine herpesvirus 4
gggagggcgtatgcttgtaatttaagatccacgttacacccaaggagaaattacaatctggacagacgtcgccc

SEQ ID NO: 75421 - DNA, 24 bp, Equine herpesvirus 4
gggcgtatgcttgtaatttaagat

SEQ ID NO: 75422 - DNA, 19 bp, Homo sapiens
gggctgtgcttgcagcaag

SEQ ID NO: 75423 - DNA, 19 bp, Homo sapiens
aggcgtatgttcattaaga

SEQ ID NO: 75424 - DNA, 22 bp, Homo sapiens
gggctgtgttaccctttaagat

SEQ ID NO: 75425 - DNA, 67 bp, Tobacco vein mottling virus
ttgtccaaacttctacttgcccatttttatcatttctgatggtaaacattcaagtaagtttgcgcaa

SEQ ID NO: 75426 - DNA, 24 bp, Tobacco vein mottling virus
tccaaacttctacttgcccatttt

SEQ ID NO: 75427 - DNA, 18 bp, Homo sapiens
cttccactagcccatttt

SEQ ID NO: 75428 - DNA, 22 bp, Homo sapiens
tctgaacttcatttcccacttt

SEQ ID NO: 75429 - DNA, 18 bp, Homo sapiens
tccaaactgttcccattt

SEQ ID NO: 75430 - DNA, 19 bp, Homo sapiens
aacttctaggccccatttt

SEQ ID NO: 75431 - DNA, 23 bp, Homo sapiens
tccagcttctccaatcccatttt

SEQ ID NO: 75432 - DNA, 21 bp, Homo sapiens
tccaaacttttatttgtgcac

SEQ ID NO: 75433 - DNA, 20 bp, Homo sapiens
cttcattatttgcccatttt

SEQ ID NO: 75434 - DNA, 25 bp, Homo sapiens
ccaaacttctatcaataatcatttt

SEQ ID NO: 75435 - DNA, 19 bp, Homo sapiens
tccggcactctgcccattt

SEQ ID NO: 75436 - DNA, 19 bp, Homo sapiens
ttccacttgcagacacttt

SEQ ID NO: 75437 - DNA, 18 bp, Homo sapiens
caagcttctacttggacc

SEQ ID NO: 75438 - DNA, 111 bp, Pestivirus Giraffe-1
gctcccaatgtaacataatgtaaataaatgtgactttatgtaaatgcaaggcagtaagcagctcccaatgtaacataatgtaaataaatgtaactttatgtaaatgcaagt

SEQ ID NO: 75439 - DNA, 24 bp, Pestivirus Giraffe-1
tcccaatgtaacataatgtaaata

SEQ ID NO: 75440 - DNA, 18 bp, Homo sapiens
tccttatgtaacaaaatg

SEQ ID NO: 75441 - DNA, 19 bp, Homo sapiens
cctaatgtaacagaaagta

SEQ ID NO: 75442 - DNA, 17 bp, Homo sapiens
cctaatgtaataatgca

SEQ ID NO: 75443 - DNA, 18 bp, Homo sapiens
tcccaatgtgacaactat

SEQ ID NO: 75444 - DNA, 19 bp, Homo sapiens
tcccataactctaatgtaa

SEQ ID NO: 75445 - DNA, 18 bp, Homo sapiens
tgtgcacacaatgtaaat

SEQ ID NO: 75446 - DNA, 19 bp, Homo sapiens
ccaatgcaacattagagta

SEQ ID NO: 75447 - DNA, 18 bp, Homo sapiens
ccactgagcataatgtaa

SEQ ID NO: 75448 - DNA, 21 bp, Homo sapiens
tcccaatgcaatcatataaat

SEQ ID NO: 75449 - DNA, 69 bp, Mushroom bacilliform virus
ctcatcctcacagtctagagggttccatcgcgcaagtgatagtacttactcaggatttgagtagatgag

SEQ ID NO: 75450 - DNA, 24 bp, Mushroom bacilliform virus
atagtacttactcaggatttgagt

SEQ ID NO: 75451 - DNA, 23 bp, Homo sapiens
cagcaataactcaggatttgagt

SEQ ID NO: 75452 - DNA, 22 bp, Homo sapiens
atagtactgcatacatttgagt

SEQ ID NO: 75453 - DNA, 22 bp, Homo sapiens
tagtagtgccaaggatttgagt

SEQ ID NO: 75454 - DNA, 17 bp, Homo sapiens
tagacttattcaggact

SEQ ID NO: 75455 - DNA, 22 bp, Homo sapiens
acagtaatttcaggatttgagt

SEQ ID NO: 75456 - DNA, 70 bp, Maize dwarf mosaic virus
acggggttcaacttttacgcagtaatttagtaatatataagtaagctattgtggtgaggttgtacctcgt

SEQ ID NO: 75457 - DNA, 24 bp, Maize dwarf mosaic virus
tattgtggtgaggttgtacctcgt

SEQ ID NO: 75458 - DNA, 22 bp, Homo sapiens
gttgtgcttccttgtacctcgt

SEQ ID NO: 75459 - DNA, 131 bp, Lumpy skin disease virus
tagtctggtggatttttgcattaattcataaaataatctttagtatatggagatgtgtaagagggacattagttcttatactaaagattttaggatttgtgatatatgcaataaaaggattttgtcaacta

SEQ ID NO: 75460 - DNA, 24 bp, Lumpy skin disease virus
ttagttcttatactaaagatttta

SEQ ID NO: 75461 - DNA, 21 bp, Homo sapiens
ttagttctcatttggatttta

SEQ ID NO: 75462 - DNA, 18 bp, Homo sapiens
ttagttcttgtaactaaa

SEQ ID NO: 75463 - DNA, 18 bp, Homo sapiens
tagttctctagagatttt

SEQ ID NO: 75464 - DNA, 18 bp, Homo sapiens
ttagttcttataccaaaa

SEQ ID NO: 75465 - DNA, 17 bp, Homo sapiens
ttagttcttatacaaag

SEQ ID NO: 75466 - DNA, 19 bp, Homo sapiens
ttagttctaatactagcag

SEQ ID NO: 75467 - DNA, 96 bp, Lumpy skin disease virus
ttgcatatatcacaaatcctaaaatctttagtataagaactaatgtccctcttacacatctccatatactaaagattattttatgaattaatgcaa

SEQ ID NO: 75468 - DNA, 24 bp, Lumpy skin disease virus
tatcacaaatcctaaaatctttag

SEQ ID NO: 75469 - DNA, 24 bp, Homo sapiens
tatcacaaatctcaaactttttag

SEQ ID NO: 75470 - DNA, 19 bp, Homo sapiens
tcacgaatccgaaacctct

SEQ ID NO: 75471 - DNA, 18 bp, Homo sapiens
cacaaacaaaatctttag

SEQ ID NO: 75472 - DNA, 25 bp, Homo sapiens
tatcacaaattcaactcatctttag

SEQ ID NO: 75473 - DNA, 20 bp, Homo sapiens
tccgaatcctcaatctttag

SEQ ID NO: 75474 - DNA, 61 bp, Human herpesvirus 6B
ggtgtgaaactatgaggaactgatgagaaatgacttacggccatgattttgtttcgtcgct

SEQ ID NO: 75475 - DNA, 24 bp, Human herpesvirus 6B
tgtgaaactatgaggaactgatga

SEQ ID NO: 75476 - DNA, 19 bp, Homo sapiens
gaaaggaggggactgatga

SEQ ID NO: 75477 - DNA, 21 bp, Homo sapiens
tgtgaggtatgaggatccctg

SEQ ID NO: 75478 - DNA, 23 bp, Homo sapiens
tgtgagggtgtgactactgatga

SEQ ID NO: 75479 - DNA, 23 bp, Homo sapiens
tggaggtactgggggaactgatg

SEQ ID NO: 75480 - DNA, 23 bp, Homo sapiens
gtgggttgcagaggaactggtga

SEQ ID NO: 75481 - DNA, 23 bp, Homo sapiens
gtgaaactatggggcttctgtga

SEQ ID NO: 75482 - DNA, 19 bp, Homo sapiens
tgtgaatttggaactgatg

SEQ ID NO: 75483 - DNA, 21 bp, Homo sapiens
tgtgcggctatgaaacagatg

SEQ ID NO: 75484 - DNA, 20 bp, Homo sapiens
tgtgcttagaggaactggtg

SEQ ID NO: 75485 - DNA, 18 bp, Homo sapiens
tgtgagactgcactgatg

SEQ ID NO: 75486 - DNA, 19 bp, Homo sapiens
tatgggactatggacgatg

SEQ ID NO: 75487 - DNA, 15 bp, Homo sapiens
tgaaaaggaactgat

SEQ ID NO: 75488 - DNA, 18 bp, Homo sapiens
tgtggggtgggactgatg

SEQ ID NO: 75489 - DNA, 18 bp, Homo sapiens
tgttaaactatactgatg

SEQ ID NO: 75490 - DNA, 21 bp, Homo sapiens
tgtgaatttagccactgatga

SEQ ID NO: 75491 - DNA, 21 bp, Homo sapiens
tggactcttgaggagctggtg

SEQ ID NO: 75492 - DNA, 25 bp, Homo sapiens
tgtaaaactgtccagccggctgatg

SEQ ID NO: 75493 - DNA, 22 bp, Homo sapiens
gtgaaacgccaagaactgatga

SEQ ID NO: 75494 - DNA, 20 bp, Homo sapiens
tggagactatgagtgaatga

SEQ ID NO: 75495 - DNA, 86 bp, Vaccinia virus
tttttttatagcgtgaaggatatgataaaaaatataattgttgtatttatcccattccaatcaccttatatgattctgtaaaaaaa

SEQ ID NO: 75496 - DNA, 24 bp, Vaccinia virus
tagcgtgaaggatatgataaaaaa

SEQ ID NO: 75497 - DNA, 20 bp, Homo sapiens
cagcgtggggatgataaaaa

SEQ ID NO: 75498 - DNA, 17 bp, Homo sapiens
gcgtgtggagataaaaa

SEQ ID NO: 75499 - DNA, 19 bp, Homo sapiens
tagcctgaagtgattgata

SEQ ID NO: 75500 - DNA, 19 bp, Homo sapiens
agtgtgaataatgataaaa

SEQ ID NO: 75501 - DNA, 23 bp, Homo sapiens
tagcgtaagggttctgatgaaaa

SEQ ID NO: 75502 - DNA, 18 bp, Homo sapiens
tagggtgagggatacaga

SEQ ID NO: 75503 - DNA, 19 bp, Homo sapiens
tagtgtgaaggagattatg

SEQ ID NO: 75504 - DNA, 18 bp, Homo sapiens
tagcatgagggtaagata

SEQ ID NO: 75505 - DNA, 18 bp, Homo sapiens
tagcgagacatgataaaa

SEQ ID NO: 75506 - DNA, 60 bp, Gallid herpesvirus 3
acgaatcatgatttgatctaccatttcagcatttattggtttatacattctcgggttcgt

SEQ ID NO: 75507 - DNA, 17 bp, Gallid herpesvirus 3
tacattctcgggttcgt

SEQ ID NO: 75508 - DNA, 18 bp, Homo sapiens
acattctcgtgggttcgt

SEQ ID NO: 75509 - DNA, 23 bp, Homo sapiens
tacattctttatacgagtttgta

SEQ ID NO: 75510 - DNA, 21 bp, Homo sapiens
tacattcctaccgaggttcgt

SEQ ID NO: 75511 - DNA, 18 bp, Homo sapiens
cacattcttcacattcgt

SEQ ID NO: 75512 - DNA, 19 bp, Homo sapiens
tacatcctcactggtttgt

SEQ ID NO: 75513 - DNA, 68 bp, Human herpesvirus 5
tgcgggcactggggacggtggtgttgtatatgtgaatttgtaaataataaatgagaccccatcctgta

SEQ ID NO: 75514 - DNA, 24 bp, Human herpesvirus 5
taaataataaatgagaccccatcc

SEQ ID NO: 75515 - DNA, 20 bp, Homo sapiens
caacacagtgagaccctgtc

SEQ ID NO: 75516 - DNA, 21 bp, Homo sapiens
acaatgaggaagaccccatcc

SEQ ID NO: 75517 - DNA, 20 bp, Homo sapiens
caacatagtgagaccctgtc

SEQ ID NO: 75518 - DNA, 20 bp, Homo sapiens
taacatggtgaaaccctgtc

SEQ ID NO: 75519 - DNA, 20 bp, Homo sapiens
taacaaagtgagaccctatc

SEQ ID NO: 75520 - DNA, 20 bp, Homo sapiens
taacatggtgaaaccccgtc

SEQ ID NO: 75521 - DNA, 19 bp, Homo sapiens
taaataataaataagggcc

SEQ ID NO: 75522 - DNA, 20 bp, Homo sapiens
taacatggtgaaaccccatc

SEQ ID NO: 75523 - DNA, 20 bp, Homo sapiens
taacagagtgagaccccgtc

SEQ ID NO: 75524 - DNA, 20 bp, Homo sapiens
aagaataaatgagaagcacc

SEQ ID NO: 75525 - DNA, 21 bp, Homo sapiens
aaaccacaatgagaccttatc

SEQ ID NO: 75526 - DNA, 20 bp, Homo sapiens
aataacaaccagctccatcc

SEQ ID NO: 75527 - DNA, 20 bp, Homo sapiens
caacaaagtgagaccctgtc

SEQ ID NO: 75528 - DNA, 19 bp, Homo sapiens
taacatggtgaaaccccat

SEQ ID NO: 75529 - DNA, 20 bp, Homo sapiens
caatatagtgagaccctgtc

SEQ ID NO: 75530 - DNA, 19 bp, Homo sapiens
caaataataaaaaccccat

SEQ ID NO: 75531 - DNA, 20 bp, Homo sapiens
caacagagtgagaccctgtc

SEQ ID NO: 75532 - DNA, 20 bp, Homo sapiens
caacatagtgagaccccatc

SEQ ID NO: 75533 - DNA, 20 bp, Homo sapiens
ataataaatgagagtggatc

SEQ ID NO: 75534 - DNA, 26 bp, Homo sapiens
taaatgacaaataacccctcccatcc

SEQ ID NO: 75535 - DNA, 20 bp, Homo sapiens
taacatggtgagaccctgtc

SEQ ID NO: 75536 - DNA, 20 bp, Homo sapiens
taacatggtgagaccccatc

SEQ ID NO: 75537 - DNA, 21 bp, Homo sapiens
taaataatgaagaggccaccc

SEQ ID NO: 75538 - DNA, 20 bp, Homo sapiens
caatatagtgagaccctatc

SEQ ID NO: 75539 - DNA, 20 bp, Homo sapiens
taacacagtgagaccccatc

SEQ ID NO: 75540 - DNA, 20 bp, Homo sapiens
taacatggtaaaaccccgtc

SEQ ID NO: 75541 - DNA, 25 bp, Homo sapiens
tgataataaacaacaggaccccatc

SEQ ID NO: 75542 - DNA, 23 bp, Homo sapiens
ggataacagagtgagaccctgtc

SEQ ID NO: 75543 - DNA, 18 bp, Homo sapiens
aacgaggggaccccatcc

SEQ ID NO: 75544 - DNA, 18 bp, Homo sapiens
aataataaatgccaaacc

SEQ ID NO: 75545 - DNA, 22 bp, Homo sapiens
aataataaatacagaattccat

SEQ ID NO: 75546 - DNA, 20 bp, Homo sapiens
taaaaataaatgagacagcc

SEQ ID NO: 75547 - DNA, 27 bp, Homo sapiens
taaataagaaatgccaccttcctgtcc

SEQ ID NO: 75548 - DNA, 18 bp, Homo sapiens
aataaatgaaaccctatc

SEQ ID NO: 75549 - DNA, 18 bp, Homo sapiens
aatgaacgagactccgtc

SEQ ID NO: 75550 - DNA, 20 bp, Homo sapiens
caacatagtgagaccctatc

SEQ ID NO: 75551 - DNA, 20 bp, Homo sapiens
caacaaaatgagatcccatc

SEQ ID NO: 75552 - DNA, 20 bp, Homo sapiens
caacagggtgagaccccatc

SEQ ID NO: 75553 - DNA, 19 bp, Homo sapiens
aataatcttggccccatcc

SEQ ID NO: 75554 - DNA, 20 bp, Homo sapiens
caacatggtgagaccctgtc

SEQ ID NO: 75555 - DNA, 21 bp, Homo sapiens
taacatggtgaaaccctgtcc

SEQ ID NO: 75556 - DNA, 20 bp, Homo sapiens
taacagagtgagaccctgtc

SEQ ID NO: 75557 - DNA, 73 bp, Equine herpesvirus 1
gaaccaaccgcacgagaaggctcgctcggaagaccgagaagggaaggttggcgggtggccggtggcggggttc

SEQ ID NO: 75558 - DNA, 24 bp, Equine herpesvirus 1
ttggcgggtggccggtggcggggt

SEQ ID NO: 75559 - DNA, 16 bp, Homo sapiens
gcgggtggtggtgggg

SEQ ID NO: 75560 - DNA, 23 bp, Homo sapiens
ttggtgggaggtattgacggggt

SEQ ID NO: 75561 - DNA, 20 bp, Homo sapiens
tggcgggtgaagggcggggt

SEQ ID NO: 75562 - DNA, 122 bp, Tupaia herpesvirus
cactacgtgtatgtagcggtgtacacggaccgacctcatcgtgtctaatgtaccgctaacgatccaccgccggcgttttatagagcatggtcacacgcacgtgtacattgtgtcacatagtg

SEQ ID NO: 75563 - DNA, 19 bp, Tupaia herpesvirus
tacattgtgtcacatagtg

SEQ ID NO: 75564 - DNA, 16 bp, Homo sapiens
tacatgtaacatagtg

SEQ ID NO: 75565 - DNA, 19 bp, Homo sapiens
tacattgtgcttcatggtg

SEQ ID NO: 75566 - DNA, 19 bp, Homo sapiens
cacagtacttcacatagtg

SEQ ID NO: 75567 - DNA, 19 bp, Homo sapiens
ctgtaggactcacatagtg

SEQ ID NO: 75568 - DNA, 19 bp, Homo sapiens
acatctcattcacatagtg

SEQ ID NO: 75569 - DNA, 17 bp, Homo sapiens
tacatcgtgcgccagtg

SEQ ID NO: 75570 - DNA, 20 bp, Homo sapiens
tacatctctgccatatagtg

SEQ ID NO: 75571 - DNA, 16 bp, Homo sapiens
tacattatgtacagtg

SEQ ID NO: 75572 - DNA, 21 bp, Homo sapiens
tacattatcgtcattatagtg

SEQ ID NO: 75573 - DNA, 18 bp, Homo sapiens
tacattatgtacaaggtg

SEQ ID NO: 75574 - DNA, 18 bp, Homo sapiens
cacattgtgttcatcttg

SEQ ID NO: 75575 - DNA, 19 bp, Homo sapiens
tacaaaatatcacatagtg

SEQ ID NO: 75576 - DNA, 19 bp, Homo sapiens
tacattaatatacatagtg

SEQ ID NO: 75577 - DNA, 16 bp, Homo sapiens
tacaagtcacatagtg

SEQ ID NO: 75578 - DNA, 20 bp, Homo sapiens
acattgtgtacagagtagtg

SEQ ID NO: 75579 - DNA, 17 bp, Homo sapiens
tacatcgtgcgtcagtg

SEQ ID NO: 75580 - DNA, 17 bp, Homo sapiens
cacatcttcacatagtg

SEQ ID NO: 75581 - DNA, 19 bp, Homo sapiens
tacattgtgatcaatggtg

SEQ ID NO: 75582 - DNA, 15 bp, Homo sapiens
acaatgcacatagtg

SEQ ID NO: 75583 - DNA, 17 bp, Homo sapiens
cacattgtgccatagtg

SEQ ID NO: 75584 - DNA, 18 bp, Homo sapiens
catgtgacccacatagtg

SEQ ID NO: 75585 - DNA, 20 bp, Homo sapiens
taccttggccacacatagtg

SEQ ID NO: 75586 - DNA, 89 bp, Tupaia herpesvirus
cgtcgggccgggtgtccgcccacgtgacgcccacgccgaggaggctgcgggggcggcagacgaggtcggggtgcccgagagggccggcg

SEQ ID NO: 75587 - DNA, 24 bp, Tupaia herpesvirus
tgcgggggcggcagacgaggtcgg

SEQ ID NO: 75588 - DNA, 20 bp, Homo sapiens
tgcgggagcggcgggaccgg

SEQ ID NO: 75589 - DNA, 19 bp, Homo sapiens
tgtgggggcggcaaggcca

SEQ ID NO: 75590 - DNA, 19 bp, Homo sapiens
tggggggcggcaggcccgg

SEQ ID NO: 75591 - DNA, 21 bp, Homo sapiens
tgcagggggtggtggaggtgg

SEQ ID NO: 75592 - DNA, 19 bp, Homo sapiens
gggggcggcaggtctccgg

SEQ ID NO: 75593 - DNA, 18 bp, Homo sapiens
gcgggggcagcgaggtcg

SEQ ID NO: 75594 - DNA, 18 bp, Homo sapiens
tgtgagggcggcggggag

SEQ ID NO: 75595 - DNA, 20 bp, Homo sapiens
tgcggcggcggcagactcgg

SEQ ID NO: 75596 - DNA, 16 bp, Homo sapiens
gggggcggcaggagcg

SEQ ID NO: 75597 - DNA, 19 bp, Homo sapiens
tggggggcggtgaggtggg

SEQ ID NO: 75598 - DNA, 28 bp, Homo sapiens
tgcgggggtcgtgggatggccgacctcg

SEQ ID NO: 75599 - DNA, 27 bp, Homo sapiens
tgcggggggggcaggtctgcgggtcgg

SEQ ID NO: 75600 - DNA, 18 bp, Homo sapiens
tgcgggggcggcgggggc

SEQ ID NO: 75601 - DNA, 18 bp, Homo sapiens
tgtgggggcaggcaggag

SEQ ID NO: 75602 - DNA, 16 bp, Homo sapiens
gcgggggcggcgggcg

SEQ ID NO: 75603 - DNA, 21 bp, Homo sapiens
tgcggggacggcgggcgccgg

SEQ ID NO: 75604 - DNA, 24 bp, Homo sapiens
tgtgggggcggcgtgtctcagtgg

SEQ ID NO: 75605 - DNA, 18 bp, Homo sapiens
tgcgggggcggcagctgg

SEQ ID NO: 75606 - DNA, 19 bp, Homo sapiens
tgtgggggcggaggcgaag

SEQ ID NO: 75607 - DNA, 17 bp, Homo sapiens
gcgggggcggcagggcg

SEQ ID NO: 75608 - DNA, 26 bp, Homo sapiens
tgcgggggtcgcagacgctccaacgg

SEQ ID NO: 75609 - DNA, 18 bp, Homo sapiens
tgcgggggtcgcgggccg

SEQ ID NO: 75610 - DNA, 18 bp, Homo sapiens
cgggggcgggcggggtcg

SEQ ID NO: 75611 - DNA, 17 bp, Homo sapiens
gcgggggtggcagggtg

SEQ ID NO: 75612 - DNA, 18 bp, Homo sapiens
tgcgggggctgcgggccg

SEQ ID NO: 75613 - DNA, 20 bp, Homo sapiens
gcgcgggcgggcggggtcgg

SEQ ID NO: 75614 - DNA, 22 bp, Homo sapiens
cggttgcggcagatgaggtcgg

SEQ ID NO: 75615 - DNA, 18 bp, Homo sapiens
gcgggggcggcgggggcg

SEQ ID NO: 75616 - DNA, 15 bp, Homo sapiens
gcgggggcggcgggc

SEQ ID NO: 75617 - DNA, 18 bp, Homo sapiens
tgtgggggcagggaggtg

SEQ ID NO: 75618 - DNA, 22 bp, Homo sapiens
tgcggcgggaatacgaggtcgg

SEQ ID NO: 75619 - DNA, 19 bp, Homo sapiens
tgcgggggcggggatgccg

SEQ ID NO: 75620 - DNA, 18 bp, Homo sapiens
ggagccgggcgaggtcgg

SEQ ID NO: 75621 - DNA, 25 bp, Homo sapiens
tgtgggggcgcaggctggccgaccc

SEQ ID NO: 75622 - DNA, 15 bp, Homo sapiens
gcgggggcggcgggt

SEQ ID NO: 75623 - DNA, 22 bp, Homo sapiens
tgaggggagcgggtgaggtcgg

SEQ ID NO: 75624 - DNA, 15 bp, Homo sapiens
cgggggcggcgggcc

SEQ ID NO: 75625 - DNA, 18 bp, Homo sapiens
tgtgggggcggcacagtc

SEQ ID NO: 75626 - DNA, 16 bp, Homo sapiens
tgcgggggcgtcgggc

SEQ ID NO: 75627 - DNA, 18 bp, Homo sapiens
tgcgtggggctgaggtcg

SEQ ID NO: 75628 - DNA, 67 bp, Chimpanzee cytomegalovirus
gtgtacgggtgctttattatcatcagcgtcatgcagactggttgtatatataacgtaccatgatcac

SEQ ID NO: 75629 - DNA, 24 bp, Chimpanzee cytomegalovirus
ttgtatatataacgtaccatgatc

SEQ ID NO: 75630 - DNA, 18 bp, Homo sapiens
ttgtatatatgatatacc

SEQ ID NO: 75631 - DNA, 18 bp, Homo sapiens
ttgtaatgataccatgat

SEQ ID NO: 75632 - DNA, 21 bp, Homo sapiens
ttatatatacagtatatgatc

SEQ ID NO: 75633 - DNA, 19 bp, Homo sapiens
ttgcatgtaataccatgat

SEQ ID NO: 75634 - DNA, 23 bp, Homo sapiens
ctgaaacaataatgtaccatgat

SEQ ID NO: 75635 - DNA, 70 bp, Human papillomavirus type 70
tcgattgcgaaaatttaattcattgtatgaaaatatttcatgtacttggcattggatagggggcaaggga

SEQ ID NO: 75636 - DNA, 21 bp, Human papillomavirus type 70
cattggatagggggcaaggga

SEQ ID NO: 75637 - DNA, 19 bp, Homo sapiens
ttagatagggagtaaggga

SEQ ID NO: 75638 - DNA, 20 bp, Homo sapiens
cattgatcaaaaacaaggga

SEQ ID NO: 75639 - DNA, 17 bp, Homo sapiens
cattggctgggcaaggg

SEQ ID NO: 75640 - DNA, 16 bp, Homo sapiens
catgggatggggaggg

SEQ ID NO: 75641 - DNA, 19 bp, Homo sapiens
cactggggtaggcaaggga

SEQ ID NO: 75642 - DNA, 17 bp, Homo sapiens
tggtaactggcaaggga

SEQ ID NO: 75643 - DNA, 18 bp, Homo sapiens
cactggatgggtggaggg

SEQ ID NO: 75644 - DNA, 18 bp, Homo sapiens
cattggtaggggcaaggg

SEQ ID NO: 75645 - DNA, 18 bp, Homo sapiens
cattggactgggaaggga

SEQ ID NO: 75646 - DNA, 19 bp, Homo sapiens
tggataggccgaaggaggg

SEQ ID NO: 75647 - DNA, 19 bp, Homo sapiens
attggataggagattcaga

SEQ ID NO: 75648 - DNA, 17 bp, Homo sapiens
attgggtagggggcagg

SEQ ID NO: 75649 - DNA, 17 bp, Homo sapiens
actgagggggcagggga

SEQ ID NO: 75650 - DNA, 19 bp, Homo sapiens
cattggatggctacaaagg

SEQ ID NO: 75651 - DNA, 18 bp, Homo sapiens
cattggaaggggtgggga

SEQ ID NO: 75652 - DNA, 16 bp, Homo sapiens
tggaaagggcaaggga

SEQ ID NO: 75653 - DNA, 20 bp, Homo sapiens
ttgagcttgggggcaaggga

SEQ ID NO: 75654 - DNA, 19 bp, Homo sapiens
cactggatgggagcagggg

SEQ ID NO: 75655 - DNA, 17 bp, Homo sapiens
cactggatggtgagggg

SEQ ID NO: 75656 - DNA, 16 bp, Homo sapiens
cactgggaggcaaggg

SEQ ID NO: 75657 - DNA, 19 bp, Homo sapiens
cactggccctgggcaaggg

SEQ ID NO: 75658 - DNA, 18 bp, Homo sapiens
ttcaatggggggcaaggg

SEQ ID NO: 75659 - DNA, 18 bp, Homo sapiens
attgggctgggggaagga

SEQ ID NO: 75660 - DNA, 18 bp, Homo sapiens
tcggggggggggcaaggg

SEQ ID NO: 75661 - DNA, 19 bp, Homo sapiens
ctgaaacagggggtgaggg

SEQ ID NO: 75662 - DNA, 17 bp, Homo sapiens
ttagataaaataaggga

SEQ ID NO: 75663 - DNA, 16 bp, Homo sapiens
cattggagggggcagg

SEQ ID NO: 75664 - DNA, 18 bp, Homo sapiens
cattagatggaataggga

SEQ ID NO: 75665 - DNA, 18 bp, Homo sapiens
cattggtaggggattaga

SEQ ID NO: 75666 - DNA, 20 bp, Homo sapiens
caagaaattggggggtaggg

SEQ ID NO: 75667 - DNA, 16 bp, Homo sapiens
tgggggaggcaaggga

SEQ ID NO: 75668 - DNA, 17 bp, Homo sapiens
ctgggtggaagaaggga

SEQ ID NO: 75669 - DNA, 19 bp, Homo sapiens
cagtgggtgggggacaagg

SEQ ID NO: 75670 - DNA, 15 bp, Homo sapiens
attggagagcaaggg

SEQ ID NO: 75671 - DNA, 16 bp, Homo sapiens
ttggaggagcgaggga

SEQ ID NO: 75672 - DNA, 19 bp, Homo sapiens
cactgcttggggcaaggga

SEQ ID NO: 75673 - DNA, 20 bp, Homo sapiens
cattggatacgtcattggga

SEQ ID NO: 75674 - DNA, 21 bp, Homo sapiens
ctggcttacaggggtgaggga

SEQ ID NO: 75675 - DNA, 20 bp, Homo sapiens
cattgagagaaggcaaggga

SEQ ID NO: 75676 - DNA, 19 bp, Homo sapiens
ttggttatggggcaaggga

SEQ ID NO: 75677 - DNA, 20 bp, Homo sapiens
cattgtggaacagtgaggga

SEQ ID NO: 75678 - DNA, 19 bp, Homo sapiens
ttggataggagcattttgg

SEQ ID NO: 75679 - DNA, 15 bp, Homo sapiens
ttggggaggcaaggg

SEQ ID NO: 75680 - DNA, 18 bp, Homo sapiens
tgggcagggggcggggga

SEQ ID NO: 75681 - DNA, 15 bp, Homo sapiens
ttggggaggcaagga

SEQ ID NO: 75682 - DNA, 19 bp, Homo sapiens
ctgggccagaggcaaggga

SEQ ID NO: 75683 - DNA, 18 bp, Homo sapiens
ttgcatgggggacaaggg

SEQ ID NO: 75684 - DNA, 19 bp, Homo sapiens
caatgccaaggggcgaggg

SEQ ID NO: 75685 - DNA, 20 bp, Homo sapiens
attgactatgaggcaaggga

SEQ ID NO: 75686 - DNA, 21 bp, Homo sapiens
caatggatagacaggaaggga

SEQ ID NO: 75687 - DNA, 18 bp, Homo sapiens
ctgggagggggcagggga

SEQ ID NO: 75688 - DNA, 15 bp, Homo sapiens
cactggatacaaggg

SEQ ID NO: 75689 - DNA, 18 bp, Homo sapiens
ggagcagggggcggggga

SEQ ID NO: 75690 - DNA, 17 bp, Homo sapiens
attggatatggggtagg

SEQ ID NO: 75691 - DNA, 16 bp, Homo sapiens
tggagggggcagggga

SEQ ID NO: 75692 - DNA, 18 bp, Homo sapiens
ctgggtggcaagcaaggg

SEQ ID NO: 75693 - DNA, 21 bp, Homo sapiens
cattggatgtgggtcccagga

SEQ ID NO: 75694 - DNA, 19 bp, Homo sapiens
cattgggaggttgaaggga

SEQ ID NO: 75695 - DNA, 20 bp, Homo sapiens
ttggtaacaaagggcagggg

SEQ ID NO: 75696 - DNA, 21 bp, Homo sapiens
attgtatagagacaaaaggga

SEQ ID NO: 75697 - DNA, 20 bp, Homo sapiens
catcggagtcagggcaaggg

SEQ ID NO: 75698 - DNA, 17 bp, Homo sapiens
catttgataggggaggg

SEQ ID NO: 75699 - DNA, 15 bp, Homo sapiens
ttggatagagagggg

SEQ ID NO: 75700 - DNA, 19 bp, Homo sapiens
attgcatacaagacaaggg

SEQ ID NO: 75701 - DNA, 22 bp, Homo sapiens
cattggatacggttatgcggga

SEQ ID NO: 75702 - DNA, 18 bp, Homo sapiens
ttggataaatgtcaaggg

SEQ ID NO: 75703 - DNA, 18 bp, Homo sapiens
ttgggtaggggacctggg

SEQ ID NO: 75704 - DNA, 21 bp, Homo sapiens
ctggataggggcgaagaaggg

SEQ ID NO: 75705 - DNA, 17 bp, Homo sapiens
cactggatggggtgggg

SEQ ID NO: 75706 - DNA, 21 bp, Homo sapiens
tcggaccaggtgggcagggga

SEQ ID NO: 75707 - DNA, 19 bp, Homo sapiens
tggttgtgggggcaaggga

SEQ ID NO: 75708 - DNA, 99 bp, Macaca mulatta rhadinovirus
cccaaaaccaagccatccaaacataaaaacaataaattgtcagattttgtttaagcattcgtatctttattggagtggggtggatggtgtggggttggg

SEQ ID NO: 75709 - DNA, 24 bp, Macaca mulatta rhadinovirus
accaagccatccaaacataaaaac

SEQ ID NO: 75710 - DNA, 18 bp, Homo sapiens
accaaccacaacataaaa

SEQ ID NO: 75711 - DNA, 18 bp, Homo sapiens
aagccatccaagtaaaaa

SEQ ID NO: 75712 - DNA, 16 bp, Homo sapiens
gccccagacataaaaa

SEQ ID NO: 75713 - DNA, 20 bp, Homo sapiens
caaagtcctcacataaaaac

SEQ ID NO: 75714 - DNA, 21 bp, Homo sapiens
ccaaaaaacaaacataaaaac

SEQ ID NO: 75715 - DNA, 20 bp, Homo sapiens
accaagccatttaaacataa

SEQ ID NO: 75716 - DNA, 22 bp, Homo sapiens
agccacttaccaggcataaaaa

SEQ ID NO: 75717 - DNA, 21 bp, Homo sapiens
gccattcgcaaacataaaaac

SEQ ID NO: 75718 - DNA, 21 bp, Homo sapiens
accgtgccgtcttcacaaaaa

SEQ ID NO: 75719 - DNA, 17 bp, Homo sapiens
caagccatccaaaacaa

SEQ ID NO: 75720 - DNA, 19 bp, Homo sapiens
ccatagccattcataaaaa

SEQ ID NO: 75721 - DNA, 19 bp, Homo sapiens
accaagtcatcgataaaaa

SEQ ID NO: 75722 - DNA, 19 bp, Homo sapiens
accaagttctgacataaaa

SEQ ID NO: 75723 - DNA, 23 bp, Homo sapiens
ccgagccaattaagacataaaaa

SEQ ID NO: 75724 - DNA, 21 bp, Homo sapiens
acaaagccaagaacataaaaa

SEQ ID NO: 75725 - DNA, 21 bp, Homo sapiens
agccgtctccaaaataaaaac

SEQ ID NO: 75726 - DNA, 22 bp, Homo sapiens
accgaccaaacaagcataaaaa

SEQ ID NO: 75727 - DNA, 19 bp, Homo sapiens
caagccaccaactcccaaa

SEQ ID NO: 75728 - DNA, 22 bp, Homo sapiens
accgcgcccagccagcataaaa

SEQ ID NO: 75729 - DNA, 24 bp, Homo sapiens
accaatgatcacaaatataaaaac

SEQ ID NO: 75730 - DNA, 21 bp, Homo sapiens
caagccattgactataaaaac

SEQ ID NO: 75731 - DNA, 18 bp, Homo sapiens
agccatccaaaaaaaaaa

SEQ ID NO: 75732 - DNA, 25 bp, Homo sapiens
ccagaccatccagggccatggaaac

SEQ ID NO: 75733 - DNA, 21 bp, Homo sapiens
caggcaaaccaaacatgaaaa

SEQ ID NO: 75734 - DNA, 21 bp, Homo sapiens
accactgtcaaacataaaaac

SEQ ID NO: 75735 - DNA, 17 bp, Homo sapiens
aagcaatcccataaaaa

SEQ ID NO: 75736 - DNA, 21 bp, Homo sapiens
ccagcaaatgaacataaaaac

SEQ ID NO: 75737 - DNA, 23 bp, Homo sapiens
caagccaaataaaacataaaaac

SEQ ID NO: 75738 - DNA, 23 bp, Homo sapiens
accaagccattcaaatttctaaa

SEQ ID NO: 75739 - DNA, 18 bp, Homo sapiens
aagccatcaaaactaaaa

SEQ ID NO: 75740 - DNA, 16 bp, Homo sapiens
aagcctaacataaaaa

SEQ ID NO: 75741 - DNA, 22 bp, Homo sapiens
accaagccctttgctacataaa

SEQ ID NO: 75742 - DNA, 19 bp, Homo sapiens
caagccattgacagcaaaa

SEQ ID NO: 75743 - DNA, 19 bp, Homo sapiens
acgaagccatccaagcata

SEQ ID NO: 75744 - DNA, 17 bp, Homo sapiens
ccaggccacccagcata

SEQ ID NO: 75745 - DNA, 20 bp, Homo sapiens
cctaagttatccaaacacaa

SEQ ID NO: 75746 - DNA, 19 bp, Homo sapiens
acaaagccatccaagcata

SEQ ID NO: 75747 - DNA, 68 bp, Peanut bud necrosis virus
gtttaagttctagatcaggaaaagagcataatgtcaaaatttataatttcggagaaaaggataaaaac

SEQ ID NO: 75748 - DNA, 24 bp, Peanut bud necrosis virus
gatcaggaaaagagcataatgtca

SEQ ID NO: 75749 - DNA, 21 bp, Homo sapiens
gatcagaagagtctctgtgtc

SEQ ID NO: 75750 - DNA, 21 bp, Homo sapiens
gatgaggaagagcacctatgt

SEQ ID NO: 75751 - DNA, 18 bp, Homo sapiens
aatcaggaagagggcaca

SEQ ID NO: 75752 - DNA, 19 bp, Homo sapiens
aggattccacataatgtca

SEQ ID NO: 75753 - DNA, 22 bp, Homo sapiens
gatcaggaatggggtcaggtca

SEQ ID NO: 75754 - DNA, 20 bp, Homo sapiens
gactaggaaaagggccacat

SEQ ID NO: 75755 - DNA, 23 bp, Homo sapiens
aattagggaagatattaatgtca

SEQ ID NO: 75756 - DNA, 18 bp, Homo sapiens
gacaggagaatcaatgtc

SEQ ID NO: 75757 - DNA, 17 bp, Homo sapiens
gatcagaaagggagata

SEQ ID NO: 75758 - DNA, 22 bp, Homo sapiens
gatcagaaatggtatgatgtca

SEQ ID NO: 75759 - DNA, 18 bp, Homo sapiens
gattaagaaaagagtgtc

SEQ ID NO: 75760 - DNA, 22 bp, Homo sapiens
gacaggaagaacacagatgtca

SEQ ID NO: 75761 - DNA, 22 bp, Homo sapiens
gaacaggaaaaacttagtgtca

SEQ ID NO: 75762 - DNA, 22 bp, Homo sapiens
aattgggagaagagcatggtca

SEQ ID NO: 75763 - DNA, 19 bp, Homo sapiens
gatgcagtaagcataatgt

SEQ ID NO: 75764 - DNA, 18 bp, Homo sapiens
atcaggaaaaatagatgt

SEQ ID NO: 75765 - DNA, 19 bp, Homo sapiens
gagcagggctgcataatgt

SEQ ID NO: 75766 - DNA, 22 bp, Homo sapiens
tcagggtaggaggtcaatgtca

SEQ ID NO: 75767 - DNA, 18 bp, Homo sapiens
gatcaggaaacagtatgt

SEQ ID NO: 75768 - DNA, 23 bp, Homo sapiens
gatcaggagatgaacttatgtca

SEQ ID NO: 75769 - DNA, 19 bp, Homo sapiens
gatcaggagaggaggaatg

SEQ ID NO: 75770 - DNA, 22 bp, Homo sapiens
caggaagagggggcatggtgtc

SEQ ID NO: 75771 - DNA, 20 bp, Homo sapiens
gataggaagaattaatgtca

SEQ ID NO: 75772 - DNA, 21 bp, Homo sapiens
ccaggaaaggcctacgatgtc

SEQ ID NO: 75773 - DNA, 17 bp, Homo sapiens
ggaaaagaaatatgtca

SEQ ID NO: 75774 - DNA, 21 bp, Homo sapiens
aattaggaaaagaggaagtca

SEQ ID NO: 75775 - DNA, 61 bp, Paramecium bursaria Chlorella virus 1
gtccattaaccgttctatgatcgacgccggtattctcgcactcatcatatggtttatgcgc

SEQ ID NO: 75776 - DNA, 17 bp, Paramecium bursaria Chlorella virus 1
tcatatggtttatgcgc

SEQ ID NO: 75777 - DNA, 18 bp, Homo sapiens
ccatatggactcatgtgc

SEQ ID NO: 75778 - DNA, 18 bp, Homo sapiens
tcattggtttattggcgc

SEQ ID NO: 75779 - DNA, 18 bp, Homo sapiens
tcatatggtcccggatgc

SEQ ID NO: 75780 - DNA, 18 bp, Homo sapiens
tcatgccaatgtatgcgc

SEQ ID NO: 75781 - DNA, 18 bp, Homo sapiens
tcatataaatgtatgcgc

SEQ ID NO: 75782 - DNA, 21 bp, Homo sapiens
tcatactgcaaatatatgcgc

SEQ ID NO: 75783 - DNA, 18 bp, Homo sapiens
ccatatggatttatgtgc

SEQ ID NO: 75784 - DNA, 95 bp, Paramecium bursaria Chlorella virus 1
gctttctttctaaaattgtcatttatcatatcgacacgaattgtatatttaaatagcatttctaacttatgatatcataatttagaaatacaagt

SEQ ID NO: 75785 - DNA, 24 bp, Paramecium bursaria Chlorella virus 1
tctttctaaaattgtcatttatca

SEQ ID NO: 75786 - DNA, 24 bp, Homo sapiens
cctttttaaagttgtcatttgaca

SEQ ID NO: 75787 - DNA, 16 bp, Homo sapiens
tctttcttgcatttat

SEQ ID NO: 75788 - DNA, 21 bp, Homo sapiens
tctttctaaagttgcaaatca

SEQ ID NO: 75789 - DNA, 19 bp, Homo sapiens
tttctcaaatgtcatttat

SEQ ID NO: 75790 - DNA, 18 bp, Homo sapiens
ctctgaattgtcatttat

SEQ ID NO: 75791 - DNA, 24 bp, Homo sapiens
tctctctaaagttgttgttctcca

SEQ ID NO: 75792 - DNA, 23 bp, Homo sapiens
tctttctaaagtttgtacattta

SEQ ID NO: 75793 - DNA, 21 bp, Homo sapiens
tctttctagaatgttatttat

SEQ ID NO: 75794 - DNA, 20 bp, Homo sapiens
tccttctaaaatggttgtca

SEQ ID NO: 75795 - DNA, 21 bp, Homo sapiens
tctttctaaagcttgaacatt

SEQ ID NO: 75796 - DNA, 21 bp, Homo sapiens
tctttctagagttaactgtca

SEQ ID NO: 75797 - DNA, 24 bp, Homo sapiens
cctttctaaatattctgtttatca

SEQ ID NO: 75798 - DNA, 21 bp, Homo sapiens
ctttctaaacaatacatttat

SEQ ID NO: 75799 - DNA, 19 bp, Homo sapiens
tctttccaaactcacattt

SEQ ID NO: 75800 - DNA, 65 bp, Rabbit oral papillomavirus
aggtttttagaggaggtaccgatacccagacatatgcaagtgtttgttgggaacttctttggctt

SEQ ID NO: 75801 - DNA, 23 bp, Rabbit oral papillomavirus
tttgttgggaacttctttggctt

SEQ ID NO: 75802 - DNA, 17 bp, Homo sapiens
tttgtggggaagtggct

SEQ ID NO: 75803 - DNA, 20 bp, Homo sapiens
ttgggaagaagccttggctt

SEQ ID NO: 75804 - DNA, 18 bp, Homo sapiens
cttgttattctttggctt

SEQ ID NO: 75805 - DNA, 17 bp, Homo sapiens
tgttgggaacttttcaa

SEQ ID NO: 75806 - DNA, 18 bp, Homo sapiens
tttgttgggatcttaaac

SEQ ID NO: 75807 - DNA, 20 bp, Homo sapiens
tttgttggcagttcagttgg

SEQ ID NO: 75808 - DNA, 23 bp, Homo sapiens
tttgctgggattgggtttggctt

SEQ ID NO: 75809 - DNA, 17 bp, Homo sapiens
tctgttggcttttggct

SEQ ID NO: 75810 - DNA, 26 bp, Homo sapiens
tttattggggaggctgactttggctt

SEQ ID NO: 75811 - DNA, 76 bp, Rabbit oral papillomavirus
acaccgcactttgtttgactgtattagtaccacatggagttgggtagataatagcagcacatgcagagtaggtagt

SEQ ID NO: 75812 - DNA, 24 bp, Rabbit oral papillomavirus
tagataatagcagcacatgcagag

SEQ ID NO: 75813 - DNA, 20 bp, Homo sapiens
taatagcagttatgatggag

SEQ ID NO: 75814 - DNA, 20 bp, Homo sapiens
tagacatgttgcacatgcag

SEQ ID NO: 75815 - DNA, 21 bp, Homo sapiens
gatggcagcagcctcacggag

SEQ ID NO: 75816 - DNA, 19 bp, Homo sapiens
gatgagagcagacacagag

SEQ ID NO: 75817 - DNA, 21 bp, Homo sapiens
gataatagtaggcattcagag

SEQ ID NO: 75818 - DNA, 21 bp, Homo sapiens
tagacaatagcggctgcccag

SEQ ID NO: 75819 - DNA, 21 bp, Homo sapiens
tagaggcaggggcacatgcag

SEQ ID NO: 75820 - DNA, 18 bp, Homo sapiens
cagatgaccacatgcaga

SEQ ID NO: 75821 - DNA, 18 bp, Homo sapiens
tagaaatagcagcacatg

SEQ ID NO: 75822 - DNA, 24 bp, Homo sapiens
tagataatgttggcaattgtagag

SEQ ID NO: 75823 - DNA, 22 bp, Homo sapiens
taggtagcagcagcactatcag

SEQ ID NO: 75824 - DNA, 60 bp, Human papillomavirus type 28
gtggtaacactgtgtccaaagtgtagttcaccactgcgactggtggtagagtgcagccac

SEQ ID NO: 75825 - DNA, 24 bp, Human papillomavirus type 28
cgactggtggtagagtgcagccac

SEQ ID NO: 75826 - DNA, 18 bp, Homo sapiens
ctgttggtagagtttcag

SEQ ID NO: 75827 - DNA, 17 bp, Homo sapiens
gtggaagctgcagccac

SEQ ID NO: 75828 - DNA, 18 bp, Homo sapiens
cgactggtaggcagttac

SEQ ID NO: 75829 - DNA, 23 bp, Homo sapiens
gactggtgggtggagaacgacag

SEQ ID NO: 75830 - DNA, 19 bp, Homo sapiens
gaatggtggtaatggctgc

SEQ ID NO: 75831 - DNA, 21 bp, Homo sapiens
gactggtggtaaaatatttgc

SEQ ID NO: 75832 - DNA, 17 bp, Homo sapiens
ctggtggtagggtgggc

SEQ ID NO: 75833 - DNA, 24 bp, Homo sapiens
ctggtggctgcagggtgcagtcac

SEQ ID NO: 75834 - DNA, 20 bp, Homo sapiens
actggctagaagtgcagtca

SEQ ID NO: 75835 - DNA, 20 bp, Homo sapiens
ctggtggcagggatgactgc

SEQ ID NO: 75836 - DNA, 24 bp, Homo sapiens
cgattggcgtttacagtgcagcca

SEQ ID NO: 75837 - DNA, 20 bp, Homo sapiens
gattggtgaggtgcagccac

SEQ ID NO: 75838 - DNA, 16 bp, Homo sapiens
ggctagagtgcagcca

SEQ ID NO: 75839 - DNA, 22 bp, Homo sapiens
gactggtgggaggggacagcca

SEQ ID NO: 75840 - DNA, 16 bp, Homo sapiens
tggtggcagcagccac

SEQ ID NO: 75841 - DNA, 18 bp, Homo sapiens
tggtggtggcggcagcca

SEQ ID NO: 75842 - DNA, 17 bp, Homo sapiens
gactgttgggtgcagcc

SEQ ID NO: 75843 - DNA, 22 bp, Homo sapiens
actggtggtgggagccagctac

SEQ ID NO: 75844 - DNA, 21 bp, Homo sapiens
gactggggccagtgcagccac

SEQ ID NO: 75845 - DNA, 23 bp, Homo sapiens
cgattggtggcagaaataactac

SEQ ID NO: 75846 - DNA, 19 bp, Homo sapiens
cggttgggggtgaggccgc

SEQ ID NO: 75847 - DNA, 16 bp, Homo sapiens
cgatcggcagtgcagc

SEQ ID NO: 75848 - DNA, 22 bp, Homo sapiens
caactggtccatgaagtgtagc

SEQ ID NO: 75849 - DNA, 17 bp, Homo sapiens
ctggtggtggaaggccc

SEQ ID NO: 75850 - DNA, 23 bp, Homo sapiens
cgcctggcctagggtgcagccac

SEQ ID NO: 75851 - DNA, 17 bp, Homo sapiens
gactggtggtggagtca

SEQ ID NO: 75852 - DNA, 19 bp, Homo sapiens
gactggtggtggagtctca

SEQ ID NO: 75853 - DNA, 17 bp, Homo sapiens
ctggtgatagggccaac

SEQ ID NO: 75854 - DNA, 17 bp, Homo sapiens
tgatgctgagtgcagcc

SEQ ID NO: 75855 - DNA, 20 bp, Homo sapiens
cgataggtggtgacggtggc

SEQ ID NO: 75856 - DNA, 20 bp, Homo sapiens
gacttgatggggtgcagcca

SEQ ID NO: 75857 - DNA, 98 bp, Human herpesvirus 8
cattgctctgttgtaaactatatataagttaaaccaaaattcgcagggagacaaggtgacggtggtgagaactcagttgagagtcagagaatacagtg

SEQ ID NO: 75858 - DNA, 24 bp, Human herpesvirus 8
taagttaaaccaaaattcgcaggg

SEQ ID NO: 75859 - DNA, 18 bp, Homo sapiens
gttaaccaaaatgacagg

SEQ ID NO: 75860 - DNA, 25 bp, Homo sapiens
caagttaaaccaggggagcatcggg

SEQ ID NO: 75861 - DNA, 23 bp, Homo sapiens
taagtcaaaccaacatggcaggg

SEQ ID NO: 75862 - DNA, 19 bp, Homo sapiens
tgattaaaccaagttcagg

SEQ ID NO: 75863 - DNA, 22 bp, Homo sapiens
taagtaaaccaaaatatacagg

SEQ ID NO: 75864 - DNA, 100 bp, Human herpesvirus 5
cttggttgtggtgatttcattctcattattgttgttttctttccgtcttgcggatgaagatgttgcgatgcggttgttgttggtgttgctatacaccgag

SEQ ID NO: 75865 - DNA, 17 bp, Human herpesvirus 5
tgttgctatacaccgag

SEQ ID NO: 75866 - DNA, 18 bp, Homo sapiens
tattgctacttcactgag

SEQ ID NO: 75867 - DNA, 19 bp, Homo sapiens
tgttactaacacacttgag

SEQ ID NO: 75868 - DNA, 18 bp, Homo sapiens
tgttaccacacagttgag

SEQ ID NO: 75869 - DNA, 19 bp, Homo sapiens
tgttgctacaacacccgag

SEQ ID NO: 75870 - DNA, 21 bp, Homo sapiens
tgttgctatatgaacacatcg

SEQ ID NO: 75871 - DNA, 115 bp, Human herpesvirus 5
agatgatctttttgttcttctggttcatttcctatgattgtttggctgctgaccgacgcgtcaggatgtgcagggcatgcggggaatcaggaccggacacgggataatttcatct

SEQ ID NO: 75872 - DNA, 24 bp, Human herpesvirus 5
tgtgcagggcatgcggggaatcag

SEQ ID NO: 75873 - DNA, 16 bp, Homo sapiens
tgggcagggcaggaat

SEQ ID NO: 75874 - DNA, 21 bp, Homo sapiens
gggcggtggtcggggaatcag

SEQ ID NO: 75875 - DNA, 20 bp, Homo sapiens
tgtgcagggcactgtgctgg

SEQ ID NO: 75876 - DNA, 21 bp, Homo sapiens
tgtgcaggaggtgggggtcag

SEQ ID NO: 75877 - DNA, 19 bp, Homo sapiens
tgtgcaaggcgagggatca

SEQ ID NO: 75878 - DNA, 16 bp, Homo sapiens
tggcagggcattgagg

SEQ ID NO: 75879 - DNA, 18 bp, Homo sapiens
tatgtggggtgggaatca

SEQ ID NO: 75880 - DNA, 19 bp, Homo sapiens
tgggcagggcagagggtca

SEQ ID NO: 75881 - DNA, 21 bp, Homo sapiens
tgtctagggcgcaagaatcag

SEQ ID NO: 75882 - DNA, 20 bp, Homo sapiens
tgtgcagggctgcctgctgg

SEQ ID NO: 75883 - DNA, 17 bp, Homo sapiens
tgtgcagggcagtggga

SEQ ID NO: 75884 - DNA, 22 bp, Homo sapiens
tgtgtaggacaacgagaatcag

SEQ ID NO: 75885 - DNA, 22 bp, Homo sapiens
tgtgcagggcggagtggatcag

SEQ ID NO: 75886 - DNA, 17 bp, Homo sapiens
tgcagggcagagggtca

SEQ ID NO: 75887 - DNA, 24 bp, Homo sapiens
tgtgcagggtgcgcaatccttcag

SEQ ID NO: 75888 - DNA, 20 bp, Homo sapiens
tgtgcaggtacatgaattag

SEQ ID NO: 75889 - DNA, 21 bp, Homo sapiens
gtgcagggcggagagaatcag

SEQ ID NO: 75890 - DNA, 27 bp, Homo sapiens
tgtgcaggtgtgtgctttaacaatcag

SEQ ID NO: 75891 - DNA, 17 bp, Homo sapiens
tgtcagggcatgtgggg

SEQ ID NO: 75892 - DNA, 22 bp, Homo sapiens
tgtggagggtatgcggaaacag

SEQ ID NO: 75893 - DNA, 18 bp, Homo sapiens
tgtgcagggcctgtgcag

SEQ ID NO: 75894 - DNA, 19 bp, Homo sapiens
tgtgcagggtggcgggtca

SEQ ID NO: 75895 - DNA, 79 bp, Human herpesvirus 1
agaacacgcggtcccctgtggtgtttttggttatttttattaaatctcgtcgacaaacagggggaaaggggcgtggtct

SEQ ID NO: 75896 - DNA, 24 bp, Human herpesvirus 1
cccctgtggtgtttttggttattt

SEQ ID NO: 75897 - DNA, 17 bp, Homo sapiens
ctttgtgcttggttatt

SEQ ID NO: 75898 - DNA, 17 bp, Homo sapiens
tagcattttggttattt

SEQ ID NO: 75899 - DNA, 19 bp, Homo sapiens
ccttgtggtgttttttgtt

SEQ ID NO: 75900 - DNA, 17 bp, Homo sapiens
tggattattggttattt

SEQ ID NO: 75901 - DNA, 18 bp, Homo sapiens
tggggtgtttttcgggtt

SEQ ID NO: 75902 - DNA, 24 bp, Homo sapiens
ccactgtggtgtttagctctattt

SEQ ID NO: 75903 - DNA, 18 bp, Homo sapiens
cctttgtgggtttttggt

SEQ ID NO: 75904 - DNA, 19 bp, Homo sapiens
cctctgtgatgttaatatt

SEQ ID NO: 75905 - DNA, 23 bp, Homo sapiens
cctctgttgtgctagggttattt

SEQ ID NO: 75906 - DNA, 23 bp, Homo sapiens
ccctttggaagccatggttattt

SEQ ID NO: 75907 - DNA, 18 bp, Homo sapiens
ctgtgtgtttttctcgtt

SEQ ID NO: 75908 - DNA, 18 bp, Homo sapiens
ccttttggtgtttttggt

SEQ ID NO: 75909 - DNA, 23 bp, Homo sapiens
ctgtgatgttcttcacgttattt

SEQ ID NO: 75910 - DNA, 20 bp, Homo sapiens
ctgtggtgctcttcttattt

SEQ ID NO: 75911 - DNA, 17 bp, Homo sapiens
cccctgtgggttttgtt

SEQ ID NO: 75912 - DNA, 23 bp, Homo sapiens
ccctgtggtgttttctgaaattt

SEQ ID NO: 75913 - DNA, 17 bp, Homo sapiens
cctctgggtgtttggtt

SEQ ID NO: 75914 - DNA, 23 bp, Homo sapiens
cctactgtttaatttggttattt

SEQ ID NO: 75915 - DNA, 22 bp, Homo sapiens
tgtgatgttttacattctattt

SEQ ID NO: 75916 - DNA, 17 bp, Homo sapiens
tgtgatgttgggtattt

SEQ ID NO: 75917 - DNA, 18 bp, Homo sapiens
tgctctgttttggttatt

SEQ ID NO: 75918 - DNA, 89 bp, Equine herpesvirus 1
gattgataaccttgatgtagcaagccaacctttggagagtttgaggtacagggacccaagaggatggttttatgcaccaggtattagtc

SEQ ID NO: 75919 - DNA, 24 bp, Equine herpesvirus 1
tgtagcaagccaacctttggagag

SEQ ID NO: 75920 - DNA, 18 bp, Homo sapiens
tgaagcaagccaggggag

SEQ ID NO: 75921 - DNA, 23 bp, Homo sapiens
tgcagcaagtcctacctggagag

SEQ ID NO: 75922 - DNA, 18 bp, Homo sapiens
gtaggggagcctttggag

SEQ ID NO: 75923 - DNA, 17 bp, Homo sapiens
tgtagcaactcctgtgg

SEQ ID NO: 75924 - DNA, 19 bp, Homo sapiens
tgaagtgaccttttggaga

SEQ ID NO: 75925 - DNA, 18 bp, Homo sapiens
gtggcaagccaacctttg

SEQ ID NO: 75926 - DNA, 21 bp, Homo sapiens
tgtagcaagcagcctccccag

SEQ ID NO: 75927 - DNA, 22 bp, Homo sapiens
tgtcagcaggctgaccaaagag

SEQ ID NO: 75928 - DNA, 21 bp, Homo sapiens
tgtcggcaagctcctggagag

SEQ ID NO: 75929 - DNA, 21 bp, Homo sapiens
tgtggccagctgaccttggag

SEQ ID NO: 75930 - DNA, 18 bp, Homo sapiens
gcagaggcttttggagag

SEQ ID NO: 75931 - DNA, 17 bp, Homo sapiens
gtagggcctttggagag

SEQ ID NO: 75932 - DNA, 23 bp, Homo sapiens
tgtaacaagctagtgcacgggag

SEQ ID NO: 75933 - DNA, 21 bp, Homo sapiens
tgtggcaaccaatcaatctgg

SEQ ID NO: 75934 - DNA, 19 bp, Homo sapiens
tgtggcataggctttggag

SEQ ID NO: 75935 - DNA, 19 bp, Homo sapiens
tgtaggaagctggccagag

SEQ ID NO: 75936 - DNA, 24 bp, Homo sapiens
tgtagcaagcccactttttccaag

SEQ ID NO: 75937 - DNA, 18 bp, Homo sapiens
gctcatgcctttggagag

SEQ ID NO: 75938 - DNA, 20 bp, Homo sapiens
tgtagcaagtttatctgcaa

SEQ ID NO: 75939 - DNA, 16 bp, Homo sapiens
tgagcaggccaaagag

SEQ ID NO: 75940 - DNA, 69 bp, Chimpanzee cytomegalovirus
cgcgaccggccaaaagaccgcgcggcgcccgtcgggccctcacagcgctcgtcgcgcggccgggcggcg

SEQ ID NO: 75941 - DNA, 24 bp, Chimpanzee cytomegalovirus
tcacagcgctcgtcgcgcggccgg

SEQ ID NO: 75942 - DNA, 21 bp, Homo sapiens
tcacacaccccgcgcggccgg

SEQ ID NO: 75943 - DNA, 23 bp, Homo sapiens
gcgcggtgctgggcagcggccgg

SEQ ID NO: 75944 - DNA, 21 bp, Homo sapiens
tcgaagagctcgtgcggccgg

SEQ ID NO: 75945 - DNA, 18 bp, Homo sapiens
tcacagcgcacggtttgg

SEQ ID NO: 75946 - DNA, 21 bp, Homo sapiens
gcagatccgttgtgcggccgg

SEQ ID NO: 75947 - DNA, 22 bp, Homo sapiens
tcgcagccggggccgcggccgg

SEQ ID NO: 75948 - DNA, 18 bp, Homo sapiens
gcgtcgcgccgcggccgg

SEQ ID NO: 75949 - DNA, 21 bp, Homo sapiens
gcggtcagggcgcgcggccgg

SEQ ID NO: 75950 - DNA, 23 bp, Homo sapiens
tcacagcgacttggagaggctgg

SEQ ID NO: 75951 - DNA, 16 bp, Homo sapiens
gcgctcgcctggccgg

SEQ ID NO: 75952 - DNA, 19 bp, Homo sapiens
cagcgccccccgtggccgg

SEQ ID NO: 75953 - DNA, 22 bp, Homo sapiens
tcacacgcagggccgcggccgg

SEQ ID NO: 75954 - DNA, 22 bp, Homo sapiens
catggccgggacgcgcggccgg

SEQ ID NO: 75955 - DNA, 22 bp, Homo sapiens
tcacacgcatctgtgcggctgg

SEQ ID NO: 75956 - DNA, 19 bp, Homo sapiens
ccacagcgctccctggccg

SEQ ID NO: 75957 - DNA, 19 bp, Homo sapiens
tcgcagcgctctcgcagag

SEQ ID NO: 75958 - DNA, 24 bp, Homo sapiens
tcgcagtgcccgtcgctgaagtgg

SEQ ID NO: 75959 - DNA, 60 bp, Potato virus A
ttgttatatagacccaccacatagtgagattttatctcggtgactggttttatgtttcaa

SEQ ID NO: 75960 - DNA, 24 bp, Potato virus A
tatatagacccaccacatagtgag

SEQ ID NO: 75961 - DNA, 24 bp, Homo sapiens
tatatagctccagagaatagtgag

SEQ ID NO: 75962 - DNA, 20 bp, Homo sapiens
tacatagatttgtcacatag

SEQ ID NO: 75963 - DNA, 24 bp, Homo sapiens
tataaagatttgcagcacagtgag

SEQ ID NO: 75964 - DNA, 21 bp, Homo sapiens
tatagggcacgttatagtgag

SEQ ID NO: 75965 - DNA, 15 bp, Homo sapiens
tatagacacatagtg

SEQ ID NO: 75966 - DNA, 19 bp, Homo sapiens
tatatagactaccacatag

SEQ ID NO: 75967 - DNA, 17 bp, Homo sapiens
tagacccagaacaagtg

SEQ ID NO: 75968 - DNA, 16 bp, Homo sapiens
gacccacccaggtgag

SEQ ID NO: 75969 - DNA, 85 bp, Rat cytomegalovirus
tttgtcgtgtgcttttcgtgtctcggggcggtttccgcgaccgaacccgtcgccgcggacgcgagcagccggatcaacgtacaag

SEQ ID NO: 75970 - DNA, 24 bp, Rat cytomegalovirus
gtgcttttcgtgtctcggggcggt

SEQ ID NO: 75971 - DNA, 22 bp, Homo sapiens
gtgcttttctgtggtgggtggt

SEQ ID NO: 75972 - DNA, 18 bp, Homo sapiens
gtgcttttgtggtggtgg

SEQ ID NO: 75973 - DNA, 110 bp, Monkeypox virus
gtccaatattttatataaaaacattttatttctagacgttgtcagaaaatcctgtaatatttttagtttttttggttgtgaataaagtatcgccctaataatattggtac

SEQ ID NO: 75974 - DNA, 24 bp, Monkeypox virus
agacgttgtcagaaaatcctgtaa

SEQ ID NO: 75975 - DNA, 21 bp, Homo sapiens
agacgttgtcaggaggtctcc

SEQ ID NO: 75976 - DNA, 19 bp, Homo sapiens
gccacggaggatcctgtaa

SEQ ID NO: 75977 - DNA, 20 bp, Homo sapiens
aaactttcaggaaatcctgt

SEQ ID NO: 75978 - DNA, 17 bp, Homo sapiens
gttgtcagtcccttgta

SEQ ID NO: 75979 - DNA, 21 bp, Homo sapiens
agactctaaaaagtcctgtaa

SEQ ID NO: 75980 - DNA, 16 bp, Homo sapiens
gacgatgcaatcctgt

SEQ ID NO: 75981 - DNA, 23 bp, Homo sapiens
agatgttgtaaattctcctgtaa

SEQ ID NO: 75982 - DNA, 20 bp, Homo sapiens
agagcgtgataaaatcctgt

SEQ ID NO: 75983 - DNA, 22 bp, Homo sapiens
agaagttagcagagtcctgtaa

SEQ ID NO: 75984 - DNA, 16 bp, Homo sapiens
gtctcagaatcctgta

SEQ ID NO: 75985 - DNA, 20 bp, Homo sapiens
gatgtagtcagaaatcaagc

SEQ ID NO: 75986 - DNA, 17 bp, Homo sapiens
agacgttgcagaaagcc

SEQ ID NO: 75987 - DNA, 16 bp, Homo sapiens
aggcgttgccagctgt

SEQ ID NO: 75988 - DNA, 20 bp, Homo sapiens
gaagttgtcaggatcaggta

SEQ ID NO: 75989 - DNA, 22 bp, Homo sapiens
gacttgtcagagctggtgctgt

SEQ ID NO: 75990 - DNA, 66 bp, Bovine herpesvirus 1
gagtctgcgctgcggcggcgctctttatactgggcggacgcccccgcagcggcaaaacacacactc

SEQ ID NO: 75991 - DNA, 24 bp, Bovine herpesvirus 1
tctgcgctgcggcggcgctcttta

SEQ ID NO: 75992 - DNA, 18 bp, Homo sapiens
tctgcgcggcggcggcct

SEQ ID NO: 75993 - DNA, 18 bp, Homo sapiens
cgcgctgcggcggcggct

SEQ ID NO: 75994 - DNA, 19 bp, Homo sapiens
gctgtgcagaagctcttta

SEQ ID NO: 75995 - DNA, 21 bp, Homo sapiens
tctgcggtgtggaccatcttt

SEQ ID NO: 75996 - DNA, 17 bp, Homo sapiens
tctgtgcctgcggcgct

SEQ ID NO: 75997 - DNA, 63 bp, Influenza A virus
tcgctttaaatacggactgaaaggagggccttctacggaaggagtgccaaagtctatgaggga

SEQ ID NO: 75998 - DNA, 22 bp, Influenza A virus
gagtgccaaagtctatgaggga

SEQ ID NO: 75999 - DNA, 20 bp, Homo sapiens
gaggccagagtgagttgggg

SEQ ID NO: 76000 - DNA, 19 bp, Homo sapiens
gagtgccagagaaaaggga

SEQ ID NO: 76001 - DNA, 16 bp, Homo sapiens
gagtatcaaatgaggg

SEQ ID NO: 76002 - DNA, 19 bp, Homo sapiens
atgccaactgcatgaggga

SEQ ID NO: 76003 - DNA, 15 bp, Homo sapiens
gcgccaaagccaggg

SEQ ID NO: 76004 - DNA, 19 bp, Homo sapiens
gagtgccaggggcaatggg

SEQ ID NO: 76005 - DNA, 17 bp, Homo sapiens
gagtgccaaagcctggg

SEQ ID NO: 76006 - DNA, 20 bp, Homo sapiens
gattgctgcagaatgaggga

SEQ ID NO: 76007 - DNA, 19 bp, Homo sapiens
tgccaaagagcctggaggg

SEQ ID NO: 76008 - DNA, 15 bp, Homo sapiens
gtccaaagtccaggg

SEQ ID NO: 76009 - DNA, 17 bp, Homo sapiens
gtggcaaagtctgtggg

SEQ ID NO: 76010 - DNA, 16 bp, Homo sapiens
ggtgccaaagtctggg

SEQ ID NO: 76011 - DNA, 20 bp, Homo sapiens
aagccccggtttgtgaggga

SEQ ID NO: 76012 - DNA, 17 bp, Homo sapiens
aagtgccaagcaaaggg

SEQ ID NO: 76013 - DNA, 19 bp, Homo sapiens
gactgccaaagcgcaggga

SEQ ID NO: 76014 - DNA, 19 bp, Homo sapiens
gaggccaggaagatggggg

SEQ ID NO: 76015 - DNA, 19 bp, Homo sapiens
gagtgccagaccctggggg

SEQ ID NO: 76016 - DNA, 18 bp, Homo sapiens
gagtggcaaagtcttgga

SEQ ID NO: 76017 - DNA, 20 bp, Homo sapiens
gagtgacactgctatgaggg

SEQ ID NO: 76018 - DNA, 17 bp, Homo sapiens
atgccaaagtcataggg

SEQ ID NO: 76019 - DNA, 21 bp, Homo sapiens
gagtgccaggtgtggatgggg

SEQ ID NO: 76020 - DNA, 20 bp, Homo sapiens
gagtgccagggactccgggg

SEQ ID NO: 76021 - DNA, 16 bp, Homo sapiens
gagtgccagtgtgggg

SEQ ID NO: 76022 - DNA, 18 bp, Homo sapiens
ggtgccaaactctgaggg

SEQ ID NO: 76023 - DNA, 17 bp, Homo sapiens
tgccgaaggacgaggga

SEQ ID NO: 76024 - DNA, 21 bp, Homo sapiens
gagtggccggagccacgaggg

SEQ ID NO: 76025 - DNA, 19 bp, Homo sapiens
aagtgccaggcggtggggg

SEQ ID NO: 76026 - DNA, 22 bp, Homo sapiens
gagtgccagggcagaacaggga

SEQ ID NO: 76027 - DNA, 20 bp, Homo sapiens
gaggccagcccacatgaggg

SEQ ID NO: 76028 - DNA, 18 bp, Homo sapiens
gaggccagatcatgaggg

SEQ ID NO: 76029 - DNA, 18 bp, Homo sapiens
ggtgtcaaagtctcagga

SEQ ID NO: 76030 - DNA, 19 bp, Homo sapiens
gaatgttaaacatgaggga

SEQ ID NO: 76031 - DNA, 22 bp, Homo sapiens
gaggccagagtgtgcctgggga

SEQ ID NO: 76032 - DNA, 17 bp, Homo sapiens
gtgttaaagtccaggga

SEQ ID NO: 76033 - DNA, 20 bp, Homo sapiens
gagtgtggtgtgatgaggga

SEQ ID NO: 76034 - DNA, 21 bp, Homo sapiens
gaggccaaagcaccatgggga

SEQ ID NO: 76035 - DNA, 21 bp, Homo sapiens
gagtctcgatctgatgaggga

SEQ ID NO: 76036 - DNA, 21 bp, Homo sapiens
gagtgccagtggttcccggga

SEQ ID NO: 76037 - DNA, 17 bp, Homo sapiens
gaggccaaagttggtgg

SEQ ID NO: 76038 - DNA, 18 bp, Homo sapiens
aagtgtcagagtctatga

SEQ ID NO: 76039 - DNA, 18 bp, Homo sapiens
aagtgccaaaggtaaggg

SEQ ID NO: 76040 - DNA, 19 bp, Homo sapiens
gagtgcacaagggtgggga

SEQ ID NO: 76041 - DNA, 17 bp, Homo sapiens
gaggccaaagtcgagga

SEQ ID NO: 76042 - DNA, 19 bp, Homo sapiens
gagtcctgggctgtgaggg

SEQ ID NO: 76043 - DNA, 21 bp, Homo sapiens
gagtattgctcaaatgaggga

SEQ ID NO: 76044 - DNA, 17 bp, Homo sapiens
gaatgccaaagccaggg

SEQ ID NO: 76045 - DNA, 19 bp, Homo sapiens
agtgctgaagtccacagga

SEQ ID NO: 76046 - DNA, 16 bp, Homo sapiens
gttccaaagtcatggg

SEQ ID NO: 76047 - DNA, 16 bp, Homo sapiens
gtcccaaagtcatggg

SEQ ID NO: 76048 - DNA, 17 bp, Homo sapiens
gagtgccaggagcaggg

SEQ ID NO: 76049 - DNA, 77 bp, Human papillomavirus type 57
gtgcggagcggcggacataaggcatctggagcagctgttcctgaatacgttgaccatagtgtgcccccgctgcgtat

SEQ ID NO: 76050 - DNA, 21 bp, Human papillomavirus type 57
tagtgtgcccccgctgcgtat

SEQ ID NO: 76051 - DNA, 21 bp, Homo sapiens
gtgtgcccaaactctgtgtat

SEQ ID NO: 76052 - DNA, 19 bp, Homo sapiens
tactgtgcccccactgggt

SEQ ID NO: 76053 - DNA, 19 bp, Homo sapiens
taatgtgctttctccatat

SEQ ID NO: 76054 - DNA, 20 bp, Homo sapiens
agtgtgcccctcctctgtat

SEQ ID NO: 76055 - DNA, 17 bp, Homo sapiens
tagtgtgctccttgcat

SEQ ID NO: 76056 - DNA, 20 bp, Homo sapiens
tagtgtgcctgtgactccat

SEQ ID NO: 76057 - DNA, 18 bp, Homo sapiens
tagtgcgcccctgagcca

SEQ ID NO: 76058 - DNA, 18 bp, Homo sapiens
taatgtgctcctgctcat

SEQ ID NO: 76059 - DNA, 17 bp, Homo sapiens
tagtgtgcactgtacat

SEQ ID NO: 76060 - DNA, 15 bp, Homo sapiens
tagtgtgccctgcgt

SEQ ID NO: 76061 - DNA, 20 bp, Homo sapiens
cagtgtgccctcgtgcacat

SEQ ID NO: 76062 - DNA, 19 bp, Homo sapiens
tactgtgccccagctatgt

SEQ ID NO: 76063 - DNA, 19 bp, Homo sapiens
tagtgtgcctccttgacat

SEQ ID NO: 76064 - DNA, 20 bp, Homo sapiens
taatgtgctcccacttgtat

SEQ ID NO: 76065 - DNA, 19 bp, Homo sapiens
tagcgtgccttgtcggtat

SEQ ID NO: 76066 - DNA, 18 bp, Homo sapiens
atgtgccctcacagatat

SEQ ID NO: 76067 - DNA, 69 bp, Human papillomavirus type 10
cacgcagatataagggcactggaacagctgctactaggcacattgaagctcgtgtgtcctcgctgcgtg

SEQ ID NO: 76068 - DNA, 24 bp, Human papillomavirus type 10
taagggcactggaacagctgctac

SEQ ID NO: 76069 - DNA, 19 bp, Homo sapiens
caagggccagacagctgct

SEQ ID NO: 76070 - DNA, 24 bp, Homo sapiens
agacacgggattggaacagttgct

SEQ ID NO: 76071 - DNA, 18 bp, Homo sapiens
gagccgggagcagctgct

SEQ ID NO: 76072 - DNA, 21 bp, Homo sapiens
caagggcactggggccgctgc

SEQ ID NO: 76073 - DNA, 16 bp, Homo sapiens
aagggcactggggccg

SEQ ID NO: 76074 - DNA, 19 bp, Homo sapiens
agggcactggagccattgc

SEQ ID NO: 76075 - DNA, 23 bp, Homo sapiens
aagggcactgggggaagggctgc

SEQ ID NO: 76076 - DNA, 20 bp, Homo sapiens
agggctcagaggcagctgct

SEQ ID NO: 76077 - DNA, 17 bp, Homo sapiens
aagggcactggctgtta

SEQ ID NO: 76078 - DNA, 18 bp, Homo sapiens
gggcctggggccagctgc

SEQ ID NO: 76079 - DNA, 21 bp, Homo sapiens
gggcaggggggtggctgctac

SEQ ID NO: 76080 - DNA, 16 bp, Homo sapiens
gggcactgcaaactac

SEQ ID NO: 76081 - DNA, 19 bp, Homo sapiens
aggctgggggacagctgct

SEQ ID NO: 76082 - DNA, 16 bp, Homo sapiens
gggcactgggagctgc

SEQ ID NO: 76083 - DNA, 19 bp, Homo sapiens
caagggttagcagctgcta

SEQ ID NO: 76084 - DNA, 18 bp, Homo sapiens
tgaggtactgcactgcta

SEQ ID NO: 76085 - DNA, 18 bp, Homo sapiens
caagggcactggagtaca

SEQ ID NO: 76086 - DNA, 21 bp, Homo sapiens
gggcgtgctgccacagctgct

SEQ ID NO: 76087 - DNA, 22 bp, Homo sapiens
aggggattggacatgctgttac

SEQ ID NO: 76088 - DNA, 20 bp, Homo sapiens
gggggggagtcacagctgct

SEQ ID NO: 76089 - DNA, 20 bp, Homo sapiens
gggggtgtggaacaggctgc

SEQ ID NO: 76090 - DNA, 20 bp, Homo sapiens
gggcactgtgagcttgctgc

SEQ ID NO: 76091 - DNA, 18 bp, Homo sapiens
gggccactggaaatctgc

SEQ ID NO: 76092 - DNA, 16 bp, Homo sapiens
gggcacacagttgcta

SEQ ID NO: 76093 - DNA, 17 bp, Homo sapiens
taaggacaacagctgct

SEQ ID NO: 76094 - DNA, 18 bp, Homo sapiens
gggctccgggcagctgct

SEQ ID NO: 76095 - DNA, 18 bp, Homo sapiens
gagcaggacagctgctac

SEQ ID NO: 76096 - DNA, 22 bp, Homo sapiens
gggcactggtgcttcggctgct

SEQ ID NO: 76097 - DNA, 19 bp, Homo sapiens
taaaggcacatgggctgct

SEQ ID NO: 76098 - DNA, 21 bp, Homo sapiens
agcagctggaatagctgctac

SEQ ID NO: 76099 - DNA, 20 bp, Homo sapiens
gggcactgtggccacagctg

SEQ ID NO: 76100 - DNA, 19 bp, Homo sapiens
gggctgctggagctgctac

SEQ ID NO: 76101 - DNA, 19 bp, Homo sapiens
gggctgctgccgctgctac

SEQ ID NO: 76102 - DNA, 20 bp, Homo sapiens
agggcactgggggtcactgc

SEQ ID NO: 76103 - DNA, 20 bp, Homo sapiens
aagggagcagcggctgctac

SEQ ID NO: 76104 - DNA, 16 bp, Homo sapiens
agggcactggagctgc

SEQ ID NO: 76105 - DNA, 17 bp, Homo sapiens
ggacaggggcagctgct

SEQ ID NO: 76106 - DNA, 18 bp, Homo sapiens
aagggtgctggaacaggc

SEQ ID NO: 76107 - DNA, 22 bp, Homo sapiens
gggcgagcaggacagctgctac

SEQ ID NO: 76108 - DNA, 19 bp, Homo sapiens
aggggtggcttcagctgct

SEQ ID NO: 76109 - DNA, 21 bp, Homo sapiens
aggggtgagggcacagctgct

SEQ ID NO: 76110 - DNA, 18 bp, Homo sapiens
agggcagcctcagctgct

SEQ ID NO: 76111 - DNA, 20 bp, Homo sapiens
aagggaacaggacagctgct

SEQ ID NO: 76112 - DNA, 18 bp, Homo sapiens
aggacactggggttgcta

SEQ ID NO: 76113 - DNA, 81 bp, Grapevine fanleaf virus
gtgcagtttacttttaatctacatattttactgtgttatttatttaagtttaattttgtagttgtaaaagttgtttgccac

SEQ ID NO: 76114 - DNA, 24 bp, Grapevine fanleaf virus
tctacatattttactgtgttattt

SEQ ID NO: 76115 - DNA, 18 bp, Homo sapiens
ctacatattttacctgtt

SEQ ID NO: 76116 - DNA, 19 bp, Homo sapiens
tacatattttatatgtgct

SEQ ID NO: 76117 - DNA, 18 bp, Homo sapiens
tacatattttacatgtgt

SEQ ID NO: 76118 - DNA, 18 bp, Homo sapiens
tacatattttattgcatt

SEQ ID NO: 76119 - DNA, 21 bp, Homo sapiens
tacatttttgttgtgttattt

SEQ ID NO: 76120 - DNA, 19 bp, Homo sapiens
tacattcacagtgttattt

SEQ ID NO: 76121 - DNA, 21 bp, Homo sapiens
cctatatattttacttgtatt

SEQ ID NO: 76122 - DNA, 27 bp, Homo sapiens
tctacctattttactgtggagttattt

SEQ ID NO: 76123 - DNA, 20 bp, Homo sapiens
tacatattttagctatagtt

SEQ ID NO: 76124 - DNA, 20 bp, Homo sapiens
tctgtgcattttactatatt

SEQ ID NO: 76125 - DNA, 19 bp, Homo sapiens
tctatttattttactagct

SEQ ID NO: 76126 - DNA, 19 bp, Homo sapiens
tacaaattttacaaatgtt

SEQ ID NO: 76127 - DNA, 22 bp, Homo sapiens
tctacttattttacagctattt

SEQ ID NO: 76128 - DNA, 19 bp, Homo sapiens
tctacatgttttacttgtt

SEQ ID NO: 76129 - DNA, 21 bp, Homo sapiens
tacatattctcctggttattt

SEQ ID NO: 76130 - DNA, 21 bp, Homo sapiens
tacatattttacatacaattt

SEQ ID NO: 76131 - DNA, 17 bp, Homo sapiens
tctacagttttactgta

SEQ ID NO: 76132 - DNA, 80 bp, Bean common mosaic necrosis virus
ggaggagccattccaacaccggagctgccagcgtggttgtaccatgagtgctgtccgaggtgcgggtatgaatattctct

SEQ ID NO: 76133 - DNA, 24 bp, Bean common mosaic necrosis virus
tccaacaccggagctgccagcgtg

SEQ ID NO: 76134 - DNA, 22 bp, Homo sapiens
cccagtgttgaaccccagcgtg

SEQ ID NO: 76135 - DNA, 20 bp, Homo sapiens
cccagcactggggctgccag

SEQ ID NO: 76136 - DNA, 18 bp, Homo sapiens
tccaacactgagctgtcc

SEQ ID NO: 76137 - DNA, 24 bp, Homo sapiens
tccagcgtaggggctgaccaagtg

SEQ ID NO: 76138 - DNA, 24 bp, Homo sapiens
tccacccttggggctgccagcgtg

SEQ ID NO: 76139 - DNA, 83 bp, Bean common mosaic necrosis virus
catagttttctgtattagatagtacgctttcaattccagtgtggttataccaccttgtgtctatgtaagttagagtggctatg

SEQ ID NO: 76140 - DNA, 24 bp, Bean common mosaic necrosis virus
tattagatagtacgctttcaattc

SEQ ID NO: 76141 - DNA, 21 bp, Homo sapiens
ttagctggcagctttcaattc

SEQ ID NO: 76142 - DNA, 18 bp, Homo sapiens
tattagatgtgctcaatt

SEQ ID NO: 76143 - DNA, 23 bp, Homo sapiens
tattagaatacttttttcaattc

SEQ ID NO: 76144 - DNA, 60 bp, Ovine adenovirus A
gagtatgcgcaactagattttaatgctactaattggacagaagcttcttggtacaaactt

SEQ ID NO: 76145 - DNA, 24 bp, Ovine adenovirus A
actagattttaatgctactaattg

SEQ ID NO: 76146 - DNA, 24 bp, Homo sapiens
ctagaacatgaatgttactaattg

SEQ ID NO: 76147 - DNA, 23 bp, Homo sapiens
tagattttagtgggccacaattg

SEQ ID NO: 76148 - DNA, 21 bp, Homo sapiens
actagatttaatgttgttacc

SEQ ID NO: 76149 - DNA, 19 bp, Homo sapiens
tagattttaatagcccact

SEQ ID NO: 76150 - DNA, 75 bp, Infectious spleen and kidney necrosis virus
gcctagacatcagaccgcgcaggctgttgttgtgttgcttgtaccacgtcacagccatataggttacgttcgggt

SEQ ID NO: 76151 - DNA, 24 bp, Infectious spleen and kidney necrosis virus
cgtcacagccatataggttacgtt

SEQ ID NO: 76152 - DNA, 20 bp, Homo sapiens
cgtcacagcatatgtgggct

SEQ ID NO: 76153 - DNA, 16 bp, Homo sapiens
tcatagccaattacgt

SEQ ID NO: 76154 - DNA, 19 bp, Homo sapiens
cgtcacagccaggtaggcc

SEQ ID NO: 76155 - DNA, 18 bp, Homo sapiens
gtcacagcaatatccgtt

SEQ ID NO: 76156 - DNA, 17 bp, Homo sapiens
cgtcacagttatgaggt

SEQ ID NO: 76157 - DNA, 18 bp, Homo sapiens
gtcacaaccatagatgtt

SEQ ID NO: 76158 - DNA, 23 bp, Homo sapiens
cgtcacagccagatttgcatgtt

SEQ ID NO: 76159 - DNA, 62 bp, Rat cytomegalovirus
tttccgtcgatctggaagcttgtgttctaaatgaatatatccttcaccaaatatcgcagaag

SEQ ID NO: 76160 - DNA, 23 bp, Rat cytomegalovirus
tccttcaccaaatatcgcagaag

SEQ ID NO: 76161 - DNA, 19 bp, Homo sapiens
ttcaccaaaaggtcagaag

SEQ ID NO: 76162 - DNA, 17 bp, Homo sapiens
ctcaccaagagcagaag

SEQ ID NO: 76163 - DNA, 21 bp, Homo sapiens
tccttcaccaatgttacatga

SEQ ID NO: 76164 - DNA, 20 bp, Homo sapiens
tccttcaccaaaaatatcag

SEQ ID NO: 76165 - DNA, 19 bp, Homo sapiens
tctctcaccaaatgtcgag

SEQ ID NO: 76166 - DNA, 15 bp, Homo sapiens
cccttcaccagcaga

SEQ ID NO: 76167 - DNA, 19 bp, Homo sapiens
tcctccaccctcattgcag

SEQ ID NO: 76168 - DNA, 24 bp, Homo sapiens
tccttcactggattagtgcagaag

SEQ ID NO: 76169 - DNA, 19 bp, Homo sapiens
tcctcaccaagccaagaag

SEQ ID NO: 76170 - DNA, 21 bp, Homo sapiens
tcctccaccaacaaacggaag

SEQ ID NO: 76171 - DNA, 15 bp, Homo sapiens
tcctccaccaacaga

SEQ ID NO: 76172 - DNA, 18 bp, Homo sapiens
ctccaccaggacaggaag

SEQ ID NO: 76173 - DNA, 21 bp, Homo sapiens
tcatcaccaaactgagccaga

SEQ ID NO: 76174 - DNA, 22 bp, Homo sapiens
tcctgtaccagccccacagaag

SEQ ID NO: 76175 - DNA, 17 bp, Homo sapiens
cttcaccaaaatcacag

SEQ ID NO: 76176 - DNA, 19 bp, Homo sapiens
ccttcaccagcacctgcag

SEQ ID NO: 76177 - DNA, 18 bp, Homo sapiens
cccttcaccagaacagaa

SEQ ID NO: 76178 - DNA, 18 bp, Homo sapiens
cttcaccaaaaataacag

SEQ ID NO: 76179 - DNA, 18 bp, Homo sapiens
tccttcactaatattcaa

SEQ ID NO: 76180 - DNA, 18 bp, Homo sapiens
cttcaccaatacgtacag

SEQ ID NO: 76181 - DNA, 18 bp, Homo sapiens
tccttcacaaatacgaag

SEQ ID NO: 76182 - DNA, 19 bp, Homo sapiens
cttcaccaggtagtcgaag

SEQ ID NO: 76183 - DNA, 19 bp, Homo sapiens
tcctttgcaaacaccagag

SEQ ID NO: 76184 - DNA, 22 bp, Homo sapiens
tccttcaccagatcgtgaccag

SEQ ID NO: 76185 - DNA, 21 bp, Homo sapiens
tccttcaccagagtactccag

SEQ ID NO: 76186 - DNA, 20 bp, Homo sapiens
ttcaccaaacatatcccaga

SEQ ID NO: 76187 - DNA, 16 bp, Homo sapiens
cttcaccaaatgcaga

SEQ ID NO: 76188 - DNA, 20 bp, Homo sapiens
tccttcactgaaagtcatcg

SEQ ID NO: 76189 - DNA, 19 bp, Homo sapiens
tcctccaccaagtatccgc

SEQ ID NO: 76190 - DNA, 23 bp, Homo sapiens
tccttcaccaggctgtaccggag

SEQ ID NO: 76191 - DNA, 25 bp, Homo sapiens
tctctcaccaaatgtgattgagaag

SEQ ID NO: 76192 - DNA, 119 bp, Paramecium bursaria Chlorella virus 1
attttctttgttcttttatgtttattttgtttgtcatttaaaaaacaacaaactttatcaaatgacaaacaaatgacaattaaatgacaaacaaagtaatagtgaagtttagaaaggat

SEQ ID NO: 76193 - DNA, 24 bp, Paramecium bursaria Chlorella virus 1
tctttgttcttttatgtttatttt

SEQ ID NO: 76194 - DNA, 22 bp, Homo sapiens
tttgttcttttcaaaacatttt

SEQ ID NO: 76195 - DNA, 25 bp, Homo sapiens
tctttattcttttattattcatttt

SEQ ID NO: 76196 - DNA, 24 bp, Homo sapiens
tcttggttcacaactgtttatttt

SEQ ID NO: 76197 - DNA, 21 bp, Homo sapiens
tttgtgcttcatgtttatttt

SEQ ID NO: 76198 - DNA, 19 bp, Homo sapiens
tctttgttcttctgtgttt

SEQ ID NO: 76199 - DNA, 18 bp, Homo sapiens
tctttgttcttgttgttt

SEQ ID NO: 76200 - DNA, 23 bp, Homo sapiens
tccttgtggcttatgtttatttt

SEQ ID NO: 76201 - DNA, 22 bp, Homo sapiens
tttgttccttttgacttatttt

SEQ ID NO: 76202 - DNA, 20 bp, Homo sapiens
tttgttctcatgtttatttt

SEQ ID NO: 76203 - DNA, 21 bp, Homo sapiens
tttgtcttttaaatccatttt

SEQ ID NO: 76204 - DNA, 25 bp, Homo sapiens
tctttgttccttttaaagttatttt

SEQ ID NO: 76205 - DNA, 21 bp, Homo sapiens
cttattttttatgtttatttt

SEQ ID NO: 76206 - DNA, 23 bp, Homo sapiens
tttcttctttacatatttatttt

SEQ ID NO: 76207 - DNA, 22 bp, Homo sapiens
cttgtacctttgtgtttatttt

SEQ ID NO: 76208 - DNA, 19 bp, Homo sapiens
tctttgttcctttgtgttt

SEQ ID NO: 76209 - DNA, 18 bp, Homo sapiens
tctttgttcagtttgttt

SEQ ID NO: 76210 - DNA, 24 bp, Homo sapiens
tctttggttcttttggttcatttt

SEQ ID NO: 76211 - DNA, 24 bp, Homo sapiens
tcttttgttcttttggttatgttt

SEQ ID NO: 76212 - DNA, 61 bp, Camelpox virus
tctacgtatctcgtcgtccaatattttatataaaaacattttatttctagacgttgccaga

SEQ ID NO: 76213 - DNA, 18 bp, Camelpox virus
tttctagacgttgccaga

SEQ ID NO: 76214 - DNA, 15 bp, Homo sapiens
tttcagacgttcaga

SEQ ID NO: 76215 - DNA, 21 bp, Homo sapiens
tttctagacctgttagctgga

SEQ ID NO: 76216 - DNA, 19 bp, Homo sapiens
tctctagaaataactcaga

SEQ ID NO: 76217 - DNA, 18 bp, Homo sapiens
tctctggaacctaccaga

SEQ ID NO: 76218 - DNA, 17 bp, Homo sapiens
tttccaaagttgctgga

SEQ ID NO: 76219 - DNA, 17 bp, Homo sapiens
tttccagacagaccaga

SEQ ID NO: 76220 - DNA, 18 bp, Homo sapiens
cttctagagtagaccaga

SEQ ID NO: 76221 - DNA, 16 bp, Homo sapiens
tttctaaaataccaga

SEQ ID NO: 76222 - DNA, 16 bp, Homo sapiens
tttccagaataccaga

SEQ ID NO: 76223 - DNA, 18 bp, Homo sapiens
tttcagacgtctcccaga

SEQ ID NO: 76224 - DNA, 22 bp, Homo sapiens
tttctagactgaatgttccaga

SEQ ID NO: 76225 - DNA, 18 bp, Homo sapiens
tttctgtacattgccaga

SEQ ID NO: 76226 - DNA, 20 bp, Homo sapiens
tttctaaaagctttgccaga

SEQ ID NO: 76227 - DNA, 18 bp, Homo sapiens
ttctaatgacttgccaga

SEQ ID NO: 76228 - DNA, 16 bp, Homo sapiens
ttcctagacacccaga

SEQ ID NO: 76229 - DNA, 17 bp, Homo sapiens
tttccaaacctgccaga

SEQ ID NO: 76230 - DNA, 17 bp, Homo sapiens
tctctagaattatcaga

SEQ ID NO: 76231 - DNA, 18 bp, Homo sapiens
tttcagtaacttgccaga

SEQ ID NO: 76232 - DNA, 19 bp, Homo sapiens
tctctagagtcactccaga

SEQ ID NO: 76233 - DNA, 19 bp, Homo sapiens
tttccagatttcttgccag

SEQ ID NO: 76234 - DNA, 20 bp, Homo sapiens
tttccagacaatgtctcaga

SEQ ID NO: 76235 - DNA, 17 bp, Homo sapiens
tttcttgaattgccaga

SEQ ID NO: 76236 - DNA, 16 bp, Homo sapiens
tttctagatacctaga

SEQ ID NO: 76237 - DNA, 18 bp, Homo sapiens
tttcacagagttgccaga

SEQ ID NO: 76238 - DNA, 16 bp, Homo sapiens
tttctggactaccaaa

SEQ ID NO: 76239 - DNA, 18 bp, Homo sapiens
tttctaaacctttgccag

SEQ ID NO: 76240 - DNA, 16 bp, Homo sapiens
tttctagagttccaga

SEQ ID NO: 76241 - DNA, 17 bp, Homo sapiens
tttcagaaattgccaga

SEQ ID NO: 76242 - DNA, 19 bp, Homo sapiens
ttctagaccttgagccgga

SEQ ID NO: 76243 - DNA, 17 bp, Homo sapiens
tttctagagtgtccaga

SEQ ID NO: 76244 - DNA, 16 bp, Homo sapiens
ttcctagagttgcaga

SEQ ID NO: 76245 - DNA, 15 bp, Homo sapiens
tctctgactgccaga

SEQ ID NO: 76246 - DNA, 18 bp, Homo sapiens
tttcctgattttgccaga

SEQ ID NO: 76247 - DNA, 18 bp, Homo sapiens
tctagacataacttcaga

SEQ ID NO: 76248 - DNA, 16 bp, Homo sapiens
tttcaaaactgccaga

SEQ ID NO: 76249 - DNA, 20 bp, Homo sapiens
tttccagacacagcagccag

SEQ ID NO: 76250 - DNA, 17 bp, Homo sapiens
tttccagacatttcaga

SEQ ID NO: 76251 - DNA, 19 bp, Homo sapiens
tctctagaggtcttgctag

SEQ ID NO: 76252 - DNA, 16 bp, Homo sapiens
tttcagacattccaga

SEQ ID NO: 76253 - DNA, 20 bp, Homo sapiens
ttcctagcctgcctgccaga

SEQ ID NO: 76254 - DNA, 17 bp, Homo sapiens
tttctagagacgccaga

SEQ ID NO: 76255 - DNA, 17 bp, Homo sapiens
tttcttaacttgccaga

SEQ ID NO: 76256 - DNA, 20 bp, Homo sapiens
tttccagacaccacaccaga

SEQ ID NO: 76257 - DNA, 16 bp, Homo sapiens
cttctagacttgtaga

SEQ ID NO: 76258 - DNA, 17 bp, Homo sapiens
tttccgacgctgccgga

SEQ ID NO: 76259 - DNA, 15 bp, Homo sapiens
tttccagttgccaga

SEQ ID NO: 76260 - DNA, 16 bp, Homo sapiens
tctctgagctgccaga

SEQ ID NO: 76261 - DNA, 16 bp, Homo sapiens
tctctagactttcaga

SEQ ID NO: 76262 - DNA, 18 bp, Homo sapiens
tttccagaaactaccaga

SEQ ID NO: 76263 - DNA, 20 bp, Homo sapiens
tttctagaggttaacctaga

SEQ ID NO: 76264 - DNA, 16 bp, Homo sapiens
tctctagaggcccaga

SEQ ID NO: 76265 - DNA, 16 bp, Homo sapiens
tctcctgactgccaga

SEQ ID NO: 76266 - DNA, 17 bp, Homo sapiens
tttccagatactgcaga

SEQ ID NO: 76267 - DNA, 19 bp, Homo sapiens
tttctaaactttagccaga

SEQ ID NO: 76268 - DNA, 17 bp, Homo sapiens
tctctaaggttgccaga

SEQ ID NO: 76269 - DNA, 20 bp, Homo sapiens
cttctagacccaatgtcaga

SEQ ID NO: 76270 - DNA, 15 bp, Homo sapiens
cttctagagtccaga

SEQ ID NO: 76271 - DNA, 19 bp, Homo sapiens
tttctagaagttcttcaga

SEQ ID NO: 76272 - DNA, 17 bp, Homo sapiens
tttctaaagcagccgga

SEQ ID NO: 76273 - DNA, 19 bp, Homo sapiens
tttccagagttcaaccaga

SEQ ID NO: 76274 - DNA, 16 bp, Homo sapiens
tttcagcattgccaga

SEQ ID NO: 76275 - DNA, 17 bp, Homo sapiens
ttcctagagccaccaga

SEQ ID NO: 76276 - DNA, 18 bp, Homo sapiens
tttctagatgttctccag

SEQ ID NO: 76277 - DNA, 18 bp, Homo sapiens
ttctagaccccccccaga

SEQ ID NO: 76278 - DNA, 18 bp, Homo sapiens
cttctagacttgattcag

SEQ ID NO: 76279 - DNA, 17 bp, Homo sapiens
cttctcactctgccaga

SEQ ID NO: 76280 - DNA, 18 bp, Homo sapiens
tttctagacgcttccaga

SEQ ID NO: 76281 - DNA, 18 bp, Homo sapiens
tctctagagccctgctag

SEQ ID NO: 76282 - DNA, 17 bp, Homo sapiens
tttccaaacatgccaga

SEQ ID NO: 76283 - DNA, 16 bp, Homo sapiens
tttctagagctccaga

SEQ ID NO: 76284 - DNA, 21 bp, Homo sapiens
tttctagagtaacttcccaga

SEQ ID NO: 76285 - DNA, 18 bp, Homo sapiens
tttctaaaccaaaccaga

SEQ ID NO: 76286 - DNA, 16 bp, Homo sapiens
cttctaaacagccaga

SEQ ID NO: 76287 - DNA, 18 bp, Homo sapiens
ttctagaccctccccaga

SEQ ID NO: 76288 - DNA, 67 bp, Human herpesvirus 2
cccgtcggtcggaagcgagtgcccttcaagcgtgtccgctcctctgggctgcatgccgtcggatggg

SEQ ID NO: 76289 - DNA, 19 bp, Human herpesvirus 2
ctgcatgccgtcggatggg

SEQ ID NO: 76290 - DNA, 17 bp, Homo sapiens
ctgcatgtcgcaataag

SEQ ID NO: 76291 - DNA, 20 bp, Homo sapiens
ctgcatgctaggatataggg

SEQ ID NO: 76292 - DNA, 17 bp, Homo sapiens
ctgcattccagcctggg

SEQ ID NO: 76293 - DNA, 16 bp, Homo sapiens
ctgtgtccgtcggagg

SEQ ID NO: 76294 - DNA, 19 bp, Homo sapiens
ctggatgtgctcagatggg

SEQ ID NO: 76295 - DNA, 16 bp, Homo sapiens
ctgcatgcgtaaatgg

SEQ ID NO: 76296 - DNA, 17 bp, Homo sapiens
ctgcacgccagtctggg

SEQ ID NO: 76297 - DNA, 18 bp, Homo sapiens
tgcatgcctgttcattgg

SEQ ID NO: 76298 - DNA, 16 bp, Homo sapiens
ctgctgcccagatggg

SEQ ID NO: 76299 - DNA, 18 bp, Homo sapiens
ctgcagcaatctggtggg

SEQ ID NO: 76300 - DNA, 18 bp, Homo sapiens
ctgatgccagcagatggg

SEQ ID NO: 76301 - DNA, 17 bp, Homo sapiens
ctgcacgccagcctggg

SEQ ID NO: 76302 - DNA, 18 bp, Homo sapiens
ctgcatgctctgaatagg

SEQ ID NO: 76303 - DNA, 19 bp, Homo sapiens
ctgcatgccgcctcatggg

SEQ ID NO: 76304 - DNA, 23 bp, Homo sapiens
ctgcatgccgctcactccgtggg

SEQ ID NO: 76305 - DNA, 17 bp, Homo sapiens
ctgcataccagcctggg

SEQ ID NO: 76306 - DNA, 22 bp, Homo sapiens
ctgcatgcattggtaggatggg

SEQ ID NO: 76307 - DNA, 16 bp, Homo sapiens
ctgcagatcagatggg

SEQ ID NO: 76308 - DNA, 16 bp, Homo sapiens
ctgcatgcgtcctggg

SEQ ID NO: 76309 - DNA, 16 bp, Homo sapiens
ctgcatgcatcctggg

SEQ ID NO: 76310 - DNA, 22 bp, Homo sapiens
ctgcataccaagggggggtggg

SEQ ID NO: 76311 - DNA, 16 bp, Homo sapiens
ctgcatgcatggcggg

SEQ ID NO: 76312 - DNA, 18 bp, Homo sapiens
ctgcatgcccttcctggg

SEQ ID NO: 76313 - DNA, 16 bp, Homo sapiens
ctgaatgccgtcgagg

SEQ ID NO: 76314 - DNA, 18 bp, Homo sapiens
ccgcgcggcccggatggg

SEQ ID NO: 76315 - DNA, 18 bp, Homo sapiens
tgcatgccagttagaggg

SEQ ID NO: 76316 - DNA, 21 bp, Homo sapiens
ctgcatgctctatagggtggg

SEQ ID NO: 76317 - DNA, 19 bp, Homo sapiens
ctgtgtctgcccaaatggg

SEQ ID NO: 76318 - DNA, 16 bp, Homo sapiens
ctgctgcccgggtggg

SEQ ID NO: 76319 - DNA, 16 bp, Homo sapiens
ctggtgcgcagatggg

SEQ ID NO: 76320 - DNA, 19 bp, Homo sapiens
tgcatgccctcctgatggg

SEQ ID NO: 76321 - DNA, 15 bp, Homo sapiens
ctgcatggcggtggg

SEQ ID NO: 76322 - DNA, 19 bp, Homo sapiens
ctgatataaaccggatggg

SEQ ID NO: 76323 - DNA, 18 bp, Homo sapiens
ctgcaccaaatggatggg

SEQ ID NO: 76324 - DNA, 15 bp, Homo sapiens
ctgctgccgtcgcgg

SEQ ID NO: 76325 - DNA, 19 bp, Homo sapiens
ctgtaagccgacaaatggg

SEQ ID NO: 76326 - DNA, 17 bp, Homo sapiens
ctgagcggccggatggg

SEQ ID NO: 76327 - DNA, 18 bp, Homo sapiens
ctgcatgcggcccctggg

SEQ ID NO: 76328 - DNA, 16 bp, Homo sapiens
ctgcatgcatggtggg

SEQ ID NO: 76329 - DNA, 15 bp, Homo sapiens
cgcatggcagatggg

SEQ ID NO: 76330 - DNA, 16 bp, Homo sapiens
tgcacgccagcctggg

SEQ ID NO: 76331 - DNA, 19 bp, Homo sapiens
ctgcatgccggtgcatggg

SEQ ID NO: 76332 - DNA, 17 bp, Homo sapiens
tggatgccacaaatggg

SEQ ID NO: 76333 - DNA, 17 bp, Homo sapiens
tacatgccaagagtggg

SEQ ID NO: 76334 - DNA, 18 bp, Homo sapiens
ctccatgccgtgagtagg

SEQ ID NO: 76335 - DNA, 15 bp, Homo sapiens
tacatgtcgaacggg

SEQ ID NO: 76336 - DNA, 20 bp, Homo sapiens
ctgcagtgtgcgggggtggg

SEQ ID NO: 76337 - DNA, 16 bp, Homo sapiens
ctgcatgcagtagcgg

SEQ ID NO: 76338 - DNA, 19 bp, Homo sapiens
ctgatgccgtcatcgaggg

SEQ ID NO: 76339 - DNA, 22 bp, Homo sapiens
ctacatgctgtttaattatggg

SEQ ID NO: 76340 - DNA, 19 bp, Homo sapiens
ctgcgagccggcaaatggg

SEQ ID NO: 76341 - DNA, 16 bp, Homo sapiens
ctgcaggccgtcatag

SEQ ID NO: 76342 - DNA, 17 bp, Homo sapiens
ctgcatgcctcaatggg

SEQ ID NO: 76343 - DNA, 18 bp, Homo sapiens
ccgcatgcggtggatggg

SEQ ID NO: 76344 - DNA, 18 bp, Homo sapiens
ctgcatacgtagtatggg

SEQ ID NO: 76345 - DNA, 17 bp, Homo sapiens
ctgcatgctgtcagcgg

SEQ ID NO: 76346 - DNA, 16 bp, Homo sapiens
tgcatgccaggctggg

SEQ ID NO: 76347 - DNA, 19 bp, Homo sapiens
ctgcatgcagagtggtggg

SEQ ID NO: 76348 - DNA, 16 bp, Homo sapiens
cgcatgtccagatggg

SEQ ID NO: 76349 - DNA, 19 bp, Homo sapiens
ctgcatgcctctcgctggg

SEQ ID NO: 76350 - DNA, 18 bp, Homo sapiens
ccgcatgcccagggtggg

SEQ ID NO: 76351 - DNA, 63 bp, Human papillomavirus type 50
ggttctcacaaaaatatgcagatctctatgagtgttgtagctctgcatggaagtggttgggcc

SEQ ID NO: 76352 - DNA, 20 bp, Human papillomavirus type 50
tgcatggaagtggttgggcc

SEQ ID NO: 76353 - DNA, 18 bp, Homo sapiens
gcatggtcagtcttgggc

SEQ ID NO: 76354 - DNA, 19 bp, Homo sapiens
tgcagtggagggctgggcc

SEQ ID NO: 76355 - DNA, 19 bp, Homo sapiens
tgcatagaaatgtgtgggc

SEQ ID NO: 76356 - DNA, 17 bp, Homo sapiens
tgcctggaggccgggcc

SEQ ID NO: 76357 - DNA, 18 bp, Homo sapiens
tgcacggaggtccggagc

SEQ ID NO: 76358 - DNA, 16 bp, Homo sapiens
gcatggaaggcgaggc

SEQ ID NO: 76359 - DNA, 16 bp, Homo sapiens
tgatgggggccgggcc

SEQ ID NO: 76360 - DNA, 17 bp, Homo sapiens
tgcatggggggccgggc

SEQ ID NO: 76361 - DNA, 18 bp, Homo sapiens
tgcagggaagtgggtgcc

SEQ ID NO: 76362 - DNA, 20 bp, Homo sapiens
tgcggtggggcgatggggcc

SEQ ID NO: 76363 - DNA, 18 bp, Homo sapiens
gcatggaagtaaatagcc

SEQ ID NO: 76364 - DNA, 16 bp, Homo sapiens
tacatggaggtaaggc

SEQ ID NO: 76365 - DNA, 18 bp, Homo sapiens
gcatggaagtcccaggcc

SEQ ID NO: 76366 - DNA, 17 bp, Homo sapiens
gcatggggctcagggcc

SEQ ID NO: 76367 - DNA, 16 bp, Homo sapiens
tgctggagagatgggc

SEQ ID NO: 76368 - DNA, 19 bp, Homo sapiens
gcatggaagcaatggggcc

SEQ ID NO: 76369 - DNA, 19 bp, Homo sapiens
tgcatggagctttcctgcc

SEQ ID NO: 76370 - DNA, 18 bp, Homo sapiens
tgcgggaagcaccgggcc

SEQ ID NO: 76371 - DNA, 20 bp, Homo sapiens
tgcatgggtgaagttgggcc

SEQ ID NO: 76372 - DNA, 16 bp, Homo sapiens
tgcacacggttgggcc

SEQ ID NO: 76373 - DNA, 18 bp, Homo sapiens
tgatggaagtgaagggcc

SEQ ID NO: 76374 - DNA, 18 bp, Homo sapiens
tgctgggggtgctgggcc

SEQ ID NO: 76375 - DNA, 16 bp, Homo sapiens
tgcagagtggttgggc

SEQ ID NO: 76376 - DNA, 19 bp, Homo sapiens
tgctatgcagtgttgggcc

SEQ ID NO: 76377 - DNA, 17 bp, Homo sapiens
tggatggaagttccagc

SEQ ID NO: 76378 - DNA, 17 bp, Homo sapiens
tgcactggagttgggcc

SEQ ID NO: 76379 - DNA, 20 bp, Homo sapiens
tgatgggagaagactgggcc

SEQ ID NO: 76380 - DNA, 18 bp, Homo sapiens
tgtctggaagtgacagcc

SEQ ID NO: 76381 - DNA, 17 bp, Homo sapiens
tgcggggaagtgggaac

SEQ ID NO: 76382 - DNA, 17 bp, Homo sapiens
gcatgggagtaacggcc

SEQ ID NO: 76383 - DNA, 23 bp, Homo sapiens
tggatggaagtgagggaagggcc

SEQ ID NO: 76384 - DNA, 17 bp, Homo sapiens
tgcatagaagtggaagc

SEQ ID NO: 76385 - DNA, 18 bp, Homo sapiens
tgtatggaaatggatgcc

SEQ ID NO: 76386 - DNA, 17 bp, Homo sapiens
tgcaatggaaggaggcc

SEQ ID NO: 76387 - DNA, 17 bp, Homo sapiens
tgctaaggtggttgggc

SEQ ID NO: 76388 - DNA, 17 bp, Homo sapiens
tgcatggaaggacagag

SEQ ID NO: 76389 - DNA, 18 bp, Homo sapiens
tgcacggaggggcaggcc

SEQ ID NO: 76390 - DNA, 15 bp, Homo sapiens
tgcatggagtagggg

SEQ ID NO: 76391 - DNA, 21 bp, Homo sapiens
tgtgtggcagcagccagggcc

SEQ ID NO: 76392 - DNA, 19 bp, Homo sapiens
tgcatggagcatacctggg

SEQ ID NO: 76393 - DNA, 19 bp, Homo sapiens
tgcttggaagtggagggcc

SEQ ID NO: 76394 - DNA, 17 bp, Homo sapiens
tgctgggcagctgggcc

SEQ ID NO: 76395 - DNA, 16 bp, Homo sapiens
gcatgcgcgttgggcc

SEQ ID NO: 76396 - DNA, 15 bp, Homo sapiens
tgctggtgattgggc

SEQ ID NO: 76397 - DNA, 16 bp, Homo sapiens
tgcaggaagtggggac

SEQ ID NO: 76398 - DNA, 19 bp, Homo sapiens
tgtatggaagtgaggaagg

SEQ ID NO: 76399 - DNA, 18 bp, Homo sapiens
tgcagggaccgctgggcc

SEQ ID NO: 76400 - DNA, 21 bp, Homo sapiens
tgcatagaagggaaactgggc

SEQ ID NO: 76401 - DNA, 16 bp, Homo sapiens
tgcagggaagtgggga

SEQ ID NO: 76402 - DNA, 19 bp, Homo sapiens
atggaaatgaagttgggcc

SEQ ID NO: 76403 - DNA, 18 bp, Homo sapiens
tgcagggaagtgggtggg

SEQ ID NO: 76404 - DNA, 17 bp, Homo sapiens
tgcaggagggccaggcc

SEQ ID NO: 76405 - DNA, 18 bp, Homo sapiens
tgcatggagtcacggggc

SEQ ID NO: 76406 - DNA, 15 bp, Homo sapiens
tacatggagtggggc

SEQ ID NO: 76407 - DNA, 16 bp, Homo sapiens
tgcatggagtgtaaac

SEQ ID NO: 76408 - DNA, 17 bp, Homo sapiens
tgcatggaagctgagac

SEQ ID NO: 76409 - DNA, 16 bp, Homo sapiens
gcatggaacagtgggc

SEQ ID NO: 76410 - DNA, 15 bp, Homo sapiens
tgcatggagggaggc

SEQ ID NO: 76411 - DNA, 20 bp, Homo sapiens
tgcacggaggtgggcagggc

SEQ ID NO: 76412 - DNA, 17 bp, Homo sapiens
tgctggaagtggcatgc

SEQ ID NO: 76413 - DNA, 19 bp, Homo sapiens
tgctggaaagtagtttggg

SEQ ID NO: 76414 - DNA, 17 bp, Homo sapiens
tgcctggaaactgggcc

SEQ ID NO: 76415 - DNA, 18 bp, Homo sapiens
tgcatggagcgcagggcc

SEQ ID NO: 76416 - DNA, 17 bp, Homo sapiens
tgctgggctgctgggcc

SEQ ID NO: 76417 - DNA, 18 bp, Homo sapiens
tgcatggaaggaaaagcc

SEQ ID NO: 76418 - DNA, 18 bp, Homo sapiens
gcatggaagagccagggc

SEQ ID NO: 76419 - DNA, 18 bp, Homo sapiens
tgcatgcaaagactgggc

SEQ ID NO: 76420 - DNA, 17 bp, Homo sapiens
tgcatgaagattcggcc

SEQ ID NO: 76421 - DNA, 18 bp, Homo sapiens
tgcatgaagacactgggc

SEQ ID NO: 76422 - DNA, 19 bp, Homo sapiens
gcatggagagcagcgggcc

SEQ ID NO: 76423 - DNA, 18 bp, Homo sapiens
tgcctggggacttgggcc

SEQ ID NO: 76424 - DNA, 16 bp, Homo sapiens
tgcctggaagtagggc

SEQ ID NO: 76425 - DNA, 17 bp, Homo sapiens
gctgtcagtggttgggc

SEQ ID NO: 76426 - DNA, 15 bp, Homo sapiens
tgctgggtgctgggc

SEQ ID NO: 76427 - DNA, 15 bp, Homo sapiens
tgcaggacagctggg

SEQ ID NO: 76428 - DNA, 18 bp, Homo sapiens
tgcatgggcggctaaggc

SEQ ID NO: 76429 - DNA, 15 bp, Homo sapiens
tgctggaacgggggc

SEQ ID NO: 76430 - DNA, 19 bp, Homo sapiens
tgcctggaggtgctgggcc

SEQ ID NO: 76431 - DNA, 23 bp, Homo sapiens
tgcatggaggctggcaggtggcc

SEQ ID NO: 76432 - DNA, 17 bp, Homo sapiens
tgcgagagagttgggcc

SEQ ID NO: 76433 - DNA, 17 bp, Homo sapiens
tggatggaaacggggcc

SEQ ID NO: 76434 - DNA, 20 bp, Homo sapiens
tgaatgtcttcagttgggcc

SEQ ID NO: 76435 - DNA, 16 bp, Homo sapiens
tgcctggaagtggggg

SEQ ID NO: 76436 - DNA, 17 bp, Homo sapiens
tgatggggaactgggcc

SEQ ID NO: 76437 - DNA, 18 bp, Homo sapiens
tgcaggaagcaagaggcc

SEQ ID NO: 76438 - DNA, 16 bp, Homo sapiens
tgcttggagtctgggc

SEQ ID NO: 76439 - DNA, 16 bp, Homo sapiens
gcatggaaatgagggc

SEQ ID NO: 76440 - DNA, 18 bp, Homo sapiens
tgcaggaagtggaacacc

SEQ ID NO: 76441 - DNA, 20 bp, Homo sapiens
tgcaggaacacgactgggcc

SEQ ID NO: 76442 - DNA, 17 bp, Homo sapiens
gcatggaacatggggcc

SEQ ID NO: 76443 - DNA, 20 bp, Homo sapiens
tgtatagatcaagttgggcc

SEQ ID NO: 76444 - DNA, 19 bp, Homo sapiens
tgctatggggagctgggcc

SEQ ID NO: 76445 - DNA, 15 bp, Homo sapiens
tgatggaagcggggc

SEQ ID NO: 76446 - DNA, 16 bp, Homo sapiens
tgcgtggtggccgggc

SEQ ID NO: 76447 - DNA, 18 bp, Homo sapiens
tgcatgaagactgggggc

SEQ ID NO: 76448 - DNA, 17 bp, Homo sapiens
tgcatagaagagacggc

SEQ ID NO: 76449 - DNA, 19 bp, Homo sapiens
tgcggggagtgggctgggc

SEQ ID NO: 76450 - DNA, 18 bp, Homo sapiens
tgcatggagggtaagagc

SEQ ID NO: 76451 - DNA, 19 bp, Homo sapiens
tgcatagactagacttggg

SEQ ID NO: 76452 - DNA, 19 bp, Homo sapiens
tgcagggaaacaaagggcc

SEQ ID NO: 76453 - DNA, 19 bp, Homo sapiens
tacaatgaagtggttgggc

SEQ ID NO: 76454 - DNA, 17 bp, Homo sapiens
tgcatggagggaagacc

SEQ ID NO: 76455 - DNA, 19 bp, Homo sapiens
catggaagtaccacaggcc

SEQ ID NO: 76456 - DNA, 17 bp, Homo sapiens
tgcaggaaatgagggcc

SEQ ID NO: 76457 - DNA, 15 bp, Homo sapiens
tgcatggaggtgagc

SEQ ID NO: 76458 - DNA, 16 bp, Homo sapiens
tacatggaaaccgggc

SEQ ID NO: 76459 - DNA, 17 bp, Homo sapiens
tgcggggaagtggtggc

SEQ ID NO: 76460 - DNA, 18 bp, Homo sapiens
tgatggagccatcgggcc

SEQ ID NO: 76461 - DNA, 17 bp, Homo sapiens
tgcatggagctccagcc

SEQ ID NO: 76462 - DNA, 17 bp, Homo sapiens
tgcatagagctgggggc

SEQ ID NO: 76463 - DNA, 16 bp, Homo sapiens
acacaagtggttgggc

SEQ ID NO: 76464 - DNA, 18 bp, Homo sapiens
tgcgatggggtccgggcc

SEQ ID NO: 76465 - DNA, 18 bp, Homo sapiens
tgaatggaaatgctgggc

SEQ ID NO: 76466 - DNA, 22 bp, Homo sapiens
tgcatggaggtggggggtgggc

SEQ ID NO: 76467 - DNA, 16 bp, Homo sapiens
tgcatagaggtcgtgc

SEQ ID NO: 76468 - DNA, 17 bp, Homo sapiens
tgcaggaaggccaggcc

SEQ ID NO: 76469 - DNA, 18 bp, Homo sapiens
tgcagggcccagttgggc

SEQ ID NO: 76470 - DNA, 18 bp, Homo sapiens
tgcatgaagcataaggcc

SEQ ID NO: 76471 - DNA, 20 bp, Homo sapiens
tgcatagaagtgtgtacggc

SEQ ID NO: 76472 - DNA, 17 bp, Homo sapiens
tgtgtggaggttgaacc

SEQ ID NO: 76473 - DNA, 16 bp, Homo sapiens
tgctggaaagcgaggg

SEQ ID NO: 76474 - DNA, 15 bp, Homo sapiens
tgcatggatggaggc

SEQ ID NO: 76475 - DNA, 19 bp, Homo sapiens
tgctggcggcggttgggcc

SEQ ID NO: 76476 - DNA, 17 bp, Homo sapiens
tgtgtagaaggctgggc

SEQ ID NO: 76477 - DNA, 18 bp, Homo sapiens
tgcatggagattctggcc

SEQ ID NO: 76478 - DNA, 16 bp, Homo sapiens
tgctgggagtacaggc

SEQ ID NO: 76479 - DNA, 18 bp, Homo sapiens
tgatgggagcagctgggc

SEQ ID NO: 76480 - DNA, 18 bp, Homo sapiens
tgctgtggaggccgggcc

SEQ ID NO: 76481 - DNA, 18 bp, Homo sapiens
tggatgaagttggttggg

SEQ ID NO: 76482 - DNA, 15 bp, Homo sapiens
tgctggaagccgggc

SEQ ID NO: 76483 - DNA, 16 bp, Homo sapiens
tgcgtgaaagttaggc

SEQ ID NO: 76484 - DNA, 18 bp, Homo sapiens
tgcgtggtggtgggtgcc

SEQ ID NO: 76485 - DNA, 17 bp, Homo sapiens
tgtgtggaagtaggggc

SEQ ID NO: 76486 - DNA, 20 bp, Homo sapiens
tgtatgtaagttactgggcc

SEQ ID NO: 76487 - DNA, 18 bp, Homo sapiens
tgcatggggttgtgggcc

SEQ ID NO: 76488 - DNA, 18 bp, Homo sapiens
tgcatgaaaaggggggcc

SEQ ID NO: 76489 - DNA, 18 bp, Homo sapiens
tggaagtgggatgaggcc

SEQ ID NO: 76490 - DNA, 16 bp, Homo sapiens
catggaaagaggggcc

SEQ ID NO: 76491 - DNA, 20 bp, Homo sapiens
tgtgtggcggctggtgggcc

SEQ ID NO: 76492 - DNA, 15 bp, Homo sapiens
tgcaggaagcgaggc

SEQ ID NO: 76493 - DNA, 19 bp, Homo sapiens
tgcaggaagtgggagatgc

SEQ ID NO: 76494 - DNA, 17 bp, Homo sapiens
tgcaggaaacctgggcc

SEQ ID NO: 76495 - DNA, 17 bp, Homo sapiens
tgcatgaaagtcttggg

SEQ ID NO: 76496 - DNA, 15 bp, Homo sapiens
tgcatggaggttgaa

SEQ ID NO: 76497 - DNA, 18 bp, Homo sapiens
tgtatggaagttagcagc

SEQ ID NO: 76498 - DNA, 19 bp, Homo sapiens
tgcgtggaagtgagggagc

SEQ ID NO: 76499 - DNA, 21 bp, Homo sapiens
tgcatggagacctagagggcc

SEQ ID NO: 76500 - DNA, 15 bp, Homo sapiens
gcatggaagggaggc

SEQ ID NO: 76501 - DNA, 19 bp, Homo sapiens
tgtgtagtagaggttgggc

SEQ ID NO: 76502 - DNA, 17 bp, Homo sapiens
tgcattgagattgggcc

SEQ ID NO: 76503 - DNA, 15 bp, Homo sapiens
tgcatgaggctgggc

SEQ ID NO: 76504 - DNA, 17 bp, Homo sapiens
gcatggggggctgggcc

SEQ ID NO: 76505 - DNA, 15 bp, Homo sapiens
tgcaggaagtgatgc

SEQ ID NO: 76506 - DNA, 17 bp, Homo sapiens
tggatggaggtgggggc

SEQ ID NO: 76507 - DNA, 15 bp, Homo sapiens
gcatggaaagagggc

SEQ ID NO: 76508 - DNA, 18 bp, Homo sapiens
atggaaatcggttgggcc

SEQ ID NO: 76509 - DNA, 17 bp, Homo sapiens
tgcatggagaaattagg

SEQ ID NO: 76510 - DNA, 16 bp, Homo sapiens
tgcaggaaggctgggc

SEQ ID NO: 76511 - DNA, 75 bp, Frog adenovirus 1
gctgcaaagatcagtggcttttctaactgcaacttatggaacagttgtttacattggcttactatatctttgtgc

SEQ ID NO: 76512 - DNA, 24 bp, Frog adenovirus 1
tttacattggcttactatatcttt

SEQ ID NO: 76513 - DNA, 27 bp, Homo sapiens
tttacattggtgtttaccagtgtcttt

SEQ ID NO: 76514 - DNA, 22 bp, Homo sapiens
tttacgttgattccacatcttt

SEQ ID NO: 76515 - DNA, 104 bp, Fowlpox virus
tagtacattacttaatatccgtaagtctttttagttcatttttaatcaactaaccaagtaataaaaatgtcattaatgctcgcgtatatgaatgaaatgtattg

SEQ ID NO: 76516 - DNA, 24 bp, Fowlpox virus
tccgtaagtctttttagttcattt

SEQ ID NO: 76517 - DNA, 23 bp, Homo sapiens
tccgggggtctcagcattcattt

SEQ ID NO: 76518 - DNA, 18 bp, Homo sapiens
taagtctttctctcattt

SEQ ID NO: 76519 - DNA, 15 bp, Homo sapiens
agtcttagttcattt

SEQ ID NO: 76520 - DNA, 19 bp, Homo sapiens
gtaagtcttcaagtcattt

SEQ ID NO: 76521 - DNA, 60 bp, Macaca mulatta rhadinovirus
cccttcgccgacgccgtggcacctggttcaccccctgtgggctatggccggaatattggg

SEQ ID NO: 76522 - DNA, 24 bp, Macaca mulatta rhadinovirus
tgtgggctatggccggaatattgg

SEQ ID NO: 76523 - DNA, 17 bp, Homo sapiens
tgggctatataatattg

SEQ ID NO: 76524 - DNA, 20 bp, Homo sapiens
tgtgggctgtggtgacctgg

SEQ ID NO: 76525 - DNA, 21 bp, Homo sapiens
tgggctgtctgagaatattgg

SEQ ID NO: 76526 - DNA, 22 bp, Homo sapiens
gtgggctattcagagatattgg

SEQ ID NO: 76527 - DNA, 21 bp, Homo sapiens
tatgggctatggttgatgtgg

SEQ ID NO: 76528 - DNA, 21 bp, Homo sapiens
tatgggctatggctgatgtgg

SEQ ID NO: 76529 - DNA, 68 bp, Melanoplus sanguinipes entomopoxvirus
ttattatttgctattctttcaatatatttaatattaatgatattgataaatataaaaaaaaatgataa

SEQ ID NO: 76530 - DNA, 24 bp, Melanoplus sanguinipes entomopoxvirus
atgatattgataaatataaaaaaa

SEQ ID NO: 76531 - DNA, 19 bp, Homo sapiens
gacacataaatataaaaaa

SEQ ID NO: 76532 - DNA, 23 bp, Homo sapiens
ataatatcgatacaaatataaaa

SEQ ID NO: 76533 - DNA, 20 bp, Homo sapiens
atgatattgaaaaacagaaa

SEQ ID NO: 76534 - DNA, 25 bp, Homo sapiens
atgatattcataaaatgacaaaaaa

SEQ ID NO: 76535 - DNA, 19 bp, Homo sapiens
atgatattgacagccaaaa

SEQ ID NO: 76536 - DNA, 19 bp, Homo sapiens
tgatattgataggttataa

SEQ ID NO: 76537 - DNA, 24 bp, Homo sapiens
tgatattgatagatatgtaaaaaa

SEQ ID NO: 76538 - DNA, 23 bp, Homo sapiens
atgcattgaaaaatataaaaaaa

SEQ ID NO: 76539 - DNA, 96 bp, Human papillomavirus type 48
caggtcaacaaaataatttgaaatgttggagaaatcgctgtactacaaaatatgctagtttatttttatgcttcagctctgtttggaagtggcttg

SEQ ID NO: 76540 - DNA, 24 bp, Human papillomavirus type 48
tgaaatgttggagaaatcgctgta

SEQ ID NO: 76541 - DNA, 21 bp, Homo sapiens
taaaaattagaaattgctgta

SEQ ID NO: 76542 - DNA, 20 bp, Homo sapiens
tgaaggttggagacatctgt

SEQ ID NO: 76543 - DNA, 19 bp, Homo sapiens
tgcaatgttggggaagctg

SEQ ID NO: 76544 - DNA, 18 bp, Homo sapiens
tgttggaatacaactgta

SEQ ID NO: 76545 - DNA, 25 bp, Homo sapiens
tgaagagttggagagaagacctgta

SEQ ID NO: 76546 - DNA, 23 bp, Homo sapiens
tgaagagttggagaggaaggctg

SEQ ID NO: 76547 - DNA, 18 bp, Homo sapiens
gaaaaaagaaattgctgt

SEQ ID NO: 76548 - DNA, 18 bp, Homo sapiens
tggaatgttggtggctgt

SEQ ID NO: 76549 - DNA, 19 bp, Homo sapiens
taaaaccggaagtcgctgt

SEQ ID NO: 76550 - DNA, 19 bp, Homo sapiens
tggaatgttggaaagtcct

SEQ ID NO: 76551 - DNA, 98 bp, Gallid herpesvirus 2
gtgagaaacaaagacaaagcgaatacgacaaattcgtttattaaacgtcacatttacgtataatatcatttaagtatagtttcgttctgccaactcac

SEQ ID NO: 76552 - DNA, 24 bp, Gallid herpesvirus 2
tataatatcatttaagtatagttt

SEQ ID NO: 76553 - DNA, 20 bp, Homo sapiens
atatcatttaagtacaattt

SEQ ID NO: 76554 - DNA, 21 bp, Homo sapiens
tacagtatcattttacagttt

SEQ ID NO: 76555 - DNA, 73 bp, Human herpesvirus 3
ctgctcggatggcgaccgtgcactactcccgccgacctgggaccccgccggtcaccctcacgtcgtcccccag

SEQ ID NO: 76556 - DNA, 24 bp, Human herpesvirus 3
gaccgtgcactactcccgccgacc

SEQ ID NO: 76557 - DNA, 23 bp, Homo sapiens
gaccgtgcgctcagtactcggcc

SEQ ID NO: 76558 - DNA, 19 bp, Homo sapiens
gaccgcgctgctcgccgac

SEQ ID NO: 76559 - DNA, 16 bp, Homo sapiens
gaccggctccccgccg

SEQ ID NO: 76560 - DNA, 21 bp, Homo sapiens
cgtgcgtgggccccgccggcc

SEQ ID NO: 76561 - DNA, 20 bp, Homo sapiens
ccgcgtgacccctgccgacc

SEQ ID NO: 76562 - DNA, 18 bp, Homo sapiens
cgtgcactaccatgcccg

SEQ ID NO: 76563 - DNA, 18 bp, Homo sapiens
gaccgtgcctgtgctgac

SEQ ID NO: 76564 - DNA, 22 bp, Homo sapiens
ccggccgcctctcccgccggcc

SEQ ID NO: 76565 - DNA, 17 bp, Homo sapiens
gtgcgcctcccgccgac

SEQ ID NO: 76566 - DNA, 21 bp, Homo sapiens
cctgtgtggaccccgccggcc

SEQ ID NO: 76567 - DNA, 18 bp, Homo sapiens
gaccgtgccgccgctgac

SEQ ID NO: 76568 - DNA, 22 bp, Homo sapiens
gaccgtgcactctcttggagcc

SEQ ID NO: 76569 - DNA, 120 bp, Acute bee paralysis virus
cgaaaaaccgagcaataggagcactatggttcgagaagacattataagacaaactcactagatggagggcttataattataagcttcttgacataatctaaccattgcgtcaaaatttcg

SEQ ID NO: 76570 - DNA, 24 bp, Acute bee paralysis virus
tatggttcgagaagacattataag

SEQ ID NO: 76571 - DNA, 20 bp, Homo sapiens
gttgcacctaagacattata

SEQ ID NO: 76572 - DNA, 23 bp, Homo sapiens
catggtctataagatattataag

SEQ ID NO: 76573 - DNA, 20 bp, Homo sapiens
ggaggaggaggcattataag

SEQ ID NO: 76574 - DNA, 120 bp, Bovine respiratory syncytial virus
aacactttggtgtgattcattttacaaccatgattatatgtaatgtaatatcaatatagttatttaaaaactcacattatctatatagttgttaatcttaaattcccacatatctgtgtt

SEQ ID NO: 76575 - DNA, 24 bp, Bovine respiratory syncytial virus
tatgtaatgtaatatcaatatagt

SEQ ID NO: 76576 - DNA, 23 bp, Homo sapiens
gtaatgtacactactgatatagt

SEQ ID NO: 76577 - DNA, 19 bp, Homo sapiens
gtaaacgaatcaatatagt

SEQ ID NO: 76578 - DNA, 18 bp, Homo sapiens
tgtaatgtttcaatatag

SEQ ID NO: 76579 - DNA, 23 bp, Homo sapiens
atatcttctaatatcaatatagt

SEQ ID NO: 76580 - DNA, 17 bp, Homo sapiens
gtaatgtaatacattag

SEQ ID NO: 76581 - DNA, 60 bp, Bovine herpesvirus 4
gggtcagagggctgctttgatggggtcaggatgttggctccaggagaggcctgttcaccc

SEQ ID NO: 76582 - DNA, 22 bp, Bovine herpesvirus 4
tccaggagaggcctgttcaccc

SEQ ID NO: 76583 - DNA, 17 bp, Homo sapiens
tccaggagaagttctca

SEQ ID NO: 76584 - DNA, 20 bp, Homo sapiens
cccgggagaggcttggaccc

SEQ ID NO: 76585 - DNA, 20 bp, Homo sapiens
cccaggagggggtggtgccc

SEQ ID NO: 76586 - DNA, 21 bp, Homo sapiens
cccaggagaggcgctgaaccc

SEQ ID NO: 76587 - DNA, 21 bp, Homo sapiens
cccaggaggggtcccagactc

SEQ ID NO: 76588 - DNA, 18 bp, Homo sapiens
caggagaggccttttcac

SEQ ID NO: 76589 - DNA, 18 bp, Homo sapiens
gaacaggcctgttcatcc

SEQ ID NO: 76590 - DNA, 19 bp, Homo sapiens
tccaagagaggttagatcc

SEQ ID NO: 76591 - DNA, 18 bp, Homo sapiens
tccaggaagacatttgct

SEQ ID NO: 76592 - DNA, 21 bp, Homo sapiens
tccaggatgggacaagcgccc

SEQ ID NO: 76593 - DNA, 16 bp, Homo sapiens
tccaggaaatgtttac

SEQ ID NO: 76594 - DNA, 15 bp, Homo sapiens
caagagaggcttcac

SEQ ID NO: 76595 - DNA, 15 bp, Homo sapiens
tccaggaaggcgccc

SEQ ID NO: 76596 - DNA, 18 bp, Homo sapiens
tccgggcaggggccgctc

SEQ ID NO: 76597 - DNA, 22 bp, Homo sapiens
tccaggaagggccatggagtcc

SEQ ID NO: 76598 - DNA, 19 bp, Homo sapiens
tccaggaggggagctgccc

SEQ ID NO: 76599 - DNA, 18 bp, Homo sapiens
caggagaggacgccgccc

SEQ ID NO: 76600 - DNA, 16 bp, Homo sapiens
tccaggagggcagttc

SEQ ID NO: 76601 - DNA, 18 bp, Homo sapiens
ggagagggcagctcaccc

SEQ ID NO: 76602 - DNA, 19 bp, Homo sapiens
caggagaggctgagggccc

SEQ ID NO: 76603 - DNA, 21 bp, Homo sapiens
tccgagggagggagcccaccc

SEQ ID NO: 76604 - DNA, 18 bp, Homo sapiens
tccaggaggcacttgttc

SEQ ID NO: 76605 - DNA, 19 bp, Homo sapiens
ccaggagagcctgtcatcc

SEQ ID NO: 76606 - DNA, 19 bp, Homo sapiens
cctgggagaggctttactc

SEQ ID NO: 76607 - DNA, 22 bp, Homo sapiens
tccagaaggggccgggcggccc

SEQ ID NO: 76608 - DNA, 20 bp, Homo sapiens
tccaggagagcgctgggccc

SEQ ID NO: 76609 - DNA, 21 bp, Homo sapiens
tccaggagggctcaagagtcc

SEQ ID NO: 76610 - DNA, 19 bp, Homo sapiens
tccaagagaggagatactc

SEQ ID NO: 76611 - DNA, 16 bp, Homo sapiens
tccaggaaggttattc

SEQ ID NO: 76612 - DNA, 18 bp, Homo sapiens
ccaggagaggcaggaccc

SEQ ID NO: 76613 - DNA, 19 bp, Homo sapiens
tccaggaagggataccatc

SEQ ID NO: 76614 - DNA, 17 bp, Homo sapiens
tccaggagaaggcatcc

SEQ ID NO: 76615 - DNA, 18 bp, Homo sapiens
tccagggaggagttgccc

SEQ ID NO: 76616 - DNA, 18 bp, Homo sapiens
tccaggaaaggcctggtc

SEQ ID NO: 76617 - DNA, 22 bp, Homo sapiens
tcctggggaggaagagctatcc

SEQ ID NO: 76618 - DNA, 20 bp, Homo sapiens
tctaggaaaggaaaatgttc

SEQ ID NO: 76619 - DNA, 17 bp, Homo sapiens
tccaggagggagcttac

SEQ ID NO: 76620 - DNA, 22 bp, Homo sapiens
tcctggggaggcccaggcaccc

SEQ ID NO: 76621 - DNA, 19 bp, Homo sapiens
tccaggagaagctgggctc

SEQ ID NO: 76622 - DNA, 24 bp, Homo sapiens
tccaggagaggacggccgccgctc

SEQ ID NO: 76623 - DNA, 21 bp, Homo sapiens
tccagagaggccacactgttc

SEQ ID NO: 76624 - DNA, 19 bp, Homo sapiens
tccaggaggcagtttgtcc

SEQ ID NO: 76625 - DNA, 21 bp, Homo sapiens
tccacgcaggcctgttcatcc

SEQ ID NO: 76626 - DNA, 18 bp, Homo sapiens
tccaggagaggcctggcc

SEQ ID NO: 76627 - DNA, 21 bp, Homo sapiens
tcctggagaggctagtgtgca

SEQ ID NO: 76628 - DNA, 17 bp, Homo sapiens
tctgggagaggcccacc

SEQ ID NO: 76629 - DNA, 16 bp, Homo sapiens
tccaggagaaggtcac

SEQ ID NO: 76630 - DNA, 24 bp, Homo sapiens
tccaggaaactgcagtgtttgttc

SEQ ID NO: 76631 - DNA, 18 bp, Homo sapiens
aagaggtgccacgtaccc

SEQ ID NO: 76632 - DNA, 18 bp, Homo sapiens
caggggctgggttcaccc

SEQ ID NO: 76633 - DNA, 16 bp, Homo sapiens
tcctggaatgttcacc

SEQ ID NO: 76634 - DNA, 23 bp, Homo sapiens
cccaggaggggtctgggggaacc

SEQ ID NO: 76635 - DNA, 19 bp, Homo sapiens
aggagaggcccagagattc

SEQ ID NO: 76636 - DNA, 18 bp, Homo sapiens
tccagagaggcccccatc

SEQ ID NO: 76637 - DNA, 18 bp, Homo sapiens
tccaggagaggggctaca

SEQ ID NO: 76638 - DNA, 19 bp, Homo sapiens
tccgggagaagcctggatc

SEQ ID NO: 76639 - DNA, 24 bp, Homo sapiens
tctaagagaggccgataaacatcc

SEQ ID NO: 76640 - DNA, 23 bp, Homo sapiens
tccaggaagggccacggttgctc

SEQ ID NO: 76641 - DNA, 22 bp, Homo sapiens
tctcaggaggtggcattcaccc

SEQ ID NO: 76642 - DNA, 16 bp, Homo sapiens
cccaggagaggtgtcc

SEQ ID NO: 76643 - DNA, 16 bp, Homo sapiens
tccacgggggctcacc

SEQ ID NO: 76644 - DNA, 19 bp, Homo sapiens
tccaggagaagcagtgttc

SEQ ID NO: 76645 - DNA, 21 bp, Homo sapiens
tccaggagagggttgaggccc

SEQ ID NO: 76646 - DNA, 18 bp, Homo sapiens
tccaggagaggagctccc

SEQ ID NO: 76647 - DNA, 20 bp, Homo sapiens
tccaggaagaagcctcatcc

SEQ ID NO: 76648 - DNA, 18 bp, Homo sapiens
tccaggaggggactgacc

SEQ ID NO: 76649 - DNA, 21 bp, Homo sapiens
cctgggagaggcacgccgtcc

SEQ ID NO: 76650 - DNA, 18 bp, Homo sapiens
caggcgtgactgttcacc

SEQ ID NO: 76651 - DNA, 16 bp, Homo sapiens
tccaggagatgccacc

SEQ ID NO: 76652 - DNA, 17 bp, Homo sapiens
tccggcaggggccgtcc

SEQ ID NO: 76653 - DNA, 16 bp, Homo sapiens
agagaggggctcaccc

SEQ ID NO: 76654 - DNA, 17 bp, Homo sapiens
caggagaggaattaccc

SEQ ID NO: 76655 - DNA, 18 bp, Homo sapiens
ccaggagaggctggatcc

SEQ ID NO: 76656 - DNA, 18 bp, Homo sapiens
tctgggagaagcctgtcc

SEQ ID NO: 76657 - DNA, 18 bp, Homo sapiens
tccaggagagagcagccc

SEQ ID NO: 76658 - DNA, 16 bp, Homo sapiens
ccaggagctgttcacc

SEQ ID NO: 76659 - DNA, 20 bp, Homo sapiens
cctgggggaggcctgcagcc

SEQ ID NO: 76660 - DNA, 18 bp, Homo sapiens
tccaggagggcctgagac

SEQ ID NO: 76661 - DNA, 18 bp, Homo sapiens
cccaggggaggcccagcc

SEQ ID NO: 76662 - DNA, 19 bp, Homo sapiens
tcgaggaggggctgctgtc

SEQ ID NO: 76663 - DNA, 21 bp, Homo sapiens
tccaggagacggcagattgtc

SEQ ID NO: 76664 - DNA, 18 bp, Homo sapiens
tccagagaggcaatgttc

SEQ ID NO: 76665 - DNA, 18 bp, Homo sapiens
tccaggaaggggactacc

SEQ ID NO: 76666 - DNA, 18 bp, Homo sapiens
tccagcagggtcttgtcc

SEQ ID NO: 76667 - DNA, 20 bp, Homo sapiens
tctgggaaaggcatttcacc

SEQ ID NO: 76668 - DNA, 22 bp, Homo sapiens
tccagagaggcctctcacaccc

SEQ ID NO: 76669 - DNA, 16 bp, Homo sapiens
tccaggaaggctcacc

SEQ ID NO: 76670 - DNA, 17 bp, Homo sapiens
ccaggggtagttcaccc

SEQ ID NO: 76671 - DNA, 17 bp, Homo sapiens
tccggggagaggcattc

SEQ ID NO: 76672 - DNA, 16 bp, Homo sapiens
tccaggaggcgtgacc

SEQ ID NO: 76673 - DNA, 18 bp, Homo sapiens
tccaaggtgcctgtttac

SEQ ID NO: 76674 - DNA, 21 bp, Homo sapiens
tccagaagagccgtttcgccc

SEQ ID NO: 76675 - DNA, 20 bp, Homo sapiens
tccaggaggcggggccatcc

SEQ ID NO: 76676 - DNA, 24 bp, Homo sapiens
tccaagagagatgggttgtttgcc

SEQ ID NO: 76677 - DNA, 17 bp, Homo sapiens
tctgggagagcccgctc

SEQ ID NO: 76678 - DNA, 17 bp, Homo sapiens
tccagaagatgttcacc

SEQ ID NO: 76679 - DNA, 19 bp, Homo sapiens
tccaggaaggagactgtcc

SEQ ID NO: 76680 - DNA, 16 bp, Homo sapiens
tccaggggagacattc

SEQ ID NO: 76681 - DNA, 17 bp, Homo sapiens
tccagaagaaattcacc

SEQ ID NO: 76682 - DNA, 21 bp, Homo sapiens
tctgggagaagctccccaccc

SEQ ID NO: 76683 - DNA, 21 bp, Homo sapiens
cccaggaggggccgggcgccc

SEQ ID NO: 76684 - DNA, 20 bp, Homo sapiens
cctgggagaggccaacatcc

SEQ ID NO: 76685 - DNA, 20 bp, Homo sapiens
ccaggagaggcaggagaccc

SEQ ID NO: 76686 - DNA, 19 bp, Homo sapiens
ccaggagaggtcagcgtcc

SEQ ID NO: 76687 - DNA, 21 bp, Homo sapiens
tccagaagaggctgggggctc

SEQ ID NO: 76688 - DNA, 20 bp, Homo sapiens
tctagaagaggtcaacattc

SEQ ID NO: 76689 - DNA, 18 bp, Homo sapiens
tccaggaggggcccgtcc

SEQ ID NO: 76690 - DNA, 18 bp, Homo sapiens
caggagacccaggttcac

SEQ ID NO: 76691 - DNA, 21 bp, Homo sapiens
cccaggagaggtgtgaggttc

SEQ ID NO: 76692 - DNA, 19 bp, Homo sapiens
cccaggaggggccccgctc

SEQ ID NO: 76693 - DNA, 18 bp, Homo sapiens
tccaggaagaggtgatcc

SEQ ID NO: 76694 - DNA, 20 bp, Homo sapiens
tccaggagatgcccgctgac

SEQ ID NO: 76695 - DNA, 19 bp, Homo sapiens
tccaggaagggccacactc

SEQ ID NO: 76696 - DNA, 20 bp, Homo sapiens
cccaggagaggctgatggtc

SEQ ID NO: 76697 - DNA, 24 bp, Homo sapiens
tccaggaaggtcagaacatcgccc

SEQ ID NO: 76698 - DNA, 21 bp, Homo sapiens
tccaggagaagcgtgaagccc

SEQ ID NO: 76699 - DNA, 22 bp, Homo sapiens
tcctggaggccaaggttcaccc

SEQ ID NO: 76700 - DNA, 22 bp, Homo sapiens
tccaggaaggctaagaaagttc

SEQ ID NO: 76701 - DNA, 16 bp, Homo sapiens
tccggagaggcggctc

SEQ ID NO: 76702 - DNA, 21 bp, Homo sapiens
tccaggagcggctgcaggacc

SEQ ID NO: 76703 - DNA, 19 bp, Homo sapiens
tctgggagaggcatcgctc

SEQ ID NO: 76704 - DNA, 19 bp, Homo sapiens
cagggtcaggcctgttcac

SEQ ID NO: 76705 - DNA, 20 bp, Homo sapiens
cccaggagaggcccaggccc

SEQ ID NO: 76706 - DNA, 18 bp, Homo sapiens
ggagaggctatgccagcc

SEQ ID NO: 76707 - DNA, 17 bp, Homo sapiens
tccaagggaagcattca

SEQ ID NO: 76708 - DNA, 19 bp, Homo sapiens
tccaggtgaggcctgtacc

SEQ ID NO: 76709 - DNA, 23 bp, Homo sapiens
tccagaagaggaagagctcaccc

SEQ ID NO: 76710 - DNA, 17 bp, Homo sapiens
tccagagaggcccattc

SEQ ID NO: 76711 - DNA, 19 bp, Homo sapiens
cccaggagagagtttattc

SEQ ID NO: 76712 - DNA, 20 bp, Homo sapiens
cccaggaggggtctgaactc

SEQ ID NO: 76713 - DNA, 20 bp, Homo sapiens
tctggaagaggcttgcagca

SEQ ID NO: 76714 - DNA, 19 bp, Homo sapiens
caggagaggctccgtgtcc

SEQ ID NO: 76715 - DNA, 18 bp, Homo sapiens
tccaggagggggcagtcc

SEQ ID NO: 76716 - DNA, 19 bp, Homo sapiens
ccaggggaggcccacaccc

SEQ ID NO: 76717 - DNA, 20 bp, Homo sapiens
tccagagaggctgagccacc

SEQ ID NO: 76718 - DNA, 18 bp, Homo sapiens
tccaggagacggaacacc

SEQ ID NO: 76719 - DNA, 19 bp, Homo sapiens
tccaggaaggcaagagccc

SEQ ID NO: 76720 - DNA, 17 bp, Homo sapiens
cccaggaggggcacacc

SEQ ID NO: 76721 - DNA, 18 bp, Homo sapiens
tccaggaggggctcagcc

SEQ ID NO: 76722 - DNA, 20 bp, Homo sapiens
tctgggaaaggcctgggacc

SEQ ID NO: 76723 - DNA, 17 bp, Homo sapiens
ccaggagaaagattcac

SEQ ID NO: 76724 - DNA, 22 bp, Homo sapiens
ccgggagaggcggaggctgctc

SEQ ID NO: 76725 - DNA, 15 bp, Homo sapiens
cccaggagagctcac

SEQ ID NO: 76726 - DNA, 20 bp, Homo sapiens
tccaggaaggttgtgcatcc

SEQ ID NO: 76727 - DNA, 16 bp, Homo sapiens
tccaggagggtgcatc

SEQ ID NO: 76728 - DNA, 20 bp, Homo sapiens
tccaggaaggctgcatgacc

SEQ ID NO: 76729 - DNA, 21 bp, Homo sapiens
tccaggagcaggccactggcc

SEQ ID NO: 76730 - DNA, 18 bp, Homo sapiens
tccaggagggctgtgtcc

SEQ ID NO: 76731 - DNA, 17 bp, Homo sapiens
tccaggaaggctgagcc

SEQ ID NO: 76732 - DNA, 20 bp, Homo sapiens
cccaggaggggcagctgttc

SEQ ID NO: 76733 - DNA, 20 bp, Homo sapiens
tcacagataactctgttcac

SEQ ID NO: 76734 - DNA, 18 bp, Homo sapiens
agagaggcctgctggccc

SEQ ID NO: 76735 - DNA, 19 bp, Homo sapiens
tctaggagaggaaccgtcc

SEQ ID NO: 76736 - DNA, 16 bp, Homo sapiens
tccaggagggatgctc

SEQ ID NO: 76737 - DNA, 22 bp, Homo sapiens
tcctggagggggtgctttaccc

SEQ ID NO: 76738 - DNA, 18 bp, Homo sapiens
tctgggaaaggccaattc

SEQ ID NO: 76739 - DNA, 20 bp, Homo sapiens
caggagaggcttgggcaccc

SEQ ID NO: 76740 - DNA, 20 bp, Homo sapiens
tctaggagaagtctgggcac

SEQ ID NO: 76741 - DNA, 18 bp, Homo sapiens
tccaggaggggctaatcc

SEQ ID NO: 76742 - DNA, 21 bp, Homo sapiens
tccagcggaggcctgtcatcc

SEQ ID NO: 76743 - DNA, 20 bp, Homo sapiens
cccgggagaggcggccgctc

SEQ ID NO: 76744 - DNA, 19 bp, Homo sapiens
cagtgagaggatctcatcc

SEQ ID NO: 76745 - DNA, 23 bp, Homo sapiens
tcccggggaggcagcggccgccc

SEQ ID NO: 76746 - DNA, 19 bp, Homo sapiens
tccaggagaggcaccactc

SEQ ID NO: 76747 - DNA, 18 bp, Homo sapiens
tccaggagggaggcgctc

SEQ ID NO: 76748 - DNA, 20 bp, Homo sapiens
tctaggagagagtactgttc

SEQ ID NO: 76749 - DNA, 19 bp, Homo sapiens
ccaggccatcctgttcacc

SEQ ID NO: 76750 - DNA, 18 bp, Homo sapiens
tcctggagaggtacgtcc

SEQ ID NO: 76751 - DNA, 18 bp, Homo sapiens
tccaggaggaggtggtcc

SEQ ID NO: 76752 - DNA, 19 bp, Homo sapiens
ggcagaggcccgtgcagcc

SEQ ID NO: 76753 - DNA, 20 bp, Homo sapiens
tccaagaggggctggagccc

SEQ ID NO: 76754 - DNA, 18 bp, Homo sapiens
tctaggagaggctcatcc

SEQ ID NO: 76755 - DNA, 20 bp, Homo sapiens
aggagaggccccagctgtcc

SEQ ID NO: 76756 - DNA, 21 bp, Homo sapiens
tccaggaaggccccccaaccc

SEQ ID NO: 76757 - DNA, 18 bp, Homo sapiens
tcctggccgcctgttcac

SEQ ID NO: 76758 - DNA, 22 bp, Homo sapiens
tccaggaaggcccagggtgtcc

SEQ ID NO: 76759 - DNA, 15 bp, Homo sapiens
ggggcctgttcaccc

SEQ ID NO: 76760 - DNA, 21 bp, Homo sapiens
caggagagactaacctcaccc

SEQ ID NO: 76761 - DNA, 18 bp, Homo sapiens
tccgtgagaggcccgacc

SEQ ID NO: 76762 - DNA, 19 bp, Homo sapiens
tctaggagaggaatctgtc

SEQ ID NO: 76763 - DNA, 23 bp, Homo sapiens
tccaggaggtggggaggtcaccc

SEQ ID NO: 76764 - DNA, 20 bp, Homo sapiens
tccaggaggggacctcgatc

SEQ ID NO: 76765 - DNA, 16 bp, Homo sapiens
cccaggagaggctttc

SEQ ID NO: 76766 - DNA, 18 bp, Homo sapiens
caggagaggcatgaactc

SEQ ID NO: 76767 - DNA, 16 bp, Homo sapiens
tccaggaggggcgccc

SEQ ID NO: 76768 - DNA, 21 bp, Homo sapiens
tccaggaggggcacagccacc

SEQ ID NO: 76769 - DNA, 19 bp, Homo sapiens
tccaggagggggccagccc

SEQ ID NO: 76770 - DNA, 15 bp, Homo sapiens
cagaagaggtgtcac

SEQ ID NO: 76771 - DNA, 18 bp, Homo sapiens
cccaggagaggtcctgcc

SEQ ID NO: 76772 - DNA, 19 bp, Homo sapiens
caggagaggttcggcatcc

SEQ ID NO: 76773 - DNA, 22 bp, Homo sapiens
tccaggaagggtggccaggccc

SEQ ID NO: 76774 - DNA, 23 bp, Homo sapiens
tccaggagatgttctacatgctc

SEQ ID NO: 76775 - DNA, 21 bp, Homo sapiens
tctgggagaggcgccaaagcc

SEQ ID NO: 76776 - DNA, 19 bp, Homo sapiens
ccaggagaggctgttgtcc

SEQ ID NO: 76777 - DNA, 21 bp, Homo sapiens
tcacaggagaggcccagactc

SEQ ID NO: 76778 - DNA, 20 bp, Homo sapiens
caggagagagcaccgggacc

SEQ ID NO: 76779 - DNA, 22 bp, Homo sapiens
tccaggaagaggccttgggccc

SEQ ID NO: 76780 - DNA, 21 bp, Homo sapiens
cagggagaggccggtgagccc

SEQ ID NO: 76781 - DNA, 18 bp, Homo sapiens
tccggcagaggccccgcc

SEQ ID NO: 76782 - DNA, 20 bp, Homo sapiens
tccaggagcagggcagtgct

SEQ ID NO: 76783 - DNA, 19 bp, Homo sapiens
ccaggagagggcacttgcc

SEQ ID NO: 76784 - DNA, 16 bp, Homo sapiens
tccaagaggggtatcc

SEQ ID NO: 76785 - DNA, 17 bp, Homo sapiens
caggctcctgttcaccc

SEQ ID NO: 76786 - DNA, 19 bp, Homo sapiens
tccatgggaggctccatcc

SEQ ID NO: 76787 - DNA, 19 bp, Homo sapiens
cctaggagaggcctgttca

SEQ ID NO: 76788 - DNA, 17 bp, Homo sapiens
tccaggaaaggatactc

SEQ ID NO: 76789 - DNA, 18 bp, Homo sapiens
tctaggggaggccagccc

SEQ ID NO: 76790 - DNA, 17 bp, Homo sapiens
cccaggagagggccacc

SEQ ID NO: 76791 - DNA, 20 bp, Homo sapiens
tccaggagggagggctcacc

SEQ ID NO: 76792 - DNA, 19 bp, Homo sapiens
tccagggagctcctgttca

SEQ ID NO: 76793 - DNA, 21 bp, Homo sapiens
tccaggaggcgcttggaaacc

SEQ ID NO: 76794 - DNA, 20 bp, Homo sapiens
cagggggagctgggccaccc

SEQ ID NO: 76795 - DNA, 20 bp, Homo sapiens
tccaggagatgaatgccgct

SEQ ID NO: 76796 - DNA, 19 bp, Homo sapiens
cagggagaagctttcatcc

SEQ ID NO: 76797 - DNA, 17 bp, Homo sapiens
cccaggagaggttgctc

SEQ ID NO: 76798 - DNA, 18 bp, Homo sapiens
tccagaagtctctgttca

SEQ ID NO: 76799 - DNA, 17 bp, Homo sapiens
tccaggagatgctgctc

SEQ ID NO: 76800 - DNA, 17 bp, Homo sapiens
cccaggagggggtgccc

SEQ ID NO: 76801 - DNA, 20 bp, Homo sapiens
tccaggagagggtgtcagcc

SEQ ID NO: 76802 - DNA, 17 bp, Homo sapiens
tccagaagaggatgtcc

SEQ ID NO: 76803 - DNA, 19 bp, Homo sapiens
tccaggagggcgccgatcc

SEQ ID NO: 76804 - DNA, 16 bp, Homo sapiens
caggaaagatgtttac

SEQ ID NO: 76805 - DNA, 22 bp, Homo sapiens
tccaggaaggctcaggcggctc

SEQ ID NO: 76806 - DNA, 23 bp, Homo sapiens
tccaggagaaggtggcggaaccc

SEQ ID NO: 76807 - DNA, 18 bp, Homo sapiens
cccaggagggggttgctc

SEQ ID NO: 76808 - DNA, 18 bp, Homo sapiens
tccagaagaggcacgtcc

SEQ ID NO: 76809 - DNA, 17 bp, Homo sapiens
tccagggaggcctggcc

SEQ ID NO: 76810 - DNA, 16 bp, Homo sapiens
caggagaggccccacc

SEQ ID NO: 76811 - DNA, 19 bp, Homo sapiens
tcaaggagaggcaaatcac

SEQ ID NO: 76812 - DNA, 20 bp, Homo sapiens
tccagagggggatcctattc

SEQ ID NO: 76813 - DNA, 20 bp, Homo sapiens
tcctaggagagcctttattc

SEQ ID NO: 76814 - DNA, 17 bp, Homo sapiens
cccaggaggggcagctc

SEQ ID NO: 76815 - DNA, 20 bp, Homo sapiens
cccaggaggggcagtgaccc

SEQ ID NO: 76816 - DNA, 22 bp, Homo sapiens
tccaggaaggggtcccgtagcc

SEQ ID NO: 76817 - DNA, 18 bp, Homo sapiens
tccaggaaggcctcccac

SEQ ID NO: 76818 - DNA, 19 bp, Homo sapiens
cccaggcccctgttcaccc

SEQ ID NO: 76819 - DNA, 19 bp, Homo sapiens
tcaaggagaggcaagtcac

SEQ ID NO: 76820 - DNA, 21 bp, Homo sapiens
tccaggaggcggtggccgccc

SEQ ID NO: 76821 - DNA, 24 bp, Homo sapiens
tccaggagcggcgcaattttgttc

SEQ ID NO: 76822 - DNA, 16 bp, Homo sapiens
tccaggagggaccacc

SEQ ID NO: 76823 - DNA, 24 bp, Homo sapiens
cctgggagaggccacaaaatgccc

SEQ ID NO: 76824 - DNA, 19 bp, Homo sapiens
caggagaagccttgtgcca

SEQ ID NO: 76825 - DNA, 20 bp, Homo sapiens
tccaggagatggtcttgccc

SEQ ID NO: 76826 - DNA, 20 bp, Homo sapiens
tccaggagtggctgctgtcc

SEQ ID NO: 76827 - DNA, 18 bp, Homo sapiens
ccgggagggggcctgtcc

SEQ ID NO: 76828 - DNA, 21 bp, Homo sapiens
tccaggaggtggaggctgccc

SEQ ID NO: 76829 - DNA, 21 bp, Homo sapiens
tccagagaggctctggggctc

SEQ ID NO: 76830 - DNA, 19 bp, Homo sapiens
tccggggaggggctcaccc

SEQ ID NO: 76831 - DNA, 19 bp, Homo sapiens
caggtgaggcctgagacac

SEQ ID NO: 76832 - DNA, 21 bp, Homo sapiens
tccaggagatgtttgacaccc

SEQ ID NO: 76833 - DNA, 126 bp, Barley yellow dwarf virus - MAV
cgaagtggaactccaccactgatcaaatcgggaaacatgcttctgtgttgtacactgccccggagcccaccgggttaacaaggctattccaccagctcgatgaaatgagagtggagtgaacggccg

SEQ ID NO: 76834 - DNA, 24 bp, Barley yellow dwarf virus - MAV
tgaaatgagagtggagtgaacggc

SEQ ID NO: 76835 - DNA, 23 bp, Homo sapiens
tgaaaagacggggggtgaacggc

SEQ ID NO: 76836 - DNA, 19 bp, Homo sapiens
tggaaggggaagtgaacgg

SEQ ID NO: 76837 - DNA, 17 bp, Homo sapiens
tggaatgaggaggggtg

SEQ ID NO: 76838 - DNA, 24 bp, Homo sapiens
tgaaatgagagagcagcagatggc

SEQ ID NO: 76839 - DNA, 18 bp, Homo sapiens
gagatgagggtggagcag

SEQ ID NO: 76840 - DNA, 23 bp, Homo sapiens
tgaagtgagggtacagaggtggc

SEQ ID NO: 76841 - DNA, 21 bp, Homo sapiens
aaatgagatgaaatgagtggc

SEQ ID NO: 76842 - DNA, 21 bp, Homo sapiens
tggaatgagggaggaagaggc

SEQ ID NO: 76843 - DNA, 18 bp, Homo sapiens
gaaatgaaagggtgggtg

SEQ ID NO: 76844 - DNA, 18 bp, Homo sapiens
tgaggtcaggctgaacgg

SEQ ID NO: 76845 - DNA, 19 bp, Homo sapiens
tgaatgagagttaggggtg

SEQ ID NO: 76846 - DNA, 16 bp, Homo sapiens
tggagtggagtggcag

SEQ ID NO: 76847 - DNA, 18 bp, Homo sapiens
cgggagtggagtgggcgg

SEQ ID NO: 76848 - DNA, 22 bp, Homo sapiens
tgaagtgggagagccaagcggc

SEQ ID NO: 76849 - DNA, 18 bp, Homo sapiens
tgagatgaggtgggcggg

SEQ ID NO: 76850 - DNA, 21 bp, Homo sapiens
tgaagtgggagaggggcaggc

SEQ ID NO: 76851 - DNA, 21 bp, Homo sapiens
tgagaatgggggtggtgtggc

SEQ ID NO: 76852 - DNA, 22 bp, Homo sapiens
tgaaatgagagtggggtaccag

SEQ ID NO: 76853 - DNA, 17 bp, Homo sapiens
tgaagtgagagcgggta

SEQ ID NO: 76854 - DNA, 18 bp, Homo sapiens
atgggagtggggaagggc

SEQ ID NO: 76855 - DNA, 24 bp, Homo sapiens
tgaaagtgagaggaggtgagtggc

SEQ ID NO: 76856 - DNA, 18 bp, Homo sapiens
tgagagtggatggaaggc

SEQ ID NO: 76857 - DNA, 18 bp, Homo sapiens
tgaaaggagaatggacgg

SEQ ID NO: 76858 - DNA, 19 bp, Homo sapiens
tggaatgtgagtaacacaa

SEQ ID NO: 76859 - DNA, 23 bp, Homo sapiens
tgaaatgaaagtaacaggaatgg

SEQ ID NO: 76860 - DNA, 21 bp, Homo sapiens
tgagggagagtggagaaaggc

SEQ ID NO: 76861 - DNA, 24 bp, Homo sapiens
tgaagtgagcatcctcttgaacgg

SEQ ID NO: 76862 - DNA, 24 bp, Homo sapiens
tgaagtgaaaaagaagtggatggc

SEQ ID NO: 76863 - DNA, 23 bp, Homo sapiens
tgaaatgagtgtggagaaagggc

SEQ ID NO: 76864 - DNA, 22 bp, Homo sapiens
tggaatgacagtatagaatggc

SEQ ID NO: 76865 - DNA, 21 bp, Homo sapiens
tgaagtgggcggtggaggggc

SEQ ID NO: 76866 - DNA, 17 bp, Homo sapiens
tgggatgaggtgaagtg

SEQ ID NO: 76867 - DNA, 22 bp, Homo sapiens
tggaatgagtgtggacaaacgg

SEQ ID NO: 76868 - DNA, 19 bp, Homo sapiens
tgagggagagtgggtgggg

SEQ ID NO: 76869 - DNA, 24 bp, Homo sapiens
tgaatgagagtggctcgtcatggc

SEQ ID NO: 76870 - DNA, 24 bp, Homo sapiens
tgagatggagtggagtgcagtggc

SEQ ID NO: 76871 - DNA, 17 bp, Homo sapiens
tgaagtaagtgtgggtg

SEQ ID NO: 76872 - DNA, 17 bp, Homo sapiens
tgggatggggtgaacgg

SEQ ID NO: 76873 - DNA, 18 bp, Homo sapiens
tggagtggaggtgcacgg

SEQ ID NO: 76874 - DNA, 64 bp, Infectious spleen and kidney necrosis virus
cgccaagaccttttcacagcactttattgtcacatcatcacacacagcagtgccgtcattggtg

SEQ ID NO: 76875 - DNA, 18 bp, Infectious spleen and kidney necrosis virus
gcagtgccgtcattggtg

SEQ ID NO: 76876 - DNA, 18 bp, Homo sapiens
gcagtccgtgactcggtg

SEQ ID NO: 76877 - DNA, 21 bp, Homo sapiens
acagtgcccaatctattggtg

SEQ ID NO: 76878 - DNA, 16 bp, Homo sapiens
gcagtgcccaatggtg

SEQ ID NO: 76879 - DNA, 16 bp, Homo sapiens
gcaggcatcaatggtg

SEQ ID NO: 76880 - DNA, 16 bp, Homo sapiens
gcggtgccgccaggtg

SEQ ID NO: 76881 - DNA, 16 bp, Homo sapiens
gcagtaccccttggtg

SEQ ID NO: 76882 - DNA, 20 bp, Homo sapiens
gcagtaccgtacagttggtg

SEQ ID NO: 76883 - DNA, 21 bp, Homo sapiens
gcagtgcccgtctgtctggtg

SEQ ID NO: 76884 - DNA, 16 bp, Homo sapiens
gcagcgcctcctggtg

SEQ ID NO: 76885 - DNA, 18 bp, Homo sapiens
acaccggtgtcattggtg

SEQ ID NO: 76886 - DNA, 18 bp, Homo sapiens
gcggtggccgcagtggtg

SEQ ID NO: 76887 - DNA, 18 bp, Homo sapiens
gcatgtaatccattggtg

SEQ ID NO: 76888 - DNA, 16 bp, Homo sapiens
acagtgccccttggtg

SEQ ID NO: 76889 - DNA, 16 bp, Homo sapiens
gctgcagtcattggtg

SEQ ID NO: 76890 - DNA, 18 bp, Homo sapiens
gcatgtgctccactggtg

SEQ ID NO: 76891 - DNA, 18 bp, Homo sapiens
gcggtgtgtgcatcggtg

SEQ ID NO: 76892 - DNA, 18 bp, Homo sapiens
gctgtgcttccactggtg

SEQ ID NO: 76893 - DNA, 16 bp, Homo sapiens
gcagtgccttctggtg

SEQ ID NO: 76894 - DNA, 17 bp, Homo sapiens
gcagtgacccatcggtg

SEQ ID NO: 76895 - DNA, 19 bp, Homo sapiens
gcagcgccaggcagtggtg

SEQ ID NO: 76896 - DNA, 19 bp, Homo sapiens
agtgccgtggagattggtg

SEQ ID NO: 76897 - DNA, 17 bp, Homo sapiens
gcagtacctccacggtg

SEQ ID NO: 76898 - DNA, 17 bp, Homo sapiens
gcagtttgccattggtg

SEQ ID NO: 76899 - DNA, 20 bp, Homo sapiens
gcagtgccgggcccatggtg

SEQ ID NO: 76900 - DNA, 18 bp, Homo sapiens
gcaatgccaaccctggtg

SEQ ID NO: 76901 - DNA, 21 bp, Homo sapiens
gcagtgcccgcctcattggtg

SEQ ID NO: 76902 - DNA, 17 bp, Homo sapiens
gcaggtgcccattggtg

SEQ ID NO: 76903 - DNA, 74 bp, Aichi virus
tgcccactcctccatggtgatataaagaccacccacttccttcgggtgagcccctaagccatggttgtactgca

SEQ ID NO: 76904 - DNA, 24 bp, Aichi virus
cctccatggtgatataaagaccac

SEQ ID NO: 76905 - DNA, 18 bp, Homo sapiens
tggatgatatgaaggcca

SEQ ID NO: 76906 - DNA, 18 bp, Homo sapiens
ctcctgaaactataaaga

SEQ ID NO: 76907 - DNA, 21 bp, Homo sapiens
ctccatgacgctaaaggccac

SEQ ID NO: 76908 - DNA, 23 bp, Homo sapiens
cctccaggggacacaaaggccac

SEQ ID NO: 76909 - DNA, 19 bp, Homo sapiens
ctacatggtgatgtgagac

SEQ ID NO: 76910 - DNA, 20 bp, Homo sapiens
ctcaatggtgacatggccac

SEQ ID NO: 76911 - DNA, 21 bp, Homo sapiens
cctcggaatgcatataaagac

SEQ ID NO: 76912 - DNA, 21 bp, Homo sapiens
cctccatggatgtcacaagac

SEQ ID NO: 76913 - DNA, 18 bp, Homo sapiens
ccccgtggtgacagacca

SEQ ID NO: 76914 - DNA, 22 bp, Homo sapiens
cctccatagtagctgggactac

SEQ ID NO: 76915 - DNA, 24 bp, Homo sapiens
ccactgtgtcaggatgaagaccac

SEQ ID NO: 76916 - DNA, 20 bp, Homo sapiens
tccacacatataaaggtcac

SEQ ID NO: 76917 - DNA, 23 bp, Homo sapiens
tctcatggtgaaccttgagacca

SEQ ID NO: 76918 - DNA, 23 bp, Homo sapiens
ctccataggttcccagaaggcca

SEQ ID NO: 76919 - DNA, 20 bp, Homo sapiens
tccatgctcattaaagacca

SEQ ID NO: 76920 - DNA, 22 bp, Homo sapiens
cttcagggtgatatcccatcac

SEQ ID NO: 76921 - DNA, 21 bp, Homo sapiens
taatgcacacataaaggccac

SEQ ID NO: 76922 - DNA, 19 bp, Homo sapiens
ccaccatggttaaaggcca

SEQ ID NO: 76923 - DNA, 20 bp, Homo sapiens
ccttctaatgattataaaga

SEQ ID NO: 76924 - DNA, 27 bp, Homo sapiens
cctccatggagcacctctggggaccac

SEQ ID NO: 76925 - DNA, 19 bp, Homo sapiens
tctgagggagaaagaccac

SEQ ID NO: 76926 - DNA, 18 bp, Homo sapiens
ccttctggctacaaagac

SEQ ID NO: 76927 - DNA, 22 bp, Homo sapiens
cctccatggtgttgctgaccac

SEQ ID NO: 76928 - DNA, 21 bp, Homo sapiens
cttcatggtgatataggagac

SEQ ID NO: 76929 - DNA, 16 bp, Homo sapiens
ccatggtgacaggcca

SEQ ID NO: 76930 - DNA, 21 bp, Homo sapiens
catggtgacgagggagaccac

SEQ ID NO: 76931 - DNA, 18 bp, Homo sapiens
cctcctcggtgaagacca

SEQ ID NO: 76932 - DNA, 25 bp, Homo sapiens
cctccatggttgcaggtaaggtcac

SEQ ID NO: 76933 - DNA, 25 bp, Homo sapiens
cctccatgttgatggatgaggtcac

SEQ ID NO: 76934 - DNA, 18 bp, Homo sapiens
catggcatgtaaagacca

SEQ ID NO: 76935 - DNA, 97 bp, Human herpesvirus 7
atgatacttttattaattcttcgttctctaattggatttaacaacgatctttggtcgcaatcacaactagcttttacttgtctgaataaaagtttat

SEQ ID NO: 76936 - DNA, 24 bp, Human herpesvirus 7
tctaattggatttaacaacgatct

SEQ ID NO: 76937 - DNA, 20 bp, Homo sapiens
caagtagctgacaacgatct

SEQ ID NO: 76938 - DNA, 18 bp, Homo sapiens
tccagttgtacaacgatc

SEQ ID NO: 76939 - DNA, 18 bp, Homo sapiens
attggatttggcaatgat

SEQ ID NO: 76940 - DNA, 66 bp, Infectious flacherie virus
ttaaatatttagtttgatatttttggtttgtataattgtattattaatattatattgtttatcagg

SEQ ID NO: 76941 - DNA, 23 bp, Infectious flacherie virus
ttaatattatattgtttatcagg

SEQ ID NO: 76942 - DNA, 22 bp, Homo sapiens
ttaatagaagttgtttatcagg

SEQ ID NO: 76943 - DNA, 22 bp, Homo sapiens
ttaatattgcatttatatcagg

SEQ ID NO: 76944 - DNA, 19 bp, Homo sapiens
tattatagagattatcagg

SEQ ID NO: 76945 - DNA, 17 bp, Homo sapiens
atattatattgttccag

SEQ ID NO: 76946 - DNA, 62 bp, Infectious flacherie virus
ttagaattaggacaccggaagtggaacgcctaagagagcgaggcccgcggtgtaggttttga

SEQ ID NO: 76947 - DNA, 24 bp, Infectious flacherie virus
taggacaccggaagtggaacgcct

SEQ ID NO: 76948 - DNA, 19 bp, Homo sapiens
cactggaagtggggtgcct

SEQ ID NO: 76949 - DNA, 24 bp, Homo sapiens
gggcaccggaatcccctgggatgc

SEQ ID NO: 76950 - DNA, 24 bp, Homo sapiens
agggcatcggaagtggggtgaccc

SEQ ID NO: 76951 - DNA, 20 bp, Homo sapiens
taggagaaagtggggtgcct

SEQ ID NO: 76952 - DNA, 23 bp, Homo sapiens
tagggggctgccaatgaacgcct

SEQ ID NO: 76953 - DNA, 19 bp, Homo sapiens
tagggcaatgggaaacgcc

SEQ ID NO: 76954 - DNA, 17 bp, Homo sapiens
aggacaccgggaccgcc

SEQ ID NO: 76955 - DNA, 19 bp, Homo sapiens
gaacaaatgaagtgggacg

SEQ ID NO: 76956 - DNA, 22 bp, Homo sapiens
ggatacaggaagtgagtgtcct

SEQ ID NO: 76957 - DNA, 21 bp, Homo sapiens
ggcaagctaagtggaatgcct

SEQ ID NO: 76958 - DNA, 62 bp, Infectious flacherie virus
gttatagctgggcacacttgcggtttccgaacgcagtcggagatacgtagtcagctagtagc

SEQ ID NO: 76959 - DNA, 24 bp, Infectious flacherie virus
tagctgggcacacttgcggtttcc

SEQ ID NO: 76960 - DNA, 20 bp, Homo sapiens
tagctaggcatatgagtttc

SEQ ID NO: 76961 - DNA, 22 bp, Homo sapiens
tagctgggcacctcactgttcc

SEQ ID NO: 76962 - DNA, 18 bp, Homo sapiens
tagctgggtggcttactc

SEQ ID NO: 76963 - DNA, 18 bp, Homo sapiens
ggcctccttgcggtttcc

SEQ ID NO: 76964 - DNA, 19 bp, Homo sapiens
gctggacacttgtggtttc

SEQ ID NO: 76965 - DNA, 22 bp, Homo sapiens
cagctgggcactctgggtttcc

SEQ ID NO: 76966 - DNA, 19 bp, Homo sapiens
tagctgaatttgtggtttc

SEQ ID NO: 76967 - DNA, 21 bp, Homo sapiens
tagctgggcatgccttattcc

SEQ ID NO: 76968 - DNA, 16 bp, Homo sapiens
cagctgggcgcgcgtt

SEQ ID NO: 76969 - DNA, 17 bp, Homo sapiens
tgggcacagcagtttcc

SEQ ID NO: 76970 - DNA, 23 bp, Homo sapiens
tagctgggtgtgttggtatgtcc

SEQ ID NO: 76971 - DNA, 18 bp, Homo sapiens
tagctgggcgtgctggct

SEQ ID NO: 76972 - DNA, 17 bp, Homo sapiens
tagctggacattggttt

SEQ ID NO: 76973 - DNA, 17 bp, Homo sapiens
gctgggcaaaccgtttc

SEQ ID NO: 76974 - DNA, 22 bp, Homo sapiens
tagctgggggtgctggagttcc

SEQ ID NO: 76975 - DNA, 19 bp, Homo sapiens
gctgggcacgctgcttttt

SEQ ID NO: 76976 - DNA, 17 bp, Homo sapiens
tagctgggcgtgctggt

SEQ ID NO: 76977 - DNA, 19 bp, Homo sapiens
gctgggccacttcgagctc

SEQ ID NO: 76978 - DNA, 19 bp, Homo sapiens
gctgggcgaatttgcagcc

SEQ ID NO: 76979 - DNA, 21 bp, Homo sapiens
tagctgggcctgtttgggtcc

SEQ ID NO: 76980 - DNA, 21 bp, Homo sapiens
tagctgagtatactaaggctt

SEQ ID NO: 76981 - DNA, 18 bp, Homo sapiens
tagctgggtatactgttt

SEQ ID NO: 76982 - DNA, 18 bp, Homo sapiens
agctgggcgtacttggtc

SEQ ID NO: 76983 - DNA, 18 bp, Homo sapiens
tagctgggcatggttgca

SEQ ID NO: 76984 - DNA, 82 bp, Gallid herpesvirus 3
gtaacgaatgctcgtgtactttataattgcatgcccgattacaatctgttctgtaagaataattatacgtagcgtgttttac

SEQ ID NO: 76985 - DNA, 17 bp, Gallid herpesvirus 3
tacgtagcgtgttttac

SEQ ID NO: 76986 - DNA, 18 bp, Homo sapiens
tacataacatctgtttta

SEQ ID NO: 76987 - DNA, 129 bp, Gallid herpesvirus 3
gtatagaagagacgcagtcaacttgccggtgccgtgaaattgtctccacactatgatgtttttactgttacaaggtaattaaagaccttcgagtttttcactccacttgtgtgacgctccttcgattat

SEQ ID NO: 76988 - DNA, 24 bp, Gallid herpesvirus 3
tagaagagacgcagtcaacttgcc

SEQ ID NO: 76989 - DNA, 21 bp, Homo sapiens
gaagaataaagtcaacttgcc

SEQ ID NO: 76990 - DNA, 24 bp, Homo sapiens
tagggaggggccctgaaacttgcc

SEQ ID NO: 76991 - DNA, 22 bp, Homo sapiens
tagaagagatgtggactgtgcc

SEQ ID NO: 76992 - DNA, 20 bp, Homo sapiens
tagaataggcagcaacttgc

SEQ ID NO: 76993 - DNA, 18 bp, Homo sapiens
gagaggaagtaacttgcc

SEQ ID NO: 76994 - DNA, 19 bp, Homo sapiens
aaaggaaatagtcaacttg

SEQ ID NO: 76995 - DNA, 19 bp, Homo sapiens
aaagacgcagcaatttgcc

SEQ ID NO: 76996 - DNA, 21 bp, Homo sapiens
gaggaaataggcacaacttgc

SEQ ID NO: 76997 - DNA, 21 bp, Homo sapiens
tagaaagattaagtgacttgc

SEQ ID NO: 76998 - DNA, 19 bp, Homo sapiens
tagtgggagaacaacttgc

SEQ ID NO: 76999 - DNA, 21 bp, Homo sapiens
aaagaggagcagtaacttgcc

SEQ ID NO: 77000 - DNA, 20 bp, Homo sapiens
gaagagacaccagagcttgc

SEQ ID NO: 77001 - DNA, 23 bp, Homo sapiens
cagaagaggtcgcacagcttgcc

SEQ ID NO: 77002 - DNA, 19 bp, Homo sapiens
aagaatcacagtcagcttg

SEQ ID NO: 77003 - DNA, 22 bp, Homo sapiens
tagaaggagcagcgaacttgcc

SEQ ID NO: 77004 - DNA, 18 bp, Homo sapiens
agaagagagacaacttgc

SEQ ID NO: 77005 - DNA, 17 bp, Homo sapiens
gaagagacccagcatgc

SEQ ID NO: 77006 - DNA, 23 bp, Homo sapiens
tagaggaggttaataaacttgcc

SEQ ID NO: 77007 - DNA, 21 bp, Homo sapiens
cagaagaggtgctacagcttg

SEQ ID NO: 77008 - DNA, 21 bp, Homo sapiens
tagaagagatgggtttttgcc

SEQ ID NO: 77009 - DNA, 19 bp, Homo sapiens
agaagagtatttcaacttg

SEQ ID NO: 77010 - DNA, 60 bp, Saimiriine herpesvirus 2
gaaaaatgtagttacaatgtaagtgttttagtttatgatacgttttacatgttatttttc

SEQ ID NO: 77011 - DNA, 22 bp, Saimiriine herpesvirus 2
tacgttttacatgttatttttc

SEQ ID NO: 77012 - DNA, 19 bp, Homo sapiens
tacgttacaattatttttc

SEQ ID NO: 77013 - DNA, 28 bp, Homo sapiens
tacattttacaacttttgttatttttcg

SEQ ID NO: 77014 - DNA, 19 bp, Homo sapiens
gcagtacagtgttattttt

SEQ ID NO: 77015 - DNA, 19 bp, Homo sapiens
gttttacatgcattatttc

SEQ ID NO: 77016 - DNA, 22 bp, Homo sapiens
tacgttttactgtacagccttc

SEQ ID NO: 77017 - DNA, 20 bp, Homo sapiens
cacgttttacagtatttttc

SEQ ID NO: 77018 - DNA, 22 bp, Homo sapiens
cacccctcagcatgttattttt

SEQ ID NO: 77019 - DNA, 21 bp, Homo sapiens
tacgttctgcattttattttt

SEQ ID NO: 77020 - DNA, 19 bp, Homo sapiens
gttttacataggacttttc

SEQ ID NO: 77021 - DNA, 19 bp, Homo sapiens
tacttttacatgtactttt

SEQ ID NO: 77022 - DNA, 62 bp, Sorghum mosaic virus
aagtattatatgtttcctatgtgagtgaggccatgcctcgttagtgtaatatatatttactt

SEQ ID NO: 77023 - DNA, 21 bp, Sorghum mosaic virus
tagtgtaatatatatttactt

SEQ ID NO: 77024 - DNA, 21 bp, Homo sapiens
cagtgtaacacaaatttgctt

SEQ ID NO: 77025 - DNA, 19 bp, Homo sapiens
atagaatatatatttactt

SEQ ID NO: 77026 - DNA, 19 bp, Homo sapiens
tagtgcaatagtatattta

SEQ ID NO: 77027 - DNA, 18 bp, Homo sapiens
gtgtaatactgtctactt

SEQ ID NO: 77028 - DNA, 18 bp, Homo sapiens
atgtaatatacataactt

SEQ ID NO: 77029 - DNA, 21 bp, Homo sapiens
taggaccatatatatttactt

SEQ ID NO: 77030 - DNA, 21 bp, Homo sapiens
tagtgcaattacgttttactt

SEQ ID NO: 77031 - DNA, 18 bp, Homo sapiens
cagtgcatatatttactt

SEQ ID NO: 77032 - DNA, 18 bp, Homo sapiens
tagtgtaaaaatttactt

SEQ ID NO: 77033 - DNA, 19 bp, Homo sapiens
tagtgtaatttacatattt

SEQ ID NO: 77034 - DNA, 21 bp, Homo sapiens
taggtatacatatatttactt

SEQ ID NO: 77035 - DNA, 18 bp, Homo sapiens
tagtgtatacatatattt

SEQ ID NO: 77036 - DNA, 62 bp, Sorghum mosaic virus
aaagtatttactattctgcaagggagtgaggacgcatcctccaaccttttagtacgtacttt

SEQ ID NO: 77037 - DNA, 24 bp, Sorghum mosaic virus
tctgcaagggagtgaggacgcatc

SEQ ID NO: 77038 - DNA, 18 bp, Homo sapiens
tctgaagggagtgactga

SEQ ID NO: 77039 - DNA, 20 bp, Homo sapiens
tctgcagagggagtgagggc

SEQ ID NO: 77040 - DNA, 23 bp, Homo sapiens
tcttaaggacaataggacgcatc

SEQ ID NO: 77041 - DNA, 19 bp, Homo sapiens
tctgcaaggtggtgggggc

SEQ ID NO: 77042 - DNA, 20 bp, Homo sapiens
tctgcaagggggtgcaggac

SEQ ID NO: 77043 - DNA, 17 bp, Homo sapiens
tgcaagggagaacgcat

SEQ ID NO: 77044 - DNA, 21 bp, Homo sapiens
cctgcgatctggggacgcatc

SEQ ID NO: 77045 - DNA, 20 bp, Homo sapiens
tgcgagggagtgggaggacg

SEQ ID NO: 77046 - DNA, 78 bp, Human herpesvirus 5
cgccgacaagacctcagcatggctcggaggctatggatcttgagcttactagccgtgaccttgacggtggctttggcg

SEQ ID NO: 77047 - DNA, 24 bp, Human herpesvirus 5
ttactagccgtgaccttgacggtg

SEQ ID NO: 77048 - DNA, 18 bp, Homo sapiens
ttattagctgtgacctta

SEQ ID NO: 77049 - DNA, 23 bp, Homo sapiens
ttattagcgttttgttgacggtg

SEQ ID NO: 77050 - DNA, 88 bp, Alcelaphine herpesvirus 1
gctaatattccagtaaataaaacttttatgaacacttgtaatggctctgtaaatttttcatttactgcacttaaatttgactgttggt

SEQ ID NO: 77051 - DNA, 24 bp, Alcelaphine herpesvirus 1
tccagtaaataaaacttttatgaa

SEQ ID NO: 77052 - DNA, 20 bp, Homo sapiens
tccagtaaataaacattatg

SEQ ID NO: 77053 - DNA, 22 bp, Homo sapiens
ccagtgtctcaaatttttatga

SEQ ID NO: 77054 - DNA, 21 bp, Homo sapiens
tccagtaaatgaggactgtga

SEQ ID NO: 77055 - DNA, 18 bp, Homo sapiens
tccagtgtataaaacttc

SEQ ID NO: 77056 - DNA, 21 bp, Homo sapiens
caataaataaaacggtttgaa

SEQ ID NO: 77057 - DNA, 21 bp, Homo sapiens
tccagtaagtgaaacactgaa

SEQ ID NO: 77058 - DNA, 23 bp, Homo sapiens
tccaataaataaaggcggcgtga

SEQ ID NO: 77059 - DNA, 18 bp, Homo sapiens
tccagtggataaaacctc

SEQ ID NO: 77060 - DNA, 23 bp, Homo sapiens
tccagtaaatgaaacatacatga

SEQ ID NO: 77061 - DNA, 22 bp, Homo sapiens
tccattgaataatcctttatga

SEQ ID NO: 77062 - DNA, 22 bp, Homo sapiens
cagtaaataaaacaaaaactga

SEQ ID NO: 77063 - DNA, 23 bp, Homo sapiens
tccagtatgaattgttttatgaa

SEQ ID NO: 77064 - DNA, 22 bp, Homo sapiens
tccactaactttatttttatga

SEQ ID NO: 77065 - DNA, 18 bp, Homo sapiens
caataaatgaaacttcca

SEQ ID NO: 77066 - DNA, 19 bp, Homo sapiens
ataaatatccttttatgaa

SEQ ID NO: 77067 - DNA, 21 bp, Homo sapiens
gtaaactttgccttttatgaa

SEQ ID NO: 77068 - DNA, 19 bp, Homo sapiens
ccagtaaataaaactgtca

SEQ ID NO: 77069 - DNA, 22 bp, Homo sapiens
tccagtaagcagaaactgatga

SEQ ID NO: 77070 - DNA, 20 bp, Homo sapiens
tccagcaaatgaagttccta

SEQ ID NO: 77071 - DNA, 28 bp, Homo sapiens
tccaataaacaatgtaagtttttatgaa

SEQ ID NO: 77072 - DNA, 23 bp, Homo sapiens
ccagtaaataatcaatattgtga

SEQ ID NO: 77073 - DNA, 22 bp, Homo sapiens
tccagtaaatggattctcctga

SEQ ID NO: 77074 - DNA, 69 bp, Equine herpesvirus 4
ttattggtcgctaagtttatccctaattgtcacgcgtggtaaaaacaacaacatagtcaagatcgttaa

SEQ ID NO: 77075 - DNA, 24 bp, Equine herpesvirus 4
ttggtcgctaagtttatccctaat

SEQ ID NO: 77076 - DNA, 21 bp, Homo sapiens
ttggtcactgctatatctcta

SEQ ID NO: 77077 - DNA, 22 bp, Homo sapiens
ttgaccactgagtttgtttcta

SEQ ID NO: 77078 - DNA, 23 bp, Homo sapiens
ttggtgttaagaatttccctaat

SEQ ID NO: 77079 - DNA, 17 bp, Homo sapiens
ggtcgacttttatccct

SEQ ID NO: 77080 - DNA, 126 bp, Meleagrid herpesvirus 1
gtgtctaatggtggaagcgtggcactggccgaaatgatatattgcgtatagagcgcgacaaacgaattagatgcgaatgtgaagatcatttttattagatgtaacatatgcctacaccaatagtac

SEQ ID NO: 77081 - DNA, 24 bp, Meleagrid herpesvirus 1
tctaatggtggaagcgtggcactg

SEQ ID NO: 77082 - DNA, 23 bp, Homo sapiens
tctagtggcggaagcaacccctg

SEQ ID NO: 77083 - DNA, 16 bp, Homo sapiens
tgatgtgcatggcact

SEQ ID NO: 77084 - DNA, 17 bp, Homo sapiens
tctggtggtgaaaggac

SEQ ID NO: 77085 - DNA, 18 bp, Homo sapiens
tctaatggtgtgaaatat

SEQ ID NO: 77086 - DNA, 23 bp, Homo sapiens
tctggggtggaaggagactactg

SEQ ID NO: 77087 - DNA, 21 bp, Homo sapiens
taatggtggaagataagactg

SEQ ID NO: 77088 - DNA, 17 bp, Homo sapiens
tggtgatggctggcact

SEQ ID NO: 77089 - DNA, 16 bp, Homo sapiens
tctaatggggaaaggc

SEQ ID NO: 77090 - DNA, 20 bp, Homo sapiens
ctggtggtggaagtgtaaac

SEQ ID NO: 77091 - DNA, 60 bp, Meleagrid herpesvirus 1
ccgtgacatttgacagacctggaattgttattctgatatatagtgggtgtgtctggccgg

SEQ ID NO: 77092 - DNA, 24 bp, Meleagrid herpesvirus 1
tttgacagacctggaattgttatt

SEQ ID NO: 77093 - DNA, 21 bp, Homo sapiens
tttgacagctctggagaagtt

SEQ ID NO: 77094 - DNA, 92 bp, Meleagrid herpesvirus 1
caacatacataatgtgcatgcgaaaccactttttcagtgtacgctgacattgtgcaacacggaggggtagcatctacatacaatatatgttg

SEQ ID NO: 77095 - DNA, 24 bp, Meleagrid herpesvirus 1
taatgtgcatgcgaaaccactttt

SEQ ID NO: 77096 - DNA, 20 bp, Homo sapiens
tgtccaagcaagccactttt

SEQ ID NO: 77097 - DNA, 17 bp, Homo sapiens
tgtgatgaagccacttt

SEQ ID NO: 77098 - DNA, 22 bp, Homo sapiens
caatggtagcgggaccactttt

SEQ ID NO: 77099 - DNA, 18 bp, Homo sapiens
atgtgcatgtggaacact

SEQ ID NO: 77100 - DNA, 22 bp, Homo sapiens
atgttaggttgagaccactttt

SEQ ID NO: 77101 - DNA, 65 bp, Lumpy skin disease virus
ctaataagtggaagccaattaagtagaagccaattaaacctaataagtggaagccaattaagtag

SEQ ID NO: 77102 - DNA, 24 bp, Lumpy skin disease virus
tggaagccaattaagtagaagcca

SEQ ID NO: 77103 - DNA, 18 bp, Homo sapiens
tagaagccaagtaggagc

SEQ ID NO: 77104 - DNA, 20 bp, Homo sapiens
tggaagccgatggggtggaa

SEQ ID NO: 77105 - DNA, 22 bp, Homo sapiens
gaaggtcaaggtccagaagcca

SEQ ID NO: 77106 - DNA, 17 bp, Homo sapiens
tgggggccagagaagcc

SEQ ID NO: 77107 - DNA, 15 bp, Homo sapiens
tggaagccagtgaag

SEQ ID NO: 77108 - DNA, 22 bp, Homo sapiens
tggggccggtttaaacagaggc

SEQ ID NO: 77109 - DNA, 19 bp, Homo sapiens
tggaagccaatggaaagcc

SEQ ID NO: 77110 - DNA, 21 bp, Homo sapiens
tggaagccatatgtaagaggc

SEQ ID NO: 77111 - DNA, 19 bp, Homo sapiens
tggaagccacttaagtgcc

SEQ ID NO: 77112 - DNA, 18 bp, Homo sapiens
tggaagccaattcagtag

SEQ ID NO: 77113 - DNA, 20 bp, Homo sapiens
tggaagccattgagagcagc

SEQ ID NO: 77114 - DNA, 17 bp, Homo sapiens
tggaagccgagtgagcc

SEQ ID NO: 77115 - DNA, 22 bp, Homo sapiens
tagaagctgattgcgcacgaag

SEQ ID NO: 77116 - DNA, 23 bp, Homo sapiens
tggggttgggatcaaagaagcca

SEQ ID NO: 77117 - DNA, 21 bp, Homo sapiens
tggcaagggcagaagtagaag

SEQ ID NO: 77118 - DNA, 20 bp, Homo sapiens
tgggagccaaagagaagcca

SEQ ID NO: 77119 - DNA, 23 bp, Homo sapiens
tggaagccaatttgtgtccaaag

SEQ ID NO: 77120 - DNA, 20 bp, Homo sapiens
tggagcccaggtgtagaagc

SEQ ID NO: 77121 - DNA, 20 bp, Homo sapiens
tgggggccggagtagaagcc

SEQ ID NO: 77122 - DNA, 24 bp, Homo sapiens
tgggagtgttaggagtagaagcca

SEQ ID NO: 77123 - DNA, 20 bp, Homo sapiens
tggaaatcaagcatagaggc

SEQ ID NO: 77124 - DNA, 20 bp, Homo sapiens
tgggggcagaagcaggagcc

SEQ ID NO: 77125 - DNA, 16 bp, Homo sapiens
tggagctaagtaggag

SEQ ID NO: 77126 - DNA, 20 bp, Homo sapiens
ggaagttggaggagaagcca

SEQ ID NO: 77127 - DNA, 25 bp, Homo sapiens
tggaagccatttttaatttaggggc

SEQ ID NO: 77128 - DNA, 18 bp, Homo sapiens
tgaaagccagttgacgcc

SEQ ID NO: 77129 - DNA, 20 bp, Homo sapiens
tagaagcctacttgtagaag

SEQ ID NO: 77130 - DNA, 20 bp, Homo sapiens
tagaaggcaaaagtagaagc

SEQ ID NO: 77131 - DNA, 22 bp, Homo sapiens
tgaaagccggaatccaggaagc

SEQ ID NO: 77132 - DNA, 19 bp, Homo sapiens
gaggctcaaaagtagaagc

SEQ ID NO: 77133 - DNA, 22 bp, Homo sapiens
ggaagccaattggatttcaagt

SEQ ID NO: 77134 - DNA, 19 bp, Homo sapiens
tgaaagccagaggaggggc

SEQ ID NO: 77135 - DNA, 16 bp, Homo sapiens
tggaagccattagagc

SEQ ID NO: 77136 - DNA, 24 bp, Homo sapiens
tggagagcaaggaagtagaagtca

SEQ ID NO: 77137 - DNA, 21 bp, Homo sapiens
gagacaggtaggtagaagcca

SEQ ID NO: 77138 - DNA, 16 bp, Homo sapiens
ggagccaacagaagcc

SEQ ID NO: 77139 - DNA, 19 bp, Homo sapiens
tggaaacttaatgtagaag

SEQ ID NO: 77140 - DNA, 121 bp, Lumpy skin disease virus
ggcttctacttaattggcttccacttattaggtttaattggcttctacttaattggcttccacttattaggtttaattggcttctacttaattggcttccacttattaggtttaattggct

SEQ ID NO: 77141 - DNA, 24 bp, Lumpy skin disease virus
taattggcttctacttaattggct

SEQ ID NO: 77142 - DNA, 17 bp, Homo sapiens
aacttgtttaattggct

SEQ ID NO: 77143 - DNA, 18 bp, Homo sapiens
tggcttctaaaagtggct

SEQ ID NO: 77144 - DNA, 23 bp, Homo sapiens
ttggcttctgtgacctgttggct

SEQ ID NO: 77145 - DNA, 18 bp, Homo sapiens
taattggctctgccaggc

SEQ ID NO: 77146 - DNA, 16 bp, Homo sapiens
taattggctcctgtgg

SEQ ID NO: 77147 - DNA, 18 bp, Homo sapiens
taattggcttttattagc

SEQ ID NO: 77148 - DNA, 18 bp, Homo sapiens
taattggcttcaattact

SEQ ID NO: 77149 - DNA, 20 bp, Homo sapiens
ttggcttctgttaagaggct

SEQ ID NO: 77150 - DNA, 21 bp, Homo sapiens
ttgatttctacttaattggct

SEQ ID NO: 77151 - DNA, 79 bp, Barley yellow mosaic virus
ccgtgccttatacatcacccacccccgctcataattcagtctttaaattatgttcgtgacgtctttgtatcaggctcgg

SEQ ID NO: 77152 - DNA, 24 bp, Barley yellow mosaic virus
tatgttcgtgacgtctttgtatca

SEQ ID NO: 77153 - DNA, 19 bp, Homo sapiens
tatgttagtgacgtctatc

SEQ ID NO: 77154 - DNA, 18 bp, Homo sapiens
tatgtgtcgtttctttgt

SEQ ID NO: 77155 - DNA, 113 bp, Indian citrus ringspot virus
ggccgttcgtattatagcattgggactcgctgttactgccctcatcttcacatccacaagggacacatctagacacgtaggagacccatcacattctctacctttcggcggcc

SEQ ID NO: 77156 - DNA, 24 bp, Indian citrus ringspot virus
tagcattgggactcgctgttactg

SEQ ID NO: 77157 - DNA, 18 bp, Homo sapiens
gcattgagattctcattg

SEQ ID NO: 77158 - DNA, 20 bp, Homo sapiens
taccattgggattcacagtt

SEQ ID NO: 77159 - DNA, 19 bp, Homo sapiens
tagtattggcaatgttact

SEQ ID NO: 77160 - DNA, 17 bp, Homo sapiens
tagcattggaaatgtta

SEQ ID NO: 77161 - DNA, 19 bp, Homo sapiens
tagcacctcgttgttactg

SEQ ID NO: 77162 - DNA, 22 bp, Homo sapiens
cagcattgggatttgtgaaact

SEQ ID NO: 77163 - DNA, 25 bp, Homo sapiens
cagcattggggtttggactcaactg

SEQ ID NO: 77164 - DNA, 18 bp, Homo sapiens
gcattgggctatcgtgct

SEQ ID NO: 77165 - DNA, 20 bp, Homo sapiens
tagcattggaactcattgct

SEQ ID NO: 77166 - DNA, 22 bp, Homo sapiens
gcattggggctggatgacgctg

SEQ ID NO: 77167 - DNA, 123 bp, Vaccinia virus
gacgataacttgatttcgaaattacccatggagatactttattactccattaaataatttatcatggagtgataatgtcctgtttcatttgtttccatgacatattacaaaatcgattccgtc

SEQ ID NO: 77168 - DNA, 24 bp, Vaccinia virus
taacttgatttcgaaattacccat

SEQ ID NO: 77169 - DNA, 15 bp, Homo sapiens
ttgatttcttaccca

SEQ ID NO: 77170 - DNA, 19 bp, Homo sapiens
taacttgatttgggattac

SEQ ID NO: 77171 - DNA, 19 bp, Homo sapiens
taacttgattctgagaaac

SEQ ID NO: 77172 - DNA, 19 bp, Homo sapiens
cttgatttctttcacccat

SEQ ID NO: 77173 - DNA, 60 bp, Equine herpesvirus 4
cggcgctttgtctagccctcttagtgggtattgttaccggctggggttttattggcgttg

SEQ ID NO: 77174 - DNA, 24 bp, Equine herpesvirus 4
tagccctcttagtgggtattgtta

SEQ ID NO: 77175 - DNA, 19 bp, Homo sapiens
cctcttagttcttttgtta

SEQ ID NO: 77176 - DNA, 25 bp, Homo sapiens
gcctctcttggtcaaatagttgtta

SEQ ID NO: 77177 - DNA, 72 bp, Fowlpox virus
tacagccacgtttactagcgggacttataagtgaaatcattttattgttctatattagattacgtaaatgta

SEQ ID NO: 77178 - DNA, 24 bp, Fowlpox virus
tagcgggacttataagtgaaatca

SEQ ID NO: 77179 - DNA, 22 bp, Homo sapiens
gcaggactgtcctgtggaatca

SEQ ID NO: 77180 - DNA, 16 bp, Homo sapiens
gctggtaagtgaaatc

SEQ ID NO: 77181 - DNA, 20 bp, Homo sapiens
tagcagggactggtgaaatc

SEQ ID NO: 77182 - DNA, 21 bp, Homo sapiens
aagattgttatgagtgaaatc

SEQ ID NO: 77183 - DNA, 118 bp, Myxoma virus
atgatggcgaaccaacagtccgagtgtcccgtttttttttaagctggtggattttttgcttaatacataagcttgtcttcggcatatggagatgctttaggggaacggtcgtcctcgt

SEQ ID NO: 77184 - DNA, 24 bp, Myxoma virus
cttgtcttcggcatatggagatgc

SEQ ID NO: 77185 - DNA, 18 bp, Homo sapiens
ttgtcttctggtgtatga

SEQ ID NO: 77186 - DNA, 21 bp, Homo sapiens
cttattttcctctggagatgc

SEQ ID NO: 77187 - DNA, 23 bp, Homo sapiens
cttgtctttggacgtacgggtgc

SEQ ID NO: 77188 - DNA, 18 bp, Homo sapiens
ttgttttcgacatatatg

SEQ ID NO: 77189 - DNA, 23 bp, Homo sapiens
cttgtcttcaggggctggggtgc

SEQ ID NO: 77190 - DNA, 22 bp, Homo sapiens
cttttctgggatatggagatgc

SEQ ID NO: 77191 - DNA, 21 bp, Homo sapiens
cttgtcttcgggtgagagtgc

SEQ ID NO: 77192 - DNA, 22 bp, Homo sapiens
cttgtctttggcaatgcagtgc

SEQ ID NO: 77193 - DNA, 21 bp, Homo sapiens
ttgtttccggcataccttatg

SEQ ID NO: 77194 - DNA, 18 bp, Homo sapiens
cttgtctttgacacgatg

SEQ ID NO: 77195 - DNA, 68 bp, Rabbit fibroma virus
ttcaacttattaggttgtgactccaataccatttttatggtaccggagtcctccgtaatatagtcgaa

SEQ ID NO: 77196 - DNA, 24 bp, Rabbit fibroma virus
taccggagtcctccgtaatatagt

SEQ ID NO: 77197 - DNA, 21 bp, Homo sapiens
atccactttctgtaatatagt

SEQ ID NO: 77198 - DNA, 18 bp, Homo sapiens
agccttctgtaatatagt

SEQ ID NO: 77199 - DNA, 115 bp, Barmah Forest virus
ctaggcagagccggcgggtacattttttcgtcagacacgggtccaggccacctacagcagagatccgttttacaaaattgcacggcagaatgtatctacgaaccggcaaaactag

SEQ ID NO: 77200 - DNA, 24 bp, Barmah Forest virus
agagatccgttttacaaaattgca

SEQ ID NO: 77201 - DNA, 20 bp, Homo sapiens
gatccaaacataaaattgca

SEQ ID NO: 77202 - DNA, 21 bp, Homo sapiens
agaaatttacacaaaattgca

SEQ ID NO: 77203 - DNA, 20 bp, Homo sapiens
gagcccattttatgagattg

SEQ ID NO: 77204 - DNA, 17 bp, Homo sapiens
gaaatccgcaaagttgc

SEQ ID NO: 77205 - DNA, 19 bp, Homo sapiens
aggtatccctcaaaattgc

SEQ ID NO: 77206 - DNA, 19 bp, Homo sapiens
agagatctttgtaaattgc

SEQ ID NO: 77207 - DNA, 17 bp, Homo sapiens
gaggcagacaaaattgc

SEQ ID NO: 77208 - DNA, 19 bp, Homo sapiens
agaaacccttacaaagttg

SEQ ID NO: 77209 - DNA, 19 bp, Homo sapiens
aagatctgaccaaaattgc

SEQ ID NO: 77210 - DNA, 21 bp, Homo sapiens
agagatcccttttgatctgca

SEQ ID NO: 77211 - DNA, 19 bp, Homo sapiens
agagatcctgttttggtgc

SEQ ID NO: 77212 - DNA, 122 bp, Chimpanzee cytomegalovirus
cgaggacggcgaggcgtctgcgtgttaaacggctgtacgcggggtgtgatgtgcttttaaaaaactggctctaagtagtctttctctgctgtccggtcgcctgcccgaccttgccgtcttcg

SEQ ID NO: 77213 - DNA, 24 bp, Chimpanzee cytomegalovirus
tttctctgctgtccggtcgcctgc

SEQ ID NO: 77214 - DNA, 21 bp, Homo sapiens
tttctctgctctccctctctg

SEQ ID NO: 77215 - DNA, 18 bp, Homo sapiens
tttctctgtgtctctcct

SEQ ID NO: 77216 - DNA, 22 bp, Homo sapiens
tttctctgctgttccacactgc

SEQ ID NO: 77217 - DNA, 22 bp, Homo sapiens
tttctctgttcttcctctttgc

SEQ ID NO: 77218 - DNA, 23 bp, Homo sapiens
tttctctgcagtgtaagtgcttg

SEQ ID NO: 77219 - DNA, 22 bp, Homo sapiens
cttctctgttctagttgcttgc

SEQ ID NO: 77220 - DNA, 23 bp, Homo sapiens
tttctctgcttcaccatgtctgc

SEQ ID NO: 77221 - DNA, 18 bp, Homo sapiens
tttcctgctgtcatctgc

SEQ ID NO: 77222 - DNA, 15 bp, Homo sapiens
tctgccgtctcactg

SEQ ID NO: 77223 - DNA, 19 bp, Homo sapiens
tttctctgcttctgggtgc

SEQ ID NO: 77224 - DNA, 25 bp, Homo sapiens
tttctgctgctgttcccagcactgc

SEQ ID NO: 77225 - DNA, 19 bp, Homo sapiens
tttctctgctgtggatctg

SEQ ID NO: 77226 - DNA, 22 bp, Homo sapiens
tttctctgttatctgggagggc

SEQ ID NO: 77227 - DNA, 19 bp, Homo sapiens
tttctctgcttctggaggc

SEQ ID NO: 77228 - DNA, 23 bp, Homo sapiens
tttctctgtttctgcagtcttgc

SEQ ID NO: 77229 - DNA, 15 bp, Homo sapiens
tttctctgctgcatc

SEQ ID NO: 77230 - DNA, 23 bp, Homo sapiens
tttctctgcttgtctgctggtgc

SEQ ID NO: 77231 - DNA, 18 bp, Homo sapiens
tttctctgtgtctgctgc

SEQ ID NO: 77232 - DNA, 28 bp, Homo sapiens
tttccctgctgttcttgcgcaggcgacc

SEQ ID NO: 77233 - DNA, 24 bp, Homo sapiens
cttctctgttgtttggagaacctg

SEQ ID NO: 77234 - DNA, 61 bp, Fowlpox virus
tctaaatttcgtgtcgcgatacggtaagggtagttactggatagacataaatcaaaataga

SEQ ID NO: 77235 - DNA, 24 bp, Fowlpox virus
tggatagacataaatcaaaataga

SEQ ID NO: 77236 - DNA, 22 bp, Homo sapiens
gacataaataagttaaaataga

SEQ ID NO: 77237 - DNA, 24 bp, Homo sapiens
tggacagacgtaagacacccatag

SEQ ID NO: 77238 - DNA, 22 bp, Homo sapiens
tggatagacctagtcaggtaga

SEQ ID NO: 77239 - DNA, 19 bp, Homo sapiens
tagatagacatatagatag

SEQ ID NO: 77240 - DNA, 27 bp, Homo sapiens
tgtatagacatgaaaaggacaaaatag

SEQ ID NO: 77241 - DNA, 18 bp, Homo sapiens
ggatagacactcccaaaa

SEQ ID NO: 77242 - DNA, 18 bp, Homo sapiens
tgtatagactcaaaatag

SEQ ID NO: 77243 - DNA, 74 bp, Fowlpox virus
ggaatttttctattttgatttatgtctatccagtaactacccttaccgtatcgcgacacgaaatttagagtttc

SEQ ID NO: 77244 - DNA, 24 bp, Fowlpox virus
tctattttgatttatgtctatcca

SEQ ID NO: 77245 - DNA, 20 bp, Homo sapiens
tctattttgattatatatgt

SEQ ID NO: 77246 - DNA, 21 bp, Homo sapiens
tctaatttgatttgaaggcct

SEQ ID NO: 77247 - DNA, 18 bp, Homo sapiens
tctttttgactctgtcca

SEQ ID NO: 77248 - DNA, 18 bp, Homo sapiens
tttgtttcttgtctatcc

SEQ ID NO: 77249 - DNA, 22 bp, Homo sapiens
tctgtttcaatctgtgtctgtc

SEQ ID NO: 77250 - DNA, 16 bp, Homo sapiens
tctattttattctatc

SEQ ID NO: 77251 - DNA, 17 bp, Homo sapiens
tattttgatattgtcta

SEQ ID NO: 77252 - DNA, 16 bp, Homo sapiens
tattttgattccatcc

SEQ ID NO: 77253 - DNA, 18 bp, Homo sapiens
tttttttttatgtctatc

SEQ ID NO: 77254 - DNA, 18 bp, Homo sapiens
tttgattcagtgtctatc

SEQ ID NO: 77255 - DNA, 19 bp, Homo sapiens
ctattttggtttattaccc

SEQ ID NO: 77256 - DNA, 19 bp, Homo sapiens
tccattttgatttatctct

SEQ ID NO: 77257 - DNA, 23 bp, Homo sapiens
tctacttgttatatgtctattca

SEQ ID NO: 77258 - DNA, 18 bp, Homo sapiens
ttttgacaaatctatcca

SEQ ID NO: 77259 - DNA, 19 bp, Homo sapiens
tctattttgatctacttct

SEQ ID NO: 77260 - DNA, 21 bp, Homo sapiens
tctttttgatatgtatctatc

SEQ ID NO: 77261 - DNA, 20 bp, Homo sapiens
tctattttcattaatgtcta

SEQ ID NO: 77262 - DNA, 18 bp, Homo sapiens
ttctgattgccctatcca

SEQ ID NO: 77263 - DNA, 20 bp, Homo sapiens
ttttgagaaatgtctattca

SEQ ID NO: 77264 - DNA, 22 bp, Homo sapiens
tctattttggctttatcttcca

SEQ ID NO: 77265 - DNA, 131 bp, Strawberry mild yellow edge virus
cacacactggtgacaacctgcattcactgccatacggagggaagtattccgacggaaccaaaagcatttgctactctggtcccggacctacccctgacatacctacacatctgcctgcgttgctagttttg

SEQ ID NO: 77266 - DNA, 24 bp, Strawberry mild yellow edge virus
tactctggtcccggacctacccct

SEQ ID NO: 77267 - DNA, 18 bp, Homo sapiens
tactctggtcacactcct

SEQ ID NO: 77268 - DNA, 19 bp, Homo sapiens
ctctggcctcaaggctacc

SEQ ID NO: 77269 - DNA, 19 bp, Homo sapiens
cactctggttcccattcct

SEQ ID NO: 77270 - DNA, 24 bp, Homo sapiens
tactctgggcctggacttgttcct

SEQ ID NO: 77271 - DNA, 24 bp, Homo sapiens
ctctggtcccctgcagttactcct

SEQ ID NO: 77272 - DNA, 17 bp, Homo sapiens
tctggtcctgatactcc

SEQ ID NO: 77273 - DNA, 23 bp, Homo sapiens
tactctgatgcctatctacttct

SEQ ID NO: 77274 - DNA, 19 bp, Homo sapiens
ctctggtcctgcagttcct

SEQ ID NO: 77275 - DNA, 19 bp, Homo sapiens
cctggtcctgggcttgcct

SEQ ID NO: 77276 - DNA, 24 bp, Homo sapiens
actctggtcaagccttctgcccct

SEQ ID NO: 77277 - DNA, 19 bp, Homo sapiens
cactctggttctaaatcct

SEQ ID NO: 77278 - DNA, 17 bp, Homo sapiens
cactctggtcttggcct

SEQ ID NO: 77279 - DNA, 19 bp, Homo sapiens
ctctggtcccctcacccct

SEQ ID NO: 77280 - DNA, 21 bp, Homo sapiens
tacattggaggatctacccct

SEQ ID NO: 77281 - DNA, 23 bp, Homo sapiens
actctggttcccttttcttaccc

SEQ ID NO: 77282 - DNA, 21 bp, Homo sapiens
tactctggacttcacattcct

SEQ ID NO: 77283 - DNA, 23 bp, Homo sapiens
tctggtccactaattctactcct

SEQ ID NO: 77284 - DNA, 20 bp, Homo sapiens
cctgcccaggacttactcct

SEQ ID NO: 77285 - DNA, 20 bp, Homo sapiens
ctctgatcccgtgaattcct

SEQ ID NO: 77286 - DNA, 24 bp, Homo sapiens
tactctggttcccaataagttcct

SEQ ID NO: 77287 - DNA, 17 bp, Homo sapiens
actctgatctggaccta

SEQ ID NO: 77288 - DNA, 21 bp, Homo sapiens
ctctggtctggaactctgcct

SEQ ID NO: 77289 - DNA, 19 bp, Homo sapiens
ccctggtcctgtcacccct

SEQ ID NO: 77290 - DNA, 23 bp, Homo sapiens
cctggtcctgccgtcttgcccct

SEQ ID NO: 77291 - DNA, 126 bp, Macaca mulatta rhadinovirus
aaataccaatgactgtcacccctaccccaagccacgcccccgtactattagaccagggtgagtaaccacgctatcctttaaaaacccatacgtggagtttgtaaggtaaacagctcgtgtatattt

SEQ ID NO: 77292 - DNA, 24 bp, Macaca mulatta rhadinovirus
cccccgtactattagaccagggtg

SEQ ID NO: 77293 - DNA, 21 bp, Homo sapiens
cccttacaaatgaccagggtg

SEQ ID NO: 77294 - DNA, 20 bp, Homo sapiens
ccttattccagaccagggtg

SEQ ID NO: 77295 - DNA, 17 bp, Homo sapiens
cccttatactattgggc

SEQ ID NO: 77296 - DNA, 20 bp, Homo sapiens
cctccctgctattagatacc

SEQ ID NO: 77297 - DNA, 21 bp, Homo sapiens
ccgacttcagggaccagggtg

SEQ ID NO: 77298 - DNA, 26 bp, Homo sapiens
cctctgactattagatccgatgggtg

SEQ ID NO: 77299 - DNA, 21 bp, Homo sapiens
ccagtgccttagaccagggtg

SEQ ID NO: 77300 - DNA, 17 bp, Homo sapiens
ccgtgttagccagggtg

SEQ ID NO: 77301 - DNA, 18 bp, Homo sapiens
cccaccgtacaccagggt

SEQ ID NO: 77302 - DNA, 19 bp, Homo sapiens
cctcgtgcttcccagggtg

SEQ ID NO: 77303 - DNA, 22 bp, Homo sapiens
cccttctactgtccccagggtg

SEQ ID NO: 77304 - DNA, 18 bp, Homo sapiens
ccccgcacttcctggggt

SEQ ID NO: 77305 - DNA, 24 bp, Homo sapiens
ccctcctgccttcagaccagggtg

SEQ ID NO: 77306 - DNA, 20 bp, Homo sapiens
ccatattagggtccagggtg

SEQ ID NO: 77307 - DNA, 21 bp, Homo sapiens
ccctcggacttccccagggtg

SEQ ID NO: 77308 - DNA, 78 bp, Equine herpesvirus 4
tgagtgttgtgtgtacctattttccactgagggaggcgcgtattcgcatgtgggaaaaaaaggtgggcatacaattta

SEQ ID NO: 77309 - DNA, 24 bp, Equine herpesvirus 4
tgggaaaaaaaggtgggcatacaa

SEQ ID NO: 77310 - DNA, 20 bp, Homo sapiens
ggtaagaaaagtaagataca

SEQ ID NO: 77311 - DNA, 20 bp, Homo sapiens
ggggaaaaaagatcaatgca

SEQ ID NO: 77312 - DNA, 19 bp, Homo sapiens
gggaagaaggtggaacaca

SEQ ID NO: 77313 - DNA, 18 bp, Homo sapiens
tgggaaagtaaggtgtca

SEQ ID NO: 77314 - DNA, 21 bp, Homo sapiens
tgggaaaaagtggtggtatac

SEQ ID NO: 77315 - DNA, 22 bp, Homo sapiens
tgggaagacaaagtacaaacat

SEQ ID NO: 77316 - DNA, 24 bp, Homo sapiens
tggaaaaaaaatccaattatacaa

SEQ ID NO: 77317 - DNA, 20 bp, Homo sapiens
tgggaaagatgaggcctgca

SEQ ID NO: 77318 - DNA, 15 bp, Homo sapiens
gggaaaaagggggat

SEQ ID NO: 77319 - DNA, 17 bp, Homo sapiens
ggaagagaggacacaca

SEQ ID NO: 77320 - DNA, 19 bp, Homo sapiens
ggaggagcgcagggcatac

SEQ ID NO: 77321 - DNA, 18 bp, Homo sapiens
taggagaaaaggcataca

SEQ ID NO: 77322 - DNA, 19 bp, Homo sapiens
tgggacaaagaggtaaaca

SEQ ID NO: 77323 - DNA, 20 bp, Homo sapiens
tgggaagagcaggtgggcac

SEQ ID NO: 77324 - DNA, 22 bp, Homo sapiens
tgggaaagtgaggtccctggca

SEQ ID NO: 77325 - DNA, 20 bp, Homo sapiens
aggaggaaaaggaagagata

SEQ ID NO: 77326 - DNA, 18 bp, Homo sapiens
tgggaaaagatggctaca

SEQ ID NO: 77327 - DNA, 17 bp, Homo sapiens
tgggaaaaggtggtggc

SEQ ID NO: 77328 - DNA, 16 bp, Homo sapiens
tgagaaaaaaacatac

SEQ ID NO: 77329 - DNA, 22 bp, Homo sapiens
tggtgaaaaaaagcaagataca

SEQ ID NO: 77330 - DNA, 25 bp, Homo sapiens
tggggaaaaggggattccaccacaa

SEQ ID NO: 77331 - DNA, 19 bp, Homo sapiens
tgggaggggaaggcgggca

SEQ ID NO: 77332 - DNA, 18 bp, Homo sapiens
tgggaaaagatggtgaca

SEQ ID NO: 77333 - DNA, 16 bp, Homo sapiens
tggcaaaaaagcatac

SEQ ID NO: 77334 - DNA, 16 bp, Homo sapiens
gggaaaaaggggtgca

SEQ ID NO: 77335 - DNA, 18 bp, Homo sapiens
ggggaaaaaaggtactgc

SEQ ID NO: 77336 - DNA, 15 bp, Homo sapiens
tgggaaggtgagata

SEQ ID NO: 77337 - DNA, 19 bp, Homo sapiens
tgggggcaaagaggtggca

SEQ ID NO: 77338 - DNA, 20 bp, Homo sapiens
tggtagaagcaaggcataca

SEQ ID NO: 77339 - DNA, 19 bp, Homo sapiens
tgggaaaggcggatgtgca

SEQ ID NO: 77340 - DNA, 16 bp, Homo sapiens
taggaaaaggtggtca

SEQ ID NO: 77341 - DNA, 18 bp, Homo sapiens
tgggaaaaagaatatgca

SEQ ID NO: 77342 - DNA, 23 bp, Homo sapiens
gggagaaaaaggctattatacaa

SEQ ID NO: 77343 - DNA, 18 bp, Homo sapiens
tgagaaaagaagggtgca

SEQ ID NO: 77344 - DNA, 20 bp, Homo sapiens
tggggaaaaaaggaggtgca

SEQ ID NO: 77345 - DNA, 18 bp, Homo sapiens
gggagagagcggcataca

SEQ ID NO: 77346 - DNA, 21 bp, Homo sapiens
tgggaaaacaaaggtttcaca

SEQ ID NO: 77347 - DNA, 22 bp, Homo sapiens
tggtgaaaaagatgacatacaa

SEQ ID NO: 77348 - DNA, 20 bp, Homo sapiens
taggaaaaaaagacaacata

SEQ ID NO: 77349 - DNA, 19 bp, Homo sapiens
tgggaaagaaggatgggca

SEQ ID NO: 77350 - DNA, 20 bp, Homo sapiens
tggcaaaaagacagtgtgca

SEQ ID NO: 77351 - DNA, 20 bp, Homo sapiens
tggggaaaaaaggggtgcat

SEQ ID NO: 77352 - DNA, 19 bp, Homo sapiens
tggagaagaaaggtggaca

SEQ ID NO: 77353 - DNA, 18 bp, Homo sapiens
tgggagaaaagtggtaca

SEQ ID NO: 77354 - DNA, 20 bp, Homo sapiens
tgggatagaaaggtgggaat

SEQ ID NO: 77355 - DNA, 19 bp, Homo sapiens
tgggaacaaaaggtaccat

SEQ ID NO: 77356 - DNA, 21 bp, Homo sapiens
tgggaaaaggaggtggagata

SEQ ID NO: 77357 - DNA, 19 bp, Homo sapiens
tgggaaacggaagtgtgca

SEQ ID NO: 77358 - DNA, 22 bp, Homo sapiens
tgggagagcaaagcaagtacaa

SEQ ID NO: 77359 - DNA, 18 bp, Homo sapiens
tgggaggaagaggtgggc

SEQ ID NO: 77360 - DNA, 23 bp, Homo sapiens
gggaaaaaaagaaaaaaatacaa

SEQ ID NO: 77361 - DNA, 23 bp, Homo sapiens
tgggaaaagtggtctttgtacaa

SEQ ID NO: 77362 - DNA, 19 bp, Homo sapiens
gggaaaaaaaaaacataca

SEQ ID NO: 77363 - DNA, 19 bp, Homo sapiens
tgggcaaagaaaggaaaca

SEQ ID NO: 77364 - DNA, 18 bp, Homo sapiens
tggggaaaaaagtttaca

SEQ ID NO: 77365 - DNA, 20 bp, Homo sapiens
tgggaaaaaggggtgtgtgc

SEQ ID NO: 77366 - DNA, 17 bp, Homo sapiens
ggggaaaaaaggctgca

SEQ ID NO: 77367 - DNA, 16 bp, Homo sapiens
tgggaaaatgggtaca

SEQ ID NO: 77368 - DNA, 19 bp, Homo sapiens
ggaagaagaaaaacataca

SEQ ID NO: 77369 - DNA, 19 bp, Homo sapiens
tgggaaaaaaggtcagagc

SEQ ID NO: 77370 - DNA, 22 bp, Homo sapiens
gggggaaaaaggtaaaaaacaa

SEQ ID NO: 77371 - DNA, 19 bp, Homo sapiens
tgggcaaaaaactgacata

SEQ ID NO: 77372 - DNA, 18 bp, Homo sapiens
tgggggaagatgagaata

SEQ ID NO: 77373 - DNA, 18 bp, Homo sapiens
tgggggaggaagacacac

SEQ ID NO: 77374 - DNA, 23 bp, Homo sapiens
tgggaaaggaagtacccagtaca

SEQ ID NO: 77375 - DNA, 17 bp, Homo sapiens
gggaaaaaaagattaca

SEQ ID NO: 77376 - DNA, 21 bp, Homo sapiens
tgggcaaaaaaaggacatgca

SEQ ID NO: 77377 - DNA, 18 bp, Homo sapiens
tgggaaagtgagacatac

SEQ ID NO: 77378 - DNA, 16 bp, Homo sapiens
ggagaaaaaggtcata

SEQ ID NO: 77379 - DNA, 24 bp, Homo sapiens
tgggaagacaggatgtctgtacaa

SEQ ID NO: 77380 - DNA, 21 bp, Homo sapiens
tgggagaaaaacagcatacaa

SEQ ID NO: 77381 - DNA, 22 bp, Homo sapiens
tgggaaaagggagggccctgca

SEQ ID NO: 77382 - DNA, 17 bp, Homo sapiens
gggaaggaagtgagcat

SEQ ID NO: 77383 - DNA, 20 bp, Homo sapiens
tgggaaagcagaactataca

SEQ ID NO: 77384 - DNA, 19 bp, Homo sapiens
ggaaaaaaagaactgtgca

SEQ ID NO: 77385 - DNA, 20 bp, Homo sapiens
gggaaaaaaaccagtgtaca

SEQ ID NO: 77386 - DNA, 18 bp, Homo sapiens
gggaaaagggggtaggca

SEQ ID NO: 77387 - DNA, 19 bp, Homo sapiens
tgagaaaaaaaaacgtaca

SEQ ID NO: 77388 - DNA, 21 bp, Homo sapiens
gggaagagaaggtgggaaaca

SEQ ID NO: 77389 - DNA, 19 bp, Homo sapiens
ggaaaaaaaggccattgca

SEQ ID NO: 77390 - DNA, 21 bp, Homo sapiens
ggaaaaaaatgcaacatacaa

SEQ ID NO: 77391 - DNA, 19 bp, Homo sapiens
tgggaaaaaaatgactaca

SEQ ID NO: 77392 - DNA, 21 bp, Homo sapiens
tggggcagaagagctatacaa

SEQ ID NO: 77393 - DNA, 20 bp, Homo sapiens
tgggaaaagaaggactgtgg

SEQ ID NO: 77394 - DNA, 18 bp, Homo sapiens
taggaaaaagaggtacac

SEQ ID NO: 77395 - DNA, 18 bp, Homo sapiens
tgggaaaaagaagataca

SEQ ID NO: 77396 - DNA, 25 bp, Homo sapiens
gggaaaaaaaggtaacaatatacaa

SEQ ID NO: 77397 - DNA, 19 bp, Homo sapiens
tgggaagtggaggtgggca

SEQ ID NO: 77398 - DNA, 17 bp, Homo sapiens
tgggaaggtgaggtcat

SEQ ID NO: 77399 - DNA, 21 bp, Homo sapiens
tgggaagatgggggtgcatca

SEQ ID NO: 77400 - DNA, 23 bp, Homo sapiens
tgggaagataaaggtaccaggca

SEQ ID NO: 77401 - DNA, 20 bp, Homo sapiens
taggaaaaaaaattatgtag

SEQ ID NO: 77402 - DNA, 18 bp, Homo sapiens
tgggaaagtgggacatac

SEQ ID NO: 77403 - DNA, 18 bp, Homo sapiens
gggaaaaaagggtttgca

SEQ ID NO: 77404 - DNA, 18 bp, Homo sapiens
tggcaaaaaaagatgtgg

SEQ ID NO: 77405 - DNA, 24 bp, Homo sapiens
tgggaaaaggcagcaccacataca

SEQ ID NO: 77406 - DNA, 17 bp, Homo sapiens
tggggaaaaggtgtgca

SEQ ID NO: 77407 - DNA, 22 bp, Homo sapiens
tgggagaagcaggcagggtaca

SEQ ID NO: 77408 - DNA, 19 bp, Homo sapiens
tgggaagcaaaggtgagca

SEQ ID NO: 77409 - DNA, 20 bp, Homo sapiens
tgagaaaaactgaggcatac

SEQ ID NO: 77410 - DNA, 19 bp, Homo sapiens
tgggaaaaagggtatctgg

SEQ ID NO: 77411 - DNA, 18 bp, Homo sapiens
tgggaaggaaggtggggc

SEQ ID NO: 77412 - DNA, 60 bp, Bovine respiratory syncytial virus
aatgtttacaatctaaacctcagaatcataaatgtgatgagctaaatttactaatacatt

SEQ ID NO: 77413 - DNA, 23 bp, Bovine respiratory syncytial virus
tgagctaaatttactaatacatt

SEQ ID NO: 77414 - DNA, 24 bp, Homo sapiens
gagctaaattgccataggtacatt

SEQ ID NO: 77415 - DNA, 18 bp, Homo sapiens
tgaaccatactaatacat

SEQ ID NO: 77416 - DNA, 21 bp, Homo sapiens
tgagcaaatttaagttacatt

SEQ ID NO: 77417 - DNA, 19 bp, Homo sapiens
tgagctaattttaacaaca

SEQ ID NO: 77418 - DNA, 20 bp, Homo sapiens
tgagccaacagtgatacatt

SEQ ID NO: 77419 - DNA, 16 bp, Homo sapiens
tgagctattaatacat

SEQ ID NO: 77420 - DNA, 74 bp, Monkeypox virus
tgtcatattgcaccagaattaataatatctctaatagatctgattagtagatacatggctatcgcaaaacaaca

SEQ ID NO: 77421 - DNA, 24 bp, Monkeypox virus
tattgcaccagaattaataatatc

SEQ ID NO: 77422 - DNA, 20 bp, Homo sapiens
tattacacgtttaataatat

SEQ ID NO: 77423 - DNA, 20 bp, Homo sapiens
ttgcaccaaaatcttctatc

SEQ ID NO: 77424 - DNA, 17 bp, Homo sapiens
tgcccaaaattagtaat

SEQ ID NO: 77425 - DNA, 18 bp, Homo sapiens
tattgcaccagggattaa

SEQ ID NO: 77426 - DNA, 95 bp, Swinepox virus
ggttctgtttcttcttccttatatatttttttattattacgtattattacataattatctctaatgaacatgtatagttccataataacagatcc

SEQ ID NO: 77427 - DNA, 24 bp, Swinepox virus
tctaatgaacatgtatagttccat

SEQ ID NO: 77428 - DNA, 22 bp, Homo sapiens
tctggagaacatgtagtcacat

SEQ ID NO: 77429 - DNA, 21 bp, Homo sapiens
taataataattctagttccat

SEQ ID NO: 77430 - DNA, 20 bp, Homo sapiens
tctaatgaaatgtgtctcca

SEQ ID NO: 77431 - DNA, 19 bp, Homo sapiens
tctaatgaacatatcggtt

SEQ ID NO: 77432 - DNA, 18 bp, Homo sapiens
tctaatgacatcagttcc

SEQ ID NO: 77433 - DNA, 21 bp, Homo sapiens
tctaaggtgttatagttccat

SEQ ID NO: 77434 - DNA, 17 bp, Homo sapiens
taatgagcatccttcca

SEQ ID NO: 77435 - DNA, 18 bp, Homo sapiens
tctgagaacatatttcca

SEQ ID NO: 77436 - DNA, 18 bp, Homo sapiens
atgaatgttcagttccat

SEQ ID NO: 77437 - DNA, 21 bp, Homo sapiens
tctgatgaactgaaattccat

SEQ ID NO: 77438 - DNA, 20 bp, Homo sapiens
taatgaactcacagttccat

SEQ ID NO: 77439 - DNA, 17 bp, Homo sapiens
tctaatgggtgtatagt

SEQ ID NO: 77440 - DNA, 20 bp, Homo sapiens
ctaatgttatatagttccat

SEQ ID NO: 77441 - DNA, 22 bp, Homo sapiens
tctggtgaaaatgtataaccat

SEQ ID NO: 77442 - DNA, 19 bp, Homo sapiens
tctaatggtttcagttcca

SEQ ID NO: 77443 - DNA, 19 bp, Homo sapiens
tctaatgaaccgtgtgcat

SEQ ID NO: 77444 - DNA, 86 bp, Monkeypox virus
taatttgattctaatataatcttcagtattggatgaatctcaattcaaattaattccattagattagattagattagattagatta

SEQ ID NO: 77445 - DNA, 24 bp, Monkeypox virus
tccattagattagattagattaga

SEQ ID NO: 77446 - DNA, 18 bp, Homo sapiens
ttagattaataaattaga

SEQ ID NO: 77447 - DNA, 19 bp, Homo sapiens
attagaataagagattaga

SEQ ID NO: 77448 - DNA, 19 bp, Homo sapiens
taaaaacaattagattaga

SEQ ID NO: 77449 - DNA, 22 bp, Homo sapiens
tccattaggtagagaccattag

SEQ ID NO: 77450 - DNA, 22 bp, Homo sapiens
cccaattctagattaggttaga

SEQ ID NO: 77451 - DNA, 19 bp, Homo sapiens
tccattagataggattaga

SEQ ID NO: 77452 - DNA, 20 bp, Homo sapiens
attagattagttcaaattag

SEQ ID NO: 77453 - DNA, 20 bp, Homo sapiens
tccattaagtgaggattaga

SEQ ID NO: 77454 - DNA, 20 bp, Homo sapiens
cccattagaggtaggttaga

SEQ ID NO: 77455 - DNA, 85 bp, Ophiostoma novo-ulmi mitovirus 5-Ld
gtccgatcctttttatccgctactccttttcagaagtaacccatttgttacctatgactaggcactaaggctcatcagttcggat

SEQ ID NO: 77456 - DNA, 24 bp, Ophiostoma novo-ulmi mitovirus 5-Ld
tgactaggcactaaggctcatcag

SEQ ID NO: 77457 - DNA, 15 bp, Homo sapiens
tgactagggactcat

SEQ ID NO: 77458 - DNA, 18 bp, Homo sapiens
gattaggcactgagagct

SEQ ID NO: 77459 - DNA, 18 bp, Homo sapiens
agggtaactaaggctcat

SEQ ID NO: 77460 - DNA, 24 bp, Homo sapiens
tggctggccactaaggaaacacag

SEQ ID NO: 77461 - DNA, 18 bp, Homo sapiens
tgacaggcactctcatca

SEQ ID NO: 77462 - DNA, 18 bp, Homo sapiens
tggccaggcactgcagtc

SEQ ID NO: 77463 - DNA, 21 bp, Homo sapiens
tgatgaggtgctaaggccatc

SEQ ID NO: 77464 - DNA, 20 bp, Homo sapiens
tgactagacgctgggagccc

SEQ ID NO: 77465 - DNA, 23 bp, Homo sapiens
tgactaggcgttctaaacatcag

SEQ ID NO: 77466 - DNA, 60 bp, Human respiratory syncytial virus
atgctacccacacaactaagctagatccttaactcatagttacataaaaacctcaagtat

SEQ ID NO: 77467 - DNA, 24 bp, Human respiratory syncytial virus
atagttacataaaaacctcaagta

SEQ ID NO: 77468 - DNA, 19 bp, Homo sapiens
atagttacataaatactcc

SEQ ID NO: 77469 - DNA, 22 bp, Homo sapiens
gttacataaaactaaaaaagta

SEQ ID NO: 77470 - DNA, 23 bp, Homo sapiens
tagttacatgatcacttcaggta

SEQ ID NO: 77471 - DNA, 26 bp, Homo sapiens
tagtgacataaaagtcttcacaagta

SEQ ID NO: 77472 - DNA, 26 bp, Homo sapiens
cagttacaaagttaaaatttcaagta

SEQ ID NO: 77473 - DNA, 21 bp, Homo sapiens
atagtcacatagacccgaagt

SEQ ID NO: 77474 - DNA, 22 bp, Homo sapiens
atagttacactgaactgaagta

SEQ ID NO: 77475 - DNA, 20 bp, Homo sapiens
gctgcgtaaaagcctcaagt

SEQ ID NO: 77476 - DNA, 18 bp, Homo sapiens
agttacataaaaactcca

SEQ ID NO: 77477 - DNA, 20 bp, Homo sapiens
atagtcatgcagcctcaagt

SEQ ID NO: 77478 - DNA, 25 bp, Homo sapiens
acagttacatggaaagctgaaagta

SEQ ID NO: 77479 - DNA, 16 bp, Homo sapiens
gttacatacctcaagt

SEQ ID NO: 77480 - DNA, 21 bp, Homo sapiens
tagttaagtcagcctcaagta

SEQ ID NO: 77481 - DNA, 22 bp, Homo sapiens
atagatgcaaataacctcaagt

SEQ ID NO: 77482 - DNA, 16 bp, Homo sapiens
gttacacaacctgagt

SEQ ID NO: 77483 - DNA, 22 bp, Homo sapiens
tagtatataaagtgctcaagta

SEQ ID NO: 77484 - DNA, 24 bp, Homo sapiens
ataattacagcgtggtttcaagta

SEQ ID NO: 77485 - DNA, 24 bp, Homo sapiens
atagttacacaaaacacacaagta

SEQ ID NO: 77486 - DNA, 19 bp, Homo sapiens
gtgaacagaaacctcaagt

SEQ ID NO: 77487 - DNA, 21 bp, Homo sapiens
acagctcaaagaacctcaggt

SEQ ID NO: 77488 - DNA, 23 bp, Homo sapiens
atagtcacatgaatgcctcaagt

SEQ ID NO: 77489 - DNA, 131 bp, Cercopithecine herpesvirus 7
gtaacattaaaacgttgttttgtttttatttggcgcctttattatggtatgtaattatgttaacgaatgtcacgtgattactttcttagattaaaaacgcacacatatgttctggtatacgcactttgttc

SEQ ID NO: 77490 - DNA, 24 bp, Cercopithecine herpesvirus 7
tggtatgtaattatgttaacgaat

SEQ ID NO: 77491 - DNA, 19 bp, Homo sapiens
tggtaggaccttgttaacg

SEQ ID NO: 77492 - DNA, 21 bp, Homo sapiens
tggtatgtgatatgtccctga

SEQ ID NO: 77493 - DNA, 75 bp, Chimpanzee cytomegalovirus
gttctctatcacacatgatgatacacactcggggacaaggagggggagtacagatcatgagtagatacagagaat

SEQ ID NO: 77494 - DNA, 24 bp, Chimpanzee cytomegalovirus
agtacagatcatgagtagatacag

SEQ ID NO: 77495 - DNA, 21 bp, Homo sapiens
agtacagataatgaaatacag

SEQ ID NO: 77496 - DNA, 17 bp, Homo sapiens
agacagatcatatgtag

SEQ ID NO: 77497 - DNA, 22 bp, Homo sapiens
agtacaattatatcaaatacag

SEQ ID NO: 77498 - DNA, 17 bp, Homo sapiens
gtccagatcatgggaca

SEQ ID NO: 77499 - DNA, 18 bp, Homo sapiens
agtacagatatgaaatag

SEQ ID NO: 77500 - DNA, 18 bp, Homo sapiens
agtctagatcatgaggac

SEQ ID NO: 77501 - DNA, 19 bp, Homo sapiens
agatatagatgtagataca

SEQ ID NO: 77502 - DNA, 20 bp, Homo sapiens
gtgcagaccatgctatgcag

SEQ ID NO: 77503 - DNA, 20 bp, Homo sapiens
agtacagatgcaggatgcag

SEQ ID NO: 77504 - DNA, 20 bp, Homo sapiens
caggtcatgagttgtcacag

SEQ ID NO: 77505 - DNA, 20 bp, Homo sapiens
agtacagattagaaaagtag

SEQ ID NO: 77506 - DNA, 19 bp, Homo sapiens
agacggatcatgagatcag

SEQ ID NO: 77507 - DNA, 18 bp, Homo sapiens
agaacaggtgtagataca

SEQ ID NO: 77508 - DNA, 21 bp, Homo sapiens
agtatagatacatgacagata

SEQ ID NO: 77509 - DNA, 22 bp, Homo sapiens
atatagatataggtagatacag

SEQ ID NO: 77510 - DNA, 16 bp, Homo sapiens
agacagatcaagatac

SEQ ID NO: 77511 - DNA, 17 bp, Homo sapiens
agtaagattatgagtag

SEQ ID NO: 77512 - DNA, 20 bp, Homo sapiens
agtcagtctcagagtagata

SEQ ID NO: 77513 - DNA, 21 bp, Homo sapiens
agtccaggtcatgaactatag

SEQ ID NO: 77514 - DNA, 19 bp, Homo sapiens
aggacaggtgaatagatac

SEQ ID NO: 77515 - DNA, 18 bp, Homo sapiens
agtgacagggtagataca

SEQ ID NO: 77516 - DNA, 17 bp, Homo sapiens
gtaagatcatgatatac

SEQ ID NO: 77517 - DNA, 130 bp, Melanoplus sanguinipes entomopoxvirus
ttatatgtaaatattgcaatataaattattaacaattcaaattgcctaattattattgaagtatcaagacctatattctaattcaattaatgaatttggtaaattatatttaatatttctaaaaatgtaa

SEQ ID NO: 77518 - DNA, 24 bp, Melanoplus sanguinipes entomopoxvirus
taaattattaacaattcaaattgc

SEQ ID NO: 77519 - DNA, 20 bp, Homo sapiens
tcattgacaattcaagttgc

SEQ ID NO: 77520 - DNA, 116 bp, Ateline herpesvirus 3
gctgcttgtggcttttaaccagtcactagtcacgcccacacatgacgaggaaaaactcctgtcagagattcaagaggtgtgtcttaagattgcagaagaactaaagcctctccagc

SEQ ID NO: 77521 - DNA, 24 bp, Ateline herpesvirus 3
tgtcagagattcaagaggtgtgtc

SEQ ID NO: 77522 - DNA, 24 bp, Homo sapiens
tggcagaggtgtgttgaggtgtgt

SEQ ID NO: 77523 - DNA, 22 bp, Homo sapiens
tgtcagaggtctgggctgggtc

SEQ ID NO: 77524 - DNA, 22 bp, Homo sapiens
tgttggaggttcaaaaggaagc

SEQ ID NO: 77525 - DNA, 21 bp, Homo sapiens
tgttaaagattcaatttatgt

SEQ ID NO: 77526 - DNA, 17 bp, Homo sapiens
tcagacaagaggtgtgt

SEQ ID NO: 77527 - DNA, 16 bp, Homo sapiens
tgtcagagtttggctg

SEQ ID NO: 77528 - DNA, 19 bp, Homo sapiens
agagattcaggggaagagt

SEQ ID NO: 77529 - DNA, 18 bp, Homo sapiens
gtcagggaataggtgtgt

SEQ ID NO: 77530 - DNA, 18 bp, Homo sapiens
gactctcaggaggtgtgt

SEQ ID NO: 77531 - DNA, 20 bp, Homo sapiens
tgtctggggctcaggtgtgt

SEQ ID NO: 77532 - DNA, 18 bp, Homo sapiens
tcagagatttgatggtgt

SEQ ID NO: 77533 - DNA, 18 bp, Homo sapiens
gtcaggaggaggtgtgtc

SEQ ID NO: 77534 - DNA, 130 bp, Myxoma virus
ttccaccaaagataattataataatttaccccatcattaatttacaaaaagtgtttacagctagcttaagtggtaggtaggtatgtaggtatgtaggtatgtaggtatgtagcttagtagtttagtgtaa

SEQ ID NO: 77535 - DNA, 24 bp, Myxoma virus
taatttacaaaaagtgtttacagc

SEQ ID NO: 77536 - DNA, 19 bp, Homo sapiens
atttacaagtgatttacag

SEQ ID NO: 77537 - DNA, 25 bp, Homo sapiens
taattcacaaaaagtgttaaatcag

SEQ ID NO: 77538 - DNA, 19 bp, Homo sapiens
ttacaaaaaggactacggc

SEQ ID NO: 77539 - DNA, 18 bp, Homo sapiens
atttacaataatttacag

SEQ ID NO: 77540 - DNA, 16 bp, Homo sapiens
tttacaagtgctgcag

SEQ ID NO: 77541 - DNA, 22 bp, Homo sapiens
taatttaaaaaaataaaacagc

SEQ ID NO: 77542 - DNA, 20 bp, Homo sapiens
tttacagaaatgccaacagc

SEQ ID NO: 77543 - DNA, 22 bp, Homo sapiens
taatttatgaaatatttacagc

SEQ ID NO: 77544 - DNA, 23 bp, Homo sapiens
taatttacaaaccaaccttacag

SEQ ID NO: 77545 - DNA, 22 bp, Homo sapiens
taatttacaattaacattacag

SEQ ID NO: 77546 - DNA, 19 bp, Homo sapiens
attcacttctgtttacagc

SEQ ID NO: 77547 - DNA, 20 bp, Homo sapiens
atttacaaaactgcatacag

SEQ ID NO: 77548 - DNA, 15 bp, Homo sapiens
tttacaaaaacacag

SEQ ID NO: 77549 - DNA, 18 bp, Homo sapiens
ttataaaaaggtctacag

SEQ ID NO: 77550 - DNA, 16 bp, Homo sapiens
tacaaaaagtggacag

SEQ ID NO: 77551 - DNA, 19 bp, Homo sapiens
taatttaaaagtattacag

SEQ ID NO: 77552 - DNA, 20 bp, Homo sapiens
taaattacaaaaaataacag

SEQ ID NO: 77553 - DNA, 19 bp, Homo sapiens
taatttacagaaaggtcta

SEQ ID NO: 77554 - DNA, 17 bp, Homo sapiens
tttacaaatatttacag

SEQ ID NO: 77555 - DNA, 21 bp, Homo sapiens
tttaaaaaacaggtttacagc

SEQ ID NO: 77556 - DNA, 22 bp, Homo sapiens
atttacaaagatttattacagc

SEQ ID NO: 77557 - DNA, 21 bp, Homo sapiens
taatttacaggcgtccacagc

SEQ ID NO: 77558 - DNA, 23 bp, Homo sapiens
tttacaaaagacccaatttacag

SEQ ID NO: 77559 - DNA, 20 bp, Homo sapiens
taattttaaaaagtgcacag

SEQ ID NO: 77560 - DNA, 22 bp, Homo sapiens
ttacaaagtactgttttacagc

SEQ ID NO: 77561 - DNA, 19 bp, Homo sapiens
taatttacggaagtgctag

SEQ ID NO: 77562 - DNA, 22 bp, Homo sapiens
taatttaccaagcaagtgcagc

SEQ ID NO: 77563 - DNA, 122 bp, Taura syndrome virus
ttcaggtgtagacccgtcattgtgacgcgtgggttgaggtgccatgaatttgtcattcatggtgcatttatctcaacagttttccctaaccgcgcgttgcgcggcagggtttttactctgag

SEQ ID NO: 77564 - DNA, 24 bp, Taura syndrome virus
gtgcatttatctcaacagttttcc

SEQ ID NO: 77565 - DNA, 19 bp, Homo sapiens
gtgtatttatctctgcttt

SEQ ID NO: 77566 - DNA, 22 bp, Homo sapiens
gtgcattcattttttttgtttt

SEQ ID NO: 77567 - DNA, 22 bp, Homo sapiens
gcgttttgaaaaacagttttcc

SEQ ID NO: 77568 - DNA, 22 bp, Homo sapiens
atgcaaggctcaatagttttcc

SEQ ID NO: 77569 - DNA, 18 bp, Homo sapiens
gtgcatctaacagttttc

SEQ ID NO: 77570 - DNA, 17 bp, Homo sapiens
gtgcatttatctcacag

SEQ ID NO: 77571 - DNA, 19 bp, Homo sapiens
gtgcatttagttcagcagc

SEQ ID NO: 77572 - DNA, 21 bp, Homo sapiens
ttatcctggtaacagttttcc

SEQ ID NO: 77573 - DNA, 23 bp, Homo sapiens
gtgcatttaactcagacaacttt

SEQ ID NO: 77574 - DNA, 21 bp, Homo sapiens
gtgcacttatttcagtcagct

SEQ ID NO: 77575 - DNA, 27 bp, Homo sapiens
gtgcattttttgcttaaacagttttcc

SEQ ID NO: 77576 - DNA, 21 bp, Homo sapiens
gtgtattatctcagtttttcc

SEQ ID NO: 77577 - DNA, 21 bp, Homo sapiens
gtgccttcctcagcagttttc

SEQ ID NO: 77578 - DNA, 19 bp, Homo sapiens
gtgcatttatcttaaaagt

SEQ ID NO: 77579 - DNA, 24 bp, Homo sapiens
gtgcatttttcttaagcatgtttt

SEQ ID NO: 77580 - DNA, 22 bp, Homo sapiens
tgcacttttttggtagttttcc

SEQ ID NO: 77581 - DNA, 20 bp, Homo sapiens
gtacatttatctctcatttc

SEQ ID NO: 77582 - DNA, 22 bp, Homo sapiens
gtgcttccagcaatagttttcc

SEQ ID NO: 77583 - DNA, 20 bp, Homo sapiens
gctgtatatcaacagttttc

SEQ ID NO: 77584 - DNA, 65 bp, Rat cytomegalovirus
cgctgttttcgcggtcccgctcgggctgtcggcgtccgtgcgcggcgcgggcccgcgttccggcg

SEQ ID NO: 77585 - DNA, 24 bp, Rat cytomegalovirus
tcccgctcgggctgtcggcgtccg

SEQ ID NO: 77586 - DNA, 23 bp, Homo sapiens
tcctgctcgggctgccgggtccg

SEQ ID NO: 77587 - DNA, 23 bp, Homo sapiens
gctcaggctgttttgcggacgcc

SEQ ID NO: 77588 - DNA, 21 bp, Homo sapiens
tcctgctcgggctgcgggccg

SEQ ID NO: 77589 - DNA, 18 bp, Homo sapiens
tcctgctggggctgtcgg

SEQ ID NO: 77590 - DNA, 22 bp, Homo sapiens
ccgttggcagcgccggcgtccg

SEQ ID NO: 77591 - DNA, 16 bp, Homo sapiens
ctcgggctcaggtccg

SEQ ID NO: 77592 - DNA, 17 bp, Homo sapiens
ccgctcggagaggcgtc

SEQ ID NO: 77593 - DNA, 16 bp, Homo sapiens
tcccttcgggctgctc

SEQ ID NO: 77594 - DNA, 26 bp, Homo sapiens
tccctttgggctgctctgcggacgcc

SEQ ID NO: 77595 - DNA, 18 bp, Homo sapiens
tcctgcccgggctggctc

SEQ ID NO: 77596 - DNA, 119 bp, Molluscum contagiosum virus
ggcacagtctcgcgtcaagaagggcccggagcccctccgagcgcacgcctgttatcccagctctcggggaagaggccggagggaggagatcttgagccctggagctcgagaccttggcc

SEQ ID NO: 77597 - DNA, 24 bp, Molluscum contagiosum virus
aagaggccggagggaggagatctt

SEQ ID NO: 77598 - DNA, 21 bp, Homo sapiens
gacacaaagggaggaggtctt

SEQ ID NO: 77599 - DNA, 19 bp, Homo sapiens
aggggccggagggggggac

SEQ ID NO: 77600 - DNA, 17 bp, Homo sapiens
aaggggccagagggtga

SEQ ID NO: 77601 - DNA, 18 bp, Homo sapiens
aagaggtggaggggggag

SEQ ID NO: 77602 - DNA, 27 bp, Homo sapiens
aaggctgtggaggttttaagatctcct

SEQ ID NO: 77603 - DNA, 18 bp, Homo sapiens
aaggggctgagggaggaa

SEQ ID NO: 77604 - DNA, 18 bp, Homo sapiens
aaggggccagagggagga

SEQ ID NO: 77605 - DNA, 19 bp, Homo sapiens
gaggactgggggtaatctt

SEQ ID NO: 77606 - DNA, 26 bp, Homo sapiens
aagggcctggtagaggaggggatctt

SEQ ID NO: 77607 - DNA, 17 bp, Homo sapiens
aaggggccggggaggag

SEQ ID NO: 77608 - DNA, 17 bp, Homo sapiens
gaggtggagggagggat

SEQ ID NO: 77609 - DNA, 17 bp, Homo sapiens
aaggggccagaggggaa

SEQ ID NO: 77610 - DNA, 23 bp, Homo sapiens
gaggggaaggggggggagatctt

SEQ ID NO: 77611 - DNA, 17 bp, Homo sapiens
gaggctggaggagtctc

SEQ ID NO: 77612 - DNA, 18 bp, Homo sapiens
agacgccgccgggggtct

SEQ ID NO: 77613 - DNA, 18 bp, Homo sapiens
agaggccgaagggaggag

SEQ ID NO: 77614 - DNA, 18 bp, Homo sapiens
agggctcggaggggggaa

SEQ ID NO: 77615 - DNA, 19 bp, Homo sapiens
agaggttggggggaggcag

SEQ ID NO: 77616 - DNA, 19 bp, Homo sapiens
aaaaaacggggggggagat

SEQ ID NO: 77617 - DNA, 21 bp, Homo sapiens
agaggctgtgaaagaggtctt

SEQ ID NO: 77618 - DNA, 17 bp, Homo sapiens
aggggctgagggaggag

SEQ ID NO: 77619 - DNA, 24 bp, Homo sapiens
agggggttggggagttgaaatctt

SEQ ID NO: 77620 - DNA, 18 bp, Homo sapiens
aagaggctgtgggggagg

SEQ ID NO: 77621 - DNA, 18 bp, Homo sapiens
aaggggcctggggggagg

SEQ ID NO: 77622 - DNA, 19 bp, Homo sapiens
agaggcatggagggaggag

SEQ ID NO: 77623 - DNA, 18 bp, Homo sapiens
gagggtggagggaggcag

SEQ ID NO: 77624 - DNA, 17 bp, Homo sapiens
agaggttggaggaggag

SEQ ID NO: 77625 - DNA, 19 bp, Homo sapiens
gaggctggagaggagctcc

SEQ ID NO: 77626 - DNA, 18 bp, Homo sapiens
agggggtggagggaggag

SEQ ID NO: 77627 - DNA, 17 bp, Homo sapiens
aagagaccggaggtgga

SEQ ID NO: 77628 - DNA, 19 bp, Homo sapiens
aggagcctggagggaggaa

SEQ ID NO: 77629 - DNA, 21 bp, Homo sapiens
aaggggctgaggggggcggat

SEQ ID NO: 77630 - DNA, 22 bp, Homo sapiens
aggggctggagagagatgcctt

SEQ ID NO: 77631 - DNA, 20 bp, Homo sapiens
gaggggtgggagggagggat

SEQ ID NO: 77632 - DNA, 23 bp, Homo sapiens
agagtctggatccttgagatctt

SEQ ID NO: 77633 - DNA, 24 bp, Homo sapiens
aagaggccagagctctcagatctt

SEQ ID NO: 77634 - DNA, 24 bp, Homo sapiens
agaggccagaagattttaagatcc

SEQ ID NO: 77635 - DNA, 19 bp, Homo sapiens
gaggtcgggaggagccctt

SEQ ID NO: 77636 - DNA, 18 bp, Homo sapiens
aggggccggagggcagga

SEQ ID NO: 77637 - DNA, 19 bp, Homo sapiens
aagaggcaggagggaggag

SEQ ID NO: 77638 - DNA, 18 bp, Homo sapiens
gaggctgagggaggagac

SEQ ID NO: 77639 - DNA, 19 bp, Homo sapiens
aggccggagagaaggtctt

SEQ ID NO: 77640 - DNA, 19 bp, Homo sapiens
aacaggttggagggaggag

SEQ ID NO: 77641 - DNA, 21 bp, Homo sapiens
aagaggtgggagggaggcaga

SEQ ID NO: 77642 - DNA, 17 bp, Homo sapiens
aaggggccggaggggag

SEQ ID NO: 77643 - DNA, 20 bp, Homo sapiens
gatgctgacggggagatctt

SEQ ID NO: 77644 - DNA, 17 bp, Homo sapiens
gaggctgagggaggaga

SEQ ID NO: 77645 - DNA, 20 bp, Homo sapiens
agaggtcaacttgaggagat

SEQ ID NO: 77646 - DNA, 21 bp, Homo sapiens
gaggtcgggggaaagtctctt

SEQ ID NO: 77647 - DNA, 130 bp, African swine fever virus
tgacgccctctctattctttatatgatgatttaagattgagtccaacatttttccaacgttttacaggaaaaaggtatttttaactatggaattaatcttaacccactatttagaaaaaaataaaagaca

SEQ ID NO: 77648 - DNA, 24 bp, African swine fever virus
tatgatgatttaagattgagtcca

SEQ ID NO: 77649 - DNA, 20 bp, Homo sapiens
tatgatgattccttttgggt

SEQ ID NO: 77650 - DNA, 23 bp, Homo sapiens
atgatgatgttaaattgggtcca

SEQ ID NO: 77651 - DNA, 22 bp, Homo sapiens
tatgaggatttaagaacctccc

SEQ ID NO: 77652 - DNA, 21 bp, Homo sapiens
tgaggtaactgggttgagtcc

SEQ ID NO: 77653 - DNA, 21 bp, Homo sapiens
tatggtgactgaatgagttca

SEQ ID NO: 77654 - DNA, 17 bp, Homo sapiens
tatgatgatttaaactg

SEQ ID NO: 77655 - DNA, 19 bp, Homo sapiens
tatgatgtttaagatatcc

SEQ ID NO: 77656 - DNA, 18 bp, Homo sapiens
atgattttaacgagtcca

SEQ ID NO: 77657 - DNA, 20 bp, Homo sapiens
tgacgggaagattgagttca

SEQ ID NO: 77658 - DNA, 22 bp, Homo sapiens
atggtgatttaagataaagcca

SEQ ID NO: 77659 - DNA, 17 bp, Homo sapiens
tgattacagtgagtcca

SEQ ID NO: 77660 - DNA, 19 bp, Homo sapiens
tgaggatcacttgagtcca

SEQ ID NO: 77661 - DNA, 80 bp, Equine herpesvirus 1
tccctcataccgcctcgtgtgtccagtgtgtaaacttccaggttctagttttggggatatataagtggctgtgacctgga

SEQ ID NO: 77662 - DNA, 19 bp, Equine herpesvirus 1
taagtggctgtgacctgga

SEQ ID NO: 77663 - DNA, 17 bp, Homo sapiens
taagtcgagcccctgga

SEQ ID NO: 77664 - DNA, 20 bp, Homo sapiens
caagtggcagaacgatctgg

SEQ ID NO: 77665 - DNA, 19 bp, Homo sapiens
taaatgaaacagacctgga

SEQ ID NO: 77666 - DNA, 18 bp, Homo sapiens
tggatctggtgacctgga

SEQ ID NO: 77667 - DNA, 15 bp, Homo sapiens
taagtgactgaccgg

SEQ ID NO: 77668 - DNA, 17 bp, Homo sapiens
taagtgctgctgctgga

SEQ ID NO: 77669 - DNA, 18 bp, Homo sapiens
agtggctactgtactgga

SEQ ID NO: 77670 - DNA, 17 bp, Homo sapiens
taaatggcttgccatgg

SEQ ID NO: 77671 - DNA, 18 bp, Homo sapiens
caagtggctcttcctgga

SEQ ID NO: 77672 - DNA, 16 bp, Homo sapiens
taaatggctgtaagga

SEQ ID NO: 77673 - DNA, 18 bp, Homo sapiens
agtggctaccacactgga

SEQ ID NO: 77674 - DNA, 20 bp, Homo sapiens
taagtggccttaagtttgga

SEQ ID NO: 77675 - DNA, 17 bp, Homo sapiens
taagaacgtgacctgga

SEQ ID NO: 77676 - DNA, 18 bp, Homo sapiens
agccacagtgtgacctgg

SEQ ID NO: 77677 - DNA, 17 bp, Homo sapiens
taaatggcgcctctgga

SEQ ID NO: 77678 - DNA, 16 bp, Homo sapiens
taagtagctccttgga

SEQ ID NO: 77679 - DNA, 19 bp, Homo sapiens
tgatggctgcagactctgg

SEQ ID NO: 77680 - DNA, 20 bp, Homo sapiens
taagtgactcgtgctttgga

SEQ ID NO: 77681 - DNA, 19 bp, Homo sapiens
caagtggctctgaccttgg

SEQ ID NO: 77682 - DNA, 19 bp, Homo sapiens
taagtggcataaatttgga

SEQ ID NO: 77683 - DNA, 20 bp, Homo sapiens
agtggctgtcgatttttgga

SEQ ID NO: 77684 - DNA, 16 bp, Homo sapiens
taagtggctttaatgg

SEQ ID NO: 77685 - DNA, 20 bp, Homo sapiens
gtggctgcgcagggacctgg

SEQ ID NO: 77686 - DNA, 16 bp, Homo sapiens
taactggctgtgctgg

SEQ ID NO: 77687 - DNA, 17 bp, Homo sapiens
taaatgtgcaacctgga

SEQ ID NO: 77688 - DNA, 18 bp, Homo sapiens
aagtaacagctgacctgg

SEQ ID NO: 77689 - DNA, 19 bp, Homo sapiens
agcaattctgtgacctgga

SEQ ID NO: 77690 - DNA, 17 bp, Homo sapiens
taagtagaggacctgga

SEQ ID NO: 77691 - DNA, 18 bp, Homo sapiens
agggctgcagacatctgg

SEQ ID NO: 77692 - DNA, 18 bp, Homo sapiens
taagtgactggacactgg

SEQ ID NO: 77693 - DNA, 17 bp, Homo sapiens
taaatggctgccatgga

SEQ ID NO: 77694 - DNA, 16 bp, Homo sapiens
aagtggcttaattgga

SEQ ID NO: 77695 - DNA, 21 bp, Homo sapiens
caagtggcttccgcatttgga

SEQ ID NO: 77696 - DNA, 18 bp, Homo sapiens
agtggccatcgggcctgg

SEQ ID NO: 77697 - DNA, 16 bp, Homo sapiens
taagcgccaacctgga

SEQ ID NO: 77698 - DNA, 25 bp, Homo sapiens
taagaggcttcacggtggcttggat

SEQ ID NO: 77699 - DNA, 16 bp, Homo sapiens
caagtgacgcgtctgg

SEQ ID NO: 77700 - DNA, 18 bp, Homo sapiens
taagtggctgctccatga

SEQ ID NO: 77701 - DNA, 18 bp, Homo sapiens
agtggctggtgggcctgg

SEQ ID NO: 77702 - DNA, 15 bp, Homo sapiens
aagtgactgtctgga

SEQ ID NO: 77703 - DNA, 18 bp, Homo sapiens
agtggctactgcactgga

SEQ ID NO: 77704 - DNA, 18 bp, Homo sapiens
aagtggctcacacctgga

SEQ ID NO: 77705 - DNA, 19 bp, Homo sapiens
taagcggctggcgacttgg

SEQ ID NO: 77706 - DNA, 16 bp, Homo sapiens
aagtggctgagatgga

SEQ ID NO: 77707 - DNA, 16 bp, Homo sapiens
caagtggctggatgga

SEQ ID NO: 77708 - DNA, 19 bp, Homo sapiens
aagtggctggctagcctgg

SEQ ID NO: 77709 - DNA, 16 bp, Homo sapiens
taagcggctgtgtaga

SEQ ID NO: 77710 - DNA, 17 bp, Homo sapiens
caagcagatgacctgga

SEQ ID NO: 77711 - DNA, 17 bp, Homo sapiens
taaatgacactgcctgg

SEQ ID NO: 77712 - DNA, 16 bp, Homo sapiens
taactgtgtgacctgg

SEQ ID NO: 77713 - DNA, 16 bp, Homo sapiens
taagtggccaacttgg

SEQ ID NO: 77714 - DNA, 19 bp, Homo sapiens
aagcaaactgtgacctgga

SEQ ID NO: 77715 - DNA, 15 bp, Homo sapiens
aagtgccgacctgga

SEQ ID NO: 77716 - DNA, 18 bp, Homo sapiens
taaatggcagtctcctgg

SEQ ID NO: 77717 - DNA, 20 bp, Homo sapiens
taagtgacaaatgccctgga

SEQ ID NO: 77718 - DNA, 19 bp, Homo sapiens
tggctgtgctgcacctgga

SEQ ID NO: 77719 - DNA, 15 bp, Homo sapiens
caagtggtgacctgg

SEQ ID NO: 77720 - DNA, 19 bp, Homo sapiens
tgatggctgtgctcttgga

SEQ ID NO: 77721 - DNA, 20 bp, Homo sapiens
agtggctgtcacaggcctgg

SEQ ID NO: 77722 - DNA, 18 bp, Homo sapiens
aagccacaggtgacctgg

SEQ ID NO: 77723 - DNA, 18 bp, Homo sapiens
caagtggcagaacctgga

SEQ ID NO: 77724 - DNA, 18 bp, Homo sapiens
caagtggctggaattgga

SEQ ID NO: 77725 - DNA, 18 bp, Homo sapiens
gctgctgtgtgacctgga

SEQ ID NO: 77726 - DNA, 18 bp, Homo sapiens
taaatgacccagcctgga

SEQ ID NO: 77727 - DNA, 21 bp, Homo sapiens
taagtgactaaccaatttgga

SEQ ID NO: 77728 - DNA, 18 bp, Homo sapiens
gcacacatgtgatctgga

SEQ ID NO: 77729 - DNA, 16 bp, Homo sapiens
aagtggctgtggtgga

SEQ ID NO: 77730 - DNA, 19 bp, Homo sapiens
tgatggctgctgccctgga

SEQ ID NO: 77731 - DNA, 20 bp, Homo sapiens
taaatggctgtagtcatgga

SEQ ID NO: 77732 - DNA, 18 bp, Homo sapiens
taaatggcttcagatgga

SEQ ID NO: 77733 - DNA, 16 bp, Homo sapiens
tgatggccatgctgga

SEQ ID NO: 77734 - DNA, 18 bp, Homo sapiens
tgactgcacacacttgga

SEQ ID NO: 77735 - DNA, 16 bp, Homo sapiens
caagtgactcacctgg

SEQ ID NO: 77736 - DNA, 18 bp, Homo sapiens
caagtggctttccctgga

SEQ ID NO: 77737 - DNA, 22 bp, Homo sapiens
aagtggctgtgctccttctgga

SEQ ID NO: 77738 - DNA, 18 bp, Homo sapiens
taagtggctgcttctgga

SEQ ID NO: 77739 - DNA, 17 bp, Homo sapiens
taagcaccatgacctgg

SEQ ID NO: 77740 - DNA, 18 bp, Homo sapiens
aagtggccggtggtctgg

SEQ ID NO: 77741 - DNA, 19 bp, Homo sapiens
taacttccagtgacctgga

SEQ ID NO: 77742 - DNA, 18 bp, Homo sapiens
taagtgactcgagtttgg

SEQ ID NO: 77743 - DNA, 19 bp, Homo sapiens
agtagccgggaggtctgga

SEQ ID NO: 77744 - DNA, 16 bp, Homo sapiens
taagtgactggcctgg

SEQ ID NO: 77745 - DNA, 17 bp, Homo sapiens
aagtggccagccttgga

SEQ ID NO: 77746 - DNA, 18 bp, Homo sapiens
agtggccagcaccttgga

SEQ ID NO: 77747 - DNA, 20 bp, Homo sapiens
aagtggccctaggggcctgg

SEQ ID NO: 77748 - DNA, 17 bp, Homo sapiens
caagtggtgggcctgga

SEQ ID NO: 77749 - DNA, 18 bp, Homo sapiens
tagctgtgtagacctgga

SEQ ID NO: 77750 - DNA, 18 bp, Homo sapiens
tgactgcagaagcctgga

SEQ ID NO: 77751 - DNA, 17 bp, Homo sapiens
taagtggcagcacgtgg

SEQ ID NO: 77752 - DNA, 17 bp, Homo sapiens
aagtggctgcagctgga

SEQ ID NO: 77753 - DNA, 18 bp, Homo sapiens
caagtggctgcaggtgga

SEQ ID NO: 77754 - DNA, 19 bp, Homo sapiens
gtggctgctgaaagcctgg

SEQ ID NO: 77755 - DNA, 19 bp, Homo sapiens
caaataactgtggtttgga

SEQ ID NO: 77756 - DNA, 60 bp, Human herpesvirus 1
cggcctgggtgggcggagggaactaacccaacgtataaatccgtccccgttccaaggccg

SEQ ID NO: 77757 - DNA, 21 bp, Human herpesvirus 1
tccgtccccgttccaaggccg

SEQ ID NO: 77758 - DNA, 19 bp, Homo sapiens
tccatccctcccgtaaggc

SEQ ID NO: 77759 - DNA, 20 bp, Homo sapiens
cccgttcccgccggcggccg

SEQ ID NO: 77760 - DNA, 16 bp, Homo sapiens
tccctccctccaaggc

SEQ ID NO: 77761 - DNA, 20 bp, Homo sapiens
tccgccccagcccttggggc

SEQ ID NO: 77762 - DNA, 18 bp, Homo sapiens
cccgttagattccaaggc

SEQ ID NO: 77763 - DNA, 22 bp, Homo sapiens
tccgccccgagacgctcagggc

SEQ ID NO: 77764 - DNA, 21 bp, Homo sapiens
cccgtccccgctggggaaggc

SEQ ID NO: 77765 - DNA, 18 bp, Homo sapiens
tcagtccccaccaggccg

SEQ ID NO: 77766 - DNA, 17 bp, Homo sapiens
cgtccccgcgccggccg

SEQ ID NO: 77767 - DNA, 19 bp, Homo sapiens
cgtccccgccggcaggccg

SEQ ID NO: 77768 - DNA, 20 bp, Homo sapiens
tccgcccatccccaaggccg

SEQ ID NO: 77769 - DNA, 18 bp, Homo sapiens
cccgtcccaaagaggccg

SEQ ID NO: 77770 - DNA, 20 bp, Homo sapiens
tccttccccatccccagggc

SEQ ID NO: 77771 - DNA, 20 bp, Homo sapiens
tccttccccgtccccagggc

SEQ ID NO: 77772 - DNA, 18 bp, Homo sapiens
gccccaaggccaaggccg

SEQ ID NO: 77773 - DNA, 19 bp, Homo sapiens
tccgtccctgctctcctag

SEQ ID NO: 77774 - DNA, 16 bp, Homo sapiens
ccgtccccgctcaggc

SEQ ID NO: 77775 - DNA, 23 bp, Homo sapiens
tccggtctgccctgctggggccg

SEQ ID NO: 77776 - DNA, 23 bp, Homo sapiens
tccctctcccgctagcgaggccg

SEQ ID NO: 77777 - DNA, 20 bp, Homo sapiens
tccctccccgtccctgaggc

SEQ ID NO: 77778 - DNA, 21 bp, Homo sapiens
tccgtcccggccccacaaggc

SEQ ID NO: 77779 - DNA, 21 bp, Homo sapiens
gtccccattcgggaaaggccg

SEQ ID NO: 77780 - DNA, 17 bp, Homo sapiens
tcccttccctccaaggc

SEQ ID NO: 77781 - DNA, 21 bp, Homo sapiens
tccgtccctactccacgaggc

SEQ ID NO: 77782 - DNA, 18 bp, Homo sapiens
tccgccccccgcgggccg

SEQ ID NO: 77783 - DNA, 20 bp, Homo sapiens
tccctccccatccccgaggc

SEQ ID NO: 77784 - DNA, 18 bp, Homo sapiens
cctgtccccgcgcggccg

SEQ ID NO: 77785 - DNA, 21 bp, Homo sapiens
tccgctccctcccgcgggccg

SEQ ID NO: 77786 - DNA, 17 bp, Homo sapiens
gccccgttccagggccg

SEQ ID NO: 77787 - DNA, 18 bp, Homo sapiens
tccgcggccccaaggccg

SEQ ID NO: 77788 - DNA, 17 bp, Homo sapiens
tccctccttcccaaggc

SEQ ID NO: 77789 - DNA, 17 bp, Homo sapiens
gtccccgtcctcggccg

SEQ ID NO: 77790 - DNA, 19 bp, Homo sapiens
cccgtccctcgccaggccg

SEQ ID NO: 77791 - DNA, 20 bp, Homo sapiens
ccgtccccaccggctgaggc

SEQ ID NO: 77792 - DNA, 20 bp, Homo sapiens
cctgtccccgttccctctcc

SEQ ID NO: 77793 - DNA, 18 bp, Homo sapiens
tccgtccccccaggaggc

SEQ ID NO: 77794 - DNA, 18 bp, Homo sapiens
cccgttcccgcaccgggc

SEQ ID NO: 77795 - DNA, 20 bp, Homo sapiens
tccctccccgctccgggccg

SEQ ID NO: 77796 - DNA, 18 bp, Homo sapiens
tccttccccgttcctaag

SEQ ID NO: 77797 - DNA, 20 bp, Homo sapiens
tccggtttcactcaaggccg

SEQ ID NO: 77798 - DNA, 19 bp, Homo sapiens
tcagtcctgatcccaaggc

SEQ ID NO: 77799 - DNA, 116 bp, Rice yellow stunt virus
cctcatgcggaactcgtgccaaattataatcttgatgtgtgtgtaatatatatatttatgtatttatcaatgttttatattgttcatattttaaaaacccaactccacatagaagg

SEQ ID NO: 77800 - DNA, 24 bp, Rice yellow stunt virus
ttcatattttaaaaacccaactcc

SEQ ID NO: 77801 - DNA, 20 bp, Homo sapiens
atactaggaaaacccagctc

SEQ ID NO: 77802 - DNA, 18 bp, Homo sapiens
ttcacattttaccagctc

SEQ ID NO: 77803 - DNA, 18 bp, Homo sapiens
tatgccaagaacccaact

SEQ ID NO: 77804 - DNA, 23 bp, Homo sapiens
ttcacattctaagggcccaattc

SEQ ID NO: 77805 - DNA, 20 bp, Homo sapiens
atattaataaaacccaattc

SEQ ID NO: 77806 - DNA, 18 bp, Homo sapiens
ttcacattttaaaaaccc

SEQ ID NO: 77807 - DNA, 25 bp, Homo sapiens
ataatttaaaaaccaccattcaact

SEQ ID NO: 77808 - DNA, 25 bp, Homo sapiens
ttcatattgttgaaaccctaattcc

SEQ ID NO: 77809 - DNA, 18 bp, Homo sapiens
ttcacatccacctaactc

SEQ ID NO: 77810 - DNA, 18 bp, Homo sapiens
tatttttgccccaactcc

SEQ ID NO: 77811 - DNA, 21 bp, Homo sapiens
ctcattgaaaaacccaattcc

SEQ ID NO: 77812 - DNA, 22 bp, Homo sapiens
ctctgccctgaaaacccaactc

SEQ ID NO: 77813 - DNA, 18 bp, Homo sapiens
tataaaaaaatccaactc

SEQ ID NO: 77814 - DNA, 20 bp, Homo sapiens
ttcacattttcatccaactc

SEQ ID NO: 77815 - DNA, 19 bp, Homo sapiens
tattttaaaaaccgacacc

SEQ ID NO: 77816 - DNA, 21 bp, Homo sapiens
ttcatttttaaaaacccactc

SEQ ID NO: 77817 - DNA, 23 bp, Homo sapiens
ttcatattttctagcatccaact

SEQ ID NO: 77818 - DNA, 81 bp, Rice yellow stunt virus
ggacccaccggaacggagggagcgacccggcaaaggccccaccacacagccgcacaacccgcccccctccggaagggaacc

SEQ ID NO: 77819 - DNA, 24 bp, Rice yellow stunt virus
acacagccgcacaacccgcccccc

SEQ ID NO: 77820 - DNA, 24 bp, Homo sapiens
acacagcctgcatgcaaaacttcc

SEQ ID NO: 77821 - DNA, 21 bp, Homo sapiens
cacagctggacgacccgcccc

SEQ ID NO: 77822 - DNA, 22 bp, Homo sapiens
acacagctgtaccatccattcc

SEQ ID NO: 77823 - DNA, 19 bp, Homo sapiens
acacaaccactcagctcgc

SEQ ID NO: 77824 - DNA, 17 bp, Homo sapiens
acagtagcacaaccacc

SEQ ID NO: 77825 - DNA, 17 bp, Homo sapiens
cagcgcccacccgcccc

SEQ ID NO: 77826 - DNA, 21 bp, Homo sapiens
acacacacaccgcccgccccc

SEQ ID NO: 77827 - DNA, 20 bp, Homo sapiens
caggcgaggccccgcccccc

SEQ ID NO: 77828 - DNA, 18 bp, Homo sapiens
acacagccggacgacacg

SEQ ID NO: 77829 - DNA, 20 bp, Homo sapiens
acgcagcccggcccgccccc

SEQ ID NO: 77830 - DNA, 21 bp, Homo sapiens
acacgacacgacccgcccccc

SEQ ID NO: 77831 - DNA, 21 bp, Homo sapiens
cacgggtgccgcgccgccccc

SEQ ID NO: 77832 - DNA, 22 bp, Homo sapiens
acagcagccagggacccgcccc

SEQ ID NO: 77833 - DNA, 22 bp, Homo sapiens
acctagcgccagacccgccccc

SEQ ID NO: 77834 - DNA, 25 bp, Homo sapiens
acacagcctctcatgtttcgttccc

SEQ ID NO: 77835 - DNA, 23 bp, Homo sapiens
acacagccagtaccccgcttccc

SEQ ID NO: 77836 - DNA, 22 bp, Homo sapiens
acacaaccaacgtttgttcccc

SEQ ID NO: 77837 - DNA, 24 bp, Homo sapiens
acacagcttcacattgaacctccc

SEQ ID NO: 77838 - DNA, 21 bp, Homo sapiens
gccgcggcctcccacccgccc

SEQ ID NO: 77839 - DNA, 18 bp, Homo sapiens
acacagccgcacactcac

SEQ ID NO: 77840 - DNA, 23 bp, Homo sapiens
cagccgcaccagctctgccctcc

SEQ ID NO: 77841 - DNA, 17 bp, Homo sapiens
cacagctgcagcctccc

SEQ ID NO: 77842 - DNA, 20 bp, Homo sapiens
cagcgccggggcccgccccc

SEQ ID NO: 77843 - DNA, 21 bp, Homo sapiens
caccgagcgcgcgacccgccc

SEQ ID NO: 77844 - DNA, 22 bp, Homo sapiens
cagccgcacccagacccgcccc

SEQ ID NO: 77845 - DNA, 19 bp, Homo sapiens
acgagcccagccccgcccc

SEQ ID NO: 77846 - DNA, 20 bp, Homo sapiens
ggacagccgcccgcccgccc

SEQ ID NO: 77847 - DNA, 20 bp, Homo sapiens
cacagccggctccctgcccc

SEQ ID NO: 77848 - DNA, 19 bp, Homo sapiens
cagccgctgagcccgcccc

SEQ ID NO: 77849 - DNA, 19 bp, Homo sapiens
acacagcctggcagtgccc

SEQ ID NO: 77850 - DNA, 19 bp, Homo sapiens
cagcagccgcgcccgcccc

SEQ ID NO: 77851 - DNA, 19 bp, Homo sapiens
acccggccgcatcgccccc

SEQ ID NO: 77852 - DNA, 20 bp, Homo sapiens
gccgccataacccgcctccc

SEQ ID NO: 77853 - DNA, 18 bp, Homo sapiens
cagccgcgcgccgccccc

SEQ ID NO: 77854 - DNA, 20 bp, Homo sapiens
caacacccgcacaacctgcc

SEQ ID NO: 77855 - DNA, 17 bp, Homo sapiens
acacaatcgcacacccc

SEQ ID NO: 77856 - DNA, 20 bp, Homo sapiens
acgcagccgcaggaccacgc

SEQ ID NO: 77857 - DNA, 17 bp, Homo sapiens
cacagccgcaccctccc

SEQ ID NO: 77858 - DNA, 23 bp, Homo sapiens
cacagccccagccaccgcccccc

SEQ ID NO: 77859 - DNA, 22 bp, Homo sapiens
acacagcccgcacctgccctcc

SEQ ID NO: 77860 - DNA, 23 bp, Homo sapiens
acacagcggtgggcgcgcccccc

SEQ ID NO: 77861 - DNA, 18 bp, Homo sapiens
cagccacacccgctctcc

SEQ ID NO: 77862 - DNA, 26 bp, Homo sapiens
acagagccgcgctgtcgccgtccccc

SEQ ID NO: 77863 - DNA, 20 bp, Homo sapiens
agccgcacagggcgccctcc

SEQ ID NO: 77864 - DNA, 26 bp, Homo sapiens
acagccgctagctggactcgccttcc

SEQ ID NO: 77865 - DNA, 19 bp, Homo sapiens
gccggcccaccccgccccc

SEQ ID NO: 77866 - DNA, 18 bp, Homo sapiens
aacacaccaacccgcccc

SEQ ID NO: 77867 - DNA, 18 bp, Homo sapiens
cacagccacacgctcccc

SEQ ID NO: 77868 - DNA, 19 bp, Homo sapiens
acgcagccgcccccactcc

SEQ ID NO: 77869 - DNA, 23 bp, Homo sapiens
acagcggctgaggctccgccccc

SEQ ID NO: 77870 - DNA, 23 bp, Homo sapiens
cagccgcacggcccgcagtcccc

SEQ ID NO: 77871 - DNA, 22 bp, Homo sapiens
acatgcttcgccctccgccccc

SEQ ID NO: 77872 - DNA, 21 bp, Homo sapiens
cacagccatcgcccgtctccc

SEQ ID NO: 77873 - DNA, 22 bp, Homo sapiens
cacagccgcggccgcccgctcc

SEQ ID NO: 77874 - DNA, 18 bp, Homo sapiens
cagccgcactccagcccc

SEQ ID NO: 77875 - DNA, 17 bp, Homo sapiens
cagccgcacgacgaccc

SEQ ID NO: 77876 - DNA, 21 bp, Homo sapiens
acagccgcacaatcatttccc

SEQ ID NO: 77877 - DNA, 20 bp, Homo sapiens
acgcagccgcacatgcttcc

SEQ ID NO: 77878 - DNA, 19 bp, Homo sapiens
gccgccacccccgccctcc

SEQ ID NO: 77879 - DNA, 21 bp, Homo sapiens
acagccgcgcaggcgctctcc

SEQ ID NO: 77880 - DNA, 22 bp, Homo sapiens
cacagccgtggtgccagcctcc

SEQ ID NO: 77881 - DNA, 21 bp, Homo sapiens
acagccgcctcccttgctccc

SEQ ID NO: 77882 - DNA, 19 bp, Homo sapiens
gcagcagacaccgcccccc

SEQ ID NO: 77883 - DNA, 19 bp, Homo sapiens
gccgcggcccccgcccccc

SEQ ID NO: 77884 - DNA, 23 bp, Homo sapiens
cagccgcacggcacacgcccccc

SEQ ID NO: 77885 - DNA, 18 bp, Homo sapiens
acaggccctcccgccccc

SEQ ID NO: 77886 - DNA, 22 bp, Homo sapiens
cacggtccgcgcaccgcccccc

SEQ ID NO: 77887 - DNA, 17 bp, Homo sapiens
acaccgccgcccgcccc

SEQ ID NO: 77888 - DNA, 22 bp, Homo sapiens
cacagccagcggcaacgcttcc

SEQ ID NO: 77889 - DNA, 18 bp, Homo sapiens
cacagccgggcaacctcc

SEQ ID NO: 77890 - DNA, 23 bp, Homo sapiens
cacagccgtcattactgtcctcc

SEQ ID NO: 77891 - DNA, 23 bp, Homo sapiens
acacagccaatcctttgctttcc

SEQ ID NO: 77892 - DNA, 20 bp, Homo sapiens
cacagccacctctgcctccc

SEQ ID NO: 77893 - DNA, 20 bp, Homo sapiens
cagccccgcccccgcccccc

SEQ ID NO: 77894 - DNA, 22 bp, Homo sapiens
acacagcctggctgccgcctcc

SEQ ID NO: 77895 - DNA, 21 bp, Homo sapiens
acaccgccagcaccccgcccc

SEQ ID NO: 77896 - DNA, 18 bp, Homo sapiens
agccgtacccccgccccc

SEQ ID NO: 77897 - DNA, 21 bp, Homo sapiens
cacagccggcagcccgcctcc

SEQ ID NO: 77898 - DNA, 20 bp, Homo sapiens
cagcagctgcagcgcccccc

SEQ ID NO: 77899 - DNA, 18 bp, Homo sapiens
gccgcagacccgccctcc

SEQ ID NO: 77900 - DNA, 24 bp, Homo sapiens
acacagccccacggccaaccctcc

SEQ ID NO: 77901 - DNA, 20 bp, Homo sapiens
cagcagctgcagccgccccc

SEQ ID NO: 77902 - DNA, 18 bp, Homo sapiens
acagcccttcccgccccc

SEQ ID NO: 77903 - DNA, 20 bp, Homo sapiens
caggtccctccccgcccccc

SEQ ID NO: 77904 - DNA, 19 bp, Homo sapiens
acacagcctgcagctcccc

SEQ ID NO: 77905 - DNA, 24 bp, Homo sapiens
cacaaataacacagcctgctttcc

SEQ ID NO: 77906 - DNA, 16 bp, Homo sapiens
gaacagccgccgcccc

SEQ ID NO: 77907 - DNA, 22 bp, Homo sapiens
acacagccatgcctgagctccc

SEQ ID NO: 77908 - DNA, 24 bp, Homo sapiens
acagcggtcagggacccgcccccc

SEQ ID NO: 77909 - DNA, 22 bp, Homo sapiens
cagccgccaccccccgccttcc

SEQ ID NO: 77910 - DNA, 19 bp, Homo sapiens
cacagcgcacaacggaacc

SEQ ID NO: 77911 - DNA, 20 bp, Homo sapiens
cagccgcacgcacagccccc

SEQ ID NO: 77912 - DNA, 22 bp, Homo sapiens
acacagcctcatccaattctcc

SEQ ID NO: 77913 - DNA, 19 bp, Homo sapiens
acacagcccgtgcagcccc

SEQ ID NO: 77914 - DNA, 22 bp, Homo sapiens
gcggcacccacccccgcccccc

SEQ ID NO: 77915 - DNA, 21 bp, Homo sapiens
gctcggccctgcccgcccccc

SEQ ID NO: 77916 - DNA, 18 bp, Homo sapiens
acacagccgcaaggctcc

SEQ ID NO: 77917 - DNA, 24 bp, Homo sapiens
cagccgcaacggactctgccctcc

SEQ ID NO: 77918 - DNA, 20 bp, Homo sapiens
cacgccccgcctccgccccc

SEQ ID NO: 77919 - DNA, 24 bp, Homo sapiens
acacaccgcacaccgaggttcgcc

SEQ ID NO: 77920 - DNA, 18 bp, Homo sapiens
cagccctgcgcacccccc

SEQ ID NO: 77921 - DNA, 17 bp, Homo sapiens
cagcgccgacccgcccc

SEQ ID NO: 77922 - DNA, 18 bp, Homo sapiens
acggcagcgcccgccccc

SEQ ID NO: 77923 - DNA, 18 bp, Homo sapiens
acacaaccccacctgccc

SEQ ID NO: 77924 - DNA, 21 bp, Homo sapiens
acagcggccgcctcgcccccc

SEQ ID NO: 77925 - DNA, 20 bp, Homo sapiens
acacagccactgtgtccccc

SEQ ID NO: 77926 - DNA, 16 bp, Homo sapiens
accagccccccgcccc

SEQ ID NO: 77927 - DNA, 18 bp, Homo sapiens
cagccgcacctcctgccc

SEQ ID NO: 77928 - DNA, 18 bp, Homo sapiens
cagccgcacaagaacccc

SEQ ID NO: 77929 - DNA, 20 bp, Homo sapiens
acgcaggcttccccgccccc

SEQ ID NO: 77930 - DNA, 19 bp, Homo sapiens
cacgcccgctccccgcccc

SEQ ID NO: 77931 - DNA, 18 bp, Homo sapiens
acacagccacaggccccc

SEQ ID NO: 77932 - DNA, 24 bp, Homo sapiens
cacagccagtacaactgcagctcc

SEQ ID NO: 77933 - DNA, 24 bp, Homo sapiens
cacagccgcgtgtagccatccccc

SEQ ID NO: 77934 - DNA, 19 bp, Homo sapiens
cacagccaacacccttgcc

SEQ ID NO: 77935 - DNA, 17 bp, Homo sapiens
acacagctccccgcccc

SEQ ID NO: 77936 - DNA, 98 bp, Rice yellow stunt virus
accaccagatacattctgtaaatagtttgctgtggttgcttagggaataggcatagaatacaaccatggttataagatagagcaggtgtatctggggt

SEQ ID NO: 77937 - DNA, 19 bp, Rice yellow stunt virus
gagcaggtgtatctggggt

SEQ ID NO: 77938 - DNA, 17 bp, Homo sapiens
gagaggcaacctggggt

SEQ ID NO: 77939 - DNA, 19 bp, Homo sapiens
gagtaggcgttcagcaggt

SEQ ID NO: 77940 - DNA, 16 bp, Homo sapiens
agccagggtctggggt

SEQ ID NO: 77941 - DNA, 19 bp, Homo sapiens
gaatgggaggcattggggt

SEQ ID NO: 77942 - DNA, 17 bp, Homo sapiens
gaggggtggcctggggt

SEQ ID NO: 77943 - DNA, 16 bp, Homo sapiens
ggccggtgtctggggt

SEQ ID NO: 77944 - DNA, 18 bp, Homo sapiens
gagcgcgcctcctggggt

SEQ ID NO: 77945 - DNA, 18 bp, Homo sapiens
gagccagggtcctggggt

SEQ ID NO: 77946 - DNA, 15 bp, Homo sapiens
gagcaggcctggggt

SEQ ID NO: 77947 - DNA, 19 bp, Homo sapiens
gaggcggtgtccctggggt

SEQ ID NO: 77948 - DNA, 17 bp, Homo sapiens
ggcaaatattctggggt

SEQ ID NO: 77949 - DNA, 17 bp, Homo sapiens
gagcaagtgctgagggt

SEQ ID NO: 77950 - DNA, 16 bp, Homo sapiens
gagaggttcccggggt

SEQ ID NO: 77951 - DNA, 17 bp, Homo sapiens
gagtggcgtcctggggt

SEQ ID NO: 77952 - DNA, 17 bp, Homo sapiens
gggcaggtggtcggggt

SEQ ID NO: 77953 - DNA, 16 bp, Homo sapiens
gagcaggtctagaagt

SEQ ID NO: 77954 - DNA, 17 bp, Homo sapiens
agcaaagtctctggggt

SEQ ID NO: 77955 - DNA, 16 bp, Homo sapiens
gagggcgtcctggggt

SEQ ID NO: 77956 - DNA, 17 bp, Homo sapiens
gagtgtgtgtccggggt

SEQ ID NO: 77957 - DNA, 15 bp, Homo sapiens
ggcagggcctggggt

SEQ ID NO: 77958 - DNA, 16 bp, Homo sapiens
gagcgtggcctggggt

SEQ ID NO: 77959 - DNA, 19 bp, Homo sapiens
gaacattttcatctggggt

SEQ ID NO: 77960 - DNA, 16 bp, Homo sapiens
gaggggtgtctggggt

SEQ ID NO: 77961 - DNA, 15 bp, Homo sapiens
ggcaggtcctggggt

SEQ ID NO: 77962 - DNA, 19 bp, Homo sapiens
gaacagtgtgctctggggt

SEQ ID NO: 77963 - DNA, 16 bp, Homo sapiens
gagaggcatctggggt

SEQ ID NO: 77964 - DNA, 19 bp, Homo sapiens
gagccagatcctctggggt

SEQ ID NO: 77965 - DNA, 18 bp, Homo sapiens
gaggaggggctctggggt

SEQ ID NO: 77966 - DNA, 17 bp, Homo sapiens
gagcaggtggctgcggt

SEQ ID NO: 77967 - DNA, 19 bp, Homo sapiens
aagcctagctgtctggggt

SEQ ID NO: 77968 - DNA, 16 bp, Homo sapiens
gagcggagttcggggt

SEQ ID NO: 77969 - DNA, 16 bp, Homo sapiens
ggcagtgccctggggt

SEQ ID NO: 77970 - DNA, 19 bp, Homo sapiens
aagtcagattgtctggggt

SEQ ID NO: 77971 - DNA, 16 bp, Homo sapiens
gagcagagcctggggt

SEQ ID NO: 77972 - DNA, 16 bp, Homo sapiens
gagcagatgatagggt

SEQ ID NO: 77973 - DNA, 18 bp, Homo sapiens
gcaggtgtgtccgatggt

SEQ ID NO: 77974 - DNA, 16 bp, Homo sapiens
gagccgtgcctggggt

SEQ ID NO: 77975 - DNA, 17 bp, Homo sapiens
gagccggtgtccacggt

SEQ ID NO: 77976 - DNA, 21 bp, Homo sapiens
gagcaggtgtaacccggcggt

SEQ ID NO: 77977 - DNA, 20 bp, Homo sapiens
gcagatgccagggctggggt

SEQ ID NO: 77978 - DNA, 18 bp, Homo sapiens
ggcattgttgtctggggt

SEQ ID NO: 77979 - DNA, 16 bp, Homo sapiens
ggcagagtcctggggt

SEQ ID NO: 77980 - DNA, 17 bp, Homo sapiens
gagcaggcaattggggt

SEQ ID NO: 77981 - DNA, 17 bp, Homo sapiens
gagcagtgctccggggt

SEQ ID NO: 77982 - DNA, 18 bp, Homo sapiens
gggcaagtcctctggggt

SEQ ID NO: 77983 - DNA, 18 bp, Homo sapiens
ggcaggtgtgtggatggt

SEQ ID NO: 77984 - DNA, 16 bp, Homo sapiens
gaggaggctctggggt

SEQ ID NO: 77985 - DNA, 18 bp, Homo sapiens
gaggggtttatctggggt

SEQ ID NO: 77986 - DNA, 19 bp, Homo sapiens
gaggggatgtttctggggt

SEQ ID NO: 77987 - DNA, 18 bp, Homo sapiens
gcagggccctcctggggt

SEQ ID NO: 77988 - DNA, 18 bp, Homo sapiens
gagcagggcacttggggt

SEQ ID NO: 77989 - DNA, 18 bp, Homo sapiens
gctggagtatcctggggt

SEQ ID NO: 77990 - DNA, 16 bp, Homo sapiens
gagcctgatctggggt

SEQ ID NO: 77991 - DNA, 19 bp, Homo sapiens
agcagggagcctctggggt

SEQ ID NO: 77992 - DNA, 16 bp, Homo sapiens
aagcaggtgtaggagt

SEQ ID NO: 77993 - DNA, 18 bp, Homo sapiens
ggctttgtgatctggggt

SEQ ID NO: 77994 - DNA, 21 bp, Homo sapiens
gagcaggtggacagcaggggt

SEQ ID NO: 77995 - DNA, 16 bp, Homo sapiens
gaggggtgcctggggt

SEQ ID NO: 77996 - DNA, 18 bp, Homo sapiens
gcaggtgtatcacaaggt

SEQ ID NO: 77997 - DNA, 19 bp, Homo sapiens
gagagggcggatctggggt

SEQ ID NO: 77998 - DNA, 20 bp, Homo sapiens
aagcaacaccagtttggggt

SEQ ID NO: 77999 - DNA, 18 bp, Homo sapiens
gagcgcggtgcccggggt

SEQ ID NO: 78000 - DNA, 18 bp, Homo sapiens
ggcaggtgccaacggggt

SEQ ID NO: 78001 - DNA, 17 bp, Homo sapiens
gaccagtggtctggggt

SEQ ID NO: 78002 - DNA, 17 bp, Homo sapiens
gaacaggcccctggggt

SEQ ID NO: 78003 - DNA, 18 bp, Homo sapiens
gggcagcgggtctggggt

SEQ ID NO: 78004 - DNA, 19 bp, Homo sapiens
gagcccctgcatctggggt

SEQ ID NO: 78005 - DNA, 16 bp, Homo sapiens
gagcaggccctggggt

SEQ ID NO: 78006 - DNA, 15 bp, Homo sapiens
ggcaggtgctggggt

SEQ ID NO: 78007 - DNA, 18 bp, Homo sapiens
gcaggtgcactgtggggt

SEQ ID NO: 78008 - DNA, 17 bp, Homo sapiens
gagcaggggcctggggt

SEQ ID NO: 78009 - DNA, 18 bp, Homo sapiens
gaggggtggtcccggggt

SEQ ID NO: 78010 - DNA, 17 bp, Homo sapiens
agcaggggtcctggggt

SEQ ID NO: 78011 - DNA, 19 bp, Homo sapiens
gagttccagtgtctggggt

SEQ ID NO: 78012 - DNA, 19 bp, Homo sapiens
gagcaggtgggagcccggg

SEQ ID NO: 78013 - DNA, 17 bp, Homo sapiens
agcaggcaggctggggt

SEQ ID NO: 78014 - DNA, 16 bp, Homo sapiens
gaaaaatgtctggggt

SEQ ID NO: 78015 - DNA, 16 bp, Homo sapiens
ggcagcggtctggggt

SEQ ID NO: 78016 - DNA, 16 bp, Homo sapiens
ggcatgtctctggggt

SEQ ID NO: 78017 - DNA, 16 bp, Homo sapiens
gagaggtgcttggggt

SEQ ID NO: 78018 - DNA, 19 bp, Homo sapiens
gaccagcgagtcctggggt

SEQ ID NO: 78019 - DNA, 18 bp, Homo sapiens
gaggaaatattctggggt

SEQ ID NO: 78020 - DNA, 16 bp, Homo sapiens
gagtaggtgttggggt

SEQ ID NO: 78021 - DNA, 19 bp, Homo sapiens
gagcaggcctcgctggggt

SEQ ID NO: 78022 - DNA, 17 bp, Homo sapiens
ggcaattggtctggggt

SEQ ID NO: 78023 - DNA, 17 bp, Homo sapiens
aagcaggtgtaggaggt

SEQ ID NO: 78024 - DNA, 18 bp, Homo sapiens
gagagggtggcctggggt

SEQ ID NO: 78025 - DNA, 16 bp, Homo sapiens
gagcagggcgtggggt

SEQ ID NO: 78026 - DNA, 19 bp, Homo sapiens
gagccagctgctctggggt

SEQ ID NO: 78027 - DNA, 16 bp, Homo sapiens
gagagggacctggggt

SEQ ID NO: 78028 - DNA, 19 bp, Homo sapiens
gagcaagtgtagaatgggt

SEQ ID NO: 78029 - DNA, 18 bp, Homo sapiens
gagcaggatgtggaaggt

SEQ ID NO: 78030 - DNA, 18 bp, Homo sapiens
gaggaaggtgtctggggt

SEQ ID NO: 78031 - DNA, 17 bp, Homo sapiens
aagcaggggcctggggt

SEQ ID NO: 78032 - DNA, 16 bp, Homo sapiens
agcaggtgcttggggt

SEQ ID NO: 78033 - DNA, 18 bp, Homo sapiens
acagctgctatctggggt

SEQ ID NO: 78034 - DNA, 21 bp, Homo sapiens
gagcaggtgtggggctggggt

SEQ ID NO: 78035 - DNA, 18 bp, Homo sapiens
gagacagaggtctggggt

SEQ ID NO: 78036 - DNA, 20 bp, Homo sapiens
gaacaggtgtataaaaaagt

SEQ ID NO: 78037 - DNA, 18 bp, Homo sapiens
ggcaggcatacttggggt

SEQ ID NO: 78038 - DNA, 15 bp, Homo sapiens
ggcaggtgtcagggt

SEQ ID NO: 78039 - DNA, 20 bp, Homo sapiens
gagcaagttcatcgtggggt

SEQ ID NO: 78040 - DNA, 20 bp, Homo sapiens
aagcaggtgtgagaaagggt

SEQ ID NO: 78041 - DNA, 18 bp, Homo sapiens
gcaggatgggtctggggt

SEQ ID NO: 78042 - DNA, 16 bp, Homo sapiens
gagcaggtgacggaat

SEQ ID NO: 78043 - DNA, 18 bp, Homo sapiens
gagttgcgttcctggggt

SEQ ID NO: 78044 - DNA, 16 bp, Homo sapiens
gaacaggtgcaggggt

SEQ ID NO: 78045 - DNA, 16 bp, Homo sapiens
gagacagacctggggt

SEQ ID NO: 78046 - DNA, 18 bp, Homo sapiens
aagcggcgctcctggggt

SEQ ID NO: 78047 - DNA, 17 bp, Homo sapiens
gagacaggccctggggt

SEQ ID NO: 78048 - DNA, 19 bp, Homo sapiens
gagccaggccctctggggt

SEQ ID NO: 78049 - DNA, 21 bp, Homo sapiens
gagcaggcttgaccctggggt

SEQ ID NO: 78050 - DNA, 16 bp, Homo sapiens
ggcggtgatctggggt

SEQ ID NO: 78051 - DNA, 17 bp, Homo sapiens
gagcacgtttctggggt

SEQ ID NO: 78052 - DNA, 17 bp, Homo sapiens
gagcaggttcaggaggt

SEQ ID NO: 78053 - DNA, 18 bp, Homo sapiens
gagcaggtgcaccaacgt

SEQ ID NO: 78054 - DNA, 18 bp, Homo sapiens
agcaggcatttctggggt

SEQ ID NO: 78055 - DNA, 19 bp, Homo sapiens
gaacaggtgtggccttggt

SEQ ID NO: 78056 - DNA, 20 bp, Homo sapiens
gagcaggtgcacacccaggt

SEQ ID NO: 78057 - DNA, 18 bp, Homo sapiens
gagcaggtgtcgggaggt

SEQ ID NO: 78058 - DNA, 17 bp, Homo sapiens
gaacaggactctggggt

SEQ ID NO: 78059 - DNA, 18 bp, Homo sapiens
gaacctgccatctggggt

SEQ ID NO: 78060 - DNA, 21 bp, Homo sapiens
gagcaagtgaagctctggggt

SEQ ID NO: 78061 - DNA, 19 bp, Homo sapiens
gagcgagtgagcctggggt

SEQ ID NO: 78062 - DNA, 17 bp, Homo sapiens
agcaggtgtgttggggt

SEQ ID NO: 78063 - DNA, 17 bp, Homo sapiens
gagctgagctctggggt

SEQ ID NO: 78064 - DNA, 18 bp, Homo sapiens
gagcagggttcccggggt

SEQ ID NO: 78065 - DNA, 16 bp, Homo sapiens
gagcaggtgtgaaggt

SEQ ID NO: 78066 - DNA, 20 bp, Homo sapiens
gagcggatgtaaaataaggt

SEQ ID NO: 78067 - DNA, 17 bp, Homo sapiens
gagaggccacctggggt

SEQ ID NO: 78068 - DNA, 17 bp, Homo sapiens
gagcagatgccgggggt

SEQ ID NO: 78069 - DNA, 19 bp, Homo sapiens
gagtggatgggtccggggt

SEQ ID NO: 78070 - DNA, 19 bp, Homo sapiens
agcaggcactgcctggggt

SEQ ID NO: 78071 - DNA, 15 bp, Homo sapiens
ggcaggtgcaggggt

SEQ ID NO: 78072 - DNA, 18 bp, Homo sapiens
gagctatggatttggggt

SEQ ID NO: 78073 - DNA, 18 bp, Homo sapiens
gagagggttcgctggggt

SEQ ID NO: 78074 - DNA, 19 bp, Homo sapiens
aagcaggtgtggccatggt

SEQ ID NO: 78075 - DNA, 18 bp, Homo sapiens
ggcaggtgtgcctggcgg

SEQ ID NO: 78076 - DNA, 17 bp, Homo sapiens
gagaaggtctctggggt

SEQ ID NO: 78077 - DNA, 20 bp, Homo sapiens
gagcaggtgcaggagaaggt

SEQ ID NO: 78078 - DNA, 18 bp, Homo sapiens
gcaggctgggtctggggt

SEQ ID NO: 78079 - DNA, 16 bp, Homo sapiens
agcagggctctggggt

SEQ ID NO: 78080 - DNA, 17 bp, Homo sapiens
gatcaaaaatctggggt

SEQ ID NO: 78081 - DNA, 16 bp, Homo sapiens
gagccagttctggggt

SEQ ID NO: 78082 - DNA, 18 bp, Homo sapiens
gaacaggtgttctctggg

SEQ ID NO: 78083 - DNA, 18 bp, Homo sapiens
gagcaaggtgtctggggt

SEQ ID NO: 78084 - DNA, 16 bp, Homo sapiens
ggcaggtgtccgcggt

SEQ ID NO: 78085 - DNA, 16 bp, Homo sapiens
gagcaagcagtggggt

SEQ ID NO: 78086 - DNA, 18 bp, Homo sapiens
gagttagtgtgctggggt

SEQ ID NO: 78087 - DNA, 16 bp, Homo sapiens
agcaggcagctggggt

SEQ ID NO: 78088 - DNA, 16 bp, Homo sapiens
gagctgctcctggggt

SEQ ID NO: 78089 - DNA, 18 bp, Homo sapiens
agtgggtgtgacctgagg

SEQ ID NO: 78090 - DNA, 93 bp, Myxoma virus
ccgctcgatagatcgcgtcgaggaagtaccaaccgtgaccactcctccggcggggatcctccgcgacgggtacatcgacgcgattctacgcgg

SEQ ID NO: 78091 - DNA, 24 bp, Myxoma virus
aggaagtaccaaccgtgaccactc

SEQ ID NO: 78092 - DNA, 20 bp, Homo sapiens
ggaagcaccaggaaaccact

SEQ ID NO: 78093 - DNA, 21 bp, Homo sapiens
aggaaatactgaccaaagctc

SEQ ID NO: 78094 - DNA, 17 bp, Homo sapiens
aggaggtgccaaatgac

SEQ ID NO: 78095 - DNA, 18 bp, Homo sapiens
ggaagatgcctgaccact

SEQ ID NO: 78096 - DNA, 22 bp, Homo sapiens
agcaagtaccagggcactgctc

SEQ ID NO: 78097 - DNA, 21 bp, Homo sapiens
aggaagtaccaccttgccctc

SEQ ID NO: 78098 - DNA, 24 bp, Homo sapiens
aggaagtacaatcttctggtcact

SEQ ID NO: 78099 - DNA, 18 bp, Homo sapiens
ggatgtatgatgaccact

SEQ ID NO: 78100 - DNA, 22 bp, Homo sapiens
aggaagtaaccatagtaccact

SEQ ID NO: 78101 - DNA, 21 bp, Homo sapiens
aggggtacccccagatcactc

SEQ ID NO: 78102 - DNA, 21 bp, Homo sapiens
aggaagtacaggccaaccccg

SEQ ID NO: 78103 - DNA, 20 bp, Homo sapiens
aggaagtacataacctcgac

SEQ ID NO: 78104 - DNA, 24 bp, Homo sapiens
aggaagcatccacagttggccact

SEQ ID NO: 78105 - DNA, 22 bp, Homo sapiens
aggaagtactactagtggactc

SEQ ID NO: 78106 - DNA, 18 bp, Homo sapiens
ggaagcaccgaccgccct

SEQ ID NO: 78107 - DNA, 20 bp, Homo sapiens
aggaaatgggagtgaccact

SEQ ID NO: 78108 - DNA, 19 bp, Homo sapiens
aggaagtatcaaatttaac

SEQ ID NO: 78109 - DNA, 20 bp, Homo sapiens
aggaagcatcagtatcacca

SEQ ID NO: 78110 - DNA, 22 bp, Homo sapiens
ggacagtgctggctgaccactc

SEQ ID NO: 78111 - DNA, 20 bp, Homo sapiens
aggaggtccccttgaccact

SEQ ID NO: 78112 - DNA, 21 bp, Homo sapiens
agcagccaaccgtggtcattc

SEQ ID NO: 78113 - DNA, 18 bp, Homo sapiens
aggaagtattggccagct

SEQ ID NO: 78114 - DNA, 23 bp, Homo sapiens
ggaatgccccacaatgaccactc

SEQ ID NO: 78115 - DNA, 21 bp, Homo sapiens
ggaagcaccgtgccgctgctc

SEQ ID NO: 78116 - DNA, 19 bp, Homo sapiens
aggatgtaccaacaatcac

SEQ ID NO: 78117 - DNA, 22 bp, Homo sapiens
ggaagggcactagtgaccactc

SEQ ID NO: 78118 - DNA, 22 bp, Homo sapiens
ggaatgccccacaatgaccact

SEQ ID NO: 78119 - DNA, 86 bp, Cercopithecine herpesvirus 7
gtgtcgtttgttgtgggtgggattatatactatttaaggcacattgtaaaatacggactttcatttcaccaatcaaccaaccacac

SEQ ID NO: 78120 - DNA, 24 bp, Cercopithecine herpesvirus 7
tcgtttgttgtgggtgggattata

SEQ ID NO: 78121 - DNA, 18 bp, Homo sapiens
gcttgttgtggttgttat

SEQ ID NO: 78122 - DNA, 28 bp, Homo sapiens
tcgttttggtgaggtgggtgggattata

SEQ ID NO: 78123 - DNA, 22 bp, Homo sapiens
ttgttggttttgtgggattata

SEQ ID NO: 78124 - DNA, 17 bp, Homo sapiens
gtttgttgctgaattat

SEQ ID NO: 78125 - DNA, 78 bp, Human papillomavirus type 49
cgttttcggttgctgggtcttataataaaatattttataaactgttttggtatgtgaggcatgttttaaccgagttcg

SEQ ID NO: 78126 - DNA, 24 bp, Human papillomavirus type 49
tgttttggtatgtgaggcatgttt

SEQ ID NO: 78127 - DNA, 22 bp, Homo sapiens
tgttttatactgaggcatgttt

SEQ ID NO: 78128 - DNA, 20 bp, Homo sapiens
ggcatatgtggggtatgttt

SEQ ID NO: 78129 - DNA, 22 bp, Homo sapiens
tgttttgttatctaacatgttt

SEQ ID NO: 78130 - DNA, 63 bp, Human papillomavirus type 49
tggctacttggcagttacaagttcacctctgccagaagtgtgtttttgccaagacatttgcca

SEQ ID NO: 78131 - DNA, 24 bp, Human papillomavirus type 49
tacttggcagttacaagttcacct

SEQ ID NO: 78132 - DNA, 21 bp, Homo sapiens
cttggagagatgagttcacct

SEQ ID NO: 78133 - DNA, 16 bp, Homo sapiens
tacttgacacagttca

SEQ ID NO: 78134 - DNA, 19 bp, Homo sapiens
ttgaagggcaagttcacct

SEQ ID NO: 78135 - DNA, 22 bp, Homo sapiens
tacttggcagtctgtgctgcct

SEQ ID NO: 78136 - DNA, 25 bp, Homo sapiens
tacttggcagtcataatatgtacac

SEQ ID NO: 78137 - DNA, 19 bp, Homo sapiens
acttcagttgtaagttcac

SEQ ID NO: 78138 - DNA, 19 bp, Homo sapiens
tacttggcatttaaatgtt

SEQ ID NO: 78139 - DNA, 19 bp, Homo sapiens
ttgggagttgagttcacct

SEQ ID NO: 78140 - DNA, 22 bp, Homo sapiens
ttggataaacacaagtttgcct

SEQ ID NO: 78141 - DNA, 22 bp, Homo sapiens
tacttggcatttaccagaacct

SEQ ID NO: 78142 - DNA, 22 bp, Homo sapiens
cacttggcggcggagttcgcct

SEQ ID NO: 78143 - DNA, 18 bp, Homo sapiens
tactagcaatgagttcac

SEQ ID NO: 78144 - DNA, 19 bp, Homo sapiens
cacttgacatgagtttacc

SEQ ID NO: 78145 - DNA, 21 bp, Homo sapiens
ttggcaacaacctaagttcac

SEQ ID NO: 78146 - DNA, 19 bp, Homo sapiens
ttggacagcaagttcacct

SEQ ID NO: 78147 - DNA, 18 bp, Homo sapiens
tactagggtttacaagtt

SEQ ID NO: 78148 - DNA, 19 bp, Homo sapiens
cttggcagtgacctgtgtc

SEQ ID NO: 78149 - DNA, 101 bp, Respiratory syncytial virus
aatctgaacttcatcgaaactctcatctataaaccatctcacttacattatttaagtagattcctagtttatagttatataaaacaattgaataccagatt

SEQ ID NO: 78150 - DNA, 24 bp, Respiratory syncytial virus
tataaaccatctcacttacattat

SEQ ID NO: 78151 - DNA, 17 bp, Homo sapiens
ccccccatttacattat

SEQ ID NO: 78152 - DNA, 61 bp, Tupaia herpesvirus
gccggcgccgcgacgcgtcggcgccagacgagcgggcgccggcgtcgtcgggcgatcgagc

SEQ ID NO: 78153 - DNA, 19 bp, Tupaia herpesvirus
cgtcgtcgggcgatcgagc

SEQ ID NO: 78154 - DNA, 20 bp, Homo sapiens
cgggcggcgggtgatcgggc

SEQ ID NO: 78155 - DNA, 19 bp, Homo sapiens
cgtcgtcagtgccaggagc

SEQ ID NO: 78156 - DNA, 18 bp, Homo sapiens
gctcccgggcgatcgagc

SEQ ID NO: 78157 - DNA, 16 bp, Homo sapiens
cgtcgtcagggtcagc

SEQ ID NO: 78158 - DNA, 17 bp, Homo sapiens
gtcgtcgaagagcgagc

SEQ ID NO: 78159 - DNA, 19 bp, Homo sapiens
cgccgtcggggcccggagc

SEQ ID NO: 78160 - DNA, 16 bp, Homo sapiens
cgtcgtcggcgacggc

SEQ ID NO: 78161 - DNA, 19 bp, Homo sapiens
cctcgtcgggcgcgagagc

SEQ ID NO: 78162 - DNA, 18 bp, Homo sapiens
cctcgtccaaaatcgagc

SEQ ID NO: 78163 - DNA, 17 bp, Homo sapiens
cgtcgtcgcgccccggc

SEQ ID NO: 78164 - DNA, 16 bp, Homo sapiens
cgtcgccgggctctgc

SEQ ID NO: 78165 - DNA, 17 bp, Homo sapiens
gttgtcgggcgacaggc

SEQ ID NO: 78166 - DNA, 18 bp, Homo sapiens
cgccgtcgcgcgttcgag

SEQ ID NO: 78167 - DNA, 19 bp, Homo sapiens
cgtcgccgccgccgcgagc

SEQ ID NO: 78168 - DNA, 16 bp, Homo sapiens
cgccgtcgggaccagc

SEQ ID NO: 78169 - DNA, 18 bp, Homo sapiens
cgtcgtcgtgacgacagc

SEQ ID NO: 78170 - DNA, 18 bp, Homo sapiens
gtcgccgggtgacaggag

SEQ ID NO: 78171 - DNA, 18 bp, Homo sapiens
cgttgtcgggcactgagc

SEQ ID NO: 78172 - DNA, 16 bp, Homo sapiens
gccgtcgggcgggagc

SEQ ID NO: 78173 - DNA, 17 bp, Homo sapiens
cgccgtcgacaccgagc

SEQ ID NO: 78174 - DNA, 18 bp, Homo sapiens
cgtcgtcgtgcagcgggc

SEQ ID NO: 78175 - DNA, 16 bp, Homo sapiens
cgcgtcgggctcgagc

SEQ ID NO: 78176 - DNA, 20 bp, Homo sapiens
cgccgtcggggtccccgagc

SEQ ID NO: 78177 - DNA, 19 bp, Homo sapiens
cgttctcgggcaaagaagc

SEQ ID NO: 78178 - DNA, 19 bp, Homo sapiens
cgtcgtcgaagacctgggc

SEQ ID NO: 78179 - DNA, 17 bp, Homo sapiens
gtcgtgataaatcgagc

SEQ ID NO: 78180 - DNA, 15 bp, Homo sapiens
gccgtcggcacgagc

SEQ ID NO: 78181 - DNA, 16 bp, Homo sapiens
cgctcggagatcgagc

SEQ ID NO: 78182 - DNA, 64 bp, Bovine polyomavirus
tctctccgcccagtctccgcctaagggaaaccagtcccatccgcaggagtccctcaggacaaga

SEQ ID NO: 78183 - DNA, 24 bp, Bovine polyomavirus
catccgcaggagtccctcaggaca

SEQ ID NO: 78184 - DNA, 21 bp, Homo sapiens
accccggagtcccttgggaca

SEQ ID NO: 78185 - DNA, 20 bp, Homo sapiens
tcctggctgtgtcctcagga

SEQ ID NO: 78186 - DNA, 19 bp, Homo sapiens
cacctgcaggagtccggac

SEQ ID NO: 78187 - DNA, 20 bp, Homo sapiens
catcccaggagtctattgga

SEQ ID NO: 78188 - DNA, 21 bp, Homo sapiens
gcaggagccatgcttggggca

SEQ ID NO: 78189 - DNA, 19 bp, Homo sapiens
caggccagccctcgggaca

SEQ ID NO: 78190 - DNA, 18 bp, Homo sapiens
cccgcaggagtcctcggg

SEQ ID NO: 78191 - DNA, 19 bp, Homo sapiens
gcagggccaggccaggaca

SEQ ID NO: 78192 - DNA, 22 bp, Homo sapiens
tccgtgccgcgccctcaggaca

SEQ ID NO: 78193 - DNA, 18 bp, Homo sapiens
cgcaggaatctcggggca

SEQ ID NO: 78194 - DNA, 20 bp, Homo sapiens
cacaggagtccctcagggca

SEQ ID NO: 78195 - DNA, 19 bp, Homo sapiens
tccgcagccgtctcaggac

SEQ ID NO: 78196 - DNA, 16 bp, Homo sapiens
tccacagggcacaggc

SEQ ID NO: 78197 - DNA, 18 bp, Homo sapiens
cacgagtccttcaggaca

SEQ ID NO: 78198 - DNA, 23 bp, Homo sapiens
cccgcgcggtctccttcagggca

SEQ ID NO: 78199 - DNA, 18 bp, Homo sapiens
tctgcactgcccctcagg

SEQ ID NO: 78200 - DNA, 22 bp, Homo sapiens
cacttgtgagccccctctcagg

SEQ ID NO: 78201 - DNA, 18 bp, Homo sapiens
tctgcggggtcccaggac

SEQ ID NO: 78202 - DNA, 23 bp, Homo sapiens
catcccaacccctcctcaggaca

SEQ ID NO: 78203 - DNA, 19 bp, Homo sapiens
atctcgcaattcctcagga

SEQ ID NO: 78204 - DNA, 16 bp, Homo sapiens
caaggccctcaggaca

SEQ ID NO: 78205 - DNA, 18 bp, Homo sapiens
catcagcaggagtcagga

SEQ ID NO: 78206 - DNA, 18 bp, Homo sapiens
cgtcagcgtgccctcagg

SEQ ID NO: 78207 - DNA, 20 bp, Homo sapiens
tctgcagtgtccttagggca

SEQ ID NO: 78208 - DNA, 20 bp, Homo sapiens
cacccgcaggggtcccgggg

SEQ ID NO: 78209 - DNA, 24 bp, Homo sapiens
catctgttgagaagcctcaggaca

SEQ ID NO: 78210 - DNA, 18 bp, Homo sapiens
catcccaggagtctaaca

SEQ ID NO: 78211 - DNA, 18 bp, Homo sapiens
catcctgtccttcaggac

SEQ ID NO: 78212 - DNA, 19 bp, Homo sapiens
cacccgcaggagttgggac

SEQ ID NO: 78213 - DNA, 22 bp, Homo sapiens
tccagcttttctcctcaggaca

SEQ ID NO: 78214 - DNA, 20 bp, Homo sapiens
cccgcagcgctctcaggaca

SEQ ID NO: 78215 - DNA, 19 bp, Homo sapiens
catccacagaaactcagga

SEQ ID NO: 78216 - DNA, 17 bp, Homo sapiens
cacctgcctccctcagg

SEQ ID NO: 78217 - DNA, 17 bp, Homo sapiens
cctgcagggccctcagg

SEQ ID NO: 78218 - DNA, 18 bp, Homo sapiens
tccccaggagtccctaca

SEQ ID NO: 78219 - DNA, 19 bp, Homo sapiens
catccgcaggagtccaggc

SEQ ID NO: 78220 - DNA, 19 bp, Homo sapiens
cgcaccagttttcaggaca

SEQ ID NO: 78221 - DNA, 19 bp, Homo sapiens
gcatttgcctcctcaggac

SEQ ID NO: 78222 - DNA, 24 bp, Homo sapiens
tcctgcaggagaggtaccgggaca

SEQ ID NO: 78223 - DNA, 20 bp, Homo sapiens
tccgctctcccctcagggca

SEQ ID NO: 78224 - DNA, 23 bp, Homo sapiens
catctgaggaagaggccaggaca

SEQ ID NO: 78225 - DNA, 21 bp, Homo sapiens
atctcattaatcctcaggaca

SEQ ID NO: 78226 - DNA, 25 bp, Homo sapiens
atccgcagtgcggttcctcagggca

SEQ ID NO: 78227 - DNA, 16 bp, Homo sapiens
tctcgcagctcaggac

SEQ ID NO: 78228 - DNA, 18 bp, Homo sapiens
caactgttcctcaggaca

SEQ ID NO: 78229 - DNA, 61 bp, Human herpesvirus 1
cctctgaaccaaactttgggtctcattgtgattcttgtcagggacgcgggggtgggagagg

SEQ ID NO: 78230 - DNA, 22 bp, Human herpesvirus 1
agggacgcgggggtgggagagg

SEQ ID NO: 78231 - DNA, 19 bp, Homo sapiens
aggggcgggtgtggggagg

SEQ ID NO: 78232 - DNA, 17 bp, Homo sapiens
ggggagaggtgggaggg

SEQ ID NO: 78233 - DNA, 25 bp, Homo sapiens
agggatgcaggggtttggggagagg

SEQ ID NO: 78234 - DNA, 18 bp, Homo sapiens
gggttgcggcaatgggag

SEQ ID NO: 78235 - DNA, 18 bp, Homo sapiens
aggggggcggggcgtggg

SEQ ID NO: 78236 - DNA, 22 bp, Homo sapiens
aggggcgcgcggggctgccggg
